United States Patent 11,421,016 (CANCER NEOEPITOPES) - sequence listing, part 26

SEQ ID NO: 1154197 - protein, 9 aa, Homo Sapiens
GNNQTAIQD

SEQ ID NO: 1154198 - protein, 9 aa, Homo Sapiens
LSVCVEEDK

SEQ ID NO: 1154199 - protein, 9 aa, Homo Sapiens
PSHWFTASV

SEQ ID NO: 1154200 - protein, 9 aa, Homo Sapiens
PDLFSLRVH

SEQ ID NO: 1154201 - protein, 9 aa, Homo Sapiens
GNEEEEEGE

SEQ ID NO: 1154202 - protein, 9 aa, Homo Sapiens
GLYCFPSSD

SEQ ID NO: 1154203 - protein, 9 aa, Homo Sapiens
PIDEHWIIK

SEQ ID NO: 1154204 - protein, 9 aa, Homo Sapiens
EVSPPPSEK

SEQ ID NO: 1154205 - protein, 9 aa, Homo Sapiens
ATPPFGLIP

SEQ ID NO: 1154206 - protein, 9 aa, Homo Sapiens
AETTKQKTS

SEQ ID NO: 1154207 - protein, 9 aa, Homo Sapiens
IFDHEDVSQ

SEQ ID NO: 1154208 - protein, 9 aa, Homo Sapiens
DKDYRDFSL

SEQ ID NO: 1154209 - protein, 9 aa, Homo Sapiens
TGLYCFPSS

SEQ ID NO: 1154210 - protein, 9 aa, Homo Sapiens
HLNQHQVTH

SEQ ID NO: 1154211 - protein, 9 aa, Homo Sapiens
AAFGGNAKS

SEQ ID NO: 1154212 - protein, 9 aa, Homo Sapiens
QSVLLSHQR

SEQ ID NO: 1154213 - protein, 9 aa, Homo Sapiens
LDSAGRGEG

SEQ ID NO: 1154214 - protein, 9 aa, Homo Sapiens
TVDKDYRDF

SEQ ID NO: 1154215 - protein, 9 aa, Homo Sapiens
LDCQIHKVD

SEQ ID NO: 1154216 - protein, 9 aa, Homo Sapiens
TVESFPNLR

SEQ ID NO: 1154217 - protein, 9 aa, Homo Sapiens
VRLMGPWHL

SEQ ID NO: 1154218 - protein, 9 aa, Homo Sapiens
DLKLDSAGR

SEQ ID NO: 1154219 - protein, 9 aa, Homo Sapiens
RPTCRVGLF

SEQ ID NO: 1154220 - protein, 9 aa, Homo Sapiens
TDRVKVTLH

SEQ ID NO: 1154221 - protein, 9 aa, Homo Sapiens
HWIIKCNDG

SEQ ID NO: 1154222 - protein, 9 aa, Homo Sapiens
KCNDGVFQR

SEQ ID NO: 1154223 - protein, 9 aa, Homo Sapiens
RLPTGLYCF

SEQ ID NO: 1154224 - protein, 9 aa, Homo Sapiens
QKGQFLWLL

SEQ ID NO: 1154225 - protein, 9 aa, Homo Sapiens
LEAVNRRLW

SEQ ID NO: 1154226 - protein, 9 aa, Homo Sapiens
DSAGRGEGQ

SEQ ID NO: 1154227 - protein, 9 aa, Homo Sapiens
RKRPQHCPP

SEQ ID NO: 1154228 - protein, 9 aa, Homo Sapiens
DEYEHLSSE

SEQ ID NO: 1154229 - protein, 9 aa, Homo Sapiens
LACASDHVK

SEQ ID NO: 1154230 - protein, 9 aa, Homo Sapiens
IWHCESNRF

SEQ ID NO: 1154231 - protein, 9 aa, Homo Sapiens
SLGRPSHWF

SEQ ID NO: 1154232 - protein, 9 aa, Homo Sapiens
DYYIQLEER

SEQ ID NO: 1154233 - protein, 9 aa, Homo Sapiens
WVTTVDKDY

SEQ ID NO: 1154234 - protein, 9 aa, Homo Sapiens
RKSGSGSGL

SEQ ID NO: 1154235 - protein, 9 aa, Homo Sapiens
VPLFIWTPW

SEQ ID NO: 1154236 - protein, 9 aa, Homo Sapiens
KLQQGVPQT

SEQ ID NO: 1154237 - protein, 9 aa, Homo Sapiens
TGTKFASPY

SEQ ID NO: 1154238 - protein, 9 aa, Homo Sapiens
LVLLAPATP

SEQ ID NO: 1154239 - protein, 9 aa, Homo Sapiens
NRTDRVKVT

SEQ ID NO: 1154240 - protein, 9 aa, Homo Sapiens
TITHRVHTI

SEQ ID NO: 1154241 - protein, 9 aa, Homo Sapiens
VLIPYESIV

SEQ ID NO: 1154242 - protein, 9 aa, Homo Sapiens
DVSQITFVV

SEQ ID NO: 1154243 - protein, 9 aa, Homo Sapiens
NNQTAIQDN

SEQ ID NO: 1154244 - protein, 9 aa, Homo Sapiens
HKVDDIQAR

SEQ ID NO: 1154245 - protein, 9 aa, Homo Sapiens
LHVVVAPGG

SEQ ID NO: 1154246 - protein, 9 aa, Homo Sapiens
KELNKAATF

SEQ ID NO: 1154247 - protein, 9 aa, Homo Sapiens
TTVDKDYRD

SEQ ID NO: 1154248 - protein, 9 aa, Homo Sapiens
RIFDHEDVS

SEQ ID NO: 1154249 - protein, 9 aa, Homo Sapiens
AKEESFRPV

SEQ ID NO: 1154250 - protein, 9 aa, Homo Sapiens
KRPQHCPPS

SEQ ID NO: 1154251 - protein, 9 aa, Homo Sapiens
EYEHLSSEA

SEQ ID NO: 1154252 - protein, 9 aa, Homo Sapiens
SNLVRLMGP

SEQ ID NO: 1154253 - protein, 9 aa, Homo Sapiens
AVVSLFNRS

SEQ ID NO: 1154254 - protein, 9 aa, Homo Sapiens
WNGFSNLVR

SEQ ID NO: 1154255 - protein, 9 aa, Homo Sapiens
FIAKEESFR

SEQ ID NO: 1154256 - protein, 9 aa, Homo Sapiens
YYIQLEERS

SEQ ID NO: 1154257 - protein, 9 aa, Homo Sapiens
NAWNGFSNL

SEQ ID NO: 1154258 - protein, 9 aa, Homo Sapiens
NKELNKAAT

SEQ ID NO: 1154259 - protein, 9 aa, Homo Sapiens
YSSLTYFWP

SEQ ID NO: 1154260 - protein, 9 aa, Homo Sapiens
HWFTASVQL

SEQ ID NO: 1154261 - protein, 9 aa, Homo Sapiens
GQFLWLLCA

SEQ ID NO: 1154262 - protein, 9 aa, Homo Sapiens
GEAAPDPAA

SEQ ID NO: 1154263 - protein, 9 aa, Homo Sapiens
KKEWWFLWQ

SEQ ID NO: 1154264 - protein, 9 aa, Homo Sapiens
LVVSLFYIY

SEQ ID NO: 1154265 - protein, 9 aa, Homo Sapiens
KLCKQHQLH

SEQ ID NO: 1154266 - protein, 9 aa, Homo Sapiens
GLKSWISVP

SEQ ID NO: 1154267 - protein, 9 aa, Homo Sapiens
ESNRFHTTI

SEQ ID NO: 1154268 - protein, 9 aa, Homo Sapiens
VTLHPEFLS

SEQ ID NO: 1154269 - protein, 9 aa, Homo Sapiens
SPPPSEKTP

SEQ ID NO: 1154270 - protein, 9 aa, Homo Sapiens
RQVTELQLS

SEQ ID NO: 1154271 - protein, 9 aa, Homo Sapiens
EWWFLWQVL

SEQ ID NO: 1154272 - protein, 9 aa, Homo Sapiens
SQIDVKGPK

SEQ ID NO: 1154273 - protein, 9 aa, Homo Sapiens
FSLRVHSLE

SEQ ID NO: 1154274 - protein, 9 aa, Homo Sapiens
AFGGNAKSV

SEQ ID NO: 1154275 - protein, 9 aa, Homo Sapiens
FHTTIAKYA

SEQ ID NO: 1154276 - protein, 9 aa, Homo Sapiens
MREQRRLKK

SEQ ID NO: 1154277 - protein, 9 aa, Homo Sapiens
IKCNDGVFQ

SEQ ID NO: 1154278 - protein, 9 aa, Homo Sapiens
TYSTTGTKF

SEQ ID NO: 1154279 - protein, 9 aa, Homo Sapiens
HRSCETSCF

SEQ ID NO: 1154280 - protein, 9 aa, Homo Sapiens
HLVPLFIWT

SEQ ID NO: 1154281 - protein, 9 aa, Homo Sapiens
LKGSQIDVK

SEQ ID NO: 1154282 - protein, 9 aa, Homo Sapiens
TVTVPTGSM

SEQ ID NO: 1154283 - protein, 9 aa, Homo Sapiens
ALRIFDHED

SEQ ID NO: 1154284 - protein, 9 aa, Homo Sapiens
HHLVPLFIW

SEQ ID NO: 1154285 - protein, 9 aa, Homo Sapiens
AVKDIRSLV

SEQ ID NO: 1154286 - protein, 9 aa, Homo Sapiens
LPAPSALVL

SEQ ID NO: 1154287 - protein, 9 aa, Homo Sapiens
ESQNKELNK

SEQ ID NO: 1154288 - protein, 9 aa, Homo Sapiens
NRFHTTIAK

SEQ ID NO: 1154289 - protein, 9 aa, Homo Sapiens
PLSKITEQE

SEQ ID NO: 1154290 - protein, 9 aa, Homo Sapiens
LQFQAQLLW

SEQ ID NO: 1154291 - protein, 9 aa, Homo Sapiens
LLPAPSALV

SEQ ID NO: 1154292 - protein, 9 aa, Homo Sapiens
EEDKIVNYA

SEQ ID NO: 1154293 - protein, 9 aa, Homo Sapiens
RILRVYGVS

SEQ ID NO: 1154294 - protein, 9 aa, Homo Sapiens
LFYIYSSLT

SEQ ID NO: 1154295 - protein, 9 aa, Homo Sapiens
FGLIPRLPT

SEQ ID NO: 1154296 - protein, 9 aa, Homo Sapiens
MLVAFYKLC

SEQ ID NO: 1154297 - protein, 9 aa, Homo Sapiens
KVTLHPEFL

SEQ ID NO: 1154298 - protein, 9 aa, Homo Sapiens
HMVSDEYEH

SEQ ID NO: 1154299 - protein, 9 aa, Homo Sapiens
VEEDKIVNY

SEQ ID NO: 1154300 - protein, 9 aa, Homo Sapiens
PRLPTGLYC

SEQ ID NO: 1154301 - protein, 9 aa, Homo Sapiens
LNQHQVTHT

SEQ ID NO: 1154302 - protein, 9 aa, Homo Sapiens
RAPAQSCRE

SEQ ID NO: 1154303 - protein, 9 aa, Homo Sapiens
PPSEKTPED

SEQ ID NO: 1154304 - protein, 9 aa, Homo Sapiens
VESFPNLRE

SEQ ID NO: 1154305 - protein, 9 aa, Homo Sapiens
QRRLKKVNQ

SEQ ID NO: 1154306 - protein, 9 aa, Homo Sapiens
HLACASDHV

SEQ ID NO: 1154307 - protein, 9 aa, Homo Sapiens
LTVKGYAKC

SEQ ID NO: 1154308 - protein, 9 aa, Homo Sapiens
RVHSLELYH

SEQ ID NO: 1154309 - protein, 9 aa, Homo Sapiens
SCQRDLGKP

SEQ ID NO: 1154310 - protein, 9 aa, Homo Sapiens
EGEAAPDPA

SEQ ID NO: 1154311 - protein, 9 aa, Homo Sapiens
KTPEDEALV

SEQ ID NO: 1154312 - protein, 9 aa, Homo Sapiens
YAKCVEVVK

SEQ ID NO: 1154313 - protein, 9 aa, Homo Sapiens
DTYRLHVVV

SEQ ID NO: 1154314 - protein, 9 aa, Homo Sapiens
LQPGSSNPR

SEQ ID NO: 1154315 - protein, 9 aa, Homo Sapiens
RVKVTLHPE

SEQ ID NO: 1154316 - protein, 9 aa, Homo Sapiens
CQIHKVDDI

SEQ ID NO: 1154317 - protein, 9 aa, Homo Sapiens
QSCREAEGL

SEQ ID NO: 1154318 - protein, 9 aa, Homo Sapiens
NSNKEMSGS

SEQ ID NO: 1154319 - protein, 9 aa, Homo Sapiens
QPGSSNPRS

SEQ ID NO: 1154320 - protein, 9 aa, Homo Sapiens
VNRRLWELY

SEQ ID NO: 1154321 - protein, 9 aa, Homo Sapiens
CPKQENIAW

SEQ ID NO: 1154322 - protein, 9 aa, Homo Sapiens
EGNEEEEEG

SEQ ID NO: 1154323 - protein, 9 aa, Homo Sapiens
IAAFGGNAK

SEQ ID NO: 1154324 - protein, 9 aa, Homo Sapiens
GFSNLVRLM

SEQ ID NO: 1154325 - protein, 9 aa, Homo Sapiens
QFQAQLLWN

SEQ ID NO: 1154326 - protein, 9 aa, Homo Sapiens
PAWAETTKQ

SEQ ID NO: 1154327 - protein, 9 aa, Homo Sapiens
TTKQKTSSD

SEQ ID NO: 1154328 - protein, 9 aa, Homo Sapiens
TAIQDNVKV

SEQ ID NO: 1154329 - protein, 9 aa, Homo Sapiens
PFGLIPRLP

SEQ ID NO: 1154330 - protein, 9 aa, Homo Sapiens
LRVHSLELY

SEQ ID NO: 1154331 - protein, 9 aa, Homo Sapiens
RKAATMREQ

SEQ ID NO: 1154332 - protein, 9 aa, Homo Sapiens
PKVDLKGSQ

SEQ ID NO: 1154333 - protein, 9 aa, Homo Sapiens
TMREQRRLK

SEQ ID NO: 1154334 - protein, 9 aa, Homo Sapiens
IGVRLLCEG

SEQ ID NO: 1154335 - protein, 9 aa, Homo Sapiens
SGSGLNAWN

SEQ ID NO: 1154336 - protein, 9 aa, Homo Sapiens
FYKLCKQHQ

SEQ ID NO: 1154337 - protein, 9 aa, Homo Sapiens
WISVPCPNL

SEQ ID NO: 1154338 - protein, 9 aa, Homo Sapiens
GSGSGLNAW

SEQ ID NO: 1154339 - protein, 9 aa, Homo Sapiens
VSERILRVY

SEQ ID NO: 1154340 - protein, 9 aa, Homo Sapiens
LFIWTPWRK

SEQ ID NO: 1154341 - protein, 9 aa, Homo Sapiens
RLWELYPDS

SEQ ID NO: 1154342 - protein, 9 aa, Homo Sapiens
SNKEMSGSS

SEQ ID NO: 1154343 - protein, 9 aa, Homo Sapiens
SQNKELNKA

SEQ ID NO: 1154344 - protein, 9 aa, Homo Sapiens
GLIPRLPTG

SEQ ID NO: 1154345 - protein, 9 aa, Homo Sapiens
MATASSTRA

SEQ ID NO: 1154346 - protein, 9 aa, Homo Sapiens
WDTTKKIAA

SEQ ID NO: 1154347 - protein, 9 aa, Homo Sapiens
NPRSQPINL

SEQ ID NO: 1154348 - protein, 9 aa, Homo Sapiens
VVSLFNRSF

SEQ ID NO: 1154349 - protein, 9 aa, Homo Sapiens
YIQLEERSG

SEQ ID NO: 1154350 - protein, 9 aa, Homo Sapiens
CKDLIKLML

SEQ ID NO: 1154351 - protein, 9 aa, Homo Sapiens
GSMATASST

SEQ ID NO: 1154352 - protein, 9 aa, Homo Sapiens
EHLSSEALE

SEQ ID NO: 1154353 - protein, 9 aa, Homo Sapiens
GSSNPRSQP

SEQ ID NO: 1154354 - protein, 9 aa, Homo Sapiens
RSCETSCFE

SEQ ID NO: 1154355 - protein, 9 aa, Homo Sapiens
APADRAPAQ

SEQ ID NO: 1154356 - protein, 9 aa, Homo Sapiens
QQNNLDDIG

SEQ ID NO: 1154357 - protein, 9 aa, Homo Sapiens
SFRKRPQHC

SEQ ID NO: 1154358 - protein, 9 aa, Homo Sapiens
ITESTWVSL

SEQ ID NO: 1154359 - protein, 9 aa, Homo Sapiens
ADRAPAQSC

SEQ ID NO: 1154360 - protein, 9 aa, Homo Sapiens
ITVSSHNSL

SEQ ID NO: 1154361 - protein, 9 aa, Homo Sapiens
YQKTVESFP

SEQ ID NO: 1154362 - protein, 9 aa, Homo Sapiens
GLNAWNGFS

SEQ ID NO: 1154363 - protein, 9 aa, Homo Sapiens
NQTAIQDNV

SEQ ID NO: 1154364 - protein, 9 aa, Homo Sapiens
HCPPSFLQE

SEQ ID NO: 1154365 - protein, 9 aa, Homo Sapiens
AWAETTKQK

SEQ ID NO: 1154366 - protein, 9 aa, Homo Sapiens
NFEMPVSIT

SEQ ID NO: 1154367 - protein, 9 aa, Homo Sapiens
VILVLIPYE

SEQ ID NO: 1154368 - protein, 9 aa, Homo Sapiens
QKTVESFPN

SEQ ID NO: 1154369 - protein, 9 aa, Homo Sapiens
IRSMIIHLL

SEQ ID NO: 1154370 - protein, 9 aa, Homo Sapiens
PSRVYCLQF

SEQ ID NO: 1154371 - protein, 9 aa, Homo Sapiens
LNAWNGFSN

SEQ ID NO: 1154372 - protein, 9 aa, Homo Sapiens
AFYKLCKQH

SEQ ID NO: 1154373 - protein, 9 aa, Homo Sapiens
QALTESQNK

SEQ ID NO: 1154374 - protein, 9 aa, Homo Sapiens
TPWRKSGSG

SEQ ID NO: 1154375 - protein, 9 aa, Homo Sapiens
IQDNVKVSL

SEQ ID NO: 1154376 - protein, 9 aa, Homo Sapiens
TVKGYAKCV

SEQ ID NO: 1154377 - protein, 9 aa, Homo Sapiens
EESFRPVMI

SEQ ID NO: 1154378 - protein, 9 aa, Homo Sapiens
LTESQNKEL

SEQ ID NO: 1154379 - protein, 9 aa, Homo Sapiens
DIGVRLLCE

SEQ ID NO: 1154380 - protein, 9 aa, Homo Sapiens
QYIPRPTCR

SEQ ID NO: 1154381 - protein, 9 aa, Homo Sapiens
LMLRNERQF

SEQ ID NO: 1154382 - protein, 9 aa, Homo Sapiens
STTGTKFAS

SEQ ID NO: 1154383 - protein, 9 aa, Homo Sapiens
EECKDLIKL

SEQ ID NO: 1154384 - protein, 9 aa, Homo Sapiens
NLLPAPSAL

SEQ ID NO: 1154385 - protein, 9 aa, Homo Sapiens
LKLDSAGRG

SEQ ID NO: 1154386 - protein, 9 aa, Homo Sapiens
VGNNQTAIQ

SEQ ID NO: 1154387 - protein, 9 aa, Homo Sapiens
APAQSCREA

SEQ ID NO: 1154388 - protein, 9 aa, Homo Sapiens
GSQIDVKGP

SEQ ID NO: 1154389 - protein, 9 aa, Homo Sapiens
QIHKVDDIQ

SEQ ID NO: 1154390 - protein, 9 aa, Homo Sapiens
KRQVTELQL

SEQ ID NO: 1154391 - protein, 9 aa, Homo Sapiens
KLELKRQVT

SEQ ID NO: 1154392 - protein, 9 aa, Homo Sapiens
FEMPVSITV

SEQ ID NO: 1154393 - protein, 9 aa, Homo Sapiens
DLQPGSSNP

SEQ ID NO: 1154394 - protein, 9 aa, Homo Sapiens
SALVLLAPA

SEQ ID NO: 1154395 - protein, 9 aa, Homo Sapiens
DQYATVTNN

SEQ ID NO: 1154396 - protein, 9 aa, Homo Sapiens
GTKFASPYF

SEQ ID NO: 1154397 - protein, 9 aa, Homo Sapiens
LIKLMLRNE

SEQ ID NO: 1154398 - protein, 9 aa, Homo Sapiens
TESQNKELN

SEQ ID NO: 1154399 - protein, 9 aa, Homo Sapiens
PNLLPAPSA

SEQ ID NO: 1154400 - protein, 9 aa, Homo Sapiens
VAFYKLCKQ

SEQ ID NO: 1154401 - protein, 9 aa, Homo Sapiens
EELPERWDT

SEQ ID NO: 1154402 - protein, 9 aa, Homo Sapiens
NKEMSGSSK

SEQ ID NO: 1154403 - protein, 9 aa, Homo Sapiens
LTYSTTGTK

SEQ ID NO: 1154404 - protein, 9 aa, Homo Sapiens
DLIKLMLRN

SEQ ID NO: 1154405 - protein, 9 aa, Homo Sapiens
SLVISLLED

SEQ ID NO: 1154406 - protein, 9 aa, Homo Sapiens
RSGSNLELD

SEQ ID NO: 1154407 - protein, 9 aa, Homo Sapiens
QKLELKRQV

SEQ ID NO: 1154408 - protein, 9 aa, Homo Sapiens
EIRSMIIHL

SEQ ID NO: 1154409 - protein, 9 aa, Homo Sapiens
SSNSNKEMS

SEQ ID NO: 1154410 - protein, 9 aa, Homo Sapiens
RQPPHHLVP

SEQ ID NO: 1154411 - protein, 9 aa, Homo Sapiens
SDHVKVVTL

SEQ ID NO: 1154412 - protein, 9 aa, Homo Sapiens
LFAAVVSLF

SEQ ID NO: 1154413 - protein, 9 aa, Homo Sapiens
CSLGRPSHW

SEQ ID NO: 1154414 - protein, 9 aa, Homo Sapiens
VSITESTWV

SEQ ID NO: 1154415 - protein, 9 aa, Homo Sapiens
ERILRVYGV

SEQ ID NO: 1154416 - protein, 9 aa, Homo Sapiens
DIRSLVISL

SEQ ID NO: 1154417 - protein, 9 aa, Homo Sapiens
GVPQTIALL

SEQ ID NO: 1154418 - protein, 9 aa, Homo Sapiens
LAPLASATE

SEQ ID NO: 1154419 - protein, 9 aa, Homo Sapiens
HSLELYHQL

SEQ ID NO: 1154420 - protein, 9 aa, Homo Sapiens
ESFRPVMII

SEQ ID NO: 1154421 - protein, 9 aa, Homo Sapiens
QYATVTNNV

SEQ ID NO: 1154422 - protein, 9 aa, Homo Sapiens
PTGLYCFPS

SEQ ID NO: 1154423 - protein, 9 aa, Homo Sapiens
ELPERWDTT

SEQ ID NO: 1154424 - protein, 9 aa, Homo Sapiens
YIYSSLTYF

SEQ ID NO: 1154425 - protein, 9 aa, Homo Sapiens
TVEVSITES

SEQ ID NO: 1154426 - protein, 9 aa, Homo Sapiens
PWHLCMGLK

SEQ ID NO: 1154427 - protein, 9 aa, Homo Sapiens
KLMLRNERQ

SEQ ID NO: 1154428 - protein, 9 aa, Homo Sapiens
IAKEESFRP

SEQ ID NO: 1154429 - protein, 9 aa, Homo Sapiens
KEWWFLWQV

SEQ ID NO: 1154430 - protein, 9 aa, Homo Sapiens
RPQHCPPSF

SEQ ID NO: 1154431 - protein, 9 aa, Homo Sapiens
WPCRPAQLP

SEQ ID NO: 1154432 - protein, 9 aa, Homo Sapiens
CESNRFHTT

SEQ ID NO: 1154433 - protein, 9 aa, Homo Sapiens
FPNLREISI

SEQ ID NO: 1154434 - protein, 9 aa, Homo Sapiens
SSNPRSQPI

SEQ ID NO: 1154435 - protein, 9 aa, Homo Sapiens
CMGLKSWIS

SEQ ID NO: 1154436 - protein, 9 aa, Homo Sapiens
VPTGSMATA

SEQ ID NO: 1154437 - protein, 9 aa, Homo Sapiens
PWRKSGSGS

SEQ ID NO: 1154438 - protein, 9 aa, Homo Sapiens
VSLFNRSFS

SEQ ID NO: 1154439 - protein, 9 aa, Homo Sapiens
VHSLELYHQ

SEQ ID NO: 1154440 - protein, 9 aa, Homo Sapiens
FNLTVKGYA

SEQ ID NO: 1154441 - protein, 9 aa, Homo Sapiens
PSALVLLAP

SEQ ID NO: 1154442 - protein, 9 aa, Homo Sapiens
SHLNQHQVT

SEQ ID NO: 1154443 - protein, 9 aa, Homo Sapiens
IPRLPTGLY

SEQ ID NO: 1154444 - protein, 9 aa, Homo Sapiens
SHWFTASVQ

SEQ ID NO: 1154445 - protein, 9 aa, Homo Sapiens
MPVSITVSS

SEQ ID NO: 1154446 - protein, 9 aa, Homo Sapiens
PERWDTTKK

SEQ ID NO: 1154447 - protein, 9 aa, Homo Sapiens
MPKVDLKGS

SEQ ID NO: 1154448 - protein, 9 aa, Homo Sapiens
TVSSHNSLV

SEQ ID NO: 1154449 - protein, 9 aa, Homo Sapiens
HLCMGLKSW

SEQ ID NO: 1154450 - protein, 9 aa, Homo Sapiens
DAVKDIRSL

SEQ ID NO: 1154451 - protein, 9 aa, Homo Sapiens
ILVLIPYES

SEQ ID NO: 1154452 - protein, 9 aa, Homo Sapiens
ISTRDPLSK

SEQ ID NO: 1154453 - protein, 9 aa, Homo Sapiens
HEIRSMIIH

SEQ ID NO: 1154454 - protein, 9 aa, Homo Sapiens
KDIRSLVIS

SEQ ID NO: 1154455 - protein, 9 aa, Homo Sapiens
KEESFRPVM

SEQ ID NO: 1154456 - protein, 9 aa, Homo Sapiens
CASDHVKVV

SEQ ID NO: 1154457 - protein, 9 aa, Homo Sapiens
NAKKEWWFL

SEQ ID NO: 1154458 - protein, 9 aa, Homo Sapiens
NEEEEEGEA

SEQ ID NO: 1154459 - protein, 9 aa, Homo Sapiens
VVAPGGQSL

SEQ ID NO: 1154460 - protein, 9 aa, Homo Sapiens
IIKCNDGVF

SEQ ID NO: 1154461 - protein, 9 aa, Homo Sapiens
ILRVYGVSE

SEQ ID NO: 1154462 - protein, 9 aa, Homo Sapiens
SMIIHLLCD

SEQ ID NO: 1154463 - protein, 9 aa, Homo Sapiens
IDEHWIIKC

SEQ ID NO: 1154464 - protein, 9 aa, Homo Sapiens
QQGVPQTIA

SEQ ID NO: 1154465 - protein, 9 aa, Homo Sapiens
TVVTITHRV

SEQ ID NO: 1154466 - protein, 9 aa, Homo Sapiens
RPRRQPPHH

SEQ ID NO: 1154467 - protein, 9 aa, Homo Sapiens
ERWDTTKKI

SEQ ID NO: 1154468 - protein, 9 aa, Homo Sapiens
GFNSHLTQH

SEQ ID NO: 1154469 - protein, 9 aa, Homo Sapiens
SHLTQHVRI

SEQ ID NO: 1154470 - protein, 9 aa, Homo Sapiens
CQRDLGKPL

SEQ ID NO: 1154471 - protein, 9 aa, Homo Sapiens
LSKITEQEK

SEQ ID NO: 1154472 - protein, 9 aa, Homo Sapiens
IWTPWRKSG

SEQ ID NO: 1154473 - protein, 9 aa, Homo Sapiens
PQTIALLTL

SEQ ID NO: 1154474 - protein, 9 aa, Homo Sapiens
ATVTNNVHE

SEQ ID NO: 1154475 - protein, 9 aa, Homo Sapiens
QFLWLLCAA

SEQ ID NO: 1154476 - protein, 9 aa, Homo Sapiens
VLLSHQRTH

SEQ ID NO: 1154477 - protein, 9 aa, Homo Sapiens
LAPATPPFG

SEQ ID NO: 1154478 - protein, 9 aa, Homo Sapiens
AQKGQFLWL

SEQ ID NO: 1154479 - protein, 9 aa, Homo Sapiens
RDQYATVTN

SEQ ID NO: 1154480 - protein, 9 aa, Homo Sapiens
CFNLTVKGY

SEQ ID NO: 1154481 - protein, 9 aa, Homo Sapiens
FNSHLTQHV

SEQ ID NO: 1154482 - protein, 9 aa, Homo Sapiens
EAQKGQFLW

SEQ ID NO: 1154483 - protein, 9 aa, Homo Sapiens
AVNRRLWEL

SEQ ID NO: 1154484 - protein, 9 aa, Homo Sapiens
MSGSSKNSS

SEQ ID NO: 1154485 - protein, 9 aa, Homo Sapiens
ITHRVHTIL

SEQ ID NO: 1154486 - protein, 9 aa, Homo Sapiens
VSPPPSEKT

SEQ ID NO: 1154487 - protein, 9 aa, Homo Sapiens
VSDEYEHLS

SEQ ID NO: 1154488 - protein, 9 aa, Homo Sapiens
MVSDEYEHL

SEQ ID NO: 1154489 - protein, 9 aa, Homo Sapiens
QTAIQDNVK

SEQ ID NO: 1154490 - protein, 9 aa, Homo Sapiens
VHRSCETSC

SEQ ID NO: 1154491 - protein, 9 aa, Homo Sapiens
WIIKCNDGV

SEQ ID NO: 1154492 - protein, 9 aa, Homo Sapiens
DKLQQGVPQ

SEQ ID NO: 1154493 - protein, 9 aa, Homo Sapiens
GSGLNAWNG

SEQ ID NO: 1154494 - protein, 9 aa, Homo Sapiens
FNRSFSSHH

SEQ ID NO: 1154495 - protein, 9 aa, Homo Sapiens
PVGNNQTAI

SEQ ID NO: 1154496 - protein, 9 aa, Homo Sapiens
SMATASSTR

SEQ ID NO: 1154497 - protein, 9 aa, Homo Sapiens
KGQFLWLLC

SEQ ID NO: 1154498 - protein, 9 aa, Homo Sapiens
SEKTPEDEA

SEQ ID NO: 1154499 - protein, 9 aa, Homo Sapiens
EDKIVNYAT

SEQ ID NO: 1154500 - protein, 9 aa, Homo Sapiens
SCETSCFEL

SEQ ID NO: 1154501 - protein, 9 aa, Homo Sapiens
RVSCQRDLG

SEQ ID NO: 1154502 - protein, 9 aa, Homo Sapiens
SAGRGEGQL

SEQ ID NO: 1154503 - protein, 9 aa, Homo Sapiens
ALTESQNKE

SEQ ID NO: 1154504 - protein, 9 aa, Homo Sapiens
CLQFQAQLL

SEQ ID NO: 1154505 - protein, 9 aa, Homo Sapiens
LQQGVPQTI

SEQ ID NO: 1154506 - protein, 9 aa, Homo Sapiens
TGSMATASS

SEQ ID NO: 1154507 - protein, 9 aa, Homo Sapiens
MGLKSWISV

SEQ ID NO: 1154508 - protein, 9 aa, Homo Sapiens
SKITEQEKD

SEQ ID NO: 1154509 - protein, 9 aa, Homo Sapiens
ASDHVKVVT

SEQ ID NO: 1154510 - protein, 9 aa, Homo Sapiens
FLWLLCAAD

SEQ ID NO: 1154511 - protein, 9 aa, Homo Sapiens
VSLFYIYSS

SEQ ID NO: 1154512 - protein, 9 aa, Homo Sapiens
DHEDVSQIT

SEQ ID NO: 1154513 - protein, 9 aa, Homo Sapiens
TATVEVSIT

SEQ ID NO: 1154514 - protein, 9 aa, Homo Sapiens
ATVEVSITE

SEQ ID NO: 1154515 - protein, 9 aa, Homo Sapiens
IRSLVISLL

SEQ ID NO: 1154516 - protein, 9 aa, Homo Sapiens
DYRDFSLRM

SEQ ID NO: 1154517 - protein, 9 aa, Homo Sapiens
SLFYIYSSL

SEQ ID NO: 1154518 - protein, 9 aa, Homo Sapiens
GYAKCVEVV

SEQ ID NO: 1154519 - protein, 9 aa, Homo Sapiens
VPCPNLLPA

SEQ ID NO: 1154520 - protein, 9 aa, Homo Sapiens
PPHHLVPLF

SEQ ID NO: 1154521 - protein, 9 aa, Homo Sapiens
PATPPFGLI

SEQ ID NO: 1154522 - protein, 9 aa, Homo Sapiens
YLGREVILV

SEQ ID NO: 1154523 - protein, 9 aa, Homo Sapiens
RRQPPHHLV

SEQ ID NO: 1154524 - protein, 9 aa, Homo Sapiens
IIHLLCDRY

SEQ ID NO: 1154525 - protein, 9 aa, Homo Sapiens
SGLNAWNGF

SEQ ID NO: 1154526 - protein, 9 aa, Homo Sapiens
WRKSGSGSG

SEQ ID NO: 1154527 - protein, 9 aa, Homo Sapiens
AKKEWWFLW

SEQ ID NO: 1154528 - protein, 9 aa, Homo Sapiens
SITESTWVS

SEQ ID NO: 1154529 - protein, 9 aa, Homo Sapiens
KWVTTVDKD

SEQ ID NO: 1154530 - protein, 9 aa, Homo Sapiens
SLFNRSFSS

SEQ ID NO: 1154531 - protein, 9 aa, Homo Sapiens
TLHPEFLSS

SEQ ID NO: 1154532 - protein, 9 aa, Homo Sapiens
SFPNLREIS

SEQ ID NO: 1154533 - protein, 9 aa, Homo Sapiens
VLLAPATPP

SEQ ID NO: 1154534 - protein, 9 aa, Homo Sapiens
RLMGPWHLC

SEQ ID NO: 1154535 - protein, 9 aa, Homo Sapiens
EAVNRRLWE

SEQ ID NO: 1154536 - protein, 9 aa, Homo Sapiens
SRVYCLQFQ

SEQ ID NO: 1154537 - protein, 9 aa, Homo Sapiens
LLAPATPPF

SEQ ID NO: 1154538 - protein, 9 aa, Homo Sapiens
SWISVPCPN

SEQ ID NO: 1154539 - protein, 9 aa, Homo Sapiens
CVEEDKIVN

SEQ ID NO: 1154540 - protein, 9 aa, Homo Sapiens
TTGTKFASP

SEQ ID NO: 1154541 - protein, 9 aa, Homo Sapiens
VYMVHRSCE

SEQ ID NO: 1154542 - protein, 9 aa, Homo Sapiens
FRPVMIISR

SEQ ID NO: 1154543 - protein, 9 aa, Homo Sapiens
CKQHQLHKH

SEQ ID NO: 1154544 - protein, 9 aa, Homo Sapiens
VVSLFYIYS

SEQ ID NO: 1154545 - protein, 9 aa, Homo Sapiens
RTDRVKVTL

SEQ ID NO: 1154546 - protein, 9 aa, Homo Sapiens
AWPCRPAQL

SEQ ID NO: 1154547 - protein, 9 aa, Homo Sapiens
VEVSITEST

SEQ ID NO: 1154548 - protein, 9 aa, Homo Sapiens
LQQNNLDDI

SEQ ID NO: 1154549 - protein, 9 aa, Homo Sapiens
VTELQLSLQ

SEQ ID NO: 1154550 - protein, 9 aa, Homo Sapiens
VTVPTGSMA

SEQ ID NO: 1154551 - protein, 9 aa, Homo Sapiens
NLTVKGYAK

SEQ ID NO: 1154552 - protein, 9 aa, Homo Sapiens
GPWHLCMGL

SEQ ID NO: 1154553 - protein, 9 aa, Homo Sapiens
LGRPSHWFT

SEQ ID NO: 1154554 - protein, 9 aa, Homo Sapiens
QNKELNKAA

SEQ ID NO: 1154555 - protein, 9 aa, Homo Sapiens
LCKQHQLHK

SEQ ID NO: 1154556 - protein, 9 aa, Homo Sapiens
KTVESFPNL

SEQ ID NO: 1154557 - protein, 9 aa, Homo Sapiens
WAETTKQKT

SEQ ID NO: 1154558 - protein, 9 aa, Homo Sapiens
DRAPAQSCR

SEQ ID NO: 1154559 - protein, 9 aa, Homo Sapiens
YMVHRSCET

SEQ ID NO: 1154560 - protein, 9 aa, Homo Sapiens
TESTWVSLE

SEQ ID NO: 1154561 - protein, 9 aa, Homo Sapiens
HVVVAPGGQ

SEQ ID NO: 1154562 - protein, 9 aa, Homo Sapiens
KGYAKCVEV

SEQ ID NO: 1154563 - protein, 9 aa, Homo Sapiens
ENIAWPCRP

SEQ ID NO: 1154564 - protein, 9 aa, Homo Sapiens
VYCLQFQAQ

SEQ ID NO: 1154565 - protein, 9 aa, Homo Sapiens
SGSGSGLNA

SEQ ID NO: 1154566 - protein, 9 aa, Homo Sapiens
RQQDLKLDS

SEQ ID NO: 1154567 - protein, 9 aa, Homo Sapiens
IHKVDDIQA

SEQ ID NO: 1154568 - protein, 9 aa, Homo Sapiens
NGFSNLVRL

SEQ ID NO: 1154569 - protein, 9 aa, Homo Sapiens
EERSGSNLE

SEQ ID NO: 1154570 - protein, 9 aa, Homo Sapiens
VDKDYRDFS

SEQ ID NO: 1154571 - protein, 9 aa, Homo Sapiens
SVPCPNLLP

SEQ ID NO: 1154572 - protein, 9 aa, Homo Sapiens
NSFRKRPQH

SEQ ID NO: 1154573 - protein, 9 aa, Homo Sapiens
LQYIPRPTC

SEQ ID NO: 1154574 - protein, 9 aa, Homo Sapiens
EMPVSITVS

SEQ ID NO: 1154575 - protein, 9 aa, Homo Sapiens
THTREKSYK

SEQ ID NO: 1154576 - protein, 9 aa, Homo Sapiens
KVDDIQARD

SEQ ID NO: 1154577 - protein, 9 aa, Homo Sapiens
VKGYAKCVE

SEQ ID NO: 1154578 - protein, 9 aa, Homo Sapiens
KSWISVPCP

SEQ ID NO: 1154579 - protein, 9 aa, Homo Sapiens
QHQVTHTRE

SEQ ID NO: 1154580 - protein, 9 aa, Homo Sapiens
EKTPEDEAL

SEQ ID NO: 1154581 - protein, 9 aa, Homo Sapiens
PRPRRQPPH

SEQ ID NO: 1154582 - protein, 9 aa, Homo Sapiens
AKSVTLFGE

SEQ ID NO: 1154583 - protein, 9 aa, Homo Sapiens
EVSITESTW

SEQ ID NO: 1154584 - protein, 9 aa, Homo Sapiens
NNVHEEKIK

SEQ ID NO: 1154585 - protein, 9 aa, Homo Sapiens
PPPSEKTPE

SEQ ID NO: 1154586 - protein, 9 aa, Homo Sapiens
GGNAKSVTL

SEQ ID NO: 1154587 - protein, 9 aa, Homo Sapiens
PKQENIAWP

SEQ ID NO: 1154588 - protein, 9 aa, Homo Sapiens
VTNNVHEEK

SEQ ID NO: 1154589 - protein, 9 aa, Homo Sapiens
YIPRPTCRV

SEQ ID NO: 1154590 - protein, 9 aa, Homo Sapiens
QRDLGKPLH

SEQ ID NO: 1154591 - protein, 9 aa, Homo Sapiens
HCESNRFHT

SEQ ID NO: 1154592 - protein, 9 aa, Homo Sapiens
LELKRQVTE

SEQ ID NO: 1154593 - protein, 9 aa, Homo Sapiens
NRRLWELYP

SEQ ID NO: 1154594 - protein, 9 aa, Homo Sapiens
SNPRSQPIN

SEQ ID NO: 1154595 - protein, 9 aa, Homo Sapiens
SVLLSHQRT

SEQ ID NO: 1154596 - protein, 9 aa, Homo Sapiens
DDIGVRLLC

SEQ ID NO: 1154597 - protein, 9 aa, Homo Sapiens
RNAKKEWWF

SEQ ID NO: 1154598 - protein, 9 aa, Homo Sapiens
FAAVVSLFN

SEQ ID NO: 1154599 - protein, 9 aa, Homo Sapiens
VRRNAKKEW

SEQ ID NO: 1154600 - protein, 9 aa, Homo Sapiens
IQLEERSGS

SEQ ID NO: 1154601 - protein, 9 aa, Homo Sapiens
ETSCFELEK

SEQ ID NO: 1154602 - protein, 9 aa, Homo Sapiens
NIAAFGGNA

SEQ ID NO: 1154603 - protein, 9 aa, Homo Sapiens
QGVPQTIAL

SEQ ID NO: 1154604 - protein, 9 aa, Homo Sapiens
TNNVHEEKI

SEQ ID NO: 1154605 - protein, 9 aa, Homo Sapiens
RVYCLQFQA

SEQ ID NO: 1154606 - protein, 9 aa, Homo Sapiens
NNLDDIGVR

SEQ ID NO: 1154607 - protein, 9 aa, Homo Sapiens
LLAPLASAT

SEQ ID NO: 1154608 - protein, 9 aa, Homo Sapiens
QHCPPSFLQ

SEQ ID NO: 1154609 - protein, 9 aa, Homo Sapiens
VYGVSEWLP

SEQ ID NO: 1154610 - protein, 9 aa, Homo Sapiens
PAPSALVLL

SEQ ID NO: 1154611 - protein, 9 aa, Homo Sapiens
PTGSMATAS

SEQ ID NO: 1154612 - protein, 9 aa, Homo Sapiens
THRVHTILS

SEQ ID NO: 1154613 - protein, 9 aa, Homo Sapiens
TRDPLSKIT

SEQ ID NO: 1154614 - protein, 9 aa, Homo Sapiens
DPLSKITEQ

SEQ ID NO: 1154615 - protein, 9 aa, Homo Sapiens
HEDVSQITF

SEQ ID NO: 1154616 - protein, 9 aa, Homo Sapiens
CETSCFELE

SEQ ID NO: 1154617 - protein, 9 aa, Homo Sapiens
LVLIPYESI

SEQ ID NO: 1154618 - protein, 9 aa, Homo Sapiens
YATVTNNVH

SEQ ID NO: 1154619 - protein, 9 aa, Homo Sapiens
LKRQVTELQ

SEQ ID NO: 1154620 - protein, 9 aa, Homo Sapiens
SERILRVYG

SEQ ID NO: 1154621 - protein, 9 aa, Homo Sapiens
KGSQIDVKG

SEQ ID NO: 1154622 - protein, 9 aa, Homo Sapiens
TVPTGSMAT

SEQ ID NO: 1154623 - protein, 9 aa, Homo Sapiens
LCMGLKSWI

SEQ ID NO: 1154624 - protein, 9 aa, Homo Sapiens
NAKSVTLFG

SEQ ID NO: 1154625 - protein, 9 aa, Homo Sapiens
SNSNKEMSG

SEQ ID NO: 1154626 - protein, 9 aa, Homo Sapiens
IDLQPGSSN

SEQ ID NO: 1154627 - protein, 9 aa, Homo Sapiens
NLVRLMGPW

SEQ ID NO: 1154628 - protein, 9 aa, Homo Sapiens
LVAFYKLCK

SEQ ID NO: 1154629 - protein, 9 aa, Homo Sapiens
YRLHVVVAP

SEQ ID NO: 1154630 - protein, 9 aa, Homo Sapiens
KAATMREQR

SEQ ID NO: 1154631 - protein, 9 aa, Homo Sapiens
DTTKKIAAT

SEQ ID NO: 1154632 - protein, 9 aa, Homo Sapiens
HCSLGRPSH

SEQ ID NO: 1154633 - protein, 9 aa, Homo Sapiens
EHWIIKCND

SEQ ID NO: 1154634 - protein, 9 aa, Homo Sapiens
GREVILVLI

SEQ ID NO: 1154635 - protein, 9 aa, Homo Sapiens
SDEYEHLSS

SEQ ID NO: 1154636 - protein, 9 aa, Homo Sapiens
SHEIRSMII

SEQ ID NO: 1154637 - protein, 9 aa, Homo Sapiens
VTHTREKSY

SEQ ID NO: 1154638 - protein, 9 aa, Homo Sapiens
TVTNNVHEE

SEQ ID NO: 1154639 - protein, 9 aa, Homo Sapiens
SITVSSHNS

SEQ ID NO: 1154640 - protein, 9 aa, Homo Sapiens
EQRRLKKVN

SEQ ID NO: 1154641 - protein, 9 aa, Homo Sapiens
QQDLKLDSA

SEQ ID NO: 1154642 - protein, 9 aa, Homo Sapiens
AQSCREAEG

SEQ ID NO: 1154643 - protein, 9 aa, Homo Sapiens
NSHLTQHVR

SEQ ID NO: 1154644 - protein, 9 aa, Homo Sapiens
EEGEAAPDP

SEQ ID NO: 1154645 - protein, 9 aa, Homo Sapiens
PTCRVGLFL

SEQ ID NO: 1154646 - protein, 9 aa, Homo Sapiens
APATPPFGL

SEQ ID NO: 1154647 - protein, 9 aa, Homo Sapiens
KFASPYFST

SEQ ID NO: 1154648 - protein, 9 aa, Homo Sapiens
FQAQLLWNK

SEQ ID NO: 1154649 - protein, 9 aa, Homo Sapiens
MGPWHLCMG

SEQ ID NO: 1154650 - protein, 9 aa, Homo Sapiens
VTTVDKDYR

SEQ ID NO: 1154651 - protein, 9 aa, Homo Sapiens
KLDSAGRGE

SEQ ID NO: 1154652 - protein, 9 aa, Homo Sapiens
NIAWPCRPA

SEQ ID NO: 1154653 - protein, 9 aa, Homo Sapiens
IYSSLTYFW

SEQ ID NO: 1154654 - protein, 9 aa, Homo Sapiens
FSNLVRLMG

SEQ ID NO: 1154655 - protein, 9 aa, Homo Sapiens
KDLIKLMLR

SEQ ID NO: 1154656 - protein, 9 aa, Homo Sapiens
YSTTGTKFA

SEQ ID NO: 1154657 - protein, 9 aa, Homo Sapiens
VVVAPGGQS

SEQ ID NO: 1154658 - protein, 9 aa, Homo Sapiens
TYRLHVVVA

SEQ ID NO: 1154659 - protein, 9 aa, Homo Sapiens
DRVKVTLHP

SEQ ID NO: 1154660 - protein, 9 aa, Homo Sapiens
EEEEGEAAP

SEQ ID NO: 1154661 - protein, 9 aa, Homo Sapiens
DEHWIIKCN

SEQ ID NO: 1154662 - protein, 9 aa, Homo Sapiens
REQRRLKKV

SEQ ID NO: 1154663 - protein, 9 aa, Homo Sapiens
IKLMLRNER

SEQ ID NO: 1154664 - protein, 9 aa, Homo Sapiens
TKFASPYFS

SEQ ID NO: 1154665 - protein, 9 aa, Homo Sapiens
WQSVLLSHQ

SEQ ID NO: 1154666 - protein, 9 aa, Homo Sapiens
STRDPLSKI

SEQ ID NO: 1154667 - protein, 9 aa, Homo Sapiens
NQHQVTHTR

SEQ ID NO: 1154668 - protein, 9 aa, Homo Sapiens
ACASDHVKV

SEQ ID NO: 1154669 - protein, 9 aa, Homo Sapiens
IAWPCRPAQ

SEQ ID NO: 1154670 - protein, 9 aa, Homo Sapiens
LPTGLYCFP

SEQ ID NO: 1154671 - protein, 9 aa, Homo Sapiens
LEELPERWD

SEQ ID NO: 1154672 - protein, 9 aa, Homo Sapiens
MVHRSCETS

SEQ ID NO: 1154673 - protein, 9 aa, Homo Sapiens
QVTELQLSL

SEQ ID NO: 1154674 - protein, 9 aa, Homo Sapiens
ETTKQKTSS

SEQ ID NO: 1154675 - protein, 9 aa, Homo Sapiens
LRVYGVSEW

SEQ ID NO: 1154676 - protein, 9 aa, Homo Sapiens
DQEAKQDKL

SEQ ID NO: 1154677 - protein, 9 aa, Homo Sapiens
SFRPVMIIS

SEQ ID NO: 1154678 - protein, 9 aa, Homo Sapiens
QENIAWPCR

SEQ ID NO: 1154679 - protein, 9 aa, Homo Sapiens
FIWTPWRKS

SEQ ID NO: 1154680 - protein, 9 aa, Homo Sapiens
FDHEDVSQI

SEQ ID NO: 1154681 - protein, 9 aa, Homo Sapiens
ATMREQRRL

SEQ ID NO: 1154682 - protein, 9 aa, Homo Sapiens
FGFNSHLTQ

SEQ ID NO: 1154683 - protein, 9 aa, Homo Sapiens
RSMIIHLLC

SEQ ID NO: 1154684 - protein, 9 aa, Homo Sapiens
RVYGVSEWL

SEQ ID NO: 1154685 - protein, 9 aa, Homo Sapiens
QNNLDDIGV

SEQ ID NO: 1154686 - protein, 9 aa, Homo Sapiens
LEERSGSNL

SEQ ID NO: 1154687 - protein, 9 aa, Homo Sapiens
RRNAKKEWW

SEQ ID NO: 1154688 - protein, 9 aa, Homo Sapiens
WHLCMGLKS

SEQ ID NO: 1154689 - protein, 9 aa, Homo Sapiens
VVTITHRVH

SEQ ID NO: 1154690 - protein, 9 aa, Homo Sapiens
LIPRLPTGL

SEQ ID NO: 1154691 - protein, 9 aa, Homo Sapiens
RLHVVVAPG

SEQ ID NO: 1154692 - protein, 9 aa, Homo Sapiens
IHLLCDRYF

SEQ ID NO: 1154693 - protein, 9 aa, Homo Sapiens
LVRLMGPWH

SEQ ID NO: 1154694 - protein, 9 aa, Homo Sapiens
LWLLCAADS

SEQ ID NO: 1154695 - protein, 9 aa, Homo Sapiens
DRTVVTITH

SEQ ID NO: 1154696 - protein, 9 aa, Homo Sapiens
SSSNSNKEM

SEQ ID NO: 1154697 - protein, 9 aa, Homo Sapiens
RFHTTIAKY

SEQ ID NO: 1154698 - protein, 9 aa, Homo Sapiens
SLRVHSLEL

SEQ ID NO: 1154699 - protein, 9 aa, Homo Sapiens
SNRFHTTIA

SEQ ID NO: 1154700 - protein, 9 aa, Homo Sapiens
LFNRSFSSH

SEQ ID NO: 1154701 - protein, 9 aa, Homo Sapiens
HLSSEALEA

SEQ ID NO: 1154702 - protein, 9 aa, Homo Sapiens
DKIVNYATN

SEQ ID NO: 1154703 - protein, 9 aa, Homo Sapiens
VKVTLHPEF

SEQ ID NO: 1154704 - protein, 9 aa, Homo Sapiens
PGSRVSCQR

SEQ ID NO: 1154705 - protein, 9 aa, Homo Sapiens
VKDIRSLVI

SEQ ID NO: 1154706 - protein, 9 aa, Homo Sapiens
VDLKGSQID

SEQ ID NO: 1154707 - protein, 9 aa, Homo Sapiens
DHVKVVTLL

SEQ ID NO: 1154708 - protein, 9 aa, Homo Sapiens
VPQTIALLT

SEQ ID NO: 1154709 - protein, 9 aa, Homo Sapiens
FYIYSSLTY

SEQ ID NO: 1154710 - protein, 9 aa, Homo Sapiens
CRVGLFLDC

SEQ ID NO: 1154711 - protein, 9 aa, Homo Sapiens
SVCVEEDKI

SEQ ID NO: 1154712 - protein, 9 aa, Homo Sapiens
QPPHHLVPL

SEQ ID NO: 1154713 - protein, 9 aa, Homo Sapiens
LDDIGVRLL

SEQ ID NO: 1154714 - protein, 9 aa, Homo Sapiens
MIIHLLCDR

SEQ ID NO: 1154715 - protein, 9 aa, Homo Sapiens
PRRQPPHHL

SEQ ID NO: 1154716 - protein, 9 aa, Homo Sapiens
VTITHRVHT

SEQ ID NO: 1154717 - protein, 9 aa, Homo Sapiens
ADRTVVTIT

SEQ ID NO: 1154718 - protein, 9 aa, Homo Sapiens
AWNGFSNLV

SEQ ID NO: 1154719 - protein, 9 aa, Homo Sapiens
DLKGSQIDV

SEQ ID NO: 1154720 - protein, 9 aa, Homo Sapiens
ELKRQVTEL

SEQ ID NO: 1154721 - protein, 9 aa, Homo Sapiens
YEHLSSEAL

SEQ ID NO: 1154722 - protein, 9 aa, Homo Sapiens
AATMREQRR

SEQ ID NO: 1154723 - protein, 9 aa, Homo Sapiens
ALVLLAPAT

SEQ ID NO: 1154724 - protein, 9 aa, Homo Sapiens
QVTHTREKS

SEQ ID NO: 1154725 - protein, 9 aa, Homo Sapiens
KQKTSSDDE

SEQ ID NO: 1154726 - protein, 9 aa, Homo Sapiens
LPERWDTTK

SEQ ID NO: 1154727 - protein, 9 aa, Homo Sapiens
VAPGGQSLS

SEQ ID NO: 1154728 - protein, 9 aa, Homo Sapiens
PPFGLIPRL

SEQ ID NO: 1154729 - protein, 9 aa, Homo Sapiens
QDLKLDSAG

SEQ ID NO: 1154730 - protein, 9 aa, Homo Sapiens
EEEGEAAPD

SEQ ID NO: 1154731 - protein, 9 aa, Homo Sapiens
QKTSSDDES

SEQ ID NO: 1154732 - protein, 9 aa, Homo Sapiens
SRVSCQRDL

SEQ ID NO: 1154733 - protein, 9 aa, Homo Sapiens
IYQKTVESF

SEQ ID NO: 1154734 - protein, 9 aa, Homo Sapiens
ICLPLEVPA

SEQ ID NO: 1154735 - protein, 9 aa, Homo Sapiens
GHRCEKKAG

SEQ ID NO: 1154736 - protein, 9 aa, Homo Sapiens
LQQGYFVEA

SEQ ID NO: 1154737 - protein, 9 aa, Homo Sapiens
DYSLMMQSS

SEQ ID NO: 1154738 - protein, 9 aa, Homo Sapiens
EEERPLPHR

SEQ ID NO: 1154739 - protein, 9 aa, Homo Sapiens
GRLAACFLN

SEQ ID NO: 1154740 - protein, 9 aa, Homo Sapiens
AKPQYPVRS

SEQ ID NO: 1154741 - protein, 9 aa, Homo Sapiens
SIMGPLGPS

SEQ ID NO: 1154742 - protein, 9 aa, Homo Sapiens
GPMATPSST

SEQ ID NO: 1154743 - protein, 9 aa, Homo Sapiens
RDNREGIKA

SEQ ID NO: 1154744 - protein, 9 aa, Homo Sapiens
FVMECPSST

SEQ ID NO: 1154745 - protein, 9 aa, Homo Sapiens
KFVMECPSS

SEQ ID NO: 1154746 - protein, 9 aa, Homo Sapiens
LLGSFEGKQ

SEQ ID NO: 1154747 - protein, 9 aa, Homo Sapiens
HVLAMVVAV

SEQ ID NO: 1154748 - protein, 9 aa, Homo Sapiens
TKLRRAHTG

SEQ ID NO: 1154749 - protein, 9 aa, Homo Sapiens
VIAQAGYMP

SEQ ID NO: 1154750 - protein, 9 aa, Homo Sapiens
FGRVMLRSG

SEQ ID NO: 1154751 - protein, 9 aa, Homo Sapiens
LMMQSSVTV

SEQ ID NO: 1154752 - protein, 9 aa, Homo Sapiens
MAAPASIMG

SEQ ID NO: 1154753 - protein, 9 aa, Homo Sapiens
RNLKQRKIS

SEQ ID NO: 1154754 - protein, 9 aa, Homo Sapiens
VKKGLQQGY

SEQ ID NO: 1154755 - protein, 9 aa, Homo Sapiens
PLFFFFAAD

SEQ ID NO: 1154756 - protein, 9 aa, Homo Sapiens
VADLFETVF

SEQ ID NO: 1154757 - protein, 9 aa, Homo Sapiens
PAPHPLFFF

SEQ ID NO: 1154758 - protein, 9 aa, Homo Sapiens
RERGSGIWS

SEQ ID NO: 1154759 - protein, 9 aa, Homo Sapiens
KERIINYAD

SEQ ID NO: 1154760 - protein, 9 aa, Homo Sapiens
NQMQHCKQL

SEQ ID NO: 1154761 - protein, 9 aa, Homo Sapiens
TFRRSVVVP

SEQ ID NO: 1154762 - protein, 9 aa, Homo Sapiens
SLMMQSSVT

SEQ ID NO: 1154763 - protein, 9 aa, Homo Sapiens
KLTPAEYSP

SEQ ID NO: 1154764 - protein, 9 aa, Homo Sapiens
MQHCKQLEG

SEQ ID NO: 1154765 - protein, 9 aa, Homo Sapiens
TNVWVQEHY

SEQ ID NO: 1154766 - protein, 9 aa, Homo Sapiens
HRCEKKAGT

SEQ ID NO: 1154767 - protein, 9 aa, Homo Sapiens
DDRNTFRRS

SEQ ID NO: 1154768 - protein, 9 aa, Homo Sapiens
IFAVDTYPR

SEQ ID NO: 1154769 - protein, 9 aa, Homo Sapiens
NHSFAQTKA

SEQ ID NO: 1154770 - protein, 9 aa, Homo Sapiens
APIPFGGIC

SEQ ID NO: 1154771 - protein, 9 aa, Homo Sapiens
RELLTNVWV

SEQ ID NO: 1154772 - protein, 9 aa, Homo Sapiens
EPEEEEEQA

SEQ ID NO: 1154773 - protein, 9 aa, Homo Sapiens
AILGSYDSK

SEQ ID NO: 1154774 - protein, 9 aa, Homo Sapiens
HLTKLRRAH

SEQ ID NO: 1154775 - protein, 9 aa, Homo Sapiens
YYSVLRHYI

SEQ ID NO: 1154776 - protein, 9 aa, Homo Sapiens
EDGSRIFQQ

SEQ ID NO: 1154777 - protein, 9 aa, Homo Sapiens
LYCPNIGRP

SEQ ID NO: 1154778 - protein, 9 aa, Homo Sapiens
KVYLKVWPD

SEQ ID NO: 1154779 - protein, 9 aa, Homo Sapiens
ADLFETVFS

SEQ ID NO: 1154780 - protein, 9 aa, Homo Sapiens
SNMGASGDH

SEQ ID NO: 1154781 - protein, 9 aa, Homo Sapiens
IINYADSSD

SEQ ID NO: 1154782 - protein, 9 aa, Homo Sapiens
LPHRDFQRQ

SEQ ID NO: 1154783 - protein, 9 aa, Homo Sapiens
QGDVELQQL

SEQ ID NO: 1154784 - protein, 9 aa, Homo Sapiens
DFKTVHLQR

SEQ ID NO: 1154785 - protein, 9 aa, Homo Sapiens
PHPLFFFFA

SEQ ID NO: 1154786 - protein, 9 aa, Homo Sapiens
LTNVWVQEH

SEQ ID NO: 1154787 - protein, 9 aa, Homo Sapiens
SGIWSVSFY

SEQ ID NO: 1154788 - protein, 9 aa, Homo Sapiens
TEYLVWWKG

SEQ ID NO: 1154789 - protein, 9 aa, Homo Sapiens
LHVSYAPCH

SEQ ID NO: 1154790 - protein, 9 aa, Homo Sapiens
WWKGYDSED

SEQ ID NO: 1154791 - protein, 9 aa, Homo Sapiens
ERIINYADS

SEQ ID NO: 1154792 - protein, 9 aa, Homo Sapiens
FEGKQRLLL

SEQ ID NO: 1154793 - protein, 9 aa, Homo Sapiens
YEYFRAEGT

SEQ ID NO: 1154794 - protein, 9 aa, Homo Sapiens
SYDSKLTPA

SEQ ID NO: 1154795 - protein, 9 aa, Homo Sapiens
MDERPIHAK

SEQ ID NO: 1154796 - protein, 9 aa, Homo Sapiens
AGYMPSIRN

SEQ ID NO: 1154797 - protein, 9 aa, Homo Sapiens
ALALNQMQH

SEQ ID NO: 1154798 - protein, 9 aa, Homo Sapiens
LIDFKTVHL

SEQ ID NO: 1154799 - protein, 9 aa, Homo Sapiens
RRSVVVPYE

SEQ ID NO: 1154800 - protein, 9 aa, Homo Sapiens
NKLARAAAV

SEQ ID NO: 1154801 - protein, 9 aa, Homo Sapiens
IAQAGYMPS

SEQ ID NO: 1154802 - protein, 9 aa, Homo Sapiens
QFRNLLEAG

SEQ ID NO: 1154803 - protein, 9 aa, Homo Sapiens
GSGIWSVSF

SEQ ID NO: 1154804 - protein, 9 aa, Homo Sapiens
AEGTNPLEQ

SEQ ID NO: 1154805 - protein, 9 aa, Homo Sapiens
SAYVNLARL

SEQ ID NO: 1154806 - protein, 9 aa, Homo Sapiens
RLAACFLNS

SEQ ID NO: 1154807 - protein, 9 aa, Homo Sapiens
FVQFRNLLE

SEQ ID NO: 1154808 - protein, 9 aa, Homo Sapiens
AGAVCDREK

SEQ ID NO: 1154809 - protein, 9 aa, Homo Sapiens
FAMKSWLQD

SEQ ID NO: 1154810 - protein, 9 aa, Homo Sapiens
AMHVLAMVV

SEQ ID NO: 1154811 - protein, 9 aa, Homo Sapiens
TGPMATPSS

SEQ ID NO: 1154812 - protein, 9 aa, Homo Sapiens
SQEARCSGA

SEQ ID NO: 1154813 - protein, 9 aa, Homo Sapiens
NLFDGQNHS

SEQ ID NO: 1154814 - protein, 9 aa, Homo Sapiens
TVHLQRDGE

SEQ ID NO: 1154815 - protein, 9 aa, Homo Sapiens
VGGAPDFNK

SEQ ID NO: 1154816 - protein, 9 aa, Homo Sapiens
QVHQGDVEL

SEQ ID NO: 1154817 - protein, 9 aa, Homo Sapiens
VIHPQFRAD

SEQ ID NO: 1154818 - protein, 9 aa, Homo Sapiens
KVIAQAGYM

SEQ ID NO: 1154819 - protein, 9 aa, Homo Sapiens
EDMARYYSV

SEQ ID NO: 1154820 - protein, 9 aa, Homo Sapiens
RTLQEVRDF

SEQ ID NO: 1154821 - protein, 9 aa, Homo Sapiens
RNLLEAGKA

SEQ ID NO: 1154822 - protein, 9 aa, Homo Sapiens
MLRSGREAA

SEQ ID NO: 1154823 - protein, 9 aa, Homo Sapiens
IIFAVDTYP

SEQ ID NO: 1154824 - protein, 9 aa, Homo Sapiens
SRASLYCPN

SEQ ID NO: 1154825 - protein, 9 aa, Homo Sapiens
DERPIHAKP

SEQ ID NO: 1154826 - protein, 9 aa, Homo Sapiens
VKVWDLNIE

SEQ ID NO: 1154827 - protein, 9 aa, Homo Sapiens
GFGFVQFRN

SEQ ID NO: 1154828 - protein, 9 aa, Homo Sapiens
ALNQMQHCK

SEQ ID NO: 1154829 - protein, 9 aa, Homo Sapiens
GCEDQAHLF

SEQ ID NO: 1154830 - protein, 9 aa, Homo Sapiens
FQNQRAKFR

SEQ ID NO: 1154831 - protein, 9 aa, Homo Sapiens
SVKVWDLNI

SEQ ID NO: 1154832 - protein, 9 aa, Homo Sapiens
KKVYLKVWP

SEQ ID NO: 1154833 - protein, 9 aa, Homo Sapiens
QQGYFVEAQ

SEQ ID NO: 1154834 - protein, 9 aa, Homo Sapiens
PSSTLFMHE

SEQ ID NO: 1154835 - protein, 9 aa, Homo Sapiens
PLVKKGLQQ

SEQ ID NO: 1154836 - protein, 9 aa, Homo Sapiens
RADLLSPEK

SEQ ID NO: 1154837 - protein, 9 aa, Homo Sapiens
DGQNHSFAQ

SEQ ID NO: 1154838 - protein, 9 aa, Homo Sapiens
RCSGASGGK

SEQ ID NO: 1154839 - protein, 9 aa, Homo Sapiens
AYFRCYKVT

SEQ ID NO: 1154840 - protein, 9 aa, Homo Sapiens
AVYEYFRAE

SEQ ID NO: 1154841 - protein, 9 aa, Homo Sapiens
ILGSYDSKL

SEQ ID NO: 1154842 - protein, 9 aa, Homo Sapiens
LAACFLNSM

SEQ ID NO: 1154843 - protein, 9 aa, Homo Sapiens
VLRHYINLI

SEQ ID NO: 1154844 - protein, 9 aa, Homo Sapiens
DLNIESRPV

SEQ ID NO: 1154845 - protein, 9 aa, Homo Sapiens
ERPLPHRDF

SEQ ID NO: 1154846 - protein, 9 aa, Homo Sapiens
VHLQRDGEE

SEQ ID NO: 1154847 - protein, 9 aa, Homo Sapiens
PQQQPAAMA

SEQ ID NO: 1154848 - protein, 9 aa, Homo Sapiens
NVWVQEHYL

SEQ ID NO: 1154849 - protein, 9 aa, Homo Sapiens
SWLQDVLRK

SEQ ID NO: 1154850 - protein, 9 aa, Homo Sapiens
PHRDFQRQV

SEQ ID NO: 1154851 - protein, 9 aa, Homo Sapiens
IPFGGICLP

SEQ ID NO: 1154852 - protein, 9 aa, Homo Sapiens
PASIMGPLG

SEQ ID NO: 1154853 - protein, 9 aa, Homo Sapiens
LVAEIAKHV

SEQ ID NO: 1154854 - protein, 9 aa, Homo Sapiens
MARYYSVLR

SEQ ID NO: 1154855 - protein, 9 aa, Homo Sapiens
LNQMQHCKQ

SEQ ID NO: 1154856 - protein, 9 aa, Homo Sapiens
NSMATLGLA

SEQ ID NO: 1154857 - protein, 9 aa, Homo Sapiens
GQNHSFAQT

SEQ ID NO: 1154858 - protein, 9 aa, Homo Sapiens
CVELVAEIA

SEQ ID NO: 1154859 - protein, 9 aa, Homo Sapiens
RASLYCPNI

SEQ ID NO: 1154860 - protein, 9 aa, Homo Sapiens
SKKSHLTKL

SEQ ID NO: 1154861 - protein, 9 aa, Homo Sapiens
PIPFGGICL

SEQ ID NO: 1154862 - protein, 9 aa, Homo Sapiens
SKLTPAEYS

SEQ ID NO: 1154863 - protein, 9 aa, Homo Sapiens
FAVDTYPRW

SEQ ID NO: 1154864 - protein, 9 aa, Homo Sapiens
LVKKGLQQG

SEQ ID NO: 1154865 - protein, 9 aa, Homo Sapiens
AATGPMATP

SEQ ID NO: 1154866 - protein, 9 aa, Homo Sapiens
QMQHCKQLE

SEQ ID NO: 1154867 - protein, 9 aa, Homo Sapiens
AVIHPQFRA

SEQ ID NO: 1154868 - protein, 9 aa, Homo Sapiens
CSGASGGKL

SEQ ID NO: 1154869 - protein, 9 aa, Homo Sapiens
QEARCSGAS

SEQ ID NO: 1154870 - protein, 9 aa, Homo Sapiens
EPRELLTNV

SEQ ID NO: 1154871 - protein, 9 aa, Homo Sapiens
LQAETTTGT

SEQ ID NO: 1154872 - protein, 9 aa, Homo Sapiens
DKIEVRDNR

SEQ ID NO: 1154873 - protein, 9 aa, Homo Sapiens
SHLTKLRRA

SEQ ID NO: 1154874 - protein, 9 aa, Homo Sapiens
GICLPLEVP

SEQ ID NO: 1154875 - protein, 9 aa, Homo Sapiens
KQRLLLITA

SEQ ID NO: 1154876 - protein, 9 aa, Homo Sapiens
FFFFAADSL

SEQ ID NO: 1154877 - protein, 9 aa, Homo Sapiens
AGPQRAMHV

SEQ ID NO: 1154878 - protein, 9 aa, Homo Sapiens
PCHVTLTTL

SEQ ID NO: 1154879 - protein, 9 aa, Homo Sapiens
NLKQRKISW

SEQ ID NO: 1154880 - protein, 9 aa, Homo Sapiens
RNTFRRSVV

SEQ ID NO: 1154881 - protein, 9 aa, Homo Sapiens
AQAGYMPSI

SEQ ID NO: 1154882 - protein, 9 aa, Homo Sapiens
GAPDFNKLA

SEQ ID NO: 1154883 - protein, 9 aa, Homo Sapiens
YADSSDPTS

SEQ ID NO: 1154884 - protein, 9 aa, Homo Sapiens
REGIKAVDA

SEQ ID NO: 1154885 - protein, 9 aa, Homo Sapiens
KSWLQDVLR

SEQ ID NO: 1154886 - protein, 9 aa, Homo Sapiens
CPNIGRPRK

SEQ ID NO: 1154887 - protein, 9 aa, Homo Sapiens
EPNLFDGQN

SEQ ID NO: 1154888 - protein, 9 aa, Homo Sapiens
NQLIIFAVD

SEQ ID NO: 1154889 - protein, 9 aa, Homo Sapiens
VYEYFRAEG

SEQ ID NO: 1154890 - protein, 9 aa, Homo Sapiens
KGTLQKFVA

SEQ ID NO: 1154891 - protein, 9 aa, Homo Sapiens
KIEVRDNRE

SEQ ID NO: 1154892 - protein, 9 aa, Homo Sapiens
YEPNLFDGQ

SEQ ID NO: 1154893 - protein, 9 aa, Homo Sapiens
QKFVADLFE

SEQ ID NO: 1154894 - protein, 9 aa, Homo Sapiens
IGSAYVNLA

SEQ ID NO: 1154895 - protein, 9 aa, Homo Sapiens
TTTGTVTPT

SEQ ID NO: 1154896 - protein, 9 aa, Homo Sapiens
FFFAADSLS

SEQ ID NO: 1154897 - protein, 9 aa, Homo Sapiens
YEGYCVELV

SEQ ID NO: 1154898 - protein, 9 aa, Homo Sapiens
DGSRIFQQV

SEQ ID NO: 1154899 - protein, 9 aa, Homo Sapiens
WFQNQRAKF

SEQ ID NO: 1154900 - protein, 9 aa, Homo Sapiens
RPLPHRDFQ

SEQ ID NO: 1154901 - protein, 9 aa, Homo Sapiens
LNIESRPVE

SEQ ID NO: 1154902 - protein, 9 aa, Homo Sapiens
TTGTVTPTA

SEQ ID NO: 1154903 - protein, 9 aa, Homo Sapiens
RAEGTNPLE

SEQ ID NO: 1154904 - protein, 9 aa, Homo Sapiens
TAATGPMAT

SEQ ID NO: 1154905 - protein, 9 aa, Homo Sapiens
PSIRNLKQR

SEQ ID NO: 1154906 - protein, 9 aa, Homo Sapiens
QFRADLLSP

SEQ ID NO: 1154907 - protein, 9 aa, Homo Sapiens
CYKVTELNN

SEQ ID NO: 1154908 - protein, 9 aa, Homo Sapiens
LGSFEGKQR

SEQ ID NO: 1154909 - protein, 9 aa, Homo Sapiens
LVWWKGYDS

SEQ ID NO: 1154910 - protein, 9 aa, Homo Sapiens
NTFRRSVVV

SEQ ID NO: 1154911 - protein, 9 aa, Homo Sapiens
KFVADLFET

SEQ ID NO: 1154912 - protein, 9 aa, Homo Sapiens
NQRAKFRRN

SEQ ID NO: 1154913 - protein, 9 aa, Homo Sapiens
DFNKLARAA

SEQ ID NO: 1154914 - protein, 9 aa, Homo Sapiens
ERPIHAKPQ

SEQ ID NO: 1154915 - protein, 9 aa, Homo Sapiens
FRADLLSPE

SEQ ID NO: 1154916 - protein, 9 aa, Homo Sapiens
AYVNLARLG

SEQ ID NO: 1154917 - protein, 9 aa, Homo Sapiens
TLQEVRDFQ

SEQ ID NO: 1154918 - protein, 9 aa, Homo Sapiens
VYLKVWPDA

SEQ ID NO: 1154919 - protein, 9 aa, Homo Sapiens
GKTEYLVWW

SEQ ID NO: 1154920 - protein, 9 aa, Homo Sapiens
SFEGKQRLL

SEQ ID NO: 1154921 - protein, 9 aa, Homo Sapiens
YLRTLQEVR

SEQ ID NO: 1154922 - protein, 9 aa, Homo Sapiens
WIGSAYVNL

SEQ ID NO: 1154923 - protein, 9 aa, Homo Sapiens
GRVMLRSGR

SEQ ID NO: 1154924 - protein, 9 aa, Homo Sapiens
RVQVWFQNQ

SEQ ID NO: 1154925 - protein, 9 aa, Homo Sapiens
CEDQAHLFK

SEQ ID NO: 1154926 - protein, 9 aa, Homo Sapiens
LFDGQNHSF

SEQ ID NO: 1154927 - protein, 9 aa, Homo Sapiens
LIIFAVDTY

SEQ ID NO: 1154928 - protein, 9 aa, Homo Sapiens
MECPSSTLF

SEQ ID NO: 1154929 - protein, 9 aa, Homo Sapiens
IHAKPQYPV

SEQ ID NO: 1154930 - protein, 9 aa, Homo Sapiens
LDDRNTFRR

SEQ ID NO: 1154931 - protein, 9 aa, Homo Sapiens
EGKQRLLLI

SEQ ID NO: 1154932 - protein, 9 aa, Homo Sapiens
YSVLRHYIN

SEQ ID NO: 1154933 - protein, 9 aa, Homo Sapiens
KVWPDATTK

SEQ ID NO: 1154934 - protein, 9 aa, Homo Sapiens
PIHAKPQYP

SEQ ID NO: 1154935 - protein, 9 aa, Homo Sapiens
AIAGAVCDR

SEQ ID NO: 1154936 - protein, 9 aa, Homo Sapiens
DNREGIKAV

SEQ ID NO: 1154937 - protein, 9 aa, Homo Sapiens
SVLRHYINL

SEQ ID NO: 1154938 - protein, 9 aa, Homo Sapiens
EQYLRTLQE

SEQ ID NO: 1154939 - protein, 9 aa, Homo Sapiens
LQKFVADLF

SEQ ID NO: 1154940 - protein, 9 aa, Homo Sapiens
PNLFDGQNH

SEQ ID NO: 1154941 - protein, 9 aa, Homo Sapiens
KVWDLNIES

SEQ ID NO: 1154942 - protein, 9 aa, Homo Sapiens
QRLLLITAP

SEQ ID NO: 1154943 - protein, 9 aa, Homo Sapiens
QAETTTGTV

SEQ ID NO: 1154944 - protein, 9 aa, Homo Sapiens
VRDNREGIK

SEQ ID NO: 1154945 - protein, 9 aa, Homo Sapiens
FRCYKVTEL

SEQ ID NO: 1154946 - protein, 9 aa, Homo Sapiens
AVCDREKRL

SEQ ID NO: 1154947 - protein, 9 aa, Homo Sapiens
RCYKVTELN

SEQ ID NO: 1154948 - protein, 9 aa, Homo Sapiens
SLYCPNIGR

SEQ ID NO: 1154949 - protein, 9 aa, Homo Sapiens
KTEYLVWWK

SEQ ID NO: 1154950 - protein, 9 aa, Homo Sapiens
QNQRAKFRR

SEQ ID NO: 1154951 - protein, 9 aa, Homo Sapiens
FKTVHLQRD

SEQ ID NO: 1154952 - protein, 9 aa, Homo Sapiens
LLTNVWVQE

SEQ ID NO: 1154953 - protein, 9 aa, Homo Sapiens
SNRKDYSLM

SEQ ID NO: 1154954 - protein, 9 aa, Homo Sapiens
ASIMGPLGP

SEQ ID NO: 1154955 - protein, 9 aa, Homo Sapiens
RIFQQVEQS

SEQ ID NO: 1154956 - protein, 9 aa, Homo Sapiens
STLFMHEFK

SEQ ID NO: 1154957 - protein, 9 aa, Homo Sapiens
WPDATTKEV

SEQ ID NO: 1154958 - protein, 9 aa, Homo Sapiens
IDFKTVHLQ

SEQ ID NO: 1154959 - protein, 9 aa, Homo Sapiens
APDFNKLAR

SEQ ID NO: 1154960 - protein, 9 aa, Homo Sapiens
QQPAAMARR

SEQ ID NO: 1154961 - protein, 9 aa, Homo Sapiens
EDQAHLFKD

SEQ ID NO: 1154962 - protein, 9 aa, Homo Sapiens
DVELQQLEA

SEQ ID NO: 1154963 - protein, 9 aa, Homo Sapiens
QNHSFAQTK

SEQ ID NO: 1154964 - protein, 9 aa, Homo Sapiens
GSYDSKLTP

SEQ ID NO: 1154965 - protein, 9 aa, Homo Sapiens
MATPSSTPG

SEQ ID NO: 1154966 - protein, 9 aa, Homo Sapiens
LQDVLRKGL

SEQ ID NO: 1154967 - protein, 9 aa, Homo Sapiens
VMECPSSTL

SEQ ID NO: 1154968 - protein, 9 aa, Homo Sapiens
FPLIDFKTV

SEQ ID NO: 1154969 - protein, 9 aa, Homo Sapiens
YFRAEGTNP

SEQ ID NO: 1154970 - protein, 9 aa, Homo Sapiens
YKVTELNNV

SEQ ID NO: 1154971 - protein, 9 aa, Homo Sapiens
EARCSGASG

SEQ ID NO: 1154972 - protein, 9 aa, Homo Sapiens
FGFVQFRNL

SEQ ID NO: 1154973 - protein, 9 aa, Homo Sapiens
EYLVWWKGY

SEQ ID NO: 1154974 - protein, 9 aa, Homo Sapiens
AAIAGAVCD

SEQ ID NO: 1154975 - protein, 9 aa, Homo Sapiens
AMEQRQGQL

SEQ ID NO: 1154976 - protein, 9 aa, Homo Sapiens
GGAPDFNKL

SEQ ID NO: 1154977 - protein, 9 aa, Homo Sapiens
RAAYFRCYK

SEQ ID NO: 1154978 - protein, 9 aa, Homo Sapiens
LTKLRRAHT

SEQ ID NO: 1154979 - protein, 9 aa, Homo Sapiens
QRAMHVLAM

SEQ ID NO: 1154980 - protein, 9 aa, Homo Sapiens
CPSSTLFMH

SEQ ID NO: 1154981 - protein, 9 aa, Homo Sapiens
KGLQQGYFV

SEQ ID NO: 1154982 - protein, 9 aa, Homo Sapiens
AHLFKDEAR

SEQ ID NO: 1154983 - protein, 9 aa, Homo Sapiens
FSKKSHLTK

SEQ ID NO: 1154984 - protein, 9 aa, Homo Sapiens
SRIFQQVEQ

SEQ ID NO: 1154985 - protein, 9 aa, Homo Sapiens
SEPEEEEEQ

SEQ ID NO: 1154986 - protein, 9 aa, Homo Sapiens
QFSQEARCS

SEQ ID NO: 1154987 - protein, 9 aa, Homo Sapiens
GFVQFRNLL

SEQ ID NO: 1154988 - protein, 9 aa, Homo Sapiens
KDYSLMMQS

SEQ ID NO: 1154989 - protein, 9 aa, Homo Sapiens
QLIIFAVDT

SEQ ID NO: 1154990 - protein, 9 aa, Homo Sapiens
SLHVSYAPC

SEQ ID NO: 1154991 - protein, 9 aa, Homo Sapiens
EGTNPLEQD

SEQ ID NO: 1154992 - protein, 9 aa, Homo Sapiens
DQAHLFKDE

SEQ ID NO: 1154993 - protein, 9 aa, Homo Sapiens
LAMEQRQGQ

SEQ ID NO: 1154994 - protein, 9 aa, Homo Sapiens
SGHRCEKKA

SEQ ID NO: 1154995 - protein, 9 aa, Homo Sapiens
RQGQLATVS

SEQ ID NO: 1154996 - protein, 9 aa, Homo Sapiens
ADSSDPTSG

SEQ ID NO: 1154997 - protein, 9 aa, Homo Sapiens
FRRSVVVPY

SEQ ID NO: 1154998 - protein, 9 aa, Homo Sapiens
TPLVKKGLQ

SEQ ID NO: 1154999 - protein, 9 aa, Homo Sapiens
GYMPSIRNL

SEQ ID NO: 1155000 - protein, 9 aa, Homo Sapiens
AVDTYPRWV

SEQ ID NO: 1155001 - protein, 9 aa, Homo Sapiens
MARRNERER

SEQ ID NO: 1155002 - protein, 9 aa, Homo Sapiens
DRNTFRRSV

SEQ ID NO: 1155003 - protein, 9 aa, Homo Sapiens
NRKDYSLMM

SEQ ID NO: 1155004 - protein, 9 aa, Homo Sapiens
QPAAMARRN

SEQ ID NO: 1155005 - protein, 9 aa, Homo Sapiens
HLFKDEARI

SEQ ID NO: 1155006 - protein, 9 aa, Homo Sapiens
TGTVTPTAI

SEQ ID NO: 1155007 - protein, 9 aa, Homo Sapiens
LPQQQPAAM

SEQ ID NO: 1155008 - protein, 9 aa, Homo Sapiens
VQFRNLLEA

SEQ ID NO: 1155009 - protein, 9 aa, Homo Sapiens
CDREKRLEA

SEQ ID NO: 1155010 - protein, 9 aa, Homo Sapiens
APCHVTLTT

SEQ ID NO: 1155011 - protein, 9 aa, Homo Sapiens
KPQYPVRSA

SEQ ID NO: 1155012 - protein, 9 aa, Homo Sapiens
PQRAMHVLA

SEQ ID NO: 1155013 - protein, 9 aa, Homo Sapiens
EQVHQGDVE

SEQ ID NO: 1155014 - protein, 9 aa, Homo Sapiens
YLVWWKGYD

SEQ ID NO: 1155015 - protein, 9 aa, Homo Sapiens
FQQVEQSRS

SEQ ID NO: 1155016 - protein, 9 aa, Homo Sapiens
GYCVELVAE

SEQ ID NO: 1155017 - protein, 9 aa, Homo Sapiens
IFQQVEQSR

SEQ ID NO: 1155018 - protein, 9 aa, Homo Sapiens
KKGLQQGYF

SEQ ID NO: 1155019 - protein, 9 aa, Homo Sapiens
RSVVVPYEP

SEQ ID NO: 1155020 - protein, 9 aa, Homo Sapiens
GIWSVSFYE

SEQ ID NO: 1155021 - protein, 9 aa, Homo Sapiens
PAAMARRNE

SEQ ID NO: 1155022 - protein, 9 aa, Homo Sapiens
EGYCVELVA

SEQ ID NO: 1155023 - protein, 9 aa, Homo Sapiens
MGASGDHDD

SEQ ID NO: 1155024 - protein, 9 aa, Homo Sapiens
HVSYAPCHV

SEQ ID NO: 1155025 - protein, 9 aa, Homo Sapiens
DSSDPTSGV

SEQ ID NO: 1155026 - protein, 9 aa, Homo Sapiens
VSYAPCHVT

SEQ ID NO: 1155027 - protein, 9 aa, Homo Sapiens
VWDLNIESR

SEQ ID NO: 1155028 - protein, 9 aa, Homo Sapiens
YCVELVAEI

SEQ ID NO: 1155029 - protein, 9 aa, Homo Sapiens
VSSGHRCEK

SEQ ID NO: 1155030 - protein, 9 aa, Homo Sapiens
TLQKFVADL

SEQ ID NO: 1155031 - protein, 9 aa, Homo Sapiens
HRDFQRQVW

SEQ ID NO: 1155032 - protein, 9 aa, Homo Sapiens
MPSIRNLKQ

SEQ ID NO: 1155033 - protein, 9 aa, Homo Sapiens
YLKVWPDAT

SEQ ID NO: 1155034 - protein, 9 aa, Homo Sapiens
KTVHLQRDG

SEQ ID NO: 1155035 - protein, 9 aa, Homo Sapiens
GPQRAMHVL

SEQ ID NO: 1155036 - protein, 9 aa, Homo Sapiens
EAVIHPQFR

SEQ ID NO: 1155037 - protein, 9 aa, Homo Sapiens
ARCSGASGG

SEQ ID NO: 1155038 - protein, 9 aa, Homo Sapiens
EKKVYLKVW

SEQ ID NO: 1155039 - protein, 9 aa, Homo Sapiens
SSTLFMHEF

SEQ ID NO: 1155040 - protein, 9 aa, Homo Sapiens
VCDREKRLE

SEQ ID NO: 1155041 - protein, 9 aa, Homo Sapiens
WSVSFYEHI

SEQ ID NO: 1155042 - protein, 9 aa, Homo Sapiens
AMARRNERE

SEQ ID NO: 1155043 - protein, 9 aa, Homo Sapiens
AAPASIMGP

SEQ ID NO: 1155044 - protein, 9 aa, Homo Sapiens
GSGKSNMGA

SEQ ID NO: 1155045 - protein, 9 aa, Homo Sapiens
VMLRSGREA

SEQ ID NO: 1155046 - protein, 9 aa, Homo Sapiens
APHPLFFFF

SEQ ID NO: 1155047 - protein, 9 aa, Homo Sapiens
AKEQVHQGD

SEQ ID NO: 1155048 - protein, 9 aa, Homo Sapiens
GKSNMGASG

SEQ ID NO: 1155049 - protein, 9 aa, Homo Sapiens
ELLTNVWVQ

SEQ ID NO: 1155050 - protein, 9 aa, Homo Sapiens
EQRQGQLAT

SEQ ID NO: 1155051 - protein, 9 aa, Homo Sapiens
RAMHVLAMV

SEQ ID NO: 1155052 - protein, 9 aa, Homo Sapiens
FLNSMATLG

SEQ ID NO: 1155053 - protein, 9 aa, Homo Sapiens
FGGICLPLE

SEQ ID NO: 1155054 - protein, 9 aa, Homo Sapiens
GTLQKFVAD

SEQ ID NO: 1155055 - protein, 9 aa, Homo Sapiens
EYFRAEGTN

SEQ ID NO: 1155056 - protein, 9 aa, Homo Sapiens
GREAAFVYA

SEQ ID NO: 1155057 - protein, 9 aa, Homo Sapiens
WLQDVLRKG

SEQ ID NO: 1155058 - protein, 9 aa, Homo Sapiens
GSFEGKQRL

SEQ ID NO: 1155059 - protein, 9 aa, Homo Sapiens
FNKLARAAA

SEQ ID NO: 1155060 - protein, 9 aa, Homo Sapiens
RGFGFVQFR

SEQ ID NO: 1155061 - protein, 9 aa, Homo Sapiens
KKSHLTKLR

SEQ ID NO: 1155062 - protein, 9 aa, Homo Sapiens
LQEVRDFQR

SEQ ID NO: 1155063 - protein, 9 aa, Homo Sapiens
ELVAEIAKH

SEQ ID NO: 1155064 - protein, 9 aa, Homo Sapiens
FVADLFETV

SEQ ID NO: 1155065 - protein, 9 aa, Homo Sapiens
QRQGQLATV

SEQ ID NO: 1155066 - protein, 9 aa, Homo Sapiens
PFAMKSWLQ

SEQ ID NO: 1155067 - protein, 9 aa, Homo Sapiens
IEVRDNREG

SEQ ID NO: 1155068 - protein, 9 aa, Homo Sapiens
YVNLARLGE

SEQ ID NO: 1155069 - protein, 9 aa, Homo Sapiens
CLPLEVPAS

SEQ ID NO: 1155070 - protein, 9 aa, Homo Sapiens
GEPRELLTN

SEQ ID NO: 1155071 - protein, 9 aa, Homo Sapiens
RIINYADSS

SEQ ID NO: 1155072 - protein, 9 aa, Homo Sapiens
GDVELQQLE

SEQ ID NO: 1155073 - protein, 9 aa, Homo Sapiens
HPLFFFFAA

SEQ ID NO: 1155074 - protein, 9 aa, Homo Sapiens
YSRASLYCP

SEQ ID NO: 1155075 - protein, 9 aa, Homo Sapiens
ACFLNSMAT

SEQ ID NO: 1155076 - protein, 9 aa, Homo Sapiens
RYYSVLRHY

SEQ ID NO: 1155077 - protein, 9 aa, Homo Sapiens
GAVCDREKR

SEQ ID NO: 1155078 - protein, 9 aa, Homo Sapiens
SIRNLKQRK

SEQ ID NO: 1155079 - protein, 9 aa, Homo Sapiens
PRELLTNVW

SEQ ID NO: 1155080 - protein, 9 aa, Homo Sapiens
WDLNIESRP

SEQ ID NO: 1155081 - protein, 9 aa, Homo Sapiens
REDGSRIFQ

SEQ ID NO: 1155082 - protein, 9 aa, Homo Sapiens
MKSWLQDVL

SEQ ID NO: 1155083 - protein, 9 aa, Homo Sapiens
QYLRTLQEV

SEQ ID NO: 1155084 - protein, 9 aa, Homo Sapiens
PQFRADLLS

SEQ ID NO: 1155085 - protein, 9 aa, Homo Sapiens
VELVAEIAK

SEQ ID NO: 1155086 - protein, 9 aa, Homo Sapiens
PDFNKLARA

SEQ ID NO: 1155087 - protein, 9 aa, Homo Sapiens
LRTLQEVRD

SEQ ID NO: 1155088 - protein, 9 aa, Homo Sapiens
EVRDNREGI

SEQ ID NO: 1155089 - protein, 9 aa, Homo Sapiens
KLRRAHTGE

SEQ ID NO: 1155090 - protein, 9 aa, Homo Sapiens
AETTTGTVT

SEQ ID NO: 1155091 - protein, 9 aa, Homo Sapiens
KSNMGASGD

SEQ ID NO: 1155092 - protein, 9 aa, Homo Sapiens
CFLNSMATL

SEQ ID NO: 1155093 - protein, 9 aa, Homo Sapiens
PFGGICLPL

SEQ ID NO: 1155094 - protein, 9 aa, Homo Sapiens
FRAEGTNPL

SEQ ID NO: 1155095 - protein, 9 aa, Homo Sapiens
TREDGSRIF

SEQ ID NO: 1155096 - protein, 9 aa, Homo Sapiens
NREGIKAVD

SEQ ID NO: 1155097 - protein, 9 aa, Homo Sapiens
CHVTLTTLM

SEQ ID NO: 1155098 - protein, 9 aa, Homo Sapiens
RVMLRSGRE

SEQ ID NO: 1155099 - protein, 9 aa, Homo Sapiens
AAAIAGAVC

SEQ ID NO: 1155100 - protein, 9 aa, Homo Sapiens
RGSGIWSVS

SEQ ID NO: 1155101 - protein, 9 aa, Homo Sapiens
HPQFRADLL

SEQ ID NO: 1155102 - protein, 9 aa, Homo Sapiens
LTGCEDQAH

SEQ ID NO: 1155103 - protein, 9 aa, Homo Sapiens
ENQLIIFAV

SEQ ID NO: 1155104 - protein, 9 aa, Homo Sapiens
RPIHAKPQY

SEQ ID NO: 1155105 - protein, 9 aa, Homo Sapiens
PLPHRDFQR

SEQ ID NO: 1155106 - protein, 9 aa, Homo Sapiens
PEEEEEQAA

SEQ ID NO: 1155107 - protein, 9 aa, Homo Sapiens
IRNLKQRKI

SEQ ID NO: 1155108 - protein, 9 aa, Homo Sapiens
GKQRLLLIT

SEQ ID NO: 1155109 - protein, 9 aa, Homo Sapiens
RSGREAAFV

SEQ ID NO: 1155110 - protein, 9 aa, Homo Sapiens
QAGPQRAMH

SEQ ID NO: 1155111 - protein, 9 aa, Homo Sapiens
LNSMATLGL

SEQ ID NO: 1155112 - protein, 9 aa, Homo Sapiens
IYSRASLYC

SEQ ID NO: 1155113 - protein, 9 aa, Homo Sapiens
GSAYVNLAR

SEQ ID NO: 1155114 - protein, 9 aa, Homo Sapiens
SSGHRCEKK

SEQ ID NO: 1155115 - protein, 9 aa, Homo Sapiens
FRNLLEAGK

SEQ ID NO: 1155116 - protein, 9 aa, Homo Sapiens
LKVWPDATT

SEQ ID NO: 1155117 - protein, 9 aa, Homo Sapiens
SGASGGKLA

SEQ ID NO: 1155118 - protein, 9 aa, Homo Sapiens
QQQPAAMAR

SEQ ID NO: 1155119 - protein, 9 aa, Homo Sapiens
SRERGSGIW

SEQ ID NO: 1155120 - protein, 9 aa, Homo Sapiens
NIESRPVET

SEQ ID NO: 1155121 - protein, 9 aa, Homo Sapiens
VDTYPRWVT

SEQ ID NO: 1155122 - protein, 9 aa, Homo Sapiens
YDSKLTPAE

SEQ ID NO: 1155123 - protein, 9 aa, Homo Sapiens
NMGASGDHD

SEQ ID NO: 1155124 - protein, 9 aa, Homo Sapiens
IAGAVCDRE

SEQ ID NO: 1155125 - protein, 9 aa, Homo Sapiens
KEQVHQGDV

SEQ ID NO: 1155126 - protein, 9 aa, Homo Sapiens
MMQSSVTVQ

SEQ ID NO: 1155127 - protein, 8 aa, Homo Sapiens
CTGKCARC

SEQ ID NO: 1155128 - protein, 9 aa, Homo Sapiens
IEQYLRTLQ

SEQ ID NO: 1155129 - protein, 9 aa, Homo Sapiens
QRAKFRRNE

SEQ ID NO: 1155130 - protein, 9 aa, Homo Sapiens
REEERPLPH

SEQ ID NO: 1155131 - protein, 9 aa, Homo Sapiens
AAMARRNER

SEQ ID NO: 1155132 - protein, 9 aa, Homo Sapiens
IWSVSFYEH

SEQ ID NO: 1155133 - protein, 9 aa, Homo Sapiens
HAKPQYPVR

SEQ ID NO: 1155134 - protein, 9 aa, Homo Sapiens
LRSGREAAF

SEQ ID NO: 1155135 - protein, 9 aa, Homo Sapiens
QAGYMPSIR

SEQ ID NO: 1155136 - protein, 9 aa, Homo Sapiens
MEQRQGQLA

SEQ ID NO: 1155137 - protein, 9 aa, Homo Sapiens
ECPSSTLFM

SEQ ID NO: 1155138 - protein, 9 aa, Homo Sapiens
KGKTEYLVW

SEQ ID NO: 1155139 - protein, 9 aa, Homo Sapiens
YFRCYKVTE

SEQ ID NO: 1155140 - protein, 9 aa, Homo Sapiens
YMPSIRNLK

SEQ ID NO: 1155141 - protein, 9 aa, Homo Sapiens
YSLMMQSSV

SEQ ID NO: 1155142 - protein, 9 aa, Homo Sapiens
DMARYYSVL

SEQ ID NO: 1155143 - protein, 9 aa, Homo Sapiens
FSQEARCSG

SEQ ID NO: 1155144 - protein, 9 aa, Homo Sapiens
PMATPSSTP

SEQ ID NO: 1155145 - protein, 9 aa, Homo Sapiens
YVGGAPDFN

SEQ ID NO: 1155146 - protein, 9 aa, Homo Sapiens
PSALALNQM

SEQ ID NO: 1155147 - protein, 9 aa, Homo Sapiens
VNLARLGER

SEQ ID NO: 1155148 - protein, 9 aa, Homo Sapiens
RPAPHPLFF

SEQ ID NO: 1155149 - protein, 9 aa, Homo Sapiens
ILQAETTTG

SEQ ID NO: 1155150 - protein, 9 aa, Homo Sapiens
QAHLFKDEA

SEQ ID NO: 1155151 - protein, 9 aa, Homo Sapiens
YAPCHVTLT

SEQ ID NO: 1155152 - protein, 9 aa, Homo Sapiens
TTTAATGPM

SEQ ID NO: 1155153 - protein, 9 aa, Homo Sapiens
MHVLAMVVA

SEQ ID NO: 1155154 - protein, 9 aa, Homo Sapiens
VWPDATTKE

SEQ ID NO: 1155155 - protein, 9 aa, Homo Sapiens
ERGSGIWSV

SEQ ID NO: 1155156 - protein, 9 aa, Homo Sapiens
AAYFRCYKV

SEQ ID NO: 1155157 - protein, 9 aa, Homo Sapiens
LFFFFAADS

SEQ ID NO: 1155158 - protein, 9 aa, Homo Sapiens
YCPNIGRPR

SEQ ID NO: 1155159 - protein, 9 aa, Homo Sapiens
NLARLGERS

SEQ ID NO: 1155160 - protein, 9 aa, Homo Sapiens
LALNQMQHC

SEQ ID NO: 1155161 - protein, 9 aa, Homo Sapiens
GLQQGYFVE

SEQ ID NO: 1155162 - protein, 9 aa, Homo Sapiens
INYADSSDP

SEQ ID NO: 1155163 - protein, 9 aa, Homo Sapiens
VAEIAKHVG

SEQ ID NO: 1155164 - protein, 9 aa, Homo Sapiens
ALAMEQRQG

SEQ ID NO: 1155165 - protein, 9 aa, Homo Sapiens
ARYYSVLRH

SEQ ID NO: 1155166 - protein, 9 aa, Homo Sapiens
VWWKGYDSE

SEQ ID NO: 1155167 - protein, 9 aa, Homo Sapiens
SWIGSAYVN

SEQ ID NO: 1155168 - protein, 9 aa, Homo Sapiens
EERPLPHRD

SEQ ID NO: 1155169 - protein, 9 aa, Homo Sapiens
TGCEDQAHL

SEQ ID NO: 1155170 - protein, 9 aa, Homo Sapiens
TTAATGPMA

SEQ ID NO: 1155171 - protein, 9 aa, Homo Sapiens
PLIDFKTVH

SEQ ID NO: 1155172 - protein, 9 aa, Homo Sapiens
AMKSWLQDV

SEQ ID NO: 1155173 - protein, 9 aa, Homo Sapiens
FDGQNHSFA

SEQ ID NO: 1155174 - protein, 9 aa, Homo Sapiens
LGSYDSKLT

SEQ ID NO: 1155175 - protein, 9 aa, Homo Sapiens
SYAPCHVTL

SEQ ID NO: 1155176 - protein, 9 aa, Homo Sapiens
GSRIFQQVE

SEQ ID NO: 1155177 - protein, 9 aa, Homo Sapiens
IESRPVETH

SEQ ID NO: 1155178 - protein, 9 aa, Homo Sapiens
KSHLTKLRR

SEQ ID NO: 1155179 - protein, 9 aa, Homo Sapiens
QGQLATVSQ

SEQ ID NO: 1155180 - protein, 9 aa, Homo Sapiens
ETTTGTVTP

SEQ ID NO: 1155181 - protein, 9 aa, Homo Sapiens
ASLYCPNIG

SEQ ID NO: 1155182 - protein, 9 aa, Homo Sapiens
RKDYSLMMQ

SEQ ID NO: 1155183 - protein, 9 aa, Homo Sapiens
IMGPLGPSA

SEQ ID NO: 1155184 - protein, 9 aa, Homo Sapiens
QDVLRKGLV

SEQ ID NO: 1155185 - protein, 9 aa, Homo Sapiens
IHPQFRADL

SEQ ID NO: 1155186 - protein, 9 aa, Homo Sapiens
DSKLTPAEY

SEQ ID NO: 1155187 - protein, 9 aa, Homo Sapiens
VHQGDVELQ

SEQ ID NO: 1155188 - protein, 9 aa, Homo Sapiens
NYADSSDPT

SEQ ID NO: 1155189 - protein, 9 aa, Homo Sapiens
APASIMGPL

SEQ ID NO: 1155190 - protein, 9 aa, Homo Sapiens
RILQAETTT

SEQ ID NO: 1155191 - protein, 9 aa, Homo Sapiens
SGREAAFVY

SEQ ID NO: 1155192 - protein, 9 aa, Homo Sapiens
SALALNQMQ

SEQ ID NO: 1155193 - protein, 9 aa, Homo Sapiens
AACFLNSMA

SEQ ID NO: 1155194 - protein, 9 aa, Homo Sapiens
SGKSNMGAS

SEQ ID NO: 1155195 - protein, 9 aa, Homo Sapiens
HQGDVELQQ

SEQ ID NO: 1155196 - protein, 9 aa, Homo Sapiens
EIEQYLRTL

SEQ ID NO: 1155197 - protein, 9 aa, Homo Sapiens
LALAMEQRQ

SEQ ID NO: 1155198 - protein, 9 aa, Homo Sapiens
ATGPMATPS

SEQ ID NO: 1155199 - protein, 9 aa, Homo Sapiens
GGICLPLEV

SEQ ID NO: 1155200 - protein, 9 aa, Homo Sapiens
LFIHSMGKG

SEQ ID NO: 1155201 - protein, 9 aa, Homo Sapiens
EDGKTKGCI

SEQ ID NO: 1155202 - protein, 9 aa, Homo Sapiens
TSMLLSKET

SEQ ID NO: 1155203 - protein, 9 aa, Homo Sapiens
HSAPKAASD

SEQ ID NO: 1155204 - protein, 9 aa, Homo Sapiens
DVPLPAGPF

SEQ ID NO: 1155205 - protein, 9 aa, Homo Sapiens
SLSSGATVG

SEQ ID NO: 1155206 - protein, 9 aa, Homo Sapiens
GEDHSHVAD

SEQ ID NO: 1155207 - protein, 9 aa, Homo Sapiens
YIYGPLGFF

SEQ ID NO: 1155208 - protein, 9 aa, Homo Sapiens
HTVNEYSPQ

SEQ ID NO: 1155209 - protein, 9 aa, Homo Sapiens
DSVDCEYDM

SEQ ID NO: 1155210 - protein, 9 aa, Homo Sapiens
RILLVGLRR

SEQ ID NO: 1155211 - protein, 9 aa, Homo Sapiens
VNIYVNSIG

SEQ ID NO: 1155212 - protein, 9 aa, Homo Sapiens
VLWDDIDNP

SEQ ID NO: 1155213 - protein, 9 aa, Homo Sapiens
HFSVAPATL

SEQ ID NO: 1155214 - protein, 9 aa, Homo Sapiens
YVSYEIRVQ

SEQ ID NO: 1155215 - protein, 9 aa, Homo Sapiens
DAELLEALL

SEQ ID NO: 1155216 - protein, 9 aa, Homo Sapiens
GEGPGPETW

SEQ ID NO: 1155217 - protein, 9 aa, Homo Sapiens
AAPGEALHS

SEQ ID NO: 1155218 - protein, 9 aa, Homo Sapiens
GHDLESPET

SEQ ID NO: 1155219 - protein, 9 aa, Homo Sapiens
NMEANMPAV

SEQ ID NO: 1155220 - protein, 9 aa, Homo Sapiens
PSAMLRPTS

SEQ ID NO: 1155221 - protein, 9 aa, Homo Sapiens
KACQEHIEA

SEQ ID NO: 1155222 - protein, 9 aa, Homo Sapiens
GKLSHGVRV

SEQ ID NO: 1155223 - protein, 9 aa, Homo Sapiens
LKACQEHIE

SEQ ID NO: 1155224 - protein, 9 aa, Homo Sapiens
YQKMALKYH

SEQ ID NO: 1155225 - protein, 9 aa, Homo Sapiens
KEDIEVYFM

SEQ ID NO: 1155226 - protein, 9 aa, Homo Sapiens
MTTHFHLKG

SEQ ID NO: 1155227 - protein, 9 aa, Homo Sapiens
KPRILLVGL

SEQ ID NO: 1155228 - protein, 9 aa, Homo Sapiens
HASVPTTFM

SEQ ID NO: 1155229 - protein, 9 aa, Homo Sapiens
LELTYIYPN

SEQ ID NO: 1155230 - protein, 9 aa, Homo Sapiens
VGAESADTE

SEQ ID NO: 1155231 - protein, 9 aa, Homo Sapiens
NMPAVLTHS

SEQ ID NO: 1155232 - protein, 9 aa, Homo Sapiens
PWKLLVLQS

SEQ ID NO: 1155233 - protein, 9 aa, Homo Sapiens
ILPYTSRKS

SEQ ID NO: 1155234 - protein, 9 aa, Homo Sapiens
SYVLRHSPQ

SEQ ID NO: 1155235 - protein, 9 aa, Homo Sapiens
LPWKLLVLQ

SEQ ID NO: 1155236 - protein, 9 aa, Homo Sapiens
LNVLWDDID

SEQ ID NO: 1155237 - protein, 9 aa, Homo Sapiens
HSVLGEAGL

SEQ ID NO: 1155238 - protein, 9 aa, Homo Sapiens
ESVAGNQET

SEQ ID NO: 1155239 - protein, 9 aa, Homo Sapiens
TVNEYSPQK

SEQ ID NO: 1155240 - protein, 9 aa, Homo Sapiens
HHKNPYPTK

SEQ ID NO: 1155241 - protein, 9 aa, Homo Sapiens
VFCKIQMEP

SEQ ID NO: 1155242 - protein, 9 aa, Homo Sapiens
MQVLNITPE

SEQ ID NO: 1155243 - protein, 9 aa, Homo Sapiens
MASEVGHDL

SEQ ID NO: 1155244 - protein, 9 aa, Homo Sapiens
APRGQGRKH

SEQ ID NO: 1155245 - protein, 9 aa, Homo Sapiens
QTACPALCP

SEQ ID NO: 1155246 - protein, 9 aa, Homo Sapiens
VKPRILLVG

SEQ ID NO: 1155247 - protein, 9 aa, Homo Sapiens
ESEEEEEER

SEQ ID NO: 1155248 - protein, 9 aa, Homo Sapiens
HSTKGNAHK

SEQ ID NO: 1155249 - protein, 9 aa, Homo Sapiens
ELLEVVGPE

SEQ ID NO: 1155250 - protein, 9 aa, Homo Sapiens
PGHPPGSVG

SEQ ID NO: 1155251 - protein, 9 aa, Homo Sapiens
QEHIEAVLL

SEQ ID NO: 1155252 - protein, 9 aa, Homo Sapiens
TPAPSALPR

SEQ ID NO: 1155253 - protein, 9 aa, Homo Sapiens
LAFAGKKRA

SEQ ID NO: 1155254 - protein, 9 aa, Homo Sapiens
MCSVCGHRF

SEQ ID NO: 1155255 - protein, 9 aa, Homo Sapiens
QNLVGKLSH

SEQ ID NO: 1155256 - protein, 9 aa, Homo Sapiens
CEYDMGSVQ

SEQ ID NO: 1155257 - protein, 9 aa, Homo Sapiens
WRFTQLDAQ

SEQ ID NO: 1155258 - protein, 9 aa, Homo Sapiens
HARIERITW

SEQ ID NO: 1155259 - protein, 9 aa, Homo Sapiens
QQNLVAFQY

SEQ ID NO: 1155260 - protein, 9 aa, Homo Sapiens
IERITWRFT

SEQ ID NO: 1155261 - protein, 9 aa, Homo Sapiens
CKIQMEPGD

SEQ ID NO: 1155262 - protein, 9 aa, Homo Sapiens
DPENEGELG

SEQ ID NO: 1155263 - protein, 9 aa, Homo Sapiens
TLVPDGSKA

SEQ ID NO: 1155264 - protein, 9 aa, Homo Sapiens
NVLWDDIDN

SEQ ID NO: 1155265 - protein, 9 aa, Homo Sapiens
REQQERCEQ

SEQ ID NO: 1155266 - protein, 9 aa, Homo Sapiens
TTFMPIVVP

SEQ ID NO: 1155267 - protein, 9 aa, Homo Sapiens
AGNQETANN

SEQ ID NO: 1155268 - protein, 9 aa, Homo Sapiens
RSTLTSLAL

SEQ ID NO: 1155269 - protein, 9 aa, Homo Sapiens
RALYDFDPE

SEQ ID NO: 1155270 - protein, 9 aa, Homo Sapiens
GQTPVYVSY

SEQ ID NO: 1155271 - protein, 9 aa, Homo Sapiens
ACQEHIEAV

SEQ ID NO: 1155272 - protein, 9 aa, Homo Sapiens
MHRRHTVNE

SEQ ID NO: 1155273 - protein, 9 aa, Homo Sapiens
DAGCVLEGI

SEQ ID NO: 1155274 - protein, 9 aa, Homo Sapiens
IPGTTQTLG

SEQ ID NO: 1155275 - protein, 9 aa, Homo Sapiens
ACPALCPDG

SEQ ID NO: 1155276 - protein, 9 aa, Homo Sapiens
QVEDAGCVL

SEQ ID NO: 1155277 - protein, 9 aa, Homo Sapiens
VQHFGDIVP

SEQ ID NO: 1155278 - protein, 9 aa, Homo Sapiens
LPLPGLTPE

SEQ ID NO: 1155279 - protein, 9 aa, Homo Sapiens
HDTTLRCTT

SEQ ID NO: 1155280 - protein, 9 aa, Homo Sapiens
LPHKRKLEA

SEQ ID NO: 1155281 - protein, 9 aa, Homo Sapiens
NEHHKNPYP

SEQ ID NO: 1155282 - protein, 9 aa, Homo Sapiens
ASSIPPTRL

SEQ ID NO: 1155283 - protein, 9 aa, Homo Sapiens
ATTQTTALS

SEQ ID NO: 1155284 - protein, 9 aa, Homo Sapiens
RGRAPRGQG

SEQ ID NO: 1155285 - protein, 9 aa, Homo Sapiens
EIKDSLWKV

SEQ ID NO: 1155286 - protein, 9 aa, Homo Sapiens
TQTTALSAS

SEQ ID NO: 1155287 - protein, 9 aa, Homo Sapiens
DFDPENEGE

SEQ ID NO: 1155288 - protein, 9 aa, Homo Sapiens
GSLVPRLAG

SEQ ID NO: 1155289 - protein, 9 aa, Homo Sapiens
ENEYQASSI

SEQ ID NO: 1155290 - protein, 9 aa, Homo Sapiens
ALMLRDTPT

SEQ ID NO: 1155291 - protein, 9 aa, Homo Sapiens
PYTSRKSRQ

SEQ ID NO: 1155292 - protein, 9 aa, Homo Sapiens
HVLIEIGYG

SEQ ID NO: 1155293 - protein, 9 aa, Homo Sapiens
NHCCAFANW

SEQ ID NO: 1155294 - protein, 9 aa, Homo Sapiens
GLDYVSHKD

SEQ ID NO: 1155295 - protein, 9 aa, Homo Sapiens
NIYVNSIGP

SEQ ID NO: 1155296 - protein, 9 aa, Homo Sapiens
ALYDFDPEN

SEQ ID NO: 1155297 - protein, 9 aa, Homo Sapiens
DDEQQNLVA

SEQ ID NO: 1155298 - protein, 9 aa, Homo Sapiens
AKHKAKCNI

SEQ ID NO: 1155299 - protein, 9 aa, Homo Sapiens
DLPHKRKLE

SEQ ID NO: 1155300 - protein, 9 aa, Homo Sapiens
VTTLSDLQT

SEQ ID NO: 1155301 - protein, 9 aa, Homo Sapiens
PKCRNITKE

SEQ ID NO: 1155302 - protein, 9 aa, Homo Sapiens
DSLHPKCRN

SEQ ID NO: 1155303 - protein, 9 aa, Homo Sapiens
VTTRDWTRA

SEQ ID NO: 1155304 - protein, 9 aa, Homo Sapiens
WALMLRDTP

SEQ ID NO: 1155305 - protein, 9 aa, Homo Sapiens
KETSNGRLP

SEQ ID NO: 1155306 - protein, 9 aa, Homo Sapiens
LSSGATVGS

SEQ ID NO: 1155307 - protein, 9 aa, Homo Sapiens
LRNRDMKVA

SEQ ID NO: 1155308 - protein, 9 aa, Homo Sapiens
RDLELVIGG

SEQ ID NO: 1155309 - protein, 9 aa, Homo Sapiens
DVYVNREWV

SEQ ID NO: 1155310 - protein, 9 aa, Homo Sapiens
RCEQQEERR

SEQ ID NO: 1155311 - protein, 9 aa, Homo Sapiens
RCTTNVEEE

SEQ ID NO: 1155312 - protein, 9 aa, Homo Sapiens
ASLTYPNHC

SEQ ID NO: 1155313 - protein, 9 aa, Homo Sapiens
KLLVLQSFI

SEQ ID NO: 1155314 - protein, 9 aa, Homo Sapiens
QHVFTVIRY

SEQ ID NO: 1155315 - protein, 9 aa, Homo Sapiens
CIFLEYASP

SEQ ID NO: 1155316 - protein, 9 aa, Homo Sapiens
SVGAESADT

SEQ ID NO: 1155317 - protein, 9 aa, Homo Sapiens
FAIEEDLPR

SEQ ID NO: 1155318 - protein, 9 aa, Homo Sapiens
MEHSTKGNA

SEQ ID NO: 1155319 - protein, 9 aa, Homo Sapiens
RDPADASDA

SEQ ID NO: 1155320 - protein, 9 aa, Homo Sapiens
VAGNQETAN

SEQ ID NO: 1155321 - protein, 9 aa, Homo Sapiens
GYQQSHLSS

SEQ ID NO: 1155322 - protein, 9 aa, Homo Sapiens
EDGFDLELT

SEQ ID NO: 1155323 - protein, 9 aa, Homo Sapiens
QTTALSASP

SEQ ID NO: 1155324 - protein, 9 aa, Homo Sapiens
RREQQERCE

SEQ ID NO: 1155325 - protein, 9 aa, Homo Sapiens
SFAARIVTT

SEQ ID NO: 1155326 - protein, 9 aa, Homo Sapiens
AAETAKHKA

SEQ ID NO: 1155327 - protein, 9 aa, Homo Sapiens
ADASDAHES

SEQ ID NO: 1155328 - protein, 9 aa, Homo Sapiens
LLDHVLIEI

SEQ ID NO: 1155329 - protein, 9 aa, Homo Sapiens
GATVGSSMY

SEQ ID NO: 1155330 - protein, 9 aa, Homo Sapiens
LRDPADASD

SEQ ID NO: 1155331 - protein, 9 aa, Homo Sapiens
RGAWALMLR

SEQ ID NO: 1155332 - protein, 9 aa, Homo Sapiens
AYQKMALKY

SEQ ID NO: 1155333 - protein, 9 aa, Homo Sapiens
ENFRSTLTS

SEQ ID NO: 1155334 - protein, 9 aa, Homo Sapiens
GNCPTKKCM

SEQ ID NO: 1155335 - protein, 9 aa, Homo Sapiens
FYHHGAGIF

SEQ ID NO: 1155336 - protein, 9 aa, Homo Sapiens
RRKEENSTE

SEQ ID NO: 1155337 - protein, 9 aa, Homo Sapiens
TFLRLGVYA

SEQ ID NO: 1155338 - protein, 9 aa, Homo Sapiens
SLQIHQTIV

SEQ ID NO: 1155339 - protein, 9 aa, Homo Sapiens
SLRTSAKPL

SEQ ID NO: 1155340 - protein, 9 aa, Homo Sapiens
GIPEPYKAD

SEQ ID NO: 1155341 - protein, 9 aa, Homo Sapiens
DGKTKGCIF

SEQ ID NO: 1155342 - protein, 9 aa, Homo Sapiens
PPDKMEVDT

SEQ ID NO: 1155343 - protein, 9 aa, Homo Sapiens
GAGKGRSQK

SEQ ID NO: 1155344 - protein, 9 aa, Homo Sapiens
SHTGERPFM

SEQ ID NO: 1155345 - protein, 9 aa, Homo Sapiens
LMLRDTPTV

SEQ ID NO: 1155346 - protein, 9 aa, Homo Sapiens
PVPSQKRSI

SEQ ID NO: 1155347 - protein, 9 aa, Homo Sapiens
EVDTNGLKM

SEQ ID NO: 1155348 - protein, 9 aa, Homo Sapiens
HRRHTVNEY

SEQ ID NO: 1155349 - protein, 9 aa, Homo Sapiens
VKGGTLKKR

SEQ ID NO: 1155350 - protein, 9 aa, Homo Sapiens
GNQETANNP

SEQ ID NO: 1155351 - protein, 9 aa, Homo Sapiens
SGATVGSSM

SEQ ID NO: 1155352 - protein, 9 aa, Homo Sapiens
QGRKHKTTP

SEQ ID NO: 1155353 - protein, 9 aa, Homo Sapiens
VKTLKYFYH

SEQ ID NO: 1155354 - protein, 9 aa, Homo Sapiens
MPAVLTHSE

SEQ ID NO: 1155355 - protein, 9 aa, Homo Sapiens
GFQALDVPL

SEQ ID NO: 1155356 - protein, 9 aa, Homo Sapiens
DIEVYFMGP

SEQ ID NO: 1155357 - protein, 9 aa, Homo Sapiens
ALSQTGFSY

SEQ ID NO: 1155358 - protein, 9 aa, Homo Sapiens
TPSHFSVAP

SEQ ID NO: 1155359 - protein, 9 aa, Homo Sapiens
PFMCSVCGH

SEQ ID NO: 1155360 - protein, 9 aa, Homo Sapiens
RLLKMKGQA

SEQ ID NO: 1155361 - protein, 9 aa, Homo Sapiens
VNYLTLGAL

SEQ ID NO: 1155362 - protein, 9 aa, Homo Sapiens
TTQTTALSA

SEQ ID NO: 1155363 - protein, 9 aa, Homo Sapiens
RELLEVVGP

SEQ ID NO: 1155364 - protein, 9 aa, Homo Sapiens
YYTLNVLWD

SEQ ID NO: 1155365 - protein, 9 aa, Homo Sapiens
MRLPWKLLV

SEQ ID NO: 1155366 - protein, 9 aa, Homo Sapiens
AAAEAALSQ

SEQ ID NO: 1155367 - protein, 9 aa, Homo Sapiens
KNDNAPVFA

SEQ ID NO: 1155368 - protein, 9 aa, Homo Sapiens
TLRCTTNVE

SEQ ID NO: 1155369 - protein, 9 aa, Homo Sapiens
SKVGLFDAE

SEQ ID NO: 1155370 - protein, 9 aa, Homo Sapiens
SLHPKCRNI

SEQ ID NO: 1155371 - protein, 9 aa, Homo Sapiens
LLEVVGPEV

SEQ ID NO: 1155372 - protein, 9 aa, Homo Sapiens
YSEGVNGSS

SEQ ID NO: 1155373 - protein, 9 aa, Homo Sapiens
EHIEAVLLN

SEQ ID NO: 1155374 - protein, 9 aa, Homo Sapiens
LNRIIEDLP

SEQ ID NO: 1155375 - protein, 9 aa, Homo Sapiens
LTYPNHCCA

SEQ ID NO: 1155376 - protein, 9 aa, Homo Sapiens
AWALMLRDT

SEQ ID NO: 1155377 - protein, 9 aa, Homo Sapiens
PWGTKNYPT

SEQ ID NO: 1155378 - protein, 9 aa, Homo Sapiens
VLRHSPQDF

SEQ ID NO: 1155379 - protein, 9 aa, Homo Sapiens
KVALSRVIH

SEQ ID NO: 1155380 - protein, 9 aa, Homo Sapiens
ETSNGRLPV

SEQ ID NO: 1155381 - protein, 9 aa, Homo Sapiens
ARIVTTLSD

SEQ ID NO: 1155382 - protein, 9 aa, Homo Sapiens
PGSVGAESA

SEQ ID NO: 1155383 - protein, 9 aa, Homo Sapiens
AEGRRKAVA

SEQ ID NO: 1155384 - protein, 9 aa, Homo Sapiens
ARRDLELVI

SEQ ID NO: 1155385 - protein, 9 aa, Homo Sapiens
EFAIEEDLP

SEQ ID NO: 1155386 - protein, 9 aa, Homo Sapiens
LGEAGLLVT

SEQ ID NO: 1155387 - protein, 9 aa, Homo Sapiens
MDPSAMLRP

SEQ ID NO: 1155388 - protein, 9 aa, Homo Sapiens
PRGQGRKHK

SEQ ID NO: 1155389 - protein, 9 aa, Homo Sapiens
KTKGCIFLE

SEQ ID NO: 1155390 - protein, 9 aa, Homo Sapiens
LKAWLNEHH

SEQ ID NO: 1155391 - protein, 9 aa, Homo Sapiens
STSLQIHQT

SEQ ID NO: 1155392 - protein, 9 aa, Homo Sapiens
EGPGPETWL

SEQ ID NO: 1155393 - protein, 9 aa, Homo Sapiens
QVLNITPEQ

SEQ ID NO: 1155394 - protein, 9 aa, Homo Sapiens
PGRTPAPSA

SEQ ID NO: 1155395 - protein, 9 aa, Homo Sapiens
ILLVGLRRS

SEQ ID NO: 1155396 - protein, 9 aa, Homo Sapiens
SSENFRSTL

SEQ ID NO: 1155397 - protein, 9 aa, Homo Sapiens
AARIVTTLS

SEQ ID NO: 1155398 - protein, 9 aa, Homo Sapiens
QKLKRRKEE

SEQ ID NO: 1155399 - protein, 9 aa, Homo Sapiens
LKGKIGYFV

SEQ ID NO: 1155400 - protein, 9 aa, Homo Sapiens
ARDDEQQNL

SEQ ID NO: 1155401 - protein, 9 aa, Homo Sapiens
TGYQQSHLS

SEQ ID NO: 1155402 - protein, 9 aa, Homo Sapiens
ENDITTFLR

SEQ ID NO: 1155403 - protein, 9 aa, Homo Sapiens
MHDTTLRCT

SEQ ID NO: 1155404 - protein, 9 aa, Homo Sapiens
VLIEIGYGL

SEQ ID NO: 1155405 - protein, 9 aa, Homo Sapiens
REWVTNISE

SEQ ID NO: 1155406 - protein, 9 aa, Homo Sapiens
ALTEKYGIP

SEQ ID NO: 1155407 - protein, 9 aa, Homo Sapiens
NCPTKKCMP

SEQ ID NO: 1155408 - protein, 9 aa, Homo Sapiens
TACPALCPD

SEQ ID NO: 1155409 - protein, 9 aa, Homo Sapiens
PVANRWIPG

SEQ ID NO: 1155410 - protein, 9 aa, Homo Sapiens
ANMPAVLTH

SEQ ID NO: 1155411 - protein, 9 aa, Homo Sapiens
TKGCIFLEY

SEQ ID NO: 1155412 - protein, 9 aa, Homo Sapiens
YLTLGALHH

SEQ ID NO: 1155413 - protein, 9 aa, Homo Sapiens
MASFLIALV

SEQ ID NO: 1155414 - protein, 9 aa, Homo Sapiens
VRHASVPTT

SEQ ID NO: 1155415 - protein, 9 aa, Homo Sapiens
VRVTDKNDN

SEQ ID NO: 1155416 - protein, 9 aa, Homo Sapiens
KGGTLKKRL

SEQ ID NO: 1155417 - protein, 9 aa, Homo Sapiens
PNHCCAFAN

SEQ ID NO: 1155418 - protein, 9 aa, Homo Sapiens
NDITTFLRG

SEQ ID NO: 1155419 - protein, 9 aa, Homo Sapiens
YVLRHSPQD

SEQ ID NO: 1155420 - protein, 9 aa, Homo Sapiens
GFDLELTYI

SEQ ID NO: 1155421 - protein, 9 aa, Homo Sapiens
SAKPLPGPP

SEQ ID NO: 1155422 - protein, 9 aa, Homo Sapiens
PYSEGVNGS

SEQ ID NO: 1155423 - protein, 9 aa, Homo Sapiens
SENSTSLQI

SEQ ID NO: 1155424 - protein, 9 aa, Homo Sapiens
TTANEAALF

SEQ ID NO: 1155425 - protein, 9 aa, Homo Sapiens
MLRPTSQDL

SEQ ID NO: 1155426 - protein, 9 aa, Homo Sapiens
PSHFSVAPA

SEQ ID NO: 1155427 - protein, 9 aa, Homo Sapiens
EQQNLVAFQ

SEQ ID NO: 1155428 - protein, 9 aa, Homo Sapiens
DASDAHESS

SEQ ID NO: 1155429 - protein, 9 aa, Homo Sapiens
GKTKGCIFL

SEQ ID NO: 1155430 - protein, 9 aa, Homo Sapiens
KEEEAIALT

SEQ ID NO: 1155431 - protein, 9 aa, Homo Sapiens
QQSHLSSAR

SEQ ID NO: 1155432 - protein, 9 aa, Homo Sapiens
EEAIALTEK

SEQ ID NO: 1155433 - protein, 9 aa, Homo Sapiens
AYYTLNVLW

SEQ ID NO: 1155434 - protein, 9 aa, Homo Sapiens
LIHSVLGEA

SEQ ID NO: 1155435 - protein, 9 aa, Homo Sapiens
VIGGVLRAE

SEQ ID NO: 1155436 - protein, 9 aa, Homo Sapiens
VIDVNIYVN

SEQ ID NO: 1155437 - protein, 9 aa, Homo Sapiens
SGSRTPGCY

SEQ ID NO: 1155438 - protein, 9 aa, Homo Sapiens
GSRTPGCYS

SEQ ID NO: 1155439 - protein, 9 aa, Homo Sapiens
APGEALHSA

SEQ ID NO: 1155440 - protein, 9 aa, Homo Sapiens
LLLTHKDFP

SEQ ID NO: 1155441 - protein, 9 aa, Homo Sapiens
ALRDRPPPC

SEQ ID NO: 1155442 - protein, 9 aa, Homo Sapiens
MAYDQFVAI

SEQ ID NO: 1155443 - protein, 9 aa, Homo Sapiens
GPGPETWLS

SEQ ID NO: 1155444 - protein, 9 aa, Homo Sapiens
PLPAGPFWI

SEQ ID NO: 1155445 - protein, 9 aa, Homo Sapiens
GSTSTAADP

SEQ ID NO: 1155446 - protein, 9 aa, Homo Sapiens
RIDGLVKGG

SEQ ID NO: 1155447 - protein, 9 aa, Homo Sapiens
HHIDYYKET

SEQ ID NO: 1155448 - protein, 9 aa, Homo Sapiens
VYVSYEIRV

SEQ ID NO: 1155449 - protein, 9 aa, Homo Sapiens
HPEFAIEED

SEQ ID NO: 1155450 - protein, 9 aa, Homo Sapiens
SGPGSTSTA

SEQ ID NO: 1155451 - protein, 9 aa, Homo Sapiens
LIEIGYGLK

SEQ ID NO: 1155452 - protein, 9 aa, Homo Sapiens
EVVGPEVLQ

SEQ ID NO: 1155453 - protein, 9 aa, Homo Sapiens
CPALCPDGS

SEQ ID NO: 1155454 - protein, 9 aa, Homo Sapiens
EASLTYPNH

SEQ ID NO: 1155455 - protein, 9 aa, Homo Sapiens
TVGSSMYTA

SEQ ID NO: 1155456 - protein, 9 aa, Homo Sapiens
LLCMAFDRF

SEQ ID NO: 1155457 - protein, 9 aa, Homo Sapiens
RPPPCFEDT

SEQ ID NO: 1155458 - protein, 9 aa, Homo Sapiens
LAPPVTTRD

SEQ ID NO: 1155459 - protein, 9 aa, Homo Sapiens
VEAVLLLMQ

SEQ ID NO: 1155460 - protein, 9 aa, Homo Sapiens
SKQEDKCGM

SEQ ID NO: 1155461 - protein, 9 aa, Homo Sapiens
PGLDYVSHK

SEQ ID NO: 1155462 - protein, 9 aa, Homo Sapiens
SHKDILPYT

SEQ ID NO: 1155463 - protein, 9 aa, Homo Sapiens
RHSPQDFDS

SEQ ID NO: 1155464 - protein, 9 aa, Homo Sapiens
DCEYDMGSV

SEQ ID NO: 1155465 - protein, 9 aa, Homo Sapiens
FDLELTYIY

SEQ ID NO: 1155466 - protein, 9 aa, Homo Sapiens
EDRSGILLD

SEQ ID NO: 1155467 - protein, 9 aa, Homo Sapiens
DEIKKAYQK

SEQ ID NO: 1155468 - protein, 9 aa, Homo Sapiens
VKTEPVDAD

SEQ ID NO: 1155469 - protein, 9 aa, Homo Sapiens
IVFCKIQME

SEQ ID NO: 1155470 - protein, 9 aa, Homo Sapiens
ASPGRTPAP

SEQ ID NO: 1155471 - protein, 9 aa, Homo Sapiens
IVTTLSDLQ

SEQ ID NO: 1155472 - protein, 9 aa, Homo Sapiens
DGFDLELTY

SEQ ID NO: 1155473 - protein, 9 aa, Homo Sapiens
TSTAADPPP

SEQ ID NO: 1155474 - protein, 9 aa, Homo Sapiens
EDTSMLLSK

SEQ ID NO: 1155475 - protein, 9 aa, Homo Sapiens
FSAHFTSGS

SEQ ID NO: 1155476 - protein, 9 aa, Homo Sapiens
LLKMKGQAA

SEQ ID NO: 1155477 - protein, 9 aa, Homo Sapiens
NRDMKVALS

SEQ ID NO: 1155478 - protein, 9 aa, Homo Sapiens
EPYKADHFQ

SEQ ID NO: 1155479 - protein, 9 aa, Homo Sapiens
QNNTFLRLG

SEQ ID NO: 1155480 - protein, 9 aa, Homo Sapiens
DHVLIEIGY

SEQ ID NO: 1155481 - protein, 9 aa, Homo Sapiens
AALFFISVL

SEQ ID NO: 1155482 - protein, 9 aa, Homo Sapiens
LCMNSDKLV

SEQ ID NO: 1155483 - protein, 9 aa, Homo Sapiens
TDSKKEDTS

SEQ ID NO: 1155484 - protein, 9 aa, Homo Sapiens
ETDSKKEDT

SEQ ID NO: 1155485 - protein, 9 aa, Homo Sapiens
FDKALRESW

SEQ ID NO: 1155486 - protein, 9 aa, Homo Sapiens
GCYSTGSQS

SEQ ID NO: 1155487 - protein, 9 aa, Homo Sapiens
GMHRRHTVN

SEQ ID NO: 1155488 - protein, 9 aa, Homo Sapiens
KLSSENFRS

SEQ ID NO: 1155489 - protein, 9 aa, Homo Sapiens
SLWKVLERK

SEQ ID NO: 1155490 - protein, 9 aa, Homo Sapiens
DFPITAMQK

SEQ ID NO: 1155491 - protein, 9 aa, Homo Sapiens
ANRWIPGTT

SEQ ID NO: 1155492 - protein, 9 aa, Homo Sapiens
QASSIPPTR

SEQ ID NO: 1155493 - protein, 9 aa, Homo Sapiens
VERLLKMKG

SEQ ID NO: 1155494 - protein, 9 aa, Homo Sapiens
FKQKFDKAL

SEQ ID NO: 1155495 - protein, 9 aa, Homo Sapiens
SGSLVPRLA

SEQ ID NO: 1155496 - protein, 9 aa, Homo Sapiens
MNYQMASFL

SEQ ID NO: 1155497 - protein, 9 aa, Homo Sapiens
KCMPAVTST

SEQ ID NO: 1155498 - protein, 9 aa, Homo Sapiens
IIEDLPHKR

SEQ ID NO: 1155499 - protein, 9 aa, Homo Sapiens
TTHFHLKGK

SEQ ID NO: 1155500 - protein, 9 aa, Homo Sapiens
ALDVPLPAG

SEQ ID NO: 1155501 - protein, 9 aa, Homo Sapiens
ITMEIVNKV

SEQ ID NO: 1155502 - protein, 9 aa, Homo Sapiens
LGMKMPYIY

SEQ ID NO: 1155503 - protein, 9 aa, Homo Sapiens
DSLWKVLER

SEQ ID NO: 1155504 - protein, 9 aa, Homo Sapiens
KMEVDTNGL

SEQ ID NO: 1155505 - protein, 9 aa, Homo Sapiens
ALSASPVSN

SEQ ID NO: 1155506 - protein, 9 aa, Homo Sapiens
GSYVLRHSP

SEQ ID NO: 1155507 - protein, 9 aa, Homo Sapiens
ADSRQNNTF

SEQ ID NO: 1155508 - protein, 9 aa, Homo Sapiens
TTRDWTRAE

SEQ ID NO: 1155509 - protein, 9 aa, Homo Sapiens
GCIFLEYAS

SEQ ID NO: 1155510 - protein, 9 aa, Homo Sapiens
CMPAVTSTP

SEQ ID NO: 1155511 - protein, 9 aa, Homo Sapiens
FSVAPATLT

SEQ ID NO: 1155512 - protein, 9 aa, Homo Sapiens
HSPQDFDSF

SEQ ID NO: 1155513 - protein, 9 aa, Homo Sapiens
NMDPSAMLR

SEQ ID NO: 1155514 - protein, 9 aa, Homo Sapiens
IKDSLWKVL

SEQ ID NO: 1155515 - protein, 9 aa, Homo Sapiens
LELVIGGVL

SEQ ID NO: 1155516 - protein, 9 aa, Homo Sapiens
FMCSVCGHR

SEQ ID NO: 1155517 - protein, 9 aa, Homo Sapiens
ATGYQQSHL

SEQ ID NO: 1155518 - protein, 9 aa, Homo Sapiens
IIGEDHSHV

SEQ ID NO: 1155519 - protein, 9 aa, Homo Sapiens
SYEIRVQAE

SEQ ID NO: 1155520 - protein, 9 aa, Homo Sapiens
QMPNMEANM

SEQ ID NO: 1155521 - protein, 9 aa, Homo Sapiens
MPNMEANMP

SEQ ID NO: 1155522 - protein, 9 aa, Homo Sapiens
TQHVFTVIR

SEQ ID NO: 1155523 - protein, 9 aa, Homo Sapiens
ARIERITWR

SEQ ID NO: 1155524 - protein, 9 aa, Homo Sapiens
SPVANRWIP

SEQ ID NO: 1155525 - protein, 9 aa, Homo Sapiens
EYQASSIPP

SEQ ID NO: 1155526 - protein, 9 aa, Homo Sapiens
YFYHHGAGI

SEQ ID NO: 1155527 - protein, 9 aa, Homo Sapiens
KEIKDSLWK

SEQ ID NO: 1155528 - protein, 9 aa, Homo Sapiens
RQFQDTGVS

SEQ ID NO: 1155529 - protein, 9 aa, Homo Sapiens
VNCARDDEQ

SEQ ID NO: 1155530 - protein, 9 aa, Homo Sapiens
WKLLVLQSF

SEQ ID NO: 1155531 - protein, 9 aa, Homo Sapiens
EGRRKAVAT

SEQ ID NO: 1155532 - protein, 9 aa, Homo Sapiens
SRQNNTFLR

SEQ ID NO: 1155533 - protein, 9 aa, Homo Sapiens
KQFKQKFDK

SEQ ID NO: 1155534 - protein, 9 aa, Homo Sapiens
RMSEAEGRR

SEQ ID NO: 1155535 - protein, 9 aa, Homo Sapiens
REQWTPSHF

SEQ ID NO: 1155536 - protein, 9 aa, Homo Sapiens
PQGSSLRTS

SEQ ID NO: 1155537 - protein, 9 aa, Homo Sapiens
GSSLRTSAK

SEQ ID NO: 1155538 - protein, 9 aa, Homo Sapiens
VGLRRSGKS

SEQ ID NO: 1155539 - protein, 9 aa, Homo Sapiens
DTGVSRPGL

SEQ ID NO: 1155540 - protein, 9 aa, Homo Sapiens
LGIPEPYKA

SEQ ID NO: 1155541 - protein, 9 aa, Homo Sapiens
GIVFCKIQM

SEQ ID NO: 1155542 - protein, 9 aa, Homo Sapiens
EAEGRRKAV

SEQ ID NO: 1155543 - protein, 9 aa, Homo Sapiens
SLCMNSDKL

SEQ ID NO: 1155544 - protein, 9 aa, Homo Sapiens
KESKVGLFD

SEQ ID NO: 1155545 - protein, 9 aa, Homo Sapiens
QMASFLIAL

SEQ ID NO: 1155546 - protein, 9 aa, Homo Sapiens
PGSTSTAAD

SEQ ID NO: 1155547 - protein, 9 aa, Homo Sapiens
LSSENFRST

SEQ ID NO: 1155548 - protein, 9 aa, Homo Sapiens
MEASLTYPN

SEQ ID NO: 1155549 - protein, 9 aa, Homo Sapiens
GVNGSSSNF

SEQ ID NO: 1155550 - protein, 9 aa, Homo Sapiens
CMNSDKLVL

SEQ ID NO: 1155551 - protein, 9 aa, Homo Sapiens
GKGRSQKST

SEQ ID NO: 1155552 - protein, 9 aa, Homo Sapiens
KMPYIYGPL

SEQ ID NO: 1155553 - protein, 9 aa, Homo Sapiens
PDKMEVDTN

SEQ ID NO: 1155554 - protein, 9 aa, Homo Sapiens
LLTVMAYDQ

SEQ ID NO: 1155555 - protein, 9 aa, Homo Sapiens
QHFGDIVPL

SEQ ID NO: 1155556 - protein, 9 aa, Homo Sapiens
GQGRKHKTT

SEQ ID NO: 1155557 - protein, 9 aa, Homo Sapiens
KGKIGYFVI

SEQ ID NO: 1155558 - protein, 9 aa, Homo Sapiens
IVNKVEAVL

SEQ ID NO: 1155559 - protein, 9 aa, Homo Sapiens
VGPEVLQDS

SEQ ID NO: 1155560 - protein, 9 aa, Homo Sapiens
LVGKLSHGV

SEQ ID NO: 1155561 - protein, 9 aa, Homo Sapiens
PLPGLTPER

SEQ ID NO: 1155562 - protein, 9 aa, Homo Sapiens
EVQHFGDIV

SEQ ID NO: 1155563 - protein, 9 aa, Homo Sapiens
LVKGGTLKK

SEQ ID NO: 1155564 - protein, 9 aa, Homo Sapiens
AVIHEVQHF

SEQ ID NO: 1155565 - protein, 9 aa, Homo Sapiens
FIHSMGKGT

SEQ ID NO: 1155566 - protein, 9 aa, Homo Sapiens
CEQQEERRE

SEQ ID NO: 1155567 - protein, 9 aa, Homo Sapiens
VPTTFMPIV

SEQ ID NO: 1155568 - protein, 9 aa, Homo Sapiens
KIQMEPGDQ

SEQ ID NO: 1155569 - protein, 9 aa, Homo Sapiens
TTFLRGKIQ

SEQ ID NO: 1155570 - protein, 9 aa, Homo Sapiens
SLVPRLAGM

SEQ ID NO: 1155571 - protein, 9 aa, Homo Sapiens
HRDPLPLPG

SEQ ID NO: 1155572 - protein, 9 aa, Homo Sapiens
SRTPGCYST

SEQ ID NO: 1155573 - protein, 9 aa, Homo Sapiens
LPAGPFWIL

SEQ ID NO: 1155574 - protein, 9 aa, Homo Sapiens
KTEPVDADD

SEQ ID NO: 1155575 - protein, 9 aa, Homo Sapiens
SAMLRPTSQ

SEQ ID NO: 1155576 - protein, 9 aa, Homo Sapiens
TEKYGIPYF

SEQ ID NO: 1155577 - protein, 9 aa, Homo Sapiens
DLELVIGGV

SEQ ID NO: 1155578 - protein, 9 aa, Homo Sapiens
SVLGEAGLL

SEQ ID NO: 1155579 - protein, 9 aa, Homo Sapiens
RTPGCYSTG

SEQ ID NO: 1155580 - protein, 9 aa, Homo Sapiens
LRHSPQDFD

SEQ ID NO: 1155581 - protein, 9 aa, Homo Sapiens
SIPPTRLLI

SEQ ID NO: 1155582 - protein, 9 aa, Homo Sapiens
YDFDPENEG

SEQ ID NO: 1155583 - protein, 9 aa, Homo Sapiens
VMAYDQFVA

SEQ ID NO: 1155584 - protein, 9 aa, Homo Sapiens
VSYEIRVQA

SEQ ID NO: 1155585 - protein, 9 aa, Homo Sapiens
PTVIDVNIY

SEQ ID NO: 1155586 - protein, 9 aa, Homo Sapiens
SSGPGSTST

SEQ ID NO: 1155587 - protein, 9 aa, Homo Sapiens
IQMEPGDQG

SEQ ID NO: 1155588 - protein, 9 aa, Homo Sapiens
AIALTEKYG

SEQ ID NO: 1155589 - protein, 9 aa, Homo Sapiens
IHSMGKGTI

SEQ ID NO: 1155590 - protein, 9 aa, Homo Sapiens
DTTANEAAL

SEQ ID NO: 1155591 - protein, 9 aa, Homo Sapiens
NQETANNPS

SEQ ID NO: 1155592 - protein, 9 aa, Homo Sapiens
TYPNHCCAF

SEQ ID NO: 1155593 - protein, 9 aa, Homo Sapiens
YHHGAGIFK

SEQ ID NO: 1155594 - protein, 9 aa, Homo Sapiens
VDTTANEAA

SEQ ID NO: 1155595 - protein, 9 aa, Homo Sapiens
ALIHSVLGE

SEQ ID NO: 1155596 - protein, 9 aa, Homo Sapiens
KPRMNYQMA

SEQ ID NO: 1155597 - protein, 9 aa, Homo Sapiens
GTKNYPTKR

SEQ ID NO: 1155598 - protein, 9 aa, Homo Sapiens
SPGRTPAPS

SEQ ID NO: 1155599 - protein, 9 aa, Homo Sapiens
QEDKCGMCG

SEQ ID NO: 1155600 - protein, 9 aa, Homo Sapiens
CLKACQEHI

SEQ ID NO: 1155601 - protein, 9 aa, Homo Sapiens
GLFDAELLE

SEQ ID NO: 1155602 - protein, 9 aa, Homo Sapiens
PYKADHFQC

SEQ ID NO: 1155603 - protein, 9 aa, Homo Sapiens
TWRFTQLDA

SEQ ID NO: 1155604 - protein, 9 aa, Homo Sapiens
GQAAEPNRG

SEQ ID NO: 1155605 - protein, 9 aa, Homo Sapiens
VPDGSKANH

SEQ ID NO: 1155606 - protein, 9 aa, Homo Sapiens
MRVKTEPVD

SEQ ID NO: 1155607 - protein, 9 aa, Homo Sapiens
RQNNTFLRL

SEQ ID NO: 1155608 - protein, 9 aa, Homo Sapiens
TALSASPVS

SEQ ID NO: 1155609 - protein, 9 aa, Homo Sapiens
LRCTTNVEE

SEQ ID NO: 1155610 - protein, 9 aa, Homo Sapiens
PNMEANMPA

SEQ ID NO: 1155611 - protein, 9 aa, Homo Sapiens
MSEAEGRRK

SEQ ID NO: 1155612 - protein, 9 aa, Homo Sapiens
YYKETSNGR

SEQ ID NO: 1155613 - protein, 9 aa, Homo Sapiens
VNGSSSNFC

SEQ ID NO: 1155614 - protein, 9 aa, Homo Sapiens
SHFSVAPAT

SEQ ID NO: 1155615 - protein, 9 aa, Homo Sapiens
DSKKEDTSM

SEQ ID NO: 1155616 - protein, 9 aa, Homo Sapiens
ETAKHKAKC

SEQ ID NO: 1155617 - protein, 9 aa, Homo Sapiens
RTSAKPLPG

SEQ ID NO: 1155618 - protein, 9 aa, Homo Sapiens
AGCVLEGIS

SEQ ID NO: 1155619 - protein, 9 aa, Homo Sapiens
NCARDDEQQ

SEQ ID NO: 1155620 - protein, 9 aa, Homo Sapiens
VDVYVNREW

SEQ ID NO: 1155621 - protein, 9 aa, Homo Sapiens
VTDKNDNAP

SEQ ID NO: 1155622 - protein, 9 aa, Homo Sapiens
KDFPITAMQ

SEQ ID NO: 1155623 - protein, 9 aa, Homo Sapiens
NENDITTFL

SEQ ID NO: 1155624 - protein, 9 aa, Homo Sapiens
DPLPLPGLT

SEQ ID NO: 1155625 - protein, 9 aa, Homo Sapiens
NEYSPQKKN

SEQ ID NO: 1155626 - protein, 9 aa, Homo Sapiens
VNKVEAVLL

SEQ ID NO: 1155627 - protein, 9 aa, Homo Sapiens
TANEAALFF

SEQ ID NO: 1155628 - protein, 9 aa, Homo Sapiens
QALDVPLPA

SEQ ID NO: 1155629 - protein, 9 aa, Homo Sapiens
VALSRVIHQ

SEQ ID NO: 1155630 - protein, 9 aa, Homo Sapiens
ATVGSSMYT

SEQ ID NO: 1155631 - protein, 9 aa, Homo Sapiens
HVFTVIRYI

SEQ ID NO: 1155632 - protein, 9 aa, Homo Sapiens
AAEAALSQT

SEQ ID NO: 1155633 - protein, 9 aa, Homo Sapiens
SLRNRDMKV

SEQ ID NO: 1155634 - protein, 9 aa, Homo Sapiens
GVSRPGLGQ

SEQ ID NO: 1155635 - protein, 9 aa, Homo Sapiens
VTMEHSTKG

SEQ ID NO: 1155636 - protein, 9 aa, Homo Sapiens
WIPGTTQTL

SEQ ID NO: 1155637 - protein, 9 aa, Homo Sapiens
RPGSYVLRH

SEQ ID NO: 1155638 - protein, 9 aa, Homo Sapiens
RQKLKRRKE

SEQ ID NO: 1155639 - protein, 9 aa, Homo Sapiens
VVGPEVLQD

SEQ ID NO: 1155640 - protein, 9 aa, Homo Sapiens
DGSKANHSS

SEQ ID NO: 1155641 - protein, 9 aa, Homo Sapiens
WGTKNYPTK

SEQ ID NO: 1155642 - protein, 9 aa, Homo Sapiens
NEAALFFIS

SEQ ID NO: 1155643 - protein, 9 aa, Homo Sapiens
FPITAMQKE

SEQ ID NO: 1155644 - protein, 9 aa, Homo Sapiens
PTKKCMPAV

SEQ ID NO: 1155645 - protein, 9 aa, Homo Sapiens
IDYYKETSN

SEQ ID NO: 1155646 - protein, 9 aa, Homo Sapiens
GHPPGSVGA

SEQ ID NO: 1155647 - protein, 9 aa, Homo Sapiens
EAALSQTGF

SEQ ID NO: 1155648 - protein, 9 aa, Homo Sapiens
LVPDGSKAN

SEQ ID NO: 1155649 - protein, 9 aa, Homo Sapiens
VPSQKRSIV

SEQ ID NO: 1155650 - protein, 9 aa, Homo Sapiens
NITKEEISK

SEQ ID NO: 1155651 - protein, 9 aa, Homo Sapiens
NATTQTTAL

SEQ ID NO: 1155652 - protein, 9 aa, Homo Sapiens
RMNYQMASF

SEQ ID NO: 1155653 - protein, 9 aa, Homo Sapiens
MGPGWEARG

SEQ ID NO: 1155654 - protein, 9 aa, Homo Sapiens
IDVNIYVNS

SEQ ID NO: 1155655 - protein, 9 aa, Homo Sapiens
GERPFMCSV

SEQ ID NO: 1155656 - protein, 9 aa, Homo Sapiens
FLRLGVYAA

SEQ ID NO: 1155657 - protein, 9 aa, Homo Sapiens
ILLDKDYNN

SEQ ID NO: 1155658 - protein, 9 aa, Homo Sapiens
GILLDKDYN

SEQ ID NO: 1155659 - protein, 9 aa, Homo Sapiens
KQKFDKALR

SEQ ID NO: 1155660 - protein, 9 aa, Homo Sapiens
SVQNLVGKL

SEQ ID NO: 1155661 - protein, 9 aa, Homo Sapiens
RGIVFCKIQ

SEQ ID NO: 1155662 - protein, 9 aa, Homo Sapiens
HLGIPEPYK

SEQ ID NO: 1155663 - protein, 9 aa, Homo Sapiens
KGCIFLEYA

SEQ ID NO: 1155664 - protein, 9 aa, Homo Sapiens
DRPPPCFED

SEQ ID NO: 1155665 - protein, 9 aa, Homo Sapiens
PYIYGPLGF

SEQ ID NO: 1155666 - protein, 9 aa, Homo Sapiens
LEVVGPEVL

SEQ ID NO: 1155667 - protein, 9 aa, Homo Sapiens
QKMALKYHP

SEQ ID NO: 1155668 - protein, 9 aa, Homo Sapiens
KAYQKMALK

SEQ ID NO: 1155669 - protein, 9 aa, Homo Sapiens
DPSAMLRPT

SEQ ID NO: 1155670 - protein, 9 aa, Homo Sapiens
EDHSHVADF

SEQ ID NO: 1155671 - protein, 9 aa, Homo Sapiens
YQEDGFDLE

SEQ ID NO: 1155672 - protein, 9 aa, Homo Sapiens
HSHVADFKA

SEQ ID NO: 1155673 - protein, 9 aa, Homo Sapiens
SSIPPTRLL

SEQ ID NO: 1155674 - protein, 9 aa, Homo Sapiens
EVKPRILLV

SEQ ID NO: 1155675 - protein, 9 aa, Homo Sapiens
EGVNGSSSN

SEQ ID NO: 1155676 - protein, 9 aa, Homo Sapiens
LWDDIDNPD

SEQ ID NO: 1155677 - protein, 9 aa, Homo Sapiens
QQERCEQQE

SEQ ID NO: 1155678 - protein, 9 aa, Homo Sapiens
LFRGAWALM

SEQ ID NO: 1155679 - protein, 9 aa, Homo Sapiens
CHRDPLPLP

SEQ ID NO: 1155680 - protein, 9 aa, Homo Sapiens
ERPFMCSVC

SEQ ID NO: 1155681 - protein, 9 aa, Homo Sapiens
EDKCGMCGG

SEQ ID NO: 1155682 - protein, 9 aa, Homo Sapiens
VGSSMYTAT

SEQ ID NO: 1155683 - protein, 9 aa, Homo Sapiens
RDDEQQNLV

SEQ ID NO: 1155684 - protein, 9 aa, Homo Sapiens
AALSQTGFS

SEQ ID NO: 1155685 - protein, 9 aa, Homo Sapiens
TPVYVSYEI

SEQ ID NO: 1155686 - protein, 9 aa, Homo Sapiens
LLTHKDFPI

SEQ ID NO: 1155687 - protein, 9 aa, Homo Sapiens
RSQKSTAGS

SEQ ID NO: 1155688 - protein, 9 aa, Homo Sapiens
EDLPHKRKL

SEQ ID NO: 1155689 - protein, 9 aa, Homo Sapiens
VSHKDILPY

SEQ ID NO: 1155690 - protein, 9 aa, Homo Sapiens
SKKEDTSML

SEQ ID NO: 1155691 - protein, 9 aa, Homo Sapiens
EHHKNPYPT

SEQ ID NO: 1155692 - protein, 9 aa, Homo Sapiens
ESNRKSLCM

SEQ ID NO: 1155693 - protein, 9 aa, Homo Sapiens
DAHESSSRG

SEQ ID NO: 1155694 - protein, 9 aa, Homo Sapiens
PALCPDGSL

SEQ ID NO: 1155695 - protein, 9 aa, Homo Sapiens
PPGHPPGSV

SEQ ID NO: 1155696 - protein, 9 aa, Homo Sapiens
SQKSTAGSA

SEQ ID NO: 1155697 - protein, 9 aa, Homo Sapiens
LTVMAYDQF

SEQ ID NO: 1155698 - protein, 9 aa, Homo Sapiens
RHTVNEYSP

SEQ ID NO: 1155699 - protein, 9 aa, Homo Sapiens
EVYFMGPGW

SEQ ID NO: 1155700 - protein, 9 aa, Homo Sapiens
PDGSKANHS

SEQ ID NO: 1155701 - protein, 9 aa, Homo Sapiens
HKDILPYTS

SEQ ID NO: 1155702 - protein, 9 aa, Homo Sapiens
PGSYVLRHS

SEQ ID NO: 1155703 - protein, 9 aa, Homo Sapiens
MKMPYIYGP

SEQ ID NO: 1155704 - protein, 9 aa, Homo Sapiens
SEAEGRRKA

SEQ ID NO: 1155705 - protein, 9 aa, Homo Sapiens
DKMEVDTNG

SEQ ID NO: 1155706 - protein, 9 aa, Homo Sapiens
RNKEIKDSL

SEQ ID NO: 1155707 - protein, 9 aa, Homo Sapiens
ENSTSLQIH

SEQ ID NO: 1155708 - protein, 9 aa, Homo Sapiens
HFTSGSLVP

SEQ ID NO: 1155709 - protein, 9 aa, Homo Sapiens
RVTDKNDNA

SEQ ID NO: 1155710 - protein, 9 aa, Homo Sapiens
IPEPYKADH

SEQ ID NO: 1155711 - protein, 9 aa, Homo Sapiens
SHVADFKAF

SEQ ID NO: 1155712 - protein, 9 aa, Homo Sapiens
EAIALTEKY

SEQ ID NO: 1155713 - protein, 9 aa, Homo Sapiens
LALIHSVLG

SEQ ID NO: 1155714 - protein, 9 aa, Homo Sapiens
RVKTEPVDA

SEQ ID NO: 1155715 - protein, 9 aa, Homo Sapiens
QTPVYVSYE

SEQ ID NO: 1155716 - protein, 9 aa, Homo Sapiens
SVRVTDKND

SEQ ID NO: 1155717 - protein, 9 aa, Homo Sapiens
GTLVPDGSK

SEQ ID NO: 1155718 - protein, 9 aa, Homo Sapiens
HLKGKIGYF

SEQ ID NO: 1155719 - protein, 9 aa, Homo Sapiens
KCTILPYTS

SEQ ID NO: 1155720 - protein, 9 aa, Homo Sapiens
KGQAAEPNR

SEQ ID NO: 1155721 - protein, 9 aa, Homo Sapiens
QFKQKFDKA

SEQ ID NO: 1155722 - protein, 9 aa, Homo Sapiens
HPKCRNITK

SEQ ID NO: 1155723 - protein, 9 aa, Homo Sapiens
QWTPSHFSV

SEQ ID NO: 1155724 - protein, 9 aa, Homo Sapiens
TPGCYSTGS

SEQ ID NO: 1155725 - protein, 9 aa, Homo Sapiens
DYVSHKDIL

SEQ ID NO: 1155726 - protein, 9 aa, Homo Sapiens
MEVDTNGLK

SEQ ID NO: 1155727 - protein, 9 aa, Homo Sapiens
SLTYPNHCC

SEQ ID NO: 1155728 - protein, 9 aa, Homo Sapiens
STAADPPPE

SEQ ID NO: 1155729 - protein, 9 aa, Homo Sapiens
KGAGKGRSQ

SEQ ID NO: 1155730 - protein, 9 aa, Homo Sapiens
QSHLSSART

SEQ ID NO: 1155731 - protein, 9 aa, Homo Sapiens
RNITKEEIS

SEQ ID NO: 1155732 - protein, 9 aa, Homo Sapiens
WLNEHHKNP

SEQ ID NO: 1155733 - protein, 9 aa, Homo Sapiens
VSVRVTDKN

SEQ ID NO: 1155734 - protein, 9 aa, Homo Sapiens
FHLKGKIGY

SEQ ID NO: 1155735 - protein, 9 aa, Homo Sapiens
EIKKAYQKM

SEQ ID NO: 1155736 - protein, 9 aa, Homo Sapiens
DARRDLELV

SEQ ID NO: 1155737 - protein, 9 aa, Homo Sapiens
MCGGDNSHC

SEQ ID NO: 1155738 - protein, 9 aa, Homo Sapiens
RRDLELVIG

SEQ ID NO: 1155739 - protein, 9 aa, Homo Sapiens
AWLNEHHKN

SEQ ID NO: 1155740 - protein, 9 aa, Homo Sapiens
DKCGMCGGD

SEQ ID NO: 1155741 - protein, 9 aa, Homo Sapiens
LCPDGSLPG

SEQ ID NO: 1155742 - protein, 9 aa, Homo Sapiens
ESKVGLFDA

SEQ ID NO: 1155743 - protein, 9 aa, Homo Sapiens
VVVTMEHST

SEQ ID NO: 1155744 - protein, 9 aa, Homo Sapiens
CFEDTGGPT

SEQ ID NO: 1155745 - protein, 9 aa, Homo Sapiens
ERCEQQEER

SEQ ID NO: 1155746 - protein, 9 aa, Homo Sapiens
IKKAYQKMA

SEQ ID NO: 1155747 - protein, 9 aa, Homo Sapiens
VGQTPVYVS

SEQ ID NO: 1155748 - protein, 9 aa, Homo Sapiens
CRALYDFDP

SEQ ID NO: 1155749 - protein, 9 aa, Homo Sapiens
DRSGILLDK

SEQ ID NO: 1155750 - protein, 9 aa, Homo Sapiens
LHPKCRNIT

SEQ ID NO: 1155751 - protein, 9 aa, Homo Sapiens
FTSGSLVPR

SEQ ID NO: 1155752 - protein, 9 aa, Homo Sapiens
PEGPYSEGV

SEQ ID NO: 1155753 - protein, 9 aa, Homo Sapiens
SSLRTSAKP

SEQ ID NO: 1155754 - protein, 9 aa, Homo Sapiens
EHSTKGNAH

SEQ ID NO: 1155755 - protein, 9 aa, Homo Sapiens
GSVGAESAD

SEQ ID NO: 1155756 - protein, 9 aa, Homo Sapiens
VPLPAGPFW

SEQ ID NO: 1155757 - protein, 9 aa, Homo Sapiens
VEDRSGILL

SEQ ID NO: 1155758 - protein, 9 aa, Homo Sapiens
STLTSLALL

SEQ ID NO: 1155759 - protein, 9 aa, Homo Sapiens
GRRKAVATC

SEQ ID NO: 1155760 - protein, 9 aa, Homo Sapiens
CPDGSLPGF

SEQ ID NO: 1155761 - protein, 9 aa, Homo Sapiens
PVTTRDWTR

SEQ ID NO: 1155762 - protein, 9 aa, Homo Sapiens
MEANMPAVL

SEQ ID NO: 1155763 - protein, 9 aa, Homo Sapiens
GMKMPYIYG

SEQ ID NO: 1155764 - protein, 9 aa, Homo Sapiens
IKPTVIDVN

SEQ ID NO: 1155765 - protein, 9 aa, Homo Sapiens
LPYTSRKSR

SEQ ID NO: 1155766 - protein, 9 aa, Homo Sapiens
KDSLWKVLE

SEQ ID NO: 1155767 - protein, 9 aa, Homo Sapiens
ALCPDGSLP

SEQ ID NO: 1155768 - protein, 9 aa, Homo Sapiens
RTSPVPSQK

SEQ ID NO: 1155769 - protein, 9 aa, Homo Sapiens
DITTFLRGK

SEQ ID NO: 1155770 - protein, 9 aa, Homo Sapiens
AGKGRSQKS

SEQ ID NO: 1155771 - protein, 9 aa, Homo Sapiens
WSASPGRTP

SEQ ID NO: 1155772 - protein, 9 aa, Homo Sapiens
TSPVPSQKR

SEQ ID NO: 1155773 - protein, 9 aa, Homo Sapiens
KALRESWTT

SEQ ID NO: 1155774 - protein, 9 aa, Homo Sapiens
KDILPYTST

SEQ ID NO: 1155775 - protein, 9 aa, Homo Sapiens
GRSQKSTAG

SEQ ID NO: 1155776 - protein, 9 aa, Homo Sapiens
KQEDKCGMC

SEQ ID NO: 1155777 - protein, 9 aa, Homo Sapiens
RIERITWRF

SEQ ID NO: 1155778 - protein, 9 aa, Homo Sapiens
TMEIVNKVE

SEQ ID NO: 1155779 - protein, 9 aa, Homo Sapiens
CPTKKCMPA

SEQ ID NO: 1155780 - protein, 9 aa, Homo Sapiens
IPPTRLLIK

SEQ ID NO: 1155781 - protein, 9 aa, Homo Sapiens
GPETWLSTS

SEQ ID NO: 1155782 - protein, 9 aa, Homo Sapiens
VDTNGLKMC

SEQ ID NO: 1155783 - protein, 9 aa, Homo Sapiens
RDPLPLPGL

SEQ ID NO: 1155784 - protein, 9 aa, Homo Sapiens
IKTQHVFTV

SEQ ID NO: 1155785 - protein, 9 aa, Homo Sapiens
KFDKALRES

SEQ ID NO: 1155786 - protein, 9 aa, Homo Sapiens
QKSTAGSAA

SEQ ID NO: 1155787 - protein, 9 aa, Homo Sapiens
LDVPLPAGP

SEQ ID NO: 1155788 - protein, 9 aa, Homo Sapiens
VIIGEDHSH

SEQ ID NO: 1155789 - protein, 9 aa, Homo Sapiens
LHSAPKAAS

SEQ ID NO: 1155790 - protein, 9 aa, Homo Sapiens
RNRDMKVAL

SEQ ID NO: 1155791 - protein, 9 aa, Homo Sapiens
GSKANHSSH

SEQ ID NO: 1155792 - protein, 9 aa, Homo Sapiens
GMCGGDNSH

SEQ ID NO: 1155793 - protein, 9 aa, Homo Sapiens
SSLSSGATV

SEQ ID NO: 1155794 - protein, 9 aa, Homo Sapiens
KLKRRKEEN

SEQ ID NO: 1155795 - protein, 9 aa, Homo Sapiens
LPGLTPERL

SEQ ID NO: 1155796 - protein, 9 aa, Homo Sapiens
QIHQTIVVQ

SEQ ID NO: 1155797 - protein, 9 aa, Homo Sapiens
AIEEDLPRT

SEQ ID NO: 1155798 - protein, 9 aa, Homo Sapiens
THKDFPITA

SEQ ID NO: 1155799 - protein, 9 aa, Homo Sapiens
QMEPGDQGL

SEQ ID NO: 1155800 - protein, 9 aa, Homo Sapiens
TSGSRTPGC

SEQ ID NO: 1155801 - protein, 9 aa, Homo Sapiens
LLVGLRRSG

SEQ ID NO: 1155802 - protein, 9 aa, Homo Sapiens
DLESPETPG

SEQ ID NO: 1155803 - protein, 9 aa, Homo Sapiens
TRDWTRAEK

SEQ ID NO: 1155804 - protein, 9 aa, Homo Sapiens
VWLNVNYLT

SEQ ID NO: 1155805 - protein, 9 aa, Homo Sapiens
PSLDSVDCE

SEQ ID NO: 1155806 - protein, 9 aa, Homo Sapiens
HFGDIVPLG

SEQ ID NO: 1155807 - protein, 9 aa, Homo Sapiens
EDAGCVLEG

SEQ ID NO: 1155808 - protein, 9 aa, Homo Sapiens
SRELLEVVG

SEQ ID NO: 1155809 - protein, 9 aa, Homo Sapiens
SPVPSQKRS

SEQ ID NO: 1155810 - protein, 9 aa, Homo Sapiens
IEVYFMGPG

SEQ ID NO: 1155811 - protein, 9 aa, Homo Sapiens
IALTEKYGI

SEQ ID NO: 1155812 - protein, 9 aa, Homo Sapiens
GEALHSAPK

SEQ ID NO: 1155813 - protein, 9 aa, Homo Sapiens
PWSASPGRT

SEQ ID NO: 1155814 - protein, 9 aa, Homo Sapiens
HIEAVLLNS

SEQ ID NO: 1155815 - protein, 9 aa, Homo Sapiens
NRWIPGTTQ

SEQ ID NO: 1155816 - protein, 9 aa, Homo Sapiens
PGEALHSAP

SEQ ID NO: 1155817 - protein, 9 aa, Homo Sapiens
LNEHHKNPY

SEQ ID NO: 1155818 - protein, 9 aa, Homo Sapiens
TDKNDNAPV

SEQ ID NO: 1155819 - protein, 9 aa, Homo Sapiens
DHSHVADFK

SEQ ID NO: 1155820 - protein, 9 aa, Homo Sapiens
KESNRKSLC

SEQ ID NO: 1155821 - protein, 9 aa, Homo Sapiens
GMRVKTEPV

SEQ ID NO: 1155822 - protein, 9 aa, Homo Sapiens
TLKYFYHHG

SEQ ID NO: 1155823 - protein, 9 aa, Homo Sapiens
FMGPGWEAR

SEQ ID NO: 1155824 - protein, 9 aa, Homo Sapiens
EEDLPRTPL

SEQ ID NO: 1155825 - protein, 9 aa, Homo Sapiens
RQVEDAGCV

SEQ ID NO: 1155826 - protein, 9 aa, Homo Sapiens
DPADASDAH

SEQ ID NO: 1155827 - protein, 9 aa, Homo Sapiens
PRILLVGLR

SEQ ID NO: 1155828 - protein, 9 aa, Homo Sapiens
HFHLKGKIG

SEQ ID NO: 1155829 - protein, 9 aa, Homo Sapiens
YPNHCCAFA

SEQ ID NO: 1155830 - protein, 9 aa, Homo Sapiens
VYFMGPGWE

SEQ ID NO: 1155831 - protein, 9 aa, Homo Sapiens
SEEEEEERV

SEQ ID NO: 1155832 - protein, 9 aa, Homo Sapiens
TMEHSTKGN

SEQ ID NO: 1155833 - protein, 9 aa, Homo Sapiens
LRPTSQDLA

SEQ ID NO: 1155834 - protein, 9 aa, Homo Sapiens
DCLKACQEH

SEQ ID NO: 1155835 - protein, 9 aa, Homo Sapiens
FQDTGVSRP

SEQ ID NO: 1155836 - protein, 9 aa, Homo Sapiens
ELTYIYPNI

SEQ ID NO: 1155837 - protein, 9 aa, Homo Sapiens
PEPYKADHF

SEQ ID NO: 1155838 - protein, 9 aa, Homo Sapiens
TFLRGKIQG

SEQ ID NO: 1155839 - protein, 9 aa, Homo Sapiens
QFQDTGVSR

SEQ ID NO: 1155840 - protein, 9 aa, Homo Sapiens
VEDAGCVLE

SEQ ID NO: 1155841 - protein, 9 aa, Homo Sapiens
RTPAPSALP

SEQ ID NO: 1155842 - protein, 9 aa, Homo Sapiens
EVGHDLESP

SEQ ID NO: 1155843 - protein, 9 aa, Homo Sapiens
VHHIDYYKE

SEQ ID NO: 1155844 - protein, 9 aa, Homo Sapiens
DLPRTPLLD

SEQ ID NO: 1155845 - protein, 9 aa, Homo Sapiens
SSGATVGSS

SEQ ID NO: 1155846 - protein, 9 aa, Homo Sapiens
LDHVLIEIG

SEQ ID NO: 1155847 - protein, 9 aa, Homo Sapiens
MKGQAAEPN

SEQ ID NO: 1155848 - protein, 9 aa, Homo Sapiens
LRTSAKPLP

SEQ ID NO: 1155849 - protein, 9 aa, Homo Sapiens
KVGLFDAEL

SEQ ID NO: 1155850 - protein, 9 aa, Homo Sapiens
EGPYSEGVN

SEQ ID NO: 1155851 - protein, 9 aa, Homo Sapiens
VDADDSNNC

SEQ ID NO: 1155852 - protein, 9 aa, Homo Sapiens
LSHGVRVEN

SEQ ID NO: 1155853 - protein, 9 aa, Homo Sapiens
STSTAADPP

SEQ ID NO: 1155854 - protein, 9 aa, Homo Sapiens
ASPVANRWI

SEQ ID NO: 1155855 - protein, 9 aa, Homo Sapiens
LKMKGQAAE

SEQ ID NO: 1155856 - protein, 9 aa, Homo Sapiens
IHSVLGEAG

SEQ ID NO: 1155857 - protein, 9 aa, Homo Sapiens
TEPVDADDS

SEQ ID NO: 1155858 - protein, 9 aa, Homo Sapiens
APPVTTRDW

SEQ ID NO: 1155859 - protein, 9 aa, Homo Sapiens
FRSTLTSLA

SEQ ID NO: 1155860 - protein, 9 aa, Homo Sapiens
KCRNITKEE

SEQ ID NO: 1155861 - protein, 9 aa, Homo Sapiens
CQEHIEAVL

SEQ ID NO: 1155862 - protein, 9 aa, Homo Sapiens
FDPENEGEL

SEQ ID NO: 1155863 - protein, 9 aa, Homo Sapiens
LKYFYHHGA

SEQ ID NO: 1155864 - protein, 9 aa, Homo Sapiens
ASEVGHDLE

SEQ ID NO: 1155865 - protein, 9 aa, Homo Sapiens
PLPLPGLTP

SEQ ID NO: 1155866 - protein, 9 aa, Homo Sapiens
LDYVSHKDI

SEQ ID NO: 1155867 - protein, 9 aa, Homo Sapiens
TATATGYQQ

SEQ ID NO: 1155868 - protein, 9 aa, Homo Sapiens
ALFFISVLF

SEQ ID NO: 1155869 - protein, 9 aa, Homo Sapiens
TAKHKAKCN

SEQ ID NO: 1155870 - protein, 9 aa, Homo Sapiens
PPPCFEDTG

SEQ ID NO: 1155871 - protein, 9 aa, Homo Sapiens
KLFIHSMGK

SEQ ID NO: 1155872 - protein, 9 aa, Homo Sapiens
IEDLPHKRK

SEQ ID NO: 1155873 - protein, 9 aa, Homo Sapiens
SYPWGTKNY

SEQ ID NO: 1155874 - protein, 9 aa, Homo Sapiens
HPPGSVGAE

SEQ ID NO: 1155875 - protein, 9 aa, Homo Sapiens
SASPGRTPA

SEQ ID NO: 1155876 - protein, 9 aa, Homo Sapiens
RAAAEAALS

SEQ ID NO: 1155877 - protein, 9 aa, Homo Sapiens
RIVTTLSDL

SEQ ID NO: 1155878 - protein, 9 aa, Homo Sapiens
TGERPFMCS

SEQ ID NO: 1155879 - protein, 9 aa, Homo Sapiens
FQALDVPLP

SEQ ID NO: 1155880 - protein, 9 aa, Homo Sapiens
LLDKDYNNI

SEQ ID NO: 1155881 - protein, 9 aa, Homo Sapiens
GEVDVYVNR

SEQ ID NO: 1155882 - protein, 9 aa, Homo Sapiens
HKDFPITAM

SEQ ID NO: 1155883 - protein, 9 aa, Homo Sapiens
HEVQHFGDI

SEQ ID NO: 1155884 - protein, 9 aa, Homo Sapiens
TSLQIHQTI

SEQ ID NO: 1155885 - protein, 9 aa, Homo Sapiens
LSQTGFSYD

SEQ ID NO: 1155886 - protein, 9 aa, Homo Sapiens
ALHSAPKAA

SEQ ID NO: 1155887 - protein, 9 aa, Homo Sapiens
LNVNYLTLG

SEQ ID NO: 1155888 - protein, 9 aa, Homo Sapiens
CVLEGISKS

SEQ ID NO: 1155889 - protein, 9 aa, Homo Sapiens
EDIEVYFMG

SEQ ID NO: 1155890 - protein, 9 aa, Homo Sapiens
RLPWKLLVL

SEQ ID NO: 1155891 - protein, 9 aa, Homo Sapiens
KMKGQAAEP

SEQ ID NO: 1155892 - protein, 9 aa, Homo Sapiens
PETWLSTSL

SEQ ID NO: 1155893 - protein, 9 aa, Homo Sapiens
VGNCPTKKC

SEQ ID NO: 1155894 - protein, 9 aa, Homo Sapiens
NYQMASFLI

SEQ ID NO: 1155895 - protein, 9 aa, Homo Sapiens
TWLSTSLSG

SEQ ID NO: 1155896 - protein, 9 aa, Homo Sapiens
LIKTQHVFT

SEQ ID NO: 1155897 - protein, 9 aa, Homo Sapiens
KKCMPAVTS

SEQ ID NO: 1155898 - protein, 9 aa, Homo Sapiens
NRIIEDLPH

SEQ ID NO: 1155899 - protein, 9 aa, Homo Sapiens
HIDYYKETS

SEQ ID NO: 1155900 - protein, 9 aa, Homo Sapiens
LRNKEIKDS

SEQ ID NO: 1155901 - protein, 9 aa, Homo Sapiens
IDGLVKGGT

SEQ ID NO: 1155902 - protein, 9 aa, Homo Sapiens
SKANHSSHQ

SEQ ID NO: 1155903 - protein, 9 aa, Homo Sapiens
NVNYLTLGA

SEQ ID NO: 1155904 - protein, 9 aa, Homo Sapiens
FLRGKIQGI

SEQ ID NO: 1155905 - protein, 9 aa, Homo Sapiens
VVTMEHSTK

SEQ ID NO: 1155906 - protein, 9 aa, Homo Sapiens
EIGYGLKPS

SEQ ID NO: 1155907 - protein, 9 aa, Homo Sapiens
EQQERCEQQ

SEQ ID NO: 1155908 - protein, 9 aa, Homo Sapiens
EEEAIALTE

SEQ ID NO: 1155909 - protein, 9 aa, Homo Sapiens
PGPETWLST

SEQ ID NO: 1155910 - protein, 9 aa, Homo Sapiens
GKIGYFVIQ

SEQ ID NO: 1155911 - protein, 9 aa, Homo Sapiens
EDRQKLKRR

SEQ ID NO: 1155912 - protein, 9 aa, Homo Sapiens
KKEDTSMLL

SEQ ID NO: 1155913 - protein, 9 aa, Homo Sapiens
PTTFMPIVV

SEQ ID NO: 1155914 - protein, 9 aa, Homo Sapiens
TSAKPLPGP

SEQ ID NO: 1155915 - protein, 9 aa, Homo Sapiens
EIVNKVEAV

SEQ ID NO: 1155916 - protein, 9 aa, Homo Sapiens
RKAVATCSS

SEQ ID NO: 1155917 - protein, 9 aa, Homo Sapiens
LFDAELLEA

SEQ ID NO: 1155918 - protein, 9 aa, Homo Sapiens
RGQGRKHKT

SEQ ID NO: 1155919 - protein, 9 aa, Homo Sapiens
DTNGLKMCE

SEQ ID NO: 1155920 - protein, 9 aa, Homo Sapiens
EALHSAPKA

SEQ ID NO: 1155921 - protein, 9 aa, Homo Sapiens
DTTLRCTTN

SEQ ID NO: 1155922 - protein, 9 aa, Homo Sapiens
GPYSEGVNG

SEQ ID NO: 1155923 - protein, 9 aa, Homo Sapiens
DKNDNAPVF

SEQ ID NO: 1155924 - protein, 9 aa, Homo Sapiens
GKGTINGLL

SEQ ID NO: 1155925 - protein, 9 aa, Homo Sapiens
VGKLSHGVR

SEQ ID NO: 1155926 - protein, 9 aa, Homo Sapiens
KHKAKCNIC

SEQ ID NO: 1155927 - protein, 9 aa, Homo Sapiens
RDRPPPCFE

SEQ ID NO: 1155928 - protein, 9 aa, Homo Sapiens
KGTINGLLD

SEQ ID NO: 1155929 - protein, 9 aa, Homo Sapiens
KAKCNICKE

SEQ ID NO: 1155930 - protein, 9 aa, Homo Sapiens
VYVNREWVT

SEQ ID NO: 1155931 - protein, 9 aa, Homo Sapiens
QKFDKALRE

SEQ ID NO: 1155932 - protein, 9 aa, Homo Sapiens
LKPRMNYQM

SEQ ID NO: 1155933 - protein, 9 aa, Homo Sapiens
LVIGGVLRA

SEQ ID NO: 1155934 - protein, 9 aa, Homo Sapiens
CARDDEQQN

SEQ ID NO: 1155935 - protein, 9 aa, Homo Sapiens
MPYIYGPLG

SEQ ID NO: 1155936 - protein, 9 aa, Homo Sapiens
VNEYSPQKK

SEQ ID NO: 1155937 - protein, 9 aa, Homo Sapiens
EQWTPSHFS

SEQ ID NO: 1155938 - protein, 9 aa, Homo Sapiens
RKEENSTEE

SEQ ID NO: 1155939 - protein, 9 aa, Homo Sapiens
NLVGKLSHG

SEQ ID NO: 1155940 - protein, 9 aa, Homo Sapiens
KVEAVLLLM

SEQ ID NO: 1155941 - protein, 9 aa, Homo Sapiens
SVPTTFMPI

SEQ ID NO: 1155942 - protein, 9 aa, Homo Sapiens
PADASDAHE

SEQ ID NO: 1155943 - protein, 9 aa, Homo Sapiens
LVGLRRSGK

SEQ ID NO: 1155944 - protein, 9 aa, Homo Sapiens
KTLKYFYHH

SEQ ID NO: 1155945 - protein, 9 aa, Homo Sapiens
TKGNAHKIM

SEQ ID NO: 1155946 - protein, 9 aa, Homo Sapiens
QETANNPSS

SEQ ID NO: 1155947 - protein, 9 aa, Homo Sapiens
MGKGTINGL

SEQ ID NO: 1155948 - protein, 9 aa, Homo Sapiens
EPVDADDSN

SEQ ID NO: 1155949 - protein, 9 aa, Homo Sapiens
ERLLKMKGQ

SEQ ID NO: 1155950 - protein, 9 aa, Homo Sapiens
TVMAYDQFV

SEQ ID NO: 1155951 - protein, 9 aa, Homo Sapiens
VKCTILPYT

SEQ ID NO: 1155952 - protein, 9 aa, Homo Sapiens
RITWRFTQL

SEQ ID NO: 1155953 - protein, 9 aa, Homo Sapiens
TLGALHHYG

SEQ ID NO: 1155954 - protein, 9 aa, Homo Sapiens
HKAKCNICK

SEQ ID NO: 1155955 - protein, 9 aa, Homo Sapiens
YQASSIPPT

SEQ ID NO: 1155956 - protein, 9 aa, Homo Sapiens
PPVTTRDWT

SEQ ID NO: 1155957 - protein, 9 aa, Homo Sapiens
TLNVLWDDI

SEQ ID NO: 1155958 - protein, 9 aa, Homo Sapiens
CMAFDRFVA

SEQ ID NO: 1155959 - protein, 9 aa, Homo Sapiens
YPWGTKNYP

SEQ ID NO: 1155960 - protein, 9 aa, Homo Sapiens
QRGRAPRGQ

SEQ ID NO: 1155961 - protein, 9 aa, Homo Sapiens
LRAAAEAAL

SEQ ID NO: 1155962 - protein, 9 aa, Homo Sapiens
EDLPRTPLL

SEQ ID NO: 1155963 - protein, 9 aa, Homo Sapiens
PRQFQDTGV

SEQ ID NO: 1155964 - protein, 9 aa, Homo Sapiens
RDWTRAEKT

SEQ ID NO: 1155965 - protein, 9 aa, Homo Sapiens
QFVAICHPL

SEQ ID NO: 1155966 - protein, 9 aa, Homo Sapiens
HVRHASVPT

SEQ ID NO: 1155967 - protein, 9 aa, Homo Sapiens
DYYKETSNG

SEQ ID NO: 1155968 - protein, 9 aa, Homo Sapiens
NEYQASSIP

SEQ ID NO: 1155969 - protein, 9 aa, Homo Sapiens
TAADPPPED

SEQ ID NO: 1155970 - protein, 9 aa, Homo Sapiens
TTALSASPV

SEQ ID NO: 1155971 - protein, 9 aa, Homo Sapiens
LMHDTTLRC

SEQ ID NO: 1155972 - protein, 9 aa, Homo Sapiens
IYGPLGFFY

SEQ ID NO: 1155973 - protein, 9 aa, Homo Sapiens
QNMDPSAML

SEQ ID NO: 1155974 - protein, 9 aa, Homo Sapiens
ANSFAARIV

SEQ ID NO: 1155975 - protein, 9 aa, Homo Sapiens
FVKCTILPY

SEQ ID NO: 1155976 - protein, 9 aa, Homo Sapiens
KLSHGVRVE

SEQ ID NO: 1155977 - protein, 9 aa, Homo Sapiens
VDCEYDMGS

SEQ ID NO: 1155978 - protein, 9 aa, Homo Sapiens
KEDTSMLLS

SEQ ID NO: 1155979 - protein, 9 aa, Homo Sapiens
THFHLKGKI

SEQ ID NO: 1155980 - protein, 9 aa, Homo Sapiens
PSQKRSIVV

SEQ ID NO: 1155981 - protein, 9 aa, Homo Sapiens
YTSRKSRQK

SEQ ID NO: 1155982 - protein, 9 aa, Homo Sapiens
SLDSVDCEY

SEQ ID NO: 1155983 - protein, 9 aa, Homo Sapiens
CTILPYTSR

SEQ ID NO: 1155984 - protein, 9 aa, Homo Sapiens
DKALRESWT

SEQ ID NO: 1155985 - protein, 9 aa, Homo Sapiens
QGSSLRTSA

SEQ ID NO: 1155986 - protein, 9 aa, Homo Sapiens
FDAELLEAL

SEQ ID NO: 1155987 - protein, 9 aa, Homo Sapiens
SMGKGTING

SEQ ID NO: 1155988 - protein, 9 aa, Homo Sapiens
QLAFAGKKR

SEQ ID NO: 1155989 - protein, 9 aa, Homo Sapiens
SGILLDKDY

SEQ ID NO: 1155990 - protein, 9 aa, Homo Sapiens
ARTSPVPSQ

SEQ ID NO: 1155991 - protein, 9 aa, Homo Sapiens
IGYGLKPSG

SEQ ID NO: 1155992 - protein, 9 aa, Homo Sapiens
HSMGKGTIN

SEQ ID NO: 1155993 - protein, 9 aa, Homo Sapiens
LVSVRVTDK

SEQ ID NO: 1155994 - protein, 9 aa, Homo Sapiens
SDAHESSSR

SEQ ID NO: 1155995 - protein, 9 aa, Homo Sapiens
LCMAFDRFV

SEQ ID NO: 1155996 - protein, 9 aa, Homo Sapiens
YHLGIPEPY

SEQ ID NO: 1155997 - protein, 9 aa, Homo Sapiens
FRGAWALML

SEQ ID NO: 1155998 - protein, 9 aa, Homo Sapiens
PGCYSTGSQ

SEQ ID NO: 1155999 - protein, 9 aa, Homo Sapiens
KRRKEENST

SEQ ID NO: 1156000 - protein, 9 aa, Homo Sapiens
LQIHQTIVV

SEQ ID NO: 1156001 - protein, 9 aa, Homo Sapiens
AHFTSGSLV

SEQ ID NO: 1156002 - protein, 9 aa, Homo Sapiens
KGRSQKSTA

SEQ ID NO: 1156003 - protein, 9 aa, Homo Sapiens
MKVALSRVI

SEQ ID NO: 1156004 - protein, 9 aa, Homo Sapiens
LTEKYGIPY

SEQ ID NO: 1156005 - protein, 9 aa, Homo Sapiens
TVIDVNIYV

SEQ ID NO: 1156006 - protein, 9 aa, Homo Sapiens
GPGSTSTAA

SEQ ID NO: 1156007 - protein, 9 aa, Homo Sapiens
LTLGALHHY

SEQ ID NO: 1156008 - protein, 9 aa, Homo Sapiens
DTSMLLSKE

SEQ ID NO: 1156009 - protein, 9 aa, Homo Sapiens
EAALFFISV

SEQ ID NO: 1156010 - protein, 9 aa, Homo Sapiens
PVYVSYEIR

SEQ ID NO: 1156011 - protein, 9 aa, Homo Sapiens
SVAGNQETA

SEQ ID NO: 1156012 - protein, 9 aa, Homo Sapiens
YQQSHLSSA

SEQ ID NO: 1156013 - protein, 9 aa, Homo Sapiens
DLELTYIYP

SEQ ID NO: 1156014 - protein, 9 aa, Homo Sapiens
HGTLVPDGS

SEQ ID NO: 1156015 - protein, 9 aa, Homo Sapiens
NRKSLCMNS

SEQ ID NO: 1156016 - protein, 9 aa, Homo Sapiens
NTFLRLGVY

SEQ ID NO: 1156017 - protein, 9 aa, Homo Sapiens
EDEIKKAYQ

SEQ ID NO: 1156018 - protein, 9 aa, Homo Sapiens
WLSTSLSGL

SEQ ID NO: 1156019 - protein, 9 aa, Homo Sapiens
RKSLCMNSD

SEQ ID NO: 1156020 - protein, 9 aa, Homo Sapiens
TNGLKMCEP

SEQ ID NO: 1156021 - protein, 9 aa, Homo Sapiens
TILPYTSRK

SEQ ID NO: 1156022 - protein, 9 aa, Homo Sapiens
PPCFEDTGG

SEQ ID NO: 1156023 - protein, 9 aa, Homo Sapiens
WTPSHFSVA

SEQ ID NO: 1156024 - protein, 9 aa, Homo Sapiens
RDMKVALSR

SEQ ID NO: 1156025 - protein, 9 aa, Homo Sapiens
LYDFDPENE

SEQ ID NO: 1156026 - protein, 9 aa, Homo Sapiens
GQTACPALC

SEQ ID NO: 1156027 - protein, 9 aa, Homo Sapiens
EEDGKTKGC

SEQ ID NO: 1156028 - protein, 9 aa, Homo Sapiens
PCFEDTGGP

SEQ ID NO: 1156029 - protein, 9 aa, Homo Sapiens
RRKAVATCS

SEQ ID NO: 1156030 - protein, 9 aa, Homo Sapiens
PRMNYQMAS

SEQ ID NO: 1156031 - protein, 9 aa, Homo Sapiens
YKETSNGRL

SEQ ID NO: 1156032 - protein, 9 aa, Homo Sapiens
HDLESPETP

SEQ ID NO: 1156033 - protein, 9 aa, Homo Sapiens
ANEAALFFI

SEQ ID NO: 1156034 - protein, 9 aa, Homo Sapiens
NREWVTNIS

SEQ ID NO: 1156035 - protein, 9 aa, Homo Sapiens
VGHDLESPE

SEQ ID NO: 1156036 - protein, 9 aa, Homo Sapiens
DEQQNLVAF

SEQ ID NO: 1156037 - protein, 9 aa, Homo Sapiens
KKAYQKMAL

SEQ ID NO: 1156038 - protein, 9 aa, Homo Sapiens
ASVPTTFMP

SEQ ID NO: 1156039 - protein, 9 aa, Homo Sapiens
WDDIDNPDQ

SEQ ID NO: 1156040 - protein, 9 aa, Homo Sapiens
NNTFLRLGV

SEQ ID NO: 1156041 - protein, 9 aa, Homo Sapiens
VLGEAGLLV

SEQ ID NO: 1156042 - protein, 9 aa, Homo Sapiens
RWIPGTTQT

SEQ ID NO: 1156043 - protein, 9 aa, Homo Sapiens
KPTVIDVNI

SEQ ID NO: 1156044 - protein, 9 aa, Homo Sapiens
NSTSLQIHQ

SEQ ID NO: 1156045 - protein, 9 aa, Homo Sapiens
TSGSLVPRL

SEQ ID NO: 1156046 - protein, 9 aa, Homo Sapiens
ELVIGGVLR

SEQ ID NO: 1156047 - protein, 9 aa, Homo Sapiens
TKKCMPAVT

SEQ ID NO: 1156048 - protein, 9 aa, Homo Sapiens
AYDQFVAIC

SEQ ID NO: 1156049 - protein, 9 aa, Homo Sapiens
AVKTLKYFY

SEQ ID NO: 1156050 - protein, 9 aa, Homo Sapiens
FCKIQMEPG

SEQ ID NO: 1156051 - protein, 9 aa, Homo Sapiens
SAPKAASDA

SEQ ID NO: 1156052 - protein, 9 aa, Homo Sapiens
LKRRKEENS

SEQ ID NO: 1156053 - protein, 9 aa, Homo Sapiens
IEIGYGLKP

SEQ ID NO: 1156054 - protein, 9 aa, Homo Sapiens
IGEDHSHVA

SEQ ID NO: 1156055 - protein, 9 aa, Homo Sapiens
DLNRIIEDL

SEQ ID NO: 1156056 - protein, 9 aa, Homo Sapiens
DQFVAICHP

SEQ ID NO: 1156057 - protein, 9 aa, Homo Sapiens
IHQTIVVQL

SEQ ID NO: 1156058 - protein, 9 aa, Homo Sapiens
WLALIHSVL

SEQ ID NO: 1156059 - protein, 9 aa, Homo Sapiens
MEIVNKVEA

SEQ ID NO: 1156060 - protein, 9 aa, Homo Sapiens
HVADFKAFR

SEQ ID NO: 1156061 - protein, 9 aa, Homo Sapiens
HCHRDPLPL

SEQ ID NO: 1156062 - protein, 9 aa, Homo Sapiens
QERCEQQEE

SEQ ID NO: 1156063 - protein, 9 aa, Homo Sapiens
NKEIKDSLW

SEQ ID NO: 1156064 - protein, 9 aa, Homo Sapiens
ASDAHESSS

SEQ ID NO: 1156065 - protein, 9 aa, Homo Sapiens
KYFYHHGAG

SEQ ID NO: 1156066 - protein, 9 aa, Homo Sapiens
GRQVEDAGC

SEQ ID NO: 1156067 - protein, 9 aa, Homo Sapiens
SPSLDSVDC

SEQ ID NO: 1156068 - protein, 9 aa, Homo Sapiens
GCVLEGISK

SEQ ID NO: 1156069 - protein, 9 aa, Homo Sapiens
DMKVALSRV

SEQ ID NO: 1156070 - protein, 9 aa, Homo Sapiens
GGTLKKRLD

SEQ ID NO: 1156071 - protein, 9 aa, Homo Sapiens
KTQHVFTVI

SEQ ID NO: 1156072 - protein, 9 aa, Homo Sapiens
SEVGHDLES

SEQ ID NO: 1156073 - protein, 9 aa, Homo Sapiens
YVSHKDILP

SEQ ID NO: 1156074 - protein, 9 aa, Homo Sapiens
SENFRSTLT

SEQ ID NO: 1156075 - protein, 9 aa, Homo Sapiens
DSRQNNTFL

SEQ ID NO: 1156076 - protein, 9 aa, Homo Sapiens
FLAPPVTTR

SEQ ID NO: 1156077 - protein, 9 aa, Homo Sapiens
PVDADDSNN

SEQ ID NO: 1156078 - protein, 9 aa, Homo Sapiens
YVNREWVTN

SEQ ID NO: 1156079 - protein, 9 aa, Homo Sapiens
NFRSTLTSL

SEQ ID NO: 1156080 - protein, 9 aa, Homo Sapiens
FARTSPVPS

SEQ ID NO: 1156081 - protein, 9 aa, Homo Sapiens
YTLNVLWDD

SEQ ID NO: 1156082 - protein, 9 aa, Homo Sapiens
RPFMCSVCG

SEQ ID NO: 1156083 - protein, 9 aa, Homo Sapiens
TGVSRPGLG

SEQ ID NO: 1156084 - protein, 9 aa, Homo Sapiens
QLLLTHKDF

SEQ ID NO: 1156085 - protein, 9 aa, Homo Sapiens
MLRDTPTVG

SEQ ID NO: 1156086 - protein, 9 aa, Homo Sapiens
CTTNVEEEF

SEQ ID NO: 1156087 - protein, 9 aa, Homo Sapiens
VSRPGLGQP

SEQ ID NO: 1156088 - protein, 9 aa, Homo Sapiens
GLVKGGTLK

SEQ ID NO: 1156089 - protein, 9 aa, Homo Sapiens
DRQKLKRRK

SEQ ID NO: 1156090 - protein, 9 aa, Homo Sapiens
RRHTVNEYS

SEQ ID NO: 1156091 - protein, 9 aa, Homo Sapiens
YKADHFQCK

SEQ ID NO: 1156092 - protein, 9 aa, Homo Sapiens
WLNVNYLTL

SEQ ID NO: 1156093 - protein, 9 aa, Homo Sapiens
ITTFLRGKI

SEQ ID NO: 1156094 - protein, 9 aa, Homo Sapiens
NSFAARIVT

SEQ ID NO: 1156095 - protein, 9 aa, Homo Sapiens
ETWLSTSLS

SEQ ID NO: 1156096 - protein, 9 aa, Homo Sapiens
HKNPYPTKG

SEQ ID NO: 1156097 - protein, 9 aa, Homo Sapiens
LRGKIQGII

SEQ ID NO: 1156098 - protein, 9 aa, Homo Sapiens
DVNIYVNSI

SEQ ID NO: 1156099 - protein, 9 aa, Homo Sapiens
YGPLGFFYI

SEQ ID NO: 1156100 - protein, 9 aa, Homo Sapiens
SNRKSLCMN

SEQ ID NO: 1156101 - protein, 9 aa, Homo Sapiens
QDTGVSRPG

SEQ ID NO: 1156102 - protein, 9 aa, Homo Sapiens
DTNLIKTQH

SEQ ID NO: 1156103 - protein, 9 aa, Homo Sapiens
LRDRPPPCF

SEQ ID NO: 1156104 - protein, 9 aa, Homo Sapiens
IHEVQHFGD

SEQ ID NO: 1156105 - protein, 9 aa, Homo Sapiens
RAPRGQGRK

SEQ ID NO: 1156106 - protein, 9 aa, Homo Sapiens
GRAPRGQGR

SEQ ID NO: 1156107 - protein, 9 aa, Homo Sapiens
TTLRCTTNV

SEQ ID NO: 1156108 - protein, 9 aa, Homo Sapiens
CGMCGGDNS

SEQ ID NO: 1156109 - protein, 9 aa, Homo Sapiens
NLIKTQHVF

SEQ ID NO: 1156110 - protein, 9 aa, Homo Sapiens
GRTPAPSAL

SEQ ID NO: 1156111 - protein, 9 aa, Homo Sapiens
ITWRFTQLD

SEQ ID NO: 1156112 - protein, 9 aa, Homo Sapiens
LDSVDCEYD

SEQ ID NO: 1156113 - protein, 9 aa, Homo Sapiens
IEEDLPRTP

SEQ ID NO: 1156114 - protein, 9 aa, Homo Sapiens
CCRALYDFD

SEQ ID NO: 1156115 - protein, 9 aa, Homo Sapiens
PEFAIEEDL

SEQ ID NO: 1156116 - protein, 9 aa, Homo Sapiens
VNREWVTNI

SEQ ID NO: 1156117 - protein, 9 aa, Homo Sapiens
AMLRPTSQD

SEQ ID NO: 1156118 - protein, 9 aa, Homo Sapiens
EANMPAVLT

SEQ ID NO: 1156119 - protein, 9 aa, Homo Sapiens
YQMASFLIA

SEQ ID NO: 1156120 - protein, 9 aa, Homo Sapiens
VIHEVQHFG

SEQ ID NO: 1156121 - protein, 9 aa, Homo Sapiens
TNLIKTQHV

SEQ ID NO: 1156122 - protein, 9 aa, Homo Sapiens
QEDGFDLEL

SEQ ID NO: 1156123 - protein, 9 aa, Homo Sapiens
EVDVYVNRE

SEQ ID NO: 1156124 - protein, 9 aa, Homo Sapiens
PRIDGLVKG

SEQ ID NO: 1156125 - protein, 9 aa, Homo Sapiens
AAAETAKHK

SEQ ID NO: 1156126 - protein, 9 aa, Homo Sapiens
ERREQQERC

SEQ ID NO: 1156127 - protein, 9 aa, Homo Sapiens
YFMGPGWEA

SEQ ID NO: 1156128 - protein, 9 aa, Homo Sapiens
RSGILLDKD

SEQ ID NO: 1156129 - protein, 9 aa, Homo Sapiens
CYSTGSQSR

SEQ ID NO: 1156130 - protein, 9 aa, Homo Sapiens
NYLTLGALH

SEQ ID NO: 1156131 - protein, 9 aa, Homo Sapiens
VANRWIPGT

SEQ ID NO: 1156132 - protein, 9 aa, Homo Sapiens
TANNPSSHP

SEQ ID NO: 1156133 - protein, 9 aa, Homo Sapiens
ATATGYQQS

SEQ ID NO: 1156134 - protein, 9 aa, Homo Sapiens
SEGVNGSSS

SEQ ID NO: 1156135 - protein, 9 aa, Homo Sapiens
KAWLNEHHK

SEQ ID NO: 1156136 - protein, 9 aa, Homo Sapiens
AETAKHKAK

SEQ ID NO: 1156137 - protein, 9 aa, Homo Sapiens
ERITWRFTQ

SEQ ID NO: 1156138 - protein, 9 aa, Homo Sapiens
YDQFVAICH

SEQ ID NO: 1156139 - protein, 9 aa, Homo Sapiens
TATGYQQSH

SEQ ID NO: 1156140 - protein, 9 aa, Homo Sapiens
DGLVKGGTL

SEQ ID NO: 1156141 - protein, 9 aa, Homo Sapiens
VQNLVGKLS

SEQ ID NO: 1156142 - protein, 9 aa, Homo Sapiens
STKGNAHKI

SEQ ID NO: 1156143 - protein, 9 aa, Homo Sapiens
PPGSVGAES

SEQ ID NO: 1156144 - protein, 9 aa, Homo Sapiens
CRNITKEEI

SEQ ID NO: 1156145 - protein, 9 aa, Homo Sapiens
VGLFDAELL

SEQ ID NO: 1156146 - protein, 9 aa, Homo Sapiens
ETANNPSSH

SEQ ID NO: 1156147 - protein, 9 aa, Homo Sapiens
KSLCMNSDK

SEQ ID NO: 1156148 - protein, 9 aa, Homo Sapiens
VLNITPEQF

SEQ ID NO: 1156149 - protein, 9 aa, Homo Sapiens
GAWALMLRD

SEQ ID NO: 1156150 - protein, 9 aa, Homo Sapiens
TAVIHEVQH

SEQ ID NO: 1156151 - protein, 9 aa, Homo Sapiens
SVDCEYDMG

SEQ ID NO: 1156152 - protein, 9 aa, Homo Sapiens
FAARIVTTL

SEQ ID NO: 1156153 - protein, 9 aa, Homo Sapiens
LTHKDFPIT

SEQ ID NO: 1156154 - protein, 9 aa, Homo Sapiens
KCGMCGGDN

SEQ ID NO: 1156155 - protein, 9 aa, Homo Sapiens
RIIEDLPHK

SEQ ID NO: 1156156 - protein, 9 aa, Homo Sapiens
GNATTQTTA

SEQ ID NO: 1156157 - protein, 9 aa, Homo Sapiens
NKVEAVLLL

SEQ ID NO: 1156158 - protein, 9 aa, Homo Sapiens
AEAALSQTG

SEQ ID NO: 1156159 - protein, 9 aa, Homo Sapiens
SAHFTSGSL

SEQ ID NO: 1156160 - protein, 9 aa, Homo Sapiens
RHASVPTTF

SEQ ID NO: 1156161 - protein, 9 aa, Homo Sapiens
SQKRSIVVS

SEQ ID NO: 1156162 - protein, 9 aa, Homo Sapiens
PQEWATYMG

SEQ ID NO: 1156163 - protein, 9 aa, Homo Sapiens
FILYIASDE

SEQ ID NO: 1156164 - protein, 9 aa, Homo Sapiens
GSGTKWALI

SEQ ID NO: 1156165 - protein, 9 aa, Homo Sapiens
AYDRYVAIF

SEQ ID NO: 1156166 - protein, 9 aa, Homo Sapiens
QAVPNKSCR

SEQ ID NO: 1156167 - protein, 9 aa, Homo Sapiens
SLNLCEQLD

SEQ ID NO: 1156168 - protein, 9 aa, Homo Sapiens
GPGGWSFSA

SEQ ID NO: 1156169 - protein, 9 aa, Homo Sapiens
GDNADTSQE

SEQ ID NO: 1156170 - protein, 9 aa, Homo Sapiens
ANRHHDCNE

SEQ ID NO: 1156171 - protein, 9 aa, Homo Sapiens
EQYEEEMEA

SEQ ID NO: 1156172 - protein, 9 aa, Homo Sapiens
FTVKIRPGL

SEQ ID NO: 1156173 - protein, 9 aa, Homo Sapiens
TQRRSCDSG

SEQ ID NO: 1156174 - protein, 9 aa, Homo Sapiens
GLDDKLLYI

SEQ ID NO: 1156175 - protein, 9 aa, Homo Sapiens
GLLIAFRAA

SEQ ID NO: 1156176 - protein, 9 aa, Homo Sapiens
VQVTGHRIS

SEQ ID NO: 1156177 - protein, 9 aa, Homo Sapiens
IRPGLLNSK

SEQ ID NO: 1156178 - protein, 9 aa, Homo Sapiens
LSPAVWAKI

SEQ ID NO: 1156179 - protein, 9 aa, Homo Sapiens
TNPDNMFSR

SEQ ID NO: 1156180 - protein, 9 aa, Homo Sapiens
RRRQRLALF

SEQ ID NO: 1156181 - protein, 9 aa, Homo Sapiens
FFGLAPPPD

SEQ ID NO: 1156182 - protein, 9 aa, Homo Sapiens
VTCDEDYQE

SEQ ID NO: 1156183 - protein, 9 aa, Homo Sapiens
KGKLEAEKV

SEQ ID NO: 1156184 - protein, 9 aa, Homo Sapiens
NTIVDFFAV

SEQ ID NO: 1156185 - protein, 9 aa, Homo Sapiens
FTTQRRSCD

SEQ ID NO: 1156186 - protein, 9 aa, Homo Sapiens
KQADGLCRK

SEQ ID NO: 1156187 - protein, 9 aa, Homo Sapiens
LAGLESDRY

SEQ ID NO: 1156188 - protein, 9 aa, Homo Sapiens
LFSHLPLLA

SEQ ID NO: 1156189 - protein, 9 aa, Homo Sapiens
KLVQNIAWQ

SEQ ID NO: 1156190 - protein, 9 aa, Homo Sapiens
GKALVSEGE

SEQ ID NO: 1156191 - protein, 9 aa, Homo Sapiens
DQPLYDCPV

SEQ ID NO: 1156192 - protein, 9 aa, Homo Sapiens
FRKDARDPV

SEQ ID NO: 1156193 - protein, 9 aa, Homo Sapiens
MQEEEKESW

SEQ ID NO: 1156194 - protein, 9 aa, Homo Sapiens
KECYLKIIP

SEQ ID NO: 1156195 - protein, 9 aa, Homo Sapiens
QRFRKDARD

SEQ ID NO: 1156196 - protein, 9 aa, Homo Sapiens
SILQKTKGQ

SEQ ID NO: 1156197 - protein, 9 aa, Homo Sapiens
RRDIDQAKI

SEQ ID NO: 1156198 - protein, 9 aa, Homo Sapiens
PAYQKNATR

SEQ ID NO: 1156199 - protein, 9 aa, Homo Sapiens
KPLRTISLN

SEQ ID NO: 1156200 - protein, 9 aa, Homo Sapiens
KRNIHYTHL

SEQ ID NO: 1156201 - protein, 9 aa, Homo Sapiens
PGGDNADTS

SEQ ID NO: 1156202 - protein, 9 aa, Homo Sapiens
NGTVVFWGL

SEQ ID NO: 1156203 - protein, 9 aa, Homo Sapiens
RIIQHFVPA

SEQ ID NO: 1156204 - protein, 9 aa, Homo Sapiens
ILCGPPPHF

SEQ ID NO: 1156205 - protein, 9 aa, Homo Sapiens
TEEPTNDPD

SEQ ID NO: 1156206 - protein, 9 aa, Homo Sapiens
TITAPSLSG

SEQ ID NO: 1156207 - protein, 9 aa, Homo Sapiens
RGLLPLHPG

SEQ ID NO: 1156208 - protein, 9 aa, Homo Sapiens
VLDKYELLK

SEQ ID NO: 1156209 - protein, 9 aa, Homo Sapiens
QPRPLPTEP

SEQ ID NO: 1156210 - protein, 9 aa, Homo Sapiens
SMILKSNEK

SEQ ID NO: 1156211 - protein, 9 aa, Homo Sapiens
HPKFQKPKH

SEQ ID NO: 1156212 - protein, 9 aa, Homo Sapiens
VVFWGLKSK

SEQ ID NO: 1156213 - protein, 9 aa, Homo Sapiens
EGQGVVILC

SEQ ID NO: 1156214 - protein, 9 aa, Homo Sapiens
FLNDEASGA

SEQ ID NO: 1156215 - protein, 9 aa, Homo Sapiens
TSLPVTNTS

SEQ ID NO: 1156216 - protein, 9 aa, Homo Sapiens
VVATSVGVT

SEQ ID NO: 1156217 - protein, 9 aa, Homo Sapiens
IIQHFVPAS

SEQ ID NO: 1156218 - protein, 9 aa, Homo Sapiens
NVLKEWLAA

SEQ ID NO: 1156219 - protein, 9 aa, Homo Sapiens
LLEMQLEHA

SEQ ID NO: 1156220 - protein, 9 aa, Homo Sapiens
SSEFIKELL

SEQ ID NO: 1156221 - protein, 9 aa, Homo Sapiens
THNKTHTGE

SEQ ID NO: 1156222 - protein, 9 aa, Homo Sapiens
PAALAPFPP

SEQ ID NO: 1156223 - protein, 9 aa, Homo Sapiens
FSQMEELEK

SEQ ID NO: 1156224 - protein, 9 aa, Homo Sapiens
ISESMLERL

SEQ ID NO: 1156225 - protein, 9 aa, Homo Sapiens
KEQRLSHFT

SEQ ID NO: 1156226 - protein, 9 aa, Homo Sapiens
ILGEQTLAV

SEQ ID NO: 1156227 - protein, 9 aa, Homo Sapiens
PDNMFSRTC

SEQ ID NO: 1156228 - protein, 9 aa, Homo Sapiens
ERRRDIDQA

SEQ ID NO: 1156229 - protein, 9 aa, Homo Sapiens
VTQHKFGMD

SEQ ID NO: 1156230 - protein, 9 aa, Homo Sapiens
SCTLHCDCE

SEQ ID NO: 1156231 - protein, 9 aa, Homo Sapiens
TQRVPCSSP

SEQ ID NO: 1156232 - protein, 9 aa, Homo Sapiens
AAAQQQQLY

SEQ ID NO: 1156233 - protein, 9 aa, Homo Sapiens
ANTSIGKET

SEQ ID NO: 1156234 - protein, 9 aa, Homo Sapiens
KTKGQESLL

SEQ ID NO: 1156235 - protein, 9 aa, Homo Sapiens
QGVVILCGP

SEQ ID NO: 1156236 - protein, 9 aa, Homo Sapiens
LAKGERKPS

SEQ ID NO: 1156237 - protein, 9 aa, Homo Sapiens
PEDECANRH

SEQ ID NO: 1156238 - protein, 9 aa, Homo Sapiens
DPTVRGNSI

SEQ ID NO: 1156239 - protein, 9 aa, Homo Sapiens
VLVANLCDD

SEQ ID NO: 1156240 - protein, 9 aa, Homo Sapiens
LKGILKQAP

SEQ ID NO: 1156241 - protein, 9 aa, Homo Sapiens
TAYQQQYEE

SEQ ID NO: 1156242 - protein, 9 aa, Homo Sapiens
GTKVELGPY

SEQ ID NO: 1156243 - protein, 9 aa, Homo Sapiens
HILANTNTD

SEQ ID NO: 1156244 - protein, 9 aa, Homo Sapiens
CNANGSSQD

SEQ ID NO: 1156245 - protein, 9 aa, Homo Sapiens
GHNKCPVIL

SEQ ID NO: 1156246 - protein, 9 aa, Homo Sapiens
CGFGLMGLF

SEQ ID NO: 1156247 - protein, 9 aa, Homo Sapiens
ECANRHHDC

SEQ ID NO: 1156248 - protein, 9 aa, Homo Sapiens
LAPFPPGPP

SEQ ID NO: 1156249 - protein, 9 aa, Homo Sapiens
TARQEDYDR

SEQ ID NO: 1156250 - protein, 9 aa, Homo Sapiens
LTASALLLK

SEQ ID NO: 1156251 - protein, 9 aa, Homo Sapiens
EDTFSQMEE

SEQ ID NO: 1156252 - protein, 9 aa, Homo Sapiens
IRSRTMAGG

SEQ ID NO: 1156253 - protein, 9 aa, Homo Sapiens
LEDLRDEYD

SEQ ID NO: 1156254 - protein, 9 aa, Homo Sapiens
IDPIRSRTM

SEQ ID NO: 1156255 - protein, 9 aa, Homo Sapiens
STGSLLWRV

SEQ ID NO: 1156256 - protein, 9 aa, Homo Sapiens
PVCGLICTN

SEQ ID NO: 1156257 - protein, 9 aa, Homo Sapiens
SGIQLGTPQ

SEQ ID NO: 1156258 - protein, 9 aa, Homo Sapiens
LAPSTHPPF

SEQ ID NO: 1156259 - protein, 9 aa, Homo Sapiens
FHKCICKGR

SEQ ID NO: 1156260 - protein, 9 aa, Homo Sapiens
IRGVSMAKL

SEQ ID NO: 1156261 - protein, 9 aa, Homo Sapiens
SSNRQSTRI

SEQ ID NO: 1156262 - protein, 9 aa, Homo Sapiens
VREGQGVVI

SEQ ID NO: 1156263 - protein, 9 aa, Homo Sapiens
TVMGHGTPP

SEQ ID NO: 1156264 - protein, 9 aa, Homo Sapiens
ETCSKSFDY

SEQ ID NO: 1156265 - protein, 9 aa, Homo Sapiens
YTLKVEGAT

SEQ ID NO: 1156266 - protein, 9 aa, Homo Sapiens
VSEGEGKNP

SEQ ID NO: 1156267 - protein, 9 aa, Homo Sapiens
ETPFFSANR

SEQ ID NO: 1156268 - protein, 9 aa, Homo Sapiens
NGQPHGAPG

SEQ ID NO: 1156269 - protein, 9 aa, Homo Sapiens
QHQTQGVLG

SEQ ID NO: 1156270 - protein, 9 aa, Homo Sapiens
PPPRETWGF

SEQ ID NO: 1156271 - protein, 9 aa, Homo Sapiens
NITLTVMGH

SEQ ID NO: 1156272 - protein, 9 aa, Homo Sapiens
HKALQVLHC

SEQ ID NO: 1156273 - protein, 9 aa, Homo Sapiens
SYLKQFFNY

SEQ ID NO: 1156274 - protein, 9 aa, Homo Sapiens
FQERLIHSL

SEQ ID NO: 1156275 - protein, 9 aa, Homo Sapiens
CKKCNANGS

SEQ ID NO: 1156276 - protein, 9 aa, Homo Sapiens
DFAQSGQDS

SEQ ID NO: 1156277 - protein, 9 aa, Homo Sapiens
TALQDPVVS

SEQ ID NO: 1156278 - protein, 9 aa, Homo Sapiens
KYSLYQVHV

SEQ ID NO: 1156279 - protein, 9 aa, Homo Sapiens
FRKMQEEEK

SEQ ID NO: 1156280 - protein, 9 aa, Homo Sapiens
PGGWSFSAY

SEQ ID NO: 1156281 - protein, 9 aa, Homo Sapiens
PGCTGSGHI

SEQ ID NO: 1156282 - protein, 9 aa, Homo Sapiens
LRFGCKRKQ

SEQ ID NO: 1156283 - protein, 9 aa, Homo Sapiens
RDGHCGFSE

SEQ ID NO: 1156284 - protein, 9 aa, Homo Sapiens
SQAAEHEYL

SEQ ID NO: 1156285 - protein, 9 aa, Homo Sapiens
ELALWDTAR

SEQ ID NO: 1156286 - protein, 9 aa, Homo Sapiens
GPRPPAALA

SEQ ID NO: 1156287 - protein, 9 aa, Homo Sapiens
PFFSANRLR

SEQ ID NO: 1156288 - protein, 9 aa, Homo Sapiens
NGLIDFTIQ

SEQ ID NO: 1156289 - protein, 9 aa, Homo Sapiens
KREDFKGKK

SEQ ID NO: 1156290 - protein, 9 aa, Homo Sapiens
QKPKHLKDK

SEQ ID NO: 1156291 - protein, 9 aa, Homo Sapiens
ICRLEALQL

SEQ ID NO: 1156292 - protein, 9 aa, Homo Sapiens
CRLEALQLS

SEQ ID NO: 1156293 - protein, 9 aa, Homo Sapiens
SSPAPLCPG

SEQ ID NO: 1156294 - protein, 9 aa, Homo Sapiens
NTTALQDPV

SEQ ID NO: 1156295 - protein, 9 aa, Homo Sapiens
RVQSKFRYP

SEQ ID NO: 1156296 - protein, 9 aa, Homo Sapiens
NKLEASKIV

SEQ ID NO: 1156297 - protein, 9 aa, Homo Sapiens
NDEASGAFT

SEQ ID NO: 1156298 - protein, 9 aa, Homo Sapiens
LLKQTHPVQ

SEQ ID NO: 1156299 - protein, 9 aa, Homo Sapiens
TGSLLWRVA

SEQ ID NO: 1156300 - protein, 9 aa, Homo Sapiens
ATPPAYSMQ

SEQ ID NO: 1156301 - protein, 9 aa, Homo Sapiens
TVPDLYHLL

SEQ ID NO: 1156302 - protein, 9 aa, Homo Sapiens
FNSLVSEAF

SEQ ID NO: 1156303 - protein, 9 aa, Homo Sapiens
RECSTSIAT

SEQ ID NO: 1156304 - protein, 9 aa, Homo Sapiens
IYILNDETQ

SEQ ID NO: 1156305 - protein, 9 aa, Homo Sapiens
RLRFGCKRK

SEQ ID NO: 1156306 - protein, 9 aa, Homo Sapiens
LLSTNTAYQ

SEQ ID NO: 1156307 - protein, 9 aa, Homo Sapiens
SEFIKELLG

SEQ ID NO: 1156308 - protein, 9 aa, Homo Sapiens
KAGVRPESW

SEQ ID NO: 1156309 - protein, 9 aa, Homo Sapiens
EGHIEKDAQ

SEQ ID NO: 1156310 - protein, 9 aa, Homo Sapiens
HNLAPSTHP

SEQ ID NO: 1156311 - protein, 9 aa, Homo Sapiens
SIYILNDET

SEQ ID NO: 1156312 - protein, 9 aa, Homo Sapiens
TSIGKETAR

SEQ ID NO: 1156313 - protein, 9 aa, Homo Sapiens
VINLAFEDA

SEQ ID NO: 1156314 - protein, 9 aa, Homo Sapiens
ALLLKRAMQ

SEQ ID NO: 1156315 - protein, 9 aa, Homo Sapiens
KVVEGMPLI

SEQ ID NO: 1156316 - protein, 9 aa, Homo Sapiens
RTISLNLCE

SEQ ID NO: 1156317 - protein, 9 aa, Homo Sapiens
EHVTQHKFG

SEQ ID NO: 1156318 - protein, 9 aa, Homo Sapiens
AVNGASLSP

SEQ ID NO: 1156319 - protein, 9 aa, Homo Sapiens
ESLTLLHNN

SEQ ID NO: 1156320 - protein, 9 aa, Homo Sapiens
ESRDQPRPL

SEQ ID NO: 1156321 - protein, 9 aa, Homo Sapiens
RPSMPSRPS

SEQ ID NO: 1156322 - protein, 9 aa, Homo Sapiens
RTDWVNDIV

SEQ ID NO: 1156323 - protein, 9 aa, Homo Sapiens
KENGQPHGA

SEQ ID NO: 1156324 - protein, 9 aa, Homo Sapiens
IADEADLRA

SEQ ID NO: 1156325 - protein, 9 aa, Homo Sapiens
REGQGVVIL

SEQ ID NO: 1156326 - protein, 9 aa, Homo Sapiens
IEVDIPVVS

SEQ ID NO: 1156327 - protein, 9 aa, Homo Sapiens
SQKEIEAFD

SEQ ID NO: 1156328 - protein, 9 aa, Homo Sapiens
VVEGMPLID

SEQ ID NO: 1156329 - protein, 9 aa, Homo Sapiens
ITLTVMGHG

SEQ ID NO: 1156330 - protein, 9 aa, Homo Sapiens
EAGADAFLE

SEQ ID NO: 1156331 - protein, 9 aa, Homo Sapiens
VSDLKIQAV

SEQ ID NO: 1156332 - protein, 9 aa, Homo Sapiens
AGIADAYAA

SEQ ID NO: 1156333 - protein, 9 aa, Homo Sapiens
TQFEYSDSS

SEQ ID NO: 1156334 - protein, 9 aa, Homo Sapiens
KSNEKLFKC

SEQ ID NO: 1156335 - protein, 9 aa, Homo Sapiens
VQSKFRYPF

SEQ ID NO: 1156336 - protein, 9 aa, Homo Sapiens
SLYQVHVSG

SEQ ID NO: 1156337 - protein, 9 aa, Homo Sapiens
LVFEVICIL

SEQ ID NO: 1156338 - protein, 9 aa, Homo Sapiens
VDLTKSHTV

SEQ ID NO: 1156339 - protein, 9 aa, Homo Sapiens
HMTETCSKS

SEQ ID NO: 1156340 - protein, 9 aa, Homo Sapiens
LVSEGEGKN

SEQ ID NO: 1156341 - protein, 9 aa, Homo Sapiens
LGKMQQLQK

SEQ ID NO: 1156342 - protein, 9 aa, Homo Sapiens
ADTILRSLM

SEQ ID NO: 1156343 - protein, 9 aa, Homo Sapiens
NYSVIDVFN

SEQ ID NO: 1156344 - protein, 9 aa, Homo Sapiens
PLSDWLQCG

SEQ ID NO: 1156345 - protein, 9 aa, Homo Sapiens
QCKEQRLSH

SEQ ID NO: 1156346 - protein, 9 aa, Homo Sapiens
YFNHKALQV

SEQ ID NO: 1156347 - protein, 9 aa, Homo Sapiens
SPKYSLYQV

SEQ ID NO: 1156348 - protein, 9 aa, Homo Sapiens
QQQQLYGRS

SEQ ID NO: 1156349 - protein, 9 aa, Homo Sapiens
ANVKLVCDI

SEQ ID NO: 1156350 - protein, 9 aa, Homo Sapiens
TSDMQDDFI

SEQ ID NO: 1156351 - protein, 9 aa, Homo Sapiens
EQTLAVTDD

SEQ ID NO: 1156352 - protein, 9 aa, Homo Sapiens
ETSERLHTV

SEQ ID NO: 1156353 - protein, 9 aa, Homo Sapiens
AATAQDLDV

SEQ ID NO: 1156354 - protein, 9 aa, Homo Sapiens
EVGEKEEAE

SEQ ID NO: 1156355 - protein, 9 aa, Homo Sapiens
ELPYFESDF

SEQ ID NO: 1156356 - protein, 9 aa, Homo Sapiens
KLCPDSKSD

SEQ ID NO: 1156357 - protein, 9 aa, Homo Sapiens
QEMHVVATV

SEQ ID NO: 1156358 - protein, 9 aa, Homo Sapiens
LSHFTNQYM

SEQ ID NO: 1156359 - protein, 9 aa, Homo Sapiens
MPAVLVANL

SEQ ID NO: 1156360 - protein, 9 aa, Homo Sapiens
ESDFWPNVL

SEQ ID NO: 1156361 - protein, 9 aa, Homo Sapiens
LEANVKLVC

SEQ ID NO: 1156362 - protein, 9 aa, Homo Sapiens
ILYEAYVMA

SEQ ID NO: 1156363 - protein, 9 aa, Homo Sapiens
SFRLPLSDW

SEQ ID NO: 1156364 - protein, 9 aa, Homo Sapiens
RYRGERNRM

SEQ ID NO: 1156365 - protein, 9 aa, Homo Sapiens
LHPGCGERP

SEQ ID NO: 1156366 - protein, 9 aa, Homo Sapiens
ISVLQPKPT

SEQ ID NO: 1156367 - protein, 9 aa, Homo Sapiens
RKRRRKAAK

SEQ ID NO: 1156368 - protein, 9 aa, Homo Sapiens
YGDPAYQKN

SEQ ID NO: 1156369 - protein, 9 aa, Homo Sapiens
FSHLPLLAR

SEQ ID NO: 1156370 - protein, 9 aa, Homo Sapiens
AGGASGAGS

SEQ ID NO: 1156371 - protein, 9 aa, Homo Sapiens
TVERLFHEF

SEQ ID NO: 1156372 - protein, 9 aa, Homo Sapiens
PYGDPAYQK

SEQ ID NO: 1156373 - protein, 9 aa, Homo Sapiens
QTQGVLGGS

SEQ ID NO: 1156374 - protein, 9 aa, Homo Sapiens
VLHCFPLDI

SEQ ID NO: 1156375 - protein, 9 aa, Homo Sapiens
LREQYEEEM

SEQ ID NO: 1156376 - protein, 9 aa, Homo Sapiens
TNDPDVAFH

SEQ ID NO: 1156377 - protein, 9 aa, Homo Sapiens
TNISVLQPK

SEQ ID NO: 1156378 - protein, 9 aa, Homo Sapiens
PVLGLSPAV

SEQ ID NO: 1156379 - protein, 9 aa, Homo Sapiens
GEQTLAVTD

SEQ ID NO: 1156380 - protein, 9 aa, Homo Sapiens
HRLHQELQD

SEQ ID NO: 1156381 - protein, 9 aa, Homo Sapiens
TVVFWGLKS

SEQ ID NO: 1156382 - protein, 9 aa, Homo Sapiens
DARSQKNTI

SEQ ID NO: 1156383 - protein, 9 aa, Homo Sapiens
FEVICILPN

SEQ ID NO: 1156384 - protein, 9 aa, Homo Sapiens
KDHSDAEEE

SEQ ID NO: 1156385 - protein, 9 aa, Homo Sapiens
AAVAGFFVV

SEQ ID NO: 1156386 - protein, 9 aa, Homo Sapiens
KTHESSQKE

SEQ ID NO: 1156387 - protein, 9 aa, Homo Sapiens
GQGVVILCG

SEQ ID NO: 1156388 - protein, 9 aa, Homo Sapiens
RRVWNKPLP

SEQ ID NO: 1156389 - protein, 9 aa, Homo Sapiens
CTGSGHIRG

SEQ ID NO: 1156390 - protein, 9 aa, Homo Sapiens
YMGRVDAVR

SEQ ID NO: 1156391 - protein, 9 aa, Homo Sapiens
RFNICALRL

SEQ ID NO: 1156392 - protein, 9 aa, Homo Sapiens
AKVKCGECG

SEQ ID NO: 1156393 - protein, 9 aa, Homo Sapiens
EEVQGKVKD

SEQ ID NO: 1156394 - protein, 9 aa, Homo Sapiens
QEKVPAGRS

SEQ ID NO: 1156395 - protein, 9 aa, Homo Sapiens
SCDKKKQEE

SEQ ID NO: 1156396 - protein, 9 aa, Homo Sapiens
TGLIYLDDL

SEQ ID NO: 1156397 - protein, 9 aa, Homo Sapiens
VDIPVVSHT

SEQ ID NO: 1156398 - protein, 9 aa, Homo Sapiens
IGHKFMATY

SEQ ID NO: 1156399 - protein, 9 aa, Homo Sapiens
GLESDRYRG

SEQ ID NO: 1156400 - protein, 9 aa, Homo Sapiens
SLEDLRDEY

SEQ ID NO: 1156401 - protein, 9 aa, Homo Sapiens
MILKSNEKL

SEQ ID NO: 1156402 - protein, 9 aa, Homo Sapiens
MDAVPLSVL

SEQ ID NO: 1156403 - protein, 9 aa, Homo Sapiens
PVGTIIGAA

SEQ ID NO: 1156404 - protein, 9 aa, Homo Sapiens
QCRETLRAT

SEQ ID NO: 1156405 - protein, 9 aa, Homo Sapiens
RLLFSAIEW

SEQ ID NO: 1156406 - protein, 9 aa, Homo Sapiens
LKQFFNYSV

SEQ ID NO: 1156407 - protein, 9 aa, Homo Sapiens
TGSDYQYIG

SEQ ID NO: 1156408 - protein, 9 aa, Homo Sapiens
GRKRLVRRR

SEQ ID NO: 1156409 - protein, 9 aa, Homo Sapiens
PSPPPRETW

SEQ ID NO: 1156410 - protein, 9 aa, Homo Sapiens
TVQNNGKIV

SEQ ID NO: 1156411 - protein, 9 aa, Homo Sapiens
LLHNNMIAL

SEQ ID NO: 1156412 - protein, 9 aa, Homo Sapiens
SLCDKLCPD

SEQ ID NO: 1156413 - protein, 9 aa, Homo Sapiens
VRFVIGWEK

SEQ ID NO: 1156414 - protein, 9 aa, Homo Sapiens
EVLPHSAEP

SEQ ID NO: 1156415 - protein, 9 aa, Homo Sapiens
ILKSNEKLF

SEQ ID NO: 1156416 - protein, 9 aa, Homo Sapiens
EFNADHPFI

SEQ ID NO: 1156417 - protein, 9 aa, Homo Sapiens
GQGLMSLFV

SEQ ID NO: 1156418 - protein, 9 aa, Homo Sapiens
GVLGGSRAL

SEQ ID NO: 1156419 - protein, 9 aa, Homo Sapiens
LWRVAGPGP

SEQ ID NO: 1156420 - protein, 9 aa, Homo Sapiens
CSRLHLIFA

SEQ ID NO: 1156421 - protein, 9 aa, Homo Sapiens
NFSQDVTFN

SEQ ID NO: 1156422 - protein, 9 aa, Homo Sapiens
MEPVGRKRR

SEQ ID NO: 1156423 - protein, 9 aa, Homo Sapiens
DSVPESPSK

SEQ ID NO: 1156424 - protein, 9 aa, Homo Sapiens
MGETQFEYS

SEQ ID NO: 1156425 - protein, 9 aa, Homo Sapiens
HPGCGERPL

SEQ ID NO: 1156426 - protein, 9 aa, Homo Sapiens
ALAPFPPGP

SEQ ID NO: 1156427 - protein, 9 aa, Homo Sapiens
QVMSFCIPT

SEQ ID NO: 1156428 - protein, 9 aa, Homo Sapiens
SPQEWATYM

SEQ ID NO: 1156429 - protein, 9 aa, Homo Sapiens
LEANDPPIF

SEQ ID NO: 1156430 - protein, 9 aa, Homo Sapiens
HQHQTQGVL

SEQ ID NO: 1156431 - protein, 9 aa, Homo Sapiens
PKGTAKTSG

SEQ ID NO: 1156432 - protein, 9 aa, Homo Sapiens
VHQVIGHKF

SEQ ID NO: 1156433 - protein, 9 aa, Homo Sapiens
TCDEDYQEL

SEQ ID NO: 1156434 - protein, 9 aa, Homo Sapiens
QGVLGGSRA

SEQ ID NO: 1156435 - protein, 9 aa, Homo Sapiens
GCEPGSSPA

SEQ ID NO: 1156436 - protein, 9 aa, Homo Sapiens
QKALRNSRD

SEQ ID NO: 1156437 - protein, 9 aa, Homo Sapiens
KEEWFILYI

SEQ ID NO: 1156438 - protein, 9 aa, Homo Sapiens
LLIAFRAAL

SEQ ID NO: 1156439 - protein, 9 aa, Homo Sapiens
PSRPSTKSD

SEQ ID NO: 1156440 - protein, 9 aa, Homo Sapiens
ISCDKKKQE

SEQ ID NO: 1156441 - protein, 9 aa, Homo Sapiens
YATVQNNGK

SEQ ID NO: 1156442 - protein, 9 aa, Homo Sapiens
FEYSDSSCE

SEQ ID NO: 1156443 - protein, 9 aa, Homo Sapiens
TPPAYSMQY

SEQ ID NO: 1156444 - protein, 9 aa, Homo Sapiens
YLSLLKQTH

SEQ ID NO: 1156445 - protein, 9 aa, Homo Sapiens
YPYGDPAYQ

SEQ ID NO: 1156446 - protein, 9 aa, Homo Sapiens
GVVILCGPP

SEQ ID NO: 1156447 - protein, 9 aa, Homo Sapiens
FESDFWPNV

SEQ ID NO: 1156448 - protein, 9 aa, Homo Sapiens
TDRSILQKT

SEQ ID NO: 1156449 - protein, 9 aa, Homo Sapiens
VMNNGVNPV

SEQ ID NO: 1156450 - protein, 9 aa, Homo Sapiens
GLMSLFVLA

SEQ ID NO: 1156451 - protein, 9 aa, Homo Sapiens
LGTKRGTHF

SEQ ID NO: 1156452 - protein, 9 aa, Homo Sapiens
TQHKFGMDL

SEQ ID NO: 1156453 - protein, 9 aa, Homo Sapiens
QTHPVQSWL

SEQ ID NO: 1156454 - protein, 9 aa, Homo Sapiens
RHHDCNETQ

SEQ ID NO: 1156455 - protein, 9 aa, Homo Sapiens
VNGASLSPS

SEQ ID NO: 1156456 - protein, 9 aa, Homo Sapiens
HESSQKEIE

SEQ ID NO: 1156457 - protein, 9 aa, Homo Sapiens
PPEDECANR

SEQ ID NO: 1156458 - protein, 9 aa, Homo Sapiens
HNALSTCVS

SEQ ID NO: 1156459 - protein, 9 aa, Homo Sapiens
DRYRGERNR

SEQ ID NO: 1156460 - protein, 9 aa, Homo Sapiens
IIYSFFGLA

SEQ ID NO: 1156461 - protein, 9 aa, Homo Sapiens
GANTSIGKE

SEQ ID NO: 1156462 - protein, 9 aa, Homo Sapiens
SASTFPLCA

SEQ ID NO: 1156463 - protein, 9 aa, Homo Sapiens
RQSEPREGL

SEQ ID NO: 1156464 - protein, 9 aa, Homo Sapiens
SSIYILNDE

SEQ ID NO: 1156465 - protein, 9 aa, Homo Sapiens
LYNFADCSR

SEQ ID NO: 1156466 - protein, 9 aa, Homo Sapiens
GHIEKDAQE

SEQ ID NO: 1156467 - protein, 9 aa, Homo Sapiens
VKFRRHRAD

SEQ ID NO: 1156468 - protein, 9 aa, Homo Sapiens
EGGADCDPV

SEQ ID NO: 1156469 - protein, 9 aa, Homo Sapiens
NRHHDCNET

SEQ ID NO: 1156470 - protein, 9 aa, Homo Sapiens
PLFSHLPLL

SEQ ID NO: 1156471 - protein, 9 aa, Homo Sapiens
LYDCPVCGL

SEQ ID NO: 1156472 - protein, 9 aa, Homo Sapiens
DRRVWNKPL

SEQ ID NO: 1156473 - protein, 9 aa, Homo Sapiens
RDEYDFKCK

SEQ ID NO: 1156474 - protein, 9 aa, Homo Sapiens
SLAKGERKP

SEQ ID NO: 1156475 - protein, 9 aa, Homo Sapiens
AIAITSDMQ

SEQ ID NO: 1156476 - protein, 9 aa, Homo Sapiens
RKMQEEEKE

SEQ ID NO: 1156477 - protein, 9 aa, Homo Sapiens
ENIIYSFFG

SEQ ID NO: 1156478 - protein, 9 aa, Homo Sapiens
CVHIRGVSM

SEQ ID NO: 1156479 - protein, 9 aa, Homo Sapiens
EAILTLTTA

SEQ ID NO: 1156480 - protein, 9 aa, Homo Sapiens
QADGLCRKL

SEQ ID NO: 1156481 - protein, 9 aa, Homo Sapiens
FESLTLLHN

SEQ ID NO: 1156482 - protein, 9 aa, Homo Sapiens
EKGKLEAEK

SEQ ID NO: 1156483 - protein, 9 aa, Homo Sapiens
KFGMDLLLG

SEQ ID NO: 1156484 - protein, 9 aa, Homo Sapiens
EWFILYIAS

SEQ ID NO: 1156485 - protein, 9 aa, Homo Sapiens
IMSGSTKSL

SEQ ID NO: 1156486 - protein, 9 aa, Homo Sapiens
SYSFFQYCN

SEQ ID NO: 1156487 - protein, 9 aa, Homo Sapiens
ASLSPSISE

SEQ ID NO: 1156488 - protein, 9 aa, Homo Sapiens
ASDRFNHIL

SEQ ID NO: 1156489 - protein, 9 aa, Homo Sapiens
AGADAFLEH

SEQ ID NO: 1156490 - protein, 9 aa, Homo Sapiens
YQYIGKLHS

SEQ ID NO: 1156491 - protein, 9 aa, Homo Sapiens
LTNPDNMFS

SEQ ID NO: 1156492 - protein, 9 aa, Homo Sapiens
RLHTVLLDV

SEQ ID NO: 1156493 - protein, 9 aa, Homo Sapiens
TTQRRSCDS

SEQ ID NO: 1156494 - protein, 9 aa, Homo Sapiens
DEPEISDYY

SEQ ID NO: 1156495 - protein, 9 aa, Homo Sapiens
LSLLKQTHP

SEQ ID NO: 1156496 - protein, 9 aa, Homo Sapiens
DTILRSLMD

SEQ ID NO: 1156497 - protein, 9 aa, Homo Sapiens
MQYVAYSPQ

SEQ ID NO: 1156498 - protein, 9 aa, Homo Sapiens
STFPLCAMQ

SEQ ID NO: 1156499 - protein, 9 aa, Homo Sapiens
VEGMPLIDG

SEQ ID NO: 1156500 - protein, 9 aa, Homo Sapiens
LQPFVSDRS

SEQ ID NO: 1156501 - protein, 9 aa, Homo Sapiens
RCSLCDKLC

SEQ ID NO: 1156502 - protein, 9 aa, Homo Sapiens
SALLLKRAM

SEQ ID NO: 1156503 - protein, 9 aa, Homo Sapiens
HLPLLARPR

SEQ ID NO: 1156504 - protein, 9 aa, Homo Sapiens
VECGSDRCN

SEQ ID NO: 1156505 - protein, 9 aa, Homo Sapiens
SLMDAVPLS

SEQ ID NO: 1156506 - protein, 9 aa, Homo Sapiens
DTSQEHVSF

SEQ ID NO: 1156507 - protein, 9 aa, Homo Sapiens
HCSSYLTKH

SEQ ID NO: 1156508 - protein, 9 aa, Homo Sapiens
NDPDVAFHG

SEQ ID NO: 1156509 - protein, 9 aa, Homo Sapiens
RLSHFTNQY

SEQ ID NO: 1156510 - protein, 9 aa, Homo Sapiens
SMPSELEYM

SEQ ID NO: 1156511 - protein, 9 aa, Homo Sapiens
VSPISESML

SEQ ID NO: 1156512 - protein, 9 aa, Homo Sapiens
LKQMKSTFE

SEQ ID NO: 1156513 - protein, 9 aa, Homo Sapiens
CYLKIIPWR

SEQ ID NO: 1156514 - protein, 9 aa, Homo Sapiens
GKAFHCSSY

SEQ ID NO: 1156515 - protein, 9 aa, Homo Sapiens
SPPPRETWG

SEQ ID NO: 1156516 - protein, 9 aa, Homo Sapiens
NQRYFRVDL

SEQ ID NO: 1156517 - protein, 9 aa, Homo Sapiens
GSTLGTKRG

SEQ ID NO: 1156518 - protein, 9 aa, Homo Sapiens
TVNVTVLEA

SEQ ID NO: 1156519 - protein, 9 aa, Homo Sapiens
TVSDLKIQA

SEQ ID NO: 1156520 - protein, 9 aa, Homo Sapiens
QVTGHRISA

SEQ ID NO: 1156521 - protein, 9 aa, Homo Sapiens
EGATPHLEM

SEQ ID NO: 1156522 - protein, 9 aa, Homo Sapiens
SGIHSGATI

SEQ ID NO: 1156523 - protein, 9 aa, Homo Sapiens
VVSPRLDVA

SEQ ID NO: 1156524 - protein, 9 aa, Homo Sapiens
TLNAHEDKV

SEQ ID NO: 1156525 - protein, 9 aa, Homo Sapiens
PAVINIVTR

SEQ ID NO: 1156526 - protein, 9 aa, Homo Sapiens
LPLSDWLQC

SEQ ID NO: 1156527 - protein, 9 aa, Homo Sapiens
HSAHMTETC

SEQ ID NO: 1156528 - protein, 9 aa, Homo Sapiens
ERIKSDPTL

SEQ ID NO: 1156529 - protein, 9 aa, Homo Sapiens
CKEQRLSHF

SEQ ID NO: 1156530 - protein, 9 aa, Homo Sapiens
SSPRWNEWL

SEQ ID NO: 1156531 - protein, 9 aa, Homo Sapiens
KCNANGSSQ

SEQ ID NO: 1156532 - protein, 9 aa, Homo Sapiens
SDSVCARPL

SEQ ID NO: 1156533 - protein, 9 aa, Homo Sapiens
FGLTCGQVM

SEQ ID NO: 1156534 - protein, 9 aa, Homo Sapiens
KQFSVKECY

SEQ ID NO: 1156535 - protein, 9 aa, Homo Sapiens
CKGRSVSLT

SEQ ID NO: 1156536 - protein, 9 aa, Homo Sapiens
RPLSHRIKS

SEQ ID NO: 1156537 - protein, 9 aa, Homo Sapiens
NKCPVILNF

SEQ ID NO: 1156538 - protein, 9 aa, Homo Sapiens
SISANSFDQ

SEQ ID NO: 1156539 - protein, 9 aa, Homo Sapiens
AFRAALFAL

SEQ ID NO: 1156540 - protein, 9 aa, Homo Sapiens
IKSLEDLRD

SEQ ID NO: 1156541 - protein, 9 aa, Homo Sapiens
KSLEDLRDE

SEQ ID NO: 1156542 - protein, 9 aa, Homo Sapiens
FQVPYVTCD

SEQ ID NO: 1156543 - protein, 9 aa, Homo Sapiens
QPKHVLKTF

SEQ ID NO: 1156544 - protein, 9 aa, Homo Sapiens
LKRNIHYTH

SEQ ID NO: 1156545 - protein, 9 aa, Homo Sapiens
GCKRKQCRE

SEQ ID NO: 1156546 - protein, 9 aa, Homo Sapiens
AAEHEYLPP

SEQ ID NO: 1156547 - protein, 9 aa, Homo Sapiens
GGLEESRDQ

SEQ ID NO: 1156548 - protein, 9 aa, Homo Sapiens
EISDYYTAT

SEQ ID NO: 1156549 - protein, 9 aa, Homo Sapiens
EMGETQFEY

SEQ ID NO: 1156550 - protein, 9 aa, Homo Sapiens
HGTKVELGP

SEQ ID NO: 1156551 - protein, 9 aa, Homo Sapiens
CDCEGGADC

SEQ ID NO: 1156552 - protein, 9 aa, Homo Sapiens
FSANRLRFG

SEQ ID NO: 1156553 - protein, 9 aa, Homo Sapiens
CDILKAVIL

SEQ ID NO: 1156554 - protein, 9 aa, Homo Sapiens
VLSQSSEFI

SEQ ID NO: 1156555 - protein, 9 aa, Homo Sapiens
AREVLPHSA

SEQ ID NO: 1156556 - protein, 9 aa, Homo Sapiens
SGQDSVPES

SEQ ID NO: 1156557 - protein, 9 aa, Homo Sapiens
SDAEEEPEA

SEQ ID NO: 1156558 - protein, 9 aa, Homo Sapiens
CICKGRSVS

SEQ ID NO: 1156559 - protein, 9 aa, Homo Sapiens
SAIEVDIPV

SEQ ID NO: 1156560 - protein, 9 aa, Homo Sapiens
RSMPSELEY

SEQ ID NO: 1156561 - protein, 9 aa, Homo Sapiens
EPTNDPDVA

SEQ ID NO: 1156562 - protein, 9 aa, Homo Sapiens
DECANRHHD

SEQ ID NO: 1156563 - protein, 9 aa, Homo Sapiens
FLCSNGVYK

SEQ ID NO: 1156564 - protein, 9 aa, Homo Sapiens
CSLCDKLCP

SEQ ID NO: 1156565 - protein, 9 aa, Homo Sapiens
ATITAPSLS

SEQ ID NO: 1156566 - protein, 9 aa, Homo Sapiens
RLVRRRPEP

SEQ ID NO: 1156567 - protein, 9 aa, Homo Sapiens
DSVCARPLS

SEQ ID NO: 1156568 - protein, 9 aa, Homo Sapiens
RKQCRETLR

SEQ ID NO: 1156569 - protein, 9 aa, Homo Sapiens
FDGGFTVKI

SEQ ID NO: 1156570 - protein, 9 aa, Homo Sapiens
KCPVILNFF

SEQ ID NO: 1156571 - protein, 9 aa, Homo Sapiens
TAKPTAVAP

SEQ ID NO: 1156572 - protein, 9 aa, Homo Sapiens
YLKQFFNYS

SEQ ID NO: 1156573 - protein, 9 aa, Homo Sapiens
TICRLEALQ

SEQ ID NO: 1156574 - protein, 9 aa, Homo Sapiens
DNMFSRTCE

SEQ ID NO: 1156575 - protein, 9 aa, Homo Sapiens
GGFTVKIRP

SEQ ID NO: 1156576 - protein, 9 aa, Homo Sapiens
FPKGTAKTS

SEQ ID NO: 1156577 - protein, 9 aa, Homo Sapiens
DRSILQKTK

SEQ ID NO: 1156578 - protein, 9 aa, Homo Sapiens
LNAHEDKVW

SEQ ID NO: 1156579 - protein, 9 aa, Homo Sapiens
VIGWEKPGQ

SEQ ID NO: 1156580 - protein, 9 aa, Homo Sapiens
HLKDKADFC

SEQ ID NO: 1156581 - protein, 9 aa, Homo Sapiens
GTKWALIQC

SEQ ID NO: 1156582 - protein, 9 aa, Homo Sapiens
CSNGVYKGF

SEQ ID NO: 1156583 - protein, 9 aa, Homo Sapiens
LKEWLAATD

SEQ ID NO: 1156584 - protein, 9 aa, Homo Sapiens
EHRTDWVND

SEQ ID NO: 1156585 - protein, 9 aa, Homo Sapiens
IASMILKSN

SEQ ID NO: 1156586 - protein, 9 aa, Homo Sapiens
GKHVQVTGH

SEQ ID NO: 1156587 - protein, 9 aa, Homo Sapiens
NNGVNPVYN

SEQ ID NO: 1156588 - protein, 9 aa, Homo Sapiens
VCVHIRGVS

SEQ ID NO: 1156589 - protein, 9 aa, Homo Sapiens
HVVATVPDL

SEQ ID NO: 1156590 - protein, 9 aa, Homo Sapiens
APSTHPPFL

SEQ ID NO: 1156591 - protein, 9 aa, Homo Sapiens
TAVAPVKES

SEQ ID NO: 1156592 - protein, 9 aa, Homo Sapiens
DAYAARKLG

SEQ ID NO: 1156593 - protein, 9 aa, Homo Sapiens
EARHNALST

SEQ ID NO: 1156594 - protein, 9 aa, Homo Sapiens
CGDVCTHGM

SEQ ID NO: 1156595 - protein, 9 aa, Homo Sapiens
HKCICKGRS

SEQ ID NO: 1156596 - protein, 9 aa, Homo Sapiens
QSEKDHSDA

SEQ ID NO: 1156597 - protein, 9 aa, Homo Sapiens
DTFSQMEEL

SEQ ID NO: 1156598 - protein, 9 aa, Homo Sapiens
EFTQFLLEM

SEQ ID NO: 1156599 - protein, 9 aa, Homo Sapiens
AEQKISCDK

SEQ ID NO: 1156600 - protein, 9 aa, Homo Sapiens
RYNPGLDDK

SEQ ID NO: 1156601 - protein, 9 aa, Homo Sapiens
VLGLSPAVW

SEQ ID NO: 1156602 - protein, 9 aa, Homo Sapiens
LRNSRDDKK

SEQ ID NO: 1156603 - protein, 9 aa, Homo Sapiens
MTETCSKSF

SEQ ID NO: 1156604 - protein, 9 aa, Homo Sapiens
TSQEHVSFH

SEQ ID NO: 1156605 - protein, 9 aa, Homo Sapiens
SRLHLIFAL

SEQ ID NO: 1156606 - protein, 9 aa, Homo Sapiens
PKHVLKTFQ

SEQ ID NO: 1156607 - protein, 9 aa, Homo Sapiens
LASDRFNHI

SEQ ID NO: 1156608 - protein, 9 aa, Homo Sapiens
EQGVILCRG

SEQ ID NO: 1156609 - protein, 9 aa, Homo Sapiens
WEKPGQVSE

SEQ ID NO: 1156610 - protein, 9 aa, Homo Sapiens
PAVWAKILS

SEQ ID NO: 1156611 - protein, 9 aa, Homo Sapiens
IKTHESSQK

SEQ ID NO: 1156612 - protein, 9 aa, Homo Sapiens
YGSTGSLLW

SEQ ID NO: 1156613 - protein, 9 aa, Homo Sapiens
PIRSRTMAG

SEQ ID NO: 1156614 - protein, 9 aa, Homo Sapiens
SWKIHMPAV

SEQ ID NO: 1156615 - protein, 9 aa, Homo Sapiens
NGCSSLPPT

SEQ ID NO: 1156616 - protein, 9 aa, Homo Sapiens
SDFWPNVLE

SEQ ID NO: 1156617 - protein, 9 aa, Homo Sapiens
DAFLEHRMN

SEQ ID NO: 1156618 - protein, 9 aa, Homo Sapiens
IYATVQNNG

SEQ ID NO: 1156619 - protein, 9 aa, Homo Sapiens
CSSPRWNEW

SEQ ID NO: 1156620 - protein, 9 aa, Homo Sapiens
QEWATYMGR

SEQ ID NO: 1156621 - protein, 9 aa, Homo Sapiens
KRLVRRRPE

SEQ ID NO: 1156622 - protein, 9 aa, Homo Sapiens
LRDEYDFKC

SEQ ID NO: 1156623 - protein, 9 aa, Homo Sapiens
AALAPFPPG

SEQ ID NO: 1156624 - protein, 9 aa, Homo Sapiens
VKIRPGLLN

SEQ ID NO: 1156625 - protein, 9 aa, Homo Sapiens
RKDARDPVT

SEQ ID NO: 1156626 - protein, 9 aa, Homo Sapiens
EENIIYSFF

SEQ ID NO: 1156627 - protein, 9 aa, Homo Sapiens
SMALDHYVA

SEQ ID NO: 1156628 - protein, 9 aa, Homo Sapiens
RIADEADLR

SEQ ID NO: 1156629 - protein, 9 aa, Homo Sapiens
SEAILTLTT

SEQ ID NO: 1156630 - protein, 9 aa, Homo Sapiens
FAQSGQDSV

SEQ ID NO: 1156631 - protein, 9 aa, Homo Sapiens
KWVTVSDLK

SEQ ID NO: 1156632 - protein, 9 aa, Homo Sapiens
KQCRETLRA

SEQ ID NO: 1156633 - protein, 9 aa, Homo Sapiens
AYQQQYEEQ

SEQ ID NO: 1156634 - protein, 9 aa, Homo Sapiens
KVKCGECGQ

SEQ ID NO: 1156635 - protein, 9 aa, Homo Sapiens
RLSAIEVDI

SEQ ID NO: 1156636 - protein, 9 aa, Homo Sapiens
RLPLSDWLQ

SEQ ID NO: 1156637 - protein, 9 aa, Homo Sapiens
PLPSAAAQQ

SEQ ID NO: 1156638 - protein, 9 aa, Homo Sapiens
SESMLERLS

SEQ ID NO: 1156639 - protein, 9 aa, Homo Sapiens
VATSVGVTR

SEQ ID NO: 1156640 - protein, 9 aa, Homo Sapiens
ESMLERLSK

SEQ ID NO: 1156641 - protein, 9 aa, Homo Sapiens
NGSASTFPL

SEQ ID NO: 1156642 - protein, 9 aa, Homo Sapiens
HQTQGVLGG

SEQ ID NO: 1156643 - protein, 9 aa, Homo Sapiens
NKPLPSCIA

SEQ ID NO: 1156644 - protein, 9 aa, Homo Sapiens
ARLLFSAIE

SEQ ID NO: 1156645 - protein, 9 aa, Homo Sapiens
DGHCGFSEP

SEQ ID NO: 1156646 - protein, 9 aa, Homo Sapiens
MFVYFDLSR

SEQ ID NO: 1156647 - protein, 9 aa, Homo Sapiens
GTIIGAATA

SEQ ID NO: 1156648 - protein, 9 aa, Homo Sapiens
ARPLSHRIK

SEQ ID NO: 1156649 - protein, 9 aa, Homo Sapiens
IFHPLHYTA

SEQ ID NO: 1156650 - protein, 9 aa, Homo Sapiens
VRTLNAHED

SEQ ID NO: 1156651 - protein, 9 aa, Homo Sapiens
PVLYLLIGD

SEQ ID NO: 1156652 - protein, 9 aa, Homo Sapiens
QKISCDKKK

SEQ ID NO: 1156653 - protein, 9 aa, Homo Sapiens
ATYMGRVDA

SEQ ID NO: 1156654 - protein, 9 aa, Homo Sapiens
EMHVVATVP

SEQ ID NO: 1156655 - protein, 9 aa, Homo Sapiens
AAAAAGGAS

SEQ ID NO: 1156656 - protein, 9 aa, Homo Sapiens
VWNKPLPSC

SEQ ID NO: 1156657 - protein, 9 aa, Homo Sapiens
EDECANRHH

SEQ ID NO: 1156658 - protein, 9 aa, Homo Sapiens
FHRDGHCGF

SEQ ID NO: 1156659 - protein, 9 aa, Homo Sapiens
REVLPHSAE

SEQ ID NO: 1156660 - protein, 9 aa, Homo Sapiens
TLKVEGATP

SEQ ID NO: 1156661 - protein, 9 aa, Homo Sapiens
DFRAIAITS

SEQ ID NO: 1156662 - protein, 9 aa, Homo Sapiens
KAFHCSSYL

SEQ ID NO: 1156663 - protein, 9 aa, Homo Sapiens
SGVKFRRHR

SEQ ID NO: 1156664 - protein, 9 aa, Homo Sapiens
SGATITAPS

SEQ ID NO: 1156665 - protein, 9 aa, Homo Sapiens
VRGGSGTKW

SEQ ID NO: 1156666 - protein, 9 aa, Homo Sapiens
FRRHRADNH

SEQ ID NO: 1156667 - protein, 9 aa, Homo Sapiens
EKDHSDAEE

SEQ ID NO: 1156668 - protein, 9 aa, Homo Sapiens
QLGTPQEKV

SEQ ID NO: 1156669 - protein, 9 aa, Homo Sapiens
LNDFHKCIC

SEQ ID NO: 1156670 - protein, 9 aa, Homo Sapiens
HPVQSWLCD

SEQ ID NO: 1156671 - protein, 9 aa, Homo Sapiens
ALLQAVPNK

SEQ ID NO: 1156672 - protein, 9 aa, Homo Sapiens
DKYELLKQM

SEQ ID NO: 1156673 - protein, 9 aa, Homo Sapiens
APLPSAAAQ

SEQ ID NO: 1156674 - protein, 9 aa, Homo Sapiens
LSTNTAYQQ

SEQ ID NO: 1156675 - protein, 9 aa, Homo Sapiens
QKTKGQESL

SEQ ID NO: 1156676 - protein, 9 aa, Homo Sapiens
QPHGAPGSI

SEQ ID NO: 1156677 - protein, 9 aa, Homo Sapiens
LGPAVINIV

SEQ ID NO: 1156678 - protein, 9 aa, Homo Sapiens
RTLNAHEDK

SEQ ID NO: 1156679 - protein, 9 aa, Homo Sapiens
KCGECGQGF

SEQ ID NO: 1156680 - protein, 9 aa, Homo Sapiens
GSGHIRGKY

SEQ ID NO: 1156681 - protein, 9 aa, Homo Sapiens
VEGATPHLE

SEQ ID NO: 1156682 - protein, 9 aa, Homo Sapiens
KFTNISVLQ

SEQ ID NO: 1156683 - protein, 9 aa, Homo Sapiens
LWVIYATVQ

SEQ ID NO: 1156684 - protein, 9 aa, Homo Sapiens
KLLNRNSEV

SEQ ID NO: 1156685 - protein, 9 aa, Homo Sapiens
MSCLLVFEV

SEQ ID NO: 1156686 - protein, 9 aa, Homo Sapiens
YQKNATRDA

SEQ ID NO: 1156687 - protein, 9 aa, Homo Sapiens
DAAWSPVRL

SEQ ID NO: 1156688 - protein, 9 aa, Homo Sapiens
CGQVMSFCI

SEQ ID NO: 1156689 - protein, 9 aa, Homo Sapiens
DYQYIGKLH

SEQ ID NO: 1156690 - protein, 9 aa, Homo Sapiens
SLPPTLTTS

SEQ ID NO: 1156691 - protein, 9 aa, Homo Sapiens
KPKHLKDKA

SEQ ID NO: 1156692 - protein, 9 aa, Homo Sapiens
EEPTNDPDV

SEQ ID NO: 1156693 - protein, 9 aa, Homo Sapiens
NLGQGLMSL

SEQ ID NO: 1156694 - protein, 9 aa, Homo Sapiens
DCSRLHLIF

SEQ ID NO: 1156695 - protein, 9 aa, Homo Sapiens
PTNDPDVAF

SEQ ID NO: 1156696 - protein, 9 aa, Homo Sapiens
GFQVPYVTC

SEQ ID NO: 1156697 - protein, 9 aa, Homo Sapiens
SMPSRPSTK

SEQ ID NO: 1156698 - protein, 9 aa, Homo Sapiens
TALCGDVCT

SEQ ID NO: 1156699 - protein, 9 aa, Homo Sapiens
QRYFRVDLD

SEQ ID NO: 1156700 - protein, 9 aa, Homo Sapiens
ANSFDQRDP

SEQ ID NO: 1156701 - protein, 9 aa, Homo Sapiens
GGWSFSAYW

SEQ ID NO: 1156702 - protein, 9 aa, Homo Sapiens
SNSDPTVRG

SEQ ID NO: 1156703 - protein, 9 aa, Homo Sapiens
GNVRFVIGW

SEQ ID NO: 1156704 - protein, 9 aa, Homo Sapiens
GRCSLCDKL

SEQ ID NO: 1156705 - protein, 9 aa, Homo Sapiens
SRIAKVKCG

SEQ ID NO: 1156706 - protein, 9 aa, Homo Sapiens
GPAVINIVT

SEQ ID NO: 1156707 - protein, 9 aa, Homo Sapiens
SPSISEPDL

SEQ ID NO: 1156708 - protein, 9 aa, Homo Sapiens
QGVILCRGG

SEQ ID NO: 1156709 - protein, 9 aa, Homo Sapiens
IQLGTPQEK

SEQ ID NO: 1156710 - protein, 9 aa, Homo Sapiens
VTRTKGYGT

SEQ ID NO: 1156711 - protein, 9 aa, Homo Sapiens
SQMEELEKH

SEQ ID NO: 1156712 - protein, 9 aa, Homo Sapiens
AGQGAAWTK

SEQ ID NO: 1156713 - protein, 9 aa, Homo Sapiens
HVLKTFQEL

SEQ ID NO: 1156714 - protein, 9 aa, Homo Sapiens
SRLSAIEVD

SEQ ID NO: 1156715 - protein, 9 aa, Homo Sapiens
RVHQVIGHK

SEQ ID NO: 1156716 - protein, 9 aa, Homo Sapiens
NICALRLWS

SEQ ID NO: 1156717 - protein, 9 aa, Homo Sapiens
RFNHILANT

SEQ ID NO: 1156718 - protein, 9 aa, Homo Sapiens
QPFVSDRSM

SEQ ID NO: 1156719 - protein, 9 aa, Homo Sapiens
LSSRRRQRL

SEQ ID NO: 1156720 - protein, 9 aa, Homo Sapiens
AAGGASGAG

SEQ ID NO: 1156721 - protein, 9 aa, Homo Sapiens
MAEQKISCD

SEQ ID NO: 1156722 - protein, 9 aa, Homo Sapiens
LPLHPGCGE

SEQ ID NO: 1156723 - protein, 9 aa, Homo Sapiens
ATSVGVTRT

SEQ ID NO: 1156724 - protein, 9 aa, Homo Sapiens
VQGKVKDAM

SEQ ID NO: 1156725 - protein, 9 aa, Homo Sapiens
YQKALRNSR

SEQ ID NO: 1156726 - protein, 9 aa, Homo Sapiens
ARQEDYDRL

SEQ ID NO: 1156727 - protein, 9 aa, Homo Sapiens
ASMALDHYV

SEQ ID NO: 1156728 - protein, 9 aa, Homo Sapiens
TKWALIQCA

SEQ ID NO: 1156729 - protein, 9 aa, Homo Sapiens
LRKRNEREQ

SEQ ID NO: 1156730 - protein, 9 aa, Homo Sapiens
FQGVINLAF

SEQ ID NO: 1156731 - protein, 9 aa, Homo Sapiens
SGGNAGIAD

SEQ ID NO: 1156732 - protein, 9 aa, Homo Sapiens
IGDKYRRQL

SEQ ID NO: 1156733 - protein, 9 aa, Homo Sapiens
ALVSEGEGK

SEQ ID NO: 1156734 - protein, 9 aa, Homo Sapiens
GQGAAWTKM

SEQ ID NO: 1156735 - protein, 9 aa, Homo Sapiens
THPVQSWLC

SEQ ID NO: 1156736 - protein, 9 aa, Homo Sapiens
PPGPGGWSF

SEQ ID NO: 1156737 - protein, 9 aa, Homo Sapiens
ESDRYRGER

SEQ ID NO: 1156738 - protein, 9 aa, Homo Sapiens
PYIASMEHR

SEQ ID NO: 1156739 - protein, 9 aa, Homo Sapiens
QTTICRLEA

SEQ ID NO: 1156740 - protein, 9 aa, Homo Sapiens
HSLEARHNA

SEQ ID NO: 1156741 - protein, 9 aa, Homo Sapiens
FSQTTICRL

SEQ ID NO: 1156742 - protein, 9 aa, Homo Sapiens
RTMAGGLFA

SEQ ID NO: 1156743 - protein, 9 aa, Homo Sapiens
NAGIADAYA

SEQ ID NO: 1156744 - protein, 9 aa, Homo Sapiens
LFSAIEWAR

SEQ ID NO: 1156745 - protein, 9 aa, Homo Sapiens
RKEMNVLKE

SEQ ID NO: 1156746 - protein, 9 aa, Homo Sapiens
KQTHPVQSW

SEQ ID NO: 1156747 - protein, 9 aa, Homo Sapiens
CACPLTNPD

SEQ ID NO: 1156748 - protein, 9 aa, Homo Sapiens
EQSEKDHSD

SEQ ID NO: 1156749 - protein, 9 aa, Homo Sapiens
TRIADEADL

SEQ ID NO: 1156750 - protein, 9 aa, Homo Sapiens
VKVIHDFNT

SEQ ID NO: 1156751 - protein, 9 aa, Homo Sapiens
LKTFQELLD

SEQ ID NO: 1156752 - protein, 9 aa, Homo Sapiens
LERIKSDPT

SEQ ID NO: 1156753 - protein, 9 aa, Homo Sapiens
GGDNADTSQ

SEQ ID NO: 1156754 - protein, 9 aa, Homo Sapiens
ALVSPISES

SEQ ID NO: 1156755 - protein, 9 aa, Homo Sapiens
DAQEFLDKQ

SEQ ID NO: 1156756 - protein, 9 aa, Homo Sapiens
NADTSQEHV

SEQ ID NO: 1156757 - protein, 9 aa, Homo Sapiens
ALQDPVVSP

SEQ ID NO: 1156758 - protein, 9 aa, Homo Sapiens
RLTVFFTTR

SEQ ID NO: 1156759 - protein, 9 aa, Homo Sapiens
PVILNFFKI

SEQ ID NO: 1156760 - protein, 9 aa, Homo Sapiens
NGSSQDALM

SEQ ID NO: 1156761 - protein, 9 aa, Homo Sapiens
ILKQAPFRS

SEQ ID NO: 1156762 - protein, 9 aa, Homo Sapiens
NIAWQLHHL

SEQ ID NO: 1156763 - protein, 9 aa, Homo Sapiens
LLQTPVTKE

SEQ ID NO: 1156764 - protein, 9 aa, Homo Sapiens
NTAYQQQYE

SEQ ID NO: 1156765 - protein, 9 aa, Homo Sapiens
RSFTEDHYV

SEQ ID NO: 1156766 - protein, 9 aa, Homo Sapiens
GQTEYFLND

SEQ ID NO: 1156767 - protein, 9 aa, Homo Sapiens
DVECGSDRC

SEQ ID NO: 1156768 - protein, 9 aa, Homo Sapiens
PKYSLYQVH

SEQ ID NO: 1156769 - protein, 9 aa, Homo Sapiens
SPAPLCPGV

SEQ ID NO: 1156770 - protein, 9 aa, Homo Sapiens
PFVSDRSMP

SEQ ID NO: 1156771 - protein, 9 aa, Homo Sapiens
KGTAKTSGF

SEQ ID NO: 1156772 - protein, 9 aa, Homo Sapiens
VSMAKLDNA

SEQ ID NO: 1156773 - protein, 9 aa, Homo Sapiens
QYEEEMEAK

SEQ ID NO: 1156774 - protein, 9 aa, Homo Sapiens
AGLIRHTIN

SEQ ID NO: 1156775 - protein, 9 aa, Homo Sapiens
RFCSGRKRL

SEQ ID NO: 1156776 - protein, 9 aa, Homo Sapiens
DPIRSRTMA

SEQ ID NO: 1156777 - protein, 9 aa, Homo Sapiens
VCARPLSHR

SEQ ID NO: 1156778 - protein, 9 aa, Homo Sapiens
KKPLRTISL

SEQ ID NO: 1156779 - protein, 9 aa, Homo Sapiens
KDAQEFLDK

SEQ ID NO: 1156780 - protein, 9 aa, Homo Sapiens
ILRSLMDAV

SEQ ID NO: 1156781 - protein, 9 aa, Homo Sapiens
QSEPREGLP

SEQ ID NO: 1156782 - protein, 9 aa, Homo Sapiens
LGTALCGDV

SEQ ID NO: 1156783 - protein, 9 aa, Homo Sapiens
QSSEFIKEL

SEQ ID NO: 1156784 - protein, 9 aa, Homo Sapiens
LEARHNALS

SEQ ID NO: 1156785 - protein, 9 aa, Homo Sapiens
LLKRAMQFG

SEQ ID NO: 1156786 - protein, 9 aa, Homo Sapiens
LVRRRPEPQ

SEQ ID NO: 1156787 - protein, 9 aa, Homo Sapiens
AQEFLDKQV

SEQ ID NO: 1156788 - protein, 9 aa, Homo Sapiens
SPPSLGKMQ

SEQ ID NO: 1156789 - protein, 9 aa, Homo Sapiens
MALDHYVAI

SEQ ID NO: 1156790 - protein, 9 aa, Homo Sapiens
GVSMAKLDN

SEQ ID NO: 1156791 - protein, 9 aa, Homo Sapiens
NFQERLIHS

SEQ ID NO: 1156792 - protein, 9 aa, Homo Sapiens
NEREQQRVR

SEQ ID NO: 1156793 - protein, 9 aa, Homo Sapiens
SDPTVRGNS

SEQ ID NO: 1156794 - protein, 9 aa, Homo Sapiens
KELPYFESD

SEQ ID NO: 1156795 - protein, 9 aa, Homo Sapiens
KMQEEEKES

SEQ ID NO: 1156796 - protein, 9 aa, Homo Sapiens
DMKRSFTED

SEQ ID NO: 1156797 - protein, 9 aa, Homo Sapiens
ILTLTTAGS

SEQ ID NO: 1156798 - protein, 9 aa, Homo Sapiens
MRKEMNVLK

SEQ ID NO: 1156799 - protein, 9 aa, Homo Sapiens
KGILKQAPF

SEQ ID NO: 1156800 - protein, 9 aa, Homo Sapiens
LVCDILKAV

SEQ ID NO: 1156801 - protein, 9 aa, Homo Sapiens
EVDIPVVSH

SEQ ID NO: 1156802 - protein, 9 aa, Homo Sapiens
VGGLLIAFR

SEQ ID NO: 1156803 - protein, 9 aa, Homo Sapiens
EILYEAYVM

SEQ ID NO: 1156804 - protein, 9 aa, Homo Sapiens
YRIIQHFVP

SEQ ID NO: 1156805 - protein, 9 aa, Homo Sapiens
WRDFRFNIC

SEQ ID NO: 1156806 - protein, 9 aa, Homo Sapiens
WDTARQEDY

SEQ ID NO: 1156807 - protein, 9 aa, Homo Sapiens
SLASDRFNH

SEQ ID NO: 1156808 - protein, 9 aa, Homo Sapiens
CDEDYQELI

SEQ ID NO: 1156809 - protein, 9 aa, Homo Sapiens
PADTEEPTN

SEQ ID NO: 1156810 - protein, 9 aa, Homo Sapiens
MEAKAELQR

SEQ ID NO: 1156811 - protein, 9 aa, Homo Sapiens
FVYFDLSRR

SEQ ID NO: 1156812 - protein, 9 aa, Homo Sapiens
SSLAKGERK

SEQ ID NO: 1156813 - protein, 9 aa, Homo Sapiens
SVGVTRTKG

SEQ ID NO: 1156814 - protein, 9 aa, Homo Sapiens
CGECGQGFS

SEQ ID NO: 1156815 - protein, 9 aa, Homo Sapiens
TTPLKGILK

SEQ ID NO: 1156816 - protein, 9 aa, Homo Sapiens
KESWSTSSD

SEQ ID NO: 1156817 - protein, 9 aa, Homo Sapiens
VTQRFRKDA

SEQ ID NO: 1156818 - protein, 9 aa, Homo Sapiens
GCTGSGHIR

SEQ ID NO: 1156819 - protein, 9 aa, Homo Sapiens
TGSGHIRGK

SEQ ID NO: 1156820 - protein, 9 aa, Homo Sapiens
AAAVTGLEC

SEQ ID NO: 1156821 - protein, 9 aa, Homo Sapiens
RFESLTLLH

SEQ ID NO: 1156822 - protein, 9 aa, Homo Sapiens
HTLERIKSD

SEQ ID NO: 1156823 - protein, 9 aa, Homo Sapiens
TTHNKTHTG

SEQ ID NO: 1156824 - protein, 9 aa, Homo Sapiens
SGSTKSLNH

SEQ ID NO: 1156825 - protein, 9 aa, Homo Sapiens
EPPGPGGWS

SEQ ID NO: 1156826 - protein, 9 aa, Homo Sapiens
SANSFDQRD

SEQ ID NO: 1156827 - protein, 9 aa, Homo Sapiens
LTVFFTTRM

SEQ ID NO: 1156828 - protein, 9 aa, Homo Sapiens
CEDVECGSD

SEQ ID NO: 1156829 - protein, 9 aa, Homo Sapiens
PLYDCPVCG

SEQ ID NO: 1156830 - protein, 9 aa, Homo Sapiens
SPRPSMPSR

SEQ ID NO: 1156831 - protein, 9 aa, Homo Sapiens
VRRRVHQVI

SEQ ID NO: 1156832 - protein, 9 aa, Homo Sapiens
EKESWSTSS

SEQ ID NO: 1156833 - protein, 9 aa, Homo Sapiens
VGEKEEAER

SEQ ID NO: 1156834 - protein, 9 aa, Homo Sapiens
AVAPVKESD

SEQ ID NO: 1156835 - protein, 9 aa, Homo Sapiens
FVNKLEASK

SEQ ID NO: 1156836 - protein, 9 aa, Homo Sapiens
FTIQLLNEL

SEQ ID NO: 1156837 - protein, 9 aa, Homo Sapiens
KISCDKKKQ

SEQ ID NO: 1156838 - protein, 9 aa, Homo Sapiens
MPLIDGRRL

SEQ ID NO: 1156839 - protein, 9 aa, Homo Sapiens
NRNSEVWLI

SEQ ID NO: 1156840 - protein, 9 aa, Homo Sapiens
KGERKPSGL

SEQ ID NO: 1156841 - protein, 9 aa, Homo Sapiens
AVAGFFVVL

SEQ ID NO: 1156842 - protein, 9 aa, Homo Sapiens
NEFHGTKVE

SEQ ID NO: 1156843 - protein, 9 aa, Homo Sapiens
AFLEHRMNW

SEQ ID NO: 1156844 - protein, 9 aa, Homo Sapiens
GKMQQLQKT

SEQ ID NO: 1156845 - protein, 9 aa, Homo Sapiens
LRLKISQPK

SEQ ID NO: 1156846 - protein, 9 aa, Homo Sapiens
KEILYEAYV

SEQ ID NO: 1156847 - protein, 9 aa, Homo Sapiens
AHMTETCSK

SEQ ID NO: 1156848 - protein, 9 aa, Homo Sapiens
TLERIKSDP

SEQ ID NO: 1156849 - protein, 9 aa, Homo Sapiens
NKTHTGEKL

SEQ ID NO: 1156850 - protein, 9 aa, Homo Sapiens
PAPQQFQGV

SEQ ID NO: 1156851 - protein, 9 aa, Homo Sapiens
KRERSISAN

SEQ ID NO: 1156852 - protein, 9 aa, Homo Sapiens
CPVCGLICT

SEQ ID NO: 1156853 - protein, 9 aa, Homo Sapiens
IILFKREDF

SEQ ID NO: 1156854 - protein, 9 aa, Homo Sapiens
GSSPAPLCP

SEQ ID NO: 1156855 - protein, 9 aa, Homo Sapiens
THSLEARHN

SEQ ID NO: 1156856 - protein, 9 aa, Homo Sapiens
LNDEASGAF

SEQ ID NO: 1156857 - protein, 9 aa, Homo Sapiens
PCSSPRWNE

SEQ ID NO: 1156858 - protein, 9 aa, Homo Sapiens
LIAFRAALF

SEQ ID NO: 1156859 - protein, 9 aa, Homo Sapiens
RKFTNISVL

SEQ ID NO: 1156860 - protein, 9 aa, Homo Sapiens
SLEARHNAL

SEQ ID NO: 1156861 - protein, 9 aa, Homo Sapiens
WALIQCAKD

SEQ ID NO: 1156862 - protein, 9 aa, Homo Sapiens
ALWDTARQE

SEQ ID NO: 1156863 - protein, 9 aa, Homo Sapiens
ACPLTNPDN

SEQ ID NO: 1156864 - protein, 9 aa, Homo Sapiens
VMGHGTPPL

SEQ ID NO: 1156865 - protein, 9 aa, Homo Sapiens
GATPHLEMR

SEQ ID NO: 1156866 - protein, 9 aa, Homo Sapiens
RKRNEREQQ

SEQ ID NO: 1156867 - protein, 9 aa, Homo Sapiens
SVCARPLSH

SEQ ID NO: 1156868 - protein, 9 aa, Homo Sapiens
TTTPLKGIL

SEQ ID NO: 1156869 - protein, 9 aa, Homo Sapiens
ERKPSGLRS

SEQ ID NO: 1156870 - protein, 9 aa, Homo Sapiens
AQCKEQRLS

SEQ ID NO: 1156871 - protein, 9 aa, Homo Sapiens
QYIGKLHSD

SEQ ID NO: 1156872 - protein, 9 aa, Homo Sapiens
DPLGPAVIN

SEQ ID NO: 1156873 - protein, 9 aa, Homo Sapiens
EMEAKAELQ

SEQ ID NO: 1156874 - protein, 9 aa, Homo Sapiens
LEHRMNWAT

SEQ ID NO: 1156875 - protein, 9 aa, Homo Sapiens
TSYSGDNVA

SEQ ID NO: 1156876 - protein, 9 aa, Homo Sapiens
PGPGGWSFS

SEQ ID NO: 1156877 - protein, 9 aa, Homo Sapiens
ECGKAFHCS

SEQ ID NO: 1156878 - protein, 9 aa, Homo Sapiens
CALRLWSLT

SEQ ID NO: 1156879 - protein, 9 aa, Homo Sapiens
PSAAAQQQQ

SEQ ID NO: 1156880 - protein, 9 aa, Homo Sapiens
TKRCNLREQ

SEQ ID NO: 1156881 - protein, 9 aa, Homo Sapiens
EEQNVDLTK

SEQ ID NO: 1156882 - protein, 9 aa, Homo Sapiens
HVTQHKFGM

SEQ ID NO: 1156883 - protein, 9 aa, Homo Sapiens
GRKRRRKAA

SEQ ID NO: 1156884 - protein, 9 aa, Homo Sapiens
MNVLKEWLA

SEQ ID NO: 1156885 - protein, 9 aa, Homo Sapiens
IKSDPTLLP

SEQ ID NO: 1156886 - protein, 9 aa, Homo Sapiens
DPLFSHLPL

SEQ ID NO: 1156887 - protein, 9 aa, Homo Sapiens
MVMNNGVNP

SEQ ID NO: 1156888 - protein, 9 aa, Homo Sapiens
EEAGADAFL

SEQ ID NO: 1156889 - protein, 9 aa, Homo Sapiens
RNSRDDKKP

SEQ ID NO: 1156890 - protein, 9 aa, Homo Sapiens
QVPYVTCDE

SEQ ID NO: 1156891 - protein, 9 aa, Homo Sapiens
AATPPAYSM

SEQ ID NO: 1156892 - protein, 9 aa, Homo Sapiens
PAVLVANLC

SEQ ID NO: 1156893 - protein, 9 aa, Homo Sapiens
RLKISQPKP

SEQ ID NO: 1156894 - protein, 9 aa, Homo Sapiens
RGVSMAKLD

SEQ ID NO: 1156895 - protein, 9 aa, Homo Sapiens
HDFNTNKCK

SEQ ID NO: 1156896 - protein, 9 aa, Homo Sapiens
YVVMFVYFD

SEQ ID NO: 1156897 - protein, 9 aa, Homo Sapiens
VILNFFKIG

SEQ ID NO: 1156898 - protein, 9 aa, Homo Sapiens
KMQQLQKTL

SEQ ID NO: 1156899 - protein, 9 aa, Homo Sapiens
SRRRQRLAL

SEQ ID NO: 1156900 - protein, 9 aa, Homo Sapiens
PKHLKDKAD

SEQ ID NO: 1156901 - protein, 9 aa, Homo Sapiens
SNEKLFKCG

SEQ ID NO: 1156902 - protein, 9 aa, Homo Sapiens
TIMSGSTKS

SEQ ID NO: 1156903 - protein, 9 aa, Homo Sapiens
LIGDKYRRQ

SEQ ID NO: 1156904 - protein, 9 aa, Homo Sapiens
VKLVCDILK

SEQ ID NO: 1156905 - protein, 9 aa, Homo Sapiens
NDFHKCICK

SEQ ID NO: 1156906 - protein, 9 aa, Homo Sapiens
LLWRVAGPG

SEQ ID NO: 1156907 - protein, 9 aa, Homo Sapiens
HNASAFPKG

SEQ ID NO: 1156908 - protein, 9 aa, Homo Sapiens
FADCSRLHL

SEQ ID NO: 1156909 - protein, 9 aa, Homo Sapiens
CVIAGQGAA

SEQ ID NO: 1156910 - protein, 9 aa, Homo Sapiens
RGGSGTKWA

SEQ ID NO: 1156911 - protein, 9 aa, Homo Sapiens
QSGQDSVPE

SEQ ID NO: 1156912 - protein, 9 aa, Homo Sapiens
LPSAAAQQQ

SEQ ID NO: 1156913 - protein, 9 aa, Homo Sapiens
QILTGLIYL

SEQ ID NO: 1156914 - protein, 9 aa, Homo Sapiens
FRAIAITSD

SEQ ID NO: 1156915 - protein, 9 aa, Homo Sapiens
PSTHPPFLT

SEQ ID NO: 1156916 - protein, 9 aa, Homo Sapiens
GIHSGATIT

SEQ ID NO: 1156917 - protein, 9 aa, Homo Sapiens
NECVRTLNA

SEQ ID NO: 1156918 - protein, 9 aa, Homo Sapiens
AKPTAVAPV

SEQ ID NO: 1156919 - protein, 9 aa, Homo Sapiens
PVGRKRRRK

SEQ ID NO: 1156920 - protein, 9 aa, Homo Sapiens
AFHCSSYLT

SEQ ID NO: 1156921 - protein, 9 aa, Homo Sapiens
TFCGSTLGT

SEQ ID NO: 1156922 - protein, 9 aa, Homo Sapiens
TFQELLDSE

SEQ ID NO: 1156923 - protein, 9 aa, Homo Sapiens
PLTNPDNMF

SEQ ID NO: 1156924 - protein, 9 aa, Homo Sapiens
GWEKPGQVS

SEQ ID NO: 1156925 - protein, 9 aa, Homo Sapiens
GEVNQRYFR

SEQ ID NO: 1156926 - protein, 9 aa, Homo Sapiens
GATITAPSL

SEQ ID NO: 1156927 - protein, 9 aa, Homo Sapiens
FVPASFRLQ

SEQ ID NO: 1156928 - protein, 9 aa, Homo Sapiens
SDRCNILEA

SEQ ID NO: 1156929 - protein, 9 aa, Homo Sapiens
SPISESMLE

SEQ ID NO: 1156930 - protein, 9 aa, Homo Sapiens
VCGLICTNY

SEQ ID NO: 1156931 - protein, 9 aa, Homo Sapiens
DGGFTVKIR

SEQ ID NO: 1156932 - protein, 9 aa, Homo Sapiens
TETCSKSFD

SEQ ID NO: 1156933 - protein, 9 aa, Homo Sapiens
DAPGTGEEV

SEQ ID NO: 1156934 - protein, 9 aa, Homo Sapiens
QAAEHEYLP

SEQ ID NO: 1156935 - protein, 9 aa, Homo Sapiens
GCSSLPPTL

SEQ ID NO: 1156936 - protein, 9 aa, Homo Sapiens
LLNRNSEVW

SEQ ID NO: 1156937 - protein, 9 aa, Homo Sapiens
IHYTHLTGT

SEQ ID NO: 1156938 - protein, 9 aa, Homo Sapiens
TEYFLNDEA

SEQ ID NO: 1156939 - protein, 9 aa, Homo Sapiens
LIDFTIQLL

SEQ ID NO: 1156940 - protein, 9 aa, Homo Sapiens
HLYRIIQHF

SEQ ID NO: 1156941 - protein, 9 aa, Homo Sapiens
KSLNHEAPT

SEQ ID NO: 1156942 - protein, 9 aa, Homo Sapiens
GVRPESWAS

SEQ ID NO: 1156943 - protein, 9 aa, Homo Sapiens
ISRIAKVKC

SEQ ID NO: 1156944 - protein, 9 aa, Homo Sapiens
RDFRFNICA

SEQ ID NO: 1156945 - protein, 9 aa, Homo Sapiens
GFFVVLFLW

SEQ ID NO: 1156946 - protein, 9 aa, Homo Sapiens
KSDPTLLPN

SEQ ID NO: 1156947 - protein, 9 aa, Homo Sapiens
STRIADEAD

SEQ ID NO: 1156948 - protein, 9 aa, Homo Sapiens
AIFHPLHYT

SEQ ID NO: 1156949 - protein, 9 aa, Homo Sapiens
KQMKSTFEK

SEQ ID NO: 1156950 - protein, 9 aa, Homo Sapiens
VGVTRTKGY

SEQ ID NO: 1156951 - protein, 9 aa, Homo Sapiens
FQELLDSES

SEQ ID NO: 1156952 - protein, 9 aa, Homo Sapiens
VVILCGPPP

SEQ ID NO: 1156953 - protein, 9 aa, Homo Sapiens
VIYATVQNN

SEQ ID NO: 1156954 - protein, 9 aa, Homo Sapiens
LNDETQYNC

SEQ ID NO: 1156955 - protein, 9 aa, Homo Sapiens
AAAAVTGLE

SEQ ID NO: 1156956 - protein, 9 aa, Homo Sapiens
KANKEILYE

SEQ ID NO: 1156957 - protein, 9 aa, Homo Sapiens
VFWGLKSKR

SEQ ID NO: 1156958 - protein, 9 aa, Homo Sapiens
YQVHVSGER

SEQ ID NO: 1156959 - protein, 9 aa, Homo Sapiens
EEMEAKAEL

SEQ ID NO: 1156960 - protein, 9 aa, Homo Sapiens
HRISATAED

SEQ ID NO: 1156961 - protein, 9 aa, Homo Sapiens
AYQKNATRD

SEQ ID NO: 1156962 - protein, 9 aa, Homo Sapiens
PRPPAALAP

SEQ ID NO: 1156963 - protein, 9 aa, Homo Sapiens
ERLFHEFTI

SEQ ID NO: 1156964 - protein, 9 aa, Homo Sapiens
YCNQIIQAF

SEQ ID NO: 1156965 - protein, 9 aa, Homo Sapiens
NHILANTNT

SEQ ID NO: 1156966 - protein, 9 aa, Homo Sapiens
RLQILTGLI

SEQ ID NO: 1156967 - protein, 9 aa, Homo Sapiens
RVWNKPLPS

SEQ ID NO: 1156968 - protein, 9 aa, Homo Sapiens
ICIKTHESS

SEQ ID NO: 1156969 - protein, 9 aa, Homo Sapiens
AVPNKSCRP

SEQ ID NO: 1156970 - protein, 9 aa, Homo Sapiens
CGFSEPLTF

SEQ ID NO: 1156971 - protein, 9 aa, Homo Sapiens
RKRLVRRRP

SEQ ID NO: 1156972 - protein, 9 aa, Homo Sapiens
CRETLRATH

SEQ ID NO: 1156973 - protein, 9 aa, Homo Sapiens
PYFESDFWP

SEQ ID NO: 1156974 - protein, 9 aa, Homo Sapiens
EEWFILYIA

SEQ ID NO: 1156975 - protein, 9 aa, Homo Sapiens
ISDYYTATS

SEQ ID NO: 1156976 - protein, 9 aa, Homo Sapiens
PRPSMPSRP

SEQ ID NO: 1156977 - protein, 9 aa, Homo Sapiens
IAKVKCGEC

SEQ ID NO: 1156978 - protein, 9 aa, Homo Sapiens
INGLIDFTI

SEQ ID NO: 1156979 - protein, 9 aa, Homo Sapiens
KIHMPAVLV

SEQ ID NO: 1156980 - protein, 9 aa, Homo Sapiens
EPVGRKRRR

SEQ ID NO: 1156981 - protein, 9 aa, Homo Sapiens
YCKKCNANG

SEQ ID NO: 1156982 - protein, 9 aa, Homo Sapiens
LREQISKYM

SEQ ID NO: 1156983 - protein, 9 aa, Homo Sapiens
REQYEEEME

SEQ ID NO: 1156984 - protein, 9 aa, Homo Sapiens
LCGDVCTHG

SEQ ID NO: 1156985 - protein, 9 aa, Homo Sapiens
WNKPLPSCI

SEQ ID NO: 1156986 - protein, 9 aa, Homo Sapiens
ICKGRSVSL

SEQ ID NO: 1156987 - protein, 9 aa, Homo Sapiens
NHKALQVLH

SEQ ID NO: 1156988 - protein, 9 aa, Homo Sapiens
ILNDETQYN

SEQ ID NO: 1156989 - protein, 9 aa, Homo Sapiens
TSVGVTRTK

SEQ ID NO: 1156990 - protein, 9 aa, Homo Sapiens
RNSEVWLIQ

SEQ ID NO: 1156991 - protein, 9 aa, Homo Sapiens
KALVSEGEG

SEQ ID NO: 1156992 - protein, 9 aa, Homo Sapiens
ATVQNNGKI

SEQ ID NO: 1156993 - protein, 9 aa, Homo Sapiens
NHRLHQELQ

SEQ ID NO: 1156994 - protein, 9 aa, Homo Sapiens
FNHILANTN

SEQ ID NO: 1156995 - protein, 9 aa, Homo Sapiens
ENHRLHQEL

SEQ ID NO: 1156996 - protein, 9 aa, Homo Sapiens
DQPRPLPTE

SEQ ID NO: 1156997 - protein, 9 aa, Homo Sapiens
KHLKDKADF

SEQ ID NO: 1156998 - protein, 9 aa, Homo Sapiens
ITSDMQDDF

SEQ ID NO: 1156999 - protein, 9 aa, Homo Sapiens
ADAYAARKL

SEQ ID NO: 1157000 - protein, 9 aa, Homo Sapiens
REETPFFSA

SEQ ID NO: 1157001 - protein, 9 aa, Homo Sapiens
VKLLNRNSE

SEQ ID NO: 1157002 - protein, 9 aa, Homo Sapiens
YSMQYVAYS

SEQ ID NO: 1157003 - protein, 9 aa, Homo Sapiens
APVKESDDK

SEQ ID NO: 1157004 - protein, 9 aa, Homo Sapiens
NFDNLGQGL

SEQ ID NO: 1157005 - protein, 9 aa, Homo Sapiens
TQFLLEMQL

SEQ ID NO: 1157006 - protein, 9 aa, Homo Sapiens
SAFPKGTAK

SEQ ID NO: 1157007 - protein, 9 aa, Homo Sapiens
TRSLLRECS

SEQ ID NO: 1157008 - protein, 9 aa, Homo Sapiens
KGSEAILTL

SEQ ID NO: 1157009 - protein, 9 aa, Homo Sapiens
ISPVLGLSP

SEQ ID NO: 1157010 - protein, 9 aa, Homo Sapiens
GASLSPSIS

SEQ ID NO: 1157011 - protein, 9 aa, Homo Sapiens
RSILQKTKG

SEQ ID NO: 1157012 - protein, 9 aa, Homo Sapiens
VERLFHEFT

SEQ ID NO: 1157013 - protein, 9 aa, Homo Sapiens
PPDPLFSHL

SEQ ID NO: 1157014 - protein, 9 aa, Homo Sapiens
VPNKSCRPH

SEQ ID NO: 1157015 - protein, 9 aa, Homo Sapiens
TILRSLMDA

SEQ ID NO: 1157016 - protein, 9 aa, Homo Sapiens
ANKEILYEA

SEQ ID NO: 1157017 - protein, 9 aa, Homo Sapiens
SNLTTHNKT

SEQ ID NO: 1157018 - protein, 9 aa, Homo Sapiens
NISVLQPKP

SEQ ID NO: 1157019 - protein, 9 aa, Homo Sapiens
LQHKDEFNA

SEQ ID NO: 1157020 - protein, 9 aa, Homo Sapiens
AQQQQLYGR

SEQ ID NO: 1157021 - protein, 9 aa, Homo Sapiens
NIIYSFFGL

SEQ ID NO: 1157022 - protein, 9 aa, Homo Sapiens
KFRRHRADN

SEQ ID NO: 1157023 - protein, 9 aa, Homo Sapiens
RLEALQLSF

SEQ ID NO: 1157024 - protein, 9 aa, Homo Sapiens
DPAYQKNAT

SEQ ID NO: 1157025 - protein, 9 aa, Homo Sapiens
QNIAWQLHH

SEQ ID NO: 1157026 - protein, 9 aa, Homo Sapiens
KTFQELLDS

SEQ ID NO: 1157027 - protein, 9 aa, Homo Sapiens
RERSISANS

SEQ ID NO: 1157028 - protein, 9 aa, Homo Sapiens
TRGLLPLHP

SEQ ID NO: 1157029 - protein, 9 aa, Homo Sapiens
SDYYTATSD

SEQ ID NO: 1157030 - protein, 9 aa, Homo Sapiens
SKEEWFILY

SEQ ID NO: 1157031 - protein, 9 aa, Homo Sapiens
LFHEFTISL

SEQ ID NO: 1157032 - protein, 9 aa, Homo Sapiens
VAATFSAEM

SEQ ID NO: 1157033 - protein, 9 aa, Homo Sapiens
EYFLNDEAS

SEQ ID NO: 1157034 - protein, 9 aa, Homo Sapiens
GHIRGKYSR

SEQ ID NO: 1157035 - protein, 9 aa, Homo Sapiens
AWQLHHLVS

SEQ ID NO: 1157036 - protein, 9 aa, Homo Sapiens
FRFNICALR

SEQ ID NO: 1157037 - protein, 9 aa, Homo Sapiens
ADTEEPTND

SEQ ID NO: 1157038 - protein, 9 aa, Homo Sapiens
KALRNSRDD

SEQ ID NO: 1157039 - protein, 9 aa, Homo Sapiens
SEPTIILFK

SEQ ID NO: 1157040 - protein, 9 aa, Homo Sapiens
GGNAGIADA

SEQ ID NO: 1157041 - protein, 9 aa, Homo Sapiens
FLEHRMNWA

SEQ ID NO: 1157042 - protein, 9 aa, Homo Sapiens
EAEKVMRDS

SEQ ID NO: 1157043 - protein, 9 aa, Homo Sapiens
STKSLNHEA

SEQ ID NO: 1157044 - protein, 9 aa, Homo Sapiens
ENGQPHGAP

SEQ ID NO: 1157045 - protein, 9 aa, Homo Sapiens
RRQRLALFL

SEQ ID NO: 1157046 - protein, 9 aa, Homo Sapiens
KLEKACISP

SEQ ID NO: 1157047 - protein, 9 aa, Homo Sapiens
GLTASALLL

SEQ ID NO: 1157048 - protein, 9 aa, Homo Sapiens
QPLYDCPVC

SEQ ID NO: 1157049 - protein, 9 aa, Homo Sapiens
NNECVRTLN

SEQ ID NO: 1157050 - protein, 9 aa, Homo Sapiens
VVITGANTS

SEQ ID NO: 1157051 - protein, 9 aa, Homo Sapiens
KVIHDFNTN

SEQ ID NO: 1157052 - protein, 9 aa, Homo Sapiens
AAAGGASGA

SEQ ID NO: 1157053 - protein, 9 aa, Homo Sapiens
QNVLGTALC

SEQ ID NO: 1157054 - protein, 9 aa, Homo Sapiens
TPAREVLPH

SEQ ID NO: 1157055 - protein, 9 aa, Homo Sapiens
YEAYVMAGV

SEQ ID NO: 1157056 - protein, 9 aa, Homo Sapiens
GKENGQPHG

SEQ ID NO: 1157057 - protein, 9 aa, Homo Sapiens
EVNQRYFRV

SEQ ID NO: 1157058 - protein, 9 aa, Homo Sapiens
ADCSRLHLI

SEQ ID NO: 1157059 - protein, 9 aa, Homo Sapiens
CANRHHDCN

SEQ ID NO: 1157060 - protein, 9 aa, Homo Sapiens
SLLKQTHPV

SEQ ID NO: 1157061 - protein, 9 aa, Homo Sapiens
HCDCEGGAD

SEQ ID NO: 1157062 - protein, 9 aa, Homo Sapiens
QNFSQDVTF

SEQ ID NO: 1157063 - protein, 9 aa, Homo Sapiens
KEMNVLKEW

SEQ ID NO: 1157064 - protein, 9 aa, Homo Sapiens
QGKALVSEG

SEQ ID NO: 1157065 - protein, 9 aa, Homo Sapiens
TWGFGHNHQ

SEQ ID NO: 1157066 - protein, 9 aa, Homo Sapiens
CLLVFEVIC

SEQ ID NO: 1157067 - protein, 9 aa, Homo Sapiens
QVLHCFPLD

SEQ ID NO: 1157068 - protein, 9 aa, Homo Sapiens
EDVECGSDR

SEQ ID NO: 1157069 - protein, 9 aa, Homo Sapiens
SNTVERLFH

SEQ ID NO: 1157070 - protein, 9 aa, Homo Sapiens
DTARQEDYD

SEQ ID NO: 1157071 - protein, 9 aa, Homo Sapiens
CGSTLGTKR

SEQ ID NO: 1157072 - protein, 9 aa, Homo Sapiens
CDSGTRMDS

SEQ ID NO: 1157073 - protein, 9 aa, Homo Sapiens
RLFHEFTIS

SEQ ID NO: 1157074 - protein, 9 aa, Homo Sapiens
FVSDRSMPS

SEQ ID NO: 1157075 - protein, 9 aa, Homo Sapiens
VPDLYHLLV

SEQ ID NO: 1157076 - protein, 9 aa, Homo Sapiens
EMQLEHAKQ

SEQ ID NO: 1157077 - protein, 9 aa, Homo Sapiens
PISESMLER

SEQ ID NO: 1157078 - protein, 9 aa, Homo Sapiens
VQNIAWQLH

SEQ ID NO: 1157079 - protein, 9 aa, Homo Sapiens
FQYCNQIIQ

SEQ ID NO: 1157080 - protein, 9 aa, Homo Sapiens
DVTFNSLVS

SEQ ID NO: 1157081 - protein, 9 aa, Homo Sapiens
YDRYVAIFH

SEQ ID NO: 1157082 - protein, 9 aa, Homo Sapiens
RRRDIDQAK

SEQ ID NO: 1157083 - protein, 9 aa, Homo Sapiens
LASMALDHY

SEQ ID NO: 1157084 - protein, 9 aa, Homo Sapiens
FSVKECYLK

SEQ ID NO: 1157085 - protein, 9 aa, Homo Sapiens
KAETSERLH

SEQ ID NO: 1157086 - protein, 9 aa, Homo Sapiens
ILQHKDEFN

SEQ ID NO: 1157087 - protein, 9 aa, Homo Sapiens
WSPVRLTVF

SEQ ID NO: 1157088 - protein, 9 aa, Homo Sapiens
NSEVWLIQK

SEQ ID NO: 1157089 - protein, 9 aa, Homo Sapiens
TIQLLNELS

SEQ ID NO: 1157090 - protein, 9 aa, Homo Sapiens
QNGSASTFP

SEQ ID NO: 1157091 - protein, 9 aa, Homo Sapiens
TTALQDPVV

SEQ ID NO: 1157092 - protein, 9 aa, Homo Sapiens
QFSVKECYL

SEQ ID NO: 1157093 - protein, 9 aa, Homo Sapiens
TPQEKVPAG

SEQ ID NO: 1157094 - protein, 9 aa, Homo Sapiens
PLLICGFGL

SEQ ID NO: 1157095 - protein, 9 aa, Homo Sapiens
LLKQMKSTF

SEQ ID NO: 1157096 - protein, 9 aa, Homo Sapiens
YCEDTFSQM

SEQ ID NO: 1157097 - protein, 9 aa, Homo Sapiens
DRYVAIFHP

SEQ ID NO: 1157098 - protein, 9 aa, Homo Sapiens
PSLGKMQQL

SEQ ID NO: 1157099 - protein, 9 aa, Homo Sapiens
DSILGEQTL

SEQ ID NO: 1157100 - protein, 9 aa, Homo Sapiens
HIEKDAQEF

SEQ ID NO: 1157101 - protein, 9 aa, Homo Sapiens
AIEWARNIP

SEQ ID NO: 1157102 - protein, 9 aa, Homo Sapiens
YVTCDEDYQ

SEQ ID NO: 1157103 - protein, 9 aa, Homo Sapiens
TLTVMGHGT

SEQ ID NO: 1157104 - protein, 9 aa, Homo Sapiens
PTIILFKRE

SEQ ID NO: 1157105 - protein, 9 aa, Homo Sapiens
REQQRVRCV

SEQ ID NO: 1157106 - protein, 9 aa, Homo Sapiens
LKQAPFRSP

SEQ ID NO: 1157107 - protein, 9 aa, Homo Sapiens
ELLKQMKST

SEQ ID NO: 1157108 - protein, 9 aa, Homo Sapiens
QTAKPTAVA

SEQ ID NO: 1157109 - protein, 9 aa, Homo Sapiens
SGDRRVWNK

SEQ ID NO: 1157110 - protein, 9 aa, Homo Sapiens
VRPESWASE

SEQ ID NO: 1157111 - protein, 9 aa, Homo Sapiens
ECSTSIATR

SEQ ID NO: 1157112 - protein, 9 aa, Homo Sapiens
YTGSDYQYI

SEQ ID NO: 1157113 - protein, 9 aa, Homo Sapiens
RILQHKDEF

SEQ ID NO: 1157114 - protein, 9 aa, Homo Sapiens
TGHRISATA

SEQ ID NO: 1157115 - protein, 9 aa, Homo Sapiens
DTSKEEWFI

SEQ ID NO: 1157116 - protein, 9 aa, Homo Sapiens
LYEAYVMAG

SEQ ID NO: 1157117 - protein, 9 aa, Homo Sapiens
RQSTRIADE

SEQ ID NO: 1157118 - protein, 9 aa, Homo Sapiens
DEPPGPGGW

SEQ ID NO: 1157119 - protein, 9 aa, Homo Sapiens
IYLDDLLPK

SEQ ID NO: 1157120 - protein, 9 aa, Homo Sapiens
SGDYVVMFV

SEQ ID NO: 1157121 - protein, 9 aa, Homo Sapiens
QFFNYSVID

SEQ ID NO: 1157122 - protein, 9 aa, Homo Sapiens
EPTIILFKR

SEQ ID NO: 1157123 - protein, 9 aa, Homo Sapiens
RHTINKITF

SEQ ID NO: 1157124 - protein, 9 aa, Homo Sapiens
GSEAILTLT

SEQ ID NO: 1157125 - protein, 9 aa, Homo Sapiens
STNTAYQQQ

SEQ ID NO: 1157126 - protein, 9 aa, Homo Sapiens
ECVRTLNAH

SEQ ID NO: 1157127 - protein, 9 aa, Homo Sapiens
ISQPKPVID

SEQ ID NO: 1157128 - protein, 9 aa, Homo Sapiens
EPEVGEKEE

SEQ ID NO: 1157129 - protein, 9 aa, Homo Sapiens
IYNEFHGTK

SEQ ID NO: 1157130 - protein, 9 aa, Homo Sapiens
NNVKVIHDF

SEQ ID NO: 1157131 - protein, 9 aa, Homo Sapiens
SAHMTETCS

SEQ ID NO: 1157132 - protein, 9 aa, Homo Sapiens
SYSGDNVAA

SEQ ID NO: 1157133 - protein, 9 aa, Homo Sapiens
SLPVTNTSS

SEQ ID NO: 1157134 - protein, 9 aa, Homo Sapiens
NSDPTVRGN

SEQ ID NO: 1157135 - protein, 9 aa, Homo Sapiens
SKDSKWVTV

SEQ ID NO: 1157136 - protein, 9 aa, Homo Sapiens
TISLNLCEQ

SEQ ID NO: 1157137 - protein, 9 aa, Homo Sapiens
ILTGLIYLD

SEQ ID NO: 1157138 - protein, 9 aa, Homo Sapiens
TLAVTDDKV

SEQ ID NO: 1157139 - protein, 9 aa, Homo Sapiens
GLCRKLEKA

SEQ ID NO: 1157140 - protein, 9 aa, Homo Sapiens
RSLLRECST

SEQ ID NO: 1157141 - protein, 9 aa, Homo Sapiens
VTGLECATL

SEQ ID NO: 1157142 - protein, 9 aa, Homo Sapiens
MSGSTKSLN

SEQ ID NO: 1157143 - protein, 9 aa, Homo Sapiens
GVILCRGGG

SEQ ID NO: 1157144 - protein, 9 aa, Homo Sapiens
QKNTIVDFF

SEQ ID NO: 1157145 - protein, 9 aa, Homo Sapiens
GLSSRRRQR

SEQ ID NO: 1157146 - protein, 9 aa, Homo Sapiens
LQKTKGQES

SEQ ID NO: 1157147 - protein, 9 aa, Homo Sapiens
LSHRIKSFD

SEQ ID NO: 1157148 - protein, 9 aa, Homo Sapiens
EEKESWSTS

SEQ ID NO: 1157149 - protein, 9 aa, Homo Sapiens
LDDKLLYIP

SEQ ID NO: 1157150 - protein, 9 aa, Homo Sapiens
FCSGRKRLV

SEQ ID NO: 1157151 - protein, 9 aa, Homo Sapiens
RRPLLICGF

SEQ ID NO: 1157152 - protein, 9 aa, Homo Sapiens
SPVLGLSPA

SEQ ID NO: 1157153 - protein, 9 aa, Homo Sapiens
AAWTKMPVC

SEQ ID NO: 1157154 - protein, 9 aa, Homo Sapiens
EMNVLKEWL

SEQ ID NO: 1157155 - protein, 9 aa, Homo Sapiens
FFLCSNGVY

SEQ ID NO: 1157156 - protein, 9 aa, Homo Sapiens
RCNLREQIS

SEQ ID NO: 1157157 - protein, 9 aa, Homo Sapiens
LTTHNKTHT

SEQ ID NO: 1157158 - protein, 9 aa, Homo Sapiens
QGVINLAFE

SEQ ID NO: 1157159 - protein, 9 aa, Homo Sapiens
EHEYLPPSA

SEQ ID NO: 1157160 - protein, 9 aa, Homo Sapiens
QGLSSRRRQ

SEQ ID NO: 1157161 - protein, 9 aa, Homo Sapiens
QFEYSDSSC

SEQ ID NO: 1157162 - protein, 9 aa, Homo Sapiens
LAAAAAAAG

SEQ ID NO: 1157163 - protein, 9 aa, Homo Sapiens
TYMGRVDAV

SEQ ID NO: 1157164 - protein, 9 aa, Homo Sapiens
CPLTNPDNM

SEQ ID NO: 1157165 - protein, 9 aa, Homo Sapiens
TSGDYVVMF

SEQ ID NO: 1157166 - protein, 9 aa, Homo Sapiens
RSRTMAGGL

SEQ ID NO: 1157167 - protein, 9 aa, Homo Sapiens
FFSANRLRF

SEQ ID NO: 1157168 - protein, 9 aa, Homo Sapiens
DRSMPSELE

SEQ ID NO: 1157169 - protein, 9 aa, Homo Sapiens
LHNLAPSTH

SEQ ID NO: 1157170 - protein, 9 aa, Homo Sapiens
GADAFLEHR

SEQ ID NO: 1157171 - protein, 9 aa, Homo Sapiens
KRCNLREQI

SEQ ID NO: 1157172 - protein, 9 aa, Homo Sapiens
RIDPIRSRT

SEQ ID NO: 1157173 - protein, 9 aa, Homo Sapiens
SSLPPTLTT

SEQ ID NO: 1157174 - protein, 9 aa, Homo Sapiens
YLPPSASAR

SEQ ID NO: 1157175 - protein, 9 aa, Homo Sapiens
IYSFFGLAP

SEQ ID NO: 1157176 - protein, 9 aa, Homo Sapiens
VSDRSMPSE

SEQ ID NO: 1157177 - protein, 9 aa, Homo Sapiens
LEAEKVMRD

SEQ ID NO: 1157178 - protein, 9 aa, Homo Sapiens
PGTGEEVQG

SEQ ID NO: 1157179 - protein, 9 aa, Homo Sapiens
AVLVANLCD

SEQ ID NO: 1157180 - protein, 9 aa, Homo Sapiens
FVIGWEKPG

SEQ ID NO: 1157181 - protein, 9 aa, Homo Sapiens
TSNSDPTVR

SEQ ID NO: 1157182 - protein, 9 aa, Homo Sapiens
RIKSDPTLL

SEQ ID NO: 1157183 - protein, 9 aa, Homo Sapiens
NSRDDKKPI

SEQ ID NO: 1157184 - protein, 9 aa, Homo Sapiens
QHFVPASFR

SEQ ID NO: 1157185 - protein, 9 aa, Homo Sapiens
LKQTHPVQS

SEQ ID NO: 1157186 - protein, 9 aa, Homo Sapiens
AEKVMRDSM

SEQ ID NO: 1157187 - protein, 9 aa, Homo Sapiens
LSAIEVDIP

SEQ ID NO: 1157188 - protein, 9 aa, Homo Sapiens
SDEPEISDY

SEQ ID NO: 1157189 - protein, 9 aa, Homo Sapiens
VIGHKFMAT

SEQ ID NO: 1157190 - protein, 9 aa, Homo Sapiens
ASYQKALRN

SEQ ID NO: 1157191 - protein, 9 aa, Homo Sapiens
ILASMALDH

SEQ ID NO: 1157192 - protein, 9 aa, Homo Sapiens
RSRLSAIEV

SEQ ID NO: 1157193 - protein, 9 aa, Homo Sapiens
SEEEQNVDL

SEQ ID NO: 1157194 - protein, 9 aa, Homo Sapiens
LYRIIQHFV

SEQ ID NO: 1157195 - protein, 9 aa, Homo Sapiens
KSCRPHGSK

SEQ ID NO: 1157196 - protein, 9 aa, Homo Sapiens
VIHDFNTNK

SEQ ID NO: 1157197 - protein, 9 aa, Homo Sapiens
EEMGETQFE

SEQ ID NO: 1157198 - protein, 9 aa, Homo Sapiens
AVNNVKVIH

SEQ ID NO: 1157199 - protein, 9 aa, Homo Sapiens
ERLHTVLLD

SEQ ID NO: 1157200 - protein, 9 aa, Homo Sapiens
NLREQISKY

SEQ ID NO: 1157201 - protein, 9 aa, Homo Sapiens
YFESDFWPN

SEQ ID NO: 1157202 - protein, 9 aa, Homo Sapiens
NGQTEYFLN

SEQ ID NO: 1157203 - protein, 9 aa, Homo Sapiens
GSDYQYIGK

SEQ ID NO: 1157204 - protein, 9 aa, Homo Sapiens
QRVPCSSPR

SEQ ID NO: 1157205 - protein, 9 aa, Homo Sapiens
MEHRTDWVN

SEQ ID NO: 1157206 - protein, 9 aa, Homo Sapiens
LLICGFGLM

SEQ ID NO: 1157207 - protein, 9 aa, Homo Sapiens
ANRLRFGCK

SEQ ID NO: 1157208 - protein, 9 aa, Homo Sapiens
FRAALFALP

SEQ ID NO: 1157209 - protein, 9 aa, Homo Sapiens
YFRVDLDSG

SEQ ID NO: 1157210 - protein, 9 aa, Homo Sapiens
SGPRPPAAL

SEQ ID NO: 1157211 - protein, 9 aa, Homo Sapiens
LEMQLEHAK

SEQ ID NO: 1157212 - protein, 9 aa, Homo Sapiens
GLIRHTINK

SEQ ID NO: 1157213 - protein, 9 aa, Homo Sapiens
WGLKSKRAE

SEQ ID NO: 1157214 - protein, 9 aa, Homo Sapiens
WRVAGPGPR

SEQ ID NO: 1157215 - protein, 9 aa, Homo Sapiens
DFTIQLLNE

SEQ ID NO: 1157216 - protein, 9 aa, Homo Sapiens
DRFNHILAN

SEQ ID NO: 1157217 - protein, 9 aa, Homo Sapiens
HFVPASFRL

SEQ ID NO: 1157218 - protein, 9 aa, Homo Sapiens
NEKLFKCGS

SEQ ID NO: 1157219 - protein, 9 aa, Homo Sapiens
RNFQERLIH

SEQ ID NO: 1157220 - protein, 9 aa, Homo Sapiens
GSSQDALMY

SEQ ID NO: 1157221 - protein, 9 aa, Homo Sapiens
LQDPVVSPR

SEQ ID NO: 1157222 - protein, 9 aa, Homo Sapiens
MLHTLERIK

SEQ ID NO: 1157223 - protein, 9 aa, Homo Sapiens
DPVLYLLIG

SEQ ID NO: 1157224 - protein, 9 aa, Homo Sapiens
LLIGDKYRR

SEQ ID NO: 1157225 - protein, 9 aa, Homo Sapiens
LIRHTINKI

SEQ ID NO: 1157226 - protein, 9 aa, Homo Sapiens
YIGKLHSDQ

SEQ ID NO: 1157227 - protein, 9 aa, Homo Sapiens
CKRKQCRET

SEQ ID NO: 1157228 - protein, 9 aa, Homo Sapiens
PLGPAVINI

SEQ ID NO: 1157229 - protein, 9 aa, Homo Sapiens
LEESRDQPR

SEQ ID NO: 1157230 - protein, 9 aa, Homo Sapiens
KVMRDSMQG

SEQ ID NO: 1157231 - protein, 9 aa, Homo Sapiens
ADGLCRKLE

SEQ ID NO: 1157232 - protein, 9 aa, Homo Sapiens
ASMEHRTDW

SEQ ID NO: 1157233 - protein, 9 aa, Homo Sapiens
VGRKRRRKA

SEQ ID NO: 1157234 - protein, 9 aa, Homo Sapiens
WVTVSDLKI

SEQ ID NO: 1157235 - protein, 9 aa, Homo Sapiens
GVNPVYNEE

SEQ ID NO: 1157236 - protein, 9 aa, Homo Sapiens
PPKFVNKLE

SEQ ID NO: 1157237 - protein, 9 aa, Homo Sapiens
GGKENGQPH

SEQ ID NO: 1157238 - protein, 9 aa, Homo Sapiens
GWSFSAYWH

SEQ ID NO: 1157239 - protein, 9 aa, Homo Sapiens
KALQVLHCF

SEQ ID NO: 1157240 - protein, 9 aa, Homo Sapiens
QEEEKESWS

SEQ ID NO: 1157241 - protein, 9 aa, Homo Sapiens
GLWVIYATV

SEQ ID NO: 1157242 - protein, 9 aa, Homo Sapiens
VRLTVFFTT

SEQ ID NO: 1157243 - protein, 9 aa, Homo Sapiens
ARHNALSTC

SEQ ID NO: 1157244 - protein, 9 aa, Homo Sapiens
CIKTHESSQ

SEQ ID NO: 1157245 - protein, 9 aa, Homo Sapiens
LLQAVPNKS

SEQ ID NO: 1157246 - protein, 9 aa, Homo Sapiens
ANGSSQDAL

SEQ ID NO: 1157247 - protein, 9 aa, Homo Sapiens
LSQNGSAST

SEQ ID NO: 1157248 - protein, 9 aa, Homo Sapiens
FLLEMQLEH

SEQ ID NO: 1157249 - protein, 9 aa, Homo Sapiens
KYELLKQMK

SEQ ID NO: 1157250 - protein, 9 aa, Homo Sapiens
EFIKELLGC

SEQ ID NO: 1157251 - protein, 9 aa, Homo Sapiens
AYSMQYVAY

SEQ ID NO: 1157252 - protein, 9 aa, Homo Sapiens
EYLPPSASA

SEQ ID NO: 1157253 - protein, 9 aa, Homo Sapiens
SHFTNQYMQ

SEQ ID NO: 1157254 - protein, 9 aa, Homo Sapiens
EEEMEAKAE

SEQ ID NO: 1157255 - protein, 9 aa, Homo Sapiens
TPHLEMRFL

SEQ ID NO: 1157256 - protein, 9 aa, Homo Sapiens
RLHQELQDA

SEQ ID NO: 1157257 - protein, 9 aa, Homo Sapiens
ILCRGGGPW

SEQ ID NO: 1157258 - protein, 9 aa, Homo Sapiens
PYVTCDEDY

SEQ ID NO: 1157259 - protein, 9 aa, Homo Sapiens
VLKTFQELL

SEQ ID NO: 1157260 - protein, 9 aa, Homo Sapiens
PPRETWGFG

SEQ ID NO: 1157261 - protein, 9 aa, Homo Sapiens
RCVIAGQGA

SEQ ID NO: 1157262 - protein, 9 aa, Homo Sapiens
ATSLPVTNT

SEQ ID NO: 1157263 - protein, 9 aa, Homo Sapiens
RRRKAAKAQ

SEQ ID NO: 1157264 - protein, 9 aa, Homo Sapiens
IASMEHRTD

SEQ ID NO: 1157265 - protein, 9 aa, Homo Sapiens
ICSEEEQNV

SEQ ID NO: 1157266 - protein, 9 aa, Homo Sapiens
LCDKLCPDS

SEQ ID NO: 1157267 - protein, 9 aa, Homo Sapiens
GAAWTKMPV

SEQ ID NO: 1157268 - protein, 9 aa, Homo Sapiens
NVKVIHDFN

SEQ ID NO: 1157269 - protein, 9 aa, Homo Sapiens
ERSISANSF

SEQ ID NO: 1157270 - protein, 9 aa, Homo Sapiens
KNTIVDFFA

SEQ ID NO: 1157271 - protein, 9 aa, Homo Sapiens
CEDTFSQME

SEQ ID NO: 1157272 - protein, 9 aa, Homo Sapiens
QNVDLTKSH

SEQ ID NO: 1157273 - protein, 9 aa, Homo Sapiens
AVTQRFRKD

SEQ ID NO: 1157274 - protein, 9 aa, Homo Sapiens
VPSPPPRET

SEQ ID NO: 1157275 - protein, 9 aa, Homo Sapiens
NAHEDKVWG

SEQ ID NO: 1157276 - protein, 9 aa, Homo Sapiens
IRHTINKIT

SEQ ID NO: 1157277 - protein, 9 aa, Homo Sapiens
SDRSMPSEL

SEQ ID NO: 1157278 - protein, 9 aa, Homo Sapiens
GILKQAPFR

SEQ ID NO: 1157279 - protein, 9 aa, Homo Sapiens
SEKDHSDAE

SEQ ID NO: 1157280 - protein, 9 aa, Homo Sapiens
FRLPLSDWL

SEQ ID NO: 1157281 - protein, 9 aa, Homo Sapiens
GMPLIDGRR

SEQ ID NO: 1157282 - protein, 9 aa, Homo Sapiens
EQNVDLTKS

SEQ ID NO: 1157283 - protein, 9 aa, Homo Sapiens
LRTISLNLC

SEQ ID NO: 1157284 - protein, 9 aa, Homo Sapiens
VFHRDGHCG

SEQ ID NO: 1157285 - protein, 9 aa, Homo Sapiens
QTLAVTDDK

SEQ ID NO: 1157286 - protein, 9 aa, Homo Sapiens
GSLLWRVAG

SEQ ID NO: 1157287 - protein, 9 aa, Homo Sapiens
QSTRIADEA

SEQ ID NO: 1157288 - protein, 9 aa, Homo Sapiens
HKDEFNADH

SEQ ID NO: 1157289 - protein, 9 aa, Homo Sapiens
VVATVPDLY

SEQ ID NO: 1157290 - protein, 9 aa, Homo Sapiens
TQGVLGGSR

SEQ ID NO: 1157291 - protein, 9 aa, Homo Sapiens
NASAFPKGT

SEQ ID NO: 1157292 - protein, 9 aa, Homo Sapiens
SRDQPRPLP

SEQ ID NO: 1157293 - protein, 9 aa, Homo Sapiens
YVAIFHPLH

SEQ ID NO: 1157294 - protein, 9 aa, Homo Sapiens
GTKRGTHFS

SEQ ID NO: 1157295 - protein, 9 aa, Homo Sapiens
QMEELEKHV

SEQ ID NO: 1157296 - protein, 9 aa, Homo Sapiens
ALQVLHCFP

SEQ ID NO: 1157297 - protein, 9 aa, Homo Sapiens
CRKLEKACI

SEQ ID NO: 1157298 - protein, 9 aa, Homo Sapiens
CDKKKQEEL

SEQ ID NO: 1157299 - protein, 9 aa, Homo Sapiens
NVDLTKSHT

SEQ ID NO: 1157300 - protein, 9 aa, Homo Sapiens
EREQQRVRC

SEQ ID NO: 1157301 - protein, 9 aa, Homo Sapiens
TTSYSGDNV

SEQ ID NO: 1157302 - protein, 9 aa, Homo Sapiens
QDVTFNSLV

SEQ ID NO: 1157303 - protein, 9 aa, Homo Sapiens
TVFFGAFAM

SEQ ID NO: 1157304 - protein, 9 aa, Homo Sapiens
QTPVTKEGE

SEQ ID NO: 1157305 - protein, 9 aa, Homo Sapiens
AAAAGGASG

SEQ ID NO: 1157306 - protein, 9 aa, Homo Sapiens
VTGHRISAT

SEQ ID NO: 1157307 - protein, 9 aa, Homo Sapiens
GSASTFPLC

SEQ ID NO: 1157308 - protein, 9 aa, Homo Sapiens
AFPKGTAKT

SEQ ID NO: 1157309 - protein, 9 aa, Homo Sapiens
SNGVYKGFP

SEQ ID NO: 1157310 - protein, 9 aa, Homo Sapiens
LGEQTLAVT

SEQ ID NO: 1157311 - protein, 9 aa, Homo Sapiens
PQQFQGVIN

SEQ ID NO: 1157312 - protein, 9 aa, Homo Sapiens
VTFNSLVSE

SEQ ID NO: 1157313 - protein, 9 aa, Homo Sapiens
LCRKLEKAC

SEQ ID NO: 1157314 - protein, 9 aa, Homo Sapiens
SGLFFLCSN

SEQ ID NO: 1157315 - protein, 9 aa, Homo Sapiens
LKSNEKLFK

SEQ ID NO: 1157316 - protein, 9 aa, Homo Sapiens
VITGANTSI

SEQ ID NO: 1157317 - protein, 9 aa, Homo Sapiens
SGHIRGKYS

SEQ ID NO: 1157318 - protein, 9 aa, Homo Sapiens
VTEPPKFVN

SEQ ID NO: 1157319 - protein, 9 aa, Homo Sapiens
SQKNTIVDF

SEQ ID NO: 1157320 - protein, 9 aa, Homo Sapiens
TWERRRDID

SEQ ID NO: 1157321 - protein, 9 aa, Homo Sapiens
LRECSTSIA

SEQ ID NO: 1157322 - protein, 9 aa, Homo Sapiens
FTNISVLQP

SEQ ID NO: 1157323 - protein, 9 aa, Homo Sapiens
DSGTRMDSR

SEQ ID NO: 1157324 - protein, 9 aa, Homo Sapiens
TIILFKRED

SEQ ID NO: 1157325 - protein, 9 aa, Homo Sapiens
WATYMGRVD

SEQ ID NO: 1157326 - protein, 9 aa, Homo Sapiens
RSLMDAVPL

SEQ ID NO: 1157327 - protein, 9 aa, Homo Sapiens
AILTLTTAG

SEQ ID NO: 1157328 - protein, 9 aa, Homo Sapiens
IEKDAQEFL

SEQ ID NO: 1157329 - protein, 9 aa, Homo Sapiens
LDPVLYLLI

SEQ ID NO: 1157330 - protein, 9 aa, Homo Sapiens
VAIFHPLHY

SEQ ID NO: 1157331 - protein, 9 aa, Homo Sapiens
LSGKLLQTP

SEQ ID NO: 1157332 - protein, 9 aa, Homo Sapiens
HMPAVLVAN

SEQ ID NO: 1157333 - protein, 9 aa, Homo Sapiens
SAAAAVTGL

SEQ ID NO: 1157334 - protein, 9 aa, Homo Sapiens
FGCKRKQCR

SEQ ID NO: 1157335 - protein, 9 aa, Homo Sapiens
ILFKREDFK

SEQ ID NO: 1157336 - protein, 9 aa, Homo Sapiens
QEFLDKQVC

SEQ ID NO: 1157337 - protein, 9 aa, Homo Sapiens
PLSHRIKSF

SEQ ID NO: 1157338 - protein, 9 aa, Homo Sapiens
FWGLKSKRA

SEQ ID NO: 1157339 - protein, 9 aa, Homo Sapiens
SLTLLHNNM

SEQ ID NO: 1157340 - protein, 9 aa, Homo Sapiens
GTALCGDVC

SEQ ID NO: 1157341 - protein, 9 aa, Homo Sapiens
AAWSPVRLT

SEQ ID NO: 1157342 - protein, 9 aa, Homo Sapiens
HPGGKENGQ

SEQ ID NO: 1157343 - protein, 9 aa, Homo Sapiens
NVAATFSAE

SEQ ID NO: 1157344 - protein, 9 aa, Homo Sapiens
LALWDTARQ

SEQ ID NO: 1157345 - protein, 9 aa, Homo Sapiens
QTEYFLNDE

SEQ ID NO: 1157346 - protein, 9 aa, Homo Sapiens
QRRSCDSGT

SEQ ID NO: 1157347 - protein, 9 aa, Homo Sapiens
TCSKSFDYG

SEQ ID NO: 1157348 - protein, 9 aa, Homo Sapiens
SSRRRQRLA

SEQ ID NO: 1157349 - protein, 9 aa, Homo Sapiens
LTGLIYLDD

SEQ ID NO: 1157350 - protein, 9 aa, Homo Sapiens
RETWGFGHN

SEQ ID NO: 1157351 - protein, 9 aa, Homo Sapiens
RGSAAAAVT

SEQ ID NO: 1157352 - protein, 9 aa, Homo Sapiens
SDRYRGERN

SEQ ID NO: 1157353 - protein, 9 aa, Homo Sapiens
LQILTGLIY

SEQ ID NO: 1157354 - protein, 9 aa, Homo Sapiens
AENHRLHQE

SEQ ID NO: 1157355 - protein, 9 aa, Homo Sapiens
HSAEPGYLL

SEQ ID NO: 1157356 - protein, 9 aa, Homo Sapiens
RDQPRPLPT

SEQ ID NO: 1157357 - protein, 9 aa, Homo Sapiens
ARSQKNTIV

SEQ ID NO: 1157358 - protein, 9 aa, Homo Sapiens
YLLIGDKYR

SEQ ID NO: 1157359 - protein, 9 aa, Homo Sapiens
NKGSEAILT

SEQ ID NO: 1157360 - protein, 9 aa, Homo Sapiens
CGSDRCNIL

SEQ ID NO: 1157361 - protein, 9 aa, Homo Sapiens
QGAAWTKMP

SEQ ID NO: 1157362 - protein, 9 aa, Homo Sapiens
GTRGLLPLH

SEQ ID NO: 1157363 - protein, 9 aa, Homo Sapiens
LVVATSVGV

SEQ ID NO: 1157364 - protein, 9 aa, Homo Sapiens
HRISFRLPL

SEQ ID NO: 1157365 - protein, 9 aa, Homo Sapiens
RMVMNNGVN

SEQ ID NO: 1157366 - protein, 9 aa, Homo Sapiens
IFEHVTQHK

SEQ ID NO: 1157367 - protein, 9 aa, Homo Sapiens
LHCDCEGGA

SEQ ID NO: 1157368 - protein, 9 aa, Homo Sapiens
GLFFLCSNG

SEQ ID NO: 1157369 - protein, 9 aa, Homo Sapiens
IQHFVPASF

SEQ ID NO: 1157370 - protein, 9 aa, Homo Sapiens
ISANSFDQR

SEQ ID NO: 1157371 - protein, 9 aa, Homo Sapiens
DKLLYIPLA

SEQ ID NO: 1157372 - protein, 9 aa, Homo Sapiens
CEGGADCDP

SEQ ID NO: 1157373 - protein, 9 aa, Homo Sapiens
VHIRGVSMA

SEQ ID NO: 1157374 - protein, 9 aa, Homo Sapiens
PLLLKRNIH

SEQ ID NO: 1157375 - protein, 9 aa, Homo Sapiens
HRTDWVNDI

SEQ ID NO: 1157376 - protein, 9 aa, Homo Sapiens
KISQPKPVI

SEQ ID NO: 1157377 - protein, 9 aa, Homo Sapiens
SMEHRTDWV

SEQ ID NO: 1157378 - protein, 9 aa, Homo Sapiens
NVKLVCDIL

SEQ ID NO: 1157379 - protein, 9 aa, Homo Sapiens
RPSTKSDGH

SEQ ID NO: 1157380 - protein, 9 aa, Homo Sapiens
DYVVMFVYF

SEQ ID NO: 1157381 - protein, 9 aa, Homo Sapiens
EAENHRLHQ

SEQ ID NO: 1157382 - protein, 9 aa, Homo Sapiens
IHDFNTNKC

SEQ ID NO: 1157383 - protein, 9 aa, Homo Sapiens
AIEVDIPVV

SEQ ID NO: 1157384 - protein, 9 aa, Homo Sapiens
ISLNLCEQL

SEQ ID NO: 1157385 - protein, 9 aa, Homo Sapiens
MKSVFDMKR

SEQ ID NO: 1157386 - protein, 9 aa, Homo Sapiens
AWSPVRLTV

SEQ ID NO: 1157387 - protein, 9 aa, Homo Sapiens
PSMPSRPST

SEQ ID NO: 1157388 - protein, 9 aa, Homo Sapiens
VTREQGVIL

SEQ ID NO: 1157389 - protein, 9 aa, Homo Sapiens
HQELQDARD

SEQ ID NO: 1157390 - protein, 9 aa, Homo Sapiens
LHNNMIALK

SEQ ID NO: 1157391 - protein, 9 aa, Homo Sapiens
IKELLGCGC

SEQ ID NO: 1157392 - protein, 9 aa, Homo Sapiens
QQQYEEQQK

SEQ ID NO: 1157393 - protein, 9 aa, Homo Sapiens
LSPSISEPD

SEQ ID NO: 1157394 - protein, 9 aa, Homo Sapiens
SSPKYSLYQ

SEQ ID NO: 1157395 - protein, 9 aa, Homo Sapiens
NANGSSQDA

SEQ ID NO: 1157396 - protein, 9 aa, Homo Sapiens
TSKEEWFIL

SEQ ID NO: 1157397 - protein, 9 aa, Homo Sapiens
GTGEEVQGK

SEQ ID NO: 1157398 - protein, 9 aa, Homo Sapiens
SGKLLQTPV

SEQ ID NO: 1157399 - protein, 9 aa, Homo Sapiens
RAIAITSDM

SEQ ID NO: 1157400 - protein, 9 aa, Homo Sapiens
ASTFPLCAM

SEQ ID NO: 1157401 - protein, 9 aa, Homo Sapiens
AAQQQQLYG

SEQ ID NO: 1157402 - protein, 9 aa, Homo Sapiens
SCDSGTRMD

SEQ ID NO: 1157403 - protein, 9 aa, Homo Sapiens
PTAVAPVKE

SEQ ID NO: 1157404 - protein, 9 aa, Homo Sapiens
SLLWRVAGP

SEQ ID NO: 1157405 - protein, 9 aa, Homo Sapiens
GKLLQTPVT

SEQ ID NO: 1157406 - protein, 9 aa, Homo Sapiens
KEWLAATDM

SEQ ID NO: 1157407 - protein, 9 aa, Homo Sapiens
KDFRAIAIT

SEQ ID NO: 1157408 - protein, 9 aa, Homo Sapiens
GLKSKRAEL

SEQ ID NO: 1157409 - protein, 9 aa, Homo Sapiens
SKKPLRTIS

SEQ ID NO: 1157410 - protein, 9 aa, Homo Sapiens
FHCSSYLTK

SEQ ID NO: 1157411 - protein, 9 aa, Homo Sapiens
GVKFRRHRA

SEQ ID NO: 1157412 - protein, 9 aa, Homo Sapiens
IRGKYSRHR

SEQ ID NO: 1157413 - protein, 9 aa, Homo Sapiens
CARPLSHRI

SEQ ID NO: 1157414 - protein, 9 aa, Homo Sapiens
RQRLALFLA

SEQ ID NO: 1157415 - protein, 9 aa, Homo Sapiens
PEEMGETQF

SEQ ID NO: 1157416 - protein, 9 aa, Homo Sapiens
TVRGNSIFN

SEQ ID NO: 1157417 - protein, 9 aa, Homo Sapiens
GDPAYQKNA

SEQ ID NO: 1157418 - protein, 9 aa, Homo Sapiens
RQEDYDRLR

SEQ ID NO: 1157419 - protein, 9 aa, Homo Sapiens
ATVPDLYHL

SEQ ID NO: 1157420 - protein, 9 aa, Homo Sapiens
ISFRLPLSD

SEQ ID NO: 1157421 - protein, 9 aa, Homo Sapiens
GETQFEYSD

SEQ ID NO: 1157422 - protein, 9 aa, Homo Sapiens
AVTGLECAT

SEQ ID NO: 1157423 - protein, 9 aa, Homo Sapiens
IDFTIQLLN

SEQ ID NO: 1157424 - protein, 9 aa, Homo Sapiens
RRKAAKAQL

SEQ ID NO: 1157425 - protein, 9 aa, Homo Sapiens
AITSDMQDD

SEQ ID NO: 1157426 - protein, 9 aa, Homo Sapiens
PLRTISLNL

SEQ ID NO: 1157427 - protein, 9 aa, Homo Sapiens
STLGTKRGT

SEQ ID NO: 1157428 - protein, 9 aa, Homo Sapiens
GSTGSLLWR

SEQ ID NO: 1157429 - protein, 9 aa, Homo Sapiens
LYLLIGDKY

SEQ ID NO: 1157430 - protein, 9 aa, Homo Sapiens
IGKVVEGMP

SEQ ID NO: 1157431 - protein, 9 aa, Homo Sapiens
PKFVNKLEA

SEQ ID NO: 1157432 - protein, 9 aa, Homo Sapiens
EDLRDEYDF

SEQ ID NO: 1157433 - protein, 9 aa, Homo Sapiens
RGRCSLCDK

SEQ ID NO: 1157434 - protein, 9 aa, Homo Sapiens
DRTRVQSKF

SEQ ID NO: 1157435 - protein, 9 aa, Homo Sapiens
RPSLRLKIS

SEQ ID NO: 1157436 - protein, 9 aa, Homo Sapiens
HHQHQTQGV

SEQ ID NO: 1157437 - protein, 9 aa, Homo Sapiens
GEEVQGKVK

SEQ ID NO: 1157438 - protein, 9 aa, Homo Sapiens
HTVLLDVTD

SEQ ID NO: 1157439 - protein, 9 aa, Homo Sapiens
AQSGQDSVP

SEQ ID NO: 1157440 - protein, 9 aa, Homo Sapiens
PHSAEPGYL

SEQ ID NO: 1157441 - protein, 9 aa, Homo Sapiens
RISFRLPLS

SEQ ID NO: 1157442 - protein, 9 aa, Homo Sapiens
SKFRYPFYY

SEQ ID NO: 1157443 - protein, 9 aa, Homo Sapiens
WFILYIASD

SEQ ID NO: 1157444 - protein, 9 aa, Homo Sapiens
ILYIASDEA

SEQ ID NO: 1157445 - protein, 9 aa, Homo Sapiens
VFEVICILP

SEQ ID NO: 1157446 - protein, 9 aa, Homo Sapiens
HSDAEEEPE

SEQ ID NO: 1157447 - protein, 9 aa, Homo Sapiens
MPSRPSTKS

SEQ ID NO: 1157448 - protein, 9 aa, Homo Sapiens
SLLRECSTS

SEQ ID NO: 1157449 - protein, 9 aa, Homo Sapiens
RNIHYTHLT

SEQ ID NO: 1157450 - protein, 9 aa, Homo Sapiens
YEEEMEAKA

SEQ ID NO: 1157451 - protein, 9 aa, Homo Sapiens
LQTPVTKEG

SEQ ID NO: 1157452 - protein, 9 aa, Homo Sapiens
SRPSTKSDG

SEQ ID NO: 1157453 - protein, 9 aa, Homo Sapiens
EPEISDYYT

SEQ ID NO: 1157454 - protein, 9 aa, Homo Sapiens
ICALRLWSL

SEQ ID NO: 1157455 - protein, 9 aa, Homo Sapiens
TIIGAATAQ

SEQ ID NO: 1157456 - protein, 9 aa, Homo Sapiens
MGHGTPPLS

SEQ ID NO: 1157457 - protein, 9 aa, Homo Sapiens
DHSDAEEEP

SEQ ID NO: 1157458 - protein, 9 aa, Homo Sapiens
PESWASEDY

SEQ ID NO: 1157459 - protein, 9 aa, Homo Sapiens
PKFQKPKHL

SEQ ID NO: 1157460 - protein, 9 aa, Homo Sapiens
SILGEQTLA

SEQ ID NO: 1157461 - protein, 9 aa, Homo Sapiens
RPLLICGFG

SEQ ID NO: 1157462 - protein, 9 aa, Homo Sapiens
KDEFNADHP

SEQ ID NO: 1157463 - protein, 9 aa, Homo Sapiens
ATAQDLDVG

SEQ ID NO: 1157464 - protein, 9 aa, Homo Sapiens
FTQFLLEMQ

SEQ ID NO: 1157465 - protein, 9 aa, Homo Sapiens
SIGKETARE

SEQ ID NO: 1157466 - protein, 9 aa, Homo Sapiens
LPGGDNADT

SEQ ID NO: 1157467 - protein, 9 aa, Homo Sapiens
VGTIIGAAT

SEQ ID NO: 1157468 - protein, 9 aa, Homo Sapiens
SSNTVERLF

SEQ ID NO: 1157469 - protein, 9 aa, Homo Sapiens
GLSPAVWAK

SEQ ID NO: 1157470 - protein, 9 aa, Homo Sapiens
LPPSASARH

SEQ ID NO: 1157471 - protein, 9 aa, Homo Sapiens
FGLAPPPDS

SEQ ID NO: 1157472 - protein, 9 aa, Homo Sapiens
QFLLEMQLE

SEQ ID NO: 1157473 - protein, 9 aa, Homo Sapiens
NGASLSPSI

SEQ ID NO: 1157474 - protein, 9 aa, Homo Sapiens
GVTRTKGYG

SEQ ID NO: 1157475 - protein, 9 aa, Homo Sapiens
AGEVNQRYF

SEQ ID NO: 1157476 - protein, 9 aa, Homo Sapiens
GDRRVWNKP

SEQ ID NO: 1157477 - protein, 9 aa, Homo Sapiens
LSGDRRVWN

SEQ ID NO: 1157478 - protein, 9 aa, Homo Sapiens
CLEHNGCSS

SEQ ID NO: 1157479 - protein, 9 aa, Homo Sapiens
SRTMAGGLF

SEQ ID NO: 1157480 - protein, 9 aa, Homo Sapiens
GHNASAFPK

SEQ ID NO: 1157481 - protein, 9 aa, Homo Sapiens
IPPDPLFSH

SEQ ID NO: 1157482 - protein, 9 aa, Homo Sapiens
QKNATRDAT

SEQ ID NO: 1157483 - protein, 9 aa, Homo Sapiens
LTCGQVMSF

SEQ ID NO: 1157484 - protein, 9 aa, Homo Sapiens
IVDFFAVEL

SEQ ID NO: 1157485 - protein, 9 aa, Homo Sapiens
VAGEVNQRY

SEQ ID NO: 1157486 - protein, 9 aa, Homo Sapiens
DPVVSPRLD

SEQ ID NO: 1157487 - protein, 9 aa, Homo Sapiens
NFADCSRLH

SEQ ID NO: 1157488 - protein, 9 aa, Homo Sapiens
NINGLIDFT

SEQ ID NO: 1157489 - protein, 9 aa, Homo Sapiens
LLRECSTSI

SEQ ID NO: 1157490 - protein, 9 aa, Homo Sapiens
GMSCLLVFE

SEQ ID NO: 1157491 - protein, 9 aa, Homo Sapiens
RLHLIFALN

SEQ ID NO: 1157492 - protein, 9 aa, Homo Sapiens
NRLRFGCKR

SEQ ID NO: 1157493 - protein, 9 aa, Homo Sapiens
RPESWASED

SEQ ID NO: 1157494 - protein, 9 aa, Homo Sapiens
FEHVTQHKF

SEQ ID NO: 1157495 - protein, 9 aa, Homo Sapiens
QSKFRYPFY

SEQ ID NO: 1157496 - protein, 9 aa, Homo Sapiens
VNKLEASKI

SEQ ID NO: 1157497 - protein, 9 aa, Homo Sapiens
YSGDNVAAT

SEQ ID NO: 1157498 - protein, 9 aa, Homo Sapiens
IIGAATAQD

SEQ ID NO: 1157499 - protein, 9 aa, Homo Sapiens
GTPQEKVPA

SEQ ID NO: 1157500 - protein, 9 aa, Homo Sapiens
TIVDFFAVE

SEQ ID NO: 1157501 - protein, 9 aa, Homo Sapiens
IAGQGAAWT

SEQ ID NO: 1157502 - protein, 9 aa, Homo Sapiens
DNADTSQEH

SEQ ID NO: 1157503 - protein, 9 aa, Homo Sapiens
NPDNMFSRT

SEQ ID NO: 1157504 - protein, 9 aa, Homo Sapiens
HNKCPVILN

SEQ ID NO: 1157505 - protein, 9 aa, Homo Sapiens
DTEEPTNDP

SEQ ID NO: 1157506 - protein, 9 aa, Homo Sapiens
FHPLHYTAR

SEQ ID NO: 1157507 - protein, 9 aa, Homo Sapiens
APGTGEEVQ

SEQ ID NO: 1157508 - protein, 9 aa, Homo Sapiens
YFLNDEASG

SEQ ID NO: 1157509 - protein, 9 aa, Homo Sapiens
FHEFTISLD

SEQ ID NO: 1157510 - protein, 9 aa, Homo Sapiens
ADTSQEHVS

SEQ ID NO: 1157511 - protein, 9 aa, Homo Sapiens
DFHKCICKG

SEQ ID NO: 1157512 - protein, 9 aa, Homo Sapiens
KPTAVAPVK

SEQ ID NO: 1157513 - protein, 9 aa, Homo Sapiens
RYFRVDLDS

SEQ ID NO: 1157514 - protein, 9 aa, Homo Sapiens
RIAKVKCGE

SEQ ID NO: 1157515 - protein, 9 aa, Homo Sapiens
DNLGQGLMS

SEQ ID NO: 1157516 - protein, 9 aa, Homo Sapiens
ALCGDVCTH

SEQ ID NO: 1157517 - protein, 9 aa, Homo Sapiens
KHVQVTGHR

SEQ ID NO: 1157518 - protein, 9 aa, Homo Sapiens
RSCDSGTRM

SEQ ID NO: 1157519 - protein, 9 aa, Homo Sapiens
DETQYNCKP

SEQ ID NO: 1157520 - protein, 9 aa, Homo Sapiens
TSERLHTVL

SEQ ID NO: 1157521 - protein, 9 aa, Homo Sapiens
NTQRVPCSS

SEQ ID NO: 1157522 - protein, 9 aa, Homo Sapiens
YSLYQVHVS

SEQ ID NO: 1157523 - protein, 9 aa, Homo Sapiens
SPRWNEWLN

SEQ ID NO: 1157524 - protein, 9 aa, Homo Sapiens
QGLMSLFVL

SEQ ID NO: 1157525 - protein, 9 aa, Homo Sapiens
KLLQTPVTK

SEQ ID NO: 1157526 - protein, 9 aa, Homo Sapiens
KECGKAFHC

SEQ ID NO: 1157527 - protein, 9 aa, Homo Sapiens
NSFDQRDPG

SEQ ID NO: 1157528 - protein, 9 aa, Homo Sapiens
DLRDEYDFK

SEQ ID NO: 1157529 - protein, 9 aa, Homo Sapiens
EDRTRVQSK

SEQ ID NO: 1157530 - protein, 9 aa, Homo Sapiens
RHRADNHEA

SEQ ID NO: 1157531 - protein, 9 aa, Homo Sapiens
EDSTWERRR

SEQ ID NO: 1157532 - protein, 9 aa, Homo Sapiens
REQGVILCR

SEQ ID NO: 1157533 - protein, 9 aa, Homo Sapiens
AGLESDRYR

SEQ ID NO: 1157534 - protein, 9 aa, Homo Sapiens
HTINKITFS

SEQ ID NO: 1157535 - protein, 9 aa, Homo Sapiens
SNRQSTRIA

SEQ ID NO: 1157536 - protein, 9 aa, Homo Sapiens
SPVRLTVFF

SEQ ID NO: 1157537 - protein, 9 aa, Homo Sapiens
NTSIGKETA

SEQ ID NO: 1157538 - protein, 9 aa, Homo Sapiens
MKRSFTEDH

SEQ ID NO: 1157539 - protein, 9 aa, Homo Sapiens
MEELEKHVL

SEQ ID NO: 1157540 - protein, 9 aa, Homo Sapiens
ASPPSLGKM

SEQ ID NO: 1157541 - protein, 9 aa, Homo Sapiens
EQQRVRCVN

SEQ ID NO: 1157542 - protein, 9 aa, Homo Sapiens
NDETQYNCK

SEQ ID NO: 1157543 - protein, 9 aa, Homo Sapiens
HATSLPVTN

SEQ ID NO: 1157544 - protein, 9 aa, Homo Sapiens
VTVLEANDP

SEQ ID NO: 1157545 - protein, 9 aa, Homo Sapiens
LGCEPGSSP

SEQ ID NO: 1157546 - protein, 9 aa, Homo Sapiens
LVQNIAWQL

SEQ ID NO: 1157547 - protein, 9 aa, Homo Sapiens
YELLKQMKS

SEQ ID NO: 1157548 - protein, 9 aa, Homo Sapiens
LSYSFFQYC

SEQ ID NO: 1157549 - protein, 9 aa, Homo Sapiens
KQFFNYSVI

SEQ ID NO: 1157550 - protein, 9 aa, Homo Sapiens
LWDTARQED

SEQ ID NO: 1157551 - protein, 9 aa, Homo Sapiens
VLKEWLAAT

SEQ ID NO: 1157552 - protein, 9 aa, Homo Sapiens
SGRKRLVRR

SEQ ID NO: 1157553 - protein, 9 aa, Homo Sapiens
NLSQNGSAS

SEQ ID NO: 1157554 - protein, 9 aa, Homo Sapiens
PLHPGCGER

SEQ ID NO: 1157555 - protein, 9 aa, Homo Sapiens
ALDHYVAIC

SEQ ID NO: 1157556 - protein, 9 aa, Homo Sapiens
RSQKNTIVD

SEQ ID NO: 1157557 - protein, 9 aa, Homo Sapiens
SPAVWAKIL

SEQ ID NO: 1157558 - protein, 9 aa, Homo Sapiens
PVTKEGERI

SEQ ID NO: 1157559 - protein, 9 aa, Homo Sapiens
ITSNSDPTV

SEQ ID NO: 1157560 - protein, 9 aa, Homo Sapiens
KFQKPKHLK

SEQ ID NO: 1157561 - protein, 9 aa, Homo Sapiens
PDPLFSHLP

SEQ ID NO: 1157562 - protein, 9 aa, Homo Sapiens
SQSSEFIKE

SEQ ID NO: 1157563 - protein, 9 aa, Homo Sapiens
GHCGFSEPL

SEQ ID NO: 1157564 - protein, 9 aa, Homo Sapiens
DCPVCGLIC

SEQ ID NO: 1157565 - protein, 9 aa, Homo Sapiens
TFSQMEELE

SEQ ID NO: 1157566 - protein, 9 aa, Homo Sapiens
RYVAIFHPL

SEQ ID NO: 1157567 - protein, 9 aa, Homo Sapiens
RFGCKRKQC

SEQ ID NO: 1157568 - protein, 9 aa, Homo Sapiens
GRRPLLICG

SEQ ID NO: 1157569 - protein, 9 aa, Homo Sapiens
LLVFEVICI

SEQ ID NO: 1157570 - protein, 9 aa, Homo Sapiens
FNHKALQVL

SEQ ID NO: 1157571 - protein, 9 aa, Homo Sapiens
QHKFGMDLL

SEQ ID NO: 1157572 - protein, 9 aa, Homo Sapiens
VFDMKRSFT

SEQ ID NO: 1157573 - protein, 9 aa, Homo Sapiens
IHSGATITA

SEQ ID NO: 1157574 - protein, 9 aa, Homo Sapiens
VAPVKESDD

SEQ ID NO: 1157575 - protein, 9 aa, Homo Sapiens
ILNFFKIGE

SEQ ID NO: 1157576 - protein, 9 aa, Homo Sapiens
VVMFVYFDL

SEQ ID NO: 1157577 - protein, 9 aa, Homo Sapiens
VCDILKAVI

SEQ ID NO: 1157578 - protein, 9 aa, Homo Sapiens
LGRRPLLIC

SEQ ID NO: 1157579 - protein, 9 aa, Homo Sapiens
FNYSVIDVF

SEQ ID NO: 1157580 - protein, 9 aa, Homo Sapiens
WMAEQKISC

SEQ ID NO: 1157581 - protein, 9 aa, Homo Sapiens
FCGSTLGTK

SEQ ID NO: 1157582 - protein, 9 aa, Homo Sapiens
DSKWVTVSD

SEQ ID NO: 1157583 - protein, 9 aa, Homo Sapiens
WVIYATVQN

SEQ ID NO: 1157584 - protein, 9 aa, Homo Sapiens
VLGTALCGD

SEQ ID NO: 1157585 - protein, 9 aa, Homo Sapiens
INKITFSEQ

SEQ ID NO: 1157586 - protein, 9 aa, Homo Sapiens
IHMPAVLVA

SEQ ID NO: 1157587 - protein, 9 aa, Homo Sapiens
DGLCRKLEK

SEQ ID NO: 1157588 - protein, 9 aa, Homo Sapiens
PPSLGKMQQ

SEQ ID NO: 1157589 - protein, 9 aa, Homo Sapiens
SLSPSISEP

SEQ ID NO: 1157590 - protein, 9 aa, Homo Sapiens
TFNSLVSEA

SEQ ID NO: 1157591 - protein, 9 aa, Homo Sapiens
EGMPLIDGR

SEQ ID NO: 1157592 - protein, 9 aa, Homo Sapiens
GIQLGTPQE

SEQ ID NO: 1157593 - protein, 9 aa, Homo Sapiens
IEWARNIPF

SEQ ID NO: 1157594 - protein, 9 aa, Homo Sapiens
RPPAALAPF

SEQ ID NO: 1157595 - protein, 9 aa, Homo Sapiens
AARLLFSAI

SEQ ID NO: 1157596 - protein, 9 aa, Homo Sapiens
DNVAATFSA

SEQ ID NO: 1157597 - protein, 9 aa, Homo Sapiens
DYYTATSDR

SEQ ID NO: 1157598 - protein, 9 aa, Homo Sapiens
LRSLMDAVP

SEQ ID NO: 1157599 - protein, 9 aa, Homo Sapiens
RVPCSSPRW

SEQ ID NO: 1157600 - protein, 9 aa, Homo Sapiens
TCGQVMSFC

SEQ ID NO: 1157601 - protein, 9 aa, Homo Sapiens
RTRVQSKFR

SEQ ID NO: 1157602 - protein, 9 aa, Homo Sapiens
GSTKSLNHE

SEQ ID NO: 1157603 - protein, 9 aa, Homo Sapiens
LFKREDFKG

SEQ ID NO: 1157604 - protein, 9 aa, Homo Sapiens
SDSILGEQT

SEQ ID NO: 1157605 - protein, 9 aa, Homo Sapiens
LSDWLQCGN

SEQ ID NO: 1157606 - protein, 9 aa, Homo Sapiens
QEAENHRLH

SEQ ID NO: 1157607 - protein, 9 aa, Homo Sapiens
YSVIDVFNQ

SEQ ID NO: 1157608 - protein, 9 aa, Homo Sapiens
CVRTLNAHE

SEQ ID NO: 1157609 - protein, 9 aa, Homo Sapiens
GVINLAFED

SEQ ID NO: 1157610 - protein, 9 aa, Homo Sapiens
HSGATITAP

SEQ ID NO: 1157611 - protein, 9 aa, Homo Sapiens
GEKEEAERL

SEQ ID NO: 1157612 - protein, 9 aa, Homo Sapiens
TVLEANDPP

SEQ ID NO: 1157613 - protein, 9 aa, Homo Sapiens
ECGSDRCNI

SEQ ID NO: 1157614 - protein, 9 aa, Homo Sapiens
VPCSSPRWN

SEQ ID NO: 1157615 - protein, 9 aa, Homo Sapiens
SQTTICRLE

SEQ ID NO: 1157616 - protein, 9 aa, Homo Sapiens
DKLVQNIAW

SEQ ID NO: 1157617 - protein, 9 aa, Homo Sapiens
PLKGILKQA

SEQ ID NO: 1157618 - protein, 9 aa, Homo Sapiens
ERKFTNISV

SEQ ID NO: 1157619 - protein, 9 aa, Homo Sapiens
CPVILNFFK

SEQ ID NO: 1157620 - protein, 9 aa, Homo Sapiens
ITAPSLSGK

SEQ ID NO: 1157621 - protein, 9 aa, Homo Sapiens
KAGLIRHTI

SEQ ID NO: 1157622 - protein, 9 aa, Homo Sapiens
SVPESPSKL

SEQ ID NO: 1157623 - protein, 9 aa, Homo Sapiens
PGLDDKLLY

SEQ ID NO: 1157624 - protein, 9 aa, Homo Sapiens
KAVTQRFRK

SEQ ID NO: 1157625 - protein, 9 aa, Homo Sapiens
WSFSAYWHQ

SEQ ID NO: 1157626 - protein, 9 aa, Homo Sapiens
GERKPSGLR

SEQ ID NO: 1157627 - protein, 9 aa, Homo Sapiens
ADAFLEHRM

SEQ ID NO: 1157628 - protein, 9 aa, Homo Sapiens
ATIMSGSTK

SEQ ID NO: 1157629 - protein, 9 aa, Homo Sapiens
PVTREQGVI

SEQ ID NO: 1157630 - protein, 9 aa, Homo Sapiens
EKDAQEFLD

SEQ ID NO: 1157631 - protein, 9 aa, Homo Sapiens
NPGLDDKLL

SEQ ID NO: 1157632 - protein, 9 aa, Homo Sapiens
PTVRGNSIF

SEQ ID NO: 1157633 - protein, 9 aa, Homo Sapiens
RAAVAGFFV

SEQ ID NO: 1157634 - protein, 9 aa, Homo Sapiens
CGKAFHCSS

SEQ ID NO: 1157635 - protein, 9 aa, Homo Sapiens
RDIDQAKIE

SEQ ID NO: 1157636 - protein, 9 aa, Homo Sapiens
ESSQKEIEA

SEQ ID NO: 1157637 - protein, 9 aa, Homo Sapiens
TPLKGILKQ

SEQ ID NO: 1157638 - protein, 9 aa, Homo Sapiens
AETSERLHT

SEQ ID NO: 1157639 - protein, 9 aa, Homo Sapiens
RSISANSFD

SEQ ID NO: 1157640 - protein, 9 aa, Homo Sapiens
LYQVHVSGE

SEQ ID NO: 1157641 - protein, 9 aa, Homo Sapiens
RADNHEASA

SEQ ID NO: 1157642 - protein, 9 aa, Homo Sapiens
CSGRKRLVR

SEQ ID NO: 1157643 - protein, 9 aa, Homo Sapiens
LDKYELLKQ

SEQ ID NO: 1157644 - protein, 9 aa, Homo Sapiens
QRLALFLAR

SEQ ID NO: 1157645 - protein, 9 aa, Homo Sapiens
GIADAYAAR

SEQ ID NO: 1157646 - protein, 9 aa, Homo Sapiens
ILQKTKGQE

SEQ ID NO: 1157647 - protein, 9 aa, Homo Sapiens
VATVPDLYH

SEQ ID NO: 1157648 - protein, 9 aa, Homo Sapiens
DKLCPDSKS

SEQ ID NO: 1157649 - protein, 9 aa, Homo Sapiens
TRMVMNNGV

SEQ ID NO: 1157650 - protein, 9 aa, Homo Sapiens
TGEEVQGKV

SEQ ID NO: 1157651 - protein, 9 aa, Homo Sapiens
DCEGGADCD

SEQ ID NO: 1157652 - protein, 9 aa, Homo Sapiens
PVVSPRLDV

SEQ ID NO: 1157653 - protein, 9 aa, Homo Sapiens
EEEQNVDLT

SEQ ID NO: 1157654 - protein, 9 aa, Homo Sapiens
SVFDMKRSF

SEQ ID NO: 1157655 - protein, 9 aa, Homo Sapiens
SFFGLAPPP

SEQ ID NO: 1157656 - protein, 9 aa, Homo Sapiens
HNGCSSLPP

SEQ ID NO: 1157657 - protein, 9 aa, Homo Sapiens
EKEEAERLT

SEQ ID NO: 1157658 - protein, 9 aa, Homo Sapiens
VLQPKPTSP

SEQ ID NO: 1157659 - protein, 9 aa, Homo Sapiens
SSSIYILND

SEQ ID NO: 1157660 - protein, 9 aa, Homo Sapiens
GTVVFWGLK

SEQ ID NO: 1157661 - protein, 9 aa, Homo Sapiens
EEQSEKDHS

SEQ ID NO: 1157662 - protein, 9 aa, Homo Sapiens
IGWEKPGQV

SEQ ID NO: 1157663 - protein, 9 aa, Homo Sapiens
DLHNLAPST

SEQ ID NO: 1157664 - protein, 9 aa, Homo Sapiens
VLGGSRALS

SEQ ID NO: 1157665 - protein, 9 aa, Homo Sapiens
LKRAMQFGS

SEQ ID NO: 1157666 - protein, 9 aa, Homo Sapiens
HRADNHEAS

SEQ ID NO: 1157667 - protein, 9 aa, Homo Sapiens
NALSTCVSH

SEQ ID NO: 1157668 - protein, 9 aa, Homo Sapiens
GLEESRDQP

SEQ ID NO: 1157669 - protein, 9 aa, Homo Sapiens
VKCGECGQG

SEQ ID NO: 1157670 - protein, 9 aa, Homo Sapiens
FKREDFKGK

SEQ ID NO: 1157671 - protein, 9 aa, Homo Sapiens
SQNGSASTF

SEQ ID NO: 1157672 - protein, 9 aa, Homo Sapiens
FNICALRLW

SEQ ID NO: 1157673 - protein, 9 aa, Homo Sapiens
CEPGSSPAP

SEQ ID NO: 1157674 - protein, 9 aa, Homo Sapiens
NTRSLLREC

SEQ ID NO: 1157675 - protein, 9 aa, Homo Sapiens
IAWQLHHLV

SEQ ID NO: 1157676 - protein, 9 aa, Homo Sapiens
TKVELGPYY

SEQ ID NO: 1157677 - protein, 9 aa, Homo Sapiens
ENGTVVFWG

SEQ ID NO: 1157678 - protein, 9 aa, Homo Sapiens
LEALQLSFK

SEQ ID NO: 1157679 - protein, 9 aa, Homo Sapiens
LGLSPAVWA

SEQ ID NO: 1157680 - protein, 9 aa, Homo Sapiens
ECYLKIIPW

SEQ ID NO: 1157681 - protein, 9 aa, Homo Sapiens
IGAATAQDL

SEQ ID NO: 1157682 - protein, 9 aa, Homo Sapiens
GSAAAAVTG

SEQ ID NO: 1157683 - protein, 9 aa, Homo Sapiens
EETPFFSAN

SEQ ID NO: 1157684 - protein, 9 aa, Homo Sapiens
ETWGFGHNH

SEQ ID NO: 1157685 - protein, 9 aa, Homo Sapiens
CRFESLTLL

SEQ ID NO: 1157686 - protein, 9 aa, Homo Sapiens
DDKLLYIPL

SEQ ID NO: 1157687 - protein, 9 aa, Homo Sapiens
PQEKVPAGR

SEQ ID NO: 1157688 - protein, 9 aa, Homo Sapiens
SRIDPIRSR

SEQ ID NO: 1157689 - protein, 9 aa, Homo Sapiens
TKGQESLLD

SEQ ID NO: 1157690 - protein, 9 aa, Homo Sapiens
TTICRLEAL

SEQ ID NO: 1157691 - protein, 9 aa, Homo Sapiens
SFFQYCNQI

SEQ ID NO: 1157692 - protein, 9 aa, Homo Sapiens
GDYVVMFVY

SEQ ID NO: 1157693 - protein, 9 aa, Homo Sapiens
EANDPPIFT

SEQ ID NO: 1157694 - protein, 9 aa, Homo Sapiens
THESSQKEI

SEQ ID NO: 1157695 - protein, 9 aa, Homo Sapiens
ASMILKSNE

SEQ ID NO: 1157696 - protein, 9 aa, Homo Sapiens
FQKPKHLKD

SEQ ID NO: 1157697 - protein, 9 aa, Homo Sapiens
AEHEYLPPS

SEQ ID NO: 1157698 - protein, 9 aa, Homo Sapiens
FFQYCNQII

SEQ ID NO: 1157699 - protein, 9 aa, Homo Sapiens
KSVFDMKRS

SEQ ID NO: 1157700 - protein, 9 aa, Homo Sapiens
TKRGTHFST

SEQ ID NO: 1157701 - protein, 9 aa, Homo Sapiens
QFQGVINLA

SEQ ID NO: 1157702 - protein, 9 aa, Homo Sapiens
VILCGPPPH

SEQ ID NO: 1157703 - protein, 9 aa, Homo Sapiens
EQKISCDKK

SEQ ID NO: 1157704 - protein, 9 aa, Homo Sapiens
GGLLIAFRA

SEQ ID NO: 1157705 - protein, 9 aa, Homo Sapiens
YNFADCSRL

SEQ ID NO: 1157706 - protein, 9 aa, Homo Sapiens
KCICKGRSV

SEQ ID NO: 1157707 - protein, 9 aa, Homo Sapiens
LQAVPNKSC

SEQ ID NO: 1157708 - protein, 9 aa, Homo Sapiens
STWERRRDI

SEQ ID NO: 1157709 - protein, 9 aa, Homo Sapiens
PSLRLKISQ

SEQ ID NO: 1157710 - protein, 9 aa, Homo Sapiens
FRPSLRLKI

SEQ ID NO: 1157711 - protein, 9 aa, Homo Sapiens
GLIDFTIQL

SEQ ID NO: 1157712 - protein, 9 aa, Homo Sapiens
KKCNANGSS

SEQ ID NO: 1157713 - protein, 9 aa, Homo Sapiens
IEDRTRVQS

SEQ ID NO: 1157714 - protein, 9 aa, Homo Sapiens
VLEANDPPI

SEQ ID NO: 1157715 - protein, 9 aa, Homo Sapiens
PIGKVVEGM

SEQ ID NO: 1157716 - protein, 9 aa, Homo Sapiens
KFVNKLEAS

SEQ ID NO: 1157717 - protein, 9 aa, Homo Sapiens
RAALFALPH

SEQ ID NO: 1157718 - protein, 9 aa, Homo Sapiens
TGLECATLL

SEQ ID NO: 1157719 - protein, 9 aa, Homo Sapiens
LTVMGHGTP

SEQ ID NO: 1157720 - protein, 9 aa, Homo Sapiens
TEPPKFVNK

SEQ ID NO: 1157721 - protein, 9 aa, Homo Sapiens
GAATAQDLD

SEQ ID NO: 1157722 - protein, 9 aa, Homo Sapiens
VLYLLIGDK

SEQ ID NO: 1157723 - protein, 9 aa, Homo Sapiens
TREQGVILC

SEQ ID NO: 1157724 - protein, 9 aa, Homo Sapiens
LICGFGLMG

SEQ ID NO: 1157725 - protein, 9 aa, Homo Sapiens
SMAKLDNAD

SEQ ID NO: 1157726 - protein, 9 aa, Homo Sapiens
AEPEVGEKE

SEQ ID NO: 1157727 - protein, 9 aa, Homo Sapiens
ISSLAKGER

SEQ ID NO: 1157728 - protein, 9 aa, Homo Sapiens
WASEDYVAP

SEQ ID NO: 1157729 - protein, 9 aa, Homo Sapiens
KRNEREQQR

SEQ ID NO: 1157730 - protein, 9 aa, Homo Sapiens
GFTVKIRPG

SEQ ID NO: 1157731 - protein, 9 aa, Homo Sapiens
QHKDEFNAD

SEQ ID NO: 1157732 - protein, 9 aa, Homo Sapiens
LMDAVPLSV

SEQ ID NO: 1157733 - protein, 9 aa, Homo Sapiens
SEGEGKNPV

SEQ ID NO: 1157734 - protein, 9 aa, Homo Sapiens
WERRRDIDQ

SEQ ID NO: 1157735 - protein, 9 aa, Homo Sapiens
YQQQYEEQQ

SEQ ID NO: 1157736 - protein, 9 aa, Homo Sapiens
GKLEAEKVM

SEQ ID NO: 1157737 - protein, 9 aa, Homo Sapiens
YIASMEHRT

SEQ ID NO: 1157738 - protein, 9 aa, Homo Sapiens
PNKSCRPHG

SEQ ID NO: 1157739 - protein, 9 aa, Homo Sapiens
SVLQPKPTS

SEQ ID NO: 1157740 - protein, 9 aa, Homo Sapiens
FSQDVTFNS

SEQ ID NO: 1157741 - protein, 9 aa, Homo Sapiens
KWALIQCAK

SEQ ID NO: 1157742 - protein, 9 aa, Homo Sapiens
ESWASEDYV

SEQ ID NO: 1157743 - protein, 9 aa, Homo Sapiens
GHGTPPLST

SEQ ID NO: 1157744 - protein, 9 aa, Homo Sapiens
FDNLGQGLM

SEQ ID NO: 1157745 - protein, 9 aa, Homo Sapiens
TKSLNHEAP

SEQ ID NO: 1157746 - protein, 9 aa, Homo Sapiens
VNNVKVIHD

SEQ ID NO: 1157747 - protein, 9 aa, Homo Sapiens
TINKITFSE

SEQ ID NO: 1157748 - protein, 9 aa, Homo Sapiens
LLGCEPGSS

SEQ ID NO: 1157749 - protein, 9 aa, Homo Sapiens
QERLIHSLP

SEQ ID NO: 1157750 - protein, 9 aa, Homo Sapiens
TVKIRPGLL

SEQ ID NO: 1157751 - protein, 9 aa, Homo Sapiens
VNPVYNEES

SEQ ID NO: 1157752 - protein, 9 aa, Homo Sapiens
PKANKEILY

SEQ ID NO: 1157753 - protein, 9 aa, Homo Sapiens
CSEEEQNVD

SEQ ID NO: 1157754 - protein, 9 aa, Homo Sapiens
YDCPVCGLI

SEQ ID NO: 1157755 - protein, 9 aa, Homo Sapiens
REQISKYMD

SEQ ID NO: 1157756 - protein, 9 aa, Homo Sapiens
GGSGTKWAL

SEQ ID NO: 1157757 - protein, 9 aa, Homo Sapiens
DFRFNICAL

SEQ ID NO: 1157758 - protein, 9 aa, Homo Sapiens
FIKELLGCG

SEQ ID NO: 1157759 - protein, 9 aa, Homo Sapiens
VLPHSAEPG

SEQ ID NO: 1157760 - protein, 9 aa, Homo Sapiens
ADLHNLAPS

SEQ ID NO: 1157761 - protein, 9 aa, Homo Sapiens
VNVTVLEAN

SEQ ID NO: 1157762 - protein, 9 aa, Homo Sapiens
PAREVLPHS

SEQ ID NO: 1157763 - protein, 9 aa, Homo Sapiens
KLEAEKVMR

SEQ ID NO: 1157764 - protein, 9 aa, Homo Sapiens
FFNYSVIDV

SEQ ID NO: 1157765 - protein, 9 aa, Homo Sapiens
LKVEGATPH

SEQ ID NO: 1157766 - protein, 9 aa, Homo Sapiens
LTLTTAGSC

SEQ ID NO: 1157767 - protein, 9 aa, Homo Sapiens
NIHYTHLTG

SEQ ID NO: 1157768 - protein, 9 aa, Homo Sapiens
SDRFNHILA

SEQ ID NO: 1157769 - protein, 9 aa, Homo Sapiens
SKWVTVSDL

SEQ ID NO: 1157770 - protein, 9 aa, Homo Sapiens
EQISKYMDR

SEQ ID NO: 1157771 - protein, 9 aa, Homo Sapiens
KRSFTEDHY

SEQ ID NO: 1157772 - protein, 9 aa, Homo Sapiens
CSTSIATRG

SEQ ID NO: 1157773 - protein, 9 aa, Homo Sapiens
APQQFQGVI

SEQ ID NO: 1157774 - protein, 9 aa, Homo Sapiens
TNTAYQQQY

SEQ ID NO: 1157775 - protein, 9 aa, Homo Sapiens
YNPGLDDKL

SEQ ID NO: 1157776 - protein, 9 aa, Homo Sapiens
YNITLTVMG

SEQ ID NO: 1157777 - protein, 9 aa, Homo Sapiens
SANRLRFGC

SEQ ID NO: 1157778 - protein, 9 aa, Homo Sapiens
EWATYMGRV

SEQ ID NO: 1157779 - protein, 9 aa, Homo Sapiens
RFRKDARDP

SEQ ID NO: 1157780 - protein, 9 aa, Homo Sapiens
RRRVHQVIG

SEQ ID NO: 1157781 - protein, 9 aa, Homo Sapiens
YILNDETQY

SEQ ID NO: 1157782 - protein, 9 aa, Homo Sapiens
FVVLFLWRS

SEQ ID NO: 1157783 - protein, 9 aa, Homo Sapiens
VILCRGGGP

SEQ ID NO: 1157784 - protein, 9 aa, Homo Sapiens
MQLEHAKQA

SEQ ID NO: 1157785 - protein, 9 aa, Homo Sapiens
WQLHHLVSD

SEQ ID NO: 1157786 - protein, 9 aa, Homo Sapiens
CTLHCDCEG

SEQ ID NO: 1157787 - protein, 9 aa, Homo Sapiens
YSFFQYCNQ

SEQ ID NO: 1157788 - protein, 9 aa, Homo Sapiens
LTLLHNNMI

SEQ ID NO: 1157789 - protein, 9 aa, Homo Sapiens
FDMKRSFTE

SEQ ID NO: 1157790 - protein, 9 aa, Homo Sapiens
ASALLLKRA

SEQ ID NO: 1157791 - protein, 9 aa, Homo Sapiens
QDSVPESPS

SEQ ID NO: 1157792 - protein, 9 aa, Homo Sapiens
SGDNVAATF

SEQ ID NO: 1157793 - protein, 9 aa, Homo Sapiens
VIAGQGAAW

SEQ ID NO: 1157794 - protein, 9 aa, Homo Sapiens
NLAPSTHPP

SEQ ID NO: 1157795 - protein, 9 aa, Homo Sapiens
LSQSSEFIK

SEQ ID NO: 1157796 - protein, 9 aa, Homo Sapiens
VTVSDLKIQ

SEQ ID NO: 1157797 - protein, 9 aa, Homo Sapiens
NLTTHNKTH

SEQ ID NO: 1157798 - protein, 9 aa, Homo Sapiens
RHNALSTCV

SEQ ID NO: 1157799 - protein, 9 aa, Homo Sapiens
LPHSAEPGY

SEQ ID NO: 1157800 - protein, 9 aa, Homo Sapiens
TLHCDCEGG

SEQ ID NO: 1157801 - protein, 9 aa, Homo Sapiens
PEVGEKEEA

SEQ ID NO: 1157802 - protein, 9 aa, Homo Sapiens
SAAAQQQQL

SEQ ID NO: 1157803 - protein, 9 aa, Homo Sapiens
RRVHQVIGH

SEQ ID NO: 1157804 - protein, 9 aa, Homo Sapiens
HCGFSEPLT

SEQ ID NO: 1157805 - protein, 9 aa, Homo Sapiens
ITGANTSIG

SEQ ID NO: 1157806 - protein, 9 aa, Homo Sapiens
KLVCDILKA

SEQ ID NO: 1157807 - protein, 9 aa, Homo Sapiens
PKQFSVKEC

SEQ ID NO: 1157808 - protein, 9 aa, Homo Sapiens
IADAYAARK

SEQ ID NO: 1157809 - protein, 9 aa, Homo Sapiens
LDHYVAICS

SEQ ID NO: 1157810 - protein, 9 aa, Homo Sapiens
LGQGLMSLF

SEQ ID NO: 1157811 - protein, 9 aa, Homo Sapiens
PAYSMQYVA

SEQ ID NO: 1157812 - protein, 9 aa, Homo Sapiens
LASPPSLGK

SEQ ID NO: 1157813 - protein, 9 aa, Homo Sapiens
AKELPYFES

SEQ ID NO: 1157814 - protein, 9 aa, Homo Sapiens
NKEILYEAY

SEQ ID NO: 1157815 - protein, 9 aa, Homo Sapiens
QYCNQIIQA

SEQ ID NO: 1157816 - protein, 9 aa, Homo Sapiens
GHRISATAE

SEQ ID NO: 1157817 - protein, 9 aa, Homo Sapiens
EEEKESWST

SEQ ID NO: 1157818 - protein, 9 aa, Homo Sapiens
VMSFCIPTE

SEQ ID NO: 1157819 - protein, 9 aa, Homo Sapiens
EPGSSPAPL

SEQ ID NO: 1157820 - protein, 9 aa, Homo Sapiens
TPVTKEGER

SEQ ID NO: 1157821 - protein, 9 aa, Homo Sapiens
GLTCGQVMS

SEQ ID NO: 1157822 - protein, 9 aa, Homo Sapiens
PRETWGFGH

SEQ ID NO: 1157823 - protein, 9 aa, Homo Sapiens
QRLSHFTNQ

SEQ ID NO: 1157824 - protein, 9 aa, Homo Sapiens
QDPVVSPRL

SEQ ID NO: 1157825 - protein, 9 aa, Homo Sapiens
TQRFRKDAR

SEQ ID NO: 1157826 - protein, 9 aa, Homo Sapiens
SMQYVAYSP

SEQ ID NO: 1157827 - protein, 9 aa, Homo Sapiens
HEYLPPSAS

SEQ ID NO: 1157828 - protein, 9 aa, Homo Sapiens
YSFFGLAPP

SEQ ID NO: 1157829 - protein, 9 aa, Homo Sapiens
HVQVTGHRI

SEQ ID NO: 1157830 - protein, 9 aa, Homo Sapiens
ENKGSEAIL

SEQ ID NO: 1157831 - protein, 9 aa, Homo Sapiens
HIRGKYSRH

SEQ ID NO: 1157832 - protein, 9 aa, Homo Sapiens
RKLEKACIS

SEQ ID NO: 1157833 - protein, 9 aa, Homo Sapiens
GLIYLDDLL

SEQ ID NO: 1157834 - protein, 9 aa, Homo Sapiens
DEFNADHPF

SEQ ID NO: 1157835 - protein, 9 aa, Homo Sapiens
CDKLCPDSK

SEQ ID NO: 1157836 - protein, 9 aa, Homo Sapiens
PVRLTVFFT

SEQ ID NO: 1157837 - protein, 9 aa, Homo Sapiens
KDSKWVTVS

SEQ ID NO: 1157838 - protein, 9 aa, Homo Sapiens
LPYFESDFW

SEQ ID NO: 1157839 - protein, 9 aa, Homo Sapiens
RNEREQQRV

SEQ ID NO: 1157840 - protein, 9 aa, Homo Sapiens
TASALLLKR

SEQ ID NO: 1157841 - protein, 9 aa, Homo Sapiens
LNRNSEVWL

SEQ ID NO: 1157842 - protein, 9 aa, Homo Sapiens
CSKSFDYGS

SEQ ID NO: 1157843 - protein, 9 aa, Homo Sapiens
FSAIEWARN

SEQ ID NO: 1157844 - protein, 9 aa, Homo Sapiens
SERLHTVLL

SEQ ID NO: 1157845 - protein, 9 aa, Homo Sapiens
CNLREQISK

SEQ ID NO: 1157846 - protein, 9 aa, Homo Sapiens
LEHNGCSSL

SEQ ID NO: 1157847 - protein, 9 aa, Homo Sapiens
QQRVRCVNE

SEQ ID NO: 1157848 - protein, 9 aa, Homo Sapiens
AGFFVVLFL

SEQ ID NO: 1157849 - protein, 9 aa, Homo Sapiens
HKFGMDLLL

SEQ ID NO: 1157850 - protein, 9 aa, Homo Sapiens
EKVMRDSMQ

SEQ ID NO: 1157851 - protein, 9 aa, Homo Sapiens
MGRVDAVRL

SEQ ID NO: 1157852 - protein, 9 aa, Homo Sapiens
YYTATSDRI

SEQ ID NO: 1157853 - protein, 9 aa, Homo Sapiens
STHPPFLTF

SEQ ID NO: 1157854 - protein, 9 aa, Homo Sapiens
KVELGPYYV

SEQ ID NO: 1157855 - protein, 9 aa, Homo Sapiens
VMFVYFDLS

SEQ ID NO: 1157856 - protein, 9 aa, Homo Sapiens
CNQIIQAFE

SEQ ID NO: 1157857 - protein, 9 aa, Homo Sapiens
LVSPISESM

SEQ ID NO: 1157858 - protein, 9 aa, Homo Sapiens
AAVTGLECA

SEQ ID NO: 1157859 - protein, 9 aa, Homo Sapiens
ATPHLEMRF

SEQ ID NO: 1157860 - protein, 9 aa, Homo Sapiens
EFHGTKVEL

SEQ ID NO: 1157861 - protein, 9 aa, Homo Sapiens
RKPSGLRSS

SEQ ID NO: 1157862 - protein, 9 aa, Homo Sapiens
PVKLLNRNS

SEQ ID NO: 1157863 - protein, 9 aa, Homo Sapiens
WKIHMPAVL

SEQ ID NO: 1157864 - protein, 9 aa, Homo Sapiens
EANVKLVCD

SEQ ID NO: 1157865 - protein, 9 aa, Homo Sapiens
VVLFLWRSF

SEQ ID NO: 1157866 - protein, 9 aa, Homo Sapiens
PGGKENGQP

SEQ ID NO: 1157867 - protein, 9 aa, Homo Sapiens
KRKQCRETL

SEQ ID NO: 1157868 - protein, 9 aa, Homo Sapiens
EVQGKVKDA

SEQ ID NO: 1157869 - protein, 9 aa, Homo Sapiens
TLGTKRGTH

SEQ ID NO: 1157870 - protein, 9 aa, Homo Sapiens
IAFRAALFA

SEQ ID NO: 1157871 - protein, 9 aa, Homo Sapiens
NVLGTALCG

SEQ ID NO: 1157872 - protein, 9 aa, Homo Sapiens
QVIGHKFMA

SEQ ID NO: 1157873 - protein, 9 aa, Homo Sapiens
FNADHPFIY

SEQ ID NO: 1157874 - protein, 9 aa, Homo Sapiens
GQDSVPESP

SEQ ID NO: 1157875 - protein, 9 aa, Homo Sapiens
TGANTSIGK

SEQ ID NO: 1157876 - protein, 9 aa, Homo Sapiens
SEVWLIQKN

SEQ ID NO: 1157877 - protein, 9 aa, Homo Sapiens
SVKECYLKI

SEQ ID NO: 1157878 - protein, 9 aa, Homo Sapiens
KHVLKTFQE

SEQ ID NO: 1157879 - protein, 9 aa, Homo Sapiens
IRYNPGLDD

SEQ ID NO: 1157880 - protein, 9 aa, Homo Sapiens
SSQKEIEAF

SEQ ID NO: 1157881 - protein, 9 aa, Homo Sapiens
PAVNGASLS

SEQ ID NO: 1157882 - protein, 9 aa, Homo Sapiens
IAITSDMQD

SEQ ID NO: 1157883 - protein, 9 aa, Homo Sapiens
HYTHLTGTP

SEQ ID NO: 1157884 - protein, 9 aa, Homo Sapiens
EVICILPND

SEQ ID NO: 1157885 - protein, 9 aa, Homo Sapiens
SGTKWALIQ

SEQ ID NO: 1157886 - protein, 9 aa, Homo Sapiens
PEISDYYTA

SEQ ID NO: 1157887 - protein, 9 aa, Homo Sapiens
VKECYLKII

SEQ ID NO: 1157888 - protein, 9 aa, Homo Sapiens
EHNGCSSLP

SEQ ID NO: 1157889 - protein, 9 aa, Homo Sapiens
LHQELQDAR

SEQ ID NO: 1157890 - protein, 9 aa, Homo Sapiens
DSTWERRRD

SEQ ID NO: 1157891 - protein, 9 aa, Homo Sapiens
EESRDQPRP

SEQ ID NO: 1157892 - protein, 9 aa, Homo Sapiens
SDYQYIGKL

SEQ ID NO: 1157893 - protein, 9 aa, Homo Sapiens
MHVVATVPD

SEQ ID NO: 1157894 - protein, 9 aa, Homo Sapiens
QQFQGVINL

SEQ ID NO: 1157895 - protein, 9 aa, Homo Sapiens
YNFDNLGQG

SEQ ID NO: 1157896 - protein, 9 aa, Homo Sapiens
GQPHGAPGS

SEQ ID NO: 1157897 - protein, 9 aa, Homo Sapiens
GKVVEGMPL

SEQ ID NO: 1157898 - protein, 9 aa, Homo Sapiens
LLKRNIHYT

SEQ ID NO: 1157899 - protein, 9 aa, Homo Sapiens
LHTLERIKS

SEQ ID NO: 1157900 - protein, 9 aa, Homo Sapiens
NTVERLFHE

SEQ ID NO: 1157901 - protein, 9 aa, Homo Sapiens
LIYLDDLLP

SEQ ID NO: 1157902 - protein, 9 aa, Homo Sapiens
VAGFFVVLF

SEQ ID NO: 1157903 - protein, 9 aa, Homo Sapiens
NSGLFFLCS

SEQ ID NO: 1157904 - protein, 9 aa, Homo Sapiens
GGHNKCPVI

SEQ ID NO: 1157905 - protein, 9 aa, Homo Sapiens
LGTPQEKVP

SEQ ID NO: 1157906 - protein, 9 aa, Homo Sapiens
VNQRYFRVD

SEQ ID NO: 1157907 - protein, 9 aa, Homo Sapiens
PPAALAPFP

SEQ ID NO: 1157908 - protein, 9 aa, Homo Sapiens
AALVSPISE

SEQ ID NO: 1157909 - protein, 9 aa, Homo Sapiens
KIRPGLLNS

SEQ ID NO: 1157910 - protein, 9 aa, Homo Sapiens
FFVVLFLWR

SEQ ID NO: 1157911 - protein, 9 aa, Homo Sapiens
VQNNGKIVI

SEQ ID NO: 1157912 - protein, 9 aa, Homo Sapiens
HNKTHTGEK

SEQ ID NO: 1157913 - protein, 9 aa, Homo Sapiens
HQVIGHKFM

SEQ ID NO: 1157914 - protein, 9 aa, Homo Sapiens
SYQKALRNS

SEQ ID NO: 1157915 - protein, 9 aa, Homo Sapiens
NVRFVIGWE

SEQ ID NO: 1157916 - protein, 9 aa, Homo Sapiens
LLLKRNIHY

SEQ ID NO: 1157917 - protein, 9 aa, Homo Sapiens
LQVLHCFPL

SEQ ID NO: 1157918 - protein, 9 aa, Homo Sapiens
SAIEWARNI

SEQ ID NO: 1157919 - protein, 9 aa, Homo Sapiens
VTVNVTVLE

SEQ ID NO: 1157920 - protein, 9 aa, Homo Sapiens
QISKYMDRA

SEQ ID NO: 1157921 - protein, 9 aa, Homo Sapiens
NRQSTRIAD

SEQ ID NO: 1157922 - protein, 9 aa, Homo Sapiens
TPFFSANRL

SEQ ID NO: 1157923 - protein, 9 aa, Homo Sapiens
IGKLHSDQD

SEQ ID NO: 1157924 - protein, 9 aa, Homo Sapiens
LHTVLLDVT

SEQ ID NO: 1157925 - protein, 9 aa, Homo Sapiens
KVEGATPHL

SEQ ID NO: 1157926 - protein, 9 aa, Homo Sapiens
RRSCDSGTR

SEQ ID NO: 1157927 - protein, 9 aa, Homo Sapiens
SQDVTFNSL

SEQ ID NO: 1157928 - protein, 9 aa, Homo Sapiens
LLAGLESDR

SEQ ID NO: 1157929 - protein, 9 aa, Homo Sapiens
YNEFHGTKV

SEQ ID NO: 1157930 - protein, 9 aa, Homo Sapiens
ASAFPKGTA

SEQ ID NO: 1157931 - protein, 9 aa, Homo Sapiens
HIRGVSMAK

SEQ ID NO: 1157932 - protein, 9 aa, Homo Sapiens
DREETPFFS

SEQ ID NO: 1157933 - protein, 9 aa, Homo Sapiens
NVTVLEAND

SEQ ID NO: 1157934 - protein, 9 aa, Homo Sapiens
DRCNILEAF

SEQ ID NO: 1157935 - protein, 9 aa, Homo Sapiens
LLFSAIEWA

SEQ ID NO: 1157936 - protein, 9 aa, Homo Sapiens
LKISQPKPV

SEQ ID NO: 1157937 - protein, 9 aa, Homo Sapiens
QVHVSGERR

SEQ ID NO: 1157938 - protein, 9 aa, Homo Sapiens
MNNGVNPVY

SEQ ID NO: 1157939 - protein, 9 aa, Homo Sapiens
EQRLSHFTN

SEQ ID NO: 1157940 - protein, 9 aa, Homo Sapiens
FHGTKVELG

SEQ ID NO: 1157941 - protein, 9 aa, Homo Sapiens
ALRNSRDDK

SEQ ID NO: 1157942 - protein, 9 aa, Homo Sapiens
PPAYSMQYV

SEQ ID NO: 1157943 - protein, 9 aa, Homo Sapiens
GSDRCNILE

SEQ ID NO: 1157944 - protein, 9 aa, Homo Sapiens
RFVIGWEKP

SEQ ID NO: 1157945 - protein, 9 aa, Homo Sapiens
NKSCRPHGS

SEQ ID NO: 1157946 - protein, 9 aa, Homo Sapiens
LFGLTCGQV

SEQ ID NO: 1157947 - protein, 9 aa, Homo Sapiens
CSSLPPTLT

SEQ ID NO: 1157948 - protein, 9 aa, Homo Sapiens
SLGKMQQLQ

SEQ ID NO: 1157949 - protein, 9 aa, Homo Sapiens
ICGFGLMGL

SEQ ID NO: 1157950 - protein, 9 aa, Homo Sapiens
GNAGIADAY

SEQ ID NO: 1157951 - protein, 9 aa, Homo Sapiens
LCSNGVYKG

SEQ ID NO: 1157952 - protein, 9 aa, Homo Sapiens
TLLHNNMIA

SEQ ID NO: 1157953 - protein, 9 aa, Homo Sapiens
LLPLHPGCG

SEQ ID NO: 1157954 - protein, 9 aa, Homo Sapiens
GQVMSFCIP

SEQ ID NO: 1157955 - protein, 9 aa, Homo Sapiens
EPPKFVNKL

SEQ ID NO: 1157956 - protein, 9 aa, Homo Sapiens
SWASEDYVA

SEQ ID NO: 1157957 - protein, 9 aa, Homo Sapiens
KVFHRDGHC

SEQ ID NO: 1157958 - protein, 9 aa, Homo Sapiens
AGVRPESWA

SEQ ID NO: 1157959 - protein, 9 aa, Homo Sapiens
LFFLCSNGV

SEQ ID NO: 1157960 - protein, 9 aa, Homo Sapiens
PGSSPAPLC

SEQ ID NO: 1157961 - protein, 9 aa, Homo Sapiens
SHLPLLARP

SEQ ID NO: 1157962 - protein, 9 aa, Homo Sapiens
SCLLVFEVI

SEQ ID NO: 1157963 - protein, 9 aa, Homo Sapiens
KDARDPVTR

SEQ ID NO: 1157964 - protein, 9 aa, Homo Sapiens
NGVNPVYNE

SEQ ID NO: 1157965 - protein, 9 aa, Homo Sapiens
TRVQSKFRY

SEQ ID NO: 1157966 - protein, 9 aa, Homo Sapiens
LESDRYRGE

SEQ ID NO: 1157967 - protein, 9 aa, Homo Sapiens
SLRLKISQP

SEQ ID NO: 1157968 - protein, 9 aa, Homo Sapiens
VPYVTCDED

SEQ ID NO: 1157969 - protein, 9 aa, Homo Sapiens
AKGERKPSG

SEQ ID NO: 1157970 - protein, 9 aa, Homo Sapiens
EIKSLEDLR

SEQ ID NO: 1157971 - protein, 9 aa, Homo Sapiens
ETQFEYSDS

SEQ ID NO: 1157972 - protein, 9 aa, Homo Sapiens
HRDGHCGFS

SEQ ID NO: 1157973 - protein, 9 aa, Homo Sapiens
KRRRKAAKA

SEQ ID NO: 1157974 - protein, 9 aa, Homo Sapiens
GLLPLHPGC

SEQ ID NO: 1157975 - protein, 9 aa, Homo Sapiens
VRGNSIFNG

SEQ ID NO: 1157976 - protein, 9 aa, Homo Sapiens
GDNVAATFS

SEQ ID NO: 1157977 - protein, 9 aa, Homo Sapiens
LLLKRAMQF

SEQ ID NO: 1157978 - protein, 9 aa, Homo Sapiens
RRHRADNHE

SEQ ID NO: 1157979 - protein, 9 aa, Homo Sapiens
YEAIQHVHG

SEQ ID NO: 1157980 - protein, 9 aa, Homo Sapiens
GVLSQDALL

SEQ ID NO: 1157981 - protein, 9 aa, Homo Sapiens
ACLDHLDPH

SEQ ID NO: 1157982 - protein, 9 aa, Homo Sapiens
GQLEEPSYT

SEQ ID NO: 1157983 - protein, 9 aa, Homo Sapiens
ITVKFLAVF

SEQ ID NO: 1157984 - protein, 9 aa, Homo Sapiens
EGEKGFPGF

SEQ ID NO: 1157985 - protein, 9 aa, Homo Sapiens
CSNLNNKNF

SEQ ID NO: 1157986 - protein, 9 aa, Homo Sapiens
KPRDPWSRT

SEQ ID NO: 1157987 - protein, 9 aa, Homo Sapiens
EVQEEEQLE

SEQ ID NO: 1157988 - protein, 9 aa, Homo Sapiens
GDSLQSRDF

SEQ ID NO: 1157989 - protein, 9 aa, Homo Sapiens
LQMLFFTTL

SEQ ID NO: 1157990 - protein, 9 aa, Homo Sapiens
ARHYLTPIY

SEQ ID NO: 1157991 - protein, 9 aa, Homo Sapiens
IRDTSQTST

SEQ ID NO: 1157992 - protein, 9 aa, Homo Sapiens
QGNLPKPIN

SEQ ID NO: 1157993 - protein, 9 aa, Homo Sapiens
ETVNLACRV

SEQ ID NO: 1157994 - protein, 9 aa, Homo Sapiens
HNFVGTFSR

SEQ ID NO: 1157995 - protein, 9 aa, Homo Sapiens
HIADMSYFV

SEQ ID NO: 1157996 - protein, 9 aa, Homo Sapiens
SECMIRVFS

SEQ ID NO: 1157997 - protein, 9 aa, Homo Sapiens
HNQGYCCHG

SEQ ID NO: 1157998 - protein, 9 aa, Homo Sapiens
HYKICRRAG

SEQ ID NO: 1157999 - protein, 9 aa, Homo Sapiens
EQLEEETGG

SEQ ID NO: 1158000 - protein, 9 aa, Homo Sapiens
CSIVGTVEL

SEQ ID NO: 1158001 - protein, 9 aa, Homo Sapiens
FDLVAHEDG

SEQ ID NO: 1158002 - protein, 9 aa, Homo Sapiens
IISATSYED

SEQ ID NO: 1158003 - protein, 9 aa, Homo Sapiens
QGYCCHGHG

SEQ ID NO: 1158004 - protein, 9 aa, Homo Sapiens
SQLTQHQRV

SEQ ID NO: 1158005 - protein, 9 aa, Homo Sapiens
IRVFSSHVF

SEQ ID NO: 1158006 - protein, 9 aa, Homo Sapiens
ADMSYFVPE

SEQ ID NO: 1158007 - protein, 9 aa, Homo Sapiens
EEEQLEEET

SEQ ID NO: 1158008 - protein, 9 aa, Homo Sapiens
IQEMHKLAK

SEQ ID NO: 1158009 - protein, 9 aa, Homo Sapiens
RLSSYYKLK

SEQ ID NO: 1158010 - protein, 9 aa, Homo Sapiens
RTAVCASIP

SEQ ID NO: 1158011 - protein, 9 aa, Homo Sapiens
HYPLNFMCL

SEQ ID NO: 1158012 - protein, 9 aa, Homo Sapiens
ARPAAPPPK

SEQ ID NO: 1158013 - protein, 9 aa, Homo Sapiens
KCHQDSAGN

SEQ ID NO: 1158014 - protein, 9 aa, Homo Sapiens
KLKLTREVL

SEQ ID NO: 1158015 - protein, 9 aa, Homo Sapiens
CSRIFRGLH

SEQ ID NO: 1158016 - protein, 9 aa, Homo Sapiens
DDTHVREVS

SEQ ID NO: 1158017 - protein, 9 aa, Homo Sapiens
TVKFLAVFG

SEQ ID NO: 1158018 - protein, 9 aa, Homo Sapiens
MAATYCRSL

SEQ ID NO: 1158019 - protein, 9 aa, Homo Sapiens
GTFSREDSD

SEQ ID NO: 1158020 - protein, 9 aa, Homo Sapiens
ANFKISSDL

SEQ ID NO: 1158021 - protein, 9 aa, Homo Sapiens
LPLELTVEP

SEQ ID NO: 1158022 - protein, 9 aa, Homo Sapiens
GFLLLRPEW

SEQ ID NO: 1158023 - protein, 9 aa, Homo Sapiens
LGWQSLRRD

SEQ ID NO: 1158024 - protein, 9 aa, Homo Sapiens
FHNQKRAGW

SEQ ID NO: 1158025 - protein, 9 aa, Homo Sapiens
LRALREAMF

SEQ ID NO: 1158026 - protein, 9 aa, Homo Sapiens
YDRMAKVVA

SEQ ID NO: 1158027 - protein, 9 aa, Homo Sapiens
DTSQTSTLQ

SEQ ID NO: 1158028 - protein, 9 aa, Homo Sapiens
GKRRPLIAF

SEQ ID NO: 1158029 - protein, 9 aa, Homo Sapiens
LDPHQPPKC

SEQ ID NO: 1158030 - protein, 9 aa, Homo Sapiens
TRQSLAARH

SEQ ID NO: 1158031 - protein, 9 aa, Homo Sapiens
DPISKPPFL

SEQ ID NO: 1158032 - protein, 9 aa, Homo Sapiens
AVRHYKICR

SEQ ID NO: 1158033 - protein, 9 aa, Homo Sapiens
LGRQMRCEL

SEQ ID NO: 1158034 - protein, 9 aa, Homo Sapiens
GTTHRGDVD

SEQ ID NO: 1158035 - protein, 9 aa, Homo Sapiens
YFLEKREEH

SEQ ID NO: 1158036 - protein, 9 aa, Homo Sapiens
LWILTSAAM

SEQ ID NO: 1158037 - protein, 9 aa, Homo Sapiens
MEVYDRMAK

SEQ ID NO: 1158038 - protein, 9 aa, Homo Sapiens
CLHKHCEAA

SEQ ID NO: 1158039 - protein, 9 aa, Homo Sapiens
SLLGWQSLR

SEQ ID NO: 1158040 - protein, 9 aa, Homo Sapiens
LEKLQKLTT

SEQ ID NO: 1158041 - protein, 9 aa, Homo Sapiens
TYCRSLHLY

SEQ ID NO: 1158042 - protein, 9 aa, Homo Sapiens
WLQTQREML

SEQ ID NO: 1158043 - protein, 9 aa, Homo Sapiens
QSLAARHYL

SEQ ID NO: 1158044 - protein, 9 aa, Homo Sapiens
FACMQDGTV

SEQ ID NO: 1158045 - protein, 9 aa, Homo Sapiens
QAAISFNLP

SEQ ID NO: 1158046 - protein, 9 aa, Homo Sapiens
TIRDTSQTS

SEQ ID NO: 1158047 - protein, 9 aa, Homo Sapiens
THCLRMVEN

SEQ ID NO: 1158048 - protein, 9 aa, Homo Sapiens
LELTVEPTE

SEQ ID NO: 1158049 - protein, 9 aa, Homo Sapiens
FRIMRLVKL

SEQ ID NO: 1158050 - protein, 9 aa, Homo Sapiens
LSRNTELKK

SEQ ID NO: 1158051 - protein, 9 aa, Homo Sapiens
CSVVYHEVL

SEQ ID NO: 1158052 - protein, 9 aa, Homo Sapiens
DEPSPVPSV

SEQ ID NO: 1158053 - protein, 9 aa, Homo Sapiens
IPIISATSY

SEQ ID NO: 1158054 - protein, 9 aa, Homo Sapiens
GGDGINSFG

SEQ ID NO: 1158055 - protein, 9 aa, Homo Sapiens
LFHALGEKQ

SEQ ID NO: 1158056 - protein, 9 aa, Homo Sapiens
NRVNTANSS

SEQ ID NO: 1158057 - protein, 9 aa, Homo Sapiens
IQHVHGPPR

SEQ ID NO: 1158058 - protein, 9 aa, Homo Sapiens
TTHVVMKTN

SEQ ID NO: 1158059 - protein, 9 aa, Homo Sapiens
LSTIRDTSQ

SEQ ID NO: 1158060 - protein, 9 aa, Homo Sapiens
PGIEGEKGF

SEQ ID NO: 1158061 - protein, 9 aa, Homo Sapiens
LCHLWLQTQ

SEQ ID NO: 1158062 - protein, 9 aa, Homo Sapiens
KTEKCPPRF

SEQ ID NO: 1158063 - protein, 9 aa, Homo Sapiens
GTLLEKLQK

SEQ ID NO: 1158064 - protein, 9 aa, Homo Sapiens
PSVEEVTLP

SEQ ID NO: 1158065 - protein, 9 aa, Homo Sapiens
ERLMAATYC

SEQ ID NO: 1158066 - protein, 9 aa, Homo Sapiens
HRARGSQRL

SEQ ID NO: 1158067 - protein, 9 aa, Homo Sapiens
YRCHYYSCA

SEQ ID NO: 1158068 - protein, 9 aa, Homo Sapiens
SSTNTMTIP

SEQ ID NO: 1158069 - protein, 9 aa, Homo Sapiens
PVCRCDSDG

SEQ ID NO: 1158070 - protein, 9 aa, Homo Sapiens
DEKNKTAPE

SEQ ID NO: 1158071 - protein, 9 aa, Homo Sapiens
AAVALGRQM

SEQ ID NO: 1158072 - protein, 9 aa, Homo Sapiens
ETGIKEEAS

SEQ ID NO: 1158073 - protein, 9 aa, Homo Sapiens
NLACRVTGT

SEQ ID NO: 1158074 - protein, 9 aa, Homo Sapiens
YCCHGHGPP

SEQ ID NO: 1158075 - protein, 9 aa, Homo Sapiens
DPHQPPKCI

SEQ ID NO: 1158076 - protein, 9 aa, Homo Sapiens
LAARHYLTP

SEQ ID NO: 1158077 - protein, 9 aa, Homo Sapiens
MHKLAKRCW

SEQ ID NO: 1158078 - protein, 9 aa, Homo Sapiens
VALGRQMRC

SEQ ID NO: 1158079 - protein, 9 aa, Homo Sapiens
EKREEHVTV

SEQ ID NO: 1158080 - protein, 9 aa, Homo Sapiens
LKSCLHKHC

SEQ ID NO: 1158081 - protein, 9 aa, Homo Sapiens
VEPGTRQSL

SEQ ID NO: 1158082 - protein, 9 aa, Homo Sapiens
FHSAEHGYV

SEQ ID NO: 1158083 - protein, 9 aa, Homo Sapiens
ATHRIPIIS

SEQ ID NO: 1158084 - protein, 9 aa, Homo Sapiens
YSQAAISFN

SEQ ID NO: 1158085 - protein, 9 aa, Homo Sapiens
TVNLACRVT

SEQ ID NO: 1158086 - protein, 9 aa, Homo Sapiens
GLRQQSITV

SEQ ID NO: 1158087 - protein, 9 aa, Homo Sapiens
TTHRGDVDE

SEQ ID NO: 1158088 - protein, 9 aa, Homo Sapiens
EFQIGQTPL

SEQ ID NO: 1158089 - protein, 9 aa, Homo Sapiens
TEGLEYPTI

SEQ ID NO: 1158090 - protein, 9 aa, Homo Sapiens
ELGETVNLA

SEQ ID NO: 1158091 - protein, 9 aa, Homo Sapiens
YINLEKETK

SEQ ID NO: 1158092 - protein, 9 aa, Homo Sapiens
IVGTVELYV

SEQ ID NO: 1158093 - protein, 9 aa, Homo Sapiens
ALREAMFHS

SEQ ID NO: 1158094 - protein, 9 aa, Homo Sapiens
GDTCQLDVD

SEQ ID NO: 1158095 - protein, 9 aa, Homo Sapiens
GASGQLEEP

SEQ ID NO: 1158096 - protein, 9 aa, Homo Sapiens
GERLMAATY

SEQ ID NO: 1158097 - protein, 9 aa, Homo Sapiens
INLEKETKT

SEQ ID NO: 1158098 - protein, 9 aa, Homo Sapiens
SRTWLEPRK

SEQ ID NO: 1158099 - protein, 9 aa, Homo Sapiens
NCSVVYHEV

SEQ ID NO: 1158100 - protein, 9 aa, Homo Sapiens
RLFHNQKRA

SEQ ID NO: 1158101 - protein, 9 aa, Homo Sapiens
FLEKREEHV

SEQ ID NO: 1158102 - protein, 9 aa, Homo Sapiens
TNAEFVCER

SEQ ID NO: 1158103 - protein, 9 aa, Homo Sapiens
AIQHVHGPP

SEQ ID NO: 1158104 - protein, 9 aa, Homo Sapiens
ICRRAGGRL

SEQ ID NO: 1158105 - protein, 9 aa, Homo Sapiens
GLLRACRLS

SEQ ID NO: 1158106 - protein, 9 aa, Homo Sapiens
VPFPDVELR

SEQ ID NO: 1158107 - protein, 9 aa, Homo Sapiens
KVYINLEKE

SEQ ID NO: 1158108 - protein, 9 aa, Homo Sapiens
TIPVCRCDS

SEQ ID NO: 1158109 - protein, 9 aa, Homo Sapiens
MDEPSPVPS

SEQ ID NO: 1158110 - protein, 9 aa, Homo Sapiens
KTQSESGDL

SEQ ID NO: 1158111 - protein, 9 aa, Homo Sapiens
GNNRVNTAN

SEQ ID NO: 1158112 - protein, 9 aa, Homo Sapiens
LLGWQSLRR

SEQ ID NO: 1158113 - protein, 9 aa, Homo Sapiens
WTRVEPGTR

SEQ ID NO: 1158114 - protein, 9 aa, Homo Sapiens
GSSWTRVEP

SEQ ID NO: 1158115 - protein, 9 aa, Homo Sapiens
VALHCTNCS

SEQ ID NO: 1158116 - protein, 9 aa, Homo Sapiens
STIRDTSQT

SEQ ID NO: 1158117 - protein, 9 aa, Homo Sapiens
IEGEKGFPG

SEQ ID NO: 1158118 - protein, 9 aa, Homo Sapiens
LLLRPEWQK

SEQ ID NO: 1158119 - protein, 9 aa, Homo Sapiens
EGTLLEKLQ

SEQ ID NO: 1158120 - protein, 9 aa, Homo Sapiens
DKSFALKSC

SEQ ID NO: 1158121 - protein, 9 aa, Homo Sapiens
FTTLLSIDI

SEQ ID NO: 1158122 - protein, 9 aa, Homo Sapiens
LTVEPTEET

SEQ ID NO: 1158123 - protein, 9 aa, Homo Sapiens
LRAVCLWIL

SEQ ID NO: 1158124 - protein, 9 aa, Homo Sapiens
GPPGIEGEK

SEQ ID NO: 1158125 - protein, 9 aa, Homo Sapiens
ASFKFGQGN

SEQ ID NO: 1158126 - protein, 9 aa, Homo Sapiens
QEKQKACHR

SEQ ID NO: 1158127 - protein, 9 aa, Homo Sapiens
NGVEFACMQ

SEQ ID NO: 1158128 - protein, 9 aa, Homo Sapiens
KTCSDPISK

SEQ ID NO: 1158129 - protein, 9 aa, Homo Sapiens
NIEMETGIK

SEQ ID NO: 1158130 - protein, 9 aa, Homo Sapiens
LRGKRRPLI

SEQ ID NO: 1158131 - protein, 9 aa, Homo Sapiens
TTLLSIDIR

SEQ ID NO: 1158132 - protein, 9 aa, Homo Sapiens
PCSNLNNKN

SEQ ID NO: 1158133 - protein, 9 aa, Homo Sapiens
ALHCTNCSV

SEQ ID NO: 1158134 - protein, 9 aa, Homo Sapiens
EVYDRMAKV

SEQ ID NO: 1158135 - protein, 9 aa, Homo Sapiens
LEYPTIEEQ

SEQ ID NO: 1158136 - protein, 9 aa, Homo Sapiens
RGDVDECSM

SEQ ID NO: 1158137 - protein, 9 aa, Homo Sapiens
CNGVEFACM

SEQ ID NO: 1158138 - protein, 9 aa, Homo Sapiens
SQRLLPDER

SEQ ID NO: 1158139 - protein, 9 aa, Homo Sapiens
THVVMKTNA

SEQ ID NO: 1158140 - protein, 9 aa, Homo Sapiens
LNNKNFSPG

SEQ ID NO: 1158141 - protein, 9 aa, Homo Sapiens
SCAGWSEPS

SEQ ID NO: 1158142 - protein, 9 aa, Homo Sapiens
PRKPRDPWS

SEQ ID NO: 1158143 - protein, 9 aa, Homo Sapiens
VKYNIVGVR

SEQ ID NO: 1158144 - protein, 9 aa, Homo Sapiens
INSFGGGQK

SEQ ID NO: 1158145 - protein, 9 aa, Homo Sapiens
TVAFNDSRD

SEQ ID NO: 1158146 - protein, 9 aa, Homo Sapiens
RLLPDERWK

SEQ ID NO: 1158147 - protein, 9 aa, Homo Sapiens
ACHRARGSQ

SEQ ID NO: 1158148 - protein, 9 aa, Homo Sapiens
THRGDVDEC

SEQ ID NO: 1158149 - protein, 9 aa, Homo Sapiens
FSPGSSWTR

SEQ ID NO: 1158150 - protein, 9 aa, Homo Sapiens
ISTVLWETV

SEQ ID NO: 1158151 - protein, 9 aa, Homo Sapiens
NCSRIFRGL

SEQ ID NO: 1158152 - protein, 9 aa, Homo Sapiens
SESGDLSRN

SEQ ID NO: 1158153 - protein, 9 aa, Homo Sapiens
FALKSCLHK

SEQ ID NO: 1158154 - protein, 9 aa, Homo Sapiens
LNFMCLITL

SEQ ID NO: 1158155 - protein, 9 aa, Homo Sapiens
CWLCSANFK

SEQ ID NO: 1158156 - protein, 9 aa, Homo Sapiens
EAIQHVHGP

SEQ ID NO: 1158157 - protein, 9 aa, Homo Sapiens
VAFNDSRDP

SEQ ID NO: 1158158 - protein, 9 aa, Homo Sapiens
IADMSYFVP

SEQ ID NO: 1158159 - protein, 9 aa, Homo Sapiens
ARGSQRLLP

SEQ ID NO: 1158160 - protein, 9 aa, Homo Sapiens
REEHVTVVV

SEQ ID NO: 1158161 - protein, 9 aa, Homo Sapiens
GETVNLACR

SEQ ID NO: 1158162 - protein, 9 aa, Homo Sapiens
KVGVHIADM

SEQ ID NO: 1158163 - protein, 9 aa, Homo Sapiens
ENNVYSQAA

SEQ ID NO: 1158164 - protein, 9 aa, Homo Sapiens
VDMKSLLGW

SEQ ID NO: 1158165 - protein, 9 aa, Homo Sapiens
LREAMFHSA

SEQ ID NO: 1158166 - protein, 9 aa, Homo Sapiens
DRLSSYYKL

SEQ ID NO: 1158167 - protein, 9 aa, Homo Sapiens
RLMAATYCR

SEQ ID NO: 1158168 - protein, 9 aa, Homo Sapiens
GINSFGGGQ

SEQ ID NO: 1158169 - protein, 9 aa, Homo Sapiens
SLAARHYLT

SEQ ID NO: 1158170 - protein, 9 aa, Homo Sapiens
QTPLSEQRK

SEQ ID NO: 1158171 - protein, 9 aa, Homo Sapiens
TNCSVVYHE

SEQ ID NO: 1158172 - protein, 9 aa, Homo Sapiens
AVALGRQMR

SEQ ID NO: 1158173 - protein, 9 aa, Homo Sapiens
PARPAAPPP

SEQ ID NO: 1158174 - protein, 9 aa, Homo Sapiens
FVGTFSRED

SEQ ID NO: 1158175 - protein, 9 aa, Homo Sapiens
LLPDERWKC

SEQ ID NO: 1158176 - protein, 9 aa, Homo Sapiens
REAMFHSAE

SEQ ID NO: 1158177 - protein, 9 aa, Homo Sapiens
SFGGGQKVR

SEQ ID NO: 1158178 - protein, 9 aa, Homo Sapiens
RGFSDKSNL

SEQ ID NO: 1158179 - protein, 9 aa, Homo Sapiens
AEQPARPAA

SEQ ID NO: 1158180 - protein, 9 aa, Homo Sapiens
WLEPRKPRD

SEQ ID NO: 1158181 - protein, 9 aa, Homo Sapiens
VMKTNAEFV

SEQ ID NO: 1158182 - protein, 9 aa, Homo Sapiens
VVMKTNAEF

SEQ ID NO: 1158183 - protein, 9 aa, Homo Sapiens
SIGRRLDFV

SEQ ID NO: 1158184 - protein, 9 aa, Homo Sapiens
AIGRLFHNQ

SEQ ID NO: 1158185 - protein, 9 aa, Homo Sapiens
STNTMTIPV

SEQ ID NO: 1158186 - protein, 9 aa, Homo Sapiens
GGFLLLRPE

SEQ ID NO: 1158187 - protein, 9 aa, Homo Sapiens
GVHIADMSY

SEQ ID NO: 1158188 - protein, 9 aa, Homo Sapiens
ENIEMETGI

SEQ ID NO: 1158189 - protein, 9 aa, Homo Sapiens
MCLITLMYL

SEQ ID NO: 1158190 - protein, 9 aa, Homo Sapiens
IMRLVKLLS

SEQ ID NO: 1158191 - protein, 9 aa, Homo Sapiens
IAPTPQKPA

SEQ ID NO: 1158192 - protein, 9 aa, Homo Sapiens
AELGETVNL

SEQ ID NO: 1158193 - protein, 9 aa, Homo Sapiens
LPCSNLNNK

SEQ ID NO: 1158194 - protein, 9 aa, Homo Sapiens
PKVYINLEK

SEQ ID NO: 1158195 - protein, 9 aa, Homo Sapiens
NNRVNTANS

SEQ ID NO: 1158196 - protein, 9 aa, Homo Sapiens
DTGVLSQDA

SEQ ID NO: 1158197 - protein, 9 aa, Homo Sapiens
NKNFSPGSS

SEQ ID NO: 1158198 - protein, 9 aa, Homo Sapiens
CLDHLDPHQ

SEQ ID NO: 1158199 - protein, 9 aa, Homo Sapiens
GVLTPLLGI

SEQ ID NO: 1158200 - protein, 9 aa, Homo Sapiens
EEQLEEETG

SEQ ID NO: 1158201 - protein, 9 aa, Homo Sapiens
VEPTEETFN

SEQ ID NO: 1158202 - protein, 9 aa, Homo Sapiens
NDSRDPLSS

SEQ ID NO: 1158203 - protein, 9 aa, Homo Sapiens
RQQSITVKF

SEQ ID NO: 1158204 - protein, 9 aa, Homo Sapiens
LTFSIGRRL

SEQ ID NO: 1158205 - protein, 9 aa, Homo Sapiens
RKFGLQGDS

SEQ ID NO: 1158206 - protein, 9 aa, Homo Sapiens
AGSAEQPAR

SEQ ID NO: 1158207 - protein, 9 aa, Homo Sapiens
EAIGRLFHN

SEQ ID NO: 1158208 - protein, 9 aa, Homo Sapiens
MKVVGNNRV

SEQ ID NO: 1158209 - protein, 9 aa, Homo Sapiens
YSENIEMET

SEQ ID NO: 1158210 - protein, 9 aa, Homo Sapiens
EMHKLAKRC

SEQ ID NO: 1158211 - protein, 9 aa, Homo Sapiens
KACHRARGS

SEQ ID NO: 1158212 - protein, 9 aa, Homo Sapiens
LWGQPAVPF

SEQ ID NO: 1158213 - protein, 9 aa, Homo Sapiens
CSDPISKPP

SEQ ID NO: 1158214 - protein, 9 aa, Homo Sapiens
LTPLLGITW

SEQ ID NO: 1158215 - protein, 9 aa, Homo Sapiens
ETVLLQLLK

SEQ ID NO: 1158216 - protein, 9 aa, Homo Sapiens
SGLRQQSIT

SEQ ID NO: 1158217 - protein, 9 aa, Homo Sapiens
SIVGTVELY

SEQ ID NO: 1158218 - protein, 9 aa, Homo Sapiens
ILLTFSIGR

SEQ ID NO: 1158219 - protein, 9 aa, Homo Sapiens
YYKLKLTRE

SEQ ID NO: 1158220 - protein, 9 aa, Homo Sapiens
YLAGCLFHA

SEQ ID NO: 1158221 - protein, 9 aa, Homo Sapiens
KNKTAPEYY

SEQ ID NO: 1158222 - protein, 9 aa, Homo Sapiens
HQQQQQQMQ

SEQ ID NO: 1158223 - protein, 9 aa, Homo Sapiens
KREEHVTVV

SEQ ID NO: 1158224 - protein, 9 aa, Homo Sapiens
HCTNCSVVY

SEQ ID NO: 1158225 - protein, 9 aa, Homo Sapiens
GQPAVPFPD

SEQ ID NO: 1158226 - protein, 9 aa, Homo Sapiens
SFKFGQGNL

SEQ ID NO: 1158227 - protein, 9 aa, Homo Sapiens
QCWLCSANF

SEQ ID NO: 1158228 - protein, 9 aa, Homo Sapiens
SRDPLSSYN

SEQ ID NO: 1158229 - protein, 9 aa, Homo Sapiens
IFRGLHFIT

SEQ ID NO: 1158230 - protein, 9 aa, Homo Sapiens
DRMAKVVAP

SEQ ID NO: 1158231 - protein, 9 aa, Homo Sapiens
SRASLADAV

SEQ ID NO: 1158232 - protein, 9 aa, Homo Sapiens
HYYSCAGWS

SEQ ID NO: 1158233 - protein, 9 aa, Homo Sapiens
THRIPIISA

SEQ ID NO: 1158234 - protein, 9 aa, Homo Sapiens
PQKPAYEKK

SEQ ID NO: 1158235 - protein, 9 aa, Homo Sapiens
RTWLEPRKP

SEQ ID NO: 1158236 - protein, 9 aa, Homo Sapiens
LSGPPGIEG

SEQ ID NO: 1158237 - protein, 9 aa, Homo Sapiens
GELSTIRDT

SEQ ID NO: 1158238 - protein, 9 aa, Homo Sapiens
GWRGDTCQL

SEQ ID NO: 1158239 - protein, 9 aa, Homo Sapiens
LHELSRTAV

SEQ ID NO: 1158240 - protein, 9 aa, Homo Sapiens
CTHCLRMVE

SEQ ID NO: 1158241 - protein, 9 aa, Homo Sapiens
PFPDVELRL

SEQ ID NO: 1158242 - protein, 9 aa, Homo Sapiens
LAGCLFHAL

SEQ ID NO: 1158243 - protein, 9 aa, Homo Sapiens
EKNKTAPEY

SEQ ID NO: 1158244 - protein, 9 aa, Homo Sapiens
KSLLGWQSL

SEQ ID NO: 1158245 - protein, 9 aa, Homo Sapiens
EKQKACHRA

SEQ ID NO: 1158246 - protein, 9 aa, Homo Sapiens
NRRIQEMHK

SEQ ID NO: 1158247 - protein, 9 aa, Homo Sapiens
VGTVELYVP

SEQ ID NO: 1158248 - protein, 9 aa, Homo Sapiens
PLELTVEPT

SEQ ID NO: 1158249 - protein, 9 aa, Homo Sapiens
EPGTRQSLA

SEQ ID NO: 1158250 - protein, 9 aa, Homo Sapiens
ASGQLEEPS

SEQ ID NO: 1158251 - protein, 9 aa, Homo Sapiens
GYLAGCLFH

SEQ ID NO: 1158252 - protein, 9 aa, Homo Sapiens
HLDPHQPPK

SEQ ID NO: 1158253 - protein, 9 aa, Homo Sapiens
SDPISKPPF

SEQ ID NO: 1158254 - protein, 9 aa, Homo Sapiens
YILYGTTHR

SEQ ID NO: 1158255 - protein, 9 aa, Homo Sapiens
KVVGNNRVN

SEQ ID NO: 1158256 - protein, 9 aa, Homo Sapiens
DSLQSRDFH

SEQ ID NO: 1158257 - protein, 9 aa, Homo Sapiens
SWTRVEPGT

SEQ ID NO: 1158258 - protein, 9 aa, Homo Sapiens
RLRAVCLWI

SEQ ID NO: 1158259 - protein, 9 aa, Homo Sapiens
KPAYEKKQN

SEQ ID NO: 1158260 - protein, 9 aa, Homo Sapiens
HVHGPPREE

SEQ ID NO: 1158261 - protein, 9 aa, Homo Sapiens
PIISATSYE

SEQ ID NO: 1158262 - protein, 9 aa, Homo Sapiens
SHYPLNFMC

SEQ ID NO: 1158263 - protein, 9 aa, Homo Sapiens
ADAVPLHIA

SEQ ID NO: 1158264 - protein, 9 aa, Homo Sapiens
PTPQKPAYE

SEQ ID NO: 1158265 - protein, 9 aa, Homo Sapiens
WILTSAAMS

SEQ ID NO: 1158266 - protein, 9 aa, Homo Sapiens
VYEAIQHVH

SEQ ID NO: 1158267 - protein, 9 aa, Homo Sapiens
HPKVYINLE

SEQ ID NO: 1158268 - protein, 9 aa, Homo Sapiens
RIQEMHKLA

SEQ ID NO: 1158269 - protein, 9 aa, Homo Sapiens
AISFNLPCS

SEQ ID NO: 1158270 - protein, 9 aa, Homo Sapiens
ILTSAAMSR

SEQ ID NO: 1158271 - protein, 9 aa, Homo Sapiens
LIAFCLLMI

SEQ ID NO: 1158272 - protein, 9 aa, Homo Sapiens
TPGNCSRIF

SEQ ID NO: 1158273 - protein, 9 aa, Homo Sapiens
RGSQRLLPD

SEQ ID NO: 1158274 - protein, 9 aa, Homo Sapiens
EPTEETFNA

SEQ ID NO: 1158275 - protein, 9 aa, Homo Sapiens
VYSQAAISF

SEQ ID NO: 1158276 - protein, 9 aa, Homo Sapiens
TVLWETVLL

SEQ ID NO: 1158277 - protein, 9 aa, Homo Sapiens
EEHVTVVVG

SEQ ID NO: 1158278 - protein, 9 aa, Homo Sapiens
ALSPKELEI

SEQ ID NO: 1158279 - protein, 9 aa, Homo Sapiens
QPAVPFPDV

SEQ ID NO: 1158280 - protein, 9 aa, Homo Sapiens
DLSRNTELK

SEQ ID NO: 1158281 - protein, 9 aa, Homo Sapiens
SPVPSVEEV

SEQ ID NO: 1158282 - protein, 9 aa, Homo Sapiens
METGIKEEA

SEQ ID NO: 1158283 - protein, 9 aa, Homo Sapiens
EKCPPRFSN

SEQ ID NO: 1158284 - protein, 9 aa, Homo Sapiens
VRNLIGPQV

SEQ ID NO: 1158285 - protein, 9 aa, Homo Sapiens
VWKTEGTLL

SEQ ID NO: 1158286 - protein, 9 aa, Homo Sapiens
SFALKSCLH

SEQ ID NO: 1158287 - protein, 9 aa, Homo Sapiens
TEGTLLEKL

SEQ ID NO: 1158288 - protein, 9 aa, Homo Sapiens
SDKSNLLSH

SEQ ID NO: 1158289 - protein, 9 aa, Homo Sapiens
IVGVRNLIG

SEQ ID NO: 1158290 - protein, 9 aa, Homo Sapiens
QLEEETGGE

SEQ ID NO: 1158291 - protein, 9 aa, Homo Sapiens
PAYEKKQND

SEQ ID NO: 1158292 - protein, 9 aa, Homo Sapiens
RGKRRPLIA

SEQ ID NO: 1158293 - protein, 9 aa, Homo Sapiens
AATYCRSLH

SEQ ID NO: 1158294 - protein, 9 aa, Homo Sapiens
YKYVRQIFN

SEQ ID NO: 1158295 - protein, 9 aa, Homo Sapiens
QGDSLQSRD

SEQ ID NO: 1158296 - protein, 9 aa, Homo Sapiens
RLFRIMRLV

SEQ ID NO: 1158297 - protein, 9 aa, Homo Sapiens
ALKSCLHKH

SEQ ID NO: 1158298 - protein, 9 aa, Homo Sapiens
RIPIISATS

SEQ ID NO: 1158299 - protein, 9 aa, Homo Sapiens
GYCCHGHGP

SEQ ID NO: 1158300 - protein, 9 aa, Homo Sapiens
PPHNQGYCC

SEQ ID NO: 1158301 - protein, 9 aa, Homo Sapiens
LSPKELEIT

SEQ ID NO: 1158302 - protein, 9 aa, Homo Sapiens
FFRLFRIMR

SEQ ID NO: 1158303 - protein, 9 aa, Homo Sapiens
ERQGLLRAC

SEQ ID NO: 1158304 - protein, 9 aa, Homo Sapiens
LSSYYKLKL

SEQ ID NO: 1158305 - protein, 9 aa, Homo Sapiens
RMAKVVAPK

SEQ ID NO: 1158306 - protein, 9 aa, Homo Sapiens
MAKVVAPKR

SEQ ID NO: 1158307 - protein, 9 aa, Homo Sapiens
TVELYVPCE

SEQ ID NO: 1158308 - protein, 9 aa, Homo Sapiens
NNVYSQAAI

SEQ ID NO: 1158309 - protein, 9 aa, Homo Sapiens
PLIAFCLLM

SEQ ID NO: 1158310 - protein, 9 aa, Homo Sapiens
EKETKTGTC

SEQ ID NO: 1158311 - protein, 9 aa, Homo Sapiens
DSAGNPVIS

SEQ ID NO: 1158312 - protein, 9 aa, Homo Sapiens
RGGDGINSF

SEQ ID NO: 1158313 - protein, 9 aa, Homo Sapiens
QLHELSRTA

SEQ ID NO: 1158314 - protein, 9 aa, Homo Sapiens
LADAVPLHI

SEQ ID NO: 1158315 - protein, 9 aa, Homo Sapiens
TAELGETVN

SEQ ID NO: 1158316 - protein, 9 aa, Homo Sapiens
LYGTTHRGD

SEQ ID NO: 1158317 - protein, 9 aa, Homo Sapiens
WGQPAVPFP

SEQ ID NO: 1158318 - protein, 9 aa, Homo Sapiens
EFYKYVRQI

SEQ ID NO: 1158319 - protein, 9 aa, Homo Sapiens
HELSRTAVC

SEQ ID NO: 1158320 - protein, 9 aa, Homo Sapiens
RAMEVYDRM

SEQ ID NO: 1158321 - protein, 9 aa, Homo Sapiens
FFTTLLSID

SEQ ID NO: 1158322 - protein, 9 aa, Homo Sapiens
AKTEKCPPR

SEQ ID NO: 1158323 - protein, 9 aa, Homo Sapiens
QYFLEKREE

SEQ ID NO: 1158324 - protein, 9 aa, Homo Sapiens
ISFNLPCSN

SEQ ID NO: 1158325 - protein, 9 aa, Homo Sapiens
ISFSECMIR

SEQ ID NO: 1158326 - protein, 9 aa, Homo Sapiens
HQPPKCITA

SEQ ID NO: 1158327 - protein, 9 aa, Homo Sapiens
LWLQTQREM

SEQ ID NO: 1158328 - protein, 9 aa, Homo Sapiens
LLEKLQKLT

SEQ ID NO: 1158329 - protein, 9 aa, Homo Sapiens
KTEGTLLEK

SEQ ID NO: 1158330 - protein, 9 aa, Homo Sapiens
EGLEYPTIE

SEQ ID NO: 1158331 - protein, 9 aa, Homo Sapiens
CAGWSEPSD

SEQ ID NO: 1158332 - protein, 9 aa, Homo Sapiens
TQSESGDLS

SEQ ID NO: 1158333 - protein, 9 aa, Homo Sapiens
NKTAPEYYL

SEQ ID NO: 1158334 - protein, 9 aa, Homo Sapiens
KFGLQGDSL

SEQ ID NO: 1158335 - protein, 9 aa, Homo Sapiens
ASLADAVPL

SEQ ID NO: 1158336 - protein, 9 aa, Homo Sapiens
YGTTHRGDV

SEQ ID NO: 1158337 - protein, 9 aa, Homo Sapiens
NNKNFSPGS

SEQ ID NO: 1158338 - protein, 9 aa, Homo Sapiens
VLTPLLGIT

SEQ ID NO: 1158339 - protein, 9 aa, Homo Sapiens
LWETVLLQL

SEQ ID NO: 1158340 - protein, 9 aa, Homo Sapiens
VELYVPCEP

SEQ ID NO: 1158341 - protein, 9 aa, Homo Sapiens
PPGIEGEKG

SEQ ID NO: 1158342 - protein, 9 aa, Homo Sapiens
MSYFVPEGS

SEQ ID NO: 1158343 - protein, 9 aa, Homo Sapiens
VLWETVLLQ

SEQ ID NO: 1158344 - protein, 9 aa, Homo Sapiens
IPVCRCDSD

SEQ ID NO: 1158345 - protein, 9 aa, Homo Sapiens
QSITVKFLA

SEQ ID NO: 1158346 - protein, 9 aa, Homo Sapiens
EELSQALSP

SEQ ID NO: 1158347 - protein, 9 aa, Homo Sapiens
VSDNDTGVL

SEQ ID NO: 1158348 - protein, 9 aa, Homo Sapiens
TRVEPGTRQ

SEQ ID NO: 1158349 - protein, 9 aa, Homo Sapiens
PLLGITWGF

SEQ ID NO: 1158350 - protein, 9 aa, Homo Sapiens
YNIVGVRNL

SEQ ID NO: 1158351 - protein, 9 aa, Homo Sapiens
DNDTGVLSQ

SEQ ID NO: 1158352 - protein, 9 aa, Homo Sapiens
QAVRHYKIC

SEQ ID NO: 1158353 - protein, 9 aa, Homo Sapiens
QPARPAAPP

SEQ ID NO: 1158354 - protein, 9 aa, Homo Sapiens
DLVAHEDGV

SEQ ID NO: 1158355 - protein, 9 aa, Homo Sapiens
RFSNNPKEL

SEQ ID NO: 1158356 - protein, 9 aa, Homo Sapiens
GSQRLLPDE

SEQ ID NO: 1158357 - protein, 9 aa, Homo Sapiens
ISKPPFLLE

SEQ ID NO: 1158358 - protein, 9 aa, Homo Sapiens
ELSTIRDTS

SEQ ID NO: 1158359 - protein, 9 aa, Homo Sapiens
EMETGIKEE

SEQ ID NO: 1158360 - protein, 9 aa, Homo Sapiens
PKELEITKM

SEQ ID NO: 1158361 - protein, 9 aa, Homo Sapiens
IHNFVGTFS

SEQ ID NO: 1158362 - protein, 9 aa, Homo Sapiens
HYLTPIYGQ

SEQ ID NO: 1158363 - protein, 9 aa, Homo Sapiens
KYDEKNKTA

SEQ ID NO: 1158364 - protein, 9 aa, Homo Sapiens
YKICRRAGG

SEQ ID NO: 1158365 - protein, 9 aa, Homo Sapiens
GDGINSFGG

SEQ ID NO: 1158366 - protein, 9 aa, Homo Sapiens
DERWKCHQD

SEQ ID NO: 1158367 - protein, 9 aa, Homo Sapiens
HVVMKTNAE

SEQ ID NO: 1158368 - protein, 9 aa, Homo Sapiens
RRPLIAFCL

SEQ ID NO: 1158369 - protein, 9 aa, Homo Sapiens
SGPPGIEGE

SEQ ID NO: 1158370 - protein, 9 aa, Homo Sapiens
CPPRFSNNP

SEQ ID NO: 1158371 - protein, 9 aa, Homo Sapiens
HCTHCLRMV

SEQ ID NO: 1158372 - protein, 9 aa, Homo Sapiens
KYNIVGVRN

SEQ ID NO: 1158373 - protein, 9 aa, Homo Sapiens
EAMFHSAEH

SEQ ID NO: 1158374 - protein, 9 aa, Homo Sapiens
LRQQSITVK

SEQ ID NO: 1158375 - protein, 9 aa, Homo Sapiens
HCLRMVENL

SEQ ID NO: 1158376 - protein, 9 aa, Homo Sapiens
GLEYPTIEE

SEQ ID NO: 1158377 - protein, 9 aa, Homo Sapiens
PGNCSRIFR

SEQ ID NO: 1158378 - protein, 9 aa, Homo Sapiens
PFDLVAHED

SEQ ID NO: 1158379 - protein, 9 aa, Homo Sapiens
MKTNAEFVC

SEQ ID NO: 1158380 - protein, 9 aa, Homo Sapiens
PRFSNNPKE

SEQ ID NO: 1158381 - protein, 9 aa, Homo Sapiens
SPGSSWTRV

SEQ ID NO: 1158382 - protein, 9 aa, Homo Sapiens
FRLFRIMRL

SEQ ID NO: 1158383 - protein, 9 aa, Homo Sapiens
APTPQKPAY

SEQ ID NO: 1158384 - protein, 9 aa, Homo Sapiens
EEVQEEEQL

SEQ ID NO: 1158385 - protein, 9 aa, Homo Sapiens
TAPEYYLYQ

SEQ ID NO: 1158386 - protein, 9 aa, Homo Sapiens
MIRVFSSHV

SEQ ID NO: 1158387 - protein, 9 aa, Homo Sapiens
LLSIDIRRM

SEQ ID NO: 1158388 - protein, 9 aa, Homo Sapiens
TWLEPRKPR

SEQ ID NO: 1158389 - protein, 9 aa, Homo Sapiens
FHALGEKQP

SEQ ID NO: 1158390 - protein, 9 aa, Homo Sapiens
LEEPSYTNA

SEQ ID NO: 1158391 - protein, 9 aa, Homo Sapiens
CHYYSCAGW

SEQ ID NO: 1158392 - protein, 9 aa, Homo Sapiens
GTRQSLAAR

SEQ ID NO: 1158393 - protein, 9 aa, Homo Sapiens
PPRFSNNPK

SEQ ID NO: 1158394 - protein, 9 aa, Homo Sapiens
VYDRMAKVV

SEQ ID NO: 1158395 - protein, 9 aa, Homo Sapiens
FSIGRRLDF

SEQ ID NO: 1158396 - protein, 9 aa, Homo Sapiens
SFNLPCSNL

SEQ ID NO: 1158397 - protein, 9 aa, Homo Sapiens
GSAEQPARP

SEQ ID NO: 1158398 - protein, 9 aa, Homo Sapiens
QQSITVKFL

SEQ ID NO: 1158399 - protein, 9 aa, Homo Sapiens
MFHSAEHGY

SEQ ID NO: 1158400 - protein, 9 aa, Homo Sapiens
PDERWKCHQ

SEQ ID NO: 1158401 - protein, 9 aa, Homo Sapiens
TLLEKLQKL

SEQ ID NO: 1158402 - protein, 9 aa, Homo Sapiens
FRGLHFITR

SEQ ID NO: 1158403 - protein, 9 aa, Homo Sapiens
KKERQGLLR

SEQ ID NO: 1158404 - protein, 9 aa, Homo Sapiens
LCSANFKIS

SEQ ID NO: 1158405 - protein, 9 aa, Homo Sapiens
IKKTCSDPI

SEQ ID NO: 1158406 - protein, 9 aa, Homo Sapiens
RQSLAARHY

SEQ ID NO: 1158407 - protein, 9 aa, Homo Sapiens
DSRDPLSSY

SEQ ID NO: 1158408 - protein, 9 aa, Homo Sapiens
PISKPPFLL

SEQ ID NO: 1158409 - protein, 9 aa, Homo Sapiens
RKPRDPWSR

SEQ ID NO: 1158410 - protein, 9 aa, Homo Sapiens
SAGNPVISS

SEQ ID NO: 1158411 - protein, 9 aa, Homo Sapiens
DGINSFGGG

SEQ ID NO: 1158412 - protein, 9 aa, Homo Sapiens
DHLDPHQPP

SEQ ID NO: 1158413 - protein, 9 aa, Homo Sapiens
SNLNNKNFS

SEQ ID NO: 1158414 - protein, 9 aa, Homo Sapiens
MHQQQQQQM

SEQ ID NO: 1158415 - protein, 9 aa, Homo Sapiens
LFFTTLLSI

SEQ ID NO: 1158416 - protein, 9 aa, Homo Sapiens
VGVRNLIGP

SEQ ID NO: 1158417 - protein, 9 aa, Homo Sapiens
RWKCHQDSA

SEQ ID NO: 1158418 - protein, 9 aa, Homo Sapiens
CQLDVDECS

SEQ ID NO: 1158419 - protein, 9 aa, Homo Sapiens
TSDDTHVRE

SEQ ID NO: 1158420 - protein, 9 aa, Homo Sapiens
NLEKETKTG

SEQ ID NO: 1158421 - protein, 9 aa, Homo Sapiens
YVRQIFNNS

SEQ ID NO: 1158422 - protein, 9 aa, Homo Sapiens
YPLNFMCLI

SEQ ID NO: 1158423 - protein, 9 aa, Homo Sapiens
NLNNKNFSP

SEQ ID NO: 1158424 - protein, 9 aa, Homo Sapiens
KLRGKRRPL

SEQ ID NO: 1158425 - protein, 9 aa, Homo Sapiens
DTVAFNDSR

SEQ ID NO: 1158426 - protein, 9 aa, Homo Sapiens
KFGQGNLPK

SEQ ID NO: 1158427 - protein, 9 aa, Homo Sapiens
DMKSLLGWQ

SEQ ID NO: 1158428 - protein, 9 aa, Homo Sapiens
ECMIRVFSS

SEQ ID NO: 1158429 - protein, 9 aa, Homo Sapiens
KMQEKQKAC

SEQ ID NO: 1158430 - protein, 9 aa, Homo Sapiens
QALSPKELE

SEQ ID NO: 1158431 - protein, 9 aa, Homo Sapiens
TVYEAIQHV

SEQ ID NO: 1158432 - protein, 9 aa, Homo Sapiens
GRGFSDKSN

SEQ ID NO: 1158433 - protein, 9 aa, Homo Sapiens
QKACHRARG

SEQ ID NO: 1158434 - protein, 9 aa, Homo Sapiens
RMVENLSME

SEQ ID NO: 1158435 - protein, 9 aa, Homo Sapiens
VNLACRVTG

SEQ ID NO: 1158436 - protein, 9 aa, Homo Sapiens
VGTFSREDS

SEQ ID NO: 1158437 - protein, 9 aa, Homo Sapiens
CMIRVFSSH

SEQ ID NO: 1158438 - protein, 9 aa, Homo Sapiens
VTEGLEYPT

SEQ ID NO: 1158439 - protein, 9 aa, Homo Sapiens
SDDTHVREV

SEQ ID NO: 1158440 - protein, 9 aa, Homo Sapiens
VHIADMSYF

SEQ ID NO: 1158441 - protein, 9 aa, Homo Sapiens
KRRPLIAFC

SEQ ID NO: 1158442 - protein, 9 aa, Homo Sapiens
DMSYFVPEG

SEQ ID NO: 1158443 - protein, 9 aa, Homo Sapiens
FSDKSNLLS

SEQ ID NO: 1158444 - protein, 9 aa, Homo Sapiens
IGQTPLSEQ

SEQ ID NO: 1158445 - protein, 9 aa, Homo Sapiens
NVHAAVALG

SEQ ID NO: 1158446 - protein, 9 aa, Homo Sapiens
TFSIGRRLD

SEQ ID NO: 1158447 - protein, 9 aa, Homo Sapiens
AVPLHIAPR

SEQ ID NO: 1158448 - protein, 9 aa, Homo Sapiens
YVTEGLEYP

SEQ ID NO: 1158449 - protein, 9 aa, Homo Sapiens
EHVTVVVGT

SEQ ID NO: 1158450 - protein, 9 aa, Homo Sapiens
NFKISSDLK

SEQ ID NO: 1158451 - protein, 9 aa, Homo Sapiens
AAISFNLPC

SEQ ID NO: 1158452 - protein, 9 aa, Homo Sapiens
RVEPGTRQS

SEQ ID NO: 1158453 - protein, 9 aa, Homo Sapiens
MGELSTIRD

SEQ ID NO: 1158454 - protein, 9 aa, Homo Sapiens
VGNNRVNTA

SEQ ID NO: 1158455 - protein, 9 aa, Homo Sapiens
GNLPKPINS

SEQ ID NO: 1158456 - protein, 9 aa, Homo Sapiens
AHEDGVDVA

SEQ ID NO: 1158457 - protein, 9 aa, Homo Sapiens
ILYGTTHRG

SEQ ID NO: 1158458 - protein, 9 aa, Homo Sapiens
CHRARGSQR

SEQ ID NO: 1158459 - protein, 9 aa, Homo Sapiens
QMLFFTTLL

SEQ ID NO: 1158460 - protein, 9 aa, Homo Sapiens
ETVYEAIQH

SEQ ID NO: 1158461 - protein, 9 aa, Homo Sapiens
TEKCPPRFS

SEQ ID NO: 1158462 - protein, 9 aa, Homo Sapiens
MQEKQKACH

SEQ ID NO: 1158463 - protein, 9 aa, Homo Sapiens
QSESGDLSR

SEQ ID NO: 1158464 - protein, 9 aa, Homo Sapiens
SVEEVTLPK

SEQ ID NO: 1158465 - protein, 9 aa, Homo Sapiens
NSFGGGQKV

SEQ ID NO: 1158466 - protein, 9 aa, Homo Sapiens
NGGFLLLRP

SEQ ID NO: 1158467 - protein, 9 aa, Homo Sapiens
VPLHIAPRW

SEQ ID NO: 1158468 - protein, 9 aa, Homo Sapiens
ECGRGFSDK

SEQ ID NO: 1158469 - protein, 9 aa, Homo Sapiens
TNCNGVEFA

SEQ ID NO: 1158470 - protein, 9 aa, Homo Sapiens
NTMTIPVCR

SEQ ID NO: 1158471 - protein, 9 aa, Homo Sapiens
GIAPTPQKP

SEQ ID NO: 1158472 - protein, 9 aa, Homo Sapiens
SSWTRVEPG

SEQ ID NO: 1158473 - protein, 9 aa, Homo Sapiens
RAVCLWILT

SEQ ID NO: 1158474 - protein, 9 aa, Homo Sapiens
KCPPRFSNN

SEQ ID NO: 1158475 - protein, 9 aa, Homo Sapiens
LGSTSDDTH

SEQ ID NO: 1158476 - protein, 9 aa, Homo Sapiens
VHAAVALGR

SEQ ID NO: 1158477 - protein, 9 aa, Homo Sapiens
ELSQALSPK

SEQ ID NO: 1158478 - protein, 9 aa, Homo Sapiens
SQALSPKEL

SEQ ID NO: 1158479 - protein, 9 aa, Homo Sapiens
GGCSIVGTV

SEQ ID NO: 1158480 - protein, 9 aa, Homo Sapiens
KTNAEFVCE

SEQ ID NO: 1158481 - protein, 9 aa, Homo Sapiens
RRIQEMHKL

SEQ ID NO: 1158482 - protein, 9 aa, Homo Sapiens
GSPLEFYKY

SEQ ID NO: 1158483 - protein, 9 aa, Homo Sapiens
YKLKLTREV

SEQ ID NO: 1158484 - protein, 9 aa, Homo Sapiens
VPSVEEVTL

SEQ ID NO: 1158485 - protein, 9 aa, Homo Sapiens
MLFFTTLLS

SEQ ID NO: 1158486 - protein, 9 aa, Homo Sapiens
AARHYLTPI

SEQ ID NO: 1158487 - protein, 9 aa, Homo Sapiens
FKFGQGNLP

SEQ ID NO: 1158488 - protein, 9 aa, Homo Sapiens
QREMLEKLT

SEQ ID NO: 1158489 - protein, 9 aa, Homo Sapiens
TQREMLEKL

SEQ ID NO: 1158490 - protein, 9 aa, Homo Sapiens
PLEFYKYVR

SEQ ID NO: 1158491 - protein, 9 aa, Homo Sapiens
LLGITWGFG

SEQ ID NO: 1158492 - protein, 9 aa, Homo Sapiens
YDEKNKTAP

SEQ ID NO: 1158493 - protein, 9 aa, Homo Sapiens
LLRPEWQKG

SEQ ID NO: 1158494 - protein, 9 aa, Homo Sapiens
TVLLQLLKE

SEQ ID NO: 1158495 - protein, 9 aa, Homo Sapiens
HQDSAGNPV

SEQ ID NO: 1158496 - protein, 9 aa, Homo Sapiens
HAAVALGRQ

SEQ ID NO: 1158497 - protein, 9 aa, Homo Sapiens
CLRMVENLS

SEQ ID NO: 1158498 - protein, 9 aa, Homo Sapiens
VCLWILTSA

SEQ ID NO: 1158499 - protein, 9 aa, Homo Sapiens
QDSAGNPVI

SEQ ID NO: 1158500 - protein, 9 aa, Homo Sapiens
VYINLEKET

SEQ ID NO: 1158501 - protein, 9 aa, Homo Sapiens
LSQALSPKE

SEQ ID NO: 1158502 - protein, 9 aa, Homo Sapiens
DTHVREVSS

SEQ ID NO: 1158503 - protein, 9 aa, Homo Sapiens
AFNDSRDPL

SEQ ID NO: 1158504 - protein, 9 aa, Homo Sapiens
GRLFHNQKR

SEQ ID NO: 1158505 - protein, 9 aa, Homo Sapiens
LGITWGFGL

SEQ ID NO: 1158506 - protein, 9 aa, Homo Sapiens
SGDLSRNTE

SEQ ID NO: 1158507 - protein, 9 aa, Homo Sapiens
VVGNNRVNT

SEQ ID NO: 1158508 - protein, 9 aa, Homo Sapiens
RIMRLVKLL

SEQ ID NO: 1158509 - protein, 9 aa, Homo Sapiens
PTEETFNAT

SEQ ID NO: 1158510 - protein, 9 aa, Homo Sapiens
PGTRQSLAA

SEQ ID NO: 1158511 - protein, 9 aa, Homo Sapiens
KSCLHKHCE

SEQ ID NO: 1158512 - protein, 9 aa, Homo Sapiens
TPLLGITWG

SEQ ID NO: 1158513 - protein, 9 aa, Homo Sapiens
RQGLLRACR

SEQ ID NO: 1158514 - protein, 9 aa, Homo Sapiens
VGYLAGCLF

SEQ ID NO: 1158515 - protein, 9 aa, Homo Sapiens
LKLTREVLS

SEQ ID NO: 1158516 - protein, 9 aa, Homo Sapiens
HRIPIISAT

SEQ ID NO: 1158517 - protein, 9 aa, Homo Sapiens
NCNGVEFAC

SEQ ID NO: 1158518 - protein, 9 aa, Homo Sapiens
HRGDVDECS

SEQ ID NO: 1158519 - protein, 9 aa, Homo Sapiens
EPSYTNAGL

SEQ ID NO: 1158520 - protein, 9 aa, Homo Sapiens
SSYYKLKLT

SEQ ID NO: 1158521 - protein, 9 aa, Homo Sapiens
QEMHKLAKR

SEQ ID NO: 1158522 - protein, 9 aa, Homo Sapiens
SRTAVCASI

SEQ ID NO: 1158523 - protein, 9 aa, Homo Sapiens
RYRCHYYSC

SEQ ID NO: 1158524 - protein, 9 aa, Homo Sapiens
EFACMQDGT

SEQ ID NO: 1158525 - protein, 9 aa, Homo Sapiens
SPLEFYKYV

SEQ ID NO: 1158526 - protein, 9 aa, Homo Sapiens
QIGQTPLSE

SEQ ID NO: 1158527 - protein, 9 aa, Homo Sapiens
GQTPLSEQR

SEQ ID NO: 1158528 - protein, 9 aa, Homo Sapiens
VGVHIADMS

SEQ ID NO: 1158529 - protein, 9 aa, Homo Sapiens
AQLHELSRT

SEQ ID NO: 1158530 - protein, 9 aa, Homo Sapiens
KSFALKSCL

SEQ ID NO: 1158531 - protein, 9 aa, Homo Sapiens
NQKRAGWAG

SEQ ID NO: 1158532 - protein, 9 aa, Homo Sapiens
ATYCRSLHL

SEQ ID NO: 1158533 - protein, 9 aa, Homo Sapiens
QKPAYEKKQ

SEQ ID NO: 1158534 - protein, 9 aa, Homo Sapiens
ACMQDGTVL

SEQ ID NO: 1158535 - protein, 9 aa, Homo Sapiens
STSDDTHVR

SEQ ID NO: 1158536 - protein, 9 aa, Homo Sapiens
YPTIEEQVD

SEQ ID NO: 1158537 - protein, 9 aa, Homo Sapiens
RHYLTPIYG

SEQ ID NO: 1158538 - protein, 9 aa, Homo Sapiens
RGDTCQLDV

SEQ ID NO: 1158539 - protein, 9 aa, Homo Sapiens
KNVHAAVAL

SEQ ID NO: 1158540 - protein, 9 aa, Homo Sapiens
TNTMTIPVC

SEQ ID NO: 1158541 - protein, 9 aa, Homo Sapiens
DTCQLDVDE

SEQ ID NO: 1158542 - protein, 9 aa, Homo Sapiens
LEPRKPRDP

SEQ ID NO: 1158543 - protein, 9 aa, Homo Sapiens
CLWILTSAA

SEQ ID NO: 1158544 - protein, 9 aa, Homo Sapiens
SLQSRDFHF

SEQ ID NO: 1158545 - protein, 9 aa, Homo Sapiens
EPSPVPSVE

SEQ ID NO: 1158546 - protein, 9 aa, Homo Sapiens
ELSRTAVCA

SEQ ID NO: 1158547 - protein, 9 aa, Homo Sapiens
KQKACHRAR

SEQ ID NO: 1158548 - protein, 9 aa, Homo Sapiens
LFRIMRLVK

SEQ ID NO: 1158549 - protein, 9 aa, Homo Sapiens
PIEFQIGQT

SEQ ID NO: 1158550 - protein, 9 aa, Homo Sapiens
QLEEPSYTN

SEQ ID NO: 1158551 - protein, 9 aa, Homo Sapiens
TVSDNDTGV

SEQ ID NO: 1158552 - protein, 9 aa, Homo Sapiens
NLPKPINSD

SEQ ID NO: 1158553 - protein, 9 aa, Homo Sapiens
SPKELEITK

SEQ ID NO: 1158554 - protein, 9 aa, Homo Sapiens
RASLADAVP

SEQ ID NO: 1158555 - protein, 9 aa, Homo Sapiens
SDNDTGVLS

SEQ ID NO: 1158556 - protein, 9 aa, Homo Sapiens
KDTVAFNDS

SEQ ID NO: 1158557 - protein, 9 aa, Homo Sapiens
RIFRGLHFI

SEQ ID NO: 1158558 - protein, 9 aa, Homo Sapiens
GVEFACMQD

SEQ ID NO: 1158559 - protein, 9 aa, Homo Sapiens
LQGDSLQSR

SEQ ID NO: 1158560 - protein, 9 aa, Homo Sapiens
DPPPHNQGY

SEQ ID NO: 1158561 - protein, 9 aa, Homo Sapiens
VPFDLVAHE

SEQ ID NO: 1158562 - protein, 9 aa, Homo Sapiens
GIEGEKGFP

SEQ ID NO: 1158563 - protein, 9 aa, Homo Sapiens
LSRTAVCAS

SEQ ID NO: 1158564 - protein, 9 aa, Homo Sapiens
DAVPLHIAP

SEQ ID NO: 1158565 - protein, 9 aa, Homo Sapiens
NQGYCCHGH

SEQ ID NO: 1158566 - protein, 9 aa, Homo Sapiens
FLLLRPEWQ

SEQ ID NO: 1158567 - protein, 9 aa, Homo Sapiens
CSANFKISS

SEQ ID NO: 1158568 - protein, 9 aa, Homo Sapiens
SANFKISSD

SEQ ID NO: 1158569 - protein, 9 aa, Homo Sapiens
TLLSIDIRR

SEQ ID NO: 1158570 - protein, 9 aa, Homo Sapiens
SLADAVPLH

SEQ ID NO: 1158571 - protein, 9 aa, Homo Sapiens
SHCTHCLRM

SEQ ID NO: 1158572 - protein, 9 aa, Homo Sapiens
TAVCASIPG

SEQ ID NO: 1158573 - protein, 9 aa, Homo Sapiens
ISATSYEDF

SEQ ID NO: 1158574 - protein, 9 aa, Homo Sapiens
GDLSRNTEL

SEQ ID NO: 1158575 - protein, 9 aa, Homo Sapiens
NFVGTFSRE

SEQ ID NO: 1158576 - protein, 9 aa, Homo Sapiens
TFFRLFRIM

SEQ ID NO: 1158577 - protein, 9 aa, Homo Sapiens
TPQKPAYEK

SEQ ID NO: 1158578 - protein, 9 aa, Homo Sapiens
NDTGVLSQD

SEQ ID NO: 1158579 - protein, 9 aa, Homo Sapiens
QVALHCTNC

SEQ ID NO: 1158580 - protein, 9 aa, Homo Sapiens
LVAHEDGVD

SEQ ID NO: 1158581 - protein, 9 aa, Homo Sapiens
SITVKFLAV

SEQ ID NO: 1158582 - protein, 9 aa, Homo Sapiens
ELTVEPTEE

SEQ ID NO: 1158583 - protein, 9 aa, Homo Sapiens
SAEQPARPA

SEQ ID NO: 1158584 - protein, 9 aa, Homo Sapiens
GVRNLIGPQ

SEQ ID NO: 1158585 - protein, 9 aa, Homo Sapiens
GCSIVGTVE

SEQ ID NO: 1158586 - protein, 9 aa, Homo Sapiens
LEKREEHVT

SEQ ID NO: 1158587 - protein, 9 aa, Homo Sapiens
KERQGLLRA

SEQ ID NO: 1158588 - protein, 9 aa, Homo Sapiens
AGASGQLEE

SEQ ID NO: 1158589 - protein, 9 aa, Homo Sapiens
SENIEMETG

SEQ ID NO: 1158590 - protein, 9 aa, Homo Sapiens
GLQGDSLQS

SEQ ID NO: 1158591 - protein, 9 aa, Homo Sapiens
TVEPTEETF

SEQ ID NO: 1158592 - protein, 9 aa, Homo Sapiens
PSPVPSVEE

SEQ ID NO: 1158593 - protein, 9 aa, Homo Sapiens
AGNPVISSP

SEQ ID NO: 1158594 - protein, 9 aa, Homo Sapiens
NLPCSNLNN

SEQ ID NO: 1158595 - protein, 9 aa, Homo Sapiens
CHQDSAGNP

SEQ ID NO: 1158596 - protein, 9 aa, Homo Sapiens
MILLTFSIG

SEQ ID NO: 1158597 - protein, 9 aa, Homo Sapiens
PAVPFPDVE

SEQ ID NO: 1158598 - protein, 9 aa, Homo Sapiens
PHNQGYCCH

SEQ ID NO: 1158599 - protein, 9 aa, Homo Sapiens
CTNCSVVYH

SEQ ID NO: 1158600 - protein, 9 aa, Homo Sapiens
NTVPFDLVA

SEQ ID NO: 1158601 - protein, 9 aa, Homo Sapiens
FMCLITLMY

SEQ ID NO: 1158602 - protein, 9 aa, Homo Sapiens
VRHYKICRR

SEQ ID NO: 1158603 - protein, 9 aa, Homo Sapiens
QGLLRACRL

SEQ ID NO: 1158604 - protein, 9 aa, Homo Sapiens
GQGNLPKPI

SEQ ID NO: 1158605 - protein, 9 aa, Homo Sapiens
AGCLFHALG

SEQ ID NO: 1158606 - protein, 9 aa, Homo Sapiens
EEPSYTNAG

SEQ ID NO: 1158607 - protein, 9 aa, Homo Sapiens
AEEVQEEEQ

SEQ ID NO: 1158608 - protein, 9 aa, Homo Sapiens
RARGSQRLL

SEQ ID NO: 1158609 - protein, 9 aa, Homo Sapiens
FSECMIRVF

SEQ ID NO: 1158610 - protein, 9 aa, Homo Sapiens
LLTFSIGRR

SEQ ID NO: 1158611 - protein, 9 aa, Homo Sapiens
IGRRLDFVH

SEQ ID NO: 1158612 - protein, 9 aa, Homo Sapiens
STVLWETVL

SEQ ID NO: 1158613 - protein, 9 aa, Homo Sapiens
WKCHQDSAG

SEQ ID NO: 1158614 - protein, 9 aa, Homo Sapiens
LLRACRLSS

SEQ ID NO: 1158615 - protein, 9 aa, Homo Sapiens
SPIEFQIGQ

SEQ ID NO: 1158616 - protein, 9 aa, Homo Sapiens
IEFQIGQTP

SEQ ID NO: 1158617 - protein, 9 aa, Homo Sapiens
AVCLWILTS

SEQ ID NO: 1158618 - protein, 9 aa, Homo Sapiens
GCLFHALGE

SEQ ID NO: 1158619 - protein, 9 aa, Homo Sapiens
GYSENIEME

SEQ ID NO: 1158620 - protein, 9 aa, Homo Sapiens
PVPSVEEVT

SEQ ID NO: 1158621 - protein, 9 aa, Homo Sapiens
NFSPGSSWT

SEQ ID NO: 1158622 - protein, 9 aa, Homo Sapiens
AYVTEGLEY

SEQ ID NO: 1158623 - protein, 9 aa, Homo Sapiens
LRMVENLSM

SEQ ID NO: 1158624 - protein, 9 aa, Homo Sapiens
RNLIGPQVY

SEQ ID NO: 1158625 - protein, 9 aa, Homo Sapiens
KNFSPGSSW

SEQ ID NO: 1158626 - protein, 9 aa, Homo Sapiens
CHLWLQTQR

SEQ ID NO: 1158627 - protein, 9 aa, Homo Sapiens
GFSDKSNLL

SEQ ID NO: 1158628 - protein, 9 aa, Homo Sapiens
QLTQHQRVH

SEQ ID NO: 1158629 - protein, 9 aa, Homo Sapiens
FGQGNLPKP

SEQ ID NO: 1158630 - protein, 9 aa, Homo Sapiens
RHYKICRRA

SEQ ID NO: 1158631 - protein, 9 aa, Homo Sapiens
ESGDLSRNT

SEQ ID NO: 1158632 - protein, 9 aa, Homo Sapiens
GSTSDDTHV

SEQ ID NO: 1158633 - protein, 9 aa, Homo Sapiens
VAHEDGVDV

SEQ ID NO: 1158634 - protein, 9 aa, Homo Sapiens
RACRLSSPE

SEQ ID NO: 1158635 - protein, 9 aa, Homo Sapiens
THVREVSSR

SEQ ID NO: 1158636 - protein, 9 aa, Homo Sapiens
HVDMKSLLG

SEQ ID NO: 1158637 - protein, 9 aa, Homo Sapiens
FQCWLCSAN

SEQ ID NO: 1158638 - protein, 9 aa, Homo Sapiens
PGSSWTRVE

SEQ ID NO: 1158639 - protein, 9 aa, Homo Sapiens
CRRAGGRLH

SEQ ID NO: 1158640 - protein, 9 aa, Homo Sapiens
NVYSQAAIS

SEQ ID NO: 1158641 - protein, 9 aa, Homo Sapiens
FNLPCSNLN

SEQ ID NO: 1158642 - protein, 9 aa, Homo Sapiens
LQTQREMLE

SEQ ID NO: 1158643 - protein, 9 aa, Homo Sapiens
VQEEEQLEE

SEQ ID NO: 1158644 - protein, 9 aa, Homo Sapiens
RPAAPPPKQ

SEQ ID NO: 1158645 - protein, 9 aa, Homo Sapiens
QRLLPDERW

SEQ ID NO: 1158646 - protein, 9 aa, Homo Sapiens
NFMCLITLM

SEQ ID NO: 1158647 - protein, 9 aa, Homo Sapiens
AMEVYDRMA

SEQ ID NO: 1158648 - protein, 9 aa, Homo Sapiens
GITWGFGLT

SEQ ID NO: 1158649 - protein, 9 aa, Homo Sapiens
NAEFVCERT

SEQ ID NO: 1158650 - protein, 9 aa, Homo Sapiens
PLNFMCLIT

SEQ ID NO: 1158651 - protein, 9 aa, Homo Sapiens
GWQSLRRDV

SEQ ID NO: 1158652 - protein, 9 aa, Homo Sapiens
MVENLSMEH

SEQ ID NO: 1158653 - protein, 9 aa, Homo Sapiens
SQAAISFNL

SEQ ID NO: 1158654 - protein, 9 aa, Homo Sapiens
TVPFDLVAH

SEQ ID NO: 1158655 - protein, 9 aa, Homo Sapiens
IEMETGIKE

SEQ ID NO: 1158656 - protein, 9 aa, Homo Sapiens
HNQKRAGWA

SEQ ID NO: 1158657 - protein, 9 aa, Homo Sapiens
YSCAGWSEP

SEQ ID NO: 1158658 - protein, 9 aa, Homo Sapiens
QTQREMLEK

SEQ ID NO: 1158659 - protein, 9 aa, Homo Sapiens
TCSDPISKP

SEQ ID NO: 1158660 - protein, 9 aa, Homo Sapiens
VLLQLLKES

SEQ ID NO: 1158661 - protein, 9 aa, Homo Sapiens
WETVLLQLL

SEQ ID NO: 1158662 - protein, 9 aa, Homo Sapiens
GTVELYVPC

SEQ ID NO: 1158663 - protein, 9 aa, Homo Sapiens
IGRLFHNQK

SEQ ID NO: 1158664 - protein, 9 aa, Homo Sapiens
KTAPEYYLY

SEQ ID NO: 1158665 - protein, 9 aa, Homo Sapiens
TFSREDSDP

SEQ ID NO: 1158666 - protein, 9 aa, Homo Sapiens
LKYDEKNKT

SEQ ID NO: 1158667 - protein, 9 aa, Homo Sapiens
NIVGVRNLI

SEQ ID NO: 1158668 - protein, 9 aa, Homo Sapiens
TGVLSQDAL

SEQ ID NO: 1158669 - protein, 9 aa, Homo Sapiens
KKTCSDPIS

SEQ ID NO: 1158670 - protein, 9 aa, Homo Sapiens
LRACRLSSP

SEQ ID NO: 1158671 - protein, 9 aa, Homo Sapiens
HVREVSSRP

SEQ ID NO: 1158672 - protein, 9 aa, Homo Sapiens
EPRKPRDPW

SEQ ID NO: 1158673 - protein, 9 aa, Homo Sapiens
AMFHSAEHG

SEQ ID NO: 1158674 - protein, 9 aa, Homo Sapiens
KICRRAGGR

SEQ ID NO: 1158675 - protein, 9 aa, Homo Sapiens
RPLIAFCLL

SEQ ID NO: 1158676 - protein, 9 aa, Homo Sapiens
QEEEQLEEE

SEQ ID NO: 1158677 - protein, 9 aa, Homo Sapiens
ERWKCHQDS

SEQ ID NO: 1158678 - protein, 9 aa, Homo Sapiens
RDTSQTSTL

SEQ ID NO: 1158679 - protein, 9 aa, Homo Sapiens
GNCSRIFRG

SEQ ID NO: 1158680 - protein, 9 aa, Homo Sapiens
QHVHGPPRE

SEQ ID NO: 1158681 - protein, 9 aa, Homo Sapiens
AVPFPDVEL

SEQ ID NO: 1158682 - protein, 9 aa, Homo Sapiens
SSNRRIQEM

SEQ ID NO: 1158683 - protein, 9 aa, Homo Sapiens
LDVDECSAR

SEQ ID NO: 1158684 - protein, 9 aa, Homo Sapiens
FYKYVRQIF

SEQ ID NO: 1158685 - protein, 9 aa, Homo Sapiens
PHQPPKCIT

SEQ ID NO: 1158686 - protein, 9 aa, Homo Sapiens
FNDSRDPLS

SEQ ID NO: 1158687 - protein, 9 aa, Homo Sapiens
MKSLLGWQS

SEQ ID NO: 1158688 - protein, 9 aa, Homo Sapiens
WRGDTCQLD

SEQ ID NO: 1158689 - protein, 9 aa, Homo Sapiens
VLSQDALLR

SEQ ID NO: 1158690 - protein, 9 aa, Homo Sapiens
SREDSDPPI

SEQ ID NO: 1158691 - protein, 9 aa, Homo Sapiens
QLDVDECSA

SEQ ID NO: 1158692 - protein, 9 aa, Homo Sapiens
SFSECMIRV

SEQ ID NO: 1158693 - protein, 9 aa, Homo Sapiens
HLWLQTQRE

SEQ ID NO: 1158694 - protein, 9 aa, Homo Sapiens
CLITLMYLP

SEQ ID NO: 1158695 - protein, 9 aa, Homo Sapiens
FGLQGDSLQ

SEQ ID NO: 1158696 - protein, 9 aa, Homo Sapiens
RVFSSHVFG

SEQ ID NO: 1158697 - protein, 9 aa, Homo Sapiens
LPDERWKCH

SEQ ID NO: 1158698 - protein, 9 aa, Homo Sapiens
FGGGQKVRL

SEQ ID NO: 1158699 - protein, 9 aa, Homo Sapiens
VEFACMQDG

SEQ ID NO: 1158700 - protein, 9 aa, Homo Sapiens
ALGRQMRCE

SEQ ID NO: 1158701 - protein, 9 aa, Homo Sapiens
SNRRIQEMH

SEQ ID NO: 1158702 - protein, 9 aa, Homo Sapiens
LDHLDPHQP

SEQ ID NO: 1158703 - protein, 9 aa, Homo Sapiens
LGETVNLAC

SEQ ID NO: 1158704 - protein, 9 aa, Homo Sapiens
WKTEGTLLE

SEQ ID NO: 1158705 - protein, 9 aa, Homo Sapiens
KYVRQIFNN

SEQ ID NO: 1158706 - protein, 9 aa, Homo Sapiens
FSREDSDPP

SEQ ID NO: 1158707 - protein, 9 aa, Homo Sapiens
LFHNQKRAG

SEQ ID NO: 1158708 - protein, 9 aa, Homo Sapiens
SGQLEEPSY

SEQ ID NO: 1158709 - protein, 9 aa, Homo Sapiens
ITFFRLFRI

SEQ ID NO: 1158710 - protein, 9 aa, Homo Sapiens
LMAATYCRS

SEQ ID NO: 1158711 - protein, 9 aa, Homo Sapiens
SRIFRGLHF

SEQ ID NO: 1158712 - protein, 9 aa, Homo Sapiens
WLCSANFKI

SEQ ID NO: 1158713 - protein, 9 aa, Homo Sapiens
LEFYKYVRQ

SEQ ID NO: 1158714 - protein, 9 aa, Homo Sapiens
SCLHKHCEA

SEQ ID NO: 1158715 - protein, 9 aa, Homo Sapiens
CLFHALGEK

SEQ ID NO: 1158716 - protein, 9 aa, Homo Sapiens
EYPTIEEQV

SEQ ID NO: 1158717 - protein, 9 aa, Homo Sapiens
GLSGPPGIE

SEQ ID NO: 1158718 - protein, 9 aa, Homo Sapiens
YCRSLHLYN

SEQ ID NO: 1158719 - protein, 9 aa, Homo Sapiens
TMTIPVCRC

SEQ ID NO: 1158720 - protein, 9 aa, Homo Sapiens
FQIGQTPLS

SEQ ID NO: 1158721 - protein, 9 aa, Homo Sapiens
RALREAMFH

SEQ ID NO: 1158722 - protein, 9 aa, Homo Sapiens
RCHYYSCAG

SEQ ID NO: 1158723 - protein, 9 aa, Homo Sapiens
ITWGFGLTT

SEQ ID NO: 1158724 - protein, 9 aa, Homo Sapiens
LHCTNCSVV

SEQ ID NO: 1158725 - protein, 9 aa, Homo Sapiens
SATSYEDFY

SEQ ID NO: 1158726 - protein, 9 aa, Homo Sapiens
CGRGFSDKS

SEQ ID NO: 1158727 - protein, 9 aa, Homo Sapiens
LEKETKTGT

SEQ ID NO: 1158728 - protein, 9 aa, Homo Sapiens
EQPARPAAP

SEQ ID NO: 1158729 - protein, 9 aa, Homo Sapiens
PPPHNQGYC

SEQ ID NO: 1158730 - protein, 9 aa, Homo Sapiens
FPDVELRLP

SEQ ID NO: 1158731 - protein, 9 aa, Homo Sapiens
YYSCAGWSE

SEQ ID NO: 1158732 - protein, 9 aa, Homo Sapiens
MTIPVCRCD

SEQ ID NO: 1158733 - protein, 9 aa, Homo Sapiens
SYYKLKLTR

SEQ ID NO: 1158734 - protein, 9 aa, Homo Sapiens
LGDYSSGDF

SEQ ID NO: 1158735 - protein, 9 aa, Homo Sapiens
LSLSQQLIR

SEQ ID NO: 1158736 - protein, 9 aa, Homo Sapiens
TVTRGHGMG

SEQ ID NO: 1158737 - protein, 9 aa, Homo Sapiens
GPIIVLVGV

SEQ ID NO: 1158738 - protein, 9 aa, Homo Sapiens
ARMWTNAGT

SEQ ID NO: 1158739 - protein, 9 aa, Homo Sapiens
SMHNTIKSK

SEQ ID NO: 1158740 - protein, 9 aa, Homo Sapiens
SLSQQLIRH

SEQ ID NO: 1158741 - protein, 9 aa, Homo Sapiens
GYGQAFLGG

SEQ ID NO: 1158742 - protein, 9 aa, Homo Sapiens
PAVPVGSGV

SEQ ID NO: 1158743 - protein, 9 aa, Homo Sapiens
QHGCTGNDA

SEQ ID NO: 1158744 - protein, 9 aa, Homo Sapiens
QFVSNQVGV

SEQ ID NO: 1158745 - protein, 9 aa, Homo Sapiens
STPSGYLGL

SEQ ID NO: 1158746 - protein, 9 aa, Homo Sapiens
CSAGPIIVL

SEQ ID NO: 1158747 - protein, 9 aa, Homo Sapiens
MRAIYIKSL

SEQ ID NO: 1158748 - protein, 9 aa, Homo Sapiens
PRNIAKHHD

SEQ ID NO: 1158749 - protein, 9 aa, Homo Sapiens
LGKLLSMET

SEQ ID NO: 1158750 - protein, 9 aa, Homo Sapiens
NYSVHNEQW

SEQ ID NO: 1158751 - protein, 9 aa, Homo Sapiens
GRSPATGLV

SEQ ID NO: 1158752 - protein, 9 aa, Homo Sapiens
NEIWYRTKQ

SEQ ID NO: 1158753 - protein, 9 aa, Homo Sapiens
ALLATAVAS

SEQ ID NO: 1158754 - protein, 9 aa, Homo Sapiens
PLCASDGMT

SEQ ID NO: 1158755 - protein, 9 aa, Homo Sapiens
TATFAPFHT

SEQ ID NO: 1158756 - protein, 9 aa, Homo Sapiens
RQTLLIERY

SEQ ID NO: 1158757 - protein, 9 aa, Homo Sapiens
SIFGTFVVY

SEQ ID NO: 1158758 - protein, 9 aa, Homo Sapiens
KQEEEGTTD

SEQ ID NO: 1158759 - protein, 9 aa, Homo Sapiens
GYLGLTDSC

SEQ ID NO: 1158760 - protein, 9 aa, Homo Sapiens
GLEIGLRLF

SEQ ID NO: 1158761 - protein, 9 aa, Homo Sapiens
FYVSLTLMH

SEQ ID NO: 1158762 - protein, 9 aa, Homo Sapiens
KHHDEGHKG

SEQ ID NO: 1158763 - protein, 9 aa, Homo Sapiens
PLSTPSSSR

SEQ ID NO: 1158764 - protein, 9 aa, Homo Sapiens
SDGMTFLSR

SEQ ID NO: 1158765 - protein, 9 aa, Homo Sapiens
EEDLMVWVD

SEQ ID NO: 1158766 - protein, 9 aa, Homo Sapiens
AYLVEVSEG

SEQ ID NO: 1158767 - protein, 9 aa, Homo Sapiens
QSLRPDPNF

SEQ ID NO: 1158768 - protein, 9 aa, Homo Sapiens
DLLLLLLPF

SEQ ID NO: 1158769 - protein, 9 aa, Homo Sapiens
GIAYLVEVS

SEQ ID NO: 1158770 - protein, 9 aa, Homo Sapiens
FFRQHGCTG

SEQ ID NO: 1158771 - protein, 9 aa, Homo Sapiens
METPRALHH

SEQ ID NO: 1158772 - protein, 9 aa, Homo Sapiens
ILSGNQTAT

SEQ ID NO: 1158773 - protein, 9 aa, Homo Sapiens
YQPRQGADA

SEQ ID NO: 1158774 - protein, 9 aa, Homo Sapiens
LQDSQDRCY

SEQ ID NO: 1158775 - protein, 9 aa, Homo Sapiens
LPVTERLQR

SEQ ID NO: 1158776 - protein, 9 aa, Homo Sapiens
TNAGTGPSA

SEQ ID NO: 1158777 - protein, 9 aa, Homo Sapiens
WTNAGTGPS

SEQ ID NO: 1158778 - protein, 9 aa, Homo Sapiens
SENKCLLLT

SEQ ID NO: 1158779 - protein, 9 aa, Homo Sapiens
GDFVSECSS

SEQ ID NO: 1158780 - protein, 9 aa, Homo Sapiens
IIFEEGSLL

SEQ ID NO: 1158781 - protein, 9 aa, Homo Sapiens
APSSASVTV

SEQ ID NO: 1158782 - protein, 9 aa, Homo Sapiens
GADARMWTN

SEQ ID NO: 1158783 - protein, 9 aa, Homo Sapiens
PVGSGVIPE

SEQ ID NO: 1158784 - protein, 9 aa, Homo Sapiens
LLSMETPRA

SEQ ID NO: 1158785 - protein, 9 aa, Homo Sapiens
QLIRHVAYE

SEQ ID NO: 1158786 - protein, 9 aa, Homo Sapiens
KLVSKQSLR

SEQ ID NO: 1158787 - protein, 9 aa, Homo Sapiens
ATAVASDYW

SEQ ID NO: 1158788 - protein, 9 aa, Homo Sapiens
FGTFVVYLV

SEQ ID NO: 1158789 - protein, 9 aa, Homo Sapiens
SGDFVSECS

SEQ ID NO: 1158790 - protein, 9 aa, Homo Sapiens
AILSEASTS

SEQ ID NO: 1158791 - protein, 9 aa, Homo Sapiens
MGDHMKVIA

SEQ ID NO: 1158792 - protein, 9 aa, Homo Sapiens
FQSSIFGTF

SEQ ID NO: 1158793 - protein, 9 aa, Homo Sapiens
LQPRNIAKH

SEQ ID NO: 1158794 - protein, 9 aa, Homo Sapiens
GCTGNDANT

SEQ ID NO: 1158795 - protein, 9 aa, Homo Sapiens
GGWRARAEC

SEQ ID NO: 1158796 - protein, 9 aa, Homo Sapiens
PRPQDHDTD

SEQ ID NO: 1158797 - protein, 9 aa, Homo Sapiens
AVFNYSVHN

SEQ ID NO: 1158798 - protein, 9 aa, Homo Sapiens
KKLVSKQSL

SEQ ID NO: 1158799 - protein, 9 aa, Homo Sapiens
VSLTLMHLG

SEQ ID NO: 1158800 - protein, 9 aa, Homo Sapiens
LVEVSEGDL

SEQ ID NO: 1158801 - protein, 9 aa, Homo Sapiens
GQAFLGGLA

SEQ ID NO: 1158802 - protein, 9 aa, Homo Sapiens
CARTCPAPS

SEQ ID NO: 1158803 - protein, 9 aa, Homo Sapiens
DSEMRAIYI

SEQ ID NO: 1158804 - protein, 9 aa, Homo Sapiens
HGMGVTAWM

SEQ ID NO: 1158805 - protein, 9 aa, Homo Sapiens
QQVQLERHE

SEQ ID NO: 1158806 - protein, 9 aa, Homo Sapiens
HNTIKSKSP

SEQ ID NO: 1158807 - protein, 9 aa, Homo Sapiens
AKPKTKKAG

SEQ ID NO: 1158808 - protein, 9 aa, Homo Sapiens
FVSECSSKG

SEQ ID NO: 1158809 - protein, 9 aa, Homo Sapiens
LEDLIERES

SEQ ID NO: 1158810 - protein, 9 aa, Homo Sapiens
TKKAGAAKA

SEQ ID NO: 1158811 - protein, 9 aa, Homo Sapiens
GKLLSMETP

SEQ ID NO: 1158812 - protein, 9 aa, Homo Sapiens
VPTPCARTC

SEQ ID NO: 1158813 - protein, 9 aa, Homo Sapiens
QPRNIAKHH

SEQ ID NO: 1158814 - protein, 9 aa, Homo Sapiens
DACRDTKTT

SEQ ID NO: 1158815 - protein, 9 aa, Homo Sapiens
AKKEILWLS

SEQ ID NO: 1158816 - protein, 9 aa, Homo Sapiens
MHNTIKSKS

SEQ ID NO: 1158817 - protein, 9 aa, Homo Sapiens
VFQSSIFGT

SEQ ID NO: 1158818 - protein, 9 aa, Homo Sapiens
KPLCASDGM

SEQ ID NO: 1158819 - protein, 9 aa, Homo Sapiens
VPVGSGVIP

SEQ ID NO: 1158820 - protein, 9 aa, Homo Sapiens
SSRTTENPT

SEQ ID NO: 1158821 - protein, 9 aa, Homo Sapiens
ARTCPAPSS

SEQ ID NO: 1158822 - protein, 9 aa, Homo Sapiens
AIYIKSLRS

SEQ ID NO: 1158823 - protein, 9 aa, Homo Sapiens
LSEASTSHI

SEQ ID NO: 1158824 - protein, 9 aa, Homo Sapiens
PTPCARTCP

SEQ ID NO: 1158825 - protein, 9 aa, Homo Sapiens
IVLVGVEHE

SEQ ID NO: 1158826 - protein, 9 aa, Homo Sapiens
FVSNQVGVP

SEQ ID NO: 1158827 - protein, 9 aa, Homo Sapiens
NQTATFAPF

SEQ ID NO: 1158828 - protein, 9 aa, Homo Sapiens
SVTVTRGHG

SEQ ID NO: 1158829 - protein, 9 aa, Homo Sapiens
TPCARTCPA

SEQ ID NO: 1158830 - protein, 9 aa, Homo Sapiens
LSFALLATA

SEQ ID NO: 1158831 - protein, 9 aa, Homo Sapiens
VIIFEEGSL

SEQ ID NO: 1158832 - protein, 9 aa, Homo Sapiens
KPKTKKAGA

SEQ ID NO: 1158833 - protein, 9 aa, Homo Sapiens
LSMETPRAL

SEQ ID NO: 1158834 - protein, 9 aa, Homo Sapiens
RSPATGLVS

SEQ ID NO: 1158835 - protein, 9 aa, Homo Sapiens
RTEDEKRKA

SEQ ID NO: 1158836 - protein, 9 aa, Homo Sapiens
SEMRAIYIK

SEQ ID NO: 1158837 - protein, 9 aa, Homo Sapiens
LPLSTPSSS

SEQ ID NO: 1158838 - protein, 9 aa, Homo Sapiens
KVIIFEEGS

SEQ ID NO: 1158839 - protein, 9 aa, Homo Sapiens
KYFKMGDHM

SEQ ID NO: 1158840 - protein, 9 aa, Homo Sapiens
DLIERESVL

SEQ ID NO: 1158841 - protein, 9 aa, Homo Sapiens
FEEGSLLYT

SEQ ID NO: 1158842 - protein, 9 aa, Homo Sapiens
CDPGYQPRQ

SEQ ID NO: 1158843 - protein, 9 aa, Homo Sapiens
GYQPRQGAD

SEQ ID NO: 1158844 - protein, 9 aa, Homo Sapiens
SASVTVTRG

SEQ ID NO: 1158845 - protein, 9 aa, Homo Sapiens
KNEIWYRTK

SEQ ID NO: 1158846 - protein, 9 aa, Homo Sapiens
NKCLLLTPS

SEQ ID NO: 1158847 - protein, 9 aa, Homo Sapiens
KLLSMETPR

SEQ ID NO: 1158848 - protein, 9 aa, Homo Sapiens
LTPPAKKEI

SEQ ID NO: 1158849 - protein, 9 aa, Homo Sapiens
TKQAAVARC

SEQ ID NO: 1158850 - protein, 9 aa, Homo Sapiens
PRQGADARM

SEQ ID NO: 1158851 - protein, 9 aa, Homo Sapiens
PAPSSASVT

SEQ ID NO: 1158852 - protein, 9 aa, Homo Sapiens
GTFVVYLVV

SEQ ID NO: 1158853 - protein, 9 aa, Homo Sapiens
MERQRTEDE

SEQ ID NO: 1158854 - protein, 9 aa, Homo Sapiens
TPSSSRTTE

SEQ ID NO: 1158855 - protein, 9 aa, Homo Sapiens
NTIKSKSPL

SEQ ID NO: 1158856 - protein, 9 aa, Homo Sapiens
IAYLVEVSE

SEQ ID NO: 1158857 - protein, 9 aa, Homo Sapiens
SRTTENPTL

SEQ ID NO: 1158858 - protein, 9 aa, Homo Sapiens
SLTLMHLGA

SEQ ID NO: 1158859 - protein, 9 aa, Homo Sapiens
FCSAGPIIV

SEQ ID NO: 1158860 - protein, 9 aa, Homo Sapiens
ARAECSACL

SEQ ID NO: 1158861 - protein, 9 aa, Homo Sapiens
GNDANTKYN

SEQ ID NO: 1158862 - protein, 9 aa, Homo Sapiens
MVWVDPLDG

SEQ ID NO: 1158863 - protein, 9 aa, Homo Sapiens
PWEGRSPAT

SEQ ID NO: 1158864 - protein, 9 aa, Homo Sapiens
LILSGNQTA

SEQ ID NO: 1158865 - protein, 9 aa, Homo Sapiens
YLVEVSEGD

SEQ ID NO: 1158866 - protein, 9 aa, Homo Sapiens
SGYLGLTDS

SEQ ID NO: 1158867 - protein, 9 aa, Homo Sapiens
ENKCLLLTP

SEQ ID NO: 1158868 - protein, 9 aa, Homo Sapiens
PVSPDQLPC

SEQ ID NO: 1158869 - protein, 9 aa, Homo Sapiens
SSIFGTFVV

SEQ ID NO: 1158870 - protein, 9 aa, Homo Sapiens
WTPTQPLLE

SEQ ID NO: 1158871 - protein, 9 aa, Homo Sapiens
ADARMWTNA

SEQ ID NO: 1158872 - protein, 9 aa, Homo Sapiens
VFNYSVHNE

SEQ ID NO: 1158873 - protein, 9 aa, Homo Sapiens
SAIKEEDLM

SEQ ID NO: 1158874 - protein, 9 aa, Homo Sapiens
EQKVIIFEE

SEQ ID NO: 1158875 - protein, 9 aa, Homo Sapiens
SLTRGLRKV

SEQ ID NO: 1158876 - protein, 9 aa, Homo Sapiens
DLMVWVDPL

SEQ ID NO: 1158877 - protein, 9 aa, Homo Sapiens
SFALLATAV

SEQ ID NO: 1158878 - protein, 9 aa, Homo Sapiens
SSSRTTENP

SEQ ID NO: 1158879 - protein, 9 aa, Homo Sapiens
CLLLTPSFP

SEQ ID NO: 1158880 - protein, 9 aa, Homo Sapiens
SEASTSHIV

SEQ ID NO: 1158881 - protein, 9 aa, Homo Sapiens
WRARAECSA

SEQ ID NO: 1158882 - protein, 9 aa, Homo Sapiens
ASGEAKPKT

SEQ ID NO: 1158883 - protein, 9 aa, Homo Sapiens
EDLMVWVDP

SEQ ID NO: 1158884 - protein, 9 aa, Homo Sapiens
TLMHLGARM

SEQ ID NO: 1158885 - protein, 9 aa, Homo Sapiens
SKQSLRPDP

SEQ ID NO: 1158886 - protein, 9 aa, Homo Sapiens
DARMWTNAG

SEQ ID NO: 1158887 - protein, 9 aa, Homo Sapiens
TEDEKRKAE

SEQ ID NO: 1158888 - protein, 9 aa, Homo Sapiens
RKKLVSKQS

SEQ ID NO: 1158889 - protein, 9 aa, Homo Sapiens
ADVIAILDA

SEQ ID NO: 1158890 - protein, 9 aa, Homo Sapiens
LKDGLEIGL

SEQ ID NO: 1158891 - protein, 9 aa, Homo Sapiens
ATFAPFHTH

SEQ ID NO: 1158892 - protein, 9 aa, Homo Sapiens
YIKSLRSPM

SEQ ID NO: 1158893 - protein, 9 aa, Homo Sapiens
KTTEAMAPD

SEQ ID NO: 1158894 - protein, 9 aa, Homo Sapiens
PAKKEILWL

SEQ ID NO: 1158895 - protein, 9 aa, Homo Sapiens
EAATADVIA

SEQ ID NO: 1158896 - protein, 9 aa, Homo Sapiens
TADVIAILD

SEQ ID NO: 1158897 - protein, 9 aa, Homo Sapiens
SRQTLLIER

SEQ ID NO: 1158898 - protein, 9 aa, Homo Sapiens
GDHMKVIAG

SEQ ID NO: 1158899 - protein, 9 aa, Homo Sapiens
TIKSKSPLP

SEQ ID NO: 1158900 - protein, 9 aa, Homo Sapiens
GPSAVPTPC

SEQ ID NO: 1158901 - protein, 9 aa, Homo Sapiens
EDLIERESV

SEQ ID NO: 1158902 - protein, 9 aa, Homo Sapiens
KCLLLTPSF

SEQ ID NO: 1158903 - protein, 9 aa, Homo Sapiens
SAVPTPCAR

SEQ ID NO: 1158904 - protein, 9 aa, Homo Sapiens
ATADVIAIL

SEQ ID NO: 1158905 - protein, 9 aa, Homo Sapiens
TRGHGMGVT

SEQ ID NO: 1158906 - protein, 9 aa, Homo Sapiens
RTKQAAVAR

SEQ ID NO: 1158907 - protein, 9 aa, Homo Sapiens
EMERQRTED

SEQ ID NO: 1158908 - protein, 9 aa, Homo Sapiens
FTPRPQDHD

SEQ ID NO: 1158909 - protein, 9 aa, Homo Sapiens
KKEILWLSL

SEQ ID NO: 1158910 - protein, 9 aa, Homo Sapiens
PSRQTLLIE

SEQ ID NO: 1158911 - protein, 9 aa, Homo Sapiens
PQPWEGRSP

SEQ ID NO: 1158912 - protein, 9 aa, Homo Sapiens
GNQTATFAP

SEQ ID NO: 1158913 - protein, 9 aa, Homo Sapiens
RTCPAPSSA

SEQ ID NO: 1158914 - protein, 9 aa, Homo Sapiens
QVQLERHEY

SEQ ID NO: 1158915 - protein, 9 aa, Homo Sapiens
RQGADARMW

SEQ ID NO: 1158916 - protein, 9 aa, Homo Sapiens
AKHHDEGHK

SEQ ID NO: 1158917 - protein, 9 aa, Homo Sapiens
PSSASVTVT

SEQ ID NO: 1158918 - protein, 9 aa, Homo Sapiens
TCPAPSSAS

SEQ ID NO: 1158919 - protein, 9 aa, Homo Sapiens
GEAKPKTKK

SEQ ID NO: 1158920 - protein, 9 aa, Homo Sapiens
SSASVTVTR

SEQ ID NO: 1158921 - protein, 9 aa, Homo Sapiens
RARAECSAC

SEQ ID NO: 1158922 - protein, 9 aa, Homo Sapiens
VFNLLKDGL

SEQ ID NO: 1158923 - protein, 9 aa, Homo Sapiens
HHDEGHKGP

SEQ ID NO: 1158924 - protein, 9 aa, Homo Sapiens
NEQWHSFAI

SEQ ID NO: 1158925 - protein, 9 aa, Homo Sapiens
ALGYGQAFL

SEQ ID NO: 1158926 - protein, 9 aa, Homo Sapiens
NVLGKLLSM

SEQ ID NO: 1158927 - protein, 9 aa, Homo Sapiens
KASLTRGLR

SEQ ID NO: 1158928 - protein, 9 aa, Homo Sapiens
CRKKLVSKQ

SEQ ID NO: 1158929 - protein, 9 aa, Homo Sapiens
SSGDFVSEC

SEQ ID NO: 1158930 - protein, 9 aa, Homo Sapiens
ASDGMTFLS

SEQ ID NO: 1158931 - protein, 9 aa, Homo Sapiens
QQLIRHVAY

SEQ ID NO: 1158932 - protein, 9 aa, Homo Sapiens
EGRSPATGL

SEQ ID NO: 1158933 - protein, 9 aa, Homo Sapiens
VSPDQLPCG

SEQ ID NO: 1158934 - protein, 9 aa, Homo Sapiens
FEEMERQRT

SEQ ID NO: 1158935 - protein, 9 aa, Homo Sapiens
LTLMHLGAR

SEQ ID NO: 1158936 - protein, 9 aa, Homo Sapiens
AIKEEDLMV

SEQ ID NO: 1158937 - protein, 9 aa, Homo Sapiens
LTRGLRKVL

SEQ ID NO: 1158938 - protein, 9 aa, Homo Sapiens
SSDQGPWTP

SEQ ID NO: 1158939 - protein, 9 aa, Homo Sapiens
AGTGPSAVP

SEQ ID NO: 1158940 - protein, 9 aa, Homo Sapiens
VLGKLLSME

SEQ ID NO: 1158941 - protein, 9 aa, Homo Sapiens
KTKKAGAAK

SEQ ID NO: 1158942 - protein, 9 aa, Homo Sapiens
PGYQPRQGA

SEQ ID NO: 1158943 - protein, 9 aa, Homo Sapiens
PSSSRTTEN

SEQ ID NO: 1158944 - protein, 9 aa, Homo Sapiens
TPSFPPPHR

SEQ ID NO: 1158945 - protein, 9 aa, Homo Sapiens
YSVHNEQWH

SEQ ID NO: 1158946 - protein, 9 aa, Homo Sapiens
GSGVIPEGL

SEQ ID NO: 1158947 - protein, 9 aa, Homo Sapiens
RQRTEDEKR

SEQ ID NO: 1158948 - protein, 9 aa, Homo Sapiens
FQIPPSRQT

SEQ ID NO: 1158949 - protein, 9 aa, Homo Sapiens
SGEAKPKTK

SEQ ID NO: 1158950 - protein, 9 aa, Homo Sapiens
YSTPSGYLG

SEQ ID NO: 1158951 - protein, 9 aa, Homo Sapiens
YVSLTLMHL

SEQ ID NO: 1158952 - protein, 9 aa, Homo Sapiens
EIWYRTKQA

SEQ ID NO: 1158953 - protein, 9 aa, Homo Sapiens
PPAKKEILW

SEQ ID NO: 1158954 - protein, 9 aa, Homo Sapiens
HYMTLPVSP

SEQ ID NO: 1158955 - protein, 9 aa, Homo Sapiens
MSMHNTIKS

SEQ ID NO: 1158956 - protein, 9 aa, Homo Sapiens
ACRDTKTTE

SEQ ID NO: 1158957 - protein, 9 aa, Homo Sapiens
DTKTTEAMA

SEQ ID NO: 1158958 - protein, 9 aa, Homo Sapiens
GLSLSQQLI

SEQ ID NO: 1158959 - protein, 9 aa, Homo Sapiens
RKVLAKCLD

SEQ ID NO: 1158960 - protein, 9 aa, Homo Sapiens
TKTTEAMAP

SEQ ID NO: 1158961 - protein, 9 aa, Homo Sapiens
ILSEASTSH

SEQ ID NO: 1158962 - protein, 9 aa, Homo Sapiens
IFEEGSLLY

SEQ ID NO: 1158963 - protein, 9 aa, Homo Sapiens
GLRKVLAKC

SEQ ID NO: 1158964 - protein, 9 aa, Homo Sapiens
HMKVIAGRF

SEQ ID NO: 1158965 - protein, 9 aa, Homo Sapiens
TLLIERYYA

SEQ ID NO: 1158966 - protein, 9 aa, Homo Sapiens
RSEQKVIIF

SEQ ID NO: 1158967 - protein, 9 aa, Homo Sapiens
QGPWTPTQP

SEQ ID NO: 1158968 - protein, 9 aa, Homo Sapiens
HAILSEAST

SEQ ID NO: 1158969 - protein, 9 aa, Homo Sapiens
ELTPPAKKE

SEQ ID NO: 1158970 - protein, 9 aa, Homo Sapiens
LLKDGLEIG

SEQ ID NO: 1158971 - protein, 9 aa, Homo Sapiens
LRKVLAKCL

SEQ ID NO: 1158972 - protein, 9 aa, Homo Sapiens
NAGTGPSAV

SEQ ID NO: 1158973 - protein, 9 aa, Homo Sapiens
KEEDLMVWV

SEQ ID NO: 1158974 - protein, 9 aa, Homo Sapiens
ADLLLLLLP

SEQ ID NO: 1158975 - protein, 9 aa, Homo Sapiens
YSSGDFVSE

SEQ ID NO: 1158976 - protein, 9 aa, Homo Sapiens
SAHAILSEA

SEQ ID NO: 1158977 - protein, 9 aa, Homo Sapiens
ALSAHAILS

SEQ ID NO: 1158978 - protein, 9 aa, Homo Sapiens
QPWEGRSPA

SEQ ID NO: 1158979 - protein, 9 aa, Homo Sapiens
ESSDQGPWT

SEQ ID NO: 1158980 - protein, 9 aa, Homo Sapiens
VTRGHGMGV

SEQ ID NO: 1158981 - protein, 9 aa, Homo Sapiens
KKQEEEGTT

SEQ ID NO: 1158982 - protein, 9 aa, Homo Sapiens
YRTKQAAVA

SEQ ID NO: 1158983 - protein, 9 aa, Homo Sapiens
EGIAYLVEV

SEQ ID NO: 1158984 - protein, 9 aa, Homo Sapiens
FALLATAVA

SEQ ID NO: 1158985 - protein, 9 aa, Homo Sapiens
DFVSECSSK

SEQ ID NO: 1158986 - protein, 9 aa, Homo Sapiens
RGLRKVLAK

SEQ ID NO: 1158987 - protein, 9 aa, Homo Sapiens
WYRTKQAAV

SEQ ID NO: 1158988 - protein, 9 aa, Homo Sapiens
QGCRIKSKF

SEQ ID NO: 1158989 - protein, 9 aa, Homo Sapiens
CPAPSSASV

SEQ ID NO: 1158990 - protein, 9 aa, Homo Sapiens
AVPTPCART

SEQ ID NO: 1158991 - protein, 9 aa, Homo Sapiens
QRTEDEKRK

SEQ ID NO: 1158992 - protein, 9 aa, Homo Sapiens
DGLEIGLRL

SEQ ID NO: 1158993 - protein, 9 aa, Homo Sapiens
RNIAKHHDE

SEQ ID NO: 1158994 - protein, 9 aa, Homo Sapiens
GDYSSGDFV

SEQ ID NO: 1158995 - protein, 9 aa, Homo Sapiens
GPQPWEGRS

SEQ ID NO: 1158996 - protein, 9 aa, Homo Sapiens
FRQHGCTGN

SEQ ID NO: 1158997 - protein, 9 aa, Homo Sapiens
SVHNEQWHS

SEQ ID NO: 1158998 - protein, 9 aa, Homo Sapiens
LIERESVLP

SEQ ID NO: 1158999 - protein, 9 aa, Homo Sapiens
TAVASDYWY

SEQ ID NO: 1159000 - protein, 9 aa, Homo Sapiens
LTPSFPPPH

SEQ ID NO: 1159001 - protein, 9 aa, Homo Sapiens
QPRQGADAR

SEQ ID NO: 1159002 - protein, 9 aa, Homo Sapiens
QEEEGTTDT

SEQ ID NO: 1159003 - protein, 9 aa, Homo Sapiens
ASLTRGLRK

SEQ ID NO: 1159004 - protein, 9 aa, Homo Sapiens
CSACLETFG

SEQ ID NO: 1159005 - protein, 9 aa, Homo Sapiens
SMETPRALH

SEQ ID NO: 1159006 - protein, 9 aa, Homo Sapiens
GTGPSAVPT

SEQ ID NO: 1159007 - protein, 9 aa, Homo Sapiens
AECSACLET

SEQ ID NO: 1159008 - protein, 9 aa, Homo Sapiens
WEAATADVI

SEQ ID NO: 1159009 - protein, 9 aa, Homo Sapiens
LLSFALLAT

SEQ ID NO: 1159010 - protein, 9 aa, Homo Sapiens
DHMKVIAGR

SEQ ID NO: 1159011 - protein, 9 aa, Homo Sapiens
LSTPSSSRT

SEQ ID NO: 1159012 - protein, 9 aa, Homo Sapiens
YFKMGDHMK

SEQ ID NO: 1159013 - protein, 9 aa, Homo Sapiens
CASDGMTFL

SEQ ID NO: 1159014 - protein, 9 aa, Homo Sapiens
LCASDGMTF

SEQ ID NO: 1159015 - protein, 9 aa, Homo Sapiens
PIIVLVGVE

SEQ ID NO: 1159016 - protein, 9 aa, Homo Sapiens
FKMGDHMKV

SEQ ID NO: 1159017 - protein, 9 aa, Homo Sapiens
SGVIPEGLV

SEQ ID NO: 1159018 - protein, 9 aa, Homo Sapiens
MWTNAGTGP

SEQ ID NO: 1159019 - protein, 9 aa, Homo Sapiens
FNYSVHNEQ

SEQ ID NO: 1159020 - protein, 9 aa, Homo Sapiens
FQQVQLERH

SEQ ID NO: 1159021 - protein, 9 aa, Homo Sapiens
LATAVASDY

SEQ ID NO: 1159022 - protein, 9 aa, Homo Sapiens
LLATAVASD

SEQ ID NO: 1159023 - protein, 9 aa, Homo Sapiens
DGHYMTLPV

SEQ ID NO: 1159024 - protein, 9 aa, Homo Sapiens
AHAILSEAS

SEQ ID NO: 1159025 - protein, 9 aa, Homo Sapiens
TLPVSPDQL

SEQ ID NO: 1159026 - protein, 9 aa, Homo Sapiens
WEGRSPATG

SEQ ID NO: 1159027 - protein, 9 aa, Homo Sapiens
DQGPWTPTQ

SEQ ID NO: 1159028 - protein, 9 aa, Homo Sapiens
SQQLIRHVA

SEQ ID NO: 1159029 - protein, 9 aa, Homo Sapiens
RMWTNAGTG

SEQ ID NO: 1159030 - protein, 9 aa, Homo Sapiens
KMGDHMKVI

SEQ ID NO: 1159031 - protein, 9 aa, Homo Sapiens
TPPAKKEIL

SEQ ID NO: 1159032 - protein, 9 aa, Homo Sapiens
IYIKSLRSP

SEQ ID NO: 1159033 - protein, 9 aa, Homo Sapiens
IELTPPAKK

SEQ ID NO: 1159034 - protein, 9 aa, Homo Sapiens
MHLGARMME

SEQ ID NO: 1159035 - protein, 9 aa, Homo Sapiens
AATADVIAI

SEQ ID NO: 1159036 - protein, 9 aa, Homo Sapiens
VIAILDAHI

SEQ ID NO: 1159037 - protein, 9 aa, Homo Sapiens
PWTPTQPLL

SEQ ID NO: 1159038 - protein, 9 aa, Homo Sapiens
EKGLSLSQQ

SEQ ID NO: 1159039 - protein, 9 aa, Homo Sapiens
LPVSPDQLP

SEQ ID NO: 1159040 - protein, 9 aa, Homo Sapiens
RPQDHDTDL

SEQ ID NO: 1159041 - protein, 9 aa, Homo Sapiens
LGFQIKKKN

SEQ ID NO: 1159042 - protein, 9 aa, Homo Sapiens
TPRPQDHDT

SEQ ID NO: 1159043 - protein, 9 aa, Homo Sapiens
PPSRQTLLI

SEQ ID NO: 1159044 - protein, 9 aa, Homo Sapiens
GHGMGVTAW

SEQ ID NO: 1159045 - protein, 9 aa, Homo Sapiens
CTGNDANTK

SEQ ID NO: 1159046 - protein, 9 aa, Homo Sapiens
VGSGVIPEG

SEQ ID NO: 1159047 - protein, 9 aa, Homo Sapiens
AGPIIVLVG

SEQ ID NO: 1159048 - protein, 9 aa, Homo Sapiens
IPPSRQTLL

SEQ ID NO: 1159049 - protein, 9 aa, Homo Sapiens
DEGIAYLVE

SEQ ID NO: 1159050 - protein, 9 aa, Homo Sapiens
QPKKQEEEG

SEQ ID NO: 1159051 - protein, 9 aa, Homo Sapiens
HGCTGNDAN

SEQ ID NO: 1159052 - protein, 9 aa, Homo Sapiens
EVSEGDLRK

SEQ ID NO: 1159053 - protein, 9 aa, Homo Sapiens
PFYVSLTLM

SEQ ID NO: 1159054 - protein, 9 aa, Homo Sapiens
DYSSGDFVS

SEQ ID NO: 1159055 - protein, 9 aa, Homo Sapiens
LSQQLIRHV

SEQ ID NO: 1159056 - protein, 9 aa, Homo Sapiens
PKKQEEEGT

SEQ ID NO: 1159057 - protein, 9 aa, Homo Sapiens
IKEEDLMVW

SEQ ID NO: 1159058 - protein, 9 aa, Homo Sapiens
VQLERHEYA

SEQ ID NO: 1159059 - protein, 9 aa, Homo Sapiens
ASVTVTRGH

SEQ ID NO: 1159060 - protein, 9 aa, Homo Sapiens
VQGCRIKSK

SEQ ID NO: 1159061 - protein, 9 aa, Homo Sapiens
SPATGLVSW

SEQ ID NO: 1159062 - protein, 9 aa, Homo Sapiens
APAVPVGSG

SEQ ID NO: 1159063 - protein, 9 aa, Homo Sapiens
TGNDANTKY

SEQ ID NO: 1159064 - protein, 9 aa, Homo Sapiens
GCRIKSKFR

SEQ ID NO: 1159065 - protein, 9 aa, Homo Sapiens
RGHGMGVTA

SEQ ID NO: 1159066 - protein, 9 aa, Homo Sapiens
EMSMHNTIK

SEQ ID NO: 1159067 - protein, 9 aa, Homo Sapiens
CRDTKTTEA

SEQ ID NO: 1159068 - protein, 9 aa, Homo Sapiens
QIPPSRQTL

SEQ ID NO: 1159069 - protein, 9 aa, Homo Sapiens
EDACRDTKT

SEQ ID NO: 1159070 - protein, 9 aa, Homo Sapiens
SDQGPWTPT

SEQ ID NO: 1159071 - protein, 9 aa, Homo Sapiens
TRGLRKVLA

SEQ ID NO: 1159072 - protein, 9 aa, Homo Sapiens
KQSLRPDPN

SEQ ID NO: 1159073 - protein, 9 aa, Homo Sapiens
LVSKQSLRP

SEQ ID NO: 1159074 - protein, 9 aa, Homo Sapiens
GESSDQGPW

SEQ ID NO: 1159075 - protein, 9 aa, Homo Sapiens
IFGTFVVYL

SEQ ID NO: 1159076 - protein, 9 aa, Homo Sapiens
SGNQTATFA

SEQ ID NO: 1159077 - protein, 9 aa, Homo Sapiens
NLLKDGLEI

SEQ ID NO: 1159078 - protein, 9 aa, Homo Sapiens
LGYGQAFLG

SEQ ID NO: 1159079 - protein, 9 aa, Homo Sapiens
KGLSLSQQL

SEQ ID NO: 1159080 - protein, 9 aa, Homo Sapiens
IIVLVGVEH

SEQ ID NO: 1159081 - protein, 9 aa, Homo Sapiens
EAKPKTKKA

SEQ ID NO: 1159082 - protein, 9 aa, Homo Sapiens
AFCSAGPII

SEQ ID NO: 1159083 - protein, 9 aa, Homo Sapiens
VEVSEGDLR

SEQ ID NO: 1159084 - protein, 9 aa, Homo Sapiens
LLLTPSFPP

SEQ ID NO: 1159085 - protein, 9 aa, Homo Sapiens
LMVWVDPLD

SEQ ID NO: 1159086 - protein, 9 aa, Homo Sapiens
IAILDAHIE

SEQ ID NO: 1159087 - protein, 9 aa, Homo Sapiens
PVTERLQRA

SEQ ID NO: 1159088 - protein, 9 aa, Homo Sapiens
DPGYQPRQG

SEQ ID NO: 1159089 - protein, 9 aa, Homo Sapiens
KEILWLSLG

SEQ ID NO: 1159090 - protein, 9 aa, Homo Sapiens
GPWTPTQPL

SEQ ID NO: 1159091 - protein, 9 aa, Homo Sapiens
ERQRTEDEK

SEQ ID NO: 1159092 - protein, 9 aa, Homo Sapiens
STPSSSRTT

SEQ ID NO: 1159093 - protein, 9 aa, Homo Sapiens
ECSACLETF

SEQ ID NO: 1159094 - protein, 9 aa, Homo Sapiens
LEIGLRLFK

SEQ ID NO: 1159095 - protein, 9 aa, Homo Sapiens
TPSGYLGLT

SEQ ID NO: 1159096 - protein, 9 aa, Homo Sapiens
VSKQSLRPD

SEQ ID NO: 1159097 - protein, 9 aa, Homo Sapiens
PCARTCPAP

SEQ ID NO: 1159098 - protein, 9 aa, Homo Sapiens
QTATFAPFH

SEQ ID NO: 1159099 - protein, 9 aa, Homo Sapiens
SAGPIIVLV

SEQ ID NO: 1159100 - protein, 9 aa, Homo Sapiens
RAIYIKSLR

SEQ ID NO: 1159101 - protein, 9 aa, Homo Sapiens
RDTKTTEAM

SEQ ID NO: 1159102 - protein, 9 aa, Homo Sapiens
YMTLPVSPD

SEQ ID NO: 1159103 - protein, 9 aa, Homo Sapiens
PKTKKAGAA

SEQ ID NO: 1159104 - protein, 9 aa, Homo Sapiens
MKVIAGRFE

SEQ ID NO: 1159105 - protein, 9 aa, Homo Sapiens
RAECSACLE

SEQ ID NO: 1159106 - protein, 9 aa, Homo Sapiens
DGMTFLSRC

SEQ ID NO: 1159107 - protein, 9 aa, Homo Sapiens
MTLPVSPDQ

SEQ ID NO: 1159108 - protein, 9 aa, Homo Sapiens
VTVTRGHGM

SEQ ID NO: 1159109 - protein, 9 aa, Homo Sapiens
LLTPSFPPP

SEQ ID NO: 1159110 - protein, 9 aa, Homo Sapiens
GPEVLQDSQ

SEQ ID NO: 1159111 - protein, 9 aa, Homo Sapiens
AVPVGSGVI

SEQ ID NO: 1159112 - protein, 9 aa, Homo Sapiens
EVLQDSQDR

SEQ ID NO: 1159113 - protein, 9 aa, Homo Sapiens
LSAHAILSE

SEQ ID NO: 1159114 - protein, 9 aa, Homo Sapiens
GMTFLSRCE

SEQ ID NO: 1159115 - protein, 9 aa, Homo Sapiens
FEMSMHNTI

SEQ ID NO: 1159116 - protein, 9 aa, Homo Sapiens
PSAVPTPCA

SEQ ID NO: 1159117 - protein, 9 aa, Homo Sapiens
PSGYLGLTD

SEQ ID NO: 1159118 - protein, 9 aa, Homo Sapiens
KQAAVARCQ

SEQ ID NO: 1159119 - protein, 9 aa, Homo Sapiens
SEQKVIIFE

SEQ ID NO: 1159120 - protein, 9 aa, Homo Sapiens
QSSIFGTFV

SEQ ID NO: 1159121 - protein, 9 aa, Homo Sapiens
QKVIIFEEG

SEQ ID NO: 1159122 - protein, 9 aa, Homo Sapiens
GWRARAECS

SEQ ID NO: 1159123 - protein, 9 aa, Homo Sapiens
EEMERQRTE

SEQ ID NO: 1159124 - protein, 9 aa, Homo Sapiens
LMHLGARMM

SEQ ID NO: 1159125 - protein, 9 aa, Homo Sapiens
QGADARMWT

SEQ ID NO: 1159126 - protein, 9 aa, Homo Sapiens
PEVLQDSQD

SEQ ID NO: 1159127 - protein, 9 aa, Homo Sapiens
MVQGCRIKS

SEQ ID NO: 1159128 - protein, 9 aa, Homo Sapiens
IWYRTKQAA

SEQ ID NO: 1159129 - protein, 9 aa, Homo Sapiens
NIAKHHDEG

SEQ ID NO: 1159130 - protein, 9 aa, Homo Sapiens
VLQDSQDRC

SEQ ID NO: 1159131 - protein, 9 aa, Homo Sapiens
CRIKSKFRV

SEQ ID NO: 1159132 - protein, 9 aa, Homo Sapiens
DEDACRDTK

SEQ ID NO: 1159133 - protein, 9 aa, Homo Sapiens
RAPAVPVGS

SEQ ID NO: 1159134 - protein, 9 aa, Homo Sapiens
GHYMTLPVS

SEQ ID NO: 1159135 - protein, 9 aa, Homo Sapiens
IKSKSPLPL

SEQ ID NO: 1159136 - protein, 9 aa, Homo Sapiens
QTLLIERYY

SEQ ID NO: 1159137 - protein, 9 aa, Homo Sapiens
MTFLSRCEF

SEQ ID NO: 1159138 - protein, 9 aa, Homo Sapiens
TGPSAVPTP

SEQ ID NO: 1159139 - protein, 9 aa, Homo Sapiens
DVIAILDAH

SEQ ID NO: 1159140 - protein, 9 aa, Homo Sapiens
RQHGCTGND

SEQ ID NO: 1159141 - protein, 9 aa, Homo Sapiens
VHNEQWHSF

SEQ ID NO: 1159142 - protein, 9 aa, Homo Sapiens
HNEQWHSFA

SEQ ID NO: 1159143 - protein, 9 aa, Homo Sapiens
ACDPGYQPR

SEQ ID NO: 1159144 - protein, 9 aa, Homo Sapiens
IAKHHDEGH

SEQ ID NO: 1159145 - protein, 9 aa, Homo Sapiens
EMRAIYIKS

SEQ ID NO: 1159146 - protein, 9 aa, Homo Sapiens
LSGNQTATF

SEQ ID NO: 1159147 - protein, 9 aa, Homo Sapiens
IKSLRSPMM

SEQ ID NO: 1159148 - protein, 9 aa, Homo Sapiens
TFVVYLVVL

SEQ ID NO: 1159149 - protein, 9 aa, Homo Sapiens
KDGLEIGLR

SEQ ID NO: 1159150 - protein, 9 aa, Homo Sapiens
YGQAFLGGL

SEQ ID NO: 1159151 - protein, 9 aa, Homo Sapiens
FNLLKDGLE

SEQ ID NO: 1159152 - protein, 9 aa, Homo Sapiens
VEEILPCLS

SEQ ID NO: 1159153 - protein, 9 aa, Homo Sapiens
GSPGHHVYP

SEQ ID NO: 1159154 - protein, 9 aa, Homo Sapiens
SAPRRMCLP

SEQ ID NO: 1159155 - protein, 9 aa, Homo Sapiens
KASTEMGLR

SEQ ID NO: 1159156 - protein, 9 aa, Homo Sapiens
TLDVFKKKF

SEQ ID NO: 1159157 - protein, 9 aa, Homo Sapiens
VPHSPENEL

SEQ ID NO: 1159158 - protein, 9 aa, Homo Sapiens
VLFFVISEC

SEQ ID NO: 1159159 - protein, 9 aa, Homo Sapiens
EVVRISHLY

SEQ ID NO: 1159160 - protein, 9 aa, Homo Sapiens
WGFSGDEVP

SEQ ID NO: 1159161 - protein, 9 aa, Homo Sapiens
KRPHSKVSL

SEQ ID NO: 1159162 - protein, 9 aa, Homo Sapiens
GQAYDKSLL

SEQ ID NO: 1159163 - protein, 9 aa, Homo Sapiens
CFSTLFLET

SEQ ID NO: 1159164 - protein, 9 aa, Homo Sapiens
VYMGKPKEK

SEQ ID NO: 1159165 - protein, 9 aa, Homo Sapiens
EYAPTSPTL

SEQ ID NO: 1159166 - protein, 9 aa, Homo Sapiens
STAKTFFTV

SEQ ID NO: 1159167 - protein, 9 aa, Homo Sapiens
DSKDGRTYF

SEQ ID NO: 1159168 - protein, 9 aa, Homo Sapiens
TVATPPRRR

SEQ ID NO: 1159169 - protein, 9 aa, Homo Sapiens
VRRITVGLI

SEQ ID NO: 1159170 - protein, 9 aa, Homo Sapiens
LCKTCYHIV

SEQ ID NO: 1159171 - protein, 9 aa, Homo Sapiens
VNDQLEEQR

SEQ ID NO: 1159172 - protein, 9 aa, Homo Sapiens
WSVKPVSSS

SEQ ID NO: 1159173 - protein, 9 aa, Homo Sapiens
FDLEDDFEI

SEQ ID NO: 1159174 - protein, 9 aa, Homo Sapiens
KPWLVEVNY

SEQ ID NO: 1159175 - protein, 9 aa, Homo Sapiens
WTNWGFSGD

SEQ ID NO: 1159176 - protein, 9 aa, Homo Sapiens
FEHHASTLS

SEQ ID NO: 1159177 - protein, 9 aa, Homo Sapiens
VFVANLDEN

SEQ ID NO: 1159178 - protein, 9 aa, Homo Sapiens
KVWWRLCKT

SEQ ID NO: 1159179 - protein, 9 aa, Homo Sapiens
HFIHILFFT

SEQ ID NO: 1159180 - protein, 9 aa, Homo Sapiens
TTERDRKKK

SEQ ID NO: 1159181 - protein, 9 aa, Homo Sapiens
PTIEPPVNL

SEQ ID NO: 1159182 - protein, 9 aa, Homo Sapiens
RRASRKTYD

SEQ ID NO: 1159183 - protein, 9 aa, Homo Sapiens
LSSTSPSSA

SEQ ID NO: 1159184 - protein, 9 aa, Homo Sapiens
GRGKKSLSA

SEQ ID NO: 1159185 - protein, 9 aa, Homo Sapiens
RCYRITWFT

SEQ ID NO: 1159186 - protein, 9 aa, Homo Sapiens
QATEAEELA

SEQ ID NO: 1159187 - protein, 9 aa, Homo Sapiens
HVRLSGWIF

SEQ ID NO: 1159188 - protein, 9 aa, Homo Sapiens
EYLEIQDEQ

SEQ ID NO: 1159189 - protein, 9 aa, Homo Sapiens
DGRGFCVNA

SEQ ID NO: 1159190 - protein, 9 aa, Homo Sapiens
FVLFFVISE

SEQ ID NO: 1159191 - protein, 9 aa, Homo Sapiens
RSCTGVTEY

SEQ ID NO: 1159192 - protein, 9 aa, Homo Sapiens
KKFPERVTA

SEQ ID NO: 1159193 - protein, 9 aa, Homo Sapiens
DTELRKEIS

SEQ ID NO: 1159194 - protein, 9 aa, Homo Sapiens
QPKHLEEVE

SEQ ID NO: 1159195 - protein, 9 aa, Homo Sapiens
STTCSGVSE

SEQ ID NO: 1159196 - protein, 9 aa, Homo Sapiens
FPERVTALE

SEQ ID NO: 1159197 - protein, 9 aa, Homo Sapiens
SFLDFNPHH

SEQ ID NO: 1159198 - protein, 9 aa, Homo Sapiens
HAEQQASQP

SEQ ID NO: 1159199 - protein, 9 aa, Homo Sapiens
QCHPLNNRL

SEQ ID NO: 1159200 - protein, 9 aa, Homo Sapiens
CVDISKGGV

SEQ ID NO: 1159201 - protein, 9 aa, Homo Sapiens
EVDIGSVLS

SEQ ID NO: 1159202 - protein, 9 aa, Homo Sapiens
MVEERERQI

SEQ ID NO: 1159203 - protein, 9 aa, Homo Sapiens
YSSSVKKSW

SEQ ID NO: 1159204 - protein, 9 aa, Homo Sapiens
VRRAFQLPP

SEQ ID NO: 1159205 - protein, 9 aa, Homo Sapiens
SARTSTSNS

SEQ ID NO: 1159206 - protein, 9 aa, Homo Sapiens
GQDRGLCRE

SEQ ID NO: 1159207 - protein, 9 aa, Homo Sapiens
EVWNPQKAI

SEQ ID NO: 1159208 - protein, 9 aa, Homo Sapiens
QKPNSRPAP

SEQ ID NO: 1159209 - protein, 9 aa, Homo Sapiens
GPNGTLFVS

SEQ ID NO: 1159210 - protein, 9 aa, Homo Sapiens
DIGSVLSLQ

SEQ ID NO: 1159211 - protein, 9 aa, Homo Sapiens
VCVTLGSET

SEQ ID NO: 1159212 - protein, 9 aa, Homo Sapiens
LKHDPCQML

SEQ ID NO: 1159213 - protein, 9 aa, Homo Sapiens
KTIFAVSGL

SEQ ID NO: 1159214 - protein, 9 aa, Homo Sapiens
EDISNTVDA

SEQ ID NO: 1159215 - protein, 9 aa, Homo Sapiens
ECGRAFIQK

SEQ ID NO: 1159216 - protein, 9 aa, Homo Sapiens
EPQLFQAER

SEQ ID NO: 1159217 - protein, 9 aa, Homo Sapiens
HPLNNRLNF

SEQ ID NO: 1159218 - protein, 9 aa, Homo Sapiens
EVLADGEKR

SEQ ID NO: 1159219 - protein, 9 aa, Homo Sapiens
ANLDENDPK

SEQ ID NO: 1159220 - protein, 9 aa, Homo Sapiens
KALTYWDLQ

SEQ ID NO: 1159221 - protein, 9 aa, Homo Sapiens
IRRMDPFAK

SEQ ID NO: 1159222 - protein, 9 aa, Homo Sapiens
NKAPGPIYD

SEQ ID NO: 1159223 - protein, 9 aa, Homo Sapiens
PAGITDHIV

SEQ ID NO: 1159224 - protein, 9 aa, Homo Sapiens
GSLYYSSSV

SEQ ID NO: 1159225 - protein, 9 aa, Homo Sapiens
ELEEEGQAY

SEQ ID NO: 1159226 - protein, 9 aa, Homo Sapiens
SSLCLINQK

SEQ ID NO: 1159227 - protein, 9 aa, Homo Sapiens
GCRKLGTVS

SEQ ID NO: 1159228 - protein, 9 aa, Homo Sapiens
AEALDRSYQ

SEQ ID NO: 1159229 - protein, 9 aa, Homo Sapiens
SDITSLNFR

SEQ ID NO: 1159230 - protein, 9 aa, Homo Sapiens
HSKQELRDG

SEQ ID NO: 1159231 - protein, 9 aa, Homo Sapiens
KDSRFQLLH

SEQ ID NO: 1159232 - protein, 9 aa, Homo Sapiens
KLVYMGKPK

SEQ ID NO: 1159233 - protein, 9 aa, Homo Sapiens
PGQDRGLCR

SEQ ID NO: 1159234 - protein, 9 aa, Homo Sapiens
RVSLIFHEE

SEQ ID NO: 1159235 - protein, 9 aa, Homo Sapiens
YLYLNAGGV

SEQ ID NO: 1159236 - protein, 9 aa, Homo Sapiens
AGDWRTTFT

SEQ ID NO: 1159237 - protein, 9 aa, Homo Sapiens
PSPLPTVAT

SEQ ID NO: 1159238 - protein, 9 aa, Homo Sapiens
NHICFEEQC

SEQ ID NO: 1159239 - protein, 9 aa, Homo Sapiens
YQGPVSDAT

SEQ ID NO: 1159240 - protein, 9 aa, Homo Sapiens
VSLIFHEEC

SEQ ID NO: 1159241 - protein, 9 aa, Homo Sapiens
CGRRFGSRP

SEQ ID NO: 1159242 - protein, 9 aa, Homo Sapiens
RWVLAVDHL

SEQ ID NO: 1159243 - protein, 9 aa, Homo Sapiens
VVAEGYVKH

SEQ ID NO: 1159244 - protein, 9 aa, Homo Sapiens
GRQASQQPA

SEQ ID NO: 1159245 - protein, 9 aa, Homo Sapiens
HKLEYLEIQ

SEQ ID NO: 1159246 - protein, 9 aa, Homo Sapiens
TPRNAGPAA

SEQ ID NO: 1159247 - protein, 9 aa, Homo Sapiens
EEAVRRAFQ

SEQ ID NO: 1159248 - protein, 9 aa, Homo Sapiens
RLNFSQVLF

SEQ ID NO: 1159249 - protein, 9 aa, Homo Sapiens
TEKKTINIS

SEQ ID NO: 1159250 - protein, 9 aa, Homo Sapiens
FNDESAEEI

SEQ ID NO: 1159251 - protein, 9 aa, Homo Sapiens
GVTATKNVA

SEQ ID NO: 1159252 - protein, 9 aa, Homo Sapiens
TERIQKDMD

SEQ ID NO: 1159253 - protein, 9 aa, Homo Sapiens
GEPHANNTK

SEQ ID NO: 1159254 - protein, 9 aa, Homo Sapiens
GFLRAQRVF

SEQ ID NO: 1159255 - protein, 9 aa, Homo Sapiens
EVHVCACPG

SEQ ID NO: 1159256 - protein, 9 aa, Homo Sapiens
FCVNASAVS

SEQ ID NO: 1159257 - protein, 9 aa, Homo Sapiens
RHIRQMQLS

SEQ ID NO: 1159258 - protein, 9 aa, Homo Sapiens
LEVHQAELD

SEQ ID NO: 1159259 - protein, 9 aa, Homo Sapiens
SSVCVTLGS

SEQ ID NO: 1159260 - protein, 9 aa, Homo Sapiens
EADVDHPDL

SEQ ID NO: 1159261 - protein, 9 aa, Homo Sapiens
QLKENIQDL

SEQ ID NO: 1159262 - protein, 9 aa, Homo Sapiens
KVPHSPENE

SEQ ID NO: 1159263 - protein, 9 aa, Homo Sapiens
PRRSFLDFN

SEQ ID NO: 1159264 - protein, 9 aa, Homo Sapiens
DYKFNDESA

SEQ ID NO: 1159265 - protein, 9 aa, Homo Sapiens
IAQKREKMH

SEQ ID NO: 1159266 - protein, 9 aa, Homo Sapiens
ATNDRVWTL

SEQ ID NO: 1159267 - protein, 9 aa, Homo Sapiens
FCSQHGSPA

SEQ ID NO: 1159268 - protein, 9 aa, Homo Sapiens
RAYEHAKIE

SEQ ID NO: 1159269 - protein, 9 aa, Homo Sapiens
TNKGRQLNK

SEQ ID NO: 1159270 - protein, 9 aa, Homo Sapiens
LCPSCGSSP

SEQ ID NO: 1159271 - protein, 9 aa, Homo Sapiens
LEIQDEQHL

SEQ ID NO: 1159272 - protein, 9 aa, Homo Sapiens
EGRDLSAWK

SEQ ID NO: 1159273 - protein, 9 aa, Homo Sapiens
MLSTPQEST

SEQ ID NO: 1159274 - protein, 9 aa, Homo Sapiens
MDPFAKKEH

SEQ ID NO: 1159275 - protein, 9 aa, Homo Sapiens
QRLQLHGVQ

SEQ ID NO: 1159276 - protein, 9 aa, Homo Sapiens
NMTQGFWEH

SEQ ID NO: 1159277 - protein, 9 aa, Homo Sapiens
DVKALTYWD

SEQ ID NO: 1159278 - protein, 9 aa, Homo Sapiens
ECMDHTLTS

SEQ ID NO: 1159279 - protein, 9 aa, Homo Sapiens
AAAAHEANE

SEQ ID NO: 1159280 - protein, 9 aa, Homo Sapiens
VANLDENDP

SEQ ID NO: 1159281 - protein, 9 aa, Homo Sapiens
RGKKSLSAP

SEQ ID NO: 1159282 - protein, 9 aa, Homo Sapiens
FANKVVLMC

SEQ ID NO: 1159283 - protein, 9 aa, Homo Sapiens
REIFYGLDV

SEQ ID NO: 1159284 - protein, 9 aa, Homo Sapiens
QGVGFDDVE

SEQ ID NO: 1159285 - protein, 9 aa, Homo Sapiens
KITGRPTLV

SEQ ID NO: 1159286 - protein, 9 aa, Homo Sapiens
SRGQSGSRR

SEQ ID NO: 1159287 - protein, 9 aa, Homo Sapiens
GNTSNKKFP

SEQ ID NO: 1159288 - protein, 9 aa, Homo Sapiens
LYWLIFSVS

SEQ ID NO: 1159289 - protein, 9 aa, Homo Sapiens
CDFRSEDNS

SEQ ID NO: 1159290 - protein, 9 aa, Homo Sapiens
YVASGSFDK

SEQ ID NO: 1159291 - protein, 9 aa, Homo Sapiens
VATPPRRRP

SEQ ID NO: 1159292 - protein, 9 aa, Homo Sapiens
HVWQLYGVR

SEQ ID NO: 1159293 - protein, 9 aa, Homo Sapiens
CIPSREQIP

SEQ ID NO: 1159294 - protein, 9 aa, Homo Sapiens
ICWSNIANS

SEQ ID NO: 1159295 - protein, 9 aa, Homo Sapiens
GFEDFEFAN

SEQ ID NO: 1159296 - protein, 9 aa, Homo Sapiens
GRRGVRGGP

SEQ ID NO: 1159297 - protein, 9 aa, Homo Sapiens
TVEWSARSE

SEQ ID NO: 1159298 - protein, 9 aa, Homo Sapiens
AAHEQRLQL

SEQ ID NO: 1159299 - protein, 9 aa, Homo Sapiens
FLIFPMLVA

SEQ ID NO: 1159300 - protein, 9 aa, Homo Sapiens
LDSGIGPFP

SEQ ID NO: 1159301 - protein, 9 aa, Homo Sapiens
VILDLKDLF

SEQ ID NO: 1159302 - protein, 9 aa, Homo Sapiens
YEDFVNFTD

SEQ ID NO: 1159303 - protein, 9 aa, Homo Sapiens
FLMNRNNVV

SEQ ID NO: 1159304 - protein, 9 aa, Homo Sapiens
ESTAKTFFT

SEQ ID NO: 1159305 - protein, 9 aa, Homo Sapiens
PLTVEWSAR

SEQ ID NO: 1159306 - protein, 9 aa, Homo Sapiens
APGPIYDVY

SEQ ID NO: 1159307 - protein, 9 aa, Homo Sapiens
VERRQKPNS

SEQ ID NO: 1159308 - protein, 9 aa, Homo Sapiens
AQSYSLEPD

SEQ ID NO: 1159309 - protein, 9 aa, Homo Sapiens
INRTFFLDV

SEQ ID NO: 1159310 - protein, 9 aa, Homo Sapiens
EKRPIAKPN

SEQ ID NO: 1159311 - protein, 9 aa, Homo Sapiens
AFSPDGKYV

SEQ ID NO: 1159312 - protein, 9 aa, Homo Sapiens
ATGVTATKN

SEQ ID NO: 1159313 - protein, 9 aa, Homo Sapiens
GTAATEKTA

SEQ ID NO: 1159314 - protein, 9 aa, Homo Sapiens
CLSENISVW

SEQ ID NO: 1159315 - protein, 9 aa, Homo Sapiens
PSREQIPRF

SEQ ID NO: 1159316 - protein, 9 aa, Homo Sapiens
HRGVQSLWG

SEQ ID NO: 1159317 - protein, 9 aa, Homo Sapiens
SRGSSQSKH

SEQ ID NO: 1159318 - protein, 9 aa, Homo Sapiens
NFTDIHHSN

SEQ ID NO: 1159319 - protein, 9 aa, Homo Sapiens
YQRPYSQAT

SEQ ID NO: 1159320 - protein, 9 aa, Homo Sapiens
VTLNLLLKL

SEQ ID NO: 1159321 - protein, 9 aa, Homo Sapiens
LEEVEGQLK

SEQ ID NO: 1159322 - protein, 9 aa, Homo Sapiens
IGEKRDSLG

SEQ ID NO: 1159323 - protein, 9 aa, Homo Sapiens
LEKVPHSPE

SEQ ID NO: 1159324 - protein, 9 aa, Homo Sapiens
KVHVWQLYG

SEQ ID NO: 1159325 - protein, 9 aa, Homo Sapiens
EDFVNFTDI

SEQ ID NO: 1159326 - protein, 9 aa, Homo Sapiens
SREQIPRFV

SEQ ID NO: 1159327 - protein, 9 aa, Homo Sapiens
FTVKELVAG

SEQ ID NO: 1159328 - protein, 9 aa, Homo Sapiens
RRQKPNSRP

SEQ ID NO: 1159329 - protein, 9 aa, Homo Sapiens
PIYDVYSFA

SEQ ID NO: 1159330 - protein, 9 aa, Homo Sapiens
YVLCDDEQT

SEQ ID NO: 1159331 - protein, 9 aa, Homo Sapiens
ERLIEEIEY

SEQ ID NO: 1159332 - protein, 9 aa, Homo Sapiens
LETFLAWLT

SEQ ID NO: 1159333 - protein, 9 aa, Homo Sapiens
KGGVYLERM

SEQ ID NO: 1159334 - protein, 9 aa, Homo Sapiens
HIRQMQLSA

SEQ ID NO: 1159335 - protein, 9 aa, Homo Sapiens
IFSAREKRN

SEQ ID NO: 1159336 - protein, 9 aa, Homo Sapiens
QPKLAHSPF

SEQ ID NO: 1159337 - protein, 9 aa, Homo Sapiens
FVTLSSPSP

SEQ ID NO: 1159338 - protein, 9 aa, Homo Sapiens
IMSNAKNWL

SEQ ID NO: 1159339 - protein, 9 aa, Homo Sapiens
QPQLERFRF

SEQ ID NO: 1159340 - protein, 9 aa, Homo Sapiens
NTDGNMPYV

SEQ ID NO: 1159341 - protein, 9 aa, Homo Sapiens
LLYWLIFSV

SEQ ID NO: 1159342 - protein, 9 aa, Homo Sapiens
LPCLSENIS

SEQ ID NO: 1159343 - protein, 9 aa, Homo Sapiens
RGDSQYSWK

SEQ ID NO: 1159344 - protein, 9 aa, Homo Sapiens
EYSIRITPR

SEQ ID NO: 1159345 - protein, 9 aa, Homo Sapiens
IYDVYSFAI

SEQ ID NO: 1159346 - protein, 9 aa, Homo Sapiens
YRGNNDHNI

SEQ ID NO: 1159347 - protein, 9 aa, Homo Sapiens
TATKNVAER

SEQ ID NO: 1159348 - protein, 9 aa, Homo Sapiens
AAHEANELF

SEQ ID NO: 1159349 - protein, 9 aa, Homo Sapiens
KKSLSAPAI

SEQ ID NO: 1159350 - protein, 9 aa, Homo Sapiens
RRMCLPAAT

SEQ ID NO: 1159351 - protein, 9 aa, Homo Sapiens
DVNLPKCLS

SEQ ID NO: 1159352 - protein, 9 aa, Homo Sapiens
AREKRNVQP

SEQ ID NO: 1159353 - protein, 9 aa, Homo Sapiens
RTLQKCENG

SEQ ID NO: 1159354 - protein, 9 aa, Homo Sapiens
KVHETVRRI

SEQ ID NO: 1159355 - protein, 9 aa, Homo Sapiens
KVASYWLIQ

SEQ ID NO: 1159356 - protein, 9 aa, Homo Sapiens
NESPEILEA

SEQ ID NO: 1159357 - protein, 9 aa, Homo Sapiens
PQCGTYGVY

SEQ ID NO: 1159358 - protein, 9 aa, Homo Sapiens
CVDAGGEPH

SEQ ID NO: 1159359 - protein, 9 aa, Homo Sapiens
TGVTEYAVQ

SEQ ID NO: 1159360 - protein, 9 aa, Homo Sapiens
WLIFIICVY

SEQ ID NO: 1159361 - protein, 9 aa, Homo Sapiens
QEEEVSTLC

SEQ ID NO: 1159362 - protein, 9 aa, Homo Sapiens
RMCLPAATG

SEQ ID NO: 1159363 - protein, 9 aa, Homo Sapiens
STTKSGTAA

SEQ ID NO: 1159364 - protein, 9 aa, Homo Sapiens
SVHYSPQLL

SEQ ID NO: 1159365 - protein, 9 aa, Homo Sapiens
TGFLDKIQV

SEQ ID NO: 1159366 - protein, 9 aa, Homo Sapiens
LDLETFLAW

SEQ ID NO: 1159367 - protein, 9 aa, Homo Sapiens
PESSVTAVP

SEQ ID NO: 1159368 - protein, 9 aa, Homo Sapiens
MKWNSPPYV

SEQ ID NO: 1159369 - protein, 9 aa, Homo Sapiens
LIFPMLVAS

SEQ ID NO: 1159370 - protein, 9 aa, Homo Sapiens
KHHPAWDCG

SEQ ID NO: 1159371 - protein, 9 aa, Homo Sapiens
NQGVGFDDV

SEQ ID NO: 1159372 - protein, 9 aa, Homo Sapiens
ICVKAHLAL

SEQ ID NO: 1159373 - protein, 9 aa, Homo Sapiens
EQCRNTSFF

SEQ ID NO: 1159374 - protein, 9 aa, Homo Sapiens
HFERRWVLA

SEQ ID NO: 1159375 - protein, 9 aa, Homo Sapiens
PRGDSQYSW

SEQ ID NO: 1159376 - protein, 9 aa, Homo Sapiens
FEVHVCACP

SEQ ID NO: 1159377 - protein, 9 aa, Homo Sapiens
RAPWRTPAV

SEQ ID NO: 1159378 - protein, 9 aa, Homo Sapiens
MLRSKMGTC

SEQ ID NO: 1159379 - protein, 9 aa, Homo Sapiens
TDGSFIGFK

SEQ ID NO: 1159380 - protein, 9 aa, Homo Sapiens
YYINRTFFL

SEQ ID NO: 1159381 - protein, 9 aa, Homo Sapiens
PCAPNEMTN

SEQ ID NO: 1159382 - protein, 9 aa, Homo Sapiens
NTITLFKTD

SEQ ID NO: 1159383 - protein, 9 aa, Homo Sapiens
GALPLGRQA

SEQ ID NO: 1159384 - protein, 9 aa, Homo Sapiens
PGAKFSIID

SEQ ID NO: 1159385 - protein, 9 aa, Homo Sapiens
WSNIANSNE

SEQ ID NO: 1159386 - protein, 9 aa, Homo Sapiens
SRMDSTGFL

SEQ ID NO: 1159387 - protein, 9 aa, Homo Sapiens
TFLAWLTEA

SEQ ID NO: 1159388 - protein, 9 aa, Homo Sapiens
CAECGRAFI

SEQ ID NO: 1159389 - protein, 9 aa, Homo Sapiens
DITSLNFRS

SEQ ID NO: 1159390 - protein, 9 aa, Homo Sapiens
YETVFPLED

SEQ ID NO: 1159391 - protein, 9 aa, Homo Sapiens
LNKYLYLNK

SEQ ID NO: 1159392 - protein, 9 aa, Homo Sapiens
CTQCGRRFG

SEQ ID NO: 1159393 - protein, 9 aa, Homo Sapiens
LKEEENRAL

SEQ ID NO: 1159394 - protein, 9 aa, Homo Sapiens
GVRGGPGKM

SEQ ID NO: 1159395 - protein, 9 aa, Homo Sapiens
PVILDLKDL

SEQ ID NO: 1159396 - protein, 9 aa, Homo Sapiens
RGQSGSRRA

SEQ ID NO: 1159397 - protein, 9 aa, Homo Sapiens
SNKKFPERV

SEQ ID NO: 1159398 - protein, 9 aa, Homo Sapiens
EAIAPNAFV

SEQ ID NO: 1159399 - protein, 9 aa, Homo Sapiens
PEILEASQF

SEQ ID NO: 1159400 - protein, 9 aa, Homo Sapiens
EQNILPLVD

SEQ ID NO: 1159401 - protein, 9 aa, Homo Sapiens
PYEDKVHVW

SEQ ID NO: 1159402 - protein, 9 aa, Homo Sapiens
GQSGSRRAS

SEQ ID NO: 1159403 - protein, 9 aa, Homo Sapiens
RNVQPPASQ

SEQ ID NO: 1159404 - protein, 9 aa, Homo Sapiens
KHMRQLRMD

SEQ ID NO: 1159405 - protein, 9 aa, Homo Sapiens
PQPAQPAQA

SEQ ID NO: 1159406 - protein, 9 aa, Homo Sapiens
TLQEFKEDI

SEQ ID NO: 1159407 - protein, 9 aa, Homo Sapiens
WEHSMLTDP

SEQ ID NO: 1159408 - protein, 9 aa, Homo Sapiens
KLEYLEIQD

SEQ ID NO: 1159409 - protein, 9 aa, Homo Sapiens
EKLLRLRRG

SEQ ID NO: 1159410 - protein, 9 aa, Homo Sapiens
AVKICNVCH

SEQ ID NO: 1159411 - protein, 9 aa, Homo Sapiens
RSQKITGRP

SEQ ID NO: 1159412 - protein, 9 aa, Homo Sapiens
QYSVYGSGG

SEQ ID NO: 1159413 - protein, 9 aa, Homo Sapiens
QHSLVMKWN

SEQ ID NO: 1159414 - protein, 9 aa, Homo Sapiens
EHSMLTDPG

SEQ ID NO: 1159415 - protein, 9 aa, Homo Sapiens
LRLRRGFLR

SEQ ID NO: 1159416 - protein, 9 aa, Homo Sapiens
GPQCGTYGV

SEQ ID NO: 1159417 - protein, 9 aa, Homo Sapiens
PKCLSHDLP

SEQ ID NO: 1159418 - protein, 9 aa, Homo Sapiens
HGRGKKSLS

SEQ ID NO: 1159419 - protein, 9 aa, Homo Sapiens
RGFLRAQRV

SEQ ID NO: 1159420 - protein, 9 aa, Homo Sapiens
KRTMHNWSS

SEQ ID NO: 1159421 - protein, 9 aa, Homo Sapiens
QYSWKSVGS

SEQ ID NO: 1159422 - protein, 9 aa, Homo Sapiens
EDPEKRPIA

SEQ ID NO: 1159423 - protein, 9 aa, Homo Sapiens
TPQESTELV

SEQ ID NO: 1159424 - protein, 9 aa, Homo Sapiens
SSSVKKSWH

SEQ ID NO: 1159425 - protein, 9 aa, Homo Sapiens
EPVALNISI

SEQ ID NO: 1159426 - protein, 9 aa, Homo Sapiens
NSPRFDVTS

SEQ ID NO: 1159427 - protein, 9 aa, Homo Sapiens
DDGGGYPEP

SEQ ID NO: 1159428 - protein, 9 aa, Homo Sapiens
TVEEILPCL

SEQ ID NO: 1159429 - protein, 9 aa, Homo Sapiens
PYLYLNAGG

SEQ ID NO: 1159430 - protein, 9 aa, Homo Sapiens
LRMDRGLPV

SEQ ID NO: 1159431 - protein, 9 aa, Homo Sapiens
TMGPISVAI

SEQ ID NO: 1159432 - protein, 9 aa, Homo Sapiens
PEEYAPTSP

SEQ ID NO: 1159433 - protein, 9 aa, Homo Sapiens
AYVFEHHAS

SEQ ID NO: 1159434 - protein, 9 aa, Homo Sapiens
LDENDPKTF

SEQ ID NO: 1159435 - protein, 9 aa, Homo Sapiens
KFLVFVANL

SEQ ID NO: 1159436 - protein, 9 aa, Homo Sapiens
GMAGDWRTT

SEQ ID NO: 1159437 - protein, 9 aa, Homo Sapiens
FVNFTDIHH

SEQ ID NO: 1159438 - protein, 9 aa, Homo Sapiens
RQIRQIVQS

SEQ ID NO: 1159439 - protein, 9 aa, Homo Sapiens
KRPIAKPNN

SEQ ID NO: 1159440 - protein, 9 aa, Homo Sapiens
PQRSIATKV

SEQ ID NO: 1159441 - protein, 9 aa, Homo Sapiens
GNNDHNISH

SEQ ID NO: 1159442 - protein, 9 aa, Homo Sapiens
IQHFCSQHG

SEQ ID NO: 1159443 - protein, 9 aa, Homo Sapiens
IRITPRKHT

SEQ ID NO: 1159444 - protein, 9 aa, Homo Sapiens
NLAPFSEVL

SEQ ID NO: 1159445 - protein, 9 aa, Homo Sapiens
YGITEVLSW

SEQ ID NO: 1159446 - protein, 9 aa, Homo Sapiens
LKVRRAFQL

SEQ ID NO: 1159447 - protein, 9 aa, Homo Sapiens
HLNKYLYLN

SEQ ID NO: 1159448 - protein, 9 aa, Homo Sapiens
TGFEDFEFA

SEQ ID NO: 1159449 - protein, 9 aa, Homo Sapiens
QCGRRFGSR

SEQ ID NO: 1159450 - protein, 9 aa, Homo Sapiens
CRKLGTVSF

SEQ ID NO: 1159451 - protein, 9 aa, Homo Sapiens
KFILLLFTI

SEQ ID NO: 1159452 - protein, 9 aa, Homo Sapiens
ITWFTSWSP

SEQ ID NO: 1159453 - protein, 9 aa, Homo Sapiens
ATMGPISVA

SEQ ID NO: 1159454 - protein, 9 aa, Homo Sapiens
LMNRNNVVP

SEQ ID NO: 1159455 - protein, 9 aa, Homo Sapiens
QKIEDISNT

SEQ ID NO: 1159456 - protein, 9 aa, Homo Sapiens
NRPDFRTNK

SEQ ID NO: 1159457 - protein, 9 aa, Homo Sapiens
LKKANKKTE

SEQ ID NO: 1159458 - protein, 9 aa, Homo Sapiens
AKLKEEENR

SEQ ID NO: 1159459 - protein, 9 aa, Homo Sapiens
GFLDKIQVT

SEQ ID NO: 1159460 - protein, 9 aa, Homo Sapiens
RISHLYILV

SEQ ID NO: 1159461 - protein, 9 aa, Homo Sapiens
SKMGTCCHH

SEQ ID NO: 1159462 - protein, 9 aa, Homo Sapiens
FRTNKGRQL

SEQ ID NO: 1159463 - protein, 9 aa, Homo Sapiens
HLNYVWIGL

SEQ ID NO: 1159464 - protein, 9 aa, Homo Sapiens
KCGHVNLHL

SEQ ID NO: 1159465 - protein, 9 aa, Homo Sapiens
LGDPRRKSL

SEQ ID NO: 1159466 - protein, 9 aa, Homo Sapiens
IFAKKINSR

SEQ ID NO: 1159467 - protein, 9 aa, Homo Sapiens
EKVNDQLEE

SEQ ID NO: 1159468 - protein, 9 aa, Homo Sapiens
AVPRARKYK

SEQ ID NO: 1159469 - protein, 9 aa, Homo Sapiens
HICFEEQCR

SEQ ID NO: 1159470 - protein, 9 aa, Homo Sapiens
RFDVTSDSA

SEQ ID NO: 1159471 - protein, 9 aa, Homo Sapiens
GKVWWRLCK

SEQ ID NO: 1159472 - protein, 9 aa, Homo Sapiens
CREIFYGLD

SEQ ID NO: 1159473 - protein, 9 aa, Homo Sapiens
EVDYNMVAF

SEQ ID NO: 1159474 - protein, 9 aa, Homo Sapiens
VVEVVRISH

SEQ ID NO: 1159475 - protein, 9 aa, Homo Sapiens
ELFKEGKEV

SEQ ID NO: 1159476 - protein, 9 aa, Homo Sapiens
KRYYDEVVA

SEQ ID NO: 1159477 - protein, 9 aa, Homo Sapiens
PIINEAMAA

SEQ ID NO: 1159478 - protein, 9 aa, Homo Sapiens
YVHTTLELF

SEQ ID NO: 1159479 - protein, 9 aa, Homo Sapiens
SVIAQKREK

SEQ ID NO: 1159480 - protein, 9 aa, Homo Sapiens
ARTSTSNSN

SEQ ID NO: 1159481 - protein, 9 aa, Homo Sapiens
SCSFHSKQE

SEQ ID NO: 1159482 - protein, 9 aa, Homo Sapiens
QQQIHPIKS

SEQ ID NO: 1159483 - protein, 9 aa, Homo Sapiens
TTEKKTINI

SEQ ID NO: 1159484 - protein, 9 aa, Homo Sapiens
TQCGRRFGS

SEQ ID NO: 1159485 - protein, 9 aa, Homo Sapiens
FVSDAYKGL

SEQ ID NO: 1159486 - protein, 9 aa, Homo Sapiens
YSQATEAEE

SEQ ID NO: 1159487 - protein, 9 aa, Homo Sapiens
LPYEDKVHV

SEQ ID NO: 1159488 - protein, 9 aa, Homo Sapiens
SKLTILAAC

SEQ ID NO: 1159489 - protein, 9 aa, Homo Sapiens
EPHANNTKW

SEQ ID NO: 1159490 - protein, 9 aa, Homo Sapiens
AMALLLQQL

SEQ ID NO: 1159491 - protein, 9 aa, Homo Sapiens
LYPQPPLLP

SEQ ID NO: 1159492 - protein, 9 aa, Homo Sapiens
KTFFTVDSS

SEQ ID NO: 1159493 - protein, 9 aa, Homo Sapiens
GHTLDVFKK

SEQ ID NO: 1159494 - protein, 9 aa, Homo Sapiens
DFNPHHFWQ

SEQ ID NO: 1159495 - protein, 9 aa, Homo Sapiens
TKQHQCDTE

SEQ ID NO: 1159496 - protein, 9 aa, Homo Sapiens
NPSESLGSN

SEQ ID NO: 1159497 - protein, 9 aa, Homo Sapiens
FDTSLISKT

SEQ ID NO: 1159498 - protein, 9 aa, Homo Sapiens
CSKPTEGDA

SEQ ID NO: 1159499 - protein, 9 aa, Homo Sapiens
KKEHIEIIA

SEQ ID NO: 1159500 - protein, 9 aa, Homo Sapiens
RRYRFENSD

SEQ ID NO: 1159501 - protein, 9 aa, Homo Sapiens
SSTTISNQA

SEQ ID NO: 1159502 - protein, 9 aa, Homo Sapiens
YRITWFTSW

SEQ ID NO: 1159503 - protein, 9 aa, Homo Sapiens
PEKRPIAKP

SEQ ID NO: 1159504 - protein, 9 aa, Homo Sapiens
LRSCTGVTE

SEQ ID NO: 1159505 - protein, 9 aa, Homo Sapiens
CVKAHLALR

SEQ ID NO: 1159506 - protein, 9 aa, Homo Sapiens
PWRTPAVPR

SEQ ID NO: 1159507 - protein, 9 aa, Homo Sapiens
KSSLCLINQ

SEQ ID NO: 1159508 - protein, 9 aa, Homo Sapiens
DRESSHDEF

SEQ ID NO: 1159509 - protein, 9 aa, Homo Sapiens
RGVRGGPGK

SEQ ID NO: 1159510 - protein, 9 aa, Homo Sapiens
SFIGFKEKP

SEQ ID NO: 1159511 - protein, 9 aa, Homo Sapiens
LIQTLQEFK

SEQ ID NO: 1159512 - protein, 9 aa, Homo Sapiens
RKAADDTWD

SEQ ID NO: 1159513 - protein, 9 aa, Homo Sapiens
AIAPNAFVM

SEQ ID NO: 1159514 - protein, 9 aa, Homo Sapiens
NVCHSLLIQ

SEQ ID NO: 1159515 - protein, 9 aa, Homo Sapiens
RDNQGVGFD

SEQ ID NO: 1159516 - protein, 9 aa, Homo Sapiens
LPAATGVTA

SEQ ID NO: 1159517 - protein, 9 aa, Homo Sapiens
VTATKNVAE

SEQ ID NO: 1159518 - protein, 9 aa, Homo Sapiens
VAEGYVKHD

SEQ ID NO: 1159519 - protein, 9 aa, Homo Sapiens
DVYQRPYSQ

SEQ ID NO: 1159520 - protein, 9 aa, Homo Sapiens
VECMDHTLT

SEQ ID NO: 1159521 - protein, 9 aa, Homo Sapiens
RYYDEVVAE

SEQ ID NO: 1159522 - protein, 9 aa, Homo Sapiens
PAEDYVPQK

SEQ ID NO: 1159523 - protein, 9 aa, Homo Sapiens
QPEAAHEQR

SEQ ID NO: 1159524 - protein, 9 aa, Homo Sapiens
SHDEFQDAL

SEQ ID NO: 1159525 - protein, 9 aa, Homo Sapiens
DPGAKFSII

SEQ ID NO: 1159526 - protein, 9 aa, Homo Sapiens
EFANKVVLM

SEQ ID NO: 1159527 - protein, 9 aa, Homo Sapiens
IEDKRDSKD

SEQ ID NO: 1159528 - protein, 9 aa, Homo Sapiens
VSSRGSSQS

SEQ ID NO: 1159529 - protein, 9 aa, Homo Sapiens
TCSGVSEES

SEQ ID NO: 1159530 - protein, 9 aa, Homo Sapiens
FTWHSSLAK

SEQ ID NO: 1159531 - protein, 9 aa, Homo Sapiens
MKRPHSKVS

SEQ ID NO: 1159532 - protein, 9 aa, Homo Sapiens
KKCTVLIHV

SEQ ID NO: 1159533 - protein, 9 aa, Homo Sapiens
YWDLQCIIL

SEQ ID NO: 1159534 - protein, 9 aa, Homo Sapiens
EHNQWYCYI

SEQ ID NO: 1159535 - protein, 9 aa, Homo Sapiens
RPAEDYVPQ

SEQ ID NO: 1159536 - protein, 9 aa, Homo Sapiens
TEHHVSLID

SEQ ID NO: 1159537 - protein, 9 aa, Homo Sapiens
IHTMESFVT

SEQ ID NO: 1159538 - protein, 9 aa, Homo Sapiens
TLGSETQAN

SEQ ID NO: 1159539 - protein, 9 aa, Homo Sapiens
NLSFSVFII

SEQ ID NO: 1159540 - protein, 9 aa, Homo Sapiens
RWVITTLKL

SEQ ID NO: 1159541 - protein, 9 aa, Homo Sapiens
CDKAFTWHS

SEQ ID NO: 1159542 - protein, 9 aa, Homo Sapiens
VRGGPGKMD

SEQ ID NO: 1159543 - protein, 9 aa, Homo Sapiens
SLHIPYRDA

SEQ ID NO: 1159544 - protein, 9 aa, Homo Sapiens
PGKVWWRLC

SEQ ID NO: 1159545 - protein, 9 aa, Homo Sapiens
SFVTLSSPS

SEQ ID NO: 1159546 - protein, 9 aa, Homo Sapiens
ENGEVKIES

SEQ ID NO: 1159547 - protein, 9 aa, Homo Sapiens
HPVVIGPSN

SEQ ID NO: 1159548 - protein, 9 aa, Homo Sapiens
HHASTLSWP

SEQ ID NO: 1159549 - protein, 9 aa, Homo Sapiens
TFFTVDSST

SEQ ID NO: 1159550 - protein, 9 aa, Homo Sapiens
EQIPRFVHG

SEQ ID NO: 1159551 - protein, 9 aa, Homo Sapiens
DFRSEDNSE

SEQ ID NO: 1159552 - protein, 9 aa, Homo Sapiens
HTNGLFSTL

SEQ ID NO: 1159553 - protein, 9 aa, Homo Sapiens
RGNNDHNIS

SEQ ID NO: 1159554 - protein, 9 aa, Homo Sapiens
FPGGLCFSV

SEQ ID NO: 1159555 - protein, 9 aa, Homo Sapiens
EAAHEQRLQ

SEQ ID NO: 1159556 - protein, 9 aa, Homo Sapiens
WNLSFSVFI

SEQ ID NO: 1159557 - protein, 9 aa, Homo Sapiens
QLLEEKVND

SEQ ID NO: 1159558 - protein, 9 aa, Homo Sapiens
CFLIFPMLV

SEQ ID NO: 1159559 - protein, 9 aa, Homo Sapiens
KEEAALVAK

SEQ ID NO: 1159560 - protein, 9 aa, Homo Sapiens
RYRFENSDQ

SEQ ID NO: 1159561 - protein, 9 aa, Homo Sapiens
LDKEEAALV

SEQ ID NO: 1159562 - protein, 9 aa, Homo Sapiens
QPPPPNSVI

SEQ ID NO: 1159563 - protein, 9 aa, Homo Sapiens
IGFKEKPQD

SEQ ID NO: 1159564 - protein, 9 aa, Homo Sapiens
QLRMDRGLP

SEQ ID NO: 1159565 - protein, 9 aa, Homo Sapiens
PNEMTNMQP

SEQ ID NO: 1159566 - protein, 9 aa, Homo Sapiens
SIGTNGTTM

SEQ ID NO: 1159567 - protein, 9 aa, Homo Sapiens
LRLGIYVHT

SEQ ID NO: 1159568 - protein, 9 aa, Homo Sapiens
CEECDKAFT

SEQ ID NO: 1159569 - protein, 9 aa, Homo Sapiens
KANKKTELQ

SEQ ID NO: 1159570 - protein, 9 aa, Homo Sapiens
STPQESTEL

SEQ ID NO: 1159571 - protein, 9 aa, Homo Sapiens
SLTAYRGNN

SEQ ID NO: 1159572 - protein, 9 aa, Homo Sapiens
LNISIGTNG

SEQ ID NO: 1159573 - protein, 9 aa, Homo Sapiens
FNGGSLYYS

SEQ ID NO: 1159574 - protein, 9 aa, Homo Sapiens
VKAHLALRH

SEQ ID NO: 1159575 - protein, 9 aa, Homo Sapiens
NRVQNSLGN

SEQ ID NO: 1159576 - protein, 9 aa, Homo Sapiens
CVYYYVAVF

SEQ ID NO: 1159577 - protein, 9 aa, Homo Sapiens
VFPLEDSIV

SEQ ID NO: 1159578 - protein, 9 aa, Homo Sapiens
RATNDRVWT

SEQ ID NO: 1159579 - protein, 9 aa, Homo Sapiens
DEEDGKDSN

SEQ ID NO: 1159580 - protein, 9 aa, Homo Sapiens
FLVFMFHGI

SEQ ID NO: 1159581 - protein, 9 aa, Homo Sapiens
PNGTLFVSD

SEQ ID NO: 1159582 - protein, 9 aa, Homo Sapiens
VDYNMVAFQ

SEQ ID NO: 1159583 - protein, 9 aa, Homo Sapiens
RGNLWVSLG

SEQ ID NO: 1159584 - protein, 9 aa, Homo Sapiens
VHYSPQLLG

SEQ ID NO: 1159585 - protein, 9 aa, Homo Sapiens
YMPTDSQYL

SEQ ID NO: 1159586 - protein, 9 aa, Homo Sapiens
AMAAAIAYG

SEQ ID NO: 1159587 - protein, 9 aa, Homo Sapiens
ETFLAWLTE

SEQ ID NO: 1159588 - protein, 9 aa, Homo Sapiens
QTLQEFKED

SEQ ID NO: 1159589 - protein, 9 aa, Homo Sapiens
DTKLRKKAH

SEQ ID NO: 1159590 - protein, 9 aa, Homo Sapiens
RLIQTLQEF

SEQ ID NO: 1159591 - protein, 9 aa, Homo Sapiens
VEERERQIR

SEQ ID NO: 1159592 - protein, 9 aa, Homo Sapiens
VETVCSKPT

SEQ ID NO: 1159593 - protein, 9 aa, Homo Sapiens
SPRFDVTSD

SEQ ID NO: 1159594 - protein, 9 aa, Homo Sapiens
VKHMRQLRM

SEQ ID NO: 1159595 - protein, 9 aa, Homo Sapiens
YTIGQTLIP

SEQ ID NO: 1159596 - protein, 9 aa, Homo Sapiens
LPTLQNKVL

SEQ ID NO: 1159597 - protein, 9 aa, Homo Sapiens
VCSKPTEGD

SEQ ID NO: 1159598 - protein, 9 aa, Homo Sapiens
LPEPAQRGN

SEQ ID NO: 1159599 - protein, 9 aa, Homo Sapiens
VSSSFGSEA

SEQ ID NO: 1159600 - protein, 9 aa, Homo Sapiens
SPYRMRRIL

SEQ ID NO: 1159601 - protein, 9 aa, Homo Sapiens
KKINSRCGS

SEQ ID NO: 1159602 - protein, 9 aa, Homo Sapiens
DLKDLFQLI

SEQ ID NO: 1159603 - protein, 9 aa, Homo Sapiens
GQQQIHPIK

SEQ ID NO: 1159604 - protein, 9 aa, Homo Sapiens
RESSHDEFQ

SEQ ID NO: 1159605 - protein, 9 aa, Homo Sapiens
WGQQQIHPI

SEQ ID NO: 1159606 - protein, 9 aa, Homo Sapiens
GVTEYAVQR

SEQ ID NO: 1159607 - protein, 9 aa, Homo Sapiens
TVRRITVGL

SEQ ID NO: 1159608 - protein, 9 aa, Homo Sapiens
DEYLEVHQA

SEQ ID NO: 1159609 - protein, 9 aa, Homo Sapiens
LSRLKGTSK

SEQ ID NO: 1159610 - protein, 9 aa, Homo Sapiens
TLNLLLKLP

SEQ ID NO: 1159611 - protein, 9 aa, Homo Sapiens
VDKSWWTNW

SEQ ID NO: 1159612 - protein, 9 aa, Homo Sapiens
AAPCRVSLN

SEQ ID NO: 1159613 - protein, 9 aa, Homo Sapiens
FKSASENYN

SEQ ID NO: 1159614 - protein, 9 aa, Homo Sapiens
AHLALRHHT

SEQ ID NO: 1159615 - protein, 9 aa, Homo Sapiens
ETVCSKPTE

SEQ ID NO: 1159616 - protein, 9 aa, Homo Sapiens
PAQPAQAPQ

SEQ ID NO: 1159617 - protein, 9 aa, Homo Sapiens
PDGKYVASG

SEQ ID NO: 1159618 - protein, 9 aa, Homo Sapiens
KKCFSTLFL

SEQ ID NO: 1159619 - protein, 9 aa, Homo Sapiens
WVTLKAEQN

SEQ ID NO: 1159620 - protein, 9 aa, Homo Sapiens
QAKKCFSTL

SEQ ID NO: 1159621 - protein, 9 aa, Homo Sapiens
PQPPLLPPT

SEQ ID NO: 1159622 - protein, 9 aa, Homo Sapiens
GWNLSFSVF

SEQ ID NO: 1159623 - protein, 9 aa, Homo Sapiens
NELFKEGKE

SEQ ID NO: 1159624 - protein, 9 aa, Homo Sapiens
RDRKKKCTV

SEQ ID NO: 1159625 - protein, 9 aa, Homo Sapiens
QCGTYGVYT

SEQ ID NO: 1159626 - protein, 9 aa, Homo Sapiens
KSLSAPAII

SEQ ID NO: 1159627 - protein, 9 aa, Homo Sapiens
RFSYIQSGC

SEQ ID NO: 1159628 - protein, 9 aa, Homo Sapiens
VAQSYSLEP

SEQ ID NO: 1159629 - protein, 9 aa, Homo Sapiens
KAFTWHSSL

SEQ ID NO: 1159630 - protein, 9 aa, Homo Sapiens
EEKVNDQLE

SEQ ID NO: 1159631 - protein, 9 aa, Homo Sapiens
PHSKVSLKV

SEQ ID NO: 1159632 - protein, 9 aa, Homo Sapiens
DEHITQWKG

SEQ ID NO: 1159633 - protein, 9 aa, Homo Sapiens
KLAHSPFAS

SEQ ID NO: 1159634 - protein, 9 aa, Homo Sapiens
PYIFRDNQG

SEQ ID NO: 1159635 - protein, 9 aa, Homo Sapiens
YIFRDNQGV

SEQ ID NO: 1159636 - protein, 9 aa, Homo Sapiens
VYQRPYSQA

SEQ ID NO: 1159637 - protein, 9 aa, Homo Sapiens
LSLRRHIRQ

SEQ ID NO: 1159638 - protein, 9 aa, Homo Sapiens
QNSRPSLQR

SEQ ID NO: 1159639 - protein, 9 aa, Homo Sapiens
SPDGKYVAS

SEQ ID NO: 1159640 - protein, 9 aa, Homo Sapiens
ECDKAFTWH

SEQ ID NO: 1159641 - protein, 9 aa, Homo Sapiens
LSRKASTEM

SEQ ID NO: 1159642 - protein, 9 aa, Homo Sapiens
HWGQQQIHP

SEQ ID NO: 1159643 - protein, 9 aa, Homo Sapiens
HHVSLIDSL

SEQ ID NO: 1159644 - protein, 9 aa, Homo Sapiens
HMRQLRMDR

SEQ ID NO: 1159645 - protein, 9 aa, Homo Sapiens
EDDFEILSV

SEQ ID NO: 1159646 - protein, 9 aa, Homo Sapiens
HTLDVFKKK

SEQ ID NO: 1159647 - protein, 9 aa, Homo Sapiens
YPLEEPTIE

SEQ ID NO: 1159648 - protein, 9 aa, Homo Sapiens
MGTCCHHCF

SEQ ID NO: 1159649 - protein, 9 aa, Homo Sapiens
SQKITGRPT

SEQ ID NO: 1159650 - protein, 9 aa, Homo Sapiens
AWTISRVVD

SEQ ID NO: 1159651 - protein, 9 aa, Homo Sapiens
LCFSVCLFR

SEQ ID NO: 1159652 - protein, 9 aa, Homo Sapiens
SQYSWKSVG

SEQ ID NO: 1159653 - protein, 9 aa, Homo Sapiens
NSGRLLHLD

SEQ ID NO: 1159654 - protein, 9 aa, Homo Sapiens
SPLPTVATP

SEQ ID NO: 1159655 - protein, 9 aa, Homo Sapiens
LGSNSPSSQ

SEQ ID NO: 1159656 - protein, 9 aa, Homo Sapiens
RCIPSREQI

SEQ ID NO: 1159657 - protein, 9 aa, Homo Sapiens
HQAELDKLT

SEQ ID NO: 1159658 - protein, 9 aa, Homo Sapiens
DKSWWTNWG

SEQ ID NO: 1159659 - protein, 9 aa, Homo Sapiens
WVITTLKLE

SEQ ID NO: 1159660 - protein, 9 aa, Homo Sapiens
LEYLEIQDE

SEQ ID NO: 1159661 - protein, 9 aa, Homo Sapiens
ANELFKEGK

SEQ ID NO: 1159662 - protein, 9 aa, Homo Sapiens
NKDGLRLST

SEQ ID NO: 1159663 - protein, 9 aa, Homo Sapiens
IGPSNSNLP

SEQ ID NO: 1159664 - protein, 9 aa, Homo Sapiens
IGTNGTTMY

SEQ ID NO: 1159665 - protein, 9 aa, Homo Sapiens
SLIFHEECS

SEQ ID NO: 1159666 - protein, 9 aa, Homo Sapiens
PASLDSART

SEQ ID NO: 1159667 - protein, 9 aa, Homo Sapiens
NMPYVLCDD

SEQ ID NO: 1159668 - protein, 9 aa, Homo Sapiens
VYYYVAVFP

SEQ ID NO: 1159669 - protein, 9 aa, Homo Sapiens
SLYPQPPLL

SEQ ID NO: 1159670 - protein, 9 aa, Homo Sapiens
KKKCTVLIH

SEQ ID NO: 1159671 - protein, 9 aa, Homo Sapiens
NLKVRRAFQ

SEQ ID NO: 1159672 - protein, 9 aa, Homo Sapiens
FILLLFTIG

SEQ ID NO: 1159673 - protein, 9 aa, Homo Sapiens
PCQMLQISR

SEQ ID NO: 1159674 - protein, 9 aa, Homo Sapiens
SQYMPTDSQ

SEQ ID NO: 1159675 - protein, 9 aa, Homo Sapiens
GFCVNASAV

SEQ ID NO: 1159676 - protein, 9 aa, Homo Sapiens
PSESLGSNS

SEQ ID NO: 1159677 - protein, 9 aa, Homo Sapiens
PQKAKRKTD

SEQ ID NO: 1159678 - protein, 9 aa, Homo Sapiens
VQLLYPRAT

SEQ ID NO: 1159679 - protein, 9 aa, Homo Sapiens
TWHSSLAKH

SEQ ID NO: 1159680 - protein, 9 aa, Homo Sapiens
ARGQPKLAH

SEQ ID NO: 1159681 - protein, 9 aa, Homo Sapiens
TLFKTDKIL

SEQ ID NO: 1159682 - protein, 9 aa, Homo Sapiens
ANSNEQDVY

SEQ ID NO: 1159683 - protein, 9 aa, Homo Sapiens
PAQAPQAQP

SEQ ID NO: 1159684 - protein, 9 aa, Homo Sapiens
VTAVPRARK

SEQ ID NO: 1159685 - protein, 9 aa, Homo Sapiens
SFSVFIICI

SEQ ID NO: 1159686 - protein, 9 aa, Homo Sapiens
TFFPGGLCF

SEQ ID NO: 1159687 - protein, 9 aa, Homo Sapiens
FKETEMEVS

SEQ ID NO: 1159688 - protein, 9 aa, Homo Sapiens
SDAYKGLFE

SEQ ID NO: 1159689 - protein, 9 aa, Homo Sapiens
WLIQLDSVK

SEQ ID NO: 1159690 - protein, 9 aa, Homo Sapiens
YYYVAVFPF

SEQ ID NO: 1159691 - protein, 9 aa, Homo Sapiens
VADLTFVLT

SEQ ID NO: 1159692 - protein, 9 aa, Homo Sapiens
VIPYLYLNA

SEQ ID NO: 1159693 - protein, 9 aa, Homo Sapiens
FSIIDSLSL

SEQ ID NO: 1159694 - protein, 9 aa, Homo Sapiens
KSCSFHSKQ

SEQ ID NO: 1159695 - protein, 9 aa, Homo Sapiens
VALNISIGT

SEQ ID NO: 1159696 - protein, 9 aa, Homo Sapiens
DYMGKDTFA

SEQ ID NO: 1159697 - protein, 9 aa, Homo Sapiens
PEKLLRLRR

SEQ ID NO: 1159698 - protein, 9 aa, Homo Sapiens
PGSVIAQKR

SEQ ID NO: 1159699 - protein, 9 aa, Homo Sapiens
LFVSDAYKG

SEQ ID NO: 1159700 - protein, 9 aa, Homo Sapiens
VWWRLCKTC

SEQ ID NO: 1159701 - protein, 9 aa, Homo Sapiens
LVMKWNSPP

SEQ ID NO: 1159702 - protein, 9 aa, Homo Sapiens
QSGSRRASR

SEQ ID NO: 1159703 - protein, 9 aa, Homo Sapiens
APFSEVLAD

SEQ ID NO: 1159704 - protein, 9 aa, Homo Sapiens
AVYQGPVSD

SEQ ID NO: 1159705 - protein, 9 aa, Homo Sapiens
RLSTELSEG

SEQ ID NO: 1159706 - protein, 9 aa, Homo Sapiens
GRLASSTTI

SEQ ID NO: 1159707 - protein, 9 aa, Homo Sapiens
VVDKSWWTN

SEQ ID NO: 1159708 - protein, 9 aa, Homo Sapiens
GGEPHANNT

SEQ ID NO: 1159709 - protein, 9 aa, Homo Sapiens
DISNTVDAM

SEQ ID NO: 1159710 - protein, 9 aa, Homo Sapiens
AKFSIIDSL

SEQ ID NO: 1159711 - protein, 9 aa, Homo Sapiens
DPGRCYRIT

SEQ ID NO: 1159712 - protein, 9 aa, Homo Sapiens
AELDKLTAQ

SEQ ID NO: 1159713 - protein, 9 aa, Homo Sapiens
FLVFVANLD

SEQ ID NO: 1159714 - protein, 9 aa, Homo Sapiens
VLCDDEQTL

SEQ ID NO: 1159715 - protein, 9 aa, Homo Sapiens
KFSIIDSLS

SEQ ID NO: 1159716 - protein, 9 aa, Homo Sapiens
SPILSRLKG

SEQ ID NO: 1159717 - protein, 9 aa, Homo Sapiens
AEASSQYMP

SEQ ID NO: 1159718 - protein, 9 aa, Homo Sapiens
VTLSSPSPS

SEQ ID NO: 1159719 - protein, 9 aa, Homo Sapiens
SPWMRSSSQ

SEQ ID NO: 1159720 - protein, 9 aa, Homo Sapiens
KVRRAFQLP

SEQ ID NO: 1159721 - protein, 9 aa, Homo Sapiens
NYPLEEPTI

SEQ ID NO: 1159722 - protein, 9 aa, Homo Sapiens
LTAYRGNND

SEQ ID NO: 1159723 - protein, 9 aa, Homo Sapiens
RLRRGFLRA

SEQ ID NO: 1159724 - protein, 9 aa, Homo Sapiens
LLEWSFMNS

SEQ ID NO: 1159725 - protein, 9 aa, Homo Sapiens
SIATKVTSA

SEQ ID NO: 1159726 - protein, 9 aa, Homo Sapiens
MQYSVYGSG

SEQ ID NO: 1159727 - protein, 9 aa, Homo Sapiens
LQKCENGMT

SEQ ID NO: 1159728 - protein, 9 aa, Homo Sapiens
TLHNLKVRR

SEQ ID NO: 1159729 - protein, 9 aa, Homo Sapiens
KKRYYDEVV

SEQ ID NO: 1159730 - protein, 9 aa, Homo Sapiens
GQTLIPRYF

SEQ ID NO: 1159731 - protein, 9 aa, Homo Sapiens
RRVGWTVHR

SEQ ID NO: 1159732 - protein, 9 aa, Homo Sapiens
IINEAMAAA

SEQ ID NO: 1159733 - protein, 9 aa, Homo Sapiens
STGIYRGPV

SEQ ID NO: 1159734 - protein, 9 aa, Homo Sapiens
GSLCFLIFP

SEQ ID NO: 1159735 - protein, 9 aa, Homo Sapiens
VFPDVSSRG

SEQ ID NO: 1159736 - protein, 9 aa, Homo Sapiens
MLCDYKFND

SEQ ID NO: 1159737 - protein, 9 aa, Homo Sapiens
HILFFTTVL

SEQ ID NO: 1159738 - protein, 9 aa, Homo Sapiens
SNSNLPKII

SEQ ID NO: 1159739 - protein, 9 aa, Homo Sapiens
PWLVEVNYS

SEQ ID NO: 1159740 - protein, 9 aa, Homo Sapiens
QFPLDLETF

SEQ ID NO: 1159741 - protein, 9 aa, Homo Sapiens
VLTLPLWAT

SEQ ID NO: 1159742 - protein, 9 aa, Homo Sapiens
VATMGPISV

SEQ ID NO: 1159743 - protein, 9 aa, Homo Sapiens
LYVNMDDGG

SEQ ID NO: 1159744 - protein, 9 aa, Homo Sapiens
NSNEQDVYQ

SEQ ID NO: 1159745 - protein, 9 aa, Homo Sapiens
ARKVHETVR

SEQ ID NO: 1159746 - protein, 9 aa, Homo Sapiens
SEADVDHPD

SEQ ID NO: 1159747 - protein, 9 aa, Homo Sapiens
AAVYSEIFL

SEQ ID NO: 1159748 - protein, 9 aa, Homo Sapiens
ILSRLKGTS

SEQ ID NO: 1159749 - protein, 9 aa, Homo Sapiens
CWSNIANSN

SEQ ID NO: 1159750 - protein, 9 aa, Homo Sapiens
PTFFPGGLC

SEQ ID NO: 1159751 - protein, 9 aa, Homo Sapiens
SGIMSNAKN

SEQ ID NO: 1159752 - protein, 9 aa, Homo Sapiens
NSRPSLQRT

SEQ ID NO: 1159753 - protein, 9 aa, Homo Sapiens
RPSLQRTQA

SEQ ID NO: 1159754 - protein, 9 aa, Homo Sapiens
GIIRLLPKH

SEQ ID NO: 1159755 - protein, 9 aa, Homo Sapiens
SVTAVPRAR

SEQ ID NO: 1159756 - protein, 9 aa, Homo Sapiens
KWSSKPTVH

SEQ ID NO: 1159757 - protein, 9 aa, Homo Sapiens
LNLLLKLPM

SEQ ID NO: 1159758 - protein, 9 aa, Homo Sapiens
DKILTNVNW

SEQ ID NO: 1159759 - protein, 9 aa, Homo Sapiens
VPRSSRRRR

SEQ ID NO: 1159760 - protein, 9 aa, Homo Sapiens
FARANSDIT

SEQ ID NO: 1159761 - protein, 9 aa, Homo Sapiens
QAEALDRSY

SEQ ID NO: 1159762 - protein, 9 aa, Homo Sapiens
FRERLIQTL

SEQ ID NO: 1159763 - protein, 9 aa, Homo Sapiens
RTPAVPRSS

SEQ ID NO: 1159764 - protein, 9 aa, Homo Sapiens
AKKEHIEII

SEQ ID NO: 1159765 - protein, 9 aa, Homo Sapiens
QRSIATKVT

SEQ ID NO: 1159766 - protein, 9 aa, Homo Sapiens
NKKTELQVG

SEQ ID NO: 1159767 - protein, 9 aa, Homo Sapiens
RQMQLSATG

SEQ ID NO: 1159768 - protein, 9 aa, Homo Sapiens
HRFGGQGNR

SEQ ID NO: 1159769 - protein, 9 aa, Homo Sapiens
ELVAGSDDY

SEQ ID NO: 1159770 - protein, 9 aa, Homo Sapiens
RTFFLDVHP

SEQ ID NO: 1159771 - protein, 9 aa, Homo Sapiens
LIEEIEYRI

SEQ ID NO: 1159772 - protein, 9 aa, Homo Sapiens
FEEQCRNTS

SEQ ID NO: 1159773 - protein, 9 aa, Homo Sapiens
EDKRDSKDG

SEQ ID NO: 1159774 - protein, 9 aa, Homo Sapiens
KAHLALRHH

SEQ ID NO: 1159775 - protein, 9 aa, Homo Sapiens
LKVDDTGKT

SEQ ID NO: 1159776 - protein, 9 aa, Homo Sapiens
PGQNAWLSY

SEQ ID NO: 1159777 - protein, 9 aa, Homo Sapiens
AREEHSCTW

SEQ ID NO: 1159778 - protein, 9 aa, Homo Sapiens
KSLHIPYRD

SEQ ID NO: 1159779 - protein, 9 aa, Homo Sapiens
ALPLGRQAS

SEQ ID NO: 1159780 - protein, 9 aa, Homo Sapiens
GQGNRFSYI

SEQ ID NO: 1159781 - protein, 9 aa, Homo Sapiens
SLVMKWNSP

SEQ ID NO: 1159782 - protein, 9 aa, Homo Sapiens
NSFEVHVCA

SEQ ID NO: 1159783 - protein, 9 aa, Homo Sapiens
LHFSSSELK

SEQ ID NO: 1159784 - protein, 9 aa, Homo Sapiens
KCTVLIHVR

SEQ ID NO: 1159785 - protein, 9 aa, Homo Sapiens
LERFRFAII

SEQ ID NO: 1159786 - protein, 9 aa, Homo Sapiens
REEHSCTWG

SEQ ID NO: 1159787 - protein, 9 aa, Homo Sapiens
FLDKIQVTE

SEQ ID NO: 1159788 - protein, 9 aa, Homo Sapiens
RPAPKSSTS

SEQ ID NO: 1159789 - protein, 9 aa, Homo Sapiens
RRKSLHIPY

SEQ ID NO: 1159790 - protein, 9 aa, Homo Sapiens
EIQDEQHLV

SEQ ID NO: 1159791 - protein, 9 aa, Homo Sapiens
ALLDGRGFC

SEQ ID NO: 1159792 - protein, 9 aa, Homo Sapiens
KDLFQLIYE

SEQ ID NO: 1159793 - protein, 9 aa, Homo Sapiens
VKELVAGSD

SEQ ID NO: 1159794 - protein, 9 aa, Homo Sapiens
PLDLETFLA

SEQ ID NO: 1159795 - protein, 9 aa, Homo Sapiens
LSQHSLVMK

SEQ ID NO: 1159796 - protein, 9 aa, Homo Sapiens
TSPSSALPV

SEQ ID NO: 1159797 - protein, 9 aa, Homo Sapiens
LLLHTPRNA

SEQ ID NO: 1159798 - protein, 9 aa, Homo Sapiens
NLLAHTNGL

SEQ ID NO: 1159799 - protein, 9 aa, Homo Sapiens
QMQLSATGC

SEQ ID NO: 1159800 - protein, 9 aa, Homo Sapiens
NILVIPYLY

SEQ ID NO: 1159801 - protein, 9 aa, Homo Sapiens
FKARGQPKL

SEQ ID NO: 1159802 - protein, 9 aa, Homo Sapiens
PEPAQRGNL

SEQ ID NO: 1159803 - protein, 9 aa, Homo Sapiens
GSFIGFKEK

SEQ ID NO: 1159804 - protein, 9 aa, Homo Sapiens
RKTRRDTQY

SEQ ID NO: 1159805 - protein, 9 aa, Homo Sapiens
SLISKTRTI

SEQ ID NO: 1159806 - protein, 9 aa, Homo Sapiens
YVFEHHAST

SEQ ID NO: 1159807 - protein, 9 aa, Homo Sapiens
VNLPKCLSH

SEQ ID NO: 1159808 - protein, 9 aa, Homo Sapiens
EAHFERRWV

SEQ ID NO: 1159809 - protein, 9 aa, Homo Sapiens
SVFIICISY

SEQ ID NO: 1159810 - protein, 9 aa, Homo Sapiens
DICVKAHLA

SEQ ID NO: 1159811 - protein, 9 aa, Homo Sapiens
SYSLEPDQI

SEQ ID NO: 1159812 - protein, 9 aa, Homo Sapiens
EVPQRSIAT

SEQ ID NO: 1159813 - protein, 9 aa, Homo Sapiens
RAICWSNIA

SEQ ID NO: 1159814 - protein, 9 aa, Homo Sapiens
CMTRLFFVL

SEQ ID NO: 1159815 - protein, 9 aa, Homo Sapiens
EHSCTWGRQ

SEQ ID NO: 1159816 - protein, 9 aa, Homo Sapiens
LVAGSDDYT

SEQ ID NO: 1159817 - protein, 9 aa, Homo Sapiens
LTVEWSARS

SEQ ID NO: 1159818 - protein, 9 aa, Homo Sapiens
LGEGGQSRF

SEQ ID NO: 1159819 - protein, 9 aa, Homo Sapiens
LDPGRCYRI

SEQ ID NO: 1159820 - protein, 9 aa, Homo Sapiens
DLEDDFEIL

SEQ ID NO: 1159821 - protein, 9 aa, Homo Sapiens
SLRRHIRQM

SEQ ID NO: 1159822 - protein, 9 aa, Homo Sapiens
MPYVLCDDE

SEQ ID NO: 1159823 - protein, 9 aa, Homo Sapiens
VRKTRRDTQ

SEQ ID NO: 1159824 - protein, 9 aa, Homo Sapiens
DHTLTSLFP

SEQ ID NO: 1159825 - protein, 9 aa, Homo Sapiens
PAWDCGRRA

SEQ ID NO: 1159826 - protein, 9 aa, Homo Sapiens
LEDDFEILS

SEQ ID NO: 1159827 - protein, 9 aa, Homo Sapiens
FIQKNLRHL

SEQ ID NO: 1159828 - protein, 9 aa, Homo Sapiens
DRKKKCTVL

SEQ ID NO: 1159829 - protein, 9 aa, Homo Sapiens
SAREKRNVQ

SEQ ID NO: 1159830 - protein, 9 aa, Homo Sapiens
LSGWIFAKK

SEQ ID NO: 1159831 - protein, 9 aa, Homo Sapiens
APWRTPAVP

SEQ ID NO: 1159832 - protein, 9 aa, Homo Sapiens
GSRRASRKT

SEQ ID NO: 1159833 - protein, 9 aa, Homo Sapiens
TELVYNKSK

SEQ ID NO: 1159834 - protein, 9 aa, Homo Sapiens
PWDTMLPPK

SEQ ID NO: 1159835 - protein, 9 aa, Homo Sapiens
QMLQISRVD

SEQ ID NO: 1159836 - protein, 9 aa, Homo Sapiens
TLCKDVTAL

SEQ ID NO: 1159837 - protein, 9 aa, Homo Sapiens
SPFFLVLFS

SEQ ID NO: 1159838 - protein, 9 aa, Homo Sapiens
EEENRALRY

SEQ ID NO: 1159839 - protein, 9 aa, Homo Sapiens
NDESAEEIR

SEQ ID NO: 1159840 - protein, 9 aa, Homo Sapiens
SNKQTERIQ

SEQ ID NO: 1159841 - protein, 9 aa, Homo Sapiens
EDVPWDTML

SEQ ID NO: 1159842 - protein, 9 aa, Homo Sapiens
QVFHEVDIG

SEQ ID NO: 1159843 - protein, 9 aa, Homo Sapiens
ASLKVSNSS

SEQ ID NO: 1159844 - protein, 9 aa, Homo Sapiens
NRLNFSQVL

SEQ ID NO: 1159845 - protein, 9 aa, Homo Sapiens
EEGQAYDKS

SEQ ID NO: 1159846 - protein, 9 aa, Homo Sapiens
KDGLRLSTE

SEQ ID NO: 1159847 - protein, 9 aa, Homo Sapiens
SFMNSNLKF

SEQ ID NO: 1159848 - protein, 9 aa, Homo Sapiens
PKSSTSDHI

SEQ ID NO: 1159849 - protein, 9 aa, Homo Sapiens
DWRTTFTVA

SEQ ID NO: 1159850 - protein, 9 aa, Homo Sapiens
GQPKLAHSP

SEQ ID NO: 1159851 - protein, 9 aa, Homo Sapiens
HPVFKETEM

SEQ ID NO: 1159852 - protein, 9 aa, Homo Sapiens
LHNLKVRRA

SEQ ID NO: 1159853 - protein, 9 aa, Homo Sapiens
ANTTTSFID

SEQ ID NO: 1159854 - protein, 9 aa, Homo Sapiens
IEDISNTVD

SEQ ID NO: 1159855 - protein, 9 aa, Homo Sapiens
FAKKINSRC

SEQ ID NO: 1159856 - protein, 9 aa, Homo Sapiens
LGRNSFEVH

SEQ ID NO: 1159857 - protein, 9 aa, Homo Sapiens
CRELDQNLS

SEQ ID NO: 1159858 - protein, 9 aa, Homo Sapiens
IFTPILNPI

SEQ ID NO: 1159859 - protein, 9 aa, Homo Sapiens
YLEIQDEQH

SEQ ID NO: 1159860 - protein, 9 aa, Homo Sapiens
GNNLPTLQN

SEQ ID NO: 1159861 - protein, 9 aa, Homo Sapiens
KREKMHPKH

SEQ ID NO: 1159862 - protein, 9 aa, Homo Sapiens
AHEQRLQLH

SEQ ID NO: 1159863 - protein, 9 aa, Homo Sapiens
LTFVLTLPL

SEQ ID NO: 1159864 - protein, 9 aa, Homo Sapiens
GGSLYYSSS

SEQ ID NO: 1159865 - protein, 9 aa, Homo Sapiens
VILCSNGVL

SEQ ID NO: 1159866 - protein, 9 aa, Homo Sapiens
SFDTSLISK

SEQ ID NO: 1159867 - protein, 9 aa, Homo Sapiens
FYTIFTPIL

SEQ ID NO: 1159868 - protein, 9 aa, Homo Sapiens
PTLCPSCGS

SEQ ID NO: 1159869 - protein, 9 aa, Homo Sapiens
QASQQPAGP

SEQ ID NO: 1159870 - protein, 9 aa, Homo Sapiens
QTLIPRYFR

SEQ ID NO: 1159871 - protein, 9 aa, Homo Sapiens
MESFVTLSS

SEQ ID NO: 1159872 - protein, 9 aa, Homo Sapiens
TNMQPGDVC

SEQ ID NO: 1159873 - protein, 9 aa, Homo Sapiens
NTTTSFIDK

SEQ ID NO: 1159874 - protein, 9 aa, Homo Sapiens
NHMSASLKV

SEQ ID NO: 1159875 - protein, 9 aa, Homo Sapiens
MRQLRMDRG

SEQ ID NO: 1159876 - protein, 9 aa, Homo Sapiens
RITPRKHTA

SEQ ID NO: 1159877 - protein, 9 aa, Homo Sapiens
AQKREKMHP

SEQ ID NO: 1159878 - protein, 9 aa, Homo Sapiens
IPSREQIPR

SEQ ID NO: 1159879 - protein, 9 aa, Homo Sapiens
RPFACTQCG

SEQ ID NO: 1159880 - protein, 9 aa, Homo Sapiens
ITLFKTDKI

SEQ ID NO: 1159881 - protein, 9 aa, Homo Sapiens
ETVFPLEDS

SEQ ID NO: 1159882 - protein, 9 aa, Homo Sapiens
KPKCVNTKV

SEQ ID NO: 1159883 - protein, 9 aa, Homo Sapiens
MGPISVAID

SEQ ID NO: 1159884 - protein, 9 aa, Homo Sapiens
PPSLYPQPP

SEQ ID NO: 1159885 - protein, 9 aa, Homo Sapiens
ALANRVQNS

SEQ ID NO: 1159886 - protein, 9 aa, Homo Sapiens
LPTVATPPR

SEQ ID NO: 1159887 - protein, 9 aa, Homo Sapiens
FKWSSKPTV

SEQ ID NO: 1159888 - protein, 9 aa, Homo Sapiens
DSNEAEDAE

SEQ ID NO: 1159889 - protein, 9 aa, Homo Sapiens
ASTTCSGVS

SEQ ID NO: 1159890 - protein, 9 aa, Homo Sapiens
LRRHIRQMQ

SEQ ID NO: 1159891 - protein, 9 aa, Homo Sapiens
GIYVHTTLE

SEQ ID NO: 1159892 - protein, 9 aa, Homo Sapiens
YEDVPWDTM

SEQ ID NO: 1159893 - protein, 9 aa, Homo Sapiens
NYNHAITEV

SEQ ID NO: 1159894 - protein, 9 aa, Homo Sapiens
WNPQKAIPI

SEQ ID NO: 1159895 - protein, 9 aa, Homo Sapiens
ARAYEHAKI

SEQ ID NO: 1159896 - protein, 9 aa, Homo Sapiens
QCDTELRKE

SEQ ID NO: 1159897 - protein, 9 aa, Homo Sapiens
ANSDITSLN

SEQ ID NO: 1159898 - protein, 9 aa, Homo Sapiens
YDKCGHVNL

SEQ ID NO: 1159899 - protein, 9 aa, Homo Sapiens
AFKWSSKPT

SEQ ID NO: 1159900 - protein, 9 aa, Homo Sapiens
AQRVFPDVS

SEQ ID NO: 1159901 - protein, 9 aa, Homo Sapiens
RMDSTGFLD

SEQ ID NO: 1159902 - protein, 9 aa, Homo Sapiens
QGPVSDATP

SEQ ID NO: 1159903 - protein, 9 aa, Homo Sapiens
DYLLYWLIF

SEQ ID NO: 1159904 - protein, 9 aa, Homo Sapiens
DNQGVGFDD

SEQ ID NO: 1159905 - protein, 9 aa, Homo Sapiens
HNQWYCYIC

SEQ ID NO: 1159906 - protein, 9 aa, Homo Sapiens
QPAQPAQAP

SEQ ID NO: 1159907 - protein, 9 aa, Homo Sapiens
ERRWVLAVD

SEQ ID NO: 1159908 - protein, 9 aa, Homo Sapiens
PVALNISIG

SEQ ID NO: 1159909 - protein, 9 aa, Homo Sapiens
LLAHTNGLF

SEQ ID NO: 1159910 - protein, 9 aa, Homo Sapiens
RRDTQYRSH

SEQ ID NO: 1159911 - protein, 9 aa, Homo Sapiens
LAVERRQKP

SEQ ID NO: 1159912 - protein, 9 aa, Homo Sapiens
ASSTTISNQ

SEQ ID NO: 1159913 - protein, 9 aa, Homo Sapiens
FRNRPDFRT

SEQ ID NO: 1159914 - protein, 9 aa, Homo Sapiens
NMQYSVYGS

SEQ ID NO: 1159915 - protein, 9 aa, Homo Sapiens
HNENGFTYF

SEQ ID NO: 1159916 - protein, 9 aa, Homo Sapiens
QLLHFSSSE

SEQ ID NO: 1159917 - protein, 9 aa, Homo Sapiens
EKRDSLGVK

SEQ ID NO: 1159918 - protein, 9 aa, Homo Sapiens
VGHGRGKKS

SEQ ID NO: 1159919 - protein, 9 aa, Homo Sapiens
KRDSKDGRT

SEQ ID NO: 1159920 - protein, 9 aa, Homo Sapiens
HTPRNAGPA

SEQ ID NO: 1159921 - protein, 9 aa, Homo Sapiens
RKGMAGDWR

SEQ ID NO: 1159922 - protein, 9 aa, Homo Sapiens
SMNESAPAG

SEQ ID NO: 1159923 - protein, 9 aa, Homo Sapiens
YPQPPLLPP

SEQ ID NO: 1159924 - protein, 9 aa, Homo Sapiens
YEHAKIEEQ

SEQ ID NO: 1159925 - protein, 9 aa, Homo Sapiens
SSFEERLIE

SEQ ID NO: 1159926 - protein, 9 aa, Homo Sapiens
TASTGIYRG

SEQ ID NO: 1159927 - protein, 9 aa, Homo Sapiens
TILAACQEH

SEQ ID NO: 1159928 - protein, 9 aa, Homo Sapiens
ILAACQEHC

SEQ ID NO: 1159929 - protein, 9 aa, Homo Sapiens
TMLPPKLVP

SEQ ID NO: 1159930 - protein, 9 aa, Homo Sapiens
WIFAKKINS

SEQ ID NO: 1159931 - protein, 9 aa, Homo Sapiens
NTSNKKFPE

SEQ ID NO: 1159932 - protein, 9 aa, Homo Sapiens
EFQDALNIL

SEQ ID NO: 1159933 - protein, 9 aa, Homo Sapiens
NDNSPRFDV

SEQ ID NO: 1159934 - protein, 9 aa, Homo Sapiens
KQTERIQKD

SEQ ID NO: 1159935 - protein, 9 aa, Homo Sapiens
NNDHNISHV

SEQ ID NO: 1159936 - protein, 9 aa, Homo Sapiens
CKDVTALKI

SEQ ID NO: 1159937 - protein, 9 aa, Homo Sapiens
RKKKCTVLI

SEQ ID NO: 1159938 - protein, 9 aa, Homo Sapiens
AIDFLMNRN

SEQ ID NO: 1159939 - protein, 9 aa, Homo Sapiens
AAAHEANEL

SEQ ID NO: 1159940 - protein, 9 aa, Homo Sapiens
KHANIHLSA

SEQ ID NO: 1159941 - protein, 9 aa, Homo Sapiens
IEEIEYRII

SEQ ID NO: 1159942 - protein, 9 aa, Homo Sapiens
KETEMEVSI

SEQ ID NO: 1159943 - protein, 9 aa, Homo Sapiens
GKDSNEAED

SEQ ID NO: 1159944 - protein, 9 aa, Homo Sapiens
VFIICISYL

SEQ ID NO: 1159945 - protein, 9 aa, Homo Sapiens
LGNTSNKKF

SEQ ID NO: 1159946 - protein, 9 aa, Homo Sapiens
GFWEHSMLT

SEQ ID NO: 1159947 - protein, 9 aa, Homo Sapiens
HDPCQMLQI

SEQ ID NO: 1159948 - protein, 9 aa, Homo Sapiens
EVSTLCKDV

SEQ ID NO: 1159949 - protein, 9 aa, Homo Sapiens
HEANELFKE

SEQ ID NO: 1159950 - protein, 9 aa, Homo Sapiens
NNLPTLQNK

SEQ ID NO: 1159951 - protein, 9 aa, Homo Sapiens
SQHCTLAVS

SEQ ID NO: 1159952 - protein, 9 aa, Homo Sapiens
LLKLPMPYI

SEQ ID NO: 1159953 - protein, 9 aa, Homo Sapiens
GIGPFPLPD

SEQ ID NO: 1159954 - protein, 9 aa, Homo Sapiens
DLSAWKKGC

SEQ ID NO: 1159955 - protein, 9 aa, Homo Sapiens
RIFIGPTLC

SEQ ID NO: 1159956 - protein, 9 aa, Homo Sapiens
PKRYTIGQT

SEQ ID NO: 1159957 - protein, 9 aa, Homo Sapiens
KAEAHFERR

SEQ ID NO: 1159958 - protein, 9 aa, Homo Sapiens
LEVNGITFL

SEQ ID NO: 1159959 - protein, 9 aa, Homo Sapiens
IFIGPTLCP

SEQ ID NO: 1159960 - protein, 9 aa, Homo Sapiens
ISNQAESMM

SEQ ID NO: 1159961 - protein, 9 aa, Homo Sapiens
VTDTKLRKK

SEQ ID NO: 1159962 - protein, 9 aa, Homo Sapiens
VKALTYWDL

SEQ ID NO: 1159963 - protein, 9 aa, Homo Sapiens
VPWDTMLPP

SEQ ID NO: 1159964 - protein, 9 aa, Homo Sapiens
TNAIDFLMN

SEQ ID NO: 1159965 - protein, 9 aa, Homo Sapiens
AFPPLAQVE

SEQ ID NO: 1159966 - protein, 9 aa, Homo Sapiens
FQDALNILP

SEQ ID NO: 1159967 - protein, 9 aa, Homo Sapiens
KARGQPKLA

SEQ ID NO: 1159968 - protein, 9 aa, Homo Sapiens
SYQIDTVIN

SEQ ID NO: 1159969 - protein, 9 aa, Homo Sapiens
RRWVLAVDH

SEQ ID NO: 1159970 - protein, 9 aa, Homo Sapiens
GNRFSYIQS

SEQ ID NO: 1159971 - protein, 9 aa, Homo Sapiens
LSEPQLFQA

SEQ ID NO: 1159972 - protein, 9 aa, Homo Sapiens
SSTSDHIST

SEQ ID NO: 1159973 - protein, 9 aa, Homo Sapiens
QQIHPIKSV

SEQ ID NO: 1159974 - protein, 9 aa, Homo Sapiens
NGEVKIESK

SEQ ID NO: 1159975 - protein, 9 aa, Homo Sapiens
AAASHGVLI

SEQ ID NO: 1159976 - protein, 9 aa, Homo Sapiens
TLCPSCGSS

SEQ ID NO: 1159977 - protein, 9 aa, Homo Sapiens
KVVKPSISE

SEQ ID NO: 1159978 - protein, 9 aa, Homo Sapiens
GRPGAREEH

SEQ ID NO: 1159979 - protein, 9 aa, Homo Sapiens
LEAGLANTT

SEQ ID NO: 1159980 - protein, 9 aa, Homo Sapiens
ALNISIGTN

SEQ ID NO: 1159981 - protein, 9 aa, Homo Sapiens
GRNSFEVHV

SEQ ID NO: 1159982 - protein, 9 aa, Homo Sapiens
YSLEPDQIG

SEQ ID NO: 1159983 - protein, 9 aa, Homo Sapiens
ENYNHAITE

SEQ ID NO: 1159984 - protein, 9 aa, Homo Sapiens
STELVYNKS

SEQ ID NO: 1159985 - protein, 9 aa, Homo Sapiens
WWTNWGFSG

SEQ ID NO: 1159986 - protein, 9 aa, Homo Sapiens
VDGDPGQNA

SEQ ID NO: 1159987 - protein, 9 aa, Homo Sapiens
GWTVHRGVQ

SEQ ID NO: 1159988 - protein, 9 aa, Homo Sapiens
KSSTSDHIS

SEQ ID NO: 1159989 - protein, 9 aa, Homo Sapiens
ERNILVIPY

SEQ ID NO: 1159990 - protein, 9 aa, Homo Sapiens
CFEEQCRNT

SEQ ID NO: 1159991 - protein, 9 aa, Homo Sapiens
QPPLLPPTS

SEQ ID NO: 1159992 - protein, 9 aa, Homo Sapiens
LNVQRAICW

SEQ ID NO: 1159993 - protein, 9 aa, Homo Sapiens
SLSAPAIIL

SEQ ID NO: 1159994 - protein, 9 aa, Homo Sapiens
TSAPRRMCL

SEQ ID NO: 1159995 - protein, 9 aa, Homo Sapiens
RTNKGRQLN

SEQ ID NO: 1159996 - protein, 9 aa, Homo Sapiens
ECVDAGGEP

SEQ ID NO: 1159997 - protein, 9 aa, Homo Sapiens
ASQPPPPNS

SEQ ID NO: 1159998 - protein, 9 aa, Homo Sapiens
PFPLPDSGN

SEQ ID NO: 1159999 - protein, 9 aa, Homo Sapiens
LLLQQLKEN

SEQ ID NO: 1160000 - protein, 9 aa, Homo Sapiens
LAPFSEVLA

SEQ ID NO: 1160001 - protein, 9 aa, Homo Sapiens
LKDLFQLIY

SEQ ID NO: 1160002 - protein, 9 aa, Homo Sapiens
TIGQTLIPR

SEQ ID NO: 1160003 - protein, 9 aa, Homo Sapiens
PSVRKLTKI

SEQ ID NO: 1160004 - protein, 9 aa, Homo Sapiens
DNSPRFDVT

SEQ ID NO: 1160005 - protein, 9 aa, Homo Sapiens
IQLDSVKQR

SEQ ID NO: 1160006 - protein, 9 aa, Homo Sapiens
DGSFIGFKE

SEQ ID NO: 1160007 - protein, 9 aa, Homo Sapiens
ASYWLIQLD

SEQ ID NO: 1160008 - protein, 9 aa, Homo Sapiens
PPVAVTDTK

SEQ ID NO: 1160009 - protein, 9 aa, Homo Sapiens
RMRRILARH

SEQ ID NO: 1160010 - protein, 9 aa, Homo Sapiens
NEQDVYQRP

SEQ ID NO: 1160011 - protein, 9 aa, Homo Sapiens
EQDVYQRPY

SEQ ID NO: 1160012 - protein, 9 aa, Homo Sapiens
ASLDSARTS

SEQ ID NO: 1160013 - protein, 9 aa, Homo Sapiens
DPEKRPIAK

SEQ ID NO: 1160014 - protein, 9 aa, Homo Sapiens
PRATNDRVW

SEQ ID NO: 1160015 - protein, 9 aa, Homo Sapiens
FVHNENGFT

SEQ ID NO: 1160016 - protein, 9 aa, Homo Sapiens
EVHQAELDK

SEQ ID NO: 1160017 - protein, 9 aa, Homo Sapiens
TGVTATKNV

SEQ ID NO: 1160018 - protein, 9 aa, Homo Sapiens
VSLKVSRHA

SEQ ID NO: 1160019 - protein, 9 aa, Homo Sapiens
RSFLDFNPH

SEQ ID NO: 1160020 - protein, 9 aa, Homo Sapiens
IANSNEQDV

SEQ ID NO: 1160021 - protein, 9 aa, Homo Sapiens
KMGTCCHHC

SEQ ID NO: 1160022 - protein, 9 aa, Homo Sapiens
EASSQYMPT

SEQ ID NO: 1160023 - protein, 9 aa, Homo Sapiens
FSGDEVPQR

SEQ ID NO: 1160024 - protein, 9 aa, Homo Sapiens
EEDGKDSNE

SEQ ID NO: 1160025 - protein, 9 aa, Homo Sapiens
YVNMDDGGG

SEQ ID NO: 1160026 - protein, 9 aa, Homo Sapiens
TLKAEQNIL

SEQ ID NO: 1160027 - protein, 9 aa, Homo Sapiens
FRFAIILYF

SEQ ID NO: 1160028 - protein, 9 aa, Homo Sapiens
RIQKDMDIT

SEQ ID NO: 1160029 - protein, 9 aa, Homo Sapiens
VAVTDTKLR

SEQ ID NO: 1160030 - protein, 9 aa, Homo Sapiens
APKSSTSDH

SEQ ID NO: 1160031 - protein, 9 aa, Homo Sapiens
RPTLVKNIP

SEQ ID NO: 1160032 - protein, 9 aa, Homo Sapiens
QIHPIKSVI

SEQ ID NO: 1160033 - protein, 9 aa, Homo Sapiens
FLDVHPPLG

SEQ ID NO: 1160034 - protein, 9 aa, Homo Sapiens
FHEECSVVT

SEQ ID NO: 1160035 - protein, 9 aa, Homo Sapiens
ANKKTELQV

SEQ ID NO: 1160036 - protein, 9 aa, Homo Sapiens
DTMLPPKLV

SEQ ID NO: 1160037 - protein, 9 aa, Homo Sapiens
MTRLFFVLF

SEQ ID NO: 1160038 - protein, 9 aa, Homo Sapiens
VAFQPTHLQ

SEQ ID NO: 1160039 - protein, 9 aa, Homo Sapiens
ASQQPAGPP

SEQ ID NO: 1160040 - protein, 9 aa, Homo Sapiens
QRQAKKCFS

SEQ ID NO: 1160041 - protein, 9 aa, Homo Sapiens
TFRERLIQT

SEQ ID NO: 1160042 - protein, 9 aa, Homo Sapiens
AVATMGPIS

SEQ ID NO: 1160043 - protein, 9 aa, Homo Sapiens
AEAHFERRW

SEQ ID NO: 1160044 - protein, 9 aa, Homo Sapiens
SLDSARTST

SEQ ID NO: 1160045 - protein, 9 aa, Homo Sapiens
VVSDVPFLT

SEQ ID NO: 1160046 - protein, 9 aa, Homo Sapiens
SYWLIQLDS

SEQ ID NO: 1160047 - protein, 9 aa, Homo Sapiens
CSQHGSPAT

SEQ ID NO: 1160048 - protein, 9 aa, Homo Sapiens
GAREEHSCT

SEQ ID NO: 1160049 - protein, 9 aa, Homo Sapiens
EDFEFANKV

SEQ ID NO: 1160050 - protein, 9 aa, Homo Sapiens
LCDYKFNDE

SEQ ID NO: 1160051 - protein, 9 aa, Homo Sapiens
VLSWATIYR

SEQ ID NO: 1160052 - protein, 9 aa, Homo Sapiens
VNTKVVKPS

SEQ ID NO: 1160053 - protein, 9 aa, Homo Sapiens
ARRVGWTVH

SEQ ID NO: 1160054 - protein, 9 aa, Homo Sapiens
RLKGTSKVA

SEQ ID NO: 1160055 - protein, 9 aa, Homo Sapiens
EQRLQLHGV

SEQ ID NO: 1160056 - protein, 9 aa, Homo Sapiens
YRMRRILAR

SEQ ID NO: 1160057 - protein, 9 aa, Homo Sapiens
ATADVSRTE

SEQ ID NO: 1160058 - protein, 9 aa, Homo Sapiens
LKAEQNILP

SEQ ID NO: 1160059 - protein, 9 aa, Homo Sapiens
SGRLLHLDM

SEQ ID NO: 1160060 - protein, 9 aa, Homo Sapiens
KTDGSFIGF

SEQ ID NO: 1160061 - protein, 9 aa, Homo Sapiens
TFQLHLSEP

SEQ ID NO: 1160062 - protein, 9 aa, Homo Sapiens
LRAQRVFPD

SEQ ID NO: 1160063 - protein, 9 aa, Homo Sapiens
NSDITSLNF

SEQ ID NO: 1160064 - protein, 9 aa, Homo Sapiens
SIIDSLSLS

SEQ ID NO: 1160065 - protein, 9 aa, Homo Sapiens
LDDISEADV

SEQ ID NO: 1160066 - protein, 9 aa, Homo Sapiens
DLETFLAWL

SEQ ID NO: 1160067 - protein, 9 aa, Homo Sapiens
AASHGVLIN

SEQ ID NO: 1160068 - protein, 9 aa, Homo Sapiens
ATKVTSAPR

SEQ ID NO: 1160069 - protein, 9 aa, Homo Sapiens
FAKKEHIEI

SEQ ID NO: 1160070 - protein, 9 aa, Homo Sapiens
RGQPKLAHS

SEQ ID NO: 1160071 - protein, 9 aa, Homo Sapiens
REQIPRFVH

SEQ ID NO: 1160072 - protein, 9 aa, Homo Sapiens
VAVDGDPGQ

SEQ ID NO: 1160073 - protein, 9 aa, Homo Sapiens
EWSARSESA

SEQ ID NO: 1160074 - protein, 9 aa, Homo Sapiens
KRQLLEEKV

SEQ ID NO: 1160075 - protein, 9 aa, Homo Sapiens
FSEVLADGE

SEQ ID NO: 1160076 - protein, 9 aa, Homo Sapiens
RPHSKVSLK

SEQ ID NO: 1160077 - protein, 9 aa, Homo Sapiens
LSAWKKGCE

SEQ ID NO: 1160078 - protein, 9 aa, Homo Sapiens
LFSSPHTSH

SEQ ID NO: 1160079 - protein, 9 aa, Homo Sapiens
VPQKAKRKT

SEQ ID NO: 1160080 - protein, 9 aa, Homo Sapiens
VPEEYAPTS

SEQ ID NO: 1160081 - protein, 9 aa, Homo Sapiens
LLHFSSSEL

SEQ ID NO: 1160082 - protein, 9 aa, Homo Sapiens
QQLKENIQD

SEQ ID NO: 1160083 - protein, 9 aa, Homo Sapiens
RKLTKIATL

SEQ ID NO: 1160084 - protein, 9 aa, Homo Sapiens
FDVTSDSAV

SEQ ID NO: 1160085 - protein, 9 aa, Homo Sapiens
QRVFPDVSS

SEQ ID NO: 1160086 - protein, 9 aa, Homo Sapiens
SPQGAFVHN

SEQ ID NO: 1160087 - protein, 9 aa, Homo Sapiens
TTLELFALM

SEQ ID NO: 1160088 - protein, 9 aa, Homo Sapiens
ADTIQHFCS

SEQ ID NO: 1160089 - protein, 9 aa, Homo Sapiens
ARANSDITS

SEQ ID NO: 1160090 - protein, 9 aa, Homo Sapiens
LLHLDMRGL

SEQ ID NO: 1160091 - protein, 9 aa, Homo Sapiens
VKICNVCHS

SEQ ID NO: 1160092 - protein, 9 aa, Homo Sapiens
VRLSGWIFA

SEQ ID NO: 1160093 - protein, 9 aa, Homo Sapiens
CTGVTEYAV

SEQ ID NO: 1160094 - protein, 9 aa, Homo Sapiens
KCENGMTGS

SEQ ID NO: 1160095 - protein, 9 aa, Homo Sapiens
WDLQCIILK

SEQ ID NO: 1160096 - protein, 9 aa, Homo Sapiens
RLFFVLFFV

SEQ ID NO: 1160097 - protein, 9 aa, Homo Sapiens
AVDGDPGQN

SEQ ID NO: 1160098 - protein, 9 aa, Homo Sapiens
KCVNTKVVK

SEQ ID NO: 1160099 - protein, 9 aa, Homo Sapiens
QDVYQRPYS

SEQ ID NO: 1160100 - protein, 9 aa, Homo Sapiens
SEPQLFQAE

SEQ ID NO: 1160101 - protein, 9 aa, Homo Sapiens
LAHSPFASE

SEQ ID NO: 1160102 - protein, 9 aa, Homo Sapiens
AEPVILDLK

SEQ ID NO: 1160103 - protein, 9 aa, Homo Sapiens
SKGGVYLER

SEQ ID NO: 1160104 - protein, 9 aa, Homo Sapiens
VMLCDYKFN

SEQ ID NO: 1160105 - protein, 9 aa, Homo Sapiens
EECSVVTEV

SEQ ID NO: 1160106 - protein, 9 aa, Homo Sapiens
LIFIICVYY

SEQ ID NO: 1160107 - protein, 9 aa, Homo Sapiens
HLDMRGLGE

SEQ ID NO: 1160108 - protein, 9 aa, Homo Sapiens
EEYAPTSPT

SEQ ID NO: 1160109 - protein, 9 aa, Homo Sapiens
VYTRVKNYV

SEQ ID NO: 1160110 - protein, 9 aa, Homo Sapiens
LCRELDQNL

SEQ ID NO: 1160111 - protein, 9 aa, Homo Sapiens
KGTSKVATS

SEQ ID NO: 1160112 - protein, 9 aa, Homo Sapiens
IQENGEVKI

SEQ ID NO: 1160113 - protein, 9 aa, Homo Sapiens
PTGATADVS

SEQ ID NO: 1160114 - protein, 9 aa, Homo Sapiens
VLADGEKRV

SEQ ID NO: 1160115 - protein, 9 aa, Homo Sapiens
EVVAEGYVK

SEQ ID NO: 1160116 - protein, 9 aa, Homo Sapiens
RQKPNSRPA

SEQ ID NO: 1160117 - protein, 9 aa, Homo Sapiens
KFNDESAEE

SEQ ID NO: 1160118 - protein, 9 aa, Homo Sapiens
KIVDQGEDF

SEQ ID NO: 1160119 - protein, 9 aa, Homo Sapiens
VRISHLYIL

SEQ ID NO: 1160120 - protein, 9 aa, Homo Sapiens
RDSLGVKYD

SEQ ID NO: 1160121 - protein, 9 aa, Homo Sapiens
TTKSGTAAT

SEQ ID NO: 1160122 - protein, 9 aa, Homo Sapiens
EERERQIRQ

SEQ ID NO: 1160123 - protein, 9 aa, Homo Sapiens
CMDHTLTSL

SEQ ID NO: 1160124 - protein, 9 aa, Homo Sapiens
YPRATNDRV

SEQ ID NO: 1160125 - protein, 9 aa, Homo Sapiens
TLTSLFPKT

SEQ ID NO: 1160126 - protein, 9 aa, Homo Sapiens
RPIAKPNNA

SEQ ID NO: 1160127 - protein, 9 aa, Homo Sapiens
LAQVETVCS

SEQ ID NO: 1160128 - protein, 9 aa, Homo Sapiens
SGGGTGGHP

SEQ ID NO: 1160129 - protein, 9 aa, Homo Sapiens
TMESFVTLS

SEQ ID NO: 1160130 - protein, 9 aa, Homo Sapiens
VIAQKREKM

SEQ ID NO: 1160131 - protein, 9 aa, Homo Sapiens
VFMFHGIRE

SEQ ID NO: 1160132 - protein, 9 aa, Homo Sapiens
QKAKRKTDR

SEQ ID NO: 1160133 - protein, 9 aa, Homo Sapiens
VVIGPSNSN

SEQ ID NO: 1160134 - protein, 9 aa, Homo Sapiens
GSNSPSSQV

SEQ ID NO: 1160135 - protein, 9 aa, Homo Sapiens
KDTFARIQE

SEQ ID NO: 1160136 - protein, 9 aa, Homo Sapiens
VEWSARSES

SEQ ID NO: 1160137 - protein, 9 aa, Homo Sapiens
QPAQAPQAQ

SEQ ID NO: 1160138 - protein, 9 aa, Homo Sapiens
TADVSRTEV

SEQ ID NO: 1160139 - protein, 9 aa, Homo Sapiens
VDIGSVLSL

SEQ ID NO: 1160140 - protein, 9 aa, Homo Sapiens
TSPLTVEWS

SEQ ID NO: 1160141 - protein, 9 aa, Homo Sapiens
QEKEAEKNY

SEQ ID NO: 1160142 - protein, 9 aa, Homo Sapiens
GTCGSHFIH

SEQ ID NO: 1160143 - protein, 9 aa, Homo Sapiens
VFEHHASTL

SEQ ID NO: 1160144 - protein, 9 aa, Homo Sapiens
GSSQSKHHP

SEQ ID NO: 1160145 - protein, 9 aa, Homo Sapiens
IMGKIVDQG

SEQ ID NO: 1160146 - protein, 9 aa, Homo Sapiens
QASQPPPPN

SEQ ID NO: 1160147 - protein, 9 aa, Homo Sapiens
NEMTNMQPG

SEQ ID NO: 1160148 - protein, 9 aa, Homo Sapiens
FEERLIEEI

SEQ ID NO: 1160149 - protein, 9 aa, Homo Sapiens
ERDRKKKCT

SEQ ID NO: 1160150 - protein, 9 aa, Homo Sapiens
FPPSLYPQP

SEQ ID NO: 1160151 - protein, 9 aa, Homo Sapiens
PEDPEKRPI

SEQ ID NO: 1160152 - protein, 9 aa, Homo Sapiens
LDSARTSTS

SEQ ID NO: 1160153 - protein, 9 aa, Homo Sapiens
TRRDTQYRS

SEQ ID NO: 1160154 - protein, 9 aa, Homo Sapiens
TLQNKVLSL

SEQ ID NO: 1160155 - protein, 9 aa, Homo Sapiens
EEHSCTWGR

SEQ ID NO: 1160156 - protein, 9 aa, Homo Sapiens
VFKKKFHYF

SEQ ID NO: 1160157 - protein, 9 aa, Homo Sapiens
KAADDTWDP

SEQ ID NO: 1160158 - protein, 9 aa, Homo Sapiens
FKKKFHYFV

SEQ ID NO: 1160159 - protein, 9 aa, Homo Sapiens
RLSGWIFAK

SEQ ID NO: 1160160 - protein, 9 aa, Homo Sapiens
SARSESAQS

SEQ ID NO: 1160161 - protein, 9 aa, Homo Sapiens
RNILVIPYL

SEQ ID NO: 1160162 - protein, 9 aa, Homo Sapiens
GVYTRVKNY

SEQ ID NO: 1160163 - protein, 9 aa, Homo Sapiens
PPLAQVETV

SEQ ID NO: 1160164 - protein, 9 aa, Homo Sapiens
YNHICFEEQ

SEQ ID NO: 1160165 - protein, 9 aa, Homo Sapiens
HDEFQDALN

SEQ ID NO: 1160166 - protein, 9 aa, Homo Sapiens
IEYLSRKAS

SEQ ID NO: 1160167 - protein, 9 aa, Homo Sapiens
VYEKCSQIS

SEQ ID NO: 1160168 - protein, 9 aa, Homo Sapiens
PLGRQASQQ

SEQ ID NO: 1160169 - protein, 9 aa, Homo Sapiens
EMEVSIPEN

SEQ ID NO: 1160170 - protein, 9 aa, Homo Sapiens
QAYDKSLLP

SEQ ID NO: 1160171 - protein, 9 aa, Homo Sapiens
DEHNQWYCY

SEQ ID NO: 1160172 - protein, 9 aa, Homo Sapiens
FFLDVHPPL

SEQ ID NO: 1160173 - protein, 9 aa, Homo Sapiens
TKVVKPSIS

SEQ ID NO: 1160174 - protein, 9 aa, Homo Sapiens
SPSSALPVK

SEQ ID NO: 1160175 - protein, 9 aa, Homo Sapiens
ERQIRQIVQ

SEQ ID NO: 1160176 - protein, 9 aa, Homo Sapiens
WDCGRRAGP

SEQ ID NO: 1160177 - protein, 9 aa, Homo Sapiens
ITEVLSWAT

SEQ ID NO: 1160178 - protein, 9 aa, Homo Sapiens
SPEDPEKRP

SEQ ID NO: 1160179 - protein, 9 aa, Homo Sapiens
LGRQASQQP

SEQ ID NO: 1160180 - protein, 9 aa, Homo Sapiens
YMGKPKEKE

SEQ ID NO: 1160181 - protein, 9 aa, Homo Sapiens
LANTTTSFI

SEQ ID NO: 1160182 - protein, 9 aa, Homo Sapiens
HSMLTDPGN

SEQ ID NO: 1160183 - protein, 9 aa, Homo Sapiens
EQCHPLNNR

SEQ ID NO: 1160184 - protein, 9 aa, Homo Sapiens
VLFSSPHTS

SEQ ID NO: 1160185 - protein, 9 aa, Homo Sapiens
ADVKALTYW

SEQ ID NO: 1160186 - protein, 9 aa, Homo Sapiens
VDYLLYWLI

SEQ ID NO: 1160187 - protein, 9 aa, Homo Sapiens
PCLSENISV

SEQ ID NO: 1160188 - protein, 9 aa, Homo Sapiens
SGWIFAKKI

SEQ ID NO: 1160189 - protein, 9 aa, Homo Sapiens
AWKHANIHL

SEQ ID NO: 1160190 - protein, 9 aa, Homo Sapiens
ASVSRRYRF

SEQ ID NO: 1160191 - protein, 9 aa, Homo Sapiens
KLTKIATLL

SEQ ID NO: 1160192 - protein, 9 aa, Homo Sapiens
FFPGGLCFS

SEQ ID NO: 1160193 - protein, 9 aa, Homo Sapiens
FTDIHHSNE

SEQ ID NO: 1160194 - protein, 9 aa, Homo Sapiens
RQAKKCFST

SEQ ID NO: 1160195 - protein, 9 aa, Homo Sapiens
RRGFLRAQR

SEQ ID NO: 1160196 - protein, 9 aa, Homo Sapiens
GDPRRKSLH

SEQ ID NO: 1160197 - protein, 9 aa, Homo Sapiens
LVFMFHGIR

SEQ ID NO: 1160198 - protein, 9 aa, Homo Sapiens
IEPPVNLTY

SEQ ID NO: 1160199 - protein, 9 aa, Homo Sapiens
LSNKQTERI

SEQ ID NO: 1160200 - protein, 9 aa, Homo Sapiens
LNVSLGQRC

SEQ ID NO: 1160201 - protein, 9 aa, Homo Sapiens
WKEGDEHIT

SEQ ID NO: 1160202 - protein, 9 aa, Homo Sapiens
VEFKSASEN

SEQ ID NO: 1160203 - protein, 9 aa, Homo Sapiens
REKRNVQPP

SEQ ID NO: 1160204 - protein, 9 aa, Homo Sapiens
HANIHLSAP

SEQ ID NO: 1160205 - protein, 9 aa, Homo Sapiens
TERDRKKKC

SEQ ID NO: 1160206 - protein, 9 aa, Homo Sapiens
DISKGGVYL

SEQ ID NO: 1160207 - protein, 9 aa, Homo Sapiens
ATEAEELAE

SEQ ID NO: 1160208 - protein, 9 aa, Homo Sapiens
KCDFRSEDN

SEQ ID NO: 1160209 - protein, 9 aa, Homo Sapiens
DSTFLVFMF

SEQ ID NO: 1160210 - protein, 9 aa, Homo Sapiens
LHTPRNAGP

SEQ ID NO: 1160211 - protein, 9 aa, Homo Sapiens
LPVFIVQTA

SEQ ID NO: 1160212 - protein, 9 aa, Homo Sapiens
PRRKSLHIP

SEQ ID NO: 1160213 - protein, 9 aa, Homo Sapiens
VHQAELDKL

SEQ ID NO: 1160214 - protein, 9 aa, Homo Sapiens
DEVVAEGYV

SEQ ID NO: 1160215 - protein, 9 aa, Homo Sapiens
HTMESFVTL

SEQ ID NO: 1160216 - protein, 9 aa, Homo Sapiens
MALLLQQLK

SEQ ID NO: 1160217 - protein, 9 aa, Homo Sapiens
PTVATPPRR

SEQ ID NO: 1160218 - protein, 9 aa, Homo Sapiens
PTVHKVIHM

SEQ ID NO: 1160219 - protein, 9 aa, Homo Sapiens
VSRRYRFEN

SEQ ID NO: 1160220 - protein, 9 aa, Homo Sapiens
KLKEEENRA

SEQ ID NO: 1160221 - protein, 9 aa, Homo Sapiens
HAKIEEQLR

SEQ ID NO: 1160222 - protein, 9 aa, Homo Sapiens
CVNTKVVKP

SEQ ID NO: 1160223 - protein, 9 aa, Homo Sapiens
VKIESKIEE

SEQ ID NO: 1160224 - protein, 9 aa, Homo Sapiens
GPFPLPDSG

SEQ ID NO: 1160225 - protein, 9 aa, Homo Sapiens
GVLINDNIV

SEQ ID NO: 1160226 - protein, 9 aa, Homo Sapiens
RSKMGTCCH

SEQ ID NO: 1160227 - protein, 9 aa, Homo Sapiens
AAVDYLLYW

SEQ ID NO: 1160228 - protein, 9 aa, Homo Sapiens
GRPTLVKNI

SEQ ID NO: 1160229 - protein, 9 aa, Homo Sapiens
FPLEDSIVT

SEQ ID NO: 1160230 - protein, 9 aa, Homo Sapiens
PQLERFRFA

SEQ ID NO: 1160231 - protein, 9 aa, Homo Sapiens
YAPTSPTLA

SEQ ID NO: 1160232 - protein, 9 aa, Homo Sapiens
SRFQLLHFS

SEQ ID NO: 1160233 - protein, 9 aa, Homo Sapiens
NLPKCLSHD

SEQ ID NO: 1160234 - protein, 9 aa, Homo Sapiens
SQSKHHPAW

SEQ ID NO: 1160235 - protein, 9 aa, Homo Sapiens
FSPDGKYVA

SEQ ID NO: 1160236 - protein, 9 aa, Homo Sapiens
EEVWNPQKA

SEQ ID NO: 1160237 - protein, 9 aa, Homo Sapiens
LDGRGFCVN

SEQ ID NO: 1160238 - protein, 9 aa, Homo Sapiens
IAPNAFVMR

SEQ ID NO: 1160239 - protein, 9 aa, Homo Sapiens
RPASLDSAR

SEQ ID NO: 1160240 - protein, 9 aa, Homo Sapiens
KVTSAPRRM

SEQ ID NO: 1160241 - protein, 9 aa, Homo Sapiens
FLDFNPHHF

SEQ ID NO: 1160242 - protein, 9 aa, Homo Sapiens
SKHHPAWDC

SEQ ID NO: 1160243 - protein, 9 aa, Homo Sapiens
SLSVHYSPQ

SEQ ID NO: 1160244 - protein, 9 aa, Homo Sapiens
AGLANTTTS

SEQ ID NO: 1160245 - protein, 9 aa, Homo Sapiens
LIHVRLSGW

SEQ ID NO: 1160246 - protein, 9 aa, Homo Sapiens
YSGPEKLLR

SEQ ID NO: 1160247 - protein, 9 aa, Homo Sapiens
SSHDEFQDA

SEQ ID NO: 1160248 - protein, 9 aa, Homo Sapiens
GLAVERRQK

SEQ ID NO: 1160249 - protein, 9 aa, Homo Sapiens
SLDKEEAAL

SEQ ID NO: 1160250 - protein, 9 aa, Homo Sapiens
RRSFLDFNP

SEQ ID NO: 1160251 - protein, 9 aa, Homo Sapiens
AVERRQKPN

SEQ ID NO: 1160252 - protein, 9 aa, Homo Sapiens
LLQQLKENI

SEQ ID NO: 1160253 - protein, 9 aa, Homo Sapiens
SGSRRASRK

SEQ ID NO: 1160254 - protein, 9 aa, Homo Sapiens
NPHHFWQWS

SEQ ID NO: 1160255 - protein, 9 aa, Homo Sapiens
IGQTLIPRY

SEQ ID NO: 1160256 - protein, 9 aa, Homo Sapiens
YINRTFFLD

SEQ ID NO: 1160257 - protein, 9 aa, Homo Sapiens
GDSQYSWKS

SEQ ID NO: 1160258 - protein, 9 aa, Homo Sapiens
PHANNTKWK

SEQ ID NO: 1160259 - protein, 9 aa, Homo Sapiens
LQCDTCREI

SEQ ID NO: 1160260 - protein, 9 aa, Homo Sapiens
EECDKAFTW

SEQ ID NO: 1160261 - protein, 9 aa, Homo Sapiens
ENRALRYLE

SEQ ID NO: 1160262 - protein, 9 aa, Homo Sapiens
QQFPLDLET

SEQ ID NO: 1160263 - protein, 9 aa, Homo Sapiens
GEGGQSRFD

SEQ ID NO: 1160264 - protein, 9 aa, Homo Sapiens
SPLTVEWSA

SEQ ID NO: 1160265 - protein, 9 aa, Homo Sapiens
ILYVNMDDG

SEQ ID NO: 1160266 - protein, 9 aa, Homo Sapiens
PGRCYRITW

SEQ ID NO: 1160267 - protein, 9 aa, Homo Sapiens
AGITDHIVQ

SEQ ID NO: 1160268 - protein, 9 aa, Homo Sapiens
GIMSNAKNW

SEQ ID NO: 1160269 - protein, 9 aa, Homo Sapiens
HCEGRDLSA

SEQ ID NO: 1160270 - protein, 9 aa, Homo Sapiens
RPGAREEHS

SEQ ID NO: 1160271 - protein, 9 aa, Homo Sapiens
TITLFKTDK

SEQ ID NO: 1160272 - protein, 9 aa, Homo Sapiens
EGQAYDKSL

SEQ ID NO: 1160273 - protein, 9 aa, Homo Sapiens
RGLCRELDQ

SEQ ID NO: 1160274 - protein, 9 aa, Homo Sapiens
FRDNQGVGF

SEQ ID NO: 1160275 - protein, 9 aa, Homo Sapiens
RRMDPFAKK

SEQ ID NO: 1160276 - protein, 9 aa, Homo Sapiens
KSFDTSLIS

SEQ ID NO: 1160277 - protein, 9 aa, Homo Sapiens
YIEYLSRKA

SEQ ID NO: 1160278 - protein, 9 aa, Homo Sapiens
RSIQENGEV

SEQ ID NO: 1160279 - protein, 9 aa, Homo Sapiens
QESTELVYN

SEQ ID NO: 1160280 - protein, 9 aa, Homo Sapiens
GKIVDQGED

SEQ ID NO: 1160281 - protein, 9 aa, Homo Sapiens
EAGLANTTT

SEQ ID NO: 1160282 - protein, 9 aa, Homo Sapiens
GAKFSIIDS

SEQ ID NO: 1160283 - protein, 9 aa, Homo Sapiens
LMKAVATMG

SEQ ID NO: 1160284 - protein, 9 aa, Homo Sapiens
GPSNSNLPK

SEQ ID NO: 1160285 - protein, 9 aa, Homo Sapiens
DPFAKKEHI

SEQ ID NO: 1160286 - protein, 9 aa, Homo Sapiens
IIDVNLPKC

SEQ ID NO: 1160287 - protein, 9 aa, Homo Sapiens
EASQFVETA

SEQ ID NO: 1160288 - protein, 9 aa, Homo Sapiens
WLVEVNYSP

SEQ ID NO: 1160289 - protein, 9 aa, Homo Sapiens
AVYEKCSQI

SEQ ID NO: 1160290 - protein, 9 aa, Homo Sapiens
DVFKKKFHY

SEQ ID NO: 1160291 - protein, 9 aa, Homo Sapiens
KDSNEAEDA

SEQ ID NO: 1160292 - protein, 9 aa, Homo Sapiens
SLGSNSPSS

SEQ ID NO: 1160293 - protein, 9 aa, Homo Sapiens
KDGRTYFVK

SEQ ID NO: 1160294 - protein, 9 aa, Homo Sapiens
DRGLCRELD

SEQ ID NO: 1160295 - protein, 9 aa, Homo Sapiens
RTTFTVAQN

SEQ ID NO: 1160296 - protein, 9 aa, Homo Sapiens
VRCIPSREQ

SEQ ID NO: 1160297 - protein, 9 aa, Homo Sapiens
GLRLSTELS

SEQ ID NO: 1160298 - protein, 9 aa, Homo Sapiens
PWMRSSSQH

SEQ ID NO: 1160299 - protein, 9 aa, Homo Sapiens
KCFSTLFLE

SEQ ID NO: 1160300 - protein, 9 aa, Homo Sapiens
SQHGSPATW

SEQ ID NO: 1160301 - protein, 9 aa, Homo Sapiens
CNVCHSLLI

SEQ ID NO: 1160302 - protein, 9 aa, Homo Sapiens
DGDPGQNAW

SEQ ID NO: 1160303 - protein, 9 aa, Homo Sapiens
RQLLEEKVN

SEQ ID NO: 1160304 - protein, 9 aa, Homo Sapiens
SGTAATEKT

SEQ ID NO: 1160305 - protein, 9 aa, Homo Sapiens
SAKSPVVSD

SEQ ID NO: 1160306 - protein, 9 aa, Homo Sapiens
HQCDTELRK

SEQ ID NO: 1160307 - protein, 9 aa, Homo Sapiens
NMDDGGGYP

SEQ ID NO: 1160308 - protein, 9 aa, Homo Sapiens
GHVNLHLKI

SEQ ID NO: 1160309 - protein, 9 aa, Homo Sapiens
VRTLQKCEN

SEQ ID NO: 1160310 - protein, 9 aa, Homo Sapiens
LLLKLPMPY

SEQ ID NO: 1160311 - protein, 9 aa, Homo Sapiens
PDFEYSIRI

SEQ ID NO: 1160312 - protein, 9 aa, Homo Sapiens
EQMGGRRGV

SEQ ID NO: 1160313 - protein, 9 aa, Homo Sapiens
PKHLEEVEG

SEQ ID NO: 1160314 - protein, 9 aa, Homo Sapiens
TGEEVWNPQ

SEQ ID NO: 1160315 - protein, 9 aa, Homo Sapiens
LCVDISKGG

SEQ ID NO: 1160316 - protein, 9 aa, Homo Sapiens
PGPIYDVYS

SEQ ID NO: 1160317 - protein, 9 aa, Homo Sapiens
QIVESTAKT

SEQ ID NO: 1160318 - protein, 9 aa, Homo Sapiens
LKSSLCLIN

SEQ ID NO: 1160319 - protein, 9 aa, Homo Sapiens
LADGEKRVL

SEQ ID NO: 1160320 - protein, 9 aa, Homo Sapiens
AVDYLLYWL

SEQ ID NO: 1160321 - protein, 9 aa, Homo Sapiens
LLDGRGFCV

SEQ ID NO: 1160322 - protein, 9 aa, Homo Sapiens
YRFENSDQP

SEQ ID NO: 1160323 - protein, 9 aa, Homo Sapiens
DLRSCTGVT

SEQ ID NO: 1160324 - protein, 9 aa, Homo Sapiens
NGGSLYYSS

SEQ ID NO: 1160325 - protein, 9 aa, Homo Sapiens
EPTIEPPVN

SEQ ID NO: 1160326 - protein, 9 aa, Homo Sapiens
LKGTSKVAT

SEQ ID NO: 1160327 - protein, 9 aa, Homo Sapiens
LPLGRQASQ

SEQ ID NO: 1160328 - protein, 9 aa, Homo Sapiens
KKYVILCSN

SEQ ID NO: 1160329 - protein, 9 aa, Homo Sapiens
QYETVFPLE

SEQ ID NO: 1160330 - protein, 9 aa, Homo Sapiens
MDSTGFLDK

SEQ ID NO: 1160331 - protein, 9 aa, Homo Sapiens
LSWATIYRI

SEQ ID NO: 1160332 - protein, 9 aa, Homo Sapiens
PMDMSLDKE

SEQ ID NO: 1160333 - protein, 9 aa, Homo Sapiens
YKFNDESAE

SEQ ID NO: 1160334 - protein, 9 aa, Homo Sapiens
HGWKEGDEH

SEQ ID NO: 1160335 - protein, 9 aa, Homo Sapiens
ESLGSNSPS

SEQ ID NO: 1160336 - protein, 9 aa, Homo Sapiens
TCCHHCFPC

SEQ ID NO: 1160337 - protein, 9 aa, Homo Sapiens
DTCREIFYG

SEQ ID NO: 1160338 - protein, 9 aa, Homo Sapiens
HNLKVRRAF

SEQ ID NO: 1160339 - protein, 9 aa, Homo Sapiens
QELRDGQGE

SEQ ID NO: 1160340 - protein, 9 aa, Homo Sapiens
HEEAVRRAF

SEQ ID NO: 1160341 - protein, 9 aa, Homo Sapiens
TVFPLEDSI

SEQ ID NO: 1160342 - protein, 9 aa, Homo Sapiens
FQDICVKAH

SEQ ID NO: 1160343 - protein, 9 aa, Homo Sapiens
ASSQYMPTD

SEQ ID NO: 1160344 - protein, 9 aa, Homo Sapiens
NDPGAKFSI

SEQ ID NO: 1160345 - protein, 9 aa, Homo Sapiens
FMNSNLKFA

SEQ ID NO: 1160346 - protein, 9 aa, Homo Sapiens
CDTELRKEI

SEQ ID NO: 1160347 - protein, 9 aa, Homo Sapiens
GAFVHNENG

SEQ ID NO: 1160348 - protein, 9 aa, Homo Sapiens
MFHGIREGI

SEQ ID NO: 1160349 - protein, 9 aa, Homo Sapiens
VWNPQKAIP

SEQ ID NO: 1160350 - protein, 9 aa, Homo Sapiens
KAEQNILPL

SEQ ID NO: 1160351 - protein, 9 aa, Homo Sapiens
HVNLHLKIS

SEQ ID NO: 1160352 - protein, 9 aa, Homo Sapiens
YGSGGGTGG

SEQ ID NO: 1160353 - protein, 9 aa, Homo Sapiens
DAKLKEEEN

SEQ ID NO: 1160354 - protein, 9 aa, Homo Sapiens
APRRMCLPA

SEQ ID NO: 1160355 - protein, 9 aa, Homo Sapiens
HSPENELKS

SEQ ID NO: 1160356 - protein, 9 aa, Homo Sapiens
DAGGEPHAN

SEQ ID NO: 1160357 - protein, 9 aa, Homo Sapiens
LSSVCVTLG

SEQ ID NO: 1160358 - protein, 9 aa, Homo Sapiens
AGTEHHVSL

SEQ ID NO: 1160359 - protein, 9 aa, Homo Sapiens
DGGGYPEPP

SEQ ID NO: 1160360 - protein, 9 aa, Homo Sapiens
QALLDGRGF

SEQ ID NO: 1160361 - protein, 9 aa, Homo Sapiens
APQAQPPQQ

SEQ ID NO: 1160362 - protein, 9 aa, Homo Sapiens
FEYSIRITP

SEQ ID NO: 1160363 - protein, 9 aa, Homo Sapiens
QSYSLEPDQ

SEQ ID NO: 1160364 - protein, 9 aa, Homo Sapiens
TNWGFSGDE

SEQ ID NO: 1160365 - protein, 9 aa, Homo Sapiens
LVEVNYSPA

SEQ ID NO: 1160366 - protein, 9 aa, Homo Sapiens
ISEADVDHP

SEQ ID NO: 1160367 - protein, 9 aa, Homo Sapiens
PRRMCLPAA

SEQ ID NO: 1160368 - protein, 9 aa, Homo Sapiens
MGGRRGVRG

SEQ ID NO: 1160369 - protein, 9 aa, Homo Sapiens
KRRKVRKTR

SEQ ID NO: 1160370 - protein, 9 aa, Homo Sapiens
TIQHFCSQH

SEQ ID NO: 1160371 - protein, 9 aa, Homo Sapiens
RSYQIDTVI

SEQ ID NO: 1160372 - protein, 9 aa, Homo Sapiens
RPPVAVTDT

SEQ ID NO: 1160373 - protein, 9 aa, Homo Sapiens
VLINDNIVF

SEQ ID NO: 1160374 - protein, 9 aa, Homo Sapiens
SNEQDVYQR

SEQ ID NO: 1160375 - protein, 9 aa, Homo Sapiens
SASENYNHA

SEQ ID NO: 1160376 - protein, 9 aa, Homo Sapiens
YKDLAWKHA

SEQ ID NO: 1160377 - protein, 9 aa, Homo Sapiens
LEEFDLEDD

SEQ ID NO: 1160378 - protein, 9 aa, Homo Sapiens
TSDHISTRS

SEQ ID NO: 1160379 - protein, 9 aa, Homo Sapiens
GGLCFSVCL

SEQ ID NO: 1160380 - protein, 9 aa, Homo Sapiens
MGKDTFARI

SEQ ID NO: 1160381 - protein, 9 aa, Homo Sapiens
VPPDLTAST

SEQ ID NO: 1160382 - protein, 9 aa, Homo Sapiens
TVPNLLAHT

SEQ ID NO: 1160383 - protein, 9 aa, Homo Sapiens
KFPERVTAL

SEQ ID NO: 1160384 - protein, 9 aa, Homo Sapiens
EVNGITFLG

SEQ ID NO: 1160385 - protein, 9 aa, Homo Sapiens
NMVAFQPTH

SEQ ID NO: 1160386 - protein, 9 aa, Homo Sapiens
KQELRDGQG

SEQ ID NO: 1160387 - protein, 9 aa, Homo Sapiens
GFSGDEVPQ

SEQ ID NO: 1160388 - protein, 9 aa, Homo Sapiens
AQAPQAQPP

SEQ ID NO: 1160389 - protein, 9 aa, Homo Sapiens
GPEKLLRLR

SEQ ID NO: 1160390 - protein, 9 aa, Homo Sapiens
APAGITDHI

SEQ ID NO: 1160391 - protein, 9 aa, Homo Sapiens
PLNNRLNFS

SEQ ID NO: 1160392 - protein, 9 aa, Homo Sapiens
ICFEEQCRN

SEQ ID NO: 1160393 - protein, 9 aa, Homo Sapiens
DMRGLGELG

SEQ ID NO: 1160394 - protein, 9 aa, Homo Sapiens
NLRHLNYVW

SEQ ID NO: 1160395 - protein, 9 aa, Homo Sapiens
SFEERLIEE

SEQ ID NO: 1160396 - protein, 9 aa, Homo Sapiens
EERLIEEIE

SEQ ID NO: 1160397 - protein, 9 aa, Homo Sapiens
CGSHFIHIL

SEQ ID NO: 1160398 - protein, 9 aa, Homo Sapiens
TKIATLLLA

SEQ ID NO: 1160399 - protein, 9 aa, Homo Sapiens
SRLPVFIVQ

SEQ ID NO: 1160400 - protein, 9 aa, Homo Sapiens
LCFLIFPML

SEQ ID NO: 1160401 - protein, 9 aa, Homo Sapiens
DKVHVWQLY

SEQ ID NO: 1160402 - protein, 9 aa, Homo Sapiens
TLQKCENGM

SEQ ID NO: 1160403 - protein, 9 aa, Homo Sapiens
HLALRHHTN

SEQ ID NO: 1160404 - protein, 9 aa, Homo Sapiens
YWLIFSVSK

SEQ ID NO: 1160405 - protein, 9 aa, Homo Sapiens
QAELDKLTA

SEQ ID NO: 1160406 - protein, 9 aa, Homo Sapiens
ITSLNFRSA

SEQ ID NO: 1160407 - protein, 9 aa, Homo Sapiens
TEAEELAEA

SEQ ID NO: 1160408 - protein, 9 aa, Homo Sapiens
NRFSYIQSG

SEQ ID NO: 1160409 - protein, 9 aa, Homo Sapiens
IYRIGEKRD

SEQ ID NO: 1160410 - protein, 9 aa, Homo Sapiens
LVLFSSPHT

SEQ ID NO: 1160411 - protein, 9 aa, Homo Sapiens
NTVDAMVDL

SEQ ID NO: 1160412 - protein, 9 aa, Homo Sapiens
GEKRDSLGV

SEQ ID NO: 1160413 - protein, 9 aa, Homo Sapiens
PAVPRSSRR

SEQ ID NO: 1160414 - protein, 9 aa, Homo Sapiens
VEVDYNMVA

SEQ ID NO: 1160415 - protein, 9 aa, Homo Sapiens
IFPMLVASY

SEQ ID NO: 1160416 - protein, 9 aa, Homo Sapiens
NLDENDPKT

SEQ ID NO: 1160417 - protein, 9 aa, Homo Sapiens
RFQLLHFSS

SEQ ID NO: 1160418 - protein, 9 aa, Homo Sapiens
RITWFTSWS

SEQ ID NO: 1160419 - protein, 9 aa, Homo Sapiens
AGGEPHANN

SEQ ID NO: 1160420 - protein, 9 aa, Homo Sapiens
FHEVDIGSV

SEQ ID NO: 1160421 - protein, 9 aa, Homo Sapiens
DTIQHFCSQ

SEQ ID NO: 1160422 - protein, 9 aa, Homo Sapiens
DNLKPWLVE

SEQ ID NO: 1160423 - protein, 9 aa, Homo Sapiens
VMLGEGGQS

SEQ ID NO: 1160424 - protein, 9 aa, Homo Sapiens
DVSSRGSSQ

SEQ ID NO: 1160425 - protein, 9 aa, Homo Sapiens
SSSQHCTLA

SEQ ID NO: 1160426 - protein, 9 aa, Homo Sapiens
RERQIRQIV

SEQ ID NO: 1160427 - protein, 9 aa, Homo Sapiens
ISIGTNGTT

SEQ ID NO: 1160428 - protein, 9 aa, Homo Sapiens
RKVRKTRRD

SEQ ID NO: 1160429 - protein, 9 aa, Homo Sapiens
VYAYVFEHH

SEQ ID NO: 1160430 - protein, 9 aa, Homo Sapiens
DFEYSIRIT

SEQ ID NO: 1160431 - protein, 9 aa, Homo Sapiens
PSLYPQPPL

SEQ ID NO: 1160432 - protein, 9 aa, Homo Sapiens
NKKFPERVT

SEQ ID NO: 1160433 - protein, 9 aa, Homo Sapiens
HGVLINDNI

SEQ ID NO: 1160434 - protein, 9 aa, Homo Sapiens
LHLSEPQLF

SEQ ID NO: 1160435 - protein, 9 aa, Homo Sapiens
FIHILFFTT

SEQ ID NO: 1160436 - protein, 9 aa, Homo Sapiens
AQNSRPSLQ

SEQ ID NO: 1160437 - protein, 9 aa, Homo Sapiens
LPIINEAMA

SEQ ID NO: 1160438 - protein, 9 aa, Homo Sapiens
DGLRLSTEL

SEQ ID NO: 1160439 - protein, 9 aa, Homo Sapiens
RQASQQPAG

SEQ ID NO: 1160440 - protein, 9 aa, Homo Sapiens
GVGFDDVES

SEQ ID NO: 1160441 - protein, 9 aa, Homo Sapiens
GPIYDVYSF

SEQ ID NO: 1160442 - protein, 9 aa, Homo Sapiens
VPRARKYKC

SEQ ID NO: 1160443 - protein, 9 aa, Homo Sapiens
YSVYGSGGG

SEQ ID NO: 1160444 - protein, 9 aa, Homo Sapiens
SPESSVTAV

SEQ ID NO: 1160445 - protein, 9 aa, Homo Sapiens
ALDRSYQID

SEQ ID NO: 1160446 - protein, 9 aa, Homo Sapiens
STLCKDVTA

SEQ ID NO: 1160447 - protein, 9 aa, Homo Sapiens
RFENSDQPI

SEQ ID NO: 1160448 - protein, 9 aa, Homo Sapiens
FEFANKVVL

SEQ ID NO: 1160449 - protein, 9 aa, Homo Sapiens
IIRLLPKHR

SEQ ID NO: 1160450 - protein, 9 aa, Homo Sapiens
WKKKYVILC

SEQ ID NO: 1160451 - protein, 9 aa, Homo Sapiens
RSPYRMRRI

SEQ ID NO: 1160452 - protein, 9 aa, Homo Sapiens
ERRQKPNSR

SEQ ID NO: 1160453 - protein, 9 aa, Homo Sapiens
LINDNIVFG

SEQ ID NO: 1160454 - protein, 9 aa, Homo Sapiens
FWEHSMLTD

SEQ ID NO: 1160455 - protein, 9 aa, Homo Sapiens
DNSPFFLVL

SEQ ID NO: 1160456 - protein, 9 aa, Homo Sapiens
MPTDSQYLS

SEQ ID NO: 1160457 - protein, 9 aa, Homo Sapiens
QKCENGMTG

SEQ ID NO: 1160458 - protein, 9 aa, Homo Sapiens
TIFAVSGLI

SEQ ID NO: 1160459 - protein, 9 aa, Homo Sapiens
RDSKDGRTY

SEQ ID NO: 1160460 - protein, 9 aa, Homo Sapiens
FERRWVLAV

SEQ ID NO: 1160461 - protein, 9 aa, Homo Sapiens
MWTSGIMSN

SEQ ID NO: 1160462 - protein, 9 aa, Homo Sapiens
VVECMDHTL

SEQ ID NO: 1160463 - protein, 9 aa, Homo Sapiens
PKLSAEAVY

SEQ ID NO: 1160464 - protein, 9 aa, Homo Sapiens
ASRMDSTGF

SEQ ID NO: 1160465 - protein, 9 aa, Homo Sapiens
VIGPSNSNL

SEQ ID NO: 1160466 - protein, 9 aa, Homo Sapiens
FMFHGIREG

SEQ ID NO: 1160467 - protein, 9 aa, Homo Sapiens
EANELFKEG

SEQ ID NO: 1160468 - protein, 9 aa, Homo Sapiens
GNLWVSLGL

SEQ ID NO: 1160469 - protein, 9 aa, Homo Sapiens
ISRVVDKSW

SEQ ID NO: 1160470 - protein, 9 aa, Homo Sapiens
VSDATPCTY

SEQ ID NO: 1160471 - protein, 9 aa, Homo Sapiens
EGDEHITQW

SEQ ID NO: 1160472 - protein, 9 aa, Homo Sapiens
TYGVYTRVK

SEQ ID NO: 1160473 - protein, 9 aa, Homo Sapiens
LLYPRATND

SEQ ID NO: 1160474 - protein, 9 aa, Homo Sapiens
FHGIREGIC

SEQ ID NO: 1160475 - protein, 9 aa, Homo Sapiens
RVQNSLGNY

SEQ ID NO: 1160476 - protein, 9 aa, Homo Sapiens
SVCVTLGSE

SEQ ID NO: 1160477 - protein, 9 aa, Homo Sapiens
IMDEHNQWY

SEQ ID NO: 1160478 - protein, 9 aa, Homo Sapiens
NAGPAASRP

SEQ ID NO: 1160479 - protein, 9 aa, Homo Sapiens
KNLRHLNYV

SEQ ID NO: 1160480 - protein, 9 aa, Homo Sapiens
GQYETVFPL

SEQ ID NO: 1160481 - protein, 9 aa, Homo Sapiens
SESLGSNSP

SEQ ID NO: 1160482 - protein, 9 aa, Homo Sapiens
QKITGRPTL

SEQ ID NO: 1160483 - protein, 9 aa, Homo Sapiens
LAACQEHCG

SEQ ID NO: 1160484 - protein, 9 aa, Homo Sapiens
PQLFQAERN

SEQ ID NO: 1160485 - protein, 9 aa, Homo Sapiens
GEVKIESKI

SEQ ID NO: 1160486 - protein, 9 aa, Homo Sapiens
TFARIQEKL

SEQ ID NO: 1160487 - protein, 9 aa, Homo Sapiens
VHVWQLYGV

SEQ ID NO: 1160488 - protein, 9 aa, Homo Sapiens
NENGFTYFY

SEQ ID NO: 1160489 - protein, 9 aa, Homo Sapiens
GESSRLPVF

SEQ ID NO: 1160490 - protein, 9 aa, Homo Sapiens
CSGVSEEST

SEQ ID NO: 1160491 - protein, 9 aa, Homo Sapiens
VSLNVSLGQ

SEQ ID NO: 1160492 - protein, 9 aa, Homo Sapiens
SQATEAEEL

SEQ ID NO: 1160493 - protein, 9 aa, Homo Sapiens
SAVRTLQKC

SEQ ID NO: 1160494 - protein, 9 aa, Homo Sapiens
ESSVTAVPR

SEQ ID NO: 1160495 - protein, 9 aa, Homo Sapiens
RTLDSGIGP

SEQ ID NO: 1160496 - protein, 9 aa, Homo Sapiens
RIDYMGKDT

SEQ ID NO: 1160497 - protein, 9 aa, Homo Sapiens
VSDVPFLTG

SEQ ID NO: 1160498 - protein, 9 aa, Homo Sapiens
DKRDSKDGR

SEQ ID NO: 1160499 - protein, 9 aa, Homo Sapiens
IICVYYYVA

SEQ ID NO: 1160500 - protein, 9 aa, Homo Sapiens
VDDTGKTIF

SEQ ID NO: 1160501 - protein, 9 aa, Homo Sapiens
LLEVNGITF

SEQ ID NO: 1160502 - protein, 9 aa, Homo Sapiens
LEEPTIEPP

SEQ ID NO: 1160503 - protein, 9 aa, Homo Sapiens
TGIYRGPVY

SEQ ID NO: 1160504 - protein, 9 aa, Homo Sapiens
PRNAGPAAS

SEQ ID NO: 1160505 - protein, 9 aa, Homo Sapiens
TNDRVWTLE

SEQ ID NO: 1160506 - protein, 9 aa, Homo Sapiens
SSQHCTLAV

SEQ ID NO: 1160507 - protein, 9 aa, Homo Sapiens
TTISNQAES

SEQ ID NO: 1160508 - protein, 9 aa, Homo Sapiens
MNSNLKFAE

SEQ ID NO: 1160509 - protein, 9 aa, Homo Sapiens
EAFPPLAQV

SEQ ID NO: 1160510 - protein, 9 aa, Homo Sapiens
QLEEFDLED

SEQ ID NO: 1160511 - protein, 9 aa, Homo Sapiens
AFVMRAQKS

SEQ ID NO: 1160512 - protein, 9 aa, Homo Sapiens
GGQGNRFSY

SEQ ID NO: 1160513 - protein, 9 aa, Homo Sapiens
EILEASQFV

SEQ ID NO: 1160514 - protein, 9 aa, Homo Sapiens
GTEHHVSLI

SEQ ID NO: 1160515 - protein, 9 aa, Homo Sapiens
NVQRAICWS

SEQ ID NO: 1160516 - protein, 9 aa, Homo Sapiens
FPPLAQVET

SEQ ID NO: 1160517 - protein, 9 aa, Homo Sapiens
ESSRLPVFI

SEQ ID NO: 1160518 - protein, 9 aa, Homo Sapiens
WMRSSSQHC

SEQ ID NO: 1160519 - protein, 9 aa, Homo Sapiens
DEFQDALNI

SEQ ID NO: 1160520 - protein, 9 aa, Homo Sapiens
ASTGIYRGP

SEQ ID NO: 1160521 - protein, 9 aa, Homo Sapiens
HSGPFRPNV

SEQ ID NO: 1160522 - protein, 9 aa, Homo Sapiens
TSPILSRLK

SEQ ID NO: 1160523 - protein, 9 aa, Homo Sapiens
IPAAVYSEI

SEQ ID NO: 1160524 - protein, 9 aa, Homo Sapiens
VYGITEVLS

SEQ ID NO: 1160525 - protein, 9 aa, Homo Sapiens
PTSAKSPVV

SEQ ID NO: 1160526 - protein, 9 aa, Homo Sapiens
LCLINQKRR

SEQ ID NO: 1160527 - protein, 9 aa, Homo Sapiens
SLCFLIFPM

SEQ ID NO: 1160528 - protein, 9 aa, Homo Sapiens
EFDLEDDFE

SEQ ID NO: 1160529 - protein, 9 aa, Homo Sapiens
GITFLGENH

SEQ ID NO: 1160530 - protein, 9 aa, Homo Sapiens
KEGDEHITQ

SEQ ID NO: 1160531 - protein, 9 aa, Homo Sapiens
ACTQCGRRF

SEQ ID NO: 1160532 - protein, 9 aa, Homo Sapiens
RRWVITTLK

SEQ ID NO: 1160533 - protein, 9 aa, Homo Sapiens
KTWKKKYVI

SEQ ID NO: 1160534 - protein, 9 aa, Homo Sapiens
GSVIAQKRE

SEQ ID NO: 1160535 - protein, 9 aa, Homo Sapiens
GTCCHHCFP

SEQ ID NO: 1160536 - protein, 9 aa, Homo Sapiens
TCREIFYGL

SEQ ID NO: 1160537 - protein, 9 aa, Homo Sapiens
RSPEDPEKR

SEQ ID NO: 1160538 - protein, 9 aa, Homo Sapiens
KAVATMGPI

SEQ ID NO: 1160539 - protein, 9 aa, Homo Sapiens
VLPIINEAM

SEQ ID NO: 1160540 - protein, 9 aa, Homo Sapiens
HYSPQLLGP

SEQ ID NO: 1160541 - protein, 9 aa, Homo Sapiens
TAVPRARKY

SEQ ID NO: 1160542 - protein, 9 aa, Homo Sapiens
NKQTERIQK

SEQ ID NO: 1160543 - protein, 9 aa, Homo Sapiens
LNNRLNFSQ

SEQ ID NO: 1160544 - protein, 9 aa, Homo Sapiens
VNGITFLGE

SEQ ID NO: 1160545 - protein, 9 aa, Homo Sapiens
TVCSKPTEG

SEQ ID NO: 1160546 - protein, 9 aa, Homo Sapiens
PCRVSLNVS

SEQ ID NO: 1160547 - protein, 9 aa, Homo Sapiens
FRSEDNSED

SEQ ID NO: 1160548 - protein, 9 aa, Homo Sapiens
EGGQSRFDT

SEQ ID NO: 1160549 - protein, 9 aa, Homo Sapiens
PVVSDVPFL

SEQ ID NO: 1160550 - protein, 9 aa, Homo Sapiens
HLEEVEGQL

SEQ ID NO: 1160551 - protein, 9 aa, Homo Sapiens
FFVLFFVIS

SEQ ID NO: 1160552 - protein, 9 aa, Homo Sapiens
IHVRLSGWI

SEQ ID NO: 1160553 - protein, 9 aa, Homo Sapiens
NTKVVKPSI

SEQ ID NO: 1160554 - protein, 9 aa, Homo Sapiens
YGIIRLLPK

SEQ ID NO: 1160555 - protein, 9 aa, Homo Sapiens
SENYNHAIT

SEQ ID NO: 1160556 - protein, 9 aa, Homo Sapiens
EIQRQAKKC

SEQ ID NO: 1160557 - protein, 9 aa, Homo Sapiens
FVMLGEGGQ

SEQ ID NO: 1160558 - protein, 9 aa, Homo Sapiens
PDLTASTGI

SEQ ID NO: 1160559 - protein, 9 aa, Homo Sapiens
HPAWDCGRR

SEQ ID NO: 1160560 - protein, 9 aa, Homo Sapiens
CKTCYHIVE

SEQ ID NO: 1160561 - protein, 9 aa, Homo Sapiens
GITEVLSWA

SEQ ID NO: 1160562 - protein, 9 aa, Homo Sapiens
QHFCSQHGS

SEQ ID NO: 1160563 - protein, 9 aa, Homo Sapiens
LRLSTELSE

SEQ ID NO: 1160564 - protein, 9 aa, Homo Sapiens
TISNQAESM

SEQ ID NO: 1160565 - protein, 9 aa, Homo Sapiens
DDTGKTIFA

SEQ ID NO: 1160566 - protein, 9 aa, Homo Sapiens
EDHKLEYLE

SEQ ID NO: 1160567 - protein, 9 aa, Homo Sapiens
MCLPAATGV

SEQ ID NO: 1160568 - protein, 9 aa, Homo Sapiens
FPMLVASYV

SEQ ID NO: 1160569 - protein, 9 aa, Homo Sapiens
NEAEDAELY

SEQ ID NO: 1160570 - protein, 9 aa, Homo Sapiens
KVVAVDGDP

SEQ ID NO: 1160571 - protein, 9 aa, Homo Sapiens
PKEKESFGE

SEQ ID NO: 1160572 - protein, 9 aa, Homo Sapiens
QQLLEWSFM

SEQ ID NO: 1160573 - protein, 9 aa, Homo Sapiens
DLTASTGIY

SEQ ID NO: 1160574 - protein, 9 aa, Homo Sapiens
ICNVCHSLL

SEQ ID NO: 1160575 - protein, 9 aa, Homo Sapiens
LRRGFLRAQ

SEQ ID NO: 1160576 - protein, 9 aa, Homo Sapiens
CGRRAGPQM

SEQ ID NO: 1160577 - protein, 9 aa, Homo Sapiens
QDRGLCREL

SEQ ID NO: 1160578 - protein, 9 aa, Homo Sapiens
MTNMQPGDV

SEQ ID NO: 1160579 - protein, 9 aa, Homo Sapiens
PGCRKLGTV

SEQ ID NO: 1160580 - protein, 9 aa, Homo Sapiens
LTKIATLLL

SEQ ID NO: 1160581 - protein, 9 aa, Homo Sapiens
LYPRATNDR

SEQ ID NO: 1160582 - protein, 9 aa, Homo Sapiens
PYSQATEAE

SEQ ID NO: 1160583 - protein, 9 aa, Homo Sapiens
NKYLYLNKP

SEQ ID NO: 1160584 - protein, 9 aa, Homo Sapiens
EVVEVVRIS

SEQ ID NO: 1160585 - protein, 9 aa, Homo Sapiens
EDGKDSNEA

SEQ ID NO: 1160586 - protein, 9 aa, Homo Sapiens
DPCAPNEMT

SEQ ID NO: 1160587 - protein, 9 aa, Homo Sapiens
RRILARHQL

SEQ ID NO: 1160588 - protein, 9 aa, Homo Sapiens
MEQVFHEVD

SEQ ID NO: 1160589 - protein, 9 aa, Homo Sapiens
TEVLSWATI

SEQ ID NO: 1160590 - protein, 9 aa, Homo Sapiens
AQVETVCSK

SEQ ID NO: 1160591 - protein, 9 aa, Homo Sapiens
QCDTCREIF

SEQ ID NO: 1160592 - protein, 9 aa, Homo Sapiens
GPVSDATPC

SEQ ID NO: 1160593 - protein, 9 aa, Homo Sapiens
PFSEVLADG

SEQ ID NO: 1160594 - protein, 9 aa, Homo Sapiens
CHPLNNRLN

SEQ ID NO: 1160595 - protein, 9 aa, Homo Sapiens
RLLHLDMRG

SEQ ID NO: 1160596 - protein, 9 aa, Homo Sapiens
DFVNFTDIH

SEQ ID NO: 1160597 - protein, 9 aa, Homo Sapiens
EEEVSTLCK

SEQ ID NO: 1160598 - protein, 9 aa, Homo Sapiens
SRLKGTSKV

SEQ ID NO: 1160599 - protein, 9 aa, Homo Sapiens
TGRPTLVKN

SEQ ID NO: 1160600 - protein, 9 aa, Homo Sapiens
SQPPPPNSV

SEQ ID NO: 1160601 - protein, 9 aa, Homo Sapiens
ICVYYYVAV

SEQ ID NO: 1160602 - protein, 9 aa, Homo Sapiens
YYDEVVAEG

SEQ ID NO: 1160603 - protein, 9 aa, Homo Sapiens
ALPVKVSLK

SEQ ID NO: 1160604 - protein, 9 aa, Homo Sapiens
IRQMQLSAT

SEQ ID NO: 1160605 - protein, 9 aa, Homo Sapiens
RNDPGAKFS

SEQ ID NO: 1160606 - protein, 9 aa, Homo Sapiens
EMTNMQPGD

SEQ ID NO: 1160607 - protein, 9 aa, Homo Sapiens
KPKEKESFG

SEQ ID NO: 1160608 - protein, 9 aa, Homo Sapiens
HSCTWGRQG

SEQ ID NO: 1160609 - protein, 9 aa, Homo Sapiens
SHGVLINDN

SEQ ID NO: 1160610 - protein, 9 aa, Homo Sapiens
DPFASGKTS

SEQ ID NO: 1160611 - protein, 9 aa, Homo Sapiens
FSVFIICIS

SEQ ID NO: 1160612 - protein, 9 aa, Homo Sapiens
MLGEGGQSR

SEQ ID NO: 1160613 - protein, 9 aa, Homo Sapiens
FPLDLETFL

SEQ ID NO: 1160614 - protein, 9 aa, Homo Sapiens
VVAVDGDPG

SEQ ID NO: 1160615 - protein, 9 aa, Homo Sapiens
GYNHICFEE

SEQ ID NO: 1160616 - protein, 9 aa, Homo Sapiens
PDFRTNKGR

SEQ ID NO: 1160617 - protein, 9 aa, Homo Sapiens
NVYGITEVL

SEQ ID NO: 1160618 - protein, 9 aa, Homo Sapiens
GTYGVYTRV

SEQ ID NO: 1160619 - protein, 9 aa, Homo Sapiens
DPVTLNLLL

SEQ ID NO: 1160620 - protein, 9 aa, Homo Sapiens
EQVFHEVDI

SEQ ID NO: 1160621 - protein, 9 aa, Homo Sapiens
LISKTRTIL

SEQ ID NO: 1160622 - protein, 9 aa, Homo Sapiens
PYVCAECGR

SEQ ID NO: 1160623 - protein, 9 aa, Homo Sapiens
TLKLEEEDP

SEQ ID NO: 1160624 - protein, 9 aa, Homo Sapiens
PVTLNLLLK

SEQ ID NO: 1160625 - protein, 9 aa, Homo Sapiens
AATGVTATK

SEQ ID NO: 1160626 - protein, 9 aa, Homo Sapiens
IFPPSLYPQ

SEQ ID NO: 1160627 - protein, 9 aa, Homo Sapiens
KAFKWSSKP

SEQ ID NO: 1160628 - protein, 9 aa, Homo Sapiens
QGFWEHSML

SEQ ID NO: 1160629 - protein, 9 aa, Homo Sapiens
PVFKETEME

SEQ ID NO: 1160630 - protein, 9 aa, Homo Sapiens
QNSLGNYDE

SEQ ID NO: 1160631 - protein, 9 aa, Homo Sapiens
EQQASQPPP

SEQ ID NO: 1160632 - protein, 9 aa, Homo Sapiens
HTLTSLFPK

SEQ ID NO: 1160633 - protein, 9 aa, Homo Sapiens
VYGSGGGTG

SEQ ID NO: 1160634 - protein, 9 aa, Homo Sapiens
EYLSRKAST

SEQ ID NO: 1160635 - protein, 9 aa, Homo Sapiens
LKENIQDLV

SEQ ID NO: 1160636 - protein, 9 aa, Homo Sapiens
MGSPGHHVY

SEQ ID NO: 1160637 - protein, 9 aa, Homo Sapiens
IATKVTSAP

SEQ ID NO: 1160638 - protein, 9 aa, Homo Sapiens
HGPSVRKLT

SEQ ID NO: 1160639 - protein, 9 aa, Homo Sapiens
SAEAVYEKC

SEQ ID NO: 1160640 - protein, 9 aa, Homo Sapiens
PEAAHEQRL

SEQ ID NO: 1160641 - protein, 9 aa, Homo Sapiens
DGKDSNEAE

SEQ ID NO: 1160642 - protein, 9 aa, Homo Sapiens
WSARSESAQ

SEQ ID NO: 1160643 - protein, 9 aa, Homo Sapiens
AKCDFRSED

SEQ ID NO: 1160644 - protein, 9 aa, Homo Sapiens
IRLLPKHRF

SEQ ID NO: 1160645 - protein, 9 aa, Homo Sapiens
PFFLVLFSS

SEQ ID NO: 1160646 - protein, 9 aa, Homo Sapiens
EEPTIEPPV

SEQ ID NO: 1160647 - protein, 9 aa, Homo Sapiens
AICWSNIAN

SEQ ID NO: 1160648 - protein, 9 aa, Homo Sapiens
EVLSWATIY

SEQ ID NO: 1160649 - protein, 9 aa, Homo Sapiens
NQEKEAEKN

SEQ ID NO: 1160650 - protein, 9 aa, Homo Sapiens
LSTIMDEHN

SEQ ID NO: 1160651 - protein, 9 aa, Homo Sapiens
RHLNYVWIG

SEQ ID NO: 1160652 - protein, 9 aa, Homo Sapiens
AKIEEQLRH

SEQ ID NO: 1160653 - protein, 9 aa, Homo Sapiens
EYSGPEKLL

SEQ ID NO: 1160654 - protein, 9 aa, Homo Sapiens
SCTGVTEYA

SEQ ID NO: 1160655 - protein, 9 aa, Homo Sapiens
FHSKQELRD

SEQ ID NO: 1160656 - protein, 9 aa, Homo Sapiens
YVPQKAKRK

SEQ ID NO: 1160657 - protein, 9 aa, Homo Sapiens
AVADLTFVL

SEQ ID NO: 1160658 - protein, 9 aa, Homo Sapiens
IVDQGEDFP

SEQ ID NO: 1160659 - protein, 9 aa, Homo Sapiens
EENRALRYL

SEQ ID NO: 1160660 - protein, 9 aa, Homo Sapiens
DKAFTWHSS

SEQ ID NO: 1160661 - protein, 9 aa, Homo Sapiens
DSLTAYRGN

SEQ ID NO: 1160662 - protein, 9 aa, Homo Sapiens
FLVLFSSPH

SEQ ID NO: 1160663 - protein, 9 aa, Homo Sapiens
PASTTCSGV

SEQ ID NO: 1160664 - protein, 9 aa, Homo Sapiens
QLDSVKQRK

SEQ ID NO: 1160665 - protein, 9 aa, Homo Sapiens
PNPSESLGS

SEQ ID NO: 1160666 - protein, 9 aa, Homo Sapiens
ESNKAPGPI

SEQ ID NO: 1160667 - protein, 9 aa, Homo Sapiens
EEAALVAKE

SEQ ID NO: 1160668 - protein, 9 aa, Homo Sapiens
HASTLSWPL

SEQ ID NO: 1160669 - protein, 9 aa, Homo Sapiens
LQNKVLSLS

SEQ ID NO: 1160670 - protein, 9 aa, Homo Sapiens
EAEELAEAF

SEQ ID NO: 1160671 - protein, 9 aa, Homo Sapiens
LIQLDSVKQ

SEQ ID NO: 1160672 - protein, 9 aa, Homo Sapiens
AHEANELFK

SEQ ID NO: 1160673 - protein, 9 aa, Homo Sapiens
ESAPAGITD

SEQ ID NO: 1160674 - protein, 9 aa, Homo Sapiens
EHHVSLIDS

SEQ ID NO: 1160675 - protein, 9 aa, Homo Sapiens
SGIGPFPLP

SEQ ID NO: 1160676 - protein, 9 aa, Homo Sapiens
VHNENGFTY

SEQ ID NO: 1160677 - protein, 9 aa, Homo Sapiens
EYLEVHQAE

SEQ ID NO: 1160678 - protein, 9 aa, Homo Sapiens
GRRFGSRPN

SEQ ID NO: 1160679 - protein, 9 aa, Homo Sapiens
KMIKRTMHN

SEQ ID NO: 1160680 - protein, 9 aa, Homo Sapiens
AYEHAKIEE

SEQ ID NO: 1160681 - protein, 9 aa, Homo Sapiens
HETVRRITV

SEQ ID NO: 1160682 - protein, 9 aa, Homo Sapiens
DDNLKPWLV

SEQ ID NO: 1160683 - protein, 9 aa, Homo Sapiens
DTGKTIFAV

SEQ ID NO: 1160684 - protein, 9 aa, Homo Sapiens
SPVVSDVPF

SEQ ID NO: 1160685 - protein, 9 aa, Homo Sapiens
EHHASTLSW

SEQ ID NO: 1160686 - protein, 9 aa, Homo Sapiens
VDISKGGVY

SEQ ID NO: 1160687 - protein, 9 aa, Homo Sapiens
DQPQLERFR

SEQ ID NO: 1160688 - protein, 9 aa, Homo Sapiens
RMDRGLPVI

SEQ ID NO: 1160689 - protein, 9 aa, Homo Sapiens
NISIGTNGT

SEQ ID NO: 1160690 - protein, 9 aa, Homo Sapiens
PPDLTASTG

SEQ ID NO: 1160691 - protein, 9 aa, Homo Sapiens
QLLYPRATN

SEQ ID NO: 1160692 - protein, 9 aa, Homo Sapiens
NNRLNFSQV

SEQ ID NO: 1160693 - protein, 9 aa, Homo Sapiens
MGKPKEKES

SEQ ID NO: 1160694 - protein, 9 aa, Homo Sapiens
LTLPLWATY

SEQ ID NO: 1160695 - protein, 9 aa, Homo Sapiens
TDIHHSNEE

SEQ ID NO: 1160696 - protein, 9 aa, Homo Sapiens
RFAIILYFY

SEQ ID NO: 1160697 - protein, 9 aa, Homo Sapiens
TVKELVAGS

SEQ ID NO: 1160698 - protein, 9 aa, Homo Sapiens
TTCSGVSEE

SEQ ID NO: 1160699 - protein, 9 aa, Homo Sapiens
NLKSSLCLI

SEQ ID NO: 1160700 - protein, 9 aa, Homo Sapiens
QNILPLVDE

SEQ ID NO: 1160701 - protein, 9 aa, Homo Sapiens
HFCSQHGSP

SEQ ID NO: 1160702 - protein, 9 aa, Homo Sapiens
LEKLEKVPH

SEQ ID NO: 1160703 - protein, 9 aa, Homo Sapiens
LEASQFVET

SEQ ID NO: 1160704 - protein, 9 aa, Homo Sapiens
KSWWTNWGF

SEQ ID NO: 1160705 - protein, 9 aa, Homo Sapiens
PVSSSFGSE

SEQ ID NO: 1160706 - protein, 9 aa, Homo Sapiens
RASRKTYDK

SEQ ID NO: 1160707 - protein, 9 aa, Homo Sapiens
MKFILLLFT

SEQ ID NO: 1160708 - protein, 9 aa, Homo Sapiens
KVRKTRRDT

SEQ ID NO: 1160709 - protein, 9 aa, Homo Sapiens
RGQYETVFP

SEQ ID NO: 1160710 - protein, 9 aa, Homo Sapiens
WTISRVVDK

SEQ ID NO: 1160711 - protein, 9 aa, Homo Sapiens
KCLSHDLPL

SEQ ID NO: 1160712 - protein, 9 aa, Homo Sapiens
SVPEEYAPT

SEQ ID NO: 1160713 - protein, 9 aa, Homo Sapiens
EAVYEKCSQ

SEQ ID NO: 1160714 - protein, 9 aa, Homo Sapiens
WRLCKTCYH

SEQ ID NO: 1160715 - protein, 9 aa, Homo Sapiens
EKRNVQPPA

SEQ ID NO: 1160716 - protein, 9 aa, Homo Sapiens
HPIKSVIPS

SEQ ID NO: 1160717 - protein, 9 aa, Homo Sapiens
TKSGTAATE

SEQ ID NO: 1160718 - protein, 9 aa, Homo Sapiens
STFLVFMFH

SEQ ID NO: 1160719 - protein, 9 aa, Homo Sapiens
EPAQRGNLW

SEQ ID NO: 1160720 - protein, 9 aa, Homo Sapiens
EAVRRAFQL

SEQ ID NO: 1160721 - protein, 9 aa, Homo Sapiens
LEWSFMNSN

SEQ ID NO: 1160722 - protein, 9 aa, Homo Sapiens
PLAQVETVC

SEQ ID NO: 1160723 - protein, 9 aa, Homo Sapiens
TLFVSDAYK

SEQ ID NO: 1160724 - protein, 9 aa, Homo Sapiens
ILVIPYLYL

SEQ ID NO: 1160725 - protein, 9 aa, Homo Sapiens
KIMGKIVDQ

SEQ ID NO: 1160726 - protein, 9 aa, Homo Sapiens
EEQCRNTSF

SEQ ID NO: 1160727 - protein, 9 aa, Homo Sapiens
IFIICVYYY

SEQ ID NO: 1160728 - protein, 9 aa, Homo Sapiens
KVSNSSKFQ

SEQ ID NO: 1160729 - protein, 9 aa, Homo Sapiens
YTIFTPILN

SEQ ID NO: 1160730 - protein, 9 aa, Homo Sapiens
TAYRGNNDH

SEQ ID NO: 1160731 - protein, 9 aa, Homo Sapiens
RRSPYRMRR

SEQ ID NO: 1160732 - protein, 9 aa, Homo Sapiens
GGVYLERMH

SEQ ID NO: 1160733 - protein, 9 aa, Homo Sapiens
SLEPDQIGP

SEQ ID NO: 1160734 - protein, 9 aa, Homo Sapiens
QRAICWSNI

SEQ ID NO: 1160735 - protein, 9 aa, Homo Sapiens
EEIEYRIIK

SEQ ID NO: 1160736 - protein, 9 aa, Homo Sapiens
ALMKAVATM

SEQ ID NO: 1160737 - protein, 9 aa, Homo Sapiens
PKLAHSPFA

SEQ ID NO: 1160738 - protein, 9 aa, Homo Sapiens
SLYYSSSVK

SEQ ID NO: 1160739 - protein, 9 aa, Homo Sapiens
IYVHTTLEL

SEQ ID NO: 1160740 - protein, 9 aa, Homo Sapiens
SGPEKLLRL

SEQ ID NO: 1160741 - protein, 9 aa, Homo Sapiens
ANKVVLMCI

SEQ ID NO: 1160742 - protein, 9 aa, Homo Sapiens
HVSLIDSLL

SEQ ID NO: 1160743 - protein, 9 aa, Homo Sapiens
QKREKMHPK

SEQ ID NO: 1160744 - protein, 9 aa, Homo Sapiens
VTLGSETQA

SEQ ID NO: 1160745 - protein, 9 aa, Homo Sapiens
GPSVRKLTK

SEQ ID NO: 1160746 - protein, 9 aa, Homo Sapiens
NEAMAAAIA

SEQ ID NO: 1160747 - protein, 9 aa, Homo Sapiens
VCAECGRAF

SEQ ID NO: 1160748 - protein, 9 aa, Homo Sapiens
NVSLGQRCW

SEQ ID NO: 1160749 - protein, 9 aa, Homo Sapiens
RKNLKSSLC

SEQ ID NO: 1160750 - protein, 9 aa, Homo Sapiens
CLINQKRRH

SEQ ID NO: 1160751 - protein, 9 aa, Homo Sapiens
SPQLLGPSC

SEQ ID NO: 1160752 - protein, 9 aa, Homo Sapiens
AYDKSLLPS

SEQ ID NO: 1160753 - protein, 9 aa, Homo Sapiens
PQESTELVY

SEQ ID NO: 1160754 - protein, 9 aa, Homo Sapiens
EVKIESKIE

SEQ ID NO: 1160755 - protein, 9 aa, Homo Sapiens
KVNDQLEEQ

SEQ ID NO: 1160756 - protein, 9 aa, Homo Sapiens
VFKETEMEV

SEQ ID NO: 1160757 - protein, 9 aa, Homo Sapiens
TELRKEISV

SEQ ID NO: 1160758 - protein, 9 aa, Homo Sapiens
LDMRGLGEL

SEQ ID NO: 1160759 - protein, 9 aa, Homo Sapiens
GNMPYVLCD

SEQ ID NO: 1160760 - protein, 9 aa, Homo Sapiens
LSAEAVYEK

SEQ ID NO: 1160761 - protein, 9 aa, Homo Sapiens
RLGIYVHTT

SEQ ID NO: 1160762 - protein, 9 aa, Homo Sapiens
TTLKLEEED

SEQ ID NO: 1160763 - protein, 9 aa, Homo Sapiens
LKIMGKIVD

SEQ ID NO: 1160764 - protein, 9 aa, Homo Sapiens
IHPIKSVIP

SEQ ID NO: 1160765 - protein, 9 aa, Homo Sapiens
VHVCACPGR

SEQ ID NO: 1160766 - protein, 9 aa, Homo Sapiens
LEEKVNDQL

SEQ ID NO: 1160767 - protein, 9 aa, Homo Sapiens
GHGRGKKSL

SEQ ID NO: 1160768 - protein, 9 aa, Homo Sapiens
RIGEKRDSL

SEQ ID NO: 1160769 - protein, 9 aa, Homo Sapiens
ATPPRRRPS

SEQ ID NO: 1160770 - protein, 9 aa, Homo Sapiens
VSTLCKDVT

SEQ ID NO: 1160771 - protein, 9 aa, Homo Sapiens
PAAVYSEIF

SEQ ID NO: 1160772 - protein, 9 aa, Homo Sapiens
KELVAGSDD

SEQ ID NO: 1160773 - protein, 9 aa, Homo Sapiens
QGNRFSYIQ

SEQ ID NO: 1160774 - protein, 9 aa, Homo Sapiens
YEKCSQISL

SEQ ID NO: 1160775 - protein, 9 aa, Homo Sapiens
YVILCSNGV

SEQ ID NO: 1160776 - protein, 9 aa, Homo Sapiens
TFFLDVHPP

SEQ ID NO: 1160777 - protein, 9 aa, Homo Sapiens
RNRPDFRTN

SEQ ID NO: 1160778 - protein, 9 aa, Homo Sapiens
PVVIGPSNS

SEQ ID NO: 1160779 - protein, 9 aa, Homo Sapiens
RLASSTTIS

SEQ ID NO: 1160780 - protein, 9 aa, Homo Sapiens
LAEASSQYM

SEQ ID NO: 1160781 - protein, 9 aa, Homo Sapiens
IFRDNQGVG

SEQ ID NO: 1160782 - protein, 9 aa, Homo Sapiens
YSPQLLGPS

SEQ ID NO: 1160783 - protein, 9 aa, Homo Sapiens
QHCTLAVSV

SEQ ID NO: 1160784 - protein, 9 aa, Homo Sapiens
AFIQKNLRH

SEQ ID NO: 1160785 - protein, 9 aa, Homo Sapiens
AECGRAFIQ

SEQ ID NO: 1160786 - protein, 9 aa, Homo Sapiens
VPQRSIATK

SEQ ID NO: 1160787 - protein, 9 aa, Homo Sapiens
VDHPDLFQN

SEQ ID NO: 1160788 - protein, 9 aa, Homo Sapiens
WKHANIHLS

SEQ ID NO: 1160789 - protein, 9 aa, Homo Sapiens
FQLLHFSSS

SEQ ID NO: 1160790 - protein, 9 aa, Homo Sapiens
EAMAAAIAY

SEQ ID NO: 1160791 - protein, 9 aa, Homo Sapiens
PILSRLKGT

SEQ ID NO: 1160792 - protein, 9 aa, Homo Sapiens
PVFIVQTAS

SEQ ID NO: 1160793 - protein, 9 aa, Homo Sapiens
RLLPKHRFS

SEQ ID NO: 1160794 - protein, 9 aa, Homo Sapiens
ASHGVLIND

SEQ ID NO: 1160795 - protein, 9 aa, Homo Sapiens
IDFLMNRNN

SEQ ID NO: 1160796 - protein, 9 aa, Homo Sapiens
SKQELRDGQ

SEQ ID NO: 1160797 - protein, 9 aa, Homo Sapiens
QQASQPPPP

SEQ ID NO: 1160798 - protein, 9 aa, Homo Sapiens
SNEAEDAEL

SEQ ID NO: 1160799 - protein, 9 aa, Homo Sapiens
DIYRIGEKR

SEQ ID NO: 1160800 - protein, 9 aa, Homo Sapiens
EVEGQLKHL

SEQ ID NO: 1160801 - protein, 9 aa, Homo Sapiens
RFRFAIILY

SEQ ID NO: 1160802 - protein, 9 aa, Homo Sapiens
VNFTDIHHS

SEQ ID NO: 1160803 - protein, 9 aa, Homo Sapiens
VPTGATADV

SEQ ID NO: 1160804 - protein, 9 aa, Homo Sapiens
LDRSYQIDT

SEQ ID NO: 1160805 - protein, 9 aa, Homo Sapiens
MSLDKEEAA

SEQ ID NO: 1160806 - protein, 9 aa, Homo Sapiens
SPASTTCSG

SEQ ID NO: 1160807 - protein, 9 aa, Homo Sapiens
DYNMVAFQP

SEQ ID NO: 1160808 - protein, 9 aa, Homo Sapiens
SPRGDSQYS

SEQ ID NO: 1160809 - protein, 9 aa, Homo Sapiens
CGHVNLHLK

SEQ ID NO: 1160810 - protein, 9 aa, Homo Sapiens
ADDTWDPFA

SEQ ID NO: 1160811 - protein, 9 aa, Homo Sapiens
LGTVSFADV

SEQ ID NO: 1160812 - protein, 9 aa, Homo Sapiens
GLANTTTSF

SEQ ID NO: 1160813 - protein, 9 aa, Homo Sapiens
WLIFSVSKQ

SEQ ID NO: 1160814 - protein, 9 aa, Homo Sapiens
KKANKKTEL

SEQ ID NO: 1160815 - protein, 9 aa, Homo Sapiens
PVAVTDTKL

SEQ ID NO: 1160816 - protein, 9 aa, Homo Sapiens
ERIQKDMDI

SEQ ID NO: 1160817 - protein, 9 aa, Homo Sapiens
SLNVSLGQR

SEQ ID NO: 1160818 - protein, 9 aa, Homo Sapiens
DFRTNKGRQ

SEQ ID NO: 1160819 - protein, 9 aa, Homo Sapiens
LVFVANLDE

SEQ ID NO: 1160820 - protein, 9 aa, Homo Sapiens
VGWTVHRGV

SEQ ID NO: 1160821 - protein, 9 aa, Homo Sapiens
SWWTNWGFS

SEQ ID NO: 1160822 - protein, 9 aa, Homo Sapiens
YWSVKPVSS

SEQ ID NO: 1160823 - protein, 9 aa, Homo Sapiens
RELDQNLSR

SEQ ID NO: 1160824 - protein, 9 aa, Homo Sapiens
TTTSFIDKG

SEQ ID NO: 1160825 - protein, 9 aa, Homo Sapiens
VKPVSSSFG

SEQ ID NO: 1160826 - protein, 9 aa, Homo Sapiens
LCKDVTALK

SEQ ID NO: 1160827 - protein, 9 aa, Homo Sapiens
NSLGNYDEM

SEQ ID NO: 1160828 - protein, 9 aa, Homo Sapiens
SLKVSRHAL

SEQ ID NO: 1160829 - protein, 9 aa, Homo Sapiens
TSAKSPVVS

SEQ ID NO: 1160830 - protein, 9 aa, Homo Sapiens
KRIFIGPTL

SEQ ID NO: 1160831 - protein, 9 aa, Homo Sapiens
STGFLDKIQ

SEQ ID NO: 1160832 - protein, 9 aa, Homo Sapiens
TVLIHVRLS

SEQ ID NO: 1160833 - protein, 9 aa, Homo Sapiens
GLPYEDKVH

SEQ ID NO: 1160834 - protein, 9 aa, Homo Sapiens
NAFVMRAQK

SEQ ID NO: 1160835 - protein, 9 aa, Homo Sapiens
AQRGNLWVS

SEQ ID NO: 1160836 - protein, 9 aa, Homo Sapiens
KQHQCDTEL

SEQ ID NO: 1160837 - protein, 9 aa, Homo Sapiens
ETVRRITVG

SEQ ID NO: 1160838 - protein, 9 aa, Homo Sapiens
KKTELQVGG

SEQ ID NO: 1160839 - protein, 9 aa, Homo Sapiens
AAQNSRPSL

SEQ ID NO: 1160840 - protein, 9 aa, Homo Sapiens
KSPVVSDVP

SEQ ID NO: 1160841 - protein, 9 aa, Homo Sapiens
ECSVVTEVG

SEQ ID NO: 1160842 - protein, 9 aa, Homo Sapiens
DVTSDSAVS

SEQ ID NO: 1160843 - protein, 9 aa, Homo Sapiens
PFACTQCGR

SEQ ID NO: 1160844 - protein, 9 aa, Homo Sapiens
GATADVSRT

SEQ ID NO: 1160845 - protein, 9 aa, Homo Sapiens
LQVGGHGTS

SEQ ID NO: 1160846 - protein, 9 aa, Homo Sapiens
SSQYMPTDS

SEQ ID NO: 1160847 - protein, 9 aa, Homo Sapiens
PDVSSRGSS

SEQ ID NO: 1160848 - protein, 9 aa, Homo Sapiens
SASLKVSNS

SEQ ID NO: 1160849 - protein, 9 aa, Homo Sapiens
ERLIQTLQE

SEQ ID NO: 1160850 - protein, 9 aa, Homo Sapiens
EKLEKVPHS

SEQ ID NO: 1160851 - protein, 9 aa, Homo Sapiens
ASTEMGLRE

SEQ ID NO: 1160852 - protein, 9 aa, Homo Sapiens
GGRRGVRGG

SEQ ID NO: 1160853 - protein, 9 aa, Homo Sapiens
KLEKVPHSP

SEQ ID NO: 1160854 - protein, 9 aa, Homo Sapiens
RLCKTCYHI

SEQ ID NO: 1160855 - protein, 9 aa, Homo Sapiens
YAYVFEHHA

SEQ ID NO: 1160856 - protein, 9 aa, Homo Sapiens
MDMSLDKEE

SEQ ID NO: 1160857 - protein, 9 aa, Homo Sapiens
EIDLRSCTG

SEQ ID NO: 1160858 - protein, 9 aa, Homo Sapiens
WDPFASGKT

SEQ ID NO: 1160859 - protein, 9 aa, Homo Sapiens
RSSSQHCTL

SEQ ID NO: 1160860 - protein, 9 aa, Homo Sapiens
ITTLKLEEE

SEQ ID NO: 1160861 - protein, 9 aa, Homo Sapiens
QKNLRHLNY

SEQ ID NO: 1160862 - protein, 9 aa, Homo Sapiens
SIQENGEVK

SEQ ID NO: 1160863 - protein, 9 aa, Homo Sapiens
KYVASGSFD

SEQ ID NO: 1160864 - protein, 9 aa, Homo Sapiens
QHQCDTELR

SEQ ID NO: 1160865 - protein, 9 aa, Homo Sapiens
FACTQCGRR

SEQ ID NO: 1160866 - protein, 9 aa, Homo Sapiens
SNKAPGPIY

SEQ ID NO: 1160867 - protein, 9 aa, Homo Sapiens
MTQGFWEHS

SEQ ID NO: 1160868 - protein, 9 aa, Homo Sapiens
KMLRSKMGT

SEQ ID NO: 1160869 - protein, 9 aa, Homo Sapiens
GDPGQNAWL

SEQ ID NO: 1160870 - protein, 9 aa, Homo Sapiens
MGKIVDQGE

SEQ ID NO: 1160871 - protein, 9 aa, Homo Sapiens
IKRTMHNWS

SEQ ID NO: 1160872 - protein, 9 aa, Homo Sapiens
EALDRSYQI

SEQ ID NO: 1160873 - protein, 9 aa, Homo Sapiens
MDDGGGYPE

SEQ ID NO: 1160874 - protein, 9 aa, Homo Sapiens
PTSPTLAMP

SEQ ID NO: 1160875 - protein, 9 aa, Homo Sapiens
CQEHCGCYT

SEQ ID NO: 1160876 - protein, 9 aa, Homo Sapiens
EFKSASENY

SEQ ID NO: 1160877 - protein, 9 aa, Homo Sapiens
LKLPMPYIT

SEQ ID NO: 1160878 - protein, 9 aa, Homo Sapiens
STIMDEHNQ

SEQ ID NO: 1160879 - protein, 9 aa, Homo Sapiens
GTLFVSDAY

SEQ ID NO: 1160880 - protein, 9 aa, Homo Sapiens
SGLAVERRQ

SEQ ID NO: 1160881 - protein, 9 aa, Homo Sapiens
WRTTFTVAQ

SEQ ID NO: 1160882 - protein, 9 aa, Homo Sapiens
GLCFSVCLF

SEQ ID NO: 1160883 - protein, 9 aa, Homo Sapiens
VTLKAEQNI

SEQ ID NO: 1160884 - protein, 9 aa, Homo Sapiens
YGVYTRVKN

SEQ ID NO: 1160885 - protein, 9 aa, Homo Sapiens
VKMIKRTMH

SEQ ID NO: 1160886 - protein, 9 aa, Homo Sapiens
NIANSNEQD

SEQ ID NO: 1160887 - protein, 9 aa, Homo Sapiens
TELQVGGHG

SEQ ID NO: 1160888 - protein, 9 aa, Homo Sapiens
ERERQIRQI

SEQ ID NO: 1160889 - protein, 9 aa, Homo Sapiens
ILDLKDLFQ

SEQ ID NO: 1160890 - protein, 9 aa, Homo Sapiens
RQLRMDRGL

SEQ ID NO: 1160891 - protein, 9 aa, Homo Sapiens
YLEVHQAEL

SEQ ID NO: 1160892 - protein, 9 aa, Homo Sapiens
DFLMNRNNV

SEQ ID NO: 1160893 - protein, 9 aa, Homo Sapiens
RDLSAWKKG

SEQ ID NO: 1160894 - protein, 9 aa, Homo Sapiens
TFLVFMFHG

SEQ ID NO: 1160895 - protein, 9 aa, Homo Sapiens
QENGEVKIE

SEQ ID NO: 1160896 - protein, 9 aa, Homo Sapiens
ADLTFVLTL

SEQ ID NO: 1160897 - protein, 9 aa, Homo Sapiens
RGFCVNASA

SEQ ID NO: 1160898 - protein, 9 aa, Homo Sapiens
DSGIGPFPL

SEQ ID NO: 1160899 - protein, 9 aa, Homo Sapiens
CDTCREIFY

SEQ ID NO: 1160900 - protein, 9 aa, Homo Sapiens
MNRNNVVPR

SEQ ID NO: 1160901 - protein, 9 aa, Homo Sapiens
LTILAACQE

SEQ ID NO: 1160902 - protein, 9 aa, Homo Sapiens
DFTVKELVA

SEQ ID NO: 1160903 - protein, 9 aa, Homo Sapiens
KYLYLNKPT

SEQ ID NO: 1160904 - protein, 9 aa, Homo Sapiens
DSRFQLLHF

SEQ ID NO: 1160905 - protein, 9 aa, Homo Sapiens
HVCACPGRD

SEQ ID NO: 1160906 - protein, 9 aa, Homo Sapiens
GFKEKPQDV

SEQ ID NO: 1160907 - protein, 9 aa, Homo Sapiens
RKVHETVRR

SEQ ID NO: 1160908 - protein, 9 aa, Homo Sapiens
YLLYWLIFS

SEQ ID NO: 1160909 - protein, 9 aa, Homo Sapiens
DFEFANKVV

SEQ ID NO: 1160910 - protein, 9 aa, Homo Sapiens
RTMHNWSST

SEQ ID NO: 1160911 - protein, 9 aa, Homo Sapiens
PQAEALDRS

SEQ ID NO: 1160912 - protein, 9 aa, Homo Sapiens
LKVSNSSKF

SEQ ID NO: 1160913 - protein, 9 aa, Homo Sapiens
ITGRPTLVK

SEQ ID NO: 1160914 - protein, 9 aa, Homo Sapiens
DMSLDKEEA

SEQ ID NO: 1160915 - protein, 9 aa, Homo Sapiens
HHPAWDCGR

SEQ ID NO: 1160916 - protein, 9 aa, Homo Sapiens
DGNMPYVLC

SEQ ID NO: 1160917 - protein, 9 aa, Homo Sapiens
ATTGEEVWN

SEQ ID NO: 1160918 - protein, 9 aa, Homo Sapiens
APNAFVMRA

SEQ ID NO: 1160919 - protein, 9 aa, Homo Sapiens
AVPRSSRRR

SEQ ID NO: 1160920 - protein, 9 aa, Homo Sapiens
LLHTPRNAG

SEQ ID NO: 1160921 - protein, 9 aa, Homo Sapiens
LEPDQIGPL

SEQ ID NO: 1160922 - protein, 9 aa, Homo Sapiens
FKTDKILTN

SEQ ID NO: 1160923 - protein, 9 aa, Homo Sapiens
HQPEAAHEQ

SEQ ID NO: 1160924 - protein, 9 aa, Homo Sapiens
VNMDDGGGY

SEQ ID NO: 1160925 - protein, 9 aa, Homo Sapiens
AEDYVPQKA

SEQ ID NO: 1160926 - protein, 9 aa, Homo Sapiens
CRVSLNVSL

SEQ ID NO: 1160927 - protein, 9 aa, Homo Sapiens
STTISNQAE

SEQ ID NO: 1160928 - protein, 9 aa, Homo Sapiens
KKKYVILCS

SEQ ID NO: 1160929 - protein, 9 aa, Homo Sapiens
AFTWHSSLA

SEQ ID NO: 1160930 - protein, 9 aa, Homo Sapiens
SNAVKMIKR

SEQ ID NO: 1160931 - protein, 9 aa, Homo Sapiens
GPKRYTIGQ

SEQ ID NO: 1160932 - protein, 9 aa, Homo Sapiens
KTRRDTQYR

SEQ ID NO: 1160933 - protein, 9 aa, Homo Sapiens
DTWDPFASG

SEQ ID NO: 1160934 - protein, 9 aa, Homo Sapiens
LSTPQESTE

SEQ ID NO: 1160935 - protein, 9 aa, Homo Sapiens
FIGPTLCPS

SEQ ID NO: 1160936 - protein, 9 aa, Homo Sapiens
AWKKGCEVS

SEQ ID NO: 1160937 - protein, 9 aa, Homo Sapiens
YEKHLNKYL

SEQ ID NO: 1160938 - protein, 9 aa, Homo Sapiens
NLWVSLGLL

SEQ ID NO: 1160939 - protein, 9 aa, Homo Sapiens
GSHFIHILF

SEQ ID NO: 1160940 - protein, 9 aa, Homo Sapiens
MSASLKVSN

SEQ ID NO: 1160941 - protein, 9 aa, Homo Sapiens
SKVSLKVSR

SEQ ID NO: 1160942 - protein, 9 aa, Homo Sapiens
YLSRKASTE

SEQ ID NO: 1160943 - protein, 9 aa, Homo Sapiens
KLSAEAVYE

SEQ ID NO: 1160944 - protein, 9 aa, Homo Sapiens
TAKTFFTVD

SEQ ID NO: 1160945 - protein, 9 aa, Homo Sapiens
NLPTLQNKV

SEQ ID NO: 1160946 - protein, 9 aa, Homo Sapiens
VRKLTKIAT

SEQ ID NO: 1160947 - protein, 9 aa, Homo Sapiens
GLCRELDQN

SEQ ID NO: 1160948 - protein, 9 aa, Homo Sapiens
CGTYGVYTR

SEQ ID NO: 1160949 - protein, 9 aa, Homo Sapiens
MAAAIAYGL

SEQ ID NO: 1160950 - protein, 9 aa, Homo Sapiens
NRGQYETVF

SEQ ID NO: 1160951 - protein, 9 aa, Homo Sapiens
VSLIDSLLH

SEQ ID NO: 1160952 - protein, 9 aa, Homo Sapiens
RFGGQGNRF

SEQ ID NO: 1160953 - protein, 9 aa, Homo Sapiens
PAQRGNLWV

SEQ ID NO: 1160954 - protein, 9 aa, Homo Sapiens
SLYWSVKPV

SEQ ID NO: 1160955 - protein, 9 aa, Homo Sapiens
DSTGFLDKI

SEQ ID NO: 1160956 - protein, 9 aa, Homo Sapiens
EELAEAFPP

SEQ ID NO: 1160957 - protein, 9 aa, Homo Sapiens
QSKHHPAWD

SEQ ID NO: 1160958 - protein, 9 aa, Homo Sapiens
AEYSGPEKL

SEQ ID NO: 1160959 - protein, 9 aa, Homo Sapiens
SKDGRTYFV

SEQ ID NO: 1160960 - protein, 9 aa, Homo Sapiens
VYQGPVSDA

SEQ ID NO: 1160961 - protein, 9 aa, Homo Sapiens
LMVEERERQ

SEQ ID NO: 1160962 - protein, 9 aa, Homo Sapiens
NAIDFLMNR

SEQ ID NO: 1160963 - protein, 9 aa, Homo Sapiens
LPKCLSHDL

SEQ ID NO: 1160964 - protein, 9 aa, Homo Sapiens
EKHLNKYLY

SEQ ID NO: 1160965 - protein, 9 aa, Homo Sapiens
WTSGIMSNA

SEQ ID NO: 1160966 - protein, 9 aa, Homo Sapiens
TSLISKTRT

SEQ ID NO: 1160967 - protein, 9 aa, Homo Sapiens
LDVFKKKFH

SEQ ID NO: 1160968 - protein, 9 aa, Homo Sapiens
SAWKKGCEV

SEQ ID NO: 1160969 - protein, 9 aa, Homo Sapiens
RANSDITSL

SEQ ID NO: 1160970 - protein, 9 aa, Homo Sapiens
SPEILEASQ

SEQ ID NO: 1160971 - protein, 9 aa, Homo Sapiens
DSARTSTSN

SEQ ID NO: 1160972 - protein, 9 aa, Homo Sapiens
HMSASLKVS

SEQ ID NO: 1160973 - protein, 9 aa, Homo Sapiens
LLKHDPCQM

SEQ ID NO: 1160974 - protein, 9 aa, Homo Sapiens
TKVTSAPRR

SEQ ID NO: 1160975 - protein, 9 aa, Homo Sapiens
LFFVLFFVI

SEQ ID NO: 1160976 - protein, 9 aa, Homo Sapiens
AACQEHCGC

SEQ ID NO: 1160977 - protein, 9 aa, Homo Sapiens
RRSQKITGR

SEQ ID NO: 1160978 - protein, 9 aa, Homo Sapiens
EPVILDLKD

SEQ ID NO: 1160979 - protein, 9 aa, Homo Sapiens
VEVVRISHL

SEQ ID NO: 1160980 - protein, 9 aa, Homo Sapiens
VDQGEDFPA

SEQ ID NO: 1160981 - protein, 9 aa, Homo Sapiens
SRPSLQRTQ

SEQ ID NO: 1160982 - protein, 9 aa, Homo Sapiens
LLKKANKKT

SEQ ID NO: 1160983 - protein, 9 aa, Homo Sapiens
CSFHSKQEL

SEQ ID NO: 1160984 - protein, 9 aa, Homo Sapiens
AEAVYEKCS

SEQ ID NO: 1160985 - protein, 9 aa, Homo Sapiens
SVKPVSSSF

SEQ ID NO: 1160986 - protein, 9 aa, Homo Sapiens
FVANLDEND

SEQ ID NO: 1160987 - protein, 9 aa, Homo Sapiens
VCHSLLIQG

SEQ ID NO: 1160988 - protein, 9 aa, Homo Sapiens
SSKPTVHKV

SEQ ID NO: 1160989 - protein, 9 aa, Homo Sapiens
NESAPAGIT

SEQ ID NO: 1160990 - protein, 9 aa, Homo Sapiens
CVTLGSETQ

SEQ ID NO: 1160991 - protein, 9 aa, Homo Sapiens
EEEGQAYDK

SEQ ID NO: 1160992 - protein, 9 aa, Homo Sapiens
TIMDEHNQW

SEQ ID NO: 1160993 - protein, 9 aa, Homo Sapiens
PSVPEEYAP

SEQ ID NO: 1160994 - protein, 9 aa, Homo Sapiens
DKEEAALVA

SEQ ID NO: 1160995 - protein, 9 aa, Homo Sapiens
ELSTIMDEH

SEQ ID NO: 1160996 - protein, 9 aa, Homo Sapiens
AEAFPPLAQ

SEQ ID NO: 1160997 - protein, 9 aa, Homo Sapiens
KRYTIGQTL

SEQ ID NO: 1160998 - protein, 9 aa, Homo Sapiens
APTSPTLAM

SEQ ID NO: 1160999 - protein, 9 aa, Homo Sapiens
TVDAMVDLL

SEQ ID NO: 1161000 - protein, 9 aa, Homo Sapiens
LVEVDYNMV

SEQ ID NO: 1161001 - protein, 9 aa, Homo Sapiens
VHTTLELFA

SEQ ID NO: 1161002 - protein, 9 aa, Homo Sapiens
KPVSSSFGS

SEQ ID NO: 1161003 - protein, 9 aa, Homo Sapiens
YEDKVHVWQ

SEQ ID NO: 1161004 - protein, 9 aa, Homo Sapiens
LHLDMRGLG

SEQ ID NO: 1161005 - protein, 9 aa, Homo Sapiens
RYTIGQTLI

SEQ ID NO: 1161006 - protein, 9 aa, Homo Sapiens
RKSLHIPYR

SEQ ID NO: 1161007 - protein, 9 aa, Homo Sapiens
FIICVYYYV

SEQ ID NO: 1161008 - protein, 9 aa, Homo Sapiens
PVSDATPCT

SEQ ID NO: 1161009 - protein, 9 aa, Homo Sapiens
TSNKKFPER

SEQ ID NO: 1161010 - protein, 9 aa, Homo Sapiens
ELQVGGHGT

SEQ ID NO: 1161011 - protein, 9 aa, Homo Sapiens
YWLIQLDSV

SEQ ID NO: 1161012 - protein, 9 aa, Homo Sapiens
RLIEEIEYR

SEQ ID NO: 1161013 - protein, 9 aa, Homo Sapiens
MKAVATMGP

SEQ ID NO: 1161014 - protein, 9 aa, Homo Sapiens
SIRITPRKH

SEQ ID NO: 1161015 - protein, 9 aa, Homo Sapiens
DISEADVDH

SEQ ID NO: 1161016 - protein, 9 aa, Homo Sapiens
ISKTRTILE

SEQ ID NO: 1161017 - protein, 9 aa, Homo Sapiens
MEVSIPENA

SEQ ID NO: 1161018 - protein, 9 aa, Homo Sapiens
TGKTIFAVS

SEQ ID NO: 1161019 - protein, 9 aa, Homo Sapiens
RLLLHTPRN

SEQ ID NO: 1161020 - protein, 9 aa, Homo Sapiens
AKKINSRCG

SEQ ID NO: 1161021 - protein, 9 aa, Homo Sapiens
HITQWKGTV

SEQ ID NO: 1161022 - protein, 9 aa, Homo Sapiens
AEQNILPLV

SEQ ID NO: 1161023 - protein, 9 aa, Homo Sapiens
SLCLINQKR

SEQ ID NO: 1161024 - protein, 9 aa, Homo Sapiens
ASENYNHAI

SEQ ID NO: 1161025 - protein, 9 aa, Homo Sapiens
SALPVKVSL

SEQ ID NO: 1161026 - protein, 9 aa, Homo Sapiens
WTVHRGVQS

SEQ ID NO: 1161027 - protein, 9 aa, Homo Sapiens
RPGCRKLGT

SEQ ID NO: 1161028 - protein, 9 aa, Homo Sapiens
EKKTINISL

SEQ ID NO: 1161029 - protein, 9 aa, Homo Sapiens
VFYTIFTPI

SEQ ID NO: 1161030 - protein, 9 aa, Homo Sapiens
INDNIVFGT

SEQ ID NO: 1161031 - protein, 9 aa, Homo Sapiens
TPPRRRPSS

SEQ ID NO: 1161032 - protein, 9 aa, Homo Sapiens
SSQSKHHPA

SEQ ID NO: 1161033 - protein, 9 aa, Homo Sapiens
NLSQHSLVM

SEQ ID NO: 1161034 - protein, 9 aa, Homo Sapiens
KAPGPIYDV

SEQ ID NO: 1161035 - protein, 9 aa, Homo Sapiens
GKDTFARIQ

SEQ ID NO: 1161036 - protein, 9 aa, Homo Sapiens
ATEKTAEDK

SEQ ID NO: 1161037 - protein, 9 aa, Homo Sapiens
TGATADVSR

SEQ ID NO: 1161038 - protein, 9 aa, Homo Sapiens
LAWKHANIH

SEQ ID NO: 1161039 - protein, 9 aa, Homo Sapiens
ESSHDEFQD

SEQ ID NO: 1161040 - protein, 9 aa, Homo Sapiens
FLRAQRVFP

SEQ ID NO: 1161041 - protein, 9 aa, Homo Sapiens
GKKSLSAPA

SEQ ID NO: 1161042 - protein, 9 aa, Homo Sapiens
KSGTAATEK

SEQ ID NO: 1161043 - protein, 9 aa, Homo Sapiens
EEVEGQLKH

SEQ ID NO: 1161044 - protein, 9 aa, Homo Sapiens
YYSSSVKKS

SEQ ID NO: 1161045 - protein, 9 aa, Homo Sapiens
YLLKHDPCQ

SEQ ID NO: 1161046 - protein, 9 aa, Homo Sapiens
RVFPDVSSR

SEQ ID NO: 1161047 - protein, 9 aa, Homo Sapiens
QRGNLWVSL

SEQ ID NO: 1161048 - protein, 9 aa, Homo Sapiens
LDVHPPLGK

SEQ ID NO: 1161049 - protein, 9 aa, Homo Sapiens
QLSNKQTER

SEQ ID NO: 1161050 - protein, 9 aa, Homo Sapiens
FEDFEFANK

SEQ ID NO: 1161051 - protein, 9 aa, Homo Sapiens
LHIPYRDAK

SEQ ID NO: 1161052 - protein, 9 aa, Homo Sapiens
PVVECMDHT

SEQ ID NO: 1161053 - protein, 9 aa, Homo Sapiens
TRPGCRKLG

SEQ ID NO: 1161054 - protein, 9 aa, Homo Sapiens
LANRVQNSL

SEQ ID NO: 1161055 - protein, 9 aa, Homo Sapiens
LVLSSVCVT

SEQ ID NO: 1161056 - protein, 9 aa, Homo Sapiens
RVGWTVHRG

SEQ ID NO: 1161057 - protein, 9 aa, Homo Sapiens
CEGRDLSAW

SEQ ID NO: 1161058 - protein, 9 aa, Homo Sapiens
SSMNESAPA

SEQ ID NO: 1161059 - protein, 9 aa, Homo Sapiens
ANRVQNSLG

SEQ ID NO: 1161060 - protein, 9 aa, Homo Sapiens
IGPTLCPSC

SEQ ID NO: 1161061 - protein, 9 aa, Homo Sapiens
LTASTGIYR

SEQ ID NO: 1161062 - protein, 9 aa, Homo Sapiens
CENGMTGSA

SEQ ID NO: 1161063 - protein, 9 aa, Homo Sapiens
TLSPASTTC

SEQ ID NO: 1161064 - protein, 9 aa, Homo Sapiens
RMDPFAKKE

SEQ ID NO: 1161065 - protein, 9 aa, Homo Sapiens
LARKVHETV

SEQ ID NO: 1161066 - protein, 9 aa, Homo Sapiens
IDVNLPKCL

SEQ ID NO: 1161067 - protein, 9 aa, Homo Sapiens
VTSAPRRMC

SEQ ID NO: 1161068 - protein, 9 aa, Homo Sapiens
LFAGTEHHV

SEQ ID NO: 1161069 - protein, 9 aa, Homo Sapiens
GTKQHQCDT

SEQ ID NO: 1161070 - protein, 9 aa, Homo Sapiens
TWKKKYVIL

SEQ ID NO: 1161071 - protein, 9 aa, Homo Sapiens
PDAVKICNV

SEQ ID NO: 1161072 - protein, 9 aa, Homo Sapiens
PLEEPTIEP

SEQ ID NO: 1161073 - protein, 9 aa, Homo Sapiens
GKPKEKESF

SEQ ID NO: 1161074 - protein, 9 aa, Homo Sapiens
MDHTLTSLF

SEQ ID NO: 1161075 - protein, 9 aa, Homo Sapiens
GRCYRITWF

SEQ ID NO: 1161076 - protein, 9 aa, Homo Sapiens
VESTAKTFF

SEQ ID NO: 1161077 - protein, 9 aa, Homo Sapiens
QDICVKAHL

SEQ ID NO: 1161078 - protein, 9 aa, Homo Sapiens
INEAMAAAI

SEQ ID NO: 1161079 - protein, 9 aa, Homo Sapiens
TDGNMPYVL

SEQ ID NO: 1161080 - protein, 9 aa, Homo Sapiens
QVETVCSKP

SEQ ID NO: 1161081 - protein, 9 aa, Homo Sapiens
GDWRTTFTV

SEQ ID NO: 1161082 - protein, 9 aa, Homo Sapiens
RVVDKSWWT

SEQ ID NO: 1161083 - protein, 9 aa, Homo Sapiens
GVYLERMHF

SEQ ID NO: 1161084 - protein, 9 aa, Homo Sapiens
AWDCGRRAG

SEQ ID NO: 1161085 - protein, 9 aa, Homo Sapiens
HEQRLQLHG

SEQ ID NO: 1161086 - protein, 9 aa, Homo Sapiens
TWDPFASGK

SEQ ID NO: 1161087 - protein, 9 aa, Homo Sapiens
NVQPPASQH

SEQ ID NO: 1161088 - protein, 9 aa, Homo Sapiens
AVTDTKLRK

SEQ ID NO: 1161089 - protein, 9 aa, Homo Sapiens
EEILPCLSE

SEQ ID NO: 1161090 - protein, 9 aa, Homo Sapiens
LVYMGKPKE

SEQ ID NO: 1161091 - protein, 9 aa, Homo Sapiens
AKKCFSTLF

SEQ ID NO: 1161092 - protein, 9 aa, Homo Sapiens
EHEEAVRRA

SEQ ID NO: 1161093 - protein, 9 aa, Homo Sapiens
GDEVPQRSI

SEQ ID NO: 1161094 - protein, 9 aa, Homo Sapiens
GQSRFDTNI

SEQ ID NO: 1161095 - protein, 9 aa, Homo Sapiens
IFHEECSVV

SEQ ID NO: 1161096 - protein, 9 aa, Homo Sapiens
WNKDGLRLS

SEQ ID NO: 1161097 - protein, 9 aa, Homo Sapiens
TDFTVKELV

SEQ ID NO: 1161098 - protein, 9 aa, Homo Sapiens
PFAKKEHIE

SEQ ID NO: 1161099 - protein, 9 aa, Homo Sapiens
TAATEKTAE

SEQ ID NO: 1161100 - protein, 9 aa, Homo Sapiens
IQKNLRHLN

SEQ ID NO: 1161101 - protein, 9 aa, Homo Sapiens
RRKVRKTRR

SEQ ID NO: 1161102 - protein, 9 aa, Homo Sapiens
KHLNKYLYL

SEQ ID NO: 1161103 - protein, 9 aa, Homo Sapiens
TWNKDGLRL

SEQ ID NO: 1161104 - protein, 9 aa, Homo Sapiens
LLRLRRGFL

SEQ ID NO: 1161105 - protein, 9 aa, Homo Sapiens
AGWNLSFSV

SEQ ID NO: 1161106 - protein, 9 aa, Homo Sapiens
DAVKICNVC

SEQ ID NO: 1161107 - protein, 9 aa, Homo Sapiens
PRFDVTSDS

SEQ ID NO: 1161108 - protein, 9 aa, Homo Sapiens
VVRISHLYI

SEQ ID NO: 1161109 - protein, 9 aa, Homo Sapiens
EILPCLSEN

SEQ ID NO: 1161110 - protein, 9 aa, Homo Sapiens
NHPVVIGPS

SEQ ID NO: 1161111 - protein, 9 aa, Homo Sapiens
EIEDKRDSK

SEQ ID NO: 1161112 - protein, 9 aa, Homo Sapiens
YSWKSVGSQ

SEQ ID NO: 1161113 - protein, 9 aa, Homo Sapiens
LKLEEEDPG

SEQ ID NO: 1161114 - protein, 9 aa, Homo Sapiens
NILPLVDEA

SEQ ID NO: 1161115 - protein, 9 aa, Homo Sapiens
KPTVHKVIH

SEQ ID NO: 1161116 - protein, 9 aa, Homo Sapiens
DEVPQRSIA

SEQ ID NO: 1161117 - protein, 9 aa, Homo Sapiens
LTYWDLQCI

SEQ ID NO: 1161118 - protein, 9 aa, Homo Sapiens
ITPRKHTAG

SEQ ID NO: 1161119 - protein, 9 aa, Homo Sapiens
YRIGEKRDS

SEQ ID NO: 1161120 - protein, 9 aa, Homo Sapiens
VASGSFDKC

SEQ ID NO: 1161121 - protein, 9 aa, Homo Sapiens
IDLRSCTGV

SEQ ID NO: 1161122 - protein, 9 aa, Homo Sapiens
IGPFPLPDS

SEQ ID NO: 1161123 - protein, 9 aa, Homo Sapiens
FNPHHFWQW

SEQ ID NO: 1161124 - protein, 9 aa, Homo Sapiens
VDAGGEPHA

SEQ ID NO: 1161125 - protein, 9 aa, Homo Sapiens
VNLHLKISC

SEQ ID NO: 1161126 - protein, 9 aa, Homo Sapiens
RKLGTVSFA

SEQ ID NO: 1161127 - protein, 9 aa, Homo Sapiens
EDYVPQKAK

SEQ ID NO: 1161128 - protein, 9 aa, Homo Sapiens
DPGQNAWLS

SEQ ID NO: 1161129 - protein, 9 aa, Homo Sapiens
AYRGNNDHN

SEQ ID NO: 1161130 - protein, 9 aa, Homo Sapiens
DLAWKHANI

SEQ ID NO: 1161131 - protein, 9 aa, Homo Sapiens
ILCSNGVLT

SEQ ID NO: 1161132 - protein, 9 aa, Homo Sapiens
GDEHITQWK

SEQ ID NO: 1161133 - protein, 9 aa, Homo Sapiens
HSLVMKWNS

SEQ ID NO: 1161134 - protein, 9 aa, Homo Sapiens
RPYSQATEA

SEQ ID NO: 1161135 - protein, 9 aa, Homo Sapiens
APNEMTNMQ

SEQ ID NO: 1161136 - protein, 9 aa, Homo Sapiens
SSALPVKVS

SEQ ID NO: 1161137 - protein, 9 aa, Homo Sapiens
YVCAECGRA

SEQ ID NO: 1161138 - protein, 9 aa, Homo Sapiens
AHWGQQQIH

SEQ ID NO: 1161139 - protein, 9 aa, Homo Sapiens
YDEVVAEGY

SEQ ID NO: 1161140 - protein, 9 aa, Homo Sapiens
FEAIAPNAF

SEQ ID NO: 1161141 - protein, 9 aa, Homo Sapiens
AVKMIKRTM

SEQ ID NO: 1161142 - protein, 9 aa, Homo Sapiens
PPNPSESLG

SEQ ID NO: 1161143 - protein, 9 aa, Homo Sapiens
IVESTAKTF

SEQ ID NO: 1161144 - protein, 9 aa, Homo Sapiens
TIEPPVNLT

SEQ ID NO: 1161145 - protein, 9 aa, Homo Sapiens
IDYMGKDTF

SEQ ID NO: 1161146 - protein, 9 aa, Homo Sapiens
CFSVCLFRR

SEQ ID NO: 1161147 - protein, 9 aa, Homo Sapiens
RVSLNVSLG

SEQ ID NO: 1161148 - protein, 9 aa, Homo Sapiens
WSSKPTVHK

SEQ ID NO: 1161149 - protein, 9 aa, Homo Sapiens
QAPQAQPPQ

SEQ ID NO: 1161150 - protein, 9 aa, Homo Sapiens
IQRQAKKCF

SEQ ID NO: 1161151 - protein, 9 aa, Homo Sapiens
PKCVNTKVV

SEQ ID NO: 1161152 - protein, 9 aa, Homo Sapiens
PGAREEHSC

SEQ ID NO: 1161153 - protein, 9 aa, Homo Sapiens
KEHEEAVRR

SEQ ID NO: 1161154 - protein, 9 aa, Homo Sapiens
RNAGPAASR

SEQ ID NO: 1161155 - protein, 9 aa, Homo Sapiens
FLGENHQDV

SEQ ID NO: 1161156 - protein, 9 aa, Homo Sapiens
NLKPWLVEV

SEQ ID NO: 1161157 - protein, 9 aa, Homo Sapiens
GKYVASGSF

SEQ ID NO: 1161158 - protein, 9 aa, Homo Sapiens
LSPASTTCS

SEQ ID NO: 1161159 - protein, 9 aa, Homo Sapiens
PAPKSSTSD

SEQ ID NO: 1161160 - protein, 9 aa, Homo Sapiens
ERPAPKSST

SEQ ID NO: 1161161 - protein, 9 aa, Homo Sapiens
NVKHMRQLR

SEQ ID NO: 1161162 - protein, 9 aa, Homo Sapiens
QIRQIVQSI

SEQ ID NO: 1161163 - protein, 9 aa, Homo Sapiens
HEECSVVTE

SEQ ID NO: 1161164 - protein, 9 aa, Homo Sapiens
KRNVQPPAS

SEQ ID NO: 1161165 - protein, 9 aa, Homo Sapiens
EWSFMNSNL

SEQ ID NO: 1161166 - protein, 9 aa, Homo Sapiens
TEMEVSIPE

SEQ ID NO: 1161167 - protein, 9 aa, Homo Sapiens
CQMLQISRV

SEQ ID NO: 1161168 - protein, 9 aa, Homo Sapiens
VITTLKLEE

SEQ ID NO: 1161169 - protein, 9 aa, Homo Sapiens
GCMTRLFFV

SEQ ID NO: 1161170 - protein, 9 aa, Homo Sapiens
MRRILARHQ

SEQ ID NO: 1161171 - protein, 9 aa, Homo Sapiens
DGKYVASGS

SEQ ID NO: 1161172 - protein, 9 aa, Homo Sapiens
LAEAFPPLA

SEQ ID NO: 1161173 - protein, 9 aa, Homo Sapiens
SRPASLDSA

SEQ ID NO: 1161174 - protein, 9 aa, Homo Sapiens
SQHSLVMKW

SEQ ID NO: 1161175 - protein, 9 aa, Homo Sapiens
SVYGSGGGT

SEQ ID NO: 1161176 - protein, 9 aa, Homo Sapiens
SNIANSNEQ

SEQ ID NO: 1161177 - protein, 9 aa, Homo Sapiens
TRRSPYRMR

SEQ ID NO: 1161178 - protein, 9 aa, Homo Sapiens
GWIFAKKIN

SEQ ID NO: 1161179 - protein, 9 aa, Homo Sapiens
FTPILNPII

SEQ ID NO: 1161180 - protein, 9 aa, Homo Sapiens
ISKGGVYLE

SEQ ID NO: 1161181 - protein, 9 aa, Homo Sapiens
GQPKHLEEV

SEQ ID NO: 1161182 - protein, 9 aa, Homo Sapiens
GEEVWNPQK

SEQ ID NO: 1161183 - protein, 9 aa, Homo Sapiens
FQLHLSEPQ

SEQ ID NO: 1161184 - protein, 9 aa, Homo Sapiens
RERLIQTLQ

SEQ ID NO: 1161185 - protein, 9 aa, Homo Sapiens
TFVLTLPLW

SEQ ID NO: 1161186 - protein, 9 aa, Homo Sapiens
PNAFVMRAQ

SEQ ID NO: 1161187 - protein, 9 aa, Homo Sapiens
QLERFRFAI

SEQ ID NO: 1161188 - protein, 9 aa, Homo Sapiens
RSEDNSEDD

SEQ ID NO: 1161189 - protein, 9 aa, Homo Sapiens
DVDHPDLFQ

SEQ ID NO: 1161190 - protein, 9 aa, Homo Sapiens
LASSTTISN

SEQ ID NO: 1161191 - protein, 9 aa, Homo Sapiens
DRSYQIDTV

SEQ ID NO: 1161192 - protein, 9 aa, Homo Sapiens
EILYVNMDD

SEQ ID NO: 1161193 - protein, 9 aa, Homo Sapiens
SVRKLTKIA

SEQ ID NO: 1161194 - protein, 9 aa, Homo Sapiens
WSFMNSNLK

SEQ ID NO: 1161195 - protein, 9 aa, Homo Sapiens
QGAFVHNEN

SEQ ID NO: 1161196 - protein, 9 aa, Homo Sapiens
TCGSHFIHI

SEQ ID NO: 1161197 - protein, 9 aa, Homo Sapiens
KVDDTGKTI

SEQ ID NO: 1161198 - protein, 9 aa, Homo Sapiens
SGDEVPQRS

SEQ ID NO: 1161199 - protein, 9 aa, Homo Sapiens
SFHSKQELR

SEQ ID NO: 1161200 - protein, 9 aa, Homo Sapiens
LRHLNYVWI

SEQ ID NO: 1161201 - protein, 9 aa, Homo Sapiens
PSNSNLPKI

SEQ ID NO: 1161202 - protein, 9 aa, Homo Sapiens
DHKLEYLEI

SEQ ID NO: 1161203 - protein, 9 aa, Homo Sapiens
ESFVTLSSP

SEQ ID NO: 1161204 - protein, 9 aa, Homo Sapiens
VSDAYKGLF

SEQ ID NO: 1161205 - protein, 9 aa, Homo Sapiens
RKASTEMGL

SEQ ID NO: 1161206 - protein, 9 aa, Homo Sapiens
CYRITWFTS

SEQ ID NO: 1161207 - protein, 9 aa, Homo Sapiens
LRSKMGTCC

SEQ ID NO: 1161208 - protein, 9 aa, Homo Sapiens
ALLLQQLKE

SEQ ID NO: 1161209 - protein, 9 aa, Homo Sapiens
MDEHNQWYC

SEQ ID NO: 1161210 - protein, 9 aa, Homo Sapiens
DTFARIQEK

SEQ ID NO: 1161211 - protein, 9 aa, Homo Sapiens
SSRLPVFIV

SEQ ID NO: 1161212 - protein, 9 aa, Homo Sapiens
HTTLELFAL

SEQ ID NO: 1161213 - protein, 9 aa, Homo Sapiens
LYYSSSVKK

SEQ ID NO: 1161214 - protein, 9 aa, Homo Sapiens
ESPEILEAS

SEQ ID NO: 1161215 - protein, 9 aa, Homo Sapiens
YDKSLLPSR

SEQ ID NO: 1161216 - protein, 9 aa, Homo Sapiens
TNGLFSTLV

SEQ ID NO: 1161217 - protein, 9 aa, Homo Sapiens
DSQYSWKSV

SEQ ID NO: 1161218 - protein, 9 aa, Homo Sapiens
MVAFQPTHL

SEQ ID NO: 1161219 - protein, 9 aa, Homo Sapiens
PAATGVTAT

SEQ ID NO: 1161220 - protein, 9 aa, Homo Sapiens
TQGFWEHSM

SEQ ID NO: 1161221 - protein, 9 aa, Homo Sapiens
KIEDISNTV

SEQ ID NO: 1161222 - protein, 9 aa, Homo Sapiens
RIHTMESFV

SEQ ID NO: 1161223 - protein, 9 aa, Homo Sapiens
AHFERRWVL

SEQ ID NO: 1161224 - protein, 9 aa, Homo Sapiens
RRHIRQMQL

SEQ ID NO: 1161225 - protein, 9 aa, Homo Sapiens
VEGQLKHLV

SEQ ID NO: 1161226 - protein, 9 aa, Homo Sapiens
SKPTVHKVI

SEQ ID NO: 1161227 - protein, 9 aa, Homo Sapiens
SGNNLPTLQ

SEQ ID NO: 1161228 - protein, 9 aa, Homo Sapiens
MRSSSQHCT

SEQ ID NO: 1161229 - protein, 9 aa, Homo Sapiens
AHTNGLFST

SEQ ID NO: 1161230 - protein, 9 aa, Homo Sapiens
SFEVHVCAC

SEQ ID NO: 1161231 - protein, 9 aa, Homo Sapiens
KSASENYNH

SEQ ID NO: 1161232 - protein, 9 aa, Homo Sapiens
TSLNFRSAS

SEQ ID NO: 1161233 - protein, 9 aa, Homo Sapiens
NRALRYLET

SEQ ID NO: 1161234 - protein, 9 aa, Homo Sapiens
DPCQMLQIS

SEQ ID NO: 1161235 - protein, 9 aa, Homo Sapiens
VEVNYSPAL

SEQ ID NO: 1161236 - protein, 9 aa, Homo Sapiens
QLLEWSFMN

SEQ ID NO: 1161237 - protein, 9 aa, Homo Sapiens
TSGIMSNAK

SEQ ID NO: 1161238 - protein, 9 aa, Homo Sapiens
ILEASQFVE

SEQ ID NO: 1161239 - protein, 9 aa, Homo Sapiens
LDLKDLFQL

SEQ ID NO: 1161240 - protein, 9 aa, Homo Sapiens
DDTWDPFAS

SEQ ID NO: 1161241 - protein, 9 aa, Homo Sapiens
ESTELVYNK

SEQ ID NO: 1161242 - protein, 9 aa, Homo Sapiens
NWGFSGDEV

SEQ ID NO: 1161243 - protein, 9 aa, Homo Sapiens
TTSFIDKGQ

SEQ ID NO: 1161244 - protein, 9 aa, Homo Sapiens
FIGFKEKPQ

SEQ ID NO: 1161245 - protein, 9 aa, Homo Sapiens
FGGQGNRFS

SEQ ID NO: 1161246 - protein, 9 aa, Homo Sapiens
KHLEEVEGQ

SEQ ID NO: 1161247 - protein, 9 aa, Homo Sapiens
LSFSVFIIC

SEQ ID NO: 1161248 - protein, 9 aa, Homo Sapiens
CDAVYQGPV

SEQ ID NO: 1161249 - protein, 9 aa, Homo Sapiens
HFSSSELKV

SEQ ID NO: 1161250 - protein, 9 aa, Homo Sapiens
RTWNKDGLR

SEQ ID NO: 1161251 - protein, 9 aa, Homo Sapiens
TFLGENHQD

SEQ ID NO: 1161252 - protein, 9 aa, Homo Sapiens
SSVTAVPRA

SEQ ID NO: 1161253 - protein, 9 aa, Homo Sapiens
KICNVCHSL

SEQ ID NO: 1161254 - protein, 9 aa, Homo Sapiens
RHAEQQASQ

SEQ ID NO: 1161255 - protein, 9 aa, Homo Sapiens
APCRVSLNV

SEQ ID NO: 1161256 - protein, 9 aa, Homo Sapiens
TTGEEVWNP

SEQ ID NO: 1161257 - protein, 9 aa, Homo Sapiens
ERFRFAIIL

SEQ ID NO: 1161258 - protein, 9 aa, Homo Sapiens
KLGTVSFAD

SEQ ID NO: 1161259 - protein, 9 aa, Homo Sapiens
DAVYQGPVS

SEQ ID NO: 1161260 - protein, 9 aa, Homo Sapiens
EEFDLEDDF

SEQ ID NO: 1161261 - protein, 9 aa, Homo Sapiens
CDYKFNDES

SEQ ID NO: 1161262 - protein, 9 aa, Homo Sapiens
RPDFRTNKG

SEQ ID NO: 1161263 - protein, 9 aa, Homo Sapiens
KDLAWKHAN

SEQ ID NO: 1161264 - protein, 9 aa, Homo Sapiens
PYRMRRILA

SEQ ID NO: 1161265 - protein, 9 aa, Homo Sapiens
HSKVSLKVS

SEQ ID NO: 1161266 - protein, 9 aa, Homo Sapiens
LVIPYLYLN

SEQ ID NO: 1161267 - protein, 9 aa, Homo Sapiens
PYVLCDDEQ

SEQ ID NO: 1161268 - protein, 9 aa, Homo Sapiens
ILPCLSENI

SEQ ID NO: 1161269 - protein, 9 aa, Homo Sapiens
QKLVYMGKP

SEQ ID NO: 1161270 - protein, 9 aa, Homo Sapiens
LKPWLVEVN

SEQ ID NO: 1161271 - protein, 9 aa, Homo Sapiens
SEVLADGEK

SEQ ID NO: 1161272 - protein, 9 aa, Homo Sapiens
GWKEGDEHI

SEQ ID NO: 1161273 - protein, 9 aa, Homo Sapiens
QNKVLSLSV

SEQ ID NO: 1161274 - protein, 9 aa, Homo Sapiens
PSSALPVKV

SEQ ID NO: 1161275 - protein, 9 aa, Homo Sapiens
WRTPAVPRS

SEQ ID NO: 1161276 - protein, 9 aa, Homo Sapiens
GSPRGDSQY

SEQ ID NO: 1161277 - protein, 9 aa, Homo Sapiens
QLHLSEPQL

SEQ ID NO: 1161278 - protein, 9 aa, Homo Sapiens
MIKRTMHNW

SEQ ID NO: 1161279 - protein, 9 aa, Homo Sapiens
KRDSLGVKY

SEQ ID NO: 1161280 - protein, 9 aa, Homo Sapiens
LQQLKENIQ

SEQ ID NO: 1161281 - protein, 9 aa, Homo Sapiens
GPTLCPSCG

SEQ ID NO: 1161282 - protein, 9 aa, Homo Sapiens
EEVSTLCKD

SEQ ID NO: 1161283 - protein, 9 aa, Homo Sapiens
DVSRTEVTS

SEQ ID NO: 1161284 - protein, 9 aa, Homo Sapiens
QSRFDTNIN

SEQ ID NO: 1161285 - protein, 9 aa, Homo Sapiens
RRYDKCGHV

SEQ ID NO: 1161286 - protein, 9 aa, Homo Sapiens
RTAAQNSRP

SEQ ID NO: 1161287 - protein, 9 aa, Homo Sapiens
IHILFFTTV

SEQ ID NO: 1161288 - protein, 9 aa, Homo Sapiens
DCGRRAGPQ

SEQ ID NO: 1161289 - protein, 9 aa, Homo Sapiens
ETRPGCRKL

SEQ ID NO: 1161290 - protein, 9 aa, Homo Sapiens
KIEEQLRHA

SEQ ID NO: 1161291 - protein, 9 aa, Homo Sapiens
RGSSQSKHH

SEQ ID NO: 1161292 - protein, 9 aa, Homo Sapiens
AQPAQAPQA

SEQ ID NO: 1161293 - protein, 9 aa, Homo Sapiens
FFLVLFSSP

SEQ ID NO: 1161294 - protein, 9 aa, Homo Sapiens
ADVDHPDLF

SEQ ID NO: 1161295 - protein, 9 aa, Homo Sapiens
CLPAATGVT

SEQ ID NO: 1161296 - protein, 9 aa, Homo Sapiens
DPRRKSLHI

SEQ ID NO: 1161297 - protein, 9 aa, Homo Sapiens
IQTLQEFKE

SEQ ID NO: 1161298 - protein, 9 aa, Homo Sapiens
AATEKTAED

SEQ ID NO: 1161299 - protein, 9 aa, Homo Sapiens
KTDKILTNV

SEQ ID NO: 1161300 - protein, 9 aa, Homo Sapiens
KLLRLRRGF

SEQ ID NO: 1161301 - protein, 9 aa, Homo Sapiens
ACQEHCGCY

SEQ ID NO: 1161302 - protein, 9 aa, Homo Sapiens
VFIVQTASY

SEQ ID NO: 1161303 - protein, 9 aa, Homo Sapiens
TVAQSYSLE

SEQ ID NO: 1161304 - protein, 9 aa, Homo Sapiens
ANIHLSAPC

SEQ ID NO: 1161305 - protein, 9 aa, Homo Sapiens
CTVLIHVRL

SEQ ID NO: 1161306 - protein, 9 aa, Homo Sapiens
KLTILAACQ

SEQ ID NO: 1161307 - protein, 9 aa, Homo Sapiens
AFVHNENGF

SEQ ID NO: 1161308 - protein, 9 aa, Homo Sapiens
GRDLSAWKK

SEQ ID NO: 1161309 - protein, 9 aa, Homo Sapiens
RLPVFIVQT

SEQ ID NO: 1161310 - protein, 9 aa, Homo Sapiens
IATTGEEVW

SEQ ID NO: 1161311 - protein, 9 aa, Homo Sapiens
VMKWNSPPY

SEQ ID NO: 1161312 - protein, 9 aa, Homo Sapiens
ALTYWDLQC

SEQ ID NO: 1161313 - protein, 9 aa, Homo Sapiens
EIFYGLDVT

SEQ ID NO: 1161314 - protein, 9 aa, Homo Sapiens
DKCGHVNLH

SEQ ID NO: 1161315 - protein, 9 aa, Homo Sapiens
RRGVRGGPG

SEQ ID NO: 1161316 - protein, 9 aa, Homo Sapiens
TLDSGIGPF

SEQ ID NO: 1161317 - protein, 9 aa, Homo Sapiens
SHFIHILFF

SEQ ID NO: 1161318 - protein, 9 aa, Homo Sapiens
ILLLFTIGF

SEQ ID NO: 1161319 - protein, 9 aa, Homo Sapiens
VHETVRRIT

SEQ ID NO: 1161320 - protein, 9 aa, Homo Sapiens
LLEEKVNDQ

SEQ ID NO: 1161321 - protein, 9 aa, Homo Sapiens
SRRYRFENS

SEQ ID NO: 1161322 - protein, 9 aa, Homo Sapiens
RYDKCGHVN

SEQ ID NO: 1161323 - protein, 9 aa, Homo Sapiens
LFKTDKILT

SEQ ID NO: 1161324 - protein, 9 aa, Homo Sapiens
WWRLCKTCY

SEQ ID NO: 1161325 - protein, 9 aa, Homo Sapiens
GVPTGATAD

SEQ ID NO: 1161326 - protein, 9 aa, Homo Sapiens
DLTFVLTLP

SEQ ID NO: 1161327 - protein, 9 aa, Homo Sapiens
PAEYSGPEK

SEQ ID NO: 1161328 - protein, 9 aa, Homo Sapiens
SSRGSSQSK

SEQ ID NO: 1161329 - protein, 9 aa, Homo Sapiens
TYWDLQCII

SEQ ID NO: 1161330 - protein, 9 aa, Homo Sapiens
TRLFFVLFF

SEQ ID NO: 1161331 - protein, 9 aa, Homo Sapiens
YLKIMGKIV

SEQ ID NO: 1161332 - protein, 9 aa, Homo Sapiens
TPAVPRSSR

SEQ ID NO: 1161333 - protein, 9 aa, Homo Sapiens
TIFTPILNP

SEQ ID NO: 1161334 - protein, 9 aa, Homo Sapiens
NAVKMIKRT

SEQ ID NO: 1161335 - protein, 9 aa, Homo Sapiens
GSGGGTGGH

SEQ ID NO: 1161336 - protein, 9 aa, Homo Sapiens
RAQRVFPDV

SEQ ID NO: 1161337 - protein, 9 aa, Homo Sapiens
SRKASTEMG

SEQ ID NO: 1161338 - protein, 9 aa, Homo Sapiens
PHSPENELK

SEQ ID NO: 1161339 - protein, 9 aa, Homo Sapiens
IPYLYLNAG

SEQ ID NO: 1161340 - protein, 9 aa, Homo Sapiens
SLGNYDEMK

SEQ ID NO: 1161341 - protein, 9 aa, Homo Sapiens
PLPTVATPP

SEQ ID NO: 1161342 - protein, 9 aa, Homo Sapiens
LIFHEECSV

SEQ ID NO: 1161343 - protein, 9 aa, Homo Sapiens
NLLLKLPMP

SEQ ID NO: 1161344 - protein, 9 aa, Homo Sapiens
VVKPSISET

SEQ ID NO: 1161345 - protein, 9 aa, Homo Sapiens
LSVHYSPQL

SEQ ID NO: 1161346 - protein, 9 aa, Homo Sapiens
VTSDSAVSI

SEQ ID NO: 1161347 - protein, 9 aa, Homo Sapiens
SPGHHVYPN

SEQ ID NO: 1161348 - protein, 9 aa, Homo Sapiens
DRPPVAVTD

SEQ ID NO: 1161349 - protein, 9 aa, Homo Sapiens
EHITQWKGT

SEQ ID NO: 1161350 - protein, 9 aa, Homo Sapiens
SASVSRRYR

SEQ ID NO: 1161351 - protein, 9 aa, Homo Sapiens
CAPNEMTNM

SEQ ID NO: 1161352 - protein, 9 aa, Homo Sapiens
FKEKPQDVD

SEQ ID NO: 1161353 - protein, 9 aa, Homo Sapiens
KLEEEDPGP

SEQ ID NO: 1161354 - protein, 9 aa, Homo Sapiens
IFYGLDVTN

SEQ ID NO: 1161355 - protein, 9 aa, Homo Sapiens
STSDHISTR

SEQ ID NO: 1161356 - protein, 9 aa, Homo Sapiens
LDFNPHHFW

SEQ ID NO: 1161357 - protein, 9 aa, Homo Sapiens
EPDQIGPLR

SEQ ID NO: 1161358 - protein, 9 aa, Homo Sapiens
MNESAPAGI

SEQ ID NO: 1161359 - protein, 9 aa, Homo Sapiens
VASYWLIQL

SEQ ID NO: 1161360 - protein, 9 aa, Homo Sapiens
QYMPTDSQY

SEQ ID NO: 1161361 - protein, 9 aa, Homo Sapiens
VLSSVCVTL

SEQ ID NO: 1161362 - protein, 9 aa, Homo Sapiens
VPNLLAHTN

SEQ ID NO: 1161363 - protein, 9 aa, Homo Sapiens
EKVPHSPEN

SEQ ID NO: 1161364 - protein, 9 aa, Homo Sapiens
AVRRAFQLP

SEQ ID NO: 1161365 - protein, 9 aa, Homo Sapiens
TDTKLRKKA

SEQ ID NO: 1161366 - protein, 9 aa, Homo Sapiens
DTSLISKTR

SEQ ID NO: 1161367 - protein, 9 aa, Homo Sapiens
TAAQNSRPS

SEQ ID NO: 1161368 - protein, 9 aa, Homo Sapiens
KYVILCSNG

SEQ ID NO: 1161369 - protein, 9 aa, Homo Sapiens
GRGFCVNAS

SEQ ID NO: 1161370 - protein, 9 aa, Homo Sapiens
SRRASRKTY

SEQ ID NO: 1161371 - protein, 9 aa, Homo Sapiens
DYVPQKAKR

SEQ ID NO: 1161372 - protein, 9 aa, Homo Sapiens
EHAKIEEQL

SEQ ID NO: 1161373 - protein, 9 aa, Homo Sapiens
NRTFFLDVH

SEQ ID NO: 1161374 - protein, 9 aa, Homo Sapiens
AADDTWDPF

SEQ ID NO: 1161375 - protein, 9 aa, Homo Sapiens
CFEAIAPNA

SEQ ID NO: 1161376 - protein, 9 aa, Homo Sapiens
VQRAICWSN

SEQ ID NO: 1161377 - protein, 9 aa, Homo Sapiens
QMGGRRGVR

SEQ ID NO: 1161378 - protein, 9 aa, Homo Sapiens
RNSFEVHVC

SEQ ID NO: 1161379 - protein, 9 aa, Homo Sapiens
PMLVASYVI

SEQ ID NO: 1161380 - protein, 9 aa, Homo Sapiens
AEQQASQPP

SEQ ID NO: 1161381 - protein, 9 aa, Homo Sapiens
KKFHYFVDS

SEQ ID NO: 1161382 - protein, 9 aa, Homo Sapiens
TVHRGVQSL

SEQ ID NO: 1161383 - protein, 9 aa, Homo Sapiens
MAGDWRTTF

SEQ ID NO: 1161384 - protein, 9 aa, Homo Sapiens
PQGAFVHNE

SEQ ID NO: 1161385 - protein, 9 aa, Homo Sapiens
SEDNSEDDF

SEQ ID NO: 1161386 - protein, 9 aa, Homo Sapiens
DDISEADVD

SEQ ID NO: 1161387 - protein, 9 aa, Homo Sapiens
YSIRITPRK

SEQ ID NO: 1161388 - protein, 9 aa, Homo Sapiens
KHDPCQMLQ

SEQ ID NO: 1161389 - protein, 9 aa, Homo Sapiens
KNLKSSLCL

SEQ ID NO: 1161390 - protein, 9 aa, Homo Sapiens
SLKVSNSSK

SEQ ID NO: 1161391 - protein, 9 aa, Homo Sapiens
GGQSRFDTN

SEQ ID NO: 1161392 - protein, 9 aa, Homo Sapiens
RSIATKVTS

SEQ ID NO: 1161393 - protein, 9 aa, Homo Sapiens
IEEQLRHAK

SEQ ID NO: 1161394 - protein, 9 aa, Homo Sapiens
VSNSSKFQV

SEQ ID NO: 1161395 - protein, 9 aa, Homo Sapiens
FAGTEHHVS

SEQ ID NO: 1161396 - protein, 9 aa, Homo Sapiens
PSLQRTQAG

SEQ ID NO: 1161397 - protein, 9 aa, Homo Sapiens
LAHTNGLFS

SEQ ID NO: 1161398 - protein, 9 aa, Homo Sapiens
SNTVDAMVD

SEQ ID NO: 1161399 - protein, 9 aa, Homo Sapiens
NGITFLGEN

SEQ ID NO: 1161400 - protein, 9 aa, Homo Sapiens
FPDVSSRGS

SEQ ID NO: 1161401 - protein, 9 aa, Homo Sapiens
VHRGVQSLW

SEQ ID NO: 1161402 - protein, 9 aa, Homo Sapiens
PNLLAHTNG

SEQ ID NO: 1161403 - protein, 9 aa, Homo Sapiens
FSAREKRNV

SEQ ID NO: 1161404 - protein, 9 aa, Homo Sapiens
HLSEPQLFQ

SEQ ID NO: 1161405 - protein, 9 aa, Homo Sapiens
TDKILTNVN

SEQ ID NO: 1161406 - protein, 9 aa, Homo Sapiens
STSPSSALP

SEQ ID NO: 1161407 - protein, 9 aa, Homo Sapiens
ASQFVETAE

SEQ ID NO: 1161408 - protein, 9 aa, Homo Sapiens
SYEDFVNFT

SEQ ID NO: 1161409 - protein, 9 aa, Homo Sapiens
REKMHPKHQ

SEQ ID NO: 1161410 - protein, 9 aa, Homo Sapiens
VQNSLGNYD

SEQ ID NO: 1161411 - protein, 9 aa, Homo Sapiens
SSTSPSSAL

SEQ ID NO: 1161412 - protein, 9 aa, Homo Sapiens
SRVVDKSWW

SEQ ID NO: 1161413 - protein, 9 aa, Homo Sapiens
AKSPVVSDV

SEQ ID NO: 1161414 - protein, 9 aa, Homo Sapiens
ISNTVDAMV

SEQ ID NO: 1161415 - protein, 9 aa, Homo Sapiens
DVPWDTMLP

SEQ ID NO: 1161416 - protein, 9 aa, Homo Sapiens
KVSLKVSRH

SEQ ID NO: 1161417 - protein, 9 aa, Homo Sapiens
GKTIFAVSG

SEQ ID NO: 1161418 - protein, 9 aa, Homo Sapiens
PTLQNKVLS

SEQ ID NO: 1161419 - protein, 9 aa, Homo Sapiens
PGGLCFSVC

SEQ ID NO: 1161420 - protein, 9 aa, Homo Sapiens
ELAEAFPPL

SEQ ID NO: 1161421 - protein, 9 aa, Homo Sapiens
GRLLHLDMR

SEQ ID NO: 1161422 - protein, 9 aa, Homo Sapiens
ADVSRTEVT

SEQ ID NO: 1161423 - protein, 9 aa, Homo Sapiens
KGMAGDWRT

SEQ ID NO: 1161424 - protein, 9 aa, Homo Sapiens
NGTLFVSDA

SEQ ID NO: 1161425 - protein, 9 aa, Homo Sapiens
WDTMLPPKL

SEQ ID NO: 1161426 - protein, 9 aa, Homo Sapiens
AEELAEAFP

SEQ ID NO: 1161427 - protein, 9 aa, Homo Sapiens
CLSHDLPLF

SEQ ID NO: 1161428 - protein, 9 aa, Homo Sapiens
ITDFTVKEL

SEQ ID NO: 1161429 - protein, 9 aa, Homo Sapiens
SVSRRYRFE

SEQ ID NO: 1161430 - protein, 9 aa, Homo Sapiens
NRNNVVPRI

SEQ ID NO: 1161431 - protein, 9 aa, Homo Sapiens
NSPFFLVLF

SEQ ID NO: 1161432 - protein, 9 aa, Homo Sapiens
SKTRTILEA

SEQ ID NO: 1161433 - protein, 9 aa, Homo Sapiens
SAPAGITDH

SEQ ID NO: 1161434 - protein, 9 aa, Homo Sapiens
LGIYVHTTL

SEQ ID NO: 1161435 - protein, 9 aa, Homo Sapiens
KINSRCGSQ

SEQ ID NO: 1161436 - protein, 9 aa, Homo Sapiens
TISRVVDKS

SEQ ID NO: 1161437 - protein, 9 aa, Homo Sapiens
EDKVHVWQL

SEQ ID NO: 1161438 - protein, 9 aa, Homo Sapiens
QYGIIRLLP

SEQ ID NO: 1161439 - protein, 9 aa, Homo Sapiens
QRPYSQATE

SEQ ID NO: 1161440 - protein, 9 aa, Homo Sapiens
NGESSRLPV

SEQ ID NO: 1161441 - protein, 9 aa, Homo Sapiens
KTELQVGGH

SEQ ID NO: 1161442 - protein, 9 aa, Homo Sapiens
ETTEKKTIN

SEQ ID NO: 1161443 - protein, 9 aa, Homo Sapiens
LYWSVKPVS

SEQ ID NO: 1161444 - protein, 9 aa, Homo Sapiens
QTERIQKDM

SEQ ID NO: 1161445 - protein, 9 aa, Homo Sapiens
GTVEEILPC

SEQ ID NO: 1161446 - protein, 9 aa, Homo Sapiens
KKKFHYFVD

SEQ ID NO: 1161447 - protein, 9 aa, Homo Sapiens
LEEEGQAYD

SEQ ID NO: 1161448 - protein, 9 aa, Homo Sapiens
YNMVAFQPT

SEQ ID NO: 1161449 - protein, 9 aa, Homo Sapiens
AKTFFTVDS

SEQ ID NO: 1161450 - protein, 9 aa, Homo Sapiens
ETEMEVSIP

SEQ ID NO: 1161451 - protein, 9 aa, Homo Sapiens
ITFLGENHQ

SEQ ID NO: 1161452 - protein, 9 aa, Homo Sapiens
QIPRFVHGA

SEQ ID NO: 1161453 - protein, 9 aa, Homo Sapiens
AVRTLQKCE

SEQ ID NO: 1161454 - protein, 9 aa, Homo Sapiens
LLPKHRFSS

SEQ ID NO: 1161455 - protein, 9 aa, Homo Sapiens
VFHEVDIGS

SEQ ID NO: 1161456 - protein, 9 aa, Homo Sapiens
VLIHVRLSG

SEQ ID NO: 1161457 - protein, 9 aa, Homo Sapiens
KEEENRALR

SEQ ID NO: 1161458 - protein, 9 aa, Homo Sapiens
HEVDIGSVL

SEQ ID NO: 1161459 - protein, 9 aa, Homo Sapiens
YMGKDTFAR

SEQ ID NO: 1161460 - protein, 9 aa, Homo Sapiens
AYEDVPWDT

SEQ ID NO: 1161461 - protein, 9 aa, Homo Sapiens
FKFHQMKHS

SEQ ID NO: 1161462 - protein, 9 aa, Homo Sapiens
GVGSMQDEL

SEQ ID NO: 1161463 - protein, 9 aa, Homo Sapiens
FASARLFFV

SEQ ID NO: 1161464 - protein, 9 aa, Homo Sapiens
DPGAPMTAL

SEQ ID NO: 1161465 - protein, 9 aa, Homo Sapiens
FYTIPTPML

SEQ ID NO: 1161466 - protein, 9 aa, Homo Sapiens
AMQQLDKNM

SEQ ID NO: 1161467 - protein, 9 aa, Homo Sapiens
GGFKIHEIQ

SEQ ID NO: 1161468 - protein, 9 aa, Homo Sapiens
AEGSLKKKR

SEQ ID NO: 1161469 - protein, 9 aa, Homo Sapiens
VWLGNLFQN

SEQ ID NO: 1161470 - protein, 9 aa, Homo Sapiens
LWGLAPNEA

SEQ ID NO: 1161471 - protein, 9 aa, Homo Sapiens
QGSGDNVDV

SEQ ID NO: 1161472 - protein, 9 aa, Homo Sapiens
APLLRSGPQ

SEQ ID NO: 1161473 - protein, 9 aa, Homo Sapiens
GFKIHEIQC

SEQ ID NO: 1161474 - protein, 9 aa, Homo Sapiens
PSVQVKGNF

SEQ ID NO: 1161475 - protein, 9 aa, Homo Sapiens
TTLGSCLMS

SEQ ID NO: 1161476 - protein, 9 aa, Homo Sapiens
QANFTTLNY

SEQ ID NO: 1161477 - protein, 9 aa, Homo Sapiens
VTCSIPNNL

SEQ ID NO: 1161478 - protein, 9 aa, Homo Sapiens
DRKGCCGKG

SEQ ID NO: 1161479 - protein, 9 aa, Homo Sapiens
QVVVRIGQA

SEQ ID NO: 1161480 - protein, 9 aa, Homo Sapiens
CGTAAQPSS

SEQ ID NO: 1161481 - protein, 9 aa, Homo Sapiens
NHARNCVKM

SEQ ID NO: 1161482 - protein, 9 aa, Homo Sapiens
NLFQNPQHG

SEQ ID NO: 1161483 - protein, 9 aa, Homo Sapiens
ESKTLNINC

SEQ ID NO: 1161484 - protein, 9 aa, Homo Sapiens
FVEQVASEG

SEQ ID NO: 1161485 - protein, 9 aa, Homo Sapiens
EEAFDFLKY

SEQ ID NO: 1161486 - protein, 9 aa, Homo Sapiens
TIPTPMLNP

SEQ ID NO: 1161487 - protein, 9 aa, Homo Sapiens
IWYPRVSWN

SEQ ID NO: 1161488 - protein, 9 aa, Homo Sapiens
LPAPVIQVK

SEQ ID NO: 1161489 - protein, 9 aa, Homo Sapiens
DDGEEVAWE

SEQ ID NO: 1161490 - protein, 9 aa, Homo Sapiens
HPRQNRAAI

SEQ ID NO: 1161491 - protein, 9 aa, Homo Sapiens
VAMQQLDKN

SEQ ID NO: 1161492 - protein, 9 aa, Homo Sapiens
LMEQIPHLK

SEQ ID NO: 1161493 - protein, 9 aa, Homo Sapiens
SHVADHGPG

SEQ ID NO: 1161494 - protein, 9 aa, Homo Sapiens
APQVLISTG

SEQ ID NO: 1161495 - protein, 9 aa, Homo Sapiens
KQEMKTAHK

SEQ ID NO: 1161496 - protein, 9 aa, Homo Sapiens
SSTCVGPHC

SEQ ID NO: 1161497 - protein, 9 aa, Homo Sapiens
TAAFRFSHA

SEQ ID NO: 1161498 - protein, 9 aa, Homo Sapiens
KGKQGREQK

SEQ ID NO: 1161499 - protein, 9 aa, Homo Sapiens
PTFISNGPF

SEQ ID NO: 1161500 - protein, 9 aa, Homo Sapiens
LLKKNAVFM

SEQ ID NO: 1161501 - protein, 9 aa, Homo Sapiens
EVAWEEESP

SEQ ID NO: 1161502 - protein, 9 aa, Homo Sapiens
CPSEHVNGK

SEQ ID NO: 1161503 - protein, 9 aa, Homo Sapiens
WPGAGPPKA

SEQ ID NO: 1161504 - protein, 9 aa, Homo Sapiens
GLRFPWVAF

SEQ ID NO: 1161505 - protein, 9 aa, Homo Sapiens
FDIESNVDP

SEQ ID NO: 1161506 - protein, 9 aa, Homo Sapiens
APVIQVKAL

SEQ ID NO: 1161507 - protein, 9 aa, Homo Sapiens
ILELKNEKV

SEQ ID NO: 1161508 - protein, 9 aa, Homo Sapiens
HEIQCVDSR

SEQ ID NO: 1161509 - protein, 9 aa, Homo Sapiens
RNEGNLETF

SEQ ID NO: 1161510 - protein, 9 aa, Homo Sapiens
NKWTGPNVS

SEQ ID NO: 1161511 - protein, 9 aa, Homo Sapiens
LLTVDPGAP

SEQ ID NO: 1161512 - protein, 9 aa, Homo Sapiens
TEFHGAFPN

SEQ ID NO: 1161513 - protein, 9 aa, Homo Sapiens
TCVGPHCCG

SEQ ID NO: 1161514 - protein, 9 aa, Homo Sapiens
IGIGTHFVV

SEQ ID NO: 1161515 - protein, 9 aa, Homo Sapiens
LPCPAASQL

SEQ ID NO: 1161516 - protein, 9 aa, Homo Sapiens
KIVFVIFCV

SEQ ID NO: 1161517 - protein, 9 aa, Homo Sapiens
QACVFCCLP

SEQ ID NO: 1161518 - protein, 9 aa, Homo Sapiens
SHATIHPLV

SEQ ID NO: 1161519 - protein, 9 aa, Homo Sapiens
NYTCGVENS

SEQ ID NO: 1161520 - protein, 9 aa, Homo Sapiens
VVRIGQAEG

SEQ ID NO: 1161521 - protein, 9 aa, Homo Sapiens
ERKHRQKHQ

SEQ ID NO: 1161522 - protein, 9 aa, Homo Sapiens
YHYTRLGSH

SEQ ID NO: 1161523 - protein, 9 aa, Homo Sapiens
PPLKLVACS

SEQ ID NO: 1161524 - protein, 9 aa, Homo Sapiens
TGSCCGYTL

SEQ ID NO: 1161525 - protein, 9 aa, Homo Sapiens
ADCGGADVA

SEQ ID NO: 1161526 - protein, 9 aa, Homo Sapiens
EAFDFLKYL

SEQ ID NO: 1161527 - protein, 9 aa, Homo Sapiens
CSIPNNLPF

SEQ ID NO: 1161528 - protein, 9 aa, Homo Sapiens
GWHHHNKDG

SEQ ID NO: 1161529 - protein, 9 aa, Homo Sapiens
QSADQCRQS

SEQ ID NO: 1161530 - protein, 9 aa, Homo Sapiens
YPISTERRT

SEQ ID NO: 1161531 - protein, 9 aa, Homo Sapiens
VVEATQAIY

SEQ ID NO: 1161532 - protein, 9 aa, Homo Sapiens
VEATQAIYL

SEQ ID NO: 1161533 - protein, 9 aa, Homo Sapiens
REEELSKGG

SEQ ID NO: 1161534 - protein, 9 aa, Homo Sapiens
ENVCLAKAK

SEQ ID NO: 1161535 - protein, 9 aa, Homo Sapiens
ISLPNHARN

SEQ ID NO: 1161536 - protein, 9 aa, Homo Sapiens
GGWHHHNKD

SEQ ID NO: 1161537 - protein, 9 aa, Homo Sapiens
GRVGVFRDY

SEQ ID NO: 1161538 - protein, 9 aa, Homo Sapiens
PNAQLPSKR

SEQ ID NO: 1161539 - protein, 9 aa, Homo Sapiens
ISLFSEIEK

SEQ ID NO: 1161540 - protein, 9 aa, Homo Sapiens
PLPVGPPAT

SEQ ID NO: 1161541 - protein, 9 aa, Homo Sapiens
QVLKDRKGC

SEQ ID NO: 1161542 - protein, 9 aa, Homo Sapiens
SEGTGLNPN

SEQ ID NO: 1161543 - protein, 9 aa, Homo Sapiens
HHPRQNRAA

SEQ ID NO: 1161544 - protein, 9 aa, Homo Sapiens
SSGRALLDT

SEQ ID NO: 1161545 - protein, 9 aa, Homo Sapiens
GTSTVDRGT

SEQ ID NO: 1161546 - protein, 9 aa, Homo Sapiens
QMKHSFEIL

SEQ ID NO: 1161547 - protein, 9 aa, Homo Sapiens
LEGADACSW

SEQ ID NO: 1161548 - protein, 9 aa, Homo Sapiens
STGTHHPRQ

SEQ ID NO: 1161549 - protein, 9 aa, Homo Sapiens
RTALSSTCV

SEQ ID NO: 1161550 - protein, 9 aa, Homo Sapiens
TLGSCLMSL

SEQ ID NO: 1161551 - protein, 9 aa, Homo Sapiens
QAPQVLIST

SEQ ID NO: 1161552 - protein, 9 aa, Homo Sapiens
AEIKAQAAL

SEQ ID NO: 1161553 - protein, 9 aa, Homo Sapiens
RMGKSSQSA

SEQ ID NO: 1161554 - protein, 9 aa, Homo Sapiens
AEVREGEEG

SEQ ID NO: 1161555 - protein, 9 aa, Homo Sapiens
QQSDLFKAQ

SEQ ID NO: 1161556 - protein, 9 aa, Homo Sapiens
NLETSALDV

SEQ ID NO: 1161557 - protein, 9 aa, Homo Sapiens
GVFRDYDNG

SEQ ID NO: 1161558 - protein, 9 aa, Homo Sapiens
LSNEVGLKR

SEQ ID NO: 1161559 - protein, 9 aa, Homo Sapiens
IPLWGYSSS

SEQ ID NO: 1161560 - protein, 9 aa, Homo Sapiens
IVKCYPVPI

SEQ ID NO: 1161561 - protein, 9 aa, Homo Sapiens
EGVFSDNFA

SEQ ID NO: 1161562 - protein, 9 aa, Homo Sapiens
HCCGAHRRG

SEQ ID NO: 1161563 - protein, 9 aa, Homo Sapiens
KETLVAMQQ

SEQ ID NO: 1161564 - protein, 9 aa, Homo Sapiens
NVDPSKAWG

SEQ ID NO: 1161565 - protein, 9 aa, Homo Sapiens
VGQAGRELL

SEQ ID NO: 1161566 - protein, 9 aa, Homo Sapiens
LSGDGAGTP

SEQ ID NO: 1161567 - protein, 9 aa, Homo Sapiens
GSCCGYTLS

SEQ ID NO: 1161568 - protein, 9 aa, Homo Sapiens
VFIVSGNLS

SEQ ID NO: 1161569 - protein, 9 aa, Homo Sapiens
SKTLNINCV

SEQ ID NO: 1161570 - protein, 9 aa, Homo Sapiens
SVKKRCSLM

SEQ ID NO: 1161571 - protein, 9 aa, Homo Sapiens
NPWRQFIYS

SEQ ID NO: 1161572 - protein, 9 aa, Homo Sapiens
VLAVFYTIP

SEQ ID NO: 1161573 - protein, 9 aa, Homo Sapiens
ETLVAMQQL

SEQ ID NO: 1161574 - protein, 9 aa, Homo Sapiens
HRFLSHSLV

SEQ ID NO: 1161575 - protein, 9 aa, Homo Sapiens
KFHQMKHSF

SEQ ID NO: 1161576 - protein, 9 aa, Homo Sapiens
TVDPGAPMT

SEQ ID NO: 1161577 - protein, 9 aa, Homo Sapiens
GRERGEDRR

SEQ ID NO: 1161578 - protein, 9 aa, Homo Sapiens
LDTPLDSGS

SEQ ID NO: 1161579 - protein, 9 aa, Homo Sapiens
VVWGPQLGR

SEQ ID NO: 1161580 - protein, 9 aa, Homo Sapiens
LVACSQISS

SEQ ID NO: 1161581 - protein, 9 aa, Homo Sapiens
PSSVQLRHF

SEQ ID NO: 1161582 - protein, 9 aa, Homo Sapiens
NLQVIYPES

SEQ ID NO: 1161583 - protein, 9 aa, Homo Sapiens
GSILSNEVG

SEQ ID NO: 1161584 - protein, 9 aa, Homo Sapiens
WVTFSQCPL

SEQ ID NO: 1161585 - protein, 9 aa, Homo Sapiens
IWGHQGSQL

SEQ ID NO: 1161586 - protein, 9 aa, Homo Sapiens
STAAFRFSH

SEQ ID NO: 1161587 - protein, 9 aa, Homo Sapiens
HGTQAPQVL

SEQ ID NO: 1161588 - protein, 9 aa, Homo Sapiens
WGHQGSQLL

SEQ ID NO: 1161589 - protein, 9 aa, Homo Sapiens
ETTEANTAE

SEQ ID NO: 1161590 - protein, 9 aa, Homo Sapiens
HSFEILDKM

SEQ ID NO: 1161591 - protein, 9 aa, Homo Sapiens
STVDRGTSG

SEQ ID NO: 1161592 - protein, 9 aa, Homo Sapiens
HPWIWYPRV

SEQ ID NO: 1161593 - protein, 9 aa, Homo Sapiens
SEDSAPGSG

SEQ ID NO: 1161594 - protein, 9 aa, Homo Sapiens
PKDYDVDAT

SEQ ID NO: 1161595 - protein, 9 aa, Homo Sapiens
YHGTQAPQV

SEQ ID NO: 1161596 - protein, 9 aa, Homo Sapiens
VACSQISSL

SEQ ID NO: 1161597 - protein, 9 aa, Homo Sapiens
YPNLETSAL

SEQ ID NO: 1161598 - protein, 9 aa, Homo Sapiens
WGLAPNEAV

SEQ ID NO: 1161599 - protein, 9 aa, Homo Sapiens
CVFIYTHMH

SEQ ID NO: 1161600 - protein, 9 aa, Homo Sapiens
PSEHVNGKS

SEQ ID NO: 1161601 - protein, 9 aa, Homo Sapiens
EASLPLARE

SEQ ID NO: 1161602 - protein, 9 aa, Homo Sapiens
FRFSHATIH

SEQ ID NO: 1161603 - protein, 9 aa, Homo Sapiens
HIDPTFISN

SEQ ID NO: 1161604 - protein, 9 aa, Homo Sapiens
QQLVFHGYL

SEQ ID NO: 1161605 - protein, 9 aa, Homo Sapiens
RDMMLENYS

SEQ ID NO: 1161606 - protein, 9 aa, Homo Sapiens
EDSAPGSGG

SEQ ID NO: 1161607 - protein, 9 aa, Homo Sapiens
SLKKKRAEF

SEQ ID NO: 1161608 - protein, 9 aa, Homo Sapiens
LWPPLKLVA

SEQ ID NO: 1161609 - protein, 9 aa, Homo Sapiens
ALLDTPLDS

SEQ ID NO: 1161610 - protein, 9 aa, Homo Sapiens
IDPTFISNG

SEQ ID NO: 1161611 - protein, 9 aa, Homo Sapiens
PLAREEELS

SEQ ID NO: 1161612 - protein, 9 aa, Homo Sapiens
QYPNLETSA

SEQ ID NO: 1161613 - protein, 9 aa, Homo Sapiens
LPLPVGPPA

SEQ ID NO: 1161614 - protein, 9 aa, Homo Sapiens
SQSADQCRQ

SEQ ID NO: 1161615 - protein, 9 aa, Homo Sapiens
AREEELSKG

SEQ ID NO: 1161616 - protein, 9 aa, Homo Sapiens
IQSLSSSSR

SEQ ID NO: 1161617 - protein, 9 aa, Homo Sapiens
DMMLENYSN

SEQ ID NO: 1161618 - protein, 9 aa, Homo Sapiens
LNPRSLITA

SEQ ID NO: 1161619 - protein, 9 aa, Homo Sapiens
VQTADPVLI

SEQ ID NO: 1161620 - protein, 9 aa, Homo Sapiens
ALIVVHLIA

SEQ ID NO: 1161621 - protein, 9 aa, Homo Sapiens
FSHATIHPL

SEQ ID NO: 1161622 - protein, 9 aa, Homo Sapiens
ISEAVQPGQ

SEQ ID NO: 1161623 - protein, 9 aa, Homo Sapiens
QLVFHGYLL

SEQ ID NO: 1161624 - protein, 9 aa, Homo Sapiens
SCMQPAAGP

SEQ ID NO: 1161625 - protein, 9 aa, Homo Sapiens
SHRFLSHSL

SEQ ID NO: 1161626 - protein, 9 aa, Homo Sapiens
HTLAVMNDC

SEQ ID NO: 1161627 - protein, 9 aa, Homo Sapiens
KQWLCLNCQ

SEQ ID NO: 1161628 - protein, 9 aa, Homo Sapiens
IGTHFVVED

SEQ ID NO: 1161629 - protein, 9 aa, Homo Sapiens
EELLKKNAV

SEQ ID NO: 1161630 - protein, 9 aa, Homo Sapiens
SKETVPEAA

SEQ ID NO: 1161631 - protein, 9 aa, Homo Sapiens
YLQSVKKRC

SEQ ID NO: 1161632 - protein, 9 aa, Homo Sapiens
WLGNLFQNP

SEQ ID NO: 1161633 - protein, 9 aa, Homo Sapiens
LKDRKGCCG

SEQ ID NO: 1161634 - protein, 9 aa, Homo Sapiens
HQLIHRSVV

SEQ ID NO: 1161635 - protein, 9 aa, Homo Sapiens
MVNWTNAPG

SEQ ID NO: 1161636 - protein, 9 aa, Homo Sapiens
KGCCGKGYA

SEQ ID NO: 1161637 - protein, 9 aa, Homo Sapiens
GMQSLSLNK

SEQ ID NO: 1161638 - protein, 9 aa, Homo Sapiens
PNNLPFTLE

SEQ ID NO: 1161639 - protein, 9 aa, Homo Sapiens
VWGPQLGRL

SEQ ID NO: 1161640 - protein, 9 aa, Homo Sapiens
KLVACSQIS

SEQ ID NO: 1161641 - protein, 9 aa, Homo Sapiens
PGTSTVDRG

SEQ ID NO: 1161642 - protein, 9 aa, Homo Sapiens
PRSLITAGR

SEQ ID NO: 1161643 - protein, 9 aa, Homo Sapiens
DALISLFSE

SEQ ID NO: 1161644 - protein, 9 aa, Homo Sapiens
LPNHARNCV

SEQ ID NO: 1161645 - protein, 9 aa, Homo Sapiens
DQHECILPS

SEQ ID NO: 1161646 - protein, 9 aa, Homo Sapiens
LQVIYPESY

SEQ ID NO: 1161647 - protein, 9 aa, Homo Sapiens
QLIEDAGVT

SEQ ID NO: 1161648 - protein, 9 aa, Homo Sapiens
HQGSQLLTR

SEQ ID NO: 1161649 - protein, 9 aa, Homo Sapiens
NAVFMGKSL

SEQ ID NO: 1161650 - protein, 9 aa, Homo Sapiens
PNVSVIQKT

SEQ ID NO: 1161651 - protein, 9 aa, Homo Sapiens
RFSHATIHP

SEQ ID NO: 1161652 - protein, 9 aa, Homo Sapiens
GMCTHCGTA

SEQ ID NO: 1161653 - protein, 9 aa, Homo Sapiens
RAAITPRSC

SEQ ID NO: 1161654 - protein, 9 aa, Homo Sapiens
AGRELLISS

SEQ ID NO: 1161655 - protein, 9 aa, Homo Sapiens
TLSGKGMQS

SEQ ID NO: 1161656 - protein, 9 aa, Homo Sapiens
EGTGLNPNA

SEQ ID NO: 1161657 - protein, 9 aa, Homo Sapiens
FFSQQLVFH

SEQ ID NO: 1161658 - protein, 9 aa, Homo Sapiens
ICVFIYTHM

SEQ ID NO: 1161659 - protein, 9 aa, Homo Sapiens
TQAPQVLIS

SEQ ID NO: 1161660 - protein, 9 aa, Homo Sapiens
VTVLYIVRE

SEQ ID NO: 1161661 - protein, 9 aa, Homo Sapiens
EIKILHQLI

SEQ ID NO: 1161662 - protein, 9 aa, Homo Sapiens
NPKPASHRF

SEQ ID NO: 1161663 - protein, 9 aa, Homo Sapiens
AKRTKQEMK

SEQ ID NO: 1161664 - protein, 9 aa, Homo Sapiens
ALFDIESNV

SEQ ID NO: 1161665 - protein, 9 aa, Homo Sapiens
TQLAEIKAQ

SEQ ID NO: 1161666 - protein, 9 aa, Homo Sapiens
GLAPNEAVG

SEQ ID NO: 1161667 - protein, 9 aa, Homo Sapiens
EGLGQLPKE

SEQ ID NO: 1161668 - protein, 9 aa, Homo Sapiens
EEEKIQSLS

SEQ ID NO: 1161669 - protein, 9 aa, Homo Sapiens
MEQIPHLKS

SEQ ID NO: 1161670 - protein, 9 aa, Homo Sapiens
EVDDVMQGK

SEQ ID NO: 1161671 - protein, 9 aa, Homo Sapiens
PTLEEEKIQ

SEQ ID NO: 1161672 - protein, 9 aa, Homo Sapiens
QTADPVLIG

SEQ ID NO: 1161673 - protein, 9 aa, Homo Sapiens
GDRTAGPPP

SEQ ID NO: 1161674 - protein, 9 aa, Homo Sapiens
PSLSTQNEN

SEQ ID NO: 1161675 - protein, 9 aa, Homo Sapiens
VKALIVVHL

SEQ ID NO: 1161676 - protein, 9 aa, Homo Sapiens
DCLYAIGGN

SEQ ID NO: 1161677 - protein, 9 aa, Homo Sapiens
GYEVWLGNL

SEQ ID NO: 1161678 - protein, 9 aa, Homo Sapiens
CIQRWAAEI

SEQ ID NO: 1161679 - protein, 9 aa, Homo Sapiens
RELLISSDL

SEQ ID NO: 1161680 - protein, 9 aa, Homo Sapiens
VQLRHFLTL

SEQ ID NO: 1161681 - protein, 9 aa, Homo Sapiens
WAGPSQNPA

SEQ ID NO: 1161682 - protein, 9 aa, Homo Sapiens
SLSTQNENN

SEQ ID NO: 1161683 - protein, 9 aa, Homo Sapiens
LGQLPKEEL

SEQ ID NO: 1161684 - protein, 9 aa, Homo Sapiens
GQYPNLETS

SEQ ID NO: 1161685 - protein, 9 aa, Homo Sapiens
TADPVLIGR

SEQ ID NO: 1161686 - protein, 9 aa, Homo Sapiens
EGHGHCLEG

SEQ ID NO: 1161687 - protein, 9 aa, Homo Sapiens
DFYAATKTW

SEQ ID NO: 1161688 - protein, 9 aa, Homo Sapiens
CLLKGKRFH

SEQ ID NO: 1161689 - protein, 9 aa, Homo Sapiens
KNAVFMGKS

SEQ ID NO: 1161690 - protein, 9 aa, Homo Sapiens
HHVGQAGRE

SEQ ID NO: 1161691 - protein, 9 aa, Homo Sapiens
PQPYAPFLW

SEQ ID NO: 1161692 - protein, 9 aa, Homo Sapiens
IVQLIEDAG

SEQ ID NO: 1161693 - protein, 9 aa, Homo Sapiens
MAKRTKQEM

SEQ ID NO: 1161694 - protein, 9 aa, Homo Sapiens
LGEAKEQFY

SEQ ID NO: 1161695 - protein, 9 aa, Homo Sapiens
SGRALLDTP

SEQ ID NO: 1161696 - protein, 9 aa, Homo Sapiens
LNYTCGVEN

SEQ ID NO: 1161697 - protein, 9 aa, Homo Sapiens
GAGTPFIID

SEQ ID NO: 1161698 - protein, 9 aa, Homo Sapiens
KAQYVLIVD

SEQ ID NO: 1161699 - protein, 9 aa, Homo Sapiens
KWTGPNVSV

SEQ ID NO: 1161700 - protein, 9 aa, Homo Sapiens
PKEELQGSG

SEQ ID NO: 1161701 - protein, 9 aa, Homo Sapiens
CMQPAAGPR

SEQ ID NO: 1161702 - protein, 9 aa, Homo Sapiens
RIGQAEGPQ

SEQ ID NO: 1161703 - protein, 9 aa, Homo Sapiens
VSLAADCGG

SEQ ID NO: 1161704 - protein, 9 aa, Homo Sapiens
KTSSPVPLP

SEQ ID NO: 1161705 - protein, 9 aa, Homo Sapiens
SPTCCRTAL

SEQ ID NO: 1161706 - protein, 9 aa, Homo Sapiens
DVSHVADHG

SEQ ID NO: 1161707 - protein, 9 aa, Homo Sapiens
LRPKDYDVD

SEQ ID NO: 1161708 - protein, 9 aa, Homo Sapiens
KETVPEAAS

SEQ ID NO: 1161709 - protein, 9 aa, Homo Sapiens
LLPCPAASQ

SEQ ID NO: 1161710 - protein, 9 aa, Homo Sapiens
HQMKHSFEI

SEQ ID NO: 1161711 - protein, 9 aa, Homo Sapiens
CRALKYILL

SEQ ID NO: 1161712 - protein, 9 aa, Homo Sapiens
DRTAGPPPR

SEQ ID NO: 1161713 - protein, 9 aa, Homo Sapiens
EVREGEEGL

SEQ ID NO: 1161714 - protein, 9 aa, Homo Sapiens
FPNAQLPSK

SEQ ID NO: 1161715 - protein, 9 aa, Homo Sapiens
RPKDYDVDA

SEQ ID NO: 1161716 - protein, 9 aa, Homo Sapiens
YFFSQQLVF

SEQ ID NO: 1161717 - protein, 9 aa, Homo Sapiens
PYLQSVKKR

SEQ ID NO: 1161718 - protein, 9 aa, Homo Sapiens
RPQARTILK

SEQ ID NO: 1161719 - protein, 9 aa, Homo Sapiens
VFVIFCVST

SEQ ID NO: 1161720 - protein, 9 aa, Homo Sapiens
AAEIVVALD

SEQ ID NO: 1161721 - protein, 9 aa, Homo Sapiens
RLSPLCYEN

SEQ ID NO: 1161722 - protein, 9 aa, Homo Sapiens
PSGHHLYKV

SEQ ID NO: 1161723 - protein, 9 aa, Homo Sapiens
DVLPAPVIQ

SEQ ID NO: 1161724 - protein, 9 aa, Homo Sapiens
LLLLPCPAA

SEQ ID NO: 1161725 - protein, 9 aa, Homo Sapiens
TLVAMQQLD

SEQ ID NO: 1161726 - protein, 9 aa, Homo Sapiens
QLLLYRVVW

SEQ ID NO: 1161727 - protein, 9 aa, Homo Sapiens
KGDRTAGPP

SEQ ID NO: 1161728 - protein, 9 aa, Homo Sapiens
TVHQSLGEA

SEQ ID NO: 1161729 - protein, 9 aa, Homo Sapiens
KRFHHQTCS

SEQ ID NO: 1161730 - protein, 9 aa, Homo Sapiens
APPFSGAAF

SEQ ID NO: 1161731 - protein, 9 aa, Homo Sapiens
APGSGGRSR

SEQ ID NO: 1161732 - protein, 9 aa, Homo Sapiens
VFIYTHMHT

SEQ ID NO: 1161733 - protein, 9 aa, Homo Sapiens
SVRMGKSSQ

SEQ ID NO: 1161734 - protein, 9 aa, Homo Sapiens
EKVELELTE

SEQ ID NO: 1161735 - protein, 9 aa, Homo Sapiens
VKKRCSLME

SEQ ID NO: 1161736 - protein, 9 aa, Homo Sapiens
PVQTADPVL

SEQ ID NO: 1161737 - protein, 9 aa, Homo Sapiens
QRWAAEIVV

SEQ ID NO: 1161738 - protein, 9 aa, Homo Sapiens
RVSLAADCG

SEQ ID NO: 1161739 - protein, 9 aa, Homo Sapiens
LVAASAPPF

SEQ ID NO: 1161740 - protein, 9 aa, Homo Sapiens
HQWCPRQAL

SEQ ID NO: 1161741 - protein, 9 aa, Homo Sapiens
GCCGKGYAW

SEQ ID NO: 1161742 - protein, 9 aa, Homo Sapiens
DDEERAARW

SEQ ID NO: 1161743 - protein, 9 aa, Homo Sapiens
YLLHNSHSA

SEQ ID NO: 1161744 - protein, 9 aa, Homo Sapiens
AYAYICVFI

SEQ ID NO: 1161745 - protein, 9 aa, Homo Sapiens
TGYEVWLGN

SEQ ID NO: 1161746 - protein, 9 aa, Homo Sapiens
PLRVGVGSM

SEQ ID NO: 1161747 - protein, 9 aa, Homo Sapiens
KCLLKGKRF

SEQ ID NO: 1161748 - protein, 9 aa, Homo Sapiens
LYRDMMLEN

SEQ ID NO: 1161749 - protein, 9 aa, Homo Sapiens
PSPSSVQLR

SEQ ID NO: 1161750 - protein, 9 aa, Homo Sapiens
GVENSTGAS

SEQ ID NO: 1161751 - protein, 9 aa, Homo Sapiens
ETSALDVRL

SEQ ID NO: 1161752 - protein, 9 aa, Homo Sapiens
MMLENYSNM

SEQ ID NO: 1161753 - protein, 9 aa, Homo Sapiens
KRKTSSPVP

SEQ ID NO: 1161754 - protein, 9 aa, Homo Sapiens
VNWTNAPGN

SEQ ID NO: 1161755 - protein, 9 aa, Homo Sapiens
GIGTHFVVE

SEQ ID NO: 1161756 - protein, 9 aa, Homo Sapiens
SLPLPVGPP

SEQ ID NO: 1161757 - protein, 9 aa, Homo Sapiens
LNGKEGVFS

SEQ ID NO: 1161758 - protein, 9 aa, Homo Sapiens
LAEVREGEE

SEQ ID NO: 1161759 - protein, 9 aa, Homo Sapiens
KHRQKHQEY

SEQ ID NO: 1161760 - protein, 9 aa, Homo Sapiens
NWTNAPGNV

SEQ ID NO: 1161761 - protein, 9 aa, Homo Sapiens
TIPTKSSKH

SEQ ID NO: 1161762 - protein, 9 aa, Homo Sapiens
DEERAARWP

SEQ ID NO: 1161763 - protein, 9 aa, Homo Sapiens
STERRTQNE

SEQ ID NO: 1161764 - protein, 9 aa, Homo Sapiens
VGLHMGEVR

SEQ ID NO: 1161765 - protein, 9 aa, Homo Sapiens
SQLLTRVFK

SEQ ID NO: 1161766 - protein, 9 aa, Homo Sapiens
QPAAGPRPQ

SEQ ID NO: 1161767 - protein, 9 aa, Homo Sapiens
VNDFYAATK

SEQ ID NO: 1161768 - protein, 9 aa, Homo Sapiens
LTPRIPLWG

SEQ ID NO: 1161769 - protein, 9 aa, Homo Sapiens
AGPPPRTIS

SEQ ID NO: 1161770 - protein, 9 aa, Homo Sapiens
EPSTLTPRI

SEQ ID NO: 1161771 - protein, 9 aa, Homo Sapiens
ACVFCCLPA

SEQ ID NO: 1161772 - protein, 9 aa, Homo Sapiens
AAQPSSGAS

SEQ ID NO: 1161773 - protein, 9 aa, Homo Sapiens
VALDDVSFS

SEQ ID NO: 1161774 - protein, 9 aa, Homo Sapiens
MTELMLLSE

SEQ ID NO: 1161775 - protein, 9 aa, Homo Sapiens
VFVDTHGLR

SEQ ID NO: 1161776 - protein, 9 aa, Homo Sapiens
EELQGSGDN

SEQ ID NO: 1161777 - protein, 9 aa, Homo Sapiens
LVAMQQLDK

SEQ ID NO: 1161778 - protein, 9 aa, Homo Sapiens
LDLQVIRVQ

SEQ ID NO: 1161779 - protein, 9 aa, Homo Sapiens
WIWGHQGSQ

SEQ ID NO: 1161780 - protein, 9 aa, Homo Sapiens
FMVNWTNAP

SEQ ID NO: 1161781 - protein, 9 aa, Homo Sapiens
AHRRGCCGL

SEQ ID NO: 1161782 - protein, 9 aa, Homo Sapiens
RSFMVNWTN

SEQ ID NO: 1161783 - protein, 9 aa, Homo Sapiens
LKGKRFHHQ

SEQ ID NO: 1161784 - protein, 9 aa, Homo Sapiens
PSLRPKDYD

SEQ ID NO: 1161785 - protein, 9 aa, Homo Sapiens
HGYLLHNSH

SEQ ID NO: 1161786 - protein, 9 aa, Homo Sapiens
APLRVGVGS

SEQ ID NO: 1161787 - protein, 9 aa, Homo Sapiens
FIIFFKNTV

SEQ ID NO: 1161788 - protein, 9 aa, Homo Sapiens
RTKKTTEIV

SEQ ID NO: 1161789 - protein, 9 aa, Homo Sapiens
GPSPSSVQL

SEQ ID NO: 1161790 - protein, 9 aa, Homo Sapiens
ASARLFFVG

SEQ ID NO: 1161791 - protein, 9 aa, Homo Sapiens
SGDGAGTPF

SEQ ID NO: 1161792 - protein, 9 aa, Homo Sapiens
FCVSTWEHC

SEQ ID NO: 1161793 - protein, 9 aa, Homo Sapiens
VFRDYDNGS

SEQ ID NO: 1161794 - protein, 9 aa, Homo Sapiens
WQSEVDDVM

SEQ ID NO: 1161795 - protein, 9 aa, Homo Sapiens
DAWDLRGVG

SEQ ID NO: 1161796 - protein, 9 aa, Homo Sapiens
LAREEELSK

SEQ ID NO: 1161797 - protein, 9 aa, Homo Sapiens
SVTVLYIVR

SEQ ID NO: 1161798 - protein, 9 aa, Homo Sapiens
QLRHFLTLA

SEQ ID NO: 1161799 - protein, 9 aa, Homo Sapiens
KIQSLSSSS

SEQ ID NO: 1161800 - protein, 9 aa, Homo Sapiens
WLPEQPGEG

SEQ ID NO: 1161801 - protein, 9 aa, Homo Sapiens
THSTGTHHP

SEQ ID NO: 1161802 - protein, 9 aa, Homo Sapiens
ELPSGHHLY

SEQ ID NO: 1161803 - protein, 9 aa, Homo Sapiens
VDRGTSGTP

SEQ ID NO: 1161804 - protein, 9 aa, Homo Sapiens
LAADCGGAD

SEQ ID NO: 1161805 - protein, 9 aa, Homo Sapiens
ARLFFVGSR

SEQ ID NO: 1161806 - protein, 9 aa, Homo Sapiens
HDNIVQLIE

SEQ ID NO: 1161807 - protein, 9 aa, Homo Sapiens
KVELELTEF

SEQ ID NO: 1161808 - protein, 9 aa, Homo Sapiens
NFIIFFKNT

SEQ ID NO: 1161809 - protein, 9 aa, Homo Sapiens
EGADACSWA

SEQ ID NO: 1161810 - protein, 9 aa, Homo Sapiens
TPGTSTVDR

SEQ ID NO: 1161811 - protein, 9 aa, Homo Sapiens
GVGVVCRQL

SEQ ID NO: 1161812 - protein, 9 aa, Homo Sapiens
ELKNEKVEL

SEQ ID NO: 1161813 - protein, 9 aa, Homo Sapiens
SQCHRLGQQ

SEQ ID NO: 1161814 - protein, 9 aa, Homo Sapiens
VLISTGNFM

SEQ ID NO: 1161815 - protein, 9 aa, Homo Sapiens
HNKDGRPLY

SEQ ID NO: 1161816 - protein, 9 aa, Homo Sapiens
QYDLNLQVI

SEQ ID NO: 1161817 - protein, 9 aa, Homo Sapiens
ILLTETGSS

SEQ ID NO: 1161818 - protein, 9 aa, Homo Sapiens
LKYLDAKKE

SEQ ID NO: 1161819 - protein, 9 aa, Homo Sapiens
IIGIAIGIG

SEQ ID NO: 1161820 - protein, 9 aa, Homo Sapiens
HNVASEKQR

SEQ ID NO: 1161821 - protein, 9 aa, Homo Sapiens
QKIEQERKH

SEQ ID NO: 1161822 - protein, 9 aa, Homo Sapiens
TETGSSTDP

SEQ ID NO: 1161823 - protein, 9 aa, Homo Sapiens
GTPFIIDEK

SEQ ID NO: 1161824 - protein, 9 aa, Homo Sapiens
TTEIVKCYP

SEQ ID NO: 1161825 - protein, 9 aa, Homo Sapiens
STLTPRIPL

SEQ ID NO: 1161826 - protein, 9 aa, Homo Sapiens
FKAQYVLIV

SEQ ID NO: 1161827 - protein, 9 aa, Homo Sapiens
GQEPCAPHL

SEQ ID NO: 1161828 - protein, 9 aa, Homo Sapiens
LSDDVVEAT

SEQ ID NO: 1161829 - protein, 9 aa, Homo Sapiens
GLHMGEVRT

SEQ ID NO: 1161830 - protein, 9 aa, Homo Sapiens
IVFVIFCVS

SEQ ID NO: 1161831 - protein, 9 aa, Homo Sapiens
RTAGPPPRT

SEQ ID NO: 1161832 - protein, 9 aa, Homo Sapiens
MNVKDLRPQ

SEQ ID NO: 1161833 - protein, 9 aa, Homo Sapiens
CCGKGYAWI

SEQ ID NO: 1161834 - protein, 9 aa, Homo Sapiens
FNPKPASHR

SEQ ID NO: 1161835 - protein, 9 aa, Homo Sapiens
EEGLGQLPK

SEQ ID NO: 1161836 - protein, 9 aa, Homo Sapiens
NEGNLETFD

SEQ ID NO: 1161837 - protein, 9 aa, Homo Sapiens
PDALISLFS

SEQ ID NO: 1161838 - protein, 9 aa, Homo Sapiens
DVVEATQAI

SEQ ID NO: 1161839 - protein, 9 aa, Homo Sapiens
CCGYTLSSL

SEQ ID NO: 1161840 - protein, 9 aa, Homo Sapiens
SCCGYTLSS

SEQ ID NO: 1161841 - protein, 9 aa, Homo Sapiens
KGMQSLSLN

SEQ ID NO: 1161842 - protein, 9 aa, Homo Sapiens
SCTQPDALI

SEQ ID NO: 1161843 - protein, 9 aa, Homo Sapiens
CSLMEQIPH

SEQ ID NO: 1161844 - protein, 9 aa, Homo Sapiens
AAITPRSCM

SEQ ID NO: 1161845 - protein, 9 aa, Homo Sapiens
LGNLFQNPQ

SEQ ID NO: 1161846 - protein, 9 aa, Homo Sapiens
CRTALSSTC

SEQ ID NO: 1161847 - protein, 9 aa, Homo Sapiens
QAEGSLKKK

SEQ ID NO: 1161848 - protein, 9 aa, Homo Sapiens
MQQLDKNMS

SEQ ID NO: 1161849 - protein, 9 aa, Homo Sapiens
VSHVADHGP

SEQ ID NO: 1161850 - protein, 9 aa, Homo Sapiens
QEMKTAHKL

SEQ ID NO: 1161851 - protein, 9 aa, Homo Sapiens
QEPCAPHLM

SEQ ID NO: 1161852 - protein, 9 aa, Homo Sapiens
SLSDDVVEA

SEQ ID NO: 1161853 - protein, 9 aa, Homo Sapiens
VTFSQCPLD

SEQ ID NO: 1161854 - protein, 9 aa, Homo Sapiens
HECILPSVQ

SEQ ID NO: 1161855 - protein, 9 aa, Homo Sapiens
GLFSVGLHM

SEQ ID NO: 1161856 - protein, 9 aa, Homo Sapiens
AATKTWDIE

SEQ ID NO: 1161857 - protein, 9 aa, Homo Sapiens
GPPPRTISP

SEQ ID NO: 1161858 - protein, 9 aa, Homo Sapiens
DCPSEHVNG

SEQ ID NO: 1161859 - protein, 9 aa, Homo Sapiens
VSFSPVHCQ

SEQ ID NO: 1161860 - protein, 9 aa, Homo Sapiens
LKETLVAMQ

SEQ ID NO: 1161861 - protein, 9 aa, Homo Sapiens
INCVDYMGQ

SEQ ID NO: 1161862 - protein, 9 aa, Homo Sapiens
PGQEPCAPH

SEQ ID NO: 1161863 - protein, 9 aa, Homo Sapiens
FSVGLHMGE

SEQ ID NO: 1161864 - protein, 9 aa, Homo Sapiens
YRVVWGPQL

SEQ ID NO: 1161865 - protein, 9 aa, Homo Sapiens
RVVWGPQLG

SEQ ID NO: 1161866 - protein, 9 aa, Homo Sapiens
SAPPFSGAA

SEQ ID NO: 1161867 - protein, 9 aa, Homo Sapiens
TCGVENSTG

SEQ ID NO: 1161868 - protein, 9 aa, Homo Sapiens
DRRPGGALA

SEQ ID NO: 1161869 - protein, 9 aa, Homo Sapiens
RVSWNQPPT

SEQ ID NO: 1161870 - protein, 9 aa, Homo Sapiens
TKGKQGREQ

SEQ ID NO: 1161871 - protein, 9 aa, Homo Sapiens
FYPWFCRAL

SEQ ID NO: 1161872 - protein, 9 aa, Homo Sapiens
PGGALASIS

SEQ ID NO: 1161873 - protein, 9 aa, Homo Sapiens
EQRDLYRDM

SEQ ID NO: 1161874 - protein, 9 aa, Homo Sapiens
GVFSDNFAV

SEQ ID NO: 1161875 - protein, 9 aa, Homo Sapiens
FVIFCVSTW

SEQ ID NO: 1161876 - protein, 9 aa, Homo Sapiens
RALLDTPLD

SEQ ID NO: 1161877 - protein, 9 aa, Homo Sapiens
GHCLEGADA

SEQ ID NO: 1161878 - protein, 9 aa, Homo Sapiens
SLPLAREEE

SEQ ID NO: 1161879 - protein, 9 aa, Homo Sapiens
PWIWYPRVS

SEQ ID NO: 1161880 - protein, 9 aa, Homo Sapiens
SGPQPYAPF

SEQ ID NO: 1161881 - protein, 9 aa, Homo Sapiens
VDVSHVADH

SEQ ID NO: 1161882 - protein, 9 aa, Homo Sapiens
AEIVVALDA

SEQ ID NO: 1161883 - protein, 9 aa, Homo Sapiens
GKQGREQKQ

SEQ ID NO: 1161884 - protein, 9 aa, Homo Sapiens
GAFPNAQLP

SEQ ID NO: 1161885 - protein, 9 aa, Homo Sapiens
DELLQAPLL

SEQ ID NO: 1161886 - protein, 9 aa, Homo Sapiens
SWVTFSQCP

SEQ ID NO: 1161887 - protein, 9 aa, Homo Sapiens
ACSWAGPSQ

SEQ ID NO: 1161888 - protein, 9 aa, Homo Sapiens
TEVKQWLCL

SEQ ID NO: 1161889 - protein, 9 aa, Homo Sapiens
GLVTCSIPN

SEQ ID NO: 1161890 - protein, 9 aa, Homo Sapiens
SKSNFIIFF

SEQ ID NO: 1161891 - protein, 9 aa, Homo Sapiens
NPRSLITAG

SEQ ID NO: 1161892 - protein, 9 aa, Homo Sapiens
LMHQWCPRQ

SEQ ID NO: 1161893 - protein, 9 aa, Homo Sapiens
MQDELLQAP

SEQ ID NO: 1161894 - protein, 9 aa, Homo Sapiens
GTGNPWRQF

SEQ ID NO: 1161895 - protein, 9 aa, Homo Sapiens
VKDLRPQAR

SEQ ID NO: 1161896 - protein, 9 aa, Homo Sapiens
LAYHYTRLG

SEQ ID NO: 1161897 - protein, 9 aa, Homo Sapiens
QVKALIVVH

SEQ ID NO: 1161898 - protein, 9 aa, Homo Sapiens
KLKETLVAM

SEQ ID NO: 1161899 - protein, 9 aa, Homo Sapiens
HSTGTHHPR

SEQ ID NO: 1161900 - protein, 9 aa, Homo Sapiens
KKRCSLMEQ

SEQ ID NO: 1161901 - protein, 9 aa, Homo Sapiens
AYICVFIYT

SEQ ID NO: 1161902 - protein, 9 aa, Homo Sapiens
ELQGSGDNV

SEQ ID NO: 1161903 - protein, 9 aa, Homo Sapiens
SEVDDVMQG

SEQ ID NO: 1161904 - protein, 9 aa, Homo Sapiens
SNEVGLKRK

SEQ ID NO: 1161905 - protein, 9 aa, Homo Sapiens
FSQQLVFHG

SEQ ID NO: 1161906 - protein, 9 aa, Homo Sapiens
PMTALQALR

SEQ ID NO: 1161907 - protein, 9 aa, Homo Sapiens
ILHQLIHRS

SEQ ID NO: 1161908 - protein, 9 aa, Homo Sapiens
DTPLDSGSL

SEQ ID NO: 1161909 - protein, 9 aa, Homo Sapiens
PRQALTAGQ

SEQ ID NO: 1161910 - protein, 9 aa, Homo Sapiens
SCLMSLLEK

SEQ ID NO: 1161911 - protein, 9 aa, Homo Sapiens
VGSMQDELL

SEQ ID NO: 1161912 - protein, 9 aa, Homo Sapiens
TPMYFFSQQ

SEQ ID NO: 1161913 - protein, 9 aa, Homo Sapiens
LPKEELQGS

SEQ ID NO: 1161914 - protein, 9 aa, Homo Sapiens
PNLETSALD

SEQ ID NO: 1161915 - protein, 9 aa, Homo Sapiens
NNHENVCLA

SEQ ID NO: 1161916 - protein, 9 aa, Homo Sapiens
TPLDSGSLT

SEQ ID NO: 1161917 - protein, 9 aa, Homo Sapiens
LRVGVGSMQ

SEQ ID NO: 1161918 - protein, 9 aa, Homo Sapiens
QESVTVLYI

SEQ ID NO: 1161919 - protein, 9 aa, Homo Sapiens
LQSVKKRCS

SEQ ID NO: 1161920 - protein, 9 aa, Homo Sapiens
AFDFLKYLD

SEQ ID NO: 1161921 - protein, 9 aa, Homo Sapiens
WAAEIVVAL

SEQ ID NO: 1161922 - protein, 9 aa, Homo Sapiens
QGMKRKTSS

SEQ ID NO: 1161923 - protein, 9 aa, Homo Sapiens
PQEGHGHCL

SEQ ID NO: 1161924 - protein, 9 aa, Homo Sapiens
DNIVQLIED

SEQ ID NO: 1161925 - protein, 9 aa, Homo Sapiens
LKLVACSQI

SEQ ID NO: 1161926 - protein, 9 aa, Homo Sapiens
RKHRQKHQE

SEQ ID NO: 1161927 - protein, 9 aa, Homo Sapiens
GWIWGHQGS

SEQ ID NO: 1161928 - protein, 9 aa, Homo Sapiens
TSTVDRGTS

SEQ ID NO: 1161929 - protein, 9 aa, Homo Sapiens
VQLIEDAGV

SEQ ID NO: 1161930 - protein, 9 aa, Homo Sapiens
KTQLAEIKA

SEQ ID NO: 1161931 - protein, 9 aa, Homo Sapiens
RDLYRDMML

SEQ ID NO: 1161932 - protein, 9 aa, Homo Sapiens
HGHCLEGAD

SEQ ID NO: 1161933 - protein, 9 aa, Homo Sapiens
SMQDELLQA

SEQ ID NO: 1161934 - protein, 9 aa, Homo Sapiens
ALDDVSFSP

SEQ ID NO: 1161935 - protein, 9 aa, Homo Sapiens
SGDNVDVLP

SEQ ID NO: 1161936 - protein, 9 aa, Homo Sapiens
QWLCLNCQM

SEQ ID NO: 1161937 - protein, 9 aa, Homo Sapiens
DLFKAQYVL

SEQ ID NO: 1161938 - protein, 9 aa, Homo Sapiens
GPRPQEGHG

SEQ ID NO: 1161939 - protein, 9 aa, Homo Sapiens
LPIRQVVVR

SEQ ID NO: 1161940 - protein, 9 aa, Homo Sapiens
LDCTGSPEG

SEQ ID NO: 1161941 - protein, 9 aa, Homo Sapiens
YTRLGSHLV

SEQ ID NO: 1161942 - protein, 9 aa, Homo Sapiens
SSKHNVASE

SEQ ID NO: 1161943 - protein, 9 aa, Homo Sapiens
TGNPWRQFI

SEQ ID NO: 1161944 - protein, 9 aa, Homo Sapiens
ELTKGKQGR

SEQ ID NO: 1161945 - protein, 9 aa, Homo Sapiens
KQGREQKQL

SEQ ID NO: 1161946 - protein, 9 aa, Homo Sapiens
EEVAWEEES

SEQ ID NO: 1161947 - protein, 9 aa, Homo Sapiens
SNNHENVCL

SEQ ID NO: 1161948 - protein, 9 aa, Homo Sapiens
IFFKNTVIS

SEQ ID NO: 1161949 - protein, 9 aa, Homo Sapiens
SLNPRSLIT

SEQ ID NO: 1161950 - protein, 9 aa, Homo Sapiens
QEASLPLAR

SEQ ID NO: 1161951 - protein, 9 aa, Homo Sapiens
QRDLYRDMM

SEQ ID NO: 1161952 - protein, 9 aa, Homo Sapiens
PQARTILKW

SEQ ID NO: 1161953 - protein, 9 aa, Homo Sapiens
WFCRALKYI

SEQ ID NO: 1161954 - protein, 9 aa, Homo Sapiens
KANKWTGPN

SEQ ID NO: 1161955 - protein, 9 aa, Homo Sapiens
ALASISEAV

SEQ ID NO: 1161956 - protein, 9 aa, Homo Sapiens
CSWAGPSQN

SEQ ID NO: 1161957 - protein, 9 aa, Homo Sapiens
LAEIKAQAA

SEQ ID NO: 1161958 - protein, 9 aa, Homo Sapiens
LPLAREEEL

SEQ ID NO: 1161959 - protein, 9 aa, Homo Sapiens
DVMQGKLEN

SEQ ID NO: 1161960 - protein, 9 aa, Homo Sapiens
FLKYLDAKK

SEQ ID NO: 1161961 - protein, 9 aa, Homo Sapiens
WHHHNKDGR

SEQ ID NO: 1161962 - protein, 9 aa, Homo Sapiens
ATLPIRQVV

SEQ ID NO: 1161963 - protein, 9 aa, Homo Sapiens
IVVALDALH

SEQ ID NO: 1161964 - protein, 9 aa, Homo Sapiens
GMKRKTSSP

SEQ ID NO: 1161965 - protein, 9 aa, Homo Sapiens
AEKQANFTT

SEQ ID NO: 1161966 - protein, 9 aa, Homo Sapiens
NNESSESEV

SEQ ID NO: 1161967 - protein, 9 aa, Homo Sapiens
RLGQQQEGH

SEQ ID NO: 1161968 - protein, 9 aa, Homo Sapiens
GAPMTALQA

SEQ ID NO: 1161969 - protein, 9 aa, Homo Sapiens
YAATKTWDI

SEQ ID NO: 1161970 - protein, 9 aa, Homo Sapiens
TLAVMNDCL

SEQ ID NO: 1161971 - protein, 9 aa, Homo Sapiens
ELAEVREGE

SEQ ID NO: 1161972 - protein, 9 aa, Homo Sapiens
FSEDSAPGS

SEQ ID NO: 1161973 - protein, 9 aa, Homo Sapiens
KRCSLMEQI

SEQ ID NO: 1161974 - protein, 9 aa, Homo Sapiens
AIGIGTHFV

SEQ ID NO: 1161975 - protein, 9 aa, Homo Sapiens
AAGPRPQEG

SEQ ID NO: 1161976 - protein, 9 aa, Homo Sapiens
LDDVSFSPV

SEQ ID NO: 1161977 - protein, 9 aa, Homo Sapiens
NCSGGFKIH

SEQ ID NO: 1161978 - protein, 9 aa, Homo Sapiens
GREQKQLLA

SEQ ID NO: 1161979 - protein, 9 aa, Homo Sapiens
NFTTLNYDG

SEQ ID NO: 1161980 - protein, 9 aa, Homo Sapiens
LAVFYTIPT

SEQ ID NO: 1161981 - protein, 9 aa, Homo Sapiens
GRWIGILLT

SEQ ID NO: 1161982 - protein, 9 aa, Homo Sapiens
ESNVDPSKA

SEQ ID NO: 1161983 - protein, 9 aa, Homo Sapiens
NRAAITPRS

SEQ ID NO: 1161984 - protein, 9 aa, Homo Sapiens
IKAQAALGR

SEQ ID NO: 1161985 - protein, 9 aa, Homo Sapiens
RGVGVVCRQ

SEQ ID NO: 1161986 - protein, 9 aa, Homo Sapiens
VASEGTGLN

SEQ ID NO: 1161987 - protein, 9 aa, Homo Sapiens
HHNKDGRPL

SEQ ID NO: 1161988 - protein, 9 aa, Homo Sapiens
SGKGMQSLS

SEQ ID NO: 1161989 - protein, 9 aa, Homo Sapiens
VHIDPTFIS

SEQ ID NO: 1161990 - protein, 9 aa, Homo Sapiens
TQPDALISL

SEQ ID NO: 1161991 - protein, 9 aa, Homo Sapiens
WGPQLGRLF

SEQ ID NO: 1161992 - protein, 9 aa, Homo Sapiens
IRVQMEEPP

SEQ ID NO: 1161993 - protein, 9 aa, Homo Sapiens
GEEGLGQLP

SEQ ID NO: 1161994 - protein, 9 aa, Homo Sapiens
KTLNINCVD

SEQ ID NO: 1161995 - protein, 9 aa, Homo Sapiens
VRMGKSSQS

SEQ ID NO: 1161996 - protein, 9 aa, Homo Sapiens
NPATLPIRQ

SEQ ID NO: 1161997 - protein, 9 aa, Homo Sapiens
NASIFASAR

SEQ ID NO: 1161998 - protein, 9 aa, Homo Sapiens
LSGKGMQSL

SEQ ID NO: 1161999 - protein, 9 aa, Homo Sapiens
EIVVALDAL

SEQ ID NO: 1162000 - protein, 9 aa, Homo Sapiens
VFYTIPTPM

SEQ ID NO: 1162001 - protein, 9 aa, Homo Sapiens
PLGRVGVFR

SEQ ID NO: 1162002 - protein, 9 aa, Homo Sapiens
HVADHGPGL

SEQ ID NO: 1162003 - protein, 9 aa, Homo Sapiens
AAFRFSHAT

SEQ ID NO: 1162004 - protein, 9 aa, Homo Sapiens
QMEEPPAVS

SEQ ID NO: 1162005 - protein, 9 aa, Homo Sapiens
EATQAIYLF

SEQ ID NO: 1162006 - protein, 9 aa, Homo Sapiens
ESVTVLYIV

SEQ ID NO: 1162007 - protein, 9 aa, Homo Sapiens
KSNNHENVC

SEQ ID NO: 1162008 - protein, 9 aa, Homo Sapiens
QSEVDDVMQ

SEQ ID NO: 1162009 - protein, 9 aa, Homo Sapiens
LLDTPLDSG

SEQ ID NO: 1162010 - protein, 9 aa, Homo Sapiens
ILPSVQVKG

SEQ ID NO: 1162011 - protein, 9 aa, Homo Sapiens
CLYAIGGNH

SEQ ID NO: 1162012 - protein, 9 aa, Homo Sapiens
PYAPFLWGL

SEQ ID NO: 1162013 - protein, 9 aa, Homo Sapiens
ASWWKTSPT

SEQ ID NO: 1162014 - protein, 9 aa, Homo Sapiens
RKTSSPVPL

SEQ ID NO: 1162015 - protein, 9 aa, Homo Sapiens
CVFCCLPAH

SEQ ID NO: 1162016 - protein, 9 aa, Homo Sapiens
TGSPEGAEA

SEQ ID NO: 1162017 - protein, 9 aa, Homo Sapiens
LRSGPQPYA

SEQ ID NO: 1162018 - protein, 9 aa, Homo Sapiens
GKRFHHQTC

SEQ ID NO: 1162019 - protein, 9 aa, Homo Sapiens
YPRVSWNQP

SEQ ID NO: 1162020 - protein, 9 aa, Homo Sapiens
DDVMQGKLE

SEQ ID NO: 1162021 - protein, 9 aa, Homo Sapiens
IAIGIGTHF

SEQ ID NO: 1162022 - protein, 9 aa, Homo Sapiens
WKTSPTCCR

SEQ ID NO: 1162023 - protein, 9 aa, Homo Sapiens
KAQAALGRD

SEQ ID NO: 1162024 - protein, 9 aa, Homo Sapiens
SNVDPSKAW

SEQ ID NO: 1162025 - protein, 9 aa, Homo Sapiens
PVLIGRERG

SEQ ID NO: 1162026 - protein, 9 aa, Homo Sapiens
VREGEEGLG

SEQ ID NO: 1162027 - protein, 9 aa, Homo Sapiens
RILELKNEK

SEQ ID NO: 1162028 - protein, 9 aa, Homo Sapiens
LFVEQVASE

SEQ ID NO: 1162029 - protein, 9 aa, Homo Sapiens
GKEGVFSDN

SEQ ID NO: 1162030 - protein, 9 aa, Homo Sapiens
MWLPEQPGE

SEQ ID NO: 1162031 - protein, 9 aa, Homo Sapiens
TKKTTEIVK

SEQ ID NO: 1162032 - protein, 9 aa, Homo Sapiens
CPRQALTAG

SEQ ID NO: 1162033 - protein, 9 aa, Homo Sapiens
WDLRGVGVV

SEQ ID NO: 1162034 - protein, 9 aa, Homo Sapiens
RDYDNGSVS

SEQ ID NO: 1162035 - protein, 9 aa, Homo Sapiens
SLAADCGGA

SEQ ID NO: 1162036 - protein, 9 aa, Homo Sapiens
VDPGAPMTA

SEQ ID NO: 1162037 - protein, 9 aa, Homo Sapiens
RRTQNEYGF

SEQ ID NO: 1162038 - protein, 9 aa, Homo Sapiens
FRNEGNLET

SEQ ID NO: 1162039 - protein, 9 aa, Homo Sapiens
ALTAGQLTH

SEQ ID NO: 1162040 - protein, 9 aa, Homo Sapiens
KDLRPQART

SEQ ID NO: 1162041 - protein, 9 aa, Homo Sapiens
YVQESVTVL

SEQ ID NO: 1162042 - protein, 9 aa, Homo Sapiens
PATLPIRQV

SEQ ID NO: 1162043 - protein, 9 aa, Homo Sapiens
VDDVMQGKL

SEQ ID NO: 1162044 - protein, 9 aa, Homo Sapiens
ATLSGKGMQ

SEQ ID NO: 1162045 - protein, 9 aa, Homo Sapiens
RREELLKKN

SEQ ID NO: 1162046 - protein, 9 aa, Homo Sapiens
LHMGEVRTA

SEQ ID NO: 1162047 - protein, 9 aa, Homo Sapiens
EELAYHYTR

SEQ ID NO: 1162048 - protein, 9 aa, Homo Sapiens
IQRWAAEIV

SEQ ID NO: 1162049 - protein, 9 aa, Homo Sapiens
CGVENSTGA

SEQ ID NO: 1162050 - protein, 9 aa, Homo Sapiens
PVIQVKALI

SEQ ID NO: 1162051 - protein, 9 aa, Homo Sapiens
KSSQSADQC

SEQ ID NO: 1162052 - protein, 9 aa, Homo Sapiens
GAHRRGCCG

SEQ ID NO: 1162053 - protein, 9 aa, Homo Sapiens
TPFIIDEKT

SEQ ID NO: 1162054 - protein, 9 aa, Homo Sapiens
RSCMQPAAG

SEQ ID NO: 1162055 - protein, 9 aa, Homo Sapiens
DLYRDMMLE

SEQ ID NO: 1162056 - protein, 9 aa, Homo Sapiens
GNLETFDKS

SEQ ID NO: 1162057 - protein, 9 aa, Homo Sapiens
FIVSGNLSI

SEQ ID NO: 1162058 - protein, 9 aa, Homo Sapiens
YDVDATLKS

SEQ ID NO: 1162059 - protein, 9 aa, Homo Sapiens
GLGQLPKEE

SEQ ID NO: 1162060 - protein, 9 aa, Homo Sapiens
LLKGKRFHH

SEQ ID NO: 1162061 - protein, 9 aa, Homo Sapiens
LYRVVWGPQ

SEQ ID NO: 1162062 - protein, 9 aa, Homo Sapiens
KTTEIVKCY

SEQ ID NO: 1162063 - protein, 9 aa, Homo Sapiens
MGEVRTARA

SEQ ID NO: 1162064 - protein, 9 aa, Homo Sapiens
DTHGLRFPW

SEQ ID NO: 1162065 - protein, 9 aa, Homo Sapiens
PCPAASQLR

SEQ ID NO: 1162066 - protein, 9 aa, Homo Sapiens
IPTPMLNPI

SEQ ID NO: 1162067 - protein, 9 aa, Homo Sapiens
LLLLLLLPC

SEQ ID NO: 1162068 - protein, 9 aa, Homo Sapiens
GILLTETGS

SEQ ID NO: 1162069 - protein, 9 aa, Homo Sapiens
LEESKTLNI

SEQ ID NO: 1162070 - protein, 9 aa, Homo Sapiens
AVNDFYAAT

SEQ ID NO: 1162071 - protein, 9 aa, Homo Sapiens
DPTFISNGP

SEQ ID NO: 1162072 - protein, 9 aa, Homo Sapiens
RRGCCGLPH

SEQ ID NO: 1162073 - protein, 9 aa, Homo Sapiens
QYVLIVDSE

SEQ ID NO: 1162074 - protein, 9 aa, Homo Sapiens
ECILPSVQV

SEQ ID NO: 1162075 - protein, 9 aa, Homo Sapiens
QQQEGHVVA

SEQ ID NO: 1162076 - protein, 9 aa, Homo Sapiens
EGPQAGSQC

SEQ ID NO: 1162077 - protein, 9 aa, Homo Sapiens
GSCLMSLLE

SEQ ID NO: 1162078 - protein, 9 aa, Homo Sapiens
VGPPATAPA

SEQ ID NO: 1162079 - protein, 9 aa, Homo Sapiens
TFISNGPFK

SEQ ID NO: 1162080 - protein, 9 aa, Homo Sapiens
ADPVLIGRE

SEQ ID NO: 1162081 - protein, 9 aa, Homo Sapiens
DSLSDDVVE

SEQ ID NO: 1162082 - protein, 9 aa, Homo Sapiens
TGPNVSVIQ

SEQ ID NO: 1162083 - protein, 9 aa, Homo Sapiens
GTAAQPSSG

SEQ ID NO: 1162084 - protein, 9 aa, Homo Sapiens
FSDNFAVQI

SEQ ID NO: 1162085 - protein, 9 aa, Homo Sapiens
RSVGMCTHC

SEQ ID NO: 1162086 - protein, 9 aa, Homo Sapiens
ITPRSCMQP

SEQ ID NO: 1162087 - protein, 9 aa, Homo Sapiens
CQYDLNLQV

SEQ ID NO: 1162088 - protein, 9 aa, Homo Sapiens
LHQLIHRSV

SEQ ID NO: 1162089 - protein, 9 aa, Homo Sapiens
ANTAEGERT

SEQ ID NO: 1162090 - protein, 9 aa, Homo Sapiens
VQMEEPPAV

SEQ ID NO: 1162091 - protein, 9 aa, Homo Sapiens
EVGLKRKDH

SEQ ID NO: 1162092 - protein, 9 aa, Homo Sapiens
TLTPRIPLW

SEQ ID NO: 1162093 - protein, 9 aa, Homo Sapiens
NPHLTEVKQ

SEQ ID NO: 1162094 - protein, 9 aa, Homo Sapiens
WPPLKLVAC

SEQ ID NO: 1162095 - protein, 9 aa, Homo Sapiens
AAQACVFCC

SEQ ID NO: 1162096 - protein, 9 aa, Homo Sapiens
SISEAVQPG

SEQ ID NO: 1162097 - protein, 9 aa, Homo Sapiens
HCGTAAQPS

SEQ ID NO: 1162098 - protein, 9 aa, Homo Sapiens
TKSSKHNVA

SEQ ID NO: 1162099 - protein, 9 aa, Homo Sapiens
AFRFSHATI

SEQ ID NO: 1162100 - protein, 9 aa, Homo Sapiens
GKSSQSADQ

SEQ ID NO: 1162101 - protein, 9 aa, Homo Sapiens
HVVAPLRVG

SEQ ID NO: 1162102 - protein, 9 aa, Homo Sapiens
HVNGKSIHD

SEQ ID NO: 1162103 - protein, 9 aa, Homo Sapiens
TAGPPPRTI

SEQ ID NO: 1162104 - protein, 9 aa, Homo Sapiens
NHENVCLAK

SEQ ID NO: 1162105 - protein, 9 aa, Homo Sapiens
AITPRSCMQ

SEQ ID NO: 1162106 - protein, 9 aa, Homo Sapiens
IPNNLPFTL

SEQ ID NO: 1162107 - protein, 9 aa, Homo Sapiens
YAYICVFIY

SEQ ID NO: 1162108 - protein, 9 aa, Homo Sapiens
ILSNEVGLK

SEQ ID NO: 1162109 - protein, 9 aa, Homo Sapiens
SNFIIFFKN

SEQ ID NO: 1162110 - protein, 9 aa, Homo Sapiens
NVFVDTHGL

SEQ ID NO: 1162111 - protein, 9 aa, Homo Sapiens
GSGGRSRSV

SEQ ID NO: 1162112 - protein, 9 aa, Homo Sapiens
GHVVAPLRV

SEQ ID NO: 1162113 - protein, 9 aa, Homo Sapiens
FCRALKYIL

SEQ ID NO: 1162114 - protein, 9 aa, Homo Sapiens
VNGKSIHDI

SEQ ID NO: 1162115 - protein, 9 aa, Homo Sapiens
GEDRRPGGA

SEQ ID NO: 1162116 - protein, 9 aa, Homo Sapiens
GLDCTGSPE

SEQ ID NO: 1162117 - protein, 9 aa, Homo Sapiens
SGASWWKTS

SEQ ID NO: 1162118 - protein, 9 aa, Homo Sapiens
RERGEDRRP

SEQ ID NO: 1162119 - protein, 9 aa, Homo Sapiens
CTQPDALIS

SEQ ID NO: 1162120 - protein, 9 aa, Homo Sapiens
KIEQERKHR

SEQ ID NO: 1162121 - protein, 9 aa, Homo Sapiens
YAPFLWGLA

SEQ ID NO: 1162122 - protein, 9 aa, Homo Sapiens
RCSLMEQIP

SEQ ID NO: 1162123 - protein, 9 aa, Homo Sapiens
PAPVIQVKA

SEQ ID NO: 1162124 - protein, 9 aa, Homo Sapiens
DCGGADVAS

SEQ ID NO: 1162125 - protein, 9 aa, Homo Sapiens
LSPLCYENM

SEQ ID NO: 1162126 - protein, 9 aa, Homo Sapiens
EEETTLGSC

SEQ ID NO: 1162127 - protein, 9 aa, Homo Sapiens
RSLITAGRI

SEQ ID NO: 1162128 - protein, 9 aa, Homo Sapiens
PFIIDEKTG

SEQ ID NO: 1162129 - protein, 9 aa, Homo Sapiens
EKIQSLSSS

SEQ ID NO: 1162130 - protein, 9 aa, Homo Sapiens
QNENNESSE

SEQ ID NO: 1162131 - protein, 9 aa, Homo Sapiens
AGSQCHRLG

SEQ ID NO: 1162132 - protein, 9 aa, Homo Sapiens
EQERKHRQK

SEQ ID NO: 1162133 - protein, 9 aa, Homo Sapiens
PVGPPATAP

SEQ ID NO: 1162134 - protein, 9 aa, Homo Sapiens
ISTERRTQN

SEQ ID NO: 1162135 - protein, 9 aa, Homo Sapiens
PHCCGAHRR

SEQ ID NO: 1162136 - protein, 9 aa, Homo Sapiens
PMYFFSQQL

SEQ ID NO: 1162137 - protein, 9 aa, Homo Sapiens
SWAGPSQNP

SEQ ID NO: 1162138 - protein, 9 aa, Homo Sapiens
VKQWLCLNC

SEQ ID NO: 1162139 - protein, 9 aa, Homo Sapiens
TWEHCWVIC

SEQ ID NO: 1162140 - protein, 9 aa, Homo Sapiens
GQAGRELLI

SEQ ID NO: 1162141 - protein, 9 aa, Homo Sapiens
LLLPCPAAS

SEQ ID NO: 1162142 - protein, 9 aa, Homo Sapiens
PTPMLNPII

SEQ ID NO: 1162143 - protein, 9 aa, Homo Sapiens
IGIAIGIGT

SEQ ID NO: 1162144 - protein, 9 aa, Homo Sapiens
HLTEVKQWL

SEQ ID NO: 1162145 - protein, 9 aa, Homo Sapiens
LIEDAGVTV

SEQ ID NO: 1162146 - protein, 9 aa, Homo Sapiens
WRQFIYSLD

SEQ ID NO: 1162147 - protein, 9 aa, Homo Sapiens
FHHVGQAGR

SEQ ID NO: 1162148 - protein, 9 aa, Homo Sapiens
TTLNYDGST

SEQ ID NO: 1162149 - protein, 9 aa, Homo Sapiens
LGRVGVFRD

SEQ ID NO: 1162150 - protein, 9 aa, Homo Sapiens
SHDCPSEHV

SEQ ID NO: 1162151 - protein, 9 aa, Homo Sapiens
LGQQQEGHV

SEQ ID NO: 1162152 - protein, 9 aa, Homo Sapiens
GPQPYAPFL

SEQ ID NO: 1162153 - protein, 9 aa, Homo Sapiens
TCCRTALSS

SEQ ID NO: 1162154 - protein, 9 aa, Homo Sapiens
HLYKVKALN

SEQ ID NO: 1162155 - protein, 9 aa, Homo Sapiens
TRLGSHLVL

SEQ ID NO: 1162156 - protein, 9 aa, Homo Sapiens
PPPRTISPP

SEQ ID NO: 1162157 - protein, 9 aa, Homo Sapiens
HQSLGEAKE

SEQ ID NO: 1162158 - protein, 9 aa, Homo Sapiens
TSPTCCRTA

SEQ ID NO: 1162159 - protein, 9 aa, Homo Sapiens
VFCCLPAHD

SEQ ID NO: 1162160 - protein, 9 aa, Homo Sapiens
TPRIPLWGY

SEQ ID NO: 1162161 - protein, 9 aa, Homo Sapiens
SIFASARLF

SEQ ID NO: 1162162 - protein, 9 aa, Homo Sapiens
LNLQVIYPE

SEQ ID NO: 1162163 - protein, 9 aa, Homo Sapiens
GQAEGPQAG

SEQ ID NO: 1162164 - protein, 9 aa, Homo Sapiens
VWGTGNPWR

SEQ ID NO: 1162165 - protein, 9 aa, Homo Sapiens
SETTEANTA

SEQ ID NO: 1162166 - protein, 9 aa, Homo Sapiens
YENMAQSGA

SEQ ID NO: 1162167 - protein, 9 aa, Homo Sapiens
AARWPGAGP

SEQ ID NO: 1162168 - protein, 9 aa, Homo Sapiens
SWWKTSPTC

SEQ ID NO: 1162169 - protein, 9 aa, Homo Sapiens
FSLNPRSLI

SEQ ID NO: 1162170 - protein, 9 aa, Homo Sapiens
WVPASWVTF

SEQ ID NO: 1162171 - protein, 9 aa, Homo Sapiens
ARWPGAGPP

SEQ ID NO: 1162172 - protein, 9 aa, Homo Sapiens
SKHNVASEK

SEQ ID NO: 1162173 - protein, 9 aa, Homo Sapiens
PSETTEANT

SEQ ID NO: 1162174 - protein, 9 aa, Homo Sapiens
TAGQLTHST

SEQ ID NO: 1162175 - protein, 9 aa, Homo Sapiens
GLKRKDHHL

SEQ ID NO: 1162176 - protein, 9 aa, Homo Sapiens
IGILLTETG

SEQ ID NO: 1162177 - protein, 9 aa, Homo Sapiens
GTHFVVEDD

SEQ ID NO: 1162178 - protein, 9 aa, Homo Sapiens
WCPRQALTA

SEQ ID NO: 1162179 - protein, 9 aa, Homo Sapiens
IQVKALIVV

SEQ ID NO: 1162180 - protein, 9 aa, Homo Sapiens
YVALDDVSF

SEQ ID NO: 1162181 - protein, 9 aa, Homo Sapiens
AANVHIDPT

SEQ ID NO: 1162182 - protein, 9 aa, Homo Sapiens
HHHNKDGRP

SEQ ID NO: 1162183 - protein, 9 aa, Homo Sapiens
LPVGPPATA

SEQ ID NO: 1162184 - protein, 9 aa, Homo Sapiens
SSQSADQCR

SEQ ID NO: 1162185 - protein, 9 aa, Homo Sapiens
TERRTQNEY

SEQ ID NO: 1162186 - protein, 9 aa, Homo Sapiens
DVSFSPVHC

SEQ ID NO: 1162187 - protein, 9 aa, Homo Sapiens
LTHSTGTHH

SEQ ID NO: 1162188 - protein, 9 aa, Homo Sapiens
AYHYTRLGS

SEQ ID NO: 1162189 - protein, 9 aa, Homo Sapiens
RIPLWGYSS

SEQ ID NO: 1162190 - protein, 9 aa, Homo Sapiens
TFDKSALEG

SEQ ID NO: 1162191 - protein, 9 aa, Homo Sapiens
KALIVVHLI

SEQ ID NO: 1162192 - protein, 9 aa, Homo Sapiens
NVCLAKAKG

SEQ ID NO: 1162193 - protein, 9 aa, Homo Sapiens
KEELQGSGD

SEQ ID NO: 1162194 - protein, 9 aa, Homo Sapiens
LISLFSEIE

SEQ ID NO: 1162195 - protein, 9 aa, Homo Sapiens
HAYAYICVF

SEQ ID NO: 1162196 - protein, 9 aa, Homo Sapiens
AGGWHHHNK

SEQ ID NO: 1162197 - protein, 9 aa, Homo Sapiens
CGKVFIVSG

SEQ ID NO: 1162198 - protein, 9 aa, Homo Sapiens
GWVPASWVT

SEQ ID NO: 1162199 - protein, 9 aa, Homo Sapiens
GSGDNVDVL

SEQ ID NO: 1162200 - protein, 9 aa, Homo Sapiens
VAASAPPFS

SEQ ID NO: 1162201 - protein, 9 aa, Homo Sapiens
AQACVFCCL

SEQ ID NO: 1162202 - protein, 9 aa, Homo Sapiens
RQNRAAITP

SEQ ID NO: 1162203 - protein, 9 aa, Homo Sapiens
LQVIRVQME

SEQ ID NO: 1162204 - protein, 9 aa, Homo Sapiens
TALSSTCVG

SEQ ID NO: 1162205 - protein, 9 aa, Homo Sapiens
QDELLQAPL

SEQ ID NO: 1162206 - protein, 9 aa, Homo Sapiens
HRRGCCGLP

SEQ ID NO: 1162207 - protein, 9 aa, Homo Sapiens
CLEGADACS

SEQ ID NO: 1162208 - protein, 9 aa, Homo Sapiens
TSSPVPLPP

SEQ ID NO: 1162209 - protein, 9 aa, Homo Sapiens
LQAPLLRSG

SEQ ID NO: 1162210 - protein, 9 aa, Homo Sapiens
KPASHRFLS

SEQ ID NO: 1162211 - protein, 9 aa, Homo Sapiens
RGEDRRPGG

SEQ ID NO: 1162212 - protein, 9 aa, Homo Sapiens
EVKQWLCLN

SEQ ID NO: 1162213 - protein, 9 aa, Homo Sapiens
LFSVGLHMG

SEQ ID NO: 1162214 - protein, 9 aa, Homo Sapiens
PLLRSGPQP

SEQ ID NO: 1162215 - protein, 9 aa, Homo Sapiens
AIREIKILH

SEQ ID NO: 1162216 - protein, 9 aa, Homo Sapiens
GHLNYTCGV

SEQ ID NO: 1162217 - protein, 9 aa, Homo Sapiens
TEANTAEGE

SEQ ID NO: 1162218 - protein, 9 aa, Homo Sapiens
HGLRFPWVA

SEQ ID NO: 1162219 - protein, 9 aa, Homo Sapiens
GRALLDTPL

SEQ ID NO: 1162220 - protein, 9 aa, Homo Sapiens
NVKDLRPQA

SEQ ID NO: 1162221 - protein, 9 aa, Homo Sapiens
APHLMHQWC

SEQ ID NO: 1162222 - protein, 9 aa, Homo Sapiens
IREIKILHQ

SEQ ID NO: 1162223 - protein, 9 aa, Homo Sapiens
ASWVTFSQC

SEQ ID NO: 1162224 - protein, 9 aa, Homo Sapiens
RGTSGTPSS

SEQ ID NO: 1162225 - protein, 9 aa, Homo Sapiens
QGREQKQLL

SEQ ID NO: 1162226 - protein, 9 aa, Homo Sapiens
VHQSLGEAK

SEQ ID NO: 1162227 - protein, 9 aa, Homo Sapiens
SALDVRLVF

SEQ ID NO: 1162228 - protein, 9 aa, Homo Sapiens
SIPNNLPFT

SEQ ID NO: 1162229 - protein, 9 aa, Homo Sapiens
KVFIVSGNL

SEQ ID NO: 1162230 - protein, 9 aa, Homo Sapiens
YDLNLQVIY

SEQ ID NO: 1162231 - protein, 9 aa, Homo Sapiens
TPRSCMQPA

SEQ ID NO: 1162232 - protein, 9 aa, Homo Sapiens
QWCPRQALT

SEQ ID NO: 1162233 - protein, 9 aa, Homo Sapiens
HLNYTCGVE

SEQ ID NO: 1162234 - protein, 9 aa, Homo Sapiens
VVAPLRVGV

SEQ ID NO: 1162235 - protein, 9 aa, Homo Sapiens
LSTQNENNE

SEQ ID NO: 1162236 - protein, 9 aa, Homo Sapiens
VTRLSPLCY

SEQ ID NO: 1162237 - protein, 9 aa, Homo Sapiens
CCRTALSST

SEQ ID NO: 1162238 - protein, 9 aa, Homo Sapiens
AQPSSGASW

SEQ ID NO: 1162239 - protein, 9 aa, Homo Sapiens
GKVFIVSGN

SEQ ID NO: 1162240 - protein, 9 aa, Homo Sapiens
TSALDVRLV

SEQ ID NO: 1162241 - protein, 9 aa, Homo Sapiens
AGQLTHSTG

SEQ ID NO: 1162242 - protein, 9 aa, Homo Sapiens
SVGMCTHCG

SEQ ID NO: 1162243 - protein, 9 aa, Homo Sapiens
KHSFEILDK

SEQ ID NO: 1162244 - protein, 9 aa, Homo Sapiens
YEVWLGNLF

SEQ ID NO: 1162245 - protein, 9 aa, Homo Sapiens
EDAGVTVTL

SEQ ID NO: 1162246 - protein, 9 aa, Homo Sapiens
CCLPAHDLS

SEQ ID NO: 1162247 - protein, 9 aa, Homo Sapiens
VIQVKALIV

SEQ ID NO: 1162248 - protein, 9 aa, Homo Sapiens
NENNESSES

SEQ ID NO: 1162249 - protein, 9 aa, Homo Sapiens
YTIPTPMLN

SEQ ID NO: 1162250 - protein, 9 aa, Homo Sapiens
DALFDIESN

SEQ ID NO: 1162251 - protein, 9 aa, Homo Sapiens
QARTILKWN

SEQ ID NO: 1162252 - protein, 9 aa, Homo Sapiens
SPLCYENMA

SEQ ID NO: 1162253 - protein, 9 aa, Homo Sapiens
FYAATKTWD

SEQ ID NO: 1162254 - protein, 9 aa, Homo Sapiens
SGGFKIHEI

SEQ ID NO: 1162255 - protein, 9 aa, Homo Sapiens
DDVVEATQA

SEQ ID NO: 1162256 - protein, 9 aa, Homo Sapiens
DYDVDATLK

SEQ ID NO: 1162257 - protein, 9 aa, Homo Sapiens
TLEEEKIQS

SEQ ID NO: 1162258 - protein, 9 aa, Homo Sapiens
VEQVASEGT

SEQ ID NO: 1162259 - protein, 9 aa, Homo Sapiens
LETSALDVR

SEQ ID NO: 1162260 - protein, 9 aa, Homo Sapiens
TSCQYDLNL

SEQ ID NO: 1162261 - protein, 9 aa, Homo Sapiens
QSLSSSSRN

SEQ ID NO: 1162262 - protein, 9 aa, Homo Sapiens
TNAPGNVEK

SEQ ID NO: 1162263 - protein, 9 aa, Homo Sapiens
KWQSEVDDV

SEQ ID NO: 1162264 - protein, 9 aa, Homo Sapiens
EEKIQSLSS

SEQ ID NO: 1162265 - protein, 9 aa, Homo Sapiens
FFKNTVISD

SEQ ID NO: 1162266 - protein, 9 aa, Homo Sapiens
SDLFKAQYV

SEQ ID NO: 1162267 - protein, 9 aa, Homo Sapiens
LLLYRVVWG

SEQ ID NO: 1162268 - protein, 9 aa, Homo Sapiens
LTKGKQGRE

SEQ ID NO: 1162269 - protein, 9 aa, Homo Sapiens
NVHIDPTFI

SEQ ID NO: 1162270 - protein, 9 aa, Homo Sapiens
MSKETVPEA

SEQ ID NO: 1162271 - protein, 9 aa, Homo Sapiens
PRQNRAAIT

SEQ ID NO: 1162272 - protein, 9 aa, Homo Sapiens
PKPASHRFL

SEQ ID NO: 1162273 - protein, 9 aa, Homo Sapiens
GGRSRSVGM

SEQ ID NO: 1162274 - protein, 9 aa, Homo Sapiens
GYLLHNSHS

SEQ ID NO: 1162275 - protein, 9 aa, Homo Sapiens
PRDDGEEVA

SEQ ID NO: 1162276 - protein, 9 aa, Homo Sapiens
LLQAPLLRS

SEQ ID NO: 1162277 - protein, 9 aa, Homo Sapiens
KQANFTTLN

SEQ ID NO: 1162278 - protein, 9 aa, Homo Sapiens
CYENMAQSG

SEQ ID NO: 1162279 - protein, 9 aa, Homo Sapiens
STQNENNES

SEQ ID NO: 1162280 - protein, 9 aa, Homo Sapiens
GSLKKKRAE

SEQ ID NO: 1162281 - protein, 9 aa, Homo Sapiens
QSDLFKAQY

SEQ ID NO: 1162282 - protein, 9 aa, Homo Sapiens
AVMNDCLYA

SEQ ID NO: 1162283 - protein, 9 aa, Homo Sapiens
LTETGSSTD

SEQ ID NO: 1162284 - protein, 9 aa, Homo Sapiens
VQESVTVLY

SEQ ID NO: 1162285 - protein, 9 aa, Homo Sapiens
GGYVALDDV

SEQ ID NO: 1162286 - protein, 9 aa, Homo Sapiens
ANKWTGPNV

SEQ ID NO: 1162287 - protein, 9 aa, Homo Sapiens
TELMLLSEI

SEQ ID NO: 1162288 - protein, 9 aa, Homo Sapiens
ASIFASARL

SEQ ID NO: 1162289 - protein, 9 aa, Homo Sapiens
AEGPQAGSQ

SEQ ID NO: 1162290 - protein, 9 aa, Homo Sapiens
SCQYDLNLQ

SEQ ID NO: 1162291 - protein, 9 aa, Homo Sapiens
GHGHCLEGA

SEQ ID NO: 1162292 - protein, 9 aa, Homo Sapiens
PISTERRTQ

SEQ ID NO: 1162293 - protein, 9 aa, Homo Sapiens
ATKTWDIEL

SEQ ID NO: 1162294 - protein, 9 aa, Homo Sapiens
FDFLKYLDA

SEQ ID NO: 1162295 - protein, 9 aa, Homo Sapiens
GPSQNPATL

SEQ ID NO: 1162296 - protein, 9 aa, Homo Sapiens
SEEEAFDFL

SEQ ID NO: 1162297 - protein, 9 aa, Homo Sapiens
CHRLGQQQE

SEQ ID NO: 1162298 - protein, 9 aa, Homo Sapiens
DDATLSGKG

SEQ ID NO: 1162299 - protein, 9 aa, Homo Sapiens
CAPHLMHQW

SEQ ID NO: 1162300 - protein, 9 aa, Homo Sapiens
GSMQDELLQ

SEQ ID NO: 1162301 - protein, 9 aa, Homo Sapiens
ELLQAPLLR

SEQ ID NO: 1162302 - protein, 9 aa, Homo Sapiens
AGPSQNPAT

SEQ ID NO: 1162303 - protein, 9 aa, Homo Sapiens
RVGVFRDYD

SEQ ID NO: 1162304 - protein, 9 aa, Homo Sapiens
NAPGNVEKY

SEQ ID NO: 1162305 - protein, 9 aa, Homo Sapiens
DNVDVLPAP

SEQ ID NO: 1162306 - protein, 9 aa, Homo Sapiens
DLRPQARTI

SEQ ID NO: 1162307 - protein, 9 aa, Homo Sapiens
RFHHQTCSC

SEQ ID NO: 1162308 - protein, 9 aa, Homo Sapiens
RVQMEEPPA

SEQ ID NO: 1162309 - protein, 9 aa, Homo Sapiens
VLIGRERGE

SEQ ID NO: 1162310 - protein, 9 aa, Homo Sapiens
SQNPATLPI

SEQ ID NO: 1162311 - protein, 9 aa, Homo Sapiens
SLRPKDYDV

SEQ ID NO: 1162312 - protein, 9 aa, Homo Sapiens
KSSKHNVAS

SEQ ID NO: 1162313 - protein, 9 aa, Homo Sapiens
SGHHLYKVK

SEQ ID NO: 1162314 - protein, 9 aa, Homo Sapiens
HLGVDVSHV

SEQ ID NO: 1162315 - protein, 9 aa, Homo Sapiens
GVDVSHVAD

SEQ ID NO: 1162316 - protein, 9 aa, Homo Sapiens
SVQLRHFLT

SEQ ID NO: 1162317 - protein, 9 aa, Homo Sapiens
ASISEAVQP

SEQ ID NO: 1162318 - protein, 9 aa, Homo Sapiens
ETTLGSCLM

SEQ ID NO: 1162319 - protein, 9 aa, Homo Sapiens
KSNFIIFFK

SEQ ID NO: 1162320 - protein, 9 aa, Homo Sapiens
MYFFSQQLV

SEQ ID NO: 1162321 - protein, 9 aa, Homo Sapiens
LPSGHHLYK

SEQ ID NO: 1162322 - protein, 9 aa, Homo Sapiens
CSGGFKIHE

SEQ ID NO: 1162323 - protein, 9 aa, Homo Sapiens
QAGSQCHRL

SEQ ID NO: 1162324 - protein, 9 aa, Homo Sapiens
GHQGSQLLT

SEQ ID NO: 1162325 - protein, 9 aa, Homo Sapiens
MGKSSQSAD

SEQ ID NO: 1162326 - protein, 9 aa, Homo Sapiens
RDDGEEVAW

SEQ ID NO: 1162327 - protein, 9 aa, Homo Sapiens
QHECILPSV

SEQ ID NO: 1162328 - protein, 9 aa, Homo Sapiens
CLAKAKGVW

SEQ ID NO: 1162329 - protein, 9 aa, Homo Sapiens
TGTHHPRQN

SEQ ID NO: 1162330 - protein, 9 aa, Homo Sapiens
SVQVKGNFA

SEQ ID NO: 1162331 - protein, 9 aa, Homo Sapiens
EESKTLNIN

SEQ ID NO: 1162332 - protein, 9 aa, Homo Sapiens
ASEGTGLNP

SEQ ID NO: 1162333 - protein, 9 aa, Homo Sapiens
VGVGSMQDE

SEQ ID NO: 1162334 - protein, 9 aa, Homo Sapiens
REIKILHQL

SEQ ID NO: 1162335 - protein, 9 aa, Homo Sapiens
TCSIPNNLP

SEQ ID NO: 1162336 - protein, 9 aa, Homo Sapiens
IPTKSSKHN

SEQ ID NO: 1162337 - protein, 9 aa, Homo Sapiens
HMGEVRTAR

SEQ ID NO: 1162338 - protein, 9 aa, Homo Sapiens
GHHLYKVKA

SEQ ID NO: 1162339 - protein, 9 aa, Homo Sapiens
VSTWEHCWV

SEQ ID NO: 1162340 - protein, 9 aa, Homo Sapiens
QNPATLPIR

SEQ ID NO: 1162341 - protein, 9 aa, Homo Sapiens
TKTWDIELS

SEQ ID NO: 1162342 - protein, 9 aa, Homo Sapiens
GALASISEA

SEQ ID NO: 1162343 - protein, 9 aa, Homo Sapiens
PCAPHLMHQ

SEQ ID NO: 1162344 - protein, 9 aa, Homo Sapiens
HVGQAGREL

SEQ ID NO: 1162345 - protein, 9 aa, Homo Sapiens
ERAARWPGA

SEQ ID NO: 1162346 - protein, 9 aa, Homo Sapiens
KIHEIQCVD

SEQ ID NO: 1162347 - protein, 9 aa, Homo Sapiens
EIKAQAALG

SEQ ID NO: 1162348 - protein, 9 aa, Homo Sapiens
FTTLNYDGS

SEQ ID NO: 1162349 - protein, 9 aa, Homo Sapiens
EEEAFDFLK

SEQ ID NO: 1162350 - protein, 9 aa, Homo Sapiens
RWIGILLTE

SEQ ID NO: 1162351 - protein, 9 aa, Homo Sapiens
APNEAVGSS

SEQ ID NO: 1162352 - protein, 9 aa, Homo Sapiens
MKHSFEILD

SEQ ID NO: 1162353 - protein, 9 aa, Homo Sapiens
GYVALDDVS

SEQ ID NO: 1162354 - protein, 9 aa, Homo Sapiens
LNASIFASA

SEQ ID NO: 1162355 - protein, 9 aa, Homo Sapiens
HFNPKPASH

SEQ ID NO: 1162356 - protein, 9 aa, Homo Sapiens
STCVGPHCC

SEQ ID NO: 1162357 - protein, 9 aa, Homo Sapiens
LVFHGYLLH

SEQ ID NO: 1162358 - protein, 9 aa, Homo Sapiens
ANVHIDPTF

SEQ ID NO: 1162359 - protein, 9 aa, Homo Sapiens
MCTHCGTAA

SEQ ID NO: 1162360 - protein, 9 aa, Homo Sapiens
MQPAAGPRP

SEQ ID NO: 1162361 - protein, 9 aa, Homo Sapiens
LCYENMAQS

SEQ ID NO: 1162362 - protein, 9 aa, Homo Sapiens
FIYPISTER

SEQ ID NO: 1162363 - protein, 9 aa, Homo Sapiens
APMTALQAL

SEQ ID NO: 1162364 - protein, 9 aa, Homo Sapiens
PTCCRTALS

SEQ ID NO: 1162365 - protein, 9 aa, Homo Sapiens
ERGEDRRPG

SEQ ID NO: 1162366 - protein, 9 aa, Homo Sapiens
QNRAAITPR

SEQ ID NO: 1162367 - protein, 9 aa, Homo Sapiens
AASAPPFSG

SEQ ID NO: 1162368 - protein, 9 aa, Homo Sapiens
KKIVFVIFC

SEQ ID NO: 1162369 - protein, 9 aa, Homo Sapiens
FFYPWFCRA

SEQ ID NO: 1162370 - protein, 9 aa, Homo Sapiens
LRGVGVVCR

SEQ ID NO: 1162371 - protein, 9 aa, Homo Sapiens
NINCVDYMG

SEQ ID NO: 1162372 - protein, 9 aa, Homo Sapiens
LPSVQVKGN

SEQ ID NO: 1162373 - protein, 9 aa, Homo Sapiens
SVGLHMGEV

SEQ ID NO: 1162374 - protein, 9 aa, Homo Sapiens
NVDVLPAPV

SEQ ID NO: 1162375 - protein, 9 aa, Homo Sapiens
NEKVELELT

SEQ ID NO: 1162376 - protein, 9 aa, Homo Sapiens
NHLGVDVSH

SEQ ID NO: 1162377 - protein, 9 aa, Homo Sapiens
SAPGSGGRS

SEQ ID NO: 1162378 - protein, 9 aa, Homo Sapiens
FQGMKRKTS

SEQ ID NO: 1162379 - protein, 9 aa, Homo Sapiens
IRQVVVRIG

SEQ ID NO: 1162380 - protein, 9 aa, Homo Sapiens
TRLSPLCYE

SEQ ID NO: 1162381 - protein, 9 aa, Homo Sapiens
QVLISTGNF

SEQ ID NO: 1162382 - protein, 9 aa, Homo Sapiens
GEEVAWEEE

SEQ ID NO: 1162383 - protein, 9 aa, Homo Sapiens
CGGADVASI

SEQ ID NO: 1162384 - protein, 9 aa, Homo Sapiens
KILHQLIHR

SEQ ID NO: 1162385 - protein, 9 aa, Homo Sapiens
EETTLGSCL

SEQ ID NO: 1162386 - protein, 9 aa, Homo Sapiens
PIRQVVVRI

SEQ ID NO: 1162387 - protein, 9 aa, Homo Sapiens
HCLEGADAC

SEQ ID NO: 1162388 - protein, 9 aa, Homo Sapiens
NAQLPSKRI

SEQ ID NO: 1162389 - protein, 9 aa, Homo Sapiens
YTLSSLSYG

SEQ ID NO: 1162390 - protein, 9 aa, Homo Sapiens
EGEEGLGQL

SEQ ID NO: 1162391 - protein, 9 aa, Homo Sapiens
QEGHGHCLE

SEQ ID NO: 1162392 - protein, 9 aa, Homo Sapiens
RRVSLAADC

SEQ ID NO: 1162393 - protein, 9 aa, Homo Sapiens
QLTHSTGTH

SEQ ID NO: 1162394 - protein, 9 aa, Homo Sapiens
RQVVVRIGQ

SEQ ID NO: 1162395 - protein, 9 aa, Homo Sapiens
LGSCLMSLL

SEQ ID NO: 1162396 - protein, 9 aa, Homo Sapiens
LLYRVVWGP

SEQ ID NO: 1162397 - protein, 9 aa, Homo Sapiens
KRTKQEMKT

SEQ ID NO: 1162398 - protein, 9 aa, Homo Sapiens
HDCPSEHVN

SEQ ID NO: 1162399 - protein, 9 aa, Homo Sapiens
MHQWCPRQA

SEQ ID NO: 1162400 - protein, 9 aa, Homo Sapiens
TQNENNESS

SEQ ID NO: 1162401 - protein, 9 aa, Homo Sapiens
APFLWGLAP

SEQ ID NO: 1162402 - protein, 9 aa, Homo Sapiens
PWFCRALKY

SEQ ID NO: 1162403 - protein, 9 aa, Homo Sapiens
QVIRVQMEE

SEQ ID NO: 1162404 - protein, 9 aa, Homo Sapiens
EANTAEGER

SEQ ID NO: 1162405 - protein, 9 aa, Homo Sapiens
KHNVASEKQ

SEQ ID NO: 1162406 - protein, 9 aa, Homo Sapiens
CLMSLLEKV

SEQ ID NO: 1162407 - protein, 9 aa, Homo Sapiens
TEIVKCYPV

SEQ ID NO: 1162408 - protein, 9 aa, Homo Sapiens
IHAYAYICV

SEQ ID NO: 1162409 - protein, 9 aa, Homo Sapiens
DCTGSPEGA

SEQ ID NO: 1162410 - protein, 9 aa, Homo Sapiens
LRHFLTLAP

SEQ ID NO: 1162411 - protein, 9 aa, Homo Sapiens
LTVDPGAPM

SEQ ID NO: 1162412 - protein, 9 aa, Homo Sapiens
ELAYHYTRL

SEQ ID NO: 1162413 - protein, 9 aa, Homo Sapiens
VGPHCCGAH

SEQ ID NO: 1162414 - protein, 9 aa, Homo Sapiens
VAPLRVGVG

SEQ ID NO: 1162415 - protein, 9 aa, Homo Sapiens
IHEIQCVDS

SEQ ID NO: 1162416 - protein, 9 aa, Homo Sapiens
THGLRFPWV

SEQ ID NO: 1162417 - protein, 9 aa, Homo Sapiens
CPAASQLRY

SEQ ID NO: 1162418 - protein, 9 aa, Homo Sapiens
CILPSVQVK

SEQ ID NO: 1162419 - protein, 9 aa, Homo Sapiens
PISLPNHAR

SEQ ID NO: 1162420 - protein, 9 aa, Homo Sapiens
PHLTEVKQW

SEQ ID NO: 1162421 - protein, 9 aa, Homo Sapiens
LSSTCVGPH

SEQ ID NO: 1162422 - protein, 9 aa, Homo Sapiens
PTKSSKHNV

SEQ ID NO: 1162423 - protein, 9 aa, Homo Sapiens
YICVFIYTH

SEQ ID NO: 1162424 - protein, 9 aa, Homo Sapiens
VCLAKAKGV

SEQ ID NO: 1162425 - protein, 9 aa, Homo Sapiens
YTCGVENST

SEQ ID NO: 1162426 - protein, 9 aa, Homo Sapiens
TVLYIVREP

SEQ ID NO: 1162427 - protein, 9 aa, Homo Sapiens
LQGSGDNVD

SEQ ID NO: 1162428 - protein, 9 aa, Homo Sapiens
GPNVSVIQK

SEQ ID NO: 1162429 - protein, 9 aa, Homo Sapiens
FLWGLAPNE

SEQ ID NO: 1162430 - protein, 9 aa, Homo Sapiens
GQLPKEELQ

SEQ ID NO: 1162431 - protein, 9 aa, Homo Sapiens
TTEANTAEG

SEQ ID NO: 1162432 - protein, 9 aa, Homo Sapiens
WWKTSPTCC

SEQ ID NO: 1162433 - protein, 9 aa, Homo Sapiens
PNHARNCVK

SEQ ID NO: 1162434 - protein, 9 aa, Homo Sapiens
VQPGQEPCA

SEQ ID NO: 1162435 - protein, 9 aa, Homo Sapiens
GASWWKTSP

SEQ ID NO: 1162436 - protein, 9 aa, Homo Sapiens
EDRRPGGAL

SEQ ID NO: 1162437 - protein, 9 aa, Homo Sapiens
MKTAHKLAK

SEQ ID NO: 1162438 - protein, 9 aa, Homo Sapiens
LFSLNPRSL

SEQ ID NO: 1162439 - protein, 9 aa, Homo Sapiens
QLPKEELQG

SEQ ID NO: 1162440 - protein, 9 aa, Homo Sapiens
DLQVIRVQM

SEQ ID NO: 1162441 - protein, 9 aa, Homo Sapiens
SLGEAKEQF

SEQ ID NO: 1162442 - protein, 9 aa, Homo Sapiens
QPGQEPCAP

SEQ ID NO: 1162443 - protein, 9 aa, Homo Sapiens
PLKLVACSQ

SEQ ID NO: 1162444 - protein, 9 aa, Homo Sapiens
DLRGVGVVC

SEQ ID NO: 1162445 - protein, 9 aa, Homo Sapiens
HRLGQQQEG

SEQ ID NO: 1162446 - protein, 9 aa, Homo Sapiens
SDDVVEATQ

SEQ ID NO: 1162447 - protein, 9 aa, Homo Sapiens
IGRERGEDR

SEQ ID NO: 1162448 - protein, 9 aa, Homo Sapiens
LETFDKSAL

SEQ ID NO: 1162449 - protein, 9 aa, Homo Sapiens
VFHGYLLHN

SEQ ID NO: 1162450 - protein, 9 aa, Homo Sapiens
EGNLETFDK

SEQ ID NO: 1162451 - protein, 9 aa, Homo Sapiens
EHVNGKSIH

SEQ ID NO: 1162452 - protein, 9 aa, Homo Sapiens
PRPQEGHGH

SEQ ID NO: 1162453 - protein, 9 aa, Homo Sapiens
LASISEAVQ

SEQ ID NO: 1162454 - protein, 9 aa, Homo Sapiens
PRIPLWGYS

SEQ ID NO: 1162455 - protein, 9 aa, Homo Sapiens
QPYAPFLWG

SEQ ID NO: 1162456 - protein, 9 aa, Homo Sapiens
SEHVNGKSI

SEQ ID NO: 1162457 - protein, 9 aa, Homo Sapiens
TLPIRQVVV

SEQ ID NO: 1162458 - protein, 9 aa, Homo Sapiens
YRDMMLENY

SEQ ID NO: 1162459 - protein, 9 aa, Homo Sapiens
VTVHQSLGE

SEQ ID NO: 1162460 - protein, 9 aa, Homo Sapiens
KDYDVDATL

SEQ ID NO: 1162461 - protein, 9 aa, Homo Sapiens
GTHHPRQNR

SEQ ID NO: 1162462 - protein, 9 aa, Homo Sapiens
AQYVLIVDS

SEQ ID NO: 1162463 - protein, 9 aa, Homo Sapiens
KEGVFSDNF

SEQ ID NO: 1162464 - protein, 9 aa, Homo Sapiens
SLPNHARNC

SEQ ID NO: 1162465 - protein, 9 aa, Homo Sapiens
DDAWDLRGV

SEQ ID NO: 1162466 - protein, 9 aa, Homo Sapiens
STWEHCWVI

SEQ ID NO: 1162467 - protein, 9 aa, Homo Sapiens
ALISLFSEI

SEQ ID NO: 1162468 - protein, 9 aa, Homo Sapiens
GSQLLTRVF

SEQ ID NO: 1162469 - protein, 9 aa, Homo Sapiens
LVTCSIPNN

SEQ ID NO: 1162470 - protein, 9 aa, Homo Sapiens
RPQEGHGHC

SEQ ID NO: 1162471 - protein, 9 aa, Homo Sapiens
QNVFVDTHG

SEQ ID NO: 1162472 - protein, 9 aa, Homo Sapiens
DFLKYLDAK

SEQ ID NO: 1162473 - protein, 9 aa, Homo Sapiens
KKTQLAEIK

SEQ ID NO: 1162474 - protein, 9 aa, Homo Sapiens
ASLPLAREE

SEQ ID NO: 1162475 - protein, 9 aa, Homo Sapiens
NNLPFTLEK

SEQ ID NO: 1162476 - protein, 9 aa, Homo Sapiens
IKILHQLIH

SEQ ID NO: 1162477 - protein, 9 aa, Homo Sapiens
VGVFRDYDN

SEQ ID NO: 1162478 - protein, 9 aa, Homo Sapiens
AGPRPQEGH

SEQ ID NO: 1162479 - protein, 9 aa, Homo Sapiens
VGLKRKDHH

SEQ ID NO: 1162480 - protein, 9 aa, Homo Sapiens
QPDALISLF

SEQ ID NO: 1162481 - protein, 9 aa, Homo Sapiens
GQLTHSTGT

SEQ ID NO: 1162482 - protein, 9 aa, Homo Sapiens
WTNAPGNVE

SEQ ID NO: 1162483 - protein, 9 aa, Homo Sapiens
HLMHQWCPR

SEQ ID NO: 1162484 - protein, 9 aa, Homo Sapiens
MKRKTSSPV

SEQ ID NO: 1162485 - protein, 9 aa, Homo Sapiens
EPCAPHLMH

SEQ ID NO: 1162486 - protein, 9 aa, Homo Sapiens
PGAPMTALQ

SEQ ID NO: 1162487 - protein, 9 aa, Homo Sapiens
FKIHEIQCV

SEQ ID NO: 1162488 - protein, 9 aa, Homo Sapiens
VVTVHQSLG

SEQ ID NO: 1162489 - protein, 9 aa, Homo Sapiens
CVGPHCCGA

SEQ ID NO: 1162490 - protein, 9 aa, Homo Sapiens
CCGAHRRGC

SEQ ID NO: 1162491 - protein, 9 aa, Homo Sapiens
CVSTWEHCW

SEQ ID NO: 1162492 - protein, 9 aa, Homo Sapiens
ERRTQNEYG

SEQ ID NO: 1162493 - protein, 9 aa, Homo Sapiens
GKGMQSLSL

SEQ ID NO: 1162494 - protein, 9 aa, Homo Sapiens
FLWPPLKLV

SEQ ID NO: 1162495 - protein, 9 aa, Homo Sapiens
SDNFAVQIN

SEQ ID NO: 1162496 - protein, 9 aa, Homo Sapiens
PWRQFIYSL

SEQ ID NO: 1162497 - protein, 9 aa, Homo Sapiens
GFFYPWFCR

SEQ ID NO: 1162498 - protein, 9 aa, Homo Sapiens
GEELAYHYT

SEQ ID NO: 1162499 - protein, 9 aa, Homo Sapiens
AWDLRGVGV

SEQ ID NO: 1162500 - protein, 9 aa, Homo Sapiens
REELLKKNA

SEQ ID NO: 1162501 - protein, 9 aa, Homo Sapiens
QALTAGQLT

SEQ ID NO: 1162502 - protein, 9 aa, Homo Sapiens
QAGRELLIS

SEQ ID NO: 1162503 - protein, 9 aa, Homo Sapiens
GGALASISE

SEQ ID NO: 1162504 - protein, 9 aa, Homo Sapiens
KKTTEIVKC

SEQ ID NO: 1162505 - protein, 9 aa, Homo Sapiens
TAAQPSSGA

SEQ ID NO: 1162506 - protein, 9 aa, Homo Sapiens
QPSSGASWW

SEQ ID NO: 1162507 - protein, 9 aa, Homo Sapiens
DGAGTPFII

SEQ ID NO: 1162508 - protein, 9 aa, Homo Sapiens
WIGILLTET

SEQ ID NO: 1162509 - protein, 9 aa, Homo Sapiens
PLCYENMAQ

SEQ ID NO: 1162510 - protein, 9 aa, Homo Sapiens
ALSSTCVGP

SEQ ID NO: 1162511 - protein, 9 aa, Homo Sapiens
GSQCHRLGQ

SEQ ID NO: 1162512 - protein, 9 aa, Homo Sapiens
RVGVGSMQD

SEQ ID NO: 1162513 - protein, 9 aa, Homo Sapiens
WTGPNVSVI

SEQ ID NO: 1162514 - protein, 9 aa, Homo Sapiens
FHGYLLHNS

SEQ ID NO: 1162515 - protein, 9 aa, Homo Sapiens
HHLYKVKAL

SEQ ID NO: 1162516 - protein, 9 aa, Homo Sapiens
NGKEGVFSD

SEQ ID NO: 1162517 - protein, 9 aa, Homo Sapiens
LNINCVDYM

SEQ ID NO: 1162518 - protein, 9 aa, Homo Sapiens
HYTRLGSHL

SEQ ID NO: 1162519 - protein, 9 aa, Homo Sapiens
LAVMNDCLY

SEQ ID NO: 1162520 - protein, 9 aa, Homo Sapiens
VIFCVSTWE

SEQ ID NO: 1162521 - protein, 9 aa, Homo Sapiens
HTPMYFFSQ

SEQ ID NO: 1162522 - protein, 9 aa, Homo Sapiens
LEEEKIQSL

SEQ ID NO: 1162523 - protein, 9 aa, Homo Sapiens
RKGCCGKGY

SEQ ID NO: 1162524 - protein, 9 aa, Homo Sapiens
VMQGKLENN

SEQ ID NO: 1162525 - protein, 9 aa, Homo Sapiens
LLLLLLPCP

SEQ ID NO: 1162526 - protein, 9 aa, Homo Sapiens
LYVQESVTV

SEQ ID NO: 1162527 - protein, 9 aa, Homo Sapiens
PRVSWNQPP

SEQ ID NO: 1162528 - protein, 9 aa, Homo Sapiens
RPGGALASI

SEQ ID NO: 1162529 - protein, 9 aa, Homo Sapiens
GPSETTEAN

SEQ ID NO: 1162530 - protein, 9 aa, Homo Sapiens
SFEILDKMR

SEQ ID NO: 1162531 - protein, 9 aa, Homo Sapiens
GIAIGIGTH

SEQ ID NO: 1162532 - protein, 9 aa, Homo Sapiens
CTGSPEGAE

SEQ ID NO: 1162533 - protein, 9 aa, Homo Sapiens
QSLGEAKEQ

SEQ ID NO: 1162534 - protein, 9 aa, Homo Sapiens
FSTAAFRFS

SEQ ID NO: 1162535 - protein, 9 aa, Homo Sapiens
SFMVNWTNA

SEQ ID NO: 1162536 - protein, 9 aa, Homo Sapiens
TLNINCVDY

SEQ ID NO: 1162537 - protein, 9 aa, Homo Sapiens
NDFYAATKT

SEQ ID NO: 1162538 - protein, 9 aa, Homo Sapiens
ANFTTLNYD

SEQ ID NO: 1162539 - protein, 9 aa, Homo Sapiens
GPQAGSQCH

SEQ ID NO: 1162540 - protein, 9 aa, Homo Sapiens
LIGRERGED

SEQ ID NO: 1162541 - protein, 9 aa, Homo Sapiens
VLPAPVIQV

SEQ ID NO: 1162542 - protein, 9 aa, Homo Sapiens
QAEGPQAGS

SEQ ID NO: 1162543 - protein, 9 aa, Homo Sapiens
VCGKVFIVS

SEQ ID NO: 1162544 - protein, 9 aa, Homo Sapiens
AFPNAQLPS

SEQ ID NO: 1162545 - protein, 9 aa, Homo Sapiens
EQVASEGTG

SEQ ID NO: 1162546 - protein, 9 aa, Homo Sapiens
QEGHVVAPL

SEQ ID NO: 1162547 - protein, 9 aa, Homo Sapiens
LFKAQYVLI

SEQ ID NO: 1162548 - protein, 9 aa, Homo Sapiens
CLPAHDLSG

SEQ ID NO: 1162549 - protein, 9 aa, Homo Sapiens
VGLDCTGSP

SEQ ID NO: 1162550 - protein, 9 aa, Homo Sapiens
PKGDRTAGP

SEQ ID NO: 1162551 - protein, 9 aa, Homo Sapiens
IESNVDPSK

SEQ ID NO: 1162552 - protein, 9 aa, Homo Sapiens
NLETFDKSA

SEQ ID NO: 1162553 - protein, 9 aa, Homo Sapiens
VGMCTHCGT

SEQ ID NO: 1162554 - protein, 9 aa, Homo Sapiens
EGHVVAPLR

SEQ ID NO: 1162555 - protein, 9 aa, Homo Sapiens
EKQANFTTL

SEQ ID NO: 1162556 - protein, 9 aa, Homo Sapiens
IIFFKNTVI

SEQ ID NO: 1162557 - protein, 9 aa, Homo Sapiens
SSVQLRHFL

SEQ ID NO: 1162558 - protein, 9 aa, Homo Sapiens
SPSSVQLRH

SEQ ID NO: 1162559 - protein, 9 aa, Homo Sapiens
YGFFYPWFC

SEQ ID NO: 1162560 - protein, 9 aa, Homo Sapiens
GYTLSSLSY

SEQ ID NO: 1162561 - protein, 9 aa, Homo Sapiens
SEAVQPGQE

SEQ ID NO: 1162562 - protein, 9 aa, Homo Sapiens
RRPGGALAS

SEQ ID NO: 1162563 - protein, 9 aa, Homo Sapiens
CTHCGTAAQ

SEQ ID NO: 1162564 - protein, 9 aa, Homo Sapiens
SILSNEVGL

SEQ ID NO: 1162565 - protein, 9 aa, Homo Sapiens
ADACSWAGP

SEQ ID NO: 1162566 - protein, 9 aa, Homo Sapiens
IEDAGVTVT

SEQ ID NO: 1162567 - protein, 9 aa, Homo Sapiens
GRELLISSD

SEQ ID NO: 1162568 - protein, 9 aa, Homo Sapiens
RQDVGLDCT

SEQ ID NO: 1162569 - protein, 9 aa, Homo Sapiens
VMNDCLYAI

SEQ ID NO: 1162570 - protein, 9 aa, Homo Sapiens
LLLLLPCPA

SEQ ID NO: 1162571 - protein, 9 aa, Homo Sapiens
AGTPFIIDE

SEQ ID NO: 1162572 - protein, 9 aa, Homo Sapiens
GTQAPQVLI

SEQ ID NO: 1162573 - protein, 9 aa, Homo Sapiens
LLTETGSST

SEQ ID NO: 1162574 - protein, 9 aa, Homo Sapiens
LGSLPLPVG

SEQ ID NO: 1162575 - protein, 9 aa, Homo Sapiens
EIVKCYPVP

SEQ ID NO: 1162576 - protein, 9 aa, Homo Sapiens
SSGASWWKT

SEQ ID NO: 1162577 - protein, 9 aa, Homo Sapiens
EERAARWPG

SEQ ID NO: 1162578 - protein, 9 aa, Homo Sapiens
VAWEEESPG

SEQ ID NO: 1162579 - protein, 9 aa, Homo Sapiens
DATLSGKGM

SEQ ID NO: 1162580 - protein, 9 aa, Homo Sapiens
IFCVSTWEH

SEQ ID NO: 1162581 - protein, 9 aa, Homo Sapiens
KKNAVFMGK

SEQ ID NO: 1162582 - protein, 9 aa, Homo Sapiens
KNEKVELEL

SEQ ID NO: 1162583 - protein, 9 aa, Homo Sapiens
AADCGGADV

SEQ ID NO: 1162584 - protein, 9 aa, Homo Sapiens
EAVQPGQEP

SEQ ID NO: 1162585 - protein, 9 aa, Homo Sapiens
QERKHRQKH

SEQ ID NO: 1162586 - protein, 9 aa, Homo Sapiens
REGEEGLGQ

SEQ ID NO: 1162587 - protein, 9 aa, Homo Sapiens
EELTKGKQG

SEQ ID NO: 1162588 - protein, 9 aa, Homo Sapiens
FKNTVISDL

SEQ ID NO: 1162589 - protein, 9 aa, Homo Sapiens
SQQLVFHGY

SEQ ID NO: 1162590 - protein, 9 aa, Homo Sapiens
QFQGMKRKT

SEQ ID NO: 1162591 - protein, 9 aa, Homo Sapiens
NIVQLIEDA

SEQ ID NO: 1162592 - protein, 9 aa, Homo Sapiens
EFHGAFPNA

SEQ ID NO: 1162593 - protein, 9 aa, Homo Sapiens
LRPQARTIL

SEQ ID NO: 1162594 - protein, 9 aa, Homo Sapiens
ELLKKNAVF

SEQ ID NO: 1162595 - protein, 9 aa, Homo Sapiens
PQAGSQCHR

SEQ ID NO: 1162596 - protein, 9 aa, Homo Sapiens
ASHRFLSHS

SEQ ID NO: 1162597 - protein, 9 aa, Homo Sapiens
NEVGLKRKD

SEQ ID NO: 1162598 - protein, 9 aa, Homo Sapiens
IGQAEGPQA

SEQ ID NO: 1162599 - protein, 9 aa, Homo Sapiens
LELKNEKVE

SEQ ID NO: 1162600 - protein, 9 aa, Homo Sapiens
RTKQEMKTA

SEQ ID NO: 1162601 - protein, 9 aa, Homo Sapiens
EGSLKKKRA

SEQ ID NO: 1162602 - protein, 9 aa, Homo Sapiens
IYPISTERR

SEQ ID NO: 1162603 - protein, 9 aa, Homo Sapiens
VENSTGASQ

SEQ ID NO: 1162604 - protein, 9 aa, Homo Sapiens
SLGSLPLPV

SEQ ID NO: 1162605 - protein, 9 aa, Homo Sapiens
CGAHRRGCC

SEQ ID NO: 1162606 - protein, 9 aa, Homo Sapiens
WYPRVSWNQ

SEQ ID NO: 1162607 - protein, 9 aa, Homo Sapiens
QSVKKRCSL

SEQ ID NO: 1162608 - protein, 9 aa, Homo Sapiens
PSTLTPRIP

SEQ ID NO: 1162609 - protein, 9 aa, Homo Sapiens
VLKDRKGCC

SEQ ID NO: 1162610 - protein, 9 aa, Homo Sapiens
GADACSWAG

SEQ ID NO: 1162611 - protein, 9 aa, Homo Sapiens
VSWNQPPTD

SEQ ID NO: 1162612 - protein, 9 aa, Homo Sapiens
FCCLPAHDL

SEQ ID NO: 1162613 - protein, 9 aa, Homo Sapiens
RAARWPGAG

SEQ ID NO: 1162614 - protein, 9 aa, Homo Sapiens
DLNLQVIYP

SEQ ID NO: 1162615 - protein, 9 aa, Homo Sapiens
YPWFCRALK

SEQ ID NO: 1162616 - protein, 9 aa, Homo Sapiens
SARLFFVGS

SEQ ID NO: 1162617 - protein, 9 aa, Homo Sapiens
WGTGNPWRQ

SEQ ID NO: 1162618 - protein, 9 aa, Homo Sapiens
SLMEQIPHL

SEQ ID NO: 1162619 - protein, 9 aa, Homo Sapiens
GNLFQNPQH

SEQ ID NO: 1162620 - protein, 9 aa, Homo Sapiens
FRDYDNGSV

SEQ ID NO: 1162621 - protein, 9 aa, Homo Sapiens
TFSQCPLDA

SEQ ID NO: 1162622 - protein, 9 aa, Homo Sapiens
ALYVQESVT

SEQ ID NO: 1162623 - protein, 9 aa, Homo Sapiens
KGKRFHHQT

SEQ ID NO: 1162624 - protein, 9 aa, Homo Sapiens
LHTPMYFFS

SEQ ID NO: 1162625 - protein, 9 aa, Homo Sapiens
THHPRQNRA

SEQ ID NO: 1162626 - protein, 9 aa, Homo Sapiens
QKCLLKGKR

SEQ ID NO: 1162627 - protein, 9 aa, Homo Sapiens
RWPGAGPPK

SEQ ID NO: 1162628 - protein, 9 aa, Homo Sapiens
QAPLLRSGP

SEQ ID NO: 1162629 - protein, 9 aa, Homo Sapiens
NKDGRPLYV

SEQ ID NO: 1162630 - protein, 9 aa, Homo Sapiens
SRSVGMCTH

SEQ ID NO: 1162631 - protein, 9 aa, Homo Sapiens
DDVSFSPVH

SEQ ID NO: 1162632 - protein, 9 aa, Homo Sapiens
QLAEIKAQA

SEQ ID NO: 1162633 - protein, 9 aa, Homo Sapiens
LTAGQLTHS

SEQ ID NO: 1162634 - protein, 9 aa, Homo Sapiens
LYKVKALNK

SEQ ID NO: 1162635 - protein, 9 aa, Homo Sapiens
APRDDGEEV

SEQ ID NO: 1162636 - protein, 9 aa, Homo Sapiens
QQEGHVVAP

SEQ ID NO: 1162637 - protein, 9 aa, Homo Sapiens
RSGPQPYAP

SEQ ID NO: 1162638 - protein, 9 aa, Homo Sapiens
MNDCLYAIG

SEQ ID NO: 1162639 - protein, 9 aa, Homo Sapiens
FHQMKHSFE

SEQ ID NO: 1162640 - protein, 9 aa, Homo Sapiens
DSAPGSGGR

SEQ ID NO: 1162641 - protein, 9 aa, Homo Sapiens
SGPSETTEA

SEQ ID NO: 1162642 - protein, 9 aa, Homo Sapiens
AVQPGQEPC

SEQ ID NO: 1162643 - protein, 9 aa, Homo Sapiens
PVVTVHQSL

SEQ ID NO: 1162644 - protein, 9 aa, Homo Sapiens
VSGNLSIHR

SEQ ID NO: 1162645 - protein, 9 aa, Homo Sapiens
DRGTSGTPS

SEQ ID NO: 1162646 - protein, 9 aa, Homo Sapiens
VFSDNFAVQ

SEQ ID NO: 1162647 - protein, 9 aa, Homo Sapiens
FHGAFPNAQ

SEQ ID NO: 1162648 - protein, 9 aa, Homo Sapiens
PSQNPATLP

SEQ ID NO: 1162649 - protein, 9 aa, Homo Sapiens
KTSPTCCRT

SEQ ID NO: 1162650 - protein, 9 aa, Homo Sapiens
GPHCCGAHR

SEQ ID NO: 1162651 - protein, 9 aa, Homo Sapiens
GSLPLPVGP

SEQ ID NO: 1162652 - protein, 9 aa, Homo Sapiens
PRSCMQPAA

SEQ ID NO: 1162653 - protein, 9 aa, Homo Sapiens
VDTHGLRFP

SEQ ID NO: 1162654 - protein, 9 aa, Homo Sapiens
IVSGNLSIH

SEQ ID NO: 1162655 - protein, 9 aa, Homo Sapiens
ENNESSESE

SEQ ID NO: 1162656 - protein, 9 aa, Homo Sapiens
IFASARLFF

SEQ ID NO: 1162657 - protein, 9 aa, Homo Sapiens
DACSWAGPS

SEQ ID NO: 1162658 - protein, 9 aa, Homo Sapiens
DPVLIGRER

SEQ ID NO: 1162659 - protein, 9 aa, Homo Sapiens
CAEKQANFT

SEQ ID NO: 1162660 - protein, 9 aa, Homo Sapiens
PGSGGRSRS

SEQ ID NO: 1162661 - protein, 9 aa, Homo Sapiens
PSSGASWWK

SEQ ID NO: 1162662 - protein, 9 aa, Homo Sapiens
LFDIESNVD

SEQ ID NO: 1162663 - protein, 9 aa, Homo Sapiens
SKANKWTGP

SEQ ID NO: 1162664 - protein, 9 aa, Homo Sapiens
GQQQEGHVV

SEQ ID NO: 1162665 - protein, 9 aa, Homo Sapiens
WIWYPRVSW

SEQ ID NO: 1162666 - protein, 9 aa, Homo Sapiens
DVDATLKSL

SEQ ID NO: 1162667 - protein, 9 aa, Homo Sapiens
VDVLPAPVI

SEQ ID NO: 1162668 - protein, 9 aa, Homo Sapiens
AVFYTIPTP

SEQ ID NO: 1162669 - protein, 9 aa, Homo Sapiens
GRSRSVGMC

SEQ ID NO: 1162670 - protein, 9 aa, Homo Sapiens
PQVLISTGN

SEQ ID NO: 1162671 - protein, 9 aa, Homo Sapiens
LKNEKVELE

SEQ ID NO: 1162672 - protein, 9 aa, Homo Sapiens
VIRVQMEEP

SEQ ID NO: 1162673 - protein, 9 aa, Homo Sapiens
VVVRIGQAE

SEQ ID NO: 1162674 - protein, 9 aa, Homo Sapiens
GDNVDVLPA

SEQ ID NO: 1162675 - protein, 9 aa, Homo Sapiens
LGVDVSHVA

SEQ ID NO: 1162676 - protein, 9 aa, Homo Sapiens
TVWGTGNPW

SEQ ID NO: 1162677 - protein, 9 aa, Homo Sapiens
QVASEGTGL

SEQ ID NO: 1162678 - protein, 9 aa, Homo Sapiens
HENVCLAKA

SEQ ID NO: 1162679 - protein, 9 aa, Homo Sapiens
GDGAGTPFI

SEQ ID NO: 1162680 - protein, 9 aa, Homo Sapiens
VKCYPVPIH

SEQ ID NO: 1162681 - protein, 9 aa, Homo Sapiens
YKVKALNKG

SEQ ID NO: 1162682 - protein, 9 aa, Homo Sapiens
NDCLYAIGG

SEQ ID NO: 1162683 - protein, 9 aa, Homo Sapiens
ETFDKSALE

SEQ ID NO: 1162684 - protein, 9 aa, Homo Sapiens
LLRSGPQPY

SEQ ID NO: 1162685 - protein, 9 aa, Homo Sapiens
RWAAEIVVA

SEQ ID NO: 1162686 - protein, 9 aa, Homo Sapiens
EMKTAHKLA

SEQ ID NO: 1162687 - protein, 9 aa, Homo Sapiens
HRQKHQEYL

SEQ ID NO: 1162688 - protein, 9 aa, Homo Sapiens
DIESNVDPS

SEQ ID NO: 1162689 - protein, 9 aa, Homo Sapiens
DGEEVAWEE

SEQ ID NO: 1162690 - protein, 9 aa, Homo Sapiens
RQALTAGQL

SEQ ID NO: 1162691 - protein, 9 aa, Homo Sapiens
TKQEMKTAH

SEQ ID NO: 1162692 - protein, 9 aa, Homo Sapiens
TVDRGTSGT

SEQ ID NO: 1162693 - protein, 9 aa, Homo Sapiens
FVDTHGLRF

SEQ ID NO: 1162694 - protein, 9 aa, Homo Sapiens
ASAPPFSGA

SEQ ID NO: 1162695 - protein, 9 aa, Homo Sapiens
LTEVKQWLC

SEQ ID NO: 1162696 - protein, 9 aa, Homo Sapiens
VPASWVTFS

SEQ ID NO: 1162697 - protein, 9 aa, Homo Sapiens
PASHRFLSH

SEQ ID NO: 1162698 - protein, 9 aa, Homo Sapiens
NVCGKVFIV

SEQ ID NO: 1162699 - protein, 9 aa, Homo Sapiens
LKKNAVFMG

SEQ ID NO: 1162700 - protein, 9 aa, Homo Sapiens
KDRKGCCGK

SEQ ID NO: 1162701 - protein, 9 aa, Homo Sapiens
EVWLGNLFQ

SEQ ID NO: 1162702 - protein, 9 aa, Homo Sapiens
PHLMHQWCP

SEQ ID NO: 1162703 - protein, 9 aa, Homo Sapiens
HGAFPNAQL

SEQ ID NO: 1162704 - protein, 9 aa, Homo Sapiens
SGGRSRSVG

SEQ ID NO: 1162705 - protein, 9 aa, Homo Sapiens
PASWVTFSQ

SEQ ID NO: 1162706 - protein, 9 aa, Homo Sapiens
THCGTAAQP

SEQ ID NO: 1162707 - protein, 9 aa, Homo Sapiens
PFLWGLAPN

SEQ ID NO: 1162708 - protein, 9 aa, Homo Sapiens
DVGLDCTGS

SEQ ID NO: 1162709 - protein, 9 aa, Homo Sapiens
YAGGWHHHN

SEQ ID NO: 1162710 - protein, 9 aa, Homo Sapiens
QCHRLGQQQ

SEQ ID NO: 1162711 - protein, 9 aa, Homo Sapiens
LAPNEAVGS

SEQ ID NO: 1162712 - protein, 9 aa, Homo Sapiens
MTGSCCGYT

SEQ ID NO: 1162713 - protein, 9 aa, Homo Sapiens
QGSQLLTRV

SEQ ID NO: 1162714 - protein, 9 aa, Homo Sapiens
CGYTLSSLS

SEQ ID NO: 1162715 - protein, 9 aa, Homo Sapiens
GNPWRQFIY

SEQ ID NO: 1162716 - protein, 9 aa, Homo Sapiens
IEQERKHRQ

SEQ ID NO: 1162717 - protein, 9 aa, Homo Sapiens
VRIGQAEGP

SEQ ID NO: 1162718 - protein, 9 aa, Homo Sapiens
RSRSVGMCT

SEQ ID NO: 1162719 - protein, 9 aa, Homo Sapiens
PAAGPRPQE

SEQ ID NO: 1162720 - protein, 9 aa, Homo Sapiens
QDVGLDCTG

SEQ ID NO: 1162721 - protein, 9 aa, Homo Sapiens
VYMGSFEEG

SEQ ID NO: 1162722 - protein, 9 aa, Homo Sapiens
GRYDKAREY

SEQ ID NO: 1162723 - protein, 9 aa, Homo Sapiens
DDKNFHLKV

SEQ ID NO: 1162724 - protein, 9 aa, Homo Sapiens
YDKAREYID

SEQ ID NO: 1162725 - protein, 9 aa, Homo Sapiens
SKLTQDQKV

SEQ ID NO: 1162726 - protein, 9 aa, Homo Sapiens
RYDKAREYI

SEQ ID NO: 1162727 - protein, 9 aa, Homo Sapiens
FPFTFTAAK

SEQ ID NO: 1162728 - protein, 9 aa, Homo Sapiens
DDNPQHHGL

SEQ ID NO: 1162729 - protein, 9 aa, Homo Sapiens
PLRSGHAGG

SEQ ID NO: 1162730 - protein, 9 aa, Homo Sapiens
AHLLPTPAM

SEQ ID NO: 1162731 - protein, 9 aa, Homo Sapiens
LQNYDAIIN

SEQ ID NO: 1162732 - protein, 9 aa, Homo Sapiens
GPVSPSCRW

SEQ ID NO: 1162733 - protein, 9 aa, Homo Sapiens
SGTALVPVG

SEQ ID NO: 1162734 - protein, 9 aa, Homo Sapiens
YFRQGNNCH

SEQ ID NO: 1162735 - protein, 9 aa, Homo Sapiens
KAPLKQLAT

SEQ ID NO: 1162736 - protein, 9 aa, Homo Sapiens
ARSGGITTS

SEQ ID NO: 1162737 - protein, 9 aa, Homo Sapiens
LARDCDHQK

SEQ ID NO: 1162738 - protein, 9 aa, Homo Sapiens
RSGGITTSS

SEQ ID NO: 1162739 - protein, 9 aa, Homo Sapiens
PTRCPPARW

SEQ ID NO: 1162740 - protein, 9 aa, Homo Sapiens
PRSPNMLSV

SEQ ID NO: 1162741 - protein, 9 aa, Homo Sapiens
GNNCHKPDT

SEQ ID NO: 1162742 - protein, 9 aa, Homo Sapiens
LKNELNEDK

SEQ ID NO: 1162743 - protein, 9 aa, Homo Sapiens
VTDTSPSST

SEQ ID NO: 1162744 - protein, 9 aa, Homo Sapiens
ESQPPVSGC

SEQ ID NO: 1162745 - protein, 9 aa, Homo Sapiens
ARQQEIEMN

SEQ ID NO: 1162746 - protein, 9 aa, Homo Sapiens
SPNMLSVAL

SEQ ID NO: 1162747 - protein, 9 aa, Homo Sapiens
PPPPPPMRR

SEQ ID NO: 1162748 - protein, 9 aa, Homo Sapiens
DLGRLGCRP

SEQ ID NO: 1162749 - protein, 9 aa, Homo Sapiens
LHTVYNKLK

SEQ ID NO: 1162750 - protein, 9 aa, Homo Sapiens
GITTSSPRW

SEQ ID NO: 1162751 - protein, 9 aa, Homo Sapiens
HFPFTFTAA

SEQ ID NO: 1162752 - protein, 9 aa, Homo Sapiens
AKGRHRKIA

SEQ ID NO: 1162753 - protein, 9 aa, Homo Sapiens
GPCAAATGA

SEQ ID NO: 1162754 - protein, 9 aa, Homo Sapiens
QYFRQGNNC

SEQ ID NO: 1162755 - protein, 9 aa, Homo Sapiens
DTQRPQVTI

SEQ ID NO: 1162756 - protein, 9 aa, Homo Sapiens
WKHLLSECY

SEQ ID NO: 1162757 - protein, 9 aa, Homo Sapiens
NYDAIINSQ

SEQ ID NO: 1162758 - protein, 9 aa, Homo Sapiens
FLWHIGRYD

SEQ ID NO: 1162759 - protein, 9 aa, Homo Sapiens
QVVYMGSFE

SEQ ID NO: 1162760 - protein, 9 aa, Homo Sapiens
LLSECYDKT

SEQ ID NO: 1162761 - protein, 9 aa, Homo Sapiens
RSPNMLSVA

SEQ ID NO: 1162762 - protein, 9 aa, Homo Sapiens
GDLATIPGM

SEQ ID NO: 1162763 - protein, 9 aa, Homo Sapiens
SSISDKSDW

SEQ ID NO: 1162764 - protein, 9 aa, Homo Sapiens
YFTAAGLFL

SEQ ID NO: 1162765 - protein, 9 aa, Homo Sapiens
SNPDPAKDP

SEQ ID NO: 1162766 - protein, 9 aa, Homo Sapiens
TAGIQGPEA

SEQ ID NO: 1162767 - protein, 9 aa, Homo Sapiens
LCSGGTAGI

SEQ ID NO: 1162768 - protein, 9 aa, Homo Sapiens
IAVSSSEQE

SEQ ID NO: 1162769 - protein, 9 aa, Homo Sapiens
VPIIAVSSS

SEQ ID NO: 1162770 - protein, 9 aa, Homo Sapiens
NNCHKPDTY

SEQ ID NO: 1162771 - protein, 9 aa, Homo Sapiens
TEVQVVYMG

SEQ ID NO: 1162772 - protein, 9 aa, Homo Sapiens
RHWLFYLCP

SEQ ID NO: 1162773 - protein, 9 aa, Homo Sapiens
CGKRFNNSL

SEQ ID NO: 1162774 - protein, 9 aa, Homo Sapiens
EDKILHFAV

SEQ ID NO: 1162775 - protein, 9 aa, Homo Sapiens
STCAAVAAS

SEQ ID NO: 1162776 - protein, 9 aa, Homo Sapiens
QDQKVKHCM

SEQ ID NO: 1162777 - protein, 9 aa, Homo Sapiens
DGLTVLNKV

SEQ ID NO: 1162778 - protein, 9 aa, Homo Sapiens
DHQKEQKCY

SEQ ID NO: 1162779 - protein, 9 aa, Homo Sapiens
CSDGLTVLN

SEQ ID NO: 1162780 - protein, 9 aa, Homo Sapiens
LFLCTVALG

SEQ ID NO: 1162781 - protein, 9 aa, Homo Sapiens
MTSAPGFPH

SEQ ID NO: 1162782 - protein, 9 aa, Homo Sapiens
TDTSPSSTG

SEQ ID NO: 1162783 - protein, 9 aa, Homo Sapiens
AAGLFLCTV

SEQ ID NO: 1162784 - protein, 9 aa, Homo Sapiens
ALHKAQMSK

SEQ ID NO: 1162785 - protein, 9 aa, Homo Sapiens
PSVKSAAGR

SEQ ID NO: 1162786 - protein, 9 aa, Homo Sapiens
AKVSSISDK

SEQ ID NO: 1162787 - protein, 9 aa, Homo Sapiens
IVSAHDTFM

SEQ ID NO: 1162788 - protein, 9 aa, Homo Sapiens
TSDMRAILL

SEQ ID NO: 1162789 - protein, 9 aa, Homo Sapiens
RRANRAPRG

SEQ ID NO: 1162790 - protein, 9 aa, Homo Sapiens
GTAGIQGPE

SEQ ID NO: 1162791 - protein, 9 aa, Homo Sapiens
WRRWRHRWF

SEQ ID NO: 1162792 - protein, 9 aa, Homo Sapiens
KVSSISDKS

SEQ ID NO: 1162793 - protein, 9 aa, Homo Sapiens
TTSSPRWWR

SEQ ID NO: 1162794 - protein, 9 aa, Homo Sapiens
LPVTDTSPS

SEQ ID NO: 1162795 - protein, 9 aa, Homo Sapiens
RAPRGCSAS

SEQ ID NO: 1162796 - protein, 9 aa, Homo Sapiens
VAASAPRPS

SEQ ID NO: 1162797 - protein, 9 aa, Homo Sapiens
LSYLFIFAV

SEQ ID NO: 1162798 - protein, 9 aa, Homo Sapiens
TCSCGAGYF

SEQ ID NO: 1162799 - protein, 9 aa, Homo Sapiens
AVIFRIRSA

SEQ ID NO: 1162800 - protein, 9 aa, Homo Sapiens
KTAPRAAWA

SEQ ID NO: 1162801 - protein, 9 aa, Homo Sapiens
WRHRWFTCS

SEQ ID NO: 1162802 - protein, 9 aa, Homo Sapiens
ADDNPQHHG

SEQ ID NO: 1162803 - protein, 9 aa, Homo Sapiens
ACARSGPKT

SEQ ID NO: 1162804 - protein, 9 aa, Homo Sapiens
LAQRWSMKK

SEQ ID NO: 1162805 - protein, 9 aa, Homo Sapiens
AVARRWEGP

SEQ ID NO: 1162806 - protein, 9 aa, Homo Sapiens
SLPVTDTSP

SEQ ID NO: 1162807 - protein, 9 aa, Homo Sapiens
DQKVKHCMF

SEQ ID NO: 1162808 - protein, 9 aa, Homo Sapiens
PRWWRRWRH

SEQ ID NO: 1162809 - protein, 9 aa, Homo Sapiens
ATGAPTPAC

SEQ ID NO: 1162810 - protein, 9 aa, Homo Sapiens
AASAPRPSV

SEQ ID NO: 1162811 - protein, 9 aa, Homo Sapiens
HRWFTCSCG

SEQ ID NO: 1162812 - protein, 9 aa, Homo Sapiens
NKLKRLEIT

SEQ ID NO: 1162813 - protein, 9 aa, Homo Sapiens
ARWGPRRCS

SEQ ID NO: 1162814 - protein, 9 aa, Homo Sapiens
QGNNCHKPD

SEQ ID NO: 1162815 - protein, 9 aa, Homo Sapiens
RPCGGFFLH

SEQ ID NO: 1162816 - protein, 9 aa, Homo Sapiens
NPQYFRQGN

SEQ ID NO: 1162817 - protein, 9 aa, Homo Sapiens
APRPSVKSA

SEQ ID NO: 1162818 - protein, 9 aa, Homo Sapiens
AAGRRANRA

SEQ ID NO: 1162819 - protein, 9 aa, Homo Sapiens
PVTDTSPSS

SEQ ID NO: 1162820 - protein, 9 aa, Homo Sapiens
RCAPGSPAP

SEQ ID NO: 1162821 - protein, 9 aa, Homo Sapiens
PAVARRWEG

SEQ ID NO: 1162822 - protein, 9 aa, Homo Sapiens
PARWGPRRC

SEQ ID NO: 1162823 - protein, 9 aa, Homo Sapiens
EGDNTQLAR

SEQ ID NO: 1162824 - protein, 9 aa, Homo Sapiens
TQDQKVKHC

SEQ ID NO: 1162825 - protein, 9 aa, Homo Sapiens
AAVAASAPR

SEQ ID NO: 1162826 - protein, 9 aa, Homo Sapiens
GGEGKALQL

SEQ ID NO: 1162827 - protein, 9 aa, Homo Sapiens
FRQGNNCHK

SEQ ID NO: 1162828 - protein, 9 aa, Homo Sapiens
QLARLEGER

SEQ ID NO: 1162829 - protein, 9 aa, Homo Sapiens
PMRRKLALL

SEQ ID NO: 1162830 - protein, 9 aa, Homo Sapiens
CSASSRCAP

SEQ ID NO: 1162831 - protein, 9 aa, Homo Sapiens
TQRPQVTIW

SEQ ID NO: 1162832 - protein, 9 aa, Homo Sapiens
ESWADDNPQ

SEQ ID NO: 1162833 - protein, 9 aa, Homo Sapiens
WGPRRCSTC

SEQ ID NO: 1162834 - protein, 9 aa, Homo Sapiens
SLAQRWSMK

SEQ ID NO: 1162835 - protein, 9 aa, Homo Sapiens
ASSRCAPGS

SEQ ID NO: 1162836 - protein, 9 aa, Homo Sapiens
NIVSAHDTF

SEQ ID NO: 1162837 - protein, 9 aa, Homo Sapiens
RQGNNCHKP

SEQ ID NO: 1162838 - protein, 9 aa, Homo Sapiens
TVYNKLKRL

SEQ ID NO: 1162839 - protein, 9 aa, Homo Sapiens
WEGPCAAAT

SEQ ID NO: 1162840 - protein, 9 aa, Homo Sapiens
PSCRWSYRC

SEQ ID NO: 1162841 - protein, 9 aa, Homo Sapiens
RSGHAGGYQ

SEQ ID NO: 1162842 - protein, 9 aa, Homo Sapiens
TFTAAKGTT

SEQ ID NO: 1162843 - protein, 9 aa, Homo Sapiens
IEVHFPFTF

SEQ ID NO: 1162844 - protein, 9 aa, Homo Sapiens
PLKQLATKA

SEQ ID NO: 1162845 - protein, 9 aa, Homo Sapiens
QHALHKAQM

SEQ ID NO: 1162846 - protein, 9 aa, Homo Sapiens
PLRPGMTSA

SEQ ID NO: 1162847 - protein, 9 aa, Homo Sapiens
LFIFAVIFR

SEQ ID NO: 1162848 - protein, 9 aa, Homo Sapiens
IANMKKLQG

SEQ ID NO: 1162849 - protein, 9 aa, Homo Sapiens
AGRRANRAP

SEQ ID NO: 1162850 - protein, 9 aa, Homo Sapiens
RDDKNFHLK

SEQ ID NO: 1162851 - protein, 9 aa, Homo Sapiens
CQPTRCPPA

SEQ ID NO: 1162852 - protein, 9 aa, Homo Sapiens
AQRWSMKKR

SEQ ID NO: 1162853 - protein, 9 aa, Homo Sapiens
DAIINSQGI

SEQ ID NO: 1162854 - protein, 9 aa, Homo Sapiens
SLHFSAHRR

SEQ ID NO: 1162855 - protein, 9 aa, Homo Sapiens
PVSPSCRWS

SEQ ID NO: 1162856 - protein, 9 aa, Homo Sapiens
CGAGYFTAA

SEQ ID NO: 1162857 - protein, 9 aa, Homo Sapiens
RCPPARWGP

SEQ ID NO: 1162858 - protein, 9 aa, Homo Sapiens
FFLHLLVPL

SEQ ID NO: 1162859 - protein, 9 aa, Homo Sapiens
FTAAKGTTV

SEQ ID NO: 1162860 - protein, 9 aa, Homo Sapiens
TPAMYSLLE

SEQ ID NO: 1162861 - protein, 9 aa, Homo Sapiens
TIWERDVSS

SEQ ID NO: 1162862 - protein, 9 aa, Homo Sapiens
QRWSMKKRT

SEQ ID NO: 1162863 - protein, 9 aa, Homo Sapiens
LGCRPLRKT

SEQ ID NO: 1162864 - protein, 9 aa, Homo Sapiens
SHPRSPNML

SEQ ID NO: 1162865 - protein, 9 aa, Homo Sapiens
FTTQHALHK

SEQ ID NO: 1162866 - protein, 9 aa, Homo Sapiens
LHKAQMSKE

SEQ ID NO: 1162867 - protein, 9 aa, Homo Sapiens
AAQIPARQQ

SEQ ID NO: 1162868 - protein, 9 aa, Homo Sapiens
QIPARQQEI

SEQ ID NO: 1162869 - protein, 9 aa, Homo Sapiens
CWGAPSANH

SEQ ID NO: 1162870 - protein, 9 aa, Homo Sapiens
AQARSGGIT

SEQ ID NO: 1162871 - protein, 9 aa, Homo Sapiens
RCSTCAAVA

SEQ ID NO: 1162872 - protein, 9 aa, Homo Sapiens
IKSSRPCGG

SEQ ID NO: 1162873 - protein, 9 aa, Homo Sapiens
QPTRCPPAR

SEQ ID NO: 1162874 - protein, 9 aa, Homo Sapiens
AFYPRAYSN

SEQ ID NO: 1162875 - protein, 9 aa, Homo Sapiens
PGMNRPFLL

SEQ ID NO: 1162876 - protein, 9 aa, Homo Sapiens
GHAGGYQTL

SEQ ID NO: 1162877 - protein, 9 aa, Homo Sapiens
RWEGPCAAA

SEQ ID NO: 1162878 - protein, 9 aa, Homo Sapiens
KLTQDQKVK

SEQ ID NO: 1162879 - protein, 9 aa, Homo Sapiens
DCDHQKEQK

SEQ ID NO: 1162880 - protein, 9 aa, Homo Sapiens
AATGAPTPA

SEQ ID NO: 1162881 - protein, 9 aa, Homo Sapiens
ASAPRPSVK

SEQ ID NO: 1162882 - protein, 9 aa, Homo Sapiens
TCAAVAASA

SEQ ID NO: 1162883 - protein, 9 aa, Homo Sapiens
CAAATGAPT

SEQ ID NO: 1162884 - protein, 9 aa, Homo Sapiens
IPARQQEIE

SEQ ID NO: 1162885 - protein, 9 aa, Homo Sapiens
CARSGPKTA

SEQ ID NO: 1162886 - protein, 9 aa, Homo Sapiens
APGSPAPAV

SEQ ID NO: 1162887 - protein, 9 aa, Homo Sapiens
FTCSCGAGY

SEQ ID NO: 1162888 - protein, 9 aa, Homo Sapiens
FLCTVALGS

SEQ ID NO: 1162889 - protein, 9 aa, Homo Sapiens
TAPRAAWAR

SEQ ID NO: 1162890 - protein, 9 aa, Homo Sapiens
SAAGRRANR

SEQ ID NO: 1162891 - protein, 9 aa, Homo Sapiens
NSLHFSAHR

SEQ ID NO: 1162892 - protein, 9 aa, Homo Sapiens
HCYPPTWRH

SEQ ID NO: 1162893 - protein, 9 aa, Homo Sapiens
EGSGTALVP

SEQ ID NO: 1162894 - protein, 9 aa, Homo Sapiens
ARLEGERPE

SEQ ID NO: 1162895 - protein, 9 aa, Homo Sapiens
VIFRIRSAE

SEQ ID NO: 1162896 - protein, 9 aa, Homo Sapiens
HLARDCDHQ

SEQ ID NO: 1162897 - protein, 9 aa, Homo Sapiens
PPVSGCAPP

SEQ ID NO: 1162898 - protein, 9 aa, Homo Sapiens
SMSNIVSAH

SEQ ID NO: 1162899 - protein, 9 aa, Homo Sapiens
HLLSECYDK

SEQ ID NO: 1162900 - protein, 9 aa, Homo Sapiens
RRWRHRWFT

SEQ ID NO: 1162901 - protein, 9 aa, Homo Sapiens
CAPGSPAPA

SEQ ID NO: 1162902 - protein, 9 aa, Homo Sapiens
VSSISDKSD

SEQ ID NO: 1162903 - protein, 9 aa, Homo Sapiens
TQHALHKAQ

SEQ ID NO: 1162904 - protein, 9 aa, Homo Sapiens
RPQVTIWER

SEQ ID NO: 1162905 - protein, 9 aa, Homo Sapiens
SSRCAPGSP

SEQ ID NO: 1162906 - protein, 9 aa, Homo Sapiens
LKQLATKAA

SEQ ID NO: 1162907 - protein, 9 aa, Homo Sapiens
PRAYSNPDP

SEQ ID NO: 1162908 - protein, 9 aa, Homo Sapiens
CPPARWGPR

SEQ ID NO: 1162909 - protein, 9 aa, Homo Sapiens
NRAPRGCSA

SEQ ID NO: 1162910 - protein, 9 aa, Homo Sapiens
AQIPARQQE

SEQ ID NO: 1162911 - protein, 9 aa, Homo Sapiens
TIPGMNRPF

SEQ ID NO: 1162912 - protein, 9 aa, Homo Sapiens
PTPACARSG

SEQ ID NO: 1162913 - protein, 9 aa, Homo Sapiens
LGRLGCRPL

SEQ ID NO: 1162914 - protein, 9 aa, Homo Sapiens
PPPLRPGMT

SEQ ID NO: 1162915 - protein, 9 aa, Homo Sapiens
WARSRPCLC

SEQ ID NO: 1162916 - protein, 9 aa, Homo Sapiens
PAPAVARRW

SEQ ID NO: 1162917 - protein, 9 aa, Homo Sapiens
SSPRWWRRW

SEQ ID NO: 1162918 - protein, 9 aa, Homo Sapiens
FTWAAKGRH

SEQ ID NO: 1162919 - protein, 9 aa, Homo Sapiens
VQVVYMGSF

SEQ ID NO: 1162920 - protein, 9 aa, Homo Sapiens
SASSRCAPG

SEQ ID NO: 1162921 - protein, 9 aa, Homo Sapiens
RPSVKSAAG

SEQ ID NO: 1162922 - protein, 9 aa, Homo Sapiens
SSLAQRWSM

SEQ ID NO: 1162923 - protein, 9 aa, Homo Sapiens
QRQTEVQVV

SEQ ID NO: 1162924 - protein, 9 aa, Homo Sapiens
AASSLAQRW

SEQ ID NO: 1162925 - protein, 9 aa, Homo Sapiens
VARRWEGPC

SEQ ID NO: 1162926 - protein, 9 aa, Homo Sapiens
KTDLGRLGC

SEQ ID NO: 1162927 - protein, 9 aa, Homo Sapiens
NPQHHGLAA

SEQ ID NO: 1162928 - protein, 9 aa, Homo Sapiens
CSCGAGYFT

SEQ ID NO: 1162929 - protein, 9 aa, Homo Sapiens
SRCAPGSPA

SEQ ID NO: 1162930 - protein, 9 aa, Homo Sapiens
PNMLSVALS

SEQ ID NO: 1162931 - protein, 9 aa, Homo Sapiens
PIIAVSSSE

SEQ ID NO: 1162932 - protein, 9 aa, Homo Sapiens
CLCSGGTAG

SEQ ID NO: 1162933 - protein, 9 aa, Homo Sapiens
HLKVYVPPS

SEQ ID NO: 1162934 - protein, 9 aa, Homo Sapiens
FFISCSDGL

SEQ ID NO: 1162935 - protein, 9 aa, Homo Sapiens
IVPIIAVSS

SEQ ID NO: 1162936 - protein, 9 aa, Homo Sapiens
GGLHTVYNK

SEQ ID NO: 1162937 - protein, 9 aa, Homo Sapiens
PTWRHWLFY

SEQ ID NO: 1162938 - protein, 9 aa, Homo Sapiens
SISDKSDWK

SEQ ID NO: 1162939 - protein, 9 aa, Homo Sapiens
AILLDWLVE

SEQ ID NO: 1162940 - protein, 9 aa, Homo Sapiens
SGHAGGYQT

SEQ ID NO: 1162941 - protein, 9 aa, Homo Sapiens
KHLLSECYD

SEQ ID NO: 1162942 - protein, 9 aa, Homo Sapiens
ATLAHLLPT

SEQ ID NO: 1162943 - protein, 9 aa, Homo Sapiens
ISDKSDWKV

SEQ ID NO: 1162944 - protein, 9 aa, Homo Sapiens
WHIGRYDKA

SEQ ID NO: 1162945 - protein, 9 aa, Homo Sapiens
MLSVALSQR

SEQ ID NO: 1162946 - protein, 9 aa, Homo Sapiens
PCAAATGAP

SEQ ID NO: 1162947 - protein, 9 aa, Homo Sapiens
PPARWGPRR

SEQ ID NO: 1162948 - protein, 9 aa, Homo Sapiens
AVSSSEQEI

SEQ ID NO: 1162949 - protein, 9 aa, Homo Sapiens
GAPSANHFQ

SEQ ID NO: 1162950 - protein, 9 aa, Homo Sapiens
RAAWARSRP

SEQ ID NO: 1162951 - protein, 9 aa, Homo Sapiens
GGKAPLKQL

SEQ ID NO: 1162952 - protein, 9 aa, Homo Sapiens
ARSRPCLCS

SEQ ID NO: 1162953 - protein, 9 aa, Homo Sapiens
VLKTDLGRL

SEQ ID NO: 1162954 - protein, 9 aa, Homo Sapiens
ALVPVGAPA

SEQ ID NO: 1162955 - protein, 9 aa, Homo Sapiens
EAQARSGGI

SEQ ID NO: 1162956 - protein, 9 aa, Homo Sapiens
PRGGEGKAL

SEQ ID NO: 1162957 - protein, 9 aa, Homo Sapiens
LVPVGAPAL

SEQ ID NO: 1162958 - protein, 9 aa, Homo Sapiens
AVLQNYDAI

SEQ ID NO: 1162959 - protein, 9 aa, Homo Sapiens
APRGCSASS

SEQ ID NO: 1162960 - protein, 9 aa, Homo Sapiens
CAPPEDLED

SEQ ID NO: 1162961 - protein, 9 aa, Homo Sapiens
WAAKGRHRK

SEQ ID NO: 1162962 - protein, 9 aa, Homo Sapiens
LTVLNKVGD

SEQ ID NO: 1162963 - protein, 9 aa, Homo Sapiens
RHRKIAWEK

SEQ ID NO: 1162964 - protein, 9 aa, Homo Sapiens
PRPSVKSAA

SEQ ID NO: 1162965 - protein, 9 aa, Homo Sapiens
CYPPTWRHW

SEQ ID NO: 1162966 - protein, 9 aa, Homo Sapiens
KIVPIIAVS

SEQ ID NO: 1162967 - protein, 9 aa, Homo Sapiens
RPCLCSGGT

SEQ ID NO: 1162968 - protein, 9 aa, Homo Sapiens
LLNPRGGEG

SEQ ID NO: 1162969 - protein, 9 aa, Homo Sapiens
PARQQEIEM

SEQ ID NO: 1162970 - protein, 9 aa, Homo Sapiens
RFNNSLHFS

SEQ ID NO: 1162971 - protein, 9 aa, Homo Sapiens
HQKEQKCYS

SEQ ID NO: 1162972 - protein, 9 aa, Homo Sapiens
GRLGCRPLR

SEQ ID NO: 1162973 - protein, 9 aa, Homo Sapiens
IGRYDKARE

SEQ ID NO: 1162974 - protein, 9 aa, Homo Sapiens
HFQQPQWPI

SEQ ID NO: 1162975 - protein, 9 aa, Homo Sapiens
GDNTQLARL

SEQ ID NO: 1162976 - protein, 9 aa, Homo Sapiens
AAWARSRPC

SEQ ID NO: 1162977 - protein, 9 aa, Homo Sapiens
TQLARLEGE

SEQ ID NO: 1162978 - protein, 9 aa, Homo Sapiens
NMKKLQGEL

SEQ ID NO: 1162979 - protein, 9 aa, Homo Sapiens
HLLPTPAMY

SEQ ID NO: 1162980 - protein, 9 aa, Homo Sapiens
DKNFHLKVY

SEQ ID NO: 1162981 - protein, 9 aa, Homo Sapiens
NTQLARLEG

SEQ ID NO: 1162982 - protein, 9 aa, Homo Sapiens
GTALVPVGA

SEQ ID NO: 1162983 - protein, 9 aa, Homo Sapiens
FTFTAAKGT

SEQ ID NO: 1162984 - protein, 9 aa, Homo Sapiens
KSSRPCGGF

SEQ ID NO: 1162985 - protein, 9 aa, Homo Sapiens
PPTWRHWLF

SEQ ID NO: 1162986 - protein, 9 aa, Homo Sapiens
WFTCSCGAG

SEQ ID NO: 1162987 - protein, 9 aa, Homo Sapiens
TAAGLFLCT

SEQ ID NO: 1162988 - protein, 9 aa, Homo Sapiens
ANRAPRGCS

SEQ ID NO: 1162989 - protein, 9 aa, Homo Sapiens
SGCAPPEDL

SEQ ID NO: 1162990 - protein, 9 aa, Homo Sapiens
TWAAKGRHR

SEQ ID NO: 1162991 - protein, 9 aa, Homo Sapiens
DMRAILLDW

SEQ ID NO: 1162992 - protein, 9 aa, Homo Sapiens
FYPRAYSNP

SEQ ID NO: 1162993 - protein, 9 aa, Homo Sapiens
SRPCLCSGG

SEQ ID NO: 1162994 - protein, 9 aa, Homo Sapiens
RLEGERPEQ

SEQ ID NO: 1162995 - protein, 9 aa, Homo Sapiens
GYFTAAGLF

SEQ ID NO: 1162996 - protein, 9 aa, Homo Sapiens
AGYFTAAGL

SEQ ID NO: 1162997 - protein, 9 aa, Homo Sapiens
PSSTGDTTP

SEQ ID NO: 1162998 - protein, 9 aa, Homo Sapiens
GLHTVYNKL

SEQ ID NO: 1162999 - protein, 9 aa, Homo Sapiens
VGPVSPSCR

SEQ ID NO: 1163000 - protein, 9 aa, Homo Sapiens
GGITTSSPR

SEQ ID NO: 1163001 - protein, 9 aa, Homo Sapiens
RHRWFTCSC

SEQ ID NO: 1163002 - protein, 9 aa, Homo Sapiens
AIINSQGIT

SEQ ID NO: 1163003 - protein, 9 aa, Homo Sapiens
QRPQVTIWE

SEQ ID NO: 1163004 - protein, 9 aa, Homo Sapiens
RAYSNPDPA

SEQ ID NO: 1163005 - protein, 9 aa, Homo Sapiens
YDAIINSQG

SEQ ID NO: 1163006 - protein, 9 aa, Homo Sapiens
CGGFFLHLL

SEQ ID NO: 1163007 - protein, 9 aa, Homo Sapiens
IFWKHLLSE

SEQ ID NO: 1163008 - protein, 9 aa, Homo Sapiens
SPSCRWSYR

SEQ ID NO: 1163009 - protein, 9 aa, Homo Sapiens
EGKALQLFR

SEQ ID NO: 1163010 - protein, 9 aa, Homo Sapiens
EEGSGTALV

SEQ ID NO: 1163011 - protein, 9 aa, Homo Sapiens
IWERDVSSD

SEQ ID NO: 1163012 - protein, 9 aa, Homo Sapiens
RPGMTSAPG

SEQ ID NO: 1163013 - protein, 9 aa, Homo Sapiens
ITTSSPRWW

SEQ ID NO: 1163014 - protein, 9 aa, Homo Sapiens
FNNSLHFSA

SEQ ID NO: 1163015 - protein, 9 aa, Homo Sapiens
VGGLHTVYN

SEQ ID NO: 1163016 - protein, 9 aa, Homo Sapiens
AVAASAPRP

SEQ ID NO: 1163017 - protein, 9 aa, Homo Sapiens
RANRAPRGC

SEQ ID NO: 1163018 - protein, 9 aa, Homo Sapiens
APSANHFQQ

SEQ ID NO: 1163019 - protein, 9 aa, Homo Sapiens
TSSPRWWRR

SEQ ID NO: 1163020 - protein, 9 aa, Homo Sapiens
PRRCSTCAA

SEQ ID NO: 1163021 - protein, 9 aa, Homo Sapiens
SVKSAAGRR

SEQ ID NO: 1163022 - protein, 9 aa, Homo Sapiens
AAKGRHRKI

SEQ ID NO: 1163023 - protein, 9 aa, Homo Sapiens
GLTVLNKVG

SEQ ID NO: 1163024 - protein, 9 aa, Homo Sapiens
VSGCAPPED

SEQ ID NO: 1163025 - protein, 9 aa, Homo Sapiens
QNPLRSGHA

SEQ ID NO: 1163026 - protein, 9 aa, Homo Sapiens
CSTCAAVAA

SEQ ID NO: 1163027 - protein, 9 aa, Homo Sapiens
ARSGPKTAP

SEQ ID NO: 1163028 - protein, 9 aa, Homo Sapiens
HALHKAQMS

SEQ ID NO: 1163029 - protein, 9 aa, Homo Sapiens
RRCSTCAAV

SEQ ID NO: 1163030 - protein, 9 aa, Homo Sapiens
DNTQLARLE

SEQ ID NO: 1163031 - protein, 9 aa, Homo Sapiens
PCGGFFLHL

SEQ ID NO: 1163032 - protein, 9 aa, Homo Sapiens
CSGGTAGIQ

SEQ ID NO: 1163033 - protein, 9 aa, Homo Sapiens
TWRHWLFYL

SEQ ID NO: 1163034 - protein, 9 aa, Homo Sapiens
SNIVSAHDT

SEQ ID NO: 1163035 - protein, 9 aa, Homo Sapiens
VLLNPRGGE

SEQ ID NO: 1163036 - protein, 9 aa, Homo Sapiens
TTQHALHKA

SEQ ID NO: 1163037 - protein, 9 aa, Homo Sapiens
GCAPPEDLE

SEQ ID NO: 1163038 - protein, 9 aa, Homo Sapiens
SCRWSYRCY

SEQ ID NO: 1163039 - protein, 9 aa, Homo Sapiens
FAVIFRIRS

SEQ ID NO: 1163040 - protein, 9 aa, Homo Sapiens
LDWLVEVQV

SEQ ID NO: 1163041 - protein, 9 aa, Homo Sapiens
MIKSSRPCG

SEQ ID NO: 1163042 - protein, 9 aa, Homo Sapiens
NELNEDKIL

SEQ ID NO: 1163043 - protein, 9 aa, Homo Sapiens
NISSDTFEI

SEQ ID NO: 1163044 - protein, 9 aa, Homo Sapiens
NMLSVALSQ

SEQ ID NO: 1163045 - protein, 9 aa, Homo Sapiens
SSRPCGGFF

SEQ ID NO: 1163046 - protein, 9 aa, Homo Sapiens
RWWRRWRHR

SEQ ID NO: 1163047 - protein, 9 aa, Homo Sapiens
QARSGGITT

SEQ ID NO: 1163048 - protein, 9 aa, Homo Sapiens
LLPTPAMYS

SEQ ID NO: 1163049 - protein, 9 aa, Homo Sapiens
ASSLAQRWS

SEQ ID NO: 1163050 - protein, 9 aa, Homo Sapiens
DKILHFAVA

SEQ ID NO: 1163051 - protein, 9 aa, Homo Sapiens
MSNIVSAHD

SEQ ID NO: 1163052 - protein, 9 aa, Homo Sapiens
GSGTALVPV

SEQ ID NO: 1163053 - protein, 9 aa, Homo Sapiens
PPMRRKLAL

SEQ ID NO: 1163054 - protein, 9 aa, Homo Sapiens
PQNPLRSGH

SEQ ID NO: 1163055 - protein, 9 aa, Homo Sapiens
PACARSGPK

SEQ ID NO: 1163056 - protein, 9 aa, Homo Sapiens
NPDPAKDPR

SEQ ID NO: 1163057 - protein, 9 aa, Homo Sapiens
VLQNYDAII

SEQ ID NO: 1163058 - protein, 9 aa, Homo Sapiens
EGPCAAATG

SEQ ID NO: 1163059 - protein, 9 aa, Homo Sapiens
VCQPTRCPP

SEQ ID NO: 1163060 - protein, 9 aa, Homo Sapiens
GAGYFTAAG

SEQ ID NO: 1163061 - protein, 9 aa, Homo Sapiens
RWSMKKRTS

SEQ ID NO: 1163062 - protein, 9 aa, Homo Sapiens
YPRAYSNPD

SEQ ID NO: 1163063 - protein, 9 aa, Homo Sapiens
TLAHLLPTP

SEQ ID NO: 1163064 - protein, 9 aa, Homo Sapiens
PPPPMRRKL

SEQ ID NO: 1163065 - protein, 9 aa, Homo Sapiens
WRHWLFYLC

SEQ ID NO: 1163066 - protein, 9 aa, Homo Sapiens
RWRHRWFTC

SEQ ID NO: 1163067 - protein, 9 aa, Homo Sapiens
PQHHGLAAH

SEQ ID NO: 1163068 - protein, 9 aa, Homo Sapiens
IIAVSSSEQ

SEQ ID NO: 1163069 - protein, 9 aa, Homo Sapiens
PRAAWARSR

SEQ ID NO: 1163070 - protein, 9 aa, Homo Sapiens
KVYVPPSIE

SEQ ID NO: 1163071 - protein, 9 aa, Homo Sapiens
QVTIWERDV

SEQ ID NO: 1163072 - protein, 9 aa, Homo Sapiens
HPRSPNMLS

SEQ ID NO: 1163073 - protein, 9 aa, Homo Sapiens
HIGRYDKAR

SEQ ID NO: 1163074 - protein, 9 aa, Homo Sapiens
KSAAGRRAN

SEQ ID NO: 1163075 - protein, 9 aa, Homo Sapiens
TGAPTPACA

SEQ ID NO: 1163076 - protein, 9 aa, Homo Sapiens
HMIKSSRPC

SEQ ID NO: 1163077 - protein, 9 aa, Homo Sapiens
ISCSDGLTV

SEQ ID NO: 1163078 - protein, 9 aa, Homo Sapiens
SGGTAGIQG

SEQ ID NO: 1163079 - protein, 9 aa, Homo Sapiens
RSMSNIVSA

SEQ ID NO: 1163080 - protein, 9 aa, Homo Sapiens
WADDNPQHH

SEQ ID NO: 1163081 - protein, 9 aa, Homo Sapiens
GCSASSRCA

SEQ ID NO: 1163082 - protein, 9 aa, Homo Sapiens
RSGPKTAPR

SEQ ID NO: 1163083 - protein, 9 aa, Homo Sapiens
SYLFIFAVI

SEQ ID NO: 1163084 - protein, 9 aa, Homo Sapiens
SSSEQEIMH

SEQ ID NO: 1163085 - protein, 9 aa, Homo Sapiens
LLDWLVEVQ

SEQ ID NO: 1163086 - protein, 9 aa, Homo Sapiens
QNYDAIINS

SEQ ID NO: 1163087 - protein, 9 aa, Homo Sapiens
VTIWERDVS

SEQ ID NO: 1163088 - protein, 9 aa, Homo Sapiens
IFAVIFRIR

SEQ ID NO: 1163089 - protein, 9 aa, Homo Sapiens
HKAQMSKEV

SEQ ID NO: 1163090 - protein, 9 aa, Homo Sapiens
AGLFLCTVA

SEQ ID NO: 1163091 - protein, 9 aa, Homo Sapiens
CAAVAASAP

SEQ ID NO: 1163092 - protein, 9 aa, Homo Sapiens
ARDCDHQKE

SEQ ID NO: 1163093 - protein, 9 aa, Homo Sapiens
GAPTPACAR

SEQ ID NO: 1163094 - protein, 9 aa, Homo Sapiens
PCLCSGGTA

SEQ ID NO: 1163095 - protein, 9 aa, Homo Sapiens
APAVARRWE

SEQ ID NO: 1163096 - protein, 9 aa, Homo Sapiens
SDMRAILLD

SEQ ID NO: 1163097 - protein, 9 aa, Homo Sapiens
RGDLATIPG

SEQ ID NO: 1163098 - protein, 9 aa, Homo Sapiens
PRGCSASSR

SEQ ID NO: 1163099 - protein, 9 aa, Homo Sapiens
PQYFRQGNN

SEQ ID NO: 1163100 - protein, 9 aa, Homo Sapiens
PPPPPPPMR

SEQ ID NO: 1163101 - protein, 9 aa, Homo Sapiens
RQTEVQVVY

SEQ ID NO: 1163102 - protein, 9 aa, Homo Sapiens
RLGCRPLRK

SEQ ID NO: 1163103 - protein, 9 aa, Homo Sapiens
PQVTIWERD

SEQ ID NO: 1163104 - protein, 9 aa, Homo Sapiens
HSRSMSNIV

SEQ ID NO: 1163105 - protein, 9 aa, Homo Sapiens
NIFWKHLLS

SEQ ID NO: 1163106 - protein, 9 aa, Homo Sapiens
QGPEAQARS

SEQ ID NO: 1163107 - protein, 9 aa, Homo Sapiens
PKTAPRAAW

SEQ ID NO: 1163108 - protein, 9 aa, Homo Sapiens
AYSNPDPAK

SEQ ID NO: 1163109 - protein, 9 aa, Homo Sapiens
PGMTSAPGF

SEQ ID NO: 1163110 - protein, 9 aa, Homo Sapiens
FTAAGLFLC

SEQ ID NO: 1163111 - protein, 9 aa, Homo Sapiens
CDHQKEQKC

SEQ ID NO: 1163112 - protein, 9 aa, Homo Sapiens
AGIQGPEAQ

SEQ ID NO: 1163113 - protein, 9 aa, Homo Sapiens
RAILLDWLV

SEQ ID NO: 1163114 - protein, 9 aa, Homo Sapiens
MKKLQGELL

SEQ ID NO: 1163115 - protein, 9 aa, Homo Sapiens
LNISSDTFE

SEQ ID NO: 1163116 - protein, 9 aa, Homo Sapiens
VSAHDTFMK

SEQ ID NO: 1163117 - protein, 9 aa, Homo Sapiens
LNPRGGEGK

SEQ ID NO: 1163118 - protein, 9 aa, Homo Sapiens
PFTFTAAKG

SEQ ID NO: 1163119 - protein, 9 aa, Homo Sapiens
EVHFPFTFT

SEQ ID NO: 1163120 - protein, 9 aa, Homo Sapiens
ANHFQQPQW

SEQ ID NO: 1163121 - protein, 9 aa, Homo Sapiens
LATIPGMNR

SEQ ID NO: 1163122 - protein, 9 aa, Homo Sapiens
DTSPSSTGD

SEQ ID NO: 1163123 - protein, 9 aa, Homo Sapiens
GIQGPEAQA

SEQ ID NO: 1163124 - protein, 9 aa, Homo Sapiens
LFLWHIGRY

SEQ ID NO: 1163125 - protein, 9 aa, Homo Sapiens
GMTSAPGFP

SEQ ID NO: 1163126 - protein, 9 aa, Homo Sapiens
PGSPAPAVA

SEQ ID NO: 1163127 - protein, 9 aa, Homo Sapiens
SPRWWRRWR

SEQ ID NO: 1163128 - protein, 9 aa, Homo Sapiens
IPGMNRPFL

SEQ ID NO: 1163129 - protein, 9 aa, Homo Sapiens
STGGKAPLK

SEQ ID NO: 1163130 - protein, 9 aa, Homo Sapiens
VPVGAPALR

SEQ ID NO: 1163131 - protein, 9 aa, Homo Sapiens
DLATIPGMN

SEQ ID NO: 1163132 - protein, 9 aa, Homo Sapiens
RDCDHQKEQ

SEQ ID NO: 1163133 - protein, 9 aa, Homo Sapiens
SAPRPSVKS

SEQ ID NO: 1163134 - protein, 9 aa, Homo Sapiens
GPKTAPRAA

SEQ ID NO: 1163135 - protein, 9 aa, Homo Sapiens
KSTGGKAPL

SEQ ID NO: 1163136 - protein, 9 aa, Homo Sapiens
TALVPVGAP

SEQ ID NO: 1163137 - protein, 9 aa, Homo Sapiens
LRPGMTSAP

SEQ ID NO: 1163138 - protein, 9 aa, Homo Sapiens
GFFLHLLVP

SEQ ID NO: 1163139 - protein, 9 aa, Homo Sapiens
VYNKLKRLE

SEQ ID NO: 1163140 - protein, 9 aa, Homo Sapiens
LPTPAMYSL

SEQ ID NO: 1163141 - protein, 9 aa, Homo Sapiens
SRPCGGFFL

SEQ ID NO: 1163142 - protein, 9 aa, Homo Sapiens
HWLFYLCPG

SEQ ID NO: 1163143 - protein, 9 aa, Homo Sapiens
WGAPSANHF

SEQ ID NO: 1163144 - protein, 9 aa, Homo Sapiens
GKAPLKQLA

SEQ ID NO: 1163145 - protein, 9 aa, Homo Sapiens
RPPPLRPGM

SEQ ID NO: 1163146 - protein, 9 aa, Homo Sapiens
FWKHLLSEC

SEQ ID NO: 1163147 - protein, 9 aa, Homo Sapiens
TSPSSTGDT

SEQ ID NO: 1163148 - protein, 9 aa, Homo Sapiens
NNSLHFSAH

SEQ ID NO: 1163149 - protein, 9 aa, Homo Sapiens
PSANHFQQP

SEQ ID NO: 1163150 - protein, 9 aa, Homo Sapiens
GPRRCSTCA

SEQ ID NO: 1163151 - protein, 9 aa, Homo Sapiens
GRHRKIAWE

SEQ ID NO: 1163152 - protein, 9 aa, Homo Sapiens
FIFAVIFRI

SEQ ID NO: 1163153 - protein, 9 aa, Homo Sapiens
MRRKLALLF

SEQ ID NO: 1163154 - protein, 9 aa, Homo Sapiens
NPRGGEGKA

SEQ ID NO: 1163155 - protein, 9 aa, Homo Sapiens
GGFFLHLLV

SEQ ID NO: 1163156 - protein, 9 aa, Homo Sapiens
DNPQHHGLA

SEQ ID NO: 1163157 - protein, 9 aa, Homo Sapiens
ARRWEGPCA

SEQ ID NO: 1163158 - protein, 9 aa, Homo Sapiens
RSRPCLCSG

SEQ ID NO: 1163159 - protein, 9 aa, Homo Sapiens
KKLQGELLL

SEQ ID NO: 1163160 - protein, 9 aa, Homo Sapiens
LSECYDKTD

SEQ ID NO: 1163161 - protein, 9 aa, Homo Sapiens
HRKIAWEKK

SEQ ID NO: 1163162 - protein, 9 aa, Homo Sapiens
RWFTCSCGA

SEQ ID NO: 1163163 - protein, 9 aa, Homo Sapiens
LWHIGRYDK

SEQ ID NO: 1163164 - protein, 9 aa, Homo Sapiens
GLFLCTVAL

SEQ ID NO: 1163165 - protein, 9 aa, Homo Sapiens
VHFPFTFTA

SEQ ID NO: 1163166 - protein, 9 aa, Homo Sapiens
RQQEIEMNR

SEQ ID NO: 1163167 - protein, 9 aa, Homo Sapiens
IINSQGITF

SEQ ID NO: 1163168 - protein, 9 aa, Homo Sapiens
PPLRPGMTS

SEQ ID NO: 1163169 - protein, 9 aa, Homo Sapiens
SPAPAVARR

SEQ ID NO: 1163170 - protein, 9 aa, Homo Sapiens
LRSGHAGGY

SEQ ID NO: 1163171 - protein, 9 aa, Homo Sapiens
ELNEDKILH

SEQ ID NO: 1163172 - protein, 9 aa, Homo Sapiens
SVGPVSPSC

SEQ ID NO: 1163173 - protein, 9 aa, Homo Sapiens
IQGPEAQAR

SEQ ID NO: 1163174 - protein, 9 aa, Homo Sapiens
SGPKTAPRA

SEQ ID NO: 1163175 - protein, 9 aa, Homo Sapiens
APTPACARS

SEQ ID NO: 1163176 - protein, 9 aa, Homo Sapiens
SDKSDWKVV

SEQ ID NO: 1163177 - protein, 9 aa, Homo Sapiens
RRGDLATIP

SEQ ID NO: 1163178 - protein, 9 aa, Homo Sapiens
KSHPRSPNM

SEQ ID NO: 1163179 - protein, 9 aa, Homo Sapiens
WWRRWRHRW

SEQ ID NO: 1163180 - protein, 9 aa, Homo Sapiens
TRCPPARWG

SEQ ID NO: 1163181 - protein, 9 aa, Homo Sapiens
PPPMRRKLA

SEQ ID NO: 1163182 - protein, 9 aa, Homo Sapiens
VKSAAGRRA

SEQ ID NO: 1163183 - protein, 9 aa, Homo Sapiens
LTQDQKVKH

SEQ ID NO: 1163184 - protein, 9 aa, Homo Sapiens
QCAKVSSIS

SEQ ID NO: 1163185 - protein, 9 aa, Homo Sapiens
ATIPGMNRP

SEQ ID NO: 1163186 - protein, 9 aa, Homo Sapiens
TPACARSGP

SEQ ID NO: 1163187 - protein, 9 aa, Homo Sapiens
GELLLNKEQ

SEQ ID NO: 1163188 - protein, 9 aa, Homo Sapiens
GPEAQARSG

SEQ ID NO: 1163189 - protein, 9 aa, Homo Sapiens
RGCSASSRC

SEQ ID NO: 1163190 - protein, 9 aa, Homo Sapiens
AWARSRPCL

SEQ ID NO: 1163191 - protein, 9 aa, Homo Sapiens
SPSSTGDTT

SEQ ID NO: 1163192 - protein, 9 aa, Homo Sapiens
QEIEMNRQQ

SEQ ID NO: 1163193 - protein, 9 aa, Homo Sapiens
GGTAGIQGP

SEQ ID NO: 1163194 - protein, 9 aa, Homo Sapiens
PVSGCAPPE

SEQ ID NO: 1163195 - protein, 9 aa, Homo Sapiens
YPPTWRHWL

SEQ ID NO: 1163196 - protein, 9 aa, Homo Sapiens
TDLGRLGCR

SEQ ID NO: 1163197 - protein, 9 aa, Homo Sapiens
SQPPVSGCA

SEQ ID NO: 1163198 - protein, 9 aa, Homo Sapiens
ILSKLTQDQ

SEQ ID NO: 1163199 - protein, 9 aa, Homo Sapiens
ANMKKLQGE

SEQ ID NO: 1163200 - protein, 9 aa, Homo Sapiens
FHLKVYVPP

SEQ ID NO: 1163201 - protein, 9 aa, Homo Sapiens
KAQMSKEVV

SEQ ID NO: 1163202 - protein, 9 aa, Homo Sapiens
NFHLKVYVP

SEQ ID NO: 1163203 - protein, 9 aa, Homo Sapiens
WSMKKRTST

SEQ ID NO: 1163204 - protein, 9 aa, Homo Sapiens
NHFQQPQWP

SEQ ID NO: 1163205 - protein, 9 aa, Homo Sapiens
SRSMSNIVS

SEQ ID NO: 1163206 - protein, 9 aa, Homo Sapiens
NEDKILHFA

SEQ ID NO: 1163207 - protein, 9 aa, Homo Sapiens
CRWSYRCYA

SEQ ID NO: 1163208 - protein, 9 aa, Homo Sapiens
LSKLTQDQK

SEQ ID NO: 1163209 - protein, 9 aa, Homo Sapiens
CAKVSSISD

SEQ ID NO: 1163210 - protein, 9 aa, Homo Sapiens
TGGKAPLKQ

SEQ ID NO: 1163211 - protein, 9 aa, Homo Sapiens
GEGKALQLF

SEQ ID NO: 1163212 - protein, 9 aa, Homo Sapiens
FISCSDGLT

SEQ ID NO: 1163213 - protein, 9 aa, Homo Sapiens
NPLRSGHAG

SEQ ID NO: 1163214 - protein, 9 aa, Homo Sapiens
QHHGLAAHS

SEQ ID NO: 1163215 - protein, 9 aa, Homo Sapiens
PTPAMYSLL

SEQ ID NO: 1163216 - protein, 9 aa, Homo Sapiens
LKTDLGRLG

SEQ ID NO: 1163217 - protein, 9 aa, Homo Sapiens
SDGLTVLNK

SEQ ID NO: 1163218 - protein, 9 aa, Homo Sapiens
HTVYNKLKR

SEQ ID NO: 1163219 - protein, 9 aa, Homo Sapiens
APRAAWARS

SEQ ID NO: 1163220 - protein, 9 aa, Homo Sapiens
LKVYVPPSI

SEQ ID NO: 1163221 - protein, 9 aa, Homo Sapiens
KILHFAVAE

SEQ ID NO: 1163222 - protein, 9 aa, Homo Sapiens
GRRANRAPR

SEQ ID NO: 1163223 - protein, 9 aa, Homo Sapiens
SGGITTSSP

SEQ ID NO: 1163224 - protein, 9 aa, Homo Sapiens
GSPAPAVAR

SEQ ID NO: 1163225 - protein, 9 aa, Homo Sapiens
LHFSAHRRT

SEQ ID NO: 1163226 - protein, 9 aa, Homo Sapiens
KRFNNSLHF

SEQ ID NO: 1163227 - protein, 9 aa, Homo Sapiens
QPPVSGCAP

SEQ ID NO: 1163228 - protein, 9 aa, Homo Sapiens
SANHFQQPQ

SEQ ID NO: 1163229 - protein, 9 aa, Homo Sapiens
LNEDKILHF

SEQ ID NO: 1163230 - protein, 9 aa, Homo Sapiens
IILSKLTQD

SEQ ID NO: 1163231 - protein, 9 aa, Homo Sapiens
QQEIEMNRQ

SEQ ID NO: 1163232 - protein, 9 aa, Homo Sapiens
SWADDNPQH

SEQ ID NO: 1163233 - protein, 9 aa, Homo Sapiens
RGGEGKALQ

SEQ ID NO: 1163234 - protein, 9 aa, Homo Sapiens
GKRFNNSLH

SEQ ID NO: 1163235 - protein, 9 aa, Homo Sapiens
YSNPDPAKD

SEQ ID NO: 1163236 - protein, 9 aa, Homo Sapiens
SCGAGYFTA

SEQ ID NO: 1163237 - protein, 9 aa, Homo Sapiens
PEAQARSGG

SEQ ID NO: 1163238 - protein, 9 aa, Homo Sapiens
KLQGELLLN

SEQ ID NO: 1163239 - protein, 9 aa, Homo Sapiens
QTEVQVVYM

SEQ ID NO: 1163240 - protein, 9 aa, Homo Sapiens
LQGELLLNK

SEQ ID NO: 1163241 - protein, 9 aa, Homo Sapiens
ILLDWLVEV

SEQ ID NO: 1163242 - protein, 9 aa, Homo Sapiens
RWGPRRCST

SEQ ID NO: 1163243 - protein, 9 aa, Homo Sapiens
PPPPPMRRK

SEQ ID NO: 1163244 - protein, 9 aa, Homo Sapiens
KNELNEDKI

SEQ ID NO: 1163245 - protein, 9 aa, Homo Sapiens
VSSSEQEIM

SEQ ID NO: 1163246 - protein, 9 aa, Homo Sapiens
QGELLLNKE

SEQ ID NO: 1163247 - protein, 9 aa, Homo Sapiens
RRWEGPCAA

SEQ ID NO: 1163248 - protein, 9 aa, Homo Sapiens
AAATGAPTP

SEQ ID NO: 1163249 - protein, 9 aa, Homo Sapiens
VSPSCRWSY

SEQ ID NO: 1163250 - protein, 9 aa, Homo Sapiens
HAGGYQTLG

SEQ ID NO: 1163251 - protein, 9 aa, Homo Sapiens
KGRHRKIAW

SEQ ID NO: 1163252 - protein, 9 aa, Homo Sapiens
VVYMGSFEE

SEQ ID NO: 1163253 - protein, 9 aa, Homo Sapiens
APLKQLATK

SEQ ID NO: 1163254 - protein, 9 aa, Homo Sapiens
VNIFWKHLL

SEQ ID NO: 1163255 - protein, 9 aa, Homo Sapiens
LAHLLPTPA

SEQ ID NO: 1163256 - protein, 9 aa, Homo Sapiens
YNKLKRLEI

SEQ ID NO: 1163257 - protein, 9 aa, Homo Sapiens
LARLEGERP

SEQ ID NO: 1163258 - protein, 9 aa, Homo Sapiens
KNFHLKVYV

SEQ ID NO: 1163259 - protein, 9 aa, Homo Sapiens
SCSDGLTVL

SEQ ID NO: 1163260 - protein, 9 aa, Homo Sapiens
EVQVVYMGS

SEQ ID NO: 1163261 - protein, 9 aa, Homo Sapiens
YLFIFAVIF

SEQ ID NO: 1163262 - protein, 9 aa, Homo Sapiens
DTRNQKTFP

SEQ ID NO: 1163263 - protein, 9 aa, Homo Sapiens
IIWTLLGKV

SEQ ID NO: 1163264 - protein, 9 aa, Homo Sapiens
NTREMGYCF

SEQ ID NO: 1163265 - protein, 9 aa, Homo Sapiens
VSLPELEDW

SEQ ID NO: 1163266 - protein, 9 aa, Homo Sapiens
KEGPGLQGG

SEQ ID NO: 1163267 - protein, 9 aa, Homo Sapiens
AENSHEERL

SEQ ID NO: 1163268 - protein, 9 aa, Homo Sapiens
TTVNENDQA

SEQ ID NO: 1163269 - protein, 9 aa, Homo Sapiens
RQSILFLLP

SEQ ID NO: 1163270 - protein, 9 aa, Homo Sapiens
FWKIKINLT

SEQ ID NO: 1163271 - protein, 9 aa, Homo Sapiens
ILFLLPGKL

SEQ ID NO: 1163272 - protein, 9 aa, Homo Sapiens
EPEVLQDSQ

SEQ ID NO: 1163273 - protein, 9 aa, Homo Sapiens
FDCADRQSI

SEQ ID NO: 1163274 - protein, 9 aa, Homo Sapiens
GMTPTVSSS

SEQ ID NO: 1163275 - protein, 9 aa, Homo Sapiens
DPYRPVRLQ

SEQ ID NO: 1163276 - protein, 9 aa, Homo Sapiens
FLFLCCLLS

SEQ ID NO: 1163277 - protein, 9 aa, Homo Sapiens
LTWVVYRFP

SEQ ID NO: 1163278 - protein, 9 aa, Homo Sapiens
SGPEDTRNQ

SEQ ID NO: 1163279 - protein, 9 aa, Homo Sapiens
FLDEEYKVP

SEQ ID NO: 1163280 - protein, 9 aa, Homo Sapiens
SQFSSRSRS

SEQ ID NO: 1163281 - protein, 9 aa, Homo Sapiens
QAERLVLHD

SEQ ID NO: 1163282 - protein, 9 aa, Homo Sapiens
TQDVQHGDR

SEQ ID NO: 1163283 - protein, 9 aa, Homo Sapiens
QGTLLIGTY

SEQ ID NO: 1163284 - protein, 9 aa, Homo Sapiens
PYSVVRNKQ

SEQ ID NO: 1163285 - protein, 9 aa, Homo Sapiens
AQAERLVLH

SEQ ID NO: 1163286 - protein, 9 aa, Homo Sapiens
SNTREMGYC

SEQ ID NO: 1163287 - protein, 9 aa, Homo Sapiens
PPAENSHEE

SEQ ID NO: 1163288 - protein, 9 aa, Homo Sapiens
LQMQKLPTR

SEQ ID NO: 1163289 - protein, 9 aa, Homo Sapiens
TAGKENHCD

SEQ ID NO: 1163290 - protein, 9 aa, Homo Sapiens
MPSPEARVL

SEQ ID NO: 1163291 - protein, 9 aa, Homo Sapiens
RAMPSPEAR

SEQ ID NO: 1163292 - protein, 9 aa, Homo Sapiens
AQPVAVFLG

SEQ ID NO: 1163293 - protein, 9 aa, Homo Sapiens
GNAGMSSVT

SEQ ID NO: 1163294 - protein, 9 aa, Homo Sapiens
NGNAGMSSV

SEQ ID NO: 1163295 - protein, 9 aa, Homo Sapiens
GLLTPIIKH

SEQ ID NO: 1163296 - protein, 9 aa, Homo Sapiens
KGAGDEDSC

SEQ ID NO: 1163297 - protein, 9 aa, Homo Sapiens
TGLYPPPGF

SEQ ID NO: 1163298 - protein, 9 aa, Homo Sapiens
PRVMSTQCV

SEQ ID NO: 1163299 - protein, 9 aa, Homo Sapiens
CGLRAMPSP

SEQ ID NO: 1163300 - protein, 9 aa, Homo Sapiens
LLNGNAGMS

SEQ ID NO: 1163301 - protein, 9 aa, Homo Sapiens
TWVVYRFPK

SEQ ID NO: 1163302 - protein, 9 aa, Homo Sapiens
QCVANTSTQ

SEQ ID NO: 1163303 - protein, 9 aa, Homo Sapiens
MAWQVSLPE

SEQ ID NO: 1163304 - protein, 9 aa, Homo Sapiens
GTESTTVNE

SEQ ID NO: 1163305 - protein, 9 aa, Homo Sapiens
PFCGPNRIE

SEQ ID NO: 1163306 - protein, 9 aa, Homo Sapiens
IGTYDSLLC

SEQ ID NO: 1163307 - protein, 9 aa, Homo Sapiens
IMALWGDPI

SEQ ID NO: 1163308 - protein, 9 aa, Homo Sapiens
NLTWVVYRF

SEQ ID NO: 1163309 - protein, 9 aa, Homo Sapiens
NLFLNSSIS

SEQ ID NO: 1163310 - protein, 9 aa, Homo Sapiens
QAIEMVEDW

SEQ ID NO: 1163311 - protein, 9 aa, Homo Sapiens
DNLKTPAKC

SEQ ID NO: 1163312 - protein, 9 aa, Homo Sapiens
IEMVEDWDT

SEQ ID NO: 1163313 - protein, 9 aa, Homo Sapiens
RSKSRSQFS

SEQ ID NO: 1163314 - protein, 9 aa, Homo Sapiens
LLTPIIKHA

SEQ ID NO: 1163315 - protein, 9 aa, Homo Sapiens
NGSNTREMG

SEQ ID NO: 1163316 - protein, 9 aa, Homo Sapiens
QHGDRWDPT

SEQ ID NO: 1163317 - protein, 9 aa, Homo Sapiens
VHAQAERLV

SEQ ID NO: 1163318 - protein, 9 aa, Homo Sapiens
QAPWDRKDP

SEQ ID NO: 1163319 - protein, 9 aa, Homo Sapiens
PEDTRNQKT

SEQ ID NO: 1163320 - protein, 9 aa, Homo Sapiens
YKVPDLDGT

SEQ ID NO: 1163321 - protein, 9 aa, Homo Sapiens
PYRPVRLQM

SEQ ID NO: 1163322 - protein, 9 aa, Homo Sapiens
NLKTPAKCL

SEQ ID NO: 1163323 - protein, 9 aa, Homo Sapiens
SKRRAQAPW

SEQ ID NO: 1163324 - protein, 9 aa, Homo Sapiens
RLVLHDQQL

SEQ ID NO: 1163325 - protein, 9 aa, Homo Sapiens
ENDQALLLL

SEQ ID NO: 1163326 - protein, 9 aa, Homo Sapiens
SRSQFSSRS

SEQ ID NO: 1163327 - protein, 9 aa, Homo Sapiens
AEGVMVQIK

SEQ ID NO: 1163328 - protein, 9 aa, Homo Sapiens
CDMHRVGKW

SEQ ID NO: 1163329 - protein, 9 aa, Homo Sapiens
REEAKEGPG

SEQ ID NO: 1163330 - protein, 9 aa, Homo Sapiens
ISQSFWKIK

SEQ ID NO: 1163331 - protein, 9 aa, Homo Sapiens
WQVSLPELE

SEQ ID NO: 1163332 - protein, 9 aa, Homo Sapiens
VDDFLPVLT

SEQ ID NO: 1163333 - protein, 9 aa, Homo Sapiens
RRAQAPWDR

SEQ ID NO: 1163334 - protein, 9 aa, Homo Sapiens
TPSGPEDTR

SEQ ID NO: 1163335 - protein, 9 aa, Homo Sapiens
RVMSTQCVA

SEQ ID NO: 1163336 - protein, 9 aa, Homo Sapiens
VPRVMSTQC

SEQ ID NO: 1163337 - protein, 9 aa, Homo Sapiens
GLDAPLFGV

SEQ ID NO: 1163338 - protein, 9 aa, Homo Sapiens
VLREEAKEG

SEQ ID NO: 1163339 - protein, 9 aa, Homo Sapiens
DGSPAEGVM

SEQ ID NO: 1163340 - protein, 9 aa, Homo Sapiens
TPIIKHAAA

SEQ ID NO: 1163341 - protein, 9 aa, Homo Sapiens
NNSGRMYGV

SEQ ID NO: 1163342 - protein, 9 aa, Homo Sapiens
GLRAMPSPE

SEQ ID NO: 1163343 - protein, 9 aa, Homo Sapiens
EDWDTELYS

SEQ ID NO: 1163344 - protein, 9 aa, Homo Sapiens
SLLNGNAGM

SEQ ID NO: 1163345 - protein, 9 aa, Homo Sapiens
TLLIGTYDS

SEQ ID NO: 1163346 - protein, 9 aa, Homo Sapiens
AERLVLHDQ

SEQ ID NO: 1163347 - protein, 9 aa, Homo Sapiens
SYIPSNGSN

SEQ ID NO: 1163348 - protein, 9 aa, Homo Sapiens
VFLGIPFAK

SEQ ID NO: 1163349 - protein, 9 aa, Homo Sapiens
AKEGPGLQG

SEQ ID NO: 1163350 - protein, 9 aa, Homo Sapiens
HTPSGPEDT

SEQ ID NO: 1163351 - protein, 9 aa, Homo Sapiens
LFLCCLLSP

SEQ ID NO: 1163352 - protein, 9 aa, Homo Sapiens
PAKCLLYPL

SEQ ID NO: 1163353 - protein, 9 aa, Homo Sapiens
GKENHCDMH

SEQ ID NO: 1163354 - protein, 9 aa, Homo Sapiens
PSGPEDTRN

SEQ ID NO: 1163355 - protein, 9 aa, Homo Sapiens
HAQAERLVL

SEQ ID NO: 1163356 - protein, 9 aa, Homo Sapiens
TPSTGLYPP

SEQ ID NO: 1163357 - protein, 9 aa, Homo Sapiens
KRRAQAPWD

SEQ ID NO: 1163358 - protein, 9 aa, Homo Sapiens
QSILFLLPG

SEQ ID NO: 1163359 - protein, 9 aa, Homo Sapiens
YEFTQDVQH

SEQ ID NO: 1163360 - protein, 9 aa, Homo Sapiens
SNHRTSPQL

SEQ ID NO: 1163361 - protein, 9 aa, Homo Sapiens
KENHCDMHR

SEQ ID NO: 1163362 - protein, 9 aa, Homo Sapiens
LPGKLLWII

SEQ ID NO: 1163363 - protein, 9 aa, Homo Sapiens
RIEHVFCDF

SEQ ID NO: 1163364 - protein, 9 aa, Homo Sapiens
KCLLYPLPP

SEQ ID NO: 1163365 - protein, 9 aa, Homo Sapiens
RETDKKKKE

SEQ ID NO: 1163366 - protein, 9 aa, Homo Sapiens
TESTTVNEN

SEQ ID NO: 1163367 - protein, 9 aa, Homo Sapiens
PSTGLYPPP

SEQ ID NO: 1163368 - protein, 9 aa, Homo Sapiens
FLHTPSGPE

SEQ ID NO: 1163369 - protein, 9 aa, Homo Sapiens
LFLNSSISQ

SEQ ID NO: 1163370 - protein, 9 aa, Homo Sapiens
LKTPAKCLL

SEQ ID NO: 1163371 - protein, 9 aa, Homo Sapiens
QDVQHGDRW

SEQ ID NO: 1163372 - protein, 9 aa, Homo Sapiens
PAENSHEER

SEQ ID NO: 1163373 - protein, 9 aa, Homo Sapiens
VQHGDRWDP

SEQ ID NO: 1163374 - protein, 9 aa, Homo Sapiens
KHAAAKGIQ

SEQ ID NO: 1163375 - protein, 9 aa, Homo Sapiens
SFLHTPSGP

SEQ ID NO: 1163376 - protein, 9 aa, Homo Sapiens
INLTWVVYR

SEQ ID NO: 1163377 - protein, 9 aa, Homo Sapiens
SGRMYGVDD

SEQ ID NO: 1163378 - protein, 9 aa, Homo Sapiens
KTAGKENHC

SEQ ID NO: 1163379 - protein, 9 aa, Homo Sapiens
IKHAAAKGI

SEQ ID NO: 1163380 - protein, 9 aa, Homo Sapiens
MSTQCVANT

SEQ ID NO: 1163381 - protein, 9 aa, Homo Sapiens
RPVRLQMQK

SEQ ID NO: 1163382 - protein, 9 aa, Homo Sapiens
EGFAQPVAV

SEQ ID NO: 1163383 - protein, 9 aa, Homo Sapiens
SSNHRTSPQ

SEQ ID NO: 1163384 - protein, 9 aa, Homo Sapiens
IEHVFCDFP

SEQ ID NO: 1163385 - protein, 9 aa, Homo Sapiens
KVPDLDGTR

SEQ ID NO: 1163386 - protein, 9 aa, Homo Sapiens
LLPGKLLWI

SEQ ID NO: 1163387 - protein, 9 aa, Homo Sapiens
TLLGKVLVC

SEQ ID NO: 1163388 - protein, 9 aa, Homo Sapiens
WTLLGKVLV

SEQ ID NO: 1163389 - protein, 9 aa, Homo Sapiens
RTSPQLSTG

SEQ ID NO: 1163390 - protein, 9 aa, Homo Sapiens
IWTLLGKVL

SEQ ID NO: 1163391 - protein, 9 aa, Homo Sapiens
PICGLRAMP

SEQ ID NO: 1163392 - protein, 9 aa, Homo Sapiens
YIPSNGSNT

SEQ ID NO: 1163393 - protein, 9 aa, Homo Sapiens
VRLQMQKLP

SEQ ID NO: 1163394 - protein, 9 aa, Homo Sapiens
WKIKINLTW

SEQ ID NO: 1163395 - protein, 9 aa, Homo Sapiens
EYKVPDLDG

SEQ ID NO: 1163396 - protein, 9 aa, Homo Sapiens
LCCLLSPLL

SEQ ID NO: 1163397 - protein, 9 aa, Homo Sapiens
ENSHEERLF

SEQ ID NO: 1163398 - protein, 9 aa, Homo Sapiens
GVMVQIKAE

SEQ ID NO: 1163399 - protein, 9 aa, Homo Sapiens
AKCLLYPLP

SEQ ID NO: 1163400 - protein, 9 aa, Homo Sapiens
ETDKKKKER

SEQ ID NO: 1163401 - protein, 9 aa, Homo Sapiens
NENDQALLL

SEQ ID NO: 1163402 - protein, 9 aa, Homo Sapiens
AWQVSLPEL

SEQ ID NO: 1163403 - protein, 9 aa, Homo Sapiens
ENHCDMHRV

SEQ ID NO: 1163404 - protein, 9 aa, Homo Sapiens
LLWIIHMML

SEQ ID NO: 1163405 - protein, 9 aa, Homo Sapiens
PNRIEHVFC

SEQ ID NO: 1163406 - protein, 9 aa, Homo Sapiens
NRIEHVFCD

SEQ ID NO: 1163407 - protein, 9 aa, Homo Sapiens
IIHMMLKNL

SEQ ID NO: 1163408 - protein, 9 aa, Homo Sapiens
EHVFCDFPP

SEQ ID NO: 1163409 - protein, 9 aa, Homo Sapiens
GGMTPTVSS

SEQ ID NO: 1163410 - protein, 9 aa, Homo Sapiens
SFWKIKINL

SEQ ID NO: 1163411 - protein, 9 aa, Homo Sapiens
DVQHGDRWD

SEQ ID NO: 1163412 - protein, 9 aa, Homo Sapiens
AGKENHCDM

SEQ ID NO: 1163413 - protein, 9 aa, Homo Sapiens
LRAMPSPEA

SEQ ID NO: 1163414 - protein, 9 aa, Homo Sapiens
EEGLVSPKG

SEQ ID NO: 1163415 - protein, 9 aa, Homo Sapiens
STQCVANTS

SEQ ID NO: 1163416 - protein, 9 aa, Homo Sapiens
QPVAVFLGI

SEQ ID NO: 1163417 - protein, 9 aa, Homo Sapiens
GLLLLLLVT

SEQ ID NO: 1163418 - protein, 9 aa, Homo Sapiens
LNGNAGMSS

SEQ ID NO: 1163419 - protein, 9 aa, Homo Sapiens
HEERLFQLE

SEQ ID NO: 1163420 - protein, 9 aa, Homo Sapiens
QSFWKIKIN

SEQ ID NO: 1163421 - protein, 9 aa, Homo Sapiens
SLPELEDWL

SEQ ID NO: 1163422 - protein, 9 aa, Homo Sapiens
LFLLPGKLL

SEQ ID NO: 1163423 - protein, 9 aa, Homo Sapiens
QALTPSTGL

SEQ ID NO: 1163424 - protein, 9 aa, Homo Sapiens
MTPTVSSSQ

SEQ ID NO: 1163425 - protein, 9 aa, Homo Sapiens
SQSFWKIKI

SEQ ID NO: 1163426 - protein, 9 aa, Homo Sapiens
PELEDWLQC

SEQ ID NO: 1163427 - protein, 9 aa, Homo Sapiens
LIIWTLLGK

SEQ ID NO: 1163428 - protein, 9 aa, Homo Sapiens
PSNGSNTRE

SEQ ID NO: 1163429 - protein, 9 aa, Homo Sapiens
GGLLLLLLV

SEQ ID NO: 1163430 - protein, 9 aa, Homo Sapiens
GPEDTRNQK

SEQ ID NO: 1163431 - protein, 9 aa, Homo Sapiens
TSSNHRTSP

SEQ ID NO: 1163432 - protein, 9 aa, Homo Sapiens
FCGPNRIEH

SEQ ID NO: 1163433 - protein, 9 aa, Homo Sapiens
FSSRSRSRS

SEQ ID NO: 1163434 - protein, 9 aa, Homo Sapiens
STGLYPPPG

SEQ ID NO: 1163435 - protein, 9 aa, Homo Sapiens
STTVNENDQ

SEQ ID NO: 1163436 - protein, 9 aa, Homo Sapiens
ERLVLHDQQ

SEQ ID NO: 1163437 - protein, 9 aa, Homo Sapiens
IIKHAAAKG

SEQ ID NO: 1163438 - protein, 9 aa, Homo Sapiens
RAQAPWDRK

SEQ ID NO: 1163439 - protein, 9 aa, Homo Sapiens
KNLFLNSSI

SEQ ID NO: 1163440 - protein, 9 aa, Homo Sapiens
HCDMHRVGK

SEQ ID NO: 1163441 - protein, 9 aa, Homo Sapiens
TVSSSQHTA

SEQ ID NO: 1163442 - protein, 9 aa, Homo Sapiens
QPPAENSHE

SEQ ID NO: 1163443 - protein, 9 aa, Homo Sapiens
MVQIKAELT

SEQ ID NO: 1163444 - protein, 9 aa, Homo Sapiens
PAEGVMVQI

SEQ ID NO: 1163445 - protein, 9 aa, Homo Sapiens
LWGDPIGDQ

SEQ ID NO: 1163446 - protein, 9 aa, Homo Sapiens
HLQALTPST

SEQ ID NO: 1163447 - protein, 9 aa, Homo Sapiens
NAGMSSVTL

SEQ ID NO: 1163448 - protein, 9 aa, Homo Sapiens
MCDNGELED

SEQ ID NO: 1163449 - protein, 9 aa, Homo Sapiens
AMPSPEARV

SEQ ID NO: 1163450 - protein, 9 aa, Homo Sapiens
WVVYRFPKN

SEQ ID NO: 1163451 - protein, 9 aa, Homo Sapiens
DKKKKERNS

SEQ ID NO: 1163452 - protein, 9 aa, Homo Sapiens
CCLLSPLLK

SEQ ID NO: 1163453 - protein, 9 aa, Homo Sapiens
NIMALWGDP

SEQ ID NO: 1163454 - protein, 9 aa, Homo Sapiens
NSSISQSFW

SEQ ID NO: 1163455 - protein, 9 aa, Homo Sapiens
IKINLTWVV

SEQ ID NO: 1163456 - protein, 9 aa, Homo Sapiens
RSQFSSRSR

SEQ ID NO: 1163457 - protein, 9 aa, Homo Sapiens
CADRQSILF

SEQ ID NO: 1163458 - protein, 9 aa, Homo Sapiens
GKVLVCAAI

SEQ ID NO: 1163459 - protein, 9 aa, Homo Sapiens
MMLKNLFLN

SEQ ID NO: 1163460 - protein, 9 aa, Homo Sapiens
MLKNLFLNS

SEQ ID NO: 1163461 - protein, 9 aa, Homo Sapiens
GTLLIGTYD

SEQ ID NO: 1163462 - protein, 9 aa, Homo Sapiens
EERLFQLEL

SEQ ID NO: 1163463 - protein, 9 aa, Homo Sapiens
GPNRIEHVF

SEQ ID NO: 1163464 - protein, 9 aa, Homo Sapiens
SVVRNKQVE

SEQ ID NO: 1163465 - protein, 9 aa, Homo Sapiens
VEDWDTELY

SEQ ID NO: 1163466 - protein, 9 aa, Homo Sapiens
ELYSFLHTP

SEQ ID NO: 1163467 - protein, 9 aa, Homo Sapiens
LVLHDQQLR

SEQ ID NO: 1163468 - protein, 9 aa, Homo Sapiens
LVSPKGAGD

SEQ ID NO: 1163469 - protein, 9 aa, Homo Sapiens
GFAQPVAVF

SEQ ID NO: 1163470 - protein, 9 aa, Homo Sapiens
VSPKGAGDE

SEQ ID NO: 1163471 - protein, 9 aa, Homo Sapiens
LPYSVVRNK

SEQ ID NO: 1163472 - protein, 9 aa, Homo Sapiens
MYGVDDFLP

SEQ ID NO: 1163473 - protein, 9 aa, Homo Sapiens
NHRTSPQLS

SEQ ID NO: 1163474 - protein, 9 aa, Homo Sapiens
ALWGDPIGD

SEQ ID NO: 1163475 - protein, 9 aa, Homo Sapiens
MVEDWDTEL

SEQ ID NO: 1163476 - protein, 9 aa, Homo Sapiens
EFTQDVQHG

SEQ ID NO: 1163477 - protein, 9 aa, Homo Sapiens
QFSSRSRSR

SEQ ID NO: 1163478 - protein, 9 aa, Homo Sapiens
GEEGLVSPK

SEQ ID NO: 1163479 - protein, 9 aa, Homo Sapiens
DTELYSFLH

SEQ ID NO: 1163480 - protein, 9 aa, Homo Sapiens
ESTTVNEND

SEQ ID NO: 1163481 - protein, 9 aa, Homo Sapiens
CGPNRIEHV

SEQ ID NO: 1163482 - protein, 9 aa, Homo Sapiens
TPAKCLLYP

SEQ ID NO: 1163483 - protein, 9 aa, Homo Sapiens
VMVQIKAEL

SEQ ID NO: 1163484 - protein, 9 aa, Homo Sapiens
PIIKHAAAK

SEQ ID NO: 1163485 - protein, 9 aa, Homo Sapiens
NHCDMHRVG

SEQ ID NO: 1163486 - protein, 9 aa, Homo Sapiens
SPKGAGDED

SEQ ID NO: 1163487 - protein, 9 aa, Homo Sapiens
IPSNGSNTR

SEQ ID NO: 1163488 - protein, 9 aa, Homo Sapiens
QVSLPELED

SEQ ID NO: 1163489 - protein, 9 aa, Homo Sapiens
EMVEDWDTE

SEQ ID NO: 1163490 - protein, 9 aa, Homo Sapiens
LREEAKEGP

SEQ ID NO: 1163491 - protein, 9 aa, Homo Sapiens
NKQVEIRAV

SEQ ID NO: 1163492 - protein, 9 aa, Homo Sapiens
KVLVCAAIV

SEQ ID NO: 1163493 - protein, 9 aa, Homo Sapiens
LDEEYKVPD

SEQ ID NO: 1163494 - protein, 9 aa, Homo Sapiens
PLTSSNHRT

SEQ ID NO: 1163495 - protein, 9 aa, Homo Sapiens
SISQSFWKI

SEQ ID NO: 1163496 - protein, 9 aa, Homo Sapiens
VAVFLGIPF

SEQ ID NO: 1163497 - protein, 9 aa, Homo Sapiens
GLKNIMALW

SEQ ID NO: 1163498 - protein, 9 aa, Homo Sapiens
LKNIMALWG

SEQ ID NO: 1163499 - protein, 9 aa, Homo Sapiens
EAKEGPGLQ

SEQ ID NO: 1163500 - protein, 9 aa, Homo Sapiens
DFFLFLCCL

SEQ ID NO: 1163501 - protein, 9 aa, Homo Sapiens
EPICGLRAM

SEQ ID NO: 1163502 - protein, 9 aa, Homo Sapiens
EEAKEGPGL

SEQ ID NO: 1163503 - protein, 9 aa, Homo Sapiens
LPELEDWLQ

SEQ ID NO: 1163504 - protein, 9 aa, Homo Sapiens
RNKQVEIRA

SEQ ID NO: 1163505 - protein, 9 aa, Homo Sapiens
NSHEERLFQ

SEQ ID NO: 1163506 - protein, 9 aa, Homo Sapiens
FAQPVAVFL

SEQ ID NO: 1163507 - protein, 9 aa, Homo Sapiens
ALTPSTGLY

SEQ ID NO: 1163508 - protein, 9 aa, Homo Sapiens
LTPSTGLYP

SEQ ID NO: 1163509 - protein, 9 aa, Homo Sapiens
QMQKLPTRP

SEQ ID NO: 1163510 - protein, 9 aa, Homo Sapiens
KIKINLTWV

SEQ ID NO: 1163511 - protein, 9 aa, Homo Sapiens
HMMLKNLFL

SEQ ID NO: 1163512 - protein, 9 aa, Homo Sapiens
ADRQSILFL

SEQ ID NO: 1163513 - protein, 9 aa, Homo Sapiens
FTQDVQHGD

SEQ ID NO: 1163514 - protein, 9 aa, Homo Sapiens
EGLVSPKGA

SEQ ID NO: 1163515 - protein, 9 aa, Homo Sapiens
AIEMVEDWD

SEQ ID NO: 1163516 - protein, 9 aa, Homo Sapiens
FLLPGKLLW

SEQ ID NO: 1163517 - protein, 9 aa, Homo Sapiens
KINLTWVVY

SEQ ID NO: 1163518 - protein, 9 aa, Homo Sapiens
CDNGELEDK

SEQ ID NO: 1163519 - protein, 9 aa, Homo Sapiens
FFLFLCCLL

SEQ ID NO: 1163520 - protein, 9 aa, Homo Sapiens
LLIGTYDSL

SEQ ID NO: 1163521 - protein, 9 aa, Homo Sapiens
KTLQGTLLI

SEQ ID NO: 1163522 - protein, 9 aa, Homo Sapiens
PKGAGDEDS

SEQ ID NO: 1163523 - protein, 9 aa, Homo Sapiens
AGGMTPTVS

SEQ ID NO: 1163524 - protein, 9 aa, Homo Sapiens
TLQGTLLIG

SEQ ID NO: 1163525 - protein, 9 aa, Homo Sapiens
KNIMALWGD

SEQ ID NO: 1163526 - protein, 9 aa, Homo Sapiens
PVRLQMQKL

SEQ ID NO: 1163527 - protein, 9 aa, Homo Sapiens
VLHDQQLRA

SEQ ID NO: 1163528 - protein, 9 aa, Homo Sapiens
SRSKSRSQF

SEQ ID NO: 1163529 - protein, 9 aa, Homo Sapiens
YGVDDFLPV

SEQ ID NO: 1163530 - protein, 9 aa, Homo Sapiens
LQALTPSTG

SEQ ID NO: 1163531 - protein, 9 aa, Homo Sapiens
LTSSNHRTS

SEQ ID NO: 1163532 - protein, 9 aa, Homo Sapiens
WGDPIGDQW

SEQ ID NO: 1163533 - protein, 9 aa, Homo Sapiens
PVAVFLGIP

SEQ ID NO: 1163534 - protein, 9 aa, Homo Sapiens
YRPVRLQMQ

SEQ ID NO: 1163535 - protein, 9 aa, Homo Sapiens
IHMMLKNLF

SEQ ID NO: 1163536 - protein, 9 aa, Homo Sapiens
GSNTREMGY

SEQ ID NO: 1163537 - protein, 9 aa, Homo Sapiens
SHEERLFQL

SEQ ID NO: 1163538 - protein, 9 aa, Homo Sapiens
LIGTYDSLL

SEQ ID NO: 1163539 - protein, 9 aa, Homo Sapiens
HRTSPQLST

SEQ ID NO: 1163540 - protein, 9 aa, Homo Sapiens
LQGTLLIGT

SEQ ID NO: 1163541 - protein, 9 aa, Homo Sapiens
GVDDFLPVL

SEQ ID NO: 1163542 - protein, 9 aa, Homo Sapiens
LQDSQDRCY

SEQ ID NO: 1163543 - protein, 9 aa, Homo Sapiens
GRMYGVDDF

SEQ ID NO: 1163544 - protein, 9 aa, Homo Sapiens
RFDCADRQS

SEQ ID NO: 1163545 - protein, 9 aa, Homo Sapiens
LGKVLVCAA

SEQ ID NO: 1163546 - protein, 9 aa, Homo Sapiens
DEEYKVPDL

SEQ ID NO: 1163547 - protein, 9 aa, Homo Sapiens
YSVVRNKQV

SEQ ID NO: 1163548 - protein, 9 aa, Homo Sapiens
SILFLLPGK

SEQ ID NO: 1163549 - protein, 9 aa, Homo Sapiens
KLLWIIHMM

SEQ ID NO: 1163550 - protein, 9 aa, Homo Sapiens
DCADRQSIL

SEQ ID NO: 1163551 - protein, 9 aa, Homo Sapiens
LYSFLHTPS

SEQ ID NO: 1163552 - protein, 9 aa, Homo Sapiens
EEYKVPDLD

SEQ ID NO: 1163553 - protein, 9 aa, Homo Sapiens
PGKLLWIIH

SEQ ID NO: 1163554 - protein, 9 aa, Homo Sapiens
VSSSQHTAG

SEQ ID NO: 1163555 - protein, 9 aa, Homo Sapiens
FLCCLLSPL

SEQ ID NO: 1163556 - protein, 9 aa, Homo Sapiens
PTVSSSQHT

SEQ ID NO: 1163557 - protein, 9 aa, Homo Sapiens
DDNLKTPAK

SEQ ID NO: 1163558 - protein, 9 aa, Homo Sapiens
AVFLGIPFA

SEQ ID NO: 1163559 - protein, 9 aa, Homo Sapiens
MALWGDPIG

SEQ ID NO: 1163560 - protein, 9 aa, Homo Sapiens
RMYGVDDFL

SEQ ID NO: 1163561 - protein, 9 aa, Homo Sapiens
KQVEIRAVL

SEQ ID NO: 1163562 - protein, 9 aa, Homo Sapiens
WIIHMMLKN

SEQ ID NO: 1163563 - protein, 9 aa, Homo Sapiens
VNENDQALL

SEQ ID NO: 1163564 - protein, 9 aa, Homo Sapiens
HAAAKGIQE

SEQ ID NO: 1163565 - protein, 9 aa, Homo Sapiens
DWDTELYSF

SEQ ID NO: 1163566 - protein, 9 aa, Homo Sapiens
TPTVSSSQH

SEQ ID NO: 1163567 - protein, 9 aa, Homo Sapiens
KTPAKCLLY

SEQ ID NO: 1163568 - protein, 9 aa, Homo Sapiens
LKNLFLNSS

SEQ ID NO: 1163569 - protein, 9 aa, Homo Sapiens
TDKKKKERN

SEQ ID NO: 1163570 - protein, 9 aa, Homo Sapiens
EDTRNQKTF

SEQ ID NO: 1163571 - protein, 9 aa, Homo Sapiens
LHTPSGPED

SEQ ID NO: 1163572 - protein, 9 aa, Homo Sapiens
SSISQSFWK

SEQ ID NO: 1163573 - protein, 9 aa, Homo Sapiens
PPLTSSNHR

SEQ ID NO: 1163574 - protein, 9 aa, Homo Sapiens
PVLREEAKE

SEQ ID NO: 1163575 - protein, 9 aa, Homo Sapiens
EVLQDSQDR

SEQ ID NO: 1163576 - protein, 9 aa, Homo Sapiens
TQCVANTST

SEQ ID NO: 1163577 - protein, 9 aa, Homo Sapiens
ICGLRAMPS

SEQ ID NO: 1163578 - protein, 9 aa, Homo Sapiens
DRQSILFLL

SEQ ID NO: 1163579 - protein, 9 aa, Homo Sapiens
TELYSFLHT

SEQ ID NO: 1163580 - protein, 9 aa, Homo Sapiens
LWIIHMMLK

SEQ ID NO: 1163581 - protein, 9 aa, Homo Sapiens
FLNSSISQS

SEQ ID NO: 1163582 - protein, 9 aa, Homo Sapiens
RLQMQKLPT

SEQ ID NO: 1163583 - protein, 9 aa, Homo Sapiens
VVRNKQVEI

SEQ ID NO: 1163584 - protein, 9 aa, Homo Sapiens
GLVSPKGAG

SEQ ID NO: 1163585 - protein, 9 aa, Homo Sapiens
SPAEGVMVQ

SEQ ID NO: 1163586 - protein, 9 aa, Homo Sapiens
LNSSISQSF

SEQ ID NO: 1163587 - protein, 9 aa, Homo Sapiens
PEVLQDSQD

SEQ ID NO: 1163588 - protein, 9 aa, Homo Sapiens
TVNENDQAL

SEQ ID NO: 1163589 - protein, 9 aa, Homo Sapiens
KQAIEMVED

SEQ ID NO: 1163590 - protein, 9 aa, Homo Sapiens
YSFLHTPSG

SEQ ID NO: 1163591 - protein, 9 aa, Homo Sapiens
SKSRSQFSS

SEQ ID NO: 1163592 - protein, 9 aa, Homo Sapiens
DFLDEEYKV

SEQ ID NO: 1163593 - protein, 9 aa, Homo Sapiens
VLQDSQDRC

SEQ ID NO: 1163594 - protein, 9 aa, Homo Sapiens
SNGSNTREM

SEQ ID NO: 1163595 - protein, 9 aa, Homo Sapiens
VMSTQCVAN

SEQ ID NO: 1163596 - protein, 9 aa, Homo Sapiens
LTPIIKHAA

SEQ ID NO: 1163597 - protein, 9 aa, Homo Sapiens
KSRSQFSSR

SEQ ID NO: 1163598 - protein, 9 aa, Homo Sapiens
AQAPWDRKD

SEQ ID NO: 1163599 - protein, 9 aa, Homo Sapiens
LDFLDEEYK

SEQ ID NO: 1163600 - protein, 9 aa, Homo Sapiens
CVANTSTQT

SEQ ID NO: 1163601 - protein, 9 aa, Homo Sapiens
NSGRMYGVD

SEQ ID NO: 1163602 - protein, 9 aa, Homo Sapiens
VRNKQVEIR

SEQ ID NO: 1163603 - protein, 9 aa, Homo Sapiens
LLGKVLVCA

SEQ ID NO: 1163604 - protein, 9 aa, Homo Sapiens
GSPAEGVMV

SEQ ID NO: 1163605 - protein, 9 aa, Homo Sapiens
PDFFLFLCC

SEQ ID NO: 1163606 - protein, 9 aa, Homo Sapiens
CLLSPLLKA

SEQ ID NO: 1163607 - protein, 9 aa, Homo Sapiens
VYEFTQDVQ

SEQ ID NO: 1163608 - protein, 9 aa, Homo Sapiens
EGVMVQIKA

SEQ ID NO: 1163609 - protein, 9 aa, Homo Sapiens
GKLLWIIHM

SEQ ID NO: 1163610 - protein, 9 aa, Homo Sapiens
WDTELYSFL

SEQ ID NO: 1163611 - protein, 9 aa, Homo Sapiens
AWQVSLPEL

SEQ ID NO: 1163612 - protein, 9 aa, Homo Sapiens
NQEEAYITM

SEQ ID NO: 1163613 - protein, 9 aa, Homo Sapiens
RPFVLWVTD

SEQ ID NO: 1163614 - protein, 9 aa, Homo Sapiens
VQPLSLPRW

SEQ ID NO: 1163615 - protein, 9 aa, Homo Sapiens
LYQSDLDQS

SEQ ID NO: 1163616 - protein, 9 aa, Homo Sapiens
YLPRPPCIY

SEQ ID NO: 1163617 - protein, 9 aa, Homo Sapiens
HHTRHQLLE

SEQ ID NO: 1163618 - protein, 9 aa, Homo Sapiens
FVLWVTDCM

SEQ ID NO: 1163619 - protein, 9 aa, Homo Sapiens
SDLDQSESC

SEQ ID NO: 1163620 - protein, 9 aa, Homo Sapiens
VSLPELEDW

SEQ ID NO: 1163621 - protein, 9 aa, Homo Sapiens
KGKIIRKQV

SEQ ID NO: 1163622 - protein, 9 aa, Homo Sapiens
LPRPPCIYE

SEQ ID NO: 1163623 - protein, 9 aa, Homo Sapiens
ILVRILDKN

SEQ ID NO: 1163624 - protein, 9 aa, Homo Sapiens
MGNYVMVLL

SEQ ID NO: 1163625 - protein, 9 aa, Homo Sapiens
PLTNMQIAR

SEQ ID NO: 1163626 - protein, 9 aa, Homo Sapiens
QDLRLNGCH

SEQ ID NO: 1163627 - protein, 9 aa, Homo Sapiens
WVTDCMGRE

SEQ ID NO: 1163628 - protein, 9 aa, Homo Sapiens
EFFQIDGCV

SEQ ID NO: 1163629 - protein, 9 aa, Homo Sapiens
QRRESTKRG

SEQ ID NO: 1163630 - protein, 9 aa, Homo Sapiens
VHFQLPPPV

SEQ ID NO: 1163631 - protein, 9 aa, Homo Sapiens
GSNQEEAYI

SEQ ID NO: 1163632 - protein, 9 aa, Homo Sapiens
DLLLRLLST

SEQ ID NO: 1163633 - protein, 9 aa, Homo Sapiens
DEELPCFIL

SEQ ID NO: 1163634 - protein, 9 aa, Homo Sapiens
IFNHGAPGS

SEQ ID NO: 1163635 - protein, 9 aa, Homo Sapiens
CCRTTFYRP

SEQ ID NO: 1163636 - protein, 9 aa, Homo Sapiens
PQNSPLGAV

SEQ ID NO: 1163637 - protein, 9 aa, Homo Sapiens
SLQRGRLCT

SEQ ID NO: 1163638 - protein, 9 aa, Homo Sapiens
SIGAIPKGH

SEQ ID NO: 1163639 - protein, 9 aa, Homo Sapiens
PAESIPTVL

SEQ ID NO: 1163640 - protein, 9 aa, Homo Sapiens
VQRTAGKMA

SEQ ID NO: 1163641 - protein, 9 aa, Homo Sapiens
ALLGAKKSI

SEQ ID NO: 1163642 - protein, 9 aa, Homo Sapiens
VLLRGCLTH

SEQ ID NO: 1163643 - protein, 9 aa, Homo Sapiens
RLNGCHLPF

SEQ ID NO: 1163644 - protein, 9 aa, Homo Sapiens
FSINQFIHF

SEQ ID NO: 1163645 - protein, 9 aa, Homo Sapiens
PDLLLRLLS

SEQ ID NO: 1163646 - protein, 9 aa, Homo Sapiens
RTTFYRPSY

SEQ ID NO: 1163647 - protein, 9 aa, Homo Sapiens
LPCFILHYE

SEQ ID NO: 1163648 - protein, 9 aa, Homo Sapiens
LLLRLLSTQ

SEQ ID NO: 1163649 - protein, 9 aa, Homo Sapiens
SQAFLSFGT

SEQ ID NO: 1163650 - protein, 9 aa, Homo Sapiens
PGPKGPWGL

SEQ ID NO: 1163651 - protein, 9 aa, Homo Sapiens
WELTVVQGE

SEQ ID NO: 1163652 - protein, 9 aa, Homo Sapiens
KKSIGAIPK

SEQ ID NO: 1163653 - protein, 9 aa, Homo Sapiens
HCTILVRIL

SEQ ID NO: 1163654 - protein, 9 aa, Homo Sapiens
IILPVGIAL

SEQ ID NO: 1163655 - protein, 9 aa, Homo Sapiens
HFQLPPPVP

SEQ ID NO: 1163656 - protein, 9 aa, Homo Sapiens
PSWSPDISG

SEQ ID NO: 1163657 - protein, 9 aa, Homo Sapiens
DRAGLLQVY

SEQ ID NO: 1163658 - protein, 9 aa, Homo Sapiens
QKWYPYYAH

SEQ ID NO: 1163659 - protein, 9 aa, Homo Sapiens
TKLKDFEYP

SEQ ID NO: 1163660 - protein, 9 aa, Homo Sapiens
DLVHALEQE

SEQ ID NO: 1163661 - protein, 9 aa, Homo Sapiens
LPVGIALIV

SEQ ID NO: 1163662 - protein, 9 aa, Homo Sapiens
GKGKIIRKQ

SEQ ID NO: 1163663 - protein, 9 aa, Homo Sapiens
QKLNFSINQ

SEQ ID NO: 1163664 - protein, 9 aa, Homo Sapiens
NKPSSHDVK

SEQ ID NO: 1163665 - protein, 9 aa, Homo Sapiens
VLYQSDLDQ

SEQ ID NO: 1163666 - protein, 9 aa, Homo Sapiens
GPPGPKGPW

SEQ ID NO: 1163667 - protein, 9 aa, Homo Sapiens
FYRPSYSVS

SEQ ID NO: 1163668 - protein, 9 aa, Homo Sapiens
PQSLHQTLQ

SEQ ID NO: 1163669 - protein, 9 aa, Homo Sapiens
YITMSSFYQ

SEQ ID NO: 1163670 - protein, 9 aa, Homo Sapiens
FLVSHFSPY

SEQ ID NO: 1163671 - protein, 9 aa, Homo Sapiens
FFAAKIIIG

SEQ ID NO: 1163672 - protein, 9 aa, Homo Sapiens
DGAGGQFQE

SEQ ID NO: 1163673 - protein, 9 aa, Homo Sapiens
FQEVYVGKE

SEQ ID NO: 1163674 - protein, 9 aa, Homo Sapiens
RWERFVLAV

SEQ ID NO: 1163675 - protein, 9 aa, Homo Sapiens
YYAHLNKKG

SEQ ID NO: 1163676 - protein, 9 aa, Homo Sapiens
PHRGPPKDK

SEQ ID NO: 1163677 - protein, 9 aa, Homo Sapiens
MTNRKFHHD

SEQ ID NO: 1163678 - protein, 9 aa, Homo Sapiens
IVEHALLQS

SEQ ID NO: 1163679 - protein, 9 aa, Homo Sapiens
LDDGNGKNY

SEQ ID NO: 1163680 - protein, 9 aa, Homo Sapiens
SYRAPQTAL

SEQ ID NO: 1163681 - protein, 9 aa, Homo Sapiens
MEVHAGVCS

SEQ ID NO: 1163682 - protein, 9 aa, Homo Sapiens
ESIPTVLDG

SEQ ID NO: 1163683 - protein, 9 aa, Homo Sapiens
GKKPTIPKK

SEQ ID NO: 1163684 - protein, 9 aa, Homo Sapiens
QALLGAKKS

SEQ ID NO: 1163685 - protein, 9 aa, Homo Sapiens
STPITRHPG

SEQ ID NO: 1163686 - protein, 9 aa, Homo Sapiens
QVSLPELED

SEQ ID NO: 1163687 - protein, 9 aa, Homo Sapiens
LPLTNMQIA

SEQ ID NO: 1163688 - protein, 9 aa, Homo Sapiens
VSNIVRSLP

SEQ ID NO: 1163689 - protein, 9 aa, Homo Sapiens
LQVFDAHDC

SEQ ID NO: 1163690 - protein, 9 aa, Homo Sapiens
TTCCRTTFY

SEQ ID NO: 1163691 - protein, 9 aa, Homo Sapiens
LKQICLIEK

SEQ ID NO: 1163692 - protein, 9 aa, Homo Sapiens
IHKGKVHGS

SEQ ID NO: 1163693 - protein, 9 aa, Homo Sapiens
KIIRKQVNY

SEQ ID NO: 1163694 - protein, 9 aa, Homo Sapiens
MAWQVSLPE

SEQ ID NO: 1163695 - protein, 9 aa, Homo Sapiens
RNYAQFISN

SEQ ID NO: 1163696 - protein, 9 aa, Homo Sapiens
HKGKVHGSI

SEQ ID NO: 1163697 - protein, 9 aa, Homo Sapiens
CIYELANPG

SEQ ID NO: 1163698 - protein, 9 aa, Homo Sapiens
YPYYAHLNK

SEQ ID NO: 1163699 - protein, 9 aa, Homo Sapiens
EATSSASSA

SEQ ID NO: 1163700 - protein, 9 aa, Homo Sapiens
PPCIYELAN

SEQ ID NO: 1163701 - protein, 9 aa, Homo Sapiens
SSAKRNYAQ

SEQ ID NO: 1163702 - protein, 9 aa, Homo Sapiens
YYLPLTNMQ

SEQ ID NO: 1163703 - protein, 9 aa, Homo Sapiens
CVVILYFLK

SEQ ID NO: 1163704 - protein, 9 aa, Homo Sapiens
LTHCHCEPD

SEQ ID NO: 1163705 - protein, 9 aa, Homo Sapiens
FMGNYVMVL

SEQ ID NO: 1163706 - protein, 9 aa, Homo Sapiens
KFHHDKRVY

SEQ ID NO: 1163707 - protein, 9 aa, Homo Sapiens
SSSPHRGPP

SEQ ID NO: 1163708 - protein, 9 aa, Homo Sapiens
KRGRMKDHR

SEQ ID NO: 1163709 - protein, 9 aa, Homo Sapiens
WSPSLQRGR

SEQ ID NO: 1163710 - protein, 9 aa, Homo Sapiens
VRSLPFVPG

SEQ ID NO: 1163711 - protein, 9 aa, Homo Sapiens
ALSAQQQRP

SEQ ID NO: 1163712 - protein, 9 aa, Homo Sapiens
FLKTHSLEA

SEQ ID NO: 1163713 - protein, 9 aa, Homo Sapiens
RDSEATSSA

SEQ ID NO: 1163714 - protein, 9 aa, Homo Sapiens
AMATERLTV

SEQ ID NO: 1163715 - protein, 9 aa, Homo Sapiens
AKRNYAQFI

SEQ ID NO: 1163716 - protein, 9 aa, Homo Sapiens
LFTLQLPQS

SEQ ID NO: 1163717 - protein, 9 aa, Homo Sapiens
TFYRPSYSV

SEQ ID NO: 1163718 - protein, 9 aa, Homo Sapiens
QLPQSLHQT

SEQ ID NO: 1163719 - protein, 9 aa, Homo Sapiens
GLRANCKTS

SEQ ID NO: 1163720 - protein, 9 aa, Homo Sapiens
ARNLGKGKI

SEQ ID NO: 1163721 - protein, 9 aa, Homo Sapiens
DISGGREIF

SEQ ID NO: 1163722 - protein, 9 aa, Homo Sapiens
IYLPRPPCI

SEQ ID NO: 1163723 - protein, 9 aa, Homo Sapiens
VCKKGEISR

SEQ ID NO: 1163724 - protein, 9 aa, Homo Sapiens
GCVTDHIEV

SEQ ID NO: 1163725 - protein, 9 aa, Homo Sapiens
DDGAGGQFQ

SEQ ID NO: 1163726 - protein, 9 aa, Homo Sapiens
VAFMGNYVM

SEQ ID NO: 1163727 - protein, 9 aa, Homo Sapiens
QDLVHALEQ

SEQ ID NO: 1163728 - protein, 9 aa, Homo Sapiens
QNSPLGAVK

SEQ ID NO: 1163729 - protein, 9 aa, Homo Sapiens
HVWAKRWER

SEQ ID NO: 1163730 - protein, 9 aa, Homo Sapiens
DGLRANCKT

SEQ ID NO: 1163731 - protein, 9 aa, Homo Sapiens
AGHCTILVR

SEQ ID NO: 1163732 - protein, 9 aa, Homo Sapiens
ALEKHVWNW

SEQ ID NO: 1163733 - protein, 9 aa, Homo Sapiens
FVQDLVHAL

SEQ ID NO: 1163734 - protein, 9 aa, Homo Sapiens
RFVQDLVHA

SEQ ID NO: 1163735 - protein, 9 aa, Homo Sapiens
FEARNPWEL

SEQ ID NO: 1163736 - protein, 9 aa, Homo Sapiens
EDEELPCFI

SEQ ID NO: 1163737 - protein, 9 aa, Homo Sapiens
KGEISREMY

SEQ ID NO: 1163738 - protein, 9 aa, Homo Sapiens
CSDAEGTAI

SEQ ID NO: 1163739 - protein, 9 aa, Homo Sapiens
AEIQNMGGE

SEQ ID NO: 1163740 - protein, 9 aa, Homo Sapiens
KADDGLRAN

SEQ ID NO: 1163741 - protein, 9 aa, Homo Sapiens
PLFTLQLPQ

SEQ ID NO: 1163742 - protein, 9 aa, Homo Sapiens
MAGHCTILV

SEQ ID NO: 1163743 - protein, 9 aa, Homo Sapiens
LEFQPSFTE

SEQ ID NO: 1163744 - protein, 9 aa, Homo Sapiens
VCSYICSEC

SEQ ID NO: 1163745 - protein, 9 aa, Homo Sapiens
SSQAFLSFG

SEQ ID NO: 1163746 - protein, 9 aa, Homo Sapiens
QELCHGCLR

SEQ ID NO: 1163747 - protein, 9 aa, Homo Sapiens
VILYFLKTH

SEQ ID NO: 1163748 - protein, 9 aa, Homo Sapiens
ILKHWTGGC

SEQ ID NO: 1163749 - protein, 9 aa, Homo Sapiens
KGPWGLPGF

SEQ ID NO: 1163750 - protein, 9 aa, Homo Sapiens
TEDSESLCG

SEQ ID NO: 1163751 - protein, 9 aa, Homo Sapiens
FNHGAPGSL

SEQ ID NO: 1163752 - protein, 9 aa, Homo Sapiens
NLHISDLEF

SEQ ID NO: 1163753 - protein, 9 aa, Homo Sapiens
HVWNWRPLS

SEQ ID NO: 1163754 - protein, 9 aa, Homo Sapiens
WQVSLPELE

SEQ ID NO: 1163755 - protein, 9 aa, Homo Sapiens
VHAGVCSYI

SEQ ID NO: 1163756 - protein, 9 aa, Homo Sapiens
LRPFVLWVT

SEQ ID NO: 1163757 - protein, 9 aa, Homo Sapiens
YFLKTHSLE

SEQ ID NO: 1163758 - protein, 9 aa, Homo Sapiens
SWSPDISGG

SEQ ID NO: 1163759 - protein, 9 aa, Homo Sapiens
LSAQQQRPY

SEQ ID NO: 1163760 - protein, 9 aa, Homo Sapiens
DSESLCGLK

SEQ ID NO: 1163761 - protein, 9 aa, Homo Sapiens
CVTDHIEVV

SEQ ID NO: 1163762 - protein, 9 aa, Homo Sapiens
TSFSSALML

SEQ ID NO: 1163763 - protein, 9 aa, Homo Sapiens
LWQGKKPTI

SEQ ID NO: 1163764 - protein, 9 aa, Homo Sapiens
FSSALMLRF

SEQ ID NO: 1163765 - protein, 9 aa, Homo Sapiens
GLRKERQCE

SEQ ID NO: 1163766 - protein, 9 aa, Homo Sapiens
DAHDCTTAH

SEQ ID NO: 1163767 - protein, 9 aa, Homo Sapiens
KRWERFVLA

SEQ ID NO: 1163768 - protein, 9 aa, Homo Sapiens
WTGGCPFRE

SEQ ID NO: 1163769 - protein, 9 aa, Homo Sapiens
PGNLQHYGT

SEQ ID NO: 1163770 - protein, 9 aa, Homo Sapiens
LPPGPDLLL

SEQ ID NO: 1163771 - protein, 9 aa, Homo Sapiens
QAFLSFGTA

SEQ ID NO: 1163772 - protein, 9 aa, Homo Sapiens
QGLRKERQC

SEQ ID NO: 1163773 - protein, 9 aa, Homo Sapiens
PFVLWVTDC

SEQ ID NO: 1163774 - protein, 9 aa, Homo Sapiens
SFGTAPVGS

SEQ ID NO: 1163775 - protein, 9 aa, Homo Sapiens
SSPHRGPPK

SEQ ID NO: 1163776 - protein, 9 aa, Homo Sapiens
KKPTIPKKG

SEQ ID NO: 1163777 - protein, 9 aa, Homo Sapiens
IQNMGGELI

SEQ ID NO: 1163778 - protein, 9 aa, Homo Sapiens
MQIARTFCF

SEQ ID NO: 1163779 - protein, 9 aa, Homo Sapiens
GIALIVITL

SEQ ID NO: 1163780 - protein, 9 aa, Homo Sapiens
GIVEHALLQ

SEQ ID NO: 1163781 - protein, 9 aa, Homo Sapiens
LPAHTLQGE

SEQ ID NO: 1163782 - protein, 9 aa, Homo Sapiens
HFSPYEWHS

SEQ ID NO: 1163783 - protein, 9 aa, Homo Sapiens
PKGPWGLPG

SEQ ID NO: 1163784 - protein, 9 aa, Homo Sapiens
QLLHHTRHQ

SEQ ID NO: 1163785 - protein, 9 aa, Homo Sapiens
LLRGCLTHC

SEQ ID NO: 1163786 - protein, 9 aa, Homo Sapiens
DLRLNGCHL

SEQ ID NO: 1163787 - protein, 9 aa, Homo Sapiens
HALARRIIT

SEQ ID NO: 1163788 - protein, 9 aa, Homo Sapiens
VTEKTAENK

SEQ ID NO: 1163789 - protein, 9 aa, Homo Sapiens
LSSAKRNYA

SEQ ID NO: 1163790 - protein, 9 aa, Homo Sapiens
VHSNLTIHQ

SEQ ID NO: 1163791 - protein, 9 aa, Homo Sapiens
YVCKKGEIS

SEQ ID NO: 1163792 - protein, 9 aa, Homo Sapiens
FLRKSSEGG

SEQ ID NO: 1163793 - protein, 9 aa, Homo Sapiens
KVEGCPVPT

SEQ ID NO: 1163794 - protein, 9 aa, Homo Sapiens
LGKGKIIRK

SEQ ID NO: 1163795 - protein, 9 aa, Homo Sapiens
EKHVWNWRP

SEQ ID NO: 1163796 - protein, 9 aa, Homo Sapiens
KTAENKPSS

SEQ ID NO: 1163797 - protein, 9 aa, Homo Sapiens
ALARRIITE

SEQ ID NO: 1163798 - protein, 9 aa, Homo Sapiens
GVCSYICSE

SEQ ID NO: 1163799 - protein, 9 aa, Homo Sapiens
YIHTEDSES

SEQ ID NO: 1163800 - protein, 9 aa, Homo Sapiens
QKHRKSRPH

SEQ ID NO: 1163801 - protein, 9 aa, Homo Sapiens
YRAPQTALS

SEQ ID NO: 1163802 - protein, 9 aa, Homo Sapiens
GAKKSIGAI

SEQ ID NO: 1163803 - protein, 9 aa, Homo Sapiens
SEATSSASS

SEQ ID NO: 1163804 - protein, 9 aa, Homo Sapiens
IHTEDSESL

SEQ ID NO: 1163805 - protein, 9 aa, Homo Sapiens
PVHFQLPPP

SEQ ID NO: 1163806 - protein, 9 aa, Homo Sapiens
ARRIITESL

SEQ ID NO: 1163807 - protein, 9 aa, Homo Sapiens
GGREIFKPR

SEQ ID NO: 1163808 - protein, 9 aa, Homo Sapiens
GKNYVDYAD

SEQ ID NO: 1163809 - protein, 9 aa, Homo Sapiens
RHQLLEQRE

SEQ ID NO: 1163810 - protein, 9 aa, Homo Sapiens
RLTVRDPRE

SEQ ID NO: 1163811 - protein, 9 aa, Homo Sapiens
EKTAENKPS

SEQ ID NO: 1163812 - protein, 9 aa, Homo Sapiens
TFFAAKIII

SEQ ID NO: 1163813 - protein, 9 aa, Homo Sapiens
SAKRNYAQF

SEQ ID NO: 1163814 - protein, 9 aa, Homo Sapiens
KSRPHSQYN

SEQ ID NO: 1163815 - protein, 9 aa, Homo Sapiens
DGNGKNYVD

SEQ ID NO: 1163816 - protein, 9 aa, Homo Sapiens
PSSQAFLSF

SEQ ID NO: 1163817 - protein, 9 aa, Homo Sapiens
LPFVPGNDA

SEQ ID NO: 1163818 - protein, 9 aa, Homo Sapiens
SYSNGVQPL

SEQ ID NO: 1163819 - protein, 9 aa, Homo Sapiens
HSNLTIHQV

SEQ ID NO: 1163820 - protein, 9 aa, Homo Sapiens
ELCHGCLRP

SEQ ID NO: 1163821 - protein, 9 aa, Homo Sapiens
PPGPDLLLR

SEQ ID NO: 1163822 - protein, 9 aa, Homo Sapiens
SFSSALMLR

SEQ ID NO: 1163823 - protein, 9 aa, Homo Sapiens
SILQFLERK

SEQ ID NO: 1163824 - protein, 9 aa, Homo Sapiens
TGGCPFREG

SEQ ID NO: 1163825 - protein, 9 aa, Homo Sapiens
SPQCSPQNS

SEQ ID NO: 1163826 - protein, 9 aa, Homo Sapiens
LPQSLHQTL

SEQ ID NO: 1163827 - protein, 9 aa, Homo Sapiens
GQFQEVYVG

SEQ ID NO: 1163828 - protein, 9 aa, Homo Sapiens
AFMGNYVMV

SEQ ID NO: 1163829 - protein, 9 aa, Homo Sapiens
NLKQICLIE

SEQ ID NO: 1163830 - protein, 9 aa, Homo Sapiens
SREMYIIQA

SEQ ID NO: 1163831 - protein, 9 aa, Homo Sapiens
ILPVGIALI

SEQ ID NO: 1163832 - protein, 9 aa, Homo Sapiens
HVDQIFNHG

SEQ ID NO: 1163833 - protein, 9 aa, Homo Sapiens
DPHCLLLPA

SEQ ID NO: 1163834 - protein, 9 aa, Homo Sapiens
LDRAGLLQV

SEQ ID NO: 1163835 - protein, 9 aa, Homo Sapiens
GTAIAPPTV

SEQ ID NO: 1163836 - protein, 9 aa, Homo Sapiens
FTLQLPQSL

SEQ ID NO: 1163837 - protein, 9 aa, Homo Sapiens
GVQPLSLPR

SEQ ID NO: 1163838 - protein, 9 aa, Homo Sapiens
WGLPGFPGF

SEQ ID NO: 1163839 - protein, 9 aa, Homo Sapiens
KKGEISREM

SEQ ID NO: 1163840 - protein, 9 aa, Homo Sapiens
GCLRPEMRT

SEQ ID NO: 1163841 - protein, 9 aa, Homo Sapiens
PFVPGNDAE

SEQ ID NO: 1163842 - protein, 9 aa, Homo Sapiens
EFQPSFTEA

SEQ ID NO: 1163843 - protein, 9 aa, Homo Sapiens
LRANCKTSQ

SEQ ID NO: 1163844 - protein, 9 aa, Homo Sapiens
AEGTAIAPP

SEQ ID NO: 1163845 - protein, 9 aa, Homo Sapiens
NGVQPLSLP

SEQ ID NO: 1163846 - protein, 9 aa, Homo Sapiens
SPSLQRGRL

SEQ ID NO: 1163847 - protein, 9 aa, Homo Sapiens
SALMLRFVS

SEQ ID NO: 1163848 - protein, 9 aa, Homo Sapiens
GGQFQEVYV

SEQ ID NO: 1163849 - protein, 9 aa, Homo Sapiens
KLQVFDAHD

SEQ ID NO: 1163850 - protein, 9 aa, Homo Sapiens
LLHHTRHQL

SEQ ID NO: 1163851 - protein, 9 aa, Homo Sapiens
VENVFLRKS

SEQ ID NO: 1163852 - protein, 9 aa, Homo Sapiens
KEPLSSAKR

SEQ ID NO: 1163853 - protein, 9 aa, Homo Sapiens
DIHKGKVHG

SEQ ID NO: 1163854 - protein, 9 aa, Homo Sapiens
IPKKGGGTP

SEQ ID NO: 1163855 - protein, 9 aa, Homo Sapiens
KALEKHVWN

SEQ ID NO: 1163856 - protein, 9 aa, Homo Sapiens
KDFEYPLIS

SEQ ID NO: 1163857 - protein, 9 aa, Homo Sapiens
GKTFTVHSN

SEQ ID NO: 1163858 - protein, 9 aa, Homo Sapiens
RSILQFLER

SEQ ID NO: 1163859 - protein, 9 aa, Homo Sapiens
LKHWTGGCP

SEQ ID NO: 1163860 - protein, 9 aa, Homo Sapiens
AESIPTVLD

SEQ ID NO: 1163861 - protein, 9 aa, Homo Sapiens
VKAEIQNMG

SEQ ID NO: 1163862 - protein, 9 aa, Homo Sapiens
SSALMLRFV

SEQ ID NO: 1163863 - protein, 9 aa, Homo Sapiens
SPQNSPLGA

SEQ ID NO: 1163864 - protein, 9 aa, Homo Sapiens
QEVYVGKET

SEQ ID NO: 1163865 - protein, 9 aa, Homo Sapiens
VQDLVHALE

SEQ ID NO: 1163866 - protein, 9 aa, Homo Sapiens
TTFYRPSYS

SEQ ID NO: 1163867 - protein, 9 aa, Homo Sapiens
MLMDSPLDR

SEQ ID NO: 1163868 - protein, 9 aa, Homo Sapiens
VLWVTDCMG

SEQ ID NO: 1163869 - protein, 9 aa, Homo Sapiens
SINQFIHFP

SEQ ID NO: 1163870 - protein, 9 aa, Homo Sapiens
LVHALEQEK

SEQ ID NO: 1163871 - protein, 9 aa, Homo Sapiens
SDLEFQPSF

SEQ ID NO: 1163872 - protein, 9 aa, Homo Sapiens
ELPCFILHY

SEQ ID NO: 1163873 - protein, 9 aa, Homo Sapiens
PTIPKKGGG

SEQ ID NO: 1163874 - protein, 9 aa, Homo Sapiens
LPPPVPGEV

SEQ ID NO: 1163875 - protein, 9 aa, Homo Sapiens
LQELCHGCL

SEQ ID NO: 1163876 - protein, 9 aa, Homo Sapiens
AAKIIIGIA

SEQ ID NO: 1163877 - protein, 9 aa, Homo Sapiens
CLQDLRLNG

SEQ ID NO: 1163878 - protein, 9 aa, Homo Sapiens
NLQHYGTFL

SEQ ID NO: 1163879 - protein, 9 aa, Homo Sapiens
IGIVEHALL

SEQ ID NO: 1163880 - protein, 9 aa, Homo Sapiens
NVFLRKSSE

SEQ ID NO: 1163881 - protein, 9 aa, Homo Sapiens
TLRPFVLWV

SEQ ID NO: 1163882 - protein, 9 aa, Homo Sapiens
RTLRPFVLW

SEQ ID NO: 1163883 - protein, 9 aa, Homo Sapiens
ARNPWELTV

SEQ ID NO: 1163884 - protein, 9 aa, Homo Sapiens
RESTKRGRM

SEQ ID NO: 1163885 - protein, 9 aa, Homo Sapiens
FFQIDGCVT

SEQ ID NO: 1163886 - protein, 9 aa, Homo Sapiens
SVVLFLVSH

SEQ ID NO: 1163887 - protein, 9 aa, Homo Sapiens
EGTAIAPPT

SEQ ID NO: 1163888 - protein, 9 aa, Homo Sapiens
QYIHTEDSE

SEQ ID NO: 1163889 - protein, 9 aa, Homo Sapiens
SSIILPVGI

SEQ ID NO: 1163890 - protein, 9 aa, Homo Sapiens
LNFSINQFI

SEQ ID NO: 1163891 - protein, 9 aa, Homo Sapiens
PSNSTPITR

SEQ ID NO: 1163892 - protein, 9 aa, Homo Sapiens
LNGCHLPFF

SEQ ID NO: 1163893 - protein, 9 aa, Homo Sapiens
LGAKKSIGA

SEQ ID NO: 1163894 - protein, 9 aa, Homo Sapiens
VWAKRWERF

SEQ ID NO: 1163895 - protein, 9 aa, Homo Sapiens
DLEFQPSFT

SEQ ID NO: 1163896 - protein, 9 aa, Homo Sapiens
NHVDQIFNH

SEQ ID NO: 1163897 - protein, 9 aa, Homo Sapiens
KMAATVTSA

SEQ ID NO: 1163898 - protein, 9 aa, Homo Sapiens
VSHFSPYEW

SEQ ID NO: 1163899 - protein, 9 aa, Homo Sapiens
SVTQQQQQS

SEQ ID NO: 1163900 - protein, 9 aa, Homo Sapiens
KHWTGGCPF

SEQ ID NO: 1163901 - protein, 9 aa, Homo Sapiens
GNLQHYGTF

SEQ ID NO: 1163902 - protein, 9 aa, Homo Sapiens
LKDFEYPLI

SEQ ID NO: 1163903 - protein, 9 aa, Homo Sapiens
VSCVVILYF

SEQ ID NO: 1163904 - protein, 9 aa, Homo Sapiens
VTQQQQQSS

SEQ ID NO: 1163905 - protein, 9 aa, Homo Sapiens
TAIAPPTVT

SEQ ID NO: 1163906 - protein, 9 aa, Homo Sapiens
GERTKLKDF

SEQ ID NO: 1163907 - protein, 9 aa, Homo Sapiens
QSESCTAED

SEQ ID NO: 1163908 - protein, 9 aa, Homo Sapiens
LFLVSHFSP

SEQ ID NO: 1163909 - protein, 9 aa, Homo Sapiens
PRPPCIYEL

SEQ ID NO: 1163910 - protein, 9 aa, Homo Sapiens
RTAGKMAAT

SEQ ID NO: 1163911 - protein, 9 aa, Homo Sapiens
TKRGRMKDH

SEQ ID NO: 1163912 - protein, 9 aa, Homo Sapiens
ITMSSFYQN

SEQ ID NO: 1163913 - protein, 9 aa, Homo Sapiens
LYFLKTHSL

SEQ ID NO: 1163914 - protein, 9 aa, Homo Sapiens
ATERLTVRD

SEQ ID NO: 1163915 - protein, 9 aa, Homo Sapiens
HISDLEFQP

SEQ ID NO: 1163916 - protein, 9 aa, Homo Sapiens
CRTTFYRPS

SEQ ID NO: 1163917 - protein, 9 aa, Homo Sapiens
RIGIVEHAL

SEQ ID NO: 1163918 - protein, 9 aa, Homo Sapiens
SLPELEDWL

SEQ ID NO: 1163919 - protein, 9 aa, Homo Sapiens
AKKSIGAIP

SEQ ID NO: 1163920 - protein, 9 aa, Homo Sapiens
PTVLDGFHS

SEQ ID NO: 1163921 - protein, 9 aa, Homo Sapiens
DSEATSSAS

SEQ ID NO: 1163922 - protein, 9 aa, Homo Sapiens
APQTALSAQ

SEQ ID NO: 1163923 - protein, 9 aa, Homo Sapiens
TIPKKGGGT

SEQ ID NO: 1163924 - protein, 9 aa, Homo Sapiens
LDQSESCTA

SEQ ID NO: 1163925 - protein, 9 aa, Homo Sapiens
GCLTHCHCE

SEQ ID NO: 1163926 - protein, 9 aa, Homo Sapiens
YQSDLDQSE

SEQ ID NO: 1163927 - protein, 9 aa, Homo Sapiens
SVKVEGCPV

SEQ ID NO: 1163928 - protein, 9 aa, Homo Sapiens
KAEIQNMGG

SEQ ID NO: 1163929 - protein, 9 aa, Homo Sapiens
PELEDWLQC

SEQ ID NO: 1163930 - protein, 9 aa, Homo Sapiens
PITRHPGRT

SEQ ID NO: 1163931 - protein, 9 aa, Homo Sapiens
STKRGRMKD

SEQ ID NO: 1163932 - protein, 9 aa, Homo Sapiens
AVTEKTAEN

SEQ ID NO: 1163933 - protein, 9 aa, Homo Sapiens
NIVRSLPFV

SEQ ID NO: 1163934 - protein, 9 aa, Homo Sapiens
NGKNYVDYA

SEQ ID NO: 1163935 - protein, 9 aa, Homo Sapiens
HVQYIHTED

SEQ ID NO: 1163936 - protein, 9 aa, Homo Sapiens
RKSRPHSQY

SEQ ID NO: 1163937 - protein, 9 aa, Homo Sapiens
SPLDRAGLL

SEQ ID NO: 1163938 - protein, 9 aa, Homo Sapiens
SDAEGTAIA

SEQ ID NO: 1163939 - protein, 9 aa, Homo Sapiens
SHFSPYEWH

SEQ ID NO: 1163940 - protein, 9 aa, Homo Sapiens
FEYPLISRI

SEQ ID NO: 1163941 - protein, 9 aa, Homo Sapiens
SNGVQPLSL

SEQ ID NO: 1163942 - protein, 9 aa, Homo Sapiens
AENKPSSHD

SEQ ID NO: 1163943 - protein, 9 aa, Homo Sapiens
ERQCELREK

SEQ ID NO: 1163944 - protein, 9 aa, Homo Sapiens
TALSAQQQR

SEQ ID NO: 1163945 - protein, 9 aa, Homo Sapiens
RKERQCELR

SEQ ID NO: 1163946 - protein, 9 aa, Homo Sapiens
YGTFLTGPL

SEQ ID NO: 1163947 - protein, 9 aa, Homo Sapiens
GDQRRESTK

SEQ ID NO: 1163948 - protein, 9 aa, Homo Sapiens
DDGNGKNYV

SEQ ID NO: 1163949 - protein, 9 aa, Homo Sapiens
ERTKLKDFE

SEQ ID NO: 1163950 - protein, 9 aa, Homo Sapiens
QTTCCRTTF

SEQ ID NO: 1163951 - protein, 9 aa, Homo Sapiens
SLPFVPGND

SEQ ID NO: 1163952 - protein, 9 aa, Homo Sapiens
FQIDGCVTD

SEQ ID NO: 1163953 - protein, 9 aa, Homo Sapiens
YVMVLLIYL

SEQ ID NO: 1163954 - protein, 9 aa, Homo Sapiens
ENKPSSHDV

SEQ ID NO: 1163955 - protein, 9 aa, Homo Sapiens
PWELTVVQG

SEQ ID NO: 1163956 - protein, 9 aa, Homo Sapiens
FDAHDCTTA

SEQ ID NO: 1163957 - protein, 9 aa, Homo Sapiens
CLIEKQAPE

SEQ ID NO: 1163958 - protein, 9 aa, Homo Sapiens
FSVAFMGNY

SEQ ID NO: 1163959 - protein, 9 aa, Homo Sapiens
LHISDLEFQ

SEQ ID NO: 1163960 - protein, 9 aa, Homo Sapiens
QFLERKEQI

SEQ ID NO: 1163961 - protein, 9 aa, Homo Sapiens
LRGCLTHCH

SEQ ID NO: 1163962 - protein, 9 aa, Homo Sapiens
SVQRTAGKM

SEQ ID NO: 1163963 - protein, 9 aa, Homo Sapiens
RRDSEATSS

SEQ ID NO: 1163964 - protein, 9 aa, Homo Sapiens
WAKRWERFV

SEQ ID NO: 1163965 - protein, 9 aa, Homo Sapiens
INTPVHFQL

SEQ ID NO: 1163966 - protein, 9 aa, Homo Sapiens
TNMQIARTF

SEQ ID NO: 1163967 - protein, 9 aa, Homo Sapiens
PQCSPQNSP

SEQ ID NO: 1163968 - protein, 9 aa, Homo Sapiens
AHDCTTAHG

SEQ ID NO: 1163969 - protein, 9 aa, Homo Sapiens
RAPQTALSA

SEQ ID NO: 1163970 - protein, 9 aa, Homo Sapiens
NTPVHFQLP

SEQ ID NO: 1163971 - protein, 9 aa, Homo Sapiens
LEKHVWNWR

SEQ ID NO: 1163972 - protein, 9 aa, Homo Sapiens
SGVLLRGCL

SEQ ID NO: 1163973 - protein, 9 aa, Homo Sapiens
TCCRTTFYR

SEQ ID NO: 1163974 - protein, 9 aa, Homo Sapiens
CLRPEMRTK

SEQ ID NO: 1163975 - protein, 9 aa, Homo Sapiens
LVSHFSPYE

SEQ ID NO: 1163976 - protein, 9 aa, Homo Sapiens
PLSLPRWRE

SEQ ID NO: 1163977 - protein, 9 aa, Homo Sapiens
ISGGREIFK

SEQ ID NO: 1163978 - protein, 9 aa, Homo Sapiens
VQYIHTEDS

SEQ ID NO: 1163979 - protein, 9 aa, Homo Sapiens
QCELREKAQ

SEQ ID NO: 1163980 - protein, 9 aa, Homo Sapiens
PCFILHYET

SEQ ID NO: 1163981 - protein, 9 aa, Homo Sapiens
LDPHALARR

SEQ ID NO: 1163982 - protein, 9 aa, Homo Sapiens
ANCKTSQIT

SEQ ID NO: 1163983 - protein, 9 aa, Homo Sapiens
PLDIHKGKV

SEQ ID NO: 1163984 - protein, 9 aa, Homo Sapiens
APSNSTPIT

SEQ ID NO: 1163985 - protein, 9 aa, Homo Sapiens
RRIITESLN

SEQ ID NO: 1163986 - protein, 9 aa, Homo Sapiens
VVILYFLKT

SEQ ID NO: 1163987 - protein, 9 aa, Homo Sapiens
WQGKKPTIP

SEQ ID NO: 1163988 - protein, 9 aa, Homo Sapiens
VVLFLVSHF

SEQ ID NO: 1163989 - protein, 9 aa, Homo Sapiens
LLLPAHTLQ

SEQ ID NO: 1163990 - protein, 9 aa, Homo Sapiens
KQICLIEKQ

SEQ ID NO: 1163991 - protein, 9 aa, Homo Sapiens
SNSTPITRH

SEQ ID NO: 1163992 - protein, 9 aa, Homo Sapiens
YSKAPLDIH

SEQ ID NO: 1163993 - protein, 9 aa, Homo Sapiens
NHGAPGSLE

SEQ ID NO: 1163994 - protein, 9 aa, Homo Sapiens
KTFTVHSNL

SEQ ID NO: 1163995 - protein, 9 aa, Homo Sapiens
TRHQLLEQR

SEQ ID NO: 1163996 - protein, 9 aa, Homo Sapiens
ILYFLKTHS

SEQ ID NO: 1163997 - protein, 9 aa, Homo Sapiens
INQFIHFPI

SEQ ID NO: 1163998 - protein, 9 aa, Homo Sapiens
ESTKRGRMK

SEQ ID NO: 1163999 - protein, 9 aa, Homo Sapiens
GIQKLNFSI

SEQ ID NO: 1164000 - protein, 9 aa, Homo Sapiens
PDISGGREI

SEQ ID NO: 1164001 - protein, 9 aa, Homo Sapiens
KHVWNWRPL

SEQ ID NO: 1164002 - protein, 9 aa, Homo Sapiens
VLFLVSHFS

SEQ ID NO: 1164003 - protein, 9 aa, Homo Sapiens
DLDQSESCT

SEQ ID NO: 1164004 - protein, 9 aa, Homo Sapiens
RSLPFVPGN

SEQ ID NO: 1164005 - protein, 9 aa, Homo Sapiens
SVENVFLRK

SEQ ID NO: 1164006 - protein, 9 aa, Homo Sapiens
TNLHISDLE

SEQ ID NO: 1164007 - protein, 9 aa, Homo Sapiens
AGKMAATVT

SEQ ID NO: 1164008 - protein, 9 aa, Homo Sapiens
LAMATERLT

SEQ ID NO: 1164009 - protein, 9 aa, Homo Sapiens
KERQCELRE

SEQ ID NO: 1164010 - protein, 9 aa, Homo Sapiens
ELSSSPHRG

SEQ ID NO: 1164011 - protein, 9 aa, Homo Sapiens
GCLQDLRLN

SEQ ID NO: 1164012 - protein, 9 aa, Homo Sapiens
TEKTAENKP

SEQ ID NO: 1164013 - protein, 9 aa, Homo Sapiens
PPGPKGPWG

SEQ ID NO: 1164014 - protein, 9 aa, Homo Sapiens
TQLLHHTRH

SEQ ID NO: 1164015 - protein, 9 aa, Homo Sapiens
TVRDPREPK

SEQ ID NO: 1164016 - protein, 9 aa, Homo Sapiens
YAHLNKKGL

SEQ ID NO: 1164017 - protein, 9 aa, Homo Sapiens
EIQNMGGEL

SEQ ID NO: 1164018 - protein, 9 aa, Homo Sapiens
MRFVQDLVH

SEQ ID NO: 1164019 - protein, 9 aa, Homo Sapiens
PSLQRGRLC

SEQ ID NO: 1164020 - protein, 9 aa, Homo Sapiens
ICLIEKQAP

SEQ ID NO: 1164021 - protein, 9 aa, Homo Sapiens
HWTGGCPFR

SEQ ID NO: 1164022 - protein, 9 aa, Homo Sapiens
VGIALIVIT

SEQ ID NO: 1164023 - protein, 9 aa, Homo Sapiens
QSDLDQSES

SEQ ID NO: 1164024 - protein, 9 aa, Homo Sapiens
HGAPGSLEN

SEQ ID NO: 1164025 - protein, 9 aa, Homo Sapiens
WERFVLAVV

SEQ ID NO: 1164026 - protein, 9 aa, Homo Sapiens
EELPCFILH

SEQ ID NO: 1164027 - protein, 9 aa, Homo Sapiens
LWVTDCMGR

SEQ ID NO: 1164028 - protein, 9 aa, Homo Sapiens
EEAYITMSS

SEQ ID NO: 1164029 - protein, 9 aa, Homo Sapiens
HAGVCSYIC

SEQ ID NO: 1164030 - protein, 9 aa, Homo Sapiens
FWSPSLQRG

SEQ ID NO: 1164031 - protein, 9 aa, Homo Sapiens
FQLPPPVPG

SEQ ID NO: 1164032 - protein, 9 aa, Homo Sapiens
NSASVENVF

SEQ ID NO: 1164033 - protein, 9 aa, Homo Sapiens
TQQQQQSSQ

SEQ ID NO: 1164034 - protein, 9 aa, Homo Sapiens
GKIIRKQVN

SEQ ID NO: 1164035 - protein, 9 aa, Homo Sapiens
GPKGPWGLP

SEQ ID NO: 1164036 - protein, 9 aa, Homo Sapiens
HRGPPKDKK

SEQ ID NO: 1164037 - protein, 9 aa, Homo Sapiens
PYYAHLNKK

SEQ ID NO: 1164038 - protein, 9 aa, Homo Sapiens
TAENKPSSH

SEQ ID NO: 1164039 - protein, 9 aa, Homo Sapiens
NLGKGKIIR

SEQ ID NO: 1164040 - protein, 9 aa, Homo Sapiens
ATSSASSAP

SEQ ID NO: 1164041 - protein, 9 aa, Homo Sapiens
SPDISGGRE

SEQ ID NO: 1164042 - protein, 9 aa, Homo Sapiens
LWKKRSILQ

SEQ ID NO: 1164043 - protein, 9 aa, Homo Sapiens
LLDDGNGKN

SEQ ID NO: 1164044 - protein, 9 aa, Homo Sapiens
LQHYGTFLT

SEQ ID NO: 1164045 - protein, 9 aa, Homo Sapiens
SRPHSQYNT

SEQ ID NO: 1164046 - protein, 9 aa, Homo Sapiens
FSVKVEGCP

SEQ ID NO: 1164047 - protein, 9 aa, Homo Sapiens
CSPQNSPLG

SEQ ID NO: 1164048 - protein, 9 aa, Homo Sapiens
TNRKFHHDK

SEQ ID NO: 1164049 - protein, 9 aa, Homo Sapiens
NYVMVLLIY

SEQ ID NO: 1164050 - protein, 9 aa, Homo Sapiens
QIFNHGAPG

SEQ ID NO: 1164051 - protein, 9 aa, Homo Sapiens
HYGTFLTGP

SEQ ID NO: 1164052 - protein, 9 aa, Homo Sapiens
TRHPGRTKG

SEQ ID NO: 1164053 - protein, 9 aa, Homo Sapiens
PGPDLLLRL

SEQ ID NO: 1164054 - protein, 9 aa, Homo Sapiens
AFLSFGTAP

SEQ ID NO: 1164055 - protein, 9 aa, Homo Sapiens
SCVVILYFL

SEQ ID NO: 1164056 - protein, 9 aa, Homo Sapiens
LDIHKGKVH

SEQ ID NO: 1164057 - protein, 9 aa, Homo Sapiens
DEEDEELPC

SEQ ID NO: 1164058 - protein, 9 aa, Homo Sapiens
QICLIEKQA

SEQ ID NO: 1164059 - protein, 9 aa, Homo Sapiens
AGVCSYICS

SEQ ID NO: 1164060 - protein, 9 aa, Homo Sapiens
QGKKPTIPK

SEQ ID NO: 1164061 - protein, 9 aa, Homo Sapiens
PHANLKQIC

SEQ ID NO: 1164062 - protein, 9 aa, Homo Sapiens
GFWSPSLQR

SEQ ID NO: 1164063 - protein, 9 aa, Homo Sapiens
EARNPWELT

SEQ ID NO: 1164064 - protein, 9 aa, Homo Sapiens
GAGGQFQEV

SEQ ID NO: 1164065 - protein, 9 aa, Homo Sapiens
RKFHHDKRV

SEQ ID NO: 1164066 - protein, 9 aa, Homo Sapiens
KTLPPGPDL

SEQ ID NO: 1164067 - protein, 9 aa, Homo Sapiens
GGCPFREGV

SEQ ID NO: 1164068 - protein, 9 aa, Homo Sapiens
TLQLPQSLH

SEQ ID NO: 1164069 - protein, 9 aa, Homo Sapiens
HHDKRVYLG

SEQ ID NO: 1164070 - protein, 9 aa, Homo Sapiens
RLQELCHGC

SEQ ID NO: 1164071 - protein, 9 aa, Homo Sapiens
CGKTFTVHS

SEQ ID NO: 1164072 - protein, 9 aa, Homo Sapiens
LQFLERKEQ

SEQ ID NO: 1164073 - protein, 9 aa, Homo Sapiens
HRKSRPHSQ

SEQ ID NO: 1164074 - protein, 9 aa, Homo Sapiens
DQSESCTAE

SEQ ID NO: 1164075 - protein, 9 aa, Homo Sapiens
VFLRKSSEG

SEQ ID NO: 1164076 - protein, 9 aa, Homo Sapiens
PHCLLLPAH

SEQ ID NO: 1164077 - protein, 9 aa, Homo Sapiens
HANLKQICL

SEQ ID NO: 1164078 - protein, 9 aa, Homo Sapiens
KKRSILQFL

SEQ ID NO: 1164079 - protein, 9 aa, Homo Sapiens
NRKFHHDKR

SEQ ID NO: 1164080 - protein, 9 aa, Homo Sapiens
TFSVKVEGC

SEQ ID NO: 1164081 - protein, 9 aa, Homo Sapiens
PLSSAKRNY

SEQ ID NO: 1164082 - protein, 9 aa, Homo Sapiens
TAGKMAATV

SEQ ID NO: 1164083 - protein, 9 aa, Homo Sapiens
LLGAKKSIG

SEQ ID NO: 1164084 - protein, 9 aa, Homo Sapiens
IAPPTVTPV

SEQ ID NO: 1164085 - protein, 9 aa, Homo Sapiens
EFEARNPWE

SEQ ID NO: 1164086 - protein, 9 aa, Homo Sapiens
IRIGIVEHA

SEQ ID NO: 1164087 - protein, 9 aa, Homo Sapiens
AIAPPTVTP

SEQ ID NO: 1164088 - protein, 9 aa, Homo Sapiens
AHLNKKGLI

SEQ ID NO: 1164089 - protein, 9 aa, Homo Sapiens
VKVEGCPVP

SEQ ID NO: 1164090 - protein, 9 aa, Homo Sapiens
VKILKHWTG

SEQ ID NO: 1164091 - protein, 9 aa, Homo Sapiens
GHCTILVRI

SEQ ID NO: 1164092 - protein, 9 aa, Homo Sapiens
IIIGIALAG

SEQ ID NO: 1164093 - protein, 9 aa, Homo Sapiens
LPELEDWLQ

SEQ ID NO: 1164094 - protein, 9 aa, Homo Sapiens
QRTAGKMAA

SEQ ID NO: 1164095 - protein, 9 aa, Homo Sapiens
ILQFLERKE

SEQ ID NO: 1164096 - protein, 9 aa, Homo Sapiens
LLGFWSPSL

SEQ ID NO: 1164097 - protein, 9 aa, Homo Sapiens
QTALSAQQQ

SEQ ID NO: 1164098 - protein, 9 aa, Homo Sapiens
DGCVTDHIE

SEQ ID NO: 1164099 - protein, 9 aa, Homo Sapiens
GNGKNYVDY

SEQ ID NO: 1164100 - protein, 9 aa, Homo Sapiens
LTVRDPREP

SEQ ID NO: 1164101 - protein, 9 aa, Homo Sapiens
QIDGCVTDH

SEQ ID NO: 1164102 - protein, 9 aa, Homo Sapiens
PCIYELANP

SEQ ID NO: 1164103 - protein, 9 aa, Homo Sapiens
LMLRFVSDS

SEQ ID NO: 1164104 - protein, 9 aa, Homo Sapiens
IDGCVTDHI

SEQ ID NO: 1164105 - protein, 9 aa, Homo Sapiens
QIARTFCFT

SEQ ID NO: 1164106 - protein, 9 aa, Homo Sapiens
AGGQFQEVY

SEQ ID NO: 1164107 - protein, 9 aa, Homo Sapiens
KLNFSINQF

SEQ ID NO: 1164108 - protein, 9 aa, Homo Sapiens
CKKGEISRE

SEQ ID NO: 1164109 - protein, 9 aa, Homo Sapiens
MAATVTSAL

SEQ ID NO: 1164110 - protein, 9 aa, Homo Sapiens
TERLTVRDP

SEQ ID NO: 1164111 - protein, 9 aa, Homo Sapiens
LRKERQCEL

SEQ ID NO: 1164112 - protein, 9 aa, Homo Sapiens
QEEAYITMS

SEQ ID NO: 1164113 - protein, 9 aa, Homo Sapiens
ISDLEFQPS

SEQ ID NO: 1164114 - protein, 9 aa, Homo Sapiens
WYPYYAHLN

SEQ ID NO: 1164115 - protein, 9 aa, Homo Sapiens
GCPVPTVHW

SEQ ID NO: 1164116 - protein, 9 aa, Homo Sapiens
ISREMYIIQ

SEQ ID NO: 1164117 - protein, 9 aa, Homo Sapiens
RTKLKDFEY

SEQ ID NO: 1164118 - protein, 9 aa, Homo Sapiens
RPHSQYNTK

SEQ ID NO: 1164119 - protein, 9 aa, Homo Sapiens
PHSQYNTKL

SEQ ID NO: 1164120 - protein, 9 aa, Homo Sapiens
TLPPGPDLL

SEQ ID NO: 1164121 - protein, 9 aa, Homo Sapiens
KILKHWTGG

SEQ ID NO: 1164122 - protein, 9 aa, Homo Sapiens
QPLSLPRWR

SEQ ID NO: 1164123 - protein, 9 aa, Homo Sapiens
DFEYPLISR

SEQ ID NO: 1164124 - protein, 9 aa, Homo Sapiens
TSSASSAPD

SEQ ID NO: 1164125 - protein, 9 aa, Homo Sapiens
SKAPLDIHK

SEQ ID NO: 1164126 - protein, 9 aa, Homo Sapiens
DQRRESTKR

SEQ ID NO: 1164127 - protein, 9 aa, Homo Sapiens
KAPLDIHKG

SEQ ID NO: 1164128 - protein, 9 aa, Homo Sapiens
VEGCPVPTV

SEQ ID NO: 1164129 - protein, 9 aa, Homo Sapiens
KHRKSRPHS

SEQ ID NO: 1164130 - protein, 9 aa, Homo Sapiens
PLDRAGLLQ

SEQ ID NO: 1164131 - protein, 9 aa, Homo Sapiens
HCLLLPAHT

SEQ ID NO: 1164132 - protein, 9 aa, Homo Sapiens
NPWELTVVQ

SEQ ID NO: 1164133 - protein, 9 aa, Homo Sapiens
DAEGTAIAP

SEQ ID NO: 1164134 - protein, 9 aa, Homo Sapiens
LRRDSEATS

SEQ ID NO: 1164135 - protein, 9 aa, Homo Sapiens
DSPLDRAGL

SEQ ID NO: 1164136 - protein, 9 aa, Homo Sapiens
YEFEARNPW

SEQ ID NO: 1164137 - protein, 9 aa, Homo Sapiens
PHVWAKRWE

SEQ ID NO: 1164138 - protein, 9 aa, Homo Sapiens
PQTALSAQQ

SEQ ID NO: 1164139 - protein, 9 aa, Homo Sapiens
PPSSQAFLS

SEQ ID NO: 1164140 - protein, 9 aa, Homo Sapiens
ALMLRFVSD

SEQ ID NO: 1164141 - protein, 9 aa, Homo Sapiens
ECGKTFTVH

SEQ ID NO: 1164142 - protein, 9 aa, Homo Sapiens
GDMTNRKFH

SEQ ID NO: 1164143 - protein, 9 aa, Homo Sapiens
IPTVLDGFH

SEQ ID NO: 1164144 - protein, 9 aa, Homo Sapiens
RGCLTHCHC

SEQ ID NO: 1164145 - protein, 9 aa, Homo Sapiens
IIGIALAGI

SEQ ID NO: 1164146 - protein, 9 aa, Homo Sapiens
SPHRGPPKD

SEQ ID NO: 1164147 - protein, 9 aa, Homo Sapiens
RANCKTSQI

SEQ ID NO: 1164148 - protein, 9 aa, Homo Sapiens
KSIGAIPKG

SEQ ID NO: 1164149 - protein, 9 aa, Homo Sapiens
HDCTTAHGM

SEQ ID NO: 1164150 - protein, 9 aa, Homo Sapiens
WKKRSILQF

SEQ ID NO: 1164151 - protein, 9 aa, Homo Sapiens
QNMGGELIM

SEQ ID NO: 1164152 - protein, 9 aa, Homo Sapiens
ADDGLRANC

SEQ ID NO: 1164153 - protein, 9 aa, Homo Sapiens
TILVRILDK

SEQ ID NO: 1164154 - protein, 9 aa, Homo Sapiens
SGGREIFKP

SEQ ID NO: 1164155 - protein, 9 aa, Homo Sapiens
HLNKKGLIN

SEQ ID NO: 1164156 - protein, 9 aa, Homo Sapiens
TPITRHPGR

SEQ ID NO: 1164157 - protein, 9 aa, Homo Sapiens
LRLNGCHLP

SEQ ID NO: 1164158 - protein, 9 aa, Homo Sapiens
GPWGLPGFP

SEQ ID NO: 1164159 - protein, 9 aa, Homo Sapiens
IQKLNFSIN

SEQ ID NO: 1164160 - protein, 9 aa, Homo Sapiens
CELREKAQK

SEQ ID NO: 1164161 - protein, 9 aa, Homo Sapiens
VHALEQEKL

SEQ ID NO: 1164162 - protein, 9 aa, Homo Sapiens
KPTIPKKGG

SEQ ID NO: 1164163 - protein, 9 aa, Homo Sapiens
GPDLLLRLL

SEQ ID NO: 1164164 - protein, 9 aa, Homo Sapiens
GLDPHALAR

SEQ ID NO: 1164165 - protein, 9 aa, Homo Sapiens
SASVENVFL

SEQ ID NO: 1164166 - protein, 9 aa, Homo Sapiens
LMLMDSPLD

SEQ ID NO: 1164167 - protein, 9 aa, Homo Sapiens
RNPWELTVV

SEQ ID NO: 1164168 - protein, 9 aa, Homo Sapiens
QVKAEIQNM

SEQ ID NO: 1164169 - protein, 9 aa, Homo Sapiens
ALLQSKLKE

SEQ ID NO: 1164170 - protein, 9 aa, Homo Sapiens
APLDIHKGK

SEQ ID NO: 1164171 - protein, 9 aa, Homo Sapiens
GKMAATVTS

SEQ ID NO: 1164172 - protein, 9 aa, Homo Sapiens
LHHTRHQLL

SEQ ID NO: 1164173 - protein, 9 aa, Homo Sapiens
DDGLRANCK

SEQ ID NO: 1164174 - protein, 9 aa, Homo Sapiens
RRESTKRGR

SEQ ID NO: 1164175 - protein, 9 aa, Homo Sapiens
LKALEKHVW

SEQ ID NO: 1164176 - protein, 9 aa, Homo Sapiens
HSQYNTKLF

SEQ ID NO: 1164177 - protein, 9 aa, Homo Sapiens
LSPQCSPQN

SEQ ID NO: 1164178 - protein, 9 aa, Homo Sapiens
LTNMQIART

SEQ ID NO: 1164179 - protein, 9 aa, Homo Sapiens
YSNGVQPLS

SEQ ID NO: 1164180 - protein, 9 aa, Homo Sapiens
ERLTVRDPR

SEQ ID NO: 1164181 - protein, 9 aa, Homo Sapiens
CPVPTVHWL

SEQ ID NO: 1164182 - protein, 9 aa, Homo Sapiens
KRNYAQFIS

SEQ ID NO: 1164183 - protein, 9 aa, Homo Sapiens
EISREMYII

SEQ ID NO: 1164184 - protein, 9 aa, Homo Sapiens
LQLPQSLHQ

SEQ ID NO: 1164185 - protein, 9 aa, Homo Sapiens
HMEVHAGVC

SEQ ID NO: 1164186 - protein, 9 aa, Homo Sapiens
GVLLRGCLT

SEQ ID NO: 1164187 - protein, 9 aa, Homo Sapiens
IIRKQVNYN

SEQ ID NO: 1164188 - protein, 9 aa, Homo Sapiens
YSSIILPVG

SEQ ID NO: 1164189 - protein, 9 aa, Homo Sapiens
VDQIFNHGA

SEQ ID NO: 1164190 - protein, 9 aa, Homo Sapiens
CFILHYETH

SEQ ID NO: 1164191 - protein, 9 aa, Homo Sapiens
VLDGFHSQE

SEQ ID NO: 1164192 - protein, 9 aa, Homo Sapiens
RTFFAAKII

SEQ ID NO: 1164193 - protein, 9 aa, Homo Sapiens
CHGCLRPEM

SEQ ID NO: 1164194 - protein, 9 aa, Homo Sapiens
KNYVDYADG

SEQ ID NO: 1164195 - protein, 9 aa, Homo Sapiens
EAYITMSSF

SEQ ID NO: 1164196 - protein, 9 aa, Homo Sapiens
RPPCIYELA

SEQ ID NO: 1164197 - protein, 9 aa, Homo Sapiens
NSTPITRHP

SEQ ID NO: 1164198 - protein, 9 aa, Homo Sapiens
HALLQSKLK

SEQ ID NO: 1164199 - protein, 9 aa, Homo Sapiens
SIILPVGIA

SEQ ID NO: 1164200 - protein, 9 aa, Homo Sapiens
PHALARRII

SEQ ID NO: 1164201 - protein, 9 aa, Homo Sapiens
NMGGELIMS

SEQ ID NO: 1164202 - protein, 9 aa, Homo Sapiens
NFSINQFIH

SEQ ID NO: 1164203 - protein, 9 aa, Homo Sapiens
QVFDAHDCT

SEQ ID NO: 1164204 - protein, 9 aa, Homo Sapiens
EVHAGVCSY

SEQ ID NO: 1164205 - protein, 9 aa, Homo Sapiens
KEFFQIDGC

SEQ ID NO: 1164206 - protein, 9 aa, Homo Sapiens
PWGLPGFPG

SEQ ID NO: 1164207 - protein, 9 aa, Homo Sapiens
LSFGTAPVG

SEQ ID NO: 1164208 - protein, 9 aa, Homo Sapiens
PPMAGHCTI

SEQ ID NO: 1164209 - protein, 9 aa, Homo Sapiens
KIIIGIALA

SEQ ID NO: 1164210 - protein, 9 aa, Homo Sapiens
LMDSPLDRA

SEQ ID NO: 1164211 - protein, 9 aa, Homo Sapiens
EEDEELPCF

SEQ ID NO: 1164212 - protein, 9 aa, Homo Sapiens
GNYVMVLLI

SEQ ID NO: 1164213 - protein, 9 aa, Homo Sapiens
QCSPQNSPL

SEQ ID NO: 1164214 - protein, 9 aa, Homo Sapiens
CTILVRILD

SEQ ID NO: 1164215 - protein, 9 aa, Homo Sapiens
ANLKQICLI

SEQ ID NO: 1164216 - protein, 9 aa, Homo Sapiens
EGCPVPTVH

SEQ ID NO: 1164217 - protein, 9 aa, Homo Sapiens
TFTVHSNLT

SEQ ID NO: 1164218 - protein, 9 aa, Homo Sapiens
RQCELREKA

SEQ ID NO: 1164219 - protein, 9 aa, Homo Sapiens
MDSPLDRAG

SEQ ID NO: 1164220 - protein, 9 aa, Homo Sapiens
AKIIIGIAL

SEQ ID NO: 1164221 - protein, 9 aa, Homo Sapiens
DPHALARRI

SEQ ID NO: 1164222 - protein, 9 aa, Homo Sapiens
AYITMSSFY

SEQ ID NO: 1164223 - protein, 9 aa, Homo Sapiens
QLPPPVPGE

SEQ ID NO: 1164224 - protein, 9 aa, Homo Sapiens
LSSSPHRGP

SEQ ID NO: 1164225 - protein, 9 aa, Homo Sapiens
HTRHQLLEQ

SEQ ID NO: 1164226 - protein, 9 aa, Homo Sapiens
FTVHSNLTI

SEQ ID NO: 1164227 - protein, 9 aa, Homo Sapiens
LCHGCLRPE

SEQ ID NO: 1164228 - protein, 9 aa, Homo Sapiens
DPELSSSPH

SEQ ID NO: 1164229 - protein, 9 aa, Homo Sapiens
ITSFSSALM

SEQ ID NO: 1164230 - protein, 9 aa, Homo Sapiens
NMQIARTFC

SEQ ID NO: 1164231 - protein, 9 aa, Homo Sapiens
FHHDKRVYL

SEQ ID NO: 1164232 - protein, 9 aa, Homo Sapiens
KRSILQFLE

SEQ ID NO: 1164233 - protein, 9 aa, Homo Sapiens
QHYGTFLTG

SEQ ID NO: 1164234 - protein, 9 aa, Homo Sapiens
MLRFVSDSS

SEQ ID NO: 1164235 - protein, 9 aa, Homo Sapiens
LKADDGLRA

SEQ ID NO: 1164236 - protein, 9 aa, Homo Sapiens
FLSFGTAPV

SEQ ID NO: 1164237 - protein, 9 aa, Homo Sapiens
WSPDISGGR

SEQ ID NO: 1164238 - protein, 9 aa, Homo Sapiens
AKRWERFVL

SEQ ID NO: 1164239 - protein, 9 aa, Homo Sapiens
DQIFNHGAP

SEQ ID NO: 1164240 - protein, 9 aa, Homo Sapiens
LARRIITES

SEQ ID NO: 1164241 - protein, 9 aa, Homo Sapiens
TFLTGPLNL

SEQ ID NO: 1164242 - protein, 9 aa, Homo Sapiens
QLLDDGNGK

SEQ ID NO: 1164243 - protein, 9 aa, Homo Sapiens
KLKDFEYPL

SEQ ID NO: 1164244 - protein, 9 aa, Homo Sapiens
VEHALLQSK

SEQ ID NO: 1164245 - protein, 9 aa, Homo Sapiens
VFDAHDCTT

SEQ ID NO: 1164246 - protein, 9 aa, Homo Sapiens
SKLQVFDAH

SEQ ID NO: 1164247 - protein, 9 aa, Homo Sapiens
GSYSNGVQP

SEQ ID NO: 1164248 - protein, 9 aa, Homo Sapiens
FPHVWAKRW

SEQ ID NO: 1164249 - protein, 9 aa, Homo Sapiens
HGCLRPEMR

SEQ ID NO: 1164250 - protein, 9 aa, Homo Sapiens
TVLDGFHSQ

SEQ ID NO: 1164251 - protein, 9 aa, Homo Sapiens
GTFLTGPLN

SEQ ID NO: 1164252 - protein, 9 aa, Homo Sapiens
IYELANPGY

SEQ ID NO: 1164253 - protein, 9 aa, Homo Sapiens
PVGIALIVI

SEQ ID NO: 1164254 - protein, 9 aa, Homo Sapiens
SSASSAPDS

SEQ ID NO: 1164255 - protein, 9 aa, Homo Sapiens
TVHSNLTIH

SEQ ID NO: 1164256 - protein, 9 aa, Homo Sapiens
EHALLQSKL

SEQ ID NO: 1164257 - protein, 9 aa, Homo Sapiens
RNLGKGKII

SEQ ID NO: 1164258 - protein, 9 aa, Homo Sapiens
SIPTVLDGF

SEQ ID NO: 1164259 - protein, 9 aa, Homo Sapiens
IVRSLPFVP

SEQ ID NO: 1164260 - protein, 9 aa, Homo Sapiens
SNQEEAYIT

SEQ ID NO: 1164261 - protein, 9 aa, Homo Sapiens
CLLLPAHTL

SEQ ID NO: 1164262 - protein, 9 aa, Homo Sapiens
KWYPYYAHL

SEQ ID NO: 1164263 - protein, 9 aa, Homo Sapiens
EDSESLCGL

SEQ ID NO: 1164264 - protein, 9 aa, Homo Sapiens
TPVHFQLPP

SEQ ID NO: 1164265 - protein, 9 aa, Homo Sapiens
FAAKIIIGI

SEQ ID NO: 1164266 - protein, 9 aa, Homo Sapiens
CSYICSECN

SEQ ID NO: 1164267 - protein, 9 aa, Homo Sapiens
NSPLGAVKS

SEQ ID NO: 1164268 - protein, 9 aa, Homo Sapiens
YLPLTNMQI

SEQ ID NO: 1164269 - protein, 9 aa, Homo Sapiens
RLKALEKHV

SEQ ID NO: 1164270 - protein, 9 aa, Homo Sapiens
NGCHLPFFP

SEQ ID NO: 1164271 - protein, 9 aa, Homo Sapiens
HTEDSESLC

SEQ ID NO: 1164272 - protein, 9 aa, Homo Sapiens
DPAESIPTV

SEQ ID NO: 1164273 - protein, 9 aa, Homo Sapiens
PMAGHCTIL

SEQ ID NO: 1164274 - protein, 9 aa, Homo Sapiens
QFQEVYVGK

SEQ ID NO: 1164275 - protein, 9 aa, Homo Sapiens
SNIVRSLPF

SEQ ID NO: 1164276 - protein, 9 aa, Homo Sapiens
DMTNRKFHH

SEQ ID NO: 1164277 - protein, 9 aa, Homo Sapiens
MATERLTVR

SEQ ID NO: 1164278 - protein, 9 aa, Homo Sapiens
GEISREMYI

SEQ ID NO: 1164279 - protein, 9 aa, Homo Sapiens
HQLLEQREQ

SEQ ID NO: 1164280 - protein, 9 aa, Homo Sapiens
CLTHCHCEP

SEQ ID NO: 1164281 - protein, 9 aa, Homo Sapiens
VLLGFWSPS

SEQ ID NO: 1164282 - protein, 9 aa, Homo Sapiens
EPLSSAKRN

SEQ ID NO: 1164283 - protein, 9 aa, Homo Sapiens
QSLHQTLQS

SEQ ID NO: 1164284 - protein, 9 aa, Homo Sapiens
MGGELIMSA

SEQ ID NO: 1164285 - protein, 9 aa, Homo Sapiens
ENVFLRKSS

SEQ ID NO: 1164286 - protein, 9 aa, Homo Sapiens
LGFWSPSLQ

SEQ ID NO: 1164287 - protein, 9 aa, Homo Sapiens
LLPAHTLQG

SEQ ID NO: 1164288 - protein, 9 aa, Homo Sapiens
ITRHPGRTK

SEQ ID NO: 1164289 - protein, 9 aa, Homo Sapiens
HALEQEKLQ

SEQ ID NO: 1164290 - protein, 9 aa, Homo Sapiens
SVAFMGNYV

SEQ ID NO: 1164291 - protein, 9 aa, Homo Sapiens
ASVENVFLR

SEQ ID NO: 1164292 - protein, 9 aa, Homo Sapiens
PELSSSPHR

SEQ ID NO: 1164293 - protein, 9 aa, Homo Sapiens
LQDLRLNGC

SEQ ID NO: 1164294 - protein, 9 aa, Homo Sapiens
NWSGGRGIS

SEQ ID NO: 1164295 - protein, 9 aa, Homo Sapiens
SFGFTTDLR

SEQ ID NO: 1164296 - protein, 9 aa, Homo Sapiens
TQQLERERA

SEQ ID NO: 1164297 - protein, 9 aa, Homo Sapiens
REFLRSLCK

SEQ ID NO: 1164298 - protein, 9 aa, Homo Sapiens
RAEPPPPPP

SEQ ID NO: 1164299 - protein, 9 aa, Homo Sapiens
PPARRRRRP

SEQ ID NO: 1164300 - protein, 9 aa, Homo Sapiens
WPPPAPGRQ

SEQ ID NO: 1164301 - protein, 9 aa, Homo Sapiens
AQHGSPAIG

SEQ ID NO: 1164302 - protein, 9 aa, Homo Sapiens
PAPQHLAAS

SEQ ID NO: 1164303 - protein, 9 aa, Homo Sapiens
DVAGAPMGS

SEQ ID NO: 1164304 - protein, 9 aa, Homo Sapiens
MVSSRSSRQ

SEQ ID NO: 1164305 - protein, 9 aa, Homo Sapiens
ALGRFRSSG

SEQ ID NO: 1164306 - protein, 9 aa, Homo Sapiens
PMLSVKKKS

SEQ ID NO: 1164307 - protein, 9 aa, Homo Sapiens
KLTTMKKVA

SEQ ID NO: 1164308 - protein, 9 aa, Homo Sapiens
LCIRSAKCR

SEQ ID NO: 1164309 - protein, 9 aa, Homo Sapiens
TTAWTRASR

SEQ ID NO: 1164310 - protein, 9 aa, Homo Sapiens
AAGRAARGT

SEQ ID NO: 1164311 - protein, 9 aa, Homo Sapiens
PQRRGHAQH

SEQ ID NO: 1164312 - protein, 9 aa, Homo Sapiens
QSEWHGWMV

SEQ ID NO: 1164313 - protein, 9 aa, Homo Sapiens
GEFWLKRQA

SEQ ID NO: 1164314 - protein, 9 aa, Homo Sapiens
DGHREILIK

SEQ ID NO: 1164315 - protein, 9 aa, Homo Sapiens
PRHCLWLWC

SEQ ID NO: 1164316 - protein, 9 aa, Homo Sapiens
MKPPRLTRS

SEQ ID NO: 1164317 - protein, 9 aa, Homo Sapiens
IYMGTDVIS

SEQ ID NO: 1164318 - protein, 9 aa, Homo Sapiens
GWGWARLSA

SEQ ID NO: 1164319 - protein, 9 aa, Homo Sapiens
QMTSSGSDT

SEQ ID NO: 1164320 - protein, 9 aa, Homo Sapiens
TTSSASKPT

SEQ ID NO: 1164321 - protein, 9 aa, Homo Sapiens
GRGAAAGSG

SEQ ID NO: 1164322 - protein, 9 aa, Homo Sapiens
VLCDELGPQ

SEQ ID NO: 1164323 - protein, 9 aa, Homo Sapiens
CRPAVASRS

SEQ ID NO: 1164324 - protein, 9 aa, Homo Sapiens
SHGVCVENS

SEQ ID NO: 1164325 - protein, 9 aa, Homo Sapiens
ESRPLCLQT

SEQ ID NO: 1164326 - protein, 9 aa, Homo Sapiens
HRGALSPTC

SEQ ID NO: 1164327 - protein, 9 aa, Homo Sapiens
RPGSPADRV

SEQ ID NO: 1164328 - protein, 9 aa, Homo Sapiens
HKVPLLEPL

SEQ ID NO: 1164329 - protein, 9 aa, Homo Sapiens
LTKRSRARE

SEQ ID NO: 1164330 - protein, 9 aa, Homo Sapiens
ARAASHRRR

SEQ ID NO: 1164331 - protein, 9 aa, Homo Sapiens
LGSRTATGT

SEQ ID NO: 1164332 - protein, 9 aa, Homo Sapiens
FPPCGGGPS

SEQ ID NO: 1164333 - protein, 9 aa, Homo Sapiens
KVGKEIKEY

SEQ ID NO: 1164334 - protein, 9 aa, Homo Sapiens
AWRPGGPAP

SEQ ID NO: 1164335 - protein, 9 aa, Homo Sapiens
CIWNINPHP

SEQ ID NO: 1164336 - protein, 9 aa, Homo Sapiens
EARAMEAHA

SEQ ID NO: 1164337 - protein, 9 aa, Homo Sapiens
GSSRWCQGA

SEQ ID NO: 1164338 - protein, 9 aa, Homo Sapiens
SPSTLDSSS

SEQ ID NO: 1164339 - protein, 9 aa, Homo Sapiens
FLAPPGAHY

SEQ ID NO: 1164340 - protein, 9 aa, Homo Sapiens
ACTMPPLLH

SEQ ID NO: 1164341 - protein, 9 aa, Homo Sapiens
GCQSAREKG

SEQ ID NO: 1164342 - protein, 9 aa, Homo Sapiens
SPSSFLLRQ

SEQ ID NO: 1164343 - protein, 9 aa, Homo Sapiens
LGLGTAVPV

SEQ ID NO: 1164344 - protein, 9 aa, Homo Sapiens
GNVGILPNS

SEQ ID NO: 1164345 - protein, 9 aa, Homo Sapiens
SSMSGVPLR

SEQ ID NO: 1164346 - protein, 9 aa, Homo Sapiens
KGCPPGFPS

SEQ ID NO: 1164347 - protein, 9 aa, Homo Sapiens
KSVFDWHVV

SEQ ID NO: 1164348 - protein, 9 aa, Homo Sapiens
RCWHKSRLL

SEQ ID NO: 1164349 - protein, 9 aa, Homo Sapiens
LLQLRYNAP

SEQ ID NO: 1164350 - protein, 9 aa, Homo Sapiens
SPLSNATTQ

SEQ ID NO: 1164351 - protein, 9 aa, Homo Sapiens
QDHDQSQAS

SEQ ID NO: 1164352 - protein, 9 aa, Homo Sapiens
RPGLKSSSF

SEQ ID NO: 1164353 - protein, 9 aa, Homo Sapiens
FFIRFLQMY

SEQ ID NO: 1164354 - protein, 9 aa, Homo Sapiens
VAHHEDDDE

SEQ ID NO: 1164355 - protein, 9 aa, Homo Sapiens
LIRVTSGLF

SEQ ID NO: 1164356 - protein, 9 aa, Homo Sapiens
RSTLMFGQR

SEQ ID NO: 1164357 - protein, 9 aa, Homo Sapiens
RRWRFKTAP

SEQ ID NO: 1164358 - protein, 9 aa, Homo Sapiens
YPEVTPHRT

SEQ ID NO: 1164359 - protein, 9 aa, Homo Sapiens
QSSCYKALL

SEQ ID NO: 1164360 - protein, 9 aa, Homo Sapiens
SAGAVRPGS

SEQ ID NO: 1164361 - protein, 9 aa, Homo Sapiens
LPTRGAGEG

SEQ ID NO: 1164362 - protein, 9 aa, Homo Sapiens
APLRLWSWC

SEQ ID NO: 1164363 - protein, 9 aa, Homo Sapiens
TSRRTRPNR

SEQ ID NO: 1164364 - protein, 9 aa, Homo Sapiens
AEKPTAALG

SEQ ID NO: 1164365 - protein, 9 aa, Homo Sapiens
YVVVSRDCP

SEQ ID NO: 1164366 - protein, 9 aa, Homo Sapiens
PELPESEFV

SEQ ID NO: 1164367 - protein, 9 aa, Homo Sapiens
RGTSAELQN

SEQ ID NO: 1164368 - protein, 9 aa, Homo Sapiens
PLFPRYTLG

SEQ ID NO: 1164369 - protein, 9 aa, Homo Sapiens
TAPRHCLWL

SEQ ID NO: 1164370 - protein, 9 aa, Homo Sapiens
ITDQITLLK

SEQ ID NO: 1164371 - protein, 9 aa, Homo Sapiens
NSQNLKSEG

SEQ ID NO: 1164372 - protein, 9 aa, Homo Sapiens
GAAPRPHPR

SEQ ID NO: 1164373 - protein, 9 aa, Homo Sapiens
LGNEEGHES

SEQ ID NO: 1164374 - protein, 9 aa, Homo Sapiens
VLTTAHCVE

SEQ ID NO: 1164375 - protein, 9 aa, Homo Sapiens
PGNATCARL

SEQ ID NO: 1164376 - protein, 9 aa, Homo Sapiens
YQCSQFAIP

SEQ ID NO: 1164377 - protein, 9 aa, Homo Sapiens
KRSAFPSRS

SEQ ID NO: 1164378 - protein, 9 aa, Homo Sapiens
SRGSPGASR

SEQ ID NO: 1164379 - protein, 9 aa, Homo Sapiens
RGFVLYAMA

SEQ ID NO: 1164380 - protein, 9 aa, Homo Sapiens
ALDSVETCN

SEQ ID NO: 1164381 - protein, 9 aa, Homo Sapiens
TWWACATRR

SEQ ID NO: 1164382 - protein, 9 aa, Homo Sapiens
RAGSRRCCL

SEQ ID NO: 1164383 - protein, 9 aa, Homo Sapiens
NPIGDQDDN

SEQ ID NO: 1164384 - protein, 9 aa, Homo Sapiens
RPGGLSQPQ

SEQ ID NO: 1164385 - protein, 9 aa, Homo Sapiens
TTSDTSLAQ

SEQ ID NO: 1164386 - protein, 9 aa, Homo Sapiens
SPQTPTSQP

SEQ ID NO: 1164387 - protein, 9 aa, Homo Sapiens
YCHGLESKQ

SEQ ID NO: 1164388 - protein, 9 aa, Homo Sapiens
LNSHRMVNT

SEQ ID NO: 1164389 - protein, 9 aa, Homo Sapiens
RGLLRIIKP

SEQ ID NO: 1164390 - protein, 9 aa, Homo Sapiens
VLRTAGTQM

SEQ ID NO: 1164391 - protein, 9 aa, Homo Sapiens
QADLQLEAL

SEQ ID NO: 1164392 - protein, 9 aa, Homo Sapiens
KKNGIWEVM

SEQ ID NO: 1164393 - protein, 9 aa, Homo Sapiens
TCPVEKKIR

SEQ ID NO: 1164394 - protein, 9 aa, Homo Sapiens
DQTLQVQEV

SEQ ID NO: 1164395 - protein, 9 aa, Homo Sapiens
IFSLNLTFG

SEQ ID NO: 1164396 - protein, 9 aa, Homo Sapiens
LEALPTRGA

SEQ ID NO: 1164397 - protein, 9 aa, Homo Sapiens
DVPQTVKSA

SEQ ID NO: 1164398 - protein, 9 aa, Homo Sapiens
GDGGAGGSA

SEQ ID NO: 1164399 - protein, 9 aa, Homo Sapiens
PSKIHGRAL

SEQ ID NO: 1164400 - protein, 9 aa, Homo Sapiens
APRPGSPAD

SEQ ID NO: 1164401 - protein, 9 aa, Homo Sapiens
LDPTSSSFS

SEQ ID NO: 1164402 - protein, 9 aa, Homo Sapiens
EPPGPACPI

SEQ ID NO: 1164403 - protein, 9 aa, Homo Sapiens
VLLLGVPQT

SEQ ID NO: 1164404 - protein, 9 aa, Homo Sapiens
PRGLCLLRA

SEQ ID NO: 1164405 - protein, 9 aa, Homo Sapiens
NAATGSFAS

SEQ ID NO: 1164406 - protein, 9 aa, Homo Sapiens
SSWYASLPS

SEQ ID NO: 1164407 - protein, 9 aa, Homo Sapiens
LNCWQKDRN

SEQ ID NO: 1164408 - protein, 9 aa, Homo Sapiens
AARPPQPPP

SEQ ID NO: 1164409 - protein, 9 aa, Homo Sapiens
NGVRQVVVR

SEQ ID NO: 1164410 - protein, 9 aa, Homo Sapiens
GALSPTCVE

SEQ ID NO: 1164411 - protein, 9 aa, Homo Sapiens
SHKHDLRLL

SEQ ID NO: 1164412 - protein, 9 aa, Homo Sapiens
LRPSSWQEC

SEQ ID NO: 1164413 - protein, 9 aa, Homo Sapiens
QLEDAAGVT

SEQ ID NO: 1164414 - protein, 9 aa, Homo Sapiens
RRRTTSTRE

SEQ ID NO: 1164415 - protein, 9 aa, Homo Sapiens
FVEWPWGLA

SEQ ID NO: 1164416 - protein, 9 aa, Homo Sapiens
SWNRWKTSS

SEQ ID NO: 1164417 - protein, 9 aa, Homo Sapiens
SRTSTSAPG

SEQ ID NO: 1164418 - protein, 9 aa, Homo Sapiens
FSFSFGTGH

SEQ ID NO: 1164419 - protein, 9 aa, Homo Sapiens
ARGIRACRR

SEQ ID NO: 1164420 - protein, 9 aa, Homo Sapiens
SEGYAADTF

SEQ ID NO: 1164421 - protein, 9 aa, Homo Sapiens
QYLCCHRRR

SEQ ID NO: 1164422 - protein, 9 aa, Homo Sapiens
GMTYLREKH

SEQ ID NO: 1164423 - protein, 9 aa, Homo Sapiens
HETTHTGEN

SEQ ID NO: 1164424 - protein, 9 aa, Homo Sapiens
PPAVRPRPG

SEQ ID NO: 1164425 - protein, 9 aa, Homo Sapiens
EQLADQNRK

SEQ ID NO: 1164426 - protein, 9 aa, Homo Sapiens
RPSVPPPAV

SEQ ID NO: 1164427 - protein, 9 aa, Homo Sapiens
PGGESEKTV

SEQ ID NO: 1164428 - protein, 9 aa, Homo Sapiens
RVLYVMCLA

SEQ ID NO: 1164429 - protein, 9 aa, Homo Sapiens
FEWASFFMV

SEQ ID NO: 1164430 - protein, 9 aa, Homo Sapiens
FKCDNGCCI

SEQ ID NO: 1164431 - protein, 9 aa, Homo Sapiens
GTRALHAHR

SEQ ID NO: 1164432 - protein, 9 aa, Homo Sapiens
EEYYRNHVS

SEQ ID NO: 1164433 - protein, 9 aa, Homo Sapiens
IFVRNQEKI

SEQ ID NO: 1164434 - protein, 9 aa, Homo Sapiens
IREKVIKGA

SEQ ID NO: 1164435 - protein, 9 aa, Homo Sapiens
DEEMFSVFA

SEQ ID NO: 1164436 - protein, 9 aa, Homo Sapiens
MPWHSCRLA

SEQ ID NO: 1164437 - protein, 9 aa, Homo Sapiens
WSFEKVEKL

SEQ ID NO: 1164438 - protein, 9 aa, Homo Sapiens
GEAGGGPSV

SEQ ID NO: 1164439 - protein, 9 aa, Homo Sapiens
PRYGHSRTP

SEQ ID NO: 1164440 - protein, 9 aa, Homo Sapiens
ANGGGSGGG

SEQ ID NO: 1164441 - protein, 9 aa, Homo Sapiens
YIPPRPGGF

SEQ ID NO: 1164442 - protein, 9 aa, Homo Sapiens
ERPPPEPRQ

SEQ ID NO: 1164443 - protein, 9 aa, Homo Sapiens
DEAPSLRCL

SEQ ID NO: 1164444 - protein, 9 aa, Homo Sapiens
TAPWALVGA

SEQ ID NO: 1164445 - protein, 9 aa, Homo Sapiens
EGTDFPRAG

SEQ ID NO: 1164446 - protein, 9 aa, Homo Sapiens
GGNTAAALV

SEQ ID NO: 1164447 - protein, 9 aa, Homo Sapiens
RKPLTKSQS

SEQ ID NO: 1164448 - protein, 9 aa, Homo Sapiens
ASVTPPTRG

SEQ ID NO: 1164449 - protein, 9 aa, Homo Sapiens
QSHRPPRAS

SEQ ID NO: 1164450 - protein, 9 aa, Homo Sapiens
EAHTCWQRR

SEQ ID NO: 1164451 - protein, 9 aa, Homo Sapiens
AHSVASQKP

SEQ ID NO: 1164452 - protein, 9 aa, Homo Sapiens
KDEWRWMVL

SEQ ID NO: 1164453 - protein, 9 aa, Homo Sapiens
DFTSEATYD

SEQ ID NO: 1164454 - protein, 9 aa, Homo Sapiens
GVVTTRYRW

SEQ ID NO: 1164455 - protein, 9 aa, Homo Sapiens
ESVKECDSI

SEQ ID NO: 1164456 - protein, 9 aa, Homo Sapiens
QEEQRKRME

SEQ ID NO: 1164457 - protein, 9 aa, Homo Sapiens
TLEGCISVK

SEQ ID NO: 1164458 - protein, 9 aa, Homo Sapiens
EGLLDLQQV

SEQ ID NO: 1164459 - protein, 9 aa, Homo Sapiens
VYKTQEEEE

SEQ ID NO: 1164460 - protein, 9 aa, Homo Sapiens
TVDMLRCLR

SEQ ID NO: 1164461 - protein, 9 aa, Homo Sapiens
ILTETASPS

SEQ ID NO: 1164462 - protein, 9 aa, Homo Sapiens
SSHRQEAEP

SEQ ID NO: 1164463 - protein, 9 aa, Homo Sapiens
PNYKLWYLD

SEQ ID NO: 1164464 - protein, 9 aa, Homo Sapiens
HFLAPGAPA

SEQ ID NO: 1164465 - protein, 9 aa, Homo Sapiens
ISASTRRQL

SEQ ID NO: 1164466 - protein, 9 aa, Homo Sapiens
RINRSLPSF

SEQ ID NO: 1164467 - protein, 9 aa, Homo Sapiens
WASFFMVVG

SEQ ID NO: 1164468 - protein, 9 aa, Homo Sapiens
DLAFGQLNS

SEQ ID NO: 1164469 - protein, 9 aa, Homo Sapiens
LVSSCFFLV

SEQ ID NO: 1164470 - protein, 9 aa, Homo Sapiens
QIEKHKACS

SEQ ID NO: 1164471 - protein, 9 aa, Homo Sapiens
LFFMEAKPW

SEQ ID NO: 1164472 - protein, 9 aa, Homo Sapiens
SKTISQYAS

SEQ ID NO: 1164473 - protein, 9 aa, Homo Sapiens
PVFFSIING

SEQ ID NO: 1164474 - protein, 9 aa, Homo Sapiens
IHGPAPAPK

SEQ ID NO: 1164475 - protein, 9 aa, Homo Sapiens
TPRKRSHHG

SEQ ID NO: 1164476 - protein, 9 aa, Homo Sapiens
GGERNLKVA

SEQ ID NO: 1164477 - protein, 9 aa, Homo Sapiens
TLRSLFCGS

SEQ ID NO: 1164478 - protein, 9 aa, Homo Sapiens
AHRLRCWHK

SEQ ID NO: 1164479 - protein, 9 aa, Homo Sapiens
SPRKCSALP

SEQ ID NO: 1164480 - protein, 9 aa, Homo Sapiens
MQESAQPPS

SEQ ID NO: 1164481 - protein, 9 aa, Homo Sapiens
TAWTCQTQD

SEQ ID NO: 1164482 - protein, 9 aa, Homo Sapiens
GLSPDHRAS

SEQ ID NO: 1164483 - protein, 9 aa, Homo Sapiens
MAMSQYFDF

SEQ ID NO: 1164484 - protein, 9 aa, Homo Sapiens
QFNAFLGCP

SEQ ID NO: 1164485 - protein, 9 aa, Homo Sapiens
GPQDPPSDT

SEQ ID NO: 1164486 - protein, 9 aa, Homo Sapiens
LLFFWRPPT

SEQ ID NO: 1164487 - protein, 9 aa, Homo Sapiens
APRRRTCAL

SEQ ID NO: 1164488 - protein, 9 aa, Homo Sapiens
PVRRREREK

SEQ ID NO: 1164489 - protein, 9 aa, Homo Sapiens
VSLGEELGA

SEQ ID NO: 1164490 - protein, 9 aa, Homo Sapiens
AHQGVGVSS

SEQ ID NO: 1164491 - protein, 9 aa, Homo Sapiens
QLWARARAA

SEQ ID NO: 1164492 - protein, 9 aa, Homo Sapiens
DKVTIAQGG

SEQ ID NO: 1164493 - protein, 9 aa, Homo Sapiens
SGVPLRSWW

SEQ ID NO: 1164494 - protein, 9 aa, Homo Sapiens
EPEFIEGGR

SEQ ID NO: 1164495 - protein, 9 aa, Homo Sapiens
GGPPEYMGQ

SEQ ID NO: 1164496 - protein, 9 aa, Homo Sapiens
GTYPGDVRH

SEQ ID NO: 1164497 - protein, 9 aa, Homo Sapiens
CHQVPYSIP

SEQ ID NO: 1164498 - protein, 9 aa, Homo Sapiens
DHDKFSTMK

SEQ ID NO: 1164499 - protein, 9 aa, Homo Sapiens
WWRRRRCSI

SEQ ID NO: 1164500 - protein, 9 aa, Homo Sapiens
SVEESLPGA

SEQ ID NO: 1164501 - protein, 9 aa, Homo Sapiens
AREKGLKTR

SEQ ID NO: 1164502 - protein, 9 aa, Homo Sapiens
DIVGSIPVF

SEQ ID NO: 1164503 - protein, 9 aa, Homo Sapiens
PLVPVVSTS

SEQ ID NO: 1164504 - protein, 9 aa, Homo Sapiens
APSKYTCPT

SEQ ID NO: 1164505 - protein, 9 aa, Homo Sapiens
NTDQATTPD

SEQ ID NO: 1164506 - protein, 9 aa, Homo Sapiens
AFPSRSLSS

SEQ ID NO: 1164507 - protein, 9 aa, Homo Sapiens
RWPWRGRRP

SEQ ID NO: 1164508 - protein, 9 aa, Homo Sapiens
HKKSLSDST

SEQ ID NO: 1164509 - protein, 9 aa, Homo Sapiens
ARFSPRPGN

SEQ ID NO: 1164510 - protein, 9 aa, Homo Sapiens
NYHEEIIIN

SEQ ID NO: 1164511 - protein, 9 aa, Homo Sapiens
GGCGSTPPP

SEQ ID NO: 1164512 - protein, 9 aa, Homo Sapiens
TAREDGDRD

SEQ ID NO: 1164513 - protein, 9 aa, Homo Sapiens
VGQRAEAAH

SEQ ID NO: 1164514 - protein, 9 aa, Homo Sapiens
TAVGTKYRM

SEQ ID NO: 1164515 - protein, 9 aa, Homo Sapiens
APRGPGMPN

SEQ ID NO: 1164516 - protein, 9 aa, Homo Sapiens
GAVRAGDPA

SEQ ID NO: 1164517 - protein, 9 aa, Homo Sapiens
HGLAPKLQC

SEQ ID NO: 1164518 - protein, 9 aa, Homo Sapiens
GDETLMQRT

SEQ ID NO: 1164519 - protein, 9 aa, Homo Sapiens
AARGQRLLG

SEQ ID NO: 1164520 - protein, 9 aa, Homo Sapiens
FVPSSSENT

SEQ ID NO: 1164521 - protein, 9 aa, Homo Sapiens
HFFSPEDMK

SEQ ID NO: 1164522 - protein, 9 aa, Homo Sapiens
KAGSSRKMK

SEQ ID NO: 1164523 - protein, 9 aa, Homo Sapiens
EGRIQMVHS

SEQ ID NO: 1164524 - protein, 9 aa, Homo Sapiens
PPARSWSAP

SEQ ID NO: 1164525 - protein, 9 aa, Homo Sapiens
VAGPWSGTS

SEQ ID NO: 1164526 - protein, 9 aa, Homo Sapiens
EQHIKENTT

SEQ ID NO: 1164527 - protein, 9 aa, Homo Sapiens
PSPSRPPPP

SEQ ID NO: 1164528 - protein, 9 aa, Homo Sapiens
CGRRARGPG

SEQ ID NO: 1164529 - protein, 9 aa, Homo Sapiens
PEDQDKMTH

SEQ ID NO: 1164530 - protein, 9 aa, Homo Sapiens
PHRAMAALA

SEQ ID NO: 1164531 - protein, 9 aa, Homo Sapiens
VGCDGGVGE

SEQ ID NO: 1164532 - protein, 9 aa, Homo Sapiens
NVVVKIPTG

SEQ ID NO: 1164533 - protein, 9 aa, Homo Sapiens
AGRLASSAP

SEQ ID NO: 1164534 - protein, 9 aa, Homo Sapiens
NGCVGALLK

SEQ ID NO: 1164535 - protein, 9 aa, Homo Sapiens
RFSRIPPHR

SEQ ID NO: 1164536 - protein, 9 aa, Homo Sapiens
TYCHTQLLI

SEQ ID NO: 1164537 - protein, 9 aa, Homo Sapiens
PSSSTVTAA

SEQ ID NO: 1164538 - protein, 9 aa, Homo Sapiens
TLGRWSITS

SEQ ID NO: 1164539 - protein, 9 aa, Homo Sapiens
LNEDKEWNN

SEQ ID NO: 1164540 - protein, 9 aa, Homo Sapiens
QHKVHVPGP

SEQ ID NO: 1164541 - protein, 9 aa, Homo Sapiens
QIKSTSFLL

SEQ ID NO: 1164542 - protein, 9 aa, Homo Sapiens
SSKPRASLN

SEQ ID NO: 1164543 - protein, 9 aa, Homo Sapiens
GFDDLDYGY

SEQ ID NO: 1164544 - protein, 9 aa, Homo Sapiens
VVIRVKAVS

SEQ ID NO: 1164545 - protein, 9 aa, Homo Sapiens
RPARIQPRA

SEQ ID NO: 1164546 - protein, 9 aa, Homo Sapiens
LPADAQAVC

SEQ ID NO: 1164547 - protein, 9 aa, Homo Sapiens
KTQQSSLHI

SEQ ID NO: 1164548 - protein, 9 aa, Homo Sapiens
VCRLINLGG

SEQ ID NO: 1164549 - protein, 9 aa, Homo Sapiens
SVETCNPEL

SEQ ID NO: 1164550 - protein, 9 aa, Homo Sapiens
KGDDTYLYI

SEQ ID NO: 1164551 - protein, 9 aa, Homo Sapiens
NARFVFGTT

SEQ ID NO: 1164552 - protein, 9 aa, Homo Sapiens
SPISACPRL

SEQ ID NO: 1164553 - protein, 9 aa, Homo Sapiens
KTETTFAFP

SEQ ID NO: 1164554 - protein, 9 aa, Homo Sapiens
GPRAEPPPP

SEQ ID NO: 1164555 - protein, 9 aa, Homo Sapiens
AAAARGAGC

SEQ ID NO: 1164556 - protein, 9 aa, Homo Sapiens
WTMSYRGTF

SEQ ID NO: 1164557 - protein, 9 aa, Homo Sapiens
STSRSTCAR

SEQ ID NO: 1164558 - protein, 9 aa, Homo Sapiens
NTVMPRLLS

SEQ ID NO: 1164559 - protein, 9 aa, Homo Sapiens
CLGRCCCSG

SEQ ID NO: 1164560 - protein, 9 aa, Homo Sapiens
ERQKHIEEQ

SEQ ID NO: 1164561 - protein, 9 aa, Homo Sapiens
SQTQNCGQR

SEQ ID NO: 1164562 - protein, 9 aa, Homo Sapiens
GDDTYLYIL

SEQ ID NO: 1164563 - protein, 9 aa, Homo Sapiens
TNVVPARWT

SEQ ID NO: 1164564 - protein, 9 aa, Homo Sapiens
SPDALGVLR

SEQ ID NO: 1164565 - protein, 9 aa, Homo Sapiens
CRAPPGGGG

SEQ ID NO: 1164566 - protein, 9 aa, Homo Sapiens
YGAQHPPLI

SEQ ID NO: 1164567 - protein, 9 aa, Homo Sapiens
RYPVCLLVL

SEQ ID NO: 1164568 - protein, 9 aa, Homo Sapiens
PSGSCAPRP

SEQ ID NO: 1164569 - protein, 9 aa, Homo Sapiens
ELSKVKYSR

SEQ ID NO: 1164570 - protein, 9 aa, Homo Sapiens
MALCSGPRP

SEQ ID NO: 1164571 - protein, 9 aa, Homo Sapiens
CVVPCWPPC

SEQ ID NO: 1164572 - protein, 9 aa, Homo Sapiens
YRFWTMPIA

SEQ ID NO: 1164573 - protein, 9 aa, Homo Sapiens
RAARGTPAP

SEQ ID NO: 1164574 - protein, 9 aa, Homo Sapiens
RVLAGEGAA

SEQ ID NO: 1164575 - protein, 9 aa, Homo Sapiens
LGPAVLEPD

SEQ ID NO: 1164576 - protein, 9 aa, Homo Sapiens
DALQGPPAP

SEQ ID NO: 1164577 - protein, 9 aa, Homo Sapiens
CCGCSGVAP

SEQ ID NO: 1164578 - protein, 9 aa, Homo Sapiens
LLGNEEGHE

SEQ ID NO: 1164579 - protein, 9 aa, Homo Sapiens
GDLGCPTMR

SEQ ID NO: 1164580 - protein, 9 aa, Homo Sapiens
CGRRFEYDG

SEQ ID NO: 1164581 - protein, 9 aa, Homo Sapiens
KQSRSEPEF

SEQ ID NO: 1164582 - protein, 9 aa, Homo Sapiens
IQANCTSTG

SEQ ID NO: 1164583 - protein, 9 aa, Homo Sapiens
SACPSSPPQ

SEQ ID NO: 1164584 - protein, 9 aa, Homo Sapiens
KPYECNTRR

SEQ ID NO: 1164585 - protein, 9 aa, Homo Sapiens
CLKTQSGQV

SEQ ID NO: 1164586 - protein, 9 aa, Homo Sapiens
ALEVTFPPG

SEQ ID NO: 1164587 - protein, 9 aa, Homo Sapiens
AWCFSCSRV

SEQ ID NO: 1164588 - protein, 9 aa, Homo Sapiens
LNTGTLQQQ

SEQ ID NO: 1164589 - protein, 9 aa, Homo Sapiens
EKCLGCCSS

SEQ ID NO: 1164590 - protein, 9 aa, Homo Sapiens
CGGKRSSRL

SEQ ID NO: 1164591 - protein, 9 aa, Homo Sapiens
RCWGSAFAA

SEQ ID NO: 1164592 - protein, 9 aa, Homo Sapiens
NNWNSSTQW

SEQ ID NO: 1164593 - protein, 9 aa, Homo Sapiens
EQTALVMQS

SEQ ID NO: 1164594 - protein, 9 aa, Homo Sapiens
GAQRVCCLR

SEQ ID NO: 1164595 - protein, 9 aa, Homo Sapiens
GFLTALQAD

SEQ ID NO: 1164596 - protein, 9 aa, Homo Sapiens
FTVCLLRPP

SEQ ID NO: 1164597 - protein, 9 aa, Homo Sapiens
ILDLCQQLR

SEQ ID NO: 1164598 - protein, 9 aa, Homo Sapiens
INLQFPIEI

SEQ ID NO: 1164599 - protein, 9 aa, Homo Sapiens
SFFSNISHS

SEQ ID NO: 1164600 - protein, 9 aa, Homo Sapiens
DEPQKSSLS

SEQ ID NO: 1164601 - protein, 9 aa, Homo Sapiens
PFPAPQTPS

SEQ ID NO: 1164602 - protein, 9 aa, Homo Sapiens
PAQPHLQPP

SEQ ID NO: 1164603 - protein, 9 aa, Homo Sapiens
WGPQGPLWL

SEQ ID NO: 1164604 - protein, 9 aa, Homo Sapiens
CELGMVVRT

SEQ ID NO: 1164605 - protein, 9 aa, Homo Sapiens
LSNATTQSP

SEQ ID NO: 1164606 - protein, 9 aa, Homo Sapiens
ALWCLFCNG

SEQ ID NO: 1164607 - protein, 9 aa, Homo Sapiens
VLAGAWQGG

SEQ ID NO: 1164608 - protein, 9 aa, Homo Sapiens
RPPRAISTF

SEQ ID NO: 1164609 - protein, 9 aa, Homo Sapiens
RRVDACQAD

SEQ ID NO: 1164610 - protein, 9 aa, Homo Sapiens
GHAQHPRRP

SEQ ID NO: 1164611 - protein, 9 aa, Homo Sapiens
MEHSWFESF

SEQ ID NO: 1164612 - protein, 9 aa, Homo Sapiens
MEKTPTFSL

SEQ ID NO: 1164613 - protein, 9 aa, Homo Sapiens
QYTPRVLTQ

SEQ ID NO: 1164614 - protein, 9 aa, Homo Sapiens
RDLGVSTQE

SEQ ID NO: 1164615 - protein, 9 aa, Homo Sapiens
FSIPQASHS

SEQ ID NO: 1164616 - protein, 9 aa, Homo Sapiens
KHFKCEECW

SEQ ID NO: 1164617 - protein, 9 aa, Homo Sapiens
AVGLRVHIA

SEQ ID NO: 1164618 - protein, 9 aa, Homo Sapiens
APEPKCPHI

SEQ ID NO: 1164619 - protein, 9 aa, Homo Sapiens
VSTSFEASN

SEQ ID NO: 1164620 - protein, 9 aa, Homo Sapiens
APHPARRPP

SEQ ID NO: 1164621 - protein, 9 aa, Homo Sapiens
LLVSLAMFR

SEQ ID NO: 1164622 - protein, 9 aa, Homo Sapiens
RMANLSECM

SEQ ID NO: 1164623 - protein, 9 aa, Homo Sapiens
VGSIGRART

SEQ ID NO: 1164624 - protein, 9 aa, Homo Sapiens
SSPATSAST

SEQ ID NO: 1164625 - protein, 9 aa, Homo Sapiens
SAGWEPSQP

SEQ ID NO: 1164626 - protein, 9 aa, Homo Sapiens
FHLACMSPP

SEQ ID NO: 1164627 - protein, 9 aa, Homo Sapiens
LNVDDSRIS

SEQ ID NO: 1164628 - protein, 9 aa, Homo Sapiens
IDLSILTET

SEQ ID NO: 1164629 - protein, 9 aa, Homo Sapiens
TTRYRWVAG

SEQ ID NO: 1164630 - protein, 9 aa, Homo Sapiens
TRELWNQGT

SEQ ID NO: 1164631 - protein, 9 aa, Homo Sapiens
PTRELGARW

SEQ ID NO: 1164632 - protein, 9 aa, Homo Sapiens
RMRSSTSPA

SEQ ID NO: 1164633 - protein, 9 aa, Homo Sapiens
CLRCCFSPL

SEQ ID NO: 1164634 - protein, 9 aa, Homo Sapiens
LLLLQNITG

SEQ ID NO: 1164635 - protein, 9 aa, Homo Sapiens
PSALPSPPS

SEQ ID NO: 1164636 - protein, 9 aa, Homo Sapiens
KLKVELREV

SEQ ID NO: 1164637 - protein, 9 aa, Homo Sapiens
DVAVLVPLL

SEQ ID NO: 1164638 - protein, 9 aa, Homo Sapiens
TQVCETTHP

SEQ ID NO: 1164639 - protein, 9 aa, Homo Sapiens
SKPSMKGLT

SEQ ID NO: 1164640 - protein, 9 aa, Homo Sapiens
STKSVRLVH

SEQ ID NO: 1164641 - protein, 9 aa, Homo Sapiens
ITAMLELSS

SEQ ID NO: 1164642 - protein, 9 aa, Homo Sapiens
TYLYILLIM

SEQ ID NO: 1164643 - protein, 9 aa, Homo Sapiens
GGGGGAPDA

SEQ ID NO: 1164644 - protein, 9 aa, Homo Sapiens
KTIRATTDY

SEQ ID NO: 1164645 - protein, 9 aa, Homo Sapiens
PVTKGTAWT

SEQ ID NO: 1164646 - protein, 9 aa, Homo Sapiens
SPPVSVWDA

SEQ ID NO: 1164647 - protein, 9 aa, Homo Sapiens
PRKLVGRAV

SEQ ID NO: 1164648 - protein, 9 aa, Homo Sapiens
DTHKQLNMI

SEQ ID NO: 1164649 - protein, 9 aa, Homo Sapiens
IQPKARGGA

SEQ ID NO: 1164650 - protein, 9 aa, Homo Sapiens
FVTQFFIRF

SEQ ID NO: 1164651 - protein, 9 aa, Homo Sapiens
TATKIYSQR

SEQ ID NO: 1164652 - protein, 9 aa, Homo Sapiens
QRAHPLRRS

SEQ ID NO: 1164653 - protein, 9 aa, Homo Sapiens
KARRKCYIS

SEQ ID NO: 1164654 - protein, 9 aa, Homo Sapiens
YPPNGVEYY

SEQ ID NO: 1164655 - protein, 9 aa, Homo Sapiens
RKPLGPRPR

SEQ ID NO: 1164656 - protein, 9 aa, Homo Sapiens
PRSCRQTPP

SEQ ID NO: 1164657 - protein, 9 aa, Homo Sapiens
IPLLQESLF

SEQ ID NO: 1164658 - protein, 9 aa, Homo Sapiens
PDMAFESIV

SEQ ID NO: 1164659 - protein, 9 aa, Homo Sapiens
LTVKESNAG

SEQ ID NO: 1164660 - protein, 9 aa, Homo Sapiens
SLVLLRHLL

SEQ ID NO: 1164661 - protein, 9 aa, Homo Sapiens
VIRVKAVSE

SEQ ID NO: 1164662 - protein, 9 aa, Homo Sapiens
EATCRNGHC

SEQ ID NO: 1164663 - protein, 9 aa, Homo Sapiens
GPEVNAGGR

SEQ ID NO: 1164664 - protein, 9 aa, Homo Sapiens
WSPFRAEAE

SEQ ID NO: 1164665 - protein, 9 aa, Homo Sapiens
MPGSCRSPR

SEQ ID NO: 1164666 - protein, 9 aa, Homo Sapiens
GRSPPLQSK

SEQ ID NO: 1164667 - protein, 9 aa, Homo Sapiens
GPEPVPTAW

SEQ ID NO: 1164668 - protein, 9 aa, Homo Sapiens
RPPTPSRLR

SEQ ID NO: 1164669 - protein, 9 aa, Homo Sapiens
GSGWSGRSA

SEQ ID NO: 1164670 - protein, 9 aa, Homo Sapiens
SWCPCPPGR

SEQ ID NO: 1164671 - protein, 9 aa, Homo Sapiens
PKPIVAPTL

SEQ ID NO: 1164672 - protein, 9 aa, Homo Sapiens
MWAAMDICA

SEQ ID NO: 1164673 - protein, 9 aa, Homo Sapiens
VACPDDQGG

SEQ ID NO: 1164674 - protein, 9 aa, Homo Sapiens
VGAPWKATA

SEQ ID NO: 1164675 - protein, 9 aa, Homo Sapiens
VVILKQLNS

SEQ ID NO: 1164676 - protein, 9 aa, Homo Sapiens
KMLGGDEED

SEQ ID NO: 1164677 - protein, 9 aa, Homo Sapiens
GIRKVYTCS

SEQ ID NO: 1164678 - protein, 9 aa, Homo Sapiens
PTLDYLRRC

SEQ ID NO: 1164679 - protein, 9 aa, Homo Sapiens
AHTWNPSTL

SEQ ID NO: 1164680 - protein, 9 aa, Homo Sapiens
WSPHTLLQL

SEQ ID NO: 1164681 - protein, 9 aa, Homo Sapiens
CWACCGTRR

SEQ ID NO: 1164682 - protein, 9 aa, Homo Sapiens
RGVDLRYET

SEQ ID NO: 1164683 - protein, 9 aa, Homo Sapiens
LQAPDAPPE

SEQ ID NO: 1164684 - protein, 9 aa, Homo Sapiens
RTRIYASMK

SEQ ID NO: 1164685 - protein, 9 aa, Homo Sapiens
KLRKVSEPV

SEQ ID NO: 1164686 - protein, 9 aa, Homo Sapiens
LEPPGPACP

SEQ ID NO: 1164687 - protein, 9 aa, Homo Sapiens
QEATCRNGH

SEQ ID NO: 1164688 - protein, 9 aa, Homo Sapiens
GYKLTGDCG

SEQ ID NO: 1164689 - protein, 9 aa, Homo Sapiens
WKYGGIYMG

SEQ ID NO: 1164690 - protein, 9 aa, Homo Sapiens
LSPPLGLHS

SEQ ID NO: 1164691 - protein, 9 aa, Homo Sapiens
PQGSELPAP

SEQ ID NO: 1164692 - protein, 9 aa, Homo Sapiens
RRSASSHDV

SEQ ID NO: 1164693 - protein, 9 aa, Homo Sapiens
SIVIGDDTC

SEQ ID NO: 1164694 - protein, 9 aa, Homo Sapiens
ALEGTVEGA

SEQ ID NO: 1164695 - protein, 9 aa, Homo Sapiens
LNRCRGVTD

SEQ ID NO: 1164696 - protein, 9 aa, Homo Sapiens
QMEKDPIDA

SEQ ID NO: 1164697 - protein, 9 aa, Homo Sapiens
AETHDLFKL

SEQ ID NO: 1164698 - protein, 9 aa, Homo Sapiens
CGPAGWGPP

SEQ ID NO: 1164699 - protein, 9 aa, Homo Sapiens
IMLLAHRLR

SEQ ID NO: 1164700 - protein, 9 aa, Homo Sapiens
AARRMLSPV

SEQ ID NO: 1164701 - protein, 9 aa, Homo Sapiens
QEVELPFSI

SEQ ID NO: 1164702 - protein, 9 aa, Homo Sapiens
LSLEAHTCW

SEQ ID NO: 1164703 - protein, 9 aa, Homo Sapiens
SKLPPVDLI

SEQ ID NO: 1164704 - protein, 9 aa, Homo Sapiens
RQYQKRITQ

SEQ ID NO: 1164705 - protein, 9 aa, Homo Sapiens
LARKVLTRV

SEQ ID NO: 1164706 - protein, 9 aa, Homo Sapiens
VPLAAESRP

SEQ ID NO: 1164707 - protein, 9 aa, Homo Sapiens
RYFLVKRPS

SEQ ID NO: 1164708 - protein, 9 aa, Homo Sapiens
PPPVTPLRV

SEQ ID NO: 1164709 - protein, 9 aa, Homo Sapiens
QNRQGPGCP

SEQ ID NO: 1164710 - protein, 9 aa, Homo Sapiens
EKTETTFAF

SEQ ID NO: 1164711 - protein, 9 aa, Homo Sapiens
PRRSSGSVL

SEQ ID NO: 1164712 - protein, 9 aa, Homo Sapiens
APPIECVNT

SEQ ID NO: 1164713 - protein, 9 aa, Homo Sapiens
LQFQFTAWP

SEQ ID NO: 1164714 - protein, 9 aa, Homo Sapiens
DSPNYKLWY

SEQ ID NO: 1164715 - protein, 9 aa, Homo Sapiens
SPSLAIWTC

SEQ ID NO: 1164716 - protein, 9 aa, Homo Sapiens
CWACRQQKT

SEQ ID NO: 1164717 - protein, 9 aa, Homo Sapiens
LRPCRCCRC

SEQ ID NO: 1164718 - protein, 9 aa, Homo Sapiens
EEDSVQSIH

SEQ ID NO: 1164719 - protein, 9 aa, Homo Sapiens
EAEAGGGGP

SEQ ID NO: 1164720 - protein, 9 aa, Homo Sapiens
LITSAARRS

SEQ ID NO: 1164721 - protein, 9 aa, Homo Sapiens
KPIAVDLSL

SEQ ID NO: 1164722 - protein, 9 aa, Homo Sapiens
TETTFAFPA

SEQ ID NO: 1164723 - protein, 9 aa, Homo Sapiens
RSGRGSLRK

SEQ ID NO: 1164724 - protein, 9 aa, Homo Sapiens
LTRERAAAA

SEQ ID NO: 1164725 - protein, 9 aa, Homo Sapiens
RFGFWRDEE

SEQ ID NO: 1164726 - protein, 9 aa, Homo Sapiens
PGISWDSFW

SEQ ID NO: 1164727 - protein, 9 aa, Homo Sapiens
SHPGQWAPS

SEQ ID NO: 1164728 - protein, 9 aa, Homo Sapiens
QSGTCSGRS

SEQ ID NO: 1164729 - protein, 9 aa, Homo Sapiens
ATTWRPPTP

SEQ ID NO: 1164730 - protein, 9 aa, Homo Sapiens
RPGNVGILP

SEQ ID NO: 1164731 - protein, 9 aa, Homo Sapiens
GADGPPRPP

SEQ ID NO: 1164732 - protein, 9 aa, Homo Sapiens
AGRCKAFST

SEQ ID NO: 1164733 - protein, 9 aa, Homo Sapiens
PCDRSWLPC

SEQ ID NO: 1164734 - protein, 9 aa, Homo Sapiens
LWARARAAT

SEQ ID NO: 1164735 - protein, 9 aa, Homo Sapiens
NAESEVDFS

SEQ ID NO: 1164736 - protein, 9 aa, Homo Sapiens
QHLAASALR

SEQ ID NO: 1164737 - protein, 9 aa, Homo Sapiens
TCNSVIRQL

SEQ ID NO: 1164738 - protein, 9 aa, Homo Sapiens
WSNSLASEK

SEQ ID NO: 1164739 - protein, 9 aa, Homo Sapiens
LSPTCVEAA

SEQ ID NO: 1164740 - protein, 9 aa, Homo Sapiens
GLGGGPRPR

SEQ ID NO: 1164741 - protein, 9 aa, Homo Sapiens
LFQHIAQHR

SEQ ID NO: 1164742 - protein, 9 aa, Homo Sapiens
PAPTSSPAT

SEQ ID NO: 1164743 - protein, 9 aa, Homo Sapiens
QDDHSNLAR

SEQ ID NO: 1164744 - protein, 9 aa, Homo Sapiens
VLQFEVLMA

SEQ ID NO: 1164745 - protein, 9 aa, Homo Sapiens
LEDAAGVTV

SEQ ID NO: 1164746 - protein, 9 aa, Homo Sapiens
FKNSFQHIS

SEQ ID NO: 1164747 - protein, 9 aa, Homo Sapiens
SAAAVQAGR

SEQ ID NO: 1164748 - protein, 9 aa, Homo Sapiens
RSSWPRWTM

SEQ ID NO: 1164749 - protein, 9 aa, Homo Sapiens
LERPDIREK

SEQ ID NO: 1164750 - protein, 9 aa, Homo Sapiens
IGLEKDSGT

SEQ ID NO: 1164751 - protein, 9 aa, Homo Sapiens
TDGTPHPAP

SEQ ID NO: 1164752 - protein, 9 aa, Homo Sapiens
YGWHWGWRT

SEQ ID NO: 1164753 - protein, 9 aa, Homo Sapiens
DNQRAQARV

SEQ ID NO: 1164754 - protein, 9 aa, Homo Sapiens
GFDIEQLIH

SEQ ID NO: 1164755 - protein, 9 aa, Homo Sapiens
PCPVYCPNG

SEQ ID NO: 1164756 - protein, 9 aa, Homo Sapiens
PWSRPSRFR

SEQ ID NO: 1164757 - protein, 9 aa, Homo Sapiens
NKVLRREVY

SEQ ID NO: 1164758 - protein, 9 aa, Homo Sapiens
GHLGGAGAR

SEQ ID NO: 1164759 - protein, 9 aa, Homo Sapiens
PQRTSRHVW

SEQ ID NO: 1164760 - protein, 9 aa, Homo Sapiens
LNVHYQMCH

SEQ ID NO: 1164761 - protein, 9 aa, Homo Sapiens
RNVVEMMIA

SEQ ID NO: 1164762 - protein, 9 aa, Homo Sapiens
LTIVRGPHD

SEQ ID NO: 1164763 - protein, 9 aa, Homo Sapiens
GAPRGQHTP

SEQ ID NO: 1164764 - protein, 9 aa, Homo Sapiens
LIPTLSSFQ

SEQ ID NO: 1164765 - protein, 9 aa, Homo Sapiens
FLCGPQKIN

SEQ ID NO: 1164766 - protein, 9 aa, Homo Sapiens
VWAIPDTEQ

SEQ ID NO: 1164767 - protein, 9 aa, Homo Sapiens
RSATSNSRH

SEQ ID NO: 1164768 - protein, 9 aa, Homo Sapiens
CSRWASSGL

SEQ ID NO: 1164769 - protein, 9 aa, Homo Sapiens
TIKVNQVQE

SEQ ID NO: 1164770 - protein, 9 aa, Homo Sapiens
YLANDMEEE

SEQ ID NO: 1164771 - protein, 9 aa, Homo Sapiens
NYFLMCAPK

SEQ ID NO: 1164772 - protein, 9 aa, Homo Sapiens
WLLWRQNGG

SEQ ID NO: 1164773 - protein, 9 aa, Homo Sapiens
YQMCHRHCC

SEQ ID NO: 1164774 - protein, 9 aa, Homo Sapiens
GMLLRLAQQ

SEQ ID NO: 1164775 - protein, 9 aa, Homo Sapiens
PPRPPARRR

SEQ ID NO: 1164776 - protein, 9 aa, Homo Sapiens
GGTPQWGAT

SEQ ID NO: 1164777 - protein, 9 aa, Homo Sapiens
VLLSIPWTQ

SEQ ID NO: 1164778 - protein, 9 aa, Homo Sapiens
TRLPRRSCC

SEQ ID NO: 1164779 - protein, 9 aa, Homo Sapiens
WGDRASRAS

SEQ ID NO: 1164780 - protein, 9 aa, Homo Sapiens
APGGRRGVL

SEQ ID NO: 1164781 - protein, 9 aa, Homo Sapiens
DEEEEASGL

SEQ ID NO: 1164782 - protein, 9 aa, Homo Sapiens
INWTKIEPS

SEQ ID NO: 1164783 - protein, 9 aa, Homo Sapiens
VALAERGRA

SEQ ID NO: 1164784 - protein, 9 aa, Homo Sapiens
TTKADVEKA

SEQ ID NO: 1164785 - protein, 9 aa, Homo Sapiens
LAPKLQCQY

SEQ ID NO: 1164786 - protein, 9 aa, Homo Sapiens
VPKNPSQLP

SEQ ID NO: 1164787 - protein, 9 aa, Homo Sapiens
KKSPAPAWW

SEQ ID NO: 1164788 - protein, 9 aa, Homo Sapiens
SSPPQGARS

SEQ ID NO: 1164789 - protein, 9 aa, Homo Sapiens
VGTRKLLVA

SEQ ID NO: 1164790 - protein, 9 aa, Homo Sapiens
SWYQRSSCH

SEQ ID NO: 1164791 - protein, 9 aa, Homo Sapiens
CSGLVRDCG

SEQ ID NO: 1164792 - protein, 9 aa, Homo Sapiens
EIIINLQFP

SEQ ID NO: 1164793 - protein, 9 aa, Homo Sapiens
HRDPQDSRV

SEQ ID NO: 1164794 - protein, 9 aa, Homo Sapiens
AQINQYCNL

SEQ ID NO: 1164795 - protein, 9 aa, Homo Sapiens
GFLLLSTWV

SEQ ID NO: 1164796 - protein, 9 aa, Homo Sapiens
FIPGHHCWV

SEQ ID NO: 1164797 - protein, 9 aa, Homo Sapiens
LPSTQQISV

SEQ ID NO: 1164798 - protein, 9 aa, Homo Sapiens
SSCYKALLL

SEQ ID NO: 1164799 - protein, 9 aa, Homo Sapiens
AEADAQAAA

SEQ ID NO: 1164800 - protein, 9 aa, Homo Sapiens
CSPCRALAR

SEQ ID NO: 1164801 - protein, 9 aa, Homo Sapiens
VECAQDEEL

SEQ ID NO: 1164802 - protein, 9 aa, Homo Sapiens
LLQESLFAT

SEQ ID NO: 1164803 - protein, 9 aa, Homo Sapiens
AERDGHWYK

SEQ ID NO: 1164804 - protein, 9 aa, Homo Sapiens
TIPCIFQAV

SEQ ID NO: 1164805 - protein, 9 aa, Homo Sapiens
SGWNLNNML

SEQ ID NO: 1164806 - protein, 9 aa, Homo Sapiens
DAPQLSYSF

SEQ ID NO: 1164807 - protein, 9 aa, Homo Sapiens
CMTRWFFNF

SEQ ID NO: 1164808 - protein, 9 aa, Homo Sapiens
ITWMAVVAG

SEQ ID NO: 1164809 - protein, 9 aa, Homo Sapiens
TLMQRTSTI

SEQ ID NO: 1164810 - protein, 9 aa, Homo Sapiens
RGSTCFFPT

SEQ ID NO: 1164811 - protein, 9 aa, Homo Sapiens
VPLGTTTKE

SEQ ID NO: 1164812 - protein, 9 aa, Homo Sapiens
REVPLTIVR

SEQ ID NO: 1164813 - protein, 9 aa, Homo Sapiens
RQMVPASIA

SEQ ID NO: 1164814 - protein, 9 aa, Homo Sapiens
PTASSAASS

SEQ ID NO: 1164815 - protein, 9 aa, Homo Sapiens
TAWHPHQGS

SEQ ID NO: 1164816 - protein, 9 aa, Homo Sapiens
PSISRESPW

SEQ ID NO: 1164817 - protein, 9 aa, Homo Sapiens
RKEEEDSTF

SEQ ID NO: 1164818 - protein, 9 aa, Homo Sapiens
RARTRGQAR

SEQ ID NO: 1164819 - protein, 9 aa, Homo Sapiens
LQDRIEKNT

SEQ ID NO: 1164820 - protein, 9 aa, Homo Sapiens
IILKVRAML

SEQ ID NO: 1164821 - protein, 9 aa, Homo Sapiens
RVQPVTKAG

SEQ ID NO: 1164822 - protein, 9 aa, Homo Sapiens
SGVGGAAWR

SEQ ID NO: 1164823 - protein, 9 aa, Homo Sapiens
LDLCQQLRE

SEQ ID NO: 1164824 - protein, 9 aa, Homo Sapiens
EQCMTSKHY

SEQ ID NO: 1164825 - protein, 9 aa, Homo Sapiens
LRKFKMRQF

SEQ ID NO: 1164826 - protein, 9 aa, Homo Sapiens
TFVPSSSEN

SEQ ID NO: 1164827 - protein, 9 aa, Homo Sapiens
LETRGSLGP

SEQ ID NO: 1164828 - protein, 9 aa, Homo Sapiens
VERPGAMAT

SEQ ID NO: 1164829 - protein, 9 aa, Homo Sapiens
CPPTGSMPP

SEQ ID NO: 1164830 - protein, 9 aa, Homo Sapiens
SEVDFSIHF

SEQ ID NO: 1164831 - protein, 9 aa, Homo Sapiens
STVTAAPSG

SEQ ID NO: 1164832 - protein, 9 aa, Homo Sapiens
AWAWSASAS

SEQ ID NO: 1164833 - protein, 9 aa, Homo Sapiens
YHSLVMCLR

SEQ ID NO: 1164834 - protein, 9 aa, Homo Sapiens
GSGGGRRPR

SEQ ID NO: 1164835 - protein, 9 aa, Homo Sapiens
NLRPSAVMQ

SEQ ID NO: 1164836 - protein, 9 aa, Homo Sapiens
ATRGEEAVL

SEQ ID NO: 1164837 - protein, 9 aa, Homo Sapiens
PRRLLTSIV

SEQ ID NO: 1164838 - protein, 9 aa, Homo Sapiens
LWSWCGTSQ

SEQ ID NO: 1164839 - protein, 9 aa, Homo Sapiens
FPVLMDPTH

SEQ ID NO: 1164840 - protein, 9 aa, Homo Sapiens
HPQRCGRTA

SEQ ID NO: 1164841 - protein, 9 aa, Homo Sapiens
GDLRTGAGG

SEQ ID NO: 1164842 - protein, 9 aa, Homo Sapiens
MAVVAGLIC

SEQ ID NO: 1164843 - protein, 9 aa, Homo Sapiens
GYQNGIKWQ

SEQ ID NO: 1164844 - protein, 9 aa, Homo Sapiens
SQSQAAPSP

SEQ ID NO: 1164845 - protein, 9 aa, Homo Sapiens
APRPPAPRQ

SEQ ID NO: 1164846 - protein, 9 aa, Homo Sapiens
HQVVYKTQE

SEQ ID NO: 1164847 - protein, 9 aa, Homo Sapiens
PQSCLIIAT

SEQ ID NO: 1164848 - protein, 9 aa, Homo Sapiens
STLSWATPS

SEQ ID NO: 1164849 - protein, 9 aa, Homo Sapiens
ALIERLEDV

SEQ ID NO: 1164850 - protein, 9 aa, Homo Sapiens
LVLTYVWPG

SEQ ID NO: 1164851 - protein, 9 aa, Homo Sapiens
TWRPPTPSR

SEQ ID NO: 1164852 - protein, 9 aa, Homo Sapiens
DGSRKEEED

SEQ ID NO: 1164853 - protein, 9 aa, Homo Sapiens
IMEPIITLE

SEQ ID NO: 1164854 - protein, 9 aa, Homo Sapiens
SPRPRTCSR

SEQ ID NO: 1164855 - protein, 9 aa, Homo Sapiens
LAFPGSFLG

SEQ ID NO: 1164856 - protein, 9 aa, Homo Sapiens
PSIDSIQKE

SEQ ID NO: 1164857 - protein, 9 aa, Homo Sapiens
RHMLEKKNW

SEQ ID NO: 1164858 - protein, 9 aa, Homo Sapiens
RVYILITSC

SEQ ID NO: 1164859 - protein, 9 aa, Homo Sapiens
LVANMYFAT

SEQ ID NO: 1164860 - protein, 9 aa, Homo Sapiens
PLSVPQTQV

SEQ ID NO: 1164861 - protein, 9 aa, Homo Sapiens
FMECDPDEL

SEQ ID NO: 1164862 - protein, 9 aa, Homo Sapiens
VSAADLRKS

SEQ ID NO: 1164863 - protein, 9 aa, Homo Sapiens
PHPTGRRPA

SEQ ID NO: 1164864 - protein, 9 aa, Homo Sapiens
TLRLRSGGL

SEQ ID NO: 1164865 - protein, 9 aa, Homo Sapiens
YTEYKPLCS

SEQ ID NO: 1164866 - protein, 9 aa, Homo Sapiens
TGAAGTRAL

SEQ ID NO: 1164867 - protein, 9 aa, Homo Sapiens
SRTSRSPDT

SEQ ID NO: 1164868 - protein, 9 aa, Homo Sapiens
VGFQVHLEA

SEQ ID NO: 1164869 - protein, 9 aa, Homo Sapiens
MKLYHSLVM

SEQ ID NO: 1164870 - protein, 9 aa, Homo Sapiens
CFLLPQAPR

SEQ ID NO: 1164871 - protein, 9 aa, Homo Sapiens
SSSSCLSQY

SEQ ID NO: 1164872 - protein, 9 aa, Homo Sapiens
VTIGRLHSH

SEQ ID NO: 1164873 - protein, 9 aa, Homo Sapiens
MELDGRRIW

SEQ ID NO: 1164874 - protein, 9 aa, Homo Sapiens
RLTRLSPES

SEQ ID NO: 1164875 - protein, 9 aa, Homo Sapiens
FIDTDWQGG

SEQ ID NO: 1164876 - protein, 9 aa, Homo Sapiens
PEDGAQFPL

SEQ ID NO: 1164877 - protein, 9 aa, Homo Sapiens
LRRSHPGGP

SEQ ID NO: 1164878 - protein, 9 aa, Homo Sapiens
RMVNTGEKR

SEQ ID NO: 1164879 - protein, 9 aa, Homo Sapiens
EGDDEVFYS

SEQ ID NO: 1164880 - protein, 9 aa, Homo Sapiens
AECTLESAA

SEQ ID NO: 1164881 - protein, 9 aa, Homo Sapiens
SYDGPLRHK

SEQ ID NO: 1164882 - protein, 9 aa, Homo Sapiens
LAISFHLLI

SEQ ID NO: 1164883 - protein, 9 aa, Homo Sapiens
FMGLRMRRL

SEQ ID NO: 1164884 - protein, 9 aa, Homo Sapiens
SVYQALISN

SEQ ID NO: 1164885 - protein, 9 aa, Homo Sapiens
WVASPPTRS

SEQ ID NO: 1164886 - protein, 9 aa, Homo Sapiens
GTTPPGRSL

SEQ ID NO: 1164887 - protein, 9 aa, Homo Sapiens
RLPCCVPPE

SEQ ID NO: 1164888 - protein, 9 aa, Homo Sapiens
RIASQAKYA

SEQ ID NO: 1164889 - protein, 9 aa, Homo Sapiens
TRLMAPVGS

SEQ ID NO: 1164890 - protein, 9 aa, Homo Sapiens
ASTRGSGGY

SEQ ID NO: 1164891 - protein, 9 aa, Homo Sapiens
DKVGGIYLL

SEQ ID NO: 1164892 - protein, 9 aa, Homo Sapiens
SLPVAFFFS

SEQ ID NO: 1164893 - protein, 9 aa, Homo Sapiens
RRLPAGTRR

SEQ ID NO: 1164894 - protein, 9 aa, Homo Sapiens
QGPLWLGVA

SEQ ID NO: 1164895 - protein, 9 aa, Homo Sapiens
PQAPRTKPA

SEQ ID NO: 1164896 - protein, 9 aa, Homo Sapiens
WYHLRFTIF

SEQ ID NO: 1164897 - protein, 9 aa, Homo Sapiens
SVRLQRESH

SEQ ID NO: 1164898 - protein, 9 aa, Homo Sapiens
LMAPVGSVM

SEQ ID NO: 1164899 - protein, 9 aa, Homo Sapiens
AAATAATTA

SEQ ID NO: 1164900 - protein, 9 aa, Homo Sapiens
LLRGLPASL

SEQ ID NO: 1164901 - protein, 9 aa, Homo Sapiens
PWALVGARA

SEQ ID NO: 1164902 - protein, 9 aa, Homo Sapiens
WAALSGDCC

SEQ ID NO: 1164903 - protein, 9 aa, Homo Sapiens
RSGGRSRAE

SEQ ID NO: 1164904 - protein, 9 aa, Homo Sapiens
QEQREQERQ

SEQ ID NO: 1164905 - protein, 9 aa, Homo Sapiens
QTPQKVADV

SEQ ID NO: 1164906 - protein, 9 aa, Homo Sapiens
LNYFLMCAP

SEQ ID NO: 1164907 - protein, 9 aa, Homo Sapiens
HGAPQARQQ

SEQ ID NO: 1164908 - protein, 9 aa, Homo Sapiens
LVSVPKKII

SEQ ID NO: 1164909 - protein, 9 aa, Homo Sapiens
RTATGTHRD

SEQ ID NO: 1164910 - protein, 9 aa, Homo Sapiens
GLNNRIVER

SEQ ID NO: 1164911 - protein, 9 aa, Homo Sapiens
LFLLVSLAM

SEQ ID NO: 1164912 - protein, 9 aa, Homo Sapiens
GSSRKMKIS

SEQ ID NO: 1164913 - protein, 9 aa, Homo Sapiens
PGDSTTSDT

SEQ ID NO: 1164914 - protein, 9 aa, Homo Sapiens
CVQSRLHLP

SEQ ID NO: 1164915 - protein, 9 aa, Homo Sapiens
RAGADGPPR

SEQ ID NO: 1164916 - protein, 9 aa, Homo Sapiens
AMPHSAMLF

SEQ ID NO: 1164917 - protein, 9 aa, Homo Sapiens
KTYMEMHYG

SEQ ID NO: 1164918 - protein, 9 aa, Homo Sapiens
PLQRSGSLL

SEQ ID NO: 1164919 - protein, 9 aa, Homo Sapiens
RFVWENGRA

SEQ ID NO: 1164920 - protein, 9 aa, Homo Sapiens
GVTSAANVA

SEQ ID NO: 1164921 - protein, 9 aa, Homo Sapiens
EAPANDADP

SEQ ID NO: 1164922 - protein, 9 aa, Homo Sapiens
PVLRPRGLL

SEQ ID NO: 1164923 - protein, 9 aa, Homo Sapiens
KSVRLVHLE

SEQ ID NO: 1164924 - protein, 9 aa, Homo Sapiens
PPTSAPTQA

SEQ ID NO: 1164925 - protein, 9 aa, Homo Sapiens
CVGGGGGVS

SEQ ID NO: 1164926 - protein, 9 aa, Homo Sapiens
NPRPGRLLG

SEQ ID NO: 1164927 - protein, 9 aa, Homo Sapiens
RAAPRTSTT

SEQ ID NO: 1164928 - protein, 9 aa, Homo Sapiens
RSSRLGWAS

SEQ ID NO: 1164929 - protein, 9 aa, Homo Sapiens
APDTIPPKR

SEQ ID NO: 1164930 - protein, 9 aa, Homo Sapiens
PQVAMLPKL

SEQ ID NO: 1164931 - protein, 9 aa, Homo Sapiens
GIRAGSLML

SEQ ID NO: 1164932 - protein, 9 aa, Homo Sapiens
GPDSTPRGR

SEQ ID NO: 1164933 - protein, 9 aa, Homo Sapiens
DGHGSCSWD

SEQ ID NO: 1164934 - protein, 9 aa, Homo Sapiens
FGQLNSPGS

SEQ ID NO: 1164935 - protein, 9 aa, Homo Sapiens
VSWGAGRLA

SEQ ID NO: 1164936 - protein, 9 aa, Homo Sapiens
EATPSDSVE

SEQ ID NO: 1164937 - protein, 9 aa, Homo Sapiens
AFLLQALVL

SEQ ID NO: 1164938 - protein, 9 aa, Homo Sapiens
FLLGNEEGH

SEQ ID NO: 1164939 - protein, 9 aa, Homo Sapiens
WHLARYFSV

SEQ ID NO: 1164940 - protein, 9 aa, Homo Sapiens
AMADDRYVA

SEQ ID NO: 1164941 - protein, 9 aa, Homo Sapiens
RRPGAAGHP

SEQ ID NO: 1164942 - protein, 9 aa, Homo Sapiens
AFHLACMSP

SEQ ID NO: 1164943 - protein, 9 aa, Homo Sapiens
EMLTPSGSA

SEQ ID NO: 1164944 - protein, 9 aa, Homo Sapiens
SSAASSSSH

SEQ ID NO: 1164945 - protein, 9 aa, Homo Sapiens
SEPVASREL

SEQ ID NO: 1164946 - protein, 9 aa, Homo Sapiens
PCTYLQIVV

SEQ ID NO: 1164947 - protein, 9 aa, Homo Sapiens
AWKQAWLPA

SEQ ID NO: 1164948 - protein, 9 aa, Homo Sapiens
SSRFSRIPP

SEQ ID NO: 1164949 - protein, 9 aa, Homo Sapiens
DRQFRPPWI

SEQ ID NO: 1164950 - protein, 9 aa, Homo Sapiens
IGRARTRGQ

SEQ ID NO: 1164951 - protein, 9 aa, Homo Sapiens
AGTGKQDSR

SEQ ID NO: 1164952 - protein, 9 aa, Homo Sapiens
KLVKHQVVY

SEQ ID NO: 1164953 - protein, 9 aa, Homo Sapiens
FLWESLYPE

SEQ ID NO: 1164954 - protein, 9 aa, Homo Sapiens
DKRLEQNQP

SEQ ID NO: 1164955 - protein, 9 aa, Homo Sapiens
IRYGWHWGW

SEQ ID NO: 1164956 - protein, 9 aa, Homo Sapiens
CRPSRGMAL

SEQ ID NO: 1164957 - protein, 9 aa, Homo Sapiens
KELKKLKTF

SEQ ID NO: 1164958 - protein, 9 aa, Homo Sapiens
LRHQVRENQ

SEQ ID NO: 1164959 - protein, 9 aa, Homo Sapiens
MVAETECRY

SEQ ID NO: 1164960 - protein, 9 aa, Homo Sapiens
RVILAPQRV

SEQ ID NO: 1164961 - protein, 9 aa, Homo Sapiens
EIRVQNGDS

SEQ ID NO: 1164962 - protein, 9 aa, Homo Sapiens
SQTRVPPGR

SEQ ID NO: 1164963 - protein, 9 aa, Homo Sapiens
LDLQQVGDY

SEQ ID NO: 1164964 - protein, 9 aa, Homo Sapiens
LLLLDPAMA

SEQ ID NO: 1164965 - protein, 9 aa, Homo Sapiens
PPWWRRPRR

SEQ ID NO: 1164966 - protein, 9 aa, Homo Sapiens
SVGCVASIN

SEQ ID NO: 1164967 - protein, 9 aa, Homo Sapiens
KMALTAFIE

SEQ ID NO: 1164968 - protein, 9 aa, Homo Sapiens
ALRMSPPAK

SEQ ID NO: 1164969 - protein, 9 aa, Homo Sapiens
VPVAPPPQP

SEQ ID NO: 1164970 - protein, 9 aa, Homo Sapiens
EELLRSLNS

SEQ ID NO: 1164971 - protein, 9 aa, Homo Sapiens
IAKIAEGVS

SEQ ID NO: 1164972 - protein, 9 aa, Homo Sapiens
FSCSRVTRS

SEQ ID NO: 1164973 - protein, 9 aa, Homo Sapiens
PCIAPPTPT

SEQ ID NO: 1164974 - protein, 9 aa, Homo Sapiens
IDWETSHVT

SEQ ID NO: 1164975 - protein, 9 aa, Homo Sapiens
VERSGHEVT

SEQ ID NO: 1164976 - protein, 9 aa, Homo Sapiens
RPRCFLTLP

SEQ ID NO: 1164977 - protein, 9 aa, Homo Sapiens
AARGLQVPV

SEQ ID NO: 1164978 - protein, 9 aa, Homo Sapiens
RAQARVGQR

SEQ ID NO: 1164979 - protein, 9 aa, Homo Sapiens
WGKRSHSSM

SEQ ID NO: 1164980 - protein, 9 aa, Homo Sapiens
WVSFAVLLI

SEQ ID NO: 1164981 - protein, 9 aa, Homo Sapiens
KLSLPESLK

SEQ ID NO: 1164982 - protein, 9 aa, Homo Sapiens
CTAALPTFR

SEQ ID NO: 1164983 - protein, 9 aa, Homo Sapiens
LQAHARGHN

SEQ ID NO: 1164984 - protein, 9 aa, Homo Sapiens
GGKPIAVDL

SEQ ID NO: 1164985 - protein, 9 aa, Homo Sapiens
MFSSKFGSI

SEQ ID NO: 1164986 - protein, 9 aa, Homo Sapiens
PEAAGGQRD

SEQ ID NO: 1164987 - protein, 9 aa, Homo Sapiens
EAQRADSGH

SEQ ID NO: 1164988 - protein, 9 aa, Homo Sapiens
TSYHAAMAT

SEQ ID NO: 1164989 - protein, 9 aa, Homo Sapiens
CPALHLVKP

SEQ ID NO: 1164990 - protein, 9 aa, Homo Sapiens
PAGTRRSSQ

SEQ ID NO: 1164991 - protein, 9 aa, Homo Sapiens
KEAIDHIQV

SEQ ID NO: 1164992 - protein, 9 aa, Homo Sapiens
PLSPKHSTR

SEQ ID NO: 1164993 - protein, 9 aa, Homo Sapiens
GLYHTASLG

SEQ ID NO: 1164994 - protein, 9 aa, Homo Sapiens
VTSGGPLSP

SEQ ID NO: 1164995 - protein, 9 aa, Homo Sapiens
KEHKQKTIQ

SEQ ID NO: 1164996 - protein, 9 aa, Homo Sapiens
RQSHIQMTK

SEQ ID NO: 1164997 - protein, 9 aa, Homo Sapiens
LSHCTLTGL

SEQ ID NO: 1164998 - protein, 9 aa, Homo Sapiens
ASTTLPQWK

SEQ ID NO: 1164999 - protein, 9 aa, Homo Sapiens
ALRAIPPRS

SEQ ID NO: 1165000 - protein, 9 aa, Homo Sapiens
LSPCNASIM

SEQ ID NO: 1165001 - protein, 9 aa, Homo Sapiens
GWWLLELPW

SEQ ID NO: 1165002 - protein, 9 aa, Homo Sapiens
HRIHPATPP

SEQ ID NO: 1165003 - protein, 9 aa, Homo Sapiens
MNTVKGTQN

SEQ ID NO: 1165004 - protein, 9 aa, Homo Sapiens
CIIHGPAPA

SEQ ID NO: 1165005 - protein, 9 aa, Homo Sapiens
GLLDLQQVG

SEQ ID NO: 1165006 - protein, 9 aa, Homo Sapiens
AFPAPVQPV

SEQ ID NO: 1165007 - protein, 9 aa, Homo Sapiens
NHFLAPGAP

SEQ ID NO: 1165008 - protein, 9 aa, Homo Sapiens
LDQMGFLAG

SEQ ID NO: 1165009 - protein, 9 aa, Homo Sapiens
WHVVPPSAA

SEQ ID NO: 1165010 - protein, 9 aa, Homo Sapiens
IAVIKGMTY

SEQ ID NO: 1165011 - protein, 9 aa, Homo Sapiens
HPPGCHCGK

SEQ ID NO: 1165012 - protein, 9 aa, Homo Sapiens
CSSLSSQTS

SEQ ID NO: 1165013 - protein, 9 aa, Homo Sapiens
TQLLPALCA

SEQ ID NO: 1165014 - protein, 9 aa, Homo Sapiens
LTLPLTINL

SEQ ID NO: 1165015 - protein, 9 aa, Homo Sapiens
CRRRMALAG

SEQ ID NO: 1165016 - protein, 9 aa, Homo Sapiens
GMIGSFSVR

SEQ ID NO: 1165017 - protein, 9 aa, Homo Sapiens
SPCLGSQDP

SEQ ID NO: 1165018 - protein, 9 aa, Homo Sapiens
YFIRSIQDF

SEQ ID NO: 1165019 - protein, 9 aa, Homo Sapiens
EEIVKLRKD

SEQ ID NO: 1165020 - protein, 9 aa, Homo Sapiens
SISERRWIL

SEQ ID NO: 1165021 - protein, 9 aa, Homo Sapiens
TCVVCHCGL

SEQ ID NO: 1165022 - protein, 9 aa, Homo Sapiens
VPCLREAVL

SEQ ID NO: 1165023 - protein, 9 aa, Homo Sapiens
TRTLAQVLS

SEQ ID NO: 1165024 - protein, 9 aa, Homo Sapiens
LPSKLPPVD

SEQ ID NO: 1165025 - protein, 9 aa, Homo Sapiens
YGTYVTLTP

SEQ ID NO: 1165026 - protein, 9 aa, Homo Sapiens
AINVHDLKY

SEQ ID NO: 1165027 - protein, 9 aa, Homo Sapiens
PGPSWTWGR

SEQ ID NO: 1165028 - protein, 9 aa, Homo Sapiens
RARTVTCKS

SEQ ID NO: 1165029 - protein, 9 aa, Homo Sapiens
AIYRRHRGA

SEQ ID NO: 1165030 - protein, 9 aa, Homo Sapiens
GRTPTTRLM

SEQ ID NO: 1165031 - protein, 9 aa, Homo Sapiens
WLAICWRSP

SEQ ID NO: 1165032 - protein, 9 aa, Homo Sapiens
RPSWPSCPI

SEQ ID NO: 1165033 - protein, 9 aa, Homo Sapiens
TPTPTTIDP

SEQ ID NO: 1165034 - protein, 9 aa, Homo Sapiens
ETRGNLGPL

SEQ ID NO: 1165035 - protein, 9 aa, Homo Sapiens
VKIPTGATN

SEQ ID NO: 1165036 - protein, 9 aa, Homo Sapiens
NHGLEATPS

SEQ ID NO: 1165037 - protein, 9 aa, Homo Sapiens
CFTFSKAKL

SEQ ID NO: 1165038 - protein, 9 aa, Homo Sapiens
KYRMPSSHS

SEQ ID NO: 1165039 - protein, 9 aa, Homo Sapiens
VLTYHLVWV

SEQ ID NO: 1165040 - protein, 9 aa, Homo Sapiens
VSSIRLCTH

SEQ ID NO: 1165041 - protein, 9 aa, Homo Sapiens
CCMHLHEKR

SEQ ID NO: 1165042 - protein, 9 aa, Homo Sapiens
QQLGAGAAA

SEQ ID NO: 1165043 - protein, 9 aa, Homo Sapiens
ATYKEGYNI

SEQ ID NO: 1165044 - protein, 9 aa, Homo Sapiens
TPEEELFGN

SEQ ID NO: 1165045 - protein, 9 aa, Homo Sapiens
WWGRRPRPQ

SEQ ID NO: 1165046 - protein, 9 aa, Homo Sapiens
IHGVRHPQD

SEQ ID NO: 1165047 - protein, 9 aa, Homo Sapiens
TPPPTWSRT

SEQ ID NO: 1165048 - protein, 9 aa, Homo Sapiens
SWLTSSFKL

SEQ ID NO: 1165049 - protein, 9 aa, Homo Sapiens
ELVQPFFEK

SEQ ID NO: 1165050 - protein, 9 aa, Homo Sapiens
GAGRLASSA

SEQ ID NO: 1165051 - protein, 9 aa, Homo Sapiens
EIQHFYYTF

SEQ ID NO: 1165052 - protein, 9 aa, Homo Sapiens
SRNCSLSLQ

SEQ ID NO: 1165053 - protein, 9 aa, Homo Sapiens
HMLEKKNWS

SEQ ID NO: 1165054 - protein, 9 aa, Homo Sapiens
TATSTLSPQ

SEQ ID NO: 1165055 - protein, 9 aa, Homo Sapiens
SRHPPGRRR

SEQ ID NO: 1165056 - protein, 9 aa, Homo Sapiens
GAMYWSDWG

SEQ ID NO: 1165057 - protein, 9 aa, Homo Sapiens
VLRAIRYPM

SEQ ID NO: 1165058 - protein, 9 aa, Homo Sapiens
REKPNLPEY

SEQ ID NO: 1165059 - protein, 9 aa, Homo Sapiens
RGTQIEETP

SEQ ID NO: 1165060 - protein, 9 aa, Homo Sapiens
DETLMQRTS

SEQ ID NO: 1165061 - protein, 9 aa, Homo Sapiens
GSPTLGTRS

SEQ ID NO: 1165062 - protein, 9 aa, Homo Sapiens
CKKSPAPAW

SEQ ID NO: 1165063 - protein, 9 aa, Homo Sapiens
SWATPSTRQ

SEQ ID NO: 1165064 - protein, 9 aa, Homo Sapiens
HGDLFSEDG

SEQ ID NO: 1165065 - protein, 9 aa, Homo Sapiens
PSLPSRGSP

SEQ ID NO: 1165066 - protein, 9 aa, Homo Sapiens
RPPWWRRPR

SEQ ID NO: 1165067 - protein, 9 aa, Homo Sapiens
GIIASTTLP

SEQ ID NO: 1165068 - protein, 9 aa, Homo Sapiens
RSPHHYYHS

SEQ ID NO: 1165069 - protein, 9 aa, Homo Sapiens
VNKYSDFAS

SEQ ID NO: 1165070 - protein, 9 aa, Homo Sapiens
MSVASAYSA

SEQ ID NO: 1165071 - protein, 9 aa, Homo Sapiens
TESPFSRKS

SEQ ID NO: 1165072 - protein, 9 aa, Homo Sapiens
IVADRSNNC

SEQ ID NO: 1165073 - protein, 9 aa, Homo Sapiens
ALSGHHSPH

SEQ ID NO: 1165074 - protein, 9 aa, Homo Sapiens
GAQFPLDYN

SEQ ID NO: 1165075 - protein, 9 aa, Homo Sapiens
GPAEWGQRL

SEQ ID NO: 1165076 - protein, 9 aa, Homo Sapiens
VKCTSSIST

SEQ ID NO: 1165077 - protein, 9 aa, Homo Sapiens
PGNQLRNHY

SEQ ID NO: 1165078 - protein, 9 aa, Homo Sapiens
RKCYISQND

SEQ ID NO: 1165079 - protein, 9 aa, Homo Sapiens
IKVFPSPQS

SEQ ID NO: 1165080 - protein, 9 aa, Homo Sapiens
GAISDVPEA

SEQ ID NO: 1165081 - protein, 9 aa, Homo Sapiens
QYMLNARLA

SEQ ID NO: 1165082 - protein, 9 aa, Homo Sapiens
LEDVPPVNQ

SEQ ID NO: 1165083 - protein, 9 aa, Homo Sapiens
GIWPNRIHT

SEQ ID NO: 1165084 - protein, 9 aa, Homo Sapiens
RPPPLVRCH

SEQ ID NO: 1165085 - protein, 9 aa, Homo Sapiens
GKGGKNRCR

SEQ ID NO: 1165086 - protein, 9 aa, Homo Sapiens
TEILTEKKT

SEQ ID NO: 1165087 - protein, 9 aa, Homo Sapiens
AAARGAGCR

SEQ ID NO: 1165088 - protein, 9 aa, Homo Sapiens
LLGVPCLRE

SEQ ID NO: 1165089 - protein, 9 aa, Homo Sapiens
VSQHVVMEV

SEQ ID NO: 1165090 - protein, 9 aa, Homo Sapiens
KTQINSQLQ

SEQ ID NO: 1165091 - protein, 9 aa, Homo Sapiens
AEGNISKKQ

SEQ ID NO: 1165092 - protein, 9 aa, Homo Sapiens
RDPLPPLRP

SEQ ID NO: 1165093 - protein, 9 aa, Homo Sapiens
SHPSAHFQR

SEQ ID NO: 1165094 - protein, 9 aa, Homo Sapiens
VSEGGPEAP

SEQ ID NO: 1165095 - protein, 9 aa, Homo Sapiens
CSKILLSLI

SEQ ID NO: 1165096 - protein, 9 aa, Homo Sapiens
SERRWILIE

SEQ ID NO: 1165097 - protein, 9 aa, Homo Sapiens
PGAQMGVPL

SEQ ID NO: 1165098 - protein, 9 aa, Homo Sapiens
STATSTLSP

SEQ ID NO: 1165099 - protein, 9 aa, Homo Sapiens
WNLRAWRTC

SEQ ID NO: 1165100 - protein, 9 aa, Homo Sapiens
SVWPNLTSQ

SEQ ID NO: 1165101 - protein, 9 aa, Homo Sapiens
TWQTRLSTH

SEQ ID NO: 1165102 - protein, 9 aa, Homo Sapiens
RSSSRTACG

SEQ ID NO: 1165103 - protein, 9 aa, Homo Sapiens
PHRYMPGTV

SEQ ID NO: 1165104 - protein, 9 aa, Homo Sapiens
GKVSTSTPT

SEQ ID NO: 1165105 - protein, 9 aa, Homo Sapiens
RACTPWPRS

SEQ ID NO: 1165106 - protein, 9 aa, Homo Sapiens
QFVPPALAL

SEQ ID NO: 1165107 - protein, 9 aa, Homo Sapiens
AHYQQPGKE

SEQ ID NO: 1165108 - protein, 9 aa, Homo Sapiens
LVLNVNKWT

SEQ ID NO: 1165109 - protein, 9 aa, Homo Sapiens
PARWATQGP

SEQ ID NO: 1165110 - protein, 9 aa, Homo Sapiens
LHKKRGGSS

SEQ ID NO: 1165111 - protein, 9 aa, Homo Sapiens
GSQGAARGL

SEQ ID NO: 1165112 - protein, 9 aa, Homo Sapiens
EAQQKKLQE

SEQ ID NO: 1165113 - protein, 9 aa, Homo Sapiens
AGADDLFCY

SEQ ID NO: 1165114 - protein, 9 aa, Homo Sapiens
QGLGVAARH

SEQ ID NO: 1165115 - protein, 9 aa, Homo Sapiens
PNGVEYYSC

SEQ ID NO: 1165116 - protein, 9 aa, Homo Sapiens
PLEPPGPAC

SEQ ID NO: 1165117 - protein, 9 aa, Homo Sapiens
SGASTRPTW

SEQ ID NO: 1165118 - protein, 9 aa, Homo Sapiens
QDPRTMSRK

SEQ ID NO: 1165119 - protein, 9 aa, Homo Sapiens
LPPLKDTER

SEQ ID NO: 1165120 - protein, 9 aa, Homo Sapiens
RCLCTGYFK

SEQ ID NO: 1165121 - protein, 9 aa, Homo Sapiens
NNYGNNFWN

SEQ ID NO: 1165122 - protein, 9 aa, Homo Sapiens
LVTIGRLHS

SEQ ID NO: 1165123 - protein, 9 aa, Homo Sapiens
ASSGLCVPS

SEQ ID NO: 1165124 - protein, 9 aa, Homo Sapiens
SQCYLYQEF

SEQ ID NO: 1165125 - protein, 9 aa, Homo Sapiens
DAPVPGGES

SEQ ID NO: 1165126 - protein, 9 aa, Homo Sapiens
RPGNATCAR

SEQ ID NO: 1165127 - protein, 9 aa, Homo Sapiens
SARRAGRHH

SEQ ID NO: 1165128 - protein, 9 aa, Homo Sapiens
VLHQNLDPT

SEQ ID NO: 1165129 - protein, 9 aa, Homo Sapiens
TTAAPRGLC

SEQ ID NO: 1165130 - protein, 9 aa, Homo Sapiens
EAAGDVSDQ

SEQ ID NO: 1165131 - protein, 9 aa, Homo Sapiens
QRGCFLRIR

SEQ ID NO: 1165132 - protein, 9 aa, Homo Sapiens
SSRISSSSH

SEQ ID NO: 1165133 - protein, 9 aa, Homo Sapiens
STLQQRHPQ

SEQ ID NO: 1165134 - protein, 9 aa, Homo Sapiens
RPVVAGQLV

SEQ ID NO: 1165135 - protein, 9 aa, Homo Sapiens
YNLIHLVPR

SEQ ID NO: 1165136 - protein, 9 aa, Homo Sapiens
STTWPLSLE

SEQ ID NO: 1165137 - protein, 9 aa, Homo Sapiens
KEALGGQAI

SEQ ID NO: 1165138 - protein, 9 aa, Homo Sapiens
WSLVEGGRK

SEQ ID NO: 1165139 - protein, 9 aa, Homo Sapiens
RWMVLAQAP

SEQ ID NO: 1165140 - protein, 9 aa, Homo Sapiens
AVLTYHLVW

SEQ ID NO: 1165141 - protein, 9 aa, Homo Sapiens
KERYGTLKT

SEQ ID NO: 1165142 - protein, 9 aa, Homo Sapiens
PPACTSKAW

SEQ ID NO: 1165143 - protein, 9 aa, Homo Sapiens
LGPKASRAT

SEQ ID NO: 1165144 - protein, 9 aa, Homo Sapiens
LYMPSAQLS

SEQ ID NO: 1165145 - protein, 9 aa, Homo Sapiens
TQRQDTSKN

SEQ ID NO: 1165146 - protein, 9 aa, Homo Sapiens
MNARGIPRS

SEQ ID NO: 1165147 - protein, 9 aa, Homo Sapiens
DLELDAPEG

SEQ ID NO: 1165148 - protein, 9 aa, Homo Sapiens
TMGTLAPWA

SEQ ID NO: 1165149 - protein, 9 aa, Homo Sapiens
TMPLLPVPS

SEQ ID NO: 1165150 - protein, 9 aa, Homo Sapiens
VLCRQVYVN

SEQ ID NO: 1165151 - protein, 9 aa, Homo Sapiens
ERLQAATGH

SEQ ID NO: 1165152 - protein, 9 aa, Homo Sapiens
GFVDHEAES

SEQ ID NO: 1165153 - protein, 9 aa, Homo Sapiens
PPTWPTQTW

SEQ ID NO: 1165154 - protein, 9 aa, Homo Sapiens
RLLIYGECC

SEQ ID NO: 1165155 - protein, 9 aa, Homo Sapiens
PPQGARSDA

SEQ ID NO: 1165156 - protein, 9 aa, Homo Sapiens
LASRYECAT

SEQ ID NO: 1165157 - protein, 9 aa, Homo Sapiens
AGPPRLGQR

SEQ ID NO: 1165158 - protein, 9 aa, Homo Sapiens
SCLVTIGRL

SEQ ID NO: 1165159 - protein, 9 aa, Homo Sapiens
RILRALWGA

SEQ ID NO: 1165160 - protein, 9 aa, Homo Sapiens
SLPESLKAY

SEQ ID NO: 1165161 - protein, 9 aa, Homo Sapiens
LLLAHAAGQ

SEQ ID NO: 1165162 - protein, 9 aa, Homo Sapiens
LIFTQNYHE

SEQ ID NO: 1165163 - protein, 9 aa, Homo Sapiens
QLCRPPTPP

SEQ ID NO: 1165164 - protein, 9 aa, Homo Sapiens
MTGAQRSFT

SEQ ID NO: 1165165 - protein, 9 aa, Homo Sapiens
VQPACLDPS

SEQ ID NO: 1165166 - protein, 9 aa, Homo Sapiens
TKTVRQWSP

SEQ ID NO: 1165167 - protein, 9 aa, Homo Sapiens
RGGAPGSEP

SEQ ID NO: 1165168 - protein, 9 aa, Homo Sapiens
GSTCFFPTL

SEQ ID NO: 1165169 - protein, 9 aa, Homo Sapiens
QIQVIGFAT

SEQ ID NO: 1165170 - protein, 9 aa, Homo Sapiens
RLIVREVPL

SEQ ID NO: 1165171 - protein, 9 aa, Homo Sapiens
SCWSMRMRM

SEQ ID NO: 1165172 - protein, 9 aa, Homo Sapiens
LVHDFTNAV

SEQ ID NO: 1165173 - protein, 9 aa, Homo Sapiens
GSPPTKQQR

SEQ ID NO: 1165174 - protein, 9 aa, Homo Sapiens
GSAADPEQP

SEQ ID NO: 1165175 - protein, 9 aa, Homo Sapiens
GFHATPEEF

SEQ ID NO: 1165176 - protein, 9 aa, Homo Sapiens
HLTWKLWPP

SEQ ID NO: 1165177 - protein, 9 aa, Homo Sapiens
DFRNYHLGV

SEQ ID NO: 1165178 - protein, 9 aa, Homo Sapiens
ARTCSPCSP

SEQ ID NO: 1165179 - protein, 9 aa, Homo Sapiens
AGLLAMLQD

SEQ ID NO: 1165180 - protein, 9 aa, Homo Sapiens
SLRQNDIKF

SEQ ID NO: 1165181 - protein, 9 aa, Homo Sapiens
CYRIMEHSW

SEQ ID NO: 1165182 - protein, 9 aa, Homo Sapiens
IHPATPPQA

SEQ ID NO: 1165183 - protein, 9 aa, Homo Sapiens
CKAQQVFVD

SEQ ID NO: 1165184 - protein, 9 aa, Homo Sapiens
LAVDVGDSM

SEQ ID NO: 1165185 - protein, 9 aa, Homo Sapiens
CIWRGLGSI

SEQ ID NO: 1165186 - protein, 9 aa, Homo Sapiens
DALARGAGP

SEQ ID NO: 1165187 - protein, 9 aa, Homo Sapiens
SCGSAPGCW

SEQ ID NO: 1165188 - protein, 9 aa, Homo Sapiens
SEWRQRSIV

SEQ ID NO: 1165189 - protein, 9 aa, Homo Sapiens
LFLPTLQSI

SEQ ID NO: 1165190 - protein, 9 aa, Homo Sapiens
EEESEEETT

SEQ ID NO: 1165191 - protein, 9 aa, Homo Sapiens
QRNIPLLLL

SEQ ID NO: 1165192 - protein, 9 aa, Homo Sapiens
NMKLVYKKH

SEQ ID NO: 1165193 - protein, 9 aa, Homo Sapiens
RHTVDMLRC

SEQ ID NO: 1165194 - protein, 9 aa, Homo Sapiens
ISKNVAMEA

SEQ ID NO: 1165195 - protein, 9 aa, Homo Sapiens
RCHLAGGLV

SEQ ID NO: 1165196 - protein, 9 aa, Homo Sapiens
ATTQSPLPI

SEQ ID NO: 1165197 - protein, 9 aa, Homo Sapiens
EGCRCYRSA

SEQ ID NO: 1165198 - protein, 9 aa, Homo Sapiens
QHPPPAKHS

SEQ ID NO: 1165199 - protein, 9 aa, Homo Sapiens
KIVKNVFPN

SEQ ID NO: 1165200 - protein, 9 aa, Homo Sapiens
APPELFLLP

SEQ ID NO: 1165201 - protein, 9 aa, Homo Sapiens
RGLPGAATA

SEQ ID NO: 1165202 - protein, 9 aa, Homo Sapiens
QHQSEGKPD

SEQ ID NO: 1165203 - protein, 9 aa, Homo Sapiens
SDHSVPPAV

SEQ ID NO: 1165204 - protein, 9 aa, Homo Sapiens
ESAYTARIS

SEQ ID NO: 1165205 - protein, 9 aa, Homo Sapiens
EPQGPSASA

SEQ ID NO: 1165206 - protein, 9 aa, Homo Sapiens
CENTRVALT

SEQ ID NO: 1165207 - protein, 9 aa, Homo Sapiens
SKLELSTVR

SEQ ID NO: 1165208 - protein, 9 aa, Homo Sapiens
MCAPKHART

SEQ ID NO: 1165209 - protein, 9 aa, Homo Sapiens
PLSKNNIAA

SEQ ID NO: 1165210 - protein, 9 aa, Homo Sapiens
NHNYLPFEA

SEQ ID NO: 1165211 - protein, 9 aa, Homo Sapiens
ERNLKVAKN

SEQ ID NO: 1165212 - protein, 9 aa, Homo Sapiens
TAMQCRKKS

SEQ ID NO: 1165213 - protein, 9 aa, Homo Sapiens
NVLKEIDTS

SEQ ID NO: 1165214 - protein, 9 aa, Homo Sapiens
EVINWNQVA

SEQ ID NO: 1165215 - protein, 9 aa, Homo Sapiens
NLSMEDFLK

SEQ ID NO: 1165216 - protein, 9 aa, Homo Sapiens
EVKVVPKPI

SEQ ID NO: 1165217 - protein, 9 aa, Homo Sapiens
KVDFWYSDQ

SEQ ID NO: 1165218 - protein, 9 aa, Homo Sapiens
GDEEDPDAA

SEQ ID NO: 1165219 - protein, 9 aa, Homo Sapiens
ERSGHEVTE

SEQ ID NO: 1165220 - protein, 9 aa, Homo Sapiens
GPVRLEYYE

SEQ ID NO: 1165221 - protein, 9 aa, Homo Sapiens
PFSGFHATP

SEQ ID NO: 1165222 - protein, 9 aa, Homo Sapiens
KEAAGDVSD

SEQ ID NO: 1165223 - protein, 9 aa, Homo Sapiens
RNLGGKPIA

SEQ ID NO: 1165224 - protein, 9 aa, Homo Sapiens
EEKHLKTLK

SEQ ID NO: 1165225 - protein, 9 aa, Homo Sapiens
SQGWNRSYP

SEQ ID NO: 1165226 - protein, 9 aa, Homo Sapiens
CLRLRTKLE

SEQ ID NO: 1165227 - protein, 9 aa, Homo Sapiens
CARLWMANA

SEQ ID NO: 1165228 - protein, 9 aa, Homo Sapiens
RCPPHRWTA

SEQ ID NO: 1165229 - protein, 9 aa, Homo Sapiens
QNPQYNPGD

SEQ ID NO: 1165230 - protein, 9 aa, Homo Sapiens
PCSRATASH

SEQ ID NO: 1165231 - protein, 9 aa, Homo Sapiens
GAWCFSCSR

SEQ ID NO: 1165232 - protein, 9 aa, Homo Sapiens
AIYKQSQHT

SEQ ID NO: 1165233 - protein, 9 aa, Homo Sapiens
YPSPVPQYT

SEQ ID NO: 1165234 - protein, 9 aa, Homo Sapiens
SSGVWSPFR

SEQ ID NO: 1165235 - protein, 9 aa, Homo Sapiens
LTWKLWPPS

SEQ ID NO: 1165236 - protein, 9 aa, Homo Sapiens
LQEALEKKD

SEQ ID NO: 1165237 - protein, 9 aa, Homo Sapiens
ALDRAVGGG

SEQ ID NO: 1165238 - protein, 9 aa, Homo Sapiens
QPLPMSPPR

SEQ ID NO: 1165239 - protein, 9 aa, Homo Sapiens
ACTSKAWTP

SEQ ID NO: 1165240 - protein, 9 aa, Homo Sapiens
GHAQRVGET

SEQ ID NO: 1165241 - protein, 9 aa, Homo Sapiens
TFLLKAWAQ

SEQ ID NO: 1165242 - protein, 9 aa, Homo Sapiens
APGVWSQVA

SEQ ID NO: 1165243 - protein, 9 aa, Homo Sapiens
PASIADMLL

SEQ ID NO: 1165244 - protein, 9 aa, Homo Sapiens
ANLCSMRKG

SEQ ID NO: 1165245 - protein, 9 aa, Homo Sapiens
TPEVLEEAC

SEQ ID NO: 1165246 - protein, 9 aa, Homo Sapiens
LLPQAPRTK

SEQ ID NO: 1165247 - protein, 9 aa, Homo Sapiens
LAQVLSGDR

SEQ ID NO: 1165248 - protein, 9 aa, Homo Sapiens
GSAPWWGRR

SEQ ID NO: 1165249 - protein, 9 aa, Homo Sapiens
VRGCSAGGG

SEQ ID NO: 1165250 - protein, 9 aa, Homo Sapiens
SMVSSVTYG

SEQ ID NO: 1165251 - protein, 9 aa, Homo Sapiens
LPKVSYVNA

SEQ ID NO: 1165252 - protein, 9 aa, Homo Sapiens
GSSEKREVL

SEQ ID NO: 1165253 - protein, 9 aa, Homo Sapiens
EGGPEAPST

SEQ ID NO: 1165254 - protein, 9 aa, Homo Sapiens
AVGGGGPAR

SEQ ID NO: 1165255 - protein, 9 aa, Homo Sapiens
QYQKRITQQ

SEQ ID NO: 1165256 - protein, 9 aa, Homo Sapiens
EYWDNNAGT

SEQ ID NO: 1165257 - protein, 9 aa, Homo Sapiens
ASMLLGECR

SEQ ID NO: 1165258 - protein, 9 aa, Homo Sapiens
LMAVGGEAI

SEQ ID NO: 1165259 - protein, 9 aa, Homo Sapiens
CRQMLPTLS

SEQ ID NO: 1165260 - protein, 9 aa, Homo Sapiens
APAAAQGPA

SEQ ID NO: 1165261 - protein, 9 aa, Homo Sapiens
LTGQRCWGS

SEQ ID NO: 1165262 - protein, 9 aa, Homo Sapiens
EPSPSEVSF

SEQ ID NO: 1165263 - protein, 9 aa, Homo Sapiens
VIAECTLES

SEQ ID NO: 1165264 - protein, 9 aa, Homo Sapiens
IGKVVKVFG

SEQ ID NO: 1165265 - protein, 9 aa, Homo Sapiens
RELKAPRAA

SEQ ID NO: 1165266 - protein, 9 aa, Homo Sapiens
GFLNEIARE

SEQ ID NO: 1165267 - protein, 9 aa, Homo Sapiens
GTCSGRSRP

SEQ ID NO: 1165268 - protein, 9 aa, Homo Sapiens
HPRGSPAWS

SEQ ID NO: 1165269 - protein, 9 aa, Homo Sapiens
DPAMAISPT

SEQ ID NO: 1165270 - protein, 9 aa, Homo Sapiens
FIPWNFPLL

SEQ ID NO: 1165271 - protein, 9 aa, Homo Sapiens
PQAKPQLGL

SEQ ID NO: 1165272 - protein, 9 aa, Homo Sapiens
PCRGPMPGS

SEQ ID NO: 1165273 - protein, 9 aa, Homo Sapiens
PRIHKVPLL

SEQ ID NO: 1165274 - protein, 9 aa, Homo Sapiens
RGGPAEWGQ

SEQ ID NO: 1165275 - protein, 9 aa, Homo Sapiens
SFFLAAMAD

SEQ ID NO: 1165276 - protein, 9 aa, Homo Sapiens
PTGATNVDI

SEQ ID NO: 1165277 - protein, 9 aa, Homo Sapiens
IPGSLPPIR

SEQ ID NO: 1165278 - protein, 9 aa, Homo Sapiens
ITVFLTGFR

SEQ ID NO: 1165279 - protein, 9 aa, Homo Sapiens
SGWHCFMTS

SEQ ID NO: 1165280 - protein, 9 aa, Homo Sapiens
CDWRFNELP

SEQ ID NO: 1165281 - protein, 9 aa, Homo Sapiens
PSRLGSRMF

SEQ ID NO: 1165282 - protein, 9 aa, Homo Sapiens
KNVCRRFRA

SEQ ID NO: 1165283 - protein, 9 aa, Homo Sapiens
TTSPPTSAP

SEQ ID NO: 1165284 - protein, 9 aa, Homo Sapiens
RWLSLFDFL

SEQ ID NO: 1165285 - protein, 9 aa, Homo Sapiens
FLDTLVRLK

SEQ ID NO: 1165286 - protein, 9 aa, Homo Sapiens
LCGPQKINC

SEQ ID NO: 1165287 - protein, 9 aa, Homo Sapiens
AEAESPADG

SEQ ID NO: 1165288 - protein, 9 aa, Homo Sapiens
CVDSAVTVA

SEQ ID NO: 1165289 - protein, 9 aa, Homo Sapiens
GSDSSDSKL

SEQ ID NO: 1165290 - protein, 9 aa, Homo Sapiens
VAHRIHPAT

SEQ ID NO: 1165291 - protein, 9 aa, Homo Sapiens
DSRVRVGYP

SEQ ID NO: 1165292 - protein, 9 aa, Homo Sapiens
EVCKKFMEC

SEQ ID NO: 1165293 - protein, 9 aa, Homo Sapiens
HHKDSALSL

SEQ ID NO: 1165294 - protein, 9 aa, Homo Sapiens
LRKWRPGAS

SEQ ID NO: 1165295 - protein, 9 aa, Homo Sapiens
SSQKPSVGP

SEQ ID NO: 1165296 - protein, 9 aa, Homo Sapiens
CSWPSWGWG

SEQ ID NO: 1165297 - protein, 9 aa, Homo Sapiens
PSGSRGCPT

SEQ ID NO: 1165298 - protein, 9 aa, Homo Sapiens
PPPALPSRP

SEQ ID NO: 1165299 - protein, 9 aa, Homo Sapiens
MAIEERKQL

SEQ ID NO: 1165300 - protein, 9 aa, Homo Sapiens
HTSTVCCMH

SEQ ID NO: 1165301 - protein, 9 aa, Homo Sapiens
WRMRSSTSP

SEQ ID NO: 1165302 - protein, 9 aa, Homo Sapiens
GSHEGVLVR

SEQ ID NO: 1165303 - protein, 9 aa, Homo Sapiens
YGSYPPARQ

SEQ ID NO: 1165304 - protein, 9 aa, Homo Sapiens
RNHWQYRDL

SEQ ID NO: 1165305 - protein, 9 aa, Homo Sapiens
QPPGGCHPA

SEQ ID NO: 1165306 - protein, 9 aa, Homo Sapiens
KVELREVTK

SEQ ID NO: 1165307 - protein, 9 aa, Homo Sapiens
HCGLDGIPF

SEQ ID NO: 1165308 - protein, 9 aa, Homo Sapiens
SVKVEEYYR

SEQ ID NO: 1165309 - protein, 9 aa, Homo Sapiens
SKKQNALAE

SEQ ID NO: 1165310 - protein, 9 aa, Homo Sapiens
WGGTPRDAG

SEQ ID NO: 1165311 - protein, 9 aa, Homo Sapiens
PDVHGGGEG

SEQ ID NO: 1165312 - protein, 9 aa, Homo Sapiens
YCFQHILLN

SEQ ID NO: 1165313 - protein, 9 aa, Homo Sapiens
LALQNGCVG

SEQ ID NO: 1165314 - protein, 9 aa, Homo Sapiens
LLRPALRIG

SEQ ID NO: 1165315 - protein, 9 aa, Homo Sapiens
TARGWSWWS

SEQ ID NO: 1165316 - protein, 9 aa, Homo Sapiens
NSFQHISSL

SEQ ID NO: 1165317 - protein, 9 aa, Homo Sapiens
LCRQMLPTL

SEQ ID NO: 1165318 - protein, 9 aa, Homo Sapiens
FTNVVPARW

SEQ ID NO: 1165319 - protein, 9 aa, Homo Sapiens
CGDDDRFLV

SEQ ID NO: 1165320 - protein, 9 aa, Homo Sapiens
PSLSTATST

SEQ ID NO: 1165321 - protein, 9 aa, Homo Sapiens
PEWRICSTT

SEQ ID NO: 1165322 - protein, 9 aa, Homo Sapiens
MPEEGSEDE

SEQ ID NO: 1165323 - protein, 9 aa, Homo Sapiens
DELGCKYQV

SEQ ID NO: 1165324 - protein, 9 aa, Homo Sapiens
GMSLITLAF

SEQ ID NO: 1165325 - protein, 9 aa, Homo Sapiens
GPPVKPNMP

SEQ ID NO: 1165326 - protein, 9 aa, Homo Sapiens
KPWLAICWR

SEQ ID NO: 1165327 - protein, 9 aa, Homo Sapiens
WQDVHQRCV

SEQ ID NO: 1165328 - protein, 9 aa, Homo Sapiens
LKDGVWSPG

SEQ ID NO: 1165329 - protein, 9 aa, Homo Sapiens
CRPPTPPAP

SEQ ID NO: 1165330 - protein, 9 aa, Homo Sapiens
DKLEELLRS

SEQ ID NO: 1165331 - protein, 9 aa, Homo Sapiens
SGHHPPAQP

SEQ ID NO: 1165332 - protein, 9 aa, Homo Sapiens
CRLENETCM

SEQ ID NO: 1165333 - protein, 9 aa, Homo Sapiens
ARDNYRANK

SEQ ID NO: 1165334 - protein, 9 aa, Homo Sapiens
RTTSTRECP

SEQ ID NO: 1165335 - protein, 9 aa, Homo Sapiens
SHCQLCSPV

SEQ ID NO: 1165336 - protein, 9 aa, Homo Sapiens
GHQAPQVAM

SEQ ID NO: 1165337 - protein, 9 aa, Homo Sapiens
YKNMVGEWV

SEQ ID NO: 1165338 - protein, 9 aa, Homo Sapiens
EQRLTPTSA

SEQ ID NO: 1165339 - protein, 9 aa, Homo Sapiens
DLDYGYGCG

SEQ ID NO: 1165340 - protein, 9 aa, Homo Sapiens
GSEWRQRSI

SEQ ID NO: 1165341 - protein, 9 aa, Homo Sapiens
GDPDAVVAS

SEQ ID NO: 1165342 - protein, 9 aa, Homo Sapiens
LCCGRAERD

SEQ ID NO: 1165343 - protein, 9 aa, Homo Sapiens
LAVAFLLQA

SEQ ID NO: 1165344 - protein, 9 aa, Homo Sapiens
RVGSVHRMV

SEQ ID NO: 1165345 - protein, 9 aa, Homo Sapiens
VGKARRRNA

SEQ ID NO: 1165346 - protein, 9 aa, Homo Sapiens
ECCSSWLRR

SEQ ID NO: 1165347 - protein, 9 aa, Homo Sapiens
PRQGSREPP

SEQ ID NO: 1165348 - protein, 9 aa, Homo Sapiens
GSDLGGPCP

SEQ ID NO: 1165349 - protein, 9 aa, Homo Sapiens
LRRCLCTGY

SEQ ID NO: 1165350 - protein, 9 aa, Homo Sapiens
GFFTPCLIK

SEQ ID NO: 1165351 - protein, 9 aa, Homo Sapiens
PCEKYRARH

SEQ ID NO: 1165352 - protein, 9 aa, Homo Sapiens
QKEPREFGW

SEQ ID NO: 1165353 - protein, 9 aa, Homo Sapiens
SYSYMTPSQ

SEQ ID NO: 1165354 - protein, 9 aa, Homo Sapiens
PTAQASCWT

SEQ ID NO: 1165355 - protein, 9 aa, Homo Sapiens
EIVKLRKDL

SEQ ID NO: 1165356 - protein, 9 aa, Homo Sapiens
PLAPLGPAV

SEQ ID NO: 1165357 - protein, 9 aa, Homo Sapiens
PVAFFFSGW

SEQ ID NO: 1165358 - protein, 9 aa, Homo Sapiens
NFSCQWPTE

SEQ ID NO: 1165359 - protein, 9 aa, Homo Sapiens
GRHRGLGGH

SEQ ID NO: 1165360 - protein, 9 aa, Homo Sapiens
YTPMRNIME

SEQ ID NO: 1165361 - protein, 9 aa, Homo Sapiens
INIFTKIWR

SEQ ID NO: 1165362 - protein, 9 aa, Homo Sapiens
NYSAAPKKK

SEQ ID NO: 1165363 - protein, 9 aa, Homo Sapiens
PDCGRLSPS

SEQ ID NO: 1165364 - protein, 9 aa, Homo Sapiens
ASHVGGVRR

SEQ ID NO: 1165365 - protein, 9 aa, Homo Sapiens
AMYWSDWGN

SEQ ID NO: 1165366 - protein, 9 aa, Homo Sapiens
SNNWNSSTQ

SEQ ID NO: 1165367 - protein, 9 aa, Homo Sapiens
WILIEYQKM

SEQ ID NO: 1165368 - protein, 9 aa, Homo Sapiens
SQRRFLVVI

SEQ ID NO: 1165369 - protein, 9 aa, Homo Sapiens
GDRGCSCFL

SEQ ID NO: 1165370 - protein, 9 aa, Homo Sapiens
EGNRNHNYL

SEQ ID NO: 1165371 - protein, 9 aa, Homo Sapiens
KRFGFWRDE

SEQ ID NO: 1165372 - protein, 9 aa, Homo Sapiens
IPVGIIIPG

SEQ ID NO: 1165373 - protein, 9 aa, Homo Sapiens
DQGGAAQLN

SEQ ID NO: 1165374 - protein, 9 aa, Homo Sapiens
RRWPPRTPL

SEQ ID NO: 1165375 - protein, 9 aa, Homo Sapiens
HIPLCPKHW

SEQ ID NO: 1165376 - protein, 9 aa, Homo Sapiens
SLPKVSYVN

SEQ ID NO: 1165377 - protein, 9 aa, Homo Sapiens
HPARRPPVA

SEQ ID NO: 1165378 - protein, 9 aa, Homo Sapiens
RYLSGIKDN

SEQ ID NO: 1165379 - protein, 9 aa, Homo Sapiens
CNRIAAVIS

SEQ ID NO: 1165380 - protein, 9 aa, Homo Sapiens
NRQLLDKYV

SEQ ID NO: 1165381 - protein, 9 aa, Homo Sapiens
VRAGEAGVI

SEQ ID NO: 1165382 - protein, 9 aa, Homo Sapiens
GPWGVVDLT

SEQ ID NO: 1165383 - protein, 9 aa, Homo Sapiens
VCEHAAAPV

SEQ ID NO: 1165384 - protein, 9 aa, Homo Sapiens
CSSWLRRIE

SEQ ID NO: 1165385 - protein, 9 aa, Homo Sapiens
SEGFYSIQI

SEQ ID NO: 1165386 - protein, 9 aa, Homo Sapiens
IFALKLVLV

SEQ ID NO: 1165387 - protein, 9 aa, Homo Sapiens
CRRARIRDC

SEQ ID NO: 1165388 - protein, 9 aa, Homo Sapiens
RSARTFVPS

SEQ ID NO: 1165389 - protein, 9 aa, Homo Sapiens
RDPARGPAP

SEQ ID NO: 1165390 - protein, 9 aa, Homo Sapiens
GTRASSPTC

SEQ ID NO: 1165391 - protein, 9 aa, Homo Sapiens
APSLWKTKK

SEQ ID NO: 1165392 - protein, 9 aa, Homo Sapiens
LYHIELLRR

SEQ ID NO: 1165393 - protein, 9 aa, Homo Sapiens
PPALVAPRG

SEQ ID NO: 1165394 - protein, 9 aa, Homo Sapiens
EHNVPEEKT

SEQ ID NO: 1165395 - protein, 9 aa, Homo Sapiens
KKQNALAEH

SEQ ID NO: 1165396 - protein, 9 aa, Homo Sapiens
TLGSMLAVA

SEQ ID NO: 1165397 - protein, 9 aa, Homo Sapiens
WDLDFLGSC

SEQ ID NO: 1165398 - protein, 9 aa, Homo Sapiens
NLWMPSTKI

SEQ ID NO: 1165399 - protein, 9 aa, Homo Sapiens
PPGAHYQQP

SEQ ID NO: 1165400 - protein, 9 aa, Homo Sapiens
RDCGAWPPP

SEQ ID NO: 1165401 - protein, 9 aa, Homo Sapiens
IFAPSLEML

SEQ ID NO: 1165402 - protein, 9 aa, Homo Sapiens
VVTLWYRPS

SEQ ID NO: 1165403 - protein, 9 aa, Homo Sapiens
CQLCSPVAR

SEQ ID NO: 1165404 - protein, 9 aa, Homo Sapiens
TSLAQKPNK

SEQ ID NO: 1165405 - protein, 9 aa, Homo Sapiens
SVAPPIECV

SEQ ID NO: 1165406 - protein, 9 aa, Homo Sapiens
LPYHSNLEK

SEQ ID NO: 1165407 - protein, 9 aa, Homo Sapiens
PCTALASGC

SEQ ID NO: 1165408 - protein, 9 aa, Homo Sapiens
RRRYLSGIK

SEQ ID NO: 1165409 - protein, 9 aa, Homo Sapiens
RLDQDINTT

SEQ ID NO: 1165410 - protein, 9 aa, Homo Sapiens
DSVGGLSDH

SEQ ID NO: 1165411 - protein, 9 aa, Homo Sapiens
ACAASERLQ

SEQ ID NO: 1165412 - protein, 9 aa, Homo Sapiens
LGRTREEPC

SEQ ID NO: 1165413 - protein, 9 aa, Homo Sapiens
YNIYGIESV

SEQ ID NO: 1165414 - protein, 9 aa, Homo Sapiens
AVLVVSGGV

SEQ ID NO: 1165415 - protein, 9 aa, Homo Sapiens
SDGHGSCSW

SEQ ID NO: 1165416 - protein, 9 aa, Homo Sapiens
KTKKSPSRV

SEQ ID NO: 1165417 - protein, 9 aa, Homo Sapiens
VTDFTSEAT

SEQ ID NO: 1165418 - protein, 9 aa, Homo Sapiens
PVGIIIPGH

SEQ ID NO: 1165419 - protein, 9 aa, Homo Sapiens
YWASGKFEL

SEQ ID NO: 1165420 - protein, 9 aa, Homo Sapiens
CLRRRLRVG

SEQ ID NO: 1165421 - protein, 9 aa, Homo Sapiens
EYYRNHVSF

SEQ ID NO: 1165422 - protein, 9 aa, Homo Sapiens
GLENMVAET

SEQ ID NO: 1165423 - protein, 9 aa, Homo Sapiens
AGADGPPRP

SEQ ID NO: 1165424 - protein, 9 aa, Homo Sapiens
QVDEEMFSV

SEQ ID NO: 1165425 - protein, 9 aa, Homo Sapiens
WSYKPQLNY

SEQ ID NO: 1165426 - protein, 9 aa, Homo Sapiens
GEPALTATT

SEQ ID NO: 1165427 - protein, 9 aa, Homo Sapiens
WQWPFGELM

SEQ ID NO: 1165428 - protein, 9 aa, Homo Sapiens
RMTQEFLEY

SEQ ID NO: 1165429 - protein, 9 aa, Homo Sapiens
RGLVWGVDC

SEQ ID NO: 1165430 - protein, 9 aa, Homo Sapiens
TFDYQSKML

SEQ ID NO: 1165431 - protein, 9 aa, Homo Sapiens
QEWYRQQVS

SEQ ID NO: 1165432 - protein, 9 aa, Homo Sapiens
CGALRSGSP

SEQ ID NO: 1165433 - protein, 9 aa, Homo Sapiens
GAAGGSDPE

SEQ ID NO: 1165434 - protein, 9 aa, Homo Sapiens
IPGHHCWVH

SEQ ID NO: 1165435 - protein, 9 aa, Homo Sapiens
NELPNPAAH

SEQ ID NO: 1165436 - protein, 9 aa, Homo Sapiens
SSPIDVWVV

SEQ ID NO: 1165437 - protein, 9 aa, Homo Sapiens
PMTTALSVL

SEQ ID NO: 1165438 - protein, 9 aa, Homo Sapiens
AKKAKDTST

SEQ ID NO: 1165439 - protein, 9 aa, Homo Sapiens
RGSPGASRE

SEQ ID NO: 1165440 - protein, 9 aa, Homo Sapiens
AGPTTCSRW

SEQ ID NO: 1165441 - protein, 9 aa, Homo Sapiens
ALQDMARPP

SEQ ID NO: 1165442 - protein, 9 aa, Homo Sapiens
RRPARIQPR

SEQ ID NO: 1165443 - protein, 9 aa, Homo Sapiens
LETPARWAT

SEQ ID NO: 1165444 - protein, 9 aa, Homo Sapiens
PEFLASSPL

SEQ ID NO: 1165445 - protein, 9 aa, Homo Sapiens
FHWNWVGTI

SEQ ID NO: 1165446 - protein, 9 aa, Homo Sapiens
LVTEGNRNH

SEQ ID NO: 1165447 - protein, 9 aa, Homo Sapiens
AGVQDGLSV

SEQ ID NO: 1165448 - protein, 9 aa, Homo Sapiens
LPQAPRTKP

SEQ ID NO: 1165449 - protein, 9 aa, Homo Sapiens
PFEVPNPCR

SEQ ID NO: 1165450 - protein, 9 aa, Homo Sapiens
APRCCLCQG

SEQ ID NO: 1165451 - protein, 9 aa, Homo Sapiens
GANVAMQNH

SEQ ID NO: 1165452 - protein, 9 aa, Homo Sapiens
MLQDTQKQL

SEQ ID NO: 1165453 - protein, 9 aa, Homo Sapiens
IHTDKKPYT

SEQ ID NO: 1165454 - protein, 9 aa, Homo Sapiens
HQGGERNLK

SEQ ID NO: 1165455 - protein, 9 aa, Homo Sapiens
QSIHGVRHP

SEQ ID NO: 1165456 - protein, 9 aa, Homo Sapiens
LKTFSLLLL

SEQ ID NO: 1165457 - protein, 9 aa, Homo Sapiens
DDTSAWRTP

SEQ ID NO: 1165458 - protein, 9 aa, Homo Sapiens
STTLDSGVY

SEQ ID NO: 1165459 - protein, 9 aa, Homo Sapiens
VVLADASFH

SEQ ID NO: 1165460 - protein, 9 aa, Homo Sapiens
SPVIAASPA

SEQ ID NO: 1165461 - protein, 9 aa, Homo Sapiens
LIVREVPLT

SEQ ID NO: 1165462 - protein, 9 aa, Homo Sapiens
ISKVGKEIK

SEQ ID NO: 1165463 - protein, 9 aa, Homo Sapiens
MDPMDGNTT

SEQ ID NO: 1165464 - protein, 9 aa, Homo Sapiens
PGKMNQQLN

SEQ ID NO: 1165465 - protein, 9 aa, Homo Sapiens
SPTHLFHTD

SEQ ID NO: 1165466 - protein, 9 aa, Homo Sapiens
PLPVPDVGI

SEQ ID NO: 1165467 - protein, 9 aa, Homo Sapiens
PPAPPEIYY

SEQ ID NO: 1165468 - protein, 9 aa, Homo Sapiens
VRMRALYDY

SEQ ID NO: 1165469 - protein, 9 aa, Homo Sapiens
GSPNSLLIC

SEQ ID NO: 1165470 - protein, 9 aa, Homo Sapiens
GTPHPAPPP

SEQ ID NO: 1165471 - protein, 9 aa, Homo Sapiens
AWKNSWIQL

SEQ ID NO: 1165472 - protein, 9 aa, Homo Sapiens
FKTIRATTD

SEQ ID NO: 1165473 - protein, 9 aa, Homo Sapiens
SQYASETKM

SEQ ID NO: 1165474 - protein, 9 aa, Homo Sapiens
KLWATGGNR

SEQ ID NO: 1165475 - protein, 9 aa, Homo Sapiens
QASGGPRYP

SEQ ID NO: 1165476 - protein, 9 aa, Homo Sapiens
ARARTCSPC

SEQ ID NO: 1165477 - protein, 9 aa, Homo Sapiens
SSIVIGERT

SEQ ID NO: 1165478 - protein, 9 aa, Homo Sapiens
RSQIEKHKA

SEQ ID NO: 1165479 - protein, 9 aa, Homo Sapiens
DRHRTLNIS

SEQ ID NO: 1165480 - protein, 9 aa, Homo Sapiens
IGSFSVRLF

SEQ ID NO: 1165481 - protein, 9 aa, Homo Sapiens
HWPMRLHPC

SEQ ID NO: 1165482 - protein, 9 aa, Homo Sapiens
SAVAAPPAA

SEQ ID NO: 1165483 - protein, 9 aa, Homo Sapiens
LQKTGIASY

SEQ ID NO: 1165484 - protein, 9 aa, Homo Sapiens
DLTFVATLP

SEQ ID NO: 1165485 - protein, 9 aa, Homo Sapiens
DWWAILLHV

SEQ ID NO: 1165486 - protein, 9 aa, Homo Sapiens
GQGKPKADM

SEQ ID NO: 1165487 - protein, 9 aa, Homo Sapiens
MATRGEEAV

SEQ ID NO: 1165488 - protein, 9 aa, Homo Sapiens
RKLLVAVEP

SEQ ID NO: 1165489 - protein, 9 aa, Homo Sapiens
GPSGFPGRG

SEQ ID NO: 1165490 - protein, 9 aa, Homo Sapiens
RARQSCCLP

SEQ ID NO: 1165491 - protein, 9 aa, Homo Sapiens
CSWQPLRQA

SEQ ID NO: 1165492 - protein, 9 aa, Homo Sapiens
KNSQNLKSE

SEQ ID NO: 1165493 - protein, 9 aa, Homo Sapiens
QGGTRVIFD

SEQ ID NO: 1165494 - protein, 9 aa, Homo Sapiens
HRFGDDVIL

SEQ ID NO: 1165495 - protein, 9 aa, Homo Sapiens
NICTLLSNE

SEQ ID NO: 1165496 - protein, 9 aa, Homo Sapiens
PLLWKVHYQ

SEQ ID NO: 1165497 - protein, 9 aa, Homo Sapiens
APKLQCQYR

SEQ ID NO: 1165498 - protein, 9 aa, Homo Sapiens
EGMCQYGEC

SEQ ID NO: 1165499 - protein, 9 aa, Homo Sapiens
LSMEDFLKT

SEQ ID NO: 1165500 - protein, 9 aa, Homo Sapiens
CGSSIEHPD

SEQ ID NO: 1165501 - protein, 9 aa, Homo Sapiens
KTIQIAIID

SEQ ID NO: 1165502 - protein, 9 aa, Homo Sapiens
LMWAGLALL

SEQ ID NO: 1165503 - protein, 9 aa, Homo Sapiens
LEPPLPPAP

SEQ ID NO: 1165504 - protein, 9 aa, Homo Sapiens
ASRATLARW

SEQ ID NO: 1165505 - protein, 9 aa, Homo Sapiens
KSTSFLLIP

SEQ ID NO: 1165506 - protein, 9 aa, Homo Sapiens
LGYPHHCPR

SEQ ID NO: 1165507 - protein, 9 aa, Homo Sapiens
DMLPKGAAS

SEQ ID NO: 1165508 - protein, 9 aa, Homo Sapiens
VLLIRTELS

SEQ ID NO: 1165509 - protein, 9 aa, Homo Sapiens
LTSTTPRAS

SEQ ID NO: 1165510 - protein, 9 aa, Homo Sapiens
PSCPIPRRD

SEQ ID NO: 1165511 - protein, 9 aa, Homo Sapiens
GQASLQLHA

SEQ ID NO: 1165512 - protein, 9 aa, Homo Sapiens
PRQGDGGAG

SEQ ID NO: 1165513 - protein, 9 aa, Homo Sapiens
DMILLTFTF

SEQ ID NO: 1165514 - protein, 9 aa, Homo Sapiens
LNARLAKVV

SEQ ID NO: 1165515 - protein, 9 aa, Homo Sapiens
VVTSVKEMD

SEQ ID NO: 1165516 - protein, 9 aa, Homo Sapiens
GKAFIPGLP

SEQ ID NO: 1165517 - protein, 9 aa, Homo Sapiens
VLFASRPAS

SEQ ID NO: 1165518 - protein, 9 aa, Homo Sapiens
RDMVRSMDR

SEQ ID NO: 1165519 - protein, 9 aa, Homo Sapiens
YGKFLGLWA

SEQ ID NO: 1165520 - protein, 9 aa, Homo Sapiens
MDDFAGKSC

SEQ ID NO: 1165521 - protein, 9 aa, Homo Sapiens
PAEPDVHGG

SEQ ID NO: 1165522 - protein, 9 aa, Homo Sapiens
LSSDGWLSP

SEQ ID NO: 1165523 - protein, 9 aa, Homo Sapiens
HRTSENTHR

SEQ ID NO: 1165524 - protein, 9 aa, Homo Sapiens
HFGVVTTRY

SEQ ID NO: 1165525 - protein, 9 aa, Homo Sapiens
IVRVGSVHR

SEQ ID NO: 1165526 - protein, 9 aa, Homo Sapiens
SILRGSWKF

SEQ ID NO: 1165527 - protein, 9 aa, Homo Sapiens
RNLRPSAVM

SEQ ID NO: 1165528 - protein, 9 aa, Homo Sapiens
STGPPAEPA

SEQ ID NO: 1165529 - protein, 9 aa, Homo Sapiens
VVGEIRRTT

SEQ ID NO: 1165530 - protein, 9 aa, Homo Sapiens
AFLRESSSL

SEQ ID NO: 1165531 - protein, 9 aa, Homo Sapiens
TPRRRLRRT

SEQ ID NO: 1165532 - protein, 9 aa, Homo Sapiens
QVSRAVNQA

SEQ ID NO: 1165533 - protein, 9 aa, Homo Sapiens
YMDMSSFNA

SEQ ID NO: 1165534 - protein, 9 aa, Homo Sapiens
FEWSNSLAS

SEQ ID NO: 1165535 - protein, 9 aa, Homo Sapiens
SAADPEQPQ

SEQ ID NO: 1165536 - protein, 9 aa, Homo Sapiens
YSYMTPSQP

SEQ ID NO: 1165537 - protein, 9 aa, Homo Sapiens
GLDNPVRSW

SEQ ID NO: 1165538 - protein, 9 aa, Homo Sapiens
QGFGGRHCE

SEQ ID NO: 1165539 - protein, 9 aa, Homo Sapiens
QTLLLKIMG

SEQ ID NO: 1165540 - protein, 9 aa, Homo Sapiens
PPVDLIHRD

SEQ ID NO: 1165541 - protein, 9 aa, Homo Sapiens
MGLRSITHF

SEQ ID NO: 1165542 - protein, 9 aa, Homo Sapiens
SHIQMTKRL

SEQ ID NO: 1165543 - protein, 9 aa, Homo Sapiens
RQEAEPPGG

SEQ ID NO: 1165544 - protein, 9 aa, Homo Sapiens
RAAAARGAG

SEQ ID NO: 1165545 - protein, 9 aa, Homo Sapiens
PPLPPAPSP

SEQ ID NO: 1165546 - protein, 9 aa, Homo Sapiens
ADAQNMGAV

SEQ ID NO: 1165547 - protein, 9 aa, Homo Sapiens
KKLQGAPPR

SEQ ID NO: 1165548 - protein, 9 aa, Homo Sapiens
FTQQGPRLW

SEQ ID NO: 1165549 - protein, 9 aa, Homo Sapiens
DIGSERYTF

SEQ ID NO: 1165550 - protein, 9 aa, Homo Sapiens
WRPPTPSRL

SEQ ID NO: 1165551 - protein, 9 aa, Homo Sapiens
TSGRSLSCC

SEQ ID NO: 1165552 - protein, 9 aa, Homo Sapiens
KNNIAAFPD

SEQ ID NO: 1165553 - protein, 9 aa, Homo Sapiens
LVKTWTQFR

SEQ ID NO: 1165554 - protein, 9 aa, Homo Sapiens
RGSRACRGC

SEQ ID NO: 1165555 - protein, 9 aa, Homo Sapiens
KRKGSFFPL

SEQ ID NO: 1165556 - protein, 9 aa, Homo Sapiens
WVLPPVPTE

SEQ ID NO: 1165557 - protein, 9 aa, Homo Sapiens
HEQIGPEAD

SEQ ID NO: 1165558 - protein, 9 aa, Homo Sapiens
APGRGRGAR

SEQ ID NO: 1165559 - protein, 9 aa, Homo Sapiens
VTAAAEADA

SEQ ID NO: 1165560 - protein, 9 aa, Homo Sapiens
LDSVETCNP

SEQ ID NO: 1165561 - protein, 9 aa, Homo Sapiens
VRERAKLQI

SEQ ID NO: 1165562 - protein, 9 aa, Homo Sapiens
KKILSGKRS

SEQ ID NO: 1165563 - protein, 9 aa, Homo Sapiens
QAAASKLGE

SEQ ID NO: 1165564 - protein, 9 aa, Homo Sapiens
PAVIEASAS

SEQ ID NO: 1165565 - protein, 9 aa, Homo Sapiens
DDAPDDQDH

SEQ ID NO: 1165566 - protein, 9 aa, Homo Sapiens
VGLRVHIAH

SEQ ID NO: 1165567 - protein, 9 aa, Homo Sapiens
GSLPPIRDP

SEQ ID NO: 1165568 - protein, 9 aa, Homo Sapiens
GINHCDWPI

SEQ ID NO: 1165569 - protein, 9 aa, Homo Sapiens
VPSGSCAPR

SEQ ID NO: 1165570 - protein, 9 aa, Homo Sapiens
LVAPLITRL

SEQ ID NO: 1165571 - protein, 9 aa, Homo Sapiens
SVTYGGSDD

SEQ ID NO: 1165572 - protein, 9 aa, Homo Sapiens
VLSPVRSGA

SEQ ID NO: 1165573 - protein, 9 aa, Homo Sapiens
PQTQVIEHI

SEQ ID NO: 1165574 - protein, 9 aa, Homo Sapiens
AVTAGPEEA

SEQ ID NO: 1165575 - protein, 9 aa, Homo Sapiens
DIIFHTTAA

SEQ ID NO: 1165576 - protein, 9 aa, Homo Sapiens
HGAAQNLAV

SEQ ID NO: 1165577 - protein, 9 aa, Homo Sapiens
LEKDSGTQR

SEQ ID NO: 1165578 - protein, 9 aa, Homo Sapiens
AISFHLLIN

SEQ ID NO: 1165579 - protein, 9 aa, Homo Sapiens
LERYLDGLT

SEQ ID NO: 1165580 - protein, 9 aa, Homo Sapiens
RALRPTASS

SEQ ID NO: 1165581 - protein, 9 aa, Homo Sapiens
CTAWCCQSG

SEQ ID NO: 1165582 - protein, 9 aa, Homo Sapiens
ESSTTLDSG

SEQ ID NO: 1165583 - protein, 9 aa, Homo Sapiens
PKPSLRPSS

SEQ ID NO: 1165584 - protein, 9 aa, Homo Sapiens
AQDVLRFSS

SEQ ID NO: 1165585 - protein, 9 aa, Homo Sapiens
ATSNSRHPP

SEQ ID NO: 1165586 - protein, 9 aa, Homo Sapiens
WCAWAWSAS

SEQ ID NO: 1165587 - protein, 9 aa, Homo Sapiens
KAGLENMVA

SEQ ID NO: 1165588 - protein, 9 aa, Homo Sapiens
DKPFDLRIY

SEQ ID NO: 1165589 - protein, 9 aa, Homo Sapiens
QNLHTAMRR

SEQ ID NO: 1165590 - protein, 9 aa, Homo Sapiens
RMSLMPCGV

SEQ ID NO: 1165591 - protein, 9 aa, Homo Sapiens
PWRGRRPPP

SEQ ID NO: 1165592 - protein, 9 aa, Homo Sapiens
VIFYVSWLQ

SEQ ID NO: 1165593 - protein, 9 aa, Homo Sapiens
WAAMDICAT

SEQ ID NO: 1165594 - protein, 9 aa, Homo Sapiens
LGPYQPGRQ

SEQ ID NO: 1165595 - protein, 9 aa, Homo Sapiens
AVGTKYRMP

SEQ ID NO: 1165596 - protein, 9 aa, Homo Sapiens
INTTKADVE

SEQ ID NO: 1165597 - protein, 9 aa, Homo Sapiens
CELLYLSTE

SEQ ID NO: 1165598 - protein, 9 aa, Homo Sapiens
SLSLRVGSG

SEQ ID NO: 1165599 - protein, 9 aa, Homo Sapiens
ALPTRGAGE

SEQ ID NO: 1165600 - protein, 9 aa, Homo Sapiens
LWNQGTGLL

SEQ ID NO: 1165601 - protein, 9 aa, Homo Sapiens
LCARLHATH

SEQ ID NO: 1165602 - protein, 9 aa, Homo Sapiens
FWFFQRHKL

SEQ ID NO: 1165603 - protein, 9 aa, Homo Sapiens
ALNKVLRRE

SEQ ID NO: 1165604 - protein, 9 aa, Homo Sapiens
PCLIKKTLG

SEQ ID NO: 1165605 - protein, 9 aa, Homo Sapiens
LEGVQLVRQ

SEQ ID NO: 1165606 - protein, 9 aa, Homo Sapiens
LWTIRLPRK

SEQ ID NO: 1165607 - protein, 9 aa, Homo Sapiens
VIFLDTLVR

SEQ ID NO: 1165608 - protein, 9 aa, Homo Sapiens
AVGRRGPDG

SEQ ID NO: 1165609 - protein, 9 aa, Homo Sapiens
AHRIHPATP

SEQ ID NO: 1165610 - protein, 9 aa, Homo Sapiens
PYIEVICQN

SEQ ID NO: 1165611 - protein, 9 aa, Homo Sapiens
LTKNGNFLE

SEQ ID NO: 1165612 - protein, 9 aa, Homo Sapiens
DESISLSLE

SEQ ID NO: 1165613 - protein, 9 aa, Homo Sapiens
QHSPNCWYL

SEQ ID NO: 1165614 - protein, 9 aa, Homo Sapiens
SQYYFRIAS

SEQ ID NO: 1165615 - protein, 9 aa, Homo Sapiens
RRRPRRRAA

SEQ ID NO: 1165616 - protein, 9 aa, Homo Sapiens
GGAPGSEPQ

SEQ ID NO: 1165617 - protein, 9 aa, Homo Sapiens
PENEAPQCP

SEQ ID NO: 1165618 - protein, 9 aa, Homo Sapiens
SATSNSRHP

SEQ ID NO: 1165619 - protein, 9 aa, Homo Sapiens
FKRTRTRIT

SEQ ID NO: 1165620 - protein, 9 aa, Homo Sapiens
NPHRLRRRK

SEQ ID NO: 1165621 - protein, 9 aa, Homo Sapiens
PMKMGRCSC

SEQ ID NO: 1165622 - protein, 9 aa, Homo Sapiens
LTLSALPLR

SEQ ID NO: 1165623 - protein, 9 aa, Homo Sapiens
EQQLGAGAA

SEQ ID NO: 1165624 - protein, 9 aa, Homo Sapiens
RTREGPSSC

SEQ ID NO: 1165625 - protein, 9 aa, Homo Sapiens
AVSQSQAAP

SEQ ID NO: 1165626 - protein, 9 aa, Homo Sapiens
KTVYANSHQ

SEQ ID NO: 1165627 - protein, 9 aa, Homo Sapiens
QLSYLLFGT

SEQ ID NO: 1165628 - protein, 9 aa, Homo Sapiens
REKGLKTRL

SEQ ID NO: 1165629 - protein, 9 aa, Homo Sapiens
FKVVTSVKE

SEQ ID NO: 1165630 - protein, 9 aa, Homo Sapiens
PRGSSSCSA

SEQ ID NO: 1165631 - protein, 9 aa, Homo Sapiens
PAVLEPDLH

SEQ ID NO: 1165632 - protein, 9 aa, Homo Sapiens
FLQPSPQTP

SEQ ID NO: 1165633 - protein, 9 aa, Homo Sapiens
FLLLSTWVL

SEQ ID NO: 1165634 - protein, 9 aa, Homo Sapiens
GITVFLTGF

SEQ ID NO: 1165635 - protein, 9 aa, Homo Sapiens
GRHRPFIWA

SEQ ID NO: 1165636 - protein, 9 aa, Homo Sapiens
SCVLYPNDN

SEQ ID NO: 1165637 - protein, 9 aa, Homo Sapiens
LDDINFDIR

SEQ ID NO: 1165638 - protein, 9 aa, Homo Sapiens
AVDFRNYHL

SEQ ID NO: 1165639 - protein, 9 aa, Homo Sapiens
DGHWYKEGS

SEQ ID NO: 1165640 - protein, 9 aa, Homo Sapiens
LGTAVPVEL

SEQ ID NO: 1165641 - protein, 9 aa, Homo Sapiens
VLQHHDTVS

SEQ ID NO: 1165642 - protein, 9 aa, Homo Sapiens
LWFLVSFQP

SEQ ID NO: 1165643 - protein, 9 aa, Homo Sapiens
LEATPSDSV

SEQ ID NO: 1165644 - protein, 9 aa, Homo Sapiens
ALCPSCRSL

SEQ ID NO: 1165645 - protein, 9 aa, Homo Sapiens
EHSETSRQS

SEQ ID NO: 1165646 - protein, 9 aa, Homo Sapiens
ALTITGICV

SEQ ID NO: 1165647 - protein, 9 aa, Homo Sapiens
FFCTGSSCH

SEQ ID NO: 1165648 - protein, 9 aa, Homo Sapiens
RIDKVGGIY

SEQ ID NO: 1165649 - protein, 9 aa, Homo Sapiens
SSAACTPSR

SEQ ID NO: 1165650 - protein, 9 aa, Homo Sapiens
NSSNWKQDG

SEQ ID NO: 1165651 - protein, 9 aa, Homo Sapiens
YTATVTKGD

SEQ ID NO: 1165652 - protein, 9 aa, Homo Sapiens
ESHHQPQTC

SEQ ID NO: 1165653 - protein, 9 aa, Homo Sapiens
AEQRFWKKR

SEQ ID NO: 1165654 - protein, 9 aa, Homo Sapiens
EVLLIRTEL

SEQ ID NO: 1165655 - protein, 9 aa, Homo Sapiens
QRDEQLQAL

SEQ ID NO: 1165656 - protein, 9 aa, Homo Sapiens
SFMVSWPSR

SEQ ID NO: 1165657 - protein, 9 aa, Homo Sapiens
FVQVKRGPG

SEQ ID NO: 1165658 - protein, 9 aa, Homo Sapiens
WLNASRDKI

SEQ ID NO: 1165659 - protein, 9 aa, Homo Sapiens
YELVKEAID

SEQ ID NO: 1165660 - protein, 9 aa, Homo Sapiens
YMGKVPCNV

SEQ ID NO: 1165661 - protein, 9 aa, Homo Sapiens
QEEDMPRPS

SEQ ID NO: 1165662 - protein, 9 aa, Homo Sapiens
QCPSCMPSG

SEQ ID NO: 1165663 - protein, 9 aa, Homo Sapiens
WPWRGRRPP

SEQ ID NO: 1165664 - protein, 9 aa, Homo Sapiens
GGALLYSVK

SEQ ID NO: 1165665 - protein, 9 aa, Homo Sapiens
LFQPYIEVI

SEQ ID NO: 1165666 - protein, 9 aa, Homo Sapiens
SQSTPGREG

SEQ ID NO: 1165667 - protein, 9 aa, Homo Sapiens
RESVLRWEQ

SEQ ID NO: 1165668 - protein, 9 aa, Homo Sapiens
VVLVAVPGV

SEQ ID NO: 1165669 - protein, 9 aa, Homo Sapiens
YMTPSQPIT

SEQ ID NO: 1165670 - protein, 9 aa, Homo Sapiens
EDAPQLSYS

SEQ ID NO: 1165671 - protein, 9 aa, Homo Sapiens
IRFLQMYSF

SEQ ID NO: 1165672 - protein, 9 aa, Homo Sapiens
SGAAPRPHP

SEQ ID NO: 1165673 - protein, 9 aa, Homo Sapiens
VLDHGLILQ

SEQ ID NO: 1165674 - protein, 9 aa, Homo Sapiens
LPNSRLTGH

SEQ ID NO: 1165675 - protein, 9 aa, Homo Sapiens
EDGAQFPLD

SEQ ID NO: 1165676 - protein, 9 aa, Homo Sapiens
RTLYHIELL

SEQ ID NO: 1165677 - protein, 9 aa, Homo Sapiens
INIADFLLW

SEQ ID NO: 1165678 - protein, 9 aa, Homo Sapiens
AQADQSVYA

SEQ ID NO: 1165679 - protein, 9 aa, Homo Sapiens
RDKIKSDHP

SEQ ID NO: 1165680 - protein, 9 aa, Homo Sapiens
NVCRRFRAS

SEQ ID NO: 1165681 - protein, 9 aa, Homo Sapiens
PTGRRPASG

SEQ ID NO: 1165682 - protein, 9 aa, Homo Sapiens
AHHPGRAGG

SEQ ID NO: 1165683 - protein, 9 aa, Homo Sapiens
LGRSRTSTS

SEQ ID NO: 1165684 - protein, 9 aa, Homo Sapiens
DEWRWMVLA

SEQ ID NO: 1165685 - protein, 9 aa, Homo Sapiens
QINQYCNLV

SEQ ID NO: 1165686 - protein, 9 aa, Homo Sapiens
MGAGEVGNF

SEQ ID NO: 1165687 - protein, 9 aa, Homo Sapiens
CGRLSPSPA

SEQ ID NO: 1165688 - protein, 9 aa, Homo Sapiens
CLVWRTPGG

SEQ ID NO: 1165689 - protein, 9 aa, Homo Sapiens
FTGGTLAIR

SEQ ID NO: 1165690 - protein, 9 aa, Homo Sapiens
LPSQRGIIP

SEQ ID NO: 1165691 - protein, 9 aa, Homo Sapiens
LFDFLSVGP

SEQ ID NO: 1165692 - protein, 9 aa, Homo Sapiens
LPTLSTLQQ

SEQ ID NO: 1165693 - protein, 9 aa, Homo Sapiens
WLKRQATFD

SEQ ID NO: 1165694 - protein, 9 aa, Homo Sapiens
FLAAMADDR

SEQ ID NO: 1165695 - protein, 9 aa, Homo Sapiens
KVGTIQRWL

SEQ ID NO: 1165696 - protein, 9 aa, Homo Sapiens
PILAPPAPG

SEQ ID NO: 1165697 - protein, 9 aa, Homo Sapiens
PLPASLGRP

SEQ ID NO: 1165698 - protein, 9 aa, Homo Sapiens
SLAMARPME

SEQ ID NO: 1165699 - protein, 9 aa, Homo Sapiens
NLTSSYKAE

SEQ ID NO: 1165700 - protein, 9 aa, Homo Sapiens
HQRSHVGKT

SEQ ID NO: 1165701 - protein, 9 aa, Homo Sapiens
QPKSKPTTG

SEQ ID NO: 1165702 - protein, 9 aa, Homo Sapiens
IQVWPAYLE

SEQ ID NO: 1165703 - protein, 9 aa, Homo Sapiens
YQKTWRVIL

SEQ ID NO: 1165704 - protein, 9 aa, Homo Sapiens
GGLVVADLV

SEQ ID NO: 1165705 - protein, 9 aa, Homo Sapiens
AGSAADPEQ

SEQ ID NO: 1165706 - protein, 9 aa, Homo Sapiens
WRLWSWAAM

SEQ ID NO: 1165707 - protein, 9 aa, Homo Sapiens
PKRQGDFCI

SEQ ID NO: 1165708 - protein, 9 aa, Homo Sapiens
ARRRRRPRR

SEQ ID NO: 1165709 - protein, 9 aa, Homo Sapiens
RIIHTGENP

SEQ ID NO: 1165710 - protein, 9 aa, Homo Sapiens
QRRFLVVIL

SEQ ID NO: 1165711 - protein, 9 aa, Homo Sapiens
FSMWDRDHD

SEQ ID NO: 1165712 - protein, 9 aa, Homo Sapiens
DDNCTLENE

SEQ ID NO: 1165713 - protein, 9 aa, Homo Sapiens
VILQDCPAG

SEQ ID NO: 1165714 - protein, 9 aa, Homo Sapiens
VDFFIEHKT

SEQ ID NO: 1165715 - protein, 9 aa, Homo Sapiens
LPTGTDHIR

SEQ ID NO: 1165716 - protein, 9 aa, Homo Sapiens
KGRMLIPCY

SEQ ID NO: 1165717 - protein, 9 aa, Homo Sapiens
VTEGNRNHN

SEQ ID NO: 1165718 - protein, 9 aa, Homo Sapiens
TIHAMKYPL

SEQ ID NO: 1165719 - protein, 9 aa, Homo Sapiens
ARRSASSHD

SEQ ID NO: 1165720 - protein, 9 aa, Homo Sapiens
IEFRPVDCA

SEQ ID NO: 1165721 - protein, 9 aa, Homo Sapiens
GGRGISSHS

SEQ ID NO: 1165722 - protein, 9 aa, Homo Sapiens
CIQLSGGLL

SEQ ID NO: 1165723 - protein, 9 aa, Homo Sapiens
LAGRTATNT

SEQ ID NO: 1165724 - protein, 9 aa, Homo Sapiens
TAQNNVVWA

SEQ ID NO: 1165725 - protein, 9 aa, Homo Sapiens
LEELLRSLN

SEQ ID NO: 1165726 - protein, 9 aa, Homo Sapiens
GSSSRTPTR

SEQ ID NO: 1165727 - protein, 9 aa, Homo Sapiens
MSASPSSTP

SEQ ID NO: 1165728 - protein, 9 aa, Homo Sapiens
PGLTHPAHQ

SEQ ID NO: 1165729 - protein, 9 aa, Homo Sapiens
IVNILQELG

SEQ ID NO: 1165730 - protein, 9 aa, Homo Sapiens
WEELLKILQ

SEQ ID NO: 1165731 - protein, 9 aa, Homo Sapiens
TPTPAPPSC

SEQ ID NO: 1165732 - protein, 9 aa, Homo Sapiens
SPEWQDVHQ

SEQ ID NO: 1165733 - protein, 9 aa, Homo Sapiens
SEMPGDAQG

SEQ ID NO: 1165734 - protein, 9 aa, Homo Sapiens
YISRCAPPA

SEQ ID NO: 1165735 - protein, 9 aa, Homo Sapiens
PRQQHRHPR

SEQ ID NO: 1165736 - protein, 9 aa, Homo Sapiens
QLQALQERL

SEQ ID NO: 1165737 - protein, 9 aa, Homo Sapiens
SIRLCTHIK

SEQ ID NO: 1165738 - protein, 9 aa, Homo Sapiens
AARSHGNGE

SEQ ID NO: 1165739 - protein, 9 aa, Homo Sapiens
TPTFLARPL

SEQ ID NO: 1165740 - protein, 9 aa, Homo Sapiens
GGRKKRRRH

SEQ ID NO: 1165741 - protein, 9 aa, Homo Sapiens
PQGPLWLGV

SEQ ID NO: 1165742 - protein, 9 aa, Homo Sapiens
ILVLNVNKW

SEQ ID NO: 1165743 - protein, 9 aa, Homo Sapiens
VQASGGPWP

SEQ ID NO: 1165744 - protein, 9 aa, Homo Sapiens
PRPRCRPHQ

SEQ ID NO: 1165745 - protein, 9 aa, Homo Sapiens
RIKWKVAFS

SEQ ID NO: 1165746 - protein, 9 aa, Homo Sapiens
WKATWAFGT

SEQ ID NO: 1165747 - protein, 9 aa, Homo Sapiens
GALRSGSPG

SEQ ID NO: 1165748 - protein, 9 aa, Homo Sapiens
KGYSKLGVH

SEQ ID NO: 1165749 - protein, 9 aa, Homo Sapiens
CKKFMECDP

SEQ ID NO: 1165750 - protein, 9 aa, Homo Sapiens
TRELGARWD

SEQ ID NO: 1165751 - protein, 9 aa, Homo Sapiens
GRGQPEAAG

SEQ ID NO: 1165752 - protein, 9 aa, Homo Sapiens
SSVVPRMSS

SEQ ID NO: 1165753 - protein, 9 aa, Homo Sapiens
GQIPGIPFS

SEQ ID NO: 1165754 - protein, 9 aa, Homo Sapiens
TQINSQLQP

SEQ ID NO: 1165755 - protein, 9 aa, Homo Sapiens
NYKILVLHL

SEQ ID NO: 1165756 - protein, 9 aa, Homo Sapiens
KVYVLNEDK

SEQ ID NO: 1165757 - protein, 9 aa, Homo Sapiens
SQRAAAQEL

SEQ ID NO: 1165758 - protein, 9 aa, Homo Sapiens
NENYMGKVP

SEQ ID NO: 1165759 - protein, 9 aa, Homo Sapiens
SQDLQVEIE

SEQ ID NO: 1165760 - protein, 9 aa, Homo Sapiens
LHRLSPSTS

SEQ ID NO: 1165761 - protein, 9 aa, Homo Sapiens
RMCAYVRRN

SEQ ID NO: 1165762 - protein, 9 aa, Homo Sapiens
GLAQVSWPQ

SEQ ID NO: 1165763 - protein, 9 aa, Homo Sapiens
SHCTLTGLL

SEQ ID NO: 1165764 - protein, 9 aa, Homo Sapiens
MQRRRKILD

SEQ ID NO: 1165765 - protein, 9 aa, Homo Sapiens
SGSVLCFSG

SEQ ID NO: 1165766 - protein, 9 aa, Homo Sapiens
SAADLRKSL

SEQ ID NO: 1165767 - protein, 9 aa, Homo Sapiens
SARHREAVG

SEQ ID NO: 1165768 - protein, 9 aa, Homo Sapiens
PRCCLCQGG

SEQ ID NO: 1165769 - protein, 9 aa, Homo Sapiens
PADSSALYP

SEQ ID NO: 1165770 - protein, 9 aa, Homo Sapiens
QTGAKSEHR

SEQ ID NO: 1165771 - protein, 9 aa, Homo Sapiens
RGQPEAAGG

SEQ ID NO: 1165772 - protein, 9 aa, Homo Sapiens
LYPATTTSP

SEQ ID NO: 1165773 - protein, 9 aa, Homo Sapiens
TGNGPPTWP

SEQ ID NO: 1165774 - protein, 9 aa, Homo Sapiens
LDDFELPQA

SEQ ID NO: 1165775 - protein, 9 aa, Homo Sapiens
PPPTPTAWS

SEQ ID NO: 1165776 - protein, 9 aa, Homo Sapiens
GEAALEPRL

SEQ ID NO: 1165777 - protein, 9 aa, Homo Sapiens
LAYIAKIAE

SEQ ID NO: 1165778 - protein, 9 aa, Homo Sapiens
PEELPGNRR

SEQ ID NO: 1165779 - protein, 9 aa, Homo Sapiens
SFFTNVVPA

SEQ ID NO: 1165780 - protein, 9 aa, Homo Sapiens
DSRGSRETM

SEQ ID NO: 1165781 - protein, 9 aa, Homo Sapiens
GVIVGSAFE

SEQ ID NO: 1165782 - protein, 9 aa, Homo Sapiens
VTQNGRAAC

SEQ ID NO: 1165783 - protein, 9 aa, Homo Sapiens
RIPISKVGK

SEQ ID NO: 1165784 - protein, 9 aa, Homo Sapiens
WRSPTHLFH

SEQ ID NO: 1165785 - protein, 9 aa, Homo Sapiens
SPRSMSPST

SEQ ID NO: 1165786 - protein, 9 aa, Homo Sapiens
YIGILQNIP

SEQ ID NO: 1165787 - protein, 9 aa, Homo Sapiens
AARVTCVPR

SEQ ID NO: 1165788 - protein, 9 aa, Homo Sapiens
EVSHLEEKQ

SEQ ID NO: 1165789 - protein, 9 aa, Homo Sapiens
PALRSGANR

SEQ ID NO: 1165790 - protein, 9 aa, Homo Sapiens
VAGAPMGSS

SEQ ID NO: 1165791 - protein, 9 aa, Homo Sapiens
PANPSAAPH

SEQ ID NO: 1165792 - protein, 9 aa, Homo Sapiens
NVVPARWTC

SEQ ID NO: 1165793 - protein, 9 aa, Homo Sapiens
GAGCRPRCC

SEQ ID NO: 1165794 - protein, 9 aa, Homo Sapiens
WRTTSSASK

SEQ ID NO: 1165795 - protein, 9 aa, Homo Sapiens
HYTLVGSHA

SEQ ID NO: 1165796 - protein, 9 aa, Homo Sapiens
YGANVAMQN

SEQ ID NO: 1165797 - protein, 9 aa, Homo Sapiens
EKQMKGVLD

SEQ ID NO: 1165798 - protein, 9 aa, Homo Sapiens
RLLDRGSFQ

SEQ ID NO: 1165799 - protein, 9 aa, Homo Sapiens
LNAFMLYRK

SEQ ID NO: 1165800 - protein, 9 aa, Homo Sapiens
LAVHGLALR

SEQ ID NO: 1165801 - protein, 9 aa, Homo Sapiens
GFQHRASLV

SEQ ID NO: 1165802 - protein, 9 aa, Homo Sapiens
RAQAPRCCL

SEQ ID NO: 1165803 - protein, 9 aa, Homo Sapiens
SALFIWPQH

SEQ ID NO: 1165804 - protein, 9 aa, Homo Sapiens
TLQQQPGCT

SEQ ID NO: 1165805 - protein, 9 aa, Homo Sapiens
PCNRSSSLF

SEQ ID NO: 1165806 - protein, 9 aa, Homo Sapiens
QHPLLGWPA

SEQ ID NO: 1165807 - protein, 9 aa, Homo Sapiens
SEEQRAERG

SEQ ID NO: 1165808 - protein, 9 aa, Homo Sapiens
IMNLVKAAR

SEQ ID NO: 1165809 - protein, 9 aa, Homo Sapiens
LSWGSHEGV

SEQ ID NO: 1165810 - protein, 9 aa, Homo Sapiens
PKQWLYKHR

SEQ ID NO: 1165811 - protein, 9 aa, Homo Sapiens
RRCSISRAR

SEQ ID NO: 1165812 - protein, 9 aa, Homo Sapiens
PKHARTFVV

SEQ ID NO: 1165813 - protein, 9 aa, Homo Sapiens
TVIALITVL

SEQ ID NO: 1165814 - protein, 9 aa, Homo Sapiens
GVAHRIHPA

SEQ ID NO: 1165815 - protein, 9 aa, Homo Sapiens
SGIKDNNPY

SEQ ID NO: 1165816 - protein, 9 aa, Homo Sapiens
IHFEMEEAN

SEQ ID NO: 1165817 - protein, 9 aa, Homo Sapiens
VRFYPARCP

SEQ ID NO: 1165818 - protein, 9 aa, Homo Sapiens
AKMHRLWKK

SEQ ID NO: 1165819 - protein, 9 aa, Homo Sapiens
RAPGRGRGA

SEQ ID NO: 1165820 - protein, 9 aa, Homo Sapiens
VKKPPLVPV

SEQ ID NO: 1165821 - protein, 9 aa, Homo Sapiens
VQPFFEKEM

SEQ ID NO: 1165822 - protein, 9 aa, Homo Sapiens
SGKSACPSS

SEQ ID NO: 1165823 - protein, 9 aa, Homo Sapiens
CFFLVYSLV

SEQ ID NO: 1165824 - protein, 9 aa, Homo Sapiens
RGLLTRPPP

SEQ ID NO: 1165825 - protein, 9 aa, Homo Sapiens
LLDPAMAIS

SEQ ID NO: 1165826 - protein, 9 aa, Homo Sapiens
RFQEIDDGL

SEQ ID NO: 1165827 - protein, 9 aa, Homo Sapiens
HGGRQLRVP

SEQ ID NO: 1165828 - protein, 9 aa, Homo Sapiens
EADMWVHSS

SEQ ID NO: 1165829 - protein, 9 aa, Homo Sapiens
EKVVDAWKS

SEQ ID NO: 1165830 - protein, 9 aa, Homo Sapiens
ASPFSATTR

SEQ ID NO: 1165831 - protein, 9 aa, Homo Sapiens
PASGGVSRY

SEQ ID NO: 1165832 - protein, 9 aa, Homo Sapiens
IALERPDIR

SEQ ID NO: 1165833 - protein, 9 aa, Homo Sapiens
ETELCKATI

SEQ ID NO: 1165834 - protein, 9 aa, Homo Sapiens
GPLFFMEAK

SEQ ID NO: 1165835 - protein, 9 aa, Homo Sapiens
INCPLMEVL

SEQ ID NO: 1165836 - protein, 9 aa, Homo Sapiens
VKNVFPNMK

SEQ ID NO: 1165837 - protein, 9 aa, Homo Sapiens
KCAECGKFF

SEQ ID NO: 1165838 - protein, 9 aa, Homo Sapiens
RGPMPGSCR

SEQ ID NO: 1165839 - protein, 9 aa, Homo Sapiens
DTRRLPCCV

SEQ ID NO: 1165840 - protein, 9 aa, Homo Sapiens
NRIVERDFQ

SEQ ID NO: 1165841 - protein, 9 aa, Homo Sapiens
GRGSTCFFP

SEQ ID NO: 1165842 - protein, 9 aa, Homo Sapiens
PTSAPTQAK

SEQ ID NO: 1165843 - protein, 9 aa, Homo Sapiens
GNFLETLPR

SEQ ID NO: 1165844 - protein, 9 aa, Homo Sapiens
SVTWSGCSS

SEQ ID NO: 1165845 - protein, 9 aa, Homo Sapiens
IADYQQTIK

SEQ ID NO: 1165846 - protein, 9 aa, Homo Sapiens
GGQSNFNRD

SEQ ID NO: 1165847 - protein, 9 aa, Homo Sapiens
GSFQNDGLK

SEQ ID NO: 1165848 - protein, 9 aa, Homo Sapiens
QISTEVQAP

SEQ ID NO: 1165849 - protein, 9 aa, Homo Sapiens
KYRARHQIP

SEQ ID NO: 1165850 - protein, 9 aa, Homo Sapiens
IIFHTTAAG

SEQ ID NO: 1165851 - protein, 9 aa, Homo Sapiens
LITWGRLTG

SEQ ID NO: 1165852 - protein, 9 aa, Homo Sapiens
STSSPCRRK

SEQ ID NO: 1165853 - protein, 9 aa, Homo Sapiens
TSPLPPPAP

SEQ ID NO: 1165854 - protein, 9 aa, Homo Sapiens
SATTRAAPP

SEQ ID NO: 1165855 - protein, 9 aa, Homo Sapiens
HYPPPRHPP

SEQ ID NO: 1165856 - protein, 9 aa, Homo Sapiens
VGNLNLAWL

SEQ ID NO: 1165857 - protein, 9 aa, Homo Sapiens
ETYYLPDVG

SEQ ID NO: 1165858 - protein, 9 aa, Homo Sapiens
PLTSATSCE

SEQ ID NO: 1165859 - protein, 9 aa, Homo Sapiens
EFGTSVVKR

SEQ ID NO: 1165860 - protein, 9 aa, Homo Sapiens
CVLHLGVTL

SEQ ID NO: 1165861 - protein, 9 aa, Homo Sapiens
ITESGFSLR

SEQ ID NO: 1165862 - protein, 9 aa, Homo Sapiens
RPVSLIESE

SEQ ID NO: 1165863 - protein, 9 aa, Homo Sapiens
VVYVLVCML

SEQ ID NO: 1165864 - protein, 9 aa, Homo Sapiens
TYEHLFRWI

SEQ ID NO: 1165865 - protein, 9 aa, Homo Sapiens
TWPTQTWTR

SEQ ID NO: 1165866 - protein, 9 aa, Homo Sapiens
APMKMGRCS

SEQ ID NO: 1165867 - protein, 9 aa, Homo Sapiens
LECDYVSTH

SEQ ID NO: 1165868 - protein, 9 aa, Homo Sapiens
ISIHDGDFH

SEQ ID NO: 1165869 - protein, 9 aa, Homo Sapiens
VTAPRHCLW

SEQ ID NO: 1165870 - protein, 9 aa, Homo Sapiens
GGLPQWRKR

SEQ ID NO: 1165871 - protein, 9 aa, Homo Sapiens
SRESEHNLL

SEQ ID NO: 1165872 - protein, 9 aa, Homo Sapiens
FDLAFGQLN

SEQ ID NO: 1165873 - protein, 9 aa, Homo Sapiens
QGGAAQLNV

SEQ ID NO: 1165874 - protein, 9 aa, Homo Sapiens
PLIRSASGP

SEQ ID NO: 1165875 - protein, 9 aa, Homo Sapiens
IPKARRKCY

SEQ ID NO: 1165876 - protein, 9 aa, Homo Sapiens
WLFCPTTLW

SEQ ID NO: 1165877 - protein, 9 aa, Homo Sapiens
QGLPDLPSQ

SEQ ID NO: 1165878 - protein, 9 aa, Homo Sapiens
SPCQFRLTG

SEQ ID NO: 1165879 - protein, 9 aa, Homo Sapiens
NLSHIVPRE

SEQ ID NO: 1165880 - protein, 9 aa, Homo Sapiens
QVCETTHPS

SEQ ID NO: 1165881 - protein, 9 aa, Homo Sapiens
QVSSLSVLW

SEQ ID NO: 1165882 - protein, 9 aa, Homo Sapiens
AGRPGRRGG

SEQ ID NO: 1165883 - protein, 9 aa, Homo Sapiens
LARPRWSRP

SEQ ID NO: 1165884 - protein, 9 aa, Homo Sapiens
LPRLTRERA

SEQ ID NO: 1165885 - protein, 9 aa, Homo Sapiens
TPDEPQKSS

SEQ ID NO: 1165886 - protein, 9 aa, Homo Sapiens
LATCCSSLS

SEQ ID NO: 1165887 - protein, 9 aa, Homo Sapiens
KAPSRSESE

SEQ ID NO: 1165888 - protein, 9 aa, Homo Sapiens
EAKTRLSMR

SEQ ID NO: 1165889 - protein, 9 aa, Homo Sapiens
QKRNRVRGL

SEQ ID NO: 1165890 - protein, 9 aa, Homo Sapiens
TDLCFSPIP

SEQ ID NO: 1165891 - protein, 9 aa, Homo Sapiens
ATSAAATTS

SEQ ID NO: 1165892 - protein, 9 aa, Homo Sapiens
LAAREMALR

SEQ ID NO: 1165893 - protein, 9 aa, Homo Sapiens
GQRRRGWRR

SEQ ID NO: 1165894 - protein, 9 aa, Homo Sapiens
RDRDPVSEI

SEQ ID NO: 1165895 - protein, 9 aa, Homo Sapiens
ITLMWRGGC

SEQ ID NO: 1165896 - protein, 9 aa, Homo Sapiens
MSPPRPQGC

SEQ ID NO: 1165897 - protein, 9 aa, Homo Sapiens
SPYNKLQWS

SEQ ID NO: 1165898 - protein, 9 aa, Homo Sapiens
GLCSCSPCR

SEQ ID NO: 1165899 - protein, 9 aa, Homo Sapiens
VGRSRCRMT

SEQ ID NO: 1165900 - protein, 9 aa, Homo Sapiens
TSVVKRRCF

SEQ ID NO: 1165901 - protein, 9 aa, Homo Sapiens
QQHKVHVPG

SEQ ID NO: 1165902 - protein, 9 aa, Homo Sapiens
KVRGVPAIA

SEQ ID NO: 1165903 - protein, 9 aa, Homo Sapiens
PPRLTRSQR

SEQ ID NO: 1165904 - protein, 9 aa, Homo Sapiens
KMCAPVGNG

SEQ ID NO: 1165905 - protein, 9 aa, Homo Sapiens
LPAGTRRSS

SEQ ID NO: 1165906 - protein, 9 aa, Homo Sapiens
HRSGPAAAP

SEQ ID NO: 1165907 - protein, 9 aa, Homo Sapiens
ESPIKKQVY

SEQ ID NO: 1165908 - protein, 9 aa, Homo Sapiens
GKRSLNGKQ

SEQ ID NO: 1165909 - protein, 9 aa, Homo Sapiens
LCPALHLVK

SEQ ID NO: 1165910 - protein, 9 aa, Homo Sapiens
SLNPRKVCT

SEQ ID NO: 1165911 - protein, 9 aa, Homo Sapiens
SHLYCQPLL

SEQ ID NO: 1165912 - protein, 9 aa, Homo Sapiens
KQCGRTFRS

SEQ ID NO: 1165913 - protein, 9 aa, Homo Sapiens
PRSGRGSLR

SEQ ID NO: 1165914 - protein, 9 aa, Homo Sapiens
AFWGGKSLY

SEQ ID NO: 1165915 - protein, 9 aa, Homo Sapiens
ITWALQGAV

SEQ ID NO: 1165916 - protein, 9 aa, Homo Sapiens
GSLLCARLH

SEQ ID NO: 1165917 - protein, 9 aa, Homo Sapiens
PPAAPTGRP

SEQ ID NO: 1165918 - protein, 9 aa, Homo Sapiens
PISTTLRPP

SEQ ID NO: 1165919 - protein, 9 aa, Homo Sapiens
SHSHSGDYH

SEQ ID NO: 1165920 - protein, 9 aa, Homo Sapiens
GKNQPHNKQ

SEQ ID NO: 1165921 - protein, 9 aa, Homo Sapiens
SSGLAPRGR

SEQ ID NO: 1165922 - protein, 9 aa, Homo Sapiens
RRCLCTGYF

SEQ ID NO: 1165923 - protein, 9 aa, Homo Sapiens
PAEKELKVV

SEQ ID NO: 1165924 - protein, 9 aa, Homo Sapiens
FRPPIVRVI

SEQ ID NO: 1165925 - protein, 9 aa, Homo Sapiens
NDRVLAINV

SEQ ID NO: 1165926 - protein, 9 aa, Homo Sapiens
ICSSARPSC

SEQ ID NO: 1165927 - protein, 9 aa, Homo Sapiens
VVNGRMRRF

SEQ ID NO: 1165928 - protein, 9 aa, Homo Sapiens
CIVSGDRRV

SEQ ID NO: 1165929 - protein, 9 aa, Homo Sapiens
LEHYLELLV

SEQ ID NO: 1165930 - protein, 9 aa, Homo Sapiens
IMFNILQSC

SEQ ID NO: 1165931 - protein, 9 aa, Homo Sapiens
HPRPPPHTH

SEQ ID NO: 1165932 - protein, 9 aa, Homo Sapiens
RLTGQRCWG

SEQ ID NO: 1165933 - protein, 9 aa, Homo Sapiens
STRSPNSTT

SEQ ID NO: 1165934 - protein, 9 aa, Homo Sapiens
SLSWYQRSS

SEQ ID NO: 1165935 - protein, 9 aa, Homo Sapiens
YNFKKHSIS

SEQ ID NO: 1165936 - protein, 9 aa, Homo Sapiens
MPIAPWSRP

SEQ ID NO: 1165937 - protein, 9 aa, Homo Sapiens
PAAWGNPSW

SEQ ID NO: 1165938 - protein, 9 aa, Homo Sapiens
EYYPNDGLT

SEQ ID NO: 1165939 - protein, 9 aa, Homo Sapiens
LSHLVQGNE

SEQ ID NO: 1165940 - protein, 9 aa, Homo Sapiens
GLLLGHSRT

SEQ ID NO: 1165941 - protein, 9 aa, Homo Sapiens
FGSSQNPHR

SEQ ID NO: 1165942 - protein, 9 aa, Homo Sapiens
YPLIRSASG

SEQ ID NO: 1165943 - protein, 9 aa, Homo Sapiens
GQRNPTTAW

SEQ ID NO: 1165944 - protein, 9 aa, Homo Sapiens
YYVGSLIGH

SEQ ID NO: 1165945 - protein, 9 aa, Homo Sapiens
ILSDLRVYL

SEQ ID NO: 1165946 - protein, 9 aa, Homo Sapiens
HSCRLAGMG

SEQ ID NO: 1165947 - protein, 9 aa, Homo Sapiens
VGNKCALED

SEQ ID NO: 1165948 - protein, 9 aa, Homo Sapiens
SGEQNLLGR

SEQ ID NO: 1165949 - protein, 9 aa, Homo Sapiens
CGALDEDAP

SEQ ID NO: 1165950 - protein, 9 aa, Homo Sapiens
EYIIGGLIM

SEQ ID NO: 1165951 - protein, 9 aa, Homo Sapiens
AEPSKGQLK

SEQ ID NO: 1165952 - protein, 9 aa, Homo Sapiens
TCISMTTIS

SEQ ID NO: 1165953 - protein, 9 aa, Homo Sapiens
DPLCCCLAV

SEQ ID NO: 1165954 - protein, 9 aa, Homo Sapiens
PWGLAGVQD

SEQ ID NO: 1165955 - protein, 9 aa, Homo Sapiens
QSRLQGAIH

SEQ ID NO: 1165956 - protein, 9 aa, Homo Sapiens
RWTRMSLGT

SEQ ID NO: 1165957 - protein, 9 aa, Homo Sapiens
GKQWHMRCL

SEQ ID NO: 1165958 - protein, 9 aa, Homo Sapiens
LAMARPMES

SEQ ID NO: 1165959 - protein, 9 aa, Homo Sapiens
LNHCIFTQR

SEQ ID NO: 1165960 - protein, 9 aa, Homo Sapiens
CTETALVMR

SEQ ID NO: 1165961 - protein, 9 aa, Homo Sapiens
QYILVRIFS

SEQ ID NO: 1165962 - protein, 9 aa, Homo Sapiens
HFWNSTKKR

SEQ ID NO: 1165963 - protein, 9 aa, Homo Sapiens
MLMGSQLAG

SEQ ID NO: 1165964 - protein, 9 aa, Homo Sapiens
LPTRPRLLP

SEQ ID NO: 1165965 - protein, 9 aa, Homo Sapiens
HLWWEWYHL

SEQ ID NO: 1165966 - protein, 9 aa, Homo Sapiens
PTSTPGPWA

SEQ ID NO: 1165967 - protein, 9 aa, Homo Sapiens
TAAAAATAA

SEQ ID NO: 1165968 - protein, 9 aa, Homo Sapiens
RSRALEEEC

SEQ ID NO: 1165969 - protein, 9 aa, Homo Sapiens
DYDFPPSMR

SEQ ID NO: 1165970 - protein, 9 aa, Homo Sapiens
VSVSTFDLV

SEQ ID NO: 1165971 - protein, 9 aa, Homo Sapiens
LLYSVKAKT

SEQ ID NO: 1165972 - protein, 9 aa, Homo Sapiens
GPACPISTT

SEQ ID NO: 1165973 - protein, 9 aa, Homo Sapiens
PAPTPPPTW

SEQ ID NO: 1165974 - protein, 9 aa, Homo Sapiens
PPAFPLTTL

SEQ ID NO: 1165975 - protein, 9 aa, Homo Sapiens
SAVSQSQAA

SEQ ID NO: 1165976 - protein, 9 aa, Homo Sapiens
APDCGRLSP

SEQ ID NO: 1165977 - protein, 9 aa, Homo Sapiens
LPGAMNARG

SEQ ID NO: 1165978 - protein, 9 aa, Homo Sapiens
GPNGEQGSD

SEQ ID NO: 1165979 - protein, 9 aa, Homo Sapiens
KALPFTRYC

SEQ ID NO: 1165980 - protein, 9 aa, Homo Sapiens
RPRCWYFPP

SEQ ID NO: 1165981 - protein, 9 aa, Homo Sapiens
LQEDQIKEK

SEQ ID NO: 1165982 - protein, 9 aa, Homo Sapiens
IYPHVLVKN

SEQ ID NO: 1165983 - protein, 9 aa, Homo Sapiens
CGSATSMAG

SEQ ID NO: 1165984 - protein, 9 aa, Homo Sapiens
DWWALGVFI

SEQ ID NO: 1165985 - protein, 9 aa, Homo Sapiens
SQCTGPLGM

SEQ ID NO: 1165986 - protein, 9 aa, Homo Sapiens
RARQVLGLL

SEQ ID NO: 1165987 - protein, 9 aa, Homo Sapiens
GLRRASGTL

SEQ ID NO: 1165988 - protein, 9 aa, Homo Sapiens
LNLDTHIVE

SEQ ID NO: 1165989 - protein, 9 aa, Homo Sapiens
QANSQPLYR

SEQ ID NO: 1165990 - protein, 9 aa, Homo Sapiens
SPCRALART

SEQ ID NO: 1165991 - protein, 9 aa, Homo Sapiens
YRNYQFFID

SEQ ID NO: 1165992 - protein, 9 aa, Homo Sapiens
TYKEGYNIY

SEQ ID NO: 1165993 - protein, 9 aa, Homo Sapiens
GFYSIQIFN

SEQ ID NO: 1165994 - protein, 9 aa, Homo Sapiens
CVNLLCGLF

SEQ ID NO: 1165995 - protein, 9 aa, Homo Sapiens
LRVQSVLLL

SEQ ID NO: 1165996 - protein, 9 aa, Homo Sapiens
GNCTNKEDT

SEQ ID NO: 1165997 - protein, 9 aa, Homo Sapiens
KLAVIKNVW

SEQ ID NO: 1165998 - protein, 9 aa, Homo Sapiens
IKENIQDNI

SEQ ID NO: 1165999 - protein, 9 aa, Homo Sapiens
YTCICIHIC

SEQ ID NO: 1166000 - protein, 9 aa, Homo Sapiens
DHAFTDDHL

SEQ ID NO: 1166001 - protein, 9 aa, Homo Sapiens
VLEVSVAAL

SEQ ID NO: 1166002 - protein, 9 aa, Homo Sapiens
PSITSMHPF

SEQ ID NO: 1166003 - protein, 9 aa, Homo Sapiens
VMVPLPVWM

SEQ ID NO: 1166004 - protein, 9 aa, Homo Sapiens
HRLEMCLGL

SEQ ID NO: 1166005 - protein, 9 aa, Homo Sapiens
LFGAQANPP

SEQ ID NO: 1166006 - protein, 9 aa, Homo Sapiens
APMGSSRTL

SEQ ID NO: 1166007 - protein, 9 aa, Homo Sapiens
ALEGFLTAL

SEQ ID NO: 1166008 - protein, 9 aa, Homo Sapiens
TWSRWLIAF

SEQ ID NO: 1166009 - protein, 9 aa, Homo Sapiens
LRYKGGTRS

SEQ ID NO: 1166010 - protein, 9 aa, Homo Sapiens
KRPSLHRYL

SEQ ID NO: 1166011 - protein, 9 aa, Homo Sapiens
PESEFVPFL

SEQ ID NO: 1166012 - protein, 9 aa, Homo Sapiens
VMQSFGAYS

SEQ ID NO: 1166013 - protein, 9 aa, Homo Sapiens
HWAMSFLGM

SEQ ID NO: 1166014 - protein, 9 aa, Homo Sapiens
AQSAISTQP

SEQ ID NO: 1166015 - protein, 9 aa, Homo Sapiens
ECTEILTFP

SEQ ID NO: 1166016 - protein, 9 aa, Homo Sapiens
VRVGYPDSW

SEQ ID NO: 1166017 - protein, 9 aa, Homo Sapiens
DKSPLTDLG

SEQ ID NO: 1166018 - protein, 9 aa, Homo Sapiens
TVQEACGKG

SEQ ID NO: 1166019 - protein, 9 aa, Homo Sapiens
LAICSDTRL

SEQ ID NO: 1166020 - protein, 9 aa, Homo Sapiens
PQAHSAAKG

SEQ ID NO: 1166021 - protein, 9 aa, Homo Sapiens
ERHRNHPHL

SEQ ID NO: 1166022 - protein, 9 aa, Homo Sapiens
LTVVRPGNT

SEQ ID NO: 1166023 - protein, 9 aa, Homo Sapiens
GAASSSSTG

SEQ ID NO: 1166024 - protein, 9 aa, Homo Sapiens
CSGCRPGNV

SEQ ID NO: 1166025 - protein, 9 aa, Homo Sapiens
SNTSRFYYY

SEQ ID NO: 1166026 - protein, 9 aa, Homo Sapiens
QYLNLITNL

SEQ ID NO: 1166027 - protein, 9 aa, Homo Sapiens
EHNRSIHTY

SEQ ID NO: 1166028 - protein, 9 aa, Homo Sapiens
ARSHGNGEG

SEQ ID NO: 1166029 - protein, 9 aa, Homo Sapiens
PFECFFLWE

SEQ ID NO: 1166030 - protein, 9 aa, Homo Sapiens
YLEHRDPQD

SEQ ID NO: 1166031 - protein, 9 aa, Homo Sapiens
SWPSWGWGW

SEQ ID NO: 1166032 - protein, 9 aa, Homo Sapiens
VDSFEWSNS

SEQ ID NO: 1166033 - protein, 9 aa, Homo Sapiens
RGWGKGASQ

SEQ ID NO: 1166034 - protein, 9 aa, Homo Sapiens
NLRADQELL

SEQ ID NO: 1166035 - protein, 9 aa, Homo Sapiens
HHYYHSGPE

SEQ ID NO: 1166036 - protein, 9 aa, Homo Sapiens
LQDSYITST

SEQ ID NO: 1166037 - protein, 9 aa, Homo Sapiens
LLLGVPCLR

SEQ ID NO: 1166038 - protein, 9 aa, Homo Sapiens
HGEQRLTPT

SEQ ID NO: 1166039 - protein, 9 aa, Homo Sapiens
WKNDTKENN

SEQ ID NO: 1166040 - protein, 9 aa, Homo Sapiens
TAWTRASRC

SEQ ID NO: 1166041 - protein, 9 aa, Homo Sapiens
RTCAGRSSK

SEQ ID NO: 1166042 - protein, 9 aa, Homo Sapiens
PQPHLTWKL

SEQ ID NO: 1166043 - protein, 9 aa, Homo Sapiens
SLPQLSPTP

SEQ ID NO: 1166044 - protein, 9 aa, Homo Sapiens
MSEKNWKQL

SEQ ID NO: 1166045 - protein, 9 aa, Homo Sapiens
EAACENTRV

SEQ ID NO: 1166046 - protein, 9 aa, Homo Sapiens
TLESAAINQ

SEQ ID NO: 1166047 - protein, 9 aa, Homo Sapiens
CPPGGPAPP

SEQ ID NO: 1166048 - protein, 9 aa, Homo Sapiens
CPAEDYVPR

SEQ ID NO: 1166049 - protein, 9 aa, Homo Sapiens
RYVCAMTRD

SEQ ID NO: 1166050 - protein, 9 aa, Homo Sapiens
FSGPRYGHS

SEQ ID NO: 1166051 - protein, 9 aa, Homo Sapiens
SGTSAARGI

SEQ ID NO: 1166052 - protein, 9 aa, Homo Sapiens
SSWEAPYSH

SEQ ID NO: 1166053 - protein, 9 aa, Homo Sapiens
IEHPEDETL

SEQ ID NO: 1166054 - protein, 9 aa, Homo Sapiens
LLVKIRSGW

SEQ ID NO: 1166055 - protein, 9 aa, Homo Sapiens
VTQRHRTDE

SEQ ID NO: 1166056 - protein, 9 aa, Homo Sapiens
NGLGSGHLR

SEQ ID NO: 1166057 - protein, 9 aa, Homo Sapiens
DHRASLLTS

SEQ ID NO: 1166058 - protein, 9 aa, Homo Sapiens
TWGGTPRDA

SEQ ID NO: 1166059 - protein, 9 aa, Homo Sapiens
AWSTLWPPA

SEQ ID NO: 1166060 - protein, 9 aa, Homo Sapiens
THSPARSVA

SEQ ID NO: 1166061 - protein, 9 aa, Homo Sapiens
KAETKKGTM

SEQ ID NO: 1166062 - protein, 9 aa, Homo Sapiens
CTMPPLLHP

SEQ ID NO: 1166063 - protein, 9 aa, Homo Sapiens
ALVMRAPRW

SEQ ID NO: 1166064 - protein, 9 aa, Homo Sapiens
MDIFELLKE

SEQ ID NO: 1166065 - protein, 9 aa, Homo Sapiens
ACGAASPPA

SEQ ID NO: 1166066 - protein, 9 aa, Homo Sapiens
QQGPRLWAS

SEQ ID NO: 1166067 - protein, 9 aa, Homo Sapiens
LQVLKKILR

SEQ ID NO: 1166068 - protein, 9 aa, Homo Sapiens
ARSLSWYQR

SEQ ID NO: 1166069 - protein, 9 aa, Homo Sapiens
EEIQVWPAY

SEQ ID NO: 1166070 - protein, 9 aa, Homo Sapiens
KGYASCATS

SEQ ID NO: 1166071 - protein, 9 aa, Homo Sapiens
DPARGPAPR

SEQ ID NO: 1166072 - protein, 9 aa, Homo Sapiens
FSCQWPTEG

SEQ ID NO: 1166073 - protein, 9 aa, Homo Sapiens
LGYSIQQRA

SEQ ID NO: 1166074 - protein, 9 aa, Homo Sapiens
PSSLLSPCN

SEQ ID NO: 1166075 - protein, 9 aa, Homo Sapiens
RTSRGQPSP

SEQ ID NO: 1166076 - protein, 9 aa, Homo Sapiens
PSCEREEKH

SEQ ID NO: 1166077 - protein, 9 aa, Homo Sapiens
AEKCPAEDY

SEQ ID NO: 1166078 - protein, 9 aa, Homo Sapiens
YMTDEKKRE

SEQ ID NO: 1166079 - protein, 9 aa, Homo Sapiens
MLSIYKDPE

SEQ ID NO: 1166080 - protein, 9 aa, Homo Sapiens
WEAALRPST

SEQ ID NO: 1166081 - protein, 9 aa, Homo Sapiens
SPYPMTTAL

SEQ ID NO: 1166082 - protein, 9 aa, Homo Sapiens
SGARACTPW

SEQ ID NO: 1166083 - protein, 9 aa, Homo Sapiens
IQAPACSST

SEQ ID NO: 1166084 - protein, 9 aa, Homo Sapiens
TGARVLSKV

SEQ ID NO: 1166085 - protein, 9 aa, Homo Sapiens
KELKVVDHR

SEQ ID NO: 1166086 - protein, 9 aa, Homo Sapiens
PGRSLPAGP

SEQ ID NO: 1166087 - protein, 9 aa, Homo Sapiens
PGPAPASST

SEQ ID NO: 1166088 - protein, 9 aa, Homo Sapiens
CLECEKTSL

SEQ ID NO: 1166089 - protein, 9 aa, Homo Sapiens
QTMKMSFSA

SEQ ID NO: 1166090 - protein, 9 aa, Homo Sapiens
GCPSGFPGR

SEQ ID NO: 1166091 - protein, 9 aa, Homo Sapiens
RIQPRARCL

SEQ ID NO: 1166092 - protein, 9 aa, Homo Sapiens
TMAVSTSNL

SEQ ID NO: 1166093 - protein, 9 aa, Homo Sapiens
QTGTRTLAQ

SEQ ID NO: 1166094 - protein, 9 aa, Homo Sapiens
IDHIQVSRG

SEQ ID NO: 1166095 - protein, 9 aa, Homo Sapiens
SLRPRSTSP

SEQ ID NO: 1166096 - protein, 9 aa, Homo Sapiens
TSWRPGLKS

SEQ ID NO: 1166097 - protein, 9 aa, Homo Sapiens
PGCHCGKVS

SEQ ID NO: 1166098 - protein, 9 aa, Homo Sapiens
LPSPRPPPL

SEQ ID NO: 1166099 - protein, 9 aa, Homo Sapiens
RLQRESHHQ

SEQ ID NO: 1166100 - protein, 9 aa, Homo Sapiens
GSWAWQGAW

SEQ ID NO: 1166101 - protein, 9 aa, Homo Sapiens
ATTSPPTSA

SEQ ID NO: 1166102 - protein, 9 aa, Homo Sapiens
QCMTSKHYL

SEQ ID NO: 1166103 - protein, 9 aa, Homo Sapiens
HKFFNVLKE

SEQ ID NO: 1166104 - protein, 9 aa, Homo Sapiens
SAAPTSCSW

SEQ ID NO: 1166105 - protein, 9 aa, Homo Sapiens
GQAIYPHVL

SEQ ID NO: 1166106 - protein, 9 aa, Homo Sapiens
PQPWWWRWG

SEQ ID NO: 1166107 - protein, 9 aa, Homo Sapiens
DSRISQTAT

SEQ ID NO: 1166108 - protein, 9 aa, Homo Sapiens
MVTGYDWWA

SEQ ID NO: 1166109 - protein, 9 aa, Homo Sapiens
PENMESVPW

SEQ ID NO: 1166110 - protein, 9 aa, Homo Sapiens
DFNNVPDLE

SEQ ID NO: 1166111 - protein, 9 aa, Homo Sapiens
MFDDYVRTC

SEQ ID NO: 1166112 - protein, 9 aa, Homo Sapiens
TSTRSLPSI

SEQ ID NO: 1166113 - protein, 9 aa, Homo Sapiens
ITRLPTSVQ

SEQ ID NO: 1166114 - protein, 9 aa, Homo Sapiens
SMKWSYKPQ

SEQ ID NO: 1166115 - protein, 9 aa, Homo Sapiens
AASACATSA

SEQ ID NO: 1166116 - protein, 9 aa, Homo Sapiens
SGGLLQCST

SEQ ID NO: 1166117 - protein, 9 aa, Homo Sapiens
PGTKGRPEP

SEQ ID NO: 1166118 - protein, 9 aa, Homo Sapiens
AFWRCSKTF

SEQ ID NO: 1166119 - protein, 9 aa, Homo Sapiens
DLRKSLEKA

SEQ ID NO: 1166120 - protein, 9 aa, Homo Sapiens
ISQVDEEMF

SEQ ID NO: 1166121 - protein, 9 aa, Homo Sapiens
DANAATCFK

SEQ ID NO: 1166122 - protein, 9 aa, Homo Sapiens
WKSTWHVFP

SEQ ID NO: 1166123 - protein, 9 aa, Homo Sapiens
GVLVRSAMG

SEQ ID NO: 1166124 - protein, 9 aa, Homo Sapiens
DATCRLFNL

SEQ ID NO: 1166125 - protein, 9 aa, Homo Sapiens
YEFRVLAIM

SEQ ID NO: 1166126 - protein, 9 aa, Homo Sapiens
EKNQLTRDW

SEQ ID NO: 1166127 - protein, 9 aa, Homo Sapiens
TPTTRLMAP

SEQ ID NO: 1166128 - protein, 9 aa, Homo Sapiens
HTTAAGIVQ

SEQ ID NO: 1166129 - protein, 9 aa, Homo Sapiens
AVAVRPRPH

SEQ ID NO: 1166130 - protein, 9 aa, Homo Sapiens
RESSSLSLP

SEQ ID NO: 1166131 - protein, 9 aa, Homo Sapiens
LLMLSFLSL

SEQ ID NO: 1166132 - protein, 9 aa, Homo Sapiens
ASGRITYSH

SEQ ID NO: 1166133 - protein, 9 aa, Homo Sapiens
VSFAVLLIL

SEQ ID NO: 1166134 - protein, 9 aa, Homo Sapiens
NGTRATNGA

SEQ ID NO: 1166135 - protein, 9 aa, Homo Sapiens
AISASTRRQ

SEQ ID NO: 1166136 - protein, 9 aa, Homo Sapiens
YECATVILH

SEQ ID NO: 1166137 - protein, 9 aa, Homo Sapiens
CVSVLLTVL

SEQ ID NO: 1166138 - protein, 9 aa, Homo Sapiens
YNYFLRLCN

SEQ ID NO: 1166139 - protein, 9 aa, Homo Sapiens
TCQTQDSAR

SEQ ID NO: 1166140 - protein, 9 aa, Homo Sapiens
DTLVRLKAV

SEQ ID NO: 1166141 - protein, 9 aa, Homo Sapiens
FWKKRRRSQ

SEQ ID NO: 1166142 - protein, 9 aa, Homo Sapiens
QLTEKIHQM

SEQ ID NO: 1166143 - protein, 9 aa, Homo Sapiens
GSAPSMPAC

SEQ ID NO: 1166144 - protein, 9 aa, Homo Sapiens
SEPKVENFN

SEQ ID NO: 1166145 - protein, 9 aa, Homo Sapiens
FFCHSTHLT

SEQ ID NO: 1166146 - protein, 9 aa, Homo Sapiens
NLARKVLTR

SEQ ID NO: 1166147 - protein, 9 aa, Homo Sapiens
GISVVSRGP

SEQ ID NO: 1166148 - protein, 9 aa, Homo Sapiens
QPPPGPSWT

SEQ ID NO: 1166149 - protein, 9 aa, Homo Sapiens
HEASEDGVD

SEQ ID NO: 1166150 - protein, 9 aa, Homo Sapiens
APRRAPHPA

SEQ ID NO: 1166151 - protein, 9 aa, Homo Sapiens
GTIQRWLKG

SEQ ID NO: 1166152 - protein, 9 aa, Homo Sapiens
GRAGGAVPT

SEQ ID NO: 1166153 - protein, 9 aa, Homo Sapiens
EECGKTFTY

SEQ ID NO: 1166154 - protein, 9 aa, Homo Sapiens
LMILVITAL

SEQ ID NO: 1166155 - protein, 9 aa, Homo Sapiens
WWELFDSNT

SEQ ID NO: 1166156 - protein, 9 aa, Homo Sapiens
PTARSRPRG

SEQ ID NO: 1166157 - protein, 9 aa, Homo Sapiens
VAAAMAEQE

SEQ ID NO: 1166158 - protein, 9 aa, Homo Sapiens
RAPRSLHAV

SEQ ID NO: 1166159 - protein, 9 aa, Homo Sapiens
VHSHPLLLA

SEQ ID NO: 1166160 - protein, 9 aa, Homo Sapiens
SPPAKPSSV

SEQ ID NO: 1166161 - protein, 9 aa, Homo Sapiens
APLLQEMQE

SEQ ID NO: 1166162 - protein, 9 aa, Homo Sapiens
LIFALKLVL

SEQ ID NO: 1166163 - protein, 9 aa, Homo Sapiens
KPAPPPPGP

SEQ ID NO: 1166164 - protein, 9 aa, Homo Sapiens
SLVTHRTSL

SEQ ID NO: 1166165 - protein, 9 aa, Homo Sapiens
ECAQDEELI

SEQ ID NO: 1166166 - protein, 9 aa, Homo Sapiens
QAEKNSQNL

SEQ ID NO: 1166167 - protein, 9 aa, Homo Sapiens
ISPVTKGTA

SEQ ID NO: 1166168 - protein, 9 aa, Homo Sapiens
KNFSCQWPT

SEQ ID NO: 1166169 - protein, 9 aa, Homo Sapiens
MDMSSFNAF

SEQ ID NO: 1166170 - protein, 9 aa, Homo Sapiens
MMERMVEQM

SEQ ID NO: 1166171 - protein, 9 aa, Homo Sapiens
EDDKPFDLR

SEQ ID NO: 1166172 - protein, 9 aa, Homo Sapiens
ILRALWGAA

SEQ ID NO: 1166173 - protein, 9 aa, Homo Sapiens
FQEIDDGLD

SEQ ID NO: 1166174 - protein, 9 aa, Homo Sapiens
SYKLTLMEI

SEQ ID NO: 1166175 - protein, 9 aa, Homo Sapiens
GPARVFTGF

SEQ ID NO: 1166176 - protein, 9 aa, Homo Sapiens
LVDLTGGVT

SEQ ID NO: 1166177 - protein, 9 aa, Homo Sapiens
GGQGVGVVG

SEQ ID NO: 1166178 - protein, 9 aa, Homo Sapiens
VVAGQLVGT

SEQ ID NO: 1166179 - protein, 9 aa, Homo Sapiens
GPSLSRWPW

SEQ ID NO: 1166180 - protein, 9 aa, Homo Sapiens
LLSPHFQPP

SEQ ID NO: 1166181 - protein, 9 aa, Homo Sapiens
LLLGHSRTE

SEQ ID NO: 1166182 - protein, 9 aa, Homo Sapiens
PIHQWRTQD

SEQ ID NO: 1166183 - protein, 9 aa, Homo Sapiens
PLRRSHPGG

SEQ ID NO: 1166184 - protein, 9 aa, Homo Sapiens
PLTIVRGPH

SEQ ID NO: 1166185 - protein, 9 aa, Homo Sapiens
MVKNHIFQL

SEQ ID NO: 1166186 - protein, 9 aa, Homo Sapiens
TTWPLSLEP

SEQ ID NO: 1166187 - protein, 9 aa, Homo Sapiens
HCKEGDRPE

SEQ ID NO: 1166188 - protein, 9 aa, Homo Sapiens
GALVALGSR

SEQ ID NO: 1166189 - protein, 9 aa, Homo Sapiens
RLLGLHLHS

SEQ ID NO: 1166190 - protein, 9 aa, Homo Sapiens
RYETLSPVP

SEQ ID NO: 1166191 - protein, 9 aa, Homo Sapiens
SSSGGRTAA

SEQ ID NO: 1166192 - protein, 9 aa, Homo Sapiens
AMRSARTFV

SEQ ID NO: 1166193 - protein, 9 aa, Homo Sapiens
YIDNLEKNS

SEQ ID NO: 1166194 - protein, 9 aa, Homo Sapiens
QVGRAGDKG

SEQ ID NO: 1166195 - protein, 9 aa, Homo Sapiens
FLLIPTLSS

SEQ ID NO: 1166196 - protein, 9 aa, Homo Sapiens
PWPALAWCA

SEQ ID NO: 1166197 - protein, 9 aa, Homo Sapiens
SCGDDDRFL

SEQ ID NO: 1166198 - protein, 9 aa, Homo Sapiens
ADFGKIVKN

SEQ ID NO: 1166199 - protein, 9 aa, Homo Sapiens
FSFDVHDDM

SEQ ID NO: 1166200 - protein, 9 aa, Homo Sapiens
LILVSMSSE

SEQ ID NO: 1166201 - protein, 9 aa, Homo Sapiens
VMVEGFGGR

SEQ ID NO: 1166202 - protein, 9 aa, Homo Sapiens
KRGPGNQLR

SEQ ID NO: 1166203 - protein, 9 aa, Homo Sapiens
PRLWLLWRQ

SEQ ID NO: 1166204 - protein, 9 aa, Homo Sapiens
GELLLFLPT

SEQ ID NO: 1166205 - protein, 9 aa, Homo Sapiens
ALPRRKVMT

SEQ ID NO: 1166206 - protein, 9 aa, Homo Sapiens
MRNIMEPII

SEQ ID NO: 1166207 - protein, 9 aa, Homo Sapiens
RQKHIEEQK

SEQ ID NO: 1166208 - protein, 9 aa, Homo Sapiens
FQRLVRDLP

SEQ ID NO: 1166209 - protein, 9 aa, Homo Sapiens
SVIYDGEVC

SEQ ID NO: 1166210 - protein, 9 aa, Homo Sapiens
VMEVSVLDR

SEQ ID NO: 1166211 - protein, 9 aa, Homo Sapiens
KSACPSSPP

SEQ ID NO: 1166212 - protein, 9 aa, Homo Sapiens
PRSMSPSTL

SEQ ID NO: 1166213 - protein, 9 aa, Homo Sapiens
KEGHCMDKP

SEQ ID NO: 1166214 - protein, 9 aa, Homo Sapiens
QCRKKSHCL

SEQ ID NO: 1166215 - protein, 9 aa, Homo Sapiens
QKSLLKRNM

SEQ ID NO: 1166216 - protein, 9 aa, Homo Sapiens
HPQGPCPPP

SEQ ID NO: 1166217 - protein, 9 aa, Homo Sapiens
GADDLFCYR

SEQ ID NO: 1166218 - protein, 9 aa, Homo Sapiens
RRMRGFWKG

SEQ ID NO: 1166219 - protein, 9 aa, Homo Sapiens
GPAEKELKV

SEQ ID NO: 1166220 - protein, 9 aa, Homo Sapiens
PKKIRLLKC

SEQ ID NO: 1166221 - protein, 9 aa, Homo Sapiens
WPPAQPHLQ

SEQ ID NO: 1166222 - protein, 9 aa, Homo Sapiens
PKSKPTTGH

SEQ ID NO: 1166223 - protein, 9 aa, Homo Sapiens
LEDVCRLIN

SEQ ID NO: 1166224 - protein, 9 aa, Homo Sapiens
QWAPHSAGL

SEQ ID NO: 1166225 - protein, 9 aa, Homo Sapiens
RHQVRENQQ

SEQ ID NO: 1166226 - protein, 9 aa, Homo Sapiens
VGNFAAYAF

SEQ ID NO: 1166227 - protein, 9 aa, Homo Sapiens
LSSFQMPPL

SEQ ID NO: 1166228 - protein, 9 aa, Homo Sapiens
FLQAHFNPQ

SEQ ID NO: 1166229 - protein, 9 aa, Homo Sapiens
LEDPTLPPL

SEQ ID NO: 1166230 - protein, 9 aa, Homo Sapiens
FSGWISGSE

SEQ ID NO: 1166231 - protein, 9 aa, Homo Sapiens
PGGKEEAQE

SEQ ID NO: 1166232 - protein, 9 aa, Homo Sapiens
LPRACAASE

SEQ ID NO: 1166233 - protein, 9 aa, Homo Sapiens
WACCGTRRS

SEQ ID NO: 1166234 - protein, 9 aa, Homo Sapiens
AWPEWRICS

SEQ ID NO: 1166235 - protein, 9 aa, Homo Sapiens
RQTPEEELF

SEQ ID NO: 1166236 - protein, 9 aa, Homo Sapiens
RRRRCSISR

SEQ ID NO: 1166237 - protein, 9 aa, Homo Sapiens
ARGAGPNHG

SEQ ID NO: 1166238 - protein, 9 aa, Homo Sapiens
KKFSNVLTY

SEQ ID NO: 1166239 - protein, 9 aa, Homo Sapiens
PARVPTPVW

SEQ ID NO: 1166240 - protein, 9 aa, Homo Sapiens
MLMVAWIRA

SEQ ID NO: 1166241 - protein, 9 aa, Homo Sapiens
QESAQPPSL

SEQ ID NO: 1166242 - protein, 9 aa, Homo Sapiens
YIASAFQNE

SEQ ID NO: 1166243 - protein, 9 aa, Homo Sapiens
SKKEDWGKR

SEQ ID NO: 1166244 - protein, 9 aa, Homo Sapiens
HECGSSIEH

SEQ ID NO: 1166245 - protein, 9 aa, Homo Sapiens
PPSPGSGVG

SEQ ID NO: 1166246 - protein, 9 aa, Homo Sapiens
DDFAGKSCN

SEQ ID NO: 1166247 - protein, 9 aa, Homo Sapiens
CPRLLPYPF

SEQ ID NO: 1166248 - protein, 9 aa, Homo Sapiens
PSPPSPSRR

SEQ ID NO: 1166249 - protein, 9 aa, Homo Sapiens
ADIIFHTTA

SEQ ID NO: 1166250 - protein, 9 aa, Homo Sapiens
TNCSSWPCA

SEQ ID NO: 1166251 - protein, 9 aa, Homo Sapiens
HRPLTSCTI

SEQ ID NO: 1166252 - protein, 9 aa, Homo Sapiens
AAWIAAVAV

SEQ ID NO: 1166253 - protein, 9 aa, Homo Sapiens
PPVLRPRGL

SEQ ID NO: 1166254 - protein, 9 aa, Homo Sapiens
RTCALRMSP

SEQ ID NO: 1166255 - protein, 9 aa, Homo Sapiens
SPASHVGGV

SEQ ID NO: 1166256 - protein, 9 aa, Homo Sapiens
WLEQMLHSC

SEQ ID NO: 1166257 - protein, 9 aa, Homo Sapiens
SRWLIAFWQ

SEQ ID NO: 1166258 - protein, 9 aa, Homo Sapiens
EDCDGEKRG

SEQ ID NO: 1166259 - protein, 9 aa, Homo Sapiens
SVLEAPPQQ

SEQ ID NO: 1166260 - protein, 9 aa, Homo Sapiens
PLLQESLFA

SEQ ID NO: 1166261 - protein, 9 aa, Homo Sapiens
LRSWLRRWR

SEQ ID NO: 1166262 - protein, 9 aa, Homo Sapiens
PGNQEKKRG

SEQ ID NO: 1166263 - protein, 9 aa, Homo Sapiens
TTQAAAALR

SEQ ID NO: 1166264 - protein, 9 aa, Homo Sapiens
QALGSRSGG

SEQ ID NO: 1166265 - protein, 9 aa, Homo Sapiens
SAAPKKKCI

SEQ ID NO: 1166266 - protein, 9 aa, Homo Sapiens
PTEPGPRVG

SEQ ID NO: 1166267 - protein, 9 aa, Homo Sapiens
EIDQLKNCG

SEQ ID NO: 1166268 - protein, 9 aa, Homo Sapiens
RKDLCANTV

SEQ ID NO: 1166269 - protein, 9 aa, Homo Sapiens
SAEKGEAAP

SEQ ID NO: 1166270 - protein, 9 aa, Homo Sapiens
SLTTYKIIP

SEQ ID NO: 1166271 - protein, 9 aa, Homo Sapiens
PQFRSIVST

SEQ ID NO: 1166272 - protein, 9 aa, Homo Sapiens
GSAPQTPQK

SEQ ID NO: 1166273 - protein, 9 aa, Homo Sapiens
EDKEREKSK

SEQ ID NO: 1166274 - protein, 9 aa, Homo Sapiens
CCFSPLKKV

SEQ ID NO: 1166275 - protein, 9 aa, Homo Sapiens
SEPECTEIL

SEQ ID NO: 1166276 - protein, 9 aa, Homo Sapiens
RVPTPVWSP

SEQ ID NO: 1166277 - protein, 9 aa, Homo Sapiens
HHCWVHILD

SEQ ID NO: 1166278 - protein, 9 aa, Homo Sapiens
TPRPIRTGP

SEQ ID NO: 1166279 - protein, 9 aa, Homo Sapiens
SYMTPSQPI

SEQ ID NO: 1166280 - protein, 9 aa, Homo Sapiens
RTVRMTQEF

SEQ ID NO: 1166281 - protein, 9 aa, Homo Sapiens
GVSFRVTWV

SEQ ID NO: 1166282 - protein, 9 aa, Homo Sapiens
SWPTATWWA

SEQ ID NO: 1166283 - protein, 9 aa, Homo Sapiens
IASQAKYAG

SEQ ID NO: 1166284 - protein, 9 aa, Homo Sapiens
AYHNNPIGD

SEQ ID NO: 1166285 - protein, 9 aa, Homo Sapiens
ATSVEESLP

SEQ ID NO: 1166286 - protein, 9 aa, Homo Sapiens
PPREHPASS

SEQ ID NO: 1166287 - protein, 9 aa, Homo Sapiens
RDCFFCGPC

SEQ ID NO: 1166288 - protein, 9 aa, Homo Sapiens
GPGSWAWQG

SEQ ID NO: 1166289 - protein, 9 aa, Homo Sapiens
LVGLLGCSS

SEQ ID NO: 1166290 - protein, 9 aa, Homo Sapiens
RQVLGLLEG

SEQ ID NO: 1166291 - protein, 9 aa, Homo Sapiens
KLVNKYSDF

SEQ ID NO: 1166292 - protein, 9 aa, Homo Sapiens
DLCLPTLDY

SEQ ID NO: 1166293 - protein, 9 aa, Homo Sapiens
WGWGWARLS

SEQ ID NO: 1166294 - protein, 9 aa, Homo Sapiens
HLAAVGVLW

SEQ ID NO: 1166295 - protein, 9 aa, Homo Sapiens
WHNLRSRAE

SEQ ID NO: 1166296 - protein, 9 aa, Homo Sapiens
IQSVKVEEY

SEQ ID NO: 1166297 - protein, 9 aa, Homo Sapiens
SGQASKALK

SEQ ID NO: 1166298 - protein, 9 aa, Homo Sapiens
SSAGDLQCQ

SEQ ID NO: 1166299 - protein, 9 aa, Homo Sapiens
FSSKFGSIP

SEQ ID NO: 1166300 - protein, 9 aa, Homo Sapiens
KCRLFYKDM

SEQ ID NO: 1166301 - protein, 9 aa, Homo Sapiens
APQRRGHAQ

SEQ ID NO: 1166302 - protein, 9 aa, Homo Sapiens
GSRSGGRSR

SEQ ID NO: 1166303 - protein, 9 aa, Homo Sapiens
PDPECEWHK

SEQ ID NO: 1166304 - protein, 9 aa, Homo Sapiens
ARHREAVGN

SEQ ID NO: 1166305 - protein, 9 aa, Homo Sapiens
DTKATPPVS

SEQ ID NO: 1166306 - protein, 9 aa, Homo Sapiens
KPLCSEDKD

SEQ ID NO: 1166307 - protein, 9 aa, Homo Sapiens
KCYISQNDM

SEQ ID NO: 1166308 - protein, 9 aa, Homo Sapiens
PPGRALHHA

SEQ ID NO: 1166309 - protein, 9 aa, Homo Sapiens
ISSPMHPVL

SEQ ID NO: 1166310 - protein, 9 aa, Homo Sapiens
VWPAYLEHR

SEQ ID NO: 1166311 - protein, 9 aa, Homo Sapiens
QLAGRTATN

SEQ ID NO: 1166312 - protein, 9 aa, Homo Sapiens
AGSRRCCLR

SEQ ID NO: 1166313 - protein, 9 aa, Homo Sapiens
DSFFSNISH

SEQ ID NO: 1166314 - protein, 9 aa, Homo Sapiens
MLPTLSTLQ

SEQ ID NO: 1166315 - protein, 9 aa, Homo Sapiens
TSTLEVLAI

SEQ ID NO: 1166316 - protein, 9 aa, Homo Sapiens
KWFAETSII

SEQ ID NO: 1166317 - protein, 9 aa, Homo Sapiens
GRCPPHRWT

SEQ ID NO: 1166318 - protein, 9 aa, Homo Sapiens
THILGKEKI

SEQ ID NO: 1166319 - protein, 9 aa, Homo Sapiens
RGTHPEAHL

SEQ ID NO: 1166320 - protein, 9 aa, Homo Sapiens
TCVESSMTP

SEQ ID NO: 1166321 - protein, 9 aa, Homo Sapiens
YRGTVHNQG

SEQ ID NO: 1166322 - protein, 9 aa, Homo Sapiens
KTCYRIMEH

SEQ ID NO: 1166323 - protein, 9 aa, Homo Sapiens
LQGAIHERD

SEQ ID NO: 1166324 - protein, 9 aa, Homo Sapiens
LYFFSPNVH

SEQ ID NO: 1166325 - protein, 9 aa, Homo Sapiens
PLGPAVLEP

SEQ ID NO: 1166326 - protein, 9 aa, Homo Sapiens
LRPRSTSPR

SEQ ID NO: 1166327 - protein, 9 aa, Homo Sapiens
CYMALCSGP

SEQ ID NO: 1166328 - protein, 9 aa, Homo Sapiens
LELVVLADA

SEQ ID NO: 1166329 - protein, 9 aa, Homo Sapiens
RRGPDGVMV

SEQ ID NO: 1166330 - protein, 9 aa, Homo Sapiens
GCGSTPPPP

SEQ ID NO: 1166331 - protein, 9 aa, Homo Sapiens
TAWCCQSGT

SEQ ID NO: 1166332 - protein, 9 aa, Homo Sapiens
GPLRHKFLD

SEQ ID NO: 1166333 - protein, 9 aa, Homo Sapiens
LGPVAETHD

SEQ ID NO: 1166334 - protein, 9 aa, Homo Sapiens
GPPWPQAAF

SEQ ID NO: 1166335 - protein, 9 aa, Homo Sapiens
KTIHCNRIA

SEQ ID NO: 1166336 - protein, 9 aa, Homo Sapiens
FNAFLGCPK

SEQ ID NO: 1166337 - protein, 9 aa, Homo Sapiens
HPVLEVSVA

SEQ ID NO: 1166338 - protein, 9 aa, Homo Sapiens
ALHLVKPRV

SEQ ID NO: 1166339 - protein, 9 aa, Homo Sapiens
LTTSPLMKP

SEQ ID NO: 1166340 - protein, 9 aa, Homo Sapiens
RASLDQMGF

SEQ ID NO: 1166341 - protein, 9 aa, Homo Sapiens
DNAQSSELR

SEQ ID NO: 1166342 - protein, 9 aa, Homo Sapiens
RSMVSSVTY

SEQ ID NO: 1166343 - protein, 9 aa, Homo Sapiens
VEEAPANDA

SEQ ID NO: 1166344 - protein, 9 aa, Homo Sapiens
MRSSTSPAA

SEQ ID NO: 1166345 - protein, 9 aa, Homo Sapiens
GQDDGWGVF

SEQ ID NO: 1166346 - protein, 9 aa, Homo Sapiens
NHSKCITEC

SEQ ID NO: 1166347 - protein, 9 aa, Homo Sapiens
SNISHSRSH

SEQ ID NO: 1166348 - protein, 9 aa, Homo Sapiens
ACPISTTLR

SEQ ID NO: 1166349 - protein, 9 aa, Homo Sapiens
SLPRLTGAL

SEQ ID NO: 1166350 - protein, 9 aa, Homo Sapiens
AGGSDPEAG

SEQ ID NO: 1166351 - protein, 9 aa, Homo Sapiens
EKAPVDFDY

SEQ ID NO: 1166352 - protein, 9 aa, Homo Sapiens
RSSLHPQQE

SEQ ID NO: 1166353 - protein, 9 aa, Homo Sapiens
MSQINLRIR

SEQ ID NO: 1166354 - protein, 9 aa, Homo Sapiens
HGVCVENSN

SEQ ID NO: 1166355 - protein, 9 aa, Homo Sapiens
WFPPCGGGP

SEQ ID NO: 1166356 - protein, 9 aa, Homo Sapiens
ISVKDHRTS

SEQ ID NO: 1166357 - protein, 9 aa, Homo Sapiens
TELCKATIP

SEQ ID NO: 1166358 - protein, 9 aa, Homo Sapiens
KAWGQIKQS

SEQ ID NO: 1166359 - protein, 9 aa, Homo Sapiens
DKYVACGSP

SEQ ID NO: 1166360 - protein, 9 aa, Homo Sapiens
SGRKLTVQE

SEQ ID NO: 1166361 - protein, 9 aa, Homo Sapiens
SAPDTQAYG

SEQ ID NO: 1166362 - protein, 9 aa, Homo Sapiens
EIRRTTQAA

SEQ ID NO: 1166363 - protein, 9 aa, Homo Sapiens
DTYGTSRLC

SEQ ID NO: 1166364 - protein, 9 aa, Homo Sapiens
VVVSRDCPR

SEQ ID NO: 1166365 - protein, 9 aa, Homo Sapiens
SAKQLVSPE

SEQ ID NO: 1166366 - protein, 9 aa, Homo Sapiens
IPCLFVSSK

SEQ ID NO: 1166367 - protein, 9 aa, Homo Sapiens
DDSKGVRMR

SEQ ID NO: 1166368 - protein, 9 aa, Homo Sapiens
RGYRERGGG

SEQ ID NO: 1166369 - protein, 9 aa, Homo Sapiens
SNITEELFL

SEQ ID NO: 1166370 - protein, 9 aa, Homo Sapiens
RSCSPAHWL

SEQ ID NO: 1166371 - protein, 9 aa, Homo Sapiens
CLQTMKMSF

SEQ ID NO: 1166372 - protein, 9 aa, Homo Sapiens
PFAPCPPTG

SEQ ID NO: 1166373 - protein, 9 aa, Homo Sapiens
SIHCSQCTG

SEQ ID NO: 1166374 - protein, 9 aa, Homo Sapiens
RIGMKLQKK

SEQ ID NO: 1166375 - protein, 9 aa, Homo Sapiens
RSVFMGLRM

SEQ ID NO: 1166376 - protein, 9 aa, Homo Sapiens
RACESLVKF

SEQ ID NO: 1166377 - protein, 9 aa, Homo Sapiens
LVSMSSERY

SEQ ID NO: 1166378 - protein, 9 aa, Homo Sapiens
TMKYEQGTG

SEQ ID NO: 1166379 - protein, 9 aa, Homo Sapiens
SRQPSATRL

SEQ ID NO: 1166380 - protein, 9 aa, Homo Sapiens
NGCVYYVDH

SEQ ID NO: 1166381 - protein, 9 aa, Homo Sapiens
KCDRTCWSS

SEQ ID NO: 1166382 - protein, 9 aa, Homo Sapiens
GDNTLGGLF

SEQ ID NO: 1166383 - protein, 9 aa, Homo Sapiens
KCEECWETC

SEQ ID NO: 1166384 - protein, 9 aa, Homo Sapiens
TCAMASNTA

SEQ ID NO: 1166385 - protein, 9 aa, Homo Sapiens
ASAASCSAA

SEQ ID NO: 1166386 - protein, 9 aa, Homo Sapiens
PTRVMVPLP

SEQ ID NO: 1166387 - protein, 9 aa, Homo Sapiens
SPHSPKHTR

SEQ ID NO: 1166388 - protein, 9 aa, Homo Sapiens
GAGAASAYA

SEQ ID NO: 1166389 - protein, 9 aa, Homo Sapiens
DRHTGFSLF

SEQ ID NO: 1166390 - protein, 9 aa, Homo Sapiens
LLAWDPPRS

SEQ ID NO: 1166391 - protein, 9 aa, Homo Sapiens
AHYSLLTKN

SEQ ID NO: 1166392 - protein, 9 aa, Homo Sapiens
TATRTTLRK

SEQ ID NO: 1166393 - protein, 9 aa, Homo Sapiens
DPLRGAMYW

SEQ ID NO: 1166394 - protein, 9 aa, Homo Sapiens
QRSIVILQD

SEQ ID NO: 1166395 - protein, 9 aa, Homo Sapiens
GPCRAAFRA

SEQ ID NO: 1166396 - protein, 9 aa, Homo Sapiens
PSPASACTM

SEQ ID NO: 1166397 - protein, 9 aa, Homo Sapiens
WPSRLGSRM

SEQ ID NO: 1166398 - protein, 9 aa, Homo Sapiens
WTWGRAPRT

SEQ ID NO: 1166399 - protein, 9 aa, Homo Sapiens
PHPAPPPSS

SEQ ID NO: 1166400 - protein, 9 aa, Homo Sapiens
EESLGKGLH

SEQ ID NO: 1166401 - protein, 9 aa, Homo Sapiens
TRSSGVWSP

SEQ ID NO: 1166402 - protein, 9 aa, Homo Sapiens
LVQPFFEKE

SEQ ID NO: 1166403 - protein, 9 aa, Homo Sapiens
FPGCWARVP

SEQ ID NO: 1166404 - protein, 9 aa, Homo Sapiens
PFSIICLKT

SEQ ID NO: 1166405 - protein, 9 aa, Homo Sapiens
SIQKEPREF

SEQ ID NO: 1166406 - protein, 9 aa, Homo Sapiens
LGVQGSAAS

SEQ ID NO: 1166407 - protein, 9 aa, Homo Sapiens
YGGSRRYDD

SEQ ID NO: 1166408 - protein, 9 aa, Homo Sapiens
KGIKGGKKF

SEQ ID NO: 1166409 - protein, 9 aa, Homo Sapiens
RTCSRRPTA

SEQ ID NO: 1166410 - protein, 9 aa, Homo Sapiens
RGSKHWSFE

SEQ ID NO: 1166411 - protein, 9 aa, Homo Sapiens
TTSASTASL

SEQ ID NO: 1166412 - protein, 9 aa, Homo Sapiens
NHTPTVRLL

SEQ ID NO: 1166413 - protein, 9 aa, Homo Sapiens
QPHNKQMEA

SEQ ID NO: 1166414 - protein, 9 aa, Homo Sapiens
SASSSGNTR

SEQ ID NO: 1166415 - protein, 9 aa, Homo Sapiens
VKDHRTSQN

SEQ ID NO: 1166416 - protein, 9 aa, Homo Sapiens
EESINWTKI

SEQ ID NO: 1166417 - protein, 9 aa, Homo Sapiens
LVLIRVTSG

SEQ ID NO: 1166418 - protein, 9 aa, Homo Sapiens
IETGLVAAA

SEQ ID NO: 1166419 - protein, 9 aa, Homo Sapiens
ASQAKYAGS

SEQ ID NO: 1166420 - protein, 9 aa, Homo Sapiens
VSVWDAYGT

SEQ ID NO: 1166421 - protein, 9 aa, Homo Sapiens
SWDNNNRSM

SEQ ID NO: 1166422 - protein, 9 aa, Homo Sapiens
VPQQEISVV

SEQ ID NO: 1166423 - protein, 9 aa, Homo Sapiens
LRCWHKSRL

SEQ ID NO: 1166424 - protein, 9 aa, Homo Sapiens
KVWCLNEAS

SEQ ID NO: 1166425 - protein, 9 aa, Homo Sapiens
IEPNFSTTR

SEQ ID NO: 1166426 - protein, 9 aa, Homo Sapiens
GPRPRVQAH

SEQ ID NO: 1166427 - protein, 9 aa, Homo Sapiens
VQPTVIASM

SEQ ID NO: 1166428 - protein, 9 aa, Homo Sapiens
HPRRPGAAG

SEQ ID NO: 1166429 - protein, 9 aa, Homo Sapiens
DGQSYCCEH

SEQ ID NO: 1166430 - protein, 9 aa, Homo Sapiens
EEETTDDSN

SEQ ID NO: 1166431 - protein, 9 aa, Homo Sapiens
VLAWQQLHW

SEQ ID NO: 1166432 - protein, 9 aa, Homo Sapiens
GSPSDMLRD

SEQ ID NO: 1166433 - protein, 9 aa, Homo Sapiens
NAPTHTLVL

SEQ ID NO: 1166434 - protein, 9 aa, Homo Sapiens
IKNVWLAER

SEQ ID NO: 1166435 - protein, 9 aa, Homo Sapiens
SGKTDICSS

SEQ ID NO: 1166436 - protein, 9 aa, Homo Sapiens
SHQSEDWYH

SEQ ID NO: 1166437 - protein, 9 aa, Homo Sapiens
QLQKLKVEL

SEQ ID NO: 1166438 - protein, 9 aa, Homo Sapiens
EWPWGLAGV

SEQ ID NO: 1166439 - protein, 9 aa, Homo Sapiens
ATTAIGGGW

SEQ ID NO: 1166440 - protein, 9 aa, Homo Sapiens
GKKVPTSFG

SEQ ID NO: 1166441 - protein, 9 aa, Homo Sapiens
VGEIRRTTQ

SEQ ID NO: 1166442 - protein, 9 aa, Homo Sapiens
SSSDASDGH

SEQ ID NO: 1166443 - protein, 9 aa, Homo Sapiens
TRALHAHRV

SEQ ID NO: 1166444 - protein, 9 aa, Homo Sapiens
AWRRSSWPR

SEQ ID NO: 1166445 - protein, 9 aa, Homo Sapiens
FIRYGWHWG

SEQ ID NO: 1166446 - protein, 9 aa, Homo Sapiens
FYIASAFQN

SEQ ID NO: 1166447 - protein, 9 aa, Homo Sapiens
FAMEKTPPC

SEQ ID NO: 1166448 - protein, 9 aa, Homo Sapiens
YMPGTVALR

SEQ ID NO: 1166449 - protein, 9 aa, Homo Sapiens
MEPIITLEG

SEQ ID NO: 1166450 - protein, 9 aa, Homo Sapiens
YLLLLNLDT

SEQ ID NO: 1166451 - protein, 9 aa, Homo Sapiens
GLPTSGSPR

SEQ ID NO: 1166452 - protein, 9 aa, Homo Sapiens
DNLTSSYKA

SEQ ID NO: 1166453 - protein, 9 aa, Homo Sapiens
LPNPAAHAL

SEQ ID NO: 1166454 - protein, 9 aa, Homo Sapiens
PPRSPLTPG

SEQ ID NO: 1166455 - protein, 9 aa, Homo Sapiens
MSCSLLTQP

SEQ ID NO: 1166456 - protein, 9 aa, Homo Sapiens
MILLTFTFS

SEQ ID NO: 1166457 - protein, 9 aa, Homo Sapiens
ARQTPEEEL

SEQ ID NO: 1166458 - protein, 9 aa, Homo Sapiens
PWSRIPPCR

SEQ ID NO: 1166459 - protein, 9 aa, Homo Sapiens
HVVMEVSVL

SEQ ID NO: 1166460 - protein, 9 aa, Homo Sapiens
YLRLTIVSC

SEQ ID NO: 1166461 - protein, 9 aa, Homo Sapiens
GPTRSTSVG

SEQ ID NO: 1166462 - protein, 9 aa, Homo Sapiens
RLTVPYAGV

SEQ ID NO: 1166463 - protein, 9 aa, Homo Sapiens
PASARRAGR

SEQ ID NO: 1166464 - protein, 9 aa, Homo Sapiens
STKIRLFTA

SEQ ID NO: 1166465 - protein, 9 aa, Homo Sapiens
VRVGKAFIP

SEQ ID NO: 1166466 - protein, 9 aa, Homo Sapiens
SMTPTDQES

SEQ ID NO: 1166467 - protein, 9 aa, Homo Sapiens
KQQMEKDPI

SEQ ID NO: 1166468 - protein, 9 aa, Homo Sapiens
LLQPWLVAK

SEQ ID NO: 1166469 - protein, 9 aa, Homo Sapiens
LLWRQNGGS

SEQ ID NO: 1166470 - protein, 9 aa, Homo Sapiens
RSVWRLWSW

SEQ ID NO: 1166471 - protein, 9 aa, Homo Sapiens
LLVAVCVLH

SEQ ID NO: 1166472 - protein, 9 aa, Homo Sapiens
QRGTSEVSL

SEQ ID NO: 1166473 - protein, 9 aa, Homo Sapiens
MAEEQSQVE

SEQ ID NO: 1166474 - protein, 9 aa, Homo Sapiens
PPICIEYII

SEQ ID NO: 1166475 - protein, 9 aa, Homo Sapiens
SALGYPHHC

SEQ ID NO: 1166476 - protein, 9 aa, Homo Sapiens
SEKREVLQF

SEQ ID NO: 1166477 - protein, 9 aa, Homo Sapiens
FKKHSISTQ

SEQ ID NO: 1166478 - protein, 9 aa, Homo Sapiens
SPGLAFSLA

SEQ ID NO: 1166479 - protein, 9 aa, Homo Sapiens
ITTKESLTT

SEQ ID NO: 1166480 - protein, 9 aa, Homo Sapiens
GQHTPAPGP

SEQ ID NO: 1166481 - protein, 9 aa, Homo Sapiens
CQVGQSATR

SEQ ID NO: 1166482 - protein, 9 aa, Homo Sapiens
TLDSCSGHC

SEQ ID NO: 1166483 - protein, 9 aa, Homo Sapiens
WCSSRNSPR

SEQ ID NO: 1166484 - protein, 9 aa, Homo Sapiens
GPSLPSRGS

SEQ ID NO: 1166485 - protein, 9 aa, Homo Sapiens
AFNHCAQPL

SEQ ID NO: 1166486 - protein, 9 aa, Homo Sapiens
QLKKELTEN

SEQ ID NO: 1166487 - protein, 9 aa, Homo Sapiens
RPGGSGHAG

SEQ ID NO: 1166488 - protein, 9 aa, Homo Sapiens
CWKATWAFG

SEQ ID NO: 1166489 - protein, 9 aa, Homo Sapiens
TALSVLVTI

SEQ ID NO: 1166490 - protein, 9 aa, Homo Sapiens
LFKTNEEKR

SEQ ID NO: 1166491 - protein, 9 aa, Homo Sapiens
QDVHQRCVQ

SEQ ID NO: 1166492 - protein, 9 aa, Homo Sapiens
APSSSVCAP

SEQ ID NO: 1166493 - protein, 9 aa, Homo Sapiens
IEPLRKALS

SEQ ID NO: 1166494 - protein, 9 aa, Homo Sapiens
IGTSTHLSY

SEQ ID NO: 1166495 - protein, 9 aa, Homo Sapiens
SGCRAPPGG

SEQ ID NO: 1166496 - protein, 9 aa, Homo Sapiens
KLRSWLRRW

SEQ ID NO: 1166497 - protein, 9 aa, Homo Sapiens
SVHRMVTNC

SEQ ID NO: 1166498 - protein, 9 aa, Homo Sapiens
GHYTLVGSH

SEQ ID NO: 1166499 - protein, 9 aa, Homo Sapiens
RVPVDQVNH

SEQ ID NO: 1166500 - protein, 9 aa, Homo Sapiens
PRWPTPSSC

SEQ ID NO: 1166501 - protein, 9 aa, Homo Sapiens
RPSAVMQSG

SEQ ID NO: 1166502 - protein, 9 aa, Homo Sapiens
ISPSLAIWT

SEQ ID NO: 1166503 - protein, 9 aa, Homo Sapiens
SDDTPMVRQ

SEQ ID NO: 1166504 - protein, 9 aa, Homo Sapiens
IQHFYYTFG

SEQ ID NO: 1166505 - protein, 9 aa, Homo Sapiens
LLAFSSGSQ

SEQ ID NO: 1166506 - protein, 9 aa, Homo Sapiens
CFLNLSQME

SEQ ID NO: 1166507 - protein, 9 aa, Homo Sapiens
CDNGCCIEM

SEQ ID NO: 1166508 - protein, 9 aa, Homo Sapiens
PRTSTTSSG

SEQ ID NO: 1166509 - protein, 9 aa, Homo Sapiens
RCHRGGRAC

SEQ ID NO: 1166510 - protein, 9 aa, Homo Sapiens
KLNKGVFRE

SEQ ID NO: 1166511 - protein, 9 aa, Homo Sapiens
MLVLEQSVL

SEQ ID NO: 1166512 - protein, 9 aa, Homo Sapiens
STWTIFAPS

SEQ ID NO: 1166513 - protein, 9 aa, Homo Sapiens
IWTCIVAPS

SEQ ID NO: 1166514 - protein, 9 aa, Homo Sapiens
SSVTWSGCS

SEQ ID NO: 1166515 - protein, 9 aa, Homo Sapiens
NVRIDKVGG

SEQ ID NO: 1166516 - protein, 9 aa, Homo Sapiens
EHPEDETLP

SEQ ID NO: 1166517 - protein, 9 aa, Homo Sapiens
ALHNPRPGR

SEQ ID NO: 1166518 - protein, 9 aa, Homo Sapiens
CHSSGGSPE

SEQ ID NO: 1166519 - protein, 9 aa, Homo Sapiens
LKENEKLRS

SEQ ID NO: 1166520 - protein, 9 aa, Homo Sapiens
PTPSSCSPR

SEQ ID NO: 1166521 - protein, 9 aa, Homo Sapiens
RLITSAARR

SEQ ID NO: 1166522 - protein, 9 aa, Homo Sapiens
QSYCCEHDL

SEQ ID NO: 1166523 - protein, 9 aa, Homo Sapiens
FLRREGMCQ

SEQ ID NO: 1166524 - protein, 9 aa, Homo Sapiens
YVTLTPKVL

SEQ ID NO: 1166525 - protein, 9 aa, Homo Sapiens
KLRDLRKED

SEQ ID NO: 1166526 - protein, 9 aa, Homo Sapiens
SMRQAGRPD

SEQ ID NO: 1166527 - protein, 9 aa, Homo Sapiens
CAFQAPPSC

SEQ ID NO: 1166528 - protein, 9 aa, Homo Sapiens
NLHTAMRRQ

SEQ ID NO: 1166529 - protein, 9 aa, Homo Sapiens
IRRGDVPQT

SEQ ID NO: 1166530 - protein, 9 aa, Homo Sapiens
SRILWFKVV

SEQ ID NO: 1166531 - protein, 9 aa, Homo Sapiens
NATCARLSA

SEQ ID NO: 1166532 - protein, 9 aa, Homo Sapiens
ISVWEFFYG

SEQ ID NO: 1166533 - protein, 9 aa, Homo Sapiens
VTSTLEVLA

SEQ ID NO: 1166534 - protein, 9 aa, Homo Sapiens
AYTEEKAYE

SEQ ID NO: 1166535 - protein, 9 aa, Homo Sapiens
AWRRRRMRG

SEQ ID NO: 1166536 - protein, 9 aa, Homo Sapiens
RSGGSGWSG

SEQ ID NO: 1166537 - protein, 9 aa, Homo Sapiens
PTCVEAASS

SEQ ID NO: 1166538 - protein, 9 aa, Homo Sapiens
VYANSHQET

SEQ ID NO: 1166539 - protein, 9 aa, Homo Sapiens
QGKSTLRGH

SEQ ID NO: 1166540 - protein, 9 aa, Homo Sapiens
SHCLQDSYI

SEQ ID NO: 1166541 - protein, 9 aa, Homo Sapiens
HHGGGGGAG

SEQ ID NO: 1166542 - protein, 9 aa, Homo Sapiens
EICLCKEIT

SEQ ID NO: 1166543 - protein, 9 aa, Homo Sapiens
MLNVHYRTP

SEQ ID NO: 1166544 - protein, 9 aa, Homo Sapiens
DLDQGPRST

SEQ ID NO: 1166545 - protein, 9 aa, Homo Sapiens
VITALGRFR

SEQ ID NO: 1166546 - protein, 9 aa, Homo Sapiens
WKKGLSLSY

SEQ ID NO: 1166547 - protein, 9 aa, Homo Sapiens
LTVQEACGK

SEQ ID NO: 1166548 - protein, 9 aa, Homo Sapiens
KYGGIYMGT

SEQ ID NO: 1166549 - protein, 9 aa, Homo Sapiens
PLWRSRSFP

SEQ ID NO: 1166550 - protein, 9 aa, Homo Sapiens
LVSVSVIMN

SEQ ID NO: 1166551 - protein, 9 aa, Homo Sapiens
ECLTISFPC

SEQ ID NO: 1166552 - protein, 9 aa, Homo Sapiens
SFQNDGLKA

SEQ ID NO: 1166553 - protein, 9 aa, Homo Sapiens
GEGPHPQAS

SEQ ID NO: 1166554 - protein, 9 aa, Homo Sapiens
ASAYSAKTP

SEQ ID NO: 1166555 - protein, 9 aa, Homo Sapiens
KRTPWKHSD

SEQ ID NO: 1166556 - protein, 9 aa, Homo Sapiens
HAQHPRRPG

SEQ ID NO: 1166557 - protein, 9 aa, Homo Sapiens
RHHHSEHMQ

SEQ ID NO: 1166558 - protein, 9 aa, Homo Sapiens
GSVLCFSGT

SEQ ID NO: 1166559 - protein, 9 aa, Homo Sapiens
EPKSFSAPD

SEQ ID NO: 1166560 - protein, 9 aa, Homo Sapiens
QQVSRAVNQ

SEQ ID NO: 1166561 - protein, 9 aa, Homo Sapiens
AVVQRTTVH

SEQ ID NO: 1166562 - protein, 9 aa, Homo Sapiens
KTPKRVTFT

SEQ ID NO: 1166563 - protein, 9 aa, Homo Sapiens
GQGSPCLGS

SEQ ID NO: 1166564 - protein, 9 aa, Homo Sapiens
HVQKYPIRM

SEQ ID NO: 1166565 - protein, 9 aa, Homo Sapiens
EEEDEDSKQ

SEQ ID NO: 1166566 - protein, 9 aa, Homo Sapiens
TITDQITLL

SEQ ID NO: 1166567 - protein, 9 aa, Homo Sapiens
NPNFCWLSL

SEQ ID NO: 1166568 - protein, 9 aa, Homo Sapiens
EYENELGRL

SEQ ID NO: 1166569 - protein, 9 aa, Homo Sapiens
SFIPTTTLA

SEQ ID NO: 1166570 - protein, 9 aa, Homo Sapiens
KILLSLIFS

SEQ ID NO: 1166571 - protein, 9 aa, Homo Sapiens
RGRGARGRE

SEQ ID NO: 1166572 - protein, 9 aa, Homo Sapiens
QRTSTIGKK

SEQ ID NO: 1166573 - protein, 9 aa, Homo Sapiens
ERGSLETRG

SEQ ID NO: 1166574 - protein, 9 aa, Homo Sapiens
DRVLAINVH

SEQ ID NO: 1166575 - protein, 9 aa, Homo Sapiens
GRATVRVGR

SEQ ID NO: 1166576 - protein, 9 aa, Homo Sapiens
MVYTIGGEK

SEQ ID NO: 1166577 - protein, 9 aa, Homo Sapiens
DLSHCSWQP

SEQ ID NO: 1166578 - protein, 9 aa, Homo Sapiens
NGEGRRPQR

SEQ ID NO: 1166579 - protein, 9 aa, Homo Sapiens
IKWKVAFSE

SEQ ID NO: 1166580 - protein, 9 aa, Homo Sapiens
EEQRAERGS

SEQ ID NO: 1166581 - protein, 9 aa, Homo Sapiens
EDSVQSIHG

SEQ ID NO: 1166582 - protein, 9 aa, Homo Sapiens
PHEAPCTPR

SEQ ID NO: 1166583 - protein, 9 aa, Homo Sapiens
NSNSSSSCL

SEQ ID NO: 1166584 - protein, 9 aa, Homo Sapiens
TEYYPNDGL

SEQ ID NO: 1166585 - protein, 9 aa, Homo Sapiens
PSPASGSTS

SEQ ID NO: 1166586 - protein, 9 aa, Homo Sapiens
TCFKRAVEL

SEQ ID NO: 1166587 - protein, 9 aa, Homo Sapiens
RRALDDTVR

SEQ ID NO: 1166588 - protein, 9 aa, Homo Sapiens
TPPGSAPSM

SEQ ID NO: 1166589 - protein, 9 aa, Homo Sapiens
PGLPPNTCT

SEQ ID NO: 1166590 - protein, 9 aa, Homo Sapiens
LGWPAAHVH

SEQ ID NO: 1166591 - protein, 9 aa, Homo Sapiens
GPGISPGAW

SEQ ID NO: 1166592 - protein, 9 aa, Homo Sapiens
TQVVVVGAP

SEQ ID NO: 1166593 - protein, 9 aa, Homo Sapiens
GVLDDSERM

SEQ ID NO: 1166594 - protein, 9 aa, Homo Sapiens
EWAHLRWAV

SEQ ID NO: 1166595 - protein, 9 aa, Homo Sapiens
PQAPDGFYR

SEQ ID NO: 1166596 - protein, 9 aa, Homo Sapiens
HNQGEPSGH

SEQ ID NO: 1166597 - protein, 9 aa, Homo Sapiens
LVIFYVSWL

SEQ ID NO: 1166598 - protein, 9 aa, Homo Sapiens
RVGKAFIPG

SEQ ID NO: 1166599 - protein, 9 aa, Homo Sapiens
KENTTYFEF

SEQ ID NO: 1166600 - protein, 9 aa, Homo Sapiens
PGGPAPAAA

SEQ ID NO: 1166601 - protein, 9 aa, Homo Sapiens
QPQSGGALW

SEQ ID NO: 1166602 - protein, 9 aa, Homo Sapiens
SAGRSWGQI

SEQ ID NO: 1166603 - protein, 9 aa, Homo Sapiens
VGALVGLEV

SEQ ID NO: 1166604 - protein, 9 aa, Homo Sapiens
APGARPEGT

SEQ ID NO: 1166605 - protein, 9 aa, Homo Sapiens
FYFVELPTV

SEQ ID NO: 1166606 - protein, 9 aa, Homo Sapiens
DFLLWQWPF

SEQ ID NO: 1166607 - protein, 9 aa, Homo Sapiens
KTDISPRET

SEQ ID NO: 1166608 - protein, 9 aa, Homo Sapiens
LSKKENTIR

SEQ ID NO: 1166609 - protein, 9 aa, Homo Sapiens
IMQDLISEP

SEQ ID NO: 1166610 - protein, 9 aa, Homo Sapiens
QPRPGLPGK

SEQ ID NO: 1166611 - protein, 9 aa, Homo Sapiens
PGLPGKAEP

SEQ ID NO: 1166612 - protein, 9 aa, Homo Sapiens
FGHYTLVGS

SEQ ID NO: 1166613 - protein, 9 aa, Homo Sapiens
RENLTNVKH

SEQ ID NO: 1166614 - protein, 9 aa, Homo Sapiens
PGPACPIST

SEQ ID NO: 1166615 - protein, 9 aa, Homo Sapiens
TEQQRLEKM

SEQ ID NO: 1166616 - protein, 9 aa, Homo Sapiens
AAGQLVKGR

SEQ ID NO: 1166617 - protein, 9 aa, Homo Sapiens
ATAATTAAC

SEQ ID NO: 1166618 - protein, 9 aa, Homo Sapiens
EALNTGTLQ

SEQ ID NO: 1166619 - protein, 9 aa, Homo Sapiens
SQKPPPPLP

SEQ ID NO: 1166620 - protein, 9 aa, Homo Sapiens
ILLLEDWLI

SEQ ID NO: 1166621 - protein, 9 aa, Homo Sapiens
YSIPSIGSS

SEQ ID NO: 1166622 - protein, 9 aa, Homo Sapiens
GSSRTLGLH

SEQ ID NO: 1166623 - protein, 9 aa, Homo Sapiens
SPSCNLWMP

SEQ ID NO: 1166624 - protein, 9 aa, Homo Sapiens
KLKTFHMKC

SEQ ID NO: 1166625 - protein, 9 aa, Homo Sapiens
SDASDGHGS

SEQ ID NO: 1166626 - protein, 9 aa, Homo Sapiens
EHRDPQDSR

SEQ ID NO: 1166627 - protein, 9 aa, Homo Sapiens
LLSTHILGK

SEQ ID NO: 1166628 - protein, 9 aa, Homo Sapiens
SPPAPVVER

SEQ ID NO: 1166629 - protein, 9 aa, Homo Sapiens
FPLLSRPRS

SEQ ID NO: 1166630 - protein, 9 aa, Homo Sapiens
FLLYGMSLI

SEQ ID NO: 1166631 - protein, 9 aa, Homo Sapiens
SSGPACGRR

SEQ ID NO: 1166632 - protein, 9 aa, Homo Sapiens
CVCPQGFGG

SEQ ID NO: 1166633 - protein, 9 aa, Homo Sapiens
STLEVLAIP

SEQ ID NO: 1166634 - protein, 9 aa, Homo Sapiens
GGPGHGSGG

SEQ ID NO: 1166635 - protein, 9 aa, Homo Sapiens
SKPAPPPPG

SEQ ID NO: 1166636 - protein, 9 aa, Homo Sapiens
VGGMWAAMD

SEQ ID NO: 1166637 - protein, 9 aa, Homo Sapiens
SSTTLDSGV

SEQ ID NO: 1166638 - protein, 9 aa, Homo Sapiens
NFTGGTLAI

SEQ ID NO: 1166639 - protein, 9 aa, Homo Sapiens
GPQKINCPL

SEQ ID NO: 1166640 - protein, 9 aa, Homo Sapiens
YQEFLLLSN

SEQ ID NO: 1166641 - protein, 9 aa, Homo Sapiens
FGTMPSRCC

SEQ ID NO: 1166642 - protein, 9 aa, Homo Sapiens
MEEANRSFL

SEQ ID NO: 1166643 - protein, 9 aa, Homo Sapiens
TRRSCSGLV

SEQ ID NO: 1166644 - protein, 9 aa, Homo Sapiens
WTMPIAPWS

SEQ ID NO: 1166645 - protein, 9 aa, Homo Sapiens
PATTTSPSR

SEQ ID NO: 1166646 - protein, 9 aa, Homo Sapiens
QNQPEYKAL

SEQ ID NO: 1166647 - protein, 9 aa, Homo Sapiens
VAPLITRLP

SEQ ID NO: 1166648 - protein, 9 aa, Homo Sapiens
MKAGLENMV

SEQ ID NO: 1166649 - protein, 9 aa, Homo Sapiens
MFSVFAPTP

SEQ ID NO: 1166650 - protein, 9 aa, Homo Sapiens
LYPLGPHPS

SEQ ID NO: 1166651 - protein, 9 aa, Homo Sapiens
TSAELQNVS

SEQ ID NO: 1166652 - protein, 9 aa, Homo Sapiens
SSWEKVPGG

SEQ ID NO: 1166653 - protein, 9 aa, Homo Sapiens
PPTSTTRTC

SEQ ID NO: 1166654 - protein, 9 aa, Homo Sapiens
AAAAAAAEN

SEQ ID NO: 1166655 - protein, 9 aa, Homo Sapiens
SCDTDGTPH

SEQ ID NO: 1166656 - protein, 9 aa, Homo Sapiens
PPRTPLFPL

SEQ ID NO: 1166657 - protein, 9 aa, Homo Sapiens
GPHPLVANM

SEQ ID NO: 1166658 - protein, 9 aa, Homo Sapiens
PRPPPHTHP

SEQ ID NO: 1166659 - protein, 9 aa, Homo Sapiens
PQATWVRDM

SEQ ID NO: 1166660 - protein, 9 aa, Homo Sapiens
SGFHATPEE

SEQ ID NO: 1166661 - protein, 9 aa, Homo Sapiens
HPATPPQAQ

SEQ ID NO: 1166662 - protein, 9 aa, Homo Sapiens
GGPWPRTSP

SEQ ID NO: 1166663 - protein, 9 aa, Homo Sapiens
YMPSAQLSG

SEQ ID NO: 1166664 - protein, 9 aa, Homo Sapiens
CRGCVIPHG

SEQ ID NO: 1166665 - protein, 9 aa, Homo Sapiens
YNSGQRWKL

SEQ ID NO: 1166666 - protein, 9 aa, Homo Sapiens
SDAGVPPLS

SEQ ID NO: 1166667 - protein, 9 aa, Homo Sapiens
NCMAAEAQK

SEQ ID NO: 1166668 - protein, 9 aa, Homo Sapiens
GQHTQVVAS

SEQ ID NO: 1166669 - protein, 9 aa, Homo Sapiens
ELNKVQLLH

SEQ ID NO: 1166670 - protein, 9 aa, Homo Sapiens
GGRSRAEKP

SEQ ID NO: 1166671 - protein, 9 aa, Homo Sapiens
SRQMWDLDF

SEQ ID NO: 1166672 - protein, 9 aa, Homo Sapiens
GPCQTCMTR

SEQ ID NO: 1166673 - protein, 9 aa, Homo Sapiens
FQKPLIQWE

SEQ ID NO: 1166674 - protein, 9 aa, Homo Sapiens
QGPPAPAGP

SEQ ID NO: 1166675 - protein, 9 aa, Homo Sapiens
EDCSKNFTN

SEQ ID NO: 1166676 - protein, 9 aa, Homo Sapiens
LKTFHMKCF

SEQ ID NO: 1166677 - protein, 9 aa, Homo Sapiens
SLSVLWKLC

SEQ ID NO: 1166678 - protein, 9 aa, Homo Sapiens
LESAAINQI

SEQ ID NO: 1166679 - protein, 9 aa, Homo Sapiens
AHFNPQRRY

SEQ ID NO: 1166680 - protein, 9 aa, Homo Sapiens
SHQPRPGLP

SEQ ID NO: 1166681 - protein, 9 aa, Homo Sapiens
VQSILSDLR

SEQ ID NO: 1166682 - protein, 9 aa, Homo Sapiens
YPSNSFYVV

SEQ ID NO: 1166683 - protein, 9 aa, Homo Sapiens
YMGTDVISI

SEQ ID NO: 1166684 - protein, 9 aa, Homo Sapiens
YQNECYLQQ

SEQ ID NO: 1166685 - protein, 9 aa, Homo Sapiens
GVQHPAGGA

SEQ ID NO: 1166686 - protein, 9 aa, Homo Sapiens
PRLWASNAM

SEQ ID NO: 1166687 - protein, 9 aa, Homo Sapiens
PGRYLTGGL

SEQ ID NO: 1166688 - protein, 9 aa, Homo Sapiens
SRPRSAASL

SEQ ID NO: 1166689 - protein, 9 aa, Homo Sapiens
SWGPTAGAA

SEQ ID NO: 1166690 - protein, 9 aa, Homo Sapiens
EKDSGTQRG

SEQ ID NO: 1166691 - protein, 9 aa, Homo Sapiens
PAQPTVPRK

SEQ ID NO: 1166692 - protein, 9 aa, Homo Sapiens
TLSPVPSPL

SEQ ID NO: 1166693 - protein, 9 aa, Homo Sapiens
RTPTPAPPS

SEQ ID NO: 1166694 - protein, 9 aa, Homo Sapiens
GPGRGLPGA

SEQ ID NO: 1166695 - protein, 9 aa, Homo Sapiens
NSLLICDPL

SEQ ID NO: 1166696 - protein, 9 aa, Homo Sapiens
YTFGKECLT

SEQ ID NO: 1166697 - protein, 9 aa, Homo Sapiens
LKMIRRGDV

SEQ ID NO: 1166698 - protein, 9 aa, Homo Sapiens
APTPIPAPV

SEQ ID NO: 1166699 - protein, 9 aa, Homo Sapiens
TLSWATPST

SEQ ID NO: 1166700 - protein, 9 aa, Homo Sapiens
CTIQYRLRY

SEQ ID NO: 1166701 - protein, 9 aa, Homo Sapiens
YGGITLMWR

SEQ ID NO: 1166702 - protein, 9 aa, Homo Sapiens
VARTSANRG

SEQ ID NO: 1166703 - protein, 9 aa, Homo Sapiens
RASSPTCST

SEQ ID NO: 1166704 - protein, 9 aa, Homo Sapiens
APLHHSTGE

SEQ ID NO: 1166705 - protein, 9 aa, Homo Sapiens
ARAPWPSSA

SEQ ID NO: 1166706 - protein, 9 aa, Homo Sapiens
RGPGMPNSL

SEQ ID NO: 1166707 - protein, 9 aa, Homo Sapiens
TVTKGDVTY

SEQ ID NO: 1166708 - protein, 9 aa, Homo Sapiens
LNVIPSLGR

SEQ ID NO: 1166709 - protein, 9 aa, Homo Sapiens
IWEVMPRTL

SEQ ID NO: 1166710 - protein, 9 aa, Homo Sapiens
TCPTSNARW

SEQ ID NO: 1166711 - protein, 9 aa, Homo Sapiens
CHYKLFQDE

SEQ ID NO: 1166712 - protein, 9 aa, Homo Sapiens
PGRRGGQAS

SEQ ID NO: 1166713 - protein, 9 aa, Homo Sapiens
VMELLPTHT

SEQ ID NO: 1166714 - protein, 9 aa, Homo Sapiens
CSGHCSGCR

SEQ ID NO: 1166715 - protein, 9 aa, Homo Sapiens
PGWLPRLTR

SEQ ID NO: 1166716 - protein, 9 aa, Homo Sapiens
TRLSPESVE

SEQ ID NO: 1166717 - protein, 9 aa, Homo Sapiens
VGPPLRGPQ

SEQ ID NO: 1166718 - protein, 9 aa, Homo Sapiens
YFHWNWVGT

SEQ ID NO: 1166719 - protein, 9 aa, Homo Sapiens
PPSYGGSRR

SEQ ID NO: 1166720 - protein, 9 aa, Homo Sapiens
SVFVTQFFI

SEQ ID NO: 1166721 - protein, 9 aa, Homo Sapiens
RPPPGRLIR

SEQ ID NO: 1166722 - protein, 9 aa, Homo Sapiens
CIFQAVVQR

SEQ ID NO: 1166723 - protein, 9 aa, Homo Sapiens
RGTVHNQGE

SEQ ID NO: 1166724 - protein, 9 aa, Homo Sapiens
KCAFQAPPS

SEQ ID NO: 1166725 - protein, 9 aa, Homo Sapiens
KKSPSRVSL

SEQ ID NO: 1166726 - protein, 9 aa, Homo Sapiens
FIYEMAVGF

SEQ ID NO: 1166727 - protein, 9 aa, Homo Sapiens
PLRHKFLDS

SEQ ID NO: 1166728 - protein, 9 aa, Homo Sapiens
PGRGLPGAA

SEQ ID NO: 1166729 - protein, 9 aa, Homo Sapiens
HEDDDEDQQ

SEQ ID NO: 1166730 - protein, 9 aa, Homo Sapiens
MLEDVCRLI

SEQ ID NO: 1166731 - protein, 9 aa, Homo Sapiens
LRKEDEFVK

SEQ ID NO: 1166732 - protein, 9 aa, Homo Sapiens
SSSRTPTRR

SEQ ID NO: 1166733 - protein, 9 aa, Homo Sapiens
KKKDKKYKK

SEQ ID NO: 1166734 - protein, 9 aa, Homo Sapiens
DYVGIDSIL

SEQ ID NO: 1166735 - protein, 9 aa, Homo Sapiens
ARRASRAGT

SEQ ID NO: 1166736 - protein, 9 aa, Homo Sapiens
SRGSRETMG

SEQ ID NO: 1166737 - protein, 9 aa, Homo Sapiens
RSLPALKIW

SEQ ID NO: 1166738 - protein, 9 aa, Homo Sapiens
VLAQEEQGA

SEQ ID NO: 1166739 - protein, 9 aa, Homo Sapiens
GNKYQTTDN

SEQ ID NO: 1166740 - protein, 9 aa, Homo Sapiens
DGSQSGYCS

SEQ ID NO: 1166741 - protein, 9 aa, Homo Sapiens
SPRPGNATC

SEQ ID NO: 1166742 - protein, 9 aa, Homo Sapiens
LGGPPEYMG

SEQ ID NO: 1166743 - protein, 9 aa, Homo Sapiens
AASEAGGPV

SEQ ID NO: 1166744 - protein, 9 aa, Homo Sapiens
CCCSGNDGR

SEQ ID NO: 1166745 - protein, 9 aa, Homo Sapiens
KKVWNLQGL

SEQ ID NO: 1166746 - protein, 9 aa, Homo Sapiens
FENYYVAYS

SEQ ID NO: 1166747 - protein, 9 aa, Homo Sapiens
TLQELERLL

SEQ ID NO: 1166748 - protein, 9 aa, Homo Sapiens
PCGGGPSGF

SEQ ID NO: 1166749 - protein, 9 aa, Homo Sapiens
RAKSLPLSP

SEQ ID NO: 1166750 - protein, 9 aa, Homo Sapiens
AAPPSLRAA

SEQ ID NO: 1166751 - protein, 9 aa, Homo Sapiens
PASHVGGVR

SEQ ID NO: 1166752 - protein, 9 aa, Homo Sapiens
CDDKVSTII

SEQ ID NO: 1166753 - protein, 9 aa, Homo Sapiens
THLIAHQSL

SEQ ID NO: 1166754 - protein, 9 aa, Homo Sapiens
AHGKKVPTS

SEQ ID NO: 1166755 - protein, 9 aa, Homo Sapiens
LRLPISGSP

SEQ ID NO: 1166756 - protein, 9 aa, Homo Sapiens
TVHNQGEPS

SEQ ID NO: 1166757 - protein, 9 aa, Homo Sapiens
VRMTQEFLE

SEQ ID NO: 1166758 - protein, 9 aa, Homo Sapiens
DKMTHLKDL

SEQ ID NO: 1166759 - protein, 9 aa, Homo Sapiens
VDHEAESVL

SEQ ID NO: 1166760 - protein, 9 aa, Homo Sapiens
SSRTACGAA

SEQ ID NO: 1166761 - protein, 9 aa, Homo Sapiens
VYQALISNV

SEQ ID NO: 1166762 - protein, 9 aa, Homo Sapiens
RALTITGIC

SEQ ID NO: 1166763 - protein, 9 aa, Homo Sapiens
WAYREEPED

SEQ ID NO: 1166764 - protein, 9 aa, Homo Sapiens
MEFDFDDEP

SEQ ID NO: 1166765 - protein, 9 aa, Homo Sapiens
LLAYIAKIA

SEQ ID NO: 1166766 - protein, 9 aa, Homo Sapiens
GSPEWQDVH

SEQ ID NO: 1166767 - protein, 9 aa, Homo Sapiens
ATHVHSHPL

SEQ ID NO: 1166768 - protein, 9 aa, Homo Sapiens
TYFEFFNDA

SEQ ID NO: 1166769 - protein, 9 aa, Homo Sapiens
DDINFDIRF

SEQ ID NO: 1166770 - protein, 9 aa, Homo Sapiens
GHKKSLSDS

SEQ ID NO: 1166771 - protein, 9 aa, Homo Sapiens
LWYLDPDVE

SEQ ID NO: 1166772 - protein, 9 aa, Homo Sapiens
ANRTPTPAP

SEQ ID NO: 1166773 - protein, 9 aa, Homo Sapiens
KRNMKSSWM

SEQ ID NO: 1166774 - protein, 9 aa, Homo Sapiens
RLVLLIEGH

SEQ ID NO: 1166775 - protein, 9 aa, Homo Sapiens
QQEISVVHI

SEQ ID NO: 1166776 - protein, 9 aa, Homo Sapiens
TCTRPLKVG

SEQ ID NO: 1166777 - protein, 9 aa, Homo Sapiens
SPRPPSISK

SEQ ID NO: 1166778 - protein, 9 aa, Homo Sapiens
PRSYTTPWA

SEQ ID NO: 1166779 - protein, 9 aa, Homo Sapiens
HPPVYLHDV

SEQ ID NO: 1166780 - protein, 9 aa, Homo Sapiens
SVGTIHAMK

SEQ ID NO: 1166781 - protein, 9 aa, Homo Sapiens
PSRCCPSGK

SEQ ID NO: 1166782 - protein, 9 aa, Homo Sapiens
PGHRVPIRV

SEQ ID NO: 1166783 - protein, 9 aa, Homo Sapiens
SLFFCGAAN

SEQ ID NO: 1166784 - protein, 9 aa, Homo Sapiens
GLLEGFLQR

SEQ ID NO: 1166785 - protein, 9 aa, Homo Sapiens
TTFGELVQP

SEQ ID NO: 1166786 - protein, 9 aa, Homo Sapiens
PCGGCPSGF

SEQ ID NO: 1166787 - protein, 9 aa, Homo Sapiens
PGQLRARGS

SEQ ID NO: 1166788 - protein, 9 aa, Homo Sapiens
GQSYCCEHD

SEQ ID NO: 1166789 - protein, 9 aa, Homo Sapiens
VCKVKMCGS

SEQ ID NO: 1166790 - protein, 9 aa, Homo Sapiens
EESEEETTD

SEQ ID NO: 1166791 - protein, 9 aa, Homo Sapiens
MQGLPDLPS

SEQ ID NO: 1166792 - protein, 9 aa, Homo Sapiens
RPPPLSLPT

SEQ ID NO: 1166793 - protein, 9 aa, Homo Sapiens
QADGSSSGA

SEQ ID NO: 1166794 - protein, 9 aa, Homo Sapiens
PRAAQETSR

SEQ ID NO: 1166795 - protein, 9 aa, Homo Sapiens
CSLRAAAAR

SEQ ID NO: 1166796 - protein, 9 aa, Homo Sapiens
SIHFEMEEA

SEQ ID NO: 1166797 - protein, 9 aa, Homo Sapiens
GLRSDWLIR

SEQ ID NO: 1166798 - protein, 9 aa, Homo Sapiens
PMRNIMEPI

SEQ ID NO: 1166799 - protein, 9 aa, Homo Sapiens
DRKDIGSER

SEQ ID NO: 1166800 - protein, 9 aa, Homo Sapiens
AVLPVFEEI

SEQ ID NO: 1166801 - protein, 9 aa, Homo Sapiens
MCLARHSLG

SEQ ID NO: 1166802 - protein, 9 aa, Homo Sapiens
GPRYPVCLL

SEQ ID NO: 1166803 - protein, 9 aa, Homo Sapiens
LIKIHEKVG

SEQ ID NO: 1166804 - protein, 9 aa, Homo Sapiens
EFLQAHFNP

SEQ ID NO: 1166805 - protein, 9 aa, Homo Sapiens
KIPLLQESL

SEQ ID NO: 1166806 - protein, 9 aa, Homo Sapiens
GPGAWWGDR

SEQ ID NO: 1166807 - protein, 9 aa, Homo Sapiens
QMALNGKPT

SEQ ID NO: 1166808 - protein, 9 aa, Homo Sapiens
RLCVGRTPP

SEQ ID NO: 1166809 - protein, 9 aa, Homo Sapiens
LWCLFCNGS

SEQ ID NO: 1166810 - protein, 9 aa, Homo Sapiens
DRASRASLD

SEQ ID NO: 1166811 - protein, 9 aa, Homo Sapiens
AEQGSFEKK

SEQ ID NO: 1166812 - protein, 9 aa, Homo Sapiens
ARVLLLPVL

SEQ ID NO: 1166813 - protein, 9 aa, Homo Sapiens
ATPVARGPA

SEQ ID NO: 1166814 - protein, 9 aa, Homo Sapiens
QDVLRFSST

SEQ ID NO: 1166815 - protein, 9 aa, Homo Sapiens
DTRPRTAPA

SEQ ID NO: 1166816 - protein, 9 aa, Homo Sapiens
PLHKKKSVW

SEQ ID NO: 1166817 - protein, 9 aa, Homo Sapiens
QGEVVTFDY

SEQ ID NO: 1166818 - protein, 9 aa, Homo Sapiens
GPTARPARA

SEQ ID NO: 1166819 - protein, 9 aa, Homo Sapiens
NPNGTIESP

SEQ ID NO: 1166820 - protein, 9 aa, Homo Sapiens
PHPSSPVPQ

SEQ ID NO: 1166821 - protein, 9 aa, Homo Sapiens
ASEMEKTPT

SEQ ID NO: 1166822 - protein, 9 aa, Homo Sapiens
GVSRYISRC

SEQ ID NO: 1166823 - protein, 9 aa, Homo Sapiens
QPSSSTVTA

SEQ ID NO: 1166824 - protein, 9 aa, Homo Sapiens
SWYASLPSP

SEQ ID NO: 1166825 - protein, 9 aa, Homo Sapiens
DWETSHVTM

SEQ ID NO: 1166826 - protein, 9 aa, Homo Sapiens
TSRSTCARL

SEQ ID NO: 1166827 - protein, 9 aa, Homo Sapiens
FKCEECWET

SEQ ID NO: 1166828 - protein, 9 aa, Homo Sapiens
VLKEIDTST

SEQ ID NO: 1166829 - protein, 9 aa, Homo Sapiens
HSPARPATE

SEQ ID NO: 1166830 - protein, 9 aa, Homo Sapiens
ASACQGGFM

SEQ ID NO: 1166831 - protein, 9 aa, Homo Sapiens
YSLKIQVSS

SEQ ID NO: 1166832 - protein, 9 aa, Homo Sapiens
KTIEMVIPV

SEQ ID NO: 1166833 - protein, 9 aa, Homo Sapiens
PARQPSRPT

SEQ ID NO: 1166834 - protein, 9 aa, Homo Sapiens
RPLTTPPER

SEQ ID NO: 1166835 - protein, 9 aa, Homo Sapiens
TGSFASAFA

SEQ ID NO: 1166836 - protein, 9 aa, Homo Sapiens
EEIVNILQE

SEQ ID NO: 1166837 - protein, 9 aa, Homo Sapiens
RKRWITESG

SEQ ID NO: 1166838 - protein, 9 aa, Homo Sapiens
AKSYSAPHT

SEQ ID NO: 1166839 - protein, 9 aa, Homo Sapiens
LIHLVPRTR

SEQ ID NO: 1166840 - protein, 9 aa, Homo Sapiens
KHIEEQKEQ

SEQ ID NO: 1166841 - protein, 9 aa, Homo Sapiens
NPHPSARSL

SEQ ID NO: 1166842 - protein, 9 aa, Homo Sapiens
TSENTHRRE

SEQ ID NO: 1166843 - protein, 9 aa, Homo Sapiens
DPEMPKSLV

SEQ ID NO: 1166844 - protein, 9 aa, Homo Sapiens
KDNSELPSD

SEQ ID NO: 1166845 - protein, 9 aa, Homo Sapiens
KNGGTCAMA

SEQ ID NO: 1166846 - protein, 9 aa, Homo Sapiens
TCIVAPSQD

SEQ ID NO: 1166847 - protein, 9 aa, Homo Sapiens
SSPGVKAPD

SEQ ID NO: 1166848 - protein, 9 aa, Homo Sapiens
DDTCQVGQS

SEQ ID NO: 1166849 - protein, 9 aa, Homo Sapiens
STRSSGVWS

SEQ ID NO: 1166850 - protein, 9 aa, Homo Sapiens
AALSGDCCS

SEQ ID NO: 1166851 - protein, 9 aa, Homo Sapiens
LVAPRGLLC

SEQ ID NO: 1166852 - protein, 9 aa, Homo Sapiens
APQHLAASA

SEQ ID NO: 1166853 - protein, 9 aa, Homo Sapiens
LAVIGINHC

SEQ ID NO: 1166854 - protein, 9 aa, Homo Sapiens
QSNFNRDPL

SEQ ID NO: 1166855 - protein, 9 aa, Homo Sapiens
FIEHPEDET

SEQ ID NO: 1166856 - protein, 9 aa, Homo Sapiens
TYMEMHYGH

SEQ ID NO: 1166857 - protein, 9 aa, Homo Sapiens
EWHKNGVKI

SEQ ID NO: 1166858 - protein, 9 aa, Homo Sapiens
VYGLVGVKA

SEQ ID NO: 1166859 - protein, 9 aa, Homo Sapiens
RGSWKFIET

SEQ ID NO: 1166860 - protein, 9 aa, Homo Sapiens
EEMFSVFAP

SEQ ID NO: 1166861 - protein, 9 aa, Homo Sapiens
ASAFQNEEY

SEQ ID NO: 1166862 - protein, 9 aa, Homo Sapiens
TFGPSASIN

SEQ ID NO: 1166863 - protein, 9 aa, Homo Sapiens
DNLEKNSGS

SEQ ID NO: 1166864 - protein, 9 aa, Homo Sapiens
PHMPMEFDF

SEQ ID NO: 1166865 - protein, 9 aa, Homo Sapiens
DPEDGAQFP

SEQ ID NO: 1166866 - protein, 9 aa, Homo Sapiens
EGEEGEEGE

SEQ ID NO: 1166867 - protein, 9 aa, Homo Sapiens
VLIMHGDLF

SEQ ID NO: 1166868 - protein, 9 aa, Homo Sapiens
DAPPELFLL

SEQ ID NO: 1166869 - protein, 9 aa, Homo Sapiens
PNFCWLSLQ

SEQ ID NO: 1166870 - protein, 9 aa, Homo Sapiens
FSKELKKLK

SEQ ID NO: 1166871 - protein, 9 aa, Homo Sapiens
VQNGDSLVH

SEQ ID NO: 1166872 - protein, 9 aa, Homo Sapiens
SKELKKLKT

SEQ ID NO: 1166873 - protein, 9 aa, Homo Sapiens
KNVWLAERL

SEQ ID NO: 1166874 - protein, 9 aa, Homo Sapiens
PCGVPSGSC

SEQ ID NO: 1166875 - protein, 9 aa, Homo Sapiens
HPFTATTKP

SEQ ID NO: 1166876 - protein, 9 aa, Homo Sapiens
GMVEGGVSG

SEQ ID NO: 1166877 - protein, 9 aa, Homo Sapiens
ENTHRRETL

SEQ ID NO: 1166878 - protein, 9 aa, Homo Sapiens
PWKATAWMS

SEQ ID NO: 1166879 - protein, 9 aa, Homo Sapiens
ARPDDLETY

SEQ ID NO: 1166880 - protein, 9 aa, Homo Sapiens
ATSAVSVAA

SEQ ID NO: 1166881 - protein, 9 aa, Homo Sapiens
CFSGTYPGD

SEQ ID NO: 1166882 - protein, 9 aa, Homo Sapiens
NMGAWGDYD

SEQ ID NO: 1166883 - protein, 9 aa, Homo Sapiens
RRRLLRCSP

SEQ ID NO: 1166884 - protein, 9 aa, Homo Sapiens
SPSVALAER

SEQ ID NO: 1166885 - protein, 9 aa, Homo Sapiens
AQLWARARA

SEQ ID NO: 1166886 - protein, 9 aa, Homo Sapiens
APHTETAKM

SEQ ID NO: 1166887 - protein, 9 aa, Homo Sapiens
WKGTESPFS

SEQ ID NO: 1166888 - protein, 9 aa, Homo Sapiens
PAPPSCSGA

SEQ ID NO: 1166889 - protein, 9 aa, Homo Sapiens
LFPRYTLGA

SEQ ID NO: 1166890 - protein, 9 aa, Homo Sapiens
CPSFIPTTT

SEQ ID NO: 1166891 - protein, 9 aa, Homo Sapiens
SIQILNLSS

SEQ ID NO: 1166892 - protein, 9 aa, Homo Sapiens
DDPCTSVKR

SEQ ID NO: 1166893 - protein, 9 aa, Homo Sapiens
ITNCSSWPC

SEQ ID NO: 1166894 - protein, 9 aa, Homo Sapiens
FYYKLAGFF

SEQ ID NO: 1166895 - protein, 9 aa, Homo Sapiens
SRWPWRGRR

SEQ ID NO: 1166896 - protein, 9 aa, Homo Sapiens
LQEFGGAVE

SEQ ID NO: 1166897 - protein, 9 aa, Homo Sapiens
LLLFLPTLQ

SEQ ID NO: 1166898 - protein, 9 aa, Homo Sapiens
GTPAPRPPA

SEQ ID NO: 1166899 - protein, 9 aa, Homo Sapiens
AGCAIGARN

SEQ ID NO: 1166900 - protein, 9 aa, Homo Sapiens
QGNCTKPFV

SEQ ID NO: 1166901 - protein, 9 aa, Homo Sapiens
EKTQQSSLH

SEQ ID NO: 1166902 - protein, 9 aa, Homo Sapiens
VPPLLRGLP

SEQ ID NO: 1166903 - protein, 9 aa, Homo Sapiens
RLMAPVGSV

SEQ ID NO: 1166904 - protein, 9 aa, Homo Sapiens
GCEEEEGCE

SEQ ID NO: 1166905 - protein, 9 aa, Homo Sapiens
QLLDVLDHG

SEQ ID NO: 1166906 - protein, 9 aa, Homo Sapiens
SAAPSMVAR

SEQ ID NO: 1166907 - protein, 9 aa, Homo Sapiens
ARHSGRGPE

SEQ ID NO: 1166908 - protein, 9 aa, Homo Sapiens
LIEGHYVHV

SEQ ID NO: 1166909 - protein, 9 aa, Homo Sapiens
ASACSAAGR

SEQ ID NO: 1166910 - protein, 9 aa, Homo Sapiens
RTAVEQWHN

SEQ ID NO: 1166911 - protein, 9 aa, Homo Sapiens
SAKGDDTYL

SEQ ID NO: 1166912 - protein, 9 aa, Homo Sapiens
FYYTFGKEC

SEQ ID NO: 1166913 - protein, 9 aa, Homo Sapiens
RTAGRLESS

SEQ ID NO: 1166914 - protein, 9 aa, Homo Sapiens
QCLTSTTPR

SEQ ID NO: 1166915 - protein, 9 aa, Homo Sapiens
DLVRPWGLA

SEQ ID NO: 1166916 - protein, 9 aa, Homo Sapiens
LSPVRSGAL

SEQ ID NO: 1166917 - protein, 9 aa, Homo Sapiens
AGSPSDMLR

SEQ ID NO: 1166918 - protein, 9 aa, Homo Sapiens
CATRRMKLR

SEQ ID NO: 1166919 - protein, 9 aa, Homo Sapiens
QRWKLLLFK

SEQ ID NO: 1166920 - protein, 9 aa, Homo Sapiens
AVLLILLLE

SEQ ID NO: 1166921 - protein, 9 aa, Homo Sapiens
PVEPGQPPR

SEQ ID NO: 1166922 - protein, 9 aa, Homo Sapiens
ASPLFACCS

SEQ ID NO: 1166923 - protein, 9 aa, Homo Sapiens
TCSRRPTAR

SEQ ID NO: 1166924 - protein, 9 aa, Homo Sapiens
LTVPYAGVY

SEQ ID NO: 1166925 - protein, 9 aa, Homo Sapiens
GMQRRRKIL

SEQ ID NO: 1166926 - protein, 9 aa, Homo Sapiens
EVNSRSLAR

SEQ ID NO: 1166927 - protein, 9 aa, Homo Sapiens
ICKEDTAFN

SEQ ID NO: 1166928 - protein, 9 aa, Homo Sapiens
GLAWSKQGP

SEQ ID NO: 1166929 - protein, 9 aa, Homo Sapiens
ALYPATTTS

SEQ ID NO: 1166930 - protein, 9 aa, Homo Sapiens
NFKKHSIST

SEQ ID NO: 1166931 - protein, 9 aa, Homo Sapiens
SQFKRTRTR

SEQ ID NO: 1166932 - protein, 9 aa, Homo Sapiens
LGSGHLRPP

SEQ ID NO: 1166933 - protein, 9 aa, Homo Sapiens
ESNTMHAIN

SEQ ID NO: 1166934 - protein, 9 aa, Homo Sapiens
SPVIPLLES

SEQ ID NO: 1166935 - protein, 9 aa, Homo Sapiens
LAFSSGSQP

SEQ ID NO: 1166936 - protein, 9 aa, Homo Sapiens
ESPYPMTTA

SEQ ID NO: 1166937 - protein, 9 aa, Homo Sapiens
SGKWECTVS

SEQ ID NO: 1166938 - protein, 9 aa, Homo Sapiens
CEEEEGCED

SEQ ID NO: 1166939 - protein, 9 aa, Homo Sapiens
WPVPPHPGQ

SEQ ID NO: 1166940 - protein, 9 aa, Homo Sapiens
GLEVRRLVI

SEQ ID NO: 1166941 - protein, 9 aa, Homo Sapiens
DYRLMMLQS

SEQ ID NO: 1166942 - protein, 9 aa, Homo Sapiens
ECDEECMHC

SEQ ID NO: 1166943 - protein, 9 aa, Homo Sapiens
ARWTCCVPS

SEQ ID NO: 1166944 - protein, 9 aa, Homo Sapiens
LGAEKRKVE

SEQ ID NO: 1166945 - protein, 9 aa, Homo Sapiens
GAVARAASH

SEQ ID NO: 1166946 - protein, 9 aa, Homo Sapiens
VAAAHKVCP

SEQ ID NO: 1166947 - protein, 9 aa, Homo Sapiens
DRGCSCFLP

SEQ ID NO: 1166948 - protein, 9 aa, Homo Sapiens
LCPSCRSLA

SEQ ID NO: 1166949 - protein, 9 aa, Homo Sapiens
LDALARGAG

SEQ ID NO: 1166950 - protein, 9 aa, Homo Sapiens
SAGKGSTTS

SEQ ID NO: 1166951 - protein, 9 aa, Homo Sapiens
CPVRRFQKP

SEQ ID NO: 1166952 - protein, 9 aa, Homo Sapiens
EQLQKLKVE

SEQ ID NO: 1166953 - protein, 9 aa, Homo Sapiens
TSCFGPSKI

SEQ ID NO: 1166954 - protein, 9 aa, Homo Sapiens
GSPREARAL

SEQ ID NO: 1166955 - protein, 9 aa, Homo Sapiens
KAIVRICQT

SEQ ID NO: 1166956 - protein, 9 aa, Homo Sapiens
KEELLEEIY

SEQ ID NO: 1166957 - protein, 9 aa, Homo Sapiens
PQTVKSASL

SEQ ID NO: 1166958 - protein, 9 aa, Homo Sapiens
MAKSYSAPH

SEQ ID NO: 1166959 - protein, 9 aa, Homo Sapiens
ETTFAFPAP

SEQ ID NO: 1166960 - protein, 9 aa, Homo Sapiens
LDLVRVRMA

SEQ ID NO: 1166961 - protein, 9 aa, Homo Sapiens
MLRCLRFPG

SEQ ID NO: 1166962 - protein, 9 aa, Homo Sapiens
AMALQSNQN

SEQ ID NO: 1166963 - protein, 9 aa, Homo Sapiens
KTISQYASE

SEQ ID NO: 1166964 - protein, 9 aa, Homo Sapiens
GPRLWASNA

SEQ ID NO: 1166965 - protein, 9 aa, Homo Sapiens
VQGNEDCVG

SEQ ID NO: 1166966 - protein, 9 aa, Homo Sapiens
RACAASERL

SEQ ID NO: 1166967 - protein, 9 aa, Homo Sapiens
RAPGCSLRA

SEQ ID NO: 1166968 - protein, 9 aa, Homo Sapiens
VFRIVLMAV

SEQ ID NO: 1166969 - protein, 9 aa, Homo Sapiens
ITQENDLAL

SEQ ID NO: 1166970 - protein, 9 aa, Homo Sapiens
RKGSLQCEC

SEQ ID NO: 1166971 - protein, 9 aa, Homo Sapiens
KNMVGEWVL

SEQ ID NO: 1166972 - protein, 9 aa, Homo Sapiens
WWACATRRM

SEQ ID NO: 1166973 - protein, 9 aa, Homo Sapiens
LLSLFPRAL

SEQ ID NO: 1166974 - protein, 9 aa, Homo Sapiens
NVVEMMIAR

SEQ ID NO: 1166975 - protein, 9 aa, Homo Sapiens
VPQPQSGGA

SEQ ID NO: 1166976 - protein, 9 aa, Homo Sapiens
PLGLSVPAD

SEQ ID NO: 1166977 - protein, 9 aa, Homo Sapiens
QPHLQPPFC

SEQ ID NO: 1166978 - protein, 9 aa, Homo Sapiens
STEVNSPPP

SEQ ID NO: 1166979 - protein, 9 aa, Homo Sapiens
SATRQPPPA

SEQ ID NO: 1166980 - protein, 9 aa, Homo Sapiens
TTKNFSCQW

SEQ ID NO: 1166981 - protein, 9 aa, Homo Sapiens
QPHLTWKLW

SEQ ID NO: 1166982 - protein, 9 aa, Homo Sapiens
LAAKQKKSR

SEQ ID NO: 1166983 - protein, 9 aa, Homo Sapiens
RWGPSLPSR

SEQ ID NO: 1166984 - protein, 9 aa, Homo Sapiens
VKTPLVEEG

SEQ ID NO: 1166985 - protein, 9 aa, Homo Sapiens
GCLTWLIGG

SEQ ID NO: 1166986 - protein, 9 aa, Homo Sapiens
DESEEEEGD

SEQ ID NO: 1166987 - protein, 9 aa, Homo Sapiens
DDQDHGAAQ

SEQ ID NO: 1166988 - protein, 9 aa, Homo Sapiens
YFPPPPCIA

SEQ ID NO: 1166989 - protein, 9 aa, Homo Sapiens
FQCVSVLLT

SEQ ID NO: 1166990 - protein, 9 aa, Homo Sapiens
SSASISPVT

SEQ ID NO: 1166991 - protein, 9 aa, Homo Sapiens
SSSASISPV

SEQ ID NO: 1166992 - protein, 9 aa, Homo Sapiens
ALWASSSSS

SEQ ID NO: 1166993 - protein, 9 aa, Homo Sapiens
CNKPSTNNT

SEQ ID NO: 1166994 - protein, 9 aa, Homo Sapiens
PPPGWLPRL

SEQ ID NO: 1166995 - protein, 9 aa, Homo Sapiens
PSTSNSQCL

SEQ ID NO: 1166996 - protein, 9 aa, Homo Sapiens
QAMAYTEEK

SEQ ID NO: 1166997 - protein, 9 aa, Homo Sapiens
QPSRPTGRT

SEQ ID NO: 1166998 - protein, 9 aa, Homo Sapiens
VGSVMSCSL

SEQ ID NO: 1166999 - protein, 9 aa, Homo Sapiens
RGDLGCPTM

SEQ ID NO: 1167000 - protein, 9 aa, Homo Sapiens
IPSIQILNL

SEQ ID NO: 1167001 - protein, 9 aa, Homo Sapiens
NMKMKTFMK

SEQ ID NO: 1167002 - protein, 9 aa, Homo Sapiens
VSPRSTTAR

SEQ ID NO: 1167003 - protein, 9 aa, Homo Sapiens
MSAIFDFRV

SEQ ID NO: 1167004 - protein, 9 aa, Homo Sapiens
TPRVLTQAS

SEQ ID NO: 1167005 - protein, 9 aa, Homo Sapiens
PHMPPATSI

SEQ ID NO: 1167006 - protein, 9 aa, Homo Sapiens
GNLSMEDFL

SEQ ID NO: 1167007 - protein, 9 aa, Homo Sapiens
HREILIKEG

SEQ ID NO: 1167008 - protein, 9 aa, Homo Sapiens
TKIYSQRSY

SEQ ID NO: 1167009 - protein, 9 aa, Homo Sapiens
LSWYQRSSC

SEQ ID NO: 1167010 - protein, 9 aa, Homo Sapiens
SLLSPCNAS

SEQ ID NO: 1167011 - protein, 9 aa, Homo Sapiens
QLLCPRVLP

SEQ ID NO: 1167012 - protein, 9 aa, Homo Sapiens
KKWDHEAIE

SEQ ID NO: 1167013 - protein, 9 aa, Homo Sapiens
TALVMQSFG

SEQ ID NO: 1167014 - protein, 9 aa, Homo Sapiens
MGQRHRLED

SEQ ID NO: 1167015 - protein, 9 aa, Homo Sapiens
MGPGGLRSG

SEQ ID NO: 1167016 - protein, 9 aa, Homo Sapiens
VEEIVNILQ

SEQ ID NO: 1167017 - protein, 9 aa, Homo Sapiens
AHKGKISPV

SEQ ID NO: 1167018 - protein, 9 aa, Homo Sapiens
VALSRPPGP

SEQ ID NO: 1167019 - protein, 9 aa, Homo Sapiens
DSIQKEPRE

SEQ ID NO: 1167020 - protein, 9 aa, Homo Sapiens
WYHTLHPAP

SEQ ID NO: 1167021 - protein, 9 aa, Homo Sapiens
LSTESGNVF

SEQ ID NO: 1167022 - protein, 9 aa, Homo Sapiens
CPTSRSRAA

SEQ ID NO: 1167023 - protein, 9 aa, Homo Sapiens
FLVKRPSLH

SEQ ID NO: 1167024 - protein, 9 aa, Homo Sapiens
PYECNTRRK

SEQ ID NO: 1167025 - protein, 9 aa, Homo Sapiens
SALLITASY

SEQ ID NO: 1167026 - protein, 9 aa, Homo Sapiens
KFWHKKWIS

SEQ ID NO: 1167027 - protein, 9 aa, Homo Sapiens
RGQPSPPFG

SEQ ID NO: 1167028 - protein, 9 aa, Homo Sapiens
SWAAMRSAR

SEQ ID NO: 1167029 - protein, 9 aa, Homo Sapiens
NKYDPPLKW

SEQ ID NO: 1167030 - protein, 9 aa, Homo Sapiens
TSWGPTAGA

SEQ ID NO: 1167031 - protein, 9 aa, Homo Sapiens
ACEKCLGCC

SEQ ID NO: 1167032 - protein, 9 aa, Homo Sapiens
SSQRRFWEQ

SEQ ID NO: 1167033 - protein, 9 aa, Homo Sapiens
YTKPGAEKA

SEQ ID NO: 1167034 - protein, 9 aa, Homo Sapiens
KIASELSHR

SEQ ID NO: 1167035 - protein, 9 aa, Homo Sapiens
KRSRAREEQ

SEQ ID NO: 1167036 - protein, 9 aa, Homo Sapiens
PLPVWMSLL

SEQ ID NO: 1167037 - protein, 9 aa, Homo Sapiens
FSFPQLPVG

SEQ ID NO: 1167038 - protein, 9 aa, Homo Sapiens
TTAIDMQVG

SEQ ID NO: 1167039 - protein, 9 aa, Homo Sapiens
SFQLHQGGE

SEQ ID NO: 1167040 - protein, 9 aa, Homo Sapiens
RCCCSGNDG

SEQ ID NO: 1167041 - protein, 9 aa, Homo Sapiens
PRWSRPLQG

SEQ ID NO: 1167042 - protein, 9 aa, Homo Sapiens
EKNPPLRFN

SEQ ID NO: 1167043 - protein, 9 aa, Homo Sapiens
AAWPEWRIC

SEQ ID NO: 1167044 - protein, 9 aa, Homo Sapiens
HSHIPLCPK

SEQ ID NO: 1167045 - protein, 9 aa, Homo Sapiens
REGRARVLL

SEQ ID NO: 1167046 - protein, 9 aa, Homo Sapiens
PVFFEEKNQ

SEQ ID NO: 1167047 - protein, 9 aa, Homo Sapiens
PYFIRSIQD

SEQ ID NO: 1167048 - protein, 9 aa, Homo Sapiens
RGQRLLGLA

SEQ ID NO: 1167049 - protein, 9 aa, Homo Sapiens
LLGLARPLS

SEQ ID NO: 1167050 - protein, 9 aa, Homo Sapiens
TKCAFQAPP

SEQ ID NO: 1167051 - protein, 9 aa, Homo Sapiens
LLPYQTCSA

SEQ ID NO: 1167052 - protein, 9 aa, Homo Sapiens
GRGPGRGLP

SEQ ID NO: 1167053 - protein, 9 aa, Homo Sapiens
VCARGRHAH

SEQ ID NO: 1167054 - protein, 9 aa, Homo Sapiens
LLEETPPRE

SEQ ID NO: 1167055 - protein, 9 aa, Homo Sapiens
AESHLFYKV

SEQ ID NO: 1167056 - protein, 9 aa, Homo Sapiens
KEAMGLCKA

SEQ ID NO: 1167057 - protein, 9 aa, Homo Sapiens
CAMASNTAR

SEQ ID NO: 1167058 - protein, 9 aa, Homo Sapiens
RMRALYDYD

SEQ ID NO: 1167059 - protein, 9 aa, Homo Sapiens
AAANKLVRH

SEQ ID NO: 1167060 - protein, 9 aa, Homo Sapiens
DDQGGAAQL

SEQ ID NO: 1167061 - protein, 9 aa, Homo Sapiens
STQARSPSS

SEQ ID NO: 1167062 - protein, 9 aa, Homo Sapiens
QHTPAPGPP

SEQ ID NO: 1167063 - protein, 9 aa, Homo Sapiens
RIHLDPLPS

SEQ ID NO: 1167064 - protein, 9 aa, Homo Sapiens
HTPTVRLLE

SEQ ID NO: 1167065 - protein, 9 aa, Homo Sapiens
HGGRPGGSG

SEQ ID NO: 1167066 - protein, 9 aa, Homo Sapiens
GLEADMWVH

SEQ ID NO: 1167067 - protein, 9 aa, Homo Sapiens
LTGQRNPYA

SEQ ID NO: 1167068 - protein, 9 aa, Homo Sapiens
YRRGRDKSP

SEQ ID NO: 1167069 - protein, 9 aa, Homo Sapiens
LECEKTSLL

SEQ ID NO: 1167070 - protein, 9 aa, Homo Sapiens
ELPAPCSLF

SEQ ID NO: 1167071 - protein, 9 aa, Homo Sapiens
LTPPLPPPP

SEQ ID NO: 1167072 - protein, 9 aa, Homo Sapiens
RSGANRTPT

SEQ ID NO: 1167073 - protein, 9 aa, Homo Sapiens
RTESPPCSR

SEQ ID NO: 1167074 - protein, 9 aa, Homo Sapiens
ELLAWDPPR

SEQ ID NO: 1167075 - protein, 9 aa, Homo Sapiens
GWPGLWPRR

SEQ ID NO: 1167076 - protein, 9 aa, Homo Sapiens
QEMVKNHIF

SEQ ID NO: 1167077 - protein, 9 aa, Homo Sapiens
EVLLSLMSD

SEQ ID NO: 1167078 - protein, 9 aa, Homo Sapiens
LVRHTEKKL

SEQ ID NO: 1167079 - protein, 9 aa, Homo Sapiens
KIITWALQG

SEQ ID NO: 1167080 - protein, 9 aa, Homo Sapiens
PRISPSLAI

SEQ ID NO: 1167081 - protein, 9 aa, Homo Sapiens
TGCHPTPVV

SEQ ID NO: 1167082 - protein, 9 aa, Homo Sapiens
ATTTSSQPS

SEQ ID NO: 1167083 - protein, 9 aa, Homo Sapiens
YSYTCICIH

SEQ ID NO: 1167084 - protein, 9 aa, Homo Sapiens
GGMVYTIGG

SEQ ID NO: 1167085 - protein, 9 aa, Homo Sapiens
SHIPLCPKH

SEQ ID NO: 1167086 - protein, 9 aa, Homo Sapiens
GMPRALWAS

SEQ ID NO: 1167087 - protein, 9 aa, Homo Sapiens
NMVAETECR

SEQ ID NO: 1167088 - protein, 9 aa, Homo Sapiens
HPSARSLSW

SEQ ID NO: 1167089 - protein, 9 aa, Homo Sapiens
RAGGAPAAA

SEQ ID NO: 1167090 - protein, 9 aa, Homo Sapiens
GHTQQDPEM

SEQ ID NO: 1167091 - protein, 9 aa, Homo Sapiens
SPCSPTTPS

SEQ ID NO: 1167092 - protein, 9 aa, Homo Sapiens
VILVGNKCA

SEQ ID NO: 1167093 - protein, 9 aa, Homo Sapiens
SALQGLAQV

SEQ ID NO: 1167094 - protein, 9 aa, Homo Sapiens
DAPEGKELM

SEQ ID NO: 1167095 - protein, 9 aa, Homo Sapiens
RTFVPSSSE

SEQ ID NO: 1167096 - protein, 9 aa, Homo Sapiens
PVPQLLLAH

SEQ ID NO: 1167097 - protein, 9 aa, Homo Sapiens
SVTPPTRGS

SEQ ID NO: 1167098 - protein, 9 aa, Homo Sapiens
SSPTCSTTT

SEQ ID NO: 1167099 - protein, 9 aa, Homo Sapiens
GGSPEWQDV

SEQ ID NO: 1167100 - protein, 9 aa, Homo Sapiens
EFIEGGRPC

SEQ ID NO: 1167101 - protein, 9 aa, Homo Sapiens
LGSMLAVAF

SEQ ID NO: 1167102 - protein, 9 aa, Homo Sapiens
RRLLTSIVI

SEQ ID NO: 1167103 - protein, 9 aa, Homo Sapiens
VELFKDVEG

SEQ ID NO: 1167104 - protein, 9 aa, Homo Sapiens
HNYLVQTEE

SEQ ID NO: 1167105 - protein, 9 aa, Homo Sapiens
LSYQCSQFA

SEQ ID NO: 1167106 - protein, 9 aa, Homo Sapiens
LVKCTSSIS

SEQ ID NO: 1167107 - protein, 9 aa, Homo Sapiens
HPGRAGGAP

SEQ ID NO: 1167108 - protein, 9 aa, Homo Sapiens
GLMANYHYF

SEQ ID NO: 1167109 - protein, 9 aa, Homo Sapiens
TSMNFVQKY

SEQ ID NO: 1167110 - protein, 9 aa, Homo Sapiens
PQGPPGPQD

SEQ ID NO: 1167111 - protein, 9 aa, Homo Sapiens
ALVATSPPA

SEQ ID NO: 1167112 - protein, 9 aa, Homo Sapiens
PSWGWGWAR

SEQ ID NO: 1167113 - protein, 9 aa, Homo Sapiens
QDCGDLRGL

SEQ ID NO: 1167114 - protein, 9 aa, Homo Sapiens
QEEAGGASQ

SEQ ID NO: 1167115 - protein, 9 aa, Homo Sapiens
PGAAGHPCR

SEQ ID NO: 1167116 - protein, 9 aa, Homo Sapiens
PTGPLFFME

SEQ ID NO: 1167117 - protein, 9 aa, Homo Sapiens
LDTGIPFPR

SEQ ID NO: 1167118 - protein, 9 aa, Homo Sapiens
EIAIQKPLC

SEQ ID NO: 1167119 - protein, 9 aa, Homo Sapiens
QQRGHDDAP

SEQ ID NO: 1167120 - protein, 9 aa, Homo Sapiens
DMLGGMGFL

SEQ ID NO: 1167121 - protein, 9 aa, Homo Sapiens
GHRPRRAPR

SEQ ID NO: 1167122 - protein, 9 aa, Homo Sapiens
PGAPRGQHT

SEQ ID NO: 1167123 - protein, 9 aa, Homo Sapiens
VDGIHEFQD

SEQ ID NO: 1167124 - protein, 9 aa, Homo Sapiens
PISKVGKEI

SEQ ID NO: 1167125 - protein, 9 aa, Homo Sapiens
GTGGIYQKP

SEQ ID NO: 1167126 - protein, 9 aa, Homo Sapiens
GCWARVPGS

SEQ ID NO: 1167127 - protein, 9 aa, Homo Sapiens
DDVCDFIDN

SEQ ID NO: 1167128 - protein, 9 aa, Homo Sapiens
TIFAPSLEM

SEQ ID NO: 1167129 - protein, 9 aa, Homo Sapiens
PGTPPMPAW

SEQ ID NO: 1167130 - protein, 9 aa, Homo Sapiens
KSLPLSPSV

SEQ ID NO: 1167131 - protein, 9 aa, Homo Sapiens
FFLMFINLG

SEQ ID NO: 1167132 - protein, 9 aa, Homo Sapiens
RSTCGRRTR

SEQ ID NO: 1167133 - protein, 9 aa, Homo Sapiens
AVWPIYPAG

SEQ ID NO: 1167134 - protein, 9 aa, Homo Sapiens
YTQRNSFQS

SEQ ID NO: 1167135 - protein, 9 aa, Homo Sapiens
LVRIFSLNL

SEQ ID NO: 1167136 - protein, 9 aa, Homo Sapiens
RILWFKVVT

SEQ ID NO: 1167137 - protein, 9 aa, Homo Sapiens
APTPPPTWS

SEQ ID NO: 1167138 - protein, 9 aa, Homo Sapiens
AGAGSAPQT

SEQ ID NO: 1167139 - protein, 9 aa, Homo Sapiens
DHTDNNDRT

SEQ ID NO: 1167140 - protein, 9 aa, Homo Sapiens
GAQEVETMT

SEQ ID NO: 1167141 - protein, 9 aa, Homo Sapiens
DLFCYRWLL

SEQ ID NO: 1167142 - protein, 9 aa, Homo Sapiens
AKQKKSRKC

SEQ ID NO: 1167143 - protein, 9 aa, Homo Sapiens
TRPTWNPAA

SEQ ID NO: 1167144 - protein, 9 aa, Homo Sapiens
QAVMYAPVK

SEQ ID NO: 1167145 - protein, 9 aa, Homo Sapiens
PSLSRWPWR

SEQ ID NO: 1167146 - protein, 9 aa, Homo Sapiens
EHLFRWILT

SEQ ID NO: 1167147 - protein, 9 aa, Homo Sapiens
TAMPQMQLQ

SEQ ID NO: 1167148 - protein, 9 aa, Homo Sapiens
VSFQPFCSL

SEQ ID NO: 1167149 - protein, 9 aa, Homo Sapiens
SAGSVKSIT

SEQ ID NO: 1167150 - protein, 9 aa, Homo Sapiens
VQHPAGGAA

SEQ ID NO: 1167151 - protein, 9 aa, Homo Sapiens
LHLALGHAQ

SEQ ID NO: 1167152 - protein, 9 aa, Homo Sapiens
RSLARCLIL

SEQ ID NO: 1167153 - protein, 9 aa, Homo Sapiens
PHQGSGAAW

SEQ ID NO: 1167154 - protein, 9 aa, Homo Sapiens
IASELSHRS

SEQ ID NO: 1167155 - protein, 9 aa, Homo Sapiens
ILWTIRLPR

SEQ ID NO: 1167156 - protein, 9 aa, Homo Sapiens
QATPLPVAD

SEQ ID NO: 1167157 - protein, 9 aa, Homo Sapiens
PTCSTTTAP

SEQ ID NO: 1167158 - protein, 9 aa, Homo Sapiens
LLGKMDYRL

SEQ ID NO: 1167159 - protein, 9 aa, Homo Sapiens
PKARGGAAA

SEQ ID NO: 1167160 - protein, 9 aa, Homo Sapiens
QPTVPRKTL

SEQ ID NO: 1167161 - protein, 9 aa, Homo Sapiens
QELVCIVSG

SEQ ID NO: 1167162 - protein, 9 aa, Homo Sapiens
CPPHRWTAH

SEQ ID NO: 1167163 - protein, 9 aa, Homo Sapiens
PPCCTTSCC

SEQ ID NO: 1167164 - protein, 9 aa, Homo Sapiens
LQGEVVTFD

SEQ ID NO: 1167165 - protein, 9 aa, Homo Sapiens
GCFLRIRQT

SEQ ID NO: 1167166 - protein, 9 aa, Homo Sapiens
HILGKEKIA

SEQ ID NO: 1167167 - protein, 9 aa, Homo Sapiens
EGYFGAVRQ

SEQ ID NO: 1167168 - protein, 9 aa, Homo Sapiens
WGRLTGQRC

SEQ ID NO: 1167169 - protein, 9 aa, Homo Sapiens
DSGHYQLRV

SEQ ID NO: 1167170 - protein, 9 aa, Homo Sapiens
SNRTVRMTQ

SEQ ID NO: 1167171 - protein, 9 aa, Homo Sapiens
VGPHPLVAN

SEQ ID NO: 1167172 - protein, 9 aa, Homo Sapiens
GVWSPFRAE

SEQ ID NO: 1167173 - protein, 9 aa, Homo Sapiens
RSESEPEKA

SEQ ID NO: 1167174 - protein, 9 aa, Homo Sapiens
ANVNEKIKI

SEQ ID NO: 1167175 - protein, 9 aa, Homo Sapiens
FISREKRGT

SEQ ID NO: 1167176 - protein, 9 aa, Homo Sapiens
PWSGTSAAR

SEQ ID NO: 1167177 - protein, 9 aa, Homo Sapiens
GSPHDIRIE

SEQ ID NO: 1167178 - protein, 9 aa, Homo Sapiens
TIQIAIIDF

SEQ ID NO: 1167179 - protein, 9 aa, Homo Sapiens
IWPILQQVA

SEQ ID NO: 1167180 - protein, 9 aa, Homo Sapiens
MVSSVTYGG

SEQ ID NO: 1167181 - protein, 9 aa, Homo Sapiens
SKILLSLIF

SEQ ID NO: 1167182 - protein, 9 aa, Homo Sapiens
KLLDKVTIA

SEQ ID NO: 1167183 - protein, 9 aa, Homo Sapiens
EAPCTPRRR

SEQ ID NO: 1167184 - protein, 9 aa, Homo Sapiens
PWALIFFSI

SEQ ID NO: 1167185 - protein, 9 aa, Homo Sapiens
NSLCSPHNL

SEQ ID NO: 1167186 - protein, 9 aa, Homo Sapiens
SWLPCRGPM

SEQ ID NO: 1167187 - protein, 9 aa, Homo Sapiens
PVDLIHRDI

SEQ ID NO: 1167188 - protein, 9 aa, Homo Sapiens
GMVVRTTSS

SEQ ID NO: 1167189 - protein, 9 aa, Homo Sapiens
TVRDGGSPS

SEQ ID NO: 1167190 - protein, 9 aa, Homo Sapiens
IGGGWPGWR

SEQ ID NO: 1167191 - protein, 9 aa, Homo Sapiens
LLELERLRE

SEQ ID NO: 1167192 - protein, 9 aa, Homo Sapiens
SASFTVAKG

SEQ ID NO: 1167193 - protein, 9 aa, Homo Sapiens
RRRMALAGW

SEQ ID NO: 1167194 - protein, 9 aa, Homo Sapiens
PRSTCGRRT

SEQ ID NO: 1167195 - protein, 9 aa, Homo Sapiens
RTSRSPDTR

SEQ ID NO: 1167196 - protein, 9 aa, Homo Sapiens
ENEDVCFIV

SEQ ID NO: 1167197 - protein, 9 aa, Homo Sapiens
RRRTCALRM

SEQ ID NO: 1167198 - protein, 9 aa, Homo Sapiens
GRPPCPPGR

SEQ ID NO: 1167199 - protein, 9 aa, Homo Sapiens
VTTRYRWVA

SEQ ID NO: 1167200 - protein, 9 aa, Homo Sapiens
SFLQPSPQT

SEQ ID NO: 1167201 - protein, 9 aa, Homo Sapiens
SSSTGTRAS

SEQ ID NO: 1167202 - protein, 9 aa, Homo Sapiens
SAWRTPVSY

SEQ ID NO: 1167203 - protein, 9 aa, Homo Sapiens
CFELDPVRR

SEQ ID NO: 1167204 - protein, 9 aa, Homo Sapiens
TTPPERRRP

SEQ ID NO: 1167205 - protein, 9 aa, Homo Sapiens
LYVMCLARH

SEQ ID NO: 1167206 - protein, 9 aa, Homo Sapiens
DMLRDSGIY

SEQ ID NO: 1167207 - protein, 9 aa, Homo Sapiens
RGQHTPAPG

SEQ ID NO: 1167208 - protein, 9 aa, Homo Sapiens
RKLTVQEAC

SEQ ID NO: 1167209 - protein, 9 aa, Homo Sapiens
STAWGGSCP

SEQ ID NO: 1167210 - protein, 9 aa, Homo Sapiens
EYDGPRFLR

SEQ ID NO: 1167211 - protein, 9 aa, Homo Sapiens
TCSAGWEPS

SEQ ID NO: 1167212 - protein, 9 aa, Homo Sapiens
AVSNLEEPT

SEQ ID NO: 1167213 - protein, 9 aa, Homo Sapiens
KEDTSTTEM

SEQ ID NO: 1167214 - protein, 9 aa, Homo Sapiens
KHDLRLLRL

SEQ ID NO: 1167215 - protein, 9 aa, Homo Sapiens
DITVTTTQS

SEQ ID NO: 1167216 - protein, 9 aa, Homo Sapiens
HAMEARAME

SEQ ID NO: 1167217 - protein, 9 aa, Homo Sapiens
HATPEEFLQ

SEQ ID NO: 1167218 - protein, 9 aa, Homo Sapiens
SLHSGAFLL

SEQ ID NO: 1167219 - protein, 9 aa, Homo Sapiens
SANTAPALP

SEQ ID NO: 1167220 - protein, 9 aa, Homo Sapiens
LLSHRPRCW

SEQ ID NO: 1167221 - protein, 9 aa, Homo Sapiens
GYMDMSSFN

SEQ ID NO: 1167222 - protein, 9 aa, Homo Sapiens
LLCGPSPHS

SEQ ID NO: 1167223 - protein, 9 aa, Homo Sapiens
NATTQSPLP

SEQ ID NO: 1167224 - protein, 9 aa, Homo Sapiens
AAGAGSAPQ

SEQ ID NO: 1167225 - protein, 9 aa, Homo Sapiens
DLNGRTRET

SEQ ID NO: 1167226 - protein, 9 aa, Homo Sapiens
IELRSLTVV

SEQ ID NO: 1167227 - protein, 9 aa, Homo Sapiens
LRCIWRGLG

SEQ ID NO: 1167228 - protein, 9 aa, Homo Sapiens
GVFVHGLFL

SEQ ID NO: 1167229 - protein, 9 aa, Homo Sapiens
KFIETKTVR

SEQ ID NO: 1167230 - protein, 9 aa, Homo Sapiens
PEVLQAREG

SEQ ID NO: 1167231 - protein, 9 aa, Homo Sapiens
RTHLIAHQS

SEQ ID NO: 1167232 - protein, 9 aa, Homo Sapiens
PPNTCTRPL

SEQ ID NO: 1167233 - protein, 9 aa, Homo Sapiens
PGTRPQAHS

SEQ ID NO: 1167234 - protein, 9 aa, Homo Sapiens
LRPSAVMQS

SEQ ID NO: 1167235 - protein, 9 aa, Homo Sapiens
PLGPRPRVQ

SEQ ID NO: 1167236 - protein, 9 aa, Homo Sapiens
KLSKIQKNI

SEQ ID NO: 1167237 - protein, 9 aa, Homo Sapiens
AYELQGACE

SEQ ID NO: 1167238 - protein, 9 aa, Homo Sapiens
DWVCSQSTP

SEQ ID NO: 1167239 - protein, 9 aa, Homo Sapiens
VACGSPEEV

SEQ ID NO: 1167240 - protein, 9 aa, Homo Sapiens
RMIPGSQHH

SEQ ID NO: 1167241 - protein, 9 aa, Homo Sapiens
CQAPGATPP

SEQ ID NO: 1167242 - protein, 9 aa, Homo Sapiens
WGDWVASPP

SEQ ID NO: 1167243 - protein, 9 aa, Homo Sapiens
VWVLPPVPT

SEQ ID NO: 1167244 - protein, 9 aa, Homo Sapiens
KTFTYSSTL

SEQ ID NO: 1167245 - protein, 9 aa, Homo Sapiens
PFLSHLVQG

SEQ ID NO: 1167246 - protein, 9 aa, Homo Sapiens
LSLPTRPRL

SEQ ID NO: 1167247 - protein, 9 aa, Homo Sapiens
QLVGTRKLL

SEQ ID NO: 1167248 - protein, 9 aa, Homo Sapiens
TMPSRCCLP

SEQ ID NO: 1167249 - protein, 9 aa, Homo Sapiens
GRGARGREG

SEQ ID NO: 1167250 - protein, 9 aa, Homo Sapiens
KLVLVSVSV

SEQ ID NO: 1167251 - protein, 9 aa, Homo Sapiens
DPHGRCCMG

SEQ ID NO: 1167252 - protein, 9 aa, Homo Sapiens
KKIHMSPDF

SEQ ID NO: 1167253 - protein, 9 aa, Homo Sapiens
DLCANTVLS

SEQ ID NO: 1167254 - protein, 9 aa, Homo Sapiens
FPLSLLFFW

SEQ ID NO: 1167255 - protein, 9 aa, Homo Sapiens
GWLHKKRGG

SEQ ID NO: 1167256 - protein, 9 aa, Homo Sapiens
GTTPSCRNH

SEQ ID NO: 1167257 - protein, 9 aa, Homo Sapiens
AYRFDSQGL

SEQ ID NO: 1167258 - protein, 9 aa, Homo Sapiens
ATPHSIHDG

SEQ ID NO: 1167259 - protein, 9 aa, Homo Sapiens
RFPSSMSGV

SEQ ID NO: 1167260 - protein, 9 aa, Homo Sapiens
DLGGPCPQT

SEQ ID NO: 1167261 - protein, 9 aa, Homo Sapiens
PQGYGNPNF

SEQ ID NO: 1167262 - protein, 9 aa, Homo Sapiens
EADAQAAAT

SEQ ID NO: 1167263 - protein, 9 aa, Homo Sapiens
NFKNSFQHI

SEQ ID NO: 1167264 - protein, 9 aa, Homo Sapiens
RPKTPLQTS

SEQ ID NO: 1167265 - protein, 9 aa, Homo Sapiens
CCLRCCFSP

SEQ ID NO: 1167266 - protein, 9 aa, Homo Sapiens
VCHWGAAPG

SEQ ID NO: 1167267 - protein, 9 aa, Homo Sapiens
LCRQVYVNR

SEQ ID NO: 1167268 - protein, 9 aa, Homo Sapiens
SCLLLPVPQ

SEQ ID NO: 1167269 - protein, 9 aa, Homo Sapiens
EMDEHNRSI

SEQ ID NO: 1167270 - protein, 9 aa, Homo Sapiens
QLGLSIDSL

SEQ ID NO: 1167271 - protein, 9 aa, Homo Sapiens
GMPNSLNQG

SEQ ID NO: 1167272 - protein, 9 aa, Homo Sapiens
APLITRLPT

SEQ ID NO: 1167273 - protein, 9 aa, Homo Sapiens
LKIWEELLK

SEQ ID NO: 1167274 - protein, 9 aa, Homo Sapiens
HLVWVPTVM

SEQ ID NO: 1167275 - protein, 9 aa, Homo Sapiens
GKGLHRRMG

SEQ ID NO: 1167276 - protein, 9 aa, Homo Sapiens
ICIEYIIGG

SEQ ID NO: 1167277 - protein, 9 aa, Homo Sapiens
SKEKESPGA

SEQ ID NO: 1167278 - protein, 9 aa, Homo Sapiens
GAAQLNVFI

SEQ ID NO: 1167279 - protein, 9 aa, Homo Sapiens
FELPQAVYY

SEQ ID NO: 1167280 - protein, 9 aa, Homo Sapiens
LQGLAQVSW

SEQ ID NO: 1167281 - protein, 9 aa, Homo Sapiens
LAQSSHCQE

SEQ ID NO: 1167282 - protein, 9 aa, Homo Sapiens
VRMAVTPKE

SEQ ID NO: 1167283 - protein, 9 aa, Homo Sapiens
TWSRTSRSP

SEQ ID NO: 1167284 - protein, 9 aa, Homo Sapiens
FLQEAPSRA

SEQ ID NO: 1167285 - protein, 9 aa, Homo Sapiens
NTQCKNGKM

SEQ ID NO: 1167286 - protein, 9 aa, Homo Sapiens
ITSMHPFTA

SEQ ID NO: 1167287 - protein, 9 aa, Homo Sapiens
GSGYRFWTM

SEQ ID NO: 1167288 - protein, 9 aa, Homo Sapiens
QHILEAPQH

SEQ ID NO: 1167289 - protein, 9 aa, Homo Sapiens
ETIYIVGGV

SEQ ID NO: 1167290 - protein, 9 aa, Homo Sapiens
SVNEACIIA

SEQ ID NO: 1167291 - protein, 9 aa, Homo Sapiens
VNGLGSGHL

SEQ ID NO: 1167292 - protein, 9 aa, Homo Sapiens
SSPHMRRRT

SEQ ID NO: 1167293 - protein, 9 aa, Homo Sapiens
NLATVNVVA

SEQ ID NO: 1167294 - protein, 9 aa, Homo Sapiens
VDMLRCLRF

SEQ ID NO: 1167295 - protein, 9 aa, Homo Sapiens
VVLAQSSHC

SEQ ID NO: 1167296 - protein, 9 aa, Homo Sapiens
PECTEILTF

SEQ ID NO: 1167297 - protein, 9 aa, Homo Sapiens
SAAWPPRHG

SEQ ID NO: 1167298 - protein, 9 aa, Homo Sapiens
STVCCMHLH

SEQ ID NO: 1167299 - protein, 9 aa, Homo Sapiens
WGRRPRPQL

SEQ ID NO: 1167300 - protein, 9 aa, Homo Sapiens
RGLTVASSL

SEQ ID NO: 1167301 - protein, 9 aa, Homo Sapiens
SSVWPNLTS

SEQ ID NO: 1167302 - protein, 9 aa, Homo Sapiens
RRLRVGSNG

SEQ ID NO: 1167303 - protein, 9 aa, Homo Sapiens
QLRNHYIIR

SEQ ID NO: 1167304 - protein, 9 aa, Homo Sapiens
HLFCYIGIL

SEQ ID NO: 1167305 - protein, 9 aa, Homo Sapiens
TSVVTGTSE

SEQ ID NO: 1167306 - protein, 9 aa, Homo Sapiens
GRREPVEPG

SEQ ID NO: 1167307 - protein, 9 aa, Homo Sapiens
DRVRQVHPV

SEQ ID NO: 1167308 - protein, 9 aa, Homo Sapiens
EPMPEEGSE

SEQ ID NO: 1167309 - protein, 9 aa, Homo Sapiens
GCQGPGAWW

SEQ ID NO: 1167310 - protein, 9 aa, Homo Sapiens
SDAPWASVT

SEQ ID NO: 1167311 - protein, 9 aa, Homo Sapiens
YHAAMATRQ

SEQ ID NO: 1167312 - protein, 9 aa, Homo Sapiens
IKISLIFLE

SEQ ID NO: 1167313 - protein, 9 aa, Homo Sapiens
EVPPPFGTM

SEQ ID NO: 1167314 - protein, 9 aa, Homo Sapiens
HTSDWVSFA

SEQ ID NO: 1167315 - protein, 9 aa, Homo Sapiens
EKNWKQLHS

SEQ ID NO: 1167316 - protein, 9 aa, Homo Sapiens
LFLRFLCPT

SEQ ID NO: 1167317 - protein, 9 aa, Homo Sapiens
PSPATSVEE

SEQ ID NO: 1167318 - protein, 9 aa, Homo Sapiens
SCELGMVVR

SEQ ID NO: 1167319 - protein, 9 aa, Homo Sapiens
FLGDSLVQL

SEQ ID NO: 1167320 - protein, 9 aa, Homo Sapiens
SPVFSGQLA

SEQ ID NO: 1167321 - protein, 9 aa, Homo Sapiens
LKDSSKSLS

SEQ ID NO: 1167322 - protein, 9 aa, Homo Sapiens
AAALSPAGQ

SEQ ID NO: 1167323 - protein, 9 aa, Homo Sapiens
HPLLLALHG

SEQ ID NO: 1167324 - protein, 9 aa, Homo Sapiens
AQGAVARAA

SEQ ID NO: 1167325 - protein, 9 aa, Homo Sapiens
CITWMAVVA

SEQ ID NO: 1167326 - protein, 9 aa, Homo Sapiens
AGTRALHAH

SEQ ID NO: 1167327 - protein, 9 aa, Homo Sapiens
RGLGTAAAE

SEQ ID NO: 1167328 - protein, 9 aa, Homo Sapiens
KDGATAVHF

SEQ ID NO: 1167329 - protein, 9 aa, Homo Sapiens
HPAGGAAAA

SEQ ID NO: 1167330 - protein, 9 aa, Homo Sapiens
ACVCSFAYQ

SEQ ID NO: 1167331 - protein, 9 aa, Homo Sapiens
WDAYGTSSL

SEQ ID NO: 1167332 - protein, 9 aa, Homo Sapiens
VKRLINPVV

SEQ ID NO: 1167333 - protein, 9 aa, Homo Sapiens
RAPTAPRPG

SEQ ID NO: 1167334 - protein, 9 aa, Homo Sapiens
QLPRRSSLG

SEQ ID NO: 1167335 - protein, 9 aa, Homo Sapiens
FPCSKILLS

SEQ ID NO: 1167336 - protein, 9 aa, Homo Sapiens
KHHYMDGQI

SEQ ID NO: 1167337 - protein, 9 aa, Homo Sapiens
SRYISRCAP

SEQ ID NO: 1167338 - protein, 9 aa, Homo Sapiens
DEEKQMKGV

SEQ ID NO: 1167339 - protein, 9 aa, Homo Sapiens
ACATRRMKL

SEQ ID NO: 1167340 - protein, 9 aa, Homo Sapiens
TFVATLPLW

SEQ ID NO: 1167341 - protein, 9 aa, Homo Sapiens
NRWLNENYM

SEQ ID NO: 1167342 - protein, 9 aa, Homo Sapiens
VPQYAQCTL

SEQ ID NO: 1167343 - protein, 9 aa, Homo Sapiens
QHANELRHQ

SEQ ID NO: 1167344 - protein, 9 aa, Homo Sapiens
NTGITVFLT

SEQ ID NO: 1167345 - protein, 9 aa, Homo Sapiens
DPQAVMYAP

SEQ ID NO: 1167346 - protein, 9 aa, Homo Sapiens
SATSALWCL

SEQ ID NO: 1167347 - protein, 9 aa, Homo Sapiens
PHHPQRCGR

SEQ ID NO: 1167348 - protein, 9 aa, Homo Sapiens
GLVAAAAKL

SEQ ID NO: 1167349 - protein, 9 aa, Homo Sapiens
HPGGPACAL

SEQ ID NO: 1167350 - protein, 9 aa, Homo Sapiens
LMGSQLAGD

SEQ ID NO: 1167351 - protein, 9 aa, Homo Sapiens
EYFHWNWVG

SEQ ID NO: 1167352 - protein, 9 aa, Homo Sapiens
ADLTQSHRP

SEQ ID NO: 1167353 - protein, 9 aa, Homo Sapiens
GSCWWHWLI

SEQ ID NO: 1167354 - protein, 9 aa, Homo Sapiens
VRVGSVHRM

SEQ ID NO: 1167355 - protein, 9 aa, Homo Sapiens
SCSIYKSTV

SEQ ID NO: 1167356 - protein, 9 aa, Homo Sapiens
VQRCVQWPA

SEQ ID NO: 1167357 - protein, 9 aa, Homo Sapiens
RGGPTAAAA

SEQ ID NO: 1167358 - protein, 9 aa, Homo Sapiens
WGSHEGVLV

SEQ ID NO: 1167359 - protein, 9 aa, Homo Sapiens
GAPGSEPQG

SEQ ID NO: 1167360 - protein, 9 aa, Homo Sapiens
RAARAHQRT

SEQ ID NO: 1167361 - protein, 9 aa, Homo Sapiens
HTIPCIFQA

SEQ ID NO: 1167362 - protein, 9 aa, Homo Sapiens
SLCGALRSG

SEQ ID NO: 1167363 - protein, 9 aa, Homo Sapiens
PYFWPQLEG

SEQ ID NO: 1167364 - protein, 9 aa, Homo Sapiens
DRPPPGRLI

SEQ ID NO: 1167365 - protein, 9 aa, Homo Sapiens
DLLHSSRFS

SEQ ID NO: 1167366 - protein, 9 aa, Homo Sapiens
LDPGAISDV

SEQ ID NO: 1167367 - protein, 9 aa, Homo Sapiens
PGNVGILPN

SEQ ID NO: 1167368 - protein, 9 aa, Homo Sapiens
KELLKRTPW

SEQ ID NO: 1167369 - protein, 9 aa, Homo Sapiens
SRHPEPMPE

SEQ ID NO: 1167370 - protein, 9 aa, Homo Sapiens
TRVGALVGL

SEQ ID NO: 1167371 - protein, 9 aa, Homo Sapiens
PPLAVPGTK

SEQ ID NO: 1167372 - protein, 9 aa, Homo Sapiens
GLGLYHTAS

SEQ ID NO: 1167373 - protein, 9 aa, Homo Sapiens
ASPTWRRTT

SEQ ID NO: 1167374 - protein, 9 aa, Homo Sapiens
EPPQSRRAT

SEQ ID NO: 1167375 - protein, 9 aa, Homo Sapiens
IKGMTYLRE

SEQ ID NO: 1167376 - protein, 9 aa, Homo Sapiens
KPKADMTGA

SEQ ID NO: 1167377 - protein, 9 aa, Homo Sapiens
KVLRREVYT

SEQ ID NO: 1167378 - protein, 9 aa, Homo Sapiens
SAQPPSLCG

SEQ ID NO: 1167379 - protein, 9 aa, Homo Sapiens
RTSPPVSVW

SEQ ID NO: 1167380 - protein, 9 aa, Homo Sapiens
VLHLFCYIG

SEQ ID NO: 1167381 - protein, 9 aa, Homo Sapiens
PGTTPPGRS

SEQ ID NO: 1167382 - protein, 9 aa, Homo Sapiens
SYHAAMATR

SEQ ID NO: 1167383 - protein, 9 aa, Homo Sapiens
APIITWEND

SEQ ID NO: 1167384 - protein, 9 aa, Homo Sapiens
SLDRCCSTP

SEQ ID NO: 1167385 - protein, 9 aa, Homo Sapiens
HGTCTAQVD

SEQ ID NO: 1167386 - protein, 9 aa, Homo Sapiens
VTSAKGDDT

SEQ ID NO: 1167387 - protein, 9 aa, Homo Sapiens
RMVLELKCK

SEQ ID NO: 1167388 - protein, 9 aa, Homo Sapiens
WPPRTPLFP

SEQ ID NO: 1167389 - protein, 9 aa, Homo Sapiens
SASPSSTPA

SEQ ID NO: 1167390 - protein, 9 aa, Homo Sapiens
THPLCPPPS

SEQ ID NO: 1167391 - protein, 9 aa, Homo Sapiens
CGGNRGAGA

SEQ ID NO: 1167392 - protein, 9 aa, Homo Sapiens
RSSKRSSPS

SEQ ID NO: 1167393 - protein, 9 aa, Homo Sapiens
RGSYSYMQV

SEQ ID NO: 1167394 - protein, 9 aa, Homo Sapiens
DIGLRQDVT

SEQ ID NO: 1167395 - protein, 9 aa, Homo Sapiens
SPPRPQGCW

SEQ ID NO: 1167396 - protein, 9 aa, Homo Sapiens
ELRPGAQEV

SEQ ID NO: 1167397 - protein, 9 aa, Homo Sapiens
FHIPVDTMV

SEQ ID NO: 1167398 - protein, 9 aa, Homo Sapiens
RKMKISFND

SEQ ID NO: 1167399 - protein, 9 aa, Homo Sapiens
WELFDSNTS

SEQ ID NO: 1167400 - protein, 9 aa, Homo Sapiens
GAHRSPGHG

SEQ ID NO: 1167401 - protein, 9 aa, Homo Sapiens
HCMDKPANC

SEQ ID NO: 1167402 - protein, 9 aa, Homo Sapiens
KLYDLDQGP

SEQ ID NO: 1167403 - protein, 9 aa, Homo Sapiens
RMSPPAKPS

SEQ ID NO: 1167404 - protein, 9 aa, Homo Sapiens
LILHQRVRP

SEQ ID NO: 1167405 - protein, 9 aa, Homo Sapiens
DPGQPPLSS

SEQ ID NO: 1167406 - protein, 9 aa, Homo Sapiens
QLSHANCMA

SEQ ID NO: 1167407 - protein, 9 aa, Homo Sapiens
QKHFNICLE

SEQ ID NO: 1167408 - protein, 9 aa, Homo Sapiens
WKQAWLPAD

SEQ ID NO: 1167409 - protein, 9 aa, Homo Sapiens
IIIHRSTTS

SEQ ID NO: 1167410 - protein, 9 aa, Homo Sapiens
ARTFVVFVQ

SEQ ID NO: 1167411 - protein, 9 aa, Homo Sapiens
ESVLRWEQE

SEQ ID NO: 1167412 - protein, 9 aa, Homo Sapiens
SLNLTPRLS

SEQ ID NO: 1167413 - protein, 9 aa, Homo Sapiens
AVGVLWGPG

SEQ ID NO: 1167414 - protein, 9 aa, Homo Sapiens
PSSPLPASL

SEQ ID NO: 1167415 - protein, 9 aa, Homo Sapiens
GPGLDAAAL

SEQ ID NO: 1167416 - protein, 9 aa, Homo Sapiens
PSMPACARG

SEQ ID NO: 1167417 - protein, 9 aa, Homo Sapiens
EAVGNLRDV

SEQ ID NO: 1167418 - protein, 9 aa, Homo Sapiens
ASRRWRMST

SEQ ID NO: 1167419 - protein, 9 aa, Homo Sapiens
SKDEWRWMV

SEQ ID NO: 1167420 - protein, 9 aa, Homo Sapiens
ILNHVGKNT

SEQ ID NO: 1167421 - protein, 9 aa, Homo Sapiens
WPGLWPRRR

SEQ ID NO: 1167422 - protein, 9 aa, Homo Sapiens
VLDRTSASV

SEQ ID NO: 1167423 - protein, 9 aa, Homo Sapiens
PSSPRRLLT

SEQ ID NO: 1167424 - protein, 9 aa, Homo Sapiens
LTINLLEEL

SEQ ID NO: 1167425 - protein, 9 aa, Homo Sapiens
WCRPWLEQM

SEQ ID NO: 1167426 - protein, 9 aa, Homo Sapiens
TPHRTSENT

SEQ ID NO: 1167427 - protein, 9 aa, Homo Sapiens
WCLLQAPDT

SEQ ID NO: 1167428 - protein, 9 aa, Homo Sapiens
ARGPRAPVR

SEQ ID NO: 1167429 - protein, 9 aa, Homo Sapiens
PPSSPLPAS

SEQ ID NO: 1167430 - protein, 9 aa, Homo Sapiens
ASAQLWARA

SEQ ID NO: 1167431 - protein, 9 aa, Homo Sapiens
PNSLNQGIP

SEQ ID NO: 1167432 - protein, 9 aa, Homo Sapiens
QDLVRPWGL

SEQ ID NO: 1167433 - protein, 9 aa, Homo Sapiens
QWRKRPVSL

SEQ ID NO: 1167434 - protein, 9 aa, Homo Sapiens
QEIDDGLDQ

SEQ ID NO: 1167435 - protein, 9 aa, Homo Sapiens
HTCWQRRTA

SEQ ID NO: 1167436 - protein, 9 aa, Homo Sapiens
APKMCAPVG

SEQ ID NO: 1167437 - protein, 9 aa, Homo Sapiens
AMDFINDTT

SEQ ID NO: 1167438 - protein, 9 aa, Homo Sapiens
PGSTPRPAP

SEQ ID NO: 1167439 - protein, 9 aa, Homo Sapiens
ESNRERGQV

SEQ ID NO: 1167440 - protein, 9 aa, Homo Sapiens
EIAQINQYC

SEQ ID NO: 1167441 - protein, 9 aa, Homo Sapiens
PASRLTYAH

SEQ ID NO: 1167442 - protein, 9 aa, Homo Sapiens
AAGAEREHH

SEQ ID NO: 1167443 - protein, 9 aa, Homo Sapiens
LVTHRTSLR

SEQ ID NO: 1167444 - protein, 9 aa, Homo Sapiens
APRGLLCPA

SEQ ID NO: 1167445 - protein, 9 aa, Homo Sapiens
SGQVLRTSA

SEQ ID NO: 1167446 - protein, 9 aa, Homo Sapiens
VVTFDYQSK

SEQ ID NO: 1167447 - protein, 9 aa, Homo Sapiens
ECAKVECAQ

SEQ ID NO: 1167448 - protein, 9 aa, Homo Sapiens
FVADRRNSN

SEQ ID NO: 1167449 - protein, 9 aa, Homo Sapiens
STPGREGRD

SEQ ID NO: 1167450 - protein, 9 aa, Homo Sapiens
RASRTLYHI

SEQ ID NO: 1167451 - protein, 9 aa, Homo Sapiens
EQLIHSPQS

SEQ ID NO: 1167452 - protein, 9 aa, Homo Sapiens
RWDAGLSGR

SEQ ID NO: 1167453 - protein, 9 aa, Homo Sapiens
PGLLPTPAD

SEQ ID NO: 1167454 - protein, 9 aa, Homo Sapiens
ARPRPLRML

SEQ ID NO: 1167455 - protein, 9 aa, Homo Sapiens
GDLSPLLSP

SEQ ID NO: 1167456 - protein, 9 aa, Homo Sapiens
TSSKVPIME

SEQ ID NO: 1167457 - protein, 9 aa, Homo Sapiens
PTPLLKEIC

SEQ ID NO: 1167458 - protein, 9 aa, Homo Sapiens
DGGVGETAP

SEQ ID NO: 1167459 - protein, 9 aa, Homo Sapiens
LLVSQVRQP

SEQ ID NO: 1167460 - protein, 9 aa, Homo Sapiens
DLDTKATPP

SEQ ID NO: 1167461 - protein, 9 aa, Homo Sapiens
WGSAFAAST

SEQ ID NO: 1167462 - protein, 9 aa, Homo Sapiens
VAVRPRPHQ

SEQ ID NO: 1167463 - protein, 9 aa, Homo Sapiens
RPRTCSRRP

SEQ ID NO: 1167464 - protein, 9 aa, Homo Sapiens
NDNPPMFSQ

SEQ ID NO: 1167465 - protein, 9 aa, Homo Sapiens
RGLCLLRAP

SEQ ID NO: 1167466 - protein, 9 aa, Homo Sapiens
HNPFLASCR

SEQ ID NO: 1167467 - protein, 9 aa, Homo Sapiens
SLSQWPWCL

SEQ ID NO: 1167468 - protein, 9 aa, Homo Sapiens
YKPLCSEDK

SEQ ID NO: 1167469 - protein, 9 aa, Homo Sapiens
CWHKSRLLQ

SEQ ID NO: 1167470 - protein, 9 aa, Homo Sapiens
SSPRSMSPS

SEQ ID NO: 1167471 - protein, 9 aa, Homo Sapiens
LVERSGHEV

SEQ ID NO: 1167472 - protein, 9 aa, Homo Sapiens
GLEKDSGTQ

SEQ ID NO: 1167473 - protein, 9 aa, Homo Sapiens
DWVASPPTR

SEQ ID NO: 1167474 - protein, 9 aa, Homo Sapiens
GPSPHSGEL

SEQ ID NO: 1167475 - protein, 9 aa, Homo Sapiens
RWASSGLCV

SEQ ID NO: 1167476 - protein, 9 aa, Homo Sapiens
VAERRKFGS

SEQ ID NO: 1167477 - protein, 9 aa, Homo Sapiens
SSSRKESAL

SEQ ID NO: 1167478 - protein, 9 aa, Homo Sapiens
TPVARGPAE

SEQ ID NO: 1167479 - protein, 9 aa, Homo Sapiens
TTGPATTAP

SEQ ID NO: 1167480 - protein, 9 aa, Homo Sapiens
LRQDCGDLR

SEQ ID NO: 1167481 - protein, 9 aa, Homo Sapiens
QLHHGGRQL

SEQ ID NO: 1167482 - protein, 9 aa, Homo Sapiens
PSGSASLMI

SEQ ID NO: 1167483 - protein, 9 aa, Homo Sapiens
SSHPSFLQP

SEQ ID NO: 1167484 - protein, 9 aa, Homo Sapiens
LKETRGNLG

SEQ ID NO: 1167485 - protein, 9 aa, Homo Sapiens
CLANHPHST

SEQ ID NO: 1167486 - protein, 9 aa, Homo Sapiens
QDKMTHLKD

SEQ ID NO: 1167487 - protein, 9 aa, Homo Sapiens
SYVCFAKGE

SEQ ID NO: 1167488 - protein, 9 aa, Homo Sapiens
RVLAINVHD

SEQ ID NO: 1167489 - protein, 9 aa, Homo Sapiens
QTALLPAHI

SEQ ID NO: 1167490 - protein, 9 aa, Homo Sapiens
CDSLRESHT

SEQ ID NO: 1167491 - protein, 9 aa, Homo Sapiens
DPYEREGLA

SEQ ID NO: 1167492 - protein, 9 aa, Homo Sapiens
PASCTAPRT

SEQ ID NO: 1167493 - protein, 9 aa, Homo Sapiens
CEQQKIRQE

SEQ ID NO: 1167494 - protein, 9 aa, Homo Sapiens
EPIGVCGQF

SEQ ID NO: 1167495 - protein, 9 aa, Homo Sapiens
VYCPNGQKG

SEQ ID NO: 1167496 - protein, 9 aa, Homo Sapiens
TQQLLPPTS

SEQ ID NO: 1167497 - protein, 9 aa, Homo Sapiens
IRLSIWPRQ

SEQ ID NO: 1167498 - protein, 9 aa, Homo Sapiens
LRCCFSPLK

SEQ ID NO: 1167499 - protein, 9 aa, Homo Sapiens
DDMRLLSDA

SEQ ID NO: 1167500 - protein, 9 aa, Homo Sapiens
ENQRGCFLR

SEQ ID NO: 1167501 - protein, 9 aa, Homo Sapiens
YDDTSAWRT

SEQ ID NO: 1167502 - protein, 9 aa, Homo Sapiens
QAHWRFTPE

SEQ ID NO: 1167503 - protein, 9 aa, Homo Sapiens
GYAADTFFI

SEQ ID NO: 1167504 - protein, 9 aa, Homo Sapiens
VKASLLLSH

SEQ ID NO: 1167505 - protein, 9 aa, Homo Sapiens
WEIAIQKPL

SEQ ID NO: 1167506 - protein, 9 aa, Homo Sapiens
WCLNEASFD

SEQ ID NO: 1167507 - protein, 9 aa, Homo Sapiens
HPHSTGPPT

SEQ ID NO: 1167508 - protein, 9 aa, Homo Sapiens
PPPPTPMCL

SEQ ID NO: 1167509 - protein, 9 aa, Homo Sapiens
PWPSSAGRS

SEQ ID NO: 1167510 - protein, 9 aa, Homo Sapiens
TGGLWAWKA

SEQ ID NO: 1167511 - protein, 9 aa, Homo Sapiens
AGVKQSAAE

SEQ ID NO: 1167512 - protein, 9 aa, Homo Sapiens
PACSSTSFM

SEQ ID NO: 1167513 - protein, 9 aa, Homo Sapiens
GSDELTVTN

SEQ ID NO: 1167514 - protein, 9 aa, Homo Sapiens
NENYCRNPG

SEQ ID NO: 1167515 - protein, 9 aa, Homo Sapiens
SWQMKTIHC

SEQ ID NO: 1167516 - protein, 9 aa, Homo Sapiens
GILARSPDG

SEQ ID NO: 1167517 - protein, 9 aa, Homo Sapiens
THYPPPRHP

SEQ ID NO: 1167518 - protein, 9 aa, Homo Sapiens
TPAPRPPAP

SEQ ID NO: 1167519 - protein, 9 aa, Homo Sapiens
SGVTSAANV

SEQ ID NO: 1167520 - protein, 9 aa, Homo Sapiens
TMEAKEVNS

SEQ ID NO: 1167521 - protein, 9 aa, Homo Sapiens
TPRESAAAV

SEQ ID NO: 1167522 - protein, 9 aa, Homo Sapiens
GCLVVHVAS

SEQ ID NO: 1167523 - protein, 9 aa, Homo Sapiens
TSCGAARPR

SEQ ID NO: 1167524 - protein, 9 aa, Homo Sapiens
STMLIHSSE

SEQ ID NO: 1167525 - protein, 9 aa, Homo Sapiens
PRRSSLGFE

SEQ ID NO: 1167526 - protein, 9 aa, Homo Sapiens
LRVLGERHT

SEQ ID NO: 1167527 - protein, 9 aa, Homo Sapiens
MRAPRWKTC

SEQ ID NO: 1167528 - protein, 9 aa, Homo Sapiens
EFVPFLTRN

SEQ ID NO: 1167529 - protein, 9 aa, Homo Sapiens
DEIEHGFEG

SEQ ID NO: 1167530 - protein, 9 aa, Homo Sapiens
HNAWLSYEL

SEQ ID NO: 1167531 - protein, 9 aa, Homo Sapiens
SCCGCSGVA

SEQ ID NO: 1167532 - protein, 9 aa, Homo Sapiens
PGRLLGAPA

SEQ ID NO: 1167533 - protein, 9 aa, Homo Sapiens
TGSMPPTAC

SEQ ID NO: 1167534 - protein, 9 aa, Homo Sapiens
EMVHQARVL

SEQ ID NO: 1167535 - protein, 9 aa, Homo Sapiens
VKAFWGGKS

SEQ ID NO: 1167536 - protein, 9 aa, Homo Sapiens
FFLWESLYP

SEQ ID NO: 1167537 - protein, 9 aa, Homo Sapiens
TPPLPPPPS

SEQ ID NO: 1167538 - protein, 9 aa, Homo Sapiens
VWRQEEKIW

SEQ ID NO: 1167539 - protein, 9 aa, Homo Sapiens
PRQASRLKP

SEQ ID NO: 1167540 - protein, 9 aa, Homo Sapiens
GWGKGASQG

SEQ ID NO: 1167541 - protein, 9 aa, Homo Sapiens
YASCATSSK

SEQ ID NO: 1167542 - protein, 9 aa, Homo Sapiens
HHRSGPAAA

SEQ ID NO: 1167543 - protein, 9 aa, Homo Sapiens
VLWGPGSWA

SEQ ID NO: 1167544 - protein, 9 aa, Homo Sapiens
IDVSGPKMD

SEQ ID NO: 1167545 - protein, 9 aa, Homo Sapiens
PPAVPQYAQ

SEQ ID NO: 1167546 - protein, 9 aa, Homo Sapiens
GSMKWSYKP

SEQ ID NO: 1167547 - protein, 9 aa, Homo Sapiens
TMPIAPWSR

SEQ ID NO: 1167548 - protein, 9 aa, Homo Sapiens
SPSLNSGKA

SEQ ID NO: 1167549 - protein, 9 aa, Homo Sapiens
NPAAQDGAR

SEQ ID NO: 1167550 - protein, 9 aa, Homo Sapiens
PQKLEQCMT

SEQ ID NO: 1167551 - protein, 9 aa, Homo Sapiens
ANTCNSVIR

SEQ ID NO: 1167552 - protein, 9 aa, Homo Sapiens
QTHERPPPE

SEQ ID NO: 1167553 - protein, 9 aa, Homo Sapiens
CWTSHWPTR

SEQ ID NO: 1167554 - protein, 9 aa, Homo Sapiens
IFGSSQNPH

SEQ ID NO: 1167555 - protein, 9 aa, Homo Sapiens
LPAAPGVQH

SEQ ID NO: 1167556 - protein, 9 aa, Homo Sapiens
IQCFWNYLD

SEQ ID NO: 1167557 - protein, 9 aa, Homo Sapiens
GLSIDSLDL

SEQ ID NO: 1167558 - protein, 9 aa, Homo Sapiens
VRAWRTSSA

SEQ ID NO: 1167559 - protein, 9 aa, Homo Sapiens
AIYPHVLVK

SEQ ID NO: 1167560 - protein, 9 aa, Homo Sapiens
PPTPTAWSW

SEQ ID NO: 1167561 - protein, 9 aa, Homo Sapiens
VVSFTELSR

SEQ ID NO: 1167562 - protein, 9 aa, Homo Sapiens
VFRGCMSMK

SEQ ID NO: 1167563 - protein, 9 aa, Homo Sapiens
DPRARLETL

SEQ ID NO: 1167564 - protein, 9 aa, Homo Sapiens
LKTLKNWSV

SEQ ID NO: 1167565 - protein, 9 aa, Homo Sapiens
PEPVPTAWR

SEQ ID NO: 1167566 - protein, 9 aa, Homo Sapiens
KKYKKRKHR

SEQ ID NO: 1167567 - protein, 9 aa, Homo Sapiens
PNTPYFIRS

SEQ ID NO: 1167568 - protein, 9 aa, Homo Sapiens
TLRLDLAGQ

SEQ ID NO: 1167569 - protein, 9 aa, Homo Sapiens
ASQTRVPPG

SEQ ID NO: 1167570 - protein, 9 aa, Homo Sapiens
PSTSRSSCH

SEQ ID NO: 1167571 - protein, 9 aa, Homo Sapiens
TGESPPASL

SEQ ID NO: 1167572 - protein, 9 aa, Homo Sapiens
YELIKKISF

SEQ ID NO: 1167573 - protein, 9 aa, Homo Sapiens
QEYENELGR

SEQ ID NO: 1167574 - protein, 9 aa, Homo Sapiens
PAPRLLPLP

SEQ ID NO: 1167575 - protein, 9 aa, Homo Sapiens
LIRGSKHWS

SEQ ID NO: 1167576 - protein, 9 aa, Homo Sapiens
HKVHVPGPE

SEQ ID NO: 1167577 - protein, 9 aa, Homo Sapiens
LLLSLGPCW

SEQ ID NO: 1167578 - protein, 9 aa, Homo Sapiens
PPISVSFPQ

SEQ ID NO: 1167579 - protein, 9 aa, Homo Sapiens
WTMAWAQHG

SEQ ID NO: 1167580 - protein, 9 aa, Homo Sapiens
PLPPPPSRC

SEQ ID NO: 1167581 - protein, 9 aa, Homo Sapiens
TEAKTRLSM

SEQ ID NO: 1167582 - protein, 9 aa, Homo Sapiens
VDVGDSMEA

SEQ ID NO: 1167583 - protein, 9 aa, Homo Sapiens
EKERRERAA

SEQ ID NO: 1167584 - protein, 9 aa, Homo Sapiens
CSGRSRPSW

SEQ ID NO: 1167585 - protein, 9 aa, Homo Sapiens
TWDKALDIR

SEQ ID NO: 1167586 - protein, 9 aa, Homo Sapiens
LWMANARRS

SEQ ID NO: 1167587 - protein, 9 aa, Homo Sapiens
TGERTCTMR

SEQ ID NO: 1167588 - protein, 9 aa, Homo Sapiens
PDIREKVIK

SEQ ID NO: 1167589 - protein, 9 aa, Homo Sapiens
DIIVSPDAL

SEQ ID NO: 1167590 - protein, 9 aa, Homo Sapiens
SACATSAAA

SEQ ID NO: 1167591 - protein, 9 aa, Homo Sapiens
GTFSFRHAA

SEQ ID NO: 1167592 - protein, 9 aa, Homo Sapiens
SNTMHAING

SEQ ID NO: 1167593 - protein, 9 aa, Homo Sapiens
GCSVAPPIE

SEQ ID NO: 1167594 - protein, 9 aa, Homo Sapiens
WGSAPWWGR

SEQ ID NO: 1167595 - protein, 9 aa, Homo Sapiens
PPYWCSQQR

SEQ ID NO: 1167596 - protein, 9 aa, Homo Sapiens
GEDTSMNFV

SEQ ID NO: 1167597 - protein, 9 aa, Homo Sapiens
HYYHSGPES

SEQ ID NO: 1167598 - protein, 9 aa, Homo Sapiens
NDNIHAMTA

SEQ ID NO: 1167599 - protein, 9 aa, Homo Sapiens
HCWVHILDN

SEQ ID NO: 1167600 - protein, 9 aa, Homo Sapiens
RERTLKIRE

SEQ ID NO: 1167601 - protein, 9 aa, Homo Sapiens
RSLRMKTSR

SEQ ID NO: 1167602 - protein, 9 aa, Homo Sapiens
TTPPPSPGS

SEQ ID NO: 1167603 - protein, 9 aa, Homo Sapiens
LRAAAQGAV

SEQ ID NO: 1167604 - protein, 9 aa, Homo Sapiens
NTRRKTFSQ

SEQ ID NO: 1167605 - protein, 9 aa, Homo Sapiens
CSRVTRSGL

SEQ ID NO: 1167606 - protein, 9 aa, Homo Sapiens
PDMLGMSLA

SEQ ID NO: 1167607 - protein, 9 aa, Homo Sapiens
YCTPRESAA

SEQ ID NO: 1167608 - protein, 9 aa, Homo Sapiens
ADMTGAQRS

SEQ ID NO: 1167609 - protein, 9 aa, Homo Sapiens
DPTSSSFSK

SEQ ID NO: 1167610 - protein, 9 aa, Homo Sapiens
QTSCFGPSK

SEQ ID NO: 1167611 - protein, 9 aa, Homo Sapiens
RRASGTLLS

SEQ ID NO: 1167612 - protein, 9 aa, Homo Sapiens
RIILVPMRF

SEQ ID NO: 1167613 - protein, 9 aa, Homo Sapiens
NWNSSTQWG

SEQ ID NO: 1167614 - protein, 9 aa, Homo Sapiens
RKTFWFFQR

SEQ ID NO: 1167615 - protein, 9 aa, Homo Sapiens
MGPLSVPPG

SEQ ID NO: 1167616 - protein, 9 aa, Homo Sapiens
MPRTLEGCI

SEQ ID NO: 1167617 - protein, 9 aa, Homo Sapiens
VPTYVSVDP

SEQ ID NO: 1167618 - protein, 9 aa, Homo Sapiens
VEGTDFPRA

SEQ ID NO: 1167619 - protein, 9 aa, Homo Sapiens
EPAYPAAAP

SEQ ID NO: 1167620 - protein, 9 aa, Homo Sapiens
QLHTAGTPV

SEQ ID NO: 1167621 - protein, 9 aa, Homo Sapiens
AAAALRAVG

SEQ ID NO: 1167622 - protein, 9 aa, Homo Sapiens
GLSKVDFWY

SEQ ID NO: 1167623 - protein, 9 aa, Homo Sapiens
SQDPRTMSR

SEQ ID NO: 1167624 - protein, 9 aa, Homo Sapiens
TEEIQSEMP

SEQ ID NO: 1167625 - protein, 9 aa, Homo Sapiens
PQAPLRLWS

SEQ ID NO: 1167626 - protein, 9 aa, Homo Sapiens
FHRMKQSRS

SEQ ID NO: 1167627 - protein, 9 aa, Homo Sapiens
LQALGSRSG

SEQ ID NO: 1167628 - protein, 9 aa, Homo Sapiens
LNEFKNNPE

SEQ ID NO: 1167629 - protein, 9 aa, Homo Sapiens
ELSLNYFLM

SEQ ID NO: 1167630 - protein, 9 aa, Homo Sapiens
PPCSRGLPT

SEQ ID NO: 1167631 - protein, 9 aa, Homo Sapiens
SYLQGHPKI

SEQ ID NO: 1167632 - protein, 9 aa, Homo Sapiens
VSTNAMLIS

SEQ ID NO: 1167633 - protein, 9 aa, Homo Sapiens
GASRNSSSV

SEQ ID NO: 1167634 - protein, 9 aa, Homo Sapiens
VLDRHRTLN

SEQ ID NO: 1167635 - protein, 9 aa, Homo Sapiens
GGPLSPKHS

SEQ ID NO: 1167636 - protein, 9 aa, Homo Sapiens
FLDVQYQKV

SEQ ID NO: 1167637 - protein, 9 aa, Homo Sapiens
KWCRPWLEQ

SEQ ID NO: 1167638 - protein, 9 aa, Homo Sapiens
SFWSLSSTW

SEQ ID NO: 1167639 - protein, 9 aa, Homo Sapiens
SSELRTYLA

SEQ ID NO: 1167640 - protein, 9 aa, Homo Sapiens
LEHRDPQDS

SEQ ID NO: 1167641 - protein, 9 aa, Homo Sapiens
AEGAGEALL

SEQ ID NO: 1167642 - protein, 9 aa, Homo Sapiens
EPPCCTTSC

SEQ ID NO: 1167643 - protein, 9 aa, Homo Sapiens
SYTTPWAGP

SEQ ID NO: 1167644 - protein, 9 aa, Homo Sapiens
VPREPVPEE

SEQ ID NO: 1167645 - protein, 9 aa, Homo Sapiens
PRPHPRGSP

SEQ ID NO: 1167646 - protein, 9 aa, Homo Sapiens
PVTAWHPHQ

SEQ ID NO: 1167647 - protein, 9 aa, Homo Sapiens
LPTPADKLT

SEQ ID NO: 1167648 - protein, 9 aa, Homo Sapiens
VYEAFNWHH

SEQ ID NO: 1167649 - protein, 9 aa, Homo Sapiens
TPLLKEICD

SEQ ID NO: 1167650 - protein, 9 aa, Homo Sapiens
GVRWGWFPP

SEQ ID NO: 1167651 - protein, 9 aa, Homo Sapiens
CPTIMSPSL

SEQ ID NO: 1167652 - protein, 9 aa, Homo Sapiens
QFHRSLWTM

SEQ ID NO: 1167653 - protein, 9 aa, Homo Sapiens
GPGCPTQAP

SEQ ID NO: 1167654 - protein, 9 aa, Homo Sapiens
DSPGRIKWK

SEQ ID NO: 1167655 - protein, 9 aa, Homo Sapiens
RGGRACPHG

SEQ ID NO: 1167656 - protein, 9 aa, Homo Sapiens
SCYCKNGAS

SEQ ID NO: 1167657 - protein, 9 aa, Homo Sapiens
RVFDVAVLV

SEQ ID NO: 1167658 - protein, 9 aa, Homo Sapiens
PRPAPSLWK

SEQ ID NO: 1167659 - protein, 9 aa, Homo Sapiens
LTSSSASIS

SEQ ID NO: 1167660 - protein, 9 aa, Homo Sapiens
LKIQVSSLS

SEQ ID NO: 1167661 - protein, 9 aa, Homo Sapiens
LSHRPRCWY

SEQ ID NO: 1167662 - protein, 9 aa, Homo Sapiens
GNTARDTLE

SEQ ID NO: 1167663 - protein, 9 aa, Homo Sapiens
PPQYCDTKS

SEQ ID NO: 1167664 - protein, 9 aa, Homo Sapiens
VLQDPLDRC

SEQ ID NO: 1167665 - protein, 9 aa, Homo Sapiens
TWRRPGPKE

SEQ ID NO: 1167666 - protein, 9 aa, Homo Sapiens
RTHSAKRCG

SEQ ID NO: 1167667 - protein, 9 aa, Homo Sapiens
KNPSQLPAL

SEQ ID NO: 1167668 - protein, 9 aa, Homo Sapiens
DRGSFQNDG

SEQ ID NO: 1167669 - protein, 9 aa, Homo Sapiens
LLKEICDDK

SEQ ID NO: 1167670 - protein, 9 aa, Homo Sapiens
GSGESHLQH

SEQ ID NO: 1167671 - protein, 9 aa, Homo Sapiens
VFNEAETRS

SEQ ID NO: 1167672 - protein, 9 aa, Homo Sapiens
SRLRSGILA

SEQ ID NO: 1167673 - protein, 9 aa, Homo Sapiens
AWAQAEALR

SEQ ID NO: 1167674 - protein, 9 aa, Homo Sapiens
GRYLAITKP

SEQ ID NO: 1167675 - protein, 9 aa, Homo Sapiens
RLRTKLEKA

SEQ ID NO: 1167676 - protein, 9 aa, Homo Sapiens
WVCSQSTPG

SEQ ID NO: 1167677 - protein, 9 aa, Homo Sapiens
QETIADYQQ

SEQ ID NO: 1167678 - protein, 9 aa, Homo Sapiens
ALNYSAAPK

SEQ ID NO: 1167679 - protein, 9 aa, Homo Sapiens
PPAPAGPPR

SEQ ID NO: 1167680 - protein, 9 aa, Homo Sapiens
SSTWLFCPT

SEQ ID NO: 1167681 - protein, 9 aa, Homo Sapiens
RSHPGGPAC

SEQ ID NO: 1167682 - protein, 9 aa, Homo Sapiens
LWWEWYHLR

SEQ ID NO: 1167683 - protein, 9 aa, Homo Sapiens
MVEGGVSGV

SEQ ID NO: 1167684 - protein, 9 aa, Homo Sapiens
FWYSMPWHS

SEQ ID NO: 1167685 - protein, 9 aa, Homo Sapiens
YILITSCDP

SEQ ID NO: 1167686 - protein, 9 aa, Homo Sapiens
DRIEKNTKR

SEQ ID NO: 1167687 - protein, 9 aa, Homo Sapiens
APHSAGLSP

SEQ ID NO: 1167688 - protein, 9 aa, Homo Sapiens
RWLGAVGLR

SEQ ID NO: 1167689 - protein, 9 aa, Homo Sapiens
ERSKGRIQQ

SEQ ID NO: 1167690 - protein, 9 aa, Homo Sapiens
PLLLLDPAM

SEQ ID NO: 1167691 - protein, 9 aa, Homo Sapiens
LVIGFGAAR

SEQ ID NO: 1167692 - protein, 9 aa, Homo Sapiens
REVIRNDGA

SEQ ID NO: 1167693 - protein, 9 aa, Homo Sapiens
YEKLADILK

SEQ ID NO: 1167694 - protein, 9 aa, Homo Sapiens
CVESSMTPL

SEQ ID NO: 1167695 - protein, 9 aa, Homo Sapiens
HALSLIATT

SEQ ID NO: 1167696 - protein, 9 aa, Homo Sapiens
GEGAALAFP

SEQ ID NO: 1167697 - protein, 9 aa, Homo Sapiens
TQSEWHGWM

SEQ ID NO: 1167698 - protein, 9 aa, Homo Sapiens
IKGDKLEEL

SEQ ID NO: 1167699 - protein, 9 aa, Homo Sapiens
IEYFHWNWV

SEQ ID NO: 1167700 - protein, 9 aa, Homo Sapiens
FLRIGSPNS

SEQ ID NO: 1167701 - protein, 9 aa, Homo Sapiens
SWGSHEGVL

SEQ ID NO: 1167702 - protein, 9 aa, Homo Sapiens
ELTHVPLRP

SEQ ID NO: 1167703 - protein, 9 aa, Homo Sapiens
ATPPVSVSK

SEQ ID NO: 1167704 - protein, 9 aa, Homo Sapiens
SGLSVSVGC

SEQ ID NO: 1167705 - protein, 9 aa, Homo Sapiens
RWLEEVQPA

SEQ ID NO: 1167706 - protein, 9 aa, Homo Sapiens
ILPAAEPMI

SEQ ID NO: 1167707 - protein, 9 aa, Homo Sapiens
EAESPADGQ

SEQ ID NO: 1167708 - protein, 9 aa, Homo Sapiens
QLRVPDTHV

SEQ ID NO: 1167709 - protein, 9 aa, Homo Sapiens
SGSLLCTPP

SEQ ID NO: 1167710 - protein, 9 aa, Homo Sapiens
RVRMAVTPK

SEQ ID NO: 1167711 - protein, 9 aa, Homo Sapiens
PGAWWGDRA

SEQ ID NO: 1167712 - protein, 9 aa, Homo Sapiens
SPVTKGTAW

SEQ ID NO: 1167713 - protein, 9 aa, Homo Sapiens
KVGPLSHCT

SEQ ID NO: 1167714 - protein, 9 aa, Homo Sapiens
GLTAPIPGA

SEQ ID NO: 1167715 - protein, 9 aa, Homo Sapiens
LEARAMEAH

SEQ ID NO: 1167716 - protein, 9 aa, Homo Sapiens
LTGGLWAWK

SEQ ID NO: 1167717 - protein, 9 aa, Homo Sapiens
LLGAEKRKV

SEQ ID NO: 1167718 - protein, 9 aa, Homo Sapiens
LVMCILTVS

SEQ ID NO: 1167719 - protein, 9 aa, Homo Sapiens
TASPLIVAG

SEQ ID NO: 1167720 - protein, 9 aa, Homo Sapiens
DVGGRECRG

SEQ ID NO: 1167721 - protein, 9 aa, Homo Sapiens
QEEEVKTKR

SEQ ID NO: 1167722 - protein, 9 aa, Homo Sapiens
HPEVPPPFG

SEQ ID NO: 1167723 - protein, 9 aa, Homo Sapiens
IYQKPRTLP

SEQ ID NO: 1167724 - protein, 9 aa, Homo Sapiens
RWHLARYFS

SEQ ID NO: 1167725 - protein, 9 aa, Homo Sapiens
LEDWLIFTQ

SEQ ID NO: 1167726 - protein, 9 aa, Homo Sapiens
THHSTPFST

SEQ ID NO: 1167727 - protein, 9 aa, Homo Sapiens
RGPAPRTRM

SEQ ID NO: 1167728 - protein, 9 aa, Homo Sapiens
EETGLTRKC

SEQ ID NO: 1167729 - protein, 9 aa, Homo Sapiens
QAPDGFYRQ

SEQ ID NO: 1167730 - protein, 9 aa, Homo Sapiens
QLNMIQQFI

SEQ ID NO: 1167731 - protein, 9 aa, Homo Sapiens
KARGGAAAQ

SEQ ID NO: 1167732 - protein, 9 aa, Homo Sapiens
YSKLLPYQT

SEQ ID NO: 1167733 - protein, 9 aa, Homo Sapiens
LQGAPPRSP

SEQ ID NO: 1167734 - protein, 9 aa, Homo Sapiens
APSRSESEP

SEQ ID NO: 1167735 - protein, 9 aa, Homo Sapiens
CLWLWCRPS

SEQ ID NO: 1167736 - protein, 9 aa, Homo Sapiens
SPRPPPLVR

SEQ ID NO: 1167737 - protein, 9 aa, Homo Sapiens
TQPPSTLLG

SEQ ID NO: 1167738 - protein, 9 aa, Homo Sapiens
GNQHQSEGK

SEQ ID NO: 1167739 - protein, 9 aa, Homo Sapiens
FFEEKNQYK

SEQ ID NO: 1167740 - protein, 9 aa, Homo Sapiens
SEDWYHTLH

SEQ ID NO: 1167741 - protein, 9 aa, Homo Sapiens
AWPPRHGWC

SEQ ID NO: 1167742 - protein, 9 aa, Homo Sapiens
IAQDVLRFS

SEQ ID NO: 1167743 - protein, 9 aa, Homo Sapiens
APLCAGSPR

SEQ ID NO: 1167744 - protein, 9 aa, Homo Sapiens
AFPLTTLAT

SEQ ID NO: 1167745 - protein, 9 aa, Homo Sapiens
ENMVAETEC

SEQ ID NO: 1167746 - protein, 9 aa, Homo Sapiens
QGPSASAQL

SEQ ID NO: 1167747 - protein, 9 aa, Homo Sapiens
NWTKIEPSV

SEQ ID NO: 1167748 - protein, 9 aa, Homo Sapiens
QLSGPVLAL

SEQ ID NO: 1167749 - protein, 9 aa, Homo Sapiens
GWTAMLVAT

SEQ ID NO: 1167750 - protein, 9 aa, Homo Sapiens
GLEDAPQLS

SEQ ID NO: 1167751 - protein, 9 aa, Homo Sapiens
PLASSHTTH

SEQ ID NO: 1167752 - protein, 9 aa, Homo Sapiens
ALRSGSPGS

SEQ ID NO: 1167753 - protein, 9 aa, Homo Sapiens
LSLFPRALP

SEQ ID NO: 1167754 - protein, 9 aa, Homo Sapiens
LTRVGALVG

SEQ ID NO: 1167755 - protein, 9 aa, Homo Sapiens
QQAACKQQS

SEQ ID NO: 1167756 - protein, 9 aa, Homo Sapiens
APASSTSRS

SEQ ID NO: 1167757 - protein, 9 aa, Homo Sapiens
QGSDGIPGP

SEQ ID NO: 1167758 - protein, 9 aa, Homo Sapiens
ALRASLEML

SEQ ID NO: 1167759 - protein, 9 aa, Homo Sapiens
NNRLLFTGT

SEQ ID NO: 1167760 - protein, 9 aa, Homo Sapiens
ICHRRYYHT

SEQ ID NO: 1167761 - protein, 9 aa, Homo Sapiens
AFTLWTSDL

SEQ ID NO: 1167762 - protein, 9 aa, Homo Sapiens
SWEAPYSHS

SEQ ID NO: 1167763 - protein, 9 aa, Homo Sapiens
GVKAPDMLG

SEQ ID NO: 1167764 - protein, 9 aa, Homo Sapiens
EKAGLLAML

SEQ ID NO: 1167765 - protein, 9 aa, Homo Sapiens
AWGIPGSLP

SEQ ID NO: 1167766 - protein, 9 aa, Homo Sapiens
PSVPPPAVP

SEQ ID NO: 1167767 - protein, 9 aa, Homo Sapiens
FTYTMSQIN

SEQ ID NO: 1167768 - protein, 9 aa, Homo Sapiens
WVPLASEEQ

SEQ ID NO: 1167769 - protein, 9 aa, Homo Sapiens
IMKLSLPES

SEQ ID NO: 1167770 - protein, 9 aa, Homo Sapiens
HLAQLLEGY

SEQ ID NO: 1167771 - protein, 9 aa, Homo Sapiens
CALPDARVA

SEQ ID NO: 1167772 - protein, 9 aa, Homo Sapiens
AIRGLTVAS

SEQ ID NO: 1167773 - protein, 9 aa, Homo Sapiens
RRCSGLSVS

SEQ ID NO: 1167774 - protein, 9 aa, Homo Sapiens
FIHIEKYQF

SEQ ID NO: 1167775 - protein, 9 aa, Homo Sapiens
GVLLQPWLV

SEQ ID NO: 1167776 - protein, 9 aa, Homo Sapiens
IFDFRVAPD

SEQ ID NO: 1167777 - protein, 9 aa, Homo Sapiens
LFSPVFFSI

SEQ ID NO: 1167778 - protein, 9 aa, Homo Sapiens
YELQGACEQ

SEQ ID NO: 1167779 - protein, 9 aa, Homo Sapiens
EGPHPQAST

SEQ ID NO: 1167780 - protein, 9 aa, Homo Sapiens
RFCELYGDR

SEQ ID NO: 1167781 - protein, 9 aa, Homo Sapiens
PTWPTQTWT

SEQ ID NO: 1167782 - protein, 9 aa, Homo Sapiens
RGSLGPKAS

SEQ ID NO: 1167783 - protein, 9 aa, Homo Sapiens
HVHSHPLLL

SEQ ID NO: 1167784 - protein, 9 aa, Homo Sapiens
PEETIATQI

SEQ ID NO: 1167785 - protein, 9 aa, Homo Sapiens
FDLVAISLE

SEQ ID NO: 1167786 - protein, 9 aa, Homo Sapiens
GIPFSSLHA

SEQ ID NO: 1167787 - protein, 9 aa, Homo Sapiens
DAWPSSPCP

SEQ ID NO: 1167788 - protein, 9 aa, Homo Sapiens
THRSPSCTW

SEQ ID NO: 1167789 - protein, 9 aa, Homo Sapiens
GPPVLVKEK

SEQ ID NO: 1167790 - protein, 9 aa, Homo Sapiens
RPLSAAGRP

SEQ ID NO: 1167791 - protein, 9 aa, Homo Sapiens
TAGAARART

SEQ ID NO: 1167792 - protein, 9 aa, Homo Sapiens
GAEKAKPSA

SEQ ID NO: 1167793 - protein, 9 aa, Homo Sapiens
AGQLVKGRL

SEQ ID NO: 1167794 - protein, 9 aa, Homo Sapiens
MIRRGDVPQ

SEQ ID NO: 1167795 - protein, 9 aa, Homo Sapiens
GTKGRPEPV

SEQ ID NO: 1167796 - protein, 9 aa, Homo Sapiens
HVLTVKESN

SEQ ID NO: 1167797 - protein, 9 aa, Homo Sapiens
GGHRPRRAP

SEQ ID NO: 1167798 - protein, 9 aa, Homo Sapiens
LGGNSLCSP

SEQ ID NO: 1167799 - protein, 9 aa, Homo Sapiens
GGFMAAWPE

SEQ ID NO: 1167800 - protein, 9 aa, Homo Sapiens
ELRPSVDHT

SEQ ID NO: 1167801 - protein, 9 aa, Homo Sapiens
LPVEKSSEF

SEQ ID NO: 1167802 - protein, 9 aa, Homo Sapiens
GCRPGNVGI

SEQ ID NO: 1167803 - protein, 9 aa, Homo Sapiens
LWLKDNSEL

SEQ ID NO: 1167804 - protein, 9 aa, Homo Sapiens
CSTTSRRAR

SEQ ID NO: 1167805 - protein, 9 aa, Homo Sapiens
LSLRQTLQG

SEQ ID NO: 1167806 - protein, 9 aa, Homo Sapiens
VIARDSILS

SEQ ID NO: 1167807 - protein, 9 aa, Homo Sapiens
TSGARVLIP

SEQ ID NO: 1167808 - protein, 9 aa, Homo Sapiens
GHIDDEAAR

SEQ ID NO: 1167809 - protein, 9 aa, Homo Sapiens
NLTPRLSVP

SEQ ID NO: 1167810 - protein, 9 aa, Homo Sapiens
SLCQNRPHL

SEQ ID NO: 1167811 - protein, 9 aa, Homo Sapiens
SNLEEPTSP

SEQ ID NO: 1167812 - protein, 9 aa, Homo Sapiens
PPTRELGAR

SEQ ID NO: 1167813 - protein, 9 aa, Homo Sapiens
PTSCSATRQ

SEQ ID NO: 1167814 - protein, 9 aa, Homo Sapiens
CPVGMACDS

SEQ ID NO: 1167815 - protein, 9 aa, Homo Sapiens
ALPAGSAAD

SEQ ID NO: 1167816 - protein, 9 aa, Homo Sapiens
PLCTVASPP

SEQ ID NO: 1167817 - protein, 9 aa, Homo Sapiens
VWCLNEASF

SEQ ID NO: 1167818 - protein, 9 aa, Homo Sapiens
RTSTSAPGR

SEQ ID NO: 1167819 - protein, 9 aa, Homo Sapiens
VYGKFLGLW

SEQ ID NO: 1167820 - protein, 9 aa, Homo Sapiens
YDHWVKKGQ

SEQ ID NO: 1167821 - protein, 9 aa, Homo Sapiens
RPRAALSVL

SEQ ID NO: 1167822 - protein, 9 aa, Homo Sapiens
GGPWDWLPP

SEQ ID NO: 1167823 - protein, 9 aa, Homo Sapiens
AGTGAQRVC

SEQ ID NO: 1167824 - protein, 9 aa, Homo Sapiens
IIHKAASDA

SEQ ID NO: 1167825 - protein, 9 aa, Homo Sapiens
FVRYLQSNM

SEQ ID NO: 1167826 - protein, 9 aa, Homo Sapiens
KKPPLVPVV

SEQ ID NO: 1167827 - protein, 9 aa, Homo Sapiens
VNPCLREPQ

SEQ ID NO: 1167828 - protein, 9 aa, Homo Sapiens
PSSSVCAPQ

SEQ ID NO: 1167829 - protein, 9 aa, Homo Sapiens
DILVLNVNK

SEQ ID NO: 1167830 - protein, 9 aa, Homo Sapiens
LPRLKDGVW

SEQ ID NO: 1167831 - protein, 9 aa, Homo Sapiens
VGQQPNVFN

SEQ ID NO: 1167832 - protein, 9 aa, Homo Sapiens
DPALSLEAH

SEQ ID NO: 1167833 - protein, 9 aa, Homo Sapiens
FSFSVATGQ

SEQ ID NO: 1167834 - protein, 9 aa, Homo Sapiens
LRRRLLRCS

SEQ ID NO: 1167835 - protein, 9 aa, Homo Sapiens
IKSTSFLLI

SEQ ID NO: 1167836 - protein, 9 aa, Homo Sapiens
REGALVALG

SEQ ID NO: 1167837 - protein, 9 aa, Homo Sapiens
KGSRGPLAS

SEQ ID NO: 1167838 - protein, 9 aa, Homo Sapiens
TPSYSYMTP

SEQ ID NO: 1167839 - protein, 9 aa, Homo Sapiens
SRPRAWGLL

SEQ ID NO: 1167840 - protein, 9 aa, Homo Sapiens
IASSVSPPQ

SEQ ID NO: 1167841 - protein, 9 aa, Homo Sapiens
WKGKGASAP

SEQ ID NO: 1167842 - protein, 9 aa, Homo Sapiens
DKVFSQTSH

SEQ ID NO: 1167843 - protein, 9 aa, Homo Sapiens
PNSTTWPLS

SEQ ID NO: 1167844 - protein, 9 aa, Homo Sapiens
AVDKRLEQN

SEQ ID NO: 1167845 - protein, 9 aa, Homo Sapiens
PWALLGREE

SEQ ID NO: 1167846 - protein, 9 aa, Homo Sapiens
DLRTGAGGG

SEQ ID NO: 1167847 - protein, 9 aa, Homo Sapiens
CGAASPPAR

SEQ ID NO: 1167848 - protein, 9 aa, Homo Sapiens
WFPPCGGCP

SEQ ID NO: 1167849 - protein, 9 aa, Homo Sapiens
WTRLPRRSC

SEQ ID NO: 1167850 - protein, 9 aa, Homo Sapiens
HTLHPAPAG

SEQ ID NO: 1167851 - protein, 9 aa, Homo Sapiens
ARTFVPSSS

SEQ ID NO: 1167852 - protein, 9 aa, Homo Sapiens
SSAPTWGCL

SEQ ID NO: 1167853 - protein, 9 aa, Homo Sapiens
SCSGARACT

SEQ ID NO: 1167854 - protein, 9 aa, Homo Sapiens
LKKILRSFM

SEQ ID NO: 1167855 - protein, 9 aa, Homo Sapiens
PKTPLQTST

SEQ ID NO: 1167856 - protein, 9 aa, Homo Sapiens
LVLEQSVLA

SEQ ID NO: 1167857 - protein, 9 aa, Homo Sapiens
PGSAPSMPA

SEQ ID NO: 1167858 - protein, 9 aa, Homo Sapiens
PSRCFVVRD

SEQ ID NO: 1167859 - protein, 9 aa, Homo Sapiens
RPDAPVPGG

SEQ ID NO: 1167860 - protein, 9 aa, Homo Sapiens
ILECDEECM

SEQ ID NO: 1167861 - protein, 9 aa, Homo Sapiens
PPWLSPLQR

SEQ ID NO: 1167862 - protein, 9 aa, Homo Sapiens
CCLCQGGLP

SEQ ID NO: 1167863 - protein, 9 aa, Homo Sapiens
MNFVQKYLE

SEQ ID NO: 1167864 - protein, 9 aa, Homo Sapiens
VASPPTRSS

SEQ ID NO: 1167865 - protein, 9 aa, Homo Sapiens
PRTMSRKIL

SEQ ID NO: 1167866 - protein, 9 aa, Homo Sapiens
TELTHVPLR

SEQ ID NO: 1167867 - protein, 9 aa, Homo Sapiens
PDKRRNTEL

SEQ ID NO: 1167868 - protein, 9 aa, Homo Sapiens
HDNTSCLYV

SEQ ID NO: 1167869 - protein, 9 aa, Homo Sapiens
KKKRDDEEE

SEQ ID NO: 1167870 - protein, 9 aa, Homo Sapiens
SDPLCCCLA

SEQ ID NO: 1167871 - protein, 9 aa, Homo Sapiens
QAGALSLSC

SEQ ID NO: 1167872 - protein, 9 aa, Homo Sapiens
TLDQMIHIL

SEQ ID NO: 1167873 - protein, 9 aa, Homo Sapiens
WLIFTQNYH

SEQ ID NO: 1167874 - protein, 9 aa, Homo Sapiens
ERGQGHIDD

SEQ ID NO: 1167875 - protein, 9 aa, Homo Sapiens
QHQRIHTDK

SEQ ID NO: 1167876 - protein, 9 aa, Homo Sapiens
LTRKCGAEI

SEQ ID NO: 1167877 - protein, 9 aa, Homo Sapiens
KPHYKRKGS

SEQ ID NO: 1167878 - protein, 9 aa, Homo Sapiens
GGGGEDAPG

SEQ ID NO: 1167879 - protein, 9 aa, Homo Sapiens
VSLLNTTKN

SEQ ID NO: 1167880 - protein, 9 aa, Homo Sapiens
QSNRTVRMT

SEQ ID NO: 1167881 - protein, 9 aa, Homo Sapiens
REGDAPFSE

SEQ ID NO: 1167882 - protein, 9 aa, Homo Sapiens
VKGFPDRKD

SEQ ID NO: 1167883 - protein, 9 aa, Homo Sapiens
DDPDIVGSI

SEQ ID NO: 1167884 - protein, 9 aa, Homo Sapiens
KCHSSGGSP

SEQ ID NO: 1167885 - protein, 9 aa, Homo Sapiens
QLQPMMSEL

SEQ ID NO: 1167886 - protein, 9 aa, Homo Sapiens
SWGWGWARL

SEQ ID NO: 1167887 - protein, 9 aa, Homo Sapiens
FSPNVHTWN

SEQ ID NO: 1167888 - protein, 9 aa, Homo Sapiens
HLLAEGTPI

SEQ ID NO: 1167889 - protein, 9 aa, Homo Sapiens
QHCQHRERI

SEQ ID NO: 1167890 - protein, 9 aa, Homo Sapiens
RVRPVVAGQ

SEQ ID NO: 1167891 - protein, 9 aa, Homo Sapiens
RSRSFPCWK

SEQ ID NO: 1167892 - protein, 9 aa, Homo Sapiens
PHHCPRHCP

SEQ ID NO: 1167893 - protein, 9 aa, Homo Sapiens
ITEDTPPPA

SEQ ID NO: 1167894 - protein, 9 aa, Homo Sapiens
VSFRVTWVS

SEQ ID NO: 1167895 - protein, 9 aa, Homo Sapiens
REAVGNLRD

SEQ ID NO: 1167896 - protein, 9 aa, Homo Sapiens
AICSDTRLQ

SEQ ID NO: 1167897 - protein, 9 aa, Homo Sapiens
LLSIPWTQI

SEQ ID NO: 1167898 - protein, 9 aa, Homo Sapiens
YGMSLITLA

SEQ ID NO: 1167899 - protein, 9 aa, Homo Sapiens
VASRELKAP

SEQ ID NO: 1167900 - protein, 9 aa, Homo Sapiens
FASRPASPL

SEQ ID NO: 1167901 - protein, 9 aa, Homo Sapiens
TFPPGTAMP

SEQ ID NO: 1167902 - protein, 9 aa, Homo Sapiens
RAAESGTRA

SEQ ID NO: 1167903 - protein, 9 aa, Homo Sapiens
TGTLQQQPG

SEQ ID NO: 1167904 - protein, 9 aa, Homo Sapiens
DLVAHHEDD

SEQ ID NO: 1167905 - protein, 9 aa, Homo Sapiens
GMGLQLLRL

SEQ ID NO: 1167906 - protein, 9 aa, Homo Sapiens
CEHVQARLC

SEQ ID NO: 1167907 - protein, 9 aa, Homo Sapiens
RPLPWPLPS

SEQ ID NO: 1167908 - protein, 9 aa, Homo Sapiens
WAQHGSPAI

SEQ ID NO: 1167909 - protein, 9 aa, Homo Sapiens
PAGPRLSIR

SEQ ID NO: 1167910 - protein, 9 aa, Homo Sapiens
TTSSPCSRA

SEQ ID NO: 1167911 - protein, 9 aa, Homo Sapiens
KPAMGLARE

SEQ ID NO: 1167912 - protein, 9 aa, Homo Sapiens
VGGIYLLYL

SEQ ID NO: 1167913 - protein, 9 aa, Homo Sapiens
QFRSIVSTL

SEQ ID NO: 1167914 - protein, 9 aa, Homo Sapiens
HVAPMGEAP

SEQ ID NO: 1167915 - protein, 9 aa, Homo Sapiens
AAESGTRAV

SEQ ID NO: 1167916 - protein, 9 aa, Homo Sapiens
VRPGSTPRP

SEQ ID NO: 1167917 - protein, 9 aa, Homo Sapiens
APPEIYYTS

SEQ ID NO: 1167918 - protein, 9 aa, Homo Sapiens
PTPSPALRA

SEQ ID NO: 1167919 - protein, 9 aa, Homo Sapiens
VPRGSDNTV

SEQ ID NO: 1167920 - protein, 9 aa, Homo Sapiens
PCWGWHWEG

SEQ ID NO: 1167921 - protein, 9 aa, Homo Sapiens
VGLCSCSPC

SEQ ID NO: 1167922 - protein, 9 aa, Homo Sapiens
LAAVGVLWG

SEQ ID NO: 1167923 - protein, 9 aa, Homo Sapiens
RVILPDDVC

SEQ ID NO: 1167924 - protein, 9 aa, Homo Sapiens
VQEIALRVC

SEQ ID NO: 1167925 - protein, 9 aa, Homo Sapiens
YTTPWAGPT

SEQ ID NO: 1167926 - protein, 9 aa, Homo Sapiens
GGGVGEPRH

SEQ ID NO: 1167927 - protein, 9 aa, Homo Sapiens
QADQSVYAF

SEQ ID NO: 1167928 - protein, 9 aa, Homo Sapiens
LLICDPLCN

SEQ ID NO: 1167929 - protein, 9 aa, Homo Sapiens
FDDLDYGYG

SEQ ID NO: 1167930 - protein, 9 aa, Homo Sapiens
ATTRPPAFI

SEQ ID NO: 1167931 - protein, 9 aa, Homo Sapiens
GQGSLPGSA

SEQ ID NO: 1167932 - protein, 9 aa, Homo Sapiens
LQKLKVELR

SEQ ID NO: 1167933 - protein, 9 aa, Homo Sapiens
YSFLQQCKK

SEQ ID NO: 1167934 - protein, 9 aa, Homo Sapiens
APGVPFAPC

SEQ ID NO: 1167935 - protein, 9 aa, Homo Sapiens
VCFAKGEVP

SEQ ID NO: 1167936 - protein, 9 aa, Homo Sapiens
LMLMGSQLA

SEQ ID NO: 1167937 - protein, 9 aa, Homo Sapiens
PPQPRLALS

SEQ ID NO: 1167938 - protein, 9 aa, Homo Sapiens
QARVGQRAE

SEQ ID NO: 1167939 - protein, 9 aa, Homo Sapiens
NCTNKEDTW

SEQ ID NO: 1167940 - protein, 9 aa, Homo Sapiens
RGDPEDGAQ

SEQ ID NO: 1167941 - protein, 9 aa, Homo Sapiens
LLPGLLPTP

SEQ ID NO: 1167942 - protein, 9 aa, Homo Sapiens
TWMAVVAGL

SEQ ID NO: 1167943 - protein, 9 aa, Homo Sapiens
CWPPPAPGR

SEQ ID NO: 1167944 - protein, 9 aa, Homo Sapiens
SPDPGQPPL

SEQ ID NO: 1167945 - protein, 9 aa, Homo Sapiens
ARCLRVPAG

SEQ ID NO: 1167946 - protein, 9 aa, Homo Sapiens
YQCVCPQGF

SEQ ID NO: 1167947 - protein, 9 aa, Homo Sapiens
SITQENDLA

SEQ ID NO: 1167948 - protein, 9 aa, Homo Sapiens
LILGPVCEH

SEQ ID NO: 1167949 - protein, 9 aa, Homo Sapiens
SRSPHHYYH

SEQ ID NO: 1167950 - protein, 9 aa, Homo Sapiens
AWRTCWSPA

SEQ ID NO: 1167951 - protein, 9 aa, Homo Sapiens
HSKLRPGFM

SEQ ID NO: 1167952 - protein, 9 aa, Homo Sapiens
QPSWATRQL

SEQ ID NO: 1167953 - protein, 9 aa, Homo Sapiens
PPPLASSHT

SEQ ID NO: 1167954 - protein, 9 aa, Homo Sapiens
GEQGSDGIP

SEQ ID NO: 1167955 - protein, 9 aa, Homo Sapiens
ERYLDGLTA

SEQ ID NO: 1167956 - protein, 9 aa, Homo Sapiens
CCQSSCYKA

SEQ ID NO: 1167957 - protein, 9 aa, Homo Sapiens
GEVGNFAAY

SEQ ID NO: 1167958 - protein, 9 aa, Homo Sapiens
GKGASAPRG

SEQ ID NO: 1167959 - protein, 9 aa, Homo Sapiens
RACRRRMAL

SEQ ID NO: 1167960 - protein, 9 aa, Homo Sapiens
GVPCTQACG

SEQ ID NO: 1167961 - protein, 9 aa, Homo Sapiens
PTLPPLKDT

SEQ ID NO: 1167962 - protein, 9 aa, Homo Sapiens
ASFILSYRW

SEQ ID NO: 1167963 - protein, 9 aa, Homo Sapiens
GLGGHLSFV

SEQ ID NO: 1167964 - protein, 9 aa, Homo Sapiens
TTWRPPTPS

SEQ ID NO: 1167965 - protein, 9 aa, Homo Sapiens
PTRKNRTRT

SEQ ID NO: 1167966 - protein, 9 aa, Homo Sapiens
SYGMVGVLQ

SEQ ID NO: 1167967 - protein, 9 aa, Homo Sapiens
RPRCRPAVA

SEQ ID NO: 1167968 - protein, 9 aa, Homo Sapiens
QKEQRFGVR

SEQ ID NO: 1167969 - protein, 9 aa, Homo Sapiens
TALASGCPR

SEQ ID NO: 1167970 - protein, 9 aa, Homo Sapiens
GTHSPARSV

SEQ ID NO: 1167971 - protein, 9 aa, Homo Sapiens
QAEGSLKKT

SEQ ID NO: 1167972 - protein, 9 aa, Homo Sapiens
SHPGGPACA

SEQ ID NO: 1167973 - protein, 9 aa, Homo Sapiens
RTSCGAARP

SEQ ID NO: 1167974 - protein, 9 aa, Homo Sapiens
GRGYRVGRM

SEQ ID NO: 1167975 - protein, 9 aa, Homo Sapiens
PRTAPALGC

SEQ ID NO: 1167976 - protein, 9 aa, Homo Sapiens
NRGNAGVKQ

SEQ ID NO: 1167977 - protein, 9 aa, Homo Sapiens
CLRTSCGAA

SEQ ID NO: 1167978 - protein, 9 aa, Homo Sapiens
TTPSANTAP

SEQ ID NO: 1167979 - protein, 9 aa, Homo Sapiens
EAEPPGGAV

SEQ ID NO: 1167980 - protein, 9 aa, Homo Sapiens
YAIRVATTL

SEQ ID NO: 1167981 - protein, 9 aa, Homo Sapiens
GRPNSSHRQ

SEQ ID NO: 1167982 - protein, 9 aa, Homo Sapiens
RTVAFWTGT

SEQ ID NO: 1167983 - protein, 9 aa, Homo Sapiens
VGEWVLPEE

SEQ ID NO: 1167984 - protein, 9 aa, Homo Sapiens
SKKENTIRI

SEQ ID NO: 1167985 - protein, 9 aa, Homo Sapiens
QRFGVRKGS

SEQ ID NO: 1167986 - protein, 9 aa, Homo Sapiens
RPGGPAPAA

SEQ ID NO: 1167987 - protein, 9 aa, Homo Sapiens
KDVQMRAAI

SEQ ID NO: 1167988 - protein, 9 aa, Homo Sapiens
TNLSPVFSG

SEQ ID NO: 1167989 - protein, 9 aa, Homo Sapiens
AWTCQTQDS

SEQ ID NO: 1167990 - protein, 9 aa, Homo Sapiens
LWATGGNRT

SEQ ID NO: 1167991 - protein, 9 aa, Homo Sapiens
RPPPPLFSQ

SEQ ID NO: 1167992 - protein, 9 aa, Homo Sapiens
APPSRPSGR

SEQ ID NO: 1167993 - protein, 9 aa, Homo Sapiens
IAYCVNLLC

SEQ ID NO: 1167994 - protein, 9 aa, Homo Sapiens
APFPAPQTP

SEQ ID NO: 1167995 - protein, 9 aa, Homo Sapiens
EPPGGAVRA

SEQ ID NO: 1167996 - protein, 9 aa, Homo Sapiens
CDTKSGSVL

SEQ ID NO: 1167997 - protein, 9 aa, Homo Sapiens
HHCGHSVLW

SEQ ID NO: 1167998 - protein, 9 aa, Homo Sapiens
DDKPFDLRI

SEQ ID NO: 1167999 - protein, 9 aa, Homo Sapiens
LTADSRKRH

SEQ ID NO: 1168000 - protein, 9 aa, Homo Sapiens
TNAVIQERR

SEQ ID NO: 1168001 - protein, 9 aa, Homo Sapiens
WLSPLQRSG

SEQ ID NO: 1168002 - protein, 9 aa, Homo Sapiens
YQFHRSLWT

SEQ ID NO: 1168003 - protein, 9 aa, Homo Sapiens
PVRSWDLRE

SEQ ID NO: 1168004 - protein, 9 aa, Homo Sapiens
GYCRTRIYA

SEQ ID NO: 1168005 - protein, 9 aa, Homo Sapiens
APLVRTGFL

SEQ ID NO: 1168006 - protein, 9 aa, Homo Sapiens
VRAGDPATT

SEQ ID NO: 1168007 - protein, 9 aa, Homo Sapiens
ASPSITSMH

SEQ ID NO: 1168008 - protein, 9 aa, Homo Sapiens
AETSIILFL

SEQ ID NO: 1168009 - protein, 9 aa, Homo Sapiens
PPMPAWPGV

SEQ ID NO: 1168010 - protein, 9 aa, Homo Sapiens
TARSRPRGG

SEQ ID NO: 1168011 - protein, 9 aa, Homo Sapiens
HCFMTSGIQ

SEQ ID NO: 1168012 - protein, 9 aa, Homo Sapiens
GLSQPQHRV

SEQ ID NO: 1168013 - protein, 9 aa, Homo Sapiens
RFISAPQPS

SEQ ID NO: 1168014 - protein, 9 aa, Homo Sapiens
FIETKTVRQ

SEQ ID NO: 1168015 - protein, 9 aa, Homo Sapiens
NAGVKQSAA

SEQ ID NO: 1168016 - protein, 9 aa, Homo Sapiens
QSLNHFLAP

SEQ ID NO: 1168017 - protein, 9 aa, Homo Sapiens
APSSPRRLL

SEQ ID NO: 1168018 - protein, 9 aa, Homo Sapiens
GALMALGGL

SEQ ID NO: 1168019 - protein, 9 aa, Homo Sapiens
PPPPLFSQS

SEQ ID NO: 1168020 - protein, 9 aa, Homo Sapiens
CSPRRSPDH

SEQ ID NO: 1168021 - protein, 9 aa, Homo Sapiens
MCAPVGNGC

SEQ ID NO: 1168022 - protein, 9 aa, Homo Sapiens
YKCAECGKF

SEQ ID NO: 1168023 - protein, 9 aa, Homo Sapiens
PAAQDGARC

SEQ ID NO: 1168024 - protein, 9 aa, Homo Sapiens
IQVIGFATE

SEQ ID NO: 1168025 - protein, 9 aa, Homo Sapiens
IMKTSPTVY

SEQ ID NO: 1168026 - protein, 9 aa, Homo Sapiens
VFIYEMAVG

SEQ ID NO: 1168027 - protein, 9 aa, Homo Sapiens
PHASPTSTP

SEQ ID NO: 1168028 - protein, 9 aa, Homo Sapiens
HSSGNVLNG

SEQ ID NO: 1168029 - protein, 9 aa, Homo Sapiens
LSGDCCSWP

SEQ ID NO: 1168030 - protein, 9 aa, Homo Sapiens
NQLTRDWKA

SEQ ID NO: 1168031 - protein, 9 aa, Homo Sapiens
KVFPSPQSH

SEQ ID NO: 1168032 - protein, 9 aa, Homo Sapiens
LREAVLLGS

SEQ ID NO: 1168033 - protein, 9 aa, Homo Sapiens
TMKGYSKLG

SEQ ID NO: 1168034 - protein, 9 aa, Homo Sapiens
CPQAIPRSP

SEQ ID NO: 1168035 - protein, 9 aa, Homo Sapiens
RPSDVLFGA

SEQ ID NO: 1168036 - protein, 9 aa, Homo Sapiens
LPLRCPRAP

SEQ ID NO: 1168037 - protein, 9 aa, Homo Sapiens
PPSAGVLSP

SEQ ID NO: 1168038 - protein, 9 aa, Homo Sapiens
LDKMTMSFW

SEQ ID NO: 1168039 - protein, 9 aa, Homo Sapiens
LGGDEEDPD

SEQ ID NO: 1168040 - protein, 9 aa, Homo Sapiens
CAIGARNKS

SEQ ID NO: 1168041 - protein, 9 aa, Homo Sapiens
RLLPLTRPR

SEQ ID NO: 1168042 - protein, 9 aa, Homo Sapiens
QSISAEDDE

SEQ ID NO: 1168043 - protein, 9 aa, Homo Sapiens
KIHQMGLKV

SEQ ID NO: 1168044 - protein, 9 aa, Homo Sapiens
RSAASSAAS

SEQ ID NO: 1168045 - protein, 9 aa, Homo Sapiens
SMRMRMIRS

SEQ ID NO: 1168046 - protein, 9 aa, Homo Sapiens
IEALNTGTL

SEQ ID NO: 1168047 - protein, 9 aa, Homo Sapiens
QHRVLAGEG

SEQ ID NO: 1168048 - protein, 9 aa, Homo Sapiens
NNTMLWNSF

SEQ ID NO: 1168049 - protein, 9 aa, Homo Sapiens
SQIEKHKAC

SEQ ID NO: 1168050 - protein, 9 aa, Homo Sapiens
SRANPRFCN

SEQ ID NO: 1168051 - protein, 9 aa, Homo Sapiens
SSIHFEMEE

SEQ ID NO: 1168052 - protein, 9 aa, Homo Sapiens
RLLGLARPL

SEQ ID NO: 1168053 - protein, 9 aa, Homo Sapiens
SMHPFTATT

SEQ ID NO: 1168054 - protein, 9 aa, Homo Sapiens
PLASEEQRA

SEQ ID NO: 1168055 - protein, 9 aa, Homo Sapiens
RAGGILAYE

SEQ ID NO: 1168056 - protein, 9 aa, Homo Sapiens
TTPSCRNHI

SEQ ID NO: 1168057 - protein, 9 aa, Homo Sapiens
VHDDMRLLS

SEQ ID NO: 1168058 - protein, 9 aa, Homo Sapiens
HNYLPFEAK

SEQ ID NO: 1168059 - protein, 9 aa, Homo Sapiens
RQLGQGLGV

SEQ ID NO: 1168060 - protein, 9 aa, Homo Sapiens
CRPRCCRWT

SEQ ID NO: 1168061 - protein, 9 aa, Homo Sapiens
EDQDKMTHL

SEQ ID NO: 1168062 - protein, 9 aa, Homo Sapiens
GIQKYFVVI

SEQ ID NO: 1168063 - protein, 9 aa, Homo Sapiens
KHRLRGSLT

SEQ ID NO: 1168064 - protein, 9 aa, Homo Sapiens
NDAIMSGCR

SEQ ID NO: 1168065 - protein, 9 aa, Homo Sapiens
QRNSFQSEC

SEQ ID NO: 1168066 - protein, 9 aa, Homo Sapiens
TDSDVLEQR

SEQ ID NO: 1168067 - protein, 9 aa, Homo Sapiens
AMASNTARG

SEQ ID NO: 1168068 - protein, 9 aa, Homo Sapiens
SHGAPQARQ

SEQ ID NO: 1168069 - protein, 9 aa, Homo Sapiens
QEQLQKLKV

SEQ ID NO: 1168070 - protein, 9 aa, Homo Sapiens
PAEVAQHIR

SEQ ID NO: 1168071 - protein, 9 aa, Homo Sapiens
HTAMRRQMR

SEQ ID NO: 1168072 - protein, 9 aa, Homo Sapiens
VTMPLLPVP

SEQ ID NO: 1168073 - protein, 9 aa, Homo Sapiens
NENDGYMDM

SEQ ID NO: 1168074 - protein, 9 aa, Homo Sapiens
FPAPQTPSM

SEQ ID NO: 1168075 - protein, 9 aa, Homo Sapiens
TGVSFRVTW

SEQ ID NO: 1168076 - protein, 9 aa, Homo Sapiens
FTCVVCHCG

SEQ ID NO: 1168077 - protein, 9 aa, Homo Sapiens
NQPEYKALF

SEQ ID NO: 1168078 - protein, 9 aa, Homo Sapiens
ILVSMSSER

SEQ ID NO: 1168079 - protein, 9 aa, Homo Sapiens
HPAPQRRGH

SEQ ID NO: 1168080 - protein, 9 aa, Homo Sapiens
MVIPVRQVA

SEQ ID NO: 1168081 - protein, 9 aa, Homo Sapiens
PSGRPRPDP

SEQ ID NO: 1168082 - protein, 9 aa, Homo Sapiens
ECWETCHIS

SEQ ID NO: 1168083 - protein, 9 aa, Homo Sapiens
RPPAPRQGS

SEQ ID NO: 1168084 - protein, 9 aa, Homo Sapiens
IVACIEPLR

SEQ ID NO: 1168085 - protein, 9 aa, Homo Sapiens
EKCPAEDYV

SEQ ID NO: 1168086 - protein, 9 aa, Homo Sapiens
KLQWSPSIL

SEQ ID NO: 1168087 - protein, 9 aa, Homo Sapiens
LGDSLVQLM

SEQ ID NO: 1168088 - protein, 9 aa, Homo Sapiens
SVVSRGPRG

SEQ ID NO: 1168089 - protein, 9 aa, Homo Sapiens
LTVASSLPW

SEQ ID NO: 1168090 - protein, 9 aa, Homo Sapiens
STLRGHFPG

SEQ ID NO: 1168091 - protein, 9 aa, Homo Sapiens
DSSYVCFAK

SEQ ID NO: 1168092 - protein, 9 aa, Homo Sapiens
WQITAQHIY

SEQ ID NO: 1168093 - protein, 9 aa, Homo Sapiens
PVARGPAEK

SEQ ID NO: 1168094 - protein, 9 aa, Homo Sapiens
WQLLNGPPI

SEQ ID NO: 1168095 - protein, 9 aa, Homo Sapiens
GQAANPQYV

SEQ ID NO: 1168096 - protein, 9 aa, Homo Sapiens
REQEQREQE

SEQ ID NO: 1168097 - protein, 9 aa, Homo Sapiens
STSAPGRSC

SEQ ID NO: 1168098 - protein, 9 aa, Homo Sapiens
APQPSSSTV

SEQ ID NO: 1168099 - protein, 9 aa, Homo Sapiens
SHEGVLVRS

SEQ ID NO: 1168100 - protein, 9 aa, Homo Sapiens
ARSRPRGGP

SEQ ID NO: 1168101 - protein, 9 aa, Homo Sapiens
VTKGDVTYT

SEQ ID NO: 1168102 - protein, 9 aa, Homo Sapiens
TPPRETDPC

SEQ ID NO: 1168103 - protein, 9 aa, Homo Sapiens
VIHYVLDRH

SEQ ID NO: 1168104 - protein, 9 aa, Homo Sapiens
ERGAVGLPR

SEQ ID NO: 1168105 - protein, 9 aa, Homo Sapiens
HGCREKIDP

SEQ ID NO: 1168106 - protein, 9 aa, Homo Sapiens
WTIRLPRKE

SEQ ID NO: 1168107 - protein, 9 aa, Homo Sapiens
MDALWGLLP

SEQ ID NO: 1168108 - protein, 9 aa, Homo Sapiens
LWAYIRKQC

SEQ ID NO: 1168109 - protein, 9 aa, Homo Sapiens
GRGRGQPEA

SEQ ID NO: 1168110 - protein, 9 aa, Homo Sapiens
RRSLMSVAS

SEQ ID NO: 1168111 - protein, 9 aa, Homo Sapiens
NIPLLLLQN

SEQ ID NO: 1168112 - protein, 9 aa, Homo Sapiens
PGPKEAISA

SEQ ID NO: 1168113 - protein, 9 aa, Homo Sapiens
HIEKYQFSL

SEQ ID NO: 1168114 - protein, 9 aa, Homo Sapiens
LSVSVGCVA

SEQ ID NO: 1168115 - protein, 9 aa, Homo Sapiens
LSISRPTSR

SEQ ID NO: 1168116 - protein, 9 aa, Homo Sapiens
VRVQPVTKA

SEQ ID NO: 1168117 - protein, 9 aa, Homo Sapiens
EWAGFLNEI

SEQ ID NO: 1168118 - protein, 9 aa, Homo Sapiens
WNSTKKRLR

SEQ ID NO: 1168119 - protein, 9 aa, Homo Sapiens
ITVTGARVL

SEQ ID NO: 1168120 - protein, 9 aa, Homo Sapiens
ESSQPRGSS

SEQ ID NO: 1168121 - protein, 9 aa, Homo Sapiens
VYNSGQRWK

SEQ ID NO: 1168122 - protein, 9 aa, Homo Sapiens
FLQQCKKCL

SEQ ID NO: 1168123 - protein, 9 aa, Homo Sapiens
LCGPSPHSG

SEQ ID NO: 1168124 - protein, 9 aa, Homo Sapiens
APNSFLTSY

SEQ ID NO: 1168125 - protein, 9 aa, Homo Sapiens
AAGGQRDGG

SEQ ID NO: 1168126 - protein, 9 aa, Homo Sapiens
FVKTLAKEL

SEQ ID NO: 1168127 - protein, 9 aa, Homo Sapiens
SLSSQTSVS

SEQ ID NO: 1168128 - protein, 9 aa, Homo Sapiens
SGYCSMQRT

SEQ ID NO: 1168129 - protein, 9 aa, Homo Sapiens
PSQPLDRQF

SEQ ID NO: 1168130 - protein, 9 aa, Homo Sapiens
VLLCGPSPH

SEQ ID NO: 1168131 - protein, 9 aa, Homo Sapiens
FGGAVEDFL

SEQ ID NO: 1168132 - protein, 9 aa, Homo Sapiens
MGEAPTYVN

SEQ ID NO: 1168133 - protein, 9 aa, Homo Sapiens
SLQERGGAS

SEQ ID NO: 1168134 - protein, 9 aa, Homo Sapiens
ACCGGKRSS

SEQ ID NO: 1168135 - protein, 9 aa, Homo Sapiens
TGLTITDQI

SEQ ID NO: 1168136 - protein, 9 aa, Homo Sapiens
NYYVGSLIG

SEQ ID NO: 1168137 - protein, 9 aa, Homo Sapiens
PSPQSHRPP

SEQ ID NO: 1168138 - protein, 9 aa, Homo Sapiens
EHGFEGKFK

SEQ ID NO: 1168139 - protein, 9 aa, Homo Sapiens
PVLWALAVL

SEQ ID NO: 1168140 - protein, 9 aa, Homo Sapiens
ASTQARSPS

SEQ ID NO: 1168141 - protein, 9 aa, Homo Sapiens
ATKIYSQRS

SEQ ID NO: 1168142 - protein, 9 aa, Homo Sapiens
PRKTLKMIR

SEQ ID NO: 1168143 - protein, 9 aa, Homo Sapiens
LHLPRLKDG

SEQ ID NO: 1168144 - protein, 9 aa, Homo Sapiens
MEKTPPCGS

SEQ ID NO: 1168145 - protein, 9 aa, Homo Sapiens
HSDTRPFAC

SEQ ID NO: 1168146 - protein, 9 aa, Homo Sapiens
PPTKQQRRS

SEQ ID NO: 1168147 - protein, 9 aa, Homo Sapiens
DFGFVRYLQ

SEQ ID NO: 1168148 - protein, 9 aa, Homo Sapiens
RMIRSVWRL

SEQ ID NO: 1168149 - protein, 9 aa, Homo Sapiens
QKHIEEQKE

SEQ ID NO: 1168150 - protein, 9 aa, Homo Sapiens
IHYVLDRHR

SEQ ID NO: 1168151 - protein, 9 aa, Homo Sapiens
VRICKEDTA

SEQ ID NO: 1168152 - protein, 9 aa, Homo Sapiens
PPVSVSKNV

SEQ ID NO: 1168153 - protein, 9 aa, Homo Sapiens
FWRCSKTFS

SEQ ID NO: 1168154 - protein, 9 aa, Homo Sapiens
SKVPYIVCQ

SEQ ID NO: 1168155 - protein, 9 aa, Homo Sapiens
VEEPQSRWT

SEQ ID NO: 1168156 - protein, 9 aa, Homo Sapiens
VIPVRQVAS

SEQ ID NO: 1168157 - protein, 9 aa, Homo Sapiens
GQLVLTSDS

SEQ ID NO: 1168158 - protein, 9 aa, Homo Sapiens
LPTMPCTYL

SEQ ID NO: 1168159 - protein, 9 aa, Homo Sapiens
EWRQRSIVI

SEQ ID NO: 1168160 - protein, 9 aa, Homo Sapiens
HLTVEDGHR

SEQ ID NO: 1168161 - protein, 9 aa, Homo Sapiens
PRFCELYGD

SEQ ID NO: 1168162 - protein, 9 aa, Homo Sapiens
IGSPNSLLI

SEQ ID NO: 1168163 - protein, 9 aa, Homo Sapiens
AANVITKNN

SEQ ID NO: 1168164 - protein, 9 aa, Homo Sapiens
NISCVLYPN

SEQ ID NO: 1168165 - protein, 9 aa, Homo Sapiens
GATPPACQG

SEQ ID NO: 1168166 - protein, 9 aa, Homo Sapiens
AEYYLYKFQ

SEQ ID NO: 1168167 - protein, 9 aa, Homo Sapiens
SPSCTWSRW

SEQ ID NO: 1168168 - protein, 9 aa, Homo Sapiens
FIMVASAQI

SEQ ID NO: 1168169 - protein, 9 aa, Homo Sapiens
PGPRVGPPL

SEQ ID NO: 1168170 - protein, 9 aa, Homo Sapiens
TSAPGRSCR

SEQ ID NO: 1168171 - protein, 9 aa, Homo Sapiens
SPPCSRGLP

SEQ ID NO: 1168172 - protein, 9 aa, Homo Sapiens
DGRGGAHRS

SEQ ID NO: 1168173 - protein, 9 aa, Homo Sapiens
FGVRKGSKR

SEQ ID NO: 1168174 - protein, 9 aa, Homo Sapiens
SSCKKEAVL

SEQ ID NO: 1168175 - protein, 9 aa, Homo Sapiens
AVPEAVSSP

SEQ ID NO: 1168176 - protein, 9 aa, Homo Sapiens
MKEECERIG

SEQ ID NO: 1168177 - protein, 9 aa, Homo Sapiens
LLLPVLVQD

SEQ ID NO: 1168178 - protein, 9 aa, Homo Sapiens
GYIDSLERY

SEQ ID NO: 1168179 - protein, 9 aa, Homo Sapiens
IAPWSRPSR

SEQ ID NO: 1168180 - protein, 9 aa, Homo Sapiens
GRQLASQSR

SEQ ID NO: 1168181 - protein, 9 aa, Homo Sapiens
LGRIGKVVK

SEQ ID NO: 1168182 - protein, 9 aa, Homo Sapiens
PVPRRGLLL

SEQ ID NO: 1168183 - protein, 9 aa, Homo Sapiens
CGRRPSGFP

SEQ ID NO: 1168184 - protein, 9 aa, Homo Sapiens
LDSPGRIKW

SEQ ID NO: 1168185 - protein, 9 aa, Homo Sapiens
CSSSLAFIC

SEQ ID NO: 1168186 - protein, 9 aa, Homo Sapiens
GTVEGAKRR

SEQ ID NO: 1168187 - protein, 9 aa, Homo Sapiens
KNYHPQCLV

SEQ ID NO: 1168188 - protein, 9 aa, Homo Sapiens
YHLRFTIFG

SEQ ID NO: 1168189 - protein, 9 aa, Homo Sapiens
GQILHRGGA

SEQ ID NO: 1168190 - protein, 9 aa, Homo Sapiens
VVINIQNKK

SEQ ID NO: 1168191 - protein, 9 aa, Homo Sapiens
VKHLINPVK

SEQ ID NO: 1168192 - protein, 9 aa, Homo Sapiens
LAGPPWPQA

SEQ ID NO: 1168193 - protein, 9 aa, Homo Sapiens
RLDLAGQEL

SEQ ID NO: 1168194 - protein, 9 aa, Homo Sapiens
AITISLAIA

SEQ ID NO: 1168195 - protein, 9 aa, Homo Sapiens
STLWPPAQP

SEQ ID NO: 1168196 - protein, 9 aa, Homo Sapiens
PAHAAGPEP

SEQ ID NO: 1168197 - protein, 9 aa, Homo Sapiens
CDGGVGETA

SEQ ID NO: 1168198 - protein, 9 aa, Homo Sapiens
PAPGRQLAS

SEQ ID NO: 1168199 - protein, 9 aa, Homo Sapiens
EYECSVEND

SEQ ID NO: 1168200 - protein, 9 aa, Homo Sapiens
RAVGTQISI

SEQ ID NO: 1168201 - protein, 9 aa, Homo Sapiens
TSEVSLAQD

SEQ ID NO: 1168202 - protein, 9 aa, Homo Sapiens
QIVGFVDHE

SEQ ID NO: 1168203 - protein, 9 aa, Homo Sapiens
PACTCISMT

SEQ ID NO: 1168204 - protein, 9 aa, Homo Sapiens
VADTSSVST

SEQ ID NO: 1168205 - protein, 9 aa, Homo Sapiens
TVFRGCMSM

SEQ ID NO: 1168206 - protein, 9 aa, Homo Sapiens
VLVCGGNRG

SEQ ID NO: 1168207 - protein, 9 aa, Homo Sapiens
AMQNHAGEK

SEQ ID NO: 1168208 - protein, 9 aa, Homo Sapiens
GPVCEHAAA

SEQ ID NO: 1168209 - protein, 9 aa, Homo Sapiens
LQPMMSELE

SEQ ID NO: 1168210 - protein, 9 aa, Homo Sapiens
IRQRDEQLQ

SEQ ID NO: 1168211 - protein, 9 aa, Homo Sapiens
PRVGPPLRG

SEQ ID NO: 1168212 - protein, 9 aa, Homo Sapiens
YGGFDDLDY

SEQ ID NO: 1168213 - protein, 9 aa, Homo Sapiens
EDGVFVHGL

SEQ ID NO: 1168214 - protein, 9 aa, Homo Sapiens
ELKVVDHRL

SEQ ID NO: 1168215 - protein, 9 aa, Homo Sapiens
GLLSHLYCQ

SEQ ID NO: 1168216 - protein, 9 aa, Homo Sapiens
EEIQSEMPG

SEQ ID NO: 1168217 - protein, 9 aa, Homo Sapiens
WGIPGSLPP

SEQ ID NO: 1168218 - protein, 9 aa, Homo Sapiens
SHQETKYRS

SEQ ID NO: 1168219 - protein, 9 aa, Homo Sapiens
QKRITQQLE

SEQ ID NO: 1168220 - protein, 9 aa, Homo Sapiens
IVKDENCGP

SEQ ID NO: 1168221 - protein, 9 aa, Homo Sapiens
SRRYDDYSS

SEQ ID NO: 1168222 - protein, 9 aa, Homo Sapiens
QCQYRSPRR

SEQ ID NO: 1168223 - protein, 9 aa, Homo Sapiens
LFLVKCTSS

SEQ ID NO: 1168224 - protein, 9 aa, Homo Sapiens
CLGSFGSIT

SEQ ID NO: 1168225 - protein, 9 aa, Homo Sapiens
LSPVTALAR

SEQ ID NO: 1168226 - protein, 9 aa, Homo Sapiens
GAAGHPCRC

SEQ ID NO: 1168227 - protein, 9 aa, Homo Sapiens
LELPWGPQG

SEQ ID NO: 1168228 - protein, 9 aa, Homo Sapiens
GGRPGGSGH

SEQ ID NO: 1168229 - protein, 9 aa, Homo Sapiens
VAQHIRPED

SEQ ID NO: 1168230 - protein, 9 aa, Homo Sapiens
ARVPGSQGA

SEQ ID NO: 1168231 - protein, 9 aa, Homo Sapiens
CDILECDEE

SEQ ID NO: 1168232 - protein, 9 aa, Homo Sapiens
PGLVCHERH

SEQ ID NO: 1168233 - protein, 9 aa, Homo Sapiens
LVVTVRDGG

SEQ ID NO: 1168234 - protein, 9 aa, Homo Sapiens
ALTQYQEME

SEQ ID NO: 1168235 - protein, 9 aa, Homo Sapiens
VTHRTSLRA

SEQ ID NO: 1168236 - protein, 9 aa, Homo Sapiens
TGRTPTTRL

SEQ ID NO: 1168237 - protein, 9 aa, Homo Sapiens
RGGAHRSPG

SEQ ID NO: 1168238 - protein, 9 aa, Homo Sapiens
TSPRLPLWR

SEQ ID NO: 1168239 - protein, 9 aa, Homo Sapiens
CGTSYHAAM

SEQ ID NO: 1168240 - protein, 9 aa, Homo Sapiens
TMQGLPDLP

SEQ ID NO: 1168241 - protein, 9 aa, Homo Sapiens
TPLSEAKNQ

SEQ ID NO: 1168242 - protein, 9 aa, Homo Sapiens
GQGHIDDEA

SEQ ID NO: 1168243 - protein, 9 aa, Homo Sapiens
KGEDANAAT

SEQ ID NO: 1168244 - protein, 9 aa, Homo Sapiens
PTIMSPSLF

SEQ ID NO: 1168245 - protein, 9 aa, Homo Sapiens
CEHAAAPVA

SEQ ID NO: 1168246 - protein, 9 aa, Homo Sapiens
ALVAQVAAV

SEQ ID NO: 1168247 - protein, 9 aa, Homo Sapiens
GGRRPRAAL

SEQ ID NO: 1168248 - protein, 9 aa, Homo Sapiens
LPGLGLYHT

SEQ ID NO: 1168249 - protein, 9 aa, Homo Sapiens
DKLNDLWSR

SEQ ID NO: 1168250 - protein, 9 aa, Homo Sapiens
HLISASAML

SEQ ID NO: 1168251 - protein, 9 aa, Homo Sapiens
ERREQEQRE

SEQ ID NO: 1168252 - protein, 9 aa, Homo Sapiens
SPSSLLSPC

SEQ ID NO: 1168253 - protein, 9 aa, Homo Sapiens
LLKEGHCMD

SEQ ID NO: 1168254 - protein, 9 aa, Homo Sapiens
VCHSGWTAM

SEQ ID NO: 1168255 - protein, 9 aa, Homo Sapiens
PAAPTGRPR

SEQ ID NO: 1168256 - protein, 9 aa, Homo Sapiens
DGCRLENET

SEQ ID NO: 1168257 - protein, 9 aa, Homo Sapiens
LPGTPAPRP

SEQ ID NO: 1168258 - protein, 9 aa, Homo Sapiens
ALGGPPEYM

SEQ ID NO: 1168259 - protein, 9 aa, Homo Sapiens
PPVAGPWSG

SEQ ID NO: 1168260 - protein, 9 aa, Homo Sapiens
LLSLGAHAN

SEQ ID NO: 1168261 - protein, 9 aa, Homo Sapiens
VASINLSTI

SEQ ID NO: 1168262 - protein, 9 aa, Homo Sapiens
PDTIPPKRV

SEQ ID NO: 1168263 - protein, 9 aa, Homo Sapiens
FFFHSQPTQ

SEQ ID NO: 1168264 - protein, 9 aa, Homo Sapiens
GVRRRRRPA

SEQ ID NO: 1168265 - protein, 9 aa, Homo Sapiens
ADLRKSLEK

SEQ ID NO: 1168266 - protein, 9 aa, Homo Sapiens
LRAAAARGA

SEQ ID NO: 1168267 - protein, 9 aa, Homo Sapiens
GWPGWRWRR

SEQ ID NO: 1168268 - protein, 9 aa, Homo Sapiens
DGLDQDEVG

SEQ ID NO: 1168269 - protein, 9 aa, Homo Sapiens
KAPVDFDYV

SEQ ID NO: 1168270 - protein, 9 aa, Homo Sapiens
VSCGSAPGC

SEQ ID NO: 1168271 - protein, 9 aa, Homo Sapiens
LPYPFHVLA

SEQ ID NO: 1168272 - protein, 9 aa, Homo Sapiens
QLPVEVGPS

SEQ ID NO: 1168273 - protein, 9 aa, Homo Sapiens
EQMLHSCRI

SEQ ID NO: 1168274 - protein, 9 aa, Homo Sapiens
STPLSEAKN

SEQ ID NO: 1168275 - protein, 9 aa, Homo Sapiens
PLKWLQLKT

SEQ ID NO: 1168276 - protein, 9 aa, Homo Sapiens
LDEKTQQSS

SEQ ID NO: 1168277 - protein, 9 aa, Homo Sapiens
ALGGQAIYP

SEQ ID NO: 1168278 - protein, 9 aa, Homo Sapiens
REEKHLKTL

SEQ ID NO: 1168279 - protein, 9 aa, Homo Sapiens
LGPLETPAR

SEQ ID NO: 1168280 - protein, 9 aa, Homo Sapiens
ARHFGVVTT

SEQ ID NO: 1168281 - protein, 9 aa, Homo Sapiens
ASDGHGSCS

SEQ ID NO: 1168282 - protein, 9 aa, Homo Sapiens
ASSHDVDLC

SEQ ID NO: 1168283 - protein, 9 aa, Homo Sapiens
ALARTSTCG

SEQ ID NO: 1168284 - protein, 9 aa, Homo Sapiens
TCWKATWAF

SEQ ID NO: 1168285 - protein, 9 aa, Homo Sapiens
VLSMGPGGL

SEQ ID NO: 1168286 - protein, 9 aa, Homo Sapiens
TVMVLPGGC

SEQ ID NO: 1168287 - protein, 9 aa, Homo Sapiens
LGTPHQHGC

SEQ ID NO: 1168288 - protein, 9 aa, Homo Sapiens
SSCEKVRPR

SEQ ID NO: 1168289 - protein, 9 aa, Homo Sapiens
IPEQKCNPI

SEQ ID NO: 1168290 - protein, 9 aa, Homo Sapiens
HADLTQSHR

SEQ ID NO: 1168291 - protein, 9 aa, Homo Sapiens
SLPPSPAPS

SEQ ID NO: 1168292 - protein, 9 aa, Homo Sapiens
QDGLSVVRG

SEQ ID NO: 1168293 - protein, 9 aa, Homo Sapiens
APSPNLPQP

SEQ ID NO: 1168294 - protein, 9 aa, Homo Sapiens
GQEVELPFS

SEQ ID NO: 1168295 - protein, 9 aa, Homo Sapiens
PIPVAEIKS

SEQ ID NO: 1168296 - protein, 9 aa, Homo Sapiens
GHSRTELTH

SEQ ID NO: 1168297 - protein, 9 aa, Homo Sapiens
RVATTLTLM

SEQ ID NO: 1168298 - protein, 9 aa, Homo Sapiens
TMSQINLRI

SEQ ID NO: 1168299 - protein, 9 aa, Homo Sapiens
MLICKSLTE

SEQ ID NO: 1168300 - protein, 9 aa, Homo Sapiens
NPVKRLINP

SEQ ID NO: 1168301 - protein, 9 aa, Homo Sapiens
NNRIVERDF

SEQ ID NO: 1168302 - protein, 9 aa, Homo Sapiens
GLGTAAAEA

SEQ ID NO: 1168303 - protein, 9 aa, Homo Sapiens
VLGLLEGFL

SEQ ID NO: 1168304 - protein, 9 aa, Homo Sapiens
LEGCRCYRS

SEQ ID NO: 1168305 - protein, 9 aa, Homo Sapiens
DVCRLINLG

SEQ ID NO: 1168306 - protein, 9 aa, Homo Sapiens
ASTWTIFAP

SEQ ID NO: 1168307 - protein, 9 aa, Homo Sapiens
ARVLSKVGG

SEQ ID NO: 1168308 - protein, 9 aa, Homo Sapiens
SWPSSPPRC

SEQ ID NO: 1168309 - protein, 9 aa, Homo Sapiens
LQLHAAVAS

SEQ ID NO: 1168310 - protein, 9 aa, Homo Sapiens
LQVPVKDHV

SEQ ID NO: 1168311 - protein, 9 aa, Homo Sapiens
SRPTGRTPT

SEQ ID NO: 1168312 - protein, 9 aa, Homo Sapiens
TSAVSVAAA

SEQ ID NO: 1168313 - protein, 9 aa, Homo Sapiens
TSALWCLFC

SEQ ID NO: 1168314 - protein, 9 aa, Homo Sapiens
HDDMRLLSD

SEQ ID NO: 1168315 - protein, 9 aa, Homo Sapiens
FIRSIQDFK

SEQ ID NO: 1168316 - protein, 9 aa, Homo Sapiens
NDGALLLQA

SEQ ID NO: 1168317 - protein, 9 aa, Homo Sapiens
IYTGCADLN

SEQ ID NO: 1168318 - protein, 9 aa, Homo Sapiens
NHTSTHDKA

SEQ ID NO: 1168319 - protein, 9 aa, Homo Sapiens
WASSSSSCA

SEQ ID NO: 1168320 - protein, 9 aa, Homo Sapiens
LGSCWWHWL

SEQ ID NO: 1168321 - protein, 9 aa, Homo Sapiens
WSPAPTPPP

SEQ ID NO: 1168322 - protein, 9 aa, Homo Sapiens
TLTLMTGLY

SEQ ID NO: 1168323 - protein, 9 aa, Homo Sapiens
GAFKTVSTS

SEQ ID NO: 1168324 - protein, 9 aa, Homo Sapiens
QQHRHPRPA

SEQ ID NO: 1168325 - protein, 9 aa, Homo Sapiens
GGPRYPVCL

SEQ ID NO: 1168326 - protein, 9 aa, Homo Sapiens
RSWGQILLL

SEQ ID NO: 1168327 - protein, 9 aa, Homo Sapiens
PGSEPQGPS

SEQ ID NO: 1168328 - protein, 9 aa, Homo Sapiens
TSFMVSWPS

SEQ ID NO: 1168329 - protein, 9 aa, Homo Sapiens
LLPTPADKL

SEQ ID NO: 1168330 - protein, 9 aa, Homo Sapiens
ELSRILWFK

SEQ ID NO: 1168331 - protein, 9 aa, Homo Sapiens
NQKKKRDDE

SEQ ID NO: 1168332 - protein, 9 aa, Homo Sapiens
PPGIRWSPL

SEQ ID NO: 1168333 - protein, 9 aa, Homo Sapiens
GPRMANLSE

SEQ ID NO: 1168334 - protein, 9 aa, Homo Sapiens
IVRAGEAGV

SEQ ID NO: 1168335 - protein, 9 aa, Homo Sapiens
FTRYCFQHI

SEQ ID NO: 1168336 - protein, 9 aa, Homo Sapiens
LVESAYTAR

SEQ ID NO: 1168337 - protein, 9 aa, Homo Sapiens
VELPTVASS

SEQ ID NO: 1168338 - protein, 9 aa, Homo Sapiens
QGYGNPNFC

SEQ ID NO: 1168339 - protein, 9 aa, Homo Sapiens
NSNANTASP

SEQ ID NO: 1168340 - protein, 9 aa, Homo Sapiens
AFLGMTLLH

SEQ ID NO: 1168341 - protein, 9 aa, Homo Sapiens
LAREGRARV

SEQ ID NO: 1168342 - protein, 9 aa, Homo Sapiens
QLWQAPRAM

SEQ ID NO: 1168343 - protein, 9 aa, Homo Sapiens
LWPPAQPHL

SEQ ID NO: 1168344 - protein, 9 aa, Homo Sapiens
AAPPTDYSK

SEQ ID NO: 1168345 - protein, 9 aa, Homo Sapiens
SRGPRGGRP

SEQ ID NO: 1168346 - protein, 9 aa, Homo Sapiens
PPLGLSVPA

SEQ ID NO: 1168347 - protein, 9 aa, Homo Sapiens
GVCVENSNP

SEQ ID NO: 1168348 - protein, 9 aa, Homo Sapiens
AVEPVAGER

SEQ ID NO: 1168349 - protein, 9 aa, Homo Sapiens
SPGVKAPDM

SEQ ID NO: 1168350 - protein, 9 aa, Homo Sapiens
PSSRRSWNR

SEQ ID NO: 1168351 - protein, 9 aa, Homo Sapiens
RHREAVGNL

SEQ ID NO: 1168352 - protein, 9 aa, Homo Sapiens
EASGPWGVV

SEQ ID NO: 1168353 - protein, 9 aa, Homo Sapiens
SGRPRPDPA

SEQ ID NO: 1168354 - protein, 9 aa, Homo Sapiens
DPDIVGSIP

SEQ ID NO: 1168355 - protein, 9 aa, Homo Sapiens
PVDCADHWI

SEQ ID NO: 1168356 - protein, 9 aa, Homo Sapiens
APEETIATQ

SEQ ID NO: 1168357 - protein, 9 aa, Homo Sapiens
NYKLWYLDP

SEQ ID NO: 1168358 - protein, 9 aa, Homo Sapiens
GLLPGLLPT

SEQ ID NO: 1168359 - protein, 9 aa, Homo Sapiens
VASCEEEFQ

SEQ ID NO: 1168360 - protein, 9 aa, Homo Sapiens
KSWLSAKCQ

SEQ ID NO: 1168361 - protein, 9 aa, Homo Sapiens
RRRPSCHRC

SEQ ID NO: 1168362 - protein, 9 aa, Homo Sapiens
GPLLLLDPA

SEQ ID NO: 1168363 - protein, 9 aa, Homo Sapiens
LSLNGVCFK

SEQ ID NO: 1168364 - protein, 9 aa, Homo Sapiens
HVLISLLCP

SEQ ID NO: 1168365 - protein, 9 aa, Homo Sapiens
IFLKGNCTN

SEQ ID NO: 1168366 - protein, 9 aa, Homo Sapiens
GTPHHISVK

SEQ ID NO: 1168367 - protein, 9 aa, Homo Sapiens
THRTSLRAL

SEQ ID NO: 1168368 - protein, 9 aa, Homo Sapiens
HPCRCHRGG

SEQ ID NO: 1168369 - protein, 9 aa, Homo Sapiens
RMPSSHSQF

SEQ ID NO: 1168370 - protein, 9 aa, Homo Sapiens
TTDNYQPYP

SEQ ID NO: 1168371 - protein, 9 aa, Homo Sapiens
ENEAPQCPS

SEQ ID NO: 1168372 - protein, 9 aa, Homo Sapiens
MLYPVLNLA

SEQ ID NO: 1168373 - protein, 9 aa, Homo Sapiens
STSPAARPP

SEQ ID NO: 1168374 - protein, 9 aa, Homo Sapiens
DTQDTRPRT

SEQ ID NO: 1168375 - protein, 9 aa, Homo Sapiens
YSPYNKLQW

SEQ ID NO: 1168376 - protein, 9 aa, Homo Sapiens
LSVKKPPLV

SEQ ID NO: 1168377 - protein, 9 aa, Homo Sapiens
SPFSATTRA

SEQ ID NO: 1168378 - protein, 9 aa, Homo Sapiens
TSQYYFRIA

SEQ ID NO: 1168379 - protein, 9 aa, Homo Sapiens
ADCQPGTGF

SEQ ID NO: 1168380 - protein, 9 aa, Homo Sapiens
RVLIPETSK

SEQ ID NO: 1168381 - protein, 9 aa, Homo Sapiens
GVPHLPRSN

SEQ ID NO: 1168382 - protein, 9 aa, Homo Sapiens
LGGAGARGE

SEQ ID NO: 1168383 - protein, 9 aa, Homo Sapiens
SPGRIKWKV

SEQ ID NO: 1168384 - protein, 9 aa, Homo Sapiens
ANKKKDKKY

SEQ ID NO: 1168385 - protein, 9 aa, Homo Sapiens
ICYLGLPHL

SEQ ID NO: 1168386 - protein, 9 aa, Homo Sapiens
WETSHVTMV

SEQ ID NO: 1168387 - protein, 9 aa, Homo Sapiens
IKNENLKTR

SEQ ID NO: 1168388 - protein, 9 aa, Homo Sapiens
NTARDTLEL

SEQ ID NO: 1168389 - protein, 9 aa, Homo Sapiens
PRRKVMTPV

SEQ ID NO: 1168390 - protein, 9 aa, Homo Sapiens
VSVSVIMNL

SEQ ID NO: 1168391 - protein, 9 aa, Homo Sapiens
KGVFVVGVV

SEQ ID NO: 1168392 - protein, 9 aa, Homo Sapiens
HDAVCNALA

SEQ ID NO: 1168393 - protein, 9 aa, Homo Sapiens
NNNRSMGGS

SEQ ID NO: 1168394 - protein, 9 aa, Homo Sapiens
CAELLRSQI

SEQ ID NO: 1168395 - protein, 9 aa, Homo Sapiens
LDYGYGCGC

SEQ ID NO: 1168396 - protein, 9 aa, Homo Sapiens
LAGGLVVAD

SEQ ID NO: 1168397 - protein, 9 aa, Homo Sapiens
SPNKPYSFA

SEQ ID NO: 1168398 - protein, 9 aa, Homo Sapiens
REQMQEQEC

SEQ ID NO: 1168399 - protein, 9 aa, Homo Sapiens
IHVPPLLRG

SEQ ID NO: 1168400 - protein, 9 aa, Homo Sapiens
PSCSGARAC

SEQ ID NO: 1168401 - protein, 9 aa, Homo Sapiens
PGQPPRRPP

SEQ ID NO: 1168402 - protein, 9 aa, Homo Sapiens
ARGGPWPRT

SEQ ID NO: 1168403 - protein, 9 aa, Homo Sapiens
RHTGFSLFY

SEQ ID NO: 1168404 - protein, 9 aa, Homo Sapiens
MADDRYVAI

SEQ ID NO: 1168405 - protein, 9 aa, Homo Sapiens
GPPILAPPA

SEQ ID NO: 1168406 - protein, 9 aa, Homo Sapiens
SPVTALARP

SEQ ID NO: 1168407 - protein, 9 aa, Homo Sapiens
GAACPPGAP

SEQ ID NO: 1168408 - protein, 9 aa, Homo Sapiens
LNDLWSRIS

SEQ ID NO: 1168409 - protein, 9 aa, Homo Sapiens
ILVLHLFCY

SEQ ID NO: 1168410 - protein, 9 aa, Homo Sapiens
CMDPAWHPW

SEQ ID NO: 1168411 - protein, 9 aa, Homo Sapiens
FCINRDNWL

SEQ ID NO: 1168412 - protein, 9 aa, Homo Sapiens
GHNAWLSYE

SEQ ID NO: 1168413 - protein, 9 aa, Homo Sapiens
NQHQSEGKP

SEQ ID NO: 1168414 - protein, 9 aa, Homo Sapiens
APWSRPSRF

SEQ ID NO: 1168415 - protein, 9 aa, Homo Sapiens
STLLGALHR

SEQ ID NO: 1168416 - protein, 9 aa, Homo Sapiens
GTSQTYFGS

SEQ ID NO: 1168417 - protein, 9 aa, Homo Sapiens
RKESALQVL

SEQ ID NO: 1168418 - protein, 9 aa, Homo Sapiens
TLWTSDLWE

SEQ ID NO: 1168419 - protein, 9 aa, Homo Sapiens
EPDLHLALG

SEQ ID NO: 1168420 - protein, 9 aa, Homo Sapiens
LGLLEGFLQ

SEQ ID NO: 1168421 - protein, 9 aa, Homo Sapiens
VIKGMTYLR

SEQ ID NO: 1168422 - protein, 9 aa, Homo Sapiens
GGEDAPGAR

SEQ ID NO: 1168423 - protein, 9 aa, Homo Sapiens
SCAPSSSVC

SEQ ID NO: 1168424 - protein, 9 aa, Homo Sapiens
DQPTIRKED

SEQ ID NO: 1168425 - protein, 9 aa, Homo Sapiens
PSVDHTFDL

SEQ ID NO: 1168426 - protein, 9 aa, Homo Sapiens
TVTLEVLLI

SEQ ID NO: 1168427 - protein, 9 aa, Homo Sapiens
PRGSPAWSR

SEQ ID NO: 1168428 - protein, 9 aa, Homo Sapiens
FDSNTSRFY

SEQ ID NO: 1168429 - protein, 9 aa, Homo Sapiens
CIQVFKPCG

SEQ ID NO: 1168430 - protein, 9 aa, Homo Sapiens
EDAPVPSTA

SEQ ID NO: 1168431 - protein, 9 aa, Homo Sapiens
RCVQWPAPS

SEQ ID NO: 1168432 - protein, 9 aa, Homo Sapiens
RPLTMATTF

SEQ ID NO: 1168433 - protein, 9 aa, Homo Sapiens
RCLGLWCSP

SEQ ID NO: 1168434 - protein, 9 aa, Homo Sapiens
RNHNYLPFE

SEQ ID NO: 1168435 - protein, 9 aa, Homo Sapiens
WWAILLHVQ

SEQ ID NO: 1168436 - protein, 9 aa, Homo Sapiens
CGQGSCSTI

SEQ ID NO: 1168437 - protein, 9 aa, Homo Sapiens
PMTSAWRSL

SEQ ID NO: 1168438 - protein, 9 aa, Homo Sapiens
HRRRGWGKG

SEQ ID NO: 1168439 - protein, 9 aa, Homo Sapiens
SLWKTKKSP

SEQ ID NO: 1168440 - protein, 9 aa, Homo Sapiens
LWASNAMMN

SEQ ID NO: 1168441 - protein, 9 aa, Homo Sapiens
LGQSIRRFI

SEQ ID NO: 1168442 - protein, 9 aa, Homo Sapiens
SFLLRQIEF

SEQ ID NO: 1168443 - protein, 9 aa, Homo Sapiens
STTTAPASC

SEQ ID NO: 1168444 - protein, 9 aa, Homo Sapiens
AFFFSGWIS

SEQ ID NO: 1168445 - protein, 9 aa, Homo Sapiens
QDSLDRCCS

SEQ ID NO: 1168446 - protein, 9 aa, Homo Sapiens
RGAAAGSGG

SEQ ID NO: 1168447 - protein, 9 aa, Homo Sapiens
DFINDTTDV

SEQ ID NO: 1168448 - protein, 9 aa, Homo Sapiens
EVMPRTLEG

SEQ ID NO: 1168449 - protein, 9 aa, Homo Sapiens
GGTRSQALP

SEQ ID NO: 1168450 - protein, 9 aa, Homo Sapiens
KSPSRVSLC

SEQ ID NO: 1168451 - protein, 9 aa, Homo Sapiens
AWIAAVAVT

SEQ ID NO: 1168452 - protein, 9 aa, Homo Sapiens
LAYELQGAC

SEQ ID NO: 1168453 - protein, 9 aa, Homo Sapiens
HFSFSVATG

SEQ ID NO: 1168454 - protein, 9 aa, Homo Sapiens
PLTMATTFD

SEQ ID NO: 1168455 - protein, 9 aa, Homo Sapiens
TSTGIGYNI

SEQ ID NO: 1168456 - protein, 9 aa, Homo Sapiens
LVEAQQKKL

SEQ ID NO: 1168457 - protein, 9 aa, Homo Sapiens
PPLRGPQRA

SEQ ID NO: 1168458 - protein, 9 aa, Homo Sapiens
SAASSRQMW

SEQ ID NO: 1168459 - protein, 9 aa, Homo Sapiens
ATYDPAGRA

SEQ ID NO: 1168460 - protein, 9 aa, Homo Sapiens
QCTQGRRWG

SEQ ID NO: 1168461 - protein, 9 aa, Homo Sapiens
EYKKTYMEM

SEQ ID NO: 1168462 - protein, 9 aa, Homo Sapiens
LAASALRTR

SEQ ID NO: 1168463 - protein, 9 aa, Homo Sapiens
TLASKASRA

SEQ ID NO: 1168464 - protein, 9 aa, Homo Sapiens
LPSRGSPPS

SEQ ID NO: 1168465 - protein, 9 aa, Homo Sapiens
EVLQFQFTA

SEQ ID NO: 1168466 - protein, 9 aa, Homo Sapiens
QESSEGEEG

SEQ ID NO: 1168467 - protein, 9 aa, Homo Sapiens
SCSGHCSGC

SEQ ID NO: 1168468 - protein, 9 aa, Homo Sapiens
SVSCGSAPG

SEQ ID NO: 1168469 - protein, 9 aa, Homo Sapiens
LPTAIVPLR

SEQ ID NO: 1168470 - protein, 9 aa, Homo Sapiens
MERIQPGGW

SEQ ID NO: 1168471 - protein, 9 aa, Homo Sapiens
RNHYIIRVV

SEQ ID NO: 1168472 - protein, 9 aa, Homo Sapiens
MVARSGTGG

SEQ ID NO: 1168473 - protein, 9 aa, Homo Sapiens
LQQVIHLLN

SEQ ID NO: 1168474 - protein, 9 aa, Homo Sapiens
STSFLLIPT

SEQ ID NO: 1168475 - protein, 9 aa, Homo Sapiens
LALGHAQRV

SEQ ID NO: 1168476 - protein, 9 aa, Homo Sapiens
ESSSGDPPV

SEQ ID NO: 1168477 - protein, 9 aa, Homo Sapiens
DDGWGVFVG

SEQ ID NO: 1168478 - protein, 9 aa, Homo Sapiens
DVHQRCVQR

SEQ ID NO: 1168479 - protein, 9 aa, Homo Sapiens
APSRCFVVR

SEQ ID NO: 1168480 - protein, 9 aa, Homo Sapiens
EAQGILWTI

SEQ ID NO: 1168481 - protein, 9 aa, Homo Sapiens
PGAMNARGI

SEQ ID NO: 1168482 - protein, 9 aa, Homo Sapiens
RLSLNGVCF

SEQ ID NO: 1168483 - protein, 9 aa, Homo Sapiens
EDTSMNFVQ

SEQ ID NO: 1168484 - protein, 9 aa, Homo Sapiens
GTMPSRCCL

SEQ ID NO: 1168485 - protein, 9 aa, Homo Sapiens
GLELVVLAD

SEQ ID NO: 1168486 - protein, 9 aa, Homo Sapiens
AVCARGRHA

SEQ ID NO: 1168487 - protein, 9 aa, Homo Sapiens
LQMYSFLQQ

SEQ ID NO: 1168488 - protein, 9 aa, Homo Sapiens
VFLDPLADA

SEQ ID NO: 1168489 - protein, 9 aa, Homo Sapiens
GGSCPAFVA

SEQ ID NO: 1168490 - protein, 9 aa, Homo Sapiens
PPPSPGSGV

SEQ ID NO: 1168491 - protein, 9 aa, Homo Sapiens
LLVAVEPVA

SEQ ID NO: 1168492 - protein, 9 aa, Homo Sapiens
WEAVAVRPR

SEQ ID NO: 1168493 - protein, 9 aa, Homo Sapiens
KARQTPEEE

SEQ ID NO: 1168494 - protein, 9 aa, Homo Sapiens
EVSFPSEEP

SEQ ID NO: 1168495 - protein, 9 aa, Homo Sapiens
TRALRARQV

SEQ ID NO: 1168496 - protein, 9 aa, Homo Sapiens
GAWGRCGPA

SEQ ID NO: 1168497 - protein, 9 aa, Homo Sapiens
WFEVVSQGR

SEQ ID NO: 1168498 - protein, 9 aa, Homo Sapiens
QHPPLIHCY

SEQ ID NO: 1168499 - protein, 9 aa, Homo Sapiens
NPPPPPTAL

SEQ ID NO: 1168500 - protein, 9 aa, Homo Sapiens
YLLAVGKQW

SEQ ID NO: 1168501 - protein, 9 aa, Homo Sapiens
ARACTPWPR

SEQ ID NO: 1168502 - protein, 9 aa, Homo Sapiens
PPPGSSPPR

SEQ ID NO: 1168503 - protein, 9 aa, Homo Sapiens
GVKQSAAEM

SEQ ID NO: 1168504 - protein, 9 aa, Homo Sapiens
TPIQPKARG

SEQ ID NO: 1168505 - protein, 9 aa, Homo Sapiens
PTLSSFQMP

SEQ ID NO: 1168506 - protein, 9 aa, Homo Sapiens
RVVSLGEEL

SEQ ID NO: 1168507 - protein, 9 aa, Homo Sapiens
VAPSQDPCT

SEQ ID NO: 1168508 - protein, 9 aa, Homo Sapiens
AYVTENNVP

SEQ ID NO: 1168509 - protein, 9 aa, Homo Sapiens
WYFPPPPCI

SEQ ID NO: 1168510 - protein, 9 aa, Homo Sapiens
IPAPVPVPV

SEQ ID NO: 1168511 - protein, 9 aa, Homo Sapiens
AAAQGPAEP

SEQ ID NO: 1168512 - protein, 9 aa, Homo Sapiens
GLFTVCLLR

SEQ ID NO: 1168513 - protein, 9 aa, Homo Sapiens
WRRTTSAST

SEQ ID NO: 1168514 - protein, 9 aa, Homo Sapiens
GGESEKTVE

SEQ ID NO: 1168515 - protein, 9 aa, Homo Sapiens
LSGHHSPHA

SEQ ID NO: 1168516 - protein, 9 aa, Homo Sapiens
DADSSYVCF

SEQ ID NO: 1168517 - protein, 9 aa, Homo Sapiens
ISPGAWKQA

SEQ ID NO: 1168518 - protein, 9 aa, Homo Sapiens
PAINSTGEH

SEQ ID NO: 1168519 - protein, 9 aa, Homo Sapiens
QRPVQREHV

SEQ ID NO: 1168520 - protein, 9 aa, Homo Sapiens
LLILLLEDW

SEQ ID NO: 1168521 - protein, 9 aa, Homo Sapiens
SREKRGTHP

SEQ ID NO: 1168522 - protein, 9 aa, Homo Sapiens
AQSLNHFLA

SEQ ID NO: 1168523 - protein, 9 aa, Homo Sapiens
PTQAKSPSP

SEQ ID NO: 1168524 - protein, 9 aa, Homo Sapiens
GHNQVPAQM

SEQ ID NO: 1168525 - protein, 9 aa, Homo Sapiens
CVTAPRHCL

SEQ ID NO: 1168526 - protein, 9 aa, Homo Sapiens
LSPLQRSGS

SEQ ID NO: 1168527 - protein, 9 aa, Homo Sapiens
EEPCGLAWS

SEQ ID NO: 1168528 - protein, 9 aa, Homo Sapiens
PAPRPTHPL

SEQ ID NO: 1168529 - protein, 9 aa, Homo Sapiens
FVPPALALL

SEQ ID NO: 1168530 - protein, 9 aa, Homo Sapiens
YNAPTHTLV

SEQ ID NO: 1168531 - protein, 9 aa, Homo Sapiens
SMEAGQQHP

SEQ ID NO: 1168532 - protein, 9 aa, Homo Sapiens
HIHCWLSPP

SEQ ID NO: 1168533 - protein, 9 aa, Homo Sapiens
TENINAVTL

SEQ ID NO: 1168534 - protein, 9 aa, Homo Sapiens
WWRLCVGRT

SEQ ID NO: 1168535 - protein, 9 aa, Homo Sapiens
LSALPLRCP

SEQ ID NO: 1168536 - protein, 9 aa, Homo Sapiens
GDRDEDGPA

SEQ ID NO: 1168537 - protein, 9 aa, Homo Sapiens
ARGAGCRPR

SEQ ID NO: 1168538 - protein, 9 aa, Homo Sapiens
LVCIVSGDR

SEQ ID NO: 1168539 - protein, 9 aa, Homo Sapiens
FTLSYDGPL

SEQ ID NO: 1168540 - protein, 9 aa, Homo Sapiens
EPCPVYCPN

SEQ ID NO: 1168541 - protein, 9 aa, Homo Sapiens
PSPHSGELS

SEQ ID NO: 1168542 - protein, 9 aa, Homo Sapiens
EKAPSSPRR

SEQ ID NO: 1168543 - protein, 9 aa, Homo Sapiens
WEKHGTCTA

SEQ ID NO: 1168544 - protein, 9 aa, Homo Sapiens
KPLGPRPRV

SEQ ID NO: 1168545 - protein, 9 aa, Homo Sapiens
NRLLFTGTP

SEQ ID NO: 1168546 - protein, 9 aa, Homo Sapiens
FLLRQIEFL

SEQ ID NO: 1168547 - protein, 9 aa, Homo Sapiens
IFFCTGSSC

SEQ ID NO: 1168548 - protein, 9 aa, Homo Sapiens
GEPRHCIEF

SEQ ID NO: 1168549 - protein, 9 aa, Homo Sapiens
RSSPSGAST

SEQ ID NO: 1168550 - protein, 9 aa, Homo Sapiens
PLCCCLAVG

SEQ ID NO: 1168551 - protein, 9 aa, Homo Sapiens
PVGMACDSV

SEQ ID NO: 1168552 - protein, 9 aa, Homo Sapiens
DPQGTRSAT

SEQ ID NO: 1168553 - protein, 9 aa, Homo Sapiens
LNYSAAPKK

SEQ ID NO: 1168554 - protein, 9 aa, Homo Sapiens
VRLQRESHH

SEQ ID NO: 1168555 - protein, 9 aa, Homo Sapiens
NASIMCPLN

SEQ ID NO: 1168556 - protein, 9 aa, Homo Sapiens
TPAEVAQHI

SEQ ID NO: 1168557 - protein, 9 aa, Homo Sapiens
PAVPQYAQC

SEQ ID NO: 1168558 - protein, 9 aa, Homo Sapiens
KLFDNLTSS

SEQ ID NO: 1168559 - protein, 9 aa, Homo Sapiens
SGARVLIPE

SEQ ID NO: 1168560 - protein, 9 aa, Homo Sapiens
CPTDTQDTR

SEQ ID NO: 1168561 - protein, 9 aa, Homo Sapiens
GKGIFTTSK

SEQ ID NO: 1168562 - protein, 9 aa, Homo Sapiens
PPSSRRSWN

SEQ ID NO: 1168563 - protein, 9 aa, Homo Sapiens
VKLRKDLEQ

SEQ ID NO: 1168564 - protein, 9 aa, Homo Sapiens
RGTSEVSLA

SEQ ID NO: 1168565 - protein, 9 aa, Homo Sapiens
PGMNMKMKT

SEQ ID NO: 1168566 - protein, 9 aa, Homo Sapiens
PLPVADTSS

SEQ ID NO: 1168567 - protein, 9 aa, Homo Sapiens
GLLCVGGGG

SEQ ID NO: 1168568 - protein, 9 aa, Homo Sapiens
QDRGLQALG

SEQ ID NO: 1168569 - protein, 9 aa, Homo Sapiens
VFLAFVIML

SEQ ID NO: 1168570 - protein, 9 aa, Homo Sapiens
RCSCGQGSC

SEQ ID NO: 1168571 - protein, 9 aa, Homo Sapiens
PHHISVKNH

SEQ ID NO: 1168572 - protein, 9 aa, Homo Sapiens
SIETGLVAA

SEQ ID NO: 1168573 - protein, 9 aa, Homo Sapiens
LYGSYPPAR

SEQ ID NO: 1168574 - protein, 9 aa, Homo Sapiens
AKAAPTPIP

SEQ ID NO: 1168575 - protein, 9 aa, Homo Sapiens
KTAPSLSTA

SEQ ID NO: 1168576 - protein, 9 aa, Homo Sapiens
RARIRDCKA

SEQ ID NO: 1168577 - protein, 9 aa, Homo Sapiens
VEDELPATS

SEQ ID NO: 1168578 - protein, 9 aa, Homo Sapiens
DDLIFALKL

SEQ ID NO: 1168579 - protein, 9 aa, Homo Sapiens
CCLPGLTHP

SEQ ID NO: 1168580 - protein, 9 aa, Homo Sapiens
VKTVYANSH

SEQ ID NO: 1168581 - protein, 9 aa, Homo Sapiens
HIVKDENCG

SEQ ID NO: 1168582 - protein, 9 aa, Homo Sapiens
SDPRARLET

SEQ ID NO: 1168583 - protein, 9 aa, Homo Sapiens
ALPADAQAV

SEQ ID NO: 1168584 - protein, 9 aa, Homo Sapiens
ERVREIRNV

SEQ ID NO: 1168585 - protein, 9 aa, Homo Sapiens
PSPSSLLSP

SEQ ID NO: 1168586 - protein, 9 aa, Homo Sapiens
GVDRSSQVS

SEQ ID NO: 1168587 - protein, 9 aa, Homo Sapiens
SVWRLWSWA

SEQ ID NO: 1168588 - protein, 9 aa, Homo Sapiens
EMPKSLVSN

SEQ ID NO: 1168589 - protein, 9 aa, Homo Sapiens
PQPRLALSP

SEQ ID NO: 1168590 - protein, 9 aa, Homo Sapiens
QPSPPFGGT

SEQ ID NO: 1168591 - protein, 9 aa, Homo Sapiens
SLPLSPSVA

SEQ ID NO: 1168592 - protein, 9 aa, Homo Sapiens
RYGHSRTPP

SEQ ID NO: 1168593 - protein, 9 aa, Homo Sapiens
NEQEKKCRL

SEQ ID NO: 1168594 - protein, 9 aa, Homo Sapiens
ENTKLLSTT

SEQ ID NO: 1168595 - protein, 9 aa, Homo Sapiens
SLIESELYF

SEQ ID NO: 1168596 - protein, 9 aa, Homo Sapiens
QKSDFSNNW

SEQ ID NO: 1168597 - protein, 9 aa, Homo Sapiens
TWSGCSSAS

SEQ ID NO: 1168598 - protein, 9 aa, Homo Sapiens
ALDVRCNED

SEQ ID NO: 1168599 - protein, 9 aa, Homo Sapiens
DFSAGDPFK

SEQ ID NO: 1168600 - protein, 9 aa, Homo Sapiens
QAPQAWSTL

SEQ ID NO: 1168601 - protein, 9 aa, Homo Sapiens
QKADIEKGL

SEQ ID NO: 1168602 - protein, 9 aa, Homo Sapiens
ARLSAASPC

SEQ ID NO: 1168603 - protein, 9 aa, Homo Sapiens
SSRWCQGAW

SEQ ID NO: 1168604 - protein, 9 aa, Homo Sapiens
CAPPATAWT

SEQ ID NO: 1168605 - protein, 9 aa, Homo Sapiens
KFVSSIRLC

SEQ ID NO: 1168606 - protein, 9 aa, Homo Sapiens
RHRTLNISH

SEQ ID NO: 1168607 - protein, 9 aa, Homo Sapiens
PAWWRLCVG

SEQ ID NO: 1168608 - protein, 9 aa, Homo Sapiens
LLRSLNSSK

SEQ ID NO: 1168609 - protein, 9 aa, Homo Sapiens
ARWDAGLSG

SEQ ID NO: 1168610 - protein, 9 aa, Homo Sapiens
SDSKLELST

SEQ ID NO: 1168611 - protein, 9 aa, Homo Sapiens
TLNIPWSRI

SEQ ID NO: 1168612 - protein, 9 aa, Homo Sapiens
AARPRRTRS

SEQ ID NO: 1168613 - protein, 9 aa, Homo Sapiens
ATGQPRPSH

SEQ ID NO: 1168614 - protein, 9 aa, Homo Sapiens
PSLHRYLSL

SEQ ID NO: 1168615 - protein, 9 aa, Homo Sapiens
VPASIADML

SEQ ID NO: 1168616 - protein, 9 aa, Homo Sapiens
KGDLRTGAG

SEQ ID NO: 1168617 - protein, 9 aa, Homo Sapiens
RAPHPARRP

SEQ ID NO: 1168618 - protein, 9 aa, Homo Sapiens
SRWCQGAWC

SEQ ID NO: 1168619 - protein, 9 aa, Homo Sapiens
RGEAALEPR

SEQ ID NO: 1168620 - protein, 9 aa, Homo Sapiens
GALLLQALT

SEQ ID NO: 1168621 - protein, 9 aa, Homo Sapiens
PDTHVTLQQ

SEQ ID NO: 1168622 - protein, 9 aa, Homo Sapiens
APGPPAAAG

SEQ ID NO: 1168623 - protein, 9 aa, Homo Sapiens
GPAPAAALS

SEQ ID NO: 1168624 - protein, 9 aa, Homo Sapiens
SKVKYSRNI

SEQ ID NO: 1168625 - protein, 9 aa, Homo Sapiens
MGQAANPQY

SEQ ID NO: 1168626 - protein, 9 aa, Homo Sapiens
RPARAAGAG

SEQ ID NO: 1168627 - protein, 9 aa, Homo Sapiens
KGVFREKPN

SEQ ID NO: 1168628 - protein, 9 aa, Homo Sapiens
RQHPPPAKH

SEQ ID NO: 1168629 - protein, 9 aa, Homo Sapiens
LLGREEIQV

SEQ ID NO: 1168630 - protein, 9 aa, Homo Sapiens
DDLFGPSEP

SEQ ID NO: 1168631 - protein, 9 aa, Homo Sapiens
THDCNKPPI

SEQ ID NO: 1168632 - protein, 9 aa, Homo Sapiens
EDQQRGHDD

SEQ ID NO: 1168633 - protein, 9 aa, Homo Sapiens
GSYAAWRAL

SEQ ID NO: 1168634 - protein, 9 aa, Homo Sapiens
GAVKVGTIQ

SEQ ID NO: 1168635 - protein, 9 aa, Homo Sapiens
ISQNHTPTV

SEQ ID NO: 1168636 - protein, 9 aa, Homo Sapiens
RLKHSLTTY

SEQ ID NO: 1168637 - protein, 9 aa, Homo Sapiens
WRWHLARYF

SEQ ID NO: 1168638 - protein, 9 aa, Homo Sapiens
SRSLFFCGA

SEQ ID NO: 1168639 - protein, 9 aa, Homo Sapiens
RSPSSAASA

SEQ ID NO: 1168640 - protein, 9 aa, Homo Sapiens
GPRVGPPLR

SEQ ID NO: 1168641 - protein, 9 aa, Homo Sapiens
TSHKHDLRL

SEQ ID NO: 1168642 - protein, 9 aa, Homo Sapiens
CRQVYVNRS

SEQ ID NO: 1168643 - protein, 9 aa, Homo Sapiens
SLRKWRPGA

SEQ ID NO: 1168644 - protein, 9 aa, Homo Sapiens
WSITSPPST

SEQ ID NO: 1168645 - protein, 9 aa, Homo Sapiens
HAFAQPFAM

SEQ ID NO: 1168646 - protein, 9 aa, Homo Sapiens
AARGAGCRP

SEQ ID NO: 1168647 - protein, 9 aa, Homo Sapiens
KAPRAAQET

SEQ ID NO: 1168648 - protein, 9 aa, Homo Sapiens
GASACQGGF

SEQ ID NO: 1168649 - protein, 9 aa, Homo Sapiens
PPVKPNMPF

SEQ ID NO: 1168650 - protein, 9 aa, Homo Sapiens
GWRRTRPLT

SEQ ID NO: 1168651 - protein, 9 aa, Homo Sapiens
NVSQHVVME

SEQ ID NO: 1168652 - protein, 9 aa, Homo Sapiens
GRLTGQRCW

SEQ ID NO: 1168653 - protein, 9 aa, Homo Sapiens
GDVSDQSTC

SEQ ID NO: 1168654 - protein, 9 aa, Homo Sapiens
SWRSGGSGW

SEQ ID NO: 1168655 - protein, 9 aa, Homo Sapiens
GSTPPPPPG

SEQ ID NO: 1168656 - protein, 9 aa, Homo Sapiens
DRSVSRDGG

SEQ ID NO: 1168657 - protein, 9 aa, Homo Sapiens
LEKMKEECE

SEQ ID NO: 1168658 - protein, 9 aa, Homo Sapiens
QTCMTRWFF

SEQ ID NO: 1168659 - protein, 9 aa, Homo Sapiens
YGHSRTPPS

SEQ ID NO: 1168660 - protein, 9 aa, Homo Sapiens
VNDILKKMP

SEQ ID NO: 1168661 - protein, 9 aa, Homo Sapiens
VVSGGVASN

SEQ ID NO: 1168662 - protein, 9 aa, Homo Sapiens
HLLMLSFLS

SEQ ID NO: 1168663 - protein, 9 aa, Homo Sapiens
MYAPVKHSS

SEQ ID NO: 1168664 - protein, 9 aa, Homo Sapiens
DIFWTCLKM

SEQ ID NO: 1168665 - protein, 9 aa, Homo Sapiens
SPGSGVGGA

SEQ ID NO: 1168666 - protein, 9 aa, Homo Sapiens
SSPPRCTSS

SEQ ID NO: 1168667 - protein, 9 aa, Homo Sapiens
TGHLGGAGA

SEQ ID NO: 1168668 - protein, 9 aa, Homo Sapiens
QPSQAPQAW

SEQ ID NO: 1168669 - protein, 9 aa, Homo Sapiens
CCTTSCCAP

SEQ ID NO: 1168670 - protein, 9 aa, Homo Sapiens
TQDSARRAS

SEQ ID NO: 1168671 - protein, 9 aa, Homo Sapiens
PPPRHPPPH

SEQ ID NO: 1168672 - protein, 9 aa, Homo Sapiens
TQQISVDSV

SEQ ID NO: 1168673 - protein, 9 aa, Homo Sapiens
RIEKNTKRK

SEQ ID NO: 1168674 - protein, 9 aa, Homo Sapiens
PGPPPPTPT

SEQ ID NO: 1168675 - protein, 9 aa, Homo Sapiens
KDLCANTVL

SEQ ID NO: 1168676 - protein, 9 aa, Homo Sapiens
TARPARAAG

SEQ ID NO: 1168677 - protein, 9 aa, Homo Sapiens
ASLEMLTPS

SEQ ID NO: 1168678 - protein, 9 aa, Homo Sapiens
QAKKGKPPE

SEQ ID NO: 1168679 - protein, 9 aa, Homo Sapiens
VDNGMAIFQ

SEQ ID NO: 1168680 - protein, 9 aa, Homo Sapiens
FQHIAQHRF

SEQ ID NO: 1168681 - protein, 9 aa, Homo Sapiens
QALAMWEKG

SEQ ID NO: 1168682 - protein, 9 aa, Homo Sapiens
ECEWHKNGV

SEQ ID NO: 1168683 - protein, 9 aa, Homo Sapiens
SSWQECDEA

SEQ ID NO: 1168684 - protein, 9 aa, Homo Sapiens
SIQSWGSTL

SEQ ID NO: 1168685 - protein, 9 aa, Homo Sapiens
LNCFTFSKA

SEQ ID NO: 1168686 - protein, 9 aa, Homo Sapiens
FECFFLWES

SEQ ID NO: 1168687 - protein, 9 aa, Homo Sapiens
ESTAWGGSC

SEQ ID NO: 1168688 - protein, 9 aa, Homo Sapiens
VSSLSVLWK

SEQ ID NO: 1168689 - protein, 9 aa, Homo Sapiens
DTTAIDMQV

SEQ ID NO: 1168690 - protein, 9 aa, Homo Sapiens
MEKDPIDAI

SEQ ID NO: 1168691 - protein, 9 aa, Homo Sapiens
HCYMALCSG

SEQ ID NO: 1168692 - protein, 9 aa, Homo Sapiens
ERRKFGSQG

SEQ ID NO: 1168693 - protein, 9 aa, Homo Sapiens
GAAREGALV

SEQ ID NO: 1168694 - protein, 9 aa, Homo Sapiens
TGPAAPLAP

SEQ ID NO: 1168695 - protein, 9 aa, Homo Sapiens
QDTRPRTAP

SEQ ID NO: 1168696 - protein, 9 aa, Homo Sapiens
AQKEQRFGV

SEQ ID NO: 1168697 - protein, 9 aa, Homo Sapiens
PGPSQSPHS

SEQ ID NO: 1168698 - protein, 9 aa, Homo Sapiens
ADTGVREDE

SEQ ID NO: 1168699 - protein, 9 aa, Homo Sapiens
LLQLLDQLV

SEQ ID NO: 1168700 - protein, 9 aa, Homo Sapiens
LADAVTKTH

SEQ ID NO: 1168701 - protein, 9 aa, Homo Sapiens
YITVQNPQY

SEQ ID NO: 1168702 - protein, 9 aa, Homo Sapiens
PRASSAGDL

SEQ ID NO: 1168703 - protein, 9 aa, Homo Sapiens
WASGKWECT

SEQ ID NO: 1168704 - protein, 9 aa, Homo Sapiens
IAQINQYCN

SEQ ID NO: 1168705 - protein, 9 aa, Homo Sapiens
EETTDDSND

SEQ ID NO: 1168706 - protein, 9 aa, Homo Sapiens
SRPPPPLFS

SEQ ID NO: 1168707 - protein, 9 aa, Homo Sapiens
ILITSCDPL

SEQ ID NO: 1168708 - protein, 9 aa, Homo Sapiens
TAIGGGWPG

SEQ ID NO: 1168709 - protein, 9 aa, Homo Sapiens
TCMDMLPKG

SEQ ID NO: 1168710 - protein, 9 aa, Homo Sapiens
SLFSFIRSP

SEQ ID NO: 1168711 - protein, 9 aa, Homo Sapiens
VYSYTCICI

SEQ ID NO: 1168712 - protein, 9 aa, Homo Sapiens
KCKIPLLQE

SEQ ID NO: 1168713 - protein, 9 aa, Homo Sapiens
QFQVSASDA

SEQ ID NO: 1168714 - protein, 9 aa, Homo Sapiens
EGGRPCCAY

SEQ ID NO: 1168715 - protein, 9 aa, Homo Sapiens
GRSSKRSSP

SEQ ID NO: 1168716 - protein, 9 aa, Homo Sapiens
PPAPGVPFA

SEQ ID NO: 1168717 - protein, 9 aa, Homo Sapiens
ANLSECMDP

SEQ ID NO: 1168718 - protein, 9 aa, Homo Sapiens
AGRHHCPPG

SEQ ID NO: 1168719 - protein, 9 aa, Homo Sapiens
LLPAAPGVQ

SEQ ID NO: 1168720 - protein, 9 aa, Homo Sapiens
LGRGGPAEW

SEQ ID NO: 1168721 - protein, 9 aa, Homo Sapiens
PTMRTLPPG

SEQ ID NO: 1168722 - protein, 9 aa, Homo Sapiens
WAYIRKQCN

SEQ ID NO: 1168723 - protein, 9 aa, Homo Sapiens
AAREMALRA

SEQ ID NO: 1168724 - protein, 9 aa, Homo Sapiens
ETPKKKRSA

SEQ ID NO: 1168725 - protein, 9 aa, Homo Sapiens
FKEPLTLQE

SEQ ID NO: 1168726 - protein, 9 aa, Homo Sapiens
VVSKGKGKS

SEQ ID NO: 1168727 - protein, 9 aa, Homo Sapiens
LLRAPLLQE

SEQ ID NO: 1168728 - protein, 9 aa, Homo Sapiens
GPNPTSSGV

SEQ ID NO: 1168729 - protein, 9 aa, Homo Sapiens
TLAKELQND

SEQ ID NO: 1168730 - protein, 9 aa, Homo Sapiens
AQWSPVIAA

SEQ ID NO: 1168731 - protein, 9 aa, Homo Sapiens
PTSPRLPLW

SEQ ID NO: 1168732 - protein, 9 aa, Homo Sapiens
GGPGAPHEA

SEQ ID NO: 1168733 - protein, 9 aa, Homo Sapiens
HGRALEKCR

SEQ ID NO: 1168734 - protein, 9 aa, Homo Sapiens
VDDSRISQT

SEQ ID NO: 1168735 - protein, 9 aa, Homo Sapiens
ATTRAAPPT

SEQ ID NO: 1168736 - protein, 9 aa, Homo Sapiens
SSPSSFLLR

SEQ ID NO: 1168737 - protein, 9 aa, Homo Sapiens
PPGPACPIS

SEQ ID NO: 1168738 - protein, 9 aa, Homo Sapiens
VWDAYGTSS

SEQ ID NO: 1168739 - protein, 9 aa, Homo Sapiens
VQLVRQHVQ

SEQ ID NO: 1168740 - protein, 9 aa, Homo Sapiens
DDLETYASP

SEQ ID NO: 1168741 - protein, 9 aa, Homo Sapiens
PGRQLASQS

SEQ ID NO: 1168742 - protein, 9 aa, Homo Sapiens
QIPGIPFSS

SEQ ID NO: 1168743 - protein, 9 aa, Homo Sapiens
CMAAEAQKQ

SEQ ID NO: 1168744 - protein, 9 aa, Homo Sapiens
VQISWQYLH

SEQ ID NO: 1168745 - protein, 9 aa, Homo Sapiens
REKVGPLSH

SEQ ID NO: 1168746 - protein, 9 aa, Homo Sapiens
GVIERVLRD

SEQ ID NO: 1168747 - protein, 9 aa, Homo Sapiens
AGDKGFLPP

SEQ ID NO: 1168748 - protein, 9 aa, Homo Sapiens
ILQNIPMEK

SEQ ID NO: 1168749 - protein, 9 aa, Homo Sapiens
AHWLRASSV

SEQ ID NO: 1168750 - protein, 9 aa, Homo Sapiens
AEREAVRTL

SEQ ID NO: 1168751 - protein, 9 aa, Homo Sapiens
MEVSVLDRT

SEQ ID NO: 1168752 - protein, 9 aa, Homo Sapiens
QLKNCGCLG

SEQ ID NO: 1168753 - protein, 9 aa, Homo Sapiens
CTARGWSWW

SEQ ID NO: 1168754 - protein, 9 aa, Homo Sapiens
GPGSGESHL

SEQ ID NO: 1168755 - protein, 9 aa, Homo Sapiens
SCSPAHWLR

SEQ ID NO: 1168756 - protein, 9 aa, Homo Sapiens
QVRQPQEGA

SEQ ID NO: 1168757 - protein, 9 aa, Homo Sapiens
RNTDQATTP

SEQ ID NO: 1168758 - protein, 9 aa, Homo Sapiens
AALEGCRCY

SEQ ID NO: 1168759 - protein, 9 aa, Homo Sapiens
ICSTTSRRA

SEQ ID NO: 1168760 - protein, 9 aa, Homo Sapiens
PPIMKTSPT

SEQ ID NO: 1168761 - protein, 9 aa, Homo Sapiens
VVDCRAFGH

SEQ ID NO: 1168762 - protein, 9 aa, Homo Sapiens
RTLPNASTW

SEQ ID NO: 1168763 - protein, 9 aa, Homo Sapiens
AGVLSPVTA

SEQ ID NO: 1168764 - protein, 9 aa, Homo Sapiens
CSAAGRAAR

SEQ ID NO: 1168765 - protein, 9 aa, Homo Sapiens
SYLLFGTQV

SEQ ID NO: 1168766 - protein, 9 aa, Homo Sapiens
QMKGVLDDS

SEQ ID NO: 1168767 - protein, 9 aa, Homo Sapiens
MGLRMRRLG

SEQ ID NO: 1168768 - protein, 9 aa, Homo Sapiens
QGAVHIVCP

SEQ ID NO: 1168769 - protein, 9 aa, Homo Sapiens
EQERREQEQ

SEQ ID NO: 1168770 - protein, 9 aa, Homo Sapiens
VPRWCSSRN

SEQ ID NO: 1168771 - protein, 9 aa, Homo Sapiens
RCDRPPPGR

SEQ ID NO: 1168772 - protein, 9 aa, Homo Sapiens
ASEEQRAER

SEQ ID NO: 1168773 - protein, 9 aa, Homo Sapiens
HCWLSPPLG

SEQ ID NO: 1168774 - protein, 9 aa, Homo Sapiens
HSSHCSPAI

SEQ ID NO: 1168775 - protein, 9 aa, Homo Sapiens
CITECVRTA

SEQ ID NO: 1168776 - protein, 9 aa, Homo Sapiens
VPRKTLKMI

SEQ ID NO: 1168777 - protein, 9 aa, Homo Sapiens
DCDGEKRGL

SEQ ID NO: 1168778 - protein, 9 aa, Homo Sapiens
PRRPPHDCM

SEQ ID NO: 1168779 - protein, 9 aa, Homo Sapiens
KIHMSPDFK

SEQ ID NO: 1168780 - protein, 9 aa, Homo Sapiens
DPCTSVKRG

SEQ ID NO: 1168781 - protein, 9 aa, Homo Sapiens
WAMSFLGMS

SEQ ID NO: 1168782 - protein, 9 aa, Homo Sapiens
PVKRLINPV

SEQ ID NO: 1168783 - protein, 9 aa, Homo Sapiens
YAFRIYDHW

SEQ ID NO: 1168784 - protein, 9 aa, Homo Sapiens
SVMSCSLLT

SEQ ID NO: 1168785 - protein, 9 aa, Homo Sapiens
PQEMVKNHI

SEQ ID NO: 1168786 - protein, 9 aa, Homo Sapiens
WLLELPWGP

SEQ ID NO: 1168787 - protein, 9 aa, Homo Sapiens
AALVDFTGG

SEQ ID NO: 1168788 - protein, 9 aa, Homo Sapiens
RRRKMTTLE

SEQ ID NO: 1168789 - protein, 9 aa, Homo Sapiens
DENCGPTLE

SEQ ID NO: 1168790 - protein, 9 aa, Homo Sapiens
GWHWEGWWS

SEQ ID NO: 1168791 - protein, 9 aa, Homo Sapiens
DSKGVRMRA

SEQ ID NO: 1168792 - protein, 9 aa, Homo Sapiens
PTSFGDAIK

SEQ ID NO: 1168793 - protein, 9 aa, Homo Sapiens
SSAHVHAAA

SEQ ID NO: 1168794 - protein, 9 aa, Homo Sapiens
QKLYDLDQG

SEQ ID NO: 1168795 - protein, 9 aa, Homo Sapiens
TQGRRWGAW

SEQ ID NO: 1168796 - protein, 9 aa, Homo Sapiens
RSRPRGGPT

SEQ ID NO: 1168797 - protein, 9 aa, Homo Sapiens
CMSPPLREI

SEQ ID NO: 1168798 - protein, 9 aa, Homo Sapiens
ERRERRRAA

SEQ ID NO: 1168799 - protein, 9 aa, Homo Sapiens
SHRQEAEPP

SEQ ID NO: 1168800 - protein, 9 aa, Homo Sapiens
PQEGAAQLR

SEQ ID NO: 1168801 - protein, 9 aa, Homo Sapiens
YGVQGLTGL

SEQ ID NO: 1168802 - protein, 9 aa, Homo Sapiens
TGAHACCRP

SEQ ID NO: 1168803 - protein, 9 aa, Homo Sapiens
LYHVVYVLV

SEQ ID NO: 1168804 - protein, 9 aa, Homo Sapiens
NKPSTNNTM

SEQ ID NO: 1168805 - protein, 9 aa, Homo Sapiens
TTDDSNDYG

SEQ ID NO: 1168806 - protein, 9 aa, Homo Sapiens
MVYRGTVHN

SEQ ID NO: 1168807 - protein, 9 aa, Homo Sapiens
YMTQKVQNI

SEQ ID NO: 1168808 - protein, 9 aa, Homo Sapiens
LVCGGNRGA

SEQ ID NO: 1168809 - protein, 9 aa, Homo Sapiens
PSPASGRRR

SEQ ID NO: 1168810 - protein, 9 aa, Homo Sapiens
PWASVTPPT

SEQ ID NO: 1168811 - protein, 9 aa, Homo Sapiens
HSETSRQSH

SEQ ID NO: 1168812 - protein, 9 aa, Homo Sapiens
QHIKENTTY

SEQ ID NO: 1168813 - protein, 9 aa, Homo Sapiens
CSPPWREAW

SEQ ID NO: 1168814 - protein, 9 aa, Homo Sapiens
LPHYFKGML

SEQ ID NO: 1168815 - protein, 9 aa, Homo Sapiens
ALKLVLVSV

SEQ ID NO: 1168816 - protein, 9 aa, Homo Sapiens
IPAPPDPSE

SEQ ID NO: 1168817 - protein, 9 aa, Homo Sapiens
HSISTQLKW

SEQ ID NO: 1168818 - protein, 9 aa, Homo Sapiens
YEDKEREKS

SEQ ID NO: 1168819 - protein, 9 aa, Homo Sapiens
MPKSLVSNL

SEQ ID NO: 1168820 - protein, 9 aa, Homo Sapiens
PNGEQGSDG

SEQ ID NO: 1168821 - protein, 9 aa, Homo Sapiens
TPPPQSQSP

SEQ ID NO: 1168822 - protein, 9 aa, Homo Sapiens
GDAGEMVHQ

SEQ ID NO: 1168823 - protein, 9 aa, Homo Sapiens
TTSSGPACG

SEQ ID NO: 1168824 - protein, 9 aa, Homo Sapiens
EDEFVKGQI

SEQ ID NO: 1168825 - protein, 9 aa, Homo Sapiens
STFGPSASI

SEQ ID NO: 1168826 - protein, 9 aa, Homo Sapiens
NTMLWNSFQ

SEQ ID NO: 1168827 - protein, 9 aa, Homo Sapiens
CPLRIMFNI

SEQ ID NO: 1168828 - protein, 9 aa, Homo Sapiens
QRSFTCTQS

SEQ ID NO: 1168829 - protein, 9 aa, Homo Sapiens
AALRAVGTQ

SEQ ID NO: 1168830 - protein, 9 aa, Homo Sapiens
GNDNIHAMT

SEQ ID NO: 1168831 - protein, 9 aa, Homo Sapiens
HLGVSDPDT

SEQ ID NO: 1168832 - protein, 9 aa, Homo Sapiens
GLYPLGPHP

SEQ ID NO: 1168833 - protein, 9 aa, Homo Sapiens
HSRSHSKTM

SEQ ID NO: 1168834 - protein, 9 aa, Homo Sapiens
MSDHLSEFA

SEQ ID NO: 1168835 - protein, 9 aa, Homo Sapiens
SPPLGLHSS

SEQ ID NO: 1168836 - protein, 9 aa, Homo Sapiens
GANVNEKIK

SEQ ID NO: 1168837 - protein, 9 aa, Homo Sapiens
PEMPKSLVS

SEQ ID NO: 1168838 - protein, 9 aa, Homo Sapiens
YTLGALGRG

SEQ ID NO: 1168839 - protein, 9 aa, Homo Sapiens
GCEDEDEDS

SEQ ID NO: 1168840 - protein, 9 aa, Homo Sapiens
EYYLYKFQH

SEQ ID NO: 1168841 - protein, 9 aa, Homo Sapiens
SQTKIILKV

SEQ ID NO: 1168842 - protein, 9 aa, Homo Sapiens
KKSRKCSKT

SEQ ID NO: 1168843 - protein, 9 aa, Homo Sapiens
DHWVKKGQQ

SEQ ID NO: 1168844 - protein, 9 aa, Homo Sapiens
VTGESPPAS

SEQ ID NO: 1168845 - protein, 9 aa, Homo Sapiens
GADIIFHTT

SEQ ID NO: 1168846 - protein, 9 aa, Homo Sapiens
LRCPRAPTA

SEQ ID NO: 1168847 - protein, 9 aa, Homo Sapiens
IRTQHNYLV

SEQ ID NO: 1168848 - protein, 9 aa, Homo Sapiens
ERDLLKKFH

SEQ ID NO: 1168849 - protein, 9 aa, Homo Sapiens
CQGGLPTSG

SEQ ID NO: 1168850 - protein, 9 aa, Homo Sapiens
AAFASRVIL

SEQ ID NO: 1168851 - protein, 9 aa, Homo Sapiens
KYNHCCVKI

SEQ ID NO: 1168852 - protein, 9 aa, Homo Sapiens
SCSSSLAFI

SEQ ID NO: 1168853 - protein, 9 aa, Homo Sapiens
DDDEDQQRG

SEQ ID NO: 1168854 - protein, 9 aa, Homo Sapiens
HRTDEVEVT

SEQ ID NO: 1168855 - protein, 9 aa, Homo Sapiens
GVPLAAESR

SEQ ID NO: 1168856 - protein, 9 aa, Homo Sapiens
AFPGTFSFR

SEQ ID NO: 1168857 - protein, 9 aa, Homo Sapiens
WKFIETKTV

SEQ ID NO: 1168858 - protein, 9 aa, Homo Sapiens
GQAIDGAEP

SEQ ID NO: 1168859 - protein, 9 aa, Homo Sapiens
ASRPSRCVV

SEQ ID NO: 1168860 - protein, 9 aa, Homo Sapiens
GSRKEEEDS

SEQ ID NO: 1168861 - protein, 9 aa, Homo Sapiens
SRETMGTLA

SEQ ID NO: 1168862 - protein, 9 aa, Homo Sapiens
YENTKLLST

SEQ ID NO: 1168863 - protein, 9 aa, Homo Sapiens
LTGTIEVGT

SEQ ID NO: 1168864 - protein, 9 aa, Homo Sapiens
YDWWAILLH

SEQ ID NO: 1168865 - protein, 9 aa, Homo Sapiens
SCNKPSTNN

SEQ ID NO: 1168866 - protein, 9 aa, Homo Sapiens
EQRVSREAA

SEQ ID NO: 1168867 - protein, 9 aa, Homo Sapiens
TMRSGQVRG

SEQ ID NO: 1168868 - protein, 9 aa, Homo Sapiens
ASGSTSRRT

SEQ ID NO: 1168869 - protein, 9 aa, Homo Sapiens
MWFPVVGLP

SEQ ID NO: 1168870 - protein, 9 aa, Homo Sapiens
EGRARVLLL

SEQ ID NO: 1168871 - protein, 9 aa, Homo Sapiens
CPTWVLAGG

SEQ ID NO: 1168872 - protein, 9 aa, Homo Sapiens
CGASWRPFS

SEQ ID NO: 1168873 - protein, 9 aa, Homo Sapiens
RLDQAEKNS

SEQ ID NO: 1168874 - protein, 9 aa, Homo Sapiens
ASSSGGRTA

SEQ ID NO: 1168875 - protein, 9 aa, Homo Sapiens
SGPTDGGEE

SEQ ID NO: 1168876 - protein, 9 aa, Homo Sapiens
CFFLWESLY

SEQ ID NO: 1168877 - protein, 9 aa, Homo Sapiens
KKRRRHQPP

SEQ ID NO: 1168878 - protein, 9 aa, Homo Sapiens
VENFNVAGK

SEQ ID NO: 1168879 - protein, 9 aa, Homo Sapiens
PGNRRLQIL

SEQ ID NO: 1168880 - protein, 9 aa, Homo Sapiens
SSLSLPAII

SEQ ID NO: 1168881 - protein, 9 aa, Homo Sapiens
PSKLPPVDL

SEQ ID NO: 1168882 - protein, 9 aa, Homo Sapiens
KLSATIVLK

SEQ ID NO: 1168883 - protein, 9 aa, Homo Sapiens
CHCGKVSTS

SEQ ID NO: 1168884 - protein, 9 aa, Homo Sapiens
HHVLGLIED

SEQ ID NO: 1168885 - protein, 9 aa, Homo Sapiens
ARPLPWPLP

SEQ ID NO: 1168886 - protein, 9 aa, Homo Sapiens
ARWLEEVQP

SEQ ID NO: 1168887 - protein, 9 aa, Homo Sapiens
GGNSLCSPH

SEQ ID NO: 1168888 - protein, 9 aa, Homo Sapiens
PGMQRRRKI

SEQ ID NO: 1168889 - protein, 9 aa, Homo Sapiens
TISLAIAAG

SEQ ID NO: 1168890 - protein, 9 aa, Homo Sapiens
SVWEFFYGH

SEQ ID NO: 1168891 - protein, 9 aa, Homo Sapiens
TCAGRSSKR

SEQ ID NO: 1168892 - protein, 9 aa, Homo Sapiens
YFRIASSVS

SEQ ID NO: 1168893 - protein, 9 aa, Homo Sapiens
SPPTDLYTH

SEQ ID NO: 1168894 - protein, 9 aa, Homo Sapiens
KTLAKELQN

SEQ ID NO: 1168895 - protein, 9 aa, Homo Sapiens
SRQSHIQMT

SEQ ID NO: 1168896 - protein, 9 aa, Homo Sapiens
CLGSQDPRT

SEQ ID NO: 1168897 - protein, 9 aa, Homo Sapiens
QISMNHVML

SEQ ID NO: 1168898 - protein, 9 aa, Homo Sapiens
TSSYNLSCK

SEQ ID NO: 1168899 - protein, 9 aa, Homo Sapiens
MRVYILITS

SEQ ID NO: 1168900 - protein, 9 aa, Homo Sapiens
FNWHHGVFV

SEQ ID NO: 1168901 - protein, 9 aa, Homo Sapiens
HTFSTLFPV

SEQ ID NO: 1168902 - protein, 9 aa, Homo Sapiens
FCTGSSCHS

SEQ ID NO: 1168903 - protein, 9 aa, Homo Sapiens
PASTRDSLT

SEQ ID NO: 1168904 - protein, 9 aa, Homo Sapiens
RGFQHRASL

SEQ ID NO: 1168905 - protein, 9 aa, Homo Sapiens
KSNMGAWGD

SEQ ID NO: 1168906 - protein, 9 aa, Homo Sapiens
GQRGRADPG

SEQ ID NO: 1168907 - protein, 9 aa, Homo Sapiens
CTQLLPALC

SEQ ID NO: 1168908 - protein, 9 aa, Homo Sapiens
RCIWRGLGS

SEQ ID NO: 1168909 - protein, 9 aa, Homo Sapiens
PPAYIPPRP

SEQ ID NO: 1168910 - protein, 9 aa, Homo Sapiens
DMWVHSSMT

SEQ ID NO: 1168911 - protein, 9 aa, Homo Sapiens
AVRAGDPAT

SEQ ID NO: 1168912 - protein, 9 aa, Homo Sapiens
VDAYHNNPI

SEQ ID NO: 1168913 - protein, 9 aa, Homo Sapiens
FLLPQAPRT

SEQ ID NO: 1168914 - protein, 9 aa, Homo Sapiens
IPPCRTAMQ

SEQ ID NO: 1168915 - protein, 9 aa, Homo Sapiens
ILSGKRSLN

SEQ ID NO: 1168916 - protein, 9 aa, Homo Sapiens
IRPVSEDLW

SEQ ID NO: 1168917 - protein, 9 aa, Homo Sapiens
PQWVLTTAH

SEQ ID NO: 1168918 - protein, 9 aa, Homo Sapiens
CVLYPNDNF

SEQ ID NO: 1168919 - protein, 9 aa, Homo Sapiens
ISREKRGTH

SEQ ID NO: 1168920 - protein, 9 aa, Homo Sapiens
TASHPPGCH

SEQ ID NO: 1168921 - protein, 9 aa, Homo Sapiens
PVDFDYVGI

SEQ ID NO: 1168922 - protein, 9 aa, Homo Sapiens
TLGALGRGS

SEQ ID NO: 1168923 - protein, 9 aa, Homo Sapiens
SNGTRATNG

SEQ ID NO: 1168924 - protein, 9 aa, Homo Sapiens
IICYLGLPH

SEQ ID NO: 1168925 - protein, 9 aa, Homo Sapiens
QMQLQALAM

SEQ ID NO: 1168926 - protein, 9 aa, Homo Sapiens
DFEESNTMH

SEQ ID NO: 1168927 - protein, 9 aa, Homo Sapiens
SLFDFLSVG

SEQ ID NO: 1168928 - protein, 9 aa, Homo Sapiens
MQRTSTIGK

SEQ ID NO: 1168929 - protein, 9 aa, Homo Sapiens
ITMKGYSKL

SEQ ID NO: 1168930 - protein, 9 aa, Homo Sapiens
VKSASLQPK

SEQ ID NO: 1168931 - protein, 9 aa, Homo Sapiens
GQIPCLFVS

SEQ ID NO: 1168932 - protein, 9 aa, Homo Sapiens
AVLLGSQSG

SEQ ID NO: 1168933 - protein, 9 aa, Homo Sapiens
APGATPPAC

SEQ ID NO: 1168934 - protein, 9 aa, Homo Sapiens
PSMVARSGT

SEQ ID NO: 1168935 - protein, 9 aa, Homo Sapiens
SAAGRPNSS

SEQ ID NO: 1168936 - protein, 9 aa, Homo Sapiens
HRIIHTGEN

SEQ ID NO: 1168937 - protein, 9 aa, Homo Sapiens
GPKEAISAS

SEQ ID NO: 1168938 - protein, 9 aa, Homo Sapiens
YPAAAPEEY

SEQ ID NO: 1168939 - protein, 9 aa, Homo Sapiens
NIFGSSQNP

SEQ ID NO: 1168940 - protein, 9 aa, Homo Sapiens
GPDVSEDQT

SEQ ID NO: 1168941 - protein, 9 aa, Homo Sapiens
SLLKRNMKS

SEQ ID NO: 1168942 - protein, 9 aa, Homo Sapiens
LRAVGTQIS

SEQ ID NO: 1168943 - protein, 9 aa, Homo Sapiens
ETALVMRAP

SEQ ID NO: 1168944 - protein, 9 aa, Homo Sapiens
DIVVIIPYF

SEQ ID NO: 1168945 - protein, 9 aa, Homo Sapiens
LPGLTHPAH

SEQ ID NO: 1168946 - protein, 9 aa, Homo Sapiens
ICTLLSNES

SEQ ID NO: 1168947 - protein, 9 aa, Homo Sapiens
HVRRSHSDT

SEQ ID NO: 1168948 - protein, 9 aa, Homo Sapiens
VSGWHCFMT

SEQ ID NO: 1168949 - protein, 9 aa, Homo Sapiens
PRSAASLPQ

SEQ ID NO: 1168950 - protein, 9 aa, Homo Sapiens
LQLTSLRTL

SEQ ID NO: 1168951 - protein, 9 aa, Homo Sapiens
CGCEPGRPL

SEQ ID NO: 1168952 - protein, 9 aa, Homo Sapiens
RGRLQGWQN

SEQ ID NO: 1168953 - protein, 9 aa, Homo Sapiens
CRGPMPGSC

SEQ ID NO: 1168954 - protein, 9 aa, Homo Sapiens
RVQSVLLLG

SEQ ID NO: 1168955 - protein, 9 aa, Homo Sapiens
CRCHRGGRA

SEQ ID NO: 1168956 - protein, 9 aa, Homo Sapiens
GRQHPPPAK

SEQ ID NO: 1168957 - protein, 9 aa, Homo Sapiens
QWRNMNTVK

SEQ ID NO: 1168958 - protein, 9 aa, Homo Sapiens
VGVVEQVVT

SEQ ID NO: 1168959 - protein, 9 aa, Homo Sapiens
TTQSPLPIL

SEQ ID NO: 1168960 - protein, 9 aa, Homo Sapiens
TKRKNHGLE

SEQ ID NO: 1168961 - protein, 9 aa, Homo Sapiens
NTASPLIVA

SEQ ID NO: 1168962 - protein, 9 aa, Homo Sapiens
CVVCHCGLD

SEQ ID NO: 1168963 - protein, 9 aa, Homo Sapiens
SVIMNLVKA

SEQ ID NO: 1168964 - protein, 9 aa, Homo Sapiens
QVGQSATRL

SEQ ID NO: 1168965 - protein, 9 aa, Homo Sapiens
CILTVSGNV

SEQ ID NO: 1168966 - protein, 9 aa, Homo Sapiens
LFFVLVNLE

SEQ ID NO: 1168967 - protein, 9 aa, Homo Sapiens
GIPFPRSSL

SEQ ID NO: 1168968 - protein, 9 aa, Homo Sapiens
ENDQVTLPE

SEQ ID NO: 1168969 - protein, 9 aa, Homo Sapiens
TGRQHPPPA

SEQ ID NO: 1168970 - protein, 9 aa, Homo Sapiens
PRPGSPADR

SEQ ID NO: 1168971 - protein, 9 aa, Homo Sapiens
PSPGTALVK

SEQ ID NO: 1168972 - protein, 9 aa, Homo Sapiens
QRCVQWPAP

SEQ ID NO: 1168973 - protein, 9 aa, Homo Sapiens
LLCPALHLV

SEQ ID NO: 1168974 - protein, 9 aa, Homo Sapiens
QKKSRKCSK

SEQ ID NO: 1168975 - protein, 9 aa, Homo Sapiens
AWWRLCVGR

SEQ ID NO: 1168976 - protein, 9 aa, Homo Sapiens
RTRSAWGDW

SEQ ID NO: 1168977 - protein, 9 aa, Homo Sapiens
RAFGHYTLV

SEQ ID NO: 1168978 - protein, 9 aa, Homo Sapiens
LFYLEQCET

SEQ ID NO: 1168979 - protein, 9 aa, Homo Sapiens
HGVKTPLVE

SEQ ID NO: 1168980 - protein, 9 aa, Homo Sapiens
YVNAIDIWM

SEQ ID NO: 1168981 - protein, 9 aa, Homo Sapiens
RAHQRTGRQ

SEQ ID NO: 1168982 - protein, 9 aa, Homo Sapiens
TLSTLQQRH

SEQ ID NO: 1168983 - protein, 9 aa, Homo Sapiens
PISACPRLL

SEQ ID NO: 1168984 - protein, 9 aa, Homo Sapiens
DFFHDRSTA

SEQ ID NO: 1168985 - protein, 9 aa, Homo Sapiens
LPFTRYCFQ

SEQ ID NO: 1168986 - protein, 9 aa, Homo Sapiens
GLSVVRGGV

SEQ ID NO: 1168987 - protein, 9 aa, Homo Sapiens
HGPAPAPKM

SEQ ID NO: 1168988 - protein, 9 aa, Homo Sapiens
AWRALGASP

SEQ ID NO: 1168989 - protein, 9 aa, Homo Sapiens
RWPTPSSCS

SEQ ID NO: 1168990 - protein, 9 aa, Homo Sapiens
WKLLLFKTF

SEQ ID NO: 1168991 - protein, 9 aa, Homo Sapiens
GQPARVPTP

SEQ ID NO: 1168992 - protein, 9 aa, Homo Sapiens
PPFGTMPSR

SEQ ID NO: 1168993 - protein, 9 aa, Homo Sapiens
SEPQGPSAS

SEQ ID NO: 1168994 - protein, 9 aa, Homo Sapiens
DEWFSRGKN

SEQ ID NO: 1168995 - protein, 9 aa, Homo Sapiens
GMGPRMANL

SEQ ID NO: 1168996 - protein, 9 aa, Homo Sapiens
WVLAWQQLH

SEQ ID NO: 1168997 - protein, 9 aa, Homo Sapiens
LAEHDAVCN

SEQ ID NO: 1168998 - protein, 9 aa, Homo Sapiens
KEPLEVQNI

SEQ ID NO: 1168999 - protein, 9 aa, Homo Sapiens
CSISRARQV

SEQ ID NO: 1169000 - protein, 9 aa, Homo Sapiens
QMKTIHCNR

SEQ ID NO: 1169001 - protein, 9 aa, Homo Sapiens
LYHTASLGT

SEQ ID NO: 1169002 - protein, 9 aa, Homo Sapiens
TYVELFKDV

SEQ ID NO: 1169003 - protein, 9 aa, Homo Sapiens
HSRTELTHV

SEQ ID NO: 1169004 - protein, 9 aa, Homo Sapiens
HPLLGWPAA

SEQ ID NO: 1169005 - protein, 9 aa, Homo Sapiens
GQGLGVAAR

SEQ ID NO: 1169006 - protein, 9 aa, Homo Sapiens
RNIMEPIIT

SEQ ID NO: 1169007 - protein, 9 aa, Homo Sapiens
WKRFVTVAE

SEQ ID NO: 1169008 - protein, 9 aa, Homo Sapiens
LGDESISLS

SEQ ID NO: 1169009 - protein, 9 aa, Homo Sapiens
GRSLSCCPR

SEQ ID NO: 1169010 - protein, 9 aa, Homo Sapiens
GCRPRCCRW

SEQ ID NO: 1169011 - protein, 9 aa, Homo Sapiens
FFWRPPTRE

SEQ ID NO: 1169012 - protein, 9 aa, Homo Sapiens
LDRTSASVK

SEQ ID NO: 1169013 - protein, 9 aa, Homo Sapiens
PRRRTCALR

SEQ ID NO: 1169014 - protein, 9 aa, Homo Sapiens
PPGCHCGKV

SEQ ID NO: 1169015 - protein, 9 aa, Homo Sapiens
RLWSWAAMR

SEQ ID NO: 1169016 - protein, 9 aa, Homo Sapiens
DEEGNLSME

SEQ ID NO: 1169017 - protein, 9 aa, Homo Sapiens
KSVWLFSIT

SEQ ID NO: 1169018 - protein, 9 aa, Homo Sapiens
MHGDLFSED

SEQ ID NO: 1169019 - protein, 9 aa, Homo Sapiens
NCDSLRESH

SEQ ID NO: 1169020 - protein, 9 aa, Homo Sapiens
WQSYLLPQG

SEQ ID NO: 1169021 - protein, 9 aa, Homo Sapiens
LRPPAYIPP

SEQ ID NO: 1169022 - protein, 9 aa, Homo Sapiens
SYKPQLNYK

SEQ ID NO: 1169023 - protein, 9 aa, Homo Sapiens
MQVGLLYEE

SEQ ID NO: 1169024 - protein, 9 aa, Homo Sapiens
CICIHICVF

SEQ ID NO: 1169025 - protein, 9 aa, Homo Sapiens
LDRAVGGGG

SEQ ID NO: 1169026 - protein, 9 aa, Homo Sapiens
NLEPAPPAW

SEQ ID NO: 1169027 - protein, 9 aa, Homo Sapiens
CCRPSRGMA

SEQ ID NO: 1169028 - protein, 9 aa, Homo Sapiens
TISQYASET

SEQ ID NO: 1169029 - protein, 9 aa, Homo Sapiens
RPRSAASLP

SEQ ID NO: 1169030 - protein, 9 aa, Homo Sapiens
WENDQVTLP

SEQ ID NO: 1169031 - protein, 9 aa, Homo Sapiens
SINLSTIKS

SEQ ID NO: 1169032 - protein, 9 aa, Homo Sapiens
RTSQNHSKC

SEQ ID NO: 1169033 - protein, 9 aa, Homo Sapiens
GARVLIPET

SEQ ID NO: 1169034 - protein, 9 aa, Homo Sapiens
NPSAAPHTL

SEQ ID NO: 1169035 - protein, 9 aa, Homo Sapiens
GSNAVGRRG

SEQ ID NO: 1169036 - protein, 9 aa, Homo Sapiens
DEQLQALQE

SEQ ID NO: 1169037 - protein, 9 aa, Homo Sapiens
ADDPCTSVK

SEQ ID NO: 1169038 - protein, 9 aa, Homo Sapiens
RATASHPPG

SEQ ID NO: 1169039 - protein, 9 aa, Homo Sapiens
YIEALNTGT

SEQ ID NO: 1169040 - protein, 9 aa, Homo Sapiens
LDCGPQLPV

SEQ ID NO: 1169041 - protein, 9 aa, Homo Sapiens
WMVQPTVIA

SEQ ID NO: 1169042 - protein, 9 aa, Homo Sapiens
PRGTSEPEC

SEQ ID NO: 1169043 - protein, 9 aa, Homo Sapiens
IGFATEQNW

SEQ ID NO: 1169044 - protein, 9 aa, Homo Sapiens
DVGDSMEAG

SEQ ID NO: 1169045 - protein, 9 aa, Homo Sapiens
SIASGTFQL

SEQ ID NO: 1169046 - protein, 9 aa, Homo Sapiens
ARWCLGRCC

SEQ ID NO: 1169047 - protein, 9 aa, Homo Sapiens
DCGAWPPPW

SEQ ID NO: 1169048 - protein, 9 aa, Homo Sapiens
CCSSWLRRI

SEQ ID NO: 1169049 - protein, 9 aa, Homo Sapiens
SYLLPQGRR

SEQ ID NO: 1169050 - protein, 9 aa, Homo Sapiens
FMTSGIQAP

SEQ ID NO: 1169051 - protein, 9 aa, Homo Sapiens
LHQLQEAAL

SEQ ID NO: 1169052 - protein, 9 aa, Homo Sapiens
EATYDPAGR

SEQ ID NO: 1169053 - protein, 9 aa, Homo Sapiens
TSSASSSGN

SEQ ID NO: 1169054 - protein, 9 aa, Homo Sapiens
TCSPCSPTT

SEQ ID NO: 1169055 - protein, 9 aa, Homo Sapiens
TGAQRVCCL

SEQ ID NO: 1169056 - protein, 9 aa, Homo Sapiens
FFLRREGMC

SEQ ID NO: 1169057 - protein, 9 aa, Homo Sapiens
VKKLQGAPP

SEQ ID NO: 1169058 - protein, 9 aa, Homo Sapiens
QSHIQMTKR

SEQ ID NO: 1169059 - protein, 9 aa, Homo Sapiens
MEEEDEDSK

SEQ ID NO: 1169060 - protein, 9 aa, Homo Sapiens
EWYRQQVSR

SEQ ID NO: 1169061 - protein, 9 aa, Homo Sapiens
FSVFVTQFF

SEQ ID NO: 1169062 - protein, 9 aa, Homo Sapiens
LRSLCKPFS

SEQ ID NO: 1169063 - protein, 9 aa, Homo Sapiens
AISMTTLPT

SEQ ID NO: 1169064 - protein, 9 aa, Homo Sapiens
RRNRGGRCL

SEQ ID NO: 1169065 - protein, 9 aa, Homo Sapiens
ATASHPPGC

SEQ ID NO: 1169066 - protein, 9 aa, Homo Sapiens
ATELVLLQR

SEQ ID NO: 1169067 - protein, 9 aa, Homo Sapiens
PARCPGCLR

SEQ ID NO: 1169068 - protein, 9 aa, Homo Sapiens
SWLCLKCGF

SEQ ID NO: 1169069 - protein, 9 aa, Homo Sapiens
IFLLAFSSG

SEQ ID NO: 1169070 - protein, 9 aa, Homo Sapiens
DFFIEHKTI

SEQ ID NO: 1169071 - protein, 9 aa, Homo Sapiens
EELEECASE

SEQ ID NO: 1169072 - protein, 9 aa, Homo Sapiens
ERLDQDINT

SEQ ID NO: 1169073 - protein, 9 aa, Homo Sapiens
PQRAKSLPL

SEQ ID NO: 1169074 - protein, 9 aa, Homo Sapiens
TSAWRTPVS

SEQ ID NO: 1169075 - protein, 9 aa, Homo Sapiens
NCGLWQRSP

SEQ ID NO: 1169076 - protein, 9 aa, Homo Sapiens
NRGEAALEP

SEQ ID NO: 1169077 - protein, 9 aa, Homo Sapiens
HANELRHQV

SEQ ID NO: 1169078 - protein, 9 aa, Homo Sapiens
INVHDLKYG

SEQ ID NO: 1169079 - protein, 9 aa, Homo Sapiens
WAWQGAWWV

SEQ ID NO: 1169080 - protein, 9 aa, Homo Sapiens
RYNAPTHTL

SEQ ID NO: 1169081 - protein, 9 aa, Homo Sapiens
HPLLPASTS

SEQ ID NO: 1169082 - protein, 9 aa, Homo Sapiens
PPRRPPPAA

SEQ ID NO: 1169083 - protein, 9 aa, Homo Sapiens
GCRPSNPWI

SEQ ID NO: 1169084 - protein, 9 aa, Homo Sapiens
LAAGKKWDH

SEQ ID NO: 1169085 - protein, 9 aa, Homo Sapiens
RPSRCVVPC

SEQ ID NO: 1169086 - protein, 9 aa, Homo Sapiens
HGTEREMEE

SEQ ID NO: 1169087 - protein, 9 aa, Homo Sapiens
GVAARHSGR

SEQ ID NO: 1169088 - protein, 9 aa, Homo Sapiens
SFSVRLFVN

SEQ ID NO: 1169089 - protein, 9 aa, Homo Sapiens
ERVRRGSSA

SEQ ID NO: 1169090 - protein, 9 aa, Homo Sapiens
IGERTEGSP

SEQ ID NO: 1169091 - protein, 9 aa, Homo Sapiens
VSPDALGVL

SEQ ID NO: 1169092 - protein, 9 aa, Homo Sapiens
GDDAHGPWC

SEQ ID NO: 1169093 - protein, 9 aa, Homo Sapiens
KMMEVQKSL

SEQ ID NO: 1169094 - protein, 9 aa, Homo Sapiens
FTSGQCQVW

SEQ ID NO: 1169095 - protein, 9 aa, Homo Sapiens
SEFADDPCT

SEQ ID NO: 1169096 - protein, 9 aa, Homo Sapiens
FAGKSCNQG

SEQ ID NO: 1169097 - protein, 9 aa, Homo Sapiens
KMMQLGGRL

SEQ ID NO: 1169098 - protein, 9 aa, Homo Sapiens
CTYLQIVVD

SEQ ID NO: 1169099 - protein, 9 aa, Homo Sapiens
IQLFGLRSD

SEQ ID NO: 1169100 - protein, 9 aa, Homo Sapiens
LRFTDAPAK

SEQ ID NO: 1169101 - protein, 9 aa, Homo Sapiens
LKSQYTKPY

SEQ ID NO: 1169102 - protein, 9 aa, Homo Sapiens
APRVALSRP

SEQ ID NO: 1169103 - protein, 9 aa, Homo Sapiens
LVNGTWDKA

SEQ ID NO: 1169104 - protein, 9 aa, Homo Sapiens
VTGYDWWAI

SEQ ID NO: 1169105 - protein, 9 aa, Homo Sapiens
QDDNCTLEN

SEQ ID NO: 1169106 - protein, 9 aa, Homo Sapiens
QVLRTSANV

SEQ ID NO: 1169107 - protein, 9 aa, Homo Sapiens
ELPTVASSI

SEQ ID NO: 1169108 - protein, 9 aa, Homo Sapiens
CEKCLGCCS

SEQ ID NO: 1169109 - protein, 9 aa, Homo Sapiens
ADTLKVVQT

SEQ ID NO: 1169110 - protein, 9 aa, Homo Sapiens
HMDGLAIRS

SEQ ID NO: 1169111 - protein, 9 aa, Homo Sapiens
PARPPPTAQ

SEQ ID NO: 1169112 - protein, 9 aa, Homo Sapiens
EGDSADPVV

SEQ ID NO: 1169113 - protein, 9 aa, Homo Sapiens
CWPPCSWPM

SEQ ID NO: 1169114 - protein, 9 aa, Homo Sapiens
SAPNSFLTS

SEQ ID NO: 1169115 - protein, 9 aa, Homo Sapiens
LFNLRADQE

SEQ ID NO: 1169116 - protein, 9 aa, Homo Sapiens
TLRKSSSAS

SEQ ID NO: 1169117 - protein, 9 aa, Homo Sapiens
PARRPPVAG

SEQ ID NO: 1169118 - protein, 9 aa, Homo Sapiens
FCNSSFHLN

SEQ ID NO: 1169119 - protein, 9 aa, Homo Sapiens
IMCPLNPAA

SEQ ID NO: 1169120 - protein, 9 aa, Homo Sapiens
VLLQPWLVA

SEQ ID NO: 1169121 - protein, 9 aa, Homo Sapiens
VPLLRDPAL

SEQ ID NO: 1169122 - protein, 9 aa, Homo Sapiens
PLLLIVAFV

SEQ ID NO: 1169123 - protein, 9 aa, Homo Sapiens
HAGFDAVTG

SEQ ID NO: 1169124 - protein, 9 aa, Homo Sapiens
TGSPPTKQQ

SEQ ID NO: 1169125 - protein, 9 aa, Homo Sapiens
KRHLIFPQP

SEQ ID NO: 1169126 - protein, 9 aa, Homo Sapiens
LCPRIHKVP

SEQ ID NO: 1169127 - protein, 9 aa, Homo Sapiens
CSGRSAASS

SEQ ID NO: 1169128 - protein, 9 aa, Homo Sapiens
SCSPCRALA

SEQ ID NO: 1169129 - protein, 9 aa, Homo Sapiens
PGAITEESA

SEQ ID NO: 1169130 - protein, 9 aa, Homo Sapiens
TPMRNIMEP

SEQ ID NO: 1169131 - protein, 9 aa, Homo Sapiens
LANDMEEED

SEQ ID NO: 1169132 - protein, 9 aa, Homo Sapiens
PTAIVPLRY

SEQ ID NO: 1169133 - protein, 9 aa, Homo Sapiens
TWWRRRRCS

SEQ ID NO: 1169134 - protein, 9 aa, Homo Sapiens
RRRFRIRQP

SEQ ID NO: 1169135 - protein, 9 aa, Homo Sapiens
LLFLPTLQS

SEQ ID NO: 1169136 - protein, 9 aa, Homo Sapiens
PMLEDVCRL

SEQ ID NO: 1169137 - protein, 9 aa, Homo Sapiens
PFVNKAGDG

SEQ ID NO: 1169138 - protein, 9 aa, Homo Sapiens
NSTLSWATP

SEQ ID NO: 1169139 - protein, 9 aa, Homo Sapiens
IGINHCDWP

SEQ ID NO: 1169140 - protein, 9 aa, Homo Sapiens
QGSDSSDSK

SEQ ID NO: 1169141 - protein, 9 aa, Homo Sapiens
VGLLSHLYC

SEQ ID NO: 1169142 - protein, 9 aa, Homo Sapiens
PAPSPNLPQ

SEQ ID NO: 1169143 - protein, 9 aa, Homo Sapiens
GSEATSQYY

SEQ ID NO: 1169144 - protein, 9 aa, Homo Sapiens
VADEYIECL

SEQ ID NO: 1169145 - protein, 9 aa, Homo Sapiens
AYPAAAPEE

SEQ ID NO: 1169146 - protein, 9 aa, Homo Sapiens
QKARQTPEE

SEQ ID NO: 1169147 - protein, 9 aa, Homo Sapiens
RRGKDITVT

SEQ ID NO: 1169148 - protein, 9 aa, Homo Sapiens
SRVILAPQR

SEQ ID NO: 1169149 - protein, 9 aa, Homo Sapiens
CLLPMLSVK

SEQ ID NO: 1169150 - protein, 9 aa, Homo Sapiens
CKKEAVLPR

SEQ ID NO: 1169151 - protein, 9 aa, Homo Sapiens
PEPGGPTEP

SEQ ID NO: 1169152 - protein, 9 aa, Homo Sapiens
HLAASALRT

SEQ ID NO: 1169153 - protein, 9 aa, Homo Sapiens
PEGVSPTSG

SEQ ID NO: 1169154 - protein, 9 aa, Homo Sapiens
PMVVVTATR

SEQ ID NO: 1169155 - protein, 9 aa, Homo Sapiens
SKKGPPVKP

SEQ ID NO: 1169156 - protein, 9 aa, Homo Sapiens
LFDSNTSRF

SEQ ID NO: 1169157 - protein, 9 aa, Homo Sapiens
TEPHGASGA

SEQ ID NO: 1169158 - protein, 9 aa, Homo Sapiens
RGCPTWVLA

SEQ ID NO: 1169159 - protein, 9 aa, Homo Sapiens
VSEGYAADT

SEQ ID NO: 1169160 - protein, 9 aa, Homo Sapiens
APLAPPALV

SEQ ID NO: 1169161 - protein, 9 aa, Homo Sapiens
CVSGLITNC

SEQ ID NO: 1169162 - protein, 9 aa, Homo Sapiens
PSQTHHSTP

SEQ ID NO: 1169163 - protein, 9 aa, Homo Sapiens
PICQPSWAT

SEQ ID NO: 1169164 - protein, 9 aa, Homo Sapiens
RLHQLQEAA

SEQ ID NO: 1169165 - protein, 9 aa, Homo Sapiens
ACICPSYLH

SEQ ID NO: 1169166 - protein, 9 aa, Homo Sapiens
QGAPLCAGS

SEQ ID NO: 1169167 - protein, 9 aa, Homo Sapiens
VKAVSEKEV

SEQ ID NO: 1169168 - protein, 9 aa, Homo Sapiens
MTTISRATW

SEQ ID NO: 1169169 - protein, 9 aa, Homo Sapiens
VRLKFHTSC

SEQ ID NO: 1169170 - protein, 9 aa, Homo Sapiens
YPARCPGCL

SEQ ID NO: 1169171 - protein, 9 aa, Homo Sapiens
VRLDPGAIS

SEQ ID NO: 1169172 - protein, 9 aa, Homo Sapiens
DEAACENTR

SEQ ID NO: 1169173 - protein, 9 aa, Homo Sapiens
QALLEHYLE

SEQ ID NO: 1169174 - protein, 9 aa, Homo Sapiens
IPYMYIRHQ

SEQ ID NO: 1169175 - protein, 9 aa, Homo Sapiens
PPGGAVRAG

SEQ ID NO: 1169176 - protein, 9 aa, Homo Sapiens
LVLLIEGHY

SEQ ID NO: 1169177 - protein, 9 aa, Homo Sapiens
VLWKLCLRF

SEQ ID NO: 1169178 - protein, 9 aa, Homo Sapiens
PCVARTSAN

SEQ ID NO: 1169179 - protein, 9 aa, Homo Sapiens
PPTDLYTHQ

SEQ ID NO: 1169180 - protein, 9 aa, Homo Sapiens
ENYYVAYSS

SEQ ID NO: 1169181 - protein, 9 aa, Homo Sapiens
DPDSGHNAW

SEQ ID NO: 1169182 - protein, 9 aa, Homo Sapiens
LIHCYMALC

SEQ ID NO: 1169183 - protein, 9 aa, Homo Sapiens
NDMEEEDED

SEQ ID NO: 1169184 - protein, 9 aa, Homo Sapiens
EVRRLVIGF

SEQ ID NO: 1169185 - protein, 9 aa, Homo Sapiens
NLLEELSLN

SEQ ID NO: 1169186 - protein, 9 aa, Homo Sapiens
VKECDSISR

SEQ ID NO: 1169187 - protein, 9 aa, Homo Sapiens
PLLSRPRSA

SEQ ID NO: 1169188 - protein, 9 aa, Homo Sapiens
TGKQDSRGS

SEQ ID NO: 1169189 - protein, 9 aa, Homo Sapiens
AFSFPQLPV

SEQ ID NO: 1169190 - protein, 9 aa, Homo Sapiens
DAYHNNPIG

SEQ ID NO: 1169191 - protein, 9 aa, Homo Sapiens
RAREEQVPQ

SEQ ID NO: 1169192 - protein, 9 aa, Homo Sapiens
LITASYDTN

SEQ ID NO: 1169193 - protein, 9 aa, Homo Sapiens
RPSWKGKGA

SEQ ID NO: 1169194 - protein, 9 aa, Homo Sapiens
GVSPTSGHD

SEQ ID NO: 1169195 - protein, 9 aa, Homo Sapiens
NLCTCPSFI

SEQ ID NO: 1169196 - protein, 9 aa, Homo Sapiens
PCTCSPPWR

SEQ ID NO: 1169197 - protein, 9 aa, Homo Sapiens
EPSQRAAAQ

SEQ ID NO: 1169198 - protein, 9 aa, Homo Sapiens
KTFHMKCFL

SEQ ID NO: 1169199 - protein, 9 aa, Homo Sapiens
KICVEEDPR

SEQ ID NO: 1169200 - protein, 9 aa, Homo Sapiens
SGASWVSGK

SEQ ID NO: 1169201 - protein, 9 aa, Homo Sapiens
AAALTTGEA

SEQ ID NO: 1169202 - protein, 9 aa, Homo Sapiens
WDNNNRSMG

SEQ ID NO: 1169203 - protein, 9 aa, Homo Sapiens
TLWYRPSDV

SEQ ID NO: 1169204 - protein, 9 aa, Homo Sapiens
PTATWWACA

SEQ ID NO: 1169205 - protein, 9 aa, Homo Sapiens
VKEMDEEGN

SEQ ID NO: 1169206 - protein, 9 aa, Homo Sapiens
DMARPPKQW

SEQ ID NO: 1169207 - protein, 9 aa, Homo Sapiens
ARMSSWSQT

SEQ ID NO: 1169208 - protein, 9 aa, Homo Sapiens
GEERVRRGS

SEQ ID NO: 1169209 - protein, 9 aa, Homo Sapiens
DIRAGTTPS

SEQ ID NO: 1169210 - protein, 9 aa, Homo Sapiens
DEKTQQSSL

SEQ ID NO: 1169211 - protein, 9 aa, Homo Sapiens
RRPPPPLPP

SEQ ID NO: 1169212 - protein, 9 aa, Homo Sapiens
GRRPSGFPD

SEQ ID NO: 1169213 - protein, 9 aa, Homo Sapiens
RGPLASGQA

SEQ ID NO: 1169214 - protein, 9 aa, Homo Sapiens
LVRFYPARC

SEQ ID NO: 1169215 - protein, 9 aa, Homo Sapiens
GPCSPCQFR

SEQ ID NO: 1169216 - protein, 9 aa, Homo Sapiens
LYSVPKNPS

SEQ ID NO: 1169217 - protein, 9 aa, Homo Sapiens
FQGVLQNAR

SEQ ID NO: 1169218 - protein, 9 aa, Homo Sapiens
AQDGARCPS

SEQ ID NO: 1169219 - protein, 9 aa, Homo Sapiens
EDTCVESSM

SEQ ID NO: 1169220 - protein, 9 aa, Homo Sapiens
AAWPPRHGW

SEQ ID NO: 1169221 - protein, 9 aa, Homo Sapiens
DPRPGHRSA

SEQ ID NO: 1169222 - protein, 9 aa, Homo Sapiens
LEKKRKKEP

SEQ ID NO: 1169223 - protein, 9 aa, Homo Sapiens
IVIGERTEG

SEQ ID NO: 1169224 - protein, 9 aa, Homo Sapiens
SGGSPEWQD

SEQ ID NO: 1169225 - protein, 9 aa, Homo Sapiens
NSWIQLFGL

SEQ ID NO: 1169226 - protein, 9 aa, Homo Sapiens
SISPVTKGT

SEQ ID NO: 1169227 - protein, 9 aa, Homo Sapiens
FWLSKKENT

SEQ ID NO: 1169228 - protein, 9 aa, Homo Sapiens
PESPIKKQV

SEQ ID NO: 1169229 - protein, 9 aa, Homo Sapiens
VVPNTANGW

SEQ ID NO: 1169230 - protein, 9 aa, Homo Sapiens
TKGRPEPVA

SEQ ID NO: 1169231 - protein, 9 aa, Homo Sapiens
WQVSSDPRA

SEQ ID NO: 1169232 - protein, 9 aa, Homo Sapiens
FLLVSLAMF

SEQ ID NO: 1169233 - protein, 9 aa, Homo Sapiens
PCNASIMCP

SEQ ID NO: 1169234 - protein, 9 aa, Homo Sapiens
LWESLYPEV

SEQ ID NO: 1169235 - protein, 9 aa, Homo Sapiens
QRTREGPSS

SEQ ID NO: 1169236 - protein, 9 aa, Homo Sapiens
YETLSPVPS

SEQ ID NO: 1169237 - protein, 9 aa, Homo Sapiens
FQDTTGDIV

SEQ ID NO: 1169238 - protein, 9 aa, Homo Sapiens
LHTAGTPVP

SEQ ID NO: 1169239 - protein, 9 aa, Homo Sapiens
GHAPRLWLL

SEQ ID NO: 1169240 - protein, 9 aa, Homo Sapiens
AQPTVPRKT

SEQ ID NO: 1169241 - protein, 9 aa, Homo Sapiens
IQPRARCLR

SEQ ID NO: 1169242 - protein, 9 aa, Homo Sapiens
EYGANVAMQ

SEQ ID NO: 1169243 - protein, 9 aa, Homo Sapiens
LLVIFYVSW

SEQ ID NO: 1169244 - protein, 9 aa, Homo Sapiens
GKQDSRGSR

SEQ ID NO: 1169245 - protein, 9 aa, Homo Sapiens
GRVHCGAPP

SEQ ID NO: 1169246 - protein, 9 aa, Homo Sapiens
TFGELVQPF

SEQ ID NO: 1169247 - protein, 9 aa, Homo Sapiens
PRALWASSS

SEQ ID NO: 1169248 - protein, 9 aa, Homo Sapiens
EAPGCWSCR

SEQ ID NO: 1169249 - protein, 9 aa, Homo Sapiens
ATWWACATR

SEQ ID NO: 1169250 - protein, 9 aa, Homo Sapiens
VRSGCRAPP

SEQ ID NO: 1169251 - protein, 9 aa, Homo Sapiens
SPGHGGRPG

SEQ ID NO: 1169252 - protein, 9 aa, Homo Sapiens
QLNHCIFTQ

SEQ ID NO: 1169253 - protein, 9 aa, Homo Sapiens
MKWSYKPQL

SEQ ID NO: 1169254 - protein, 9 aa, Homo Sapiens
TSRSPDTRA

SEQ ID NO: 1169255 - protein, 9 aa, Homo Sapiens
FTVAKGKSS

SEQ ID NO: 1169256 - protein, 9 aa, Homo Sapiens
PRARQPLPL

SEQ ID NO: 1169257 - protein, 9 aa, Homo Sapiens
NLHLLAEGT

SEQ ID NO: 1169258 - protein, 9 aa, Homo Sapiens
SRGLPTTGP

SEQ ID NO: 1169259 - protein, 9 aa, Homo Sapiens
HPGQWAPSK

SEQ ID NO: 1169260 - protein, 9 aa, Homo Sapiens
RLKELLMML

SEQ ID NO: 1169261 - protein, 9 aa, Homo Sapiens
GAAWHVVPP

SEQ ID NO: 1169262 - protein, 9 aa, Homo Sapiens
RLINPVVQA

SEQ ID NO: 1169263 - protein, 9 aa, Homo Sapiens
PVADTSSVS

SEQ ID NO: 1169264 - protein, 9 aa, Homo Sapiens
LHRGGAPGS

SEQ ID NO: 1169265 - protein, 9 aa, Homo Sapiens
IRMKFLFYA

SEQ ID NO: 1169266 - protein, 9 aa, Homo Sapiens
KLPPVLMLH

SEQ ID NO: 1169267 - protein, 9 aa, Homo Sapiens
SQQSISAED

SEQ ID NO: 1169268 - protein, 9 aa, Homo Sapiens
ANTAPALPM

SEQ ID NO: 1169269 - protein, 9 aa, Homo Sapiens
QISVDSVFV

SEQ ID NO: 1169270 - protein, 9 aa, Homo Sapiens
VFPSPQSHR

SEQ ID NO: 1169271 - protein, 9 aa, Homo Sapiens
HTQLLIHSM

SEQ ID NO: 1169272 - protein, 9 aa, Homo Sapiens
LMLSFLSLR

SEQ ID NO: 1169273 - protein, 9 aa, Homo Sapiens
LAWDPPRSC

SEQ ID NO: 1169274 - protein, 9 aa, Homo Sapiens
SLMPCGVPS

SEQ ID NO: 1169275 - protein, 9 aa, Homo Sapiens
KHSTRSSGV

SEQ ID NO: 1169276 - protein, 9 aa, Homo Sapiens
LVTQNGRAA

SEQ ID NO: 1169277 - protein, 9 aa, Homo Sapiens
MSSERYLHL

SEQ ID NO: 1169278 - protein, 9 aa, Homo Sapiens
RRIWVDYSI

SEQ ID NO: 1169279 - protein, 9 aa, Homo Sapiens
PRLLPLTRP

SEQ ID NO: 1169280 - protein, 9 aa, Homo Sapiens
RDDEEEEAS

SEQ ID NO: 1169281 - protein, 9 aa, Homo Sapiens
MLGGDEEDP

SEQ ID NO: 1169282 - protein, 9 aa, Homo Sapiens
GPLGMPSDI

SEQ ID NO: 1169283 - protein, 9 aa, Homo Sapiens
NATTTSSQP

SEQ ID NO: 1169284 - protein, 9 aa, Homo Sapiens
VASIETGLV

SEQ ID NO: 1169285 - protein, 9 aa, Homo Sapiens
QRIHTDKKP

SEQ ID NO: 1169286 - protein, 9 aa, Homo Sapiens
YMLNARLAK

SEQ ID NO: 1169287 - protein, 9 aa, Homo Sapiens
SRIPPCRTA

SEQ ID NO: 1169288 - protein, 9 aa, Homo Sapiens
YTCSHCPDS

SEQ ID NO: 1169289 - protein, 9 aa, Homo Sapiens
MRMIRSVWR

SEQ ID NO: 1169290 - protein, 9 aa, Homo Sapiens
HVHLALKAQ

SEQ ID NO: 1169291 - protein, 9 aa, Homo Sapiens
HYVPFEDDK

SEQ ID NO: 1169292 - protein, 9 aa, Homo Sapiens
VKMCGSNLQ

SEQ ID NO: 1169293 - protein, 9 aa, Homo Sapiens
TWSSSTRSS

SEQ ID NO: 1169294 - protein, 9 aa, Homo Sapiens
ELAKLVNKY

SEQ ID NO: 1169295 - protein, 9 aa, Homo Sapiens
LPKLLCRQM

SEQ ID NO: 1169296 - protein, 9 aa, Homo Sapiens
YNKGRDWCL

SEQ ID NO: 1169297 - protein, 9 aa, Homo Sapiens
MMVMLDPEW

SEQ ID NO: 1169298 - protein, 9 aa, Homo Sapiens
VDPLRGAMY

SEQ ID NO: 1169299 - protein, 9 aa, Homo Sapiens
SCFFLVYSL

SEQ ID NO: 1169300 - protein, 9 aa, Homo Sapiens
IWEELLKIL

SEQ ID NO: 1169301 - protein, 9 aa, Homo Sapiens
GAGEGPAPG

SEQ ID NO: 1169302 - protein, 9 aa, Homo Sapiens
SQPKSKPTT

SEQ ID NO: 1169303 - protein, 9 aa, Homo Sapiens
LHHAGPEDG

SEQ ID NO: 1169304 - protein, 9 aa, Homo Sapiens
SQEWQVSSD

SEQ ID NO: 1169305 - protein, 9 aa, Homo Sapiens
LYGDRKLFQ

SEQ ID NO: 1169306 - protein, 9 aa, Homo Sapiens
CRRCSGLSV

SEQ ID NO: 1169307 - protein, 9 aa, Homo Sapiens
KEMFSSKFG

SEQ ID NO: 1169308 - protein, 9 aa, Homo Sapiens
LLFIVLLGI

SEQ ID NO: 1169309 - protein, 9 aa, Homo Sapiens
LTRRWPLPQ

SEQ ID NO: 1169310 - protein, 9 aa, Homo Sapiens
CCSLATCCS

SEQ ID NO: 1169311 - protein, 9 aa, Homo Sapiens
GGASQSQNA

SEQ ID NO: 1169312 - protein, 9 aa, Homo Sapiens
GCWPPPAPG

SEQ ID NO: 1169313 - protein, 9 aa, Homo Sapiens
KIRLLKCDR

SEQ ID NO: 1169314 - protein, 9 aa, Homo Sapiens
EMDIFELLK

SEQ ID NO: 1169315 - protein, 9 aa, Homo Sapiens
TINLLEELS

SEQ ID NO: 1169316 - protein, 9 aa, Homo Sapiens
SPATTWRPP

SEQ ID NO: 1169317 - protein, 9 aa, Homo Sapiens
LSQWPWCLF

SEQ ID NO: 1169318 - protein, 9 aa, Homo Sapiens
YDAYVTENN

SEQ ID NO: 1169319 - protein, 9 aa, Homo Sapiens
SLTVVTFSF

SEQ ID NO: 1169320 - protein, 9 aa, Homo Sapiens
HSLVMCLRL

SEQ ID NO: 1169321 - protein, 9 aa, Homo Sapiens
LEGLEDAPQ

SEQ ID NO: 1169322 - protein, 9 aa, Homo Sapiens
TWPLSLEPD

SEQ ID NO: 1169323 - protein, 9 aa, Homo Sapiens
KDITVTTTQ

SEQ ID NO: 1169324 - protein, 9 aa, Homo Sapiens
LSAQSAIST

SEQ ID NO: 1169325 - protein, 9 aa, Homo Sapiens
SLLRAGGIL

SEQ ID NO: 1169326 - protein, 9 aa, Homo Sapiens
TPSPALRAA

SEQ ID NO: 1169327 - protein, 9 aa, Homo Sapiens
WGRCGPAGW

SEQ ID NO: 1169328 - protein, 9 aa, Homo Sapiens
HSCRIQKSD

SEQ ID NO: 1169329 - protein, 9 aa, Homo Sapiens
PGGPAPPPT

SEQ ID NO: 1169330 - protein, 9 aa, Homo Sapiens
LLEHYLELL

SEQ ID NO: 1169331 - protein, 9 aa, Homo Sapiens
RCCMGLIVF

SEQ ID NO: 1169332 - protein, 9 aa, Homo Sapiens
RNPTTAWTR

SEQ ID NO: 1169333 - protein, 9 aa, Homo Sapiens
GVLKQDLVR

SEQ ID NO: 1169334 - protein, 9 aa, Homo Sapiens
REARALSRG

SEQ ID NO: 1169335 - protein, 9 aa, Homo Sapiens
LAARQESTT

SEQ ID NO: 1169336 - protein, 9 aa, Homo Sapiens
AEPAYPAAA

SEQ ID NO: 1169337 - protein, 9 aa, Homo Sapiens
AATAATTAA

SEQ ID NO: 1169338 - protein, 9 aa, Homo Sapiens
DSCSGHCSG

SEQ ID NO: 1169339 - protein, 9 aa, Homo Sapiens
KIHGRALEK

SEQ ID NO: 1169340 - protein, 9 aa, Homo Sapiens
WTAHREPHP

SEQ ID NO: 1169341 - protein, 9 aa, Homo Sapiens
TSSSFSKWC

SEQ ID NO: 1169342 - protein, 9 aa, Homo Sapiens
VRVRMAVTP

SEQ ID NO: 1169343 - protein, 9 aa, Homo Sapiens
FPPHGPVVR

SEQ ID NO: 1169344 - protein, 9 aa, Homo Sapiens
STSRSSCHN

SEQ ID NO: 1169345 - protein, 9 aa, Homo Sapiens
PTQTWTRLP

SEQ ID NO: 1169346 - protein, 9 aa, Homo Sapiens
PGPQDPPSD

SEQ ID NO: 1169347 - protein, 9 aa, Homo Sapiens
GWSWWSPWK

SEQ ID NO: 1169348 - protein, 9 aa, Homo Sapiens
NASRDKIKS

SEQ ID NO: 1169349 - protein, 9 aa, Homo Sapiens
WRPGASRRW

SEQ ID NO: 1169350 - protein, 9 aa, Homo Sapiens
KVLWPLRPP

SEQ ID NO: 1169351 - protein, 9 aa, Homo Sapiens
PAAAPRGPE

SEQ ID NO: 1169352 - protein, 9 aa, Homo Sapiens
SPRRAPLNS

SEQ ID NO: 1169353 - protein, 9 aa, Homo Sapiens
KGPCQTCMT

SEQ ID NO: 1169354 - protein, 9 aa, Homo Sapiens
AVRPRPHQP

SEQ ID NO: 1169355 - protein, 9 aa, Homo Sapiens
RAASHRRRL

SEQ ID NO: 1169356 - protein, 9 aa, Homo Sapiens
WPAGLQSMP

SEQ ID NO: 1169357 - protein, 9 aa, Homo Sapiens
NICPKYLTY

SEQ ID NO: 1169358 - protein, 9 aa, Homo Sapiens
NHPHSTGPP

SEQ ID NO: 1169359 - protein, 9 aa, Homo Sapiens
HQMGLKVVR

SEQ ID NO: 1169360 - protein, 9 aa, Homo Sapiens
LELHPPAIR

SEQ ID NO: 1169361 - protein, 9 aa, Homo Sapiens
PAKLVQSIL

SEQ ID NO: 1169362 - protein, 9 aa, Homo Sapiens
RWATQGPAA

SEQ ID NO: 1169363 - protein, 9 aa, Homo Sapiens
SKNFTNPNG

SEQ ID NO: 1169364 - protein, 9 aa, Homo Sapiens
HETETKEPE

SEQ ID NO: 1169365 - protein, 9 aa, Homo Sapiens
ALAWCAWAW

SEQ ID NO: 1169366 - protein, 9 aa, Homo Sapiens
LEVTFPPGT

SEQ ID NO: 1169367 - protein, 9 aa, Homo Sapiens
MNFTGGTLA

SEQ ID NO: 1169368 - protein, 9 aa, Homo Sapiens
AAGTPHHIS

SEQ ID NO: 1169369 - protein, 9 aa, Homo Sapiens
ECSVENDVS

SEQ ID NO: 1169370 - protein, 9 aa, Homo Sapiens
QLPVGNSTL

SEQ ID NO: 1169371 - protein, 9 aa, Homo Sapiens
RIGSPNSLL

SEQ ID NO: 1169372 - protein, 9 aa, Homo Sapiens
VLGGMVYTI

SEQ ID NO: 1169373 - protein, 9 aa, Homo Sapiens
ALERPDIRE

SEQ ID NO: 1169374 - protein, 9 aa, Homo Sapiens
PIRVSPRST

SEQ ID NO: 1169375 - protein, 9 aa, Homo Sapiens
LVDAVVQAV

SEQ ID NO: 1169376 - protein, 9 aa, Homo Sapiens
LARCLILAV

SEQ ID NO: 1169377 - protein, 9 aa, Homo Sapiens
DSGVTQRHR

SEQ ID NO: 1169378 - protein, 9 aa, Homo Sapiens
LWLLWRQNG

SEQ ID NO: 1169379 - protein, 9 aa, Homo Sapiens
ISWDSFWGA

SEQ ID NO: 1169380 - protein, 9 aa, Homo Sapiens
QAFLRESSS

SEQ ID NO: 1169381 - protein, 9 aa, Homo Sapiens
VVSLGEELG

SEQ ID NO: 1169382 - protein, 9 aa, Homo Sapiens
RCPRAPTAP

SEQ ID NO: 1169383 - protein, 9 aa, Homo Sapiens
GGGRGPGRG

SEQ ID NO: 1169384 - protein, 9 aa, Homo Sapiens
IDLSHCSWQ

SEQ ID NO: 1169385 - protein, 9 aa, Homo Sapiens
FKKRRRRVR

SEQ ID NO: 1169386 - protein, 9 aa, Homo Sapiens
LMSPNKPYS

SEQ ID NO: 1169387 - protein, 9 aa, Homo Sapiens
KIWEELLKI

SEQ ID NO: 1169388 - protein, 9 aa, Homo Sapiens
EQTPGFKGH

SEQ ID NO: 1169389 - protein, 9 aa, Homo Sapiens
LTPKVLVFP

SEQ ID NO: 1169390 - protein, 9 aa, Homo Sapiens
RCFELDPVR

SEQ ID NO: 1169391 - protein, 9 aa, Homo Sapiens
HMPMEFDFD

SEQ ID NO: 1169392 - protein, 9 aa, Homo Sapiens
VRVGSCVDS

SEQ ID NO: 1169393 - protein, 9 aa, Homo Sapiens
KSKKGPPVK

SEQ ID NO: 1169394 - protein, 9 aa, Homo Sapiens
VTKCAFQAP

SEQ ID NO: 1169395 - protein, 9 aa, Homo Sapiens
LREKIMKLS

SEQ ID NO: 1169396 - protein, 9 aa, Homo Sapiens
RYGWHWGWR

SEQ ID NO: 1169397 - protein, 9 aa, Homo Sapiens
INPHPSARS

SEQ ID NO: 1169398 - protein, 9 aa, Homo Sapiens
INADKAPSR

SEQ ID NO: 1169399 - protein, 9 aa, Homo Sapiens
RALSRGSPG

SEQ ID NO: 1169400 - protein, 9 aa, Homo Sapiens
WSIDMDDFA

SEQ ID NO: 1169401 - protein, 9 aa, Homo Sapiens
TTHCTFVDQ

SEQ ID NO: 1169402 - protein, 9 aa, Homo Sapiens
TALHIKLWA

SEQ ID NO: 1169403 - protein, 9 aa, Homo Sapiens
RGCFLRIRQ

SEQ ID NO: 1169404 - protein, 9 aa, Homo Sapiens
RDGGWGWRS

SEQ ID NO: 1169405 - protein, 9 aa, Homo Sapiens
YEREGLAGQ

SEQ ID NO: 1169406 - protein, 9 aa, Homo Sapiens
SDHIAALKE

SEQ ID NO: 1169407 - protein, 9 aa, Homo Sapiens
LELPTTEHC

SEQ ID NO: 1169408 - protein, 9 aa, Homo Sapiens
MPGTVALRE

SEQ ID NO: 1169409 - protein, 9 aa, Homo Sapiens
QYYFRIASS

SEQ ID NO: 1169410 - protein, 9 aa, Homo Sapiens
AASERLQAA

SEQ ID NO: 1169411 - protein, 9 aa, Homo Sapiens
GHGGRPGGS

SEQ ID NO: 1169412 - protein, 9 aa, Homo Sapiens
TRAAPPTDY

SEQ ID NO: 1169413 - protein, 9 aa, Homo Sapiens
EGAAGGSDP

SEQ ID NO: 1169414 - protein, 9 aa, Homo Sapiens
LYPVCHVHN

SEQ ID NO: 1169415 - protein, 9 aa, Homo Sapiens
GEDAPGARP

SEQ ID NO: 1169416 - protein, 9 aa, Homo Sapiens
GFWRDEEST

SEQ ID NO: 1169417 - protein, 9 aa, Homo Sapiens
GCPLRIMFN

SEQ ID NO: 1169418 - protein, 9 aa, Homo Sapiens
KEPESTLHA

SEQ ID NO: 1169419 - protein, 9 aa, Homo Sapiens
ESWQMKTIH

SEQ ID NO: 1169420 - protein, 9 aa, Homo Sapiens
TAQVDALNS

SEQ ID NO: 1169421 - protein, 9 aa, Homo Sapiens
PEAPSTRAA

SEQ ID NO: 1169422 - protein, 9 aa, Homo Sapiens
YSDQCNMIN

SEQ ID NO: 1169423 - protein, 9 aa, Homo Sapiens
NNRSMGGSW

SEQ ID NO: 1169424 - protein, 9 aa, Homo Sapiens
TSAKGDDTY

SEQ ID NO: 1169425 - protein, 9 aa, Homo Sapiens
GCWSCRRRS

SEQ ID NO: 1169426 - protein, 9 aa, Homo Sapiens
ELGVGLGDE

SEQ ID NO: 1169427 - protein, 9 aa, Homo Sapiens
LKPAGPCSA

SEQ ID NO: 1169428 - protein, 9 aa, Homo Sapiens
GHTIPCIFQ

SEQ ID NO: 1169429 - protein, 9 aa, Homo Sapiens
FAPSLEMLL

SEQ ID NO: 1169430 - protein, 9 aa, Homo Sapiens
RSCRRRPSC

SEQ ID NO: 1169431 - protein, 9 aa, Homo Sapiens
QDSARRASR

SEQ ID NO: 1169432 - protein, 9 aa, Homo Sapiens
NSLDNLCCM

SEQ ID NO: 1169433 - protein, 9 aa, Homo Sapiens
TGLLLFSHL

SEQ ID NO: 1169434 - protein, 9 aa, Homo Sapiens
EAPSRALRG

SEQ ID NO: 1169435 - protein, 9 aa, Homo Sapiens
FPPSMRQAG

SEQ ID NO: 1169436 - protein, 9 aa, Homo Sapiens
LKSEGFYSI

SEQ ID NO: 1169437 - protein, 9 aa, Homo Sapiens
IDYFQNRTD

SEQ ID NO: 1169438 - protein, 9 aa, Homo Sapiens
QPARVPTPV

SEQ ID NO: 1169439 - protein, 9 aa, Homo Sapiens
GNPSWCPCP

SEQ ID NO: 1169440 - protein, 9 aa, Homo Sapiens
HSRTPPSAA

SEQ ID NO: 1169441 - protein, 9 aa, Homo Sapiens
SGADHIYDL

SEQ ID NO: 1169442 - protein, 9 aa, Homo Sapiens
YPICFTMAV

SEQ ID NO: 1169443 - protein, 9 aa, Homo Sapiens
SAVMQSGGI

SEQ ID NO: 1169444 - protein, 9 aa, Homo Sapiens
VDQVNHKDA

SEQ ID NO: 1169445 - protein, 9 aa, Homo Sapiens
WDKALDIRP

SEQ ID NO: 1169446 - protein, 9 aa, Homo Sapiens
VKKPHRYMP

SEQ ID NO: 1169447 - protein, 9 aa, Homo Sapiens
LGSQDPRTM

SEQ ID NO: 1169448 - protein, 9 aa, Homo Sapiens
LRSGILARS

SEQ ID NO: 1169449 - protein, 9 aa, Homo Sapiens
PSTDLCLPT

SEQ ID NO: 1169450 - protein, 9 aa, Homo Sapiens
SPPLQSKFT

SEQ ID NO: 1169451 - protein, 9 aa, Homo Sapiens
MKVRGVPAI

SEQ ID NO: 1169452 - protein, 9 aa, Homo Sapiens
RRLLRCSPS

SEQ ID NO: 1169453 - protein, 9 aa, Homo Sapiens
QASVLQNLH

SEQ ID NO: 1169454 - protein, 9 aa, Homo Sapiens
PSTLLGALH

SEQ ID NO: 1169455 - protein, 9 aa, Homo Sapiens
KRTKAVIFC

SEQ ID NO: 1169456 - protein, 9 aa, Homo Sapiens
NGPPTWPTQ

SEQ ID NO: 1169457 - protein, 9 aa, Homo Sapiens
ETLMQRTST

SEQ ID NO: 1169458 - protein, 9 aa, Homo Sapiens
AVAAPPAAR

SEQ ID NO: 1169459 - protein, 9 aa, Homo Sapiens
VGETAPWAL

SEQ ID NO: 1169460 - protein, 9 aa, Homo Sapiens
AFLPSLNLT

SEQ ID NO: 1169461 - protein, 9 aa, Homo Sapiens
RCWGSYAAW

SEQ ID NO: 1169462 - protein, 9 aa, Homo Sapiens
ALSPAPQQV

SEQ ID NO: 1169463 - protein, 9 aa, Homo Sapiens
PQWRKRPVS

SEQ ID NO: 1169464 - protein, 9 aa, Homo Sapiens
VDDEGDRMF

SEQ ID NO: 1169465 - protein, 9 aa, Homo Sapiens
RIQPGGWFE

SEQ ID NO: 1169466 - protein, 9 aa, Homo Sapiens
RSLSCCPRP

SEQ ID NO: 1169467 - protein, 9 aa, Homo Sapiens
PAEPAYPAA

SEQ ID NO: 1169468 - protein, 9 aa, Homo Sapiens
DHVVHTLGA

SEQ ID NO: 1169469 - protein, 9 aa, Homo Sapiens
TWTQFRNYP

SEQ ID NO: 1169470 - protein, 9 aa, Homo Sapiens
GLGTAVPVE

SEQ ID NO: 1169471 - protein, 9 aa, Homo Sapiens
RPPCPPGRG

SEQ ID NO: 1169472 - protein, 9 aa, Homo Sapiens
PAGWGPPAR

SEQ ID NO: 1169473 - protein, 9 aa, Homo Sapiens
WDHEAIEAN

SEQ ID NO: 1169474 - protein, 9 aa, Homo Sapiens
RRLRYKGGT

SEQ ID NO: 1169475 - protein, 9 aa, Homo Sapiens
RPFECFFLW

SEQ ID NO: 1169476 - protein, 9 aa, Homo Sapiens
ELDGRRIWV

SEQ ID NO: 1169477 - protein, 9 aa, Homo Sapiens
YIEVICQNL

SEQ ID NO: 1169478 - protein, 9 aa, Homo Sapiens
KLVRICKED

SEQ ID NO: 1169479 - protein, 9 aa, Homo Sapiens
EPSSACLPS

SEQ ID NO: 1169480 - protein, 9 aa, Homo Sapiens
GPRPRCRPH

SEQ ID NO: 1169481 - protein, 9 aa, Homo Sapiens
RFKTAPMKM

SEQ ID NO: 1169482 - protein, 9 aa, Homo Sapiens
RWLNENYMG

SEQ ID NO: 1169483 - protein, 9 aa, Homo Sapiens
MEAGQQHPL

SEQ ID NO: 1169484 - protein, 9 aa, Homo Sapiens
DVEQVLVDA

SEQ ID NO: 1169485 - protein, 9 aa, Homo Sapiens
VPQLLLAHA

SEQ ID NO: 1169486 - protein, 9 aa, Homo Sapiens
APVDFDYVG

SEQ ID NO: 1169487 - protein, 9 aa, Homo Sapiens
EGFGGRRQC

SEQ ID NO: 1169488 - protein, 9 aa, Homo Sapiens
GNDGRTRSS

SEQ ID NO: 1169489 - protein, 9 aa, Homo Sapiens
RTTEYYPND

SEQ ID NO: 1169490 - protein, 9 aa, Homo Sapiens
CARGRHAHH

SEQ ID NO: 1169491 - protein, 9 aa, Homo Sapiens
RSPDTRACN

SEQ ID NO: 1169492 - protein, 9 aa, Homo Sapiens
SSCSARWCL

SEQ ID NO: 1169493 - protein, 9 aa, Homo Sapiens
DAVTQRPPV

SEQ ID NO: 1169494 - protein, 9 aa, Homo Sapiens
SLFYYKLAG

SEQ ID NO: 1169495 - protein, 9 aa, Homo Sapiens
LSVPPGIRW

SEQ ID NO: 1169496 - protein, 9 aa, Homo Sapiens
GKSSQDLQV

SEQ ID NO: 1169497 - protein, 9 aa, Homo Sapiens
SPPQAAGAE

SEQ ID NO: 1169498 - protein, 9 aa, Homo Sapiens
HAMKYPLPL

SEQ ID NO: 1169499 - protein, 9 aa, Homo Sapiens
EVVTFDYQS

SEQ ID NO: 1169500 - protein, 9 aa, Homo Sapiens
EEAPANDAD

SEQ ID NO: 1169501 - protein, 9 aa, Homo Sapiens
GLVCHERHR

SEQ ID NO: 1169502 - protein, 9 aa, Homo Sapiens
QSSELRTYL

SEQ ID NO: 1169503 - protein, 9 aa, Homo Sapiens
ATAWTSWPT

SEQ ID NO: 1169504 - protein, 9 aa, Homo Sapiens
SSCFFLVYS

SEQ ID NO: 1169505 - protein, 9 aa, Homo Sapiens
IKKALNYSA

SEQ ID NO: 1169506 - protein, 9 aa, Homo Sapiens
YTKPYLKSK

SEQ ID NO: 1169507 - protein, 9 aa, Homo Sapiens
RPWLEQMLH

SEQ ID NO: 1169508 - protein, 9 aa, Homo Sapiens
SPTSGHDRR

SEQ ID NO: 1169509 - protein, 9 aa, Homo Sapiens
DLGVSTQES

SEQ ID NO: 1169510 - protein, 9 aa, Homo Sapiens
QVAMLPKLL

SEQ ID NO: 1169511 - protein, 9 aa, Homo Sapiens
VIKNVWLAE

SEQ ID NO: 1169512 - protein, 9 aa, Homo Sapiens
HTSTHDKAI

SEQ ID NO: 1169513 - protein, 9 aa, Homo Sapiens
DVDIRKDLC

SEQ ID NO: 1169514 - protein, 9 aa, Homo Sapiens
KFKLEDHMD

SEQ ID NO: 1169515 - protein, 9 aa, Homo Sapiens
HRTRAVFNH

SEQ ID NO: 1169516 - protein, 9 aa, Homo Sapiens
LTWLIGGGG

SEQ ID NO: 1169517 - protein, 9 aa, Homo Sapiens
VRICQTVGV

SEQ ID NO: 1169518 - protein, 9 aa, Homo Sapiens
KRYAYRFDS

SEQ ID NO: 1169519 - protein, 9 aa, Homo Sapiens
SHLVQGNED

SEQ ID NO: 1169520 - protein, 9 aa, Homo Sapiens
QFKRTRTRI

SEQ ID NO: 1169521 - protein, 9 aa, Homo Sapiens
HTAVGTKYR

SEQ ID NO: 1169522 - protein, 9 aa, Homo Sapiens
HVGKNTHKV

SEQ ID NO: 1169523 - protein, 9 aa, Homo Sapiens
PPGTTPPGR

SEQ ID NO: 1169524 - protein, 9 aa, Homo Sapiens
IVREVPLTI

SEQ ID NO: 1169525 - protein, 9 aa, Homo Sapiens
PACTSKAWT

SEQ ID NO: 1169526 - protein, 9 aa, Homo Sapiens
WPGGPADRE

SEQ ID NO: 1169527 - protein, 9 aa, Homo Sapiens
VLYAMAASV

SEQ ID NO: 1169528 - protein, 9 aa, Homo Sapiens
FHTDRHTGF

SEQ ID NO: 1169529 - protein, 9 aa, Homo Sapiens
NHHQQQQQQ

SEQ ID NO: 1169530 - protein, 9 aa, Homo Sapiens
VGIIASTTL

SEQ ID NO: 1169531 - protein, 9 aa, Homo Sapiens
IKLWATGGN

SEQ ID NO: 1169532 - protein, 9 aa, Homo Sapiens
RPSGFPGGG

SEQ ID NO: 1169533 - protein, 9 aa, Homo Sapiens
GEKPYQCDC

SEQ ID NO: 1169534 - protein, 9 aa, Homo Sapiens
AATPVARGP

SEQ ID NO: 1169535 - protein, 9 aa, Homo Sapiens
ASSAASACS

SEQ ID NO: 1169536 - protein, 9 aa, Homo Sapiens
GHTWAYREE

SEQ ID NO: 1169537 - protein, 9 aa, Homo Sapiens
SVKSITAML

SEQ ID NO: 1169538 - protein, 9 aa, Homo Sapiens
ASVKKDILV

SEQ ID NO: 1169539 - protein, 9 aa, Homo Sapiens
LLNGPPIMK

SEQ ID NO: 1169540 - protein, 9 aa, Homo Sapiens
LSQPQHRVL

SEQ ID NO: 1169541 - protein, 9 aa, Homo Sapiens
CWWHWLITW

SEQ ID NO: 1169542 - protein, 9 aa, Homo Sapiens
EAVAVRPRP

SEQ ID NO: 1169543 - protein, 9 aa, Homo Sapiens
TIEVGTGAG

SEQ ID NO: 1169544 - protein, 9 aa, Homo Sapiens
FAQQRYEDL

SEQ ID NO: 1169545 - protein, 9 aa, Homo Sapiens
ACQGGFMAA

SEQ ID NO: 1169546 - protein, 9 aa, Homo Sapiens
SCRSLAMAR

SEQ ID NO: 1169547 - protein, 9 aa, Homo Sapiens
DEHNRSIHT

SEQ ID NO: 1169548 - protein, 9 aa, Homo Sapiens
SKDAGCAIG

SEQ ID NO: 1169549 - protein, 9 aa, Homo Sapiens
LYWASGKFE

SEQ ID NO: 1169550 - protein, 9 aa, Homo Sapiens
KLHVAPMGE

SEQ ID NO: 1169551 - protein, 9 aa, Homo Sapiens
AGPRLSIRR

SEQ ID NO: 1169552 - protein, 9 aa, Homo Sapiens
RITQQLERE

SEQ ID NO: 1169553 - protein, 9 aa, Homo Sapiens
FVVINIQNK

SEQ ID NO: 1169554 - protein, 9 aa, Homo Sapiens
MLSVKKKSA

SEQ ID NO: 1169555 - protein, 9 aa, Homo Sapiens
SAPTWGCLC

SEQ ID NO: 1169556 - protein, 9 aa, Homo Sapiens
LNLITNLSG

SEQ ID NO: 1169557 - protein, 9 aa, Homo Sapiens
VSLIESELY

SEQ ID NO: 1169558 - protein, 9 aa, Homo Sapiens
GQHPEVPPP

SEQ ID NO: 1169559 - protein, 9 aa, Homo Sapiens
GEKKNALTQ

SEQ ID NO: 1169560 - protein, 9 aa, Homo Sapiens
RICAFLLWK

SEQ ID NO: 1169561 - protein, 9 aa, Homo Sapiens
SINIFTKIW

SEQ ID NO: 1169562 - protein, 9 aa, Homo Sapiens
ALLLSLGPC

SEQ ID NO: 1169563 - protein, 9 aa, Homo Sapiens
KILSGKRSL

SEQ ID NO: 1169564 - protein, 9 aa, Homo Sapiens
KSSLSPPHP

SEQ ID NO: 1169565 - protein, 9 aa, Homo Sapiens
ESEEEEGDV

SEQ ID NO: 1169566 - protein, 9 aa, Homo Sapiens
KAQSENEDV

SEQ ID NO: 1169567 - protein, 9 aa, Homo Sapiens
ALDGGNTAA

SEQ ID NO: 1169568 - protein, 9 aa, Homo Sapiens
CSWAARVTC

SEQ ID NO: 1169569 - protein, 9 aa, Homo Sapiens
VDPHGRCCM

SEQ ID NO: 1169570 - protein, 9 aa, Homo Sapiens
CVASINLST

SEQ ID NO: 1169571 - protein, 9 aa, Homo Sapiens
DVLRFSSTE

SEQ ID NO: 1169572 - protein, 9 aa, Homo Sapiens
GPPAAAGAA

SEQ ID NO: 1169573 - protein, 9 aa, Homo Sapiens
KCGAEILPR

SEQ ID NO: 1169574 - protein, 9 aa, Homo Sapiens
DIRIEHTMA

SEQ ID NO: 1169575 - protein, 9 aa, Homo Sapiens
ELDEVNPCL

SEQ ID NO: 1169576 - protein, 9 aa, Homo Sapiens
LSPKKIRLL

SEQ ID NO: 1169577 - protein, 9 aa, Homo Sapiens
AARGTPAPT

SEQ ID NO: 1169578 - protein, 9 aa, Homo Sapiens
PAYPAAAPE

SEQ ID NO: 1169579 - protein, 9 aa, Homo Sapiens
CLPGLTHPA

SEQ ID NO: 1169580 - protein, 9 aa, Homo Sapiens
KQKKSRKCS

SEQ ID NO: 1169581 - protein, 9 aa, Homo Sapiens
SAASSAASA

SEQ ID NO: 1169582 - protein, 9 aa, Homo Sapiens
LVLLQRQHA

SEQ ID NO: 1169583 - protein, 9 aa, Homo Sapiens
LFFFHSQPT

SEQ ID NO: 1169584 - protein, 9 aa, Homo Sapiens
PSSAASACA

SEQ ID NO: 1169585 - protein, 9 aa, Homo Sapiens
PDHRGGNPR

SEQ ID NO: 1169586 - protein, 9 aa, Homo Sapiens
PLGTTTKEE

SEQ ID NO: 1169587 - protein, 9 aa, Homo Sapiens
RMFWYSMPW

SEQ ID NO: 1169588 - protein, 9 aa, Homo Sapiens
NQGTGLLAA

SEQ ID NO: 1169589 - protein, 9 aa, Homo Sapiens
LDRCCSTPS

SEQ ID NO: 1169590 - protein, 9 aa, Homo Sapiens
LAKLVNKYS

SEQ ID NO: 1169591 - protein, 9 aa, Homo Sapiens
KNIFGSSQN

SEQ ID NO: 1169592 - protein, 9 aa, Homo Sapiens
TTLASPTWR

SEQ ID NO: 1169593 - protein, 9 aa, Homo Sapiens
SIQIFNGLY

SEQ ID NO: 1169594 - protein, 9 aa, Homo Sapiens
IYDDTSAWR

SEQ ID NO: 1169595 - protein, 9 aa, Homo Sapiens
EGDSSWLTS

SEQ ID NO: 1169596 - protein, 9 aa, Homo Sapiens
ASACTMPPL

SEQ ID NO: 1169597 - protein, 9 aa, Homo Sapiens
ITYSHSPPR

SEQ ID NO: 1169598 - protein, 9 aa, Homo Sapiens
ASLICHRRY

SEQ ID NO: 1169599 - protein, 9 aa, Homo Sapiens
GLWCSPRRS

SEQ ID NO: 1169600 - protein, 9 aa, Homo Sapiens
CTVASPPRR

SEQ ID NO: 1169601 - protein, 9 aa, Homo Sapiens
PPALPSRPA

SEQ ID NO: 1169602 - protein, 9 aa, Homo Sapiens
NGVEYYSCV

SEQ ID NO: 1169603 - protein, 9 aa, Homo Sapiens
QRNPTTAWT

SEQ ID NO: 1169604 - protein, 9 aa, Homo Sapiens
PPRGWCSAA

SEQ ID NO: 1169605 - protein, 9 aa, Homo Sapiens
NHGFVVEVS

SEQ ID NO: 1169606 - protein, 9 aa, Homo Sapiens
RERGPPSHC

SEQ ID NO: 1169607 - protein, 9 aa, Homo Sapiens
LEFQLNHML

SEQ ID NO: 1169608 - protein, 9 aa, Homo Sapiens
YHLVWVPTV

SEQ ID NO: 1169609 - protein, 9 aa, Homo Sapiens
QPAHAEPAS

SEQ ID NO: 1169610 - protein, 9 aa, Homo Sapiens
PLTLSALPL

SEQ ID NO: 1169611 - protein, 9 aa, Homo Sapiens
ACEQQKIRQ

SEQ ID NO: 1169612 - protein, 9 aa, Homo Sapiens
AQKNIDWET

SEQ ID NO: 1169613 - protein, 9 aa, Homo Sapiens
DLWSRISHL

SEQ ID NO: 1169614 - protein, 9 aa, Homo Sapiens
SDLGGPCPQ

SEQ ID NO: 1169615 - protein, 9 aa, Homo Sapiens
YCDILECDE

SEQ ID NO: 1169616 - protein, 9 aa, Homo Sapiens
RQRAPRSLH

SEQ ID NO: 1169617 - protein, 9 aa, Homo Sapiens
RVTSGLFFA

SEQ ID NO: 1169618 - protein, 9 aa, Homo Sapiens
FTDAPAKMS

SEQ ID NO: 1169619 - protein, 9 aa, Homo Sapiens
NVLRPPAYI

SEQ ID NO: 1169620 - protein, 9 aa, Homo Sapiens
TLQVQEVLS

SEQ ID NO: 1169621 - protein, 9 aa, Homo Sapiens
PVACPDDQG

SEQ ID NO: 1169622 - protein, 9 aa, Homo Sapiens
LQCQYRSPR

SEQ ID NO: 1169623 - protein, 9 aa, Homo Sapiens
PSWCPCPPG

SEQ ID NO: 1169624 - protein, 9 aa, Homo Sapiens
CSPHNLNAN

SEQ ID NO: 1169625 - protein, 9 aa, Homo Sapiens
EFVCHWGAA

SEQ ID NO: 1169626 - protein, 9 aa, Homo Sapiens
LLLCYLNVI

SEQ ID NO: 1169627 - protein, 9 aa, Homo Sapiens
QVQEPVGSQ

SEQ ID NO: 1169628 - protein, 9 aa, Homo Sapiens
DGQIPCLFV

SEQ ID NO: 1169629 - protein, 9 aa, Homo Sapiens
WYASLPSPS

SEQ ID NO: 1169630 - protein, 9 aa, Homo Sapiens
DPRISPSLA

SEQ ID NO: 1169631 - protein, 9 aa, Homo Sapiens
SPGRAEARL

SEQ ID NO: 1169632 - protein, 9 aa, Homo Sapiens
NRSLFMGLR

SEQ ID NO: 1169633 - protein, 9 aa, Homo Sapiens
DCQPGTGFF

SEQ ID NO: 1169634 - protein, 9 aa, Homo Sapiens
LPFVNKAGD

SEQ ID NO: 1169635 - protein, 9 aa, Homo Sapiens
SQTHHSTPF

SEQ ID NO: 1169636 - protein, 9 aa, Homo Sapiens
TPMVRQAAA

SEQ ID NO: 1169637 - protein, 9 aa, Homo Sapiens
PTTCSRWAS

SEQ ID NO: 1169638 - protein, 9 aa, Homo Sapiens
RAVGQRLSA

SEQ ID NO: 1169639 - protein, 9 aa, Homo Sapiens
AGFDIEQLI

SEQ ID NO: 1169640 - protein, 9 aa, Homo Sapiens
QSLTGAHAC

SEQ ID NO: 1169641 - protein, 9 aa, Homo Sapiens
VLVKEKEMV

SEQ ID NO: 1169642 - protein, 9 aa, Homo Sapiens
ESTLHALRL

SEQ ID NO: 1169643 - protein, 9 aa, Homo Sapiens
QSAREKGLK

SEQ ID NO: 1169644 - protein, 9 aa, Homo Sapiens
GIWPAGLQS

SEQ ID NO: 1169645 - protein, 9 aa, Homo Sapiens
RRASRAGTT

SEQ ID NO: 1169646 - protein, 9 aa, Homo Sapiens
RQMLPTLST

SEQ ID NO: 1169647 - protein, 9 aa, Homo Sapiens
RHHCPPGGH

SEQ ID NO: 1169648 - protein, 9 aa, Homo Sapiens
AAGVTVHLR

SEQ ID NO: 1169649 - protein, 9 aa, Homo Sapiens
RASQTQNCG

SEQ ID NO: 1169650 - protein, 9 aa, Homo Sapiens
TWLQGGTRV

SEQ ID NO: 1169651 - protein, 9 aa, Homo Sapiens
CYAIRVATT

SEQ ID NO: 1169652 - protein, 9 aa, Homo Sapiens
ITFLTQRQD

SEQ ID NO: 1169653 - protein, 9 aa, Homo Sapiens
SRESPSSHG

SEQ ID NO: 1169654 - protein, 9 aa, Homo Sapiens
EYIECLVWR

SEQ ID NO: 1169655 - protein, 9 aa, Homo Sapiens
TAQASCWTS

SEQ ID NO: 1169656 - protein, 9 aa, Homo Sapiens
LPDARVAGG

SEQ ID NO: 1169657 - protein, 9 aa, Homo Sapiens
QAHFNPQRR

SEQ ID NO: 1169658 - protein, 9 aa, Homo Sapiens
PPPAPCSWP

SEQ ID NO: 1169659 - protein, 9 aa, Homo Sapiens
FLRLCNFRN

SEQ ID NO: 1169660 - protein, 9 aa, Homo Sapiens
PTTPLSHSA

SEQ ID NO: 1169661 - protein, 9 aa, Homo Sapiens
INSTGEHTE

SEQ ID NO: 1169662 - protein, 9 aa, Homo Sapiens
RMKLRSWLR

SEQ ID NO: 1169663 - protein, 9 aa, Homo Sapiens
KDQWRLRKF

SEQ ID NO: 1169664 - protein, 9 aa, Homo Sapiens
TSAWKNSWI

SEQ ID NO: 1169665 - protein, 9 aa, Homo Sapiens
RSCSGLVRD

SEQ ID NO: 1169666 - protein, 9 aa, Homo Sapiens
PCRVIRLHQ

SEQ ID NO: 1169667 - protein, 9 aa, Homo Sapiens
CPSSPPQGA

SEQ ID NO: 1169668 - protein, 9 aa, Homo Sapiens
TLSNYYVGS

SEQ ID NO: 1169669 - protein, 9 aa, Homo Sapiens
MTSWRPGLK

SEQ ID NO: 1169670 - protein, 9 aa, Homo Sapiens
SCAPRPPSA

SEQ ID NO: 1169671 - protein, 9 aa, Homo Sapiens
AAPPAARSH

SEQ ID NO: 1169672 - protein, 9 aa, Homo Sapiens
NIFTKIWRW

SEQ ID NO: 1169673 - protein, 9 aa, Homo Sapiens
DPDAVVASS

SEQ ID NO: 1169674 - protein, 9 aa, Homo Sapiens
SGILARSPD

SEQ ID NO: 1169675 - protein, 9 aa, Homo Sapiens
RSPRSCSPA

SEQ ID NO: 1169676 - protein, 9 aa, Homo Sapiens
QAIYPHVLV

SEQ ID NO: 1169677 - protein, 9 aa, Homo Sapiens
NKLVRHTEK

SEQ ID NO: 1169678 - protein, 9 aa, Homo Sapiens
LFPRALPVQ

SEQ ID NO: 1169679 - protein, 9 aa, Homo Sapiens
LAACCGGKR

SEQ ID NO: 1169680 - protein, 9 aa, Homo Sapiens
VGGRGRGQP

SEQ ID NO: 1169681 - protein, 9 aa, Homo Sapiens
EGCISVKDH

SEQ ID NO: 1169682 - protein, 9 aa, Homo Sapiens
TSASTQARS

SEQ ID NO: 1169683 - protein, 9 aa, Homo Sapiens
FMLFLVMCI

SEQ ID NO: 1169684 - protein, 9 aa, Homo Sapiens
LPPPPVTAW

SEQ ID NO: 1169685 - protein, 9 aa, Homo Sapiens
MQLGGRLVL

SEQ ID NO: 1169686 - protein, 9 aa, Homo Sapiens
SPRAGSRRC

SEQ ID NO: 1169687 - protein, 9 aa, Homo Sapiens
WFAYHFFCH

SEQ ID NO: 1169688 - protein, 9 aa, Homo Sapiens
EAALRPSTS

SEQ ID NO: 1169689 - protein, 9 aa, Homo Sapiens
RGIRACRRR

SEQ ID NO: 1169690 - protein, 9 aa, Homo Sapiens
EVLQAREGP

SEQ ID NO: 1169691 - protein, 9 aa, Homo Sapiens
EALPTRGAG

SEQ ID NO: 1169692 - protein, 9 aa, Homo Sapiens
VLLAHRLRC

SEQ ID NO: 1169693 - protein, 9 aa, Homo Sapiens
DLRYETLSP

SEQ ID NO: 1169694 - protein, 9 aa, Homo Sapiens
TPLQTSTGG

SEQ ID NO: 1169695 - protein, 9 aa, Homo Sapiens
CVIPHGQHT

SEQ ID NO: 1169696 - protein, 9 aa, Homo Sapiens
VKGRLVLLI

SEQ ID NO: 1169697 - protein, 9 aa, Homo Sapiens
GAASAYAPP

SEQ ID NO: 1169698 - protein, 9 aa, Homo Sapiens
KLVRFYPAR

SEQ ID NO: 1169699 - protein, 9 aa, Homo Sapiens
NGRAPGRGR

SEQ ID NO: 1169700 - protein, 9 aa, Homo Sapiens
PPTPSRLRS

SEQ ID NO: 1169701 - protein, 9 aa, Homo Sapiens
GSRSLFFCG

SEQ ID NO: 1169702 - protein, 9 aa, Homo Sapiens
ANARRSPRS

SEQ ID NO: 1169703 - protein, 9 aa, Homo Sapiens
PSWATRQLW

SEQ ID NO: 1169704 - protein, 9 aa, Homo Sapiens
PGGRRGVLL

SEQ ID NO: 1169705 - protein, 9 aa, Homo Sapiens
AKPQLGLSI

SEQ ID NO: 1169706 - protein, 9 aa, Homo Sapiens
SQLHHGGRQ

SEQ ID NO: 1169707 - protein, 9 aa, Homo Sapiens
WKTKKSPSR

SEQ ID NO: 1169708 - protein, 9 aa, Homo Sapiens
RQLASQSRG

SEQ ID NO: 1169709 - protein, 9 aa, Homo Sapiens
GQSATRLYC

SEQ ID NO: 1169710 - protein, 9 aa, Homo Sapiens
SRDRDPVSE

SEQ ID NO: 1169711 - protein, 9 aa, Homo Sapiens
QLADQNRKD

SEQ ID NO: 1169712 - protein, 9 aa, Homo Sapiens
AGERALTRV

SEQ ID NO: 1169713 - protein, 9 aa, Homo Sapiens
MKGYSKLGV

SEQ ID NO: 1169714 - protein, 9 aa, Homo Sapiens
PSTNNTMLW

SEQ ID NO: 1169715 - protein, 9 aa, Homo Sapiens
MTLLHTQSL

SEQ ID NO: 1169716 - protein, 9 aa, Homo Sapiens
LSVLLPAAP

SEQ ID NO: 1169717 - protein, 9 aa, Homo Sapiens
RSPDHRGGN

SEQ ID NO: 1169718 - protein, 9 aa, Homo Sapiens
QDSRVRVGY

SEQ ID NO: 1169719 - protein, 9 aa, Homo Sapiens
QLEQAYIRG

SEQ ID NO: 1169720 - protein, 9 aa, Homo Sapiens
SVSPPQAAG

SEQ ID NO: 1169721 - protein, 9 aa, Homo Sapiens
IRACRRRMA

SEQ ID NO: 1169722 - protein, 9 aa, Homo Sapiens
AAPGVQHPA

SEQ ID NO: 1169723 - protein, 9 aa, Homo Sapiens
VYILITSCD

SEQ ID NO: 1169724 - protein, 9 aa, Homo Sapiens
SGCSSASAR

SEQ ID NO: 1169725 - protein, 9 aa, Homo Sapiens
LSILTETAS

SEQ ID NO: 1169726 - protein, 9 aa, Homo Sapiens
PALVAPRGL

SEQ ID NO: 1169727 - protein, 9 aa, Homo Sapiens
WSRWLIAFW

SEQ ID NO: 1169728 - protein, 9 aa, Homo Sapiens
PVEKSSEFL

SEQ ID NO: 1169729 - protein, 9 aa, Homo Sapiens
RFWHIWHNI

SEQ ID NO: 1169730 - protein, 9 aa, Homo Sapiens
APTIMPLLQ

SEQ ID NO: 1169731 - protein, 9 aa, Homo Sapiens
EGALRSAKS

SEQ ID NO: 1169732 - protein, 9 aa, Homo Sapiens
WHPGSWPVA

SEQ ID NO: 1169733 - protein, 9 aa, Homo Sapiens
HLTLLAMYN

SEQ ID NO: 1169734 - protein, 9 aa, Homo Sapiens
WLKDNSELP

SEQ ID NO: 1169735 - protein, 9 aa, Homo Sapiens
SASTRRQLS

SEQ ID NO: 1169736 - protein, 9 aa, Homo Sapiens
APCVARTSA

SEQ ID NO: 1169737 - protein, 9 aa, Homo Sapiens
CGPQKINCP

SEQ ID NO: 1169738 - protein, 9 aa, Homo Sapiens
TGHAPRLWL

SEQ ID NO: 1169739 - protein, 9 aa, Homo Sapiens
TYVWPGGPA

SEQ ID NO: 1169740 - protein, 9 aa, Homo Sapiens
TGGVTTNIH

SEQ ID NO: 1169741 - protein, 9 aa, Homo Sapiens
PRTKPAMGL

SEQ ID NO: 1169742 - protein, 9 aa, Homo Sapiens
SCHLRMSVG

SEQ ID NO: 1169743 - protein, 9 aa, Homo Sapiens
AGLELVVLA

SEQ ID NO: 1169744 - protein, 9 aa, Homo Sapiens
APPGAHYQQ

SEQ ID NO: 1169745 - protein, 9 aa, Homo Sapiens
KVPLLEPLV

SEQ ID NO: 1169746 - protein, 9 aa, Homo Sapiens
PHPVLLSIP

SEQ ID NO: 1169747 - protein, 9 aa, Homo Sapiens
RMGPLSVPP

SEQ ID NO: 1169748 - protein, 9 aa, Homo Sapiens
TPADSSALY

SEQ ID NO: 1169749 - protein, 9 aa, Homo Sapiens
QATWVRDMV

SEQ ID NO: 1169750 - protein, 9 aa, Homo Sapiens
ALSLSCSCS

SEQ ID NO: 1169751 - protein, 9 aa, Homo Sapiens
REPSQRAAA

SEQ ID NO: 1169752 - protein, 9 aa, Homo Sapiens
RWCQGAWCF

SEQ ID NO: 1169753 - protein, 9 aa, Homo Sapiens
PASGSTSRR

SEQ ID NO: 1169754 - protein, 9 aa, Homo Sapiens
RRLGGEQRK

SEQ ID NO: 1169755 - protein, 9 aa, Homo Sapiens
KNHGLEATP

SEQ ID NO: 1169756 - protein, 9 aa, Homo Sapiens
DAVCNALAG

SEQ ID NO: 1169757 - protein, 9 aa, Homo Sapiens
DAQENVLVS

SEQ ID NO: 1169758 - protein, 9 aa, Homo Sapiens
ALVGLLGCS

SEQ ID NO: 1169759 - protein, 9 aa, Homo Sapiens
LTAVVQRTT

SEQ ID NO: 1169760 - protein, 9 aa, Homo Sapiens
VEEYYRNHV

SEQ ID NO: 1169761 - protein, 9 aa, Homo Sapiens
RPSLHRYLS

SEQ ID NO: 1169762 - protein, 9 aa, Homo Sapiens
FLMCAPKHA

SEQ ID NO: 1169763 - protein, 9 aa, Homo Sapiens
MALNGKPTP

SEQ ID NO: 1169764 - protein, 9 aa, Homo Sapiens
SCWTSHWPT

SEQ ID NO: 1169765 - protein, 9 aa, Homo Sapiens
NPPLRFNLI

SEQ ID NO: 1169766 - protein, 9 aa, Homo Sapiens
ASEAGGPVR

SEQ ID NO: 1169767 - protein, 9 aa, Homo Sapiens
MGRCSCGQG

SEQ ID NO: 1169768 - protein, 9 aa, Homo Sapiens
PVRRFQKPL

SEQ ID NO: 1169769 - protein, 9 aa, Homo Sapiens
KKTPKRVTF

SEQ ID NO: 1169770 - protein, 9 aa, Homo Sapiens
QVWVLPPVP

SEQ ID NO: 1169771 - protein, 9 aa, Homo Sapiens
KSSQDLQVE

SEQ ID NO: 1169772 - protein, 9 aa, Homo Sapiens
AWTPRKLVG

SEQ ID NO: 1169773 - protein, 9 aa, Homo Sapiens
ATWAFGTPS

SEQ ID NO: 1169774 - protein, 9 aa, Homo Sapiens
VLPHIYPLC

SEQ ID NO: 1169775 - protein, 9 aa, Homo Sapiens
HRLSPSTST

SEQ ID NO: 1169776 - protein, 9 aa, Homo Sapiens
GKFLGLWAY

SEQ ID NO: 1169777 - protein, 9 aa, Homo Sapiens
IFIIIHRST

SEQ ID NO: 1169778 - protein, 9 aa, Homo Sapiens
GRRGSRACR

SEQ ID NO: 1169779 - protein, 9 aa, Homo Sapiens
TAWSWAAGP

SEQ ID NO: 1169780 - protein, 9 aa, Homo Sapiens
VWSPGLPPN

SEQ ID NO: 1169781 - protein, 9 aa, Homo Sapiens
RSAWGDWVA

SEQ ID NO: 1169782 - protein, 9 aa, Homo Sapiens
MACAGLFTV

SEQ ID NO: 1169783 - protein, 9 aa, Homo Sapiens
AQARVGQRA

SEQ ID NO: 1169784 - protein, 9 aa, Homo Sapiens
RWAVFDEYN

SEQ ID NO: 1169785 - protein, 9 aa, Homo Sapiens
ENVDGIHEF

SEQ ID NO: 1169786 - protein, 9 aa, Homo Sapiens
GALHRLSPS

SEQ ID NO: 1169787 - protein, 9 aa, Homo Sapiens
LRAPGPPST

SEQ ID NO: 1169788 - protein, 9 aa, Homo Sapiens
AQRADSGHY

SEQ ID NO: 1169789 - protein, 9 aa, Homo Sapiens
RYCFQHILL

SEQ ID NO: 1169790 - protein, 9 aa, Homo Sapiens
RVRGLLRII

SEQ ID NO: 1169791 - protein, 9 aa, Homo Sapiens
RTREEPCGL

SEQ ID NO: 1169792 - protein, 9 aa, Homo Sapiens
NAFLGCPKE

SEQ ID NO: 1169793 - protein, 9 aa, Homo Sapiens
RTLPPGTRP

SEQ ID NO: 1169794 - protein, 9 aa, Homo Sapiens
IVVPRGSDN

SEQ ID NO: 1169795 - protein, 9 aa, Homo Sapiens
RLLSLGAHA

SEQ ID NO: 1169796 - protein, 9 aa, Homo Sapiens
RPRRAPRRR

SEQ ID NO: 1169797 - protein, 9 aa, Homo Sapiens
PQAIPRSPC

SEQ ID NO: 1169798 - protein, 9 aa, Homo Sapiens
CCSSLSLRV

SEQ ID NO: 1169799 - protein, 9 aa, Homo Sapiens
TIHAGFDAV

SEQ ID NO: 1169800 - protein, 9 aa, Homo Sapiens
INWNQVAVI

SEQ ID NO: 1169801 - protein, 9 aa, Homo Sapiens
VAGIGKSML

SEQ ID NO: 1169802 - protein, 9 aa, Homo Sapiens
NGSGADHIY

SEQ ID NO: 1169803 - protein, 9 aa, Homo Sapiens
VPPVNQMVK

SEQ ID NO: 1169804 - protein, 9 aa, Homo Sapiens
LGTAAAEAS

SEQ ID NO: 1169805 - protein, 9 aa, Homo Sapiens
FMEAKPWLA

SEQ ID NO: 1169806 - protein, 9 aa, Homo Sapiens
IEQLIHSPQ

SEQ ID NO: 1169807 - protein, 9 aa, Homo Sapiens
WLSPPLGLH

SEQ ID NO: 1169808 - protein, 9 aa, Homo Sapiens
RVSLLNTTK

SEQ ID NO: 1169809 - protein, 9 aa, Homo Sapiens
NCTLENEDV

SEQ ID NO: 1169810 - protein, 9 aa, Homo Sapiens
TTCTHRSPS

SEQ ID NO: 1169811 - protein, 9 aa, Homo Sapiens
GAAAKRYAC

SEQ ID NO: 1169812 - protein, 9 aa, Homo Sapiens
PPLRFNLIL

SEQ ID NO: 1169813 - protein, 9 aa, Homo Sapiens
LVVASLCIL

SEQ ID NO: 1169814 - protein, 9 aa, Homo Sapiens
AIDGAEPSK

SEQ ID NO: 1169815 - protein, 9 aa, Homo Sapiens
VVQTGQDLK

SEQ ID NO: 1169816 - protein, 9 aa, Homo Sapiens
TLKVVQTGQ

SEQ ID NO: 1169817 - protein, 9 aa, Homo Sapiens
RHLLAWDLD

SEQ ID NO: 1169818 - protein, 9 aa, Homo Sapiens
RVGETRALR

SEQ ID NO: 1169819 - protein, 9 aa, Homo Sapiens
EIQVWPAYL

SEQ ID NO: 1169820 - protein, 9 aa, Homo Sapiens
PKNYLRLTI

SEQ ID NO: 1169821 - protein, 9 aa, Homo Sapiens
HMKCFLNLS

SEQ ID NO: 1169822 - protein, 9 aa, Homo Sapiens
LNYQTQVCE

SEQ ID NO: 1169823 - protein, 9 aa, Homo Sapiens
RAEKPTAAL

SEQ ID NO: 1169824 - protein, 9 aa, Homo Sapiens
ALWAPLHHS

SEQ ID NO: 1169825 - protein, 9 aa, Homo Sapiens
LPDLPSQRG

SEQ ID NO: 1169826 - protein, 9 aa, Homo Sapiens
QRSGSLLCT

SEQ ID NO: 1169827 - protein, 9 aa, Homo Sapiens
YHWAMSFLG

SEQ ID NO: 1169828 - protein, 9 aa, Homo Sapiens
CLREAVLLG

SEQ ID NO: 1169829 - protein, 9 aa, Homo Sapiens
VPCWPPCSW

SEQ ID NO: 1169830 - protein, 9 aa, Homo Sapiens
RGIPRSTCG

SEQ ID NO: 1169831 - protein, 9 aa, Homo Sapiens
SVPKNPSQL

SEQ ID NO: 1169832 - protein, 9 aa, Homo Sapiens
RRWGAWHPG

SEQ ID NO: 1169833 - protein, 9 aa, Homo Sapiens
TAVHFAASR

SEQ ID NO: 1169834 - protein, 9 aa, Homo Sapiens
DCFFCGPCM

SEQ ID NO: 1169835 - protein, 9 aa, Homo Sapiens
STVLDCGPQ

SEQ ID NO: 1169836 - protein, 9 aa, Homo Sapiens
GRAGDKGFL

SEQ ID NO: 1169837 - protein, 9 aa, Homo Sapiens
VVSENEAEL

SEQ ID NO: 1169838 - protein, 9 aa, Homo Sapiens
LSHIVPREP

SEQ ID NO: 1169839 - protein, 9 aa, Homo Sapiens
INICTLLSN

SEQ ID NO: 1169840 - protein, 9 aa, Homo Sapiens
LETYASPPG

SEQ ID NO: 1169841 - protein, 9 aa, Homo Sapiens
SRTLYHIEL

SEQ ID NO: 1169842 - protein, 9 aa, Homo Sapiens
CTEWAGFLN

SEQ ID NO: 1169843 - protein, 9 aa, Homo Sapiens
QMAIEERKQ

SEQ ID NO: 1169844 - protein, 9 aa, Homo Sapiens
PAPRPPAPR

SEQ ID NO: 1169845 - protein, 9 aa, Homo Sapiens
SLIFSVFVT

SEQ ID NO: 1169846 - protein, 9 aa, Homo Sapiens
TTRLMAPVG

SEQ ID NO: 1169847 - protein, 9 aa, Homo Sapiens
CPAFVAFTL

SEQ ID NO: 1169848 - protein, 9 aa, Homo Sapiens
WRNMNTVKG

SEQ ID NO: 1169849 - protein, 9 aa, Homo Sapiens
WRLRKFKMR

SEQ ID NO: 1169850 - protein, 9 aa, Homo Sapiens
GRLLGLHLH

SEQ ID NO: 1169851 - protein, 9 aa, Homo Sapiens
HCGKVSTST

SEQ ID NO: 1169852 - protein, 9 aa, Homo Sapiens
ASSWYASLP

SEQ ID NO: 1169853 - protein, 9 aa, Homo Sapiens
NFNRDPLPP

SEQ ID NO: 1169854 - protein, 9 aa, Homo Sapiens
MVRSMDRKS

SEQ ID NO: 1169855 - protein, 9 aa, Homo Sapiens
EFTTFVKTL

SEQ ID NO: 1169856 - protein, 9 aa, Homo Sapiens
FCGPCMLCF

SEQ ID NO: 1169857 - protein, 9 aa, Homo Sapiens
ALLARVRPV

SEQ ID NO: 1169858 - protein, 9 aa, Homo Sapiens
RRGHAQHPR

SEQ ID NO: 1169859 - protein, 9 aa, Homo Sapiens
RRLVIGFGA

SEQ ID NO: 1169860 - protein, 9 aa, Homo Sapiens
LRVHIAHGR

SEQ ID NO: 1169861 - protein, 9 aa, Homo Sapiens
HLPRLKDGV

SEQ ID NO: 1169862 - protein, 9 aa, Homo Sapiens
LCSTTCTHR

SEQ ID NO: 1169863 - protein, 9 aa, Homo Sapiens
ECTQLLPAL

SEQ ID NO: 1169864 - protein, 9 aa, Homo Sapiens
FRIASSVSP

SEQ ID NO: 1169865 - protein, 9 aa, Homo Sapiens
ELPESEFVP

SEQ ID NO: 1169866 - protein, 9 aa, Homo Sapiens
FSQSVVEVY

SEQ ID NO: 1169867 - protein, 9 aa, Homo Sapiens
PRPGRLLGA

SEQ ID NO: 1169868 - protein, 9 aa, Homo Sapiens
LQSNQNMRG

SEQ ID NO: 1169869 - protein, 9 aa, Homo Sapiens
IADFGFVRY

SEQ ID NO: 1169870 - protein, 9 aa, Homo Sapiens
LAAESRPLC

SEQ ID NO: 1169871 - protein, 9 aa, Homo Sapiens
TPDEESINW

SEQ ID NO: 1169872 - protein, 9 aa, Homo Sapiens
MPCTYLQIV

SEQ ID NO: 1169873 - protein, 9 aa, Homo Sapiens
SHPSFLQPS

SEQ ID NO: 1169874 - protein, 9 aa, Homo Sapiens
KSTSEENIE

SEQ ID NO: 1169875 - protein, 9 aa, Homo Sapiens
SRCFVVRDA

SEQ ID NO: 1169876 - protein, 9 aa, Homo Sapiens
TGTIEVGTG

SEQ ID NO: 1169877 - protein, 9 aa, Homo Sapiens
GARVLSKVG

SEQ ID NO: 1169878 - protein, 9 aa, Homo Sapiens
KINCPLMEV

SEQ ID NO: 1169879 - protein, 9 aa, Homo Sapiens
PGGGGVRWG

SEQ ID NO: 1169880 - protein, 9 aa, Homo Sapiens
VNRSLTVQP

SEQ ID NO: 1169881 - protein, 9 aa, Homo Sapiens
LGPLLLLDP

SEQ ID NO: 1169882 - protein, 9 aa, Homo Sapiens
CLQWIIQCF

SEQ ID NO: 1169883 - protein, 9 aa, Homo Sapiens
ACPHGAACP

SEQ ID NO: 1169884 - protein, 9 aa, Homo Sapiens
KGVRMRALY

SEQ ID NO: 1169885 - protein, 9 aa, Homo Sapiens
QEAPSRALR

SEQ ID NO: 1169886 - protein, 9 aa, Homo Sapiens
RLEQNQPEY

SEQ ID NO: 1169887 - protein, 9 aa, Homo Sapiens
TALGRFRSS

SEQ ID NO: 1169888 - protein, 9 aa, Homo Sapiens
SRPGSCISY

SEQ ID NO: 1169889 - protein, 9 aa, Homo Sapiens
RSGCRAPPG

SEQ ID NO: 1169890 - protein, 9 aa, Homo Sapiens
STPTFLARP

SEQ ID NO: 1169891 - protein, 9 aa, Homo Sapiens
ASMSNPYPR

SEQ ID NO: 1169892 - protein, 9 aa, Homo Sapiens
DEESTAWGG

SEQ ID NO: 1169893 - protein, 9 aa, Homo Sapiens
LGRSPPLQS

SEQ ID NO: 1169894 - protein, 9 aa, Homo Sapiens
GAHYQQPGK

SEQ ID NO: 1169895 - protein, 9 aa, Homo Sapiens
RVEASVIKE

SEQ ID NO: 1169896 - protein, 9 aa, Homo Sapiens
SPPTRSSSR

SEQ ID NO: 1169897 - protein, 9 aa, Homo Sapiens
ECSVEFALD

SEQ ID NO: 1169898 - protein, 9 aa, Homo Sapiens
GPAVLEPDL

SEQ ID NO: 1169899 - protein, 9 aa, Homo Sapiens
DHIAALKEM

SEQ ID NO: 1169900 - protein, 9 aa, Homo Sapiens
EYMGQRHRL

SEQ ID NO: 1169901 - protein, 9 aa, Homo Sapiens
LWSWAAMRS

SEQ ID NO: 1169902 - protein, 9 aa, Homo Sapiens
LKKLKTFHM

SEQ ID NO: 1169903 - protein, 9 aa, Homo Sapiens
TRPPAFITT

SEQ ID NO: 1169904 - protein, 9 aa, Homo Sapiens
SPGTALVKL

SEQ ID NO: 1169905 - protein, 9 aa, Homo Sapiens
TQLKWSLVE

SEQ ID NO: 1169906 - protein, 9 aa, Homo Sapiens
RIMEHSWFE

SEQ ID NO: 1169907 - protein, 9 aa, Homo Sapiens
RAQADQSVY

SEQ ID NO: 1169908 - protein, 9 aa, Homo Sapiens
SALWCLFCN

SEQ ID NO: 1169909 - protein, 9 aa, Homo Sapiens
EAETEPHGA

SEQ ID NO: 1169910 - protein, 9 aa, Homo Sapiens
TESSQPRGS

SEQ ID NO: 1169911 - protein, 9 aa, Homo Sapiens
CVYYVDHNT

SEQ ID NO: 1169912 - protein, 9 aa, Homo Sapiens
GQLAGRTAT

SEQ ID NO: 1169913 - protein, 9 aa, Homo Sapiens
SNSSNWKQD

SEQ ID NO: 1169914 - protein, 9 aa, Homo Sapiens
SASDAGVPP

SEQ ID NO: 1169915 - protein, 9 aa, Homo Sapiens
RAGDPATTA

SEQ ID NO: 1169916 - protein, 9 aa, Homo Sapiens
LCSPHNLNA

SEQ ID NO: 1169917 - protein, 9 aa, Homo Sapiens
TVCKRGNLW

SEQ ID NO: 1169918 - protein, 9 aa, Homo Sapiens
PFPPAASRD

SEQ ID NO: 1169919 - protein, 9 aa, Homo Sapiens
VREVPLTIV

SEQ ID NO: 1169920 - protein, 9 aa, Homo Sapiens
TATLGLCIR

SEQ ID NO: 1169921 - protein, 9 aa, Homo Sapiens
SSACTDSWW

SEQ ID NO: 1169922 - protein, 9 aa, Homo Sapiens
NDIEQICSR

SEQ ID NO: 1169923 - protein, 9 aa, Homo Sapiens
SCSSLSSQT

SEQ ID NO: 1169924 - protein, 9 aa, Homo Sapiens
LRFNLILMM

SEQ ID NO: 1169925 - protein, 9 aa, Homo Sapiens
APALGRIGK

SEQ ID NO: 1169926 - protein, 9 aa, Homo Sapiens
SAVTVAVGC

SEQ ID NO: 1169927 - protein, 9 aa, Homo Sapiens
SEHMQHVVQ

SEQ ID NO: 1169928 - protein, 9 aa, Homo Sapiens
APASCTAPR

SEQ ID NO: 1169929 - protein, 9 aa, Homo Sapiens
RSLPGPAPA

SEQ ID NO: 1169930 - protein, 9 aa, Homo Sapiens
SLEMLTPSG

SEQ ID NO: 1169931 - protein, 9 aa, Homo Sapiens
YICEECGKT

SEQ ID NO: 1169932 - protein, 9 aa, Homo Sapiens
ESVELSEPL

SEQ ID NO: 1169933 - protein, 9 aa, Homo Sapiens
CIEYIIGGL

SEQ ID NO: 1169934 - protein, 9 aa, Homo Sapiens
LGGWAKMHR

SEQ ID NO: 1169935 - protein, 9 aa, Homo Sapiens
GYSIQQRAT

SEQ ID NO: 1169936 - protein, 9 aa, Homo Sapiens
PSRPPPPLF

SEQ ID NO: 1169937 - protein, 9 aa, Homo Sapiens
PTAGAARAR

SEQ ID NO: 1169938 - protein, 9 aa, Homo Sapiens
EWASFFMVV

SEQ ID NO: 1169939 - protein, 9 aa, Homo Sapiens
GHDDAPDDQ

SEQ ID NO: 1169940 - protein, 9 aa, Homo Sapiens
LVGARAPWP

SEQ ID NO: 1169941 - protein, 9 aa, Homo Sapiens
LQGFPGPKG

SEQ ID NO: 1169942 - protein, 9 aa, Homo Sapiens
LLTMWTCMD

SEQ ID NO: 1169943 - protein, 9 aa, Homo Sapiens
CPLTSATSC

SEQ ID NO: 1169944 - protein, 9 aa, Homo Sapiens
ATVFRGCMS

SEQ ID NO: 1169945 - protein, 9 aa, Homo Sapiens
PVPPHPGQE

SEQ ID NO: 1169946 - protein, 9 aa, Homo Sapiens
KGHFLSTPR

SEQ ID NO: 1169947 - protein, 9 aa, Homo Sapiens
LMDIGLRQD

SEQ ID NO: 1169948 - protein, 9 aa, Homo Sapiens
LRLTIVSCF

SEQ ID NO: 1169949 - protein, 9 aa, Homo Sapiens
SLRPSSWQE

SEQ ID NO: 1169950 - protein, 9 aa, Homo Sapiens
SGLVRDCGA

SEQ ID NO: 1169951 - protein, 9 aa, Homo Sapiens
PQRVGEKRF

SEQ ID NO: 1169952 - protein, 9 aa, Homo Sapiens
KKSSGASWV

SEQ ID NO: 1169953 - protein, 9 aa, Homo Sapiens
LDNLCCMDP

SEQ ID NO: 1169954 - protein, 9 aa, Homo Sapiens
TAALVRAQA

SEQ ID NO: 1169955 - protein, 9 aa, Homo Sapiens
KEAISASTR

SEQ ID NO: 1169956 - protein, 9 aa, Homo Sapiens
SAGGDASCA

SEQ ID NO: 1169957 - protein, 9 aa, Homo Sapiens
VVDPLRGAM

SEQ ID NO: 1169958 - protein, 9 aa, Homo Sapiens
GGPERGAVG

SEQ ID NO: 1169959 - protein, 9 aa, Homo Sapiens
RFTPEIPAP

SEQ ID NO: 1169960 - protein, 9 aa, Homo Sapiens
LQWIIQCFW

SEQ ID NO: 1169961 - protein, 9 aa, Homo Sapiens
TYTRMVLEL

SEQ ID NO: 1169962 - protein, 9 aa, Homo Sapiens
LYSVKAKTQ

SEQ ID NO: 1169963 - protein, 9 aa, Homo Sapiens
GGGPRPRPP

SEQ ID NO: 1169964 - protein, 9 aa, Homo Sapiens
KGEDIFWTC

SEQ ID NO: 1169965 - protein, 9 aa, Homo Sapiens
CSLQKTGIA

SEQ ID NO: 1169966 - protein, 9 aa, Homo Sapiens
EGTVEGAKR

SEQ ID NO: 1169967 - protein, 9 aa, Homo Sapiens
SISTQLKWS

SEQ ID NO: 1169968 - protein, 9 aa, Homo Sapiens
CEPPCCTTS

SEQ ID NO: 1169969 - protein, 9 aa, Homo Sapiens
WRGLGSINT

SEQ ID NO: 1169970 - protein, 9 aa, Homo Sapiens
PKAETKKGT

SEQ ID NO: 1169971 - protein, 9 aa, Homo Sapiens
SFHLLINSR

SEQ ID NO: 1169972 - protein, 9 aa, Homo Sapiens
YYTFGKECL

SEQ ID NO: 1169973 - protein, 9 aa, Homo Sapiens
LNGKQEKLL

SEQ ID NO: 1169974 - protein, 9 aa, Homo Sapiens
ARKAASVLE

SEQ ID NO: 1169975 - protein, 9 aa, Homo Sapiens
AMAYTEEKA

SEQ ID NO: 1169976 - protein, 9 aa, Homo Sapiens
GVRKPLGPR

SEQ ID NO: 1169977 - protein, 9 aa, Homo Sapiens
SAAGAQHEA

SEQ ID NO: 1169978 - protein, 9 aa, Homo Sapiens
IRGLTVASS

SEQ ID NO: 1169979 - protein, 9 aa, Homo Sapiens
IFYVSWLQH

SEQ ID NO: 1169980 - protein, 9 aa, Homo Sapiens
AAQETIADY

SEQ ID NO: 1169981 - protein, 9 aa, Homo Sapiens
PHKPEPGGP

SEQ ID NO: 1169982 - protein, 9 aa, Homo Sapiens
RAAQKNIDW

SEQ ID NO: 1169983 - protein, 9 aa, Homo Sapiens
ERGRATVRV

SEQ ID NO: 1169984 - protein, 9 aa, Homo Sapiens
IHLVPRTRE

SEQ ID NO: 1169985 - protein, 9 aa, Homo Sapiens
TPETVVSRE

SEQ ID NO: 1169986 - protein, 9 aa, Homo Sapiens
MLVDFFIEH

SEQ ID NO: 1169987 - protein, 9 aa, Homo Sapiens
PIECVNTPG

SEQ ID NO: 1169988 - protein, 9 aa, Homo Sapiens
SCRIQKSDF

SEQ ID NO: 1169989 - protein, 9 aa, Homo Sapiens
LLKLSCGDD

SEQ ID NO: 1169990 - protein, 9 aa, Homo Sapiens
FVNKAGDGV

SEQ ID NO: 1169991 - protein, 9 aa, Homo Sapiens
ATSCELGMV

SEQ ID NO: 1169992 - protein, 9 aa, Homo Sapiens
QEVQISWQY

SEQ ID NO: 1169993 - protein, 9 aa, Homo Sapiens
QGLTGLQGF

SEQ ID NO: 1169994 - protein, 9 aa, Homo Sapiens
RLFVNRFGR

SEQ ID NO: 1169995 - protein, 9 aa, Homo Sapiens
QVLDDKNVC

SEQ ID NO: 1169996 - protein, 9 aa, Homo Sapiens
LVSPEASLS

SEQ ID NO: 1169997 - protein, 9 aa, Homo Sapiens
ICPKYLTYD

SEQ ID NO: 1169998 - protein, 9 aa, Homo Sapiens
CHCGLDGIP

SEQ ID NO: 1169999 - protein, 9 aa, Homo Sapiens
AESGTRAVR

SEQ ID NO: 1170000 - protein, 9 aa, Homo Sapiens
VVEVDVSAS

SEQ ID NO: 1170001 - protein, 9 aa, Homo Sapiens
LEVQNIPDN

SEQ ID NO: 1170002 - protein, 9 aa, Homo Sapiens
QGVAGIGKS

SEQ ID NO: 1170003 - protein, 9 aa, Homo Sapiens
PRSWGCTSL

SEQ ID NO: 1170004 - protein, 9 aa, Homo Sapiens
RMRMIRSVW

SEQ ID NO: 1170005 - protein, 9 aa, Homo Sapiens
NRGGRCLQV

SEQ ID NO: 1170006 - protein, 9 aa, Homo Sapiens
WSASASSCS

SEQ ID NO: 1170007 - protein, 9 aa, Homo Sapiens
SACTDSWWV

SEQ ID NO: 1170008 - protein, 9 aa, Homo Sapiens
PIYPAGLGR

SEQ ID NO: 1170009 - protein, 9 aa, Homo Sapiens
WSRPSRFRI

SEQ ID NO: 1170010 - protein, 9 aa, Homo Sapiens
RRPAQTCCG

SEQ ID NO: 1170011 - protein, 9 aa, Homo Sapiens
RECLGSFGS

SEQ ID NO: 1170012 - protein, 9 aa, Homo Sapiens
CPIPRRDPR

SEQ ID NO: 1170013 - protein, 9 aa, Homo Sapiens
ARSPPQYCD

SEQ ID NO: 1170014 - protein, 9 aa, Homo Sapiens
TQSHRPLTS

SEQ ID NO: 1170015 - protein, 9 aa, Homo Sapiens
SSWLTSSFK

SEQ ID NO: 1170016 - protein, 9 aa, Homo Sapiens
NPPMFSQSV

SEQ ID NO: 1170017 - protein, 9 aa, Homo Sapiens
MDMLPKGAA

SEQ ID NO: 1170018 - protein, 9 aa, Homo Sapiens
TGLLAACFI

SEQ ID NO: 1170019 - protein, 9 aa, Homo Sapiens
LSHANCMAA

SEQ ID NO: 1170020 - protein, 9 aa, Homo Sapiens
CGSSCFECT

SEQ ID NO: 1170021 - protein, 9 aa, Homo Sapiens
YIKVFPSPQ

SEQ ID NO: 1170022 - protein, 9 aa, Homo Sapiens
YYKDQWRLR

SEQ ID NO: 1170023 - protein, 9 aa, Homo Sapiens
HKTISFEGC

SEQ ID NO: 1170024 - protein, 9 aa, Homo Sapiens
GGGRNFPDT

SEQ ID NO: 1170025 - protein, 9 aa, Homo Sapiens
HCPLTSATS

SEQ ID NO: 1170026 - protein, 9 aa, Homo Sapiens
SSRQTGAKS

SEQ ID NO: 1170027 - protein, 9 aa, Homo Sapiens
CTPWPRSYT

SEQ ID NO: 1170028 - protein, 9 aa, Homo Sapiens
GRPSGFPGG

SEQ ID NO: 1170029 - protein, 9 aa, Homo Sapiens
EGDRMFLRV

SEQ ID NO: 1170030 - protein, 9 aa, Homo Sapiens
PGVKAPDML

SEQ ID NO: 1170031 - protein, 9 aa, Homo Sapiens
PAVWPIYPA

SEQ ID NO: 1170032 - protein, 9 aa, Homo Sapiens
SLFMGLRSI

SEQ ID NO: 1170033 - protein, 9 aa, Homo Sapiens
RLSIRRLRR

SEQ ID NO: 1170034 - protein, 9 aa, Homo Sapiens
RPLGPPTAA

SEQ ID NO: 1170035 - protein, 9 aa, Homo Sapiens
ATTPDNTAA

SEQ ID NO: 1170036 - protein, 9 aa, Homo Sapiens
HLDPLPSAS

SEQ ID NO: 1170037 - protein, 9 aa, Homo Sapiens
VSRSPTSVD

SEQ ID NO: 1170038 - protein, 9 aa, Homo Sapiens
QYASETKMS

SEQ ID NO: 1170039 - protein, 9 aa, Homo Sapiens
VDKRLEQNQ

SEQ ID NO: 1170040 - protein, 9 aa, Homo Sapiens
PEVLQDPLD

SEQ ID NO: 1170041 - protein, 9 aa, Homo Sapiens
PEIPAPPDP

SEQ ID NO: 1170042 - protein, 9 aa, Homo Sapiens
GSELPAPCS

SEQ ID NO: 1170043 - protein, 9 aa, Homo Sapiens
LPGSMPTAP

SEQ ID NO: 1170044 - protein, 9 aa, Homo Sapiens
IASAFQNEE

SEQ ID NO: 1170045 - protein, 9 aa, Homo Sapiens
GMVAHTWNP

SEQ ID NO: 1170046 - protein, 9 aa, Homo Sapiens
TGGIYQKPR

SEQ ID NO: 1170047 - protein, 9 aa, Homo Sapiens
LLGHSRTEL

SEQ ID NO: 1170048 - protein, 9 aa, Homo Sapiens
DENYYQKTW

SEQ ID NO: 1170049 - protein, 9 aa, Homo Sapiens
PVSLRRRHL

SEQ ID NO: 1170050 - protein, 9 aa, Homo Sapiens
SGGALWAPL

SEQ ID NO: 1170051 - protein, 9 aa, Homo Sapiens
SSSVCAPQT

SEQ ID NO: 1170052 - protein, 9 aa, Homo Sapiens
QSHRPLTSC

SEQ ID NO: 1170053 - protein, 9 aa, Homo Sapiens
KEDEFVKGQ

SEQ ID NO: 1170054 - protein, 9 aa, Homo Sapiens
PTHYPPPRH

SEQ ID NO: 1170055 - protein, 9 aa, Homo Sapiens
LVLLRHLLA

SEQ ID NO: 1170056 - protein, 9 aa, Homo Sapiens
ENLTNVKHL

SEQ ID NO: 1170057 - protein, 9 aa, Homo Sapiens
TALVMRAPR

SEQ ID NO: 1170058 - protein, 9 aa, Homo Sapiens
RGGVRKPLG

SEQ ID NO: 1170059 - protein, 9 aa, Homo Sapiens
PQRYTKPGA

SEQ ID NO: 1170060 - protein, 9 aa, Homo Sapiens
TPDNTAAQK

SEQ ID NO: 1170061 - protein, 9 aa, Homo Sapiens
CRGVDANRS

SEQ ID NO: 1170062 - protein, 9 aa, Homo Sapiens
TRAAPPSLR

SEQ ID NO: 1170063 - protein, 9 aa, Homo Sapiens
RYYLLAVGK

SEQ ID NO: 1170064 - protein, 9 aa, Homo Sapiens
LYKFQHSPN

SEQ ID NO: 1170065 - protein, 9 aa, Homo Sapiens
KLWYLDPDV

SEQ ID NO: 1170066 - protein, 9 aa, Homo Sapiens
GGCSVAPPI

SEQ ID NO: 1170067 - protein, 9 aa, Homo Sapiens
HEFQDTTGD

SEQ ID NO: 1170068 - protein, 9 aa, Homo Sapiens
RDKSPLTDL

SEQ ID NO: 1170069 - protein, 9 aa, Homo Sapiens
IIKTIEMVI

SEQ ID NO: 1170070 - protein, 9 aa, Homo Sapiens
EFALDVRCN

SEQ ID NO: 1170071 - protein, 9 aa, Homo Sapiens
PRLSIRRLR

SEQ ID NO: 1170072 - protein, 9 aa, Homo Sapiens
GRALHHAGP

SEQ ID NO: 1170073 - protein, 9 aa, Homo Sapiens
AEARGGPWP

SEQ ID NO: 1170074 - protein, 9 aa, Homo Sapiens
MCLRLRTKL

SEQ ID NO: 1170075 - protein, 9 aa, Homo Sapiens
NGKPTPPPQ

SEQ ID NO: 1170076 - protein, 9 aa, Homo Sapiens
IVAPTLSVV

SEQ ID NO: 1170077 - protein, 9 aa, Homo Sapiens
SLWTMSYRG

SEQ ID NO: 1170078 - protein, 9 aa, Homo Sapiens
NSHQPRPGL

SEQ ID NO: 1170079 - protein, 9 aa, Homo Sapiens
SELRTYLAG

SEQ ID NO: 1170080 - protein, 9 aa, Homo Sapiens
FLGCPKERV

SEQ ID NO: 1170081 - protein, 9 aa, Homo Sapiens
VCVENSNPT

SEQ ID NO: 1170082 - protein, 9 aa, Homo Sapiens
KTFSLLLLR

SEQ ID NO: 1170083 - protein, 9 aa, Homo Sapiens
SSISERRWI

SEQ ID NO: 1170084 - protein, 9 aa, Homo Sapiens
VWLFSITAD

SEQ ID NO: 1170085 - protein, 9 aa, Homo Sapiens
DNRSQKRVS

SEQ ID NO: 1170086 - protein, 9 aa, Homo Sapiens
PHPARRPPV

SEQ ID NO: 1170087 - protein, 9 aa, Homo Sapiens
LYQYMLNAR

SEQ ID NO: 1170088 - protein, 9 aa, Homo Sapiens
GGPRPRPPP

SEQ ID NO: 1170089 - protein, 9 aa, Homo Sapiens
ENFNVAGKI

SEQ ID NO: 1170090 - protein, 9 aa, Homo Sapiens
NHCDWPIFF

SEQ ID NO: 1170091 - protein, 9 aa, Homo Sapiens
MLNCWQKDR

SEQ ID NO: 1170092 - protein, 9 aa, Homo Sapiens
AASPPARSW

SEQ ID NO: 1170093 - protein, 9 aa, Homo Sapiens
QRKRMEEER

SEQ ID NO: 1170094 - protein, 9 aa, Homo Sapiens
KVRAMLEFQ

SEQ ID NO: 1170095 - protein, 9 aa, Homo Sapiens
IRRAGPGSD

SEQ ID NO: 1170096 - protein, 9 aa, Homo Sapiens
ACIEPLRKA

SEQ ID NO: 1170097 - protein, 9 aa, Homo Sapiens
MCAYVRRNS

SEQ ID NO: 1170098 - protein, 9 aa, Homo Sapiens
EPESTLHAL

SEQ ID NO: 1170099 - protein, 9 aa, Homo Sapiens
SSSCSARWC

SEQ ID NO: 1170100 - protein, 9 aa, Homo Sapiens
FGTPSWRPP

SEQ ID NO: 1170101 - protein, 9 aa, Homo Sapiens
SSSFSKWCR

SEQ ID NO: 1170102 - protein, 9 aa, Homo Sapiens
EAGGGPSVF

SEQ ID NO: 1170103 - protein, 9 aa, Homo Sapiens
VHGLFLDGA

SEQ ID NO: 1170104 - protein, 9 aa, Homo Sapiens
GVPAIALVG

SEQ ID NO: 1170105 - protein, 9 aa, Homo Sapiens
AVCNALAGG

SEQ ID NO: 1170106 - protein, 9 aa, Homo Sapiens
GPEHLSPEE

SEQ ID NO: 1170107 - protein, 9 aa, Homo Sapiens
LNSGKAPSS

SEQ ID NO: 1170108 - protein, 9 aa, Homo Sapiens
VNHKDARAC

SEQ ID NO: 1170109 - protein, 9 aa, Homo Sapiens
KIWRWHLAR

SEQ ID NO: 1170110 - protein, 9 aa, Homo Sapiens
TGLQGFPGP

SEQ ID NO: 1170111 - protein, 9 aa, Homo Sapiens
GLSDHIAAL

SEQ ID NO: 1170112 - protein, 9 aa, Homo Sapiens
PTSPEGVSP

SEQ ID NO: 1170113 - protein, 9 aa, Homo Sapiens
EELFLLVSL

SEQ ID NO: 1170114 - protein, 9 aa, Homo Sapiens
SQGLAQACQ

SEQ ID NO: 1170115 - protein, 9 aa, Homo Sapiens
CQQLREITE

SEQ ID NO: 1170116 - protein, 9 aa, Homo Sapiens
AMEAHAMEA

SEQ ID NO: 1170117 - protein, 9 aa, Homo Sapiens
YEDMVAESC

SEQ ID NO: 1170118 - protein, 9 aa, Homo Sapiens
DVHDDMRLL

SEQ ID NO: 1170119 - protein, 9 aa, Homo Sapiens
MKMGRCSCG

SEQ ID NO: 1170120 - protein, 9 aa, Homo Sapiens
EVKTKRQRK

SEQ ID NO: 1170121 - protein, 9 aa, Homo Sapiens
CEKYRARHQ

SEQ ID NO: 1170122 - protein, 9 aa, Homo Sapiens
PATSAVSVA

SEQ ID NO: 1170123 - protein, 9 aa, Homo Sapiens
RTSTCGSAT

SEQ ID NO: 1170124 - protein, 9 aa, Homo Sapiens
FWTMPIAPW

SEQ ID NO: 1170125 - protein, 9 aa, Homo Sapiens
TSAAATTSP

SEQ ID NO: 1170126 - protein, 9 aa, Homo Sapiens
HSNLEKKRK

SEQ ID NO: 1170127 - protein, 9 aa, Homo Sapiens
LTVDAYHNN

SEQ ID NO: 1170128 - protein, 9 aa, Homo Sapiens
RRRNPGSKP

SEQ ID NO: 1170129 - protein, 9 aa, Homo Sapiens
QTQDSARRA

SEQ ID NO: 1170130 - protein, 9 aa, Homo Sapiens
TTAHCVEPD

SEQ ID NO: 1170131 - protein, 9 aa, Homo Sapiens
CSTTCTHRS

SEQ ID NO: 1170132 - protein, 9 aa, Homo Sapiens
QLMLMGSQL

SEQ ID NO: 1170133 - protein, 9 aa, Homo Sapiens
APALPMVVV

SEQ ID NO: 1170134 - protein, 9 aa, Homo Sapiens
HHHHQQRLS

SEQ ID NO: 1170135 - protein, 9 aa, Homo Sapiens
HSFLVPSPQ

SEQ ID NO: 1170136 - protein, 9 aa, Homo Sapiens
NQVPAQMEE

SEQ ID NO: 1170137 - protein, 9 aa, Homo Sapiens
YQPGRQPAT

SEQ ID NO: 1170138 - protein, 9 aa, Homo Sapiens
AKSLPLSPS

SEQ ID NO: 1170139 - protein, 9 aa, Homo Sapiens
KGVRRLGSL

SEQ ID NO: 1170140 - protein, 9 aa, Homo Sapiens
NRSIHTYQV

SEQ ID NO: 1170141 - protein, 9 aa, Homo Sapiens
LPAALEGCR

SEQ ID NO: 1170142 - protein, 9 aa, Homo Sapiens
SPQPWWWRW

SEQ ID NO: 1170143 - protein, 9 aa, Homo Sapiens
WLSAKCQIA

SEQ ID NO: 1170144 - protein, 9 aa, Homo Sapiens
VPTMAPSTP

SEQ ID NO: 1170145 - protein, 9 aa, Homo Sapiens
GISSHSPRR

SEQ ID NO: 1170146 - protein, 9 aa, Homo Sapiens
KLPPVDLIH

SEQ ID NO: 1170147 - protein, 9 aa, Homo Sapiens
AEPDVHGGG

SEQ ID NO: 1170148 - protein, 9 aa, Homo Sapiens
TSPEGVSPT

SEQ ID NO: 1170149 - protein, 9 aa, Homo Sapiens
SRSTCARLW

SEQ ID NO: 1170150 - protein, 9 aa, Homo Sapiens
KMTMSFWKR

SEQ ID NO: 1170151 - protein, 9 aa, Homo Sapiens
VGKVKINSK

SEQ ID NO: 1170152 - protein, 9 aa, Homo Sapiens
VGPQRAKSL

SEQ ID NO: 1170153 - protein, 9 aa, Homo Sapiens
FFFSGWISG

SEQ ID NO: 1170154 - protein, 9 aa, Homo Sapiens
VVGCIMAEV

SEQ ID NO: 1170155 - protein, 9 aa, Homo Sapiens
LGHTWAYRE

SEQ ID NO: 1170156 - protein, 9 aa, Homo Sapiens
ELLRSQIEK

SEQ ID NO: 1170157 - protein, 9 aa, Homo Sapiens
DCMPIAVLT

SEQ ID NO: 1170158 - protein, 9 aa, Homo Sapiens
PGRGGGPWD

SEQ ID NO: 1170159 - protein, 9 aa, Homo Sapiens
SGGVSRYIS

SEQ ID NO: 1170160 - protein, 9 aa, Homo Sapiens
IEGGRPCCA

SEQ ID NO: 1170161 - protein, 9 aa, Homo Sapiens
EPNFSTTRK

SEQ ID NO: 1170162 - protein, 9 aa, Homo Sapiens
SCGQGSCST

SEQ ID NO: 1170163 - protein, 9 aa, Homo Sapiens
LPTSGSPRE

SEQ ID NO: 1170164 - protein, 9 aa, Homo Sapiens
YLPNSRLTG

SEQ ID NO: 1170165 - protein, 9 aa, Homo Sapiens
AVGCRRCSG

SEQ ID NO: 1170166 - protein, 9 aa, Homo Sapiens
VSELAPRLV

SEQ ID NO: 1170167 - protein, 9 aa, Homo Sapiens
LSWATPSTR

SEQ ID NO: 1170168 - protein, 9 aa, Homo Sapiens
LPTLDYLRR

SEQ ID NO: 1170169 - protein, 9 aa, Homo Sapiens
GALLYSVKA

SEQ ID NO: 1170170 - protein, 9 aa, Homo Sapiens
PGAPHEAPC

SEQ ID NO: 1170171 - protein, 9 aa, Homo Sapiens
YIHDHFIHI

SEQ ID NO: 1170172 - protein, 9 aa, Homo Sapiens
SQSPHSPKH

SEQ ID NO: 1170173 - protein, 9 aa, Homo Sapiens
WPQLEGPRE

SEQ ID NO: 1170174 - protein, 9 aa, Homo Sapiens
VAALVAQVA

SEQ ID NO: 1170175 - protein, 9 aa, Homo Sapiens
EASASPSSE

SEQ ID NO: 1170176 - protein, 9 aa, Homo Sapiens
LRTSCGAAR

SEQ ID NO: 1170177 - protein, 9 aa, Homo Sapiens
PNLYPLIRS

SEQ ID NO: 1170178 - protein, 9 aa, Homo Sapiens
ALARGAGPN

SEQ ID NO: 1170179 - protein, 9 aa, Homo Sapiens
NFSTTRKVN

SEQ ID NO: 1170180 - protein, 9 aa, Homo Sapiens
KVQLLHEQI

SEQ ID NO: 1170181 - protein, 9 aa, Homo Sapiens
RTCGRPSTS

SEQ ID NO: 1170182 - protein, 9 aa, Homo Sapiens
TFRADGATT

SEQ ID NO: 1170183 - protein, 9 aa, Homo Sapiens
VAGRCKAFS

SEQ ID NO: 1170184 - protein, 9 aa, Homo Sapiens
TCSGRSRPS

SEQ ID NO: 1170185 - protein, 9 aa, Homo Sapiens
KAPSRCFVV

SEQ ID NO: 1170186 - protein, 9 aa, Homo Sapiens
IPETELCKA

SEQ ID NO: 1170187 - protein, 9 aa, Homo Sapiens
GILAYELLP

SEQ ID NO: 1170188 - protein, 9 aa, Homo Sapiens
GPHPSSPVP

SEQ ID NO: 1170189 - protein, 9 aa, Homo Sapiens
VNSRSLARC

SEQ ID NO: 1170190 - protein, 9 aa, Homo Sapiens
FLYHVVYVL

SEQ ID NO: 1170191 - protein, 9 aa, Homo Sapiens
AWLSPISAC

SEQ ID NO: 1170192 - protein, 9 aa, Homo Sapiens
LTVVTFSFD

SEQ ID NO: 1170193 - protein, 9 aa, Homo Sapiens
GPHPQASTP

SEQ ID NO: 1170194 - protein, 9 aa, Homo Sapiens
NPRKVCTGG

SEQ ID NO: 1170195 - protein, 9 aa, Homo Sapiens
EHARSEAGE

SEQ ID NO: 1170196 - protein, 9 aa, Homo Sapiens
DDFEESNTM

SEQ ID NO: 1170197 - protein, 9 aa, Homo Sapiens
SGHEVTEGI

SEQ ID NO: 1170198 - protein, 9 aa, Homo Sapiens
MEEERKRRI

SEQ ID NO: 1170199 - protein, 9 aa, Homo Sapiens
PCWPPCSWP

SEQ ID NO: 1170200 - protein, 9 aa, Homo Sapiens
SHANCMAAE

SEQ ID NO: 1170201 - protein, 9 aa, Homo Sapiens
AGAVRPGST

SEQ ID NO: 1170202 - protein, 9 aa, Homo Sapiens
PTSCSWAAR

SEQ ID NO: 1170203 - protein, 9 aa, Homo Sapiens
QGWLHKKRG

SEQ ID NO: 1170204 - protein, 9 aa, Homo Sapiens
LHTQSLETL

SEQ ID NO: 1170205 - protein, 9 aa, Homo Sapiens
AVFDEYNED

SEQ ID NO: 1170206 - protein, 9 aa, Homo Sapiens
LAIRFISAP

SEQ ID NO: 1170207 - protein, 9 aa, Homo Sapiens
VGKEIKEYV

SEQ ID NO: 1170208 - protein, 9 aa, Homo Sapiens
NYYQKTWRV

SEQ ID NO: 1170209 - protein, 9 aa, Homo Sapiens
LGLTAPIPG

SEQ ID NO: 1170210 - protein, 9 aa, Homo Sapiens
QPWLVAKAF

SEQ ID NO: 1170211 - protein, 9 aa, Homo Sapiens
SLLCTPPGS

SEQ ID NO: 1170212 - protein, 9 aa, Homo Sapiens
VSTQESQFL

SEQ ID NO: 1170213 - protein, 9 aa, Homo Sapiens
GSIGRARTR

SEQ ID NO: 1170214 - protein, 9 aa, Homo Sapiens
KSTLRGHFP

SEQ ID NO: 1170215 - protein, 9 aa, Homo Sapiens
TPWPRSYTT

SEQ ID NO: 1170216 - protein, 9 aa, Homo Sapiens
GYSVVTINH

SEQ ID NO: 1170217 - protein, 9 aa, Homo Sapiens
PPGFPSRNC

SEQ ID NO: 1170218 - protein, 9 aa, Homo Sapiens
ILVGNKCAL

SEQ ID NO: 1170219 - protein, 9 aa, Homo Sapiens
LAVLAVDVG

SEQ ID NO: 1170220 - protein, 9 aa, Homo Sapiens
SLLNLSSMT

SEQ ID NO: 1170221 - protein, 9 aa, Homo Sapiens
PLAGPCRAA

SEQ ID NO: 1170222 - protein, 9 aa, Homo Sapiens
GPAEPDVHG

SEQ ID NO: 1170223 - protein, 9 aa, Homo Sapiens
DSVQSIHGV

SEQ ID NO: 1170224 - protein, 9 aa, Homo Sapiens
NEIEPNFST

SEQ ID NO: 1170225 - protein, 9 aa, Homo Sapiens
KKRRRRVRK

SEQ ID NO: 1170226 - protein, 9 aa, Homo Sapiens
VARLTWRRP

SEQ ID NO: 1170227 - protein, 9 aa, Homo Sapiens
DLEDPTLPP

SEQ ID NO: 1170228 - protein, 9 aa, Homo Sapiens
LLLDPAMAI

SEQ ID NO: 1170229 - protein, 9 aa, Homo Sapiens
RSPSCTWSR

SEQ ID NO: 1170230 - protein, 9 aa, Homo Sapiens
EYMTDEKKR

SEQ ID NO: 1170231 - protein, 9 aa, Homo Sapiens
TKGSPIDVL

SEQ ID NO: 1170232 - protein, 9 aa, Homo Sapiens
QVIHLLNGL

SEQ ID NO: 1170233 - protein, 9 aa, Homo Sapiens
HKDSALSLV

SEQ ID NO: 1170234 - protein, 9 aa, Homo Sapiens
AAPTSCSWA

SEQ ID NO: 1170235 - protein, 9 aa, Homo Sapiens
QHVVMEVSV

SEQ ID NO: 1170236 - protein, 9 aa, Homo Sapiens
WLVAKAFGP

SEQ ID NO: 1170237 - protein, 9 aa, Homo Sapiens
DPECEWHKN

SEQ ID NO: 1170238 - protein, 9 aa, Homo Sapiens
SLPSRGSPP

SEQ ID NO: 1170239 - protein, 9 aa, Homo Sapiens
TVAKGKSST

SEQ ID NO: 1170240 - protein, 9 aa, Homo Sapiens
EIEHGFEGK

SEQ ID NO: 1170241 - protein, 9 aa, Homo Sapiens
LLAHRLRCW

SEQ ID NO: 1170242 - protein, 9 aa, Homo Sapiens
GRAERDGHW

SEQ ID NO: 1170243 - protein, 9 aa, Homo Sapiens
HDIRIEHTM

SEQ ID NO: 1170244 - protein, 9 aa, Homo Sapiens
PTRGSSRWC

SEQ ID NO: 1170245 - protein, 9 aa, Homo Sapiens
GRRGVLLQP

SEQ ID NO: 1170246 - protein, 9 aa, Homo Sapiens
TLDYLRRCS

SEQ ID NO: 1170247 - protein, 9 aa, Homo Sapiens
RGRRAEAKE

SEQ ID NO: 1170248 - protein, 9 aa, Homo Sapiens
VQSRLHLPR

SEQ ID NO: 1170249 - protein, 9 aa, Homo Sapiens
KEDLPRELK

SEQ ID NO: 1170250 - protein, 9 aa, Homo Sapiens
QEVETMTKQ

SEQ ID NO: 1170251 - protein, 9 aa, Homo Sapiens
NECDKVFSQ

SEQ ID NO: 1170252 - protein, 9 aa, Homo Sapiens
EMQESAQPP

SEQ ID NO: 1170253 - protein, 9 aa, Homo Sapiens
DQWRLRKFK

SEQ ID NO: 1170254 - protein, 9 aa, Homo Sapiens
PPGTRPQAH

SEQ ID NO: 1170255 - protein, 9 aa, Homo Sapiens
PPANGAPPE

SEQ ID NO: 1170256 - protein, 9 aa, Homo Sapiens
PGQWAPSKY

SEQ ID NO: 1170257 - protein, 9 aa, Homo Sapiens
YPMTTALSV

SEQ ID NO: 1170258 - protein, 9 aa, Homo Sapiens
RRGWGKGAS

SEQ ID NO: 1170259 - protein, 9 aa, Homo Sapiens
PRELKIKFL

SEQ ID NO: 1170260 - protein, 9 aa, Homo Sapiens
VPYIVCQCV

SEQ ID NO: 1170261 - protein, 9 aa, Homo Sapiens
PKADMTGAQ

SEQ ID NO: 1170262 - protein, 9 aa, Homo Sapiens
ILQLTSLRT

SEQ ID NO: 1170263 - protein, 9 aa, Homo Sapiens
TLKREALVK

SEQ ID NO: 1170264 - protein, 9 aa, Homo Sapiens
SAAGRAARG

SEQ ID NO: 1170265 - protein, 9 aa, Homo Sapiens
PEEELFGNN

SEQ ID NO: 1170266 - protein, 9 aa, Homo Sapiens
NSSAHVHAA

SEQ ID NO: 1170267 - protein, 9 aa, Homo Sapiens
EEEESEEET

SEQ ID NO: 1170268 - protein, 9 aa, Homo Sapiens
VWPGGPADR

SEQ ID NO: 1170269 - protein, 9 aa, Homo Sapiens
QGPGAWWGD

SEQ ID NO: 1170270 - protein, 9 aa, Homo Sapiens
VDFDYVGID

SEQ ID NO: 1170271 - protein, 9 aa, Homo Sapiens
RNMNTVKGT

SEQ ID NO: 1170272 - protein, 9 aa, Homo Sapiens
LVALGSRCD

SEQ ID NO: 1170273 - protein, 9 aa, Homo Sapiens
LEALEGTVE

SEQ ID NO: 1170274 - protein, 9 aa, Homo Sapiens
GIYDDTSAW

SEQ ID NO: 1170275 - protein, 9 aa, Homo Sapiens
RHPVGRSRC

SEQ ID NO: 1170276 - protein, 9 aa, Homo Sapiens
WRGRRPPPP

SEQ ID NO: 1170277 - protein, 9 aa, Homo Sapiens
YKKHFWNST

SEQ ID NO: 1170278 - protein, 9 aa, Homo Sapiens
ICNNKWFAE

SEQ ID NO: 1170279 - protein, 9 aa, Homo Sapiens
RACEDGCRL

SEQ ID NO: 1170280 - protein, 9 aa, Homo Sapiens
SGRSLSCCP

SEQ ID NO: 1170281 - protein, 9 aa, Homo Sapiens
GKNRCRGKN

SEQ ID NO: 1170282 - protein, 9 aa, Homo Sapiens
LKVRAMLEF

SEQ ID NO: 1170283 - protein, 9 aa, Homo Sapiens
SIICLKTQS

SEQ ID NO: 1170284 - protein, 9 aa, Homo Sapiens
IRKQFFSFS

SEQ ID NO: 1170285 - protein, 9 aa, Homo Sapiens
QGDGGAGGS

SEQ ID NO: 1170286 - protein, 9 aa, Homo Sapiens
SSAASACSA

SEQ ID NO: 1170287 - protein, 9 aa, Homo Sapiens
AWKAGTGAQ

SEQ ID NO: 1170288 - protein, 9 aa, Homo Sapiens
DLGCPTMRT

SEQ ID NO: 1170289 - protein, 9 aa, Homo Sapiens
EDTPPPACT

SEQ ID NO: 1170290 - protein, 9 aa, Homo Sapiens
ADGQGAAGA

SEQ ID NO: 1170291 - protein, 9 aa, Homo Sapiens
HLVKPRVLH

SEQ ID NO: 1170292 - protein, 9 aa, Homo Sapiens
SQLEDAAGV

SEQ ID NO: 1170293 - protein, 9 aa, Homo Sapiens
ASTRPTWNP

SEQ ID NO: 1170294 - protein, 9 aa, Homo Sapiens
EHVLVGCDG

SEQ ID NO: 1170295 - protein, 9 aa, Homo Sapiens
DHSVPPAVR

SEQ ID NO: 1170296 - protein, 9 aa, Homo Sapiens
CHCPTDTQD

SEQ ID NO: 1170297 - protein, 9 aa, Homo Sapiens
AFLLWKKRF

SEQ ID NO: 1170298 - protein, 9 aa, Homo Sapiens
SPSRVSLCQ

SEQ ID NO: 1170299 - protein, 9 aa, Homo Sapiens
ARQVLGLLE

SEQ ID NO: 1170300 - protein, 9 aa, Homo Sapiens
VIPEPPPLA

SEQ ID NO: 1170301 - protein, 9 aa, Homo Sapiens
QNECYLQQA

SEQ ID NO: 1170302 - protein, 9 aa, Homo Sapiens
GVYPASAGT

SEQ ID NO: 1170303 - protein, 9 aa, Homo Sapiens
LLESELLAD

SEQ ID NO: 1170304 - protein, 9 aa, Homo Sapiens
VASEMEKTP

SEQ ID NO: 1170305 - protein, 9 aa, Homo Sapiens
SPALPDAWP

SEQ ID NO: 1170306 - protein, 9 aa, Homo Sapiens
CQGGFMAAW

SEQ ID NO: 1170307 - protein, 9 aa, Homo Sapiens
HGRCHLAGG

SEQ ID NO: 1170308 - protein, 9 aa, Homo Sapiens
VKAHGKKVP

SEQ ID NO: 1170309 - protein, 9 aa, Homo Sapiens
IMNIIDIVV

SEQ ID NO: 1170310 - protein, 9 aa, Homo Sapiens
FKLEDHMDG

SEQ ID NO: 1170311 - protein, 9 aa, Homo Sapiens
ELERLLELE

SEQ ID NO: 1170312 - protein, 9 aa, Homo Sapiens
KRLRTMKIK

SEQ ID NO: 1170313 - protein, 9 aa, Homo Sapiens
ELKCKHSKS

SEQ ID NO: 1170314 - protein, 9 aa, Homo Sapiens
CPAGPTSQL

SEQ ID NO: 1170315 - protein, 9 aa, Homo Sapiens
VQEPVGSQE

SEQ ID NO: 1170316 - protein, 9 aa, Homo Sapiens
RLWASNAMM

SEQ ID NO: 1170317 - protein, 9 aa, Homo Sapiens
ALHRLSPST

SEQ ID NO: 1170318 - protein, 9 aa, Homo Sapiens
LGPQEMVKN

SEQ ID NO: 1170319 - protein, 9 aa, Homo Sapiens
DPVLRTGNP

SEQ ID NO: 1170320 - protein, 9 aa, Homo Sapiens
VDSAVTVAV

SEQ ID NO: 1170321 - protein, 9 aa, Homo Sapiens
GWQNCVWQV

SEQ ID NO: 1170322 - protein, 9 aa, Homo Sapiens
YVKIYITVQ

SEQ ID NO: 1170323 - protein, 9 aa, Homo Sapiens
VWLVAPLIT

SEQ ID NO: 1170324 - protein, 9 aa, Homo Sapiens
YKRKGSFFP

SEQ ID NO: 1170325 - protein, 9 aa, Homo Sapiens
KRDDEEEEA

SEQ ID NO: 1170326 - protein, 9 aa, Homo Sapiens
KKISFRVLA

SEQ ID NO: 1170327 - protein, 9 aa, Homo Sapiens
PGVQHPAGG

SEQ ID NO: 1170328 - protein, 9 aa, Homo Sapiens
IPWSRIPPC

SEQ ID NO: 1170329 - protein, 9 aa, Homo Sapiens
RPPARRRRR

SEQ ID NO: 1170330 - protein, 9 aa, Homo Sapiens
DAYVTENNV

SEQ ID NO: 1170331 - protein, 9 aa, Homo Sapiens
KDGVWSPGL

SEQ ID NO: 1170332 - protein, 9 aa, Homo Sapiens
GFVRYLQSN

SEQ ID NO: 1170333 - protein, 9 aa, Homo Sapiens
SVLDRTSAS

SEQ ID NO: 1170334 - protein, 9 aa, Homo Sapiens
QHVLETAAK

SEQ ID NO: 1170335 - protein, 9 aa, Homo Sapiens
YHFFCHYKL

SEQ ID NO: 1170336 - protein, 9 aa, Homo Sapiens
IVPLRYELS

SEQ ID NO: 1170337 - protein, 9 aa, Homo Sapiens
AGRLESSLR

SEQ ID NO: 1170338 - protein, 9 aa, Homo Sapiens
APRGQHTPA

SEQ ID NO: 1170339 - protein, 9 aa, Homo Sapiens
AAFPHELRH

SEQ ID NO: 1170340 - protein, 9 aa, Homo Sapiens
RSIHTYQVC

SEQ ID NO: 1170341 - protein, 9 aa, Homo Sapiens
YTMSQINLR

SEQ ID NO: 1170342 - protein, 9 aa, Homo Sapiens
HGLALRVVS

SEQ ID NO: 1170343 - protein, 9 aa, Homo Sapiens
KNPPLRFNL

SEQ ID NO: 1170344 - protein, 9 aa, Homo Sapiens
DLQLEALPT

SEQ ID NO: 1170345 - protein, 9 aa, Homo Sapiens
PAPPAPPEI

SEQ ID NO: 1170346 - protein, 9 aa, Homo Sapiens
TCTLHNWKF

SEQ ID NO: 1170347 - protein, 9 aa, Homo Sapiens
DVDHTDNND

SEQ ID NO: 1170348 - protein, 9 aa, Homo Sapiens
SELSHRSGS

SEQ ID NO: 1170349 - protein, 9 aa, Homo Sapiens
RVCCLRCCF

SEQ ID NO: 1170350 - protein, 9 aa, Homo Sapiens
SPNSTTWPL

SEQ ID NO: 1170351 - protein, 9 aa, Homo Sapiens
LTALQADPP

SEQ ID NO: 1170352 - protein, 9 aa, Homo Sapiens
KYKKRKHRA

SEQ ID NO: 1170353 - protein, 9 aa, Homo Sapiens
GGGSHFFSP

SEQ ID NO: 1170354 - protein, 9 aa, Homo Sapiens
FIVWMCTAA

SEQ ID NO: 1170355 - protein, 9 aa, Homo Sapiens
LPGRGAPAQ

SEQ ID NO: 1170356 - protein, 9 aa, Homo Sapiens
TKDLKKKEV

SEQ ID NO: 1170357 - protein, 9 aa, Homo Sapiens
KIAEGVSDT

SEQ ID NO: 1170358 - protein, 9 aa, Homo Sapiens
HPSPSPTWR

SEQ ID NO: 1170359 - protein, 9 aa, Homo Sapiens
WHGWMVSSR

SEQ ID NO: 1170360 - protein, 9 aa, Homo Sapiens
FSITADPYE

SEQ ID NO: 1170361 - protein, 9 aa, Homo Sapiens
PVGSVMSCS

SEQ ID NO: 1170362 - protein, 9 aa, Homo Sapiens
VPGSQGAAR

SEQ ID NO: 1170363 - protein, 9 aa, Homo Sapiens
GSIAYCVNL

SEQ ID NO: 1170364 - protein, 9 aa, Homo Sapiens
WQAFLRESS

SEQ ID NO: 1170365 - protein, 9 aa, Homo Sapiens
IILVPMRFF

SEQ ID NO: 1170366 - protein, 9 aa, Homo Sapiens
EGAGEALLA

SEQ ID NO: 1170367 - protein, 9 aa, Homo Sapiens
CNFRNASEV

SEQ ID NO: 1170368 - protein, 9 aa, Homo Sapiens
PATAWTSWP

SEQ ID NO: 1170369 - protein, 9 aa, Homo Sapiens
QDHGAAQNL

SEQ ID NO: 1170370 - protein, 9 aa, Homo Sapiens
SNGSKKFSN

SEQ ID NO: 1170371 - protein, 9 aa, Homo Sapiens
NYEPYVVVS

SEQ ID NO: 1170372 - protein, 9 aa, Homo Sapiens
AQNLAVHGL

SEQ ID NO: 1170373 - protein, 9 aa, Homo Sapiens
TRRPRSPSG

SEQ ID NO: 1170374 - protein, 9 aa, Homo Sapiens
HRSLWTMSY

SEQ ID NO: 1170375 - protein, 9 aa, Homo Sapiens
EQCETNLTT

SEQ ID NO: 1170376 - protein, 9 aa, Homo Sapiens
PHYKRKGSF

SEQ ID NO: 1170377 - protein, 9 aa, Homo Sapiens
DGGAGGSAA

SEQ ID NO: 1170378 - protein, 9 aa, Homo Sapiens
AGPPSAGVL

SEQ ID NO: 1170379 - protein, 9 aa, Homo Sapiens
PQSRWTRMS

SEQ ID NO: 1170380 - protein, 9 aa, Homo Sapiens
DGPPRPPAR

SEQ ID NO: 1170381 - protein, 9 aa, Homo Sapiens
FPPPPCIAP

SEQ ID NO: 1170382 - protein, 9 aa, Homo Sapiens
IRLPRKEEN

SEQ ID NO: 1170383 - protein, 9 aa, Homo Sapiens
VRLEYYENE

SEQ ID NO: 1170384 - protein, 9 aa, Homo Sapiens
ETRSTLMFG

SEQ ID NO: 1170385 - protein, 9 aa, Homo Sapiens
RQGSREPPQ

SEQ ID NO: 1170386 - protein, 9 aa, Homo Sapiens
RSVPLAITI

SEQ ID NO: 1170387 - protein, 9 aa, Homo Sapiens
NETPKKKRS

SEQ ID NO: 1170388 - protein, 9 aa, Homo Sapiens
LSLRQNDIK

SEQ ID NO: 1170389 - protein, 9 aa, Homo Sapiens
CGRRTRKQT

SEQ ID NO: 1170390 - protein, 9 aa, Homo Sapiens
GGTLAIRFI

SEQ ID NO: 1170391 - protein, 9 aa, Homo Sapiens
MLRNDLLTI

SEQ ID NO: 1170392 - protein, 9 aa, Homo Sapiens
QEGDSADPV

SEQ ID NO: 1170393 - protein, 9 aa, Homo Sapiens
LLDKMTMSF

SEQ ID NO: 1170394 - protein, 9 aa, Homo Sapiens
FVTKCAFQA

SEQ ID NO: 1170395 - protein, 9 aa, Homo Sapiens
VRRSHSDTR

SEQ ID NO: 1170396 - protein, 9 aa, Homo Sapiens
VRPFECFFL

SEQ ID NO: 1170397 - protein, 9 aa, Homo Sapiens
IDQLKNCGC

SEQ ID NO: 1170398 - protein, 9 aa, Homo Sapiens
ADRRNSNRY

SEQ ID NO: 1170399 - protein, 9 aa, Homo Sapiens
SEKNWKQLH

SEQ ID NO: 1170400 - protein, 9 aa, Homo Sapiens
GRAPRQLGQ

SEQ ID NO: 1170401 - protein, 9 aa, Homo Sapiens
GETRALRAR

SEQ ID NO: 1170402 - protein, 9 aa, Homo Sapiens
LGSRCDRPP

SEQ ID NO: 1170403 - protein, 9 aa, Homo Sapiens
LGWASGRIT

SEQ ID NO: 1170404 - protein, 9 aa, Homo Sapiens
RLRRRLLRC

SEQ ID NO: 1170405 - protein, 9 aa, Homo Sapiens
ETLAARQES

SEQ ID NO: 1170406 - protein, 9 aa, Homo Sapiens
SVQSIHGVR

SEQ ID NO: 1170407 - protein, 9 aa, Homo Sapiens
YEAAVVEVD

SEQ ID NO: 1170408 - protein, 9 aa, Homo Sapiens
LSLMSDHLS

SEQ ID NO: 1170409 - protein, 9 aa, Homo Sapiens
GLDQDEVGG

SEQ ID NO: 1170410 - protein, 9 aa, Homo Sapiens
NGSKKFSNV

SEQ ID NO: 1170411 - protein, 9 aa, Homo Sapiens
GFATEQNWD

SEQ ID NO: 1170412 - protein, 9 aa, Homo Sapiens
CADLNGRTR

SEQ ID NO: 1170413 - protein, 9 aa, Homo Sapiens
PACALPDAR

SEQ ID NO: 1170414 - protein, 9 aa, Homo Sapiens
DAQAAATEE

SEQ ID NO: 1170415 - protein, 9 aa, Homo Sapiens
TSLRLPISG

SEQ ID NO: 1170416 - protein, 9 aa, Homo Sapiens
PGPLAGPCR

SEQ ID NO: 1170417 - protein, 9 aa, Homo Sapiens
TDTLYGLAS

SEQ ID NO: 1170418 - protein, 9 aa, Homo Sapiens
DSYITSTKT

SEQ ID NO: 1170419 - protein, 9 aa, Homo Sapiens
APSLEMLLV

SEQ ID NO: 1170420 - protein, 9 aa, Homo Sapiens
EGFFLDASQ

SEQ ID NO: 1170421 - protein, 9 aa, Homo Sapiens
SVHPPVYLH

SEQ ID NO: 1170422 - protein, 9 aa, Homo Sapiens
GSKPSMKGL

SEQ ID NO: 1170423 - protein, 9 aa, Homo Sapiens
TFFITDGRS

SEQ ID NO: 1170424 - protein, 9 aa, Homo Sapiens
CRLLVAVCV

SEQ ID NO: 1170425 - protein, 9 aa, Homo Sapiens
HHSTGERTC

SEQ ID NO: 1170426 - protein, 9 aa, Homo Sapiens
YQKPRTLPR

SEQ ID NO: 1170427 - protein, 9 aa, Homo Sapiens
TPCLIKKTL

SEQ ID NO: 1170428 - protein, 9 aa, Homo Sapiens
VYVNRSLTV

SEQ ID NO: 1170429 - protein, 9 aa, Homo Sapiens
EWRICSTTS

SEQ ID NO: 1170430 - protein, 9 aa, Homo Sapiens
GPACALPDA

SEQ ID NO: 1170431 - protein, 9 aa, Homo Sapiens
DDYTLSVHP

SEQ ID NO: 1170432 - protein, 9 aa, Homo Sapiens
DVLDHGLIL

SEQ ID NO: 1170433 - protein, 9 aa, Homo Sapiens
LELTVVVLV

SEQ ID NO: 1170434 - protein, 9 aa, Homo Sapiens
SATSCELGM

SEQ ID NO: 1170435 - protein, 9 aa, Homo Sapiens
ARRAGRHHC

SEQ ID NO: 1170436 - protein, 9 aa, Homo Sapiens
VLCFSGTYP

SEQ ID NO: 1170437 - protein, 9 aa, Homo Sapiens
KSSSASSLV

SEQ ID NO: 1170438 - protein, 9 aa, Homo Sapiens
KWRPGASRR

SEQ ID NO: 1170439 - protein, 9 aa, Homo Sapiens
IVILGLFCT

SEQ ID NO: 1170440 - protein, 9 aa, Homo Sapiens
EEIQHFYYT

SEQ ID NO: 1170441 - protein, 9 aa, Homo Sapiens
ECDEAPSLR

SEQ ID NO: 1170442 - protein, 9 aa, Homo Sapiens
AADKGDLRT

SEQ ID NO: 1170443 - protein, 9 aa, Homo Sapiens
CRSSWAALS

SEQ ID NO: 1170444 - protein, 9 aa, Homo Sapiens
LVKPRVLHQ

SEQ ID NO: 1170445 - protein, 9 aa, Homo Sapiens
LRLWSWCGT

SEQ ID NO: 1170446 - protein, 9 aa, Homo Sapiens
PVIPLLESE

SEQ ID NO: 1170447 - protein, 9 aa, Homo Sapiens
SDLEDPTLP

SEQ ID NO: 1170448 - protein, 9 aa, Homo Sapiens
VSRGVGSKD

SEQ ID NO: 1170449 - protein, 9 aa, Homo Sapiens
TVASSLPWT

SEQ ID NO: 1170450 - protein, 9 aa, Homo Sapiens
GSRRYDDYS

SEQ ID NO: 1170451 - protein, 9 aa, Homo Sapiens
PSSPPRCTS

SEQ ID NO: 1170452 - protein, 9 aa, Homo Sapiens
RQKQKADIE

SEQ ID NO: 1170453 - protein, 9 aa, Homo Sapiens
ARQPLPLPP

SEQ ID NO: 1170454 - protein, 9 aa, Homo Sapiens
DDEGDRMFL

SEQ ID NO: 1170455 - protein, 9 aa, Homo Sapiens
LARHIRGER

SEQ ID NO: 1170456 - protein, 9 aa, Homo Sapiens
AISDVPEAI

SEQ ID NO: 1170457 - protein, 9 aa, Homo Sapiens
ATGHHHRSG

SEQ ID NO: 1170458 - protein, 9 aa, Homo Sapiens
KQLRKYLFQ

SEQ ID NO: 1170459 - protein, 9 aa, Homo Sapiens
QQRHPQGPC

SEQ ID NO: 1170460 - protein, 9 aa, Homo Sapiens
HTETAKMYA

SEQ ID NO: 1170461 - protein, 9 aa, Homo Sapiens
RRDEAGGGP

SEQ ID NO: 1170462 - protein, 9 aa, Homo Sapiens
HANLCSMRK

SEQ ID NO: 1170463 - protein, 9 aa, Homo Sapiens
SSEFLSEPM

SEQ ID NO: 1170464 - protein, 9 aa, Homo Sapiens
CLNLRQGFM

SEQ ID NO: 1170465 - protein, 9 aa, Homo Sapiens
QVVYKTQEE

SEQ ID NO: 1170466 - protein, 9 aa, Homo Sapiens
TSSSLLLLA

SEQ ID NO: 1170467 - protein, 9 aa, Homo Sapiens
PRRSPDHRG

SEQ ID NO: 1170468 - protein, 9 aa, Homo Sapiens
AKIASELSH

SEQ ID NO: 1170469 - protein, 9 aa, Homo Sapiens
SAASSSSHL

SEQ ID NO: 1170470 - protein, 9 aa, Homo Sapiens
SNRERGQVQ

SEQ ID NO: 1170471 - protein, 9 aa, Homo Sapiens
VFMGLRMRR

SEQ ID NO: 1170472 - protein, 9 aa, Homo Sapiens
RIPPCRTAM

SEQ ID NO: 1170473 - protein, 9 aa, Homo Sapiens
TFGKECLTI

SEQ ID NO: 1170474 - protein, 9 aa, Homo Sapiens
LCNFRNASE

SEQ ID NO: 1170475 - protein, 9 aa, Homo Sapiens
RLQGWQNCV

SEQ ID NO: 1170476 - protein, 9 aa, Homo Sapiens
TKKRLRTMK

SEQ ID NO: 1170477 - protein, 9 aa, Homo Sapiens
RRAPRRRTC

SEQ ID NO: 1170478 - protein, 9 aa, Homo Sapiens
IVVDPLRGA

SEQ ID NO: 1170479 - protein, 9 aa, Homo Sapiens
GEEASGPWG

SEQ ID NO: 1170480 - protein, 9 aa, Homo Sapiens
DGWLSPALA

SEQ ID NO: 1170481 - protein, 9 aa, Homo Sapiens
SRCDRPPPG

SEQ ID NO: 1170482 - protein, 9 aa, Homo Sapiens
MEDFLKTRV

SEQ ID NO: 1170483 - protein, 9 aa, Homo Sapiens
SPLPAPRPT

SEQ ID NO: 1170484 - protein, 9 aa, Homo Sapiens
SRGPHPADP

SEQ ID NO: 1170485 - protein, 9 aa, Homo Sapiens
GGNPRPAAR

SEQ ID NO: 1170486 - protein, 9 aa, Homo Sapiens
SGIQIQVIG

SEQ ID NO: 1170487 - protein, 9 aa, Homo Sapiens
PSTSSRISS

SEQ ID NO: 1170488 - protein, 9 aa, Homo Sapiens
LPPGTRPQA

SEQ ID NO: 1170489 - protein, 9 aa, Homo Sapiens
NIKSPGLAF

SEQ ID NO: 1170490 - protein, 9 aa, Homo Sapiens
LGKGLHRRM

SEQ ID NO: 1170491 - protein, 9 aa, Homo Sapiens
PVPQSCLII

SEQ ID NO: 1170492 - protein, 9 aa, Homo Sapiens
IHDRSVSRD

SEQ ID NO: 1170493 - protein, 9 aa, Homo Sapiens
VAVEPVAGE

SEQ ID NO: 1170494 - protein, 9 aa, Homo Sapiens
WYLDPDVEY

SEQ ID NO: 1170495 - protein, 9 aa, Homo Sapiens
NKLLDKVTI

SEQ ID NO: 1170496 - protein, 9 aa, Homo Sapiens
VTGARVLSK

SEQ ID NO: 1170497 - protein, 9 aa, Homo Sapiens
YVPQQEISV

SEQ ID NO: 1170498 - protein, 9 aa, Homo Sapiens
AGEYECSVE

SEQ ID NO: 1170499 - protein, 9 aa, Homo Sapiens
WLSPISACP

SEQ ID NO: 1170500 - protein, 9 aa, Homo Sapiens
SGQPARVPT

SEQ ID NO: 1170501 - protein, 9 aa, Homo Sapiens
ASLPSPSCN

SEQ ID NO: 1170502 - protein, 9 aa, Homo Sapiens
AVHFAASRG

SEQ ID NO: 1170503 - protein, 9 aa, Homo Sapiens
VPVKDHVVH

SEQ ID NO: 1170504 - protein, 9 aa, Homo Sapiens
KEGYNIYGI

SEQ ID NO: 1170505 - protein, 9 aa, Homo Sapiens
SLQLHAAVA

SEQ ID NO: 1170506 - protein, 9 aa, Homo Sapiens
EVNAGGRRE

SEQ ID NO: 1170507 - protein, 9 aa, Homo Sapiens
LLQAPDAPP

SEQ ID NO: 1170508 - protein, 9 aa, Homo Sapiens
LAAALQDHD

SEQ ID NO: 1170509 - protein, 9 aa, Homo Sapiens
SAASLPQLS

SEQ ID NO: 1170510 - protein, 9 aa, Homo Sapiens
AAVGVLWGP

SEQ ID NO: 1170511 - protein, 9 aa, Homo Sapiens
AGPHPTGRR

SEQ ID NO: 1170512 - protein, 9 aa, Homo Sapiens
WAPLHHSTG

SEQ ID NO: 1170513 - protein, 9 aa, Homo Sapiens
QRLSAQSAI

SEQ ID NO: 1170514 - protein, 9 aa, Homo Sapiens
RACNLCTCP

SEQ ID NO: 1170515 - protein, 9 aa, Homo Sapiens
DFHRMKQSR

SEQ ID NO: 1170516 - protein, 9 aa, Homo Sapiens
TPSRPGSCI

SEQ ID NO: 1170517 - protein, 9 aa, Homo Sapiens
KDPIDAITG

SEQ ID NO: 1170518 - protein, 9 aa, Homo Sapiens
FMMVMLDPE

SEQ ID NO: 1170519 - protein, 9 aa, Homo Sapiens
PGSAVAAPP

SEQ ID NO: 1170520 - protein, 9 aa, Homo Sapiens
RYGTLKTPP

SEQ ID NO: 1170521 - protein, 9 aa, Homo Sapiens
SCSCSSSLA

SEQ ID NO: 1170522 - protein, 9 aa, Homo Sapiens
ESEEFQRIL

SEQ ID NO: 1170523 - protein, 9 aa, Homo Sapiens
MPQYHSSVN

SEQ ID NO: 1170524 - protein, 9 aa, Homo Sapiens
ETIATQILA

SEQ ID NO: 1170525 - protein, 9 aa, Homo Sapiens
AEPPPPPPQ

SEQ ID NO: 1170526 - protein, 9 aa, Homo Sapiens
GLKKTPKRV

SEQ ID NO: 1170527 - protein, 9 aa, Homo Sapiens
VRVIDVSNG

SEQ ID NO: 1170528 - protein, 9 aa, Homo Sapiens
TLFFFHSQP

SEQ ID NO: 1170529 - protein, 9 aa, Homo Sapiens
STSSRISSS

SEQ ID NO: 1170530 - protein, 9 aa, Homo Sapiens
SQPRAAEKC

SEQ ID NO: 1170531 - protein, 9 aa, Homo Sapiens
GWGWRSPKC

SEQ ID NO: 1170532 - protein, 9 aa, Homo Sapiens
LWKTKKSPS

SEQ ID NO: 1170533 - protein, 9 aa, Homo Sapiens
VSLCQNRPH

SEQ ID NO: 1170534 - protein, 9 aa, Homo Sapiens
IAECTLESA

SEQ ID NO: 1170535 - protein, 9 aa, Homo Sapiens
DLQNAATGS

SEQ ID NO: 1170536 - protein, 9 aa, Homo Sapiens
MKSACEKCL

SEQ ID NO: 1170537 - protein, 9 aa, Homo Sapiens
TAPSAELST

SEQ ID NO: 1170538 - protein, 9 aa, Homo Sapiens
ANSLDNLCC

SEQ ID NO: 1170539 - protein, 9 aa, Homo Sapiens
LHHKDSALS

SEQ ID NO: 1170540 - protein, 9 aa, Homo Sapiens
QRADSGHYQ

SEQ ID NO: 1170541 - protein, 9 aa, Homo Sapiens
ARLTWRRPG

SEQ ID NO: 1170542 - protein, 9 aa, Homo Sapiens
FSFGTGHRL

SEQ ID NO: 1170543 - protein, 9 aa, Homo Sapiens
AAPSEPVAS

SEQ ID NO: 1170544 - protein, 9 aa, Homo Sapiens
DPLPPLRPL

SEQ ID NO: 1170545 - protein, 9 aa, Homo Sapiens
LSPSVALAE

SEQ ID NO: 1170546 - protein, 9 aa, Homo Sapiens
TMSFWKRRN

SEQ ID NO: 1170547 - protein, 9 aa, Homo Sapiens
RFCNSSFHL

SEQ ID NO: 1170548 - protein, 9 aa, Homo Sapiens
QSRSEPEFI

SEQ ID NO: 1170549 - protein, 9 aa, Homo Sapiens
WLASRPSRC

SEQ ID NO: 1170550 - protein, 9 aa, Homo Sapiens
SVVSDVPEE

SEQ ID NO: 1170551 - protein, 9 aa, Homo Sapiens
LFMGLRSIT

SEQ ID NO: 1170552 - protein, 9 aa, Homo Sapiens
LRPGGLSQP

SEQ ID NO: 1170553 - protein, 9 aa, Homo Sapiens
LPAPCSLFP

SEQ ID NO: 1170554 - protein, 9 aa, Homo Sapiens
ERMVEQMCI

SEQ ID NO: 1170555 - protein, 9 aa, Homo Sapiens
MTLKALVKT

SEQ ID NO: 1170556 - protein, 9 aa, Homo Sapiens
TQLKKELTE

SEQ ID NO: 1170557 - protein, 9 aa, Homo Sapiens
KDYPSNSFY

SEQ ID NO: 1170558 - protein, 9 aa, Homo Sapiens
SGSPREARA

SEQ ID NO: 1170559 - protein, 9 aa, Homo Sapiens
IWPAGLQSM

SEQ ID NO: 1170560 - protein, 9 aa, Homo Sapiens
EMDEEGNLS

SEQ ID NO: 1170561 - protein, 9 aa, Homo Sapiens
TEVNSPPPS

SEQ ID NO: 1170562 - protein, 9 aa, Homo Sapiens
SARRSPSWS

SEQ ID NO: 1170563 - protein, 9 aa, Homo Sapiens
TILLEETPP

SEQ ID NO: 1170564 - protein, 9 aa, Homo Sapiens
PSRLRSGIL

SEQ ID NO: 1170565 - protein, 9 aa, Homo Sapiens
SCRRRPSCH

SEQ ID NO: 1170566 - protein, 9 aa, Homo Sapiens
KATYEHLFR

SEQ ID NO: 1170567 - protein, 9 aa, Homo Sapiens
GLLFKGRGQ

SEQ ID NO: 1170568 - protein, 9 aa, Homo Sapiens
VREIRNVVE

SEQ ID NO: 1170569 - protein, 9 aa, Homo Sapiens
LPRRSCCSR

SEQ ID NO: 1170570 - protein, 9 aa, Homo Sapiens
SPDGSQSGY

SEQ ID NO: 1170571 - protein, 9 aa, Homo Sapiens
SSGSVLCFS

SEQ ID NO: 1170572 - protein, 9 aa, Homo Sapiens
GIQIQVIGF

SEQ ID NO: 1170573 - protein, 9 aa, Homo Sapiens
ICLQWIIQC

SEQ ID NO: 1170574 - protein, 9 aa, Homo Sapiens
MVQPTVIAS

SEQ ID NO: 1170575 - protein, 9 aa, Homo Sapiens
PGPKPSLRP

SEQ ID NO: 1170576 - protein, 9 aa, Homo Sapiens
KCNPICQPS

SEQ ID NO: 1170577 - protein, 9 aa, Homo Sapiens
QSNTAIVSV

SEQ ID NO: 1170578 - protein, 9 aa, Homo Sapiens
ALGYPHHCP

SEQ ID NO: 1170579 - protein, 9 aa, Homo Sapiens
QMGFLAGTG

SEQ ID NO: 1170580 - protein, 9 aa, Homo Sapiens
PHDIRIEHT

SEQ ID NO: 1170581 - protein, 9 aa, Homo Sapiens
ACSAGGDAS

SEQ ID NO: 1170582 - protein, 9 aa, Homo Sapiens
GHGSCSWDS

SEQ ID NO: 1170583 - protein, 9 aa, Homo Sapiens
KFVGVMPQY

SEQ ID NO: 1170584 - protein, 9 aa, Homo Sapiens
MAGRKASGS

SEQ ID NO: 1170585 - protein, 9 aa, Homo Sapiens
SDTYGTSRL

SEQ ID NO: 1170586 - protein, 9 aa, Homo Sapiens
PQGFGGRHC

SEQ ID NO: 1170587 - protein, 9 aa, Homo Sapiens
QKHRRRGWG

SEQ ID NO: 1170588 - protein, 9 aa, Homo Sapiens
PSQAPQAWS

SEQ ID NO: 1170589 - protein, 9 aa, Homo Sapiens
SPPSRASAG

SEQ ID NO: 1170590 - protein, 9 aa, Homo Sapiens
YYWINSLLY

SEQ ID NO: 1170591 - protein, 9 aa, Homo Sapiens
MRMRMIRSV

SEQ ID NO: 1170592 - protein, 9 aa, Homo Sapiens
VCKKSPAPA

SEQ ID NO: 1170593 - protein, 9 aa, Homo Sapiens
VQLDQTLQV

SEQ ID NO: 1170594 - protein, 9 aa, Homo Sapiens
YGYKLTGDC

SEQ ID NO: 1170595 - protein, 9 aa, Homo Sapiens
IEEIEAAPP

SEQ ID NO: 1170596 - protein, 9 aa, Homo Sapiens
SYQYILVRI

SEQ ID NO: 1170597 - protein, 9 aa, Homo Sapiens
SNTAIVSVI

SEQ ID NO: 1170598 - protein, 9 aa, Homo Sapiens
LGRRRYLSG

SEQ ID NO: 1170599 - protein, 9 aa, Homo Sapiens
LRQNDIKFF

SEQ ID NO: 1170600 - protein, 9 aa, Homo Sapiens
VLAIPQLPS

SEQ ID NO: 1170601 - protein, 9 aa, Homo Sapiens
NYLRLTIVS

SEQ ID NO: 1170602 - protein, 9 aa, Homo Sapiens
LPCTCSPPW

SEQ ID NO: 1170603 - protein, 9 aa, Homo Sapiens
ALLMSPNKP

SEQ ID NO: 1170604 - protein, 9 aa, Homo Sapiens
MRGFWKGTE

SEQ ID NO: 1170605 - protein, 9 aa, Homo Sapiens
KKTATKIYS

SEQ ID NO: 1170606 - protein, 9 aa, Homo Sapiens
ELQDRIEKN

SEQ ID NO: 1170607 - protein, 9 aa, Homo Sapiens
KNSWIQLFG

SEQ ID NO: 1170608 - protein, 9 aa, Homo Sapiens
GSWPVAQRM

SEQ ID NO: 1170609 - protein, 9 aa, Homo Sapiens
DRSPQAPLR

SEQ ID NO: 1170610 - protein, 9 aa, Homo Sapiens
IYIVGGVST

SEQ ID NO: 1170611 - protein, 9 aa, Homo Sapiens
PCPPGGPAP

SEQ ID NO: 1170612 - protein, 9 aa, Homo Sapiens
GSQHHMEPG

SEQ ID NO: 1170613 - protein, 9 aa, Homo Sapiens
ASRLKPSAP

SEQ ID NO: 1170614 - protein, 9 aa, Homo Sapiens
QVLCRQVYV

SEQ ID NO: 1170615 - protein, 9 aa, Homo Sapiens
EEGKGIFTT

SEQ ID NO: 1170616 - protein, 9 aa, Homo Sapiens
SFLQFMMVM

SEQ ID NO: 1170617 - protein, 9 aa, Homo Sapiens
PGDDAHGPW

SEQ ID NO: 1170618 - protein, 9 aa, Homo Sapiens
GHEVTEGIV

SEQ ID NO: 1170619 - protein, 9 aa, Homo Sapiens
SAAGTPHHI

SEQ ID NO: 1170620 - protein, 9 aa, Homo Sapiens
SDWVSFAVL

SEQ ID NO: 1170621 - protein, 9 aa, Homo Sapiens
TRTTPADSS

SEQ ID NO: 1170622 - protein, 9 aa, Homo Sapiens
CCKSFKGSS

SEQ ID NO: 1170623 - protein, 9 aa, Homo Sapiens
APPRSGRGS

SEQ ID NO: 1170624 - protein, 9 aa, Homo Sapiens
VLNVNKWTE

SEQ ID NO: 1170625 - protein, 9 aa, Homo Sapiens
ETMVNFCCY

SEQ ID NO: 1170626 - protein, 9 aa, Homo Sapiens
VWEFFYGHF

SEQ ID NO: 1170627 - protein, 9 aa, Homo Sapiens
RGAAAKRYA

SEQ ID NO: 1170628 - protein, 9 aa, Homo Sapiens
SGHCSGCRP

SEQ ID NO: 1170629 - protein, 9 aa, Homo Sapiens
RLGSRMFWY

SEQ ID NO: 1170630 - protein, 9 aa, Homo Sapiens
DSGVYTEPY

SEQ ID NO: 1170631 - protein, 9 aa, Homo Sapiens
GDKLEELLR

SEQ ID NO: 1170632 - protein, 9 aa, Homo Sapiens
AKEVNSRSL

SEQ ID NO: 1170633 - protein, 9 aa, Homo Sapiens
PRRDPRPGH

SEQ ID NO: 1170634 - protein, 9 aa, Homo Sapiens
HQLQEAALM

SEQ ID NO: 1170635 - protein, 9 aa, Homo Sapiens
QSQAAPSPL

SEQ ID NO: 1170636 - protein, 9 aa, Homo Sapiens
GKPTPPPQS

SEQ ID NO: 1170637 - protein, 9 aa, Homo Sapiens
HHCPPGGHP

SEQ ID NO: 1170638 - protein, 9 aa, Homo Sapiens
GRITYSHSP

SEQ ID NO: 1170639 - protein, 9 aa, Homo Sapiens
AGDGVGQAS

SEQ ID NO: 1170640 - protein, 9 aa, Homo Sapiens
YGQHRSSSG

SEQ ID NO: 1170641 - protein, 9 aa, Homo Sapiens
VEYKPPKNP

SEQ ID NO: 1170642 - protein, 9 aa, Homo Sapiens
VKIRSGWRS

SEQ ID NO: 1170643 - protein, 9 aa, Homo Sapiens
DNWLVTFWT

SEQ ID NO: 1170644 - protein, 9 aa, Homo Sapiens
GRIQMVHSS

SEQ ID NO: 1170645 - protein, 9 aa, Homo Sapiens
MLPKGAASC

SEQ ID NO: 1170646 - protein, 9 aa, Homo Sapiens
SNEVLLSLM

SEQ ID NO: 1170647 - protein, 9 aa, Homo Sapiens
RTTFGELVQ

SEQ ID NO: 1170648 - protein, 9 aa, Homo Sapiens
AVISVTAMQ

SEQ ID NO: 1170649 - protein, 9 aa, Homo Sapiens
GALRSAIIH

SEQ ID NO: 1170650 - protein, 9 aa, Homo Sapiens
ITQLKKELT

SEQ ID NO: 1170651 - protein, 9 aa, Homo Sapiens
HRERINRSL

SEQ ID NO: 1170652 - protein, 9 aa, Homo Sapiens
GEGRRPQRY

SEQ ID NO: 1170653 - protein, 9 aa, Homo Sapiens
RPQRYTKPG

SEQ ID NO: 1170654 - protein, 9 aa, Homo Sapiens
SAGPEVDVF

SEQ ID NO: 1170655 - protein, 9 aa, Homo Sapiens
PARAAGAGS

SEQ ID NO: 1170656 - protein, 9 aa, Homo Sapiens
ELAPRLVGA

SEQ ID NO: 1170657 - protein, 9 aa, Homo Sapiens
ESPPASLKN

SEQ ID NO: 1170658 - protein, 9 aa, Homo Sapiens
VSSVTYGGS

SEQ ID NO: 1170659 - protein, 9 aa, Homo Sapiens
CWARVPGSQ

SEQ ID NO: 1170660 - protein, 9 aa, Homo Sapiens
TYLQIVVDV

SEQ ID NO: 1170661 - protein, 9 aa, Homo Sapiens
QVQEVLSTT

SEQ ID NO: 1170662 - protein, 9 aa, Homo Sapiens
MSPPAKPSS

SEQ ID NO: 1170663 - protein, 9 aa, Homo Sapiens
VPFEDDKPF

SEQ ID NO: 1170664 - protein, 9 aa, Homo Sapiens
EWYHLRFTI

SEQ ID NO: 1170665 - protein, 9 aa, Homo Sapiens
PTIRKEDFN

SEQ ID NO: 1170666 - protein, 9 aa, Homo Sapiens
HQGVGVSSA

SEQ ID NO: 1170667 - protein, 9 aa, Homo Sapiens
DQFVPPALA

SEQ ID NO: 1170668 - protein, 9 aa, Homo Sapiens
SCNLWMPST

SEQ ID NO: 1170669 - protein, 9 aa, Homo Sapiens
TVLWLKDNS

SEQ ID NO: 1170670 - protein, 9 aa, Homo Sapiens
QLKWSLVEG

SEQ ID NO: 1170671 - protein, 9 aa, Homo Sapiens
PPTPTSPRL

SEQ ID NO: 1170672 - protein, 9 aa, Homo Sapiens
SRSSRQTGA

SEQ ID NO: 1170673 - protein, 9 aa, Homo Sapiens
CDEAPSLRC

SEQ ID NO: 1170674 - protein, 9 aa, Homo Sapiens
PQRLDGLLN

SEQ ID NO: 1170675 - protein, 9 aa, Homo Sapiens
PEEKTKRRN

SEQ ID NO: 1170676 - protein, 9 aa, Homo Sapiens
QEKKRGKPL

SEQ ID NO: 1170677 - protein, 9 aa, Homo Sapiens
RDGHWYKEG

SEQ ID NO: 1170678 - protein, 9 aa, Homo Sapiens
KQAKKGKPP

SEQ ID NO: 1170679 - protein, 9 aa, Homo Sapiens
IPVRQVASA

SEQ ID NO: 1170680 - protein, 9 aa, Homo Sapiens
KGEAAPPAP

SEQ ID NO: 1170681 - protein, 9 aa, Homo Sapiens
YSHSPPRGW

SEQ ID NO: 1170682 - protein, 9 aa, Homo Sapiens
GFKGHFLST

SEQ ID NO: 1170683 - protein, 9 aa, Homo Sapiens
LGRCCCSGN

SEQ ID NO: 1170684 - protein, 9 aa, Homo Sapiens
PSMKGLTEA

SEQ ID NO: 1170685 - protein, 9 aa, Homo Sapiens
PPATAWTSW

SEQ ID NO: 1170686 - protein, 9 aa, Homo Sapiens
TAPALPMVV

SEQ ID NO: 1170687 - protein, 9 aa, Homo Sapiens
RTSGGPGAW

SEQ ID NO: 1170688 - protein, 9 aa, Homo Sapiens
DQNRKDAEA

SEQ ID NO: 1170689 - protein, 9 aa, Homo Sapiens
DLPNRMCAY

SEQ ID NO: 1170690 - protein, 9 aa, Homo Sapiens
VHDLKYGTP

SEQ ID NO: 1170691 - protein, 9 aa, Homo Sapiens
LNVEHSETS

SEQ ID NO: 1170692 - protein, 9 aa, Homo Sapiens
RVLVCGGNR

SEQ ID NO: 1170693 - protein, 9 aa, Homo Sapiens
GAPPECCSS

SEQ ID NO: 1170694 - protein, 9 aa, Homo Sapiens
EIEAAPPKA

SEQ ID NO: 1170695 - protein, 9 aa, Homo Sapiens
IVSPDALGV

SEQ ID NO: 1170696 - protein, 9 aa, Homo Sapiens
SPEKAPSSP

SEQ ID NO: 1170697 - protein, 9 aa, Homo Sapiens
APDAPPELF

SEQ ID NO: 1170698 - protein, 9 aa, Homo Sapiens
PERRRPARI

SEQ ID NO: 1170699 - protein, 9 aa, Homo Sapiens
CCLRTSCGA

SEQ ID NO: 1170700 - protein, 9 aa, Homo Sapiens
ELYGPKKCG

SEQ ID NO: 1170701 - protein, 9 aa, Homo Sapiens
ERIQPGGWF

SEQ ID NO: 1170702 - protein, 9 aa, Homo Sapiens
LLINSRKCL

SEQ ID NO: 1170703 - protein, 9 aa, Homo Sapiens
DNATTTSSQ

SEQ ID NO: 1170704 - protein, 9 aa, Homo Sapiens
QNNAVLVVS

SEQ ID NO: 1170705 - protein, 9 aa, Homo Sapiens
GYRVGRMRP

SEQ ID NO: 1170706 - protein, 9 aa, Homo Sapiens
SGKSVVSDV

SEQ ID NO: 1170707 - protein, 9 aa, Homo Sapiens
NTLGGLFPV

SEQ ID NO: 1170708 - protein, 9 aa, Homo Sapiens
AYAFRIYDH

SEQ ID NO: 1170709 - protein, 9 aa, Homo Sapiens
GGGQPAHAE

SEQ ID NO: 1170710 - protein, 9 aa, Homo Sapiens
FNVAGKIHT

SEQ ID NO: 1170711 - protein, 9 aa, Homo Sapiens
EAETRSTLM

SEQ ID NO: 1170712 - protein, 9 aa, Homo Sapiens
LLEELSLNY

SEQ ID NO: 1170713 - protein, 9 aa, Homo Sapiens
GPSVFCPHP

SEQ ID NO: 1170714 - protein, 9 aa, Homo Sapiens
RQASRLKPS

SEQ ID NO: 1170715 - protein, 9 aa, Homo Sapiens
LIRGGGGAC

SEQ ID NO: 1170716 - protein, 9 aa, Homo Sapiens
AFGPARVFT

SEQ ID NO: 1170717 - protein, 9 aa, Homo Sapiens
WRCFELDPV

SEQ ID NO: 1170718 - protein, 9 aa, Homo Sapiens
RTRGQARAG

SEQ ID NO: 1170719 - protein, 9 aa, Homo Sapiens
GKGVRRLGS

SEQ ID NO: 1170720 - protein, 9 aa, Homo Sapiens
QTPGGSSCK

SEQ ID NO: 1170721 - protein, 9 aa, Homo Sapiens
AASSSSHLP

SEQ ID NO: 1170722 - protein, 9 aa, Homo Sapiens
HRPRCWYFP

SEQ ID NO: 1170723 - protein, 9 aa, Homo Sapiens
EVCAASERL

SEQ ID NO: 1170724 - protein, 9 aa, Homo Sapiens
SGRQVHRTR

SEQ ID NO: 1170725 - protein, 9 aa, Homo Sapiens
PWREAWRRS

SEQ ID NO: 1170726 - protein, 9 aa, Homo Sapiens
AWGRCGPAG

SEQ ID NO: 1170727 - protein, 9 aa, Homo Sapiens
PTHLFHTDR

SEQ ID NO: 1170728 - protein, 9 aa, Homo Sapiens
FALALLLSL

SEQ ID NO: 1170729 - protein, 9 aa, Homo Sapiens
LVFLTIYNV

SEQ ID NO: 1170730 - protein, 9 aa, Homo Sapiens
VHRMVTNCS

SEQ ID NO: 1170731 - protein, 9 aa, Homo Sapiens
AVIKGMTYL

SEQ ID NO: 1170732 - protein, 9 aa, Homo Sapiens
KLDEKTQQS

SEQ ID NO: 1170733 - protein, 9 aa, Homo Sapiens
WIAAVAVTA

SEQ ID NO: 1170734 - protein, 9 aa, Homo Sapiens
SRNSSSVWP

SEQ ID NO: 1170735 - protein, 9 aa, Homo Sapiens
PTTGHAPRL

SEQ ID NO: 1170736 - protein, 9 aa, Homo Sapiens
WETCHISNL

SEQ ID NO: 1170737 - protein, 9 aa, Homo Sapiens
SSGGSPEWQ

SEQ ID NO: 1170738 - protein, 9 aa, Homo Sapiens
GGPGSAVAA

SEQ ID NO: 1170739 - protein, 9 aa, Homo Sapiens
GTRPQAHSA

SEQ ID NO: 1170740 - protein, 9 aa, Homo Sapiens
VLAGEGAAL

SEQ ID NO: 1170741 - protein, 9 aa, Homo Sapiens
VNGRMRRFA

SEQ ID NO: 1170742 - protein, 9 aa, Homo Sapiens
PEWQITAQH

SEQ ID NO: 1170743 - protein, 9 aa, Homo Sapiens
CLLQAPDTD

SEQ ID NO: 1170744 - protein, 9 aa, Homo Sapiens
TGFFTPCLI

SEQ ID NO: 1170745 - protein, 9 aa, Homo Sapiens
PTSTRSLPS

SEQ ID NO: 1170746 - protein, 9 aa, Homo Sapiens
GGRPPCPPG

SEQ ID NO: 1170747 - protein, 9 aa, Homo Sapiens
RLEMCLGLP

SEQ ID NO: 1170748 - protein, 9 aa, Homo Sapiens
LRTGNPLSV

SEQ ID NO: 1170749 - protein, 9 aa, Homo Sapiens
QGPRLWASN

SEQ ID NO: 1170750 - protein, 9 aa, Homo Sapiens
MCPLNPAAQ

SEQ ID NO: 1170751 - protein, 9 aa, Homo Sapiens
PPTACLANH

SEQ ID NO: 1170752 - protein, 9 aa, Homo Sapiens
TQTWTRLPR

SEQ ID NO: 1170753 - protein, 9 aa, Homo Sapiens
IRTELSLLL

SEQ ID NO: 1170754 - protein, 9 aa, Homo Sapiens
GALLPFLDV

SEQ ID NO: 1170755 - protein, 9 aa, Homo Sapiens
GFMAAWPEW

SEQ ID NO: 1170756 - protein, 9 aa, Homo Sapiens
GVQGLTGLQ

SEQ ID NO: 1170757 - protein, 9 aa, Homo Sapiens
VLAINVHDL

SEQ ID NO: 1170758 - protein, 9 aa, Homo Sapiens
CTAPRTCAG

SEQ ID NO: 1170759 - protein, 9 aa, Homo Sapiens
VPLAITISL

SEQ ID NO: 1170760 - protein, 9 aa, Homo Sapiens
PGCWARVPG

SEQ ID NO: 1170761 - protein, 9 aa, Homo Sapiens
AERGRATVR

SEQ ID NO: 1170762 - protein, 9 aa, Homo Sapiens
NLAVHGLAL

SEQ ID NO: 1170763 - protein, 9 aa, Homo Sapiens
SKMNKDVQM

SEQ ID NO: 1170764 - protein, 9 aa, Homo Sapiens
QCGRTFRSA

SEQ ID NO: 1170765 - protein, 9 aa, Homo Sapiens
CETTHPSPS

SEQ ID NO: 1170766 - protein, 9 aa, Homo Sapiens
LKLAVIKNV

SEQ ID NO: 1170767 - protein, 9 aa, Homo Sapiens
VFPSLQGAP

SEQ ID NO: 1170768 - protein, 9 aa, Homo Sapiens
PPAQSLNHF

SEQ ID NO: 1170769 - protein, 9 aa, Homo Sapiens
KRGLGTAAA

SEQ ID NO: 1170770 - protein, 9 aa, Homo Sapiens
KPSHGVCVE

SEQ ID NO: 1170771 - protein, 9 aa, Homo Sapiens
DDTPMVRQA

SEQ ID NO: 1170772 - protein, 9 aa, Homo Sapiens
LCLPTLDYL

SEQ ID NO: 1170773 - protein, 9 aa, Homo Sapiens
LQDPLDRCY

SEQ ID NO: 1170774 - protein, 9 aa, Homo Sapiens
ESEVDFSIH

SEQ ID NO: 1170775 - protein, 9 aa, Homo Sapiens
LYLSTESGN

SEQ ID NO: 1170776 - protein, 9 aa, Homo Sapiens
FLSVYQALI

SEQ ID NO: 1170777 - protein, 9 aa, Homo Sapiens
TPRPAPSLW

SEQ ID NO: 1170778 - protein, 9 aa, Homo Sapiens
RQLLDKYVA

SEQ ID NO: 1170779 - protein, 9 aa, Homo Sapiens
PGSCISYPE

SEQ ID NO: 1170780 - protein, 9 aa, Homo Sapiens
NAATCFKRA

SEQ ID NO: 1170781 - protein, 9 aa, Homo Sapiens
GASRESPSS

SEQ ID NO: 1170782 - protein, 9 aa, Homo Sapiens
TANGWAGQP

SEQ ID NO: 1170783 - protein, 9 aa, Homo Sapiens
IHCSQCTGP

SEQ ID NO: 1170784 - protein, 9 aa, Homo Sapiens
NCGQRMKEG

SEQ ID NO: 1170785 - protein, 9 aa, Homo Sapiens
AVIAAGPLY

SEQ ID NO: 1170786 - protein, 9 aa, Homo Sapiens
SGRGPEVNA

SEQ ID NO: 1170787 - protein, 9 aa, Homo Sapiens
GRRFEYDGP

SEQ ID NO: 1170788 - protein, 9 aa, Homo Sapiens
ELPNGCVYY

SEQ ID NO: 1170789 - protein, 9 aa, Homo Sapiens
NSHQETKYR

SEQ ID NO: 1170790 - protein, 9 aa, Homo Sapiens
SSSSSCAPS

SEQ ID NO: 1170791 - protein, 9 aa, Homo Sapiens
GAARWLVLS

SEQ ID NO: 1170792 - protein, 9 aa, Homo Sapiens
VPIRVSPRS

SEQ ID NO: 1170793 - protein, 9 aa, Homo Sapiens
GQIKQSNTA

SEQ ID NO: 1170794 - protein, 9 aa, Homo Sapiens
WRILNHVGK

SEQ ID NO: 1170795 - protein, 9 aa, Homo Sapiens
PKVENFNVA

SEQ ID NO: 1170796 - protein, 9 aa, Homo Sapiens
RRSPSWSAA

SEQ ID NO: 1170797 - protein, 9 aa, Homo Sapiens
MSLLERVLF

SEQ ID NO: 1170798 - protein, 9 aa, Homo Sapiens
SSAPASTRD

SEQ ID NO: 1170799 - protein, 9 aa, Homo Sapiens
CCQSGTCSG

SEQ ID NO: 1170800 - protein, 9 aa, Homo Sapiens
WGAGRLASS

SEQ ID NO: 1170801 - protein, 9 aa, Homo Sapiens
EGKPDKSEE

SEQ ID NO: 1170802 - protein, 9 aa, Homo Sapiens
PFSSLHAWN

SEQ ID NO: 1170803 - protein, 9 aa, Homo Sapiens
GNATCARLS

SEQ ID NO: 1170804 - protein, 9 aa, Homo Sapiens
SAYTARISV

SEQ ID NO: 1170805 - protein, 9 aa, Homo Sapiens
CRALARTST

SEQ ID NO: 1170806 - protein, 9 aa, Homo Sapiens
DVQYQKVPV

SEQ ID NO: 1170807 - protein, 9 aa, Homo Sapiens
SKKFSNVLT

SEQ ID NO: 1170808 - protein, 9 aa, Homo Sapiens
PPSLCGALR

SEQ ID NO: 1170809 - protein, 9 aa, Homo Sapiens
GRGQILHRG

SEQ ID NO: 1170810 - protein, 9 aa, Homo Sapiens
LIRTELSLL

SEQ ID NO: 1170811 - protein, 9 aa, Homo Sapiens
PFLDVQYQK

SEQ ID NO: 1170812 - protein, 9 aa, Homo Sapiens
KELTENINA

SEQ ID NO: 1170813 - protein, 9 aa, Homo Sapiens
TAESHLFYK

SEQ ID NO: 1170814 - protein, 9 aa, Homo Sapiens
DAQAVCARG

SEQ ID NO: 1170815 - protein, 9 aa, Homo Sapiens
TYVPVAPPP

SEQ ID NO: 1170816 - protein, 9 aa, Homo Sapiens
PGGPTEPGP

SEQ ID NO: 1170817 - protein, 9 aa, Homo Sapiens
NGEQGSDGI

SEQ ID NO: 1170818 - protein, 9 aa, Homo Sapiens
RQVHPVLRA

SEQ ID NO: 1170819 - protein, 9 aa, Homo Sapiens
VIAASPAPT

SEQ ID NO: 1170820 - protein, 9 aa, Homo Sapiens
WIQLFGLRS

SEQ ID NO: 1170821 - protein, 9 aa, Homo Sapiens
LSRGSPGAS

SEQ ID NO: 1170822 - protein, 9 aa, Homo Sapiens
EKPYQCDCC

SEQ ID NO: 1170823 - protein, 9 aa, Homo Sapiens
EEGNGRAPG

SEQ ID NO: 1170824 - protein, 9 aa, Homo Sapiens
IEACCSLQK

SEQ ID NO: 1170825 - protein, 9 aa, Homo Sapiens
GSGHLRPPV

SEQ ID NO: 1170826 - protein, 9 aa, Homo Sapiens
PPRCWGSAF

SEQ ID NO: 1170827 - protein, 9 aa, Homo Sapiens
ESPWEAALR

SEQ ID NO: 1170828 - protein, 9 aa, Homo Sapiens
RRTRPNRVL

SEQ ID NO: 1170829 - protein, 9 aa, Homo Sapiens
PEESLGKGL

SEQ ID NO: 1170830 - protein, 9 aa, Homo Sapiens
HPHQGSGAA

SEQ ID NO: 1170831 - protein, 9 aa, Homo Sapiens
IVIGDDTCQ

SEQ ID NO: 1170832 - protein, 9 aa, Homo Sapiens
PGTAMPQMQ

SEQ ID NO: 1170833 - protein, 9 aa, Homo Sapiens
AFIPGLPAP

SEQ ID NO: 1170834 - protein, 9 aa, Homo Sapiens
ASEQQLGAG

SEQ ID NO: 1170835 - protein, 9 aa, Homo Sapiens
NRERGQVQE

SEQ ID NO: 1170836 - protein, 9 aa, Homo Sapiens
GIAYLVVAS

SEQ ID NO: 1170837 - protein, 9 aa, Homo Sapiens
PEPPRPHAS

SEQ ID NO: 1170838 - protein, 9 aa, Homo Sapiens
LSRILWFKV

SEQ ID NO: 1170839 - protein, 9 aa, Homo Sapiens
IARDSILSH

SEQ ID NO: 1170840 - protein, 9 aa, Homo Sapiens
FYLDEIEHG

SEQ ID NO: 1170841 - protein, 9 aa, Homo Sapiens
FLLWKKRFG

SEQ ID NO: 1170842 - protein, 9 aa, Homo Sapiens
KIINYKILV

SEQ ID NO: 1170843 - protein, 9 aa, Homo Sapiens
TRRVQPIKL

SEQ ID NO: 1170844 - protein, 9 aa, Homo Sapiens
RWSPLPALS

SEQ ID NO: 1170845 - protein, 9 aa, Homo Sapiens
TLPLTINLL

SEQ ID NO: 1170846 - protein, 9 aa, Homo Sapiens
RSIVILQDC

SEQ ID NO: 1170847 - protein, 9 aa, Homo Sapiens
GTRATNGAP

SEQ ID NO: 1170848 - protein, 9 aa, Homo Sapiens
CQTCMTRWF

SEQ ID NO: 1170849 - protein, 9 aa, Homo Sapiens
ALRSAIIHK

SEQ ID NO: 1170850 - protein, 9 aa, Homo Sapiens
TAIDMQVGL

SEQ ID NO: 1170851 - protein, 9 aa, Homo Sapiens
LQAHFNPQR

SEQ ID NO: 1170852 - protein, 9 aa, Homo Sapiens
NVDGIHEFQ

SEQ ID NO: 1170853 - protein, 9 aa, Homo Sapiens
KWSYKPQLN

SEQ ID NO: 1170854 - protein, 9 aa, Homo Sapiens
LDSGVYTEP

SEQ ID NO: 1170855 - protein, 9 aa, Homo Sapiens
SLLTKNGNF

SEQ ID NO: 1170856 - protein, 9 aa, Homo Sapiens
VVYKTQEEE

SEQ ID NO: 1170857 - protein, 9 aa, Homo Sapiens
SPGMQRRRK

SEQ ID NO: 1170858 - protein, 9 aa, Homo Sapiens
KSSGASWVS

SEQ ID NO: 1170859 - protein, 9 aa, Homo Sapiens
NLEKKRKKE

SEQ ID NO: 1170860 - protein, 9 aa, Homo Sapiens
SKGSRGPLA

SEQ ID NO: 1170861 - protein, 9 aa, Homo Sapiens
AYLVVASLC

SEQ ID NO: 1170862 - protein, 9 aa, Homo Sapiens
AAGKKWDHE

SEQ ID NO: 1170863 - protein, 9 aa, Homo Sapiens
AACTPSRPG

SEQ ID NO: 1170864 - protein, 9 aa, Homo Sapiens
SEHNLLVHK

SEQ ID NO: 1170865 - protein, 9 aa, Homo Sapiens
MARPMESRP

SEQ ID NO: 1170866 - protein, 9 aa, Homo Sapiens
FGGTPQWGA

SEQ ID NO: 1170867 - protein, 9 aa, Homo Sapiens
AAPRPHPRG

SEQ ID NO: 1170868 - protein, 9 aa, Homo Sapiens
MCQYGECLH

SEQ ID NO: 1170869 - protein, 9 aa, Homo Sapiens
APQRVGEKR

SEQ ID NO: 1170870 - protein, 9 aa, Homo Sapiens
GHSRTPPSA

SEQ ID NO: 1170871 - protein, 9 aa, Homo Sapiens
LWAWKAGTG

SEQ ID NO: 1170872 - protein, 9 aa, Homo Sapiens
RRSWNRWKT

SEQ ID NO: 1170873 - protein, 9 aa, Homo Sapiens
ASPALPDAW

SEQ ID NO: 1170874 - protein, 9 aa, Homo Sapiens
LRLDLAGQE

SEQ ID NO: 1170875 - protein, 9 aa, Homo Sapiens
DITEGDSSW

SEQ ID NO: 1170876 - protein, 9 aa, Homo Sapiens
HPEDETLPI

SEQ ID NO: 1170877 - protein, 9 aa, Homo Sapiens
GAPGRRGSR

SEQ ID NO: 1170878 - protein, 9 aa, Homo Sapiens
SPTCVEAAS

SEQ ID NO: 1170879 - protein, 9 aa, Homo Sapiens
DLCFSPIPV

SEQ ID NO: 1170880 - protein, 9 aa, Homo Sapiens
FSNNWNSST

SEQ ID NO: 1170881 - protein, 9 aa, Homo Sapiens
PLTINLLEE

SEQ ID NO: 1170882 - protein, 9 aa, Homo Sapiens
PISLTRTEK

SEQ ID NO: 1170883 - protein, 9 aa, Homo Sapiens
KCTSSISTF

SEQ ID NO: 1170884 - protein, 9 aa, Homo Sapiens
NRGAGASCF

SEQ ID NO: 1170885 - protein, 9 aa, Homo Sapiens
PRLALSPAP

SEQ ID NO: 1170886 - protein, 9 aa, Homo Sapiens
TTPADSSAL

SEQ ID NO: 1170887 - protein, 9 aa, Homo Sapiens
VTYGGSDDY

SEQ ID NO: 1170888 - protein, 9 aa, Homo Sapiens
NFPPHGTER

SEQ ID NO: 1170889 - protein, 9 aa, Homo Sapiens
RSHSDTRPF

SEQ ID NO: 1170890 - protein, 9 aa, Homo Sapiens
MPSDIHVEA

SEQ ID NO: 1170891 - protein, 9 aa, Homo Sapiens
PTMAPSTPT

SEQ ID NO: 1170892 - protein, 9 aa, Homo Sapiens
PGWRWRRGH

SEQ ID NO: 1170893 - protein, 9 aa, Homo Sapiens
PYMTQKVQN

SEQ ID NO: 1170894 - protein, 9 aa, Homo Sapiens
TSRTSRGQP

SEQ ID NO: 1170895 - protein, 9 aa, Homo Sapiens
LLPMLSVKK

SEQ ID NO: 1170896 - protein, 9 aa, Homo Sapiens
VATVFRGCM

SEQ ID NO: 1170897 - protein, 9 aa, Homo Sapiens
RLRSGGLPQ

SEQ ID NO: 1170898 - protein, 9 aa, Homo Sapiens
RAAGAGSAP

SEQ ID NO: 1170899 - protein, 9 aa, Homo Sapiens
PLRVQSVLL

SEQ ID NO: 1170900 - protein, 9 aa, Homo Sapiens
APSRALRGS

SEQ ID NO: 1170901 - protein, 9 aa, Homo Sapiens
PALGCWSSA

SEQ ID NO: 1170902 - protein, 9 aa, Homo Sapiens
YIPVGIIIP

SEQ ID NO: 1170903 - protein, 9 aa, Homo Sapiens
ACTPWPRSY

SEQ ID NO: 1170904 - protein, 9 aa, Homo Sapiens
EPGPRVGPP

SEQ ID NO: 1170905 - protein, 9 aa, Homo Sapiens
VCAMTRDSL

SEQ ID NO: 1170906 - protein, 9 aa, Homo Sapiens
WVDYSITKR

SEQ ID NO: 1170907 - protein, 9 aa, Homo Sapiens
KIPLSKNNI

SEQ ID NO: 1170908 - protein, 9 aa, Homo Sapiens
VTYVRSGCR

SEQ ID NO: 1170909 - protein, 9 aa, Homo Sapiens
RESHTIVYL

SEQ ID NO: 1170910 - protein, 9 aa, Homo Sapiens
RGSDTDIWK

SEQ ID NO: 1170911 - protein, 9 aa, Homo Sapiens
HSEQFNAFL

SEQ ID NO: 1170912 - protein, 9 aa, Homo Sapiens
DPEWQITAQ

SEQ ID NO: 1170913 - protein, 9 aa, Homo Sapiens
PALSRTGRR

SEQ ID NO: 1170914 - protein, 9 aa, Homo Sapiens
TGGLDNPVR

SEQ ID NO: 1170915 - protein, 9 aa, Homo Sapiens
TFSTLFPVL

SEQ ID NO: 1170916 - protein, 9 aa, Homo Sapiens
RTRPNRVLT

SEQ ID NO: 1170917 - protein, 9 aa, Homo Sapiens
TGGKKVLNL

SEQ ID NO: 1170918 - protein, 9 aa, Homo Sapiens
DYEKREELR

SEQ ID NO: 1170919 - protein, 9 aa, Homo Sapiens
EPLEPPGPA

SEQ ID NO: 1170920 - protein, 9 aa, Homo Sapiens
FRGCMSMKE

SEQ ID NO: 1170921 - protein, 9 aa, Homo Sapiens
DMVRSMDRK

SEQ ID NO: 1170922 - protein, 9 aa, Homo Sapiens
AAFNHCAQP

SEQ ID NO: 1170923 - protein, 9 aa, Homo Sapiens
ACISVGRYL

SEQ ID NO: 1170924 - protein, 9 aa, Homo Sapiens
RMKFSMWDR

SEQ ID NO: 1170925 - protein, 9 aa, Homo Sapiens
PARRRRRPR

SEQ ID NO: 1170926 - protein, 9 aa, Homo Sapiens
AFGHRSMDP

SEQ ID NO: 1170927 - protein, 9 aa, Homo Sapiens
GMACDSVSG

SEQ ID NO: 1170928 - protein, 9 aa, Homo Sapiens
PIMKTSPTV

SEQ ID NO: 1170929 - protein, 9 aa, Homo Sapiens
PDDQDHGAA

SEQ ID NO: 1170930 - protein, 9 aa, Homo Sapiens
VLNLATVNV

SEQ ID NO: 1170931 - protein, 9 aa, Homo Sapiens
NNCIQVFKP

SEQ ID NO: 1170932 - protein, 9 aa, Homo Sapiens
APTQQLLPP

SEQ ID NO: 1170933 - protein, 9 aa, Homo Sapiens
DVVIRVKAV

SEQ ID NO: 1170934 - protein, 9 aa, Homo Sapiens
LHPQWAPHS

SEQ ID NO: 1170935 - protein, 9 aa, Homo Sapiens
CELYGDRKL

SEQ ID NO: 1170936 - protein, 9 aa, Homo Sapiens
RIHTRENLT

SEQ ID NO: 1170937 - protein, 9 aa, Homo Sapiens
VLRTSANVN

SEQ ID NO: 1170938 - protein, 9 aa, Homo Sapiens
QHWSFVKWL

SEQ ID NO: 1170939 - protein, 9 aa, Homo Sapiens
LWGLLPVLG

SEQ ID NO: 1170940 - protein, 9 aa, Homo Sapiens
LRVPDTHVT

SEQ ID NO: 1170941 - protein, 9 aa, Homo Sapiens
DDFELPQAV

SEQ ID NO: 1170942 - protein, 9 aa, Homo Sapiens
LDTLVRLKA

SEQ ID NO: 1170943 - protein, 9 aa, Homo Sapiens
ACALPDARV

SEQ ID NO: 1170944 - protein, 9 aa, Homo Sapiens
GHHPPAQPW

SEQ ID NO: 1170945 - protein, 9 aa, Homo Sapiens
MASLRQDCG

SEQ ID NO: 1170946 - protein, 9 aa, Homo Sapiens
KALLLPVQL

SEQ ID NO: 1170947 - protein, 9 aa, Homo Sapiens
ILIHDRSVS

SEQ ID NO: 1170948 - protein, 9 aa, Homo Sapiens
NSHETETKE

SEQ ID NO: 1170949 - protein, 9 aa, Homo Sapiens
IVRVIDVSN

SEQ ID NO: 1170950 - protein, 9 aa, Homo Sapiens
LRMSVGTSS

SEQ ID NO: 1170951 - protein, 9 aa, Homo Sapiens
HSGNNVVSE

SEQ ID NO: 1170952 - protein, 9 aa, Homo Sapiens
NGPPVLVKE

SEQ ID NO: 1170953 - protein, 9 aa, Homo Sapiens
PPSPSSLLS

SEQ ID NO: 1170954 - protein, 9 aa, Homo Sapiens
GEDANAATC

SEQ ID NO: 1170955 - protein, 9 aa, Homo Sapiens
VASQKPPPP

SEQ ID NO: 1170956 - protein, 9 aa, Homo Sapiens
RKAEAESPA

SEQ ID NO: 1170957 - protein, 9 aa, Homo Sapiens
VCDFIDNLD

SEQ ID NO: 1170958 - protein, 9 aa, Homo Sapiens
TPDMAFESI

SEQ ID NO: 1170959 - protein, 9 aa, Homo Sapiens
TNTYAAGGM

SEQ ID NO: 1170960 - protein, 9 aa, Homo Sapiens
PPLGLHSSI

SEQ ID NO: 1170961 - protein, 9 aa, Homo Sapiens
NVPEEKTKR

SEQ ID NO: 1170962 - protein, 9 aa, Homo Sapiens
NRDNWLVTF

SEQ ID NO: 1170963 - protein, 9 aa, Homo Sapiens
KIFNQFSVT

SEQ ID NO: 1170964 - protein, 9 aa, Homo Sapiens
NAGRYYCAA

SEQ ID NO: 1170965 - protein, 9 aa, Homo Sapiens
PPKQWLYKH

SEQ ID NO: 1170966 - protein, 9 aa, Homo Sapiens
ICKSLTEQF

SEQ ID NO: 1170967 - protein, 9 aa, Homo Sapiens
RRKMTTLER

SEQ ID NO: 1170968 - protein, 9 aa, Homo Sapiens
IERLEDVPP

SEQ ID NO: 1170969 - protein, 9 aa, Homo Sapiens
VPVDQVNHK

SEQ ID NO: 1170970 - protein, 9 aa, Homo Sapiens
LGRHGEQRL

SEQ ID NO: 1170971 - protein, 9 aa, Homo Sapiens
SVPPLGLSV

SEQ ID NO: 1170972 - protein, 9 aa, Homo Sapiens
CICPSYLHS

SEQ ID NO: 1170973 - protein, 9 aa, Homo Sapiens
TSPPATATW

SEQ ID NO: 1170974 - protein, 9 aa, Homo Sapiens
VASLCILTG

SEQ ID NO: 1170975 - protein, 9 aa, Homo Sapiens
PLLSTHILG

SEQ ID NO: 1170976 - protein, 9 aa, Homo Sapiens
MRLLSDATM

SEQ ID NO: 1170977 - protein, 9 aa, Homo Sapiens
PETELCKAT

SEQ ID NO: 1170978 - protein, 9 aa, Homo Sapiens
MSSWSQTSC

SEQ ID NO: 1170979 - protein, 9 aa, Homo Sapiens
RLTGHSTHL

SEQ ID NO: 1170980 - protein, 9 aa, Homo Sapiens
SAQLWARAR

SEQ ID NO: 1170981 - protein, 9 aa, Homo Sapiens
PKTFLLKAW

SEQ ID NO: 1170982 - protein, 9 aa, Homo Sapiens
PTDTQDTRP

SEQ ID NO: 1170983 - protein, 9 aa, Homo Sapiens
TVVNGRMRR

SEQ ID NO: 1170984 - protein, 9 aa, Homo Sapiens
VHVRRSHSD

SEQ ID NO: 1170985 - protein, 9 aa, Homo Sapiens
PEGLLDLQQ

SEQ ID NO: 1170986 - protein, 9 aa, Homo Sapiens
LWGLKYIHS

SEQ ID NO: 1170987 - protein, 9 aa, Homo Sapiens
TELVLLQRQ

SEQ ID NO: 1170988 - protein, 9 aa, Homo Sapiens
LRYNAPTHT

SEQ ID NO: 1170989 - protein, 9 aa, Homo Sapiens
PQLPVEVGP

SEQ ID NO: 1170990 - protein, 9 aa, Homo Sapiens
FYPARCPGC

SEQ ID NO: 1170991 - protein, 9 aa, Homo Sapiens
AKIFNQFSV

SEQ ID NO: 1170992 - protein, 9 aa, Homo Sapiens
AQRVCCLRC

SEQ ID NO: 1170993 - protein, 9 aa, Homo Sapiens
PRLLPYPFH

SEQ ID NO: 1170994 - protein, 9 aa, Homo Sapiens
QLTRDWKAS

SEQ ID NO: 1170995 - protein, 9 aa, Homo Sapiens
LSLPESLKA

SEQ ID NO: 1170996 - protein, 9 aa, Homo Sapiens
KRKNHGLEA

SEQ ID NO: 1170997 - protein, 9 aa, Homo Sapiens
ASRHPEPMP

SEQ ID NO: 1170998 - protein, 9 aa, Homo Sapiens
VSDQSTCTS

SEQ ID NO: 1170999 - protein, 9 aa, Homo Sapiens
GNQRSNRSL

SEQ ID NO: 1171000 - protein, 9 aa, Homo Sapiens
LFTVCLLRP

SEQ ID NO: 1171001 - protein, 9 aa, Homo Sapiens
PLFACCSLA

SEQ ID NO: 1171002 - protein, 9 aa, Homo Sapiens
ARTSANRGE

SEQ ID NO: 1171003 - protein, 9 aa, Homo Sapiens
ELCKATIPI

SEQ ID NO: 1171004 - protein, 9 aa, Homo Sapiens
WPLRPPPLS

SEQ ID NO: 1171005 - protein, 9 aa, Homo Sapiens
SSHGAPQAR

SEQ ID NO: 1171006 - protein, 9 aa, Homo Sapiens
LLRAGGILA

SEQ ID NO: 1171007 - protein, 9 aa, Homo Sapiens
RRSPDHRGG

SEQ ID NO: 1171008 - protein, 9 aa, Homo Sapiens
PEVPPPFGT

SEQ ID NO: 1171009 - protein, 9 aa, Homo Sapiens
DMTGAQRSF

SEQ ID NO: 1171010 - protein, 9 aa, Homo Sapiens
NINRRNSPL

SEQ ID NO: 1171011 - protein, 9 aa, Homo Sapiens
DKVRMDPPA

SEQ ID NO: 1171012 - protein, 9 aa, Homo Sapiens
CASELSRQV

SEQ ID NO: 1171013 - protein, 9 aa, Homo Sapiens
PIAVDLSLW

SEQ ID NO: 1171014 - protein, 9 aa, Homo Sapiens
HDTVSGTSR

SEQ ID NO: 1171015 - protein, 9 aa, Homo Sapiens
ALLYSVKAK

SEQ ID NO: 1171016 - protein, 9 aa, Homo Sapiens
TGPSLSRWP

SEQ ID NO: 1171017 - protein, 9 aa, Homo Sapiens
PTAALGWSP

SEQ ID NO: 1171018 - protein, 9 aa, Homo Sapiens
FRIYDHWVK

SEQ ID NO: 1171019 - protein, 9 aa, Homo Sapiens
SSSRTACGA

SEQ ID NO: 1171020 - protein, 9 aa, Homo Sapiens
IIVACIEPL

SEQ ID NO: 1171021 - protein, 9 aa, Homo Sapiens
PLCSTTCTH

SEQ ID NO: 1171022 - protein, 9 aa, Homo Sapiens
HDDAPDDQD

SEQ ID NO: 1171023 - protein, 9 aa, Homo Sapiens
TTPPGRSLP

SEQ ID NO: 1171024 - protein, 9 aa, Homo Sapiens
SRMFWYSMP

SEQ ID NO: 1171025 - protein, 9 aa, Homo Sapiens
TKSVRLVHL

SEQ ID NO: 1171026 - protein, 9 aa, Homo Sapiens
SLMSDHLSE

SEQ ID NO: 1171027 - protein, 9 aa, Homo Sapiens
LHLLAEGTP

SEQ ID NO: 1171028 - protein, 9 aa, Homo Sapiens
ASCEEEFQQ

SEQ ID NO: 1171029 - protein, 9 aa, Homo Sapiens
AQLSYLLFG

SEQ ID NO: 1171030 - protein, 9 aa, Homo Sapiens
GLITNCSSW

SEQ ID NO: 1171031 - protein, 9 aa, Homo Sapiens
EVIRNDGAL

SEQ ID NO: 1171032 - protein, 9 aa, Homo Sapiens
KVEEYYRNH

SEQ ID NO: 1171033 - protein, 9 aa, Homo Sapiens
GNFAQQRYE

SEQ ID NO: 1171034 - protein, 9 aa, Homo Sapiens
AEKGEAAPP

SEQ ID NO: 1171035 - protein, 9 aa, Homo Sapiens
FASRVILAP

SEQ ID NO: 1171036 - protein, 9 aa, Homo Sapiens
SVFCPHPAP

SEQ ID NO: 1171037 - protein, 9 aa, Homo Sapiens
VVDAWKSTW

SEQ ID NO: 1171038 - protein, 9 aa, Homo Sapiens
IAEGVSDTN

SEQ ID NO: 1171039 - protein, 9 aa, Homo Sapiens
RVEGLKYYR

SEQ ID NO: 1171040 - protein, 9 aa, Homo Sapiens
GGLWAWKAG

SEQ ID NO: 1171041 - protein, 9 aa, Homo Sapiens
LVGRAVRRK

SEQ ID NO: 1171042 - protein, 9 aa, Homo Sapiens
QTQNCGQRM

SEQ ID NO: 1171043 - protein, 9 aa, Homo Sapiens
KHQRAHTGE

SEQ ID NO: 1171044 - protein, 9 aa, Homo Sapiens
IPQASHSHS

SEQ ID NO: 1171045 - protein, 9 aa, Homo Sapiens
CVARTSANR

SEQ ID NO: 1171046 - protein, 9 aa, Homo Sapiens
VLEPDLHLA

SEQ ID NO: 1171047 - protein, 9 aa, Homo Sapiens
SALHHKDSA

SEQ ID NO: 1171048 - protein, 9 aa, Homo Sapiens
NGLYSGHSG

SEQ ID NO: 1171049 - protein, 9 aa, Homo Sapiens
RSYQQQHKV

SEQ ID NO: 1171050 - protein, 9 aa, Homo Sapiens
AARAHQRTG

SEQ ID NO: 1171051 - protein, 9 aa, Homo Sapiens
LPPGGKEEA

SEQ ID NO: 1171052 - protein, 9 aa, Homo Sapiens
APEGKELMQ

SEQ ID NO: 1171053 - protein, 9 aa, Homo Sapiens
GQASKALKE

SEQ ID NO: 1171054 - protein, 9 aa, Homo Sapiens
SCVSGLITN

SEQ ID NO: 1171055 - protein, 9 aa, Homo Sapiens
PYNKLQWSP

SEQ ID NO: 1171056 - protein, 9 aa, Homo Sapiens
VGCRRCSGL

SEQ ID NO: 1171057 - protein, 9 aa, Homo Sapiens
PPSHCQLCS

SEQ ID NO: 1171058 - protein, 9 aa, Homo Sapiens
ANAPCVART

SEQ ID NO: 1171059 - protein, 9 aa, Homo Sapiens
LSRPRSAAS

SEQ ID NO: 1171060 - protein, 9 aa, Homo Sapiens
ILGLFCTIQ

SEQ ID NO: 1171061 - protein, 9 aa, Homo Sapiens
KSEHTPEVL

SEQ ID NO: 1171062 - protein, 9 aa, Homo Sapiens
FWTCLKMSI

SEQ ID NO: 1171063 - protein, 9 aa, Homo Sapiens
PQLPVGNST

SEQ ID NO: 1171064 - protein, 9 aa, Homo Sapiens
EGHCMDKPA

SEQ ID NO: 1171065 - protein, 9 aa, Homo Sapiens
ASGQASKAL

SEQ ID NO: 1171066 - protein, 9 aa, Homo Sapiens
AAVISVTAM

SEQ ID NO: 1171067 - protein, 9 aa, Homo Sapiens
ASSAGDLQC

SEQ ID NO: 1171068 - protein, 9 aa, Homo Sapiens
CTPSRPGSC

SEQ ID NO: 1171069 - protein, 9 aa, Homo Sapiens
TKAGSSRKM

SEQ ID NO: 1171070 - protein, 9 aa, Homo Sapiens
LRRTSPLPP

SEQ ID NO: 1171071 - protein, 9 aa, Homo Sapiens
EAVPEAVSS

SEQ ID NO: 1171072 - protein, 9 aa, Homo Sapiens
SPLPPGGKE

SEQ ID NO: 1171073 - protein, 9 aa, Homo Sapiens
RNCVQSRLH

SEQ ID NO: 1171074 - protein, 9 aa, Homo Sapiens
RTPLFPLLS

SEQ ID NO: 1171075 - protein, 9 aa, Homo Sapiens
EGNISKKQN

SEQ ID NO: 1171076 - protein, 9 aa, Homo Sapiens
GCHPAWLSP

SEQ ID NO: 1171077 - protein, 9 aa, Homo Sapiens
PRESAAAVQ

SEQ ID NO: 1171078 - protein, 9 aa, Homo Sapiens
AIGGGWPGW

SEQ ID NO: 1171079 - protein, 9 aa, Homo Sapiens
FRAEAETEP

SEQ ID NO: 1171080 - protein, 9 aa, Homo Sapiens
SFLVPSPQL

SEQ ID NO: 1171081 - protein, 9 aa, Homo Sapiens
SYVNAIDIW

SEQ ID NO: 1171082 - protein, 9 aa, Homo Sapiens
RPERVQPIA

SEQ ID NO: 1171083 - protein, 9 aa, Homo Sapiens
ITECVRTAL

SEQ ID NO: 1171084 - protein, 9 aa, Homo Sapiens
VHPPVYLHD

SEQ ID NO: 1171085 - protein, 9 aa, Homo Sapiens
PALPDAWPS

SEQ ID NO: 1171086 - protein, 9 aa, Homo Sapiens
HDFTNAVIQ

SEQ ID NO: 1171087 - protein, 9 aa, Homo Sapiens
LAMWEKGWD

SEQ ID NO: 1171088 - protein, 9 aa, Homo Sapiens
NRRLQILRQ

SEQ ID NO: 1171089 - protein, 9 aa, Homo Sapiens
GAEGAGEAL

SEQ ID NO: 1171090 - protein, 9 aa, Homo Sapiens
IAAVAVTAG

SEQ ID NO: 1171091 - protein, 9 aa, Homo Sapiens
ALEGCRCYR

SEQ ID NO: 1171092 - protein, 9 aa, Homo Sapiens
PHLTWKLWP

SEQ ID NO: 1171093 - protein, 9 aa, Homo Sapiens
DRDEDGPAQ

SEQ ID NO: 1171094 - protein, 9 aa, Homo Sapiens
QRAERGSLE

SEQ ID NO: 1171095 - protein, 9 aa, Homo Sapiens
LSPGACRPA

SEQ ID NO: 1171096 - protein, 9 aa, Homo Sapiens
ALDYHTPAG

SEQ ID NO: 1171097 - protein, 9 aa, Homo Sapiens
QKEELLEEI

SEQ ID NO: 1171098 - protein, 9 aa, Homo Sapiens
GPCPQTPCW

SEQ ID NO: 1171099 - protein, 9 aa, Homo Sapiens
NPYKCKCGK

SEQ ID NO: 1171100 - protein, 9 aa, Homo Sapiens
HRPVCKVKM

SEQ ID NO: 1171101 - protein, 9 aa, Homo Sapiens
MVEGFGGRR

SEQ ID NO: 1171102 - protein, 9 aa, Homo Sapiens
GPRSTLAKV

SEQ ID NO: 1171103 - protein, 9 aa, Homo Sapiens
GVRQVVVRP

SEQ ID NO: 1171104 - protein, 9 aa, Homo Sapiens
RQGDGGAGG

SEQ ID NO: 1171105 - protein, 9 aa, Homo Sapiens
PEWQDVHQR

SEQ ID NO: 1171106 - protein, 9 aa, Homo Sapiens
PRAPVRAWR

SEQ ID NO: 1171107 - protein, 9 aa, Homo Sapiens
YDPPLKWLQ

SEQ ID NO: 1171108 - protein, 9 aa, Homo Sapiens
FSLFYYKLA

SEQ ID NO: 1171109 - protein, 9 aa, Homo Sapiens
LHSCRIQKS

SEQ ID NO: 1171110 - protein, 9 aa, Homo Sapiens
ELFKDVEGK

SEQ ID NO: 1171111 - protein, 9 aa, Homo Sapiens
SRRFQCVSV

SEQ ID NO: 1171112 - protein, 9 aa, Homo Sapiens
NRVRGLLRI

SEQ ID NO: 1171113 - protein, 9 aa, Homo Sapiens
PKHSTRSSG

SEQ ID NO: 1171114 - protein, 9 aa, Homo Sapiens
ALDDTVRER

SEQ ID NO: 1171115 - protein, 9 aa, Homo Sapiens
PPAPVVERP

SEQ ID NO: 1171116 - protein, 9 aa, Homo Sapiens
VLIPETSKL

SEQ ID NO: 1171117 - protein, 9 aa, Homo Sapiens
FVCHWGAAP

SEQ ID NO: 1171118 - protein, 9 aa, Homo Sapiens
IHDHFIHIE

SEQ ID NO: 1171119 - protein, 9 aa, Homo Sapiens
LCSEDKDVV

SEQ ID NO: 1171120 - protein, 9 aa, Homo Sapiens
MMEVQKSLL

SEQ ID NO: 1171121 - protein, 9 aa, Homo Sapiens
PYSHSKLRP

SEQ ID NO: 1171122 - protein, 9 aa, Homo Sapiens
DASQHILEA

SEQ ID NO: 1171123 - protein, 9 aa, Homo Sapiens
KLEELLRSL

SEQ ID NO: 1171124 - protein, 9 aa, Homo Sapiens
ISMNHVMLA

SEQ ID NO: 1171125 - protein, 9 aa, Homo Sapiens
DIVVPRGSD

SEQ ID NO: 1171126 - protein, 9 aa, Homo Sapiens
PPPPGSSPP

SEQ ID NO: 1171127 - protein, 9 aa, Homo Sapiens
HIVPREPVP

SEQ ID NO: 1171128 - protein, 9 aa, Homo Sapiens
VLLRHLLAW

SEQ ID NO: 1171129 - protein, 9 aa, Homo Sapiens
EMEEANRSF

SEQ ID NO: 1171130 - protein, 9 aa, Homo Sapiens
GRTSGRSLS

SEQ ID NO: 1171131 - protein, 9 aa, Homo Sapiens
EPFRNLSPP

SEQ ID NO: 1171132 - protein, 9 aa, Homo Sapiens
SVASQKPPP

SEQ ID NO: 1171133 - protein, 9 aa, Homo Sapiens
FWIGRVHCG

SEQ ID NO: 1171134 - protein, 9 aa, Homo Sapiens
LYRLRVLGE

SEQ ID NO: 1171135 - protein, 9 aa, Homo Sapiens
GQGAAGAGR

SEQ ID NO: 1171136 - protein, 9 aa, Homo Sapiens
PAARPPQPP

SEQ ID NO: 1171137 - protein, 9 aa, Homo Sapiens
GQVRGPPIL

SEQ ID NO: 1171138 - protein, 9 aa, Homo Sapiens
VTQRPPVLD

SEQ ID NO: 1171139 - protein, 9 aa, Homo Sapiens
AHPLRRSHP

SEQ ID NO: 1171140 - protein, 9 aa, Homo Sapiens
NEKAPVDFD

SEQ ID NO: 1171141 - protein, 9 aa, Homo Sapiens
VSTLKREAL

SEQ ID NO: 1171142 - protein, 9 aa, Homo Sapiens
FHMKCFLNL

SEQ ID NO: 1171143 - protein, 9 aa, Homo Sapiens
KNVAMEAVA

SEQ ID NO: 1171144 - protein, 9 aa, Homo Sapiens
PCRSSWAAL

SEQ ID NO: 1171145 - protein, 9 aa, Homo Sapiens
AFEVVWAAI

SEQ ID NO: 1171146 - protein, 9 aa, Homo Sapiens
GSLRKWRPG

SEQ ID NO: 1171147 - protein, 9 aa, Homo Sapiens
LTNVKHLIN

SEQ ID NO: 1171148 - protein, 9 aa, Homo Sapiens
GRYLTGGLW

SEQ ID NO: 1171149 - protein, 9 aa, Homo Sapiens
MCTAALPTF

SEQ ID NO: 1171150 - protein, 9 aa, Homo Sapiens
APRTESSQP

SEQ ID NO: 1171151 - protein, 9 aa, Homo Sapiens
REHSLELEH

SEQ ID NO: 1171152 - protein, 9 aa, Homo Sapiens
NGRMRRFAD

SEQ ID NO: 1171153 - protein, 9 aa, Homo Sapiens
CAGLFTVCL

SEQ ID NO: 1171154 - protein, 9 aa, Homo Sapiens
NHYIIRVVS

SEQ ID NO: 1171155 - protein, 9 aa, Homo Sapiens
HMPPATSIP

SEQ ID NO: 1171156 - protein, 9 aa, Homo Sapiens
YENELGRLA

SEQ ID NO: 1171157 - protein, 9 aa, Homo Sapiens
PPPPLPACL

SEQ ID NO: 1171158 - protein, 9 aa, Homo Sapiens
CPRARQPLP

SEQ ID NO: 1171159 - protein, 9 aa, Homo Sapiens
TKLEKALSA

SEQ ID NO: 1171160 - protein, 9 aa, Homo Sapiens
GAEKRKVEI

SEQ ID NO: 1171161 - protein, 9 aa, Homo Sapiens
EPVEPGQPP

SEQ ID NO: 1171162 - protein, 9 aa, Homo Sapiens
MPPTACLAN

SEQ ID NO: 1171163 - protein, 9 aa, Homo Sapiens
PQYLNLITN

SEQ ID NO: 1171164 - protein, 9 aa, Homo Sapiens
LPRFCELYG

SEQ ID NO: 1171165 - protein, 9 aa, Homo Sapiens
SRPAQPTVP

SEQ ID NO: 1171166 - protein, 9 aa, Homo Sapiens
GRLLGAPAP

SEQ ID NO: 1171167 - protein, 9 aa, Homo Sapiens
RRRPARIQP

SEQ ID NO: 1171168 - protein, 9 aa, Homo Sapiens
GALRAIPPR

SEQ ID NO: 1171169 - protein, 9 aa, Homo Sapiens
GPAPEETIA

SEQ ID NO: 1171170 - protein, 9 aa, Homo Sapiens
TCWLCTARG

SEQ ID NO: 1171171 - protein, 9 aa, Homo Sapiens
QKLKVELRE

SEQ ID NO: 1171172 - protein, 9 aa, Homo Sapiens
YWRILNHVG

SEQ ID NO: 1171173 - protein, 9 aa, Homo Sapiens
RRQLRPDSG

SEQ ID NO: 1171174 - protein, 9 aa, Homo Sapiens
AAREGALVA

SEQ ID NO: 1171175 - protein, 9 aa, Homo Sapiens
MESRPGPCS

SEQ ID NO: 1171176 - protein, 9 aa, Homo Sapiens
GVRRLGSLV

SEQ ID NO: 1171177 - protein, 9 aa, Homo Sapiens
SKIHGRALE

SEQ ID NO: 1171178 - protein, 9 aa, Homo Sapiens
TDFTSEATY

SEQ ID NO: 1171179 - protein, 9 aa, Homo Sapiens
VCAPQTTGR

SEQ ID NO: 1171180 - protein, 9 aa, Homo Sapiens
HWCKLCDWE

SEQ ID NO: 1171181 - protein, 9 aa, Homo Sapiens
PAPCSWPSW

SEQ ID NO: 1171182 - protein, 9 aa, Homo Sapiens
GRFGELLLF

SEQ ID NO: 1171183 - protein, 9 aa, Homo Sapiens
YRKEMRAKV

SEQ ID NO: 1171184 - protein, 9 aa, Homo Sapiens
WSGRSARMS

SEQ ID NO: 1171185 - protein, 9 aa, Homo Sapiens
HFIHIEKYQ

SEQ ID NO: 1171186 - protein, 9 aa, Homo Sapiens
TLEGPNILP

SEQ ID NO: 1171187 - protein, 9 aa, Homo Sapiens
AATQSRLQG

SEQ ID NO: 1171188 - protein, 9 aa, Homo Sapiens
SPPQYCDTK

SEQ ID NO: 1171189 - protein, 9 aa, Homo Sapiens
TNLSGCTAH

SEQ ID NO: 1171190 - protein, 9 aa, Homo Sapiens
EMFSSKFGS

SEQ ID NO: 1171191 - protein, 9 aa, Homo Sapiens
QGSELPAPC

SEQ ID NO: 1171192 - protein, 9 aa, Homo Sapiens
RGWSGDSAC

SEQ ID NO: 1171193 - protein, 9 aa, Homo Sapiens
GLCGDVHVQ

SEQ ID NO: 1171194 - protein, 9 aa, Homo Sapiens
DKALDIRPV

SEQ ID NO: 1171195 - protein, 9 aa, Homo Sapiens
PSPLSNATT

SEQ ID NO: 1171196 - protein, 9 aa, Homo Sapiens
LLEGFLQRE

SEQ ID NO: 1171197 - protein, 9 aa, Homo Sapiens
RWPPRTPLF

SEQ ID NO: 1171198 - protein, 9 aa, Homo Sapiens
GLTEAKTRL

SEQ ID NO: 1171199 - protein, 9 aa, Homo Sapiens
MHADAQNMG

SEQ ID NO: 1171200 - protein, 9 aa, Homo Sapiens
PETCPVEKK

SEQ ID NO: 1171201 - protein, 9 aa, Homo Sapiens
TTAAIPGYQ

SEQ ID NO: 1171202 - protein, 9 aa, Homo Sapiens
RHGEQRLTP

SEQ ID NO: 1171203 - protein, 9 aa, Homo Sapiens
PQAAFASRV

SEQ ID NO: 1171204 - protein, 9 aa, Homo Sapiens
GDVTYTKAK

SEQ ID NO: 1171205 - protein, 9 aa, Homo Sapiens
GGMGPRMAN

SEQ ID NO: 1171206 - protein, 9 aa, Homo Sapiens
SSLSPPHPV

SEQ ID NO: 1171207 - protein, 9 aa, Homo Sapiens
RKSQTKIIL

SEQ ID NO: 1171208 - protein, 9 aa, Homo Sapiens
WTPRPPRPP

SEQ ID NO: 1171209 - protein, 9 aa, Homo Sapiens
SPAETRGAA

SEQ ID NO: 1171210 - protein, 9 aa, Homo Sapiens
EVDFSIHFN

SEQ ID NO: 1171211 - protein, 9 aa, Homo Sapiens
NKKKDKKYK

SEQ ID NO: 1171212 - protein, 9 aa, Homo Sapiens
IRESTQEKN

SEQ ID NO: 1171213 - protein, 9 aa, Homo Sapiens
KMCGSNLQG

SEQ ID NO: 1171214 - protein, 9 aa, Homo Sapiens
GGITLMWRG

SEQ ID NO: 1171215 - protein, 9 aa, Homo Sapiens
LIYGECCSH

SEQ ID NO: 1171216 - protein, 9 aa, Homo Sapiens
PCWALRFQR

SEQ ID NO: 1171217 - protein, 9 aa, Homo Sapiens
EEEDEDEDA

SEQ ID NO: 1171218 - protein, 9 aa, Homo Sapiens
HPPEDGVFV

SEQ ID NO: 1171219 - protein, 9 aa, Homo Sapiens
RAAQETSRT

SEQ ID NO: 1171220 - protein, 9 aa, Homo Sapiens
MANGGGSGG

SEQ ID NO: 1171221 - protein, 9 aa, Homo Sapiens
SIRIDGDNT

SEQ ID NO: 1171222 - protein, 9 aa, Homo Sapiens
SSCLSQYFE

SEQ ID NO: 1171223 - protein, 9 aa, Homo Sapiens
KLQEDQIKE

SEQ ID NO: 1171224 - protein, 9 aa, Homo Sapiens
NQPHNKQME

SEQ ID NO: 1171225 - protein, 9 aa, Homo Sapiens
DHFIHIEKY

SEQ ID NO: 1171226 - protein, 9 aa, Homo Sapiens
SFKQRTHLI

SEQ ID NO: 1171227 - protein, 9 aa, Homo Sapiens
KDHRTSQNH

SEQ ID NO: 1171228 - protein, 9 aa, Homo Sapiens
FKTVSTSFE

SEQ ID NO: 1171229 - protein, 9 aa, Homo Sapiens
AWTSWPTAT

SEQ ID NO: 1171230 - protein, 9 aa, Homo Sapiens
PTWRTTSSA

SEQ ID NO: 1171231 - protein, 9 aa, Homo Sapiens
QACIQLSGG

SEQ ID NO: 1171232 - protein, 9 aa, Homo Sapiens
SLRQDCGDL

SEQ ID NO: 1171233 - protein, 9 aa, Homo Sapiens
PCLGSQDPR

SEQ ID NO: 1171234 - protein, 9 aa, Homo Sapiens
EPSQPQAPF

SEQ ID NO: 1171235 - protein, 9 aa, Homo Sapiens
RLGWWLLEL

SEQ ID NO: 1171236 - protein, 9 aa, Homo Sapiens
LSYGMVGVL

SEQ ID NO: 1171237 - protein, 9 aa, Homo Sapiens
LRIGMKLQK

SEQ ID NO: 1171238 - protein, 9 aa, Homo Sapiens
VATGTNLSP

SEQ ID NO: 1171239 - protein, 9 aa, Homo Sapiens
PAPPRRTLL

SEQ ID NO: 1171240 - protein, 9 aa, Homo Sapiens
SCCEPPCCT

SEQ ID NO: 1171241 - protein, 9 aa, Homo Sapiens
DPSEEPVPR

SEQ ID NO: 1171242 - protein, 9 aa, Homo Sapiens
TAAPGQPGR

SEQ ID NO: 1171243 - protein, 9 aa, Homo Sapiens
HSTGERTCT

SEQ ID NO: 1171244 - protein, 9 aa, Homo Sapiens
ERLLELERL

SEQ ID NO: 1171245 - protein, 9 aa, Homo Sapiens
KTSRILNLQ

SEQ ID NO: 1171246 - protein, 9 aa, Homo Sapiens
AAEKCPAED

SEQ ID NO: 1171247 - protein, 9 aa, Homo Sapiens
TCTQSEWHG

SEQ ID NO: 1171248 - protein, 9 aa, Homo Sapiens
RPRERSYGC

SEQ ID NO: 1171249 - protein, 9 aa, Homo Sapiens
PLTRPRLLP

SEQ ID NO: 1171250 - protein, 9 aa, Homo Sapiens
EEAEEEEED

SEQ ID NO: 1171251 - protein, 9 aa, Homo Sapiens
PHRRTRSRT

SEQ ID NO: 1171252 - protein, 9 aa, Homo Sapiens
EMALRASLE

SEQ ID NO: 1171253 - protein, 9 aa, Homo Sapiens
KLLCRQMLP

SEQ ID NO: 1171254 - protein, 9 aa, Homo Sapiens
RRTRKQTKV

SEQ ID NO: 1171255 - protein, 9 aa, Homo Sapiens
HGAACPPGA

SEQ ID NO: 1171256 - protein, 9 aa, Homo Sapiens
CPHHCGHSV

SEQ ID NO: 1171257 - protein, 9 aa, Homo Sapiens
EVDVEEGTW

SEQ ID NO: 1171258 - protein, 9 aa, Homo Sapiens
FFTFPNIAR

SEQ ID NO: 1171259 - protein, 9 aa, Homo Sapiens
SLNSGKAPS

SEQ ID NO: 1171260 - protein, 9 aa, Homo Sapiens
RASSAGDLQ

SEQ ID NO: 1171261 - protein, 9 aa, Homo Sapiens
SLSTGQTAT

SEQ ID NO: 1171262 - protein, 9 aa, Homo Sapiens
SLIATTRPP

SEQ ID NO: 1171263 - protein, 9 aa, Homo Sapiens
RPSGAAPRP

SEQ ID NO: 1171264 - protein, 9 aa, Homo Sapiens
RSSGVWSPF

SEQ ID NO: 1171265 - protein, 9 aa, Homo Sapiens
FGPNPTSSG

SEQ ID NO: 1171266 - protein, 9 aa, Homo Sapiens
CHGLESKQL

SEQ ID NO: 1171267 - protein, 9 aa, Homo Sapiens
KETRGNLGP

SEQ ID NO: 1171268 - protein, 9 aa, Homo Sapiens
SQSCLTSFN

SEQ ID NO: 1171269 - protein, 9 aa, Homo Sapiens
PARSVAAGA

SEQ ID NO: 1171270 - protein, 9 aa, Homo Sapiens
SHTIVYLLS

SEQ ID NO: 1171271 - protein, 9 aa, Homo Sapiens
IASTTLPQW

SEQ ID NO: 1171272 - protein, 9 aa, Homo Sapiens
PPTAQASCW

SEQ ID NO: 1171273 - protein, 9 aa, Homo Sapiens
TPHMATMNP

SEQ ID NO: 1171274 - protein, 9 aa, Homo Sapiens
CTCPSFIPT

SEQ ID NO: 1171275 - protein, 9 aa, Homo Sapiens
WMANARRSP

SEQ ID NO: 1171276 - protein, 9 aa, Homo Sapiens
SRTELTHVP

SEQ ID NO: 1171277 - protein, 9 aa, Homo Sapiens
VCRRFRASN

SEQ ID NO: 1171278 - protein, 9 aa, Homo Sapiens
SSQANSQPL

SEQ ID NO: 1171279 - protein, 9 aa, Homo Sapiens
GRAARGTPA

SEQ ID NO: 1171280 - protein, 9 aa, Homo Sapiens
CTQGRRWGA

SEQ ID NO: 1171281 - protein, 9 aa, Homo Sapiens
WIKKSSGAS

SEQ ID NO: 1171282 - protein, 9 aa, Homo Sapiens
RTSPLPPPA

SEQ ID NO: 1171283 - protein, 9 aa, Homo Sapiens
PSSWGKVWC

SEQ ID NO: 1171284 - protein, 9 aa, Homo Sapiens
ALSCCDPQG

SEQ ID NO: 1171285 - protein, 9 aa, Homo Sapiens
AQFPLDYNY

SEQ ID NO: 1171286 - protein, 9 aa, Homo Sapiens
NTIRIVDLG

SEQ ID NO: 1171287 - protein, 9 aa, Homo Sapiens
TPAPGPPAA

SEQ ID NO: 1171288 - protein, 9 aa, Homo Sapiens
GRGPEVNAG

SEQ ID NO: 1171289 - protein, 9 aa, Homo Sapiens
TRCWACCGT

SEQ ID NO: 1171290 - protein, 9 aa, Homo Sapiens
IKNYHPQCL

SEQ ID NO: 1171291 - protein, 9 aa, Homo Sapiens
GLHRRMGPL

SEQ ID NO: 1171292 - protein, 9 aa, Homo Sapiens
FSPDSALLI

SEQ ID NO: 1171293 - protein, 9 aa, Homo Sapiens
WPMRLHPCP

SEQ ID NO: 1171294 - protein, 9 aa, Homo Sapiens
LGMPSDIHV

SEQ ID NO: 1171295 - protein, 9 aa, Homo Sapiens
RLRVGSNGS

SEQ ID NO: 1171296 - protein, 9 aa, Homo Sapiens
LYSGHSGEQ

SEQ ID NO: 1171297 - protein, 9 aa, Homo Sapiens
SGSSSRTPT

SEQ ID NO: 1171298 - protein, 9 aa, Homo Sapiens
FPRAGRQAW

SEQ ID NO: 1171299 - protein, 9 aa, Homo Sapiens
DVPPVNQMV

SEQ ID NO: 1171300 - protein, 9 aa, Homo Sapiens
ESGGLGGGP

SEQ ID NO: 1171301 - protein, 9 aa, Homo Sapiens
NWLVTFWTS

SEQ ID NO: 1171302 - protein, 9 aa, Homo Sapiens
SEMEKTPTF

SEQ ID NO: 1171303 - protein, 9 aa, Homo Sapiens
MPPATSIPP

SEQ ID NO: 1171304 - protein, 9 aa, Homo Sapiens
GASGAGHPW

SEQ ID NO: 1171305 - protein, 9 aa, Homo Sapiens
CDPQGTRSA

SEQ ID NO: 1171306 - protein, 9 aa, Homo Sapiens
SLMILVITA

SEQ ID NO: 1171307 - protein, 9 aa, Homo Sapiens
PDVSEDQTA

SEQ ID NO: 1171308 - protein, 9 aa, Homo Sapiens
EQCNPETCP

SEQ ID NO: 1171309 - protein, 9 aa, Homo Sapiens
LFLQEAPSR

SEQ ID NO: 1171310 - protein, 9 aa, Homo Sapiens
SHCKEGDRP

SEQ ID NO: 1171311 - protein, 9 aa, Homo Sapiens
EDSFAMEKT

SEQ ID NO: 1171312 - protein, 9 aa, Homo Sapiens
IDFRKGLGW

SEQ ID NO: 1171313 - protein, 9 aa, Homo Sapiens
ITAENVAKN

SEQ ID NO: 1171314 - protein, 9 aa, Homo Sapiens
RSRAREEQV

SEQ ID NO: 1171315 - protein, 9 aa, Homo Sapiens
PTSSSFSKW

SEQ ID NO: 1171316 - protein, 9 aa, Homo Sapiens
QEISVVHIH

SEQ ID NO: 1171317 - protein, 9 aa, Homo Sapiens
FWSLSSTWL

SEQ ID NO: 1171318 - protein, 9 aa, Homo Sapiens
HPDHNQVGR

SEQ ID NO: 1171319 - protein, 9 aa, Homo Sapiens
TLILHQRVR

SEQ ID NO: 1171320 - protein, 9 aa, Homo Sapiens
LTLLAMYNS

SEQ ID NO: 1171321 - protein, 9 aa, Homo Sapiens
EEVKTKRQR

SEQ ID NO: 1171322 - protein, 9 aa, Homo Sapiens
MVSEGGPEA

SEQ ID NO: 1171323 - protein, 9 aa, Homo Sapiens
TIADYQQTI

SEQ ID NO: 1171324 - protein, 9 aa, Homo Sapiens
LFFWRPPTR

SEQ ID NO: 1171325 - protein, 9 aa, Homo Sapiens
CWGSAFAAS

SEQ ID NO: 1171326 - protein, 9 aa, Homo Sapiens
VEEDPRACE

SEQ ID NO: 1171327 - protein, 9 aa, Homo Sapiens
GNNVVSENE

SEQ ID NO: 1171328 - protein, 9 aa, Homo Sapiens
KGSTTSNWK

SEQ ID NO: 1171329 - protein, 9 aa, Homo Sapiens
GRPLTMATT

SEQ ID NO: 1171330 - protein, 9 aa, Homo Sapiens
HVSITQEND

SEQ ID NO: 1171331 - protein, 9 aa, Homo Sapiens
PPRLGQRRR

SEQ ID NO: 1171332 - protein, 9 aa, Homo Sapiens
PKGAASCTE

SEQ ID NO: 1171333 - protein, 9 aa, Homo Sapiens
GSFFPLTEG

SEQ ID NO: 1171334 - protein, 9 aa, Homo Sapiens
SHASKGVPH

SEQ ID NO: 1171335 - protein, 9 aa, Homo Sapiens
YWGVDRSSQ

SEQ ID NO: 1171336 - protein, 9 aa, Homo Sapiens
SAARGIRAC

SEQ ID NO: 1171337 - protein, 9 aa, Homo Sapiens
CLGLPLLPL

SEQ ID NO: 1171338 - protein, 9 aa, Homo Sapiens
ALRVVSLGE

SEQ ID NO: 1171339 - protein, 9 aa, Homo Sapiens
IIVSPDALG

SEQ ID NO: 1171340 - protein, 9 aa, Homo Sapiens
RLKAEQGSF

SEQ ID NO: 1171341 - protein, 9 aa, Homo Sapiens
RHAHHPGRA

SEQ ID NO: 1171342 - protein, 9 aa, Homo Sapiens
RMVEQMCIT

SEQ ID NO: 1171343 - protein, 9 aa, Homo Sapiens
FIWPQHSYK

SEQ ID NO: 1171344 - protein, 9 aa, Homo Sapiens
NIHAMTAQG

SEQ ID NO: 1171345 - protein, 9 aa, Homo Sapiens
TALDYHTPA

SEQ ID NO: 1171346 - protein, 9 aa, Homo Sapiens
PPAQPWPGV

SEQ ID NO: 1171347 - protein, 9 aa, Homo Sapiens
SPQTGTRTL

SEQ ID NO: 1171348 - protein, 9 aa, Homo Sapiens
ATTAAPRGL

SEQ ID NO: 1171349 - protein, 9 aa, Homo Sapiens
SLRMKTSRR

SEQ ID NO: 1171350 - protein, 9 aa, Homo Sapiens
ALGRIGKVV

SEQ ID NO: 1171351 - protein, 9 aa, Homo Sapiens
CEFYSSQSQ

SEQ ID NO: 1171352 - protein, 9 aa, Homo Sapiens
HKLNKGVFR

SEQ ID NO: 1171353 - protein, 9 aa, Homo Sapiens
RGAARPRPL

SEQ ID NO: 1171354 - protein, 9 aa, Homo Sapiens
SVFNEAETR

SEQ ID NO: 1171355 - protein, 9 aa, Homo Sapiens
QCQAPGATP

SEQ ID NO: 1171356 - protein, 9 aa, Homo Sapiens
AGQQHPLLG

SEQ ID NO: 1171357 - protein, 9 aa, Homo Sapiens
VLVDAVVQA

SEQ ID NO: 1171358 - protein, 9 aa, Homo Sapiens
SSHTTHCTF

SEQ ID NO: 1171359 - protein, 9 aa, Homo Sapiens
HYSRADAAK

SEQ ID NO: 1171360 - protein, 9 aa, Homo Sapiens
AIDHIQVSR

SEQ ID NO: 1171361 - protein, 9 aa, Homo Sapiens
QDLGYQNGI

SEQ ID NO: 1171362 - protein, 9 aa, Homo Sapiens
LKHIRTQHN

SEQ ID NO: 1171363 - protein, 9 aa, Homo Sapiens
SGHHSPHAL

SEQ ID NO: 1171364 - protein, 9 aa, Homo Sapiens
RIDGDNTLG

SEQ ID NO: 1171365 - protein, 9 aa, Homo Sapiens
PLAAESRPL

SEQ ID NO: 1171366 - protein, 9 aa, Homo Sapiens
IAAILFFVM

SEQ ID NO: 1171367 - protein, 9 aa, Homo Sapiens
ANRGEAALE

SEQ ID NO: 1171368 - protein, 9 aa, Homo Sapiens
QTCSAGWEP

SEQ ID NO: 1171369 - protein, 9 aa, Homo Sapiens
KSFSAPDTQ

SEQ ID NO: 1171370 - protein, 9 aa, Homo Sapiens
RKRDKQSRH

SEQ ID NO: 1171371 - protein, 9 aa, Homo Sapiens
IRSPRINAT

SEQ ID NO: 1171372 - protein, 9 aa, Homo Sapiens
YRRLQEFGG

SEQ ID NO: 1171373 - protein, 9 aa, Homo Sapiens
ASSHTTHCT

SEQ ID NO: 1171374 - protein, 9 aa, Homo Sapiens
LETLASKAS

SEQ ID NO: 1171375 - protein, 9 aa, Homo Sapiens
HVGGVRRRR

SEQ ID NO: 1171376 - protein, 9 aa, Homo Sapiens
EAGGASQSQ

SEQ ID NO: 1171377 - protein, 9 aa, Homo Sapiens
QGAPTIMPL

SEQ ID NO: 1171378 - protein, 9 aa, Homo Sapiens
KVKMCGSNL

SEQ ID NO: 1171379 - protein, 9 aa, Homo Sapiens
LLLQNITGF

SEQ ID NO: 1171380 - protein, 9 aa, Homo Sapiens
TESGFSLRM

SEQ ID NO: 1171381 - protein, 9 aa, Homo Sapiens
WLRASSVVP

SEQ ID NO: 1171382 - protein, 9 aa, Homo Sapiens
TNLKKIHMS

SEQ ID NO: 1171383 - protein, 9 aa, Homo Sapiens
ALRFQRLVR

SEQ ID NO: 1171384 - protein, 9 aa, Homo Sapiens
GVFPVLMDP

SEQ ID NO: 1171385 - protein, 9 aa, Homo Sapiens
GCADLNGRT

SEQ ID NO: 1171386 - protein, 9 aa, Homo Sapiens
TRKALITFL

SEQ ID NO: 1171387 - protein, 9 aa, Homo Sapiens
RPALRIGMK

SEQ ID NO: 1171388 - protein, 9 aa, Homo Sapiens
IQKEPREFG

SEQ ID NO: 1171389 - protein, 9 aa, Homo Sapiens
SAGITLRSL

SEQ ID NO: 1171390 - protein, 9 aa, Homo Sapiens
LPVWMSLLE

SEQ ID NO: 1171391 - protein, 9 aa, Homo Sapiens
PAPAWWRLC

SEQ ID NO: 1171392 - protein, 9 aa, Homo Sapiens
PSAGALKPA

SEQ ID NO: 1171393 - protein, 9 aa, Homo Sapiens
RSGGLPQWR

SEQ ID NO: 1171394 - protein, 9 aa, Homo Sapiens
NVLVSYSLV

SEQ ID NO: 1171395 - protein, 9 aa, Homo Sapiens
EPPSPGTAL

SEQ ID NO: 1171396 - protein, 9 aa, Homo Sapiens
YQLMLNCWQ

SEQ ID NO: 1171397 - protein, 9 aa, Homo Sapiens
LSKVKYSRN

SEQ ID NO: 1171398 - protein, 9 aa, Homo Sapiens
TISQNHTPT

SEQ ID NO: 1171399 - protein, 9 aa, Homo Sapiens
VSFPSEEPS

SEQ ID NO: 1171400 - protein, 9 aa, Homo Sapiens
HGSGGGRGP

SEQ ID NO: 1171401 - protein, 9 aa, Homo Sapiens
GLQGFPGPK

SEQ ID NO: 1171402 - protein, 9 aa, Homo Sapiens
LKPSQKHFN

SEQ ID NO: 1171403 - protein, 9 aa, Homo Sapiens
AWSKQGPVS

SEQ ID NO: 1171404 - protein, 9 aa, Homo Sapiens
QGYIDSLER

SEQ ID NO: 1171405 - protein, 9 aa, Homo Sapiens
GGNRGAGAS

SEQ ID NO: 1171406 - protein, 9 aa, Homo Sapiens
SGDSACSPS

SEQ ID NO: 1171407 - protein, 9 aa, Homo Sapiens
VGSTSGARV

SEQ ID NO: 1171408 - protein, 9 aa, Homo Sapiens
WAKIASELS

SEQ ID NO: 1171409 - protein, 9 aa, Homo Sapiens
VRFQEIDDG

SEQ ID NO: 1171410 - protein, 9 aa, Homo Sapiens
PEEGDDEVF

SEQ ID NO: 1171411 - protein, 9 aa, Homo Sapiens
CPPGAPRGQ

SEQ ID NO: 1171412 - protein, 9 aa, Homo Sapiens
SRRCCLRTS

SEQ ID NO: 1171413 - protein, 9 aa, Homo Sapiens
LVTLFFFHS

SEQ ID NO: 1171414 - protein, 9 aa, Homo Sapiens
STDLCLPTL

SEQ ID NO: 1171415 - protein, 9 aa, Homo Sapiens
DKQSRHLGA

SEQ ID NO: 1171416 - protein, 9 aa, Homo Sapiens
ECGKFFCHS

SEQ ID NO: 1171417 - protein, 9 aa, Homo Sapiens
CVLWKKGLS

SEQ ID NO: 1171418 - protein, 9 aa, Homo Sapiens
DKEWNNLGT

SEQ ID NO: 1171419 - protein, 9 aa, Homo Sapiens
TKRQRKSRG

SEQ ID NO: 1171420 - protein, 9 aa, Homo Sapiens
LFSFIRSPR

SEQ ID NO: 1171421 - protein, 9 aa, Homo Sapiens
PALGRALGY

SEQ ID NO: 1171422 - protein, 9 aa, Homo Sapiens
PRPRPPPPR

SEQ ID NO: 1171423 - protein, 9 aa, Homo Sapiens
RIELRSLTV

SEQ ID NO: 1171424 - protein, 9 aa, Homo Sapiens
CSDHSVPPA

SEQ ID NO: 1171425 - protein, 9 aa, Homo Sapiens
KTLKNWSVT

SEQ ID NO: 1171426 - protein, 9 aa, Homo Sapiens
IMHGDLFSE

SEQ ID NO: 1171427 - protein, 9 aa, Homo Sapiens
HGQHTQVVA

SEQ ID NO: 1171428 - protein, 9 aa, Homo Sapiens
PDDVCDFID

SEQ ID NO: 1171429 - protein, 9 aa, Homo Sapiens
HCQLCSPVA

SEQ ID NO: 1171430 - protein, 9 aa, Homo Sapiens
DFEHTIHAG

SEQ ID NO: 1171431 - protein, 9 aa, Homo Sapiens
RVVSFTELS

SEQ ID NO: 1171432 - protein, 9 aa, Homo Sapiens
CPHIAQVPE

SEQ ID NO: 1171433 - protein, 9 aa, Homo Sapiens
LYPLIRSAS

SEQ ID NO: 1171434 - protein, 9 aa, Homo Sapiens
WGLKYIHSA

SEQ ID NO: 1171435 - protein, 9 aa, Homo Sapiens
QAPPSCLRF

SEQ ID NO: 1171436 - protein, 9 aa, Homo Sapiens
ASFTVAKGK

SEQ ID NO: 1171437 - protein, 9 aa, Homo Sapiens
VKIADFGFV

SEQ ID NO: 1171438 - protein, 9 aa, Homo Sapiens
QVMPLLLIV

SEQ ID NO: 1171439 - protein, 9 aa, Homo Sapiens
LAGAWQGGS

SEQ ID NO: 1171440 - protein, 9 aa, Homo Sapiens
MVVVTATRT

SEQ ID NO: 1171441 - protein, 9 aa, Homo Sapiens
RRWILIEYQ

SEQ ID NO: 1171442 - protein, 9 aa, Homo Sapiens
IKSPGLAFS

SEQ ID NO: 1171443 - protein, 9 aa, Homo Sapiens
ISQYASETK

SEQ ID NO: 1171444 - protein, 9 aa, Homo Sapiens
HFEMEEANR

SEQ ID NO: 1171445 - protein, 9 aa, Homo Sapiens
DSSWLTSSF

SEQ ID NO: 1171446 - protein, 9 aa, Homo Sapiens
GAEPSKGQL

SEQ ID NO: 1171447 - protein, 9 aa, Homo Sapiens
QFESPKKKV

SEQ ID NO: 1171448 - protein, 9 aa, Homo Sapiens
VLLQLRYNA

SEQ ID NO: 1171449 - protein, 9 aa, Homo Sapiens
INGAELYWA

SEQ ID NO: 1171450 - protein, 9 aa, Homo Sapiens
GGPGAWGRC

SEQ ID NO: 1171451 - protein, 9 aa, Homo Sapiens
ELSFKEPLT

SEQ ID NO: 1171452 - protein, 9 aa, Homo Sapiens
GGLDDRSPQ

SEQ ID NO: 1171453 - protein, 9 aa, Homo Sapiens
DHGTSVILP

SEQ ID NO: 1171454 - protein, 9 aa, Homo Sapiens
SSWSQTSCF

SEQ ID NO: 1171455 - protein, 9 aa, Homo Sapiens
EILTEKKTQ

SEQ ID NO: 1171456 - protein, 9 aa, Homo Sapiens
AVVASSSGG

SEQ ID NO: 1171457 - protein, 9 aa, Homo Sapiens
KGGTRSQAL

SEQ ID NO: 1171458 - protein, 9 aa, Homo Sapiens
LDALQGPPA

SEQ ID NO: 1171459 - protein, 9 aa, Homo Sapiens
PGGPACALP

SEQ ID NO: 1171460 - protein, 9 aa, Homo Sapiens
QPLPLPPQP

SEQ ID NO: 1171461 - protein, 9 aa, Homo Sapiens
KESNAGRYY

SEQ ID NO: 1171462 - protein, 9 aa, Homo Sapiens
ATPLFPRYT

SEQ ID NO: 1171463 - protein, 9 aa, Homo Sapiens
SCSTISQNH

SEQ ID NO: 1171464 - protein, 9 aa, Homo Sapiens
RGSGGYGGS

SEQ ID NO: 1171465 - protein, 9 aa, Homo Sapiens
SPWEAALRP

SEQ ID NO: 1171466 - protein, 9 aa, Homo Sapiens
VGYPDSWVP

SEQ ID NO: 1171467 - protein, 9 aa, Homo Sapiens
EEIIGKVEK

SEQ ID NO: 1171468 - protein, 9 aa, Homo Sapiens
IISLKISLR

SEQ ID NO: 1171469 - protein, 9 aa, Homo Sapiens
SSRNSPRRC

SEQ ID NO: 1171470 - protein, 9 aa, Homo Sapiens
GHYVHVVLA

SEQ ID NO: 1171471 - protein, 9 aa, Homo Sapiens
LSAAGRPNS

SEQ ID NO: 1171472 - protein, 9 aa, Homo Sapiens
LQHHDTVSG

SEQ ID NO: 1171473 - protein, 9 aa, Homo Sapiens
GDVHVQLRQ

SEQ ID NO: 1171474 - protein, 9 aa, Homo Sapiens
EPRRPPHDC

SEQ ID NO: 1171475 - protein, 9 aa, Homo Sapiens
NRPHLPHHP

SEQ ID NO: 1171476 - protein, 9 aa, Homo Sapiens
TACLANHPH

SEQ ID NO: 1171477 - protein, 9 aa, Homo Sapiens
KWECTVSMA

SEQ ID NO: 1171478 - protein, 9 aa, Homo Sapiens
CRACEDGCR

SEQ ID NO: 1171479 - protein, 9 aa, Homo Sapiens
IQILNLSSD

SEQ ID NO: 1171480 - protein, 9 aa, Homo Sapiens
RRPPHDCMP

SEQ ID NO: 1171481 - protein, 9 aa, Homo Sapiens
RSLTVVTFS

SEQ ID NO: 1171482 - protein, 9 aa, Homo Sapiens
PALSLEAHT

SEQ ID NO: 1171483 - protein, 9 aa, Homo Sapiens
REQRERRER

SEQ ID NO: 1171484 - protein, 9 aa, Homo Sapiens
RVQAHWRFT

SEQ ID NO: 1171485 - protein, 9 aa, Homo Sapiens
GTPIDWGEE

SEQ ID NO: 1171486 - protein, 9 aa, Homo Sapiens
WRTPVSYQN

SEQ ID NO: 1171487 - protein, 9 aa, Homo Sapiens
PPECCSSWL

SEQ ID NO: 1171488 - protein, 9 aa, Homo Sapiens
LAGLELVVL

SEQ ID NO: 1171489 - protein, 9 aa, Homo Sapiens
CEKVRPRKV

SEQ ID NO: 1171490 - protein, 9 aa, Homo Sapiens
WRSVRMYNK

SEQ ID NO: 1171491 - protein, 9 aa, Homo Sapiens
AANCADCQP

SEQ ID NO: 1171492 - protein, 9 aa, Homo Sapiens
SAREKGLKT

SEQ ID NO: 1171493 - protein, 9 aa, Homo Sapiens
TAVVQRTTV

SEQ ID NO: 1171494 - protein, 9 aa, Homo Sapiens
YYSQDDNCT

SEQ ID NO: 1171495 - protein, 9 aa, Homo Sapiens
NVKHLINPV

SEQ ID NO: 1171496 - protein, 9 aa, Homo Sapiens
QHVQKYPIR

SEQ ID NO: 1171497 - protein, 9 aa, Homo Sapiens
RNRGGRCLQ

SEQ ID NO: 1171498 - protein, 9 aa, Homo Sapiens
ALDEDAPVP

SEQ ID NO: 1171499 - protein, 9 aa, Homo Sapiens
SSQPSRMEN

SEQ ID NO: 1171500 - protein, 9 aa, Homo Sapiens
GSPAWSRGA

SEQ ID NO: 1171501 - protein, 9 aa, Homo Sapiens
VWVPTVMPV

SEQ ID NO: 1171502 - protein, 9 aa, Homo Sapiens
WSVTLSCIK

SEQ ID NO: 1171503 - protein, 9 aa, Homo Sapiens
ADPVVTSRQ

SEQ ID NO: 1171504 - protein, 9 aa, Homo Sapiens
QLGRSRTST

SEQ ID NO: 1171505 - protein, 9 aa, Homo Sapiens
LASPALPDA

SEQ ID NO: 1171506 - protein, 9 aa, Homo Sapiens
KCSALPRRK

SEQ ID NO: 1171507 - protein, 9 aa, Homo Sapiens
DEECMHCSG

SEQ ID NO: 1171508 - protein, 9 aa, Homo Sapiens
SRGCPTWVL

SEQ ID NO: 1171509 - protein, 9 aa, Homo Sapiens
MPPLLHPQW

SEQ ID NO: 1171510 - protein, 9 aa, Homo Sapiens
SSENTALSC

SEQ ID NO: 1171511 - protein, 9 aa, Homo Sapiens
WRGASFILS

SEQ ID NO: 1171512 - protein, 9 aa, Homo Sapiens
SASSLVAAS

SEQ ID NO: 1171513 - protein, 9 aa, Homo Sapiens
PNGCVYYVD

SEQ ID NO: 1171514 - protein, 9 aa, Homo Sapiens
RFRSSGLSA

SEQ ID NO: 1171515 - protein, 9 aa, Homo Sapiens
DGVWSPGLP

SEQ ID NO: 1171516 - protein, 9 aa, Homo Sapiens
NEDKEWNNL

SEQ ID NO: 1171517 - protein, 9 aa, Homo Sapiens
RFLVVILKQ

SEQ ID NO: 1171518 - protein, 9 aa, Homo Sapiens
VSANSCGDD

SEQ ID NO: 1171519 - protein, 9 aa, Homo Sapiens
TTHPSPSPT

SEQ ID NO: 1171520 - protein, 9 aa, Homo Sapiens
AIIHKAASD

SEQ ID NO: 1171521 - protein, 9 aa, Homo Sapiens
GASTRGSGG

SEQ ID NO: 1171522 - protein, 9 aa, Homo Sapiens
GCMSMKEVD

SEQ ID NO: 1171523 - protein, 9 aa, Homo Sapiens
ENAESEVDF

SEQ ID NO: 1171524 - protein, 9 aa, Homo Sapiens
LFGLRSDWL

SEQ ID NO: 1171525 - protein, 9 aa, Homo Sapiens
RVALLTMWT

SEQ ID NO: 1171526 - protein, 9 aa, Homo Sapiens
LGDKGLKKM

SEQ ID NO: 1171527 - protein, 9 aa, Homo Sapiens
NIMEPIITL

SEQ ID NO: 1171528 - protein, 9 aa, Homo Sapiens
TCWQRRTAA

SEQ ID NO: 1171529 - protein, 9 aa, Homo Sapiens
TEGDSSWLT

SEQ ID NO: 1171530 - protein, 9 aa, Homo Sapiens
RIAQDVLRF

SEQ ID NO: 1171531 - protein, 9 aa, Homo Sapiens
GEEGEEGEA

SEQ ID NO: 1171532 - protein, 9 aa, Homo Sapiens
GFPSRNCSL

SEQ ID NO: 1171533 - protein, 9 aa, Homo Sapiens
SEDQTALLP

SEQ ID NO: 1171534 - protein, 9 aa, Homo Sapiens
PALQPPGGC

SEQ ID NO: 1171535 - protein, 9 aa, Homo Sapiens
RPVCKVKMC

SEQ ID NO: 1171536 - protein, 9 aa, Homo Sapiens
PPTRGSSRW

SEQ ID NO: 1171537 - protein, 9 aa, Homo Sapiens
PQTPTSQPK

SEQ ID NO: 1171538 - protein, 9 aa, Homo Sapiens
GSNHTSTHD

SEQ ID NO: 1171539 - protein, 9 aa, Homo Sapiens
PAFVAFTLW

SEQ ID NO: 1171540 - protein, 9 aa, Homo Sapiens
LSNTVMPRL

SEQ ID NO: 1171541 - protein, 9 aa, Homo Sapiens
LGLSVPADY

SEQ ID NO: 1171542 - protein, 9 aa, Homo Sapiens
GLRVHIAHG

SEQ ID NO: 1171543 - protein, 9 aa, Homo Sapiens
QRLQGEVVT

SEQ ID NO: 1171544 - protein, 9 aa, Homo Sapiens
PHELRHSLC

SEQ ID NO: 1171545 - protein, 9 aa, Homo Sapiens
VNAGGRREP

SEQ ID NO: 1171546 - protein, 9 aa, Homo Sapiens
VATTLTLMT

SEQ ID NO: 1171547 - protein, 9 aa, Homo Sapiens
SPCRRKRIP

SEQ ID NO: 1171548 - protein, 9 aa, Homo Sapiens
YLATHVHSH

SEQ ID NO: 1171549 - protein, 9 aa, Homo Sapiens
FEPVFFEEK

SEQ ID NO: 1171550 - protein, 9 aa, Homo Sapiens
AGEALLARV

SEQ ID NO: 1171551 - protein, 9 aa, Homo Sapiens
CAQDEELIH

SEQ ID NO: 1171552 - protein, 9 aa, Homo Sapiens
THPEAHLRS

SEQ ID NO: 1171553 - protein, 9 aa, Homo Sapiens
QPVYDAYVT

SEQ ID NO: 1171554 - protein, 9 aa, Homo Sapiens
DTLKVVQTG

SEQ ID NO: 1171555 - protein, 9 aa, Homo Sapiens
ERYVCAMTR

SEQ ID NO: 1171556 - protein, 9 aa, Homo Sapiens
QGQRNPTTA

SEQ ID NO: 1171557 - protein, 9 aa, Homo Sapiens
ANIKSPGLA

SEQ ID NO: 1171558 - protein, 9 aa, Homo Sapiens
KVECAQDEE

SEQ ID NO: 1171559 - protein, 9 aa, Homo Sapiens
STPFSTQIP

SEQ ID NO: 1171560 - protein, 9 aa, Homo Sapiens
LHTAMRRQM

SEQ ID NO: 1171561 - protein, 9 aa, Homo Sapiens
ECREQQQKL

SEQ ID NO: 1171562 - protein, 9 aa, Homo Sapiens
RRNPGSKPS

SEQ ID NO: 1171563 - protein, 9 aa, Homo Sapiens
RPYKCAECC

SEQ ID NO: 1171564 - protein, 9 aa, Homo Sapiens
GAGAAAGNL

SEQ ID NO: 1171565 - protein, 9 aa, Homo Sapiens
VVADLVAHH

SEQ ID NO: 1171566 - protein, 9 aa, Homo Sapiens
ASPAPTSSP

SEQ ID NO: 1171567 - protein, 9 aa, Homo Sapiens
GLVWGVDCP

SEQ ID NO: 1171568 - protein, 9 aa, Homo Sapiens
DLVRVRMAV

SEQ ID NO: 1171569 - protein, 9 aa, Homo Sapiens
PLQQCFKKM

SEQ ID NO: 1171570 - protein, 9 aa, Homo Sapiens
PPAVAERVL

SEQ ID NO: 1171571 - protein, 9 aa, Homo Sapiens
ERQKQKADI

SEQ ID NO: 1171572 - protein, 9 aa, Homo Sapiens
LPQAQLMLM

SEQ ID NO: 1171573 - protein, 9 aa, Homo Sapiens
CKIPLLQES

SEQ ID NO: 1171574 - protein, 9 aa, Homo Sapiens
CLIKKTLGL

SEQ ID NO: 1171575 - protein, 9 aa, Homo Sapiens
FRNLSPPTD

SEQ ID NO: 1171576 - protein, 9 aa, Homo Sapiens
SGPRPRCRP

SEQ ID NO: 1171577 - protein, 9 aa, Homo Sapiens
SSSLAFICT

SEQ ID NO: 1171578 - protein, 9 aa, Homo Sapiens
WGPSLPSRG

SEQ ID NO: 1171579 - protein, 9 aa, Homo Sapiens
QVHPVLRAP

SEQ ID NO: 1171580 - protein, 9 aa, Homo Sapiens
ASCARWRTR

SEQ ID NO: 1171581 - protein, 9 aa, Homo Sapiens
DAPWASVTP

SEQ ID NO: 1171582 - protein, 9 aa, Homo Sapiens
GRLASSAPT

SEQ ID NO: 1171583 - protein, 9 aa, Homo Sapiens
CPECSVEFA

SEQ ID NO: 1171584 - protein, 9 aa, Homo Sapiens
ALGVFIYEM

SEQ ID NO: 1171585 - protein, 9 aa, Homo Sapiens
NEPQRPPRS

SEQ ID NO: 1171586 - protein, 9 aa, Homo Sapiens
RRRRRPAQT

SEQ ID NO: 1171587 - protein, 9 aa, Homo Sapiens
TSSPCRRKR

SEQ ID NO: 1171588 - protein, 9 aa, Homo Sapiens
GSLETRGSL

SEQ ID NO: 1171589 - protein, 9 aa, Homo Sapiens
AREEPSSGN

SEQ ID NO: 1171590 - protein, 9 aa, Homo Sapiens
QLLAERQKH

SEQ ID NO: 1171591 - protein, 9 aa, Homo Sapiens
STMDALWGL

SEQ ID NO: 1171592 - protein, 9 aa, Homo Sapiens
RTLKIREER

SEQ ID NO: 1171593 - protein, 9 aa, Homo Sapiens
GRGTSAELQ

SEQ ID NO: 1171594 - protein, 9 aa, Homo Sapiens
EAIDHIQVS

SEQ ID NO: 1171595 - protein, 9 aa, Homo Sapiens
GCPPGFPSR

SEQ ID NO: 1171596 - protein, 9 aa, Homo Sapiens
WNPSTLGGQ

SEQ ID NO: 1171597 - protein, 9 aa, Homo Sapiens
PPPSSRSKL

SEQ ID NO: 1171598 - protein, 9 aa, Homo Sapiens
LTATTTVLV

SEQ ID NO: 1171599 - protein, 9 aa, Homo Sapiens
EPPLPPAPS

SEQ ID NO: 1171600 - protein, 9 aa, Homo Sapiens
MYTDNRSQK

SEQ ID NO: 1171601 - protein, 9 aa, Homo Sapiens
PPPTAQASC

SEQ ID NO: 1171602 - protein, 9 aa, Homo Sapiens
PRTRAANVI

SEQ ID NO: 1171603 - protein, 9 aa, Homo Sapiens
FSTTRKVNT

SEQ ID NO: 1171604 - protein, 9 aa, Homo Sapiens
LDQAEKNSQ

SEQ ID NO: 1171605 - protein, 9 aa, Homo Sapiens
YPHHCPRHC

SEQ ID NO: 1171606 - protein, 9 aa, Homo Sapiens
RWCSSRNSP

SEQ ID NO: 1171607 - protein, 9 aa, Homo Sapiens
AWPPPWLSP

SEQ ID NO: 1171608 - protein, 9 aa, Homo Sapiens
VRLKAVDNT

SEQ ID NO: 1171609 - protein, 9 aa, Homo Sapiens
RAFHLACMS

SEQ ID NO: 1171610 - protein, 9 aa, Homo Sapiens
TRPQAHSAA

SEQ ID NO: 1171611 - protein, 9 aa, Homo Sapiens
ALRIGMKLQ

SEQ ID NO: 1171612 - protein, 9 aa, Homo Sapiens
TIDLSILTE

SEQ ID NO: 1171613 - protein, 9 aa, Homo Sapiens
RTLAQVLSG

SEQ ID NO: 1171614 - protein, 9 aa, Homo Sapiens
LNLSSMTPT

SEQ ID NO: 1171615 - protein, 9 aa, Homo Sapiens
TPSAPPQGF

SEQ ID NO: 1171616 - protein, 9 aa, Homo Sapiens
NKQRGTSEV

SEQ ID NO: 1171617 - protein, 9 aa, Homo Sapiens
LEGFLQRED

SEQ ID NO: 1171618 - protein, 9 aa, Homo Sapiens
VYLLLLNLD

SEQ ID NO: 1171619 - protein, 9 aa, Homo Sapiens
GCEPGRPLG

SEQ ID NO: 1171620 - protein, 9 aa, Homo Sapiens
PEDGVFVHG

SEQ ID NO: 1171621 - protein, 9 aa, Homo Sapiens
VKTLAKELQ

SEQ ID NO: 1171622 - protein, 9 aa, Homo Sapiens
TYGIIFACV

SEQ ID NO: 1171623 - protein, 9 aa, Homo Sapiens
KQRGTSEVS

SEQ ID NO: 1171624 - protein, 9 aa, Homo Sapiens
GLAGVQDGL

SEQ ID NO: 1171625 - protein, 9 aa, Homo Sapiens
VNLSHIVPR

SEQ ID NO: 1171626 - protein, 9 aa, Homo Sapiens
ASTSHKHDL

SEQ ID NO: 1171627 - protein, 9 aa, Homo Sapiens
MSLFSFIRS

SEQ ID NO: 1171628 - protein, 9 aa, Homo Sapiens
ETEPHGASG

SEQ ID NO: 1171629 - protein, 9 aa, Homo Sapiens
APRGLCLLR

SEQ ID NO: 1171630 - protein, 9 aa, Homo Sapiens
SACSPSEAA

SEQ ID NO: 1171631 - protein, 9 aa, Homo Sapiens
SPCNASIMC

SEQ ID NO: 1171632 - protein, 9 aa, Homo Sapiens
AWRSLRMKT

SEQ ID NO: 1171633 - protein, 9 aa, Homo Sapiens
LGSALQGLA

SEQ ID NO: 1171634 - protein, 9 aa, Homo Sapiens
PLMAAEPTT

SEQ ID NO: 1171635 - protein, 9 aa, Homo Sapiens
AGAPGRRGS

SEQ ID NO: 1171636 - protein, 9 aa, Homo Sapiens
VILPFVNKA

SEQ ID NO: 1171637 - protein, 9 aa, Homo Sapiens
WIFLSVYQA

SEQ ID NO: 1171638 - protein, 9 aa, Homo Sapiens
QNGRAACGA

SEQ ID NO: 1171639 - protein, 9 aa, Homo Sapiens
PTAAAAATA

SEQ ID NO: 1171640 - protein, 9 aa, Homo Sapiens
QFFIDTDWQ

SEQ ID NO: 1171641 - protein, 9 aa, Homo Sapiens
PATTAPEAP

SEQ ID NO: 1171642 - protein, 9 aa, Homo Sapiens
TTGHAPRLW

SEQ ID NO: 1171643 - protein, 9 aa, Homo Sapiens
RRTESPPCS

SEQ ID NO: 1171644 - protein, 9 aa, Homo Sapiens
QMYSFLQQC

SEQ ID NO: 1171645 - protein, 9 aa, Homo Sapiens
CWGSYAAWR

SEQ ID NO: 1171646 - protein, 9 aa, Homo Sapiens
RRAPPRSGR

SEQ ID NO: 1171647 - protein, 9 aa, Homo Sapiens
KLLVAVEPV

SEQ ID NO: 1171648 - protein, 9 aa, Homo Sapiens
FDMRVYILI

SEQ ID NO: 1171649 - protein, 9 aa, Homo Sapiens
LQGPPAPAG

SEQ ID NO: 1171650 - protein, 9 aa, Homo Sapiens
GLTITDQIT

SEQ ID NO: 1171651 - protein, 9 aa, Homo Sapiens
NYQTQVCET

SEQ ID NO: 1171652 - protein, 9 aa, Homo Sapiens
WLPCRGPMP

SEQ ID NO: 1171653 - protein, 9 aa, Homo Sapiens
FVATLPLWA

SEQ ID NO: 1171654 - protein, 9 aa, Homo Sapiens
QRPRCFLTL

SEQ ID NO: 1171655 - protein, 9 aa, Homo Sapiens
AETKKGTME

SEQ ID NO: 1171656 - protein, 9 aa, Homo Sapiens
DFLAHVCGS

SEQ ID NO: 1171657 - protein, 9 aa, Homo Sapiens
PSKTPPTNA

SEQ ID NO: 1171658 - protein, 9 aa, Homo Sapiens
LPVFEEIIG

SEQ ID NO: 1171659 - protein, 9 aa, Homo Sapiens
INANNRLLF

SEQ ID NO: 1171660 - protein, 9 aa, Homo Sapiens
RLKFHTSCP

SEQ ID NO: 1171661 - protein, 9 aa, Homo Sapiens
TLFLLYGMS

SEQ ID NO: 1171662 - protein, 9 aa, Homo Sapiens
LVELSKVKY

SEQ ID NO: 1171663 - protein, 9 aa, Homo Sapiens
VEESLPGAM

SEQ ID NO: 1171664 - protein, 9 aa, Homo Sapiens
EQRAERGSL

SEQ ID NO: 1171665 - protein, 9 aa, Homo Sapiens
QDAAGRGRA

SEQ ID NO: 1171666 - protein, 9 aa, Homo Sapiens
VNKAGDGVG

SEQ ID NO: 1171667 - protein, 9 aa, Homo Sapiens
LPVGNSTLS

SEQ ID NO: 1171668 - protein, 9 aa, Homo Sapiens
YVAYSSMIY

SEQ ID NO: 1171669 - protein, 9 aa, Homo Sapiens
FLASSPLTT

SEQ ID NO: 1171670 - protein, 9 aa, Homo Sapiens
RRRPAQTCC

SEQ ID NO: 1171671 - protein, 9 aa, Homo Sapiens
LDSSSRGRI

SEQ ID NO: 1171672 - protein, 9 aa, Homo Sapiens
TTAPASCTA

SEQ ID NO: 1171673 - protein, 9 aa, Homo Sapiens
TPSANTAPA

SEQ ID NO: 1171674 - protein, 9 aa, Homo Sapiens
PQGARSDAP

SEQ ID NO: 1171675 - protein, 9 aa, Homo Sapiens
LKEGHCMDK

SEQ ID NO: 1171676 - protein, 9 aa, Homo Sapiens
ELNKLLDKV

SEQ ID NO: 1171677 - protein, 9 aa, Homo Sapiens
APALGCWSS

SEQ ID NO: 1171678 - protein, 9 aa, Homo Sapiens
ALMLAGGFF

SEQ ID NO: 1171679 - protein, 9 aa, Homo Sapiens
PGGSSCKKE

SEQ ID NO: 1171680 - protein, 9 aa, Homo Sapiens
RWRMSTWPS

SEQ ID NO: 1171681 - protein, 9 aa, Homo Sapiens
RTTSSPCSR

SEQ ID NO: 1171682 - protein, 9 aa, Homo Sapiens
DVIARDSIL

SEQ ID NO: 1171683 - protein, 9 aa, Homo Sapiens
ETTHTGENP

SEQ ID NO: 1171684 - protein, 9 aa, Homo Sapiens
GRLTPSPQG

SEQ ID NO: 1171685 - protein, 9 aa, Homo Sapiens
GGKKVLNLC

SEQ ID NO: 1171686 - protein, 9 aa, Homo Sapiens
LGLCIRSAK

SEQ ID NO: 1171687 - protein, 9 aa, Homo Sapiens
WTGMVAHTW

SEQ ID NO: 1171688 - protein, 9 aa, Homo Sapiens
VTQFFIRFL

SEQ ID NO: 1171689 - protein, 9 aa, Homo Sapiens
MVLPGGCFF

SEQ ID NO: 1171690 - protein, 9 aa, Homo Sapiens
SGLITNCSS

SEQ ID NO: 1171691 - protein, 9 aa, Homo Sapiens
GVPCLREAV

SEQ ID NO: 1171692 - protein, 9 aa, Homo Sapiens
PFEDDKPFD

SEQ ID NO: 1171693 - protein, 9 aa, Homo Sapiens
SPRPPIHQW

SEQ ID NO: 1171694 - protein, 9 aa, Homo Sapiens
DPESPIKKQ

SEQ ID NO: 1171695 - protein, 9 aa, Homo Sapiens
HCLASPSPI

SEQ ID NO: 1171696 - protein, 9 aa, Homo Sapiens
ECGEVRFHS

SEQ ID NO: 1171697 - protein, 9 aa, Homo Sapiens
SLNQGIPGR

SEQ ID NO: 1171698 - protein, 9 aa, Homo Sapiens
DGRAPRQLG

SEQ ID NO: 1171699 - protein, 9 aa, Homo Sapiens
RPNTPYFIR

SEQ ID NO: 1171700 - protein, 9 aa, Homo Sapiens
NMIQQFIQD

SEQ ID NO: 1171701 - protein, 9 aa, Homo Sapiens
QATTPDNTA

SEQ ID NO: 1171702 - protein, 9 aa, Homo Sapiens
QDPPSDTTS

SEQ ID NO: 1171703 - protein, 9 aa, Homo Sapiens
AHVEKQLWG

SEQ ID NO: 1171704 - protein, 9 aa, Homo Sapiens
KLCDWEIQL

SEQ ID NO: 1171705 - protein, 9 aa, Homo Sapiens
NARGIPRST

SEQ ID NO: 1171706 - protein, 9 aa, Homo Sapiens
ECRGCVIPH

SEQ ID NO: 1171707 - protein, 9 aa, Homo Sapiens
QPRAAEKCP

SEQ ID NO: 1171708 - protein, 9 aa, Homo Sapiens
DVAISMTTL

SEQ ID NO: 1171709 - protein, 9 aa, Homo Sapiens
GLPRACAAS

SEQ ID NO: 1171710 - protein, 9 aa, Homo Sapiens
IVPREPVPE

SEQ ID NO: 1171711 - protein, 9 aa, Homo Sapiens
HREPHPHKP

SEQ ID NO: 1171712 - protein, 9 aa, Homo Sapiens
PAPPPTSSP

SEQ ID NO: 1171713 - protein, 9 aa, Homo Sapiens
VEGGRKSQT

SEQ ID NO: 1171714 - protein, 9 aa, Homo Sapiens
LGPPTAASP

SEQ ID NO: 1171715 - protein, 9 aa, Homo Sapiens
CHPTPVVRL

SEQ ID NO: 1171716 - protein, 9 aa, Homo Sapiens
WCPCPPGRL

SEQ ID NO: 1171717 - protein, 9 aa, Homo Sapiens
PCTQACGRL

SEQ ID NO: 1171718 - protein, 9 aa, Homo Sapiens
PPKNTSVVT

SEQ ID NO: 1171719 - protein, 9 aa, Homo Sapiens
IRSIQDFKL

SEQ ID NO: 1171720 - protein, 9 aa, Homo Sapiens
HEVTEGIVS

SEQ ID NO: 1171721 - protein, 9 aa, Homo Sapiens
LVMQSFGAY

SEQ ID NO: 1171722 - protein, 9 aa, Homo Sapiens
GVDLRYETL

SEQ ID NO: 1171723 - protein, 9 aa, Homo Sapiens
ITNLSGCTA

SEQ ID NO: 1171724 - protein, 9 aa, Homo Sapiens
PLCPPPSPL

SEQ ID NO: 1171725 - protein, 9 aa, Homo Sapiens
DDATCRLFN

SEQ ID NO: 1171726 - protein, 9 aa, Homo Sapiens
RGLPTTGPA

SEQ ID NO: 1171727 - protein, 9 aa, Homo Sapiens
AVAERVLRA

SEQ ID NO: 1171728 - protein, 9 aa, Homo Sapiens
SVYGLVGVK

SEQ ID NO: 1171729 - protein, 9 aa, Homo Sapiens
SCWWHWLIT

SEQ ID NO: 1171730 - protein, 9 aa, Homo Sapiens
HPASSSSSP

SEQ ID NO: 1171731 - protein, 9 aa, Homo Sapiens
LLPVLVQDA

SEQ ID NO: 1171732 - protein, 9 aa, Homo Sapiens
AQDEELIHL

SEQ ID NO: 1171733 - protein, 9 aa, Homo Sapiens
FRIHLDPLP

SEQ ID NO: 1171734 - protein, 9 aa, Homo Sapiens
DEPFRNLSP

SEQ ID NO: 1171735 - protein, 9 aa, Homo Sapiens
EEDEDEDAD

SEQ ID NO: 1171736 - protein, 9 aa, Homo Sapiens
APGCSLRAA

SEQ ID NO: 1171737 - protein, 9 aa, Homo Sapiens
PACLDPSSL

SEQ ID NO: 1171738 - protein, 9 aa, Homo Sapiens
AQGSPHDIR

SEQ ID NO: 1171739 - protein, 9 aa, Homo Sapiens
GTDFPRAGR

SEQ ID NO: 1171740 - protein, 9 aa, Homo Sapiens
IGARNKSWL

SEQ ID NO: 1171741 - protein, 9 aa, Homo Sapiens
SVVHIHCWL

SEQ ID NO: 1171742 - protein, 9 aa, Homo Sapiens
ALGCWSSAP

SEQ ID NO: 1171743 - protein, 9 aa, Homo Sapiens
VGVCRMGPL

SEQ ID NO: 1171744 - protein, 9 aa, Homo Sapiens
ALQVLLPEE

SEQ ID NO: 1171745 - protein, 9 aa, Homo Sapiens
TVTGESPPA

SEQ ID NO: 1171746 - protein, 9 aa, Homo Sapiens
CSWPSSPPR

SEQ ID NO: 1171747 - protein, 9 aa, Homo Sapiens
LGLPLLPLQ

SEQ ID NO: 1171748 - protein, 9 aa, Homo Sapiens
GLKAIVRIC

SEQ ID NO: 1171749 - protein, 9 aa, Homo Sapiens
HHEDDDEDQ

SEQ ID NO: 1171750 - protein, 9 aa, Homo Sapiens
TGHSTHLSG

SEQ ID NO: 1171751 - protein, 9 aa, Homo Sapiens
RTESSQPRG

SEQ ID NO: 1171752 - protein, 9 aa, Homo Sapiens
AGLENMVAE

SEQ ID NO: 1171753 - protein, 9 aa, Homo Sapiens
TRERAAAAL

SEQ ID NO: 1171754 - protein, 9 aa, Homo Sapiens
YFVVINIQN

SEQ ID NO: 1171755 - protein, 9 aa, Homo Sapiens
HVPQILQPF

SEQ ID NO: 1171756 - protein, 9 aa, Homo Sapiens
AVLRTAGTQ

SEQ ID NO: 1171757 - protein, 9 aa, Homo Sapiens
HEGSSQRMS

SEQ ID NO: 1171758 - protein, 9 aa, Homo Sapiens
NSRGLVWGV

SEQ ID NO: 1171759 - protein, 9 aa, Homo Sapiens
LWRQNGGSG

SEQ ID NO: 1171760 - protein, 9 aa, Homo Sapiens
PWAAAWGPA

SEQ ID NO: 1171761 - protein, 9 aa, Homo Sapiens
GTLAPWALL

SEQ ID NO: 1171762 - protein, 9 aa, Homo Sapiens
LERVLFYRA

SEQ ID NO: 1171763 - protein, 9 aa, Homo Sapiens
DINFDIRFE

SEQ ID NO: 1171764 - protein, 9 aa, Homo Sapiens
FVVGVVEQV

SEQ ID NO: 1171765 - protein, 9 aa, Homo Sapiens
TYLPNSRLT

SEQ ID NO: 1171766 - protein, 9 aa, Homo Sapiens
LPQWAAWRR

SEQ ID NO: 1171767 - protein, 9 aa, Homo Sapiens
GLGDESISL

SEQ ID NO: 1171768 - protein, 9 aa, Homo Sapiens
FLTQRQDTS

SEQ ID NO: 1171769 - protein, 9 aa, Homo Sapiens
RRALRRVDA

SEQ ID NO: 1171770 - protein, 9 aa, Homo Sapiens
EREEKHLKT

SEQ ID NO: 1171771 - protein, 9 aa, Homo Sapiens
AIGARNKSW

SEQ ID NO: 1171772 - protein, 9 aa, Homo Sapiens
PGATPPACQ

SEQ ID NO: 1171773 - protein, 9 aa, Homo Sapiens
LFKGRGQIL

SEQ ID NO: 1171774 - protein, 9 aa, Homo Sapiens
VTRGRRAEA

SEQ ID NO: 1171775 - protein, 9 aa, Homo Sapiens
AFKTVSTSF

SEQ ID NO: 1171776 - protein, 9 aa, Homo Sapiens
AHDVGGREC

SEQ ID NO: 1171777 - protein, 9 aa, Homo Sapiens
VRTTSSPCS

SEQ ID NO: 1171778 - protein, 9 aa, Homo Sapiens
GQRLLGLAR

SEQ ID NO: 1171779 - protein, 9 aa, Homo Sapiens
NPGSKPSMK

SEQ ID NO: 1171780 - protein, 9 aa, Homo Sapiens
VFDVAVLVP

SEQ ID NO: 1171781 - protein, 9 aa, Homo Sapiens
GARSDAPWA

SEQ ID NO: 1171782 - protein, 9 aa, Homo Sapiens
AGPTSQLKL

SEQ ID NO: 1171783 - protein, 9 aa, Homo Sapiens
TSPRPPSTS

SEQ ID NO: 1171784 - protein, 9 aa, Homo Sapiens
DTCQVGQSA

SEQ ID NO: 1171785 - protein, 9 aa, Homo Sapiens
LQYLCCHRR

SEQ ID NO: 1171786 - protein, 9 aa, Homo Sapiens
PNLPQPHLT

SEQ ID NO: 1171787 - protein, 9 aa, Homo Sapiens
PSFLQPSPQ

SEQ ID NO: 1171788 - protein, 9 aa, Homo Sapiens
VPRRGLLLG

SEQ ID NO: 1171789 - protein, 9 aa, Homo Sapiens
DRYYLLAVG

SEQ ID NO: 1171790 - protein, 9 aa, Homo Sapiens
WCSPRRSPD

SEQ ID NO: 1171791 - protein, 9 aa, Homo Sapiens
AWKRFVTVA

SEQ ID NO: 1171792 - protein, 9 aa, Homo Sapiens
TRSGLKKTP

SEQ ID NO: 1171793 - protein, 9 aa, Homo Sapiens
LQDCPAGPT

SEQ ID NO: 1171794 - protein, 9 aa, Homo Sapiens
ARGWSWWSP

SEQ ID NO: 1171795 - protein, 9 aa, Homo Sapiens
ANVITKNND

SEQ ID NO: 1171796 - protein, 9 aa, Homo Sapiens
GRGISSHSP

SEQ ID NO: 1171797 - protein, 9 aa, Homo Sapiens
LLAERQKHI

SEQ ID NO: 1171798 - protein, 9 aa, Homo Sapiens
IDSIQKEPR

SEQ ID NO: 1171799 - protein, 9 aa, Homo Sapiens
SRQTGAKSE

SEQ ID NO: 1171800 - protein, 9 aa, Homo Sapiens
AMTAQGSSE

SEQ ID NO: 1171801 - protein, 9 aa, Homo Sapiens
GMVGVLQFE

SEQ ID NO: 1171802 - protein, 9 aa, Homo Sapiens
TYVRSGCRA

SEQ ID NO: 1171803 - protein, 9 aa, Homo Sapiens
PKKCGPKPK

SEQ ID NO: 1171804 - protein, 9 aa, Homo Sapiens
CTSSISTFL

SEQ ID NO: 1171805 - protein, 9 aa, Homo Sapiens
FEMEEANRS

SEQ ID NO: 1171806 - protein, 9 aa, Homo Sapiens
RWSASFTVA

SEQ ID NO: 1171807 - protein, 9 aa, Homo Sapiens
TSTCGSATS

SEQ ID NO: 1171808 - protein, 9 aa, Homo Sapiens
PEAEARGGP

SEQ ID NO: 1171809 - protein, 9 aa, Homo Sapiens
KKCRLFYKD

SEQ ID NO: 1171810 - protein, 9 aa, Homo Sapiens
QDMARPPKQ

SEQ ID NO: 1171811 - protein, 9 aa, Homo Sapiens
EASEDGVDA

SEQ ID NO: 1171812 - protein, 9 aa, Homo Sapiens
WLQGGTRVI

SEQ ID NO: 1171813 - protein, 9 aa, Homo Sapiens
SKVDFWYSD

SEQ ID NO: 1171814 - protein, 9 aa, Homo Sapiens
SSGATGTTA

SEQ ID NO: 1171815 - protein, 9 aa, Homo Sapiens
LYQEFLLLS

SEQ ID NO: 1171816 - protein, 9 aa, Homo Sapiens
QSGGALWAP

SEQ ID NO: 1171817 - protein, 9 aa, Homo Sapiens
DYPSNSFYV

SEQ ID NO: 1171818 - protein, 9 aa, Homo Sapiens
SPQAPLRLW

SEQ ID NO: 1171819 - protein, 9 aa, Homo Sapiens
IEVGTGAGA

SEQ ID NO: 1171820 - protein, 9 aa, Homo Sapiens
PTDGGEEEM

SEQ ID NO: 1171821 - protein, 9 aa, Homo Sapiens
ETILKTCSL

SEQ ID NO: 1171822 - protein, 9 aa, Homo Sapiens
QMGVPLAAE

SEQ ID NO: 1171823 - protein, 9 aa, Homo Sapiens
VPQTVKSAS

SEQ ID NO: 1171824 - protein, 9 aa, Homo Sapiens
GRRTRKQTK

SEQ ID NO: 1171825 - protein, 9 aa, Homo Sapiens
TSFLLIPTL

SEQ ID NO: 1171826 - protein, 9 aa, Homo Sapiens
PGCLRRRLR

SEQ ID NO: 1171827 - protein, 9 aa, Homo Sapiens
VWSPFRAEA

SEQ ID NO: 1171828 - protein, 9 aa, Homo Sapiens
SYRLKHSLT

SEQ ID NO: 1171829 - protein, 9 aa, Homo Sapiens
YLYKFQHSP

SEQ ID NO: 1171830 - protein, 9 aa, Homo Sapiens
QAPQVAMLP

SEQ ID NO: 1171831 - protein, 9 aa, Homo Sapiens
AAPSMVARS

SEQ ID NO: 1171832 - protein, 9 aa, Homo Sapiens
QRRTAAPGQ

SEQ ID NO: 1171833 - protein, 9 aa, Homo Sapiens
EAKAPSRCF

SEQ ID NO: 1171834 - protein, 9 aa, Homo Sapiens
YVFLDPLAD

SEQ ID NO: 1171835 - protein, 9 aa, Homo Sapiens
PQRCGRTAG

SEQ ID NO: 1171836 - protein, 9 aa, Homo Sapiens
KVPTASQCL

SEQ ID NO: 1171837 - protein, 9 aa, Homo Sapiens
DQATTPDNT

SEQ ID NO: 1171838 - protein, 9 aa, Homo Sapiens
FSINIFTKI

SEQ ID NO: 1171839 - protein, 9 aa, Homo Sapiens
SSGASWVSG

SEQ ID NO: 1171840 - protein, 9 aa, Homo Sapiens
FNSSAHVHA

SEQ ID NO: 1171841 - protein, 9 aa, Homo Sapiens
HPGSWPVAQ

SEQ ID NO: 1171842 - protein, 9 aa, Homo Sapiens
AQPHLQPPF

SEQ ID NO: 1171843 - protein, 9 aa, Homo Sapiens
NYFLRLCNF

SEQ ID NO: 1171844 - protein, 9 aa, Homo Sapiens
CCVPPEDAE

SEQ ID NO: 1171845 - protein, 9 aa, Homo Sapiens
LPDDVCDFI

SEQ ID NO: 1171846 - protein, 9 aa, Homo Sapiens
APRPHPRGS

SEQ ID NO: 1171847 - protein, 9 aa, Homo Sapiens
RKQLMVTMP

SEQ ID NO: 1171848 - protein, 9 aa, Homo Sapiens
SEEPVPRRG

SEQ ID NO: 1171849 - protein, 9 aa, Homo Sapiens
STTGESEKQ

SEQ ID NO: 1171850 - protein, 9 aa, Homo Sapiens
PSDVLFGAK

SEQ ID NO: 1171851 - protein, 9 aa, Homo Sapiens
AGGGGPGHG

SEQ ID NO: 1171852 - protein, 9 aa, Homo Sapiens
HSVASQKPP

SEQ ID NO: 1171853 - protein, 9 aa, Homo Sapiens
GVMPQYHSS

SEQ ID NO: 1171854 - protein, 9 aa, Homo Sapiens
GGGPGSAVA

SEQ ID NO: 1171855 - protein, 9 aa, Homo Sapiens
WTQIPQGCL

SEQ ID NO: 1171856 - protein, 9 aa, Homo Sapiens
SSKFGSIPK

SEQ ID NO: 1171857 - protein, 9 aa, Homo Sapiens
PTHPLCTVA

SEQ ID NO: 1171858 - protein, 9 aa, Homo Sapiens
DLEHKYWKN

SEQ ID NO: 1171859 - protein, 9 aa, Homo Sapiens
TSSGPACGR

SEQ ID NO: 1171860 - protein, 9 aa, Homo Sapiens
IELRRTVNT

SEQ ID NO: 1171861 - protein, 9 aa, Homo Sapiens
WCLGRCCCS

SEQ ID NO: 1171862 - protein, 9 aa, Homo Sapiens
TAGQGLSYS

SEQ ID NO: 1171863 - protein, 9 aa, Homo Sapiens
PTPVWSPRP

SEQ ID NO: 1171864 - protein, 9 aa, Homo Sapiens
HDEDPQAVM

SEQ ID NO: 1171865 - protein, 9 aa, Homo Sapiens
MVGVLQFEV

SEQ ID NO: 1171866 - protein, 9 aa, Homo Sapiens
NTCNSVIRQ

SEQ ID NO: 1171867 - protein, 9 aa, Homo Sapiens
SPCSSISER

SEQ ID NO: 1171868 - protein, 9 aa, Homo Sapiens
GCVYYVDHN

SEQ ID NO: 1171869 - protein, 9 aa, Homo Sapiens
PVQREHVLV

SEQ ID NO: 1171870 - protein, 9 aa, Homo Sapiens
LRERTLKIR

SEQ ID NO: 1171871 - protein, 9 aa, Homo Sapiens
NSRLTGHST

SEQ ID NO: 1171872 - protein, 9 aa, Homo Sapiens
SLGSASPDP

SEQ ID NO: 1171873 - protein, 9 aa, Homo Sapiens
HGSNHTSTH

SEQ ID NO: 1171874 - protein, 9 aa, Homo Sapiens
WRQEEKIWE

SEQ ID NO: 1171875 - protein, 9 aa, Homo Sapiens
QELTDYLMK

SEQ ID NO: 1171876 - protein, 9 aa, Homo Sapiens
VEGTIEVED

SEQ ID NO: 1171877 - protein, 9 aa, Homo Sapiens
VIRLHQLQE

SEQ ID NO: 1171878 - protein, 9 aa, Homo Sapiens
GGGTELGPL

SEQ ID NO: 1171879 - protein, 9 aa, Homo Sapiens
HSPPAPVVE

SEQ ID NO: 1171880 - protein, 9 aa, Homo Sapiens
PKVSYVNAI

SEQ ID NO: 1171881 - protein, 9 aa, Homo Sapiens
SNHTSTHDK

SEQ ID NO: 1171882 - protein, 9 aa, Homo Sapiens
PDAVVASSS

SEQ ID NO: 1171883 - protein, 9 aa, Homo Sapiens
WRSPKCIIH

SEQ ID NO: 1171884 - protein, 9 aa, Homo Sapiens
VAFLLQALV

SEQ ID NO: 1171885 - protein, 9 aa, Homo Sapiens
GLGGNSLCS

SEQ ID NO: 1171886 - protein, 9 aa, Homo Sapiens
TSTPGPWAA

SEQ ID NO: 1171887 - protein, 9 aa, Homo Sapiens
TLSCIKISL

SEQ ID NO: 1171888 - protein, 9 aa, Homo Sapiens
ATWVRDMVR

SEQ ID NO: 1171889 - protein, 9 aa, Homo Sapiens
QVHRTRAVF

SEQ ID NO: 1171890 - protein, 9 aa, Homo Sapiens
TCVPRWCSS

SEQ ID NO: 1171891 - protein, 9 aa, Homo Sapiens
ISVGRYLAI

SEQ ID NO: 1171892 - protein, 9 aa, Homo Sapiens
CCIEMMKLC

SEQ ID NO: 1171893 - protein, 9 aa, Homo Sapiens
FPRYTLGAL

SEQ ID NO: 1171894 - protein, 9 aa, Homo Sapiens
RVLGGWAKM

SEQ ID NO: 1171895 - protein, 9 aa, Homo Sapiens
PHGCQSARE

SEQ ID NO: 1171896 - protein, 9 aa, Homo Sapiens
QDEPSSACL

SEQ ID NO: 1171897 - protein, 9 aa, Homo Sapiens
GRVAQLEQA

SEQ ID NO: 1171898 - protein, 9 aa, Homo Sapiens
VSQVRQPQE

SEQ ID NO: 1171899 - protein, 9 aa, Homo Sapiens
SGPACGRRA

SEQ ID NO: 1171900 - protein, 9 aa, Homo Sapiens
FKGHFLSTP

SEQ ID NO: 1171901 - protein, 9 aa, Homo Sapiens
WRRGKDITV

SEQ ID NO: 1171902 - protein, 9 aa, Homo Sapiens
VEDHIKNYH

SEQ ID NO: 1171903 - protein, 9 aa, Homo Sapiens
TPGPWAAAW

SEQ ID NO: 1171904 - protein, 9 aa, Homo Sapiens
QHISSLRDD

SEQ ID NO: 1171905 - protein, 9 aa, Homo Sapiens
TRGQARAGG

SEQ ID NO: 1171906 - protein, 9 aa, Homo Sapiens
IICLKTQSG

SEQ ID NO: 1171907 - protein, 9 aa, Homo Sapiens
PPAPGRQLA

SEQ ID NO: 1171908 - protein, 9 aa, Homo Sapiens
TGTRTLAQV

SEQ ID NO: 1171909 - protein, 9 aa, Homo Sapiens
GQCQVWVLP

SEQ ID NO: 1171910 - protein, 9 aa, Homo Sapiens
SLDNLCCMD

SEQ ID NO: 1171911 - protein, 9 aa, Homo Sapiens
SLGAHANFF

SEQ ID NO: 1171912 - protein, 9 aa, Homo Sapiens
PFSILRGSW

SEQ ID NO: 1171913 - protein, 9 aa, Homo Sapiens
STIKSILIH

SEQ ID NO: 1171914 - protein, 9 aa, Homo Sapiens
LTVEDGHRE

SEQ ID NO: 1171915 - protein, 9 aa, Homo Sapiens
SWWSPWKPS

SEQ ID NO: 1171916 - protein, 9 aa, Homo Sapiens
MKQSRSEPE

SEQ ID NO: 1171917 - protein, 9 aa, Homo Sapiens
LLQPTTENT

SEQ ID NO: 1171918 - protein, 9 aa, Homo Sapiens
CGLAWSKQG

SEQ ID NO: 1171919 - protein, 9 aa, Homo Sapiens
TPPPPPGWL

SEQ ID NO: 1171920 - protein, 9 aa, Homo Sapiens
DCPAGPTSQ

SEQ ID NO: 1171921 - protein, 9 aa, Homo Sapiens
RRKVMTPVR

SEQ ID NO: 1171922 - protein, 9 aa, Homo Sapiens
PDVGQQPNV

SEQ ID NO: 1171923 - protein, 9 aa, Homo Sapiens
SPAWSRGAA

SEQ ID NO: 1171924 - protein, 9 aa, Homo Sapiens
APRTSTTSS

SEQ ID NO: 1171925 - protein, 9 aa, Homo Sapiens
HRNFLVSGW

SEQ ID NO: 1171926 - protein, 9 aa, Homo Sapiens
RTAPALGCW

SEQ ID NO: 1171927 - protein, 9 aa, Homo Sapiens
AAEQRVSRE

SEQ ID NO: 1171928 - protein, 9 aa, Homo Sapiens
SPSEVSFPS

SEQ ID NO: 1171929 - protein, 9 aa, Homo Sapiens
PLCPKHWFQ

SEQ ID NO: 1171930 - protein, 9 aa, Homo Sapiens
GFPDRKDIG

SEQ ID NO: 1171931 - protein, 9 aa, Homo Sapiens
GRGSLRKWR

SEQ ID NO: 1171932 - protein, 9 aa, Homo Sapiens
ALGSRSGGR

SEQ ID NO: 1171933 - protein, 9 aa, Homo Sapiens
ELPWGPQGP

SEQ ID NO: 1171934 - protein, 9 aa, Homo Sapiens
CGFTQDRGL

SEQ ID NO: 1171935 - protein, 9 aa, Homo Sapiens
RPGAQEVQI

SEQ ID NO: 1171936 - protein, 9 aa, Homo Sapiens
WASGRITYS

SEQ ID NO: 1171937 - protein, 9 aa, Homo Sapiens
TGKSVWLFS

SEQ ID NO: 1171938 - protein, 9 aa, Homo Sapiens
AGHTIPCIF

SEQ ID NO: 1171939 - protein, 9 aa, Homo Sapiens
RKCSKTSRK

SEQ ID NO: 1171940 - protein, 9 aa, Homo Sapiens
KNSGSQSGT

SEQ ID NO: 1171941 - protein, 9 aa, Homo Sapiens
YLHSHGRTD

SEQ ID NO: 1171942 - protein, 9 aa, Homo Sapiens
LLALGHTWA

SEQ ID NO: 1171943 - protein, 9 aa, Homo Sapiens
AAQETSRTS

SEQ ID NO: 1171944 - protein, 9 aa, Homo Sapiens
TLYGLASAA

SEQ ID NO: 1171945 - protein, 9 aa, Homo Sapiens
DHGAAQNLA

SEQ ID NO: 1171946 - protein, 9 aa, Homo Sapiens
SRVGQAMAY

SEQ ID NO: 1171947 - protein, 9 aa, Homo Sapiens
EDGHREILI

SEQ ID NO: 1171948 - protein, 9 aa, Homo Sapiens
TPSRLRSGI

SEQ ID NO: 1171949 - protein, 9 aa, Homo Sapiens
DQDKMTHLK

SEQ ID NO: 1171950 - protein, 9 aa, Homo Sapiens
NVEDELPAT

SEQ ID NO: 1171951 - protein, 9 aa, Homo Sapiens
RELPNGCVY

SEQ ID NO: 1171952 - protein, 9 aa, Homo Sapiens
ASVLQNLHT

SEQ ID NO: 1171953 - protein, 9 aa, Homo Sapiens
PAPAPQHLA

SEQ ID NO: 1171954 - protein, 9 aa, Homo Sapiens
PGPPAAAGA

SEQ ID NO: 1171955 - protein, 9 aa, Homo Sapiens
VKAPDMLGM

SEQ ID NO: 1171956 - protein, 9 aa, Homo Sapiens
YSVKAKTQP

SEQ ID NO: 1171957 - protein, 9 aa, Homo Sapiens
RQDTSKNII

SEQ ID NO: 1171958 - protein, 9 aa, Homo Sapiens
TCSHCPDSR

SEQ ID NO: 1171959 - protein, 9 aa, Homo Sapiens
LGVAARHSG

SEQ ID NO: 1171960 - protein, 9 aa, Homo Sapiens
SCHRCTAWC

SEQ ID NO: 1171961 - protein, 9 aa, Homo Sapiens
RPPSTSSPC

SEQ ID NO: 1171962 - protein, 9 aa, Homo Sapiens
TRALRPTAS

SEQ ID NO: 1171963 - protein, 9 aa, Homo Sapiens
KFHTSCPES

SEQ ID NO: 1171964 - protein, 9 aa, Homo Sapiens
PTARPARAA

SEQ ID NO: 1171965 - protein, 9 aa, Homo Sapiens
MAVGGEAIY

SEQ ID NO: 1171966 - protein, 9 aa, Homo Sapiens
AAPPKAHEV

SEQ ID NO: 1171967 - protein, 9 aa, Homo Sapiens
DVGIGTVHL

SEQ ID NO: 1171968 - protein, 9 aa, Homo Sapiens
SHCSWQPLR

SEQ ID NO: 1171969 - protein, 9 aa, Homo Sapiens
NAVGRRGPD

SEQ ID NO: 1171970 - protein, 9 aa, Homo Sapiens
PDARVAGGG

SEQ ID NO: 1171971 - protein, 9 aa, Homo Sapiens
LFQDEPSSA

SEQ ID NO: 1171972 - protein, 9 aa, Homo Sapiens
RSSGSVLCF

SEQ ID NO: 1171973 - protein, 9 aa, Homo Sapiens
ENFKNSFQH

SEQ ID NO: 1171974 - protein, 9 aa, Homo Sapiens
AVIKNVWLA

SEQ ID NO: 1171975 - protein, 9 aa, Homo Sapiens
PSRVSLCQN

SEQ ID NO: 1171976 - protein, 9 aa, Homo Sapiens
LGRLMTCWK

SEQ ID NO: 1171977 - protein, 9 aa, Homo Sapiens
PGGLSQPQH

SEQ ID NO: 1171978 - protein, 9 aa, Homo Sapiens
PSCWSMRMR

SEQ ID NO: 1171979 - protein, 9 aa, Homo Sapiens
PSANTAPAL

SEQ ID NO: 1171980 - protein, 9 aa, Homo Sapiens
FLPSLNLTP

SEQ ID NO: 1171981 - protein, 9 aa, Homo Sapiens
SPSGASTRP

SEQ ID NO: 1171982 - protein, 9 aa, Homo Sapiens
PGPANPSAA

SEQ ID NO: 1171983 - protein, 9 aa, Homo Sapiens
EKRFGFWRD

SEQ ID NO: 1171984 - protein, 9 aa, Homo Sapiens
CQRLGPSPC

SEQ ID NO: 1171985 - protein, 9 aa, Homo Sapiens
ASPPTRSSS

SEQ ID NO: 1171986 - protein, 9 aa, Homo Sapiens
SETSRQSHI

SEQ ID NO: 1171987 - protein, 9 aa, Homo Sapiens
ALPTLPPYW

SEQ ID NO: 1171988 - protein, 9 aa, Homo Sapiens
SACPRLLPY

SEQ ID NO: 1171989 - protein, 9 aa, Homo Sapiens
YKEPESTLH

SEQ ID NO: 1171990 - protein, 9 aa, Homo Sapiens
VVRPQSVFV

SEQ ID NO: 1171991 - protein, 9 aa, Homo Sapiens
NANAPCVAR

SEQ ID NO: 1171992 - protein, 9 aa, Homo Sapiens
LLGCSSHQG

SEQ ID NO: 1171993 - protein, 9 aa, Homo Sapiens
PGPWAAAWG

SEQ ID NO: 1171994 - protein, 9 aa, Homo Sapiens
SHPPGCHCG

SEQ ID NO: 1171995 - protein, 9 aa, Homo Sapiens
HDCNKPPIY

SEQ ID NO: 1171996 - protein, 9 aa, Homo Sapiens
SSGYGQHRS

SEQ ID NO: 1171997 - protein, 9 aa, Homo Sapiens
TIYIVGGVS

SEQ ID NO: 1171998 - protein, 9 aa, Homo Sapiens
AHREPHPHK

SEQ ID NO: 1171999 - protein, 9 aa, Homo Sapiens
SLSSTWLFC

SEQ ID NO: 1172000 - protein, 9 aa, Homo Sapiens
NTRVALTSS

SEQ ID NO: 1172001 - protein, 9 aa, Homo Sapiens
AVSANSCGD

SEQ ID NO: 1172002 - protein, 9 aa, Homo Sapiens
RRSSWPRWT

SEQ ID NO: 1172003 - protein, 9 aa, Homo Sapiens
HTWNPSTLG

SEQ ID NO: 1172004 - protein, 9 aa, Homo Sapiens
LHWLQRLGW

SEQ ID NO: 1172005 - protein, 9 aa, Homo Sapiens
LQPWLVAKA

SEQ ID NO: 1172006 - protein, 9 aa, Homo Sapiens
SMSPSTLDS

SEQ ID NO: 1172007 - protein, 9 aa, Homo Sapiens
FLPTMPCTY

SEQ ID NO: 1172008 - protein, 9 aa, Homo Sapiens
IGMKLQKKI

SEQ ID NO: 1172009 - protein, 9 aa, Homo Sapiens
TTSPLMKPP

SEQ ID NO: 1172010 - protein, 9 aa, Homo Sapiens
DQESSEGEE

SEQ ID NO: 1172011 - protein, 9 aa, Homo Sapiens
QYEDMVAES

SEQ ID NO: 1172012 - protein, 9 aa, Homo Sapiens
GGQRDGGRG

SEQ ID NO: 1172013 - protein, 9 aa, Homo Sapiens
KSEHRNFLV

SEQ ID NO: 1172014 - protein, 9 aa, Homo Sapiens
NNMLVLEQS

SEQ ID NO: 1172015 - protein, 9 aa, Homo Sapiens
SSMTPTDQE

SEQ ID NO: 1172016 - protein, 9 aa, Homo Sapiens
MKLQKKIWE

SEQ ID NO: 1172017 - protein, 9 aa, Homo Sapiens
GVTQRHRTD

SEQ ID NO: 1172018 - protein, 9 aa, Homo Sapiens
SFSHNSYLQ

SEQ ID NO: 1172019 - protein, 9 aa, Homo Sapiens
PQAPFPAPQ

SEQ ID NO: 1172020 - protein, 9 aa, Homo Sapiens
PVGNSTLSW

SEQ ID NO: 1172021 - protein, 9 aa, Homo Sapiens
FPQAPDGFY

SEQ ID NO: 1172022 - protein, 9 aa, Homo Sapiens
AMAFSFPQL

SEQ ID NO: 1172023 - protein, 9 aa, Homo Sapiens
PWKHSDYAA

SEQ ID NO: 1172024 - protein, 9 aa, Homo Sapiens
ASQKPPPPL

SEQ ID NO: 1172025 - protein, 9 aa, Homo Sapiens
SVEYKPPKN

SEQ ID NO: 1172026 - protein, 9 aa, Homo Sapiens
PLKVIWPIL

SEQ ID NO: 1172027 - protein, 9 aa, Homo Sapiens
NTAAALVDF

SEQ ID NO: 1172028 - protein, 9 aa, Homo Sapiens
ALECDYVST

SEQ ID NO: 1172029 - protein, 9 aa, Homo Sapiens
LLSLGPCWA

SEQ ID NO: 1172030 - protein, 9 aa, Homo Sapiens
ELYGDRKLF

SEQ ID NO: 1172031 - protein, 9 aa, Homo Sapiens
PRVPLPPPP

SEQ ID NO: 1172032 - protein, 9 aa, Homo Sapiens
PGSAARTCW

SEQ ID NO: 1172033 - protein, 9 aa, Homo Sapiens
YEDLEHKYW

SEQ ID NO: 1172034 - protein, 9 aa, Homo Sapiens
HACCRPSRG

SEQ ID NO: 1172035 - protein, 9 aa, Homo Sapiens
PLGPPTAAS

SEQ ID NO: 1172036 - protein, 9 aa, Homo Sapiens
DSSNSHETE

SEQ ID NO: 1172037 - protein, 9 aa, Homo Sapiens
PLIHPRPPP

SEQ ID NO: 1172038 - protein, 9 aa, Homo Sapiens
KTPLQTSTG

SEQ ID NO: 1172039 - protein, 9 aa, Homo Sapiens
LGPVCEHAA

SEQ ID NO: 1172040 - protein, 9 aa, Homo Sapiens
KNRTRTTPA

SEQ ID NO: 1172041 - protein, 9 aa, Homo Sapiens
GSSPPRCWG

SEQ ID NO: 1172042 - protein, 9 aa, Homo Sapiens
NFLVSGWHC

SEQ ID NO: 1172043 - protein, 9 aa, Homo Sapiens
FSATTRAAP

SEQ ID NO: 1172044 - protein, 9 aa, Homo Sapiens
KHWSFEKVE

SEQ ID NO: 1172045 - protein, 9 aa, Homo Sapiens
SQWPWCLFI

SEQ ID NO: 1172046 - protein, 9 aa, Homo Sapiens
LRTKLEKAL

SEQ ID NO: 1172047 - protein, 9 aa, Homo Sapiens
LGGMVYTIG

SEQ ID NO: 1172048 - protein, 9 aa, Homo Sapiens
ISSSSHPSF

SEQ ID NO: 1172049 - protein, 9 aa, Homo Sapiens
GIRACRRRM

SEQ ID NO: 1172050 - protein, 9 aa, Homo Sapiens
DSARRASRA

SEQ ID NO: 1172051 - protein, 9 aa, Homo Sapiens
MPACARGPR

SEQ ID NO: 1172052 - protein, 9 aa, Homo Sapiens
LLPFLDVQY

SEQ ID NO: 1172053 - protein, 9 aa, Homo Sapiens
NICHQVPYS

SEQ ID NO: 1172054 - protein, 9 aa, Homo Sapiens
FLLKAWAQA

SEQ ID NO: 1172055 - protein, 9 aa, Homo Sapiens
QPGTGFFRD

SEQ ID NO: 1172056 - protein, 9 aa, Homo Sapiens
HLGYSVVTI

SEQ ID NO: 1172057 - protein, 9 aa, Homo Sapiens
TPCWGWHWE

SEQ ID NO: 1172058 - protein, 9 aa, Homo Sapiens
CLQDSYITS

SEQ ID NO: 1172059 - protein, 9 aa, Homo Sapiens
WTQFRNYPR

SEQ ID NO: 1172060 - protein, 9 aa, Homo Sapiens
YYEKLADIL

SEQ ID NO: 1172061 - protein, 9 aa, Homo Sapiens
FWRDEESTA

SEQ ID NO: 1172062 - protein, 9 aa, Homo Sapiens
FTTFVKTLA

SEQ ID NO: 1172063 - protein, 9 aa, Homo Sapiens
VVMQGVAGI

SEQ ID NO: 1172064 - protein, 9 aa, Homo Sapiens
QLVSPEASL

SEQ ID NO: 1172065 - protein, 9 aa, Homo Sapiens
TQRGRVIAV

SEQ ID NO: 1172066 - protein, 9 aa, Homo Sapiens
LSCCDPQGT

SEQ ID NO: 1172067 - protein, 9 aa, Homo Sapiens
RSMGGSWNF

SEQ ID NO: 1172068 - protein, 9 aa, Homo Sapiens
REHHSCTPV

SEQ ID NO: 1172069 - protein, 9 aa, Homo Sapiens
QACTCPVGM

SEQ ID NO: 1172070 - protein, 9 aa, Homo Sapiens
ILHRGGAPG

SEQ ID NO: 1172071 - protein, 9 aa, Homo Sapiens
LDDKNVCRR

SEQ ID NO: 1172072 - protein, 9 aa, Homo Sapiens
RYTVLSMGP

SEQ ID NO: 1172073 - protein, 9 aa, Homo Sapiens
HEFKCDNGC

SEQ ID NO: 1172074 - protein, 9 aa, Homo Sapiens
EDLLAREGR

SEQ ID NO: 1172075 - protein, 9 aa, Homo Sapiens
LLMPPPGLR

SEQ ID NO: 1172076 - protein, 9 aa, Homo Sapiens
IVGSIPVFK

SEQ ID NO: 1172077 - protein, 9 aa, Homo Sapiens
CADCQPGTG

SEQ ID NO: 1172078 - protein, 9 aa, Homo Sapiens
LYYEKLADI

SEQ ID NO: 1172079 - protein, 9 aa, Homo Sapiens
AAPTGRPRM

SEQ ID NO: 1172080 - protein, 9 aa, Homo Sapiens
CGAEILPRQ

SEQ ID NO: 1172081 - protein, 9 aa, Homo Sapiens
SRRTRPNRV

SEQ ID NO: 1172082 - protein, 9 aa, Homo Sapiens
RPPHDCMPI

SEQ ID NO: 1172083 - protein, 9 aa, Homo Sapiens
GHLRPPVPQ

SEQ ID NO: 1172084 - protein, 9 aa, Homo Sapiens
YRPSDVLFG

SEQ ID NO: 1172085 - protein, 9 aa, Homo Sapiens
ETTDDSNDY

SEQ ID NO: 1172086 - protein, 9 aa, Homo Sapiens
GGGAASSSS

SEQ ID NO: 1172087 - protein, 9 aa, Homo Sapiens
SQAAPSPLE

SEQ ID NO: 1172088 - protein, 9 aa, Homo Sapiens
TRTRITDDQ

SEQ ID NO: 1172089 - protein, 9 aa, Homo Sapiens
PRARDNYRA

SEQ ID NO: 1172090 - protein, 9 aa, Homo Sapiens
AGRPNSSHR

SEQ ID NO: 1172091 - protein, 9 aa, Homo Sapiens
EDPRACESL

SEQ ID NO: 1172092 - protein, 9 aa, Homo Sapiens
KREDCMAPG

SEQ ID NO: 1172093 - protein, 9 aa, Homo Sapiens
PDAPVPGGE

SEQ ID NO: 1172094 - protein, 9 aa, Homo Sapiens
ASLCILTGF

SEQ ID NO: 1172095 - protein, 9 aa, Homo Sapiens
GWAKMHRLW

SEQ ID NO: 1172096 - protein, 9 aa, Homo Sapiens
PTHTFSTLF

SEQ ID NO: 1172097 - protein, 9 aa, Homo Sapiens
RTPTRRPRS

SEQ ID NO: 1172098 - protein, 9 aa, Homo Sapiens
ECCSHMEHA

SEQ ID NO: 1172099 - protein, 9 aa, Homo Sapiens
RFKYYHWAM

SEQ ID NO: 1172100 - protein, 9 aa, Homo Sapiens
YPVGYCRTR

SEQ ID NO: 1172101 - protein, 9 aa, Homo Sapiens
KALNYSAAP

SEQ ID NO: 1172102 - protein, 9 aa, Homo Sapiens
EKDPIDAIT

SEQ ID NO: 1172103 - protein, 9 aa, Homo Sapiens
LGVSDPDTK

SEQ ID NO: 1172104 - protein, 9 aa, Homo Sapiens
HQVPYSIPS

SEQ ID NO: 1172105 - protein, 9 aa, Homo Sapiens
TPLVEEGNG

SEQ ID NO: 1172106 - protein, 9 aa, Homo Sapiens
GPQGSELPA

SEQ ID NO: 1172107 - protein, 9 aa, Homo Sapiens
LTGDCGKIK

SEQ ID NO: 1172108 - protein, 9 aa, Homo Sapiens
SPQYLNLIT

SEQ ID NO: 1172109 - protein, 9 aa, Homo Sapiens
LQALAMWEK

SEQ ID NO: 1172110 - protein, 9 aa, Homo Sapiens
LSPESVELS

SEQ ID NO: 1172111 - protein, 9 aa, Homo Sapiens
EPGDPDAVV

SEQ ID NO: 1172112 - protein, 9 aa, Homo Sapiens
RFYPARCPG

SEQ ID NO: 1172113 - protein, 9 aa, Homo Sapiens
MRNGVRQVV

SEQ ID NO: 1172114 - protein, 9 aa, Homo Sapiens
KIKIFFCTG

SEQ ID NO: 1172115 - protein, 9 aa, Homo Sapiens
SARSLSWYQ

SEQ ID NO: 1172116 - protein, 9 aa, Homo Sapiens
FLRTVAFWT

SEQ ID NO: 1172117 - protein, 9 aa, Homo Sapiens
NSTTWPLSL

SEQ ID NO: 1172118 - protein, 9 aa, Homo Sapiens
LCKATIPIF

SEQ ID NO: 1172119 - protein, 9 aa, Homo Sapiens
CGKVSTSTP

SEQ ID NO: 1172120 - protein, 9 aa, Homo Sapiens
PQHRVLAGE

SEQ ID NO: 1172121 - protein, 9 aa, Homo Sapiens
NAGKQTVMV

SEQ ID NO: 1172122 - protein, 9 aa, Homo Sapiens
VGTGGIYQK

SEQ ID NO: 1172123 - protein, 9 aa, Homo Sapiens
LLPTGTDHI

SEQ ID NO: 1172124 - protein, 9 aa, Homo Sapiens
NFSIPQASH

SEQ ID NO: 1172125 - protein, 9 aa, Homo Sapiens
EELPGNRRL

SEQ ID NO: 1172126 - protein, 9 aa, Homo Sapiens
KSMKEPLEV

SEQ ID NO: 1172127 - protein, 9 aa, Homo Sapiens
ADRVRQVHP

SEQ ID NO: 1172128 - protein, 9 aa, Homo Sapiens
AEGALRSAK

SEQ ID NO: 1172129 - protein, 9 aa, Homo Sapiens
GRSQELVCI

SEQ ID NO: 1172130 - protein, 9 aa, Homo Sapiens
LHLAAHYSR

SEQ ID NO: 1172131 - protein, 9 aa, Homo Sapiens
FIHVKPPSC

SEQ ID NO: 1172132 - protein, 9 aa, Homo Sapiens
MVEQMCITQ

SEQ ID NO: 1172133 - protein, 9 aa, Homo Sapiens
PDPALSLEA

SEQ ID NO: 1172134 - protein, 9 aa, Homo Sapiens
CGQFIPWNF

SEQ ID NO: 1172135 - protein, 9 aa, Homo Sapiens
TVSAGKGST

SEQ ID NO: 1172136 - protein, 9 aa, Homo Sapiens
PPSPLPAPR

SEQ ID NO: 1172137 - protein, 9 aa, Homo Sapiens
EQRFGVRKG

SEQ ID NO: 1172138 - protein, 9 aa, Homo Sapiens
SMVARSGTG

SEQ ID NO: 1172139 - protein, 9 aa, Homo Sapiens
PPIVRVIDV

SEQ ID NO: 1172140 - protein, 9 aa, Homo Sapiens
SHRPPRASS

SEQ ID NO: 1172141 - protein, 9 aa, Homo Sapiens
GLDDRSPQA

SEQ ID NO: 1172142 - protein, 9 aa, Homo Sapiens
YYLLAVGKQ

SEQ ID NO: 1172143 - protein, 9 aa, Homo Sapiens
RALWASSSS

SEQ ID NO: 1172144 - protein, 9 aa, Homo Sapiens
DIRKDLCAN

SEQ ID NO: 1172145 - protein, 9 aa, Homo Sapiens
LPVADTSSV

SEQ ID NO: 1172146 - protein, 9 aa, Homo Sapiens
GEGGPERGA

SEQ ID NO: 1172147 - protein, 9 aa, Homo Sapiens
RSSTSPAAR

SEQ ID NO: 1172148 - protein, 9 aa, Homo Sapiens
ALPGSMPTA

SEQ ID NO: 1172149 - protein, 9 aa, Homo Sapiens
ASKASRALG

SEQ ID NO: 1172150 - protein, 9 aa, Homo Sapiens
PGVSRSPTS

SEQ ID NO: 1172151 - protein, 9 aa, Homo Sapiens
VPLSVPQTQ

SEQ ID NO: 1172152 - protein, 9 aa, Homo Sapiens
LRTMKIKCS

SEQ ID NO: 1172153 - protein, 9 aa, Homo Sapiens
RSPPQYCDT

SEQ ID NO: 1172154 - protein, 9 aa, Homo Sapiens
VLIRVTSGL

SEQ ID NO: 1172155 - protein, 9 aa, Homo Sapiens
KRLINPVVQ

SEQ ID NO: 1172156 - protein, 9 aa, Homo Sapiens
PSRPGSCIS

SEQ ID NO: 1172157 - protein, 9 aa, Homo Sapiens
PQGIPSSPQ

SEQ ID NO: 1172158 - protein, 9 aa, Homo Sapiens
MGLKVVRLC

SEQ ID NO: 1172159 - protein, 9 aa, Homo Sapiens
NFVQKYLEN

SEQ ID NO: 1172160 - protein, 9 aa, Homo Sapiens
MMLYPVLNL

SEQ ID NO: 1172161 - protein, 9 aa, Homo Sapiens
CTSSASSSG

SEQ ID NO: 1172162 - protein, 9 aa, Homo Sapiens
GRKLTVQEA

SEQ ID NO: 1172163 - protein, 9 aa, Homo Sapiens
QAKGRMLIP

SEQ ID NO: 1172164 - protein, 9 aa, Homo Sapiens
TCICIHICV

SEQ ID NO: 1172165 - protein, 9 aa, Homo Sapiens
WGVFVGLQN

SEQ ID NO: 1172166 - protein, 9 aa, Homo Sapiens
CSVENDVSF

SEQ ID NO: 1172167 - protein, 9 aa, Homo Sapiens
NRTPTPAPP

SEQ ID NO: 1172168 - protein, 9 aa, Homo Sapiens
TSATSCELG

SEQ ID NO: 1172169 - protein, 9 aa, Homo Sapiens
PEPPPLASS

SEQ ID NO: 1172170 - protein, 9 aa, Homo Sapiens
DSGTQRGRV

SEQ ID NO: 1172171 - protein, 9 aa, Homo Sapiens
EHNLLVHKA

SEQ ID NO: 1172172 - protein, 9 aa, Homo Sapiens
CYIGILQNI

SEQ ID NO: 1172173 - protein, 9 aa, Homo Sapiens
QVVKQKKTA

SEQ ID NO: 1172174 - protein, 9 aa, Homo Sapiens
AKPSAAGAQ

SEQ ID NO: 1172175 - protein, 9 aa, Homo Sapiens
SRSESEPEK

SEQ ID NO: 1172176 - protein, 9 aa, Homo Sapiens
RPVSLRRRH

SEQ ID NO: 1172177 - protein, 9 aa, Homo Sapiens
FCHYKLFQD

SEQ ID NO: 1172178 - protein, 9 aa, Homo Sapiens
GPPGPQDPP

SEQ ID NO: 1172179 - protein, 9 aa, Homo Sapiens
LEHVHLALK

SEQ ID NO: 1172180 - protein, 9 aa, Homo Sapiens
SPEGVSPTS

SEQ ID NO: 1172181 - protein, 9 aa, Homo Sapiens
VTGVSFRVT

SEQ ID NO: 1172182 - protein, 9 aa, Homo Sapiens
FVRYYNKQH

SEQ ID NO: 1172183 - protein, 9 aa, Homo Sapiens
VKEKLVRFY

SEQ ID NO: 1172184 - protein, 9 aa, Homo Sapiens
DFSNNWNSS

SEQ ID NO: 1172185 - protein, 9 aa, Homo Sapiens
VGVAHRIHP

SEQ ID NO: 1172186 - protein, 9 aa, Homo Sapiens
SARRPVSLI

SEQ ID NO: 1172187 - protein, 9 aa, Homo Sapiens
GAANCADCQ

SEQ ID NO: 1172188 - protein, 9 aa, Homo Sapiens
AISTFGPSA

SEQ ID NO: 1172189 - protein, 9 aa, Homo Sapiens
VWMCTAALP

SEQ ID NO: 1172190 - protein, 9 aa, Homo Sapiens
CGLFLALLD

SEQ ID NO: 1172191 - protein, 9 aa, Homo Sapiens
LPGLLPTPA

SEQ ID NO: 1172192 - protein, 9 aa, Homo Sapiens
ESVPWTPRP

SEQ ID NO: 1172193 - protein, 9 aa, Homo Sapiens
CEKTSLLQA

SEQ ID NO: 1172194 - protein, 9 aa, Homo Sapiens
VRPRPHQPR

SEQ ID NO: 1172195 - protein, 9 aa, Homo Sapiens
HMGIWPAGL

SEQ ID NO: 1172196 - protein, 9 aa, Homo Sapiens
QRKDYPSNS

SEQ ID NO: 1172197 - protein, 9 aa, Homo Sapiens
DEDPQAVMY

SEQ ID NO: 1172198 - protein, 9 aa, Homo Sapiens
GLKKMTLKA

SEQ ID NO: 1172199 - protein, 9 aa, Homo Sapiens
AAQNLAVHG

SEQ ID NO: 1172200 - protein, 9 aa, Homo Sapiens
LEDWSFLQF

SEQ ID NO: 1172201 - protein, 9 aa, Homo Sapiens
GPSQSPHSP

SEQ ID NO: 1172202 - protein, 9 aa, Homo Sapiens
SSASKPTMA

SEQ ID NO: 1172203 - protein, 9 aa, Homo Sapiens
GQISTEVQA

SEQ ID NO: 1172204 - protein, 9 aa, Homo Sapiens
AGQGLSYSK

SEQ ID NO: 1172205 - protein, 9 aa, Homo Sapiens
HDRSTATSQ

SEQ ID NO: 1172206 - protein, 9 aa, Homo Sapiens
LGGRPPCPP

SEQ ID NO: 1172207 - protein, 9 aa, Homo Sapiens
GSRGCPTWV

SEQ ID NO: 1172208 - protein, 9 aa, Homo Sapiens
FPCWKTCLT

SEQ ID NO: 1172209 - protein, 9 aa, Homo Sapiens
VKERYGTLK

SEQ ID NO: 1172210 - protein, 9 aa, Homo Sapiens
LSVYQALIS

SEQ ID NO: 1172211 - protein, 9 aa, Homo Sapiens
PTGPAAPLA

SEQ ID NO: 1172212 - protein, 9 aa, Homo Sapiens
GGVGGRGRG

SEQ ID NO: 1172213 - protein, 9 aa, Homo Sapiens
LVAVEPVAG

SEQ ID NO: 1172214 - protein, 9 aa, Homo Sapiens
LHQNLDPTS

SEQ ID NO: 1172215 - protein, 9 aa, Homo Sapiens
LSHRSGSQC

SEQ ID NO: 1172216 - protein, 9 aa, Homo Sapiens
PPGGPAPPP

SEQ ID NO: 1172217 - protein, 9 aa, Homo Sapiens
RLIRGGGGA

SEQ ID NO: 1172218 - protein, 9 aa, Homo Sapiens
ESSSLSLPA

SEQ ID NO: 1172219 - protein, 9 aa, Homo Sapiens
RVRRGSSAL

SEQ ID NO: 1172220 - protein, 9 aa, Homo Sapiens
DSLDRCCST

SEQ ID NO: 1172221 - protein, 9 aa, Homo Sapiens
APSAELSTG

SEQ ID NO: 1172222 - protein, 9 aa, Homo Sapiens
YTIGGEKDS

SEQ ID NO: 1172223 - protein, 9 aa, Homo Sapiens
GRQLRVPDT

SEQ ID NO: 1172224 - protein, 9 aa, Homo Sapiens
LPLQGARAP

SEQ ID NO: 1172225 - protein, 9 aa, Homo Sapiens
PGSSPPRCW

SEQ ID NO: 1172226 - protein, 9 aa, Homo Sapiens
TLRPPAQIP

SEQ ID NO: 1172227 - protein, 9 aa, Homo Sapiens
RPSGRPRPD

SEQ ID NO: 1172228 - protein, 9 aa, Homo Sapiens
KSQQSISAE

SEQ ID NO: 1172229 - protein, 9 aa, Homo Sapiens
NQGIPGRYL

SEQ ID NO: 1172230 - protein, 9 aa, Homo Sapiens
CTQACGRLF

SEQ ID NO: 1172231 - protein, 9 aa, Homo Sapiens
HGNGEGRRP

SEQ ID NO: 1172232 - protein, 9 aa, Homo Sapiens
PQAVMYAPV

SEQ ID NO: 1172233 - protein, 9 aa, Homo Sapiens
ASCTRILVF

SEQ ID NO: 1172234 - protein, 9 aa, Homo Sapiens
EDGCRLENE

SEQ ID NO: 1172235 - protein, 9 aa, Homo Sapiens
ASIETGLVA

SEQ ID NO: 1172236 - protein, 9 aa, Homo Sapiens
IITWALQGA

SEQ ID NO: 1172237 - protein, 9 aa, Homo Sapiens
AVAVTAGPE

SEQ ID NO: 1172238 - protein, 9 aa, Homo Sapiens
TREFLRSLC

SEQ ID NO: 1172239 - protein, 9 aa, Homo Sapiens
CTLHNWKFW

SEQ ID NO: 1172240 - protein, 9 aa, Homo Sapiens
RVDACQADR

SEQ ID NO: 1172241 - protein, 9 aa, Homo Sapiens
TPLGPQEMV

SEQ ID NO: 1172242 - protein, 9 aa, Homo Sapiens
EAIYTGCAD

SEQ ID NO: 1172243 - protein, 9 aa, Homo Sapiens
ALRAAAQGA

SEQ ID NO: 1172244 - protein, 9 aa, Homo Sapiens
EEQTPGFKG

SEQ ID NO: 1172245 - protein, 9 aa, Homo Sapiens
PMPGSCRSP

SEQ ID NO: 1172246 - protein, 9 aa, Homo Sapiens
CSRRPTARS

SEQ ID NO: 1172247 - protein, 9 aa, Homo Sapiens
LPMLSVKKK

SEQ ID NO: 1172248 - protein, 9 aa, Homo Sapiens
GGPAPAAAL

SEQ ID NO: 1172249 - protein, 9 aa, Homo Sapiens
YSHSKLRPG

SEQ ID NO: 1172250 - protein, 9 aa, Homo Sapiens
SFSKWCRPW

SEQ ID NO: 1172251 - protein, 9 aa, Homo Sapiens
ADLVAHHED

SEQ ID NO: 1172252 - protein, 9 aa, Homo Sapiens
VLLLPVLVQ

SEQ ID NO: 1172253 - protein, 9 aa, Homo Sapiens
LVKHQVVYK

SEQ ID NO: 1172254 - protein, 9 aa, Homo Sapiens
ALTSSSASI

SEQ ID NO: 1172255 - protein, 9 aa, Homo Sapiens
TGTDHIRSC

SEQ ID NO: 1172256 - protein, 9 aa, Homo Sapiens
PSAGVLSPV

SEQ ID NO: 1172257 - protein, 9 aa, Homo Sapiens
RVPIRVSPR

SEQ ID NO: 1172258 - protein, 9 aa, Homo Sapiens
QDIIVSPDA

SEQ ID NO: 1172259 - protein, 9 aa, Homo Sapiens
RVGRMCFLL

SEQ ID NO: 1172260 - protein, 9 aa, Homo Sapiens
DDTYLYILL

SEQ ID NO: 1172261 - protein, 9 aa, Homo Sapiens
ILQKYNHCC

SEQ ID NO: 1172262 - protein, 9 aa, Homo Sapiens
GRECRGCVI

SEQ ID NO: 1172263 - protein, 9 aa, Homo Sapiens
KGGMGPRMA

SEQ ID NO: 1172264 - protein, 9 aa, Homo Sapiens
TFVKTLAKE

SEQ ID NO: 1172265 - protein, 9 aa, Homo Sapiens
QTQVIEHIT

SEQ ID NO: 1172266 - protein, 9 aa, Homo Sapiens
PPPVTAWHP

SEQ ID NO: 1172267 - protein, 9 aa, Homo Sapiens
DPSGSRGCP

SEQ ID NO: 1172268 - protein, 9 aa, Homo Sapiens
TPSGSASLM

SEQ ID NO: 1172269 - protein, 9 aa, Homo Sapiens
PPRPHASPT

SEQ ID NO: 1172270 - protein, 9 aa, Homo Sapiens
LEDTHKQLN

SEQ ID NO: 1172271 - protein, 9 aa, Homo Sapiens
QPWWWRWGP

SEQ ID NO: 1172272 - protein, 9 aa, Homo Sapiens
LAPPAPGVP

SEQ ID NO: 1172273 - protein, 9 aa, Homo Sapiens
KIMKLSLPE

SEQ ID NO: 1172274 - protein, 9 aa, Homo Sapiens
VFSGQLAGR

SEQ ID NO: 1172275 - protein, 9 aa, Homo Sapiens
ALAMWEKGW

SEQ ID NO: 1172276 - protein, 9 aa, Homo Sapiens
DDLVELSKV

SEQ ID NO: 1172277 - protein, 9 aa, Homo Sapiens
STSWGPTAG

SEQ ID NO: 1172278 - protein, 9 aa, Homo Sapiens
ASVLEAPPQ

SEQ ID NO: 1172279 - protein, 9 aa, Homo Sapiens
FFSIINGQL

SEQ ID NO: 1172280 - protein, 9 aa, Homo Sapiens
GALWAPLHH

SEQ ID NO: 1172281 - protein, 9 aa, Homo Sapiens
PPSPGTALV

SEQ ID NO: 1172282 - protein, 9 aa, Homo Sapiens
PPQVCFLLL

SEQ ID NO: 1172283 - protein, 9 aa, Homo Sapiens
LAKITMKGY

SEQ ID NO: 1172284 - protein, 9 aa, Homo Sapiens
RIAAVISVT

SEQ ID NO: 1172285 - protein, 9 aa, Homo Sapiens
VRQAAASKL

SEQ ID NO: 1172286 - protein, 9 aa, Homo Sapiens
SEATYDPAG

SEQ ID NO: 1172287 - protein, 9 aa, Homo Sapiens
LVGLEVRRL

SEQ ID NO: 1172288 - protein, 9 aa, Homo Sapiens
PVGVKHRLR

SEQ ID NO: 1172289 - protein, 9 aa, Homo Sapiens
RPTGPLFFM

SEQ ID NO: 1172290 - protein, 9 aa, Homo Sapiens
YFKGMLSIY

SEQ ID NO: 1172291 - protein, 9 aa, Homo Sapiens
EDMVAESCG

SEQ ID NO: 1172292 - protein, 9 aa, Homo Sapiens
WKTWLQGGT

SEQ ID NO: 1172293 - protein, 9 aa, Homo Sapiens
FFMVVGKKR

SEQ ID NO: 1172294 - protein, 9 aa, Homo Sapiens
QATFDPKAW

SEQ ID NO: 1172295 - protein, 9 aa, Homo Sapiens
VVVVAAIVG

SEQ ID NO: 1172296 - protein, 9 aa, Homo Sapiens
LKFVGVMPQ

SEQ ID NO: 1172297 - protein, 9 aa, Homo Sapiens
GSRGPLASG

SEQ ID NO: 1172298 - protein, 9 aa, Homo Sapiens
SPPQGKSTL

SEQ ID NO: 1172299 - protein, 9 aa, Homo Sapiens
PQTPSMRTV

SEQ ID NO: 1172300 - protein, 9 aa, Homo Sapiens
AGSAPQTPQ

SEQ ID NO: 1172301 - protein, 9 aa, Homo Sapiens
GTTTPSANT

SEQ ID NO: 1172302 - protein, 9 aa, Homo Sapiens
SDVAISMTT

SEQ ID NO: 1172303 - protein, 9 aa, Homo Sapiens
SAPHTETAK

SEQ ID NO: 1172304 - protein, 9 aa, Homo Sapiens
ADKGDLRTG

SEQ ID NO: 1172305 - protein, 9 aa, Homo Sapiens
CYYWINSLL

SEQ ID NO: 1172306 - protein, 9 aa, Homo Sapiens
LFLLYGMSL

SEQ ID NO: 1172307 - protein, 9 aa, Homo Sapiens
LADQNRKDA

SEQ ID NO: 1172308 - protein, 9 aa, Homo Sapiens
SLYPEVTPH

SEQ ID NO: 1172309 - protein, 9 aa, Homo Sapiens
FCVTAPRHC

SEQ ID NO: 1172310 - protein, 9 aa, Homo Sapiens
MDKTVRFQQ

SEQ ID NO: 1172311 - protein, 9 aa, Homo Sapiens
RELWNQGTG

SEQ ID NO: 1172312 - protein, 9 aa, Homo Sapiens
LLKAWAQAE

SEQ ID NO: 1172313 - protein, 9 aa, Homo Sapiens
SHEASEDGV

SEQ ID NO: 1172314 - protein, 9 aa, Homo Sapiens
VVVAAIVGL

SEQ ID NO: 1172315 - protein, 9 aa, Homo Sapiens
GIPNLGIWP

SEQ ID NO: 1172316 - protein, 9 aa, Homo Sapiens
DKTVRFQQQ

SEQ ID NO: 1172317 - protein, 9 aa, Homo Sapiens
DPEAGDSDT

SEQ ID NO: 1172318 - protein, 9 aa, Homo Sapiens
IREITWKND

SEQ ID NO: 1172319 - protein, 9 aa, Homo Sapiens
SLVMCLRLR

SEQ ID NO: 1172320 - protein, 9 aa, Homo Sapiens
CGLWQRSPH

SEQ ID NO: 1172321 - protein, 9 aa, Homo Sapiens
GKPDKSEES

SEQ ID NO: 1172322 - protein, 9 aa, Homo Sapiens
TPNHTGCHP

SEQ ID NO: 1172323 - protein, 9 aa, Homo Sapiens
KKSLSDSTM

SEQ ID NO: 1172324 - protein, 9 aa, Homo Sapiens
PSASAQLWA

SEQ ID NO: 1172325 - protein, 9 aa, Homo Sapiens
GLPGKAEPS

SEQ ID NO: 1172326 - protein, 9 aa, Homo Sapiens
PPLQSKFTN

SEQ ID NO: 1172327 - protein, 9 aa, Homo Sapiens
CAMTRDSLS

SEQ ID NO: 1172328 - protein, 9 aa, Homo Sapiens
RLMTCWKAT

SEQ ID NO: 1172329 - protein, 9 aa, Homo Sapiens
YGLASAASC

SEQ ID NO: 1172330 - protein, 9 aa, Homo Sapiens
RALDDTVRE

SEQ ID NO: 1172331 - protein, 9 aa, Homo Sapiens
VPLRPGGLS

SEQ ID NO: 1172332 - protein, 9 aa, Homo Sapiens
GPAPAPKMC

SEQ ID NO: 1172333 - protein, 9 aa, Homo Sapiens
RVAGGGQPA

SEQ ID NO: 1172334 - protein, 9 aa, Homo Sapiens
RARQPLPLP

SEQ ID NO: 1172335 - protein, 9 aa, Homo Sapiens
IVLLGIYLV

SEQ ID NO: 1172336 - protein, 9 aa, Homo Sapiens
GTESPFSRK

SEQ ID NO: 1172337 - protein, 9 aa, Homo Sapiens
IITWENDQV

SEQ ID NO: 1172338 - protein, 9 aa, Homo Sapiens
GKPSHGVCV

SEQ ID NO: 1172339 - protein, 9 aa, Homo Sapiens
PIQPKARGG

SEQ ID NO: 1172340 - protein, 9 aa, Homo Sapiens
ELTVVVLVA

SEQ ID NO: 1172341 - protein, 9 aa, Homo Sapiens
NCDWRFNEL

SEQ ID NO: 1172342 - protein, 9 aa, Homo Sapiens
RGSPAWSRG

SEQ ID NO: 1172343 - protein, 9 aa, Homo Sapiens
LPLPHWPMR

SEQ ID NO: 1172344 - protein, 9 aa, Homo Sapiens
QINSQLQPM

SEQ ID NO: 1172345 - protein, 9 aa, Homo Sapiens
LANHPHSTG

SEQ ID NO: 1172346 - protein, 9 aa, Homo Sapiens
IELSENCVY

SEQ ID NO: 1172347 - protein, 9 aa, Homo Sapiens
ELVCIVSGD

SEQ ID NO: 1172348 - protein, 9 aa, Homo Sapiens
TPHQHGCRE

SEQ ID NO: 1172349 - protein, 9 aa, Homo Sapiens
PAAPSEPVA

SEQ ID NO: 1172350 - protein, 9 aa, Homo Sapiens
RPAVASRST

SEQ ID NO: 1172351 - protein, 9 aa, Homo Sapiens
RQTGAKSEH

SEQ ID NO: 1172352 - protein, 9 aa, Homo Sapiens
MGFLAGTGK

SEQ ID NO: 1172353 - protein, 9 aa, Homo Sapiens
VAQVAAVVA

SEQ ID NO: 1172354 - protein, 9 aa, Homo Sapiens
GLSYSKSNG

SEQ ID NO: 1172355 - protein, 9 aa, Homo Sapiens
VLALEVTFP

SEQ ID NO: 1172356 - protein, 9 aa, Homo Sapiens
QKQKADIEK

SEQ ID NO: 1172357 - protein, 9 aa, Homo Sapiens
RMTSWRPGL

SEQ ID NO: 1172358 - protein, 9 aa, Homo Sapiens
GALNKVLRR

SEQ ID NO: 1172359 - protein, 9 aa, Homo Sapiens
HPPAQPWPG

SEQ ID NO: 1172360 - protein, 9 aa, Homo Sapiens
ERRLITSAA

SEQ ID NO: 1172361 - protein, 9 aa, Homo Sapiens
PRAPTAPRP

SEQ ID NO: 1172362 - protein, 9 aa, Homo Sapiens
TAPMKMGRC

SEQ ID NO: 1172363 - protein, 9 aa, Homo Sapiens
TGFFRDISN

SEQ ID NO: 1172364 - protein, 9 aa, Homo Sapiens
VKPRVLHQN

SEQ ID NO: 1172365 - protein, 9 aa, Homo Sapiens
WRGRYGRHR

SEQ ID NO: 1172366 - protein, 9 aa, Homo Sapiens
SGSEATSQY

SEQ ID NO: 1172367 - protein, 9 aa, Homo Sapiens
VVFVASMLL

SEQ ID NO: 1172368 - protein, 9 aa, Homo Sapiens
LTHPAHQPL

SEQ ID NO: 1172369 - protein, 9 aa, Homo Sapiens
QNLDPTSSS

SEQ ID NO: 1172370 - protein, 9 aa, Homo Sapiens
ETHDCNKPP

SEQ ID NO: 1172371 - protein, 9 aa, Homo Sapiens
AHANFFHPE

SEQ ID NO: 1172372 - protein, 9 aa, Homo Sapiens
PMHPVLEVS

SEQ ID NO: 1172373 - protein, 9 aa, Homo Sapiens
GASAPRGPG

SEQ ID NO: 1172374 - protein, 9 aa, Homo Sapiens
GWMPGMNMK

SEQ ID NO: 1172375 - protein, 9 aa, Homo Sapiens
WQGGSHTRS

SEQ ID NO: 1172376 - protein, 9 aa, Homo Sapiens
TVYEAAVVE

SEQ ID NO: 1172377 - protein, 9 aa, Homo Sapiens
GVGVVGVCR

SEQ ID NO: 1172378 - protein, 9 aa, Homo Sapiens
QMVPASIAD

SEQ ID NO: 1172379 - protein, 9 aa, Homo Sapiens
QASRLKPSA

SEQ ID NO: 1172380 - protein, 9 aa, Homo Sapiens
QLYIDFRKG

SEQ ID NO: 1172381 - protein, 9 aa, Homo Sapiens
GIWEVMPRT

SEQ ID NO: 1172382 - protein, 9 aa, Homo Sapiens
CKTTCASSV

SEQ ID NO: 1172383 - protein, 9 aa, Homo Sapiens
PLRGPQRAH

SEQ ID NO: 1172384 - protein, 9 aa, Homo Sapiens
IRVQNGDSL

SEQ ID NO: 1172385 - protein, 9 aa, Homo Sapiens
PLNPAAQDG

SEQ ID NO: 1172386 - protein, 9 aa, Homo Sapiens
VMVLPGGCF

SEQ ID NO: 1172387 - protein, 9 aa, Homo Sapiens
KIMGQAANP

SEQ ID NO: 1172388 - protein, 9 aa, Homo Sapiens
MDIGLRQDV

SEQ ID NO: 1172389 - protein, 9 aa, Homo Sapiens
LSIVITVFM

SEQ ID NO: 1172390 - protein, 9 aa, Homo Sapiens
ATTYEENRA

SEQ ID NO: 1172391 - protein, 9 aa, Homo Sapiens
CSLDYAGYN

SEQ ID NO: 1172392 - protein, 9 aa, Homo Sapiens
LFTGTPVQN

SEQ ID NO: 1172393 - protein, 9 aa, Homo Sapiens
LPQEEEVKT

SEQ ID NO: 1172394 - protein, 9 aa, Homo Sapiens
SPESVELSE

SEQ ID NO: 1172395 - protein, 9 aa, Homo Sapiens
LVGNKCALE

SEQ ID NO: 1172396 - protein, 9 aa, Homo Sapiens
WMAVVAGLI

SEQ ID NO: 1172397 - protein, 9 aa, Homo Sapiens
CPHPAPPTR

SEQ ID NO: 1172398 - protein, 9 aa, Homo Sapiens
HVEKQLWGK

SEQ ID NO: 1172399 - protein, 9 aa, Homo Sapiens
AFGHYTLVG

SEQ ID NO: 1172400 - protein, 9 aa, Homo Sapiens
SAHFQRPPT

SEQ ID NO: 1172401 - protein, 9 aa, Homo Sapiens
SSVSPPQAA

SEQ ID NO: 1172402 - protein, 9 aa, Homo Sapiens
QQSISAEDD

SEQ ID NO: 1172403 - protein, 9 aa, Homo Sapiens
PSRSESEPE

SEQ ID NO: 1172404 - protein, 9 aa, Homo Sapiens
RQATFDPKA

SEQ ID NO: 1172405 - protein, 9 aa, Homo Sapiens
TLLLKIMGQ

SEQ ID NO: 1172406 - protein, 9 aa, Homo Sapiens
RLASSAPTW

SEQ ID NO: 1172407 - protein, 9 aa, Homo Sapiens
FCPRARQPL

SEQ ID NO: 1172408 - protein, 9 aa, Homo Sapiens
YPKKPGAPC

SEQ ID NO: 1172409 - protein, 9 aa, Homo Sapiens
SCRLAGMGL

SEQ ID NO: 1172410 - protein, 9 aa, Homo Sapiens
AVNLVGCLT

SEQ ID NO: 1172411 - protein, 9 aa, Homo Sapiens
LLELPWGPQ

SEQ ID NO: 1172412 - protein, 9 aa, Homo Sapiens
GLLPTPADK

SEQ ID NO: 1172413 - protein, 9 aa, Homo Sapiens
TRWSAWPCG

SEQ ID NO: 1172414 - protein, 9 aa, Homo Sapiens
LRCLRFPGL

SEQ ID NO: 1172415 - protein, 9 aa, Homo Sapiens
SSCAPSSSV

SEQ ID NO: 1172416 - protein, 9 aa, Homo Sapiens
TSCLYVGPG

SEQ ID NO: 1172417 - protein, 9 aa, Homo Sapiens
WWRRPRRQR

SEQ ID NO: 1172418 - protein, 9 aa, Homo Sapiens
ELYQKRALT

SEQ ID NO: 1172419 - protein, 9 aa, Homo Sapiens
WTSDLWERP

SEQ ID NO: 1172420 - protein, 9 aa, Homo Sapiens
FVWENGRAL

SEQ ID NO: 1172421 - protein, 9 aa, Homo Sapiens
VSSRSSRQT

SEQ ID NO: 1172422 - protein, 9 aa, Homo Sapiens
RSKEKTLGI

SEQ ID NO: 1172423 - protein, 9 aa, Homo Sapiens
PLTKSQSCL

SEQ ID NO: 1172424 - protein, 9 aa, Homo Sapiens
LEKNPPLRF

SEQ ID NO: 1172425 - protein, 9 aa, Homo Sapiens
VADGHFHTV

SEQ ID NO: 1172426 - protein, 9 aa, Homo Sapiens
SCRACEDGC

SEQ ID NO: 1172427 - protein, 9 aa, Homo Sapiens
QGPVPRCKT

SEQ ID NO: 1172428 - protein, 9 aa, Homo Sapiens
LNLLVIFYV

SEQ ID NO: 1172429 - protein, 9 aa, Homo Sapiens
GPPPPTPTA

SEQ ID NO: 1172430 - protein, 9 aa, Homo Sapiens
SPHHYYHSG

SEQ ID NO: 1172431 - protein, 9 aa, Homo Sapiens
FAINICTLL

SEQ ID NO: 1172432 - protein, 9 aa, Homo Sapiens
AYAQLSYLL

SEQ ID NO: 1172433 - protein, 9 aa, Homo Sapiens
EMLDITTKE

SEQ ID NO: 1172434 - protein, 9 aa, Homo Sapiens
NSFQSECVG

SEQ ID NO: 1172435 - protein, 9 aa, Homo Sapiens
ESHLFYKVA

SEQ ID NO: 1172436 - protein, 9 aa, Homo Sapiens
CSPCQFRLT

SEQ ID NO: 1172437 - protein, 9 aa, Homo Sapiens
EGKLHVAPM

SEQ ID NO: 1172438 - protein, 9 aa, Homo Sapiens
KTPPTNALT

SEQ ID NO: 1172439 - protein, 9 aa, Homo Sapiens
TYNKGRDWC

SEQ ID NO: 1172440 - protein, 9 aa, Homo Sapiens
PSSPQPWWW

SEQ ID NO: 1172441 - protein, 9 aa, Homo Sapiens
ALSVLAGAW

SEQ ID NO: 1172442 - protein, 9 aa, Homo Sapiens
ATVTKGDVT

SEQ ID NO: 1172443 - protein, 9 aa, Homo Sapiens
LHQGGERNL

SEQ ID NO: 1172444 - protein, 9 aa, Homo Sapiens
GSLIGHEGD

SEQ ID NO: 1172445 - protein, 9 aa, Homo Sapiens
EEPVPRRGL

SEQ ID NO: 1172446 - protein, 9 aa, Homo Sapiens
NLKKIHMSP

SEQ ID NO: 1172447 - protein, 9 aa, Homo Sapiens
KKIWESWQM

SEQ ID NO: 1172448 - protein, 9 aa, Homo Sapiens
KKGVFVVGV

SEQ ID NO: 1172449 - protein, 9 aa, Homo Sapiens
AHVHAAANG

SEQ ID NO: 1172450 - protein, 9 aa, Homo Sapiens
KGMLSIYKD

SEQ ID NO: 1172451 - protein, 9 aa, Homo Sapiens
ECIWNINPH

SEQ ID NO: 1172452 - protein, 9 aa, Homo Sapiens
KKKEVVEEA

SEQ ID NO: 1172453 - protein, 9 aa, Homo Sapiens
NLCLLPFLK

SEQ ID NO: 1172454 - protein, 9 aa, Homo Sapiens
KQSNTAIVS

SEQ ID NO: 1172455 - protein, 9 aa, Homo Sapiens
APAGPPRLG

SEQ ID NO: 1172456 - protein, 9 aa, Homo Sapiens
EAHAMEARA

SEQ ID NO: 1172457 - protein, 9 aa, Homo Sapiens
SPTWRTTSS

SEQ ID NO: 1172458 - protein, 9 aa, Homo Sapiens
QIRFWHIWH

SEQ ID NO: 1172459 - protein, 9 aa, Homo Sapiens
ILAYELLPA

SEQ ID NO: 1172460 - protein, 9 aa, Homo Sapiens
PPIRDPARG

SEQ ID NO: 1172461 - protein, 9 aa, Homo Sapiens
RRKRIPVAT

SEQ ID NO: 1172462 - protein, 9 aa, Homo Sapiens
DPQACIQLS

SEQ ID NO: 1172463 - protein, 9 aa, Homo Sapiens
FQRPPTPFL

SEQ ID NO: 1172464 - protein, 9 aa, Homo Sapiens
PPHGPVVRP

SEQ ID NO: 1172465 - protein, 9 aa, Homo Sapiens
DGALLLQAL

SEQ ID NO: 1172466 - protein, 9 aa, Homo Sapiens
GGPDSTPRG

SEQ ID NO: 1172467 - protein, 9 aa, Homo Sapiens
VHLEAVAGQ

SEQ ID NO: 1172468 - protein, 9 aa, Homo Sapiens
ILGKEKIAS

SEQ ID NO: 1172469 - protein, 9 aa, Homo Sapiens
VQTGQDLKE

SEQ ID NO: 1172470 - protein, 9 aa, Homo Sapiens
LPHWPMRLH

SEQ ID NO: 1172471 - protein, 9 aa, Homo Sapiens
RSMSPSTLD

SEQ ID NO: 1172472 - protein, 9 aa, Homo Sapiens
VLEQRDSKC

SEQ ID NO: 1172473 - protein, 9 aa, Homo Sapiens
WGWRSPKCI

SEQ ID NO: 1172474 - protein, 9 aa, Homo Sapiens
TSANRGEAA

SEQ ID NO: 1172475 - protein, 9 aa, Homo Sapiens
MSGCRPSNP

SEQ ID NO: 1172476 - protein, 9 aa, Homo Sapiens
SCGDDVLVV

SEQ ID NO: 1172477 - protein, 9 aa, Homo Sapiens
YSIQIFNGL

SEQ ID NO: 1172478 - protein, 9 aa, Homo Sapiens
SLNGKQEKL

SEQ ID NO: 1172479 - protein, 9 aa, Homo Sapiens
PTTRLMAPV

SEQ ID NO: 1172480 - protein, 9 aa, Homo Sapiens
QDCPAGPTS

SEQ ID NO: 1172481 - protein, 9 aa, Homo Sapiens
NVNHVVILQ

SEQ ID NO: 1172482 - protein, 9 aa, Homo Sapiens
RIASSVSPP

SEQ ID NO: 1172483 - protein, 9 aa, Homo Sapiens
VAVGCRRCS

SEQ ID NO: 1172484 - protein, 9 aa, Homo Sapiens
GCPTMRTLP

SEQ ID NO: 1172485 - protein, 9 aa, Homo Sapiens
TQRHRTDEV

SEQ ID NO: 1172486 - protein, 9 aa, Homo Sapiens
VWENGRALE

SEQ ID NO: 1172487 - protein, 9 aa, Homo Sapiens
GGVRKPLGP

SEQ ID NO: 1172488 - protein, 9 aa, Homo Sapiens
RTCWSPAPT

SEQ ID NO: 1172489 - protein, 9 aa, Homo Sapiens
SKASRALGG

SEQ ID NO: 1172490 - protein, 9 aa, Homo Sapiens
KCALEDERV

SEQ ID NO: 1172491 - protein, 9 aa, Homo Sapiens
NMLVLEQSV

SEQ ID NO: 1172492 - protein, 9 aa, Homo Sapiens
LGYSVVTIN

SEQ ID NO: 1172493 - protein, 9 aa, Homo Sapiens
ALPDAWPSS

SEQ ID NO: 1172494 - protein, 9 aa, Homo Sapiens
VREPSQRAA

SEQ ID NO: 1172495 - protein, 9 aa, Homo Sapiens
FLAAGKKWD

SEQ ID NO: 1172496 - protein, 9 aa, Homo Sapiens
EQGSDGIPG

SEQ ID NO: 1172497 - protein, 9 aa, Homo Sapiens
AECGKFFCH

SEQ ID NO: 1172498 - protein, 9 aa, Homo Sapiens
LASEEQRAE

SEQ ID NO: 1172499 - protein, 9 aa, Homo Sapiens
TTEVVRRCP

SEQ ID NO: 1172500 - protein, 9 aa, Homo Sapiens
LDPLADAVT

SEQ ID NO: 1172501 - protein, 9 aa, Homo Sapiens
ILNVEHSET

SEQ ID NO: 1172502 - protein, 9 aa, Homo Sapiens
APTAPRPGS

SEQ ID NO: 1172503 - protein, 9 aa, Homo Sapiens
PLEPPLPPA

SEQ ID NO: 1172504 - protein, 9 aa, Homo Sapiens
RPRQGDGGA

SEQ ID NO: 1172505 - protein, 9 aa, Homo Sapiens
WRDEESTAW

SEQ ID NO: 1172506 - protein, 9 aa, Homo Sapiens
PADPPLGLP

SEQ ID NO: 1172507 - protein, 9 aa, Homo Sapiens
VLRWEQEVA

SEQ ID NO: 1172508 - protein, 9 aa, Homo Sapiens
LPASTSSSL

SEQ ID NO: 1172509 - protein, 9 aa, Homo Sapiens
SASTASLRC

SEQ ID NO: 1172510 - protein, 9 aa, Homo Sapiens
RPPPPRSWG

SEQ ID NO: 1172511 - protein, 9 aa, Homo Sapiens
RVHIAHGRC

SEQ ID NO: 1172512 - protein, 9 aa, Homo Sapiens
LRKTFWFFQ

SEQ ID NO: 1172513 - protein, 9 aa, Homo Sapiens
CTQSEWHGW

SEQ ID NO: 1172514 - protein, 9 aa, Homo Sapiens
VHRTRAVFN

SEQ ID NO: 1172515 - protein, 9 aa, Homo Sapiens
ICPSYLHSH

SEQ ID NO: 1172516 - protein, 9 aa, Homo Sapiens
AGQRGRADP

SEQ ID NO: 1172517 - protein, 9 aa, Homo Sapiens
PDHDKFSTM

SEQ ID NO: 1172518 - protein, 9 aa, Homo Sapiens
EDTHKQLNM

SEQ ID NO: 1172519 - protein, 9 aa, Homo Sapiens
LCSDHSVPP

SEQ ID NO: 1172520 - protein, 9 aa, Homo Sapiens
STPPPPPGW

SEQ ID NO: 1172521 - protein, 9 aa, Homo Sapiens
GARNKSWLS

SEQ ID NO: 1172522 - protein, 9 aa, Homo Sapiens
RQDVTLELQ

SEQ ID NO: 1172523 - protein, 9 aa, Homo Sapiens
EKIMKLSLP

SEQ ID NO: 1172524 - protein, 9 aa, Homo Sapiens
LLWKKRFGQ

SEQ ID NO: 1172525 - protein, 9 aa, Homo Sapiens
AEVTSTLEV

SEQ ID NO: 1172526 - protein, 9 aa, Homo Sapiens
AGRGTSAEL

SEQ ID NO: 1172527 - protein, 9 aa, Homo Sapiens
REEPSSGNG

SEQ ID NO: 1172528 - protein, 9 aa, Homo Sapiens
RLQGAIHER

SEQ ID NO: 1172529 - protein, 9 aa, Homo Sapiens
RPDIREKVI

SEQ ID NO: 1172530 - protein, 9 aa, Homo Sapiens
PGHRSASPG

SEQ ID NO: 1172531 - protein, 9 aa, Homo Sapiens
LLGIYLVTV

SEQ ID NO: 1172532 - protein, 9 aa, Homo Sapiens
IHAMTAQGS

SEQ ID NO: 1172533 - protein, 9 aa, Homo Sapiens
ATRLYCSLG

SEQ ID NO: 1172534 - protein, 9 aa, Homo Sapiens
HCQHRERIN

SEQ ID NO: 1172535 - protein, 9 aa, Homo Sapiens
VSRFPSSMS

SEQ ID NO: 1172536 - protein, 9 aa, Homo Sapiens
RCCSTPSMY

SEQ ID NO: 1172537 - protein, 9 aa, Homo Sapiens
AHRSPGHGG

SEQ ID NO: 1172538 - protein, 9 aa, Homo Sapiens
GLSPGACRP

SEQ ID NO: 1172539 - protein, 9 aa, Homo Sapiens
CNKPPIYKT

SEQ ID NO: 1172540 - protein, 9 aa, Homo Sapiens
PKKKRSAFP

SEQ ID NO: 1172541 - protein, 9 aa, Homo Sapiens
WLITWGRLT

SEQ ID NO: 1172542 - protein, 9 aa, Homo Sapiens
MLGRHGEQR

SEQ ID NO: 1172543 - protein, 9 aa, Homo Sapiens
RRHRGALSP

SEQ ID NO: 1172544 - protein, 9 aa, Homo Sapiens
SIKIINYKI

SEQ ID NO: 1172545 - protein, 9 aa, Homo Sapiens
KGLKKMTLK

SEQ ID NO: 1172546 - protein, 9 aa, Homo Sapiens
VGRYLAITK

SEQ ID NO: 1172547 - protein, 9 aa, Homo Sapiens
RVALSRPPG

SEQ ID NO: 1172548 - protein, 9 aa, Homo Sapiens
KLLSTTGES

SEQ ID NO: 1172549 - protein, 9 aa, Homo Sapiens
GGRGAAAGS

SEQ ID NO: 1172550 - protein, 9 aa, Homo Sapiens
CCHRRRQLR

SEQ ID NO: 1172551 - protein, 9 aa, Homo Sapiens
PGWQSYLLP

SEQ ID NO: 1172552 - protein, 9 aa, Homo Sapiens
SPLPPPAPC

SEQ ID NO: 1172553 - protein, 9 aa, Homo Sapiens
ATSPATTWR

SEQ ID NO: 1172554 - protein, 9 aa, Homo Sapiens
IRGSKHWSF

SEQ ID NO: 1172555 - protein, 9 aa, Homo Sapiens
GTPLSISRP

SEQ ID NO: 1172556 - protein, 9 aa, Homo Sapiens
QVYLLLLNL

SEQ ID NO: 1172557 - protein, 9 aa, Homo Sapiens
PLKKVWNLQ

SEQ ID NO: 1172558 - protein, 9 aa, Homo Sapiens
GRCHLAGGL

SEQ ID NO: 1172559 - protein, 9 aa, Homo Sapiens
HTPEVLEEA

SEQ ID NO: 1172560 - protein, 9 aa, Homo Sapiens
AQGRKPKNF

SEQ ID NO: 1172561 - protein, 9 aa, Homo Sapiens
WAHLRWAVF

SEQ ID NO: 1172562 - protein, 9 aa, Homo Sapiens
ALYGYKLTG

SEQ ID NO: 1172563 - protein, 9 aa, Homo Sapiens
SSGSSGGGA

SEQ ID NO: 1172564 - protein, 9 aa, Homo Sapiens
GDVPQTVKS

SEQ ID NO: 1172565 - protein, 9 aa, Homo Sapiens
VENDVSFPD

SEQ ID NO: 1172566 - protein, 9 aa, Homo Sapiens
IQQQLEITG

SEQ ID NO: 1172567 - protein, 9 aa, Homo Sapiens
SLTGAHACC

SEQ ID NO: 1172568 - protein, 9 aa, Homo Sapiens
DLPRELKIK

SEQ ID NO: 1172569 - protein, 9 aa, Homo Sapiens
LDRQFRPPW

SEQ ID NO: 1172570 - protein, 9 aa, Homo Sapiens
FMLNVHYRT

SEQ ID NO: 1172571 - protein, 9 aa, Homo Sapiens
EKMKEECER

SEQ ID NO: 1172572 - protein, 9 aa, Homo Sapiens
ICLCKEITC

SEQ ID NO: 1172573 - protein, 9 aa, Homo Sapiens
RRTRPLTTP

SEQ ID NO: 1172574 - protein, 9 aa, Homo Sapiens
RMLMVAWIR

SEQ ID NO: 1172575 - protein, 9 aa, Homo Sapiens
KTPLVEEGN

SEQ ID NO: 1172576 - protein, 9 aa, Homo Sapiens
EKPYECNTR

SEQ ID NO: 1172577 - protein, 9 aa, Homo Sapiens
LARGAGPNH

SEQ ID NO: 1172578 - protein, 9 aa, Homo Sapiens
TALFGAQAN

SEQ ID NO: 1172579 - protein, 9 aa, Homo Sapiens
SARMSSWSQ

SEQ ID NO: 1172580 - protein, 9 aa, Homo Sapiens
LPPAPSPNL

SEQ ID NO: 1172581 - protein, 9 aa, Homo Sapiens
VVQRTTVHV

SEQ ID NO: 1172582 - protein, 9 aa, Homo Sapiens
PLPSASPFS

SEQ ID NO: 1172583 - protein, 9 aa, Homo Sapiens
RGRTSGRSL

SEQ ID NO: 1172584 - protein, 9 aa, Homo Sapiens
SLRLPISGS

SEQ ID NO: 1172585 - protein, 9 aa, Homo Sapiens
GHHVLGLIE

SEQ ID NO: 1172586 - protein, 9 aa, Homo Sapiens
NHTGCHPTP

SEQ ID NO: 1172587 - protein, 9 aa, Homo Sapiens
TGPLFFMEA

SEQ ID NO: 1172588 - protein, 9 aa, Homo Sapiens
EGHESYELQ

SEQ ID NO: 1172589 - protein, 9 aa, Homo Sapiens
EAPSLRCLG

SEQ ID NO: 1172590 - protein, 9 aa, Homo Sapiens
SENTHRRET

SEQ ID NO: 1172591 - protein, 9 aa, Homo Sapiens
LGMTLLHTQ

SEQ ID NO: 1172592 - protein, 9 aa, Homo Sapiens
QNYHEEIII

SEQ ID NO: 1172593 - protein, 9 aa, Homo Sapiens
KRQGDFCIF

SEQ ID NO: 1172594 - protein, 9 aa, Homo Sapiens
PGSGVGGAA

SEQ ID NO: 1172595 - protein, 9 aa, Homo Sapiens
QASCWTSHW

SEQ ID NO: 1172596 - protein, 9 aa, Homo Sapiens
MTPLDTNCL

SEQ ID NO: 1172597 - protein, 9 aa, Homo Sapiens
RSAASLPQL

SEQ ID NO: 1172598 - protein, 9 aa, Homo Sapiens
QIKEKRKHK

SEQ ID NO: 1172599 - protein, 9 aa, Homo Sapiens
TAAVGKARR

SEQ ID NO: 1172600 - protein, 9 aa, Homo Sapiens
WGRAPRTES

SEQ ID NO: 1172601 - protein, 9 aa, Homo Sapiens
RSKLRKVSE

SEQ ID NO: 1172602 - protein, 9 aa, Homo Sapiens
IKEKRKHKD

SEQ ID NO: 1172603 - protein, 9 aa, Homo Sapiens
TLPQWKQSS

SEQ ID NO: 1172604 - protein, 9 aa, Homo Sapiens
PPTWSRTSR

SEQ ID NO: 1172605 - protein, 9 aa, Homo Sapiens
RESPSSHGA

SEQ ID NO: 1172606 - protein, 9 aa, Homo Sapiens
SPRSCSPAH

SEQ ID NO: 1172607 - protein, 9 aa, Homo Sapiens
HQDLGYQNG

SEQ ID NO: 1172608 - protein, 9 aa, Homo Sapiens
IYITVQNPQ

SEQ ID NO: 1172609 - protein, 9 aa, Homo Sapiens
LHHSTGERT

SEQ ID NO: 1172610 - protein, 9 aa, Homo Sapiens
SAPTQAKSP

SEQ ID NO: 1172611 - protein, 9 aa, Homo Sapiens
GWRSVRMYN

SEQ ID NO: 1172612 - protein, 9 aa, Homo Sapiens
RVPGSQGAA

SEQ ID NO: 1172613 - protein, 9 aa, Homo Sapiens
SLRCIWRGL

SEQ ID NO: 1172614 - protein, 9 aa, Homo Sapiens
SPHRRTRSR

SEQ ID NO: 1172615 - protein, 9 aa, Homo Sapiens
NRLKENEKL

SEQ ID NO: 1172616 - protein, 9 aa, Homo Sapiens
HHHHHQQRL

SEQ ID NO: 1172617 - protein, 9 aa, Homo Sapiens
VKTKRQRKS

SEQ ID NO: 1172618 - protein, 9 aa, Homo Sapiens
GPRAPVRAW

SEQ ID NO: 1172619 - protein, 9 aa, Homo Sapiens
PTRPRLLPL

SEQ ID NO: 1172620 - protein, 9 aa, Homo Sapiens
GALSLSCSC

SEQ ID NO: 1172621 - protein, 9 aa, Homo Sapiens
KKTSRILNL

SEQ ID NO: 1172622 - protein, 9 aa, Homo Sapiens
KVYTCSHCP

SEQ ID NO: 1172623 - protein, 9 aa, Homo Sapiens
CGGCPSGFP

SEQ ID NO: 1172624 - protein, 9 aa, Homo Sapiens
VDACQADRH

SEQ ID NO: 1172625 - protein, 9 aa, Homo Sapiens
PDRKDIGSE

SEQ ID NO: 1172626 - protein, 9 aa, Homo Sapiens
CVRLGDVIS

SEQ ID NO: 1172627 - protein, 9 aa, Homo Sapiens
EALLARVRP

SEQ ID NO: 1172628 - protein, 9 aa, Homo Sapiens
RGLPLTLSA

SEQ ID NO: 1172629 - protein, 9 aa, Homo Sapiens
QCVCPQGFG

SEQ ID NO: 1172630 - protein, 9 aa, Homo Sapiens
AVGFQVHLE

SEQ ID NO: 1172631 - protein, 9 aa, Homo Sapiens
VQKYPIRMS

SEQ ID NO: 1172632 - protein, 9 aa, Homo Sapiens
TYPKKPGAP

SEQ ID NO: 1172633 - protein, 9 aa, Homo Sapiens
ARGIPRSTC

SEQ ID NO: 1172634 - protein, 9 aa, Homo Sapiens
LYAMAASVM

SEQ ID NO: 1172635 - protein, 9 aa, Homo Sapiens
VGNGCAGGG

SEQ ID NO: 1172636 - protein, 9 aa, Homo Sapiens
PRACESLVK

SEQ ID NO: 1172637 - protein, 9 aa, Homo Sapiens
DIELSENCV

SEQ ID NO: 1172638 - protein, 9 aa, Homo Sapiens
KESPVIPLL

SEQ ID NO: 1172639 - protein, 9 aa, Homo Sapiens
VLLPTGTDH

SEQ ID NO: 1172640 - protein, 9 aa, Homo Sapiens
LITVLDRDS

SEQ ID NO: 1172641 - protein, 9 aa, Homo Sapiens
PVIAASPAP

SEQ ID NO: 1172642 - protein, 9 aa, Homo Sapiens
RGLGGHLSF

SEQ ID NO: 1172643 - protein, 9 aa, Homo Sapiens
FPTLPRFCP

SEQ ID NO: 1172644 - protein, 9 aa, Homo Sapiens
WTCLKMSIG

SEQ ID NO: 1172645 - protein, 9 aa, Homo Sapiens
RELGARWDA

SEQ ID NO: 1172646 - protein, 9 aa, Homo Sapiens
KATAWMSPS

SEQ ID NO: 1172647 - protein, 9 aa, Homo Sapiens
LINSRKCLR

SEQ ID NO: 1172648 - protein, 9 aa, Homo Sapiens
GHFPGCWAR

SEQ ID NO: 1172649 - protein, 9 aa, Homo Sapiens
PGCWPFHLI

SEQ ID NO: 1172650 - protein, 9 aa, Homo Sapiens
WLGGPTARP

SEQ ID NO: 1172651 - protein, 9 aa, Homo Sapiens
NECYLQQAA

SEQ ID NO: 1172652 - protein, 9 aa, Homo Sapiens
GADHIYDLN

SEQ ID NO: 1172653 - protein, 9 aa, Homo Sapiens
QPELRPSVD

SEQ ID NO: 1172654 - protein, 9 aa, Homo Sapiens
TTTSSQPSR

SEQ ID NO: 1172655 - protein, 9 aa, Homo Sapiens
GSTSRRTRP

SEQ ID NO: 1172656 - protein, 9 aa, Homo Sapiens
PPPGLRPCR

SEQ ID NO: 1172657 - protein, 9 aa, Homo Sapiens
RHRGALSPT

SEQ ID NO: 1172658 - protein, 9 aa, Homo Sapiens
LCSGPRPRC

SEQ ID NO: 1172659 - protein, 9 aa, Homo Sapiens
SKLRKVSEP

SEQ ID NO: 1172660 - protein, 9 aa, Homo Sapiens
CQSSCYKAL

SEQ ID NO: 1172661 - protein, 9 aa, Homo Sapiens
CNPETCPVE

SEQ ID NO: 1172662 - protein, 9 aa, Homo Sapiens
QRRRKILDT

SEQ ID NO: 1172663 - protein, 9 aa, Homo Sapiens
DLQVEIEPV

SEQ ID NO: 1172664 - protein, 9 aa, Homo Sapiens
LRYETLSPV

SEQ ID NO: 1172665 - protein, 9 aa, Homo Sapiens
SGLAPRGRG

SEQ ID NO: 1172666 - protein, 9 aa, Homo Sapiens
ICSDTRLQT

SEQ ID NO: 1172667 - protein, 9 aa, Homo Sapiens
ESIVKKQIV

SEQ ID NO: 1172668 - protein, 9 aa, Homo Sapiens
GCLPPEPGD

SEQ ID NO: 1172669 - protein, 9 aa, Homo Sapiens
ALVGARAPW

SEQ ID NO: 1172670 - protein, 9 aa, Homo Sapiens
TPSCRNHIK

SEQ ID NO: 1172671 - protein, 9 aa, Homo Sapiens
GITLRSLFC

SEQ ID NO: 1172672 - protein, 9 aa, Homo Sapiens
HDGDFHVPQ

SEQ ID NO: 1172673 - protein, 9 aa, Homo Sapiens
CSMRKGSLQ

SEQ ID NO: 1172674 - protein, 9 aa, Homo Sapiens
VARGPAEKE

SEQ ID NO: 1172675 - protein, 9 aa, Homo Sapiens
NGCCIEMMK

SEQ ID NO: 1172676 - protein, 9 aa, Homo Sapiens
SVWQRRRRI

SEQ ID NO: 1172677 - protein, 9 aa, Homo Sapiens
NQFSVTSAW

SEQ ID NO: 1172678 - protein, 9 aa, Homo Sapiens
HHCPRHCPR

SEQ ID NO: 1172679 - protein, 9 aa, Homo Sapiens
GLVGVKASL

SEQ ID NO: 1172680 - protein, 9 aa, Homo Sapiens
LDELGCKYQ

SEQ ID NO: 1172681 - protein, 9 aa, Homo Sapiens
RLWMANARR

SEQ ID NO: 1172682 - protein, 9 aa, Homo Sapiens
RGTVTPPPG

SEQ ID NO: 1172683 - protein, 9 aa, Homo Sapiens
GFTTDLRSN

SEQ ID NO: 1172684 - protein, 9 aa, Homo Sapiens
KASRALGGH

SEQ ID NO: 1172685 - protein, 9 aa, Homo Sapiens
GPLSVPPGI

SEQ ID NO: 1172686 - protein, 9 aa, Homo Sapiens
EGEKNQLTR

SEQ ID NO: 1172687 - protein, 9 aa, Homo Sapiens
CSVEFALDV

SEQ ID NO: 1172688 - protein, 9 aa, Homo Sapiens
AYCVNLLCG

SEQ ID NO: 1172689 - protein, 9 aa, Homo Sapiens
RPCRCCRCL

SEQ ID NO: 1172690 - protein, 9 aa, Homo Sapiens
PRHCIEFRP

SEQ ID NO: 1172691 - protein, 9 aa, Homo Sapiens
TNSNANTAS

SEQ ID NO: 1172692 - protein, 9 aa, Homo Sapiens
FRIRQPILQ

SEQ ID NO: 1172693 - protein, 9 aa, Homo Sapiens
GCTSLRLPI

SEQ ID NO: 1172694 - protein, 9 aa, Homo Sapiens
TLQQVIHLL

SEQ ID NO: 1172695 - protein, 9 aa, Homo Sapiens
ERGDLGCPT

SEQ ID NO: 1172696 - protein, 9 aa, Homo Sapiens
VSVPKKIIT

SEQ ID NO: 1172697 - protein, 9 aa, Homo Sapiens
DLTGGVTTN

SEQ ID NO: 1172698 - protein, 9 aa, Homo Sapiens
FPGSFLGRT

SEQ ID NO: 1172699 - protein, 9 aa, Homo Sapiens
GQGLSPDHR

SEQ ID NO: 1172700 - protein, 9 aa, Homo Sapiens
QSRHLGADG

SEQ ID NO: 1172701 - protein, 9 aa, Homo Sapiens
RVRKYTLVS

SEQ ID NO: 1172702 - protein, 9 aa, Homo Sapiens
HSVLWTLYF

SEQ ID NO: 1172703 - protein, 9 aa, Homo Sapiens
GRRIWVDYS

SEQ ID NO: 1172704 - protein, 9 aa, Homo Sapiens
STNNTMLWN

SEQ ID NO: 1172705 - protein, 9 aa, Homo Sapiens
FRPPWIEAC

SEQ ID NO: 1172706 - protein, 9 aa, Homo Sapiens
YLTGGLWAW

SEQ ID NO: 1172707 - protein, 9 aa, Homo Sapiens
SIAVIKGMT

SEQ ID NO: 1172708 - protein, 9 aa, Homo Sapiens
SLSCCPRPR

SEQ ID NO: 1172709 - protein, 9 aa, Homo Sapiens
HGSNAVGRR

SEQ ID NO: 1172710 - protein, 9 aa, Homo Sapiens
ILTGTIEVG

SEQ ID NO: 1172711 - protein, 9 aa, Homo Sapiens
IEGHYVHVV

SEQ ID NO: 1172712 - protein, 9 aa, Homo Sapiens
WSKQGPVSL

SEQ ID NO: 1172713 - protein, 9 aa, Homo Sapiens
TGLVAAAAK

SEQ ID NO: 1172714 - protein, 9 aa, Homo Sapiens
WIGRVHCGA

SEQ ID NO: 1172715 - protein, 9 aa, Homo Sapiens
DTQAYGHEI

SEQ ID NO: 1172716 - protein, 9 aa, Homo Sapiens
RALTRVGAL

SEQ ID NO: 1172717 - protein, 9 aa, Homo Sapiens
LARTSTCGS

SEQ ID NO: 1172718 - protein, 9 aa, Homo Sapiens
KDSGTQRGR

SEQ ID NO: 1172719 - protein, 9 aa, Homo Sapiens
NLQVLKKIL

SEQ ID NO: 1172720 - protein, 9 aa, Homo Sapiens
FSILRGSWK

SEQ ID NO: 1172721 - protein, 9 aa, Homo Sapiens
KAGLLAMLQ

SEQ ID NO: 1172722 - protein, 9 aa, Homo Sapiens
CCPRPRCRP

SEQ ID NO: 1172723 - protein, 9 aa, Homo Sapiens
IYGIESVKI

SEQ ID NO: 1172724 - protein, 9 aa, Homo Sapiens
LPRRSSLGF

SEQ ID NO: 1172725 - protein, 9 aa, Homo Sapiens
AHGRCHLAG

SEQ ID NO: 1172726 - protein, 9 aa, Homo Sapiens
GQGSCSTIS

SEQ ID NO: 1172727 - protein, 9 aa, Homo Sapiens
PTWRRTTSA

SEQ ID NO: 1172728 - protein, 9 aa, Homo Sapiens
DSLERYLDG

SEQ ID NO: 1172729 - protein, 9 aa, Homo Sapiens
SGRHRGLGG

SEQ ID NO: 1172730 - protein, 9 aa, Homo Sapiens
SGGLPQWRK

SEQ ID NO: 1172731 - protein, 9 aa, Homo Sapiens
WALIFFSIA

SEQ ID NO: 1172732 - protein, 9 aa, Homo Sapiens
GPPRLGQRR

SEQ ID NO: 1172733 - protein, 9 aa, Homo Sapiens
YITSTKTRK

SEQ ID NO: 1172734 - protein, 9 aa, Homo Sapiens
ARQPSRPTG

SEQ ID NO: 1172735 - protein, 9 aa, Homo Sapiens
SPGLPPNTC

SEQ ID NO: 1172736 - protein, 9 aa, Homo Sapiens
RRSHPGGPA

SEQ ID NO: 1172737 - protein, 9 aa, Homo Sapiens
NLRSRAECD

SEQ ID NO: 1172738 - protein, 9 aa, Homo Sapiens
DWRFNELPN

SEQ ID NO: 1172739 - protein, 9 aa, Homo Sapiens
RSSWAALSG

SEQ ID NO: 1172740 - protein, 9 aa, Homo Sapiens
FHRSLWTMS

SEQ ID NO: 1172741 - protein, 9 aa, Homo Sapiens
EKKILSGKR

SEQ ID NO: 1172742 - protein, 9 aa, Homo Sapiens
APCTPRRRL

SEQ ID NO: 1172743 - protein, 9 aa, Homo Sapiens
IRSGWRSVR

SEQ ID NO: 1172744 - protein, 9 aa, Homo Sapiens
GKFFCHSTH

SEQ ID NO: 1172745 - protein, 9 aa, Homo Sapiens
SCGAARPRR

SEQ ID NO: 1172746 - protein, 9 aa, Homo Sapiens
QDGARCPSC

SEQ ID NO: 1172747 - protein, 9 aa, Homo Sapiens
QDASCTRIL

SEQ ID NO: 1172748 - protein, 9 aa, Homo Sapiens
RPPLPVPDV

SEQ ID NO: 1172749 - protein, 9 aa, Homo Sapiens
TELFQTLIS

SEQ ID NO: 1172750 - protein, 9 aa, Homo Sapiens
PSSWQECDE

SEQ ID NO: 1172751 - protein, 9 aa, Homo Sapiens
CHDNTSCLY

SEQ ID NO: 1172752 - protein, 9 aa, Homo Sapiens
GGGEGGPER

SEQ ID NO: 1172753 - protein, 9 aa, Homo Sapiens
SSLRPRPPE

SEQ ID NO: 1172754 - protein, 9 aa, Homo Sapiens
ARPARAAGA

SEQ ID NO: 1172755 - protein, 9 aa, Homo Sapiens
EWSNSLASE

SEQ ID NO: 1172756 - protein, 9 aa, Homo Sapiens
SAQGRKPKN

SEQ ID NO: 1172757 - protein, 9 aa, Homo Sapiens
VNEACIIAL

SEQ ID NO: 1172758 - protein, 9 aa, Homo Sapiens
DYHTPAGFN

SEQ ID NO: 1172759 - protein, 9 aa, Homo Sapiens
LVRAQADLQ

SEQ ID NO: 1172760 - protein, 9 aa, Homo Sapiens
ERGPPSHCQ

SEQ ID NO: 1172761 - protein, 9 aa, Homo Sapiens
RVSGVFPVL

SEQ ID NO: 1172762 - protein, 9 aa, Homo Sapiens
APQVAMLPK

SEQ ID NO: 1172763 - protein, 9 aa, Homo Sapiens
VRPRKVPTA

SEQ ID NO: 1172764 - protein, 9 aa, Homo Sapiens
RIVLMAVGG

SEQ ID NO: 1172765 - protein, 9 aa, Homo Sapiens
IYPLCSTTC

SEQ ID NO: 1172766 - protein, 9 aa, Homo Sapiens
LDEIEHGFE

SEQ ID NO: 1172767 - protein, 9 aa, Homo Sapiens
ARTVTCKST

SEQ ID NO: 1172768 - protein, 9 aa, Homo Sapiens
LSPQLCRPP

SEQ ID NO: 1172769 - protein, 9 aa, Homo Sapiens
GWLPRLTRE

SEQ ID NO: 1172770 - protein, 9 aa, Homo Sapiens
GDVRHGFRS

SEQ ID NO: 1172771 - protein, 9 aa, Homo Sapiens
TPKRVTFTR

SEQ ID NO: 1172772 - protein, 9 aa, Homo Sapiens
SSSSCAPSS

SEQ ID NO: 1172773 - protein, 9 aa, Homo Sapiens
DGDRDEDGP

SEQ ID NO: 1172774 - protein, 9 aa, Homo Sapiens
HPPAIRGLT

SEQ ID NO: 1172775 - protein, 9 aa, Homo Sapiens
PGSSWEKVP

SEQ ID NO: 1172776 - protein, 9 aa, Homo Sapiens
AVRPRPGPL

SEQ ID NO: 1172777 - protein, 9 aa, Homo Sapiens
TCTEWAGFL

SEQ ID NO: 1172778 - protein, 9 aa, Homo Sapiens
PHTHPLCPP

SEQ ID NO: 1172779 - protein, 9 aa, Homo Sapiens
SLRESHTIV

SEQ ID NO: 1172780 - protein, 9 aa, Homo Sapiens
DAQNMGAVA

SEQ ID NO: 1172781 - protein, 9 aa, Homo Sapiens
TKKPTETPQ

SEQ ID NO: 1172782 - protein, 9 aa, Homo Sapiens
GPAPASSTS

SEQ ID NO: 1172783 - protein, 9 aa, Homo Sapiens
TAMLVATSA

SEQ ID NO: 1172784 - protein, 9 aa, Homo Sapiens
QPVVVVAAI

SEQ ID NO: 1172785 - protein, 9 aa, Homo Sapiens
LVGVKASLL

SEQ ID NO: 1172786 - protein, 9 aa, Homo Sapiens
FWQAFLRES

SEQ ID NO: 1172787 - protein, 9 aa, Homo Sapiens
CACGFSAVM

SEQ ID NO: 1172788 - protein, 9 aa, Homo Sapiens
YASLPSPSC

SEQ ID NO: 1172789 - protein, 9 aa, Homo Sapiens
CPQTPCWGW

SEQ ID NO: 1172790 - protein, 9 aa, Homo Sapiens
APPRSPLTP

SEQ ID NO: 1172791 - protein, 9 aa, Homo Sapiens
LRRASGTLL

SEQ ID NO: 1172792 - protein, 9 aa, Homo Sapiens
NLLVIFYVS

SEQ ID NO: 1172793 - protein, 9 aa, Homo Sapiens
KGPGVSRSP

SEQ ID NO: 1172794 - protein, 9 aa, Homo Sapiens
GALGRGSTC

SEQ ID NO: 1172795 - protein, 9 aa, Homo Sapiens
LRSWWLASR

SEQ ID NO: 1172796 - protein, 9 aa, Homo Sapiens
FIRFLQMYS

SEQ ID NO: 1172797 - protein, 9 aa, Homo Sapiens
GVFVVGVVE

SEQ ID NO: 1172798 - protein, 9 aa, Homo Sapiens
EIEPNFSTT

SEQ ID NO: 1172799 - protein, 9 aa, Homo Sapiens
ANSQPLYRF

SEQ ID NO: 1172800 - protein, 9 aa, Homo Sapiens
AILSLRQTL

SEQ ID NO: 1172801 - protein, 9 aa, Homo Sapiens
QERGGASLK

SEQ ID NO: 1172802 - protein, 9 aa, Homo Sapiens
PREARALSR

SEQ ID NO: 1172803 - protein, 9 aa, Homo Sapiens
QTPSMRTVT

SEQ ID NO: 1172804 - protein, 9 aa, Homo Sapiens
TSDLWERPG

SEQ ID NO: 1172805 - protein, 9 aa, Homo Sapiens
AQLEQAYIR

SEQ ID NO: 1172806 - protein, 9 aa, Homo Sapiens
FHTTAAGIV

SEQ ID NO: 1172807 - protein, 9 aa, Homo Sapiens
SRIPPHRCF

SEQ ID NO: 1172808 - protein, 9 aa, Homo Sapiens
QTCCGQIPG

SEQ ID NO: 1172809 - protein, 9 aa, Homo Sapiens
LTAAEQRVS

SEQ ID NO: 1172810 - protein, 9 aa, Homo Sapiens
PRPPPLVRC

SEQ ID NO: 1172811 - protein, 9 aa, Homo Sapiens
KLVQSILSD

SEQ ID NO: 1172812 - protein, 9 aa, Homo Sapiens
FIILEKNPP

SEQ ID NO: 1172813 - protein, 9 aa, Homo Sapiens
LYGMSLITL

SEQ ID NO: 1172814 - protein, 9 aa, Homo Sapiens
GGHLSFVRS

SEQ ID NO: 1172815 - protein, 9 aa, Homo Sapiens
RRTRSRTGA

SEQ ID NO: 1172816 - protein, 9 aa, Homo Sapiens
GSTPRPAPS

SEQ ID NO: 1172817 - protein, 9 aa, Homo Sapiens
RRPSGFPDI

SEQ ID NO: 1172818 - protein, 9 aa, Homo Sapiens
RPTSRARQS

SEQ ID NO: 1172819 - protein, 9 aa, Homo Sapiens
GLEDWSFLQ

SEQ ID NO: 1172820 - protein, 9 aa, Homo Sapiens
RPASPLFAC

SEQ ID NO: 1172821 - protein, 9 aa, Homo Sapiens
KIQKVWAIP

SEQ ID NO: 1172822 - protein, 9 aa, Homo Sapiens
NLLGRSPPL

SEQ ID NO: 1172823 - protein, 9 aa, Homo Sapiens
VRKTCYRIM

SEQ ID NO: 1172824 - protein, 9 aa, Homo Sapiens
AGKGSTTSN

SEQ ID NO: 1172825 - protein, 9 aa, Homo Sapiens
LSTGQTATS

SEQ ID NO: 1172826 - protein, 9 aa, Homo Sapiens
LHEQIGPEA

SEQ ID NO: 1172827 - protein, 9 aa, Homo Sapiens
GTALVKLPR

SEQ ID NO: 1172828 - protein, 9 aa, Homo Sapiens
AHTCWQRRT

SEQ ID NO: 1172829 - protein, 9 aa, Homo Sapiens
GTVHNQGEP

SEQ ID NO: 1172830 - protein, 9 aa, Homo Sapiens
PLFLVFLTI

SEQ ID NO: 1172831 - protein, 9 aa, Homo Sapiens
SRKCSKTSR

SEQ ID NO: 1172832 - protein, 9 aa, Homo Sapiens
NYVPQQEIS

SEQ ID NO: 1172833 - protein, 9 aa, Homo Sapiens
EQRKRMEEE

SEQ ID NO: 1172834 - protein, 9 aa, Homo Sapiens
LTRPPPAPP

SEQ ID NO: 1172835 - protein, 9 aa, Homo Sapiens
RGRADPGGR

SEQ ID NO: 1172836 - protein, 9 aa, Homo Sapiens
PSRGGLCPG

SEQ ID NO: 1172837 - protein, 9 aa, Homo Sapiens
DCGPQLPVE

SEQ ID NO: 1172838 - protein, 9 aa, Homo Sapiens
RHRNHPHLP

SEQ ID NO: 1172839 - protein, 9 aa, Homo Sapiens
VIMNLVKAA

SEQ ID NO: 1172840 - protein, 9 aa, Homo Sapiens
QRTTVHVTR

SEQ ID NO: 1172841 - protein, 9 aa, Homo Sapiens
AFLGCPKER

SEQ ID NO: 1172842 - protein, 9 aa, Homo Sapiens
GLCVPSARR

SEQ ID NO: 1172843 - protein, 9 aa, Homo Sapiens
TSMAGRKAS

SEQ ID NO: 1172844 - protein, 9 aa, Homo Sapiens
KRSSRLGWA

SEQ ID NO: 1172845 - protein, 9 aa, Homo Sapiens
SHDVDLCLV

SEQ ID NO: 1172846 - protein, 9 aa, Homo Sapiens
SPTTPSPAS

SEQ ID NO: 1172847 - protein, 9 aa, Homo Sapiens
NMESVPWTP

SEQ ID NO: 1172848 - protein, 9 aa, Homo Sapiens
HNPRPGRLL

SEQ ID NO: 1172849 - protein, 9 aa, Homo Sapiens
TPEIPAPPD

SEQ ID NO: 1172850 - protein, 9 aa, Homo Sapiens
WPPPWLSPL

SEQ ID NO: 1172851 - protein, 9 aa, Homo Sapiens
SCSLASPAL

SEQ ID NO: 1172852 - protein, 9 aa, Homo Sapiens
RKEDFNNVP

SEQ ID NO: 1172853 - protein, 9 aa, Homo Sapiens
SIGQRPVQR

SEQ ID NO: 1172854 - protein, 9 aa, Homo Sapiens
ADIIEYFHW

SEQ ID NO: 1172855 - protein, 9 aa, Homo Sapiens
PGGWFEVVS

SEQ ID NO: 1172856 - protein, 9 aa, Homo Sapiens
CANTVLSGG

SEQ ID NO: 1172857 - protein, 9 aa, Homo Sapiens
VYRGTVHNQ

SEQ ID NO: 1172858 - protein, 9 aa, Homo Sapiens
AFPHELRHS

SEQ ID NO: 1172859 - protein, 9 aa, Homo Sapiens
GFGGNFAQQ

SEQ ID NO: 1172860 - protein, 9 aa, Homo Sapiens
VSYVNAIDI

SEQ ID NO: 1172861 - protein, 9 aa, Homo Sapiens
GSEPQGPSA

SEQ ID NO: 1172862 - protein, 9 aa, Homo Sapiens
SRFSRIPPH

SEQ ID NO: 1172863 - protein, 9 aa, Homo Sapiens
SSVTYGGSD

SEQ ID NO: 1172864 - protein, 9 aa, Homo Sapiens
QALISNVLW

SEQ ID NO: 1172865 - protein, 9 aa, Homo Sapiens
FCYIGILQN

SEQ ID NO: 1172866 - protein, 9 aa, Homo Sapiens
ARMASLRQD

SEQ ID NO: 1172867 - protein, 9 aa, Homo Sapiens
PDLHLALGH

SEQ ID NO: 1172868 - protein, 9 aa, Homo Sapiens
RWITESGFS

SEQ ID NO: 1172869 - protein, 9 aa, Homo Sapiens
YKDQWRLRK

SEQ ID NO: 1172870 - protein, 9 aa, Homo Sapiens
IIQCFWNYL

SEQ ID NO: 1172871 - protein, 9 aa, Homo Sapiens
KYFVVINIQ

SEQ ID NO: 1172872 - protein, 9 aa, Homo Sapiens
TGKKRQSRN

SEQ ID NO: 1172873 - protein, 9 aa, Homo Sapiens
LGTDSHLLA

SEQ ID NO: 1172874 - protein, 9 aa, Homo Sapiens
NISKKQNAL

SEQ ID NO: 1172875 - protein, 9 aa, Homo Sapiens
SNSHETETK

SEQ ID NO: 1172876 - protein, 9 aa, Homo Sapiens
EDDYSLKIQ

SEQ ID NO: 1172877 - protein, 9 aa, Homo Sapiens
VPPPAVPQY

SEQ ID NO: 1172878 - protein, 9 aa, Homo Sapiens
HPGQEVHLG

SEQ ID NO: 1172879 - protein, 9 aa, Homo Sapiens
LLQEMQESA

SEQ ID NO: 1172880 - protein, 9 aa, Homo Sapiens
NSSSVWPNL

SEQ ID NO: 1172881 - protein, 9 aa, Homo Sapiens
TSMHPFTAT

SEQ ID NO: 1172882 - protein, 9 aa, Homo Sapiens
QCNPETCPV

SEQ ID NO: 1172883 - protein, 9 aa, Homo Sapiens
RRGLGRGGP

SEQ ID NO: 1172884 - protein, 9 aa, Homo Sapiens
DEEDPDAAK

SEQ ID NO: 1172885 - protein, 9 aa, Homo Sapiens
CSLSLQERG

SEQ ID NO: 1172886 - protein, 9 aa, Homo Sapiens
WATPSTRQS

SEQ ID NO: 1172887 - protein, 9 aa, Homo Sapiens
RRSGPTDGG

SEQ ID NO: 1172888 - protein, 9 aa, Homo Sapiens
WKPSRPRWP

SEQ ID NO: 1172889 - protein, 9 aa, Homo Sapiens
VHLRKKVGL

SEQ ID NO: 1172890 - protein, 9 aa, Homo Sapiens
VGTKYRMPS

SEQ ID NO: 1172891 - protein, 9 aa, Homo Sapiens
GLWQRSPHR

SEQ ID NO: 1172892 - protein, 9 aa, Homo Sapiens
GWRWRRGHR

SEQ ID NO: 1172893 - protein, 9 aa, Homo Sapiens
KGKGASAPR

SEQ ID NO: 1172894 - protein, 9 aa, Homo Sapiens
RPRKVPTAS

SEQ ID NO: 1172895 - protein, 9 aa, Homo Sapiens
VWVVGCIMA

SEQ ID NO: 1172896 - protein, 9 aa, Homo Sapiens
PPITGGWGL

SEQ ID NO: 1172897 - protein, 9 aa, Homo Sapiens
QIRLPTAIV

SEQ ID NO: 1172898 - protein, 9 aa, Homo Sapiens
KWDHEAIEA

SEQ ID NO: 1172899 - protein, 9 aa, Homo Sapiens
DRRKAEAES

SEQ ID NO: 1172900 - protein, 9 aa, Homo Sapiens
AAWRRRRMR

SEQ ID NO: 1172901 - protein, 9 aa, Homo Sapiens
RPTASSAAS

SEQ ID NO: 1172902 - protein, 9 aa, Homo Sapiens
LHLGLTAPI

SEQ ID NO: 1172903 - protein, 9 aa, Homo Sapiens
WGSYAAWRA

SEQ ID NO: 1172904 - protein, 9 aa, Homo Sapiens
SPSITSMHP

SEQ ID NO: 1172905 - protein, 9 aa, Homo Sapiens
RRFITSVVR

SEQ ID NO: 1172906 - protein, 9 aa, Homo Sapiens
NGIKWQNFV

SEQ ID NO: 1172907 - protein, 9 aa, Homo Sapiens
QHNYLVQTE

SEQ ID NO: 1172908 - protein, 9 aa, Homo Sapiens
SGQGLSPDH

SEQ ID NO: 1172909 - protein, 9 aa, Homo Sapiens
PTPADKLTP

SEQ ID NO: 1172910 - protein, 9 aa, Homo Sapiens
SPKCIIHGP

SEQ ID NO: 1172911 - protein, 9 aa, Homo Sapiens
RTTSSASKP

SEQ ID NO: 1172912 - protein, 9 aa, Homo Sapiens
VAKGKSSTQ

SEQ ID NO: 1172913 - protein, 9 aa, Homo Sapiens
REIRNVVEM

SEQ ID NO: 1172914 - protein, 9 aa, Homo Sapiens
QGLSYSKSN

SEQ ID NO: 1172915 - protein, 9 aa, Homo Sapiens
CNLWMPSTK

SEQ ID NO: 1172916 - protein, 9 aa, Homo Sapiens
LQIRFWHIW

SEQ ID NO: 1172917 - protein, 9 aa, Homo Sapiens
CRICAFLLW

SEQ ID NO: 1172918 - protein, 9 aa, Homo Sapiens
WRPGGPAPA

SEQ ID NO: 1172919 - protein, 9 aa, Homo Sapiens
WITESGFSL

SEQ ID NO: 1172920 - protein, 9 aa, Homo Sapiens
RFLQMYSFL

SEQ ID NO: 1172921 - protein, 9 aa, Homo Sapiens
LLLEDWLIF

SEQ ID NO: 1172922 - protein, 9 aa, Homo Sapiens
GDESISLSL

SEQ ID NO: 1172923 - protein, 9 aa, Homo Sapiens
SAPPQGFRT

SEQ ID NO: 1172924 - protein, 9 aa, Homo Sapiens
PGYQLWFLV

SEQ ID NO: 1172925 - protein, 9 aa, Homo Sapiens
HTTEVVRRC

SEQ ID NO: 1172926 - protein, 9 aa, Homo Sapiens
SDRDLGVST

SEQ ID NO: 1172927 - protein, 9 aa, Homo Sapiens
PSLRAARAH

SEQ ID NO: 1172928 - protein, 9 aa, Homo Sapiens
VQNIPDNFG

SEQ ID NO: 1172929 - protein, 9 aa, Homo Sapiens
LRGAMYWSD

SEQ ID NO: 1172930 - protein, 9 aa, Homo Sapiens
KAFWGGKSL

SEQ ID NO: 1172931 - protein, 9 aa, Homo Sapiens
RDGLKAIVR

SEQ ID NO: 1172932 - protein, 9 aa, Homo Sapiens
YSHWCKLCD

SEQ ID NO: 1172933 - protein, 9 aa, Homo Sapiens
AEKRKVEIA

SEQ ID NO: 1172934 - protein, 9 aa, Homo Sapiens
HTGCHPTPV

SEQ ID NO: 1172935 - protein, 9 aa, Homo Sapiens
DAPDDQDHG

SEQ ID NO: 1172936 - protein, 9 aa, Homo Sapiens
ERTLKIREE

SEQ ID NO: 1172937 - protein, 9 aa, Homo Sapiens
PPTDYSKLL

SEQ ID NO: 1172938 - protein, 9 aa, Homo Sapiens
PGLYPLGPH

SEQ ID NO: 1172939 - protein, 9 aa, Homo Sapiens
GPQLPVEVG

SEQ ID NO: 1172940 - protein, 9 aa, Homo Sapiens
FFTPCLIKK

SEQ ID NO: 1172941 - protein, 9 aa, Homo Sapiens
VINGAELYW

SEQ ID NO: 1172942 - protein, 9 aa, Homo Sapiens
VGCVASINL

SEQ ID NO: 1172943 - protein, 9 aa, Homo Sapiens
PSPGSGVGG

SEQ ID NO: 1172944 - protein, 9 aa, Homo Sapiens
FTQNYHEEI

SEQ ID NO: 1172945 - protein, 9 aa, Homo Sapiens
LRSDWLIRA

SEQ ID NO: 1172946 - protein, 9 aa, Homo Sapiens
EKSSEFLSE

SEQ ID NO: 1172947 - protein, 9 aa, Homo Sapiens
LALRVVSLG

SEQ ID NO: 1172948 - protein, 9 aa, Homo Sapiens
KKTYMEMHY

SEQ ID NO: 1172949 - protein, 9 aa, Homo Sapiens
ESSEGEEGE

SEQ ID NO: 1172950 - protein, 9 aa, Homo Sapiens
PFRNLSPPT

SEQ ID NO: 1172951 - protein, 9 aa, Homo Sapiens
AINSTGEHT

SEQ ID NO: 1172952 - protein, 9 aa, Homo Sapiens
LSLQEEIVK

SEQ ID NO: 1172953 - protein, 9 aa, Homo Sapiens
DGLKAIVRI

SEQ ID NO: 1172954 - protein, 9 aa, Homo Sapiens
GHREILIKE

SEQ ID NO: 1172955 - protein, 9 aa, Homo Sapiens
YCGALDEDA

SEQ ID NO: 1172956 - protein, 9 aa, Homo Sapiens
YQTQVCETT

SEQ ID NO: 1172957 - protein, 9 aa, Homo Sapiens
AWSASASSC

SEQ ID NO: 1172958 - protein, 9 aa, Homo Sapiens
VRPRERSYG

SEQ ID NO: 1172959 - protein, 9 aa, Homo Sapiens
ILPIQRVPR

SEQ ID NO: 1172960 - protein, 9 aa, Homo Sapiens
TTLRKSSSA

SEQ ID NO: 1172961 - protein, 9 aa, Homo Sapiens
TVSTSFEAS

SEQ ID NO: 1172962 - protein, 9 aa, Homo Sapiens
HFYYTFGKE

SEQ ID NO: 1172963 - protein, 9 aa, Homo Sapiens
RPHLPHHPS

SEQ ID NO: 1172964 - protein, 9 aa, Homo Sapiens
CSPTTPSPA

SEQ ID NO: 1172965 - protein, 9 aa, Homo Sapiens
SSGLCVPSA

SEQ ID NO: 1172966 - protein, 9 aa, Homo Sapiens
VGKPSHGVC

SEQ ID NO: 1172967 - protein, 9 aa, Homo Sapiens
RHSGRGPEV

SEQ ID NO: 1172968 - protein, 9 aa, Homo Sapiens
IEMVIPVRQ

SEQ ID NO: 1172969 - protein, 9 aa, Homo Sapiens
GAAGTRALH

SEQ ID NO: 1172970 - protein, 9 aa, Homo Sapiens
QWSPVIAAS

SEQ ID NO: 1172971 - protein, 9 aa, Homo Sapiens
LASSAPTWG

SEQ ID NO: 1172972 - protein, 9 aa, Homo Sapiens
QGPRSTLAK

SEQ ID NO: 1172973 - protein, 9 aa, Homo Sapiens
PRTRMSPPC

SEQ ID NO: 1172974 - protein, 9 aa, Homo Sapiens
KALSALFIW

SEQ ID NO: 1172975 - protein, 9 aa, Homo Sapiens
PLHHSTGER

SEQ ID NO: 1172976 - protein, 9 aa, Homo Sapiens
GWRSPKCII

SEQ ID NO: 1172977 - protein, 9 aa, Homo Sapiens
RTAAPGQPG

SEQ ID NO: 1172978 - protein, 9 aa, Homo Sapiens
SVKKDILVL

SEQ ID NO: 1172979 - protein, 9 aa, Homo Sapiens
NMCKHKVFS

SEQ ID NO: 1172980 - protein, 9 aa, Homo Sapiens
AYTFERVFG

SEQ ID NO: 1172981 - protein, 9 aa, Homo Sapiens
AKLVNKYSD

SEQ ID NO: 1172982 - protein, 9 aa, Homo Sapiens
LEQNQPEYK

SEQ ID NO: 1172983 - protein, 9 aa, Homo Sapiens
GCPRHGPTR

SEQ ID NO: 1172984 - protein, 9 aa, Homo Sapiens
TVKSASLQP

SEQ ID NO: 1172985 - protein, 9 aa, Homo Sapiens
RRPPVAGPW

SEQ ID NO: 1172986 - protein, 9 aa, Homo Sapiens
HSVPPAVRP

SEQ ID NO: 1172987 - protein, 9 aa, Homo Sapiens
AWRTSSACS

SEQ ID NO: 1172988 - protein, 9 aa, Homo Sapiens
LGWSPCDRS

SEQ ID NO: 1172989 - protein, 9 aa, Homo Sapiens
FLVKCTSSI

SEQ ID NO: 1172990 - protein, 9 aa, Homo Sapiens
PLITRLPTS

SEQ ID NO: 1172991 - protein, 9 aa, Homo Sapiens
PPPWDQFVP

SEQ ID NO: 1172992 - protein, 9 aa, Homo Sapiens
RTFRADGAT

SEQ ID NO: 1172993 - protein, 9 aa, Homo Sapiens
SAELQNVSQ

SEQ ID NO: 1172994 - protein, 9 aa, Homo Sapiens
ASVFALALL

SEQ ID NO: 1172995 - protein, 9 aa, Homo Sapiens
EGFLQREDL

SEQ ID NO: 1172996 - protein, 9 aa, Homo Sapiens
KKGGGALLY

SEQ ID NO: 1172997 - protein, 9 aa, Homo Sapiens
AAAHKVCPV

SEQ ID NO: 1172998 - protein, 9 aa, Homo Sapiens
HVLETAAKH

SEQ ID NO: 1172999 - protein, 9 aa, Homo Sapiens
PQVVKQKKT

SEQ ID NO: 1173000 - protein, 9 aa, Homo Sapiens
LCPTIMSPS

SEQ ID NO: 1173001 - protein, 9 aa, Homo Sapiens
QSQHTTEVV

SEQ ID NO: 1173002 - protein, 9 aa, Homo Sapiens
VLVRSAMGR

SEQ ID NO: 1173003 - protein, 9 aa, Homo Sapiens
GARGREGGV

SEQ ID NO: 1173004 - protein, 9 aa, Homo Sapiens
SEEEEGDVE

SEQ ID NO: 1173005 - protein, 9 aa, Homo Sapiens
CTTSCCAPA

SEQ ID NO: 1173006 - protein, 9 aa, Homo Sapiens
ASLMILVIT

SEQ ID NO: 1173007 - protein, 9 aa, Homo Sapiens
RYGRHRPFI

SEQ ID NO: 1173008 - protein, 9 aa, Homo Sapiens
APPAPPEIY

SEQ ID NO: 1173009 - protein, 9 aa, Homo Sapiens
LLHTQSLET

SEQ ID NO: 1173010 - protein, 9 aa, Homo Sapiens
KECDSISRL

SEQ ID NO: 1173011 - protein, 9 aa, Homo Sapiens
AFSCTPDGQ

SEQ ID NO: 1173012 - protein, 9 aa, Homo Sapiens
RMSSWSQTS

SEQ ID NO: 1173013 - protein, 9 aa, Homo Sapiens
ILLSLIFSV

SEQ ID NO: 1173014 - protein, 9 aa, Homo Sapiens
ELNRLKENE

SEQ ID NO: 1173015 - protein, 9 aa, Homo Sapiens
AQYRCACGF

SEQ ID NO: 1173016 - protein, 9 aa, Homo Sapiens
LQPKTAPSL

SEQ ID NO: 1173017 - protein, 9 aa, Homo Sapiens
NLVGCLTWL

SEQ ID NO: 1173018 - protein, 9 aa, Homo Sapiens
FTQDRGLQA

SEQ ID NO: 1173019 - protein, 9 aa, Homo Sapiens
CRMGPLPLP

SEQ ID NO: 1173020 - protein, 9 aa, Homo Sapiens
PPAASRDSF

SEQ ID NO: 1173021 - protein, 9 aa, Homo Sapiens
GFGAAREGA

SEQ ID NO: 1173022 - protein, 9 aa, Homo Sapiens
PNPTSSGVY

SEQ ID NO: 1173023 - protein, 9 aa, Homo Sapiens
VAKAFGPAR

SEQ ID NO: 1173024 - protein, 9 aa, Homo Sapiens
WPTEGRIQM

SEQ ID NO: 1173025 - protein, 9 aa, Homo Sapiens
APPPPGPAN

SEQ ID NO: 1173026 - protein, 9 aa, Homo Sapiens
KLELSTVRH

SEQ ID NO: 1173027 - protein, 9 aa, Homo Sapiens
RDLLKKFHI

SEQ ID NO: 1173028 - protein, 9 aa, Homo Sapiens
TCQVGQSAT

SEQ ID NO: 1173029 - protein, 9 aa, Homo Sapiens
TDLCLPTLD

SEQ ID NO: 1173030 - protein, 9 aa, Homo Sapiens
CFTCVVCHC

SEQ ID NO: 1173031 - protein, 9 aa, Homo Sapiens
WATRWSAWP

SEQ ID NO: 1173032 - protein, 9 aa, Homo Sapiens
PPTPTPRPI

SEQ ID NO: 1173033 - protein, 9 aa, Homo Sapiens
ACVDVLSSD

SEQ ID NO: 1173034 - protein, 9 aa, Homo Sapiens
APRAMRPSG

SEQ ID NO: 1173035 - protein, 9 aa, Homo Sapiens
LRRRLRVGS

SEQ ID NO: 1173036 - protein, 9 aa, Homo Sapiens
ICDDKVSTI

SEQ ID NO: 1173037 - protein, 9 aa, Homo Sapiens
DAKAAPTPI

SEQ ID NO: 1173038 - protein, 9 aa, Homo Sapiens
SFEWSNSLA

SEQ ID NO: 1173039 - protein, 9 aa, Homo Sapiens
GRKAPRVAL

SEQ ID NO: 1173040 - protein, 9 aa, Homo Sapiens
QCKKCLKAY

SEQ ID NO: 1173041 - protein, 9 aa, Homo Sapiens
PNGQKGEPG

SEQ ID NO: 1173042 - protein, 9 aa, Homo Sapiens
LHLLMLSFL

SEQ ID NO: 1173043 - protein, 9 aa, Homo Sapiens
SYQNECYLQ

SEQ ID NO: 1173044 - protein, 9 aa, Homo Sapiens
ISLTRTEKL

SEQ ID NO: 1173045 - protein, 9 aa, Homo Sapiens
RSQYEQLAD

SEQ ID NO: 1173046 - protein, 9 aa, Homo Sapiens
RRRAAPRTS

SEQ ID NO: 1173047 - protein, 9 aa, Homo Sapiens
EEAVPEAVS

SEQ ID NO: 1173048 - protein, 9 aa, Homo Sapiens
SSCSLASPA

SEQ ID NO: 1173049 - protein, 9 aa, Homo Sapiens
RRPRQGDGG

SEQ ID NO: 1173050 - protein, 9 aa, Homo Sapiens
YVCAMTRDS

SEQ ID NO: 1173051 - protein, 9 aa, Homo Sapiens
ATAWMSPSV

SEQ ID NO: 1173052 - protein, 9 aa, Homo Sapiens
MESVPWTPR

SEQ ID NO: 1173053 - protein, 9 aa, Homo Sapiens
IETKTVRQW

SEQ ID NO: 1173054 - protein, 9 aa, Homo Sapiens
SAWPCGGTT

SEQ ID NO: 1173055 - protein, 9 aa, Homo Sapiens
TVKESNAGR

SEQ ID NO: 1173056 - protein, 9 aa, Homo Sapiens
TTPLSHSAS

SEQ ID NO: 1173057 - protein, 9 aa, Homo Sapiens
AAKQKKSRK

SEQ ID NO: 1173058 - protein, 9 aa, Homo Sapiens
QANPPPPPT

SEQ ID NO: 1173059 - protein, 9 aa, Homo Sapiens
PVQLLCPRV

SEQ ID NO: 1173060 - protein, 9 aa, Homo Sapiens
GQRLSAQSA

SEQ ID NO: 1173061 - protein, 9 aa, Homo Sapiens
VVGAPWKAT

SEQ ID NO: 1173062 - protein, 9 aa, Homo Sapiens
WLCTARGWS

SEQ ID NO: 1173063 - protein, 9 aa, Homo Sapiens
ASEDGVDAS

SEQ ID NO: 1173064 - protein, 9 aa, Homo Sapiens
NYGGITLMW

SEQ ID NO: 1173065 - protein, 9 aa, Homo Sapiens
LMKPPRLTR

SEQ ID NO: 1173066 - protein, 9 aa, Homo Sapiens
RGMLLRLAQ

SEQ ID NO: 1173067 - protein, 9 aa, Homo Sapiens
LEYKVKERY

SEQ ID NO: 1173068 - protein, 9 aa, Homo Sapiens
QRTSRHVWF

SEQ ID NO: 1173069 - protein, 9 aa, Homo Sapiens
PLAPPALVA

SEQ ID NO: 1173070 - protein, 9 aa, Homo Sapiens
VSVGCVASI

SEQ ID NO: 1173071 - protein, 9 aa, Homo Sapiens
GSGSLLCAR

SEQ ID NO: 1173072 - protein, 9 aa, Homo Sapiens
AFLYHVVYV

SEQ ID NO: 1173073 - protein, 9 aa, Homo Sapiens
KYIDNLEKN

SEQ ID NO: 1173074 - protein, 9 aa, Homo Sapiens
SCVCKKSPA

SEQ ID NO: 1173075 - protein, 9 aa, Homo Sapiens
CGPTLEVVV

SEQ ID NO: 1173076 - protein, 9 aa, Homo Sapiens
LWLWCRPSW

SEQ ID NO: 1173077 - protein, 9 aa, Homo Sapiens
NRTDSNGIC

SEQ ID NO: 1173078 - protein, 9 aa, Homo Sapiens
MVQARGRAQ

SEQ ID NO: 1173079 - protein, 9 aa, Homo Sapiens
GGPSGFPGR

SEQ ID NO: 1173080 - protein, 9 aa, Homo Sapiens
PRLLPLIHP

SEQ ID NO: 1173081 - protein, 9 aa, Homo Sapiens
SPSPNCGLW

SEQ ID NO: 1173082 - protein, 9 aa, Homo Sapiens
EFKCDNGCC

SEQ ID NO: 1173083 - protein, 9 aa, Homo Sapiens
TTKDLKKKE

SEQ ID NO: 1173084 - protein, 9 aa, Homo Sapiens
RSQKRVSEK

SEQ ID NO: 1173085 - protein, 9 aa, Homo Sapiens
DQTALLPAH

SEQ ID NO: 1173086 - protein, 9 aa, Homo Sapiens
GPGRILRAL

SEQ ID NO: 1173087 - protein, 9 aa, Homo Sapiens
SRKMKISFN

SEQ ID NO: 1173088 - protein, 9 aa, Homo Sapiens
LDSCSGHCS

SEQ ID NO: 1173089 - protein, 9 aa, Homo Sapiens
LQALLEHYL

SEQ ID NO: 1173090 - protein, 9 aa, Homo Sapiens
THVHSHPLL

SEQ ID NO: 1173091 - protein, 9 aa, Homo Sapiens
LLSRPRSAA

SEQ ID NO: 1173092 - protein, 9 aa, Homo Sapiens
AKSEHRNFL

SEQ ID NO: 1173093 - protein, 9 aa, Homo Sapiens
DCKAQQVFV

SEQ ID NO: 1173094 - protein, 9 aa, Homo Sapiens
TGHHHRSGP

SEQ ID NO: 1173095 - protein, 9 aa, Homo Sapiens
NPTSSGVYP

SEQ ID NO: 1173096 - protein, 9 aa, Homo Sapiens
VGVMPQYHS

SEQ ID NO: 1173097 - protein, 9 aa, Homo Sapiens
LDVLDHGLI

SEQ ID NO: 1173098 - protein, 9 aa, Homo Sapiens
TRIPISKVG

SEQ ID NO: 1173099 - protein, 9 aa, Homo Sapiens
LAAMADDRY

SEQ ID NO: 1173100 - protein, 9 aa, Homo Sapiens
WCLFCNGSQ

SEQ ID NO: 1173101 - protein, 9 aa, Homo Sapiens
QNLLGRSPP

SEQ ID NO: 1173102 - protein, 9 aa, Homo Sapiens
GVLFASRPA

SEQ ID NO: 1173103 - protein, 9 aa, Homo Sapiens
RRRRCCGCN

SEQ ID NO: 1173104 - protein, 9 aa, Homo Sapiens
DPPLKWLQL

SEQ ID NO: 1173105 - protein, 9 aa, Homo Sapiens
ARDVIARDS

SEQ ID NO: 1173106 - protein, 9 aa, Homo Sapiens
TMSAIFDFR

SEQ ID NO: 1173107 - protein, 9 aa, Homo Sapiens
APQTPQKVA

SEQ ID NO: 1173108 - protein, 9 aa, Homo Sapiens
FLGMTLLHT

SEQ ID NO: 1173109 - protein, 9 aa, Homo Sapiens
WSLSSTWLF

SEQ ID NO: 1173110 - protein, 9 aa, Homo Sapiens
KQKADIEKG

SEQ ID NO: 1173111 - protein, 9 aa, Homo Sapiens
SPSPTWRTT

SEQ ID NO: 1173112 - protein, 9 aa, Homo Sapiens
TFSAVNGLG

SEQ ID NO: 1173113 - protein, 9 aa, Homo Sapiens
AVAFLLQAL

SEQ ID NO: 1173114 - protein, 9 aa, Homo Sapiens
VVDPHGRCC

SEQ ID NO: 1173115 - protein, 9 aa, Homo Sapiens
NPRPAARLS

SEQ ID NO: 1173116 - protein, 9 aa, Homo Sapiens
AGRAARGTP

SEQ ID NO: 1173117 - protein, 9 aa, Homo Sapiens
PAGPPRLGQ

SEQ ID NO: 1173118 - protein, 9 aa, Homo Sapiens
LQRLGWWLL

SEQ ID NO: 1173119 - protein, 9 aa, Homo Sapiens
RYECATVIL

SEQ ID NO: 1173120 - protein, 9 aa, Homo Sapiens
DEKKREKVI

SEQ ID NO: 1173121 - protein, 9 aa, Homo Sapiens
KVPYIVCQC

SEQ ID NO: 1173122 - protein, 9 aa, Homo Sapiens
KPLHKKKSV

SEQ ID NO: 1173123 - protein, 9 aa, Homo Sapiens
MPSAQLSGP

SEQ ID NO: 1173124 - protein, 9 aa, Homo Sapiens
MALAGWPGL

SEQ ID NO: 1173125 - protein, 9 aa, Homo Sapiens
SWGKRSHSS

SEQ ID NO: 1173126 - protein, 9 aa, Homo Sapiens
EPAPPAWGI

SEQ ID NO: 1173127 - protein, 9 aa, Homo Sapiens
CAASERLNR

SEQ ID NO: 1173128 - protein, 9 aa, Homo Sapiens
ARSPDGSQS

SEQ ID NO: 1173129 - protein, 9 aa, Homo Sapiens
LNLATVNVV

SEQ ID NO: 1173130 - protein, 9 aa, Homo Sapiens
QQHMGIWPA

SEQ ID NO: 1173131 - protein, 9 aa, Homo Sapiens
LPLKVIWPI

SEQ ID NO: 1173132 - protein, 9 aa, Homo Sapiens
PQTGTRTLA

SEQ ID NO: 1173133 - protein, 9 aa, Homo Sapiens
LYHSLVMCL

SEQ ID NO: 1173134 - protein, 9 aa, Homo Sapiens
IYGECCSHM

SEQ ID NO: 1173135 - protein, 9 aa, Homo Sapiens
PLPALSRTG

SEQ ID NO: 1173136 - protein, 9 aa, Homo Sapiens
AAGVPCTQA

SEQ ID NO: 1173137 - protein, 9 aa, Homo Sapiens
KNKDREHYV

SEQ ID NO: 1173138 - protein, 9 aa, Homo Sapiens
RYYNKQHVL

SEQ ID NO: 1173139 - protein, 9 aa, Homo Sapiens
RTGAAGTRA

SEQ ID NO: 1173140 - protein, 9 aa, Homo Sapiens
KAHGKKVPT

SEQ ID NO: 1173141 - protein, 9 aa, Homo Sapiens
TTLATQPPS

SEQ ID NO: 1173142 - protein, 9 aa, Homo Sapiens
KTHSHIPLC

SEQ ID NO: 1173143 - protein, 9 aa, Homo Sapiens
MVASAQISM

SEQ ID NO: 1173144 - protein, 9 aa, Homo Sapiens
NYHPQCLVL

SEQ ID NO: 1173145 - protein, 9 aa, Homo Sapiens
WPRWTMAWA

SEQ ID NO: 1173146 - protein, 9 aa, Homo Sapiens
GSSDPLCCC

SEQ ID NO: 1173147 - protein, 9 aa, Homo Sapiens
QGGPFNPGS

SEQ ID NO: 1173148 - protein, 9 aa, Homo Sapiens
SASVKKDIL

SEQ ID NO: 1173149 - protein, 9 aa, Homo Sapiens
LGVAWVLGW

SEQ ID NO: 1173150 - protein, 9 aa, Homo Sapiens
SRISQTATK

SEQ ID NO: 1173151 - protein, 9 aa, Homo Sapiens
VGYCRTRIY

SEQ ID NO: 1173152 - protein, 9 aa, Homo Sapiens
LCDELGPQP

SEQ ID NO: 1173153 - protein, 9 aa, Homo Sapiens
ANDMEEEDE

SEQ ID NO: 1173154 - protein, 9 aa, Homo Sapiens
HERLELTVV

SEQ ID NO: 1173155 - protein, 9 aa, Homo Sapiens
KKEDWGKRS

SEQ ID NO: 1173156 - protein, 9 aa, Homo Sapiens
WRCSKTFSA

SEQ ID NO: 1173157 - protein, 9 aa, Homo Sapiens
GGMGFLTSI

SEQ ID NO: 1173158 - protein, 9 aa, Homo Sapiens
GSVKSITAM

SEQ ID NO: 1173159 - protein, 9 aa, Homo Sapiens
GLESKQLRK

SEQ ID NO: 1173160 - protein, 9 aa, Homo Sapiens
ADGATTYEE

SEQ ID NO: 1173161 - protein, 9 aa, Homo Sapiens
GTLSNYYVG

SEQ ID NO: 1173162 - protein, 9 aa, Homo Sapiens
TVIASMSNP

SEQ ID NO: 1173163 - protein, 9 aa, Homo Sapiens
DPAAWGNPS

SEQ ID NO: 1173164 - protein, 9 aa, Homo Sapiens
RPRPQLGRS

SEQ ID NO: 1173165 - protein, 9 aa, Homo Sapiens
KTSLLQALD

SEQ ID NO: 1173166 - protein, 9 aa, Homo Sapiens
PVAKKSQVS

SEQ ID NO: 1173167 - protein, 9 aa, Homo Sapiens
FFVLVNLEV

SEQ ID NO: 1173168 - protein, 9 aa, Homo Sapiens
VAMLPKLLC

SEQ ID NO: 1173169 - protein, 9 aa, Homo Sapiens
YEPYVVVSR

SEQ ID NO: 1173170 - protein, 9 aa, Homo Sapiens
PASGRRREG

SEQ ID NO: 1173171 - protein, 9 aa, Homo Sapiens
WARVPGSQG

SEQ ID NO: 1173172 - protein, 9 aa, Homo Sapiens
LAPPPREHP

SEQ ID NO: 1173173 - protein, 9 aa, Homo Sapiens
RCCLCQGGL

SEQ ID NO: 1173174 - protein, 9 aa, Homo Sapiens
LPVLVQDAA

SEQ ID NO: 1173175 - protein, 9 aa, Homo Sapiens
RSLVTHRTS

SEQ ID NO: 1173176 - protein, 9 aa, Homo Sapiens
NIRMKFLFY

SEQ ID NO: 1173177 - protein, 9 aa, Homo Sapiens
FLRFLCPTI

SEQ ID NO: 1173178 - protein, 9 aa, Homo Sapiens
RVRQVHPVL

SEQ ID NO: 1173179 - protein, 9 aa, Homo Sapiens
PRPRCRPAV

SEQ ID NO: 1173180 - protein, 9 aa, Homo Sapiens
LSQLHHGGR

SEQ ID NO: 1173181 - protein, 9 aa, Homo Sapiens
RLHPCPPGG

SEQ ID NO: 1173182 - protein, 9 aa, Homo Sapiens
KMNFTGGTL

SEQ ID NO: 1173183 - protein, 9 aa, Homo Sapiens
EKEELEECA

SEQ ID NO: 1173184 - protein, 9 aa, Homo Sapiens
TRVSLLNTT

SEQ ID NO: 1173185 - protein, 9 aa, Homo Sapiens
ETPLEENIL

SEQ ID NO: 1173186 - protein, 9 aa, Homo Sapiens
PMGEAPTYV

SEQ ID NO: 1173187 - protein, 9 aa, Homo Sapiens
IRFETFQTI

SEQ ID NO: 1173188 - protein, 9 aa, Homo Sapiens
LDTMDDPDI

SEQ ID NO: 1173189 - protein, 9 aa, Homo Sapiens
DRPERVQPI

SEQ ID NO: 1173190 - protein, 9 aa, Homo Sapiens
DPDKLNDLW

SEQ ID NO: 1173191 - protein, 9 aa, Homo Sapiens
WVLPEEMVD

SEQ ID NO: 1173192 - protein, 9 aa, Homo Sapiens
GDFHVPQIL

SEQ ID NO: 1173193 - protein, 9 aa, Homo Sapiens
MGGSWNFGP

SEQ ID NO: 1173194 - protein, 9 aa, Homo Sapiens
ARDMLGGMG

SEQ ID NO: 1173195 - protein, 9 aa, Homo Sapiens
SIAYCVNLL

SEQ ID NO: 1173196 - protein, 9 aa, Homo Sapiens
LLKLKEMFS

SEQ ID NO: 1173197 - protein, 9 aa, Homo Sapiens
TYTMSQINL

SEQ ID NO: 1173198 - protein, 9 aa, Homo Sapiens
TSVILPFVN

SEQ ID NO: 1173199 - protein, 9 aa, Homo Sapiens
LYFYLCLAI

SEQ ID NO: 1173200 - protein, 9 aa, Homo Sapiens
SQNHSKCIT

SEQ ID NO: 1173201 - protein, 9 aa, Homo Sapiens
APDALWTEA

SEQ ID NO: 1173202 - protein, 9 aa, Homo Sapiens
RKKSHCLQD

SEQ ID NO: 1173203 - protein, 9 aa, Homo Sapiens
SHHQPQTCT

SEQ ID NO: 1173204 - protein, 9 aa, Homo Sapiens
AIVPLRYEL

SEQ ID NO: 1173205 - protein, 9 aa, Homo Sapiens
WRSLRMKTS

SEQ ID NO: 1173206 - protein, 9 aa, Homo Sapiens
WGNPSWCPC

SEQ ID NO: 1173207 - protein, 9 aa, Homo Sapiens
GPGVSRSPT

SEQ ID NO: 1173208 - protein, 9 aa, Homo Sapiens
AASLPQLSP

SEQ ID NO: 1173209 - protein, 9 aa, Homo Sapiens
NDGRTRSSG

SEQ ID NO: 1173210 - protein, 9 aa, Homo Sapiens
GLPTTGPAT

SEQ ID NO: 1173211 - protein, 9 aa, Homo Sapiens
PPAPSPNLP

SEQ ID NO: 1173212 - protein, 9 aa, Homo Sapiens
VPRCKTTCA

SEQ ID NO: 1173213 - protein, 9 aa, Homo Sapiens
LRDLRKEDE

SEQ ID NO: 1173214 - protein, 9 aa, Homo Sapiens
NYYVAYSSM

SEQ ID NO: 1173215 - protein, 9 aa, Homo Sapiens
DPPLGLPAG

SEQ ID NO: 1173216 - protein, 9 aa, Homo Sapiens
MNMKMKTFM

SEQ ID NO: 1173217 - protein, 9 aa, Homo Sapiens
SCELLYLST

SEQ ID NO: 1173218 - protein, 9 aa, Homo Sapiens
PTPTSPRLP

SEQ ID NO: 1173219 - protein, 9 aa, Homo Sapiens
LLLKEKMMQ

SEQ ID NO: 1173220 - protein, 9 aa, Homo Sapiens
STWLFCPTT

SEQ ID NO: 1173221 - protein, 9 aa, Homo Sapiens
SSPPRCWGS

SEQ ID NO: 1173222 - protein, 9 aa, Homo Sapiens
YIVGGVSTS

SEQ ID NO: 1173223 - protein, 9 aa, Homo Sapiens
VMQGVAGIG

SEQ ID NO: 1173224 - protein, 9 aa, Homo Sapiens
SAANVAKGA

SEQ ID NO: 1173225 - protein, 9 aa, Homo Sapiens
PLVRTGFLL

SEQ ID NO: 1173226 - protein, 9 aa, Homo Sapiens
VYVLVCMLG

SEQ ID NO: 1173227 - protein, 9 aa, Homo Sapiens
TTVLVSLVE

SEQ ID NO: 1173228 - protein, 9 aa, Homo Sapiens
PHHGGGGGA

SEQ ID NO: 1173229 - protein, 9 aa, Homo Sapiens
SLETRGSLG

SEQ ID NO: 1173230 - protein, 9 aa, Homo Sapiens
NTVKGTQNY

SEQ ID NO: 1173231 - protein, 9 aa, Homo Sapiens
SKQLRKYLF

SEQ ID NO: 1173232 - protein, 9 aa, Homo Sapiens
GCHCGKVST

SEQ ID NO: 1173233 - protein, 9 aa, Homo Sapiens
DYFQNRTDS

SEQ ID NO: 1173234 - protein, 9 aa, Homo Sapiens
TRKQTKVLW

SEQ ID NO: 1173235 - protein, 9 aa, Homo Sapiens
AWPCGGTTT

SEQ ID NO: 1173236 - protein, 9 aa, Homo Sapiens
GPMPGSCRS

SEQ ID NO: 1173237 - protein, 9 aa, Homo Sapiens
PTSSPATSA

SEQ ID NO: 1173238 - protein, 9 aa, Homo Sapiens
RRAPHPARR

SEQ ID NO: 1173239 - protein, 9 aa, Homo Sapiens
RQVHRTRAV

SEQ ID NO: 1173240 - protein, 9 aa, Homo Sapiens
CPSGFPGRG

SEQ ID NO: 1173241 - protein, 9 aa, Homo Sapiens
DCRAFGHYT

SEQ ID NO: 1173242 - protein, 9 aa, Homo Sapiens
TLPPLKDTE

SEQ ID NO: 1173243 - protein, 9 aa, Homo Sapiens
ASGCPRHGP

SEQ ID NO: 1173244 - protein, 9 aa, Homo Sapiens
GCFTYTMSQ

SEQ ID NO: 1173245 - protein, 9 aa, Homo Sapiens
SPSRCCPSG

SEQ ID NO: 1173246 - protein, 9 aa, Homo Sapiens
GKPIAVDLS

SEQ ID NO: 1173247 - protein, 9 aa, Homo Sapiens
WGVVDLTQE

SEQ ID NO: 1173248 - protein, 9 aa, Homo Sapiens
RDEDGPAQQ

SEQ ID NO: 1173249 - protein, 9 aa, Homo Sapiens
VCNALAGGL

SEQ ID NO: 1173250 - protein, 9 aa, Homo Sapiens
HSPARSVAA

SEQ ID NO: 1173251 - protein, 9 aa, Homo Sapiens
AARQESTTD

SEQ ID NO: 1173252 - protein, 9 aa, Homo Sapiens
KSYSAPHTE

SEQ ID NO: 1173253 - protein, 9 aa, Homo Sapiens
VWLAERLGG

SEQ ID NO: 1173254 - protein, 9 aa, Homo Sapiens
SNLAGPPWP

SEQ ID NO: 1173255 - protein, 9 aa, Homo Sapiens
QAQLMLMGS

SEQ ID NO: 1173256 - protein, 9 aa, Homo Sapiens
SSIRLCTHI

SEQ ID NO: 1173257 - protein, 9 aa, Homo Sapiens
LRHHGLLFL

SEQ ID NO: 1173258 - protein, 9 aa, Homo Sapiens
RWLVLSPVR

SEQ ID NO: 1173259 - protein, 9 aa, Homo Sapiens
GCAGGGVGE

SEQ ID NO: 1173260 - protein, 9 aa, Homo Sapiens
CKIQKVWAI

SEQ ID NO: 1173261 - protein, 9 aa, Homo Sapiens
EGVQLVRQH

SEQ ID NO: 1173262 - protein, 9 aa, Homo Sapiens
EEFTTFVKT

SEQ ID NO: 1173263 - protein, 9 aa, Homo Sapiens
SVLWTLYFY

SEQ ID NO: 1173264 - protein, 9 aa, Homo Sapiens
TSLRALHRG

SEQ ID NO: 1173265 - protein, 9 aa, Homo Sapiens
RSGEERVRR

SEQ ID NO: 1173266 - protein, 9 aa, Homo Sapiens
LLPRFCELY

SEQ ID NO: 1173267 - protein, 9 aa, Homo Sapiens
AGTRRSSQR

SEQ ID NO: 1173268 - protein, 9 aa, Homo Sapiens
QARGRAQAD

SEQ ID NO: 1173269 - protein, 9 aa, Homo Sapiens
SSPKEAMGL

SEQ ID NO: 1173270 - protein, 9 aa, Homo Sapiens
APVPGGESE

SEQ ID NO: 1173271 - protein, 9 aa, Homo Sapiens
STGTRASSP

SEQ ID NO: 1173272 - protein, 9 aa, Homo Sapiens
RCKTTCASS

SEQ ID NO: 1173273 - protein, 9 aa, Homo Sapiens
GLAREKVGP

SEQ ID NO: 1173274 - protein, 9 aa, Homo Sapiens
DNNNRSMGG

SEQ ID NO: 1173275 - protein, 9 aa, Homo Sapiens
STIINICPK

SEQ ID NO: 1173276 - protein, 9 aa, Homo Sapiens
DMAPALGRI

SEQ ID NO: 1173277 - protein, 9 aa, Homo Sapiens
AGLEHVHLA

SEQ ID NO: 1173278 - protein, 9 aa, Homo Sapiens
GTSEPECTE

SEQ ID NO: 1173279 - protein, 9 aa, Homo Sapiens
LTQYQEMEK

SEQ ID NO: 1173280 - protein, 9 aa, Homo Sapiens
QMWDLDFLG

SEQ ID NO: 1173281 - protein, 9 aa, Homo Sapiens
EYQKMALTA

SEQ ID NO: 1173282 - protein, 9 aa, Homo Sapiens
VEKSSEFLS

SEQ ID NO: 1173283 - protein, 9 aa, Homo Sapiens
REKEELEEC

SEQ ID NO: 1173284 - protein, 9 aa, Homo Sapiens
PNMPFIVSM

SEQ ID NO: 1173285 - protein, 9 aa, Homo Sapiens
VFLGDSLVQ

SEQ ID NO: 1173286 - protein, 9 aa, Homo Sapiens
AQEVETMTK

SEQ ID NO: 1173287 - protein, 9 aa, Homo Sapiens
APTWGCLCR

SEQ ID NO: 1173288 - protein, 9 aa, Homo Sapiens
KGTESPFSR

SEQ ID NO: 1173289 - protein, 9 aa, Homo Sapiens
EKTLGIRAG

SEQ ID NO: 1173290 - protein, 9 aa, Homo Sapiens
GGWAKMHRL

SEQ ID NO: 1173291 - protein, 9 aa, Homo Sapiens
MQVGSSGAD

SEQ ID NO: 1173292 - protein, 9 aa, Homo Sapiens
FIVLLGIYL

SEQ ID NO: 1173293 - protein, 9 aa, Homo Sapiens
ELVLLQRQH

SEQ ID NO: 1173294 - protein, 9 aa, Homo Sapiens
HQRTGRQHP

SEQ ID NO: 1173295 - protein, 9 aa, Homo Sapiens
NIIRLSIWP

SEQ ID NO: 1173296 - protein, 9 aa, Homo Sapiens
PPLPACLNL

SEQ ID NO: 1173297 - protein, 9 aa, Homo Sapiens
RCSGLSVSV

SEQ ID NO: 1173298 - protein, 9 aa, Homo Sapiens
AWQGAWWVL

SEQ ID NO: 1173299 - protein, 9 aa, Homo Sapiens
SQKHFNICL

SEQ ID NO: 1173300 - protein, 9 aa, Homo Sapiens
TKGDVTYTK

SEQ ID NO: 1173301 - protein, 9 aa, Homo Sapiens
SVEFALDVR

SEQ ID NO: 1173302 - protein, 9 aa, Homo Sapiens
GPGAPHEAP

SEQ ID NO: 1173303 - protein, 9 aa, Homo Sapiens
RCSISRARQ

SEQ ID NO: 1173304 - protein, 9 aa, Homo Sapiens
DWFPPCGGC

SEQ ID NO: 1173305 - protein, 9 aa, Homo Sapiens
AATGHHHRS

SEQ ID NO: 1173306 - protein, 9 aa, Homo Sapiens
WAARVTCVP

SEQ ID NO: 1173307 - protein, 9 aa, Homo Sapiens
QEDQIKEKR

SEQ ID NO: 1173308 - protein, 9 aa, Homo Sapiens
PVFEEIIGK

SEQ ID NO: 1173309 - protein, 9 aa, Homo Sapiens
SLLTQPSPA

SEQ ID NO: 1173310 - protein, 9 aa, Homo Sapiens
GLVRPGSSW

SEQ ID NO: 1173311 - protein, 9 aa, Homo Sapiens
EPGGPTEPG

SEQ ID NO: 1173312 - protein, 9 aa, Homo Sapiens
PRRWPPRTP

SEQ ID NO: 1173313 - protein, 9 aa, Homo Sapiens
GHVRLHRLQ

SEQ ID NO: 1173314 - protein, 9 aa, Homo Sapiens
LVKEAIDHI

SEQ ID NO: 1173315 - protein, 9 aa, Homo Sapiens
KEFGTSVVK

SEQ ID NO: 1173316 - protein, 9 aa, Homo Sapiens
SECVGPFSD

SEQ ID NO: 1173317 - protein, 9 aa, Homo Sapiens
CSSTSFMVS

SEQ ID NO: 1173318 - protein, 9 aa, Homo Sapiens
WAGPTTCSR

SEQ ID NO: 1173319 - protein, 9 aa, Homo Sapiens
PQLSPTPSA

SEQ ID NO: 1173320 - protein, 9 aa, Homo Sapiens
PRPPSTSSP

SEQ ID NO: 1173321 - protein, 9 aa, Homo Sapiens
YVCFAKGEV

SEQ ID NO: 1173322 - protein, 9 aa, Homo Sapiens
RQLHTAGTP

SEQ ID NO: 1173323 - protein, 9 aa, Homo Sapiens
VCGSSCFEC

SEQ ID NO: 1173324 - protein, 9 aa, Homo Sapiens
SLPALKIWE

SEQ ID NO: 1173325 - protein, 9 aa, Homo Sapiens
AREKVGPLS

SEQ ID NO: 1173326 - protein, 9 aa, Homo Sapiens
TPLRVQSVL

SEQ ID NO: 1173327 - protein, 9 aa, Homo Sapiens
AMSQYFDFA

SEQ ID NO: 1173328 - protein, 9 aa, Homo Sapiens
PAKHSSSQC

SEQ ID NO: 1173329 - protein, 9 aa, Homo Sapiens
PSPGPQAAA

SEQ ID NO: 1173330 - protein, 9 aa, Homo Sapiens
RKAASVLEA

SEQ ID NO: 1173331 - protein, 9 aa, Homo Sapiens
LAMLQDTQK

SEQ ID NO: 1173332 - protein, 9 aa, Homo Sapiens
QSQNANAPC

SEQ ID NO: 1173333 - protein, 9 aa, Homo Sapiens
PGNQRSNRS

SEQ ID NO: 1173334 - protein, 9 aa, Homo Sapiens
EEQRKRMEE

SEQ ID NO: 1173335 - protein, 9 aa, Homo Sapiens
CPLNPAAQD

SEQ ID NO: 1173336 - protein, 9 aa, Homo Sapiens
RPSSWQECD

SEQ ID NO: 1173337 - protein, 9 aa, Homo Sapiens
AELSTGPPA

SEQ ID NO: 1173338 - protein, 9 aa, Homo Sapiens
GYDWWAILL

SEQ ID NO: 1173339 - protein, 9 aa, Homo Sapiens
QLHAAVASL

SEQ ID NO: 1173340 - protein, 9 aa, Homo Sapiens
QEAQYRCAC

SEQ ID NO: 1173341 - protein, 9 aa, Homo Sapiens
GGCPSGFPG

SEQ ID NO: 1173342 - protein, 9 aa, Homo Sapiens
QNKFIEMKN

SEQ ID NO: 1173343 - protein, 9 aa, Homo Sapiens
IQKSDFSNN

SEQ ID NO: 1173344 - protein, 9 aa, Homo Sapiens
AERVLRAIR

SEQ ID NO: 1173345 - protein, 9 aa, Homo Sapiens
EVQKSLLKR

SEQ ID NO: 1173346 - protein, 9 aa, Homo Sapiens
ASPPARSWS

SEQ ID NO: 1173347 - protein, 9 aa, Homo Sapiens
PPGPQDPPS

SEQ ID NO: 1173348 - protein, 9 aa, Homo Sapiens
EEDDYSLKI

SEQ ID NO: 1173349 - protein, 9 aa, Homo Sapiens
LVGCDGGVG

SEQ ID NO: 1173350 - protein, 9 aa, Homo Sapiens
KISLRPRST

SEQ ID NO: 1173351 - protein, 9 aa, Homo Sapiens
CARLSASST

SEQ ID NO: 1173352 - protein, 9 aa, Homo Sapiens
LWASKNGHH

SEQ ID NO: 1173353 - protein, 9 aa, Homo Sapiens
TSGLMWAGL

SEQ ID NO: 1173354 - protein, 9 aa, Homo Sapiens
LGALHRLSP

SEQ ID NO: 1173355 - protein, 9 aa, Homo Sapiens
AAGPLYSDG

SEQ ID NO: 1173356 - protein, 9 aa, Homo Sapiens
MECDPDELR

SEQ ID NO: 1173357 - protein, 9 aa, Homo Sapiens
GQTATSPAT

SEQ ID NO: 1173358 - protein, 9 aa, Homo Sapiens
GRAQADQSV

SEQ ID NO: 1173359 - protein, 9 aa, Homo Sapiens
PGLGLYHTA

SEQ ID NO: 1173360 - protein, 9 aa, Homo Sapiens
GTGGQGVGV

SEQ ID NO: 1173361 - protein, 9 aa, Homo Sapiens
RSLFMGLRS

SEQ ID NO: 1173362 - protein, 9 aa, Homo Sapiens
LRVGSNGSK

SEQ ID NO: 1173363 - protein, 9 aa, Homo Sapiens
WPWWATRWS

SEQ ID NO: 1173364 - protein, 9 aa, Homo Sapiens
GLLLFSHLG

SEQ ID NO: 1173365 - protein, 9 aa, Homo Sapiens
IVCPHHCGH

SEQ ID NO: 1173366 - protein, 9 aa, Homo Sapiens
RSASPGPKP

SEQ ID NO: 1173367 - protein, 9 aa, Homo Sapiens
RLPLWRSRS

SEQ ID NO: 1173368 - protein, 9 aa, Homo Sapiens
RKRMEEERK

SEQ ID NO: 1173369 - protein, 9 aa, Homo Sapiens
PAAGVPCTQ

SEQ ID NO: 1173370 - protein, 9 aa, Homo Sapiens
TWKNDTKEN

SEQ ID NO: 1173371 - protein, 9 aa, Homo Sapiens
CNLSCLVTI

SEQ ID NO: 1173372 - protein, 9 aa, Homo Sapiens
LQEEIVKLR

SEQ ID NO: 1173373 - protein, 9 aa, Homo Sapiens
LSYRWLSLF

SEQ ID NO: 1173374 - protein, 9 aa, Homo Sapiens
EVTPHRTSE

SEQ ID NO: 1173375 - protein, 9 aa, Homo Sapiens
RIHTDKKPY

SEQ ID NO: 1173376 - protein, 9 aa, Homo Sapiens
GGLPTSGSP

SEQ ID NO: 1173377 - protein, 9 aa, Homo Sapiens
SEAVAVDFR

SEQ ID NO: 1173378 - protein, 9 aa, Homo Sapiens
RVLASSWYA

SEQ ID NO: 1173379 - protein, 9 aa, Homo Sapiens
DARVAGGGQ

SEQ ID NO: 1173380 - protein, 9 aa, Homo Sapiens
PGSGSLLCA

SEQ ID NO: 1173381 - protein, 9 aa, Homo Sapiens
GPQAAALTT

SEQ ID NO: 1173382 - protein, 9 aa, Homo Sapiens
APWALLGRE

SEQ ID NO: 1173383 - protein, 9 aa, Homo Sapiens
HAQRVGETR

SEQ ID NO: 1173384 - protein, 9 aa, Homo Sapiens
PSWPSCPIP

SEQ ID NO: 1173385 - protein, 9 aa, Homo Sapiens
RLPTAIVPL

SEQ ID NO: 1173386 - protein, 9 aa, Homo Sapiens
QLVKGRLVL

SEQ ID NO: 1173387 - protein, 9 aa, Homo Sapiens
LQSKFTNLE

SEQ ID NO: 1173388 - protein, 9 aa, Homo Sapiens
SVGPQRAKS

SEQ ID NO: 1173389 - protein, 9 aa, Homo Sapiens
KRLEQNQPE

SEQ ID NO: 1173390 - protein, 9 aa, Homo Sapiens
LRVRQPPPG

SEQ ID NO: 1173391 - protein, 9 aa, Homo Sapiens
GVLWGPGSW

SEQ ID NO: 1173392 - protein, 9 aa, Homo Sapiens
TSEENIEIK

SEQ ID NO: 1173393 - protein, 9 aa, Homo Sapiens
SPSSAASAC

SEQ ID NO: 1173394 - protein, 9 aa, Homo Sapiens
HLVQGNEDC

SEQ ID NO: 1173395 - protein, 9 aa, Homo Sapiens
HSNLARKVL

SEQ ID NO: 1173396 - protein, 9 aa, Homo Sapiens
VIPEVLQAR

SEQ ID NO: 1173397 - protein, 9 aa, Homo Sapiens
LKLVLVSVS

SEQ ID NO: 1173398 - protein, 9 aa, Homo Sapiens
GQRWKLLLF

SEQ ID NO: 1173399 - protein, 9 aa, Homo Sapiens
PAPAGPPRL

SEQ ID NO: 1173400 - protein, 9 aa, Homo Sapiens
LLDRGSFQN

SEQ ID NO: 1173401 - protein, 9 aa, Homo Sapiens
LDVQYQKVP

SEQ ID NO: 1173402 - protein, 9 aa, Homo Sapiens
EVLRRCLCT

SEQ ID NO: 1173403 - protein, 9 aa, Homo Sapiens
KLTVQEACG

SEQ ID NO: 1173404 - protein, 9 aa, Homo Sapiens
KVGLLSHLY

SEQ ID NO: 1173405 - protein, 9 aa, Homo Sapiens
PRTESSQPR

SEQ ID NO: 1173406 - protein, 9 aa, Homo Sapiens
GHLAAVGVL

SEQ ID NO: 1173407 - protein, 9 aa, Homo Sapiens
VPVACPDDQ

SEQ ID NO: 1173408 - protein, 9 aa, Homo Sapiens
GMPSDIHVE

SEQ ID NO: 1173409 - protein, 9 aa, Homo Sapiens
SMTTLPTVL

SEQ ID NO: 1173410 - protein, 9 aa, Homo Sapiens
TLSVHPPVY

SEQ ID NO: 1173411 - protein, 9 aa, Homo Sapiens
KDHVVHTLG

SEQ ID NO: 1173412 - protein, 9 aa, Homo Sapiens
EIPAPPDPS

SEQ ID NO: 1173413 - protein, 9 aa, Homo Sapiens
GAVGLPRAC

SEQ ID NO: 1173414 - protein, 9 aa, Homo Sapiens
GEYECSVEN

SEQ ID NO: 1173415 - protein, 9 aa, Homo Sapiens
KDENCGPTL

SEQ ID NO: 1173416 - protein, 9 aa, Homo Sapiens
DMLGMSLAS

SEQ ID NO: 1173417 - protein, 9 aa, Homo Sapiens
RCGRTAGRL

SEQ ID NO: 1173418 - protein, 9 aa, Homo Sapiens
QASGGPWPA

SEQ ID NO: 1173419 - protein, 9 aa, Homo Sapiens
NLSPVFSGQ

SEQ ID NO: 1173420 - protein, 9 aa, Homo Sapiens
MEPPRGPLP

SEQ ID NO: 1173421 - protein, 9 aa, Homo Sapiens
DLPYHSNLE

SEQ ID NO: 1173422 - protein, 9 aa, Homo Sapiens
IPPKRVALL

SEQ ID NO: 1173423 - protein, 9 aa, Homo Sapiens
RLNYQTQVC

SEQ ID NO: 1173424 - protein, 9 aa, Homo Sapiens
LPPTSTTRT

SEQ ID NO: 1173425 - protein, 9 aa, Homo Sapiens
PPPPWDQFV

SEQ ID NO: 1173426 - protein, 9 aa, Homo Sapiens
GYQLWFLVS

SEQ ID NO: 1173427 - protein, 9 aa, Homo Sapiens
NLGIWPNRI

SEQ ID NO: 1173428 - protein, 9 aa, Homo Sapiens
AALAFPGSF

SEQ ID NO: 1173429 - protein, 9 aa, Homo Sapiens
CKNGGTCAM

SEQ ID NO: 1173430 - protein, 9 aa, Homo Sapiens
GDSACSPSE

SEQ ID NO: 1173431 - protein, 9 aa, Homo Sapiens
APPAQSLNH

SEQ ID NO: 1173432 - protein, 9 aa, Homo Sapiens
CEWHKNGVK

SEQ ID NO: 1173433 - protein, 9 aa, Homo Sapiens
NDQVTLPEE

SEQ ID NO: 1173434 - protein, 9 aa, Homo Sapiens
PCPTSRSRA

SEQ ID NO: 1173435 - protein, 9 aa, Homo Sapiens
QALLGAEKR

SEQ ID NO: 1173436 - protein, 9 aa, Homo Sapiens
NLLVHKAVA

SEQ ID NO: 1173437 - protein, 9 aa, Homo Sapiens
YEHLFRWIL

SEQ ID NO: 1173438 - protein, 9 aa, Homo Sapiens
AANKLVRHT

SEQ ID NO: 1173439 - protein, 9 aa, Homo Sapiens
VVIIPYFIT

SEQ ID NO: 1173440 - protein, 9 aa, Homo Sapiens
KSPSPATSV

SEQ ID NO: 1173441 - protein, 9 aa, Homo Sapiens
ILQDCPAGP

SEQ ID NO: 1173442 - protein, 9 aa, Homo Sapiens
GQELTDYLM

SEQ ID NO: 1173443 - protein, 9 aa, Homo Sapiens
GVLQFEVLM

SEQ ID NO: 1173444 - protein, 9 aa, Homo Sapiens
GCISVKDHR

SEQ ID NO: 1173445 - protein, 9 aa, Homo Sapiens
DYTLSVHPP

SEQ ID NO: 1173446 - protein, 9 aa, Homo Sapiens
KEEAQEAQG

SEQ ID NO: 1173447 - protein, 9 aa, Homo Sapiens
AYVRRNSVE

SEQ ID NO: 1173448 - protein, 9 aa, Homo Sapiens
DGGWGWRSP

SEQ ID NO: 1173449 - protein, 9 aa, Homo Sapiens
SWGKVWCLN

SEQ ID NO: 1173450 - protein, 9 aa, Homo Sapiens
DDEDQQRGH

SEQ ID NO: 1173451 - protein, 9 aa, Homo Sapiens
IRVTSGLFF

SEQ ID NO: 1173452 - protein, 9 aa, Homo Sapiens
EDAAGVTVH

SEQ ID NO: 1173453 - protein, 9 aa, Homo Sapiens
RGPDVSEDQ

SEQ ID NO: 1173454 - protein, 9 aa, Homo Sapiens
GNAGVKQSA

SEQ ID NO: 1173455 - protein, 9 aa, Homo Sapiens
RSLCKPFSD

SEQ ID NO: 1173456 - protein, 9 aa, Homo Sapiens
GRRARGPGR

SEQ ID NO: 1173457 - protein, 9 aa, Homo Sapiens
SQSVVEVYF

SEQ ID NO: 1173458 - protein, 9 aa, Homo Sapiens
GDKGLKKMT

SEQ ID NO: 1173459 - protein, 9 aa, Homo Sapiens
FPPHGTERE

SEQ ID NO: 1173460 - protein, 9 aa, Homo Sapiens
GVQGSAASS

SEQ ID NO: 1173461 - protein, 9 aa, Homo Sapiens
LPRPAVDPA

SEQ ID NO: 1173462 - protein, 9 aa, Homo Sapiens
AGGKGPGVS

SEQ ID NO: 1173463 - protein, 9 aa, Homo Sapiens
DFGKIVKNV

SEQ ID NO: 1173464 - protein, 9 aa, Homo Sapiens
DKSFKQRTH

SEQ ID NO: 1173465 - protein, 9 aa, Homo Sapiens
SRESPWEAA

SEQ ID NO: 1173466 - protein, 9 aa, Homo Sapiens
IPPHRCFLI

SEQ ID NO: 1173467 - protein, 9 aa, Homo Sapiens
WTCQTQDSA

SEQ ID NO: 1173468 - protein, 9 aa, Homo Sapiens
SRLKELLMM

SEQ ID NO: 1173469 - protein, 9 aa, Homo Sapiens
LLLIVAFVL

SEQ ID NO: 1173470 - protein, 9 aa, Homo Sapiens
ARPPKQWLY

SEQ ID NO: 1173471 - protein, 9 aa, Homo Sapiens
HVASCEEEF

SEQ ID NO: 1173472 - protein, 9 aa, Homo Sapiens
RAISTFGPS

SEQ ID NO: 1173473 - protein, 9 aa, Homo Sapiens
RLGSRTATG

SEQ ID NO: 1173474 - protein, 9 aa, Homo Sapiens
PTPRPIRTG

SEQ ID NO: 1173475 - protein, 9 aa, Homo Sapiens
FLRAFLRTV

SEQ ID NO: 1173476 - protein, 9 aa, Homo Sapiens
GDPPVNYVP

SEQ ID NO: 1173477 - protein, 9 aa, Homo Sapiens
KESPGAPRR

SEQ ID NO: 1173478 - protein, 9 aa, Homo Sapiens
VQEVLSTTS

SEQ ID NO: 1173479 - protein, 9 aa, Homo Sapiens
PGTPAPRPP

SEQ ID NO: 1173480 - protein, 9 aa, Homo Sapiens
ISQTATKQK

SEQ ID NO: 1173481 - protein, 9 aa, Homo Sapiens
PPLIHCYMA

SEQ ID NO: 1173482 - protein, 9 aa, Homo Sapiens
KKILRSFMK

SEQ ID NO: 1173483 - protein, 9 aa, Homo Sapiens
RFGDDVILD

SEQ ID NO: 1173484 - protein, 9 aa, Homo Sapiens
GAEREHHSC

SEQ ID NO: 1173485 - protein, 9 aa, Homo Sapiens
GVVGVCRMG

SEQ ID NO: 1173486 - protein, 9 aa, Homo Sapiens
LDDFFHDRS

SEQ ID NO: 1173487 - protein, 9 aa, Homo Sapiens
ITQQLERER

SEQ ID NO: 1173488 - protein, 9 aa, Homo Sapiens
FSEAAAFPH

SEQ ID NO: 1173489 - protein, 9 aa, Homo Sapiens
WRIGGGTPL

SEQ ID NO: 1173490 - protein, 9 aa, Homo Sapiens
RGWSWWSPW

SEQ ID NO: 1173491 - protein, 9 aa, Homo Sapiens
DDYSLKIQV

SEQ ID NO: 1173492 - protein, 9 aa, Homo Sapiens
MSPPLREIP

SEQ ID NO: 1173493 - protein, 9 aa, Homo Sapiens
DVKMMERMV

SEQ ID NO: 1173494 - protein, 9 aa, Homo Sapiens
ATSIPPPPG

SEQ ID NO: 1173495 - protein, 9 aa, Homo Sapiens
ALCSGPRPR

SEQ ID NO: 1173496 - protein, 9 aa, Homo Sapiens
NIARATKFK

SEQ ID NO: 1173497 - protein, 9 aa, Homo Sapiens
KMMLYPVLN

SEQ ID NO: 1173498 - protein, 9 aa, Homo Sapiens
VEFALDVRC

SEQ ID NO: 1173499 - protein, 9 aa, Homo Sapiens
EEDEDSKQN

SEQ ID NO: 1173500 - protein, 9 aa, Homo Sapiens
RPSTSSRIS

SEQ ID NO: 1173501 - protein, 9 aa, Homo Sapiens
SSWGKVWCL

SEQ ID NO: 1173502 - protein, 9 aa, Homo Sapiens
DGGRGAAAG

SEQ ID NO: 1173503 - protein, 9 aa, Homo Sapiens
GIGKNQPHN

SEQ ID NO: 1173504 - protein, 9 aa, Homo Sapiens
SSGWMPGMN

SEQ ID NO: 1173505 - protein, 9 aa, Homo Sapiens
WGLLRPALR

SEQ ID NO: 1173506 - protein, 9 aa, Homo Sapiens
VYEAAVVEV

SEQ ID NO: 1173507 - protein, 9 aa, Homo Sapiens
LLEDWLIFT

SEQ ID NO: 1173508 - protein, 9 aa, Homo Sapiens
GRCCMGLIV

SEQ ID NO: 1173509 - protein, 9 aa, Homo Sapiens
RVLRAIRYP

SEQ ID NO: 1173510 - protein, 9 aa, Homo Sapiens
PNFSTTRKV

SEQ ID NO: 1173511 - protein, 9 aa, Homo Sapiens
WLFSITADP

SEQ ID NO: 1173512 - protein, 9 aa, Homo Sapiens
LRLAQQDPQ

SEQ ID NO: 1173513 - protein, 9 aa, Homo Sapiens
ASSRQMWDL

SEQ ID NO: 1173514 - protein, 9 aa, Homo Sapiens
SWGAGRLAS

SEQ ID NO: 1173515 - protein, 9 aa, Homo Sapiens
WFKVVTSVK

SEQ ID NO: 1173516 - protein, 9 aa, Homo Sapiens
ICHQVPYSI

SEQ ID NO: 1173517 - protein, 9 aa, Homo Sapiens
YCPNGQKGE

SEQ ID NO: 1173518 - protein, 9 aa, Homo Sapiens
MVSWPSRLG

SEQ ID NO: 1173519 - protein, 9 aa, Homo Sapiens
PVCKVKMCG

SEQ ID NO: 1173520 - protein, 9 aa, Homo Sapiens
LGGQAIYPH

SEQ ID NO: 1173521 - protein, 9 aa, Homo Sapiens
WPFHLISAS

SEQ ID NO: 1173522 - protein, 9 aa, Homo Sapiens
CFLRIRQTM

SEQ ID NO: 1173523 - protein, 9 aa, Homo Sapiens
GHHHRSGPA

SEQ ID NO: 1173524 - protein, 9 aa, Homo Sapiens
GGGGVSVYG

SEQ ID NO: 1173525 - protein, 9 aa, Homo Sapiens
RPDDLETYA

SEQ ID NO: 1173526 - protein, 9 aa, Homo Sapiens
RREQRERRE

SEQ ID NO: 1173527 - protein, 9 aa, Homo Sapiens
CLCTGYFKN

SEQ ID NO: 1173528 - protein, 9 aa, Homo Sapiens
SGGKNGQGS

SEQ ID NO: 1173529 - protein, 9 aa, Homo Sapiens
VLAVIGINH

SEQ ID NO: 1173530 - protein, 9 aa, Homo Sapiens
RGGAAAQAL

SEQ ID NO: 1173531 - protein, 9 aa, Homo Sapiens
AWEAVAVRP

SEQ ID NO: 1173532 - protein, 9 aa, Homo Sapiens
EQRERRERR

SEQ ID NO: 1173533 - protein, 9 aa, Homo Sapiens
YDLDQGPRS

SEQ ID NO: 1173534 - protein, 9 aa, Homo Sapiens
PQGPSASAQ

SEQ ID NO: 1173535 - protein, 9 aa, Homo Sapiens
LKLKEMFSS

SEQ ID NO: 1173536 - protein, 9 aa, Homo Sapiens
MGSQLAGDI

SEQ ID NO: 1173537 - protein, 9 aa, Homo Sapiens
DIRPVSEDL

SEQ ID NO: 1173538 - protein, 9 aa, Homo Sapiens
PRRQRAPRS

SEQ ID NO: 1173539 - protein, 9 aa, Homo Sapiens
EMALHLAAH

SEQ ID NO: 1173540 - protein, 9 aa, Homo Sapiens
FDYVGIDSI

SEQ ID NO: 1173541 - protein, 9 aa, Homo Sapiens
KAWAQAEAL

SEQ ID NO: 1173542 - protein, 9 aa, Homo Sapiens
PSSCSPRAA

SEQ ID NO: 1173543 - protein, 9 aa, Homo Sapiens
GSATSMAGR

SEQ ID NO: 1173544 - protein, 9 aa, Homo Sapiens
AAHYSRADA

SEQ ID NO: 1173545 - protein, 9 aa, Homo Sapiens
DDEEEEASG

SEQ ID NO: 1173546 - protein, 9 aa, Homo Sapiens
AMNARGIPR

SEQ ID NO: 1173547 - protein, 9 aa, Homo Sapiens
TLPNASTWT

SEQ ID NO: 1173548 - protein, 9 aa, Homo Sapiens
PVLEVSVAA

SEQ ID NO: 1173549 - protein, 9 aa, Homo Sapiens
STPSAEKGE

SEQ ID NO: 1173550 - protein, 9 aa, Homo Sapiens
TKIRLFTAI

SEQ ID NO: 1173551 - protein, 9 aa, Homo Sapiens
TLLQLLDQL

SEQ ID NO: 1173552 - protein, 9 aa, Homo Sapiens
PHGASGAGH

SEQ ID NO: 1173553 - protein, 9 aa, Homo Sapiens
KPGAEKAKP

SEQ ID NO: 1173554 - protein, 9 aa, Homo Sapiens
TSASVKKDI

SEQ ID NO: 1173555 - protein, 9 aa, Homo Sapiens
LACISVGRY

SEQ ID NO: 1173556 - protein, 9 aa, Homo Sapiens
ILKVRAMLE

SEQ ID NO: 1173557 - protein, 9 aa, Homo Sapiens
KRGKPLEND

SEQ ID NO: 1173558 - protein, 9 aa, Homo Sapiens
RSTATSQAG

SEQ ID NO: 1173559 - protein, 9 aa, Homo Sapiens
ELLLFLPTL

SEQ ID NO: 1173560 - protein, 9 aa, Homo Sapiens
SDSSDSKLE

SEQ ID NO: 1173561 - protein, 9 aa, Homo Sapiens
AGWPGLWPR

SEQ ID NO: 1173562 - protein, 9 aa, Homo Sapiens
GCRRCSGLS

SEQ ID NO: 1173563 - protein, 9 aa, Homo Sapiens
YVHVVLAQS

SEQ ID NO: 1173564 - protein, 9 aa, Homo Sapiens
LVEYGANVA

SEQ ID NO: 1173565 - protein, 9 aa, Homo Sapiens
TPVWSPRPP

SEQ ID NO: 1173566 - protein, 9 aa, Homo Sapiens
PQSHRPPRA

SEQ ID NO: 1173567 - protein, 9 aa, Homo Sapiens
KQTKVLWPL

SEQ ID NO: 1173568 - protein, 9 aa, Homo Sapiens
VGIIIPGHI

SEQ ID NO: 1173569 - protein, 9 aa, Homo Sapiens
CAECGKFFC

SEQ ID NO: 1173570 - protein, 9 aa, Homo Sapiens
MLVKKLQGA

SEQ ID NO: 1173571 - protein, 9 aa, Homo Sapiens
TFRSASHLR

SEQ ID NO: 1173572 - protein, 9 aa, Homo Sapiens
SNLQAKGRM

SEQ ID NO: 1173573 - protein, 9 aa, Homo Sapiens
VSTSTPTFL

SEQ ID NO: 1173574 - protein, 9 aa, Homo Sapiens
GFFRDISNS

SEQ ID NO: 1173575 - protein, 9 aa, Homo Sapiens
LDKYVACGS

SEQ ID NO: 1173576 - protein, 9 aa, Homo Sapiens
SGPWGVVDL

SEQ ID NO: 1173577 - protein, 9 aa, Homo Sapiens
SELPAPCSL

SEQ ID NO: 1173578 - protein, 9 aa, Homo Sapiens
EKPHMPMEF

SEQ ID NO: 1173579 - protein, 9 aa, Homo Sapiens
LNQGIPGRY

SEQ ID NO: 1173580 - protein, 9 aa, Homo Sapiens
SWMFAKIFN

SEQ ID NO: 1173581 - protein, 9 aa, Homo Sapiens
RTRAANVIT

SEQ ID NO: 1173582 - protein, 9 aa, Homo Sapiens
KGMTYLREK

SEQ ID NO: 1173583 - protein, 9 aa, Homo Sapiens
NILPIQRVP

SEQ ID NO: 1173584 - protein, 9 aa, Homo Sapiens
CPSCMPSGT

SEQ ID NO: 1173585 - protein, 9 aa, Homo Sapiens
PRALPVQIR

SEQ ID NO: 1173586 - protein, 9 aa, Homo Sapiens
GRMLIPCYE

SEQ ID NO: 1173587 - protein, 9 aa, Homo Sapiens
IKKSSGASW

SEQ ID NO: 1173588 - protein, 9 aa, Homo Sapiens
PAPRQGSRE

SEQ ID NO: 1173589 - protein, 9 aa, Homo Sapiens
PSPSRRRAP

SEQ ID NO: 1173590 - protein, 9 aa, Homo Sapiens
PKCIIHGPA

SEQ ID NO: 1173591 - protein, 9 aa, Homo Sapiens
KTVSTSFEA

SEQ ID NO: 1173592 - protein, 9 aa, Homo Sapiens
ESAQPPSLC

SEQ ID NO: 1173593 - protein, 9 aa, Homo Sapiens
EGAADKGDL

SEQ ID NO: 1173594 - protein, 9 aa, Homo Sapiens
SGSPMTSAW

SEQ ID NO: 1173595 - protein, 9 aa, Homo Sapiens
FMGIMDKTV

SEQ ID NO: 1173596 - protein, 9 aa, Homo Sapiens
NSFSHNSYL

SEQ ID NO: 1173597 - protein, 9 aa, Homo Sapiens
GGGGPGHGS

SEQ ID NO: 1173598 - protein, 9 aa, Homo Sapiens
AKPQRTSRH

SEQ ID NO: 1173599 - protein, 9 aa, Homo Sapiens
KTGAFKTVS

SEQ ID NO: 1173600 - protein, 9 aa, Homo Sapiens
PAHQPLGSM

SEQ ID NO: 1173601 - protein, 9 aa, Homo Sapiens
APEAPGCWS

SEQ ID NO: 1173602 - protein, 9 aa, Homo Sapiens
TCFFPTLPR

SEQ ID NO: 1173603 - protein, 9 aa, Homo Sapiens
QRPPRSILS

SEQ ID NO: 1173604 - protein, 9 aa, Homo Sapiens
PRVLHQNLD

SEQ ID NO: 1173605 - protein, 9 aa, Homo Sapiens
LQKYNHCCV

SEQ ID NO: 1173606 - protein, 9 aa, Homo Sapiens
EFLASSPLT

SEQ ID NO: 1173607 - protein, 9 aa, Homo Sapiens
RALHHAGPE

SEQ ID NO: 1173608 - protein, 9 aa, Homo Sapiens
VYTIGGEKD

SEQ ID NO: 1173609 - protein, 9 aa, Homo Sapiens
QECDEAPSL

SEQ ID NO: 1173610 - protein, 9 aa, Homo Sapiens
VFSDYLRER

SEQ ID NO: 1173611 - protein, 9 aa, Homo Sapiens
LNTTKNFSC

SEQ ID NO: 1173612 - protein, 9 aa, Homo Sapiens
TTTLASPTW

SEQ ID NO: 1173613 - protein, 9 aa, Homo Sapiens
LVRLDPGAI

SEQ ID NO: 1173614 - protein, 9 aa, Homo Sapiens
FLCPTIMSP

SEQ ID NO: 1173615 - protein, 9 aa, Homo Sapiens
VVTGTSEVT

SEQ ID NO: 1173616 - protein, 9 aa, Homo Sapiens
RLPRRSCCS

SEQ ID NO: 1173617 - protein, 9 aa, Homo Sapiens
GARAPPPGT

SEQ ID NO: 1173618 - protein, 9 aa, Homo Sapiens
GHSVLWTLY

SEQ ID NO: 1173619 - protein, 9 aa, Homo Sapiens
PAVASRSTA

SEQ ID NO: 1173620 - protein, 9 aa, Homo Sapiens
TPPGRSLPA

SEQ ID NO: 1173621 - protein, 9 aa, Homo Sapiens
NGIWEVMPR

SEQ ID NO: 1173622 - protein, 9 aa, Homo Sapiens
RLYCSLGVQ

SEQ ID NO: 1173623 - protein, 9 aa, Homo Sapiens
SSCSPRAAE

SEQ ID NO: 1173624 - protein, 9 aa, Homo Sapiens
FQHISSLRD

SEQ ID NO: 1173625 - protein, 9 aa, Homo Sapiens
THDKAITLQ

SEQ ID NO: 1173626 - protein, 9 aa, Homo Sapiens
QLSPTPSAP

SEQ ID NO: 1173627 - protein, 9 aa, Homo Sapiens
SYNLSCKLH

SEQ ID NO: 1173628 - protein, 9 aa, Homo Sapiens
KHRRRGWGK

SEQ ID NO: 1173629 - protein, 9 aa, Homo Sapiens
CQYGECLHS

SEQ ID NO: 1173630 - protein, 9 aa, Homo Sapiens
EFWLKRQAT

SEQ ID NO: 1173631 - protein, 9 aa, Homo Sapiens
TKSQSCLTS

SEQ ID NO: 1173632 - protein, 9 aa, Homo Sapiens
KEKTLGIRA

SEQ ID NO: 1173633 - protein, 9 aa, Homo Sapiens
ALWGAATPV

SEQ ID NO: 1173634 - protein, 9 aa, Homo Sapiens
TPARWATQG

SEQ ID NO: 1173635 - protein, 9 aa, Homo Sapiens
TTCSRWASS

SEQ ID NO: 1173636 - protein, 9 aa, Homo Sapiens
SELAPRLVG

SEQ ID NO: 1173637 - protein, 9 aa, Homo Sapiens
RRLQILRQV

SEQ ID NO: 1173638 - protein, 9 aa, Homo Sapiens
EIQLSHANC

SEQ ID NO: 1173639 - protein, 9 aa, Homo Sapiens
AGFLNEIAR

SEQ ID NO: 1173640 - protein, 9 aa, Homo Sapiens
KAPSSPRRL

SEQ ID NO: 1173641 - protein, 9 aa, Homo Sapiens
YRERGGGCL

SEQ ID NO: 1173642 - protein, 9 aa, Homo Sapiens
QFSSSGKGV

SEQ ID NO: 1173643 - protein, 9 aa, Homo Sapiens
PQPQSGGAL

SEQ ID NO: 1173644 - protein, 9 aa, Homo Sapiens
SWSQTSCFG

SEQ ID NO: 1173645 - protein, 9 aa, Homo Sapiens
RARTCSPCS

SEQ ID NO: 1173646 - protein, 9 aa, Homo Sapiens
EKHGTCTAQ

SEQ ID NO: 1173647 - protein, 9 aa, Homo Sapiens
GLRMRRLGT

SEQ ID NO: 1173648 - protein, 9 aa, Homo Sapiens
SRCVVPCWP

SEQ ID NO: 1173649 - protein, 9 aa, Homo Sapiens
NNKWFAETS

SEQ ID NO: 1173650 - protein, 9 aa, Homo Sapiens
QCPSAQGRK

SEQ ID NO: 1173651 - protein, 9 aa, Homo Sapiens
GIHEFQDTT

SEQ ID NO: 1173652 - protein, 9 aa, Homo Sapiens
INQYCNLVS

SEQ ID NO: 1173653 - protein, 9 aa, Homo Sapiens
DLDFLGSCW

SEQ ID NO: 1173654 - protein, 9 aa, Homo Sapiens
YGECCSHME

SEQ ID NO: 1173655 - protein, 9 aa, Homo Sapiens
GPLAGPCRA

SEQ ID NO: 1173656 - protein, 9 aa, Homo Sapiens
ANTASPLIV

SEQ ID NO: 1173657 - protein, 9 aa, Homo Sapiens
DYHKCKIPL

SEQ ID NO: 1173658 - protein, 9 aa, Homo Sapiens
HIRPEDLWV

SEQ ID NO: 1173659 - protein, 9 aa, Homo Sapiens
ILWGLKYIH

SEQ ID NO: 1173660 - protein, 9 aa, Homo Sapiens
QLGGRLVLN

SEQ ID NO: 1173661 - protein, 9 aa, Homo Sapiens
LMQRTSTIG

SEQ ID NO: 1173662 - protein, 9 aa, Homo Sapiens
PHGRCCMGL

SEQ ID NO: 1173663 - protein, 9 aa, Homo Sapiens
GFLAGTGKQ

SEQ ID NO: 1173664 - protein, 9 aa, Homo Sapiens
LPQLSPTPS

SEQ ID NO: 1173665 - protein, 9 aa, Homo Sapiens
GRSAASSAA

SEQ ID NO: 1173666 - protein, 9 aa, Homo Sapiens
GGRPLRPPI

SEQ ID NO: 1173667 - protein, 9 aa, Homo Sapiens
QHDSSAGPE

SEQ ID NO: 1173668 - protein, 9 aa, Homo Sapiens
WTGGLDNPV

SEQ ID NO: 1173669 - protein, 9 aa, Homo Sapiens
SQRMSRQPS

SEQ ID NO: 1173670 - protein, 9 aa, Homo Sapiens
PMRLHPCPP

SEQ ID NO: 1173671 - protein, 9 aa, Homo Sapiens
GTQRGRVIA

SEQ ID NO: 1173672 - protein, 9 aa, Homo Sapiens
LEADMWVHS

SEQ ID NO: 1173673 - protein, 9 aa, Homo Sapiens
NKQHVLETA

SEQ ID NO: 1173674 - protein, 9 aa, Homo Sapiens
WRLCVGRTP

SEQ ID NO: 1173675 - protein, 9 aa, Homo Sapiens
CSTPSMYFE

SEQ ID NO: 1173676 - protein, 9 aa, Homo Sapiens
LWGPGSWAW

SEQ ID NO: 1173677 - protein, 9 aa, Homo Sapiens
FQVSASDAG

SEQ ID NO: 1173678 - protein, 9 aa, Homo Sapiens
MPLLLIVAF

SEQ ID NO: 1173679 - protein, 9 aa, Homo Sapiens
CRGCQGPGA

SEQ ID NO: 1173680 - protein, 9 aa, Homo Sapiens
ARNKSWLSA

SEQ ID NO: 1173681 - protein, 9 aa, Homo Sapiens
SGAGHPWTP

SEQ ID NO: 1173682 - protein, 9 aa, Homo Sapiens
TPHHISVKN

SEQ ID NO: 1173683 - protein, 9 aa, Homo Sapiens
SKTFSAVNG

SEQ ID NO: 1173684 - protein, 9 aa, Homo Sapiens
ASLPPSPAP

SEQ ID NO: 1173685 - protein, 9 aa, Homo Sapiens
IYRRHRGAL

SEQ ID NO: 1173686 - protein, 9 aa, Homo Sapiens
NKALPFTRY

SEQ ID NO: 1173687 - protein, 9 aa, Homo Sapiens
WRWGPSLPS

SEQ ID NO: 1173688 - protein, 9 aa, Homo Sapiens
GWFEVVSQG

SEQ ID NO: 1173689 - protein, 9 aa, Homo Sapiens
GRSRCRMTS

SEQ ID NO: 1173690 - protein, 9 aa, Homo Sapiens
SFLGRTREE

SEQ ID NO: 1173691 - protein, 9 aa, Homo Sapiens
LGARWDAGL

SEQ ID NO: 1173692 - protein, 9 aa, Homo Sapiens
AVAVDFRNY

SEQ ID NO: 1173693 - protein, 9 aa, Homo Sapiens
SPQLCRPPT

SEQ ID NO: 1173694 - protein, 9 aa, Homo Sapiens
HYFKGMLSI

SEQ ID NO: 1173695 - protein, 9 aa, Homo Sapiens
TPKVLVFPV

SEQ ID NO: 1173696 - protein, 9 aa, Homo Sapiens
MPRPSISAE

SEQ ID NO: 1173697 - protein, 9 aa, Homo Sapiens
GDGVGQASL

SEQ ID NO: 1173698 - protein, 9 aa, Homo Sapiens
VSITQENDL

SEQ ID NO: 1173699 - protein, 9 aa, Homo Sapiens
LQPTTENTP

SEQ ID NO: 1173700 - protein, 9 aa, Homo Sapiens
ACPPGAPRG

SEQ ID NO: 1173701 - protein, 9 aa, Homo Sapiens
PRPDPALSL

SEQ ID NO: 1173702 - protein, 9 aa, Homo Sapiens
RLAILTGTI

SEQ ID NO: 1173703 - protein, 9 aa, Homo Sapiens
HHYMDGQIP

SEQ ID NO: 1173704 - protein, 9 aa, Homo Sapiens
AGHVRLHRL

SEQ ID NO: 1173705 - protein, 9 aa, Homo Sapiens
CWPFHLISA

SEQ ID NO: 1173706 - protein, 9 aa, Homo Sapiens
RTVVMQGVA

SEQ ID NO: 1173707 - protein, 9 aa, Homo Sapiens
VIYDGEVCA

SEQ ID NO: 1173708 - protein, 9 aa, Homo Sapiens
KTSGLMWAG

SEQ ID NO: 1173709 - protein, 9 aa, Homo Sapiens
TVRFQQQSN

SEQ ID NO: 1173710 - protein, 9 aa, Homo Sapiens
APPSCSGAR

SEQ ID NO: 1173711 - protein, 9 aa, Homo Sapiens
EHCPLTSAT

SEQ ID NO: 1173712 - protein, 9 aa, Homo Sapiens
KREELRKSK

SEQ ID NO: 1173713 - protein, 9 aa, Homo Sapiens
GEWVLPEEM

SEQ ID NO: 1173714 - protein, 9 aa, Homo Sapiens
WRRPRRQRA

SEQ ID NO: 1173715 - protein, 9 aa, Homo Sapiens
SSWMFAKIF

SEQ ID NO: 1173716 - protein, 9 aa, Homo Sapiens
NSPPPSPPS

SEQ ID NO: 1173717 - protein, 9 aa, Homo Sapiens
FSVATGQPR

SEQ ID NO: 1173718 - protein, 9 aa, Homo Sapiens
YSAKTPCPY

SEQ ID NO: 1173719 - protein, 9 aa, Homo Sapiens
TGCADLNGR

SEQ ID NO: 1173720 - protein, 9 aa, Homo Sapiens
RARVLLLPV

SEQ ID NO: 1173721 - protein, 9 aa, Homo Sapiens
ARRSPSWSA

SEQ ID NO: 1173722 - protein, 9 aa, Homo Sapiens
LLYLSTESG

SEQ ID NO: 1173723 - protein, 9 aa, Homo Sapiens
PRTCAGRSS

SEQ ID NO: 1173724 - protein, 9 aa, Homo Sapiens
CREQQQKLQ

SEQ ID NO: 1173725 - protein, 9 aa, Homo Sapiens
HIEEQKEQR

SEQ ID NO: 1173726 - protein, 9 aa, Homo Sapiens
VTLSCIKIS

SEQ ID NO: 1173727 - protein, 9 aa, Homo Sapiens
LYNFKKHSI

SEQ ID NO: 1173728 - protein, 9 aa, Homo Sapiens
GSRTATGTH

SEQ ID NO: 1173729 - protein, 9 aa, Homo Sapiens
SPKKIRLLK

SEQ ID NO: 1173730 - protein, 9 aa, Homo Sapiens
TQRNSFQSE

SEQ ID NO: 1173731 - protein, 9 aa, Homo Sapiens
IASMSNPYP

SEQ ID NO: 1173732 - protein, 9 aa, Homo Sapiens
RRRQLRPDS

SEQ ID NO: 1173733 - protein, 9 aa, Homo Sapiens
QYRCACGFS

SEQ ID NO: 1173734 - protein, 9 aa, Homo Sapiens
LIFSVFVTQ

SEQ ID NO: 1173735 - protein, 9 aa, Homo Sapiens
LSGIKDNNP

SEQ ID NO: 1173736 - protein, 9 aa, Homo Sapiens
DVSDQSTCT

SEQ ID NO: 1173737 - protein, 9 aa, Homo Sapiens
LHQRVRPRE

SEQ ID NO: 1173738 - protein, 9 aa, Homo Sapiens
QASLQLHAA

SEQ ID NO: 1173739 - protein, 9 aa, Homo Sapiens
IRVSPRSTT

SEQ ID NO: 1173740 - protein, 9 aa, Homo Sapiens
IRCCCRRRR

SEQ ID NO: 1173741 - protein, 9 aa, Homo Sapiens
LEKKNWSGG

SEQ ID NO: 1173742 - protein, 9 aa, Homo Sapiens
PRWTMAWAQ

SEQ ID NO: 1173743 - protein, 9 aa, Homo Sapiens
PGSFLGRTR

SEQ ID NO: 1173744 - protein, 9 aa, Homo Sapiens
PVSVWDAYG

SEQ ID NO: 1173745 - protein, 9 aa, Homo Sapiens
IECLVWRTP

SEQ ID NO: 1173746 - protein, 9 aa, Homo Sapiens
KYVLDDFEL

SEQ ID NO: 1173747 - protein, 9 aa, Homo Sapiens
RAAAQGAVA

SEQ ID NO: 1173748 - protein, 9 aa, Homo Sapiens
KHFWNSTKK

SEQ ID NO: 1173749 - protein, 9 aa, Homo Sapiens
VTAMQCRKK

SEQ ID NO: 1173750 - protein, 9 aa, Homo Sapiens
FIEGGRPCC

SEQ ID NO: 1173751 - protein, 9 aa, Homo Sapiens
KHIRTQHNY

SEQ ID NO: 1173752 - protein, 9 aa, Homo Sapiens
ACAGLFTVC

SEQ ID NO: 1173753 - protein, 9 aa, Homo Sapiens
PLPGTPAPR

SEQ ID NO: 1173754 - protein, 9 aa, Homo Sapiens
VLGGWAKMH

SEQ ID NO: 1173755 - protein, 9 aa, Homo Sapiens
QLWFLVSFQ

SEQ ID NO: 1173756 - protein, 9 aa, Homo Sapiens
RNDGALLLQ

SEQ ID NO: 1173757 - protein, 9 aa, Homo Sapiens
SCCLPGLTH

SEQ ID NO: 1173758 - protein, 9 aa, Homo Sapiens
IHIEKYQFS

SEQ ID NO: 1173759 - protein, 9 aa, Homo Sapiens
GRGAPAQSP

SEQ ID NO: 1173760 - protein, 9 aa, Homo Sapiens
WWVLAWQQL

SEQ ID NO: 1173761 - protein, 9 aa, Homo Sapiens
HVQLRQRII

SEQ ID NO: 1173762 - protein, 9 aa, Homo Sapiens
HIDDEAARR

SEQ ID NO: 1173763 - protein, 9 aa, Homo Sapiens
TGGWGLLCV

SEQ ID NO: 1173764 - protein, 9 aa, Homo Sapiens
SRPASPLFA

SEQ ID NO: 1173765 - protein, 9 aa, Homo Sapiens
IFHTTAAGI

SEQ ID NO: 1173766 - protein, 9 aa, Homo Sapiens
MDPPAPTQQ

SEQ ID NO: 1173767 - protein, 9 aa, Homo Sapiens
HVLALEVTF

SEQ ID NO: 1173768 - protein, 9 aa, Homo Sapiens
GAATPVARG

SEQ ID NO: 1173769 - protein, 9 aa, Homo Sapiens
ISVTAMQCR

SEQ ID NO: 1173770 - protein, 9 aa, Homo Sapiens
IPEPPPLAS

SEQ ID NO: 1173771 - protein, 9 aa, Homo Sapiens
YQALISNVL

SEQ ID NO: 1173772 - protein, 9 aa, Homo Sapiens
EAFNWHHGV

SEQ ID NO: 1173773 - protein, 9 aa, Homo Sapiens
GEKIPLSKN

SEQ ID NO: 1173774 - protein, 9 aa, Homo Sapiens
CQPSWATRQ

SEQ ID NO: 1173775 - protein, 9 aa, Homo Sapiens
SPCPTSRSR

SEQ ID NO: 1173776 - protein, 9 aa, Homo Sapiens
HYGHQAPQV

SEQ ID NO: 1173777 - protein, 9 aa, Homo Sapiens
GRPSTSRSS

SEQ ID NO: 1173778 - protein, 9 aa, Homo Sapiens
CLPRPQGAA

SEQ ID NO: 1173779 - protein, 9 aa, Homo Sapiens
SEEFQRILK

SEQ ID NO: 1173780 - protein, 9 aa, Homo Sapiens
VTALARPRW

SEQ ID NO: 1173781 - protein, 9 aa, Homo Sapiens
KTNEEKRQC

SEQ ID NO: 1173782 - protein, 9 aa, Homo Sapiens
IAAGPLYSD

SEQ ID NO: 1173783 - protein, 9 aa, Homo Sapiens
SGWRSVRMY

SEQ ID NO: 1173784 - protein, 9 aa, Homo Sapiens
RSPTHLFHT

SEQ ID NO: 1173785 - protein, 9 aa, Homo Sapiens
AGQELTDYL

SEQ ID NO: 1173786 - protein, 9 aa, Homo Sapiens
PRCKTTCAS

SEQ ID NO: 1173787 - protein, 9 aa, Homo Sapiens
SNMGAWGDY

SEQ ID NO: 1173788 - protein, 9 aa, Homo Sapiens
GGVGETAPW

SEQ ID NO: 1173789 - protein, 9 aa, Homo Sapiens
AAEPMICSL

SEQ ID NO: 1173790 - protein, 9 aa, Homo Sapiens
TLSALPLRC

SEQ ID NO: 1173791 - protein, 9 aa, Homo Sapiens
GTAMPQMQL

SEQ ID NO: 1173792 - protein, 9 aa, Homo Sapiens
AALPGSMPT

SEQ ID NO: 1173793 - protein, 9 aa, Homo Sapiens
MQRTREGPS

SEQ ID NO: 1173794 - protein, 9 aa, Homo Sapiens
VVKIPTGAT

SEQ ID NO: 1173795 - protein, 9 aa, Homo Sapiens
GHPAPQRRG

SEQ ID NO: 1173796 - protein, 9 aa, Homo Sapiens
TLSSGLAPR

SEQ ID NO: 1173797 - protein, 9 aa, Homo Sapiens
WHNICHQVP

SEQ ID NO: 1173798 - protein, 9 aa, Homo Sapiens
SVENDVSFP

SEQ ID NO: 1173799 - protein, 9 aa, Homo Sapiens
TGRRPASGH

SEQ ID NO: 1173800 - protein, 9 aa, Homo Sapiens
VGTIQRWLK

SEQ ID NO: 1173801 - protein, 9 aa, Homo Sapiens
ASAPRGPGM

SEQ ID NO: 1173802 - protein, 9 aa, Homo Sapiens
FENAESEVD

SEQ ID NO: 1173803 - protein, 9 aa, Homo Sapiens
GNFAAYAFA

SEQ ID NO: 1173804 - protein, 9 aa, Homo Sapiens
MACDSVSGE

SEQ ID NO: 1173805 - protein, 9 aa, Homo Sapiens
RPGPLAGPC

SEQ ID NO: 1173806 - protein, 9 aa, Homo Sapiens
SRHVWFREP

SEQ ID NO: 1173807 - protein, 9 aa, Homo Sapiens
PLTTLATQP

SEQ ID NO: 1173808 - protein, 9 aa, Homo Sapiens
AHWRFTPEI

SEQ ID NO: 1173809 - protein, 9 aa, Homo Sapiens
HLQHSPSQS

SEQ ID NO: 1173810 - protein, 9 aa, Homo Sapiens
KTAPMKMGR

SEQ ID NO: 1173811 - protein, 9 aa, Homo Sapiens
LLDVLDHGL

SEQ ID NO: 1173812 - protein, 9 aa, Homo Sapiens
ELPFSILRG

SEQ ID NO: 1173813 - protein, 9 aa, Homo Sapiens
QLLHEQIGP

SEQ ID NO: 1173814 - protein, 9 aa, Homo Sapiens
RVMVPLPVW

SEQ ID NO: 1173815 - protein, 9 aa, Homo Sapiens
FLGLWAYIR

SEQ ID NO: 1173816 - protein, 9 aa, Homo Sapiens
RPQLGRSRT

SEQ ID NO: 1173817 - protein, 9 aa, Homo Sapiens
ISDIRAGTT

SEQ ID NO: 1173818 - protein, 9 aa, Homo Sapiens
GEKRFGFWR

SEQ ID NO: 1173819 - protein, 9 aa, Homo Sapiens
TWALQGAVH

SEQ ID NO: 1173820 - protein, 9 aa, Homo Sapiens
KVFSDYLRE

SEQ ID NO: 1173821 - protein, 9 aa, Homo Sapiens
MICSLHQAW

SEQ ID NO: 1173822 - protein, 9 aa, Homo Sapiens
RQLWQAPRA

SEQ ID NO: 1173823 - protein, 9 aa, Homo Sapiens
TNVKHLINP

SEQ ID NO: 1173824 - protein, 9 aa, Homo Sapiens
APKHARTFV

SEQ ID NO: 1173825 - protein, 9 aa, Homo Sapiens
RLSASSTRA

SEQ ID NO: 1173826 - protein, 9 aa, Homo Sapiens
SWPSRLGSR

SEQ ID NO: 1173827 - protein, 9 aa, Homo Sapiens
RRMALAGWP

SEQ ID NO: 1173828 - protein, 9 aa, Homo Sapiens
SNANTASPL

SEQ ID NO: 1173829 - protein, 9 aa, Homo Sapiens
WRFKTAPMK

SEQ ID NO: 1173830 - protein, 9 aa, Homo Sapiens
IHDGDFHVP

SEQ ID NO: 1173831 - protein, 9 aa, Homo Sapiens
AAAAATAAT

SEQ ID NO: 1173832 - protein, 9 aa, Homo Sapiens
AMLVATSAC

SEQ ID NO: 1173833 - protein, 9 aa, Homo Sapiens
SSPCPTSRS

SEQ ID NO: 1173834 - protein, 9 aa, Homo Sapiens
GLPLTLSAL

SEQ ID NO: 1173835 - protein, 9 aa, Homo Sapiens
GVSWGAGRL

SEQ ID NO: 1173836 - protein, 9 aa, Homo Sapiens
PSPPFGGTP

SEQ ID NO: 1173837 - protein, 9 aa, Homo Sapiens
LASGCPRHG

SEQ ID NO: 1173838 - protein, 9 aa, Homo Sapiens
CKYQVDLSK

SEQ ID NO: 1173839 - protein, 9 aa, Homo Sapiens
FVSSIRLCT

SEQ ID NO: 1173840 - protein, 9 aa, Homo Sapiens
GRPLGPPTA

SEQ ID NO: 1173841 - protein, 9 aa, Homo Sapiens
KQKTIQIAI

SEQ ID NO: 1173842 - protein, 9 aa, Homo Sapiens
GCCIEMMKL

SEQ ID NO: 1173843 - protein, 9 aa, Homo Sapiens
MAAEPTTPL

SEQ ID NO: 1173844 - protein, 9 aa, Homo Sapiens
RRTTSTREC

SEQ ID NO: 1173845 - protein, 9 aa, Homo Sapiens
WWHWLITWG

SEQ ID NO: 1173846 - protein, 9 aa, Homo Sapiens
RRTSPLPPP

SEQ ID NO: 1173847 - protein, 9 aa, Homo Sapiens
SMAGRKASG

SEQ ID NO: 1173848 - protein, 9 aa, Homo Sapiens
RTPPPTATN

SEQ ID NO: 1173849 - protein, 9 aa, Homo Sapiens
IRKDLCANT

SEQ ID NO: 1173850 - protein, 9 aa, Homo Sapiens
GQWAPSKYT

SEQ ID NO: 1173851 - protein, 9 aa, Homo Sapiens
FIEHKTISF

SEQ ID NO: 1173852 - protein, 9 aa, Homo Sapiens
PHYFKGMLS

SEQ ID NO: 1173853 - protein, 9 aa, Homo Sapiens
PDSTPRGRT

SEQ ID NO: 1173854 - protein, 9 aa, Homo Sapiens
KKIRLLKCD

SEQ ID NO: 1173855 - protein, 9 aa, Homo Sapiens
EHAAAPVAR

SEQ ID NO: 1173856 - protein, 9 aa, Homo Sapiens
PTTEHCPLT

SEQ ID NO: 1173857 - protein, 9 aa, Homo Sapiens
NPTTAWTRA

SEQ ID NO: 1173858 - protein, 9 aa, Homo Sapiens
TGYFKNVAR

SEQ ID NO: 1173859 - protein, 9 aa, Homo Sapiens
LSKVERANT

SEQ ID NO: 1173860 - protein, 9 aa, Homo Sapiens
QIKQSNTAI

SEQ ID NO: 1173861 - protein, 9 aa, Homo Sapiens
GSAFEVVWA

SEQ ID NO: 1173862 - protein, 9 aa, Homo Sapiens
RQTPPGSAP

SEQ ID NO: 1173863 - protein, 9 aa, Homo Sapiens
GLGRGGPAE

SEQ ID NO: 1173864 - protein, 9 aa, Homo Sapiens
RSKVPYIVC

SEQ ID NO: 1173865 - protein, 9 aa, Homo Sapiens
IGLKPRARD

SEQ ID NO: 1173866 - protein, 9 aa, Homo Sapiens
RTKLEKALS

SEQ ID NO: 1173867 - protein, 9 aa, Homo Sapiens
ARWASQEWQ

SEQ ID NO: 1173868 - protein, 9 aa, Homo Sapiens
ASLRQDCGD

SEQ ID NO: 1173869 - protein, 9 aa, Homo Sapiens
KTVRFQQQS

SEQ ID NO: 1173870 - protein, 9 aa, Homo Sapiens
PRGGPTAAA

SEQ ID NO: 1173871 - protein, 9 aa, Homo Sapiens
GMALCPSCR

SEQ ID NO: 1173872 - protein, 9 aa, Homo Sapiens
YLSTESGNV

SEQ ID NO: 1173873 - protein, 9 aa, Homo Sapiens
FNELPNPAA

SEQ ID NO: 1173874 - protein, 9 aa, Homo Sapiens
RRVRKYTLV

SEQ ID NO: 1173875 - protein, 9 aa, Homo Sapiens
AKPWLAICW

SEQ ID NO: 1173876 - protein, 9 aa, Homo Sapiens
MTTALSVLV

SEQ ID NO: 1173877 - protein, 9 aa, Homo Sapiens
AWKSTWHVF

SEQ ID NO: 1173878 - protein, 9 aa, Homo Sapiens
MSGQGKPKA

SEQ ID NO: 1173879 - protein, 9 aa, Homo Sapiens
RHCIEFRPV

SEQ ID NO: 1173880 - protein, 9 aa, Homo Sapiens
GKNTHKVEE

SEQ ID NO: 1173881 - protein, 9 aa, Homo Sapiens
LCTHIKEVH

SEQ ID NO: 1173882 - protein, 9 aa, Homo Sapiens
RAQADLQLE

SEQ ID NO: 1173883 - protein, 9 aa, Homo Sapiens
LQTSTGGIS

SEQ ID NO: 1173884 - protein, 9 aa, Homo Sapiens
PVLMDPTHC

SEQ ID NO: 1173885 - protein, 9 aa, Homo Sapiens
RAAFRAQAP

SEQ ID NO: 1173886 - protein, 9 aa, Homo Sapiens
DNSELPSDE

SEQ ID NO: 1173887 - protein, 9 aa, Homo Sapiens
AGAAAGNLS

SEQ ID NO: 1173888 - protein, 9 aa, Homo Sapiens
SMDPMDGNT

SEQ ID NO: 1173889 - protein, 9 aa, Homo Sapiens
PPPAVPQYA

SEQ ID NO: 1173890 - protein, 9 aa, Homo Sapiens
PRPSGAAPR

SEQ ID NO: 1173891 - protein, 9 aa, Homo Sapiens
VRQHVQKYP

SEQ ID NO: 1173892 - protein, 9 aa, Homo Sapiens
RGLQALGSR

SEQ ID NO: 1173893 - protein, 9 aa, Homo Sapiens
ASGTLLSGD

SEQ ID NO: 1173894 - protein, 9 aa, Homo Sapiens
GGPVRLEYY

SEQ ID NO: 1173895 - protein, 9 aa, Homo Sapiens
FIRSPRINA

SEQ ID NO: 1173896 - protein, 9 aa, Homo Sapiens
ECLGSFGSI

SEQ ID NO: 1173897 - protein, 9 aa, Homo Sapiens
LARSPDGSQ

SEQ ID NO: 1173898 - protein, 9 aa, Homo Sapiens
SAGVLSPVT

SEQ ID NO: 1173899 - protein, 9 aa, Homo Sapiens
SHLQHSPSQ

SEQ ID NO: 1173900 - protein, 9 aa, Homo Sapiens
HQRMKFSMW

SEQ ID NO: 1173901 - protein, 9 aa, Homo Sapiens
SSRSKLRKV

SEQ ID NO: 1173902 - protein, 9 aa, Homo Sapiens
GGRPCCAYL

SEQ ID NO: 1173903 - protein, 9 aa, Homo Sapiens
EQEQREQER

SEQ ID NO: 1173904 - protein, 9 aa, Homo Sapiens
SLSCSCSSS

SEQ ID NO: 1173905 - protein, 9 aa, Homo Sapiens
ADDRYVAIC

SEQ ID NO: 1173906 - protein, 9 aa, Homo Sapiens
LSFKEPLTL

SEQ ID NO: 1173907 - protein, 9 aa, Homo Sapiens
FRPVDCADH

SEQ ID NO: 1173908 - protein, 9 aa, Homo Sapiens
AAPHTLCSD

SEQ ID NO: 1173909 - protein, 9 aa, Homo Sapiens
RRPRRQRAP

SEQ ID NO: 1173910 - protein, 9 aa, Homo Sapiens
VQARDVIAR

SEQ ID NO: 1173911 - protein, 9 aa, Homo Sapiens
LEMCLGLPL

SEQ ID NO: 1173912 - protein, 9 aa, Homo Sapiens
YRIMEHSWF

SEQ ID NO: 1173913 - protein, 9 aa, Homo Sapiens
SVPPPAVPQ

SEQ ID NO: 1173914 - protein, 9 aa, Homo Sapiens
EEPSPSEVS

SEQ ID NO: 1173915 - protein, 9 aa, Homo Sapiens
LTIRCCCRR

SEQ ID NO: 1173916 - protein, 9 aa, Homo Sapiens
GVVLLCGPS

SEQ ID NO: 1173917 - protein, 9 aa, Homo Sapiens
EHDAVCNAL

SEQ ID NO: 1173918 - protein, 9 aa, Homo Sapiens
ELSTGPPAE

SEQ ID NO: 1173919 - protein, 9 aa, Homo Sapiens
HRSPGHGGR

SEQ ID NO: 1173920 - protein, 9 aa, Homo Sapiens
NYQFFIDTD

SEQ ID NO: 1173921 - protein, 9 aa, Homo Sapiens
EGFYSIQIF

SEQ ID NO: 1173922 - protein, 9 aa, Homo Sapiens
TMTKQLGAH

SEQ ID NO: 1173923 - protein, 9 aa, Homo Sapiens
IVSMRYFLV

SEQ ID NO: 1173924 - protein, 9 aa, Homo Sapiens
PFGTMPSRC

SEQ ID NO: 1173925 - protein, 9 aa, Homo Sapiens
RTVTVPRNC

SEQ ID NO: 1173926 - protein, 9 aa, Homo Sapiens
ARVGQRAEA

SEQ ID NO: 1173927 - protein, 9 aa, Homo Sapiens
AAHKVCPVL

SEQ ID NO: 1173928 - protein, 9 aa, Homo Sapiens
SKSQQSISA

SEQ ID NO: 1173929 - protein, 9 aa, Homo Sapiens
LVQASGGPW

SEQ ID NO: 1173930 - protein, 9 aa, Homo Sapiens
GAARGLQVP

SEQ ID NO: 1173931 - protein, 9 aa, Homo Sapiens
AGTNYTLRY

SEQ ID NO: 1173932 - protein, 9 aa, Homo Sapiens
SVFMGLRMR

SEQ ID NO: 1173933 - protein, 9 aa, Homo Sapiens
IPRRDPRPG

SEQ ID NO: 1173934 - protein, 8 aa, Homo Sapiens
KGFTATLF

SEQ ID NO: 1173935 - protein, 9 aa, Homo Sapiens
RSGPAAAPR

SEQ ID NO: 1173936 - protein, 9 aa, Homo Sapiens
TLEVLAIPQ

SEQ ID NO: 1173937 - protein, 9 aa, Homo Sapiens
LEQMLHSCR

SEQ ID NO: 1173938 - protein, 9 aa, Homo Sapiens
LKKELTENI

SEQ ID NO: 1173939 - protein, 9 aa, Homo Sapiens
RSRTGAAGT

SEQ ID NO: 1173940 - protein, 9 aa, Homo Sapiens
AVLAVDVGD

SEQ ID NO: 1173941 - protein, 9 aa, Homo Sapiens
DHSNLARKV

SEQ ID NO: 1173942 - protein, 9 aa, Homo Sapiens
PPPRSWGCT

SEQ ID NO: 1173943 - protein, 9 aa, Homo Sapiens
YCSLGVQGS

SEQ ID NO: 1173944 - protein, 9 aa, Homo Sapiens
SLPTRPRLL

SEQ ID NO: 1173945 - protein, 9 aa, Homo Sapiens
LRLCNFRNA

SEQ ID NO: 1173946 - protein, 9 aa, Homo Sapiens
GLTVASSLP

SEQ ID NO: 1173947 - protein, 9 aa, Homo Sapiens
WDPPRSCRQ

SEQ ID NO: 1173948 - protein, 9 aa, Homo Sapiens
ETPPRETDP

SEQ ID NO: 1173949 - protein, 9 aa, Homo Sapiens
FDNLTSSYK

SEQ ID NO: 1173950 - protein, 9 aa, Homo Sapiens
ASSSPRSMS

SEQ ID NO: 1173951 - protein, 9 aa, Homo Sapiens
YHKCKIPLL

SEQ ID NO: 1173952 - protein, 9 aa, Homo Sapiens
STSSSLLLL

SEQ ID NO: 1173953 - protein, 9 aa, Homo Sapiens
LWMPSTKIR

SEQ ID NO: 1173954 - protein, 9 aa, Homo Sapiens
KGFPDRKDI

SEQ ID NO: 1173955 - protein, 9 aa, Homo Sapiens
TAGRLESSL

SEQ ID NO: 1173956 - protein, 9 aa, Homo Sapiens
DAVVASSSG

SEQ ID NO: 1173957 - protein, 9 aa, Homo Sapiens
LGGPCPQTP

SEQ ID NO: 1173958 - protein, 9 aa, Homo Sapiens
LNVNKWTET

SEQ ID NO: 1173959 - protein, 9 aa, Homo Sapiens
GSCVDSAVT

SEQ ID NO: 1173960 - protein, 9 aa, Homo Sapiens
RAPVRAWRT

SEQ ID NO: 1173961 - protein, 9 aa, Homo Sapiens
PLRLWSWCG

SEQ ID NO: 1173962 - protein, 9 aa, Homo Sapiens
PLSEAKNQL

SEQ ID NO: 1173963 - protein, 9 aa, Homo Sapiens
CALRMSPPA

SEQ ID NO: 1173964 - protein, 9 aa, Homo Sapiens
DASDGHGSC

SEQ ID NO: 1173965 - protein, 9 aa, Homo Sapiens
EETIATQIL

SEQ ID NO: 1173966 - protein, 9 aa, Homo Sapiens
IILEKNPPL

SEQ ID NO: 1173967 - protein, 9 aa, Homo Sapiens
CAGALMLAG

SEQ ID NO: 1173968 - protein, 9 aa, Homo Sapiens
DHMDGLAIR

SEQ ID NO: 1173969 - protein, 9 aa, Homo Sapiens
LTLQESPTC

SEQ ID NO: 1173970 - protein, 9 aa, Homo Sapiens
EGLMVTRGR

SEQ ID NO: 1173971 - protein, 9 aa, Homo Sapiens
AFSDAAFNH

SEQ ID NO: 1173972 - protein, 9 aa, Homo Sapiens
PPPDKRRNT

SEQ ID NO: 1173973 - protein, 9 aa, Homo Sapiens
WALQGAVHI

SEQ ID NO: 1173974 - protein, 9 aa, Homo Sapiens
DQDINTTKA

SEQ ID NO: 1173975 - protein, 9 aa, Homo Sapiens
KVLIMHGDL

SEQ ID NO: 1173976 - protein, 9 aa, Homo Sapiens
LLKKFHIPV

SEQ ID NO: 1173977 - protein, 9 aa, Homo Sapiens
LTTMKKVAD

SEQ ID NO: 1173978 - protein, 9 aa, Homo Sapiens
KCDNGCCIE

SEQ ID NO: 1173979 - protein, 9 aa, Homo Sapiens
CRLEEEYED

SEQ ID NO: 1173980 - protein, 9 aa, Homo Sapiens
KLTGDCGKI

SEQ ID NO: 1173981 - protein, 9 aa, Homo Sapiens
IIHRSTTSQ

SEQ ID NO: 1173982 - protein, 9 aa, Homo Sapiens
GLWAWKAGT

SEQ ID NO: 1173983 - protein, 9 aa, Homo Sapiens
PCGGRPSGF

SEQ ID NO: 1173984 - protein, 9 aa, Homo Sapiens
LEKLPPVLM

SEQ ID NO: 1173985 - protein, 9 aa, Homo Sapiens
RKCGAEILP

SEQ ID NO: 1173986 - protein, 9 aa, Homo Sapiens
VQLLHEQIG

SEQ ID NO: 1173987 - protein, 9 aa, Homo Sapiens
EFQLNHMLP

SEQ ID NO: 1173988 - protein, 9 aa, Homo Sapiens
TGVREDEPA

SEQ ID NO: 1173989 - protein, 9 aa, Homo Sapiens
PDALWTEAR

SEQ ID NO: 1173990 - protein, 9 aa, Homo Sapiens
IVWMCTAAL

SEQ ID NO: 1173991 - protein, 9 aa, Homo Sapiens
QHHDTVSGT

SEQ ID NO: 1173992 - protein, 9 aa, Homo Sapiens
VYDAYVTEN

SEQ ID NO: 1173993 - protein, 9 aa, Homo Sapiens
VGLLGCSSH

SEQ ID NO: 1173994 - protein, 9 aa, Homo Sapiens
LPPEPGDPD

SEQ ID NO: 1173995 - protein, 9 aa, Homo Sapiens
PSHCQLCSP

SEQ ID NO: 1173996 - protein, 9 aa, Homo Sapiens
PAMAISPTG

SEQ ID NO: 1173997 - protein, 9 aa, Homo Sapiens
SPSSHGAPQ

SEQ ID NO: 1173998 - protein, 9 aa, Homo Sapiens
VSPTSGHDR

SEQ ID NO: 1173999 - protein, 9 aa, Homo Sapiens
EREHHSCTP

SEQ ID NO: 1174000 - protein, 9 aa, Homo Sapiens
RRARFSPRP

SEQ ID NO: 1174001 - protein, 9 aa, Homo Sapiens
DHIQVSRGV

SEQ ID NO: 1174002 - protein, 9 aa, Homo Sapiens
RPPPHTHPL

SEQ ID NO: 1174003 - protein, 9 aa, Homo Sapiens
EEKPHMPME

SEQ ID NO: 1174004 - protein, 9 aa, Homo Sapiens
ALGHTWAYR

SEQ ID NO: 1174005 - protein, 9 aa, Homo Sapiens
APCSWPSWG

SEQ ID NO: 1174006 - protein, 9 aa, Homo Sapiens
TQSGQVLRT

SEQ ID NO: 1174007 - protein, 9 aa, Homo Sapiens
GGILAYELL

SEQ ID NO: 1174008 - protein, 9 aa, Homo Sapiens
ATAESHLFY

SEQ ID NO: 1174009 - protein, 9 aa, Homo Sapiens
STGERTCTM

SEQ ID NO: 1174010 - protein, 9 aa, Homo Sapiens
FLSSPKEAM

SEQ ID NO: 1174011 - protein, 9 aa, Homo Sapiens
PAPPPPGPA

SEQ ID NO: 1174012 - protein, 9 aa, Homo Sapiens
WPPGSGSLL

SEQ ID NO: 1174013 - protein, 9 aa, Homo Sapiens
PSPTWRTTS

SEQ ID NO: 1174014 - protein, 9 aa, Homo Sapiens
PIKKQVYLL

SEQ ID NO: 1174015 - protein, 9 aa, Homo Sapiens
LQERGGASL

SEQ ID NO: 1174016 - protein, 9 aa, Homo Sapiens
SSRLGWASG

SEQ ID NO: 1174017 - protein, 9 aa, Homo Sapiens
ECDYVSTHL

SEQ ID NO: 1174018 - protein, 9 aa, Homo Sapiens
EEAQEAQGI

SEQ ID NO: 1174019 - protein, 9 aa, Homo Sapiens
PQASHSHSG

SEQ ID NO: 1174020 - protein, 9 aa, Homo Sapiens
TIQRWLKGQ

SEQ ID NO: 1174021 - protein, 9 aa, Homo Sapiens
TVEGAKRRD

SEQ ID NO: 1174022 - protein, 9 aa, Homo Sapiens
LLTRPPPAP

SEQ ID NO: 1174023 - protein, 9 aa, Homo Sapiens
SSFWSLSST

SEQ ID NO: 1174024 - protein, 9 aa, Homo Sapiens
TFTRALRPT

SEQ ID NO: 1174025 - protein, 9 aa, Homo Sapiens
PPWREAWRR

SEQ ID NO: 1174026 - protein, 9 aa, Homo Sapiens
PADGQGAAG

SEQ ID NO: 1174027 - protein, 9 aa, Homo Sapiens
QVSASDAGV

SEQ ID NO: 1174028 - protein, 9 aa, Homo Sapiens
CEDGCRLEN

SEQ ID NO: 1174029 - protein, 9 aa, Homo Sapiens
GIMDKTVRF

SEQ ID NO: 1174030 - protein, 9 aa, Homo Sapiens
DTTDVNDAL

SEQ ID NO: 1174031 - protein, 9 aa, Homo Sapiens
RDSFKNQLV

SEQ ID NO: 1174032 - protein, 9 aa, Homo Sapiens
GRLQGWQNC

SEQ ID NO: 1174033 - protein, 9 aa, Homo Sapiens
CCPSGKSAC

SEQ ID NO: 1174034 - protein, 9 aa, Homo Sapiens
TAKLDEKTQ

SEQ ID NO: 1174035 - protein, 9 aa, Homo Sapiens
DFEDIIKND

SEQ ID NO: 1174036 - protein, 9 aa, Homo Sapiens
RCRMTSWRP

SEQ ID NO: 1174037 - protein, 9 aa, Homo Sapiens
EKRGLGTAA

SEQ ID NO: 1174038 - protein, 9 aa, Homo Sapiens
FTNAVIQER

SEQ ID NO: 1174039 - protein, 9 aa, Homo Sapiens
PPRHPPPHP

SEQ ID NO: 1174040 - protein, 9 aa, Homo Sapiens
KGIFTTSKT

SEQ ID NO: 1174041 - protein, 9 aa, Homo Sapiens
SSRQMWDLD

SEQ ID NO: 1174042 - protein, 9 aa, Homo Sapiens
FVPFLTRNY

SEQ ID NO: 1174043 - protein, 9 aa, Homo Sapiens
THCTFVDQM

SEQ ID NO: 1174044 - protein, 9 aa, Homo Sapiens
YEKREELRK

SEQ ID NO: 1174045 - protein, 9 aa, Homo Sapiens
HCCVKIYTF

SEQ ID NO: 1174046 - protein, 9 aa, Homo Sapiens
PCGRRPSGF

SEQ ID NO: 1174047 - protein, 9 aa, Homo Sapiens
LELDAPEGK

SEQ ID NO: 1174048 - protein, 9 aa, Homo Sapiens
YCSMQRTRE

SEQ ID NO: 1174049 - protein, 9 aa, Homo Sapiens
GGFDDLDYG

SEQ ID NO: 1174050 - protein, 9 aa, Homo Sapiens
APVGSVMSC

SEQ ID NO: 1174051 - protein, 9 aa, Homo Sapiens
MTQEFLEYH

SEQ ID NO: 1174052 - protein, 9 aa, Homo Sapiens
HYKLFQDEP

SEQ ID NO: 1174053 - protein, 9 aa, Homo Sapiens
EKESPGAPR

SEQ ID NO: 1174054 - protein, 9 aa, Homo Sapiens
VAPPPQPGN

SEQ ID NO: 1174055 - protein, 9 aa, Homo Sapiens
RGNRRRFRI

SEQ ID NO: 1174056 - protein, 9 aa, Homo Sapiens
AVKVGTIQR

SEQ ID NO: 1174057 - protein, 9 aa, Homo Sapiens
GPLYSDGAW

SEQ ID NO: 1174058 - protein, 9 aa, Homo Sapiens
PGLYFFSPN

SEQ ID NO: 1174059 - protein, 9 aa, Homo Sapiens
DAAGRGRAS

SEQ ID NO: 1174060 - protein, 9 aa, Homo Sapiens
AAAREEPSS

SEQ ID NO: 1174061 - protein, 9 aa, Homo Sapiens
SVVRGGVRK

SEQ ID NO: 1174062 - protein, 9 aa, Homo Sapiens
LDRHRTLNI

SEQ ID NO: 1174063 - protein, 9 aa, Homo Sapiens
RSGQVRGPP

SEQ ID NO: 1174064 - protein, 9 aa, Homo Sapiens
KSLSDSTML

SEQ ID NO: 1174065 - protein, 9 aa, Homo Sapiens
VSQSQAAPS

SEQ ID NO: 1174066 - protein, 9 aa, Homo Sapiens
VRDGGSPSL

SEQ ID NO: 1174067 - protein, 9 aa, Homo Sapiens
LEAGLEHVH

SEQ ID NO: 1174068 - protein, 9 aa, Homo Sapiens
CFYFVELPT

SEQ ID NO: 1174069 - protein, 9 aa, Homo Sapiens
RLELTVVVL

SEQ ID NO: 1174070 - protein, 9 aa, Homo Sapiens
SEKVVDAWK

SEQ ID NO: 1174071 - protein, 9 aa, Homo Sapiens
GKMNQQLNR

SEQ ID NO: 1174072 - protein, 9 aa, Homo Sapiens
LASSPLTTS

SEQ ID NO: 1174073 - protein, 9 aa, Homo Sapiens
CLVVHVASC

SEQ ID NO: 1174074 - protein, 9 aa, Homo Sapiens
GNSNSSSSC

SEQ ID NO: 1174075 - protein, 9 aa, Homo Sapiens
RIPVATGLR

SEQ ID NO: 1174076 - protein, 9 aa, Homo Sapiens
FTKIWRWHL

SEQ ID NO: 1174077 - protein, 9 aa, Homo Sapiens
IRAMKVRGV

SEQ ID NO: 1174078 - protein, 9 aa, Homo Sapiens
LQDMARPPK

SEQ ID NO: 1174079 - protein, 9 aa, Homo Sapiens
KAKDTSTIK

SEQ ID NO: 1174080 - protein, 9 aa, Homo Sapiens
AGPSALPSP

SEQ ID NO: 1174081 - protein, 9 aa, Homo Sapiens
RSPHRRTRS

SEQ ID NO: 1174082 - protein, 9 aa, Homo Sapiens
ASSSGNTRT

SEQ ID NO: 1174083 - protein, 9 aa, Homo Sapiens
TSRRSLMSV

SEQ ID NO: 1174084 - protein, 9 aa, Homo Sapiens
ENYCRNPGD

SEQ ID NO: 1174085 - protein, 9 aa, Homo Sapiens
SPSDMLRDS

SEQ ID NO: 1174086 - protein, 9 aa, Homo Sapiens
TMDDPDIVG

SEQ ID NO: 1174087 - protein, 9 aa, Homo Sapiens
HPAPPTRDA

SEQ ID NO: 1174088 - protein, 9 aa, Homo Sapiens
DINTTKADV

SEQ ID NO: 1174089 - protein, 9 aa, Homo Sapiens
SHETETKEP

SEQ ID NO: 1174090 - protein, 9 aa, Homo Sapiens
ATSASTQAR

SEQ ID NO: 1174091 - protein, 9 aa, Homo Sapiens
CRPWLEQML

SEQ ID NO: 1174092 - protein, 9 aa, Homo Sapiens
QPPRRPPPA

SEQ ID NO: 1174093 - protein, 9 aa, Homo Sapiens
AQIRLPTAI

SEQ ID NO: 1174094 - protein, 9 aa, Homo Sapiens
PGRIKWKVA

SEQ ID NO: 1174095 - protein, 9 aa, Homo Sapiens
YFWPQLEGP

SEQ ID NO: 1174096 - protein, 9 aa, Homo Sapiens
GRRPRPQLG

SEQ ID NO: 1174097 - protein, 9 aa, Homo Sapiens
RQLRVPDTH

SEQ ID NO: 1174098 - protein, 9 aa, Homo Sapiens
NGGSGRRLG

SEQ ID NO: 1174099 - protein, 9 aa, Homo Sapiens
CSPCSPTTP

SEQ ID NO: 1174100 - protein, 9 aa, Homo Sapiens
SLNQQGTHS

SEQ ID NO: 1174101 - protein, 9 aa, Homo Sapiens
QICLQWIIQ

SEQ ID NO: 1174102 - protein, 9 aa, Homo Sapiens
LKFHTSCPE

SEQ ID NO: 1174103 - protein, 9 aa, Homo Sapiens
ANDADPSLD

SEQ ID NO: 1174104 - protein, 9 aa, Homo Sapiens
LARPLSAAG

SEQ ID NO: 1174105 - protein, 9 aa, Homo Sapiens
TSPPVSVWD

SEQ ID NO: 1174106 - protein, 9 aa, Homo Sapiens
VPTSFGDAI

SEQ ID NO: 1174107 - protein, 9 aa, Homo Sapiens
PEFIEGGRP

SEQ ID NO: 1174108 - protein, 9 aa, Homo Sapiens
YFLVKRPSL

SEQ ID NO: 1174109 - protein, 9 aa, Homo Sapiens
RMSSPRRAP

SEQ ID NO: 1174110 - protein, 9 aa, Homo Sapiens
LCTGYFKNV

SEQ ID NO: 1174111 - protein, 9 aa, Homo Sapiens
PMVRQAAAS

SEQ ID NO: 1174112 - protein, 9 aa, Homo Sapiens
SCFLPVFSN

SEQ ID NO: 1174113 - protein, 9 aa, Homo Sapiens
RITYSHSPP

SEQ ID NO: 1174114 - protein, 9 aa, Homo Sapiens
MIHILLCLK

SEQ ID NO: 1174115 - protein, 9 aa, Homo Sapiens
LKWLQLKTT

SEQ ID NO: 1174116 - protein, 9 aa, Homo Sapiens
LSHCSWQPL

SEQ ID NO: 1174117 - protein, 9 aa, Homo Sapiens
LSPLLSPHF

SEQ ID NO: 1174118 - protein, 9 aa, Homo Sapiens
ALGYSIQQR

SEQ ID NO: 1174119 - protein, 9 aa, Homo Sapiens
CHRHCCDIY

SEQ ID NO: 1174120 - protein, 9 aa, Homo Sapiens
DTWQTRLST

SEQ ID NO: 1174121 - protein, 9 aa, Homo Sapiens
GKGPGVSRS

SEQ ID NO: 1174122 - protein, 9 aa, Homo Sapiens
SEGAGRHSP

SEQ ID NO: 1174123 - protein, 9 aa, Homo Sapiens
TSCSWAARV

SEQ ID NO: 1174124 - protein, 9 aa, Homo Sapiens
PECEWHKNG

SEQ ID NO: 1174125 - protein, 9 aa, Homo Sapiens
SKNIIRLSI

SEQ ID NO: 1174126 - protein, 9 aa, Homo Sapiens
SGALMALGG

SEQ ID NO: 1174127 - protein, 9 aa, Homo Sapiens
IRTGPSLSR

SEQ ID NO: 1174128 - protein, 9 aa, Homo Sapiens
TMRTLPPGT

SEQ ID NO: 1174129 - protein, 9 aa, Homo Sapiens
SSGDPPVNY

SEQ ID NO: 1174130 - protein, 9 aa, Homo Sapiens
PSLQGAPTI

SEQ ID NO: 1174131 - protein, 9 aa, Homo Sapiens
RRREGDAPF

SEQ ID NO: 1174132 - protein, 9 aa, Homo Sapiens
VGARAPWPS

SEQ ID NO: 1174133 - protein, 9 aa, Homo Sapiens
CSPAINSTG

SEQ ID NO: 1174134 - protein, 9 aa, Homo Sapiens
LPDVGQQPN

SEQ ID NO: 1174135 - protein, 9 aa, Homo Sapiens
IDTDWQGGI

SEQ ID NO: 1174136 - protein, 9 aa, Homo Sapiens
LVEEGNGRA

SEQ ID NO: 1174137 - protein, 9 aa, Homo Sapiens
AGVIERVLR

SEQ ID NO: 1174138 - protein, 9 aa, Homo Sapiens
IDMDDFAGK

SEQ ID NO: 1174139 - protein, 9 aa, Homo Sapiens
PPSRVEASV

SEQ ID NO: 1174140 - protein, 9 aa, Homo Sapiens
LVATSPPAT

SEQ ID NO: 1174141 - protein, 9 aa, Homo Sapiens
AAGAQDGQM

SEQ ID NO: 1174142 - protein, 9 aa, Homo Sapiens
FEEIIGKVE

SEQ ID NO: 1174143 - protein, 9 aa, Homo Sapiens
RWCLGRCCC

SEQ ID NO: 1174144 - protein, 9 aa, Homo Sapiens
DLFSEDGVT

SEQ ID NO: 1174145 - protein, 9 aa, Homo Sapiens
RPPEPLEPP

SEQ ID NO: 1174146 - protein, 9 aa, Homo Sapiens
VPNPCRSSW

SEQ ID NO: 1174147 - protein, 9 aa, Homo Sapiens
TCARLWMAN

SEQ ID NO: 1174148 - protein, 9 aa, Homo Sapiens
AKPSSVTWS

SEQ ID NO: 1174149 - protein, 9 aa, Homo Sapiens
GSKDAGCAI

SEQ ID NO: 1174150 - protein, 9 aa, Homo Sapiens
LDLAGQELT

SEQ ID NO: 1174151 - protein, 9 aa, Homo Sapiens
NSPVGVKHR

SEQ ID NO: 1174152 - protein, 9 aa, Homo Sapiens
KRTRTRITD

SEQ ID NO: 1174153 - protein, 9 aa, Homo Sapiens
SSISTFLLL

SEQ ID NO: 1174154 - protein, 9 aa, Homo Sapiens
CWGWHWEGW

SEQ ID NO: 1174155 - protein, 9 aa, Homo Sapiens
PSGFPGRGG

SEQ ID NO: 1174156 - protein, 9 aa, Homo Sapiens
APAAALSPA

SEQ ID NO: 1174157 - protein, 9 aa, Homo Sapiens
PTASQCLTS

SEQ ID NO: 1174158 - protein, 9 aa, Homo Sapiens
QGAWCFSCS

SEQ ID NO: 1174159 - protein, 9 aa, Homo Sapiens
TALSCCDPQ

SEQ ID NO: 1174160 - protein, 9 aa, Homo Sapiens
WAKMHRLWK

SEQ ID NO: 1174161 - protein, 9 aa, Homo Sapiens
LSLRVGSGY

SEQ ID NO: 1174162 - protein, 9 aa, Homo Sapiens
VPPEDAERS

SEQ ID NO: 1174163 - protein, 9 aa, Homo Sapiens
ILLLGVPCL

SEQ ID NO: 1174164 - protein, 9 aa, Homo Sapiens
RPPPAPPRR

SEQ ID NO: 1174165 - protein, 9 aa, Homo Sapiens
KSPGLAFSL

SEQ ID NO: 1174166 - protein, 9 aa, Homo Sapiens
GSAPGCWPF

SEQ ID NO: 1174167 - protein, 9 aa, Homo Sapiens
LAINVHDLK

SEQ ID NO: 1174168 - protein, 9 aa, Homo Sapiens
DSWLCLKCG

SEQ ID NO: 1174169 - protein, 9 aa, Homo Sapiens
QGTHSALSS

SEQ ID NO: 1174170 - protein, 9 aa, Homo Sapiens
LAHVCGSSC

SEQ ID NO: 1174171 - protein, 9 aa, Homo Sapiens
PSFIPTTTL

SEQ ID NO: 1174172 - protein, 9 aa, Homo Sapiens
GSSSGATGT

SEQ ID NO: 1174173 - protein, 9 aa, Homo Sapiens
PRGASTRGS

SEQ ID NO: 1174174 - protein, 9 aa, Homo Sapiens
FMVSWPSRL

SEQ ID NO: 1174175 - protein, 9 aa, Homo Sapiens
DALWGLLPV

SEQ ID NO: 1174176 - protein, 9 aa, Homo Sapiens
RDPVSEITG

SEQ ID NO: 1174177 - protein, 9 aa, Homo Sapiens
QKKTATKIY

SEQ ID NO: 1174178 - protein, 9 aa, Homo Sapiens
PRGPEQTHE

SEQ ID NO: 1174179 - protein, 9 aa, Homo Sapiens
EAGGPVRLE

SEQ ID NO: 1174180 - protein, 9 aa, Homo Sapiens
TTTSPSRCC

SEQ ID NO: 1174181 - protein, 9 aa, Homo Sapiens
VPTASQCLT

SEQ ID NO: 1174182 - protein, 9 aa, Homo Sapiens
GGSGRRLGG

SEQ ID NO: 1174183 - protein, 9 aa, Homo Sapiens
EQLQALQER

SEQ ID NO: 1174184 - protein, 9 aa, Homo Sapiens
CLPTLDYLR

SEQ ID NO: 1174185 - protein, 9 aa, Homo Sapiens
PQEEEVKTK

SEQ ID NO: 1174186 - protein, 9 aa, Homo Sapiens
GSRMFWYSM

SEQ ID NO: 1174187 - protein, 9 aa, Homo Sapiens
TRACNLCTC

SEQ ID NO: 1174188 - protein, 9 aa, Homo Sapiens
DLAGQELTD

SEQ ID NO: 1174189 - protein, 9 aa, Homo Sapiens
SGRSRPSWP

SEQ ID NO: 1174190 - protein, 9 aa, Homo Sapiens
SVGLCSCSP

SEQ ID NO: 1174191 - protein, 9 aa, Homo Sapiens
QVSRGVGSK

SEQ ID NO: 1174192 - protein, 9 aa, Homo Sapiens
LPISGSPMT

SEQ ID NO: 1174193 - protein, 9 aa, Homo Sapiens
GTVTPPPGW

SEQ ID NO: 1174194 - protein, 9 aa, Homo Sapiens
VSHLEEKQG

SEQ ID NO: 1174195 - protein, 9 aa, Homo Sapiens
KEDFNNVPD

SEQ ID NO: 1174196 - protein, 9 aa, Homo Sapiens
APANDADPS

SEQ ID NO: 1174197 - protein, 9 aa, Homo Sapiens
AARHSGRGP

SEQ ID NO: 1174198 - protein, 9 aa, Homo Sapiens
SGYRFWTMP

SEQ ID NO: 1174199 - protein, 9 aa, Homo Sapiens
FSPIPVAEI

SEQ ID NO: 1174200 - protein, 9 aa, Homo Sapiens
VIPATMSAI

SEQ ID NO: 1174201 - protein, 9 aa, Homo Sapiens
AVMQSGGIL

SEQ ID NO: 1174202 - protein, 9 aa, Homo Sapiens
MYSFLQQCK

SEQ ID NO: 1174203 - protein, 9 aa, Homo Sapiens
RDISNSSNW

SEQ ID NO: 1174204 - protein, 9 aa, Homo Sapiens
LQGWQNCVW

SEQ ID NO: 1174205 - protein, 9 aa, Homo Sapiens
GTWGGTPRD

SEQ ID NO: 1174206 - protein, 9 aa, Homo Sapiens
ADSGHYQLR

SEQ ID NO: 1174207 - protein, 9 aa, Homo Sapiens
STSTPTFLA

SEQ ID NO: 1174208 - protein, 9 aa, Homo Sapiens
SLRCLGLWC

SEQ ID NO: 1174209 - protein, 9 aa, Homo Sapiens
VIDYFQNRT

SEQ ID NO: 1174210 - protein, 9 aa, Homo Sapiens
AAEADAQAA

SEQ ID NO: 1174211 - protein, 9 aa, Homo Sapiens
STGQTATSP

SEQ ID NO: 1174212 - protein, 9 aa, Homo Sapiens
AGLLFRMLM

SEQ ID NO: 1174213 - protein, 9 aa, Homo Sapiens
DSDTYGTSR

SEQ ID NO: 1174214 - protein, 9 aa, Homo Sapiens
ADIRFVWEN

SEQ ID NO: 1174215 - protein, 9 aa, Homo Sapiens
RSLPGTTRM

SEQ ID NO: 1174216 - protein, 9 aa, Homo Sapiens
FFCGAANCA

SEQ ID NO: 1174217 - protein, 9 aa, Homo Sapiens
CMSMKEVDE

SEQ ID NO: 1174218 - protein, 9 aa, Homo Sapiens
IGVCGQFIP

SEQ ID NO: 1174219 - protein, 9 aa, Homo Sapiens
PPSAGALKP

SEQ ID NO: 1174220 - protein, 9 aa, Homo Sapiens
APQCPSCMP

SEQ ID NO: 1174221 - protein, 9 aa, Homo Sapiens
SALQVLLPE

SEQ ID NO: 1174222 - protein, 9 aa, Homo Sapiens
GAVHIVCPH

SEQ ID NO: 1174223 - protein, 9 aa, Homo Sapiens
PANDADPSL

SEQ ID NO: 1174224 - protein, 9 aa, Homo Sapiens
LAGWPGLWP

SEQ ID NO: 1174225 - protein, 9 aa, Homo Sapiens
SDTRPFACE

SEQ ID NO: 1174226 - protein, 9 aa, Homo Sapiens
MQEQLQKLK

SEQ ID NO: 1174227 - protein, 9 aa, Homo Sapiens
DRMFLRVLI

SEQ ID NO: 1174228 - protein, 9 aa, Homo Sapiens
ETCPVEKKI

SEQ ID NO: 1174229 - protein, 9 aa, Homo Sapiens
PHPSARSLS

SEQ ID NO: 1174230 - protein, 9 aa, Homo Sapiens
VAAGAMAGV

SEQ ID NO: 1174231 - protein, 9 aa, Homo Sapiens
TRSLPSISR

SEQ ID NO: 1174232 - protein, 9 aa, Homo Sapiens
TKEEMERFW

SEQ ID NO: 1174233 - protein, 9 aa, Homo Sapiens
VLRREVYTS

SEQ ID NO: 1174234 - protein, 9 aa, Homo Sapiens
TGQRNPYAD

SEQ ID NO: 1174235 - protein, 9 aa, Homo Sapiens
QRAPRSLHA

SEQ ID NO: 1174236 - protein, 9 aa, Homo Sapiens
GYPHHCPRH

SEQ ID NO: 1174237 - protein, 9 aa, Homo Sapiens
DAWKSTWHV

SEQ ID NO: 1174238 - protein, 9 aa, Homo Sapiens
LRLSRGGAP

SEQ ID NO: 1174239 - protein, 9 aa, Homo Sapiens
SPCNRSSSL

SEQ ID NO: 1174240 - protein, 9 aa, Homo Sapiens
TPKQVDTWQ

SEQ ID NO: 1174241 - protein, 9 aa, Homo Sapiens
SSRESEHNL

SEQ ID NO: 1174242 - protein, 9 aa, Homo Sapiens
GQATPLPVA

SEQ ID NO: 1174243 - protein, 9 aa, Homo Sapiens
AVADLTFVA

SEQ ID NO: 1174244 - protein, 9 aa, Homo Sapiens
QAAALTTGE

SEQ ID NO: 1174245 - protein, 9 aa, Homo Sapiens
ENEQEKKCR

SEQ ID NO: 1174246 - protein, 9 aa, Homo Sapiens
NFDIRFETF

SEQ ID NO: 1174247 - protein, 9 aa, Homo Sapiens
EPPPPPPQP

SEQ ID NO: 1174248 - protein, 9 aa, Homo Sapiens
QQLLPPTST

SEQ ID NO: 1174249 - protein, 9 aa, Homo Sapiens
AWHPGSWPV

SEQ ID NO: 1174250 - protein, 9 aa, Homo Sapiens
FGDFLGREC

SEQ ID NO: 1174251 - protein, 9 aa, Homo Sapiens
SQAKYAGSQ

SEQ ID NO: 1174252 - protein, 9 aa, Homo Sapiens
PRRGLLLGH

SEQ ID NO: 1174253 - protein, 9 aa, Homo Sapiens
DGVDASEPM

SEQ ID NO: 1174254 - protein, 9 aa, Homo Sapiens
IQIAIIDFL

SEQ ID NO: 1174255 - protein, 9 aa, Homo Sapiens
ASRESPSSH

SEQ ID NO: 1174256 - protein, 9 aa, Homo Sapiens
AQNNVVWAL

SEQ ID NO: 1174257 - protein, 9 aa, Homo Sapiens
RWKLLLFKT

SEQ ID NO: 1174258 - protein, 9 aa, Homo Sapiens
ALHAHRVPG

SEQ ID NO: 1174259 - protein, 9 aa, Homo Sapiens
CVDVLSSDG

SEQ ID NO: 1174260 - protein, 9 aa, Homo Sapiens
RESTQEKNL

SEQ ID NO: 1174261 - protein, 9 aa, Homo Sapiens
RPPKQWLYK

SEQ ID NO: 1174262 - protein, 9 aa, Homo Sapiens
TGPATTAPE

SEQ ID NO: 1174263 - protein, 9 aa, Homo Sapiens
PTGTDHIRS

SEQ ID NO: 1174264 - protein, 9 aa, Homo Sapiens
VLDDSERMA

SEQ ID NO: 1174265 - protein, 9 aa, Homo Sapiens
LDDRSPQAP

SEQ ID NO: 1174266 - protein, 9 aa, Homo Sapiens
LLKEKMMQL

SEQ ID NO: 1174267 - protein, 9 aa, Homo Sapiens
IGQRPVQRE

SEQ ID NO: 1174268 - protein, 9 aa, Homo Sapiens
KEPEVVFLG

SEQ ID NO: 1174269 - protein, 9 aa, Homo Sapiens
GSSGGGAAS

SEQ ID NO: 1174270 - protein, 9 aa, Homo Sapiens
YPLCSTTCT

SEQ ID NO: 1174271 - protein, 9 aa, Homo Sapiens
TRSPNSTTW

SEQ ID NO: 1174272 - protein, 9 aa, Homo Sapiens
ALPDARVAG

SEQ ID NO: 1174273 - protein, 9 aa, Homo Sapiens
GKSVVSDVP

SEQ ID NO: 1174274 - protein, 9 aa, Homo Sapiens
LMLHLKRFV

SEQ ID NO: 1174275 - protein, 9 aa, Homo Sapiens
LTEKKTQSL

SEQ ID NO: 1174276 - protein, 9 aa, Homo Sapiens
LQGACEQQK

SEQ ID NO: 1174277 - protein, 9 aa, Homo Sapiens
EEGCEDEDE

SEQ ID NO: 1174278 - protein, 9 aa, Homo Sapiens
SGRITYSHS

SEQ ID NO: 1174279 - protein, 9 aa, Homo Sapiens
KEQRFGVRK

SEQ ID NO: 1174280 - protein, 9 aa, Homo Sapiens
YLELLVQAV

SEQ ID NO: 1174281 - protein, 9 aa, Homo Sapiens
MTYLREKHK

SEQ ID NO: 1174282 - protein, 9 aa, Homo Sapiens
VAISMTTLP

SEQ ID NO: 1174283 - protein, 9 aa, Homo Sapiens
GLEHVHLAL

SEQ ID NO: 1174284 - protein, 9 aa, Homo Sapiens
GGNFAQQRY

SEQ ID NO: 1174285 - protein, 9 aa, Homo Sapiens
DDDRFLVGR

SEQ ID NO: 1174286 - protein, 9 aa, Homo Sapiens
WSAAPTSCS

SEQ ID NO: 1174287 - protein, 9 aa, Homo Sapiens
TACGAASPP

SEQ ID NO: 1174288 - protein, 9 aa, Homo Sapiens
PATATWRMR

SEQ ID NO: 1174289 - protein, 9 aa, Homo Sapiens
CAPRPPSAG

SEQ ID NO: 1174290 - protein, 9 aa, Homo Sapiens
RLRLSRGGA

SEQ ID NO: 1174291 - protein, 9 aa, Homo Sapiens
DVEGKSRGC

SEQ ID NO: 1174292 - protein, 9 aa, Homo Sapiens
ESAAAVQAG

SEQ ID NO: 1174293 - protein, 9 aa, Homo Sapiens
ARCPGCLRR

SEQ ID NO: 1174294 - protein, 9 aa, Homo Sapiens
GQSIRRFIT

SEQ ID NO: 1174295 - protein, 9 aa, Homo Sapiens
LRNHYIIRV

SEQ ID NO: 1174296 - protein, 9 aa, Homo Sapiens
DTISQVMPL

SEQ ID NO: 1174297 - protein, 9 aa, Homo Sapiens
RASQTRVPP

SEQ ID NO: 1174298 - protein, 9 aa, Homo Sapiens
GILWTIRLP

SEQ ID NO: 1174299 - protein, 9 aa, Homo Sapiens
RSLWTMSYR

SEQ ID NO: 1174300 - protein, 9 aa, Homo Sapiens
YKLFQDEPS

SEQ ID NO: 1174301 - protein, 9 aa, Homo Sapiens
LAITISLAI

SEQ ID NO: 1174302 - protein, 9 aa, Homo Sapiens
PPRSCRQTP

SEQ ID NO: 1174303 - protein, 9 aa, Homo Sapiens
SPPHPVLLS

SEQ ID NO: 1174304 - protein, 9 aa, Homo Sapiens
DSRANPRFC

SEQ ID NO: 1174305 - protein, 9 aa, Homo Sapiens
QKNIKENIQ

SEQ ID NO: 1174306 - protein, 9 aa, Homo Sapiens
VMSCSLLTQ

SEQ ID NO: 1174307 - protein, 9 aa, Homo Sapiens
LLPEDTPPS

SEQ ID NO: 1174308 - protein, 9 aa, Homo Sapiens
PTTGPATTA

SEQ ID NO: 1174309 - protein, 9 aa, Homo Sapiens
EWEKHGTCT

SEQ ID NO: 1174310 - protein, 9 aa, Homo Sapiens
NSGKAPSSG

SEQ ID NO: 1174311 - protein, 9 aa, Homo Sapiens
TELSRILWF

SEQ ID NO: 1174312 - protein, 9 aa, Homo Sapiens
KRKVEIAFY

SEQ ID NO: 1174313 - protein, 9 aa, Homo Sapiens
RPPTRELGA

SEQ ID NO: 1174314 - protein, 9 aa, Homo Sapiens
LEGTVEGAK

SEQ ID NO: 1174315 - protein, 9 aa, Homo Sapiens
FFLAAMADD

SEQ ID NO: 1174316 - protein, 9 aa, Homo Sapiens
SHSSMSGQG

SEQ ID NO: 1174317 - protein, 9 aa, Homo Sapiens
HGGGGGAGP

SEQ ID NO: 1174318 - protein, 9 aa, Homo Sapiens
EQLVESAYT

SEQ ID NO: 1174319 - protein, 9 aa, Homo Sapiens
VPPGRALHH

SEQ ID NO: 1174320 - protein, 9 aa, Homo Sapiens
PFAMPHSAM

SEQ ID NO: 1174321 - protein, 9 aa, Homo Sapiens
TVEDGHREI

SEQ ID NO: 1174322 - protein, 9 aa, Homo Sapiens
LRSLTVVTF

SEQ ID NO: 1174323 - protein, 9 aa, Homo Sapiens
EPASARRAG

SEQ ID NO: 1174324 - protein, 9 aa, Homo Sapiens
KKLKTFHMK

SEQ ID NO: 1174325 - protein, 9 aa, Homo Sapiens
NQRSNRSLP

SEQ ID NO: 1174326 - protein, 9 aa, Homo Sapiens
AEREHHSCT

SEQ ID NO: 1174327 - protein, 9 aa, Homo Sapiens
LLAAKQKKS

SEQ ID NO: 1174328 - protein, 9 aa, Homo Sapiens
SASISPVTK

SEQ ID NO: 1174329 - protein, 9 aa, Homo Sapiens
GGPAPPPTS

SEQ ID NO: 1174330 - protein, 9 aa, Homo Sapiens
VLTVKESNA

SEQ ID NO: 1174331 - protein, 9 aa, Homo Sapiens
LCPGSPPQG

SEQ ID NO: 1174332 - protein, 9 aa, Homo Sapiens
AHTPHMATM

SEQ ID NO: 1174333 - protein, 9 aa, Homo Sapiens
SLQEEIVKL

SEQ ID NO: 1174334 - protein, 9 aa, Homo Sapiens
ALISNVLWR

SEQ ID NO: 1174335 - protein, 9 aa, Homo Sapiens
MATTFDDCL

SEQ ID NO: 1174336 - protein, 9 aa, Homo Sapiens
ITALGRFRS

SEQ ID NO: 1174337 - protein, 9 aa, Homo Sapiens
QPKARGGAA

SEQ ID NO: 1174338 - protein, 9 aa, Homo Sapiens
GVPLRSWWL

SEQ ID NO: 1174339 - protein, 9 aa, Homo Sapiens
GPDGVMVRV

SEQ ID NO: 1174340 - protein, 9 aa, Homo Sapiens
HPCPPGGPA

SEQ ID NO: 1174341 - protein, 9 aa, Homo Sapiens
PPSMRQAGR

SEQ ID NO: 1174342 - protein, 9 aa, Homo Sapiens
QETGKKRQS

SEQ ID NO: 1174343 - protein, 9 aa, Homo Sapiens
PAHVEKQLW

SEQ ID NO: 1174344 - protein, 9 aa, Homo Sapiens
YFVELPTVA

SEQ ID NO: 1174345 - protein, 9 aa, Homo Sapiens
QYRDLEAMA

SEQ ID NO: 1174346 - protein, 9 aa, Homo Sapiens
HHHRSGPAA

SEQ ID NO: 1174347 - protein, 9 aa, Homo Sapiens
NLEEAIYTG

SEQ ID NO: 1174348 - protein, 9 aa, Homo Sapiens
YLPDVGQQP

SEQ ID NO: 1174349 - protein, 9 aa, Homo Sapiens
HNGTCATFW

SEQ ID NO: 1174350 - protein, 9 aa, Homo Sapiens
PGLRPCRCC

SEQ ID NO: 1174351 - protein, 9 aa, Homo Sapiens
VGLPRACAA

SEQ ID NO: 1174352 - protein, 9 aa, Homo Sapiens
RAGTTPSCR

SEQ ID NO: 1174353 - protein, 9 aa, Homo Sapiens
AALVRAQAD

SEQ ID NO: 1174354 - protein, 9 aa, Homo Sapiens
LICHRRYYH

SEQ ID NO: 1174355 - protein, 9 aa, Homo Sapiens
SPPSPSSLL

SEQ ID NO: 1174356 - protein, 9 aa, Homo Sapiens
GSASLMILV

SEQ ID NO: 1174357 - protein, 9 aa, Homo Sapiens
HPAPAPQHL

SEQ ID NO: 1174358 - protein, 9 aa, Homo Sapiens
EAVRTLVAH

SEQ ID NO: 1174359 - protein, 9 aa, Homo Sapiens
SSPVPQPQS

SEQ ID NO: 1174360 - protein, 9 aa, Homo Sapiens
FSDAAFNHC

SEQ ID NO: 1174361 - protein, 9 aa, Homo Sapiens
VLLILLLED

SEQ ID NO: 1174362 - protein, 9 aa, Homo Sapiens
CYLNVIPSL

SEQ ID NO: 1174363 - protein, 9 aa, Homo Sapiens
KLTALDYHT

SEQ ID NO: 1174364 - protein, 9 aa, Homo Sapiens
PPPPCIAPP

SEQ ID NO: 1174365 - protein, 9 aa, Homo Sapiens
DAAFNHCAQ

SEQ ID NO: 1174366 - protein, 9 aa, Homo Sapiens
GGILQLTSL

SEQ ID NO: 1174367 - protein, 9 aa, Homo Sapiens
EFGGAVEDF

SEQ ID NO: 1174368 - protein, 9 aa, Homo Sapiens
RESHHQPQT

SEQ ID NO: 1174369 - protein, 9 aa, Homo Sapiens
VQGLTGLQG

SEQ ID NO: 1174370 - protein, 9 aa, Homo Sapiens
ANNRLLFTG

SEQ ID NO: 1174371 - protein, 9 aa, Homo Sapiens
APPAARSHG

SEQ ID NO: 1174372 - protein, 9 aa, Homo Sapiens
HFKCEECWE

SEQ ID NO: 1174373 - protein, 9 aa, Homo Sapiens
IHCWLSPPL

SEQ ID NO: 1174374 - protein, 9 aa, Homo Sapiens
QHFYYTFGK

SEQ ID NO: 1174375 - protein, 9 aa, Homo Sapiens
DGRRIWVDY

SEQ ID NO: 1174376 - protein, 9 aa, Homo Sapiens
PPATSIPPP

SEQ ID NO: 1174377 - protein, 9 aa, Homo Sapiens
KKRGGSSTL

SEQ ID NO: 1174378 - protein, 9 aa, Homo Sapiens
SSTRAPALR

SEQ ID NO: 1174379 - protein, 9 aa, Homo Sapiens
SAFEVVWAA

SEQ ID NO: 1174380 - protein, 9 aa, Homo Sapiens
KENQRGCFL

SEQ ID NO: 1174381 - protein, 9 aa, Homo Sapiens
VAPPIECVN

SEQ ID NO: 1174382 - protein, 9 aa, Homo Sapiens
EGRGYRVGR

SEQ ID NO: 1174383 - protein, 9 aa, Homo Sapiens
EDELPATSA

SEQ ID NO: 1174384 - protein, 9 aa, Homo Sapiens
SDSWLCLKC

SEQ ID NO: 1174385 - protein, 9 aa, Homo Sapiens
FPRALPVQI

SEQ ID NO: 1174386 - protein, 9 aa, Homo Sapiens
ASAQISMNH

SEQ ID NO: 1174387 - protein, 9 aa, Homo Sapiens
AALSPAGQR

SEQ ID NO: 1174388 - protein, 9 aa, Homo Sapiens
NYMGKVPCN

SEQ ID NO: 1174389 - protein, 9 aa, Homo Sapiens
GEEAVPEAV

SEQ ID NO: 1174390 - protein, 9 aa, Homo Sapiens
LSMGAGEVG

SEQ ID NO: 1174391 - protein, 9 aa, Homo Sapiens
KVGGIYLLY

SEQ ID NO: 1174392 - protein, 9 aa, Homo Sapiens
WRRPGPKEA

SEQ ID NO: 1174393 - protein, 9 aa, Homo Sapiens
VGGGGPARP

SEQ ID NO: 1174394 - protein, 9 aa, Homo Sapiens
HQRCVQRCV

SEQ ID NO: 1174395 - protein, 9 aa, Homo Sapiens
GQRNPYADI

SEQ ID NO: 1174396 - protein, 9 aa, Homo Sapiens
YLGASTSHK

SEQ ID NO: 1174397 - protein, 9 aa, Homo Sapiens
VAAIVGLYR

SEQ ID NO: 1174398 - protein, 9 aa, Homo Sapiens
LTMATTFDD

SEQ ID NO: 1174399 - protein, 9 aa, Homo Sapiens
AVLEPDLHL

SEQ ID NO: 1174400 - protein, 9 aa, Homo Sapiens
RPAARLSMG

SEQ ID NO: 1174401 - protein, 9 aa, Homo Sapiens
SDFEHTIHA

SEQ ID NO: 1174402 - protein, 9 aa, Homo Sapiens
QLRQRIILY

SEQ ID NO: 1174403 - protein, 9 aa, Homo Sapiens
AWCCQSGTC

SEQ ID NO: 1174404 - protein, 9 aa, Homo Sapiens
PTWGCLCRA

SEQ ID NO: 1174405 - protein, 9 aa, Homo Sapiens
EGGLRRASG

SEQ ID NO: 1174406 - protein, 9 aa, Homo Sapiens
SSLSVLWKL

SEQ ID NO: 1174407 - protein, 9 aa, Homo Sapiens
DADAQENVL

SEQ ID NO: 1174408 - protein, 9 aa, Homo Sapiens
EKTGAFKTV

SEQ ID NO: 1174409 - protein, 9 aa, Homo Sapiens
TWGRLTGQR

SEQ ID NO: 1174410 - protein, 9 aa, Homo Sapiens
GDSADPVVT

SEQ ID NO: 1174411 - protein, 9 aa, Homo Sapiens
CFVVRDAPW

SEQ ID NO: 1174412 - protein, 9 aa, Homo Sapiens
NSGQRWKLL

SEQ ID NO: 1174413 - protein, 9 aa, Homo Sapiens
LLRERTLKI

SEQ ID NO: 1174414 - protein, 9 aa, Homo Sapiens
MDTRRVQPI

SEQ ID NO: 1174415 - protein, 9 aa, Homo Sapiens
ARSVAAGAM

SEQ ID NO: 1174416 - protein, 9 aa, Homo Sapiens
AKIAEGVSD

SEQ ID NO: 1174417 - protein, 9 aa, Homo Sapiens
TLAARQEST

SEQ ID NO: 1174418 - protein, 9 aa, Homo Sapiens
EEIIINLQF

SEQ ID NO: 1174419 - protein, 9 aa, Homo Sapiens
LPVPDVGIG

SEQ ID NO: 1174420 - protein, 9 aa, Homo Sapiens
TDFPRAGRQ

SEQ ID NO: 1174421 - protein, 9 aa, Homo Sapiens
SGCLYRLRV

SEQ ID NO: 1174422 - protein, 9 aa, Homo Sapiens
RKKRRRHQP

SEQ ID NO: 1174423 - protein, 9 aa, Homo Sapiens
QEAPDCGRL

SEQ ID NO: 1174424 - protein, 9 aa, Homo Sapiens
SRHHHSEHM

SEQ ID NO: 1174425 - protein, 9 aa, Homo Sapiens
MDTVCKRGN

SEQ ID NO: 1174426 - protein, 9 aa, Homo Sapiens
TAFIPGHHC

SEQ ID NO: 1174427 - protein, 9 aa, Homo Sapiens
LPCRGPMPG

SEQ ID NO: 1174428 - protein, 9 aa, Homo Sapiens
ALSGDCCSW

SEQ ID NO: 1174429 - protein, 9 aa, Homo Sapiens
PVLVQDAAG

SEQ ID NO: 1174430 - protein, 9 aa, Homo Sapiens
ADSSNSHET

SEQ ID NO: 1174431 - protein, 9 aa, Homo Sapiens
HTAGTPVPE

SEQ ID NO: 1174432 - protein, 9 aa, Homo Sapiens
VIPLLESEL

SEQ ID NO: 1174433 - protein, 9 aa, Homo Sapiens
LSAASPCSS

SEQ ID NO: 1174434 - protein, 9 aa, Homo Sapiens
NQEKKRGKP

SEQ ID NO: 1174435 - protein, 9 aa, Homo Sapiens
HTGFSLFYY

SEQ ID NO: 1174436 - protein, 9 aa, Homo Sapiens
ATCFKRAVE

SEQ ID NO: 1174437 - protein, 9 aa, Homo Sapiens
ECERIGAKH

SEQ ID NO: 1174438 - protein, 9 aa, Homo Sapiens
IDKVGGIYL

SEQ ID NO: 1174439 - protein, 9 aa, Homo Sapiens
AKATYEHLF

SEQ ID NO: 1174440 - protein, 9 aa, Homo Sapiens
ALITFLTQR

SEQ ID NO: 1174441 - protein, 9 aa, Homo Sapiens
LKVVDHRLE

SEQ ID NO: 1174442 - protein, 9 aa, Homo Sapiens
CSCFLPVFS

SEQ ID NO: 1174443 - protein, 9 aa, Homo Sapiens
YPVCLLVLG

SEQ ID NO: 1174444 - protein, 9 aa, Homo Sapiens
IDVWVVGCI

SEQ ID NO: 1174445 - protein, 9 aa, Homo Sapiens
AMAASVMVL

SEQ ID NO: 1174446 - protein, 9 aa, Homo Sapiens
EPSKGQLKT

SEQ ID NO: 1174447 - protein, 9 aa, Homo Sapiens
SPQGGPFNP

SEQ ID NO: 1174448 - protein, 9 aa, Homo Sapiens
VMCLRLRTK

SEQ ID NO: 1174449 - protein, 9 aa, Homo Sapiens
KVKINSKSI

SEQ ID NO: 1174450 - protein, 9 aa, Homo Sapiens
GTSAELQNV

SEQ ID NO: 1174451 - protein, 9 aa, Homo Sapiens
HNSYLQGHP

SEQ ID NO: 1174452 - protein, 9 aa, Homo Sapiens
AFRAQAPRC

SEQ ID NO: 1174453 - protein, 9 aa, Homo Sapiens
PRRAPRRRT

SEQ ID NO: 1174454 - protein, 9 aa, Homo Sapiens
RTSRHVWFR

SEQ ID NO: 1174455 - protein, 9 aa, Homo Sapiens
RTRKQTKVL

SEQ ID NO: 1174456 - protein, 9 aa, Homo Sapiens
DTSKNIIRL

SEQ ID NO: 1174457 - protein, 9 aa, Homo Sapiens
FLQMYSFLQ

SEQ ID NO: 1174458 - protein, 9 aa, Homo Sapiens
RSGSLLCTP

SEQ ID NO: 1174459 - protein, 9 aa, Homo Sapiens
HTSCPESFA

SEQ ID NO: 1174460 - protein, 9 aa, Homo Sapiens
LDGGNTAAA

SEQ ID NO: 1174461 - protein, 9 aa, Homo Sapiens
VTSVKEMDE

SEQ ID NO: 1174462 - protein, 9 aa, Homo Sapiens
RLEDVPPVN

SEQ ID NO: 1174463 - protein, 9 aa, Homo Sapiens
AAVQAGRGT

SEQ ID NO: 1174464 - protein, 9 aa, Homo Sapiens
EPHGASGAG

SEQ ID NO: 1174465 - protein, 9 aa, Homo Sapiens
KQGWLHKKR

SEQ ID NO: 1174466 - protein, 9 aa, Homo Sapiens
TAAALVDFT

SEQ ID NO: 1174467 - protein, 9 aa, Homo Sapiens
YGDRKLFQV

SEQ ID NO: 1174468 - protein, 9 aa, Homo Sapiens
DSTPRGRTS

SEQ ID NO: 1174469 - protein, 9 aa, Homo Sapiens
RRPRRRAAP

SEQ ID NO: 1174470 - protein, 9 aa, Homo Sapiens
GLPDLPSQR

SEQ ID NO: 1174471 - protein, 9 aa, Homo Sapiens
QGAWWVLAW

SEQ ID NO: 1174472 - protein, 9 aa, Homo Sapiens
IPPRSCRRR

SEQ ID NO: 1174473 - protein, 9 aa, Homo Sapiens
SLPSPSCNL

SEQ ID NO: 1174474 - protein, 9 aa, Homo Sapiens
LTRVEGLKY

SEQ ID NO: 1174475 - protein, 9 aa, Homo Sapiens
TRGNLGPLE

SEQ ID NO: 1174476 - protein, 9 aa, Homo Sapiens
SAASACSAA

SEQ ID NO: 1174477 - protein, 9 aa, Homo Sapiens
YAPPRSSPC

SEQ ID NO: 1174478 - protein, 9 aa, Homo Sapiens
AGALMLAGG

SEQ ID NO: 1174479 - protein, 9 aa, Homo Sapiens
VLDDKNVCR

SEQ ID NO: 1174480 - protein, 9 aa, Homo Sapiens
VGSKDAGCA

SEQ ID NO: 1174481 - protein, 9 aa, Homo Sapiens
EEDPRACES

SEQ ID NO: 1174482 - protein, 9 aa, Homo Sapiens
SIEEIEAAP

SEQ ID NO: 1174483 - protein, 9 aa, Homo Sapiens
PSVPPLGLS

SEQ ID NO: 1174484 - protein, 9 aa, Homo Sapiens
ASAVIAAGP

SEQ ID NO: 1174485 - protein, 9 aa, Homo Sapiens
KEELEECAS

SEQ ID NO: 1174486 - protein, 9 aa, Homo Sapiens
RSGHEVTEG

SEQ ID NO: 1174487 - protein, 9 aa, Homo Sapiens
QRSSIHFEM

SEQ ID NO: 1174488 - protein, 9 aa, Homo Sapiens
GAGRHSPAR

SEQ ID NO: 1174489 - protein, 9 aa, Homo Sapiens
YPFHVLALE

SEQ ID NO: 1174490 - protein, 9 aa, Homo Sapiens
GGVSRYISR

SEQ ID NO: 1174491 - protein, 9 aa, Homo Sapiens
ITEELFLLV

SEQ ID NO: 1174492 - protein, 9 aa, Homo Sapiens
PTAWSWAAG

SEQ ID NO: 1174493 - protein, 9 aa, Homo Sapiens
PDTQAYGHE

SEQ ID NO: 1174494 - protein, 9 aa, Homo Sapiens
LRLRTKLEK

SEQ ID NO: 1174495 - protein, 9 aa, Homo Sapiens
FSDYLRERA

SEQ ID NO: 1174496 - protein, 9 aa, Homo Sapiens
RTSLRALHR

SEQ ID NO: 1174497 - protein, 9 aa, Homo Sapiens
GILCCGLFL

SEQ ID NO: 1174498 - protein, 9 aa, Homo Sapiens
MTHLKDLIA

SEQ ID NO: 1174499 - protein, 9 aa, Homo Sapiens
GTDVISIRP

SEQ ID NO: 1174500 - protein, 9 aa, Homo Sapiens
VQAVGFQVH

SEQ ID NO: 1174501 - protein, 9 aa, Homo Sapiens
GECCSHMEH

SEQ ID NO: 1174502 - protein, 9 aa, Homo Sapiens
RGAGASCFH

SEQ ID NO: 1174503 - protein, 9 aa, Homo Sapiens
RVGYPDSWV

SEQ ID NO: 1174504 - protein, 9 aa, Homo Sapiens
CHPAWLSPI

SEQ ID NO: 1174505 - protein, 9 aa, Homo Sapiens
CDCCGRSFS

SEQ ID NO: 1174506 - protein, 9 aa, Homo Sapiens
NVIPSLGRQ

SEQ ID NO: 1174507 - protein, 9 aa, Homo Sapiens
LTMWTCMDM

SEQ ID NO: 1174508 - protein, 9 aa, Homo Sapiens
WEKVPGGLQ

SEQ ID NO: 1174509 - protein, 9 aa, Homo Sapiens
SYTCICIHI

SEQ ID NO: 1174510 - protein, 9 aa, Homo Sapiens
PPLSLPTRP

SEQ ID NO: 1174511 - protein, 9 aa, Homo Sapiens
ALQNGCVGA

SEQ ID NO: 1174512 - protein, 9 aa, Homo Sapiens
AGGGQPAHA

SEQ ID NO: 1174513 - protein, 9 aa, Homo Sapiens
SCSWAARVT

SEQ ID NO: 1174514 - protein, 9 aa, Homo Sapiens
VTLGRWSIT

SEQ ID NO: 1174515 - protein, 9 aa, Homo Sapiens
HHPPAQPWP

SEQ ID NO: 1174516 - protein, 9 aa, Homo Sapiens
KKPGAPCLA

SEQ ID NO: 1174517 - protein, 9 aa, Homo Sapiens
GPQCPSGCA

SEQ ID NO: 1174518 - protein, 9 aa, Homo Sapiens
LCVGGGGGV

SEQ ID NO: 1174519 - protein, 9 aa, Homo Sapiens
ATVILHSPL

SEQ ID NO: 1174520 - protein, 9 aa, Homo Sapiens
KRRRHQPPT

SEQ ID NO: 1174521 - protein, 9 aa, Homo Sapiens
DRDLGVSTQ

SEQ ID NO: 1174522 - protein, 9 aa, Homo Sapiens
KPSVGPQRA

SEQ ID NO: 1174523 - protein, 9 aa, Homo Sapiens
HGLESKQLR

SEQ ID NO: 1174524 - protein, 9 aa, Homo Sapiens
LFCYIGILQ

SEQ ID NO: 1174525 - protein, 9 aa, Homo Sapiens
TQRPPVLDE

SEQ ID NO: 1174526 - protein, 9 aa, Homo Sapiens
SLVPLSVPQ

SEQ ID NO: 1174527 - protein, 9 aa, Homo Sapiens
DTSTIKVNQ

SEQ ID NO: 1174528 - protein, 9 aa, Homo Sapiens
GRGLPLTLS

SEQ ID NO: 1174529 - protein, 9 aa, Homo Sapiens
LPFPPAASR

SEQ ID NO: 1174530 - protein, 9 aa, Homo Sapiens
AGAWQGGSH

SEQ ID NO: 1174531 - protein, 9 aa, Homo Sapiens
GVSRSPTSV

SEQ ID NO: 1174532 - protein, 9 aa, Homo Sapiens
WPAYLEHRD

SEQ ID NO: 1174533 - protein, 9 aa, Homo Sapiens
SCYKALLLP

SEQ ID NO: 1174534 - protein, 9 aa, Homo Sapiens
PPRSCRRRP

SEQ ID NO: 1174535 - protein, 9 aa, Homo Sapiens
ILLTFTFSA

SEQ ID NO: 1174536 - protein, 9 aa, Homo Sapiens
GSHFFSPED

SEQ ID NO: 1174537 - protein, 9 aa, Homo Sapiens
TPPPTATNA

SEQ ID NO: 1174538 - protein, 9 aa, Homo Sapiens
NIIDIVVII

SEQ ID NO: 1174539 - protein, 9 aa, Homo Sapiens
MRSGQVRGP

SEQ ID NO: 1174540 - protein, 9 aa, Homo Sapiens
QYTKPYLKS

SEQ ID NO: 1174541 - protein, 9 aa, Homo Sapiens
ESEEETTDD

SEQ ID NO: 1174542 - protein, 9 aa, Homo Sapiens
LNIPWSRIP

SEQ ID NO: 1174543 - protein, 9 aa, Homo Sapiens
GIIFACVCS

SEQ ID NO: 1174544 - protein, 9 aa, Homo Sapiens
RLLVAVCVL

SEQ ID NO: 1174545 - protein, 9 aa, Homo Sapiens
VYVLNEDKE

SEQ ID NO: 1174546 - protein, 9 aa, Homo Sapiens
QNGGSGRRL

SEQ ID NO: 1174547 - protein, 9 aa, Homo Sapiens
EDPQAVMYA

SEQ ID NO: 1174548 - protein, 9 aa, Homo Sapiens
LKVVQTGQD

SEQ ID NO: 1174549 - protein, 9 aa, Homo Sapiens
ITVLDRDSG

SEQ ID NO: 1174550 - protein, 9 aa, Homo Sapiens
GAELYWASG

SEQ ID NO: 1174551 - protein, 9 aa, Homo Sapiens
ALTATTTVL

SEQ ID NO: 1174552 - protein, 9 aa, Homo Sapiens
HYQCLRHPV

SEQ ID NO: 1174553 - protein, 9 aa, Homo Sapiens
TQNCGQRMK

SEQ ID NO: 1174554 - protein, 9 aa, Homo Sapiens
GSSIQSWGS

SEQ ID NO: 1174555 - protein, 9 aa, Homo Sapiens
RERESVLRW

SEQ ID NO: 1174556 - protein, 9 aa, Homo Sapiens
PISVSFPQA

SEQ ID NO: 1174557 - protein, 9 aa, Homo Sapiens
PLGPQEMVK

SEQ ID NO: 1174558 - protein, 9 aa, Homo Sapiens
RLETLASKA

SEQ ID NO: 1174559 - protein, 9 aa, Homo Sapiens
GASFILSYR

SEQ ID NO: 1174560 - protein, 9 aa, Homo Sapiens
PTPAPPSCS

SEQ ID NO: 1174561 - protein, 9 aa, Homo Sapiens
ILVRIFSLN

SEQ ID NO: 1174562 - protein, 9 aa, Homo Sapiens
IGKNQPHNK

SEQ ID NO: 1174563 - protein, 9 aa, Homo Sapiens
WRPPWWRRP

SEQ ID NO: 1174564 - protein, 9 aa, Homo Sapiens
CIAPPTPTS

SEQ ID NO: 1174565 - protein, 9 aa, Homo Sapiens
TSPPTSAPT

SEQ ID NO: 1174566 - protein, 9 aa, Homo Sapiens
RLWLLWRQN

SEQ ID NO: 1174567 - protein, 9 aa, Homo Sapiens
IHQMGLKVV

SEQ ID NO: 1174568 - protein, 9 aa, Homo Sapiens
AQHIRPEDL

SEQ ID NO: 1174569 - protein, 9 aa, Homo Sapiens
SAHVHAAAN

SEQ ID NO: 1174570 - protein, 9 aa, Homo Sapiens
PHPRGSPAW

SEQ ID NO: 1174571 - protein, 9 aa, Homo Sapiens
GYGNPNFCW

SEQ ID NO: 1174572 - protein, 9 aa, Homo Sapiens
GRRGPDGVM

SEQ ID NO: 1174573 - protein, 9 aa, Homo Sapiens
RAMEAHAME

SEQ ID NO: 1174574 - protein, 9 aa, Homo Sapiens
LAFVIMLLA

SEQ ID NO: 1174575 - protein, 9 aa, Homo Sapiens
NGEAGGGPS

SEQ ID NO: 1174576 - protein, 9 aa, Homo Sapiens
AREGALVAL

SEQ ID NO: 1174577 - protein, 9 aa, Homo Sapiens
KDILVLNVN

SEQ ID NO: 1174578 - protein, 9 aa, Homo Sapiens
SEQFNAFLG

SEQ ID NO: 1174579 - protein, 9 aa, Homo Sapiens
PPLKWLQLK

SEQ ID NO: 1174580 - protein, 9 aa, Homo Sapiens
VGGVRRRRR

SEQ ID NO: 1174581 - protein, 9 aa, Homo Sapiens
LLGRSPPLQ

SEQ ID NO: 1174582 - protein, 9 aa, Homo Sapiens
PQAQLMLMG

SEQ ID NO: 1174583 - protein, 9 aa, Homo Sapiens
APAPLTPPL

SEQ ID NO: 1174584 - protein, 9 aa, Homo Sapiens
RCLRVPAGP

SEQ ID NO: 1174585 - protein, 9 aa, Homo Sapiens
PSHPGQWAP

SEQ ID NO: 1174586 - protein, 9 aa, Homo Sapiens
LSKVDFWYS

SEQ ID NO: 1174587 - protein, 9 aa, Homo Sapiens
HKYWKNLTF

SEQ ID NO: 1174588 - protein, 9 aa, Homo Sapiens
GDSTTSDTS

SEQ ID NO: 1174589 - protein, 9 aa, Homo Sapiens
PLFSQSMAP

SEQ ID NO: 1174590 - protein, 9 aa, Homo Sapiens
GPPAPAGPP

SEQ ID NO: 1174591 - protein, 9 aa, Homo Sapiens
AGALNKVLR

SEQ ID NO: 1174592 - protein, 9 aa, Homo Sapiens
CCYYWINSL

SEQ ID NO: 1174593 - protein, 9 aa, Homo Sapiens
NRCRGVTDT

SEQ ID NO: 1174594 - protein, 9 aa, Homo Sapiens
RFWTMPIAP

SEQ ID NO: 1174595 - protein, 9 aa, Homo Sapiens
HPQASTPSG

SEQ ID NO: 1174596 - protein, 9 aa, Homo Sapiens
EMNGKLFDN

SEQ ID NO: 1174597 - protein, 9 aa, Homo Sapiens
SDPDTKGSP

SEQ ID NO: 1174598 - protein, 9 aa, Homo Sapiens
GRALGYSIQ

SEQ ID NO: 1174599 - protein, 9 aa, Homo Sapiens
ESLPGAMNA

SEQ ID NO: 1174600 - protein, 9 aa, Homo Sapiens
LDPLPSASP

SEQ ID NO: 1174601 - protein, 9 aa, Homo Sapiens
STHLSYQCS

SEQ ID NO: 1174602 - protein, 9 aa, Homo Sapiens
RAHTGERHH

SEQ ID NO: 1174603 - protein, 9 aa, Homo Sapiens
PPRSGRGSL

SEQ ID NO: 1174604 - protein, 9 aa, Homo Sapiens
TYKFKLEDH

SEQ ID NO: 1174605 - protein, 9 aa, Homo Sapiens
QAPGATPPA

SEQ ID NO: 1174606 - protein, 9 aa, Homo Sapiens
FLAFVIMLL

SEQ ID NO: 1174607 - protein, 9 aa, Homo Sapiens
THLHEWIDL

SEQ ID NO: 1174608 - protein, 9 aa, Homo Sapiens
YSVPKNPSQ

SEQ ID NO: 1174609 - protein, 9 aa, Homo Sapiens
HLDALARGA

SEQ ID NO: 1174610 - protein, 9 aa, Homo Sapiens
HCPPGGHPA

SEQ ID NO: 1174611 - protein, 9 aa, Homo Sapiens
VTLQQVIHL

SEQ ID NO: 1174612 - protein, 9 aa, Homo Sapiens
YIAKIAEGV

SEQ ID NO: 1174613 - protein, 9 aa, Homo Sapiens
VLNEDKEWN

SEQ ID NO: 1174614 - protein, 9 aa, Homo Sapiens
SGGGAASSS

SEQ ID NO: 1174615 - protein, 9 aa, Homo Sapiens
RGPHPADPP

SEQ ID NO: 1174616 - protein, 9 aa, Homo Sapiens
NVVSENEAE

SEQ ID NO: 1174617 - protein, 9 aa, Homo Sapiens
PSRGMALCP

SEQ ID NO: 1174618 - protein, 9 aa, Homo Sapiens
RPRWSRPLQ

SEQ ID NO: 1174619 - protein, 9 aa, Homo Sapiens
ANENDGYMD

SEQ ID NO: 1174620 - protein, 9 aa, Homo Sapiens
PCSPCQFRL

SEQ ID NO: 1174621 - protein, 9 aa, Homo Sapiens
GSKGSRGPL

SEQ ID NO: 1174622 - protein, 9 aa, Homo Sapiens
ERLKAEQGS

SEQ ID NO: 1174623 - protein, 9 aa, Homo Sapiens
CPPGGHPAP

SEQ ID NO: 1174624 - protein, 9 aa, Homo Sapiens
LDGRRIWVD

SEQ ID NO: 1174625 - protein, 9 aa, Homo Sapiens
RWSAWPCGG

SEQ ID NO: 1174626 - protein, 9 aa, Homo Sapiens
DTSMNFVQK

SEQ ID NO: 1174627 - protein, 9 aa, Homo Sapiens
YQQQHKVHV

SEQ ID NO: 1174628 - protein, 9 aa, Homo Sapiens
MKGLTEAKT

SEQ ID NO: 1174629 - protein, 9 aa, Homo Sapiens
WMCTAALPT

SEQ ID NO: 1174630 - protein, 9 aa, Homo Sapiens
VCHCGLDGI

SEQ ID NO: 1174631 - protein, 9 aa, Homo Sapiens
WGQILLLGV

SEQ ID NO: 1174632 - protein, 9 aa, Homo Sapiens
ITISLAIAA

SEQ ID NO: 1174633 - protein, 9 aa, Homo Sapiens
APRAAQETS

SEQ ID NO: 1174634 - protein, 9 aa, Homo Sapiens
HRYMPGTVA

SEQ ID NO: 1174635 - protein, 9 aa, Homo Sapiens
CRPGNVGIL

SEQ ID NO: 1174636 - protein, 9 aa, Homo Sapiens
QRVGEKRFG

SEQ ID NO: 1174637 - protein, 9 aa, Homo Sapiens
HCGHSVLWT

SEQ ID NO: 1174638 - protein, 9 aa, Homo Sapiens
SPLPLKVIW

SEQ ID NO: 1174639 - protein, 9 aa, Homo Sapiens
LIEYQKMAL

SEQ ID NO: 1174640 - protein, 9 aa, Homo Sapiens
AEGLMVTRG

SEQ ID NO: 1174641 - protein, 9 aa, Homo Sapiens
PRPPSAGAL

SEQ ID NO: 1174642 - protein, 9 aa, Homo Sapiens
TKYRMPSSH

SEQ ID NO: 1174643 - protein, 9 aa, Homo Sapiens
RPVDCADHW

SEQ ID NO: 1174644 - protein, 9 aa, Homo Sapiens
ASKNGHHVL

SEQ ID NO: 1174645 - protein, 9 aa, Homo Sapiens
EGFLTALQA

SEQ ID NO: 1174646 - protein, 9 aa, Homo Sapiens
WALGVFIYE

SEQ ID NO: 1174647 - protein, 9 aa, Homo Sapiens
SQPVYDAYV

SEQ ID NO: 1174648 - protein, 9 aa, Homo Sapiens
HDLFKLPQL

SEQ ID NO: 1174649 - protein, 9 aa, Homo Sapiens
QPMMSELEE

SEQ ID NO: 1174650 - protein, 9 aa, Homo Sapiens
MTPRKRSHH

SEQ ID NO: 1174651 - protein, 9 aa, Homo Sapiens
LDCGAAPGV

SEQ ID NO: 1174652 - protein, 9 aa, Homo Sapiens
STSPHHPQR

SEQ ID NO: 1174653 - protein, 9 aa, Homo Sapiens
GVKRKADTP

SEQ ID NO: 1174654 - protein, 9 aa, Homo Sapiens
GVCFKRISG

SEQ ID NO: 1174655 - protein, 9 aa, Homo Sapiens
SPPPSPPSP

SEQ ID NO: 1174656 - protein, 9 aa, Homo Sapiens
PRSCSPAHW

SEQ ID NO: 1174657 - protein, 9 aa, Homo Sapiens
PLCAGSPRK

SEQ ID NO: 1174658 - protein, 9 aa, Homo Sapiens
RPSRFRIHL

SEQ ID NO: 1174659 - protein, 9 aa, Homo Sapiens
NPICQPSWA

SEQ ID NO: 1174660 - protein, 9 aa, Homo Sapiens
ELLRSLNSS

SEQ ID NO: 1174661 - protein, 9 aa, Homo Sapiens
RTCTLHNWK

SEQ ID NO: 1174662 - protein, 9 aa, Homo Sapiens
APSLRCLGL

SEQ ID NO: 1174663 - protein, 9 aa, Homo Sapiens
RSPSWSAAP

SEQ ID NO: 1174664 - protein, 9 aa, Homo Sapiens
TRVIFDDYK

SEQ ID NO: 1174665 - protein, 9 aa, Homo Sapiens
PLCLQTMKM

SEQ ID NO: 1174666 - protein, 9 aa, Homo Sapiens
PLSLPTRPR

SEQ ID NO: 1174667 - protein, 9 aa, Homo Sapiens
FQGYIDSLE

SEQ ID NO: 1174668 - protein, 9 aa, Homo Sapiens
IQKNIKENI

SEQ ID NO: 1174669 - protein, 9 aa, Homo Sapiens
PTDYSKLLP

SEQ ID NO: 1174670 - protein, 9 aa, Homo Sapiens
PVSEITGAP

SEQ ID NO: 1174671 - protein, 9 aa, Homo Sapiens
YLSAGHVRL

SEQ ID NO: 1174672 - protein, 9 aa, Homo Sapiens
TTFVKTLAK

SEQ ID NO: 1174673 - protein, 9 aa, Homo Sapiens
SLCSPHNLN

SEQ ID NO: 1174674 - protein, 9 aa, Homo Sapiens
SLGVQGSAA

SEQ ID NO: 1174675 - protein, 9 aa, Homo Sapiens
SEATSQYYF

SEQ ID NO: 1174676 - protein, 9 aa, Homo Sapiens
STPGPWAAA

SEQ ID NO: 1174677 - protein, 9 aa, Homo Sapiens
PQAAGAERE

SEQ ID NO: 1174678 - protein, 9 aa, Homo Sapiens
AFSSGSQPL

SEQ ID NO: 1174679 - protein, 9 aa, Homo Sapiens
YPLDLVRVR

SEQ ID NO: 1174680 - protein, 9 aa, Homo Sapiens
LKAPRAAQE

SEQ ID NO: 1174681 - protein, 9 aa, Homo Sapiens
LLTSIVIGD

SEQ ID NO: 1174682 - protein, 9 aa, Homo Sapiens
VGEFWLKRQ

SEQ ID NO: 1174683 - protein, 9 aa, Homo Sapiens
SGSSGGGAA

SEQ ID NO: 1174684 - protein, 9 aa, Homo Sapiens
LSYSKSNGR

SEQ ID NO: 1174685 - protein, 9 aa, Homo Sapiens
LTSDSWLCL

SEQ ID NO: 1174686 - protein, 9 aa, Homo Sapiens
RQIEFLKGQ

SEQ ID NO: 1174687 - protein, 9 aa, Homo Sapiens
VGEGGLRRA

SEQ ID NO: 1174688 - protein, 9 aa, Homo Sapiens
LLTAAEQRV

SEQ ID NO: 1174689 - protein, 9 aa, Homo Sapiens
PVLNLATVN

SEQ ID NO: 1174690 - protein, 9 aa, Homo Sapiens
SFSGPRYGH

SEQ ID NO: 1174691 - protein, 9 aa, Homo Sapiens
SSEKREVLQ

SEQ ID NO: 1174692 - protein, 9 aa, Homo Sapiens
TPTVRLLEL

SEQ ID NO: 1174693 - protein, 9 aa, Homo Sapiens
DRLDQAEKN

SEQ ID NO: 1174694 - protein, 9 aa, Homo Sapiens
VNKPYMTQK

SEQ ID NO: 1174695 - protein, 9 aa, Homo Sapiens
KQHVLETAA

SEQ ID NO: 1174696 - protein, 9 aa, Homo Sapiens
ASRYECATV

SEQ ID NO: 1174697 - protein, 9 aa, Homo Sapiens
GTSTHLSYQ

SEQ ID NO: 1174698 - protein, 9 aa, Homo Sapiens
TVQLPRRSS

SEQ ID NO: 1174699 - protein, 9 aa, Homo Sapiens
PDHRASLLT

SEQ ID NO: 1174700 - protein, 9 aa, Homo Sapiens
RWSITSPPS

SEQ ID NO: 1174701 - protein, 9 aa, Homo Sapiens
SSPSKIHGR

SEQ ID NO: 1174702 - protein, 9 aa, Homo Sapiens
TGAFKTVST

SEQ ID NO: 1174703 - protein, 9 aa, Homo Sapiens
ITWGRLTGQ

SEQ ID NO: 1174704 - protein, 9 aa, Homo Sapiens
VPLGTPHQH

SEQ ID NO: 1174705 - protein, 9 aa, Homo Sapiens
RLRRTSPLP

SEQ ID NO: 1174706 - protein, 9 aa, Homo Sapiens
WSVMFFLMF

SEQ ID NO: 1174707 - protein, 9 aa, Homo Sapiens
SLPWTTPAS

SEQ ID NO: 1174708 - protein, 9 aa, Homo Sapiens
SSSFWSLSS

SEQ ID NO: 1174709 - protein, 9 aa, Homo Sapiens
NRLIKIHEK

SEQ ID NO: 1174710 - protein, 9 aa, Homo Sapiens
HTRENLTNV

SEQ ID NO: 1174711 - protein, 9 aa, Homo Sapiens
SHTTHCTFV

SEQ ID NO: 1174712 - protein, 9 aa, Homo Sapiens
FSPVFFSII

SEQ ID NO: 1174713 - protein, 9 aa, Homo Sapiens
VSLRRRHLG

SEQ ID NO: 1174714 - protein, 9 aa, Homo Sapiens
KEICDDKVS

SEQ ID NO: 1174715 - protein, 9 aa, Homo Sapiens
ADTPTPTTI

SEQ ID NO: 1174716 - protein, 9 aa, Homo Sapiens
LRGSWKFIE

SEQ ID NO: 1174717 - protein, 9 aa, Homo Sapiens
LIAFWQAFL

SEQ ID NO: 1174718 - protein, 9 aa, Homo Sapiens
LVLHLFCYI

SEQ ID NO: 1174719 - protein, 9 aa, Homo Sapiens
GGVTTNIHL

SEQ ID NO: 1174720 - protein, 9 aa, Homo Sapiens
LRQYQKRIT

SEQ ID NO: 1174721 - protein, 9 aa, Homo Sapiens
SFFMVVGKK

SEQ ID NO: 1174722 - protein, 9 aa, Homo Sapiens
NFLETLPRS

SEQ ID NO: 1174723 - protein, 9 aa, Homo Sapiens
SGHNPFLAS

SEQ ID NO: 1174724 - protein, 9 aa, Homo Sapiens
NNCIFIIIH

SEQ ID NO: 1174725 - protein, 9 aa, Homo Sapiens
LSVLAGAWQ

SEQ ID NO: 1174726 - protein, 9 aa, Homo Sapiens
SDAAFNHCA

SEQ ID NO: 1174727 - protein, 9 aa, Homo Sapiens
PTPIQPKAR

SEQ ID NO: 1174728 - protein, 9 aa, Homo Sapiens
DSSSRGRIQ

SEQ ID NO: 1174729 - protein, 9 aa, Homo Sapiens
SSYNLSCKL

SEQ ID NO: 1174730 - protein, 9 aa, Homo Sapiens
RVGSGYRFW

SEQ ID NO: 1174731 - protein, 9 aa, Homo Sapiens
PSVAGRCKA

SEQ ID NO: 1174732 - protein, 9 aa, Homo Sapiens
EECASELSR

SEQ ID NO: 1174733 - protein, 9 aa, Homo Sapiens
FVKWLGTDS

SEQ ID NO: 1174734 - protein, 9 aa, Homo Sapiens
PPAHVEKQL

SEQ ID NO: 1174735 - protein, 9 aa, Homo Sapiens
SRVTRSGLK

SEQ ID NO: 1174736 - protein, 9 aa, Homo Sapiens
LRESSSLSL

SEQ ID NO: 1174737 - protein, 9 aa, Homo Sapiens
CQHRERINR

SEQ ID NO: 1174738 - protein, 9 aa, Homo Sapiens
RTRSSGWMP

SEQ ID NO: 1174739 - protein, 9 aa, Homo Sapiens
PTRRPRSPS

SEQ ID NO: 1174740 - protein, 9 aa, Homo Sapiens
GGMWAAMDI

SEQ ID NO: 1174741 - protein, 9 aa, Homo Sapiens
GLQVPVKDH

SEQ ID NO: 1174742 - protein, 9 aa, Homo Sapiens
TAIVPLRYE

SEQ ID NO: 1174743 - protein, 9 aa, Homo Sapiens
RKMTTLERR

SEQ ID NO: 1174744 - protein, 9 aa, Homo Sapiens
VITVFMLNV

SEQ ID NO: 1174745 - protein, 9 aa, Homo Sapiens
RGSSDPLCC

SEQ ID NO: 1174746 - protein, 9 aa, Homo Sapiens
PTGRTPTTR

SEQ ID NO: 1174747 - protein, 9 aa, Homo Sapiens
TCLKMSIGA

SEQ ID NO: 1174748 - protein, 9 aa, Homo Sapiens
EGPSSCEKV

SEQ ID NO: 1174749 - protein, 9 aa, Homo Sapiens
RPRGGPTAA

SEQ ID NO: 1174750 - protein, 9 aa, Homo Sapiens
TVFMLNVHY

SEQ ID NO: 1174751 - protein, 9 aa, Homo Sapiens
SRRWRMSTW

SEQ ID NO: 1174752 - protein, 9 aa, Homo Sapiens
SLSTATSTL

SEQ ID NO: 1174753 - protein, 9 aa, Homo Sapiens
MLEKKNWSG

SEQ ID NO: 1174754 - protein, 9 aa, Homo Sapiens
GDHLTLLAM

SEQ ID NO: 1174755 - protein, 9 aa, Homo Sapiens
RFGVRKGSK

SEQ ID NO: 1174756 - protein, 9 aa, Homo Sapiens
ATSQYYFRI

SEQ ID NO: 1174757 - protein, 9 aa, Homo Sapiens
CNADVVIRV

SEQ ID NO: 1174758 - protein, 9 aa, Homo Sapiens
CTAQVDALN

SEQ ID NO: 1174759 - protein, 9 aa, Homo Sapiens
HPVLRAPGP

SEQ ID NO: 1174760 - protein, 9 aa, Homo Sapiens
GSDGIPGPF

SEQ ID NO: 1174761 - protein, 9 aa, Homo Sapiens
PWTPRPPRP

SEQ ID NO: 1174762 - protein, 9 aa, Homo Sapiens
TSQPKSKPT

SEQ ID NO: 1174763 - protein, 9 aa, Homo Sapiens
CSTISQNHT

SEQ ID NO: 1174764 - protein, 9 aa, Homo Sapiens
PGHGSGGGR

SEQ ID NO: 1174765 - protein, 9 aa, Homo Sapiens
SRYECATVI

SEQ ID NO: 1174766 - protein, 9 aa, Homo Sapiens
YVLDDFELP

SEQ ID NO: 1174767 - protein, 9 aa, Homo Sapiens
DSFAMEKTP

SEQ ID NO: 1174768 - protein, 9 aa, Homo Sapiens
YTLSVHPPV

SEQ ID NO: 1174769 - protein, 9 aa, Homo Sapiens
FTPCLIKKT

SEQ ID NO: 1174770 - protein, 9 aa, Homo Sapiens
EWVLPEEMV

SEQ ID NO: 1174771 - protein, 9 aa, Homo Sapiens
GTYVTLTPK

SEQ ID NO: 1174772 - protein, 9 aa, Homo Sapiens
GCPTWVLAG

SEQ ID NO: 1174773 - protein, 9 aa, Homo Sapiens
VAARHSGRG

SEQ ID NO: 1174774 - protein, 9 aa, Homo Sapiens
FSRIPPHRC

SEQ ID NO: 1174775 - protein, 9 aa, Homo Sapiens
SALSLVAAS

SEQ ID NO: 1174776 - protein, 9 aa, Homo Sapiens
LPLTRPRLL

SEQ ID NO: 1174777 - protein, 9 aa, Homo Sapiens
NTPYFIRSI

SEQ ID NO: 1174778 - protein, 9 aa, Homo Sapiens
DSSALYPAT

SEQ ID NO: 1174779 - protein, 9 aa, Homo Sapiens
KEKMMQLGG

SEQ ID NO: 1174780 - protein, 9 aa, Homo Sapiens
LSPPHPVLL

SEQ ID NO: 1174781 - protein, 9 aa, Homo Sapiens
GRRLGGEQR

SEQ ID NO: 1174782 - protein, 9 aa, Homo Sapiens
LPMVVVTAT

SEQ ID NO: 1174783 - protein, 9 aa, Homo Sapiens
GLTHPAHQP

SEQ ID NO: 1174784 - protein, 9 aa, Homo Sapiens
GAQHPPLIH

SEQ ID NO: 1174785 - protein, 9 aa, Homo Sapiens
HVQARLCFS

SEQ ID NO: 1174786 - protein, 9 aa, Homo Sapiens
DDYVRTCTL

SEQ ID NO: 1174787 - protein, 9 aa, Homo Sapiens
PGPQGSELP

SEQ ID NO: 1174788 - protein, 9 aa, Homo Sapiens
DGPRFLRLL

SEQ ID NO: 1174789 - protein, 9 aa, Homo Sapiens
TGGTLAIRF

SEQ ID NO: 1174790 - protein, 9 aa, Homo Sapiens
STKKRLRTM

SEQ ID NO: 1174791 - protein, 9 aa, Homo Sapiens
FQPYIEVIC

SEQ ID NO: 1174792 - protein, 9 aa, Homo Sapiens
TGPLGMPSD

SEQ ID NO: 1174793 - protein, 9 aa, Homo Sapiens
LCAGSPRKC

SEQ ID NO: 1174794 - protein, 9 aa, Homo Sapiens
QFIPWNFPL

SEQ ID NO: 1174795 - protein, 9 aa, Homo Sapiens
RPPPEPRQQ

SEQ ID NO: 1174796 - protein, 9 aa, Homo Sapiens
KRALTITGI

SEQ ID NO: 1174797 - protein, 9 aa, Homo Sapiens
VINWNQVAV

SEQ ID NO: 1174798 - protein, 9 aa, Homo Sapiens
SPAPTSSPA

SEQ ID NO: 1174799 - protein, 9 aa, Homo Sapiens
RFDSQGLAQ

SEQ ID NO: 1174800 - protein, 9 aa, Homo Sapiens
SQVVTLSQA

SEQ ID NO: 1174801 - protein, 9 aa, Homo Sapiens
LPGKAEPSL

SEQ ID NO: 1174802 - protein, 9 aa, Homo Sapiens
SGGRSRAEK

SEQ ID NO: 1174803 - protein, 9 aa, Homo Sapiens
VQSVLLLGV

SEQ ID NO: 1174804 - protein, 9 aa, Homo Sapiens
TPPAPRLLP

SEQ ID NO: 1174805 - protein, 9 aa, Homo Sapiens
PAHAEPASA

SEQ ID NO: 1174806 - protein, 9 aa, Homo Sapiens
PPRCTSSAS

SEQ ID NO: 1174807 - protein, 9 aa, Homo Sapiens
AASSSSTGT

SEQ ID NO: 1174808 - protein, 9 aa, Homo Sapiens
CWLSPPLGL

SEQ ID NO: 1174809 - protein, 9 aa, Homo Sapiens
SKFTNLEEA

SEQ ID NO: 1174810 - protein, 9 aa, Homo Sapiens
CFTYTMSQI

SEQ ID NO: 1174811 - protein, 9 aa, Homo Sapiens
LRSGANRTP

SEQ ID NO: 1174812 - protein, 9 aa, Homo Sapiens
DYEDLEHKY

SEQ ID NO: 1174813 - protein, 9 aa, Homo Sapiens
ARGREGGVG

SEQ ID NO: 1174814 - protein, 9 aa, Homo Sapiens
GGSSCKKEA

SEQ ID NO: 1174815 - protein, 9 aa, Homo Sapiens
KTLGIRAGS

SEQ ID NO: 1174816 - protein, 9 aa, Homo Sapiens
AGWEPSQPQ

SEQ ID NO: 1174817 - protein, 9 aa, Homo Sapiens
TVSAADLRK

SEQ ID NO: 1174818 - protein, 9 aa, Homo Sapiens
TDTQDTRPR

SEQ ID NO: 1174819 - protein, 9 aa, Homo Sapiens
GRRRNPGSK

SEQ ID NO: 1174820 - protein, 9 aa, Homo Sapiens
FTTDLRSNT

SEQ ID NO: 1174821 - protein, 9 aa, Homo Sapiens
QMLHSCRIQ

SEQ ID NO: 1174822 - protein, 9 aa, Homo Sapiens
LRARQVLGL

SEQ ID NO: 1174823 - protein, 9 aa, Homo Sapiens
QQRRSRGRP

SEQ ID NO: 1174824 - protein, 9 aa, Homo Sapiens
SPWKPSRPR

SEQ ID NO: 1174825 - protein, 9 aa, Homo Sapiens
WPEWRICST

SEQ ID NO: 1174826 - protein, 9 aa, Homo Sapiens
GVFREKPNL

SEQ ID NO: 1174827 - protein, 9 aa, Homo Sapiens
KSPNIPYMY

SEQ ID NO: 1174828 - protein, 9 aa, Homo Sapiens
QRSSCHLRM

SEQ ID NO: 1174829 - protein, 9 aa, Homo Sapiens
SSGGRTAAV

SEQ ID NO: 1174830 - protein, 9 aa, Homo Sapiens
KSFKQRTHL

SEQ ID NO: 1174831 - protein, 9 aa, Homo Sapiens
GVKASLLLS

SEQ ID NO: 1174832 - protein, 9 aa, Homo Sapiens
ISMTTLPTV

SEQ ID NO: 1174833 - protein, 9 aa, Homo Sapiens
PGRAGGAPA

SEQ ID NO: 1174834 - protein, 9 aa, Homo Sapiens
AGFDAVTGE

SEQ ID NO: 1174835 - protein, 9 aa, Homo Sapiens
WCKLCDWEI

SEQ ID NO: 1174836 - protein, 9 aa, Homo Sapiens
LPFLDVQYQ

SEQ ID NO: 1174837 - protein, 9 aa, Homo Sapiens
GGGVRWGWF

SEQ ID NO: 1174838 - protein, 9 aa, Homo Sapiens
KRSKEKTLG

SEQ ID NO: 1174839 - protein, 9 aa, Homo Sapiens
PTKQQRRSR

SEQ ID NO: 1174840 - protein, 9 aa, Homo Sapiens
SGFPDITEG

SEQ ID NO: 1174841 - protein, 9 aa, Homo Sapiens
LPVQLLCPR

SEQ ID NO: 1174842 - protein, 9 aa, Homo Sapiens
GNEEGHESY

SEQ ID NO: 1174843 - protein, 9 aa, Homo Sapiens
RKEENQAVK

SEQ ID NO: 1174844 - protein, 9 aa, Homo Sapiens
TSSSASISP

SEQ ID NO: 1174845 - protein, 9 aa, Homo Sapiens
PTYVSVDPA

SEQ ID NO: 1174846 - protein, 9 aa, Homo Sapiens
RWEQEVAEE

SEQ ID NO: 1174847 - protein, 9 aa, Homo Sapiens
ALTRRWPLP

SEQ ID NO: 1174848 - protein, 9 aa, Homo Sapiens
AVPGTKGRP

SEQ ID NO: 1174849 - protein, 9 aa, Homo Sapiens
TPTPRPIRT

SEQ ID NO: 1174850 - protein, 9 aa, Homo Sapiens
VVDHRLEMC

SEQ ID NO: 1174851 - protein, 9 aa, Homo Sapiens
VQRPRCFLT

SEQ ID NO: 1174852 - protein, 9 aa, Homo Sapiens
NRRRFRIRQ

SEQ ID NO: 1174853 - protein, 9 aa, Homo Sapiens
WMVLAQAPI

SEQ ID NO: 1174854 - protein, 9 aa, Homo Sapiens
PGGCHPAWL

SEQ ID NO: 1174855 - protein, 9 aa, Homo Sapiens
SIPQASHSH

SEQ ID NO: 1174856 - protein, 9 aa, Homo Sapiens
VVLLCGPSP

SEQ ID NO: 1174857 - protein, 9 aa, Homo Sapiens
PPSAPPTPS

SEQ ID NO: 1174858 - protein, 9 aa, Homo Sapiens
AGTPVPEKP

SEQ ID NO: 1174859 - protein, 9 aa, Homo Sapiens
LEQCETNLT

SEQ ID NO: 1174860 - protein, 9 aa, Homo Sapiens
KPQLNYKTK

SEQ ID NO: 1174861 - protein, 9 aa, Homo Sapiens
EQGAPLCAG

SEQ ID NO: 1174862 - protein, 9 aa, Homo Sapiens
AAAQGAVAR

SEQ ID NO: 1174863 - protein, 9 aa, Homo Sapiens
VVCHCGLDG

SEQ ID NO: 1174864 - protein, 9 aa, Homo Sapiens
FLQREDLLA

SEQ ID NO: 1174865 - protein, 9 aa, Homo Sapiens
RNGVRQVVV

SEQ ID NO: 1174866 - protein, 9 aa, Homo Sapiens
QGRRWGAWH

SEQ ID NO: 1174867 - protein, 9 aa, Homo Sapiens
VTPPTRGSS

SEQ ID NO: 1174868 - protein, 9 aa, Homo Sapiens
SGLCVPSAR

SEQ ID NO: 1174869 - protein, 9 aa, Homo Sapiens
EKKRGKPLE

SEQ ID NO: 1174870 - protein, 9 aa, Homo Sapiens
QKTIQIAII

SEQ ID NO: 1174871 - protein, 9 aa, Homo Sapiens
LAVPGTKGR

SEQ ID NO: 1174872 - protein, 9 aa, Homo Sapiens
DAPAKMSVM

SEQ ID NO: 1174873 - protein, 9 aa, Homo Sapiens
APPALVAPR

SEQ ID NO: 1174874 - protein, 9 aa, Homo Sapiens
TPPTNALTL

SEQ ID NO: 1174875 - protein, 9 aa, Homo Sapiens
TSSACSAGG

SEQ ID NO: 1174876 - protein, 9 aa, Homo Sapiens
ERTCTMRSG

SEQ ID NO: 1174877 - protein, 9 aa, Homo Sapiens
LATFVADRR

SEQ ID NO: 1174878 - protein, 9 aa, Homo Sapiens
DSQGLAQAC

SEQ ID NO: 1174879 - protein, 9 aa, Homo Sapiens
AAAGAAAPA

SEQ ID NO: 1174880 - protein, 9 aa, Homo Sapiens
YRWLSLFDF

SEQ ID NO: 1174881 - protein, 9 aa, Homo Sapiens
TKIWRWHLA

SEQ ID NO: 1174882 - protein, 9 aa, Homo Sapiens
MIALERPDI

SEQ ID NO: 1174883 - protein, 9 aa, Homo Sapiens
QLKDSSKSL

SEQ ID NO: 1174884 - protein, 9 aa, Homo Sapiens
REMALRASL

SEQ ID NO: 1174885 - protein, 9 aa, Homo Sapiens
AQGEEAVPE

SEQ ID NO: 1174886 - protein, 9 aa, Homo Sapiens
PPGSCGFTQ

SEQ ID NO: 1174887 - protein, 9 aa, Homo Sapiens
IRLHQLQEA

SEQ ID NO: 1174888 - protein, 9 aa, Homo Sapiens
AQAPRCCLC

SEQ ID NO: 1174889 - protein, 9 aa, Homo Sapiens
ADFGFVRYL

SEQ ID NO: 1174890 - protein, 9 aa, Homo Sapiens
YFLMCAPKH

SEQ ID NO: 1174891 - protein, 9 aa, Homo Sapiens
KDGKALSGH

SEQ ID NO: 1174892 - protein, 9 aa, Homo Sapiens
PFPRSSLHP

SEQ ID NO: 1174893 - protein, 9 aa, Homo Sapiens
PLRPPPLSL

SEQ ID NO: 1174894 - protein, 9 aa, Homo Sapiens
YKCAECCKS

SEQ ID NO: 1174895 - protein, 9 aa, Homo Sapiens
RAGEAGVIE

SEQ ID NO: 1174896 - protein, 9 aa, Homo Sapiens
SLPGPAPAS

SEQ ID NO: 1174897 - protein, 9 aa, Homo Sapiens
CFLTLPLTI

SEQ ID NO: 1174898 - protein, 9 aa, Homo Sapiens
QNGIKWQNF

SEQ ID NO: 1174899 - protein, 9 aa, Homo Sapiens
VLSSDGWLS

SEQ ID NO: 1174900 - protein, 9 aa, Homo Sapiens
GNLNLAWLL

SEQ ID NO: 1174901 - protein, 9 aa, Homo Sapiens
SRPRWPTPS

SEQ ID NO: 1174902 - protein, 9 aa, Homo Sapiens
AMTRDSLSN

SEQ ID NO: 1174903 - protein, 9 aa, Homo Sapiens
PAVAERVLR

SEQ ID NO: 1174904 - protein, 9 aa, Homo Sapiens
SISAEDDEE

SEQ ID NO: 1174905 - protein, 9 aa, Homo Sapiens
WRTSSACSA

SEQ ID NO: 1174906 - protein, 9 aa, Homo Sapiens
APCLADGQK

SEQ ID NO: 1174907 - protein, 9 aa, Homo Sapiens
EWQVSSDPR

SEQ ID NO: 1174908 - protein, 9 aa, Homo Sapiens
AQGILWTIR

SEQ ID NO: 1174909 - protein, 9 aa, Homo Sapiens
IGRVHCGAP

SEQ ID NO: 1174910 - protein, 9 aa, Homo Sapiens
SAWKNSWIQ

SEQ ID NO: 1174911 - protein, 9 aa, Homo Sapiens
VPPAVRPRP

SEQ ID NO: 1174912 - protein, 9 aa, Homo Sapiens
AIMQDLISE

SEQ ID NO: 1174913 - protein, 9 aa, Homo Sapiens
AAMDICATG

SEQ ID NO: 1174914 - protein, 9 aa, Homo Sapiens
VDFAINICT

SEQ ID NO: 1174915 - protein, 9 aa, Homo Sapiens
ENVLVSYSL

SEQ ID NO: 1174916 - protein, 9 aa, Homo Sapiens
SSSCLSQYF

SEQ ID NO: 1174917 - protein, 9 aa, Homo Sapiens
AKLDEKTQQ

SEQ ID NO: 1174918 - protein, 9 aa, Homo Sapiens
PTNALTLAQ

SEQ ID NO: 1174919 - protein, 9 aa, Homo Sapiens
RLLGAPAPP

SEQ ID NO: 1174920 - protein, 9 aa, Homo Sapiens
GRGLPGAAT

SEQ ID NO: 1174921 - protein, 9 aa, Homo Sapiens
PLLKEICDD

SEQ ID NO: 1174922 - protein, 9 aa, Homo Sapiens
ERVLFYRAR

SEQ ID NO: 1174923 - protein, 9 aa, Homo Sapiens
LYELIKKIS

SEQ ID NO: 1174924 - protein, 9 aa, Homo Sapiens
PPPAFPLTT

SEQ ID NO: 1174925 - protein, 9 aa, Homo Sapiens
TFAFPAPVQ

SEQ ID NO: 1174926 - protein, 9 aa, Homo Sapiens
ASSPLTTSP

SEQ ID NO: 1174927 - protein, 9 aa, Homo Sapiens
PPEDGVFVH

SEQ ID NO: 1174928 - protein, 9 aa, Homo Sapiens
APAEPAYPA

SEQ ID NO: 1174929 - protein, 9 aa, Homo Sapiens
PMICSLHQA

SEQ ID NO: 1174930 - protein, 9 aa, Homo Sapiens
QSCLIIATE

SEQ ID NO: 1174931 - protein, 9 aa, Homo Sapiens
RIPPHRCFL

SEQ ID NO: 1174932 - protein, 9 aa, Homo Sapiens
ENTIRIVDL

SEQ ID NO: 1174933 - protein, 9 aa, Homo Sapiens
DPQGYGNPN

SEQ ID NO: 1174934 - protein, 9 aa, Homo Sapiens
SRGAARPRP

SEQ ID NO: 1174935 - protein, 9 aa, Homo Sapiens
CSARWCLGR

SEQ ID NO: 1174936 - protein, 9 aa, Homo Sapiens
GPGPSQSPH

SEQ ID NO: 1174937 - protein, 9 aa, Homo Sapiens
RRGLLLGHS

SEQ ID NO: 1174938 - protein, 9 aa, Homo Sapiens
TWLFCPTTL

SEQ ID NO: 1174939 - protein, 9 aa, Homo Sapiens
NVDDSRISQ

SEQ ID NO: 1174940 - protein, 9 aa, Homo Sapiens
TWNPSTLGG

SEQ ID NO: 1174941 - protein, 9 aa, Homo Sapiens
LEEECEFYS

SEQ ID NO: 1174942 - protein, 9 aa, Homo Sapiens
DAAALPGSM

SEQ ID NO: 1174943 - protein, 9 aa, Homo Sapiens
FMTYEFLQA

SEQ ID NO: 1174944 - protein, 9 aa, Homo Sapiens
LLFRMLMVA

SEQ ID NO: 1174945 - protein, 9 aa, Homo Sapiens
ATGSFASAF

SEQ ID NO: 1174946 - protein, 9 aa, Homo Sapiens
QDLQVEIEP

SEQ ID NO: 1174947 - protein, 9 aa, Homo Sapiens
DKIKSDHPG

SEQ ID NO: 1174948 - protein, 9 aa, Homo Sapiens
GPTDGGEEE

SEQ ID NO: 1174949 - protein, 9 aa, Homo Sapiens
IRGGGGACP

SEQ ID NO: 1174950 - protein, 9 aa, Homo Sapiens
LTQPSPASA

SEQ ID NO: 1174951 - protein, 9 aa, Homo Sapiens
GRNFPDTFW

SEQ ID NO: 1174952 - protein, 9 aa, Homo Sapiens
WRSRSFPCW

SEQ ID NO: 1174953 - protein, 9 aa, Homo Sapiens
GNRRRFRIR

SEQ ID NO: 1174954 - protein, 9 aa, Homo Sapiens
PAQSLNHFL

SEQ ID NO: 1174955 - protein, 9 aa, Homo Sapiens
GDRASRASL

SEQ ID NO: 1174956 - protein, 9 aa, Homo Sapiens
KMGRCSCGQ

SEQ ID NO: 1174957 - protein, 9 aa, Homo Sapiens
WCFSCSRVT

SEQ ID NO: 1174958 - protein, 9 aa, Homo Sapiens
RPPQPPPAL

SEQ ID NO: 1174959 - protein, 9 aa, Homo Sapiens
LPSVPPLGL

SEQ ID NO: 1174960 - protein, 9 aa, Homo Sapiens
TLAQWSPVI

SEQ ID NO: 1174961 - protein, 9 aa, Homo Sapiens
DHIRSCGGV

SEQ ID NO: 1174962 - protein, 9 aa, Homo Sapiens
KQLNMIQQF

SEQ ID NO: 1174963 - protein, 9 aa, Homo Sapiens
GTGAQRVCC

SEQ ID NO: 1174964 - protein, 9 aa, Homo Sapiens
LRQAKDFDF

SEQ ID NO: 1174965 - protein, 9 aa, Homo Sapiens
TTALSVLVT

SEQ ID NO: 1174966 - protein, 9 aa, Homo Sapiens
MLTPSGSAS

SEQ ID NO: 1174967 - protein, 9 aa, Homo Sapiens
SQDPCTALA

SEQ ID NO: 1174968 - protein, 9 aa, Homo Sapiens
QKSSLSPPH

SEQ ID NO: 1174969 - protein, 9 aa, Homo Sapiens
LGSASPDPG

SEQ ID NO: 1174970 - protein, 9 aa, Homo Sapiens
LSTIKSILI

SEQ ID NO: 1174971 - protein, 9 aa, Homo Sapiens
GGVSTSWGP

SEQ ID NO: 1174972 - protein, 9 aa, Homo Sapiens
KFSTMKYEQ

SEQ ID NO: 1174973 - protein, 9 aa, Homo Sapiens
PGFTGLTIT

SEQ ID NO: 1174974 - protein, 9 aa, Homo Sapiens
NGQKGEPGE

SEQ ID NO: 1174975 - protein, 9 aa, Homo Sapiens
AWVLGWLPQ

SEQ ID NO: 1174976 - protein, 9 aa, Homo Sapiens
LHTSDWVSF

SEQ ID NO: 1174977 - protein, 9 aa, Homo Sapiens
TPTFSLKEK

SEQ ID NO: 1174978 - protein, 9 aa, Homo Sapiens
MIRSVWRLW

SEQ ID NO: 1174979 - protein, 9 aa, Homo Sapiens
DSYLSAGHV

SEQ ID NO: 1174980 - protein, 9 aa, Homo Sapiens
TEKKTQSLM

SEQ ID NO: 1174981 - protein, 9 aa, Homo Sapiens
LSSFLIFFI

SEQ ID NO: 1174982 - protein, 9 aa, Homo Sapiens
YECSVENDV

SEQ ID NO: 1174983 - protein, 9 aa, Homo Sapiens
VPWTPRPPR

SEQ ID NO: 1174984 - protein, 9 aa, Homo Sapiens
LRWEQEVAE

SEQ ID NO: 1174985 - protein, 9 aa, Homo Sapiens
CSCVSGLIT

SEQ ID NO: 1174986 - protein, 9 aa, Homo Sapiens
GRRPRAALS

SEQ ID NO: 1174987 - protein, 9 aa, Homo Sapiens
DIIEQLVES

SEQ ID NO: 1174988 - protein, 9 aa, Homo Sapiens
SVVPRMSSP

SEQ ID NO: 1174989 - protein, 9 aa, Homo Sapiens
KRFVTVAEL

SEQ ID NO: 1174990 - protein, 9 aa, Homo Sapiens
YVRTCTLHN

SEQ ID NO: 1174991 - protein, 9 aa, Homo Sapiens
EKLSATIVL

SEQ ID NO: 1174992 - protein, 9 aa, Homo Sapiens
TILRHHGLL

SEQ ID NO: 1174993 - protein, 9 aa, Homo Sapiens
APPECCSSW

SEQ ID NO: 1174994 - protein, 9 aa, Homo Sapiens
QAATGHHHR

SEQ ID NO: 1174995 - protein, 9 aa, Homo Sapiens
AESAGITLR

SEQ ID NO: 1174996 - protein, 9 aa, Homo Sapiens
PRLGQRRRG

SEQ ID NO: 1174997 - protein, 9 aa, Homo Sapiens
QNCVWQVWS

SEQ ID NO: 1174998 - protein, 9 aa, Homo Sapiens
QRAHTGERH

SEQ ID NO: 1174999 - protein, 9 aa, Homo Sapiens
QKKIWESWQ

SEQ ID NO: 1175000 - protein, 9 aa, Homo Sapiens
AQPPSLCGA

SEQ ID NO: 1175001 - protein, 9 aa, Homo Sapiens
YPATTTSPS

SEQ ID NO: 1175002 - protein, 9 aa, Homo Sapiens
YAHLAQLLE

SEQ ID NO: 1175003 - protein, 9 aa, Homo Sapiens
TKGTAWTCQ

SEQ ID NO: 1175004 - protein, 9 aa, Homo Sapiens
LCAGALMLA

SEQ ID NO: 1175005 - protein, 9 aa, Homo Sapiens
AFYLDEIEH

SEQ ID NO: 1175006 - protein, 9 aa, Homo Sapiens
NSWRSGGSG

SEQ ID NO: 1175007 - protein, 9 aa, Homo Sapiens
GQQHPLLGW

SEQ ID NO: 1175008 - protein, 9 aa, Homo Sapiens
RVGALVGLE

SEQ ID NO: 1175009 - protein, 9 aa, Homo Sapiens
LTTSSYNLS

SEQ ID NO: 1175010 - protein, 9 aa, Homo Sapiens
RTPTTRLMA

SEQ ID NO: 1175011 - protein, 9 aa, Homo Sapiens
LGGHLSFVR

SEQ ID NO: 1175012 - protein, 9 aa, Homo Sapiens
GTPQWGATW

SEQ ID NO: 1175013 - protein, 9 aa, Homo Sapiens
ASRTLYHIE

SEQ ID NO: 1175014 - protein, 9 aa, Homo Sapiens
QDSYITSTK

SEQ ID NO: 1175015 - protein, 9 aa, Homo Sapiens
QREDLLARE

SEQ ID NO: 1175016 - protein, 9 aa, Homo Sapiens
VGRAGGAVP

SEQ ID NO: 1175017 - protein, 9 aa, Homo Sapiens
AAQALPADA

SEQ ID NO: 1175018 - protein, 9 aa, Homo Sapiens
SNETPKKKR

SEQ ID NO: 1175019 - protein, 9 aa, Homo Sapiens
TRTCGRPST

SEQ ID NO: 1175020 - protein, 9 aa, Homo Sapiens
LLHVLISLL

SEQ ID NO: 1175021 - protein, 9 aa, Homo Sapiens
GGAGAASAY

SEQ ID NO: 1175022 - protein, 9 aa, Homo Sapiens
LNPAAQDGA

SEQ ID NO: 1175023 - protein, 9 aa, Homo Sapiens
EERVRRGSS

SEQ ID NO: 1175024 - protein, 9 aa, Homo Sapiens
TTFAFPAPV

SEQ ID NO: 1175025 - protein, 9 aa, Homo Sapiens
SQHILEAPQ

SEQ ID NO: 1175026 - protein, 9 aa, Homo Sapiens
PKTAPSLST

SEQ ID NO: 1175027 - protein, 9 aa, Homo Sapiens
ARLETLASK

SEQ ID NO: 1175028 - protein, 9 aa, Homo Sapiens
RLKDGVWSP

SEQ ID NO: 1175029 - protein, 9 aa, Homo Sapiens
GGPWPALAW

SEQ ID NO: 1175030 - protein, 9 aa, Homo Sapiens
SLRAARAHQ

SEQ ID NO: 1175031 - protein, 9 aa, Homo Sapiens
PGSGESHLQ

SEQ ID NO: 1175032 - protein, 9 aa, Homo Sapiens
PQAAALTTG

SEQ ID NO: 1175033 - protein, 9 aa, Homo Sapiens
KKRSAFPSR

SEQ ID NO: 1175034 - protein, 9 aa, Homo Sapiens
PCGLAWSKQ

SEQ ID NO: 1175035 - protein, 9 aa, Homo Sapiens
LVRPGSSWE

SEQ ID NO: 1175036 - protein, 9 aa, Homo Sapiens
PEQTHERPP

SEQ ID NO: 1175037 - protein, 9 aa, Homo Sapiens
DRSWLPCRG

SEQ ID NO: 1175038 - protein, 9 aa, Homo Sapiens
YFRGSYSYM

SEQ ID NO: 1175039 - protein, 9 aa, Homo Sapiens
PASGHHPPA

SEQ ID NO: 1175040 - protein, 9 aa, Homo Sapiens
RRFRIRQPI

SEQ ID NO: 1175041 - protein, 9 aa, Homo Sapiens
HTLLQLLDQ

SEQ ID NO: 1175042 - protein, 9 aa, Homo Sapiens
LTGGVTTNI

SEQ ID NO: 1175043 - protein, 9 aa, Homo Sapiens
RSTAPSPRA

SEQ ID NO: 1175044 - protein, 9 aa, Homo Sapiens
ALFGAQANP

SEQ ID NO: 1175045 - protein, 9 aa, Homo Sapiens
SKAWTPRKL

SEQ ID NO: 1175046 - protein, 9 aa, Homo Sapiens
FEHTIHAGF

SEQ ID NO: 1175047 - protein, 9 aa, Homo Sapiens
LDEDAPVPS

SEQ ID NO: 1175048 - protein, 9 aa, Homo Sapiens
TSAPTQAKS

SEQ ID NO: 1175049 - protein, 9 aa, Homo Sapiens
WQQLHWLQR

SEQ ID NO: 1175050 - protein, 9 aa, Homo Sapiens
VDPDSGHNA

SEQ ID NO: 1175051 - protein, 9 aa, Homo Sapiens
PVPDVGIGT

SEQ ID NO: 1175052 - protein, 9 aa, Homo Sapiens
GPERGAVGL

SEQ ID NO: 1175053 - protein, 9 aa, Homo Sapiens
VLWLKDNSE

SEQ ID NO: 1175054 - protein, 9 aa, Homo Sapiens
GRDKSPLTD

SEQ ID NO: 1175055 - protein, 9 aa, Homo Sapiens
KTFLLKAWA

SEQ ID NO: 1175056 - protein, 9 aa, Homo Sapiens
GKSACPSSP

SEQ ID NO: 1175057 - protein, 9 aa, Homo Sapiens
STMKYEQGT

SEQ ID NO: 1175058 - protein, 9 aa, Homo Sapiens
ANPSAAPHT

SEQ ID NO: 1175059 - protein, 9 aa, Homo Sapiens
LLSTTGESE

SEQ ID NO: 1175060 - protein, 9 aa, Homo Sapiens
DAFPVAGQN

SEQ ID NO: 1175061 - protein, 9 aa, Homo Sapiens
DLELHPPAI

SEQ ID NO: 1175062 - protein, 9 aa, Homo Sapiens
APRTCAGRS

SEQ ID NO: 1175063 - protein, 9 aa, Homo Sapiens
DHIKNYHPQ

SEQ ID NO: 1175064 - protein, 9 aa, Homo Sapiens
DGLLNRCRG

SEQ ID NO: 1175065 - protein, 9 aa, Homo Sapiens
KFLGLWAYI

SEQ ID NO: 1175066 - protein, 9 aa, Homo Sapiens
QTRVPPGRA

SEQ ID NO: 1175067 - protein, 9 aa, Homo Sapiens
FTWVDHSEC

SEQ ID NO: 1175068 - protein, 9 aa, Homo Sapiens
PGHHCWVHI

SEQ ID NO: 1175069 - protein, 9 aa, Homo Sapiens
WALRFQRLV

SEQ ID NO: 1175070 - protein, 9 aa, Homo Sapiens
PPDKRRNTE

SEQ ID NO: 1175071 - protein, 9 aa, Homo Sapiens
LQEAPSRAL

SEQ ID NO: 1175072 - protein, 9 aa, Homo Sapiens
PNCGLWQRS

SEQ ID NO: 1175073 - protein, 9 aa, Homo Sapiens
SYLSAGHVR

SEQ ID NO: 1175074 - protein, 9 aa, Homo Sapiens
GAKSEHRNF

SEQ ID NO: 1175075 - protein, 9 aa, Homo Sapiens
PRHGPTRST

SEQ ID NO: 1175076 - protein, 9 aa, Homo Sapiens
RKNRTRTTP

SEQ ID NO: 1175077 - protein, 9 aa, Homo Sapiens
SNSFSHNSY

SEQ ID NO: 1175078 - protein, 9 aa, Homo Sapiens
INDTTDVND

SEQ ID NO: 1175079 - protein, 9 aa, Homo Sapiens
KKKRSAFPS

SEQ ID NO: 1175080 - protein, 9 aa, Homo Sapiens
VLAISFHLL

SEQ ID NO: 1175081 - protein, 9 aa, Homo Sapiens
GIPGRYLTG

SEQ ID NO: 1175082 - protein, 9 aa, Homo Sapiens
FEDIIKNDG

SEQ ID NO: 1175083 - protein, 9 aa, Homo Sapiens
PPPPGPANP

SEQ ID NO: 1175084 - protein, 9 aa, Homo Sapiens
FSVNEACII

SEQ ID NO: 1175085 - protein, 9 aa, Homo Sapiens
WLGVAWVLG

SEQ ID NO: 1175086 - protein, 9 aa, Homo Sapiens
TTPDNTAAQ

SEQ ID NO: 1175087 - protein, 9 aa, Homo Sapiens
YLDPDVEYE

SEQ ID NO: 1175088 - protein, 9 aa, Homo Sapiens
MNKDVQMRA

SEQ ID NO: 1175089 - protein, 9 aa, Homo Sapiens
QEFGGAVED

SEQ ID NO: 1175090 - protein, 9 aa, Homo Sapiens
WIEACCSLQ

SEQ ID NO: 1175091 - protein, 9 aa, Homo Sapiens
EDWYHTLHP

SEQ ID NO: 1175092 - protein, 9 aa, Homo Sapiens
CRAFGHYTL

SEQ ID NO: 1175093 - protein, 9 aa, Homo Sapiens
GGVSVYGLV

SEQ ID NO: 1175094 - protein, 9 aa, Homo Sapiens
SAYELVVTV

SEQ ID NO: 1175095 - protein, 9 aa, Homo Sapiens
PRARLETLA

SEQ ID NO: 1175096 - protein, 9 aa, Homo Sapiens
TALVKLPRN

SEQ ID NO: 1175097 - protein, 9 aa, Homo Sapiens
SHGSNAVGR

SEQ ID NO: 1175098 - protein, 9 aa, Homo Sapiens
TPPACQGMA

SEQ ID NO: 1175099 - protein, 9 aa, Homo Sapiens
NLSSMTPTD

SEQ ID NO: 1175100 - protein, 9 aa, Homo Sapiens
PNLEPAPPA

SEQ ID NO: 1175101 - protein, 9 aa, Homo Sapiens
RGPRAEPPP

SEQ ID NO: 1175102 - protein, 9 aa, Homo Sapiens
TEGNRNHNY

SEQ ID NO: 1175103 - protein, 9 aa, Homo Sapiens
TIRIVDLGE

SEQ ID NO: 1175104 - protein, 9 aa, Homo Sapiens
GSRVVPNTA

SEQ ID NO: 1175105 - protein, 9 aa, Homo Sapiens
LIMHGDLFS

SEQ ID NO: 1175106 - protein, 9 aa, Homo Sapiens
LIHSPQSYS

SEQ ID NO: 1175107 - protein, 9 aa, Homo Sapiens
TVRMTQEFL

SEQ ID NO: 1175108 - protein, 9 aa, Homo Sapiens
AGAPMGSSR

SEQ ID NO: 1175109 - protein, 9 aa, Homo Sapiens
QTTDNYQPY

SEQ ID NO: 1175110 - protein, 9 aa, Homo Sapiens
TPAPPSCSG

SEQ ID NO: 1175111 - protein, 9 aa, Homo Sapiens
ANSHQETKY

SEQ ID NO: 1175112 - protein, 9 aa, Homo Sapiens
VTFDYQSKM

SEQ ID NO: 1175113 - protein, 9 aa, Homo Sapiens
RIGKVVKVF

SEQ ID NO: 1175114 - protein, 9 aa, Homo Sapiens
SAAATTSPP

SEQ ID NO: 1175115 - protein, 9 aa, Homo Sapiens
LSSQTSVSC

SEQ ID NO: 1175116 - protein, 9 aa, Homo Sapiens
DELTVTNAR

SEQ ID NO: 1175117 - protein, 9 aa, Homo Sapiens
LYGLASAAS

SEQ ID NO: 1175118 - protein, 9 aa, Homo Sapiens
FLRESSSLS

SEQ ID NO: 1175119 - protein, 9 aa, Homo Sapiens
RCTSSASSS

SEQ ID NO: 1175120 - protein, 9 aa, Homo Sapiens
EKNTKRKNH

SEQ ID NO: 1175121 - protein, 9 aa, Homo Sapiens
LVKRPSLHR

SEQ ID NO: 1175122 - protein, 9 aa, Homo Sapiens
IPEVLQARE

SEQ ID NO: 1175123 - protein, 9 aa, Homo Sapiens
AECGRGFQH

SEQ ID NO: 1175124 - protein, 9 aa, Homo Sapiens
TQIPQGCLP

SEQ ID NO: 1175125 - protein, 9 aa, Homo Sapiens
AGGAAAARG

SEQ ID NO: 1175126 - protein, 9 aa, Homo Sapiens
QELDRMKEN

SEQ ID NO: 1175127 - protein, 9 aa, Homo Sapiens
FKGRGQILH

SEQ ID NO: 1175128 - protein, 9 aa, Homo Sapiens
CTRILVFPT

SEQ ID NO: 1175129 - protein, 9 aa, Homo Sapiens
CSSISERRW

SEQ ID NO: 1175130 - protein, 9 aa, Homo Sapiens
SKAKLVALE

SEQ ID NO: 1175131 - protein, 9 aa, Homo Sapiens
QMQEQECRE

SEQ ID NO: 1175132 - protein, 9 aa, Homo Sapiens
ETKTVRQWS

SEQ ID NO: 1175133 - protein, 9 aa, Homo Sapiens
AVGKARRRN

SEQ ID NO: 1175134 - protein, 9 aa, Homo Sapiens
HLLINSRKC

SEQ ID NO: 1175135 - protein, 9 aa, Homo Sapiens
SVRLFVNRF

SEQ ID NO: 1175136 - protein, 9 aa, Homo Sapiens
ARVPTPVWS

SEQ ID NO: 1175137 - protein, 9 aa, Homo Sapiens
VALLTMWTC

SEQ ID NO: 1175138 - protein, 9 aa, Homo Sapiens
EGAGRHSPA

SEQ ID NO: 1175139 - protein, 9 aa, Homo Sapiens
WMPGMNMKM

SEQ ID NO: 1175140 - protein, 9 aa, Homo Sapiens
ELDPVRRRE

SEQ ID NO: 1175141 - protein, 9 aa, Homo Sapiens
LLSPCNASI

SEQ ID NO: 1175142 - protein, 9 aa, Homo Sapiens
VRTCTLHNW

SEQ ID NO: 1175143 - protein, 9 aa, Homo Sapiens
ELKAPRAAQ

SEQ ID NO: 1175144 - protein, 9 aa, Homo Sapiens
PGTFSFRHA

SEQ ID NO: 1175145 - protein, 9 aa, Homo Sapiens
LPTLPPYWC

SEQ ID NO: 1175146 - protein, 9 aa, Homo Sapiens
ANVAMQNHA

SEQ ID NO: 1175147 - protein, 9 aa, Homo Sapiens
TGTNLSPVF

SEQ ID NO: 1175148 - protein, 9 aa, Homo Sapiens
LKFWHKKWI

SEQ ID NO: 1175149 - protein, 9 aa, Homo Sapiens
ECTLESAAI

SEQ ID NO: 1175150 - protein, 9 aa, Homo Sapiens
GAPRRAPHP

SEQ ID NO: 1175151 - protein, 9 aa, Homo Sapiens
PPLPPPPSR

SEQ ID NO: 1175152 - protein, 9 aa, Homo Sapiens
PMGSSRTLG

SEQ ID NO: 1175153 - protein, 9 aa, Homo Sapiens
DLCQQLREI

SEQ ID NO: 1175154 - protein, 9 aa, Homo Sapiens
LSCSCSSSL

SEQ ID NO: 1175155 - protein, 9 aa, Homo Sapiens
DVLEQRDSK

SEQ ID NO: 1175156 - protein, 9 aa, Homo Sapiens
PQLLLAHAA

SEQ ID NO: 1175157 - protein, 9 aa, Homo Sapiens
QAPLRLWSW

SEQ ID NO: 1175158 - protein, 9 aa, Homo Sapiens
IEHPDHNQV

SEQ ID NO: 1175159 - protein, 9 aa, Homo Sapiens
AAWHVVPPS

SEQ ID NO: 1175160 - protein, 9 aa, Homo Sapiens
GLGWKWIHE

SEQ ID NO: 1175161 - protein, 9 aa, Homo Sapiens
KMTHLKDLI

SEQ ID NO: 1175162 - protein, 9 aa, Homo Sapiens
GLRPCRCCR

SEQ ID NO: 1175163 - protein, 9 aa, Homo Sapiens
SDVLFGAKL

SEQ ID NO: 1175164 - protein, 9 aa, Homo Sapiens
AYIRGSKIR

SEQ ID NO: 1175165 - protein, 9 aa, Homo Sapiens
PLSISRPTS

SEQ ID NO: 1175166 - protein, 9 aa, Homo Sapiens
DFLSVGPMS

SEQ ID NO: 1175167 - protein, 9 aa, Homo Sapiens
PPHDCMPIA

SEQ ID NO: 1175168 - protein, 9 aa, Homo Sapiens
IIRVVSFTE

SEQ ID NO: 1175169 - protein, 9 aa, Homo Sapiens
HKNGVKIER

SEQ ID NO: 1175170 - protein, 9 aa, Homo Sapiens
LVAHHEDDD

SEQ ID NO: 1175171 - protein, 9 aa, Homo Sapiens
VNESFGFTT

SEQ ID NO: 1175172 - protein, 9 aa, Homo Sapiens
LTTPPERRR

SEQ ID NO: 1175173 - protein, 9 aa, Homo Sapiens
GEVVTFDYQ

SEQ ID NO: 1175174 - protein, 9 aa, Homo Sapiens
EATSQYYFR

SEQ ID NO: 1175175 - protein, 9 aa, Homo Sapiens
GNKCALEDE

SEQ ID NO: 1175176 - protein, 9 aa, Homo Sapiens
RIGGGTPLS

SEQ ID NO: 1175177 - protein, 9 aa, Homo Sapiens
HISVKNHSL

SEQ ID NO: 1175178 - protein, 9 aa, Homo Sapiens
LTKSQSCLT

SEQ ID NO: 1175179 - protein, 9 aa, Homo Sapiens
DIEQLIHSP

SEQ ID NO: 1175180 - protein, 9 aa, Homo Sapiens
SPPTKQQRR

SEQ ID NO: 1175181 - protein, 9 aa, Homo Sapiens
GGGPSVFCP

SEQ ID NO: 1175182 - protein, 9 aa, Homo Sapiens
PKEMVPPGG

SEQ ID NO: 1175183 - protein, 9 aa, Homo Sapiens
QGSAASSRQ

SEQ ID NO: 1175184 - protein, 9 aa, Homo Sapiens
STGPPTSCS

SEQ ID NO: 1175185 - protein, 9 aa, Homo Sapiens
VKPHYKRKG

SEQ ID NO: 1175186 - protein, 9 aa, Homo Sapiens
GAGEVGNFA

SEQ ID NO: 1175187 - protein, 9 aa, Homo Sapiens
PPPLSLPTR

SEQ ID NO: 1175188 - protein, 9 aa, Homo Sapiens
RVTGVSFRV

SEQ ID NO: 1175189 - protein, 9 aa, Homo Sapiens
LAGPCRAAF

SEQ ID NO: 1175190 - protein, 9 aa, Homo Sapiens
FSDVAISMT

SEQ ID NO: 1175191 - protein, 9 aa, Homo Sapiens
YPLGPHPSS

SEQ ID NO: 1175192 - protein, 9 aa, Homo Sapiens
HNKQMEAEF

SEQ ID NO: 1175193 - protein, 9 aa, Homo Sapiens
YKQSQHTTE

SEQ ID NO: 1175194 - protein, 9 aa, Homo Sapiens
GPHPADPPL

SEQ ID NO: 1175195 - protein, 9 aa, Homo Sapiens
VTVRDGGSP

SEQ ID NO: 1175196 - protein, 9 aa, Homo Sapiens
SGSQSGTKM

SEQ ID NO: 1175197 - protein, 9 aa, Homo Sapiens
VVTINHIVD

SEQ ID NO: 1175198 - protein, 9 aa, Homo Sapiens
KVENFNVAG

SEQ ID NO: 1175199 - protein, 9 aa, Homo Sapiens
KQLVSPEAS

SEQ ID NO: 1175200 - protein, 9 aa, Homo Sapiens
MDYRLMMLQ

SEQ ID NO: 1175201 - protein, 9 aa, Homo Sapiens
QEQECREQQ

SEQ ID NO: 1175202 - protein, 9 aa, Homo Sapiens
GEDIFWTCL

SEQ ID NO: 1175203 - protein, 9 aa, Homo Sapiens
AVGKQWHMR

SEQ ID NO: 1175204 - protein, 9 aa, Homo Sapiens
VWRLWSWAA

SEQ ID NO: 1175205 - protein, 9 aa, Homo Sapiens
KGVSWGAGR

SEQ ID NO: 1175206 - protein, 9 aa, Homo Sapiens
KPLIQWEKD

SEQ ID NO: 1175207 - protein, 9 aa, Homo Sapiens
SALYPATTT

SEQ ID NO: 1175208 - protein, 9 aa, Homo Sapiens
GNQEKKRGK

SEQ ID NO: 1175209 - protein, 9 aa, Homo Sapiens
TAMLELSSI

SEQ ID NO: 1175210 - protein, 9 aa, Homo Sapiens
YYHSGPESG

SEQ ID NO: 1175211 - protein, 9 aa, Homo Sapiens
KMIRRGDVP

SEQ ID NO: 1175212 - protein, 9 aa, Homo Sapiens
AAAGSGGGR

SEQ ID NO: 1175213 - protein, 9 aa, Homo Sapiens
HKVCPVLWA

SEQ ID NO: 1175214 - protein, 9 aa, Homo Sapiens
PPLPVPDVG

SEQ ID NO: 1175215 - protein, 9 aa, Homo Sapiens
AGISVVSRG

SEQ ID NO: 1175216 - protein, 9 aa, Homo Sapiens
ATRRMKLRS

SEQ ID NO: 1175217 - protein, 9 aa, Homo Sapiens
CATVILHSP

SEQ ID NO: 1175218 - protein, 9 aa, Homo Sapiens
GSNGSKKFS

SEQ ID NO: 1175219 - protein, 9 aa, Homo Sapiens
WPSSAGRSW

SEQ ID NO: 1175220 - protein, 9 aa, Homo Sapiens
KMNKDVQMR

SEQ ID NO: 1175221 - protein, 9 aa, Homo Sapiens
LVRDCGAWP

SEQ ID NO: 1175222 - protein, 9 aa, Homo Sapiens
WGSRVVPNT

SEQ ID NO: 1175223 - protein, 9 aa, Homo Sapiens
QSRGPHPAD

SEQ ID NO: 1175224 - protein, 9 aa, Homo Sapiens
VLDCGPQLP

SEQ ID NO: 1175225 - protein, 9 aa, Homo Sapiens
ELPTTEHCP

SEQ ID NO: 1175226 - protein, 9 aa, Homo Sapiens
VHLEYGLPS

SEQ ID NO: 1175227 - protein, 9 aa, Homo Sapiens
VSTSWGPTA

SEQ ID NO: 1175228 - protein, 9 aa, Homo Sapiens
SGIQAPACS

SEQ ID NO: 1175229 - protein, 9 aa, Homo Sapiens
AAHQGVGVS

SEQ ID NO: 1175230 - protein, 9 aa, Homo Sapiens
WLPQWAAWR

SEQ ID NO: 1175231 - protein, 9 aa, Homo Sapiens
DVHGGGEGG

SEQ ID NO: 1175232 - protein, 9 aa, Homo Sapiens
GGKGPGVSR

SEQ ID NO: 1175233 - protein, 9 aa, Homo Sapiens
TKIILKVRA

SEQ ID NO: 1175234 - protein, 9 aa, Homo Sapiens
GREEIQVWP

SEQ ID NO: 1175235 - protein, 9 aa, Homo Sapiens
RTLEGCISV

SEQ ID NO: 1175236 - protein, 9 aa, Homo Sapiens
GGCLPPEPG

SEQ ID NO: 1175237 - protein, 9 aa, Homo Sapiens
VHQRCVQRC

SEQ ID NO: 1175238 - protein, 9 aa, Homo Sapiens
RPAVDPAAW

SEQ ID NO: 1175239 - protein, 9 aa, Homo Sapiens
GAAHDVGGR

SEQ ID NO: 1175240 - protein, 9 aa, Homo Sapiens
RVGQRAEAA

SEQ ID NO: 1175241 - protein, 9 aa, Homo Sapiens
AASACSAAG

SEQ ID NO: 1175242 - protein, 9 aa, Homo Sapiens
NKWTETSAE

SEQ ID NO: 1175243 - protein, 9 aa, Homo Sapiens
IAPPTPTSP

SEQ ID NO: 1175244 - protein, 9 aa, Homo Sapiens
NLVYHILRT

SEQ ID NO: 1175245 - protein, 9 aa, Homo Sapiens
GCLCRAPPS

SEQ ID NO: 1175246 - protein, 9 aa, Homo Sapiens
GNGEGRRPQ

SEQ ID NO: 1175247 - protein, 9 aa, Homo Sapiens
ICWRSPTHL

SEQ ID NO: 1175248 - protein, 9 aa, Homo Sapiens
DPRTMSRKI

SEQ ID NO: 1175249 - protein, 9 aa, Homo Sapiens
RRYLSGIKD

SEQ ID NO: 1175250 - protein, 9 aa, Homo Sapiens
AAGAGRGQE

SEQ ID NO: 1175251 - protein, 9 aa, Homo Sapiens
SRWTRMSLG

SEQ ID NO: 1175252 - protein, 9 aa, Homo Sapiens
LPSASPFSA

SEQ ID NO: 1175253 - protein, 9 aa, Homo Sapiens
AQETIADYQ

SEQ ID NO: 1175254 - protein, 9 aa, Homo Sapiens
LYDLDQGPR

SEQ ID NO: 1175255 - protein, 9 aa, Homo Sapiens
PACPISTTL

SEQ ID NO: 1175256 - protein, 9 aa, Homo Sapiens
PWLVAKAFG

SEQ ID NO: 1175257 - protein, 9 aa, Homo Sapiens
VLWTLYFYL

SEQ ID NO: 1175258 - protein, 9 aa, Homo Sapiens
PSGKSACPS

SEQ ID NO: 1175259 - protein, 9 aa, Homo Sapiens
ATAREDGDR

SEQ ID NO: 1175260 - protein, 9 aa, Homo Sapiens
RLQEFGGAV

SEQ ID NO: 1175261 - protein, 9 aa, Homo Sapiens
ASRAGTTTP

SEQ ID NO: 1175262 - protein, 9 aa, Homo Sapiens
EDMILLTFT

SEQ ID NO: 1175263 - protein, 9 aa, Homo Sapiens
SASPFSATT

SEQ ID NO: 1175264 - protein, 9 aa, Homo Sapiens
YFQNRTDSN

SEQ ID NO: 1175265 - protein, 9 aa, Homo Sapiens
RRTRSAWGD

SEQ ID NO: 1175266 - protein, 9 aa, Homo Sapiens
KHSISTQLK

SEQ ID NO: 1175267 - protein, 9 aa, Homo Sapiens
IDIVVIIPY

SEQ ID NO: 1175268 - protein, 9 aa, Homo Sapiens
MASLYKRFT

SEQ ID NO: 1175269 - protein, 9 aa, Homo Sapiens
PSRPTGRTP

SEQ ID NO: 1175270 - protein, 9 aa, Homo Sapiens
QGSFEKKIR

SEQ ID NO: 1175271 - protein, 9 aa, Homo Sapiens
GVRKGSKRG

SEQ ID NO: 1175272 - protein, 9 aa, Homo Sapiens
NPLTTSSYN

SEQ ID NO: 1175273 - protein, 9 aa, Homo Sapiens
TSGSPREAR

SEQ ID NO: 1175274 - protein, 9 aa, Homo Sapiens
PPIHQWRTQ

SEQ ID NO: 1175275 - protein, 9 aa, Homo Sapiens
ASVIKERVP

SEQ ID NO: 1175276 - protein, 9 aa, Homo Sapiens
DWFPPCGGG

SEQ ID NO: 1175277 - protein, 9 aa, Homo Sapiens
TSGIQAPAC

SEQ ID NO: 1175278 - protein, 9 aa, Homo Sapiens
RAEGALRSA

SEQ ID NO: 1175279 - protein, 9 aa, Homo Sapiens
TSPHHPQRC

SEQ ID NO: 1175280 - protein, 9 aa, Homo Sapiens
PPAPRQGSR

SEQ ID NO: 1175281 - protein, 9 aa, Homo Sapiens
FLKHIRTQH

SEQ ID NO: 1175282 - protein, 9 aa, Homo Sapiens
GCRAPPGGG

SEQ ID NO: 1175283 - protein, 9 aa, Homo Sapiens
RTEKLISPC

SEQ ID NO: 1175284 - protein, 9 aa, Homo Sapiens
AYAPPRSSP

SEQ ID NO: 1175285 - protein, 9 aa, Homo Sapiens
VEAASSALA

SEQ ID NO: 1175286 - protein, 9 aa, Homo Sapiens
RDEAGGGPG

SEQ ID NO: 1175287 - protein, 9 aa, Homo Sapiens
KECLTISFP

SEQ ID NO: 1175288 - protein, 9 aa, Homo Sapiens
LELKCKHSK

SEQ ID NO: 1175289 - protein, 9 aa, Homo Sapiens
SQMAIEERK

SEQ ID NO: 1175290 - protein, 9 aa, Homo Sapiens
ACCRPSRGM

SEQ ID NO: 1175291 - protein, 9 aa, Homo Sapiens
GTDHIRSCG

SEQ ID NO: 1175292 - protein, 9 aa, Homo Sapiens
WSFVKWLGT

SEQ ID NO: 1175293 - protein, 9 aa, Homo Sapiens
KSKPTTGHA

SEQ ID NO: 1175294 - protein, 9 aa, Homo Sapiens
AQQKKLQEM

SEQ ID NO: 1175295 - protein, 9 aa, Homo Sapiens
SRPSWPSCP

SEQ ID NO: 1175296 - protein, 9 aa, Homo Sapiens
LKDNSELPS

SEQ ID NO: 1175297 - protein, 9 aa, Homo Sapiens
SMRTVTVPR

SEQ ID NO: 1175298 - protein, 9 aa, Homo Sapiens
PLTTSSYNL

SEQ ID NO: 1175299 - protein, 9 aa, Homo Sapiens
KAFGHRSMD

SEQ ID NO: 1175300 - protein, 9 aa, Homo Sapiens
CHRRYYHTG

SEQ ID NO: 1175301 - protein, 9 aa, Homo Sapiens
GQSNFNRDP

SEQ ID NO: 1175302 - protein, 9 aa, Homo Sapiens
IYPAGLGRW

SEQ ID NO: 1175303 - protein, 9 aa, Homo Sapiens
CSMQRTREG

SEQ ID NO: 1175304 - protein, 9 aa, Homo Sapiens
RRHQPPTPT

SEQ ID NO: 1175305 - protein, 9 aa, Homo Sapiens
GSPRKCSAL

SEQ ID NO: 1175306 - protein, 9 aa, Homo Sapiens
ASGGPWPAL

SEQ ID NO: 1175307 - protein, 9 aa, Homo Sapiens
SPAPTPPPT

SEQ ID NO: 1175308 - protein, 9 aa, Homo Sapiens
INPVKRLIN

SEQ ID NO: 1175309 - protein, 9 aa, Homo Sapiens
EPGRPLGPP

SEQ ID NO: 1175310 - protein, 9 aa, Homo Sapiens
DSSKSLSMF

SEQ ID NO: 1175311 - protein, 9 aa, Homo Sapiens
AAGSGGGRR

SEQ ID NO: 1175312 - protein, 9 aa, Homo Sapiens
VVEMMIARL

SEQ ID NO: 1175313 - protein, 9 aa, Homo Sapiens
IQKVWAIPD

SEQ ID NO: 1175314 - protein, 9 aa, Homo Sapiens
PRGPLPMGP

SEQ ID NO: 1175315 - protein, 9 aa, Homo Sapiens
TESVKECDS

SEQ ID NO: 1175316 - protein, 9 aa, Homo Sapiens
GFTGLTITD

SEQ ID NO: 1175317 - protein, 9 aa, Homo Sapiens
TRRKTFSQK

SEQ ID NO: 1175318 - protein, 9 aa, Homo Sapiens
HHSCTPVPV

SEQ ID NO: 1175319 - protein, 9 aa, Homo Sapiens
EKNSGSQSG

SEQ ID NO: 1175320 - protein, 9 aa, Homo Sapiens
VRVGRMCFL

SEQ ID NO: 1175321 - protein, 9 aa, Homo Sapiens
PSGASTRPT

SEQ ID NO: 1175322 - protein, 9 aa, Homo Sapiens
GAHANFFHP

SEQ ID NO: 1175323 - protein, 9 aa, Homo Sapiens
SLQPKTAPS

SEQ ID NO: 1175324 - protein, 9 aa, Homo Sapiens
AAAQALPAD

SEQ ID NO: 1175325 - protein, 9 aa, Homo Sapiens
KIRSGWRSV

SEQ ID NO: 1175326 - protein, 9 aa, Homo Sapiens
IRSVWRLWS

SEQ ID NO: 1175327 - protein, 9 aa, Homo Sapiens
SATSMAGRK

SEQ ID NO: 1175328 - protein, 9 aa, Homo Sapiens
VRQPQEGAA

SEQ ID NO: 1175329 - protein, 9 aa, Homo Sapiens
KKVLNLCLL

SEQ ID NO: 1175330 - protein, 9 aa, Homo Sapiens
DTSAWRTPV

SEQ ID NO: 1175331 - protein, 9 aa, Homo Sapiens
FWYSDQCNM

SEQ ID NO: 1175332 - protein, 9 aa, Homo Sapiens
PYEREGLAG

SEQ ID NO: 1175333 - protein, 9 aa, Homo Sapiens
EVDFAINIC

SEQ ID NO: 1175334 - protein, 9 aa, Homo Sapiens
SMKAGLENM

SEQ ID NO: 1175335 - protein, 9 aa, Homo Sapiens
MPMEFDFDD

SEQ ID NO: 1175336 - protein, 9 aa, Homo Sapiens
SKCITECVR

SEQ ID NO: 1175337 - protein, 9 aa, Homo Sapiens
SQPRGSSSC

SEQ ID NO: 1175338 - protein, 9 aa, Homo Sapiens
FDDYVRTCT

SEQ ID NO: 1175339 - protein, 9 aa, Homo Sapiens
CRQTPPGSA

SEQ ID NO: 1175340 - protein, 9 aa, Homo Sapiens
ACVLWKKGL

SEQ ID NO: 1175341 - protein, 9 aa, Homo Sapiens
PPPMLEDVC

SEQ ID NO: 1175342 - protein, 9 aa, Homo Sapiens
HYVLDRHRT

SEQ ID NO: 1175343 - protein, 9 aa, Homo Sapiens
KPDPECEWH

SEQ ID NO: 1175344 - protein, 9 aa, Homo Sapiens
ASCWTSHWP

SEQ ID NO: 1175345 - protein, 9 aa, Homo Sapiens
NQWWELFDS

SEQ ID NO: 1175346 - protein, 9 aa, Homo Sapiens
EGKGIFTTS

SEQ ID NO: 1175347 - protein, 9 aa, Homo Sapiens
LFASRPASP

SEQ ID NO: 1175348 - protein, 9 aa, Homo Sapiens
LVAKAFGPA

SEQ ID NO: 1175349 - protein, 9 aa, Homo Sapiens
KTATKIYSQ

SEQ ID NO: 1175350 - protein, 9 aa, Homo Sapiens
FSSGSQPLL

SEQ ID NO: 1175351 - protein, 9 aa, Homo Sapiens
QPSPASACT

SEQ ID NO: 1175352 - protein, 9 aa, Homo Sapiens
GLLFRMLMV

SEQ ID NO: 1175353 - protein, 9 aa, Homo Sapiens
KAAHKGKIS

SEQ ID NO: 1175354 - protein, 9 aa, Homo Sapiens
RRPRAALSV

SEQ ID NO: 1175355 - protein, 9 aa, Homo Sapiens
GAPCLADGQ

SEQ ID NO: 1175356 - protein, 9 aa, Homo Sapiens
LQGAVHIVC

SEQ ID NO: 1175357 - protein, 9 aa, Homo Sapiens
PRMSLMPCG

SEQ ID NO: 1175358 - protein, 9 aa, Homo Sapiens
TIKNENLKT

SEQ ID NO: 1175359 - protein, 9 aa, Homo Sapiens
PRCWYFPPP

SEQ ID NO: 1175360 - protein, 9 aa, Homo Sapiens
LTYHLVWVP

SEQ ID NO: 1175361 - protein, 9 aa, Homo Sapiens
CNNKWFAET

SEQ ID NO: 1175362 - protein, 9 aa, Homo Sapiens
PHLPHHPSW

SEQ ID NO: 1175363 - protein, 9 aa, Homo Sapiens
KLKEMFSSK

SEQ ID NO: 1175364 - protein, 9 aa, Homo Sapiens
HHHHHHQQR

SEQ ID NO: 1175365 - protein, 9 aa, Homo Sapiens
SRALGGHLA

SEQ ID NO: 1175366 - protein, 9 aa, Homo Sapiens
YTESVKECD

SEQ ID NO: 1175367 - protein, 9 aa, Homo Sapiens
NALTLAQWS

SEQ ID NO: 1175368 - protein, 9 aa, Homo Sapiens
GDFLGRECL

SEQ ID NO: 1175369 - protein, 9 aa, Homo Sapiens
TPPMPAWPG

SEQ ID NO: 1175370 - protein, 9 aa, Homo Sapiens
LADTGVRED

SEQ ID NO: 1175371 - protein, 9 aa, Homo Sapiens
SLLICDPLC

SEQ ID NO: 1175372 - protein, 9 aa, Homo Sapiens
TKLLSTTGE

SEQ ID NO: 1175373 - protein, 9 aa, Homo Sapiens
QTVKSASLQ

SEQ ID NO: 1175374 - protein, 9 aa, Homo Sapiens
QPPAAPPPP

SEQ ID NO: 1175375 - protein, 9 aa, Homo Sapiens
RVFTGFVEW

SEQ ID NO: 1175376 - protein, 9 aa, Homo Sapiens
AAPRGLCLL

SEQ ID NO: 1175377 - protein, 9 aa, Homo Sapiens
AAMADDRYV

SEQ ID NO: 1175378 - protein, 9 aa, Homo Sapiens
TKHRARTVT

SEQ ID NO: 1175379 - protein, 9 aa, Homo Sapiens
MYRRLQEFG

SEQ ID NO: 1175380 - protein, 9 aa, Homo Sapiens
LWGAATPVA

SEQ ID NO: 1175381 - protein, 9 aa, Homo Sapiens
WLPRLTRER

SEQ ID NO: 1175382 - protein, 9 aa, Homo Sapiens
RQGPGCPTQ

SEQ ID NO: 1175383 - protein, 9 aa, Homo Sapiens
APRTKPAMG

SEQ ID NO: 1175384 - protein, 9 aa, Homo Sapiens
VSREAAGSA

SEQ ID NO: 1175385 - protein, 9 aa, Homo Sapiens
ELVVLADAS

SEQ ID NO: 1175386 - protein, 9 aa, Homo Sapiens
NYCRNPGDD

SEQ ID NO: 1175387 - protein, 9 aa, Homo Sapiens
QAAPEPKCP

SEQ ID NO: 1175388 - protein, 9 aa, Homo Sapiens
QRVSGVFPV

SEQ ID NO: 1175389 - protein, 9 aa, Homo Sapiens
QKVQNIIFH

SEQ ID NO: 1175390 - protein, 9 aa, Homo Sapiens
VPARWTCCV

SEQ ID NO: 1175391 - protein, 9 aa, Homo Sapiens
KPEPGGPTE

SEQ ID NO: 1175392 - protein, 9 aa, Homo Sapiens
KPPIYKTKQ

SEQ ID NO: 1175393 - protein, 9 aa, Homo Sapiens
LHRRMGPLS

SEQ ID NO: 1175394 - protein, 9 aa, Homo Sapiens
AGTTTPSAN

SEQ ID NO: 1175395 - protein, 9 aa, Homo Sapiens
WVVGCIMAE

SEQ ID NO: 1175396 - protein, 9 aa, Homo Sapiens
TRGRRAEAK

SEQ ID NO: 1175397 - protein, 9 aa, Homo Sapiens
GEGPAPGGR

SEQ ID NO: 1175398 - protein, 9 aa, Homo Sapiens
TPADKLTPK

SEQ ID NO: 1175399 - protein, 9 aa, Homo Sapiens
LLRHLLAWD

SEQ ID NO: 1175400 - protein, 9 aa, Homo Sapiens
GRAPRTESS

SEQ ID NO: 1175401 - protein, 9 aa, Homo Sapiens
GEQRKRRRR

SEQ ID NO: 1175402 - protein, 9 aa, Homo Sapiens
QSTPGREGR

SEQ ID NO: 1175403 - protein, 9 aa, Homo Sapiens
SSSHPSFLQ

SEQ ID NO: 1175404 - protein, 9 aa, Homo Sapiens
LPLTINLLE

SEQ ID NO: 1175405 - protein, 9 aa, Homo Sapiens
GAIHERDQL

SEQ ID NO: 1175406 - protein, 9 aa, Homo Sapiens
PLPWPLPST

SEQ ID NO: 1175407 - protein, 9 aa, Homo Sapiens
RSWLRRWRF

SEQ ID NO: 1175408 - protein, 9 aa, Homo Sapiens
AWQGGSHTR

SEQ ID NO: 1175409 - protein, 9 aa, Homo Sapiens
SPKHSTRSS

SEQ ID NO: 1175410 - protein, 9 aa, Homo Sapiens
SCTETALVM

SEQ ID NO: 1175411 - protein, 9 aa, Homo Sapiens
MGVPLAAES

SEQ ID NO: 1175412 - protein, 9 aa, Homo Sapiens
LPQPHLTWK

SEQ ID NO: 1175413 - protein, 9 aa, Homo Sapiens
FLHLGLTAP

SEQ ID NO: 1175414 - protein, 9 aa, Homo Sapiens
RVVPNTANG

SEQ ID NO: 1175415 - protein, 9 aa, Homo Sapiens
LQPPFCPRA

SEQ ID NO: 1175416 - protein, 9 aa, Homo Sapiens
FPVVGLPRR

SEQ ID NO: 1175417 - protein, 9 aa, Homo Sapiens
FVLYAMAAS

SEQ ID NO: 1175418 - protein, 9 aa, Homo Sapiens
CVEAASSAL

SEQ ID NO: 1175419 - protein, 9 aa, Homo Sapiens
SHCSPAINS

SEQ ID NO: 1175420 - protein, 9 aa, Homo Sapiens
KNALTQYQE

SEQ ID NO: 1175421 - protein, 9 aa, Homo Sapiens
TSANVNHVV

SEQ ID NO: 1175422 - protein, 9 aa, Homo Sapiens
FELDPVRRR

SEQ ID NO: 1175423 - protein, 9 aa, Homo Sapiens
NRVVRNNLC

SEQ ID NO: 1175424 - protein, 9 aa, Homo Sapiens
WVDHSECGE

SEQ ID NO: 1175425 - protein, 9 aa, Homo Sapiens
EAGADDLFC

SEQ ID NO: 1175426 - protein, 9 aa, Homo Sapiens
INYKILVLH

SEQ ID NO: 1175427 - protein, 9 aa, Homo Sapiens
TPLSHSASS

SEQ ID NO: 1175428 - protein, 9 aa, Homo Sapiens
KGGKNRCRG

SEQ ID NO: 1175429 - protein, 9 aa, Homo Sapiens
VKQSAAEMY

SEQ ID NO: 1175430 - protein, 9 aa, Homo Sapiens
CETNLTTLT

SEQ ID NO: 1175431 - protein, 9 aa, Homo Sapiens
VPYAGVYLQ

SEQ ID NO: 1175432 - protein, 9 aa, Homo Sapiens
IRKVYTCSH

SEQ ID NO: 1175433 - protein, 9 aa, Homo Sapiens
RHQPPTPTP

SEQ ID NO: 1175434 - protein, 9 aa, Homo Sapiens
SRTTLSSGL

SEQ ID NO: 1175435 - protein, 9 aa, Homo Sapiens
PIRDPARGP

SEQ ID NO: 1175436 - protein, 9 aa, Homo Sapiens
QVRGPPILA

SEQ ID NO: 1175437 - protein, 9 aa, Homo Sapiens
NGKLFDNLT

SEQ ID NO: 1175438 - protein, 9 aa, Homo Sapiens
CLLRAPLLQ

SEQ ID NO: 1175439 - protein, 9 aa, Homo Sapiens
RTSSACSAG

SEQ ID NO: 1175440 - protein, 9 aa, Homo Sapiens
NPETCPVEK

SEQ ID NO: 1175441 - protein, 9 aa, Homo Sapiens
AKGRMLIPC

SEQ ID NO: 1175442 - protein, 9 aa, Homo Sapiens
SSIEHPDHN

SEQ ID NO: 1175443 - protein, 9 aa, Homo Sapiens
LLTFTFSAV

SEQ ID NO: 1175444 - protein, 9 aa, Homo Sapiens
SGPAAAPRG

SEQ ID NO: 1175445 - protein, 9 aa, Homo Sapiens
PQGGPFNPG

SEQ ID NO: 1175446 - protein, 9 aa, Homo Sapiens
SPEASLSIT

SEQ ID NO: 1175447 - protein, 9 aa, Homo Sapiens
LQPSPQTPT

SEQ ID NO: 1175448 - protein, 9 aa, Homo Sapiens
EISVVHIHC

SEQ ID NO: 1175449 - protein, 9 aa, Homo Sapiens
RTRSRTGAA

SEQ ID NO: 1175450 - protein, 9 aa, Homo Sapiens
HLFRWILTR

SEQ ID NO: 1175451 - protein, 9 aa, Homo Sapiens
TPAHTPHMA

SEQ ID NO: 1175452 - protein, 9 aa, Homo Sapiens
ALSRGSPGA

SEQ ID NO: 1175453 - protein, 9 aa, Homo Sapiens
EEGDDEVFY

SEQ ID NO: 1175454 - protein, 9 aa, Homo Sapiens
VRILVNGTW

SEQ ID NO: 1175455 - protein, 9 aa, Homo Sapiens
AAWRALGAS

SEQ ID NO: 1175456 - protein, 9 aa, Homo Sapiens
KVKYSRNIV

SEQ ID NO: 1175457 - protein, 9 aa, Homo Sapiens
PLPWTSLHS

SEQ ID NO: 1175458 - protein, 9 aa, Homo Sapiens
EATPHSIHD

SEQ ID NO: 1175459 - protein, 9 aa, Homo Sapiens
VPHLPRSNP

SEQ ID NO: 1175460 - protein, 9 aa, Homo Sapiens
QNHSKCITE

SEQ ID NO: 1175461 - protein, 9 aa, Homo Sapiens
EAAQETIAD

SEQ ID NO: 1175462 - protein, 9 aa, Homo Sapiens
PLQSKFTNL

SEQ ID NO: 1175463 - protein, 9 aa, Homo Sapiens
QLVSRFPSS

SEQ ID NO: 1175464 - protein, 9 aa, Homo Sapiens
IRRLRRRLL

SEQ ID NO: 1175465 - protein, 9 aa, Homo Sapiens
KNTKRKNHG

SEQ ID NO: 1175466 - protein, 9 aa, Homo Sapiens
SFSAPDTQA

SEQ ID NO: 1175467 - protein, 9 aa, Homo Sapiens
LSDYEKREE

SEQ ID NO: 1175468 - protein, 9 aa, Homo Sapiens
KCGPKPKTF

SEQ ID NO: 1175469 - protein, 9 aa, Homo Sapiens
PSPQTPTSQ

SEQ ID NO: 1175470 - protein, 9 aa, Homo Sapiens
VGQASLQLH

SEQ ID NO: 1175471 - protein, 9 aa, Homo Sapiens
VGQAMAYTE

SEQ ID NO: 1175472 - protein, 9 aa, Homo Sapiens
RADSGHYQL

SEQ ID NO: 1175473 - protein, 9 aa, Homo Sapiens
AIDMQVGLL

SEQ ID NO: 1175474 - protein, 9 aa, Homo Sapiens
SLSRWPWRG

SEQ ID NO: 1175475 - protein, 9 aa, Homo Sapiens
TIRLPRKEE

SEQ ID NO: 1175476 - protein, 9 aa, Homo Sapiens
PPCPPGRGL

SEQ ID NO: 1175477 - protein, 9 aa, Homo Sapiens
LASGQASKA

SEQ ID NO: 1175478 - protein, 9 aa, Homo Sapiens
SGGMPRALW

SEQ ID NO: 1175479 - protein, 9 aa, Homo Sapiens
VPAIALVGC

SEQ ID NO: 1175480 - protein, 9 aa, Homo Sapiens
AVLQHHDTV

SEQ ID NO: 1175481 - protein, 9 aa, Homo Sapiens
LWYRPSDVL

SEQ ID NO: 1175482 - protein, 9 aa, Homo Sapiens
KSILIHDRS

SEQ ID NO: 1175483 - protein, 9 aa, Homo Sapiens
RSNRSLPGT

SEQ ID NO: 1175484 - protein, 9 aa, Homo Sapiens
EMFSVFAPT

SEQ ID NO: 1175485 - protein, 9 aa, Homo Sapiens
QLLDKYVAC

SEQ ID NO: 1175486 - protein, 9 aa, Homo Sapiens
LTWEATPHS

SEQ ID NO: 1175487 - protein, 9 aa, Homo Sapiens
SVKKPPLVP

SEQ ID NO: 1175488 - protein, 9 aa, Homo Sapiens
PIVAPTLSV

SEQ ID NO: 1175489 - protein, 9 aa, Homo Sapiens
LHIKLWATG

SEQ ID NO: 1175490 - protein, 9 aa, Homo Sapiens
TAWGGSCPA

SEQ ID NO: 1175491 - protein, 9 aa, Homo Sapiens
LARVRPVVA

SEQ ID NO: 1175492 - protein, 9 aa, Homo Sapiens
RAPLLQEMQ

SEQ ID NO: 1175493 - protein, 9 aa, Homo Sapiens
ARVLIPETS

SEQ ID NO: 1175494 - protein, 9 aa, Homo Sapiens
HVRLHRLQL

SEQ ID NO: 1175495 - protein, 9 aa, Homo Sapiens
GSMPPTACL

SEQ ID NO: 1175496 - protein, 9 aa, Homo Sapiens
RPRTAPALG

SEQ ID NO: 1175497 - protein, 9 aa, Homo Sapiens
GPVVRPGGM

SEQ ID NO: 1175498 - protein, 9 aa, Homo Sapiens
GNGPPTWPT

SEQ ID NO: 1175499 - protein, 9 aa, Homo Sapiens
WQRRTAAPG

SEQ ID NO: 1175500 - protein, 9 aa, Homo Sapiens
VRDCGAWPP

SEQ ID NO: 1175501 - protein, 9 aa, Homo Sapiens
PDGVMVRVG

SEQ ID NO: 1175502 - protein, 9 aa, Homo Sapiens
HNVPEEKTK

SEQ ID NO: 1175503 - protein, 9 aa, Homo Sapiens
ASCTETALV

SEQ ID NO: 1175504 - protein, 9 aa, Homo Sapiens
GGIYQKPRT

SEQ ID NO: 1175505 - protein, 9 aa, Homo Sapiens
HPEPMPEEG

SEQ ID NO: 1175506 - protein, 9 aa, Homo Sapiens
RDVIARDSI

SEQ ID NO: 1175507 - protein, 9 aa, Homo Sapiens
WQYRDLEAM

SEQ ID NO: 1175508 - protein, 9 aa, Homo Sapiens
VGVKASLLL

SEQ ID NO: 1175509 - protein, 9 aa, Homo Sapiens
LPGNRRLQI

SEQ ID NO: 1175510 - protein, 9 aa, Homo Sapiens
RALGYSIQQ

SEQ ID NO: 1175511 - protein, 9 aa, Homo Sapiens
SGTPRVPLP

SEQ ID NO: 1175512 - protein, 9 aa, Homo Sapiens
CMDKPANCT

SEQ ID NO: 1175513 - protein, 9 aa, Homo Sapiens
VLMLHLKRF

SEQ ID NO: 1175514 - protein, 9 aa, Homo Sapiens
KRVTFTRAL

SEQ ID NO: 1175515 - protein, 9 aa, Homo Sapiens
EPLTLQESP

SEQ ID NO: 1175516 - protein, 9 aa, Homo Sapiens
HEGVLVRSA

SEQ ID NO: 1175517 - protein, 9 aa, Homo Sapiens
LYGHTSTVC

SEQ ID NO: 1175518 - protein, 9 aa, Homo Sapiens
FLVSFQPFC

SEQ ID NO: 1175519 - protein, 9 aa, Homo Sapiens
IGDRGCSCF

SEQ ID NO: 1175520 - protein, 9 aa, Homo Sapiens
ASRVILAPQ

SEQ ID NO: 1175521 - protein, 9 aa, Homo Sapiens
LCCGLFLAL

SEQ ID NO: 1175522 - protein, 9 aa, Homo Sapiens
SCTAPRTCA

SEQ ID NO: 1175523 - protein, 9 aa, Homo Sapiens
VKPPSCPQA

SEQ ID NO: 1175524 - protein, 9 aa, Homo Sapiens
EVPNPCRSS

SEQ ID NO: 1175525 - protein, 9 aa, Homo Sapiens
KQLHSSGNV

SEQ ID NO: 1175526 - protein, 9 aa, Homo Sapiens
TPLPVADTS

SEQ ID NO: 1175527 - protein, 9 aa, Homo Sapiens
GKAPSSGVP

SEQ ID NO: 1175528 - protein, 9 aa, Homo Sapiens
ALVALGSRC

SEQ ID NO: 1175529 - protein, 9 aa, Homo Sapiens
VTVHLRKKV

SEQ ID NO: 1175530 - protein, 9 aa, Homo Sapiens
PWFMEICLC

SEQ ID NO: 1175531 - protein, 9 aa, Homo Sapiens
NLDPTSSSF

SEQ ID NO: 1175532 - protein, 9 aa, Homo Sapiens
PGACRPACT

SEQ ID NO: 1175533 - protein, 9 aa, Homo Sapiens
PKSFSAPDT

SEQ ID NO: 1175534 - protein, 9 aa, Homo Sapiens
WRRPKTPLQ

SEQ ID NO: 1175535 - protein, 9 aa, Homo Sapiens
VLTSDSWLC

SEQ ID NO: 1175536 - protein, 9 aa, Homo Sapiens
MKGVLDDSE

SEQ ID NO: 1175537 - protein, 9 aa, Homo Sapiens
RKVGEGGLR

SEQ ID NO: 1175538 - protein, 9 aa, Homo Sapiens
IVRICQTVG

SEQ ID NO: 1175539 - protein, 9 aa, Homo Sapiens
WGARVIALP

SEQ ID NO: 1175540 - protein, 9 aa, Homo Sapiens
QLGTAGQGL

SEQ ID NO: 1175541 - protein, 9 aa, Homo Sapiens
VKYSRNIVK

SEQ ID NO: 1175542 - protein, 9 aa, Homo Sapiens
AVVEVDVSA

SEQ ID NO: 1175543 - protein, 9 aa, Homo Sapiens
MPGMNMKMK

SEQ ID NO: 1175544 - protein, 9 aa, Homo Sapiens
LLPVQLLCP

SEQ ID NO: 1175545 - protein, 9 aa, Homo Sapiens
TSLSLSQWP

SEQ ID NO: 1175546 - protein, 9 aa, Homo Sapiens
HEAPCTPRR

SEQ ID NO: 1175547 - protein, 9 aa, Homo Sapiens
YKKRKHRAH

SEQ ID NO: 1175548 - protein, 9 aa, Homo Sapiens
GRSWGQILL

SEQ ID NO: 1175549 - protein, 9 aa, Homo Sapiens
KGDKLEELL

SEQ ID NO: 1175550 - protein, 9 aa, Homo Sapiens
LEIAQINQY

SEQ ID NO: 1175551 - protein, 9 aa, Homo Sapiens
MPGDAQGSP

SEQ ID NO: 1175552 - protein, 9 aa, Homo Sapiens
QGSREPPQS

SEQ ID NO: 1175553 - protein, 9 aa, Homo Sapiens
VPNTANGWA

SEQ ID NO: 1175554 - protein, 9 aa, Homo Sapiens
ISTQLKWSL

SEQ ID NO: 1175555 - protein, 9 aa, Homo Sapiens
ELRSLTVVT

SEQ ID NO: 1175556 - protein, 9 aa, Homo Sapiens
GGGPWDWFP

SEQ ID NO: 1175557 - protein, 9 aa, Homo Sapiens
CNLCTCPSF

SEQ ID NO: 1175558 - protein, 9 aa, Homo Sapiens
EHAEKLSAT

SEQ ID NO: 1175559 - protein, 9 aa, Homo Sapiens
LDASQHILE

SEQ ID NO: 1175560 - protein, 9 aa, Homo Sapiens
FLRSLCKPF

SEQ ID NO: 1175561 - protein, 9 aa, Homo Sapiens
MCILTVSGN

SEQ ID NO: 1175562 - protein, 9 aa, Homo Sapiens
IANNCIFII

SEQ ID NO: 1175563 - protein, 9 aa, Homo Sapiens
QHMGIWPAG

SEQ ID NO: 1175564 - protein, 9 aa, Homo Sapiens
PRGLLCPAL

SEQ ID NO: 1175565 - protein, 9 aa, Homo Sapiens
CHVHNLMLW

SEQ ID NO: 1175566 - protein, 9 aa, Homo Sapiens
AINICTLLS

SEQ ID NO: 1175567 - protein, 9 aa, Homo Sapiens
LKVIWPILQ

SEQ ID NO: 1175568 - protein, 9 aa, Homo Sapiens
VFSNLAGPP

SEQ ID NO: 1175569 - protein, 9 aa, Homo Sapiens
FLEGVQLVR

SEQ ID NO: 1175570 - protein, 9 aa, Homo Sapiens
QQLKDSSKS

SEQ ID NO: 1175571 - protein, 9 aa, Homo Sapiens
QRQDTSKNI

SEQ ID NO: 1175572 - protein, 9 aa, Homo Sapiens
PSLNSGKAP

SEQ ID NO: 1175573 - protein, 9 aa, Homo Sapiens
HAAAPVARL

SEQ ID NO: 1175574 - protein, 9 aa, Homo Sapiens
DTGIPFPRS

SEQ ID NO: 1175575 - protein, 9 aa, Homo Sapiens
CEPGRPLGP

SEQ ID NO: 1175576 - protein, 9 aa, Homo Sapiens
KVRILVNGT

SEQ ID NO: 1175577 - protein, 9 aa, Homo Sapiens
YQRSSCHLR

SEQ ID NO: 1175578 - protein, 9 aa, Homo Sapiens
WVHSSMTPN

SEQ ID NO: 1175579 - protein, 9 aa, Homo Sapiens
TVPRNCVQS

SEQ ID NO: 1175580 - protein, 9 aa, Homo Sapiens
LSQITAQNN

SEQ ID NO: 1175581 - protein, 9 aa, Homo Sapiens
RERGQVQEP

SEQ ID NO: 1175582 - protein, 9 aa, Homo Sapiens
DMLRCLRFP

SEQ ID NO: 1175583 - protein, 9 aa, Homo Sapiens
KSQTKIILK

SEQ ID NO: 1175584 - protein, 9 aa, Homo Sapiens
PRYTLGALG

SEQ ID NO: 1175585 - protein, 9 aa, Homo Sapiens
YVSTHLHEW

SEQ ID NO: 1175586 - protein, 9 aa, Homo Sapiens
TLKALVKTW

SEQ ID NO: 1175587 - protein, 9 aa, Homo Sapiens
HVTLQQVIH

SEQ ID NO: 1175588 - protein, 9 aa, Homo Sapiens
HHDTVSGTS

SEQ ID NO: 1175589 - protein, 9 aa, Homo Sapiens
LMANYHYFL

SEQ ID NO: 1175590 - protein, 9 aa, Homo Sapiens
RDLRKEDEF

SEQ ID NO: 1175591 - protein, 9 aa, Homo Sapiens
TEYKPLCSE

SEQ ID NO: 1175592 - protein, 9 aa, Homo Sapiens
YEQLADQNR

SEQ ID NO: 1175593 - protein, 9 aa, Homo Sapiens
AWRTPVSYQ

SEQ ID NO: 1175594 - protein, 9 aa, Homo Sapiens
SKPTMASSS

SEQ ID NO: 1175595 - protein, 9 aa, Homo Sapiens
SGHLRPPVP

SEQ ID NO: 1175596 - protein, 9 aa, Homo Sapiens
SEGAAGGSD

SEQ ID NO: 1175597 - protein, 9 aa, Homo Sapiens
SSCHLRMSV

SEQ ID NO: 1175598 - protein, 9 aa, Homo Sapiens
PSAEKGEAA

SEQ ID NO: 1175599 - protein, 9 aa, Homo Sapiens
ERTEGSPMT

SEQ ID NO: 1175600 - protein, 9 aa, Homo Sapiens
LPATSAVSV

SEQ ID NO: 1175601 - protein, 9 aa, Homo Sapiens
APWPSSAGR

SEQ ID NO: 1175602 - protein, 9 aa, Homo Sapiens
NFCWLSLQD

SEQ ID NO: 1175603 - protein, 9 aa, Homo Sapiens
ASGGPRYPV

SEQ ID NO: 1175604 - protein, 9 aa, Homo Sapiens
RCGPAGWGP

SEQ ID NO: 1175605 - protein, 9 aa, Homo Sapiens
PRSRDCFFC

SEQ ID NO: 1175606 - protein, 9 aa, Homo Sapiens
THDLFKLPQ

SEQ ID NO: 1175607 - protein, 9 aa, Homo Sapiens
RHRPFIWAL

SEQ ID NO: 1175608 - protein, 9 aa, Homo Sapiens
KIYITVQNP

SEQ ID NO: 1175609 - protein, 9 aa, Homo Sapiens
REQTALVMQ

SEQ ID NO: 1175610 - protein, 9 aa, Homo Sapiens
REGPSSCEK

SEQ ID NO: 1175611 - protein, 9 aa, Homo Sapiens
RDNWLVTFW

SEQ ID NO: 1175612 - protein, 9 aa, Homo Sapiens
RKADTPTPT

SEQ ID NO: 1175613 - protein, 9 aa, Homo Sapiens
MEAHAMEAR

SEQ ID NO: 1175614 - protein, 9 aa, Homo Sapiens
NEFKNNPEI

SEQ ID NO: 1175615 - protein, 9 aa, Homo Sapiens
LAWQQLHWL

SEQ ID NO: 1175616 - protein, 9 aa, Homo Sapiens
VSRGPRGGR

SEQ ID NO: 1175617 - protein, 9 aa, Homo Sapiens
TAAPRGLCL

SEQ ID NO: 1175618 - protein, 9 aa, Homo Sapiens
GGQAIYPHV

SEQ ID NO: 1175619 - protein, 9 aa, Homo Sapiens
HQPPTPTPR

SEQ ID NO: 1175620 - protein, 9 aa, Homo Sapiens
CLASPSPIR

SEQ ID NO: 1175621 - protein, 9 aa, Homo Sapiens
EWRWMVLAQ

SEQ ID NO: 1175622 - protein, 9 aa, Homo Sapiens
GGLSQPQHR

SEQ ID NO: 1175623 - protein, 9 aa, Homo Sapiens
SHLFYKVAS

SEQ ID NO: 1175624 - protein, 9 aa, Homo Sapiens
SPTSTPGPW

SEQ ID NO: 1175625 - protein, 9 aa, Homo Sapiens
LQQRHPQGP

SEQ ID NO: 1175626 - protein, 9 aa, Homo Sapiens
STESGNVFV

SEQ ID NO: 1175627 - protein, 9 aa, Homo Sapiens
CCMDPAWHP

SEQ ID NO: 1175628 - protein, 9 aa, Homo Sapiens
WPRSYTTPW

SEQ ID NO: 1175629 - protein, 9 aa, Homo Sapiens
WGAWHPGSW

SEQ ID NO: 1175630 - protein, 9 aa, Homo Sapiens
ACRPACTCI

SEQ ID NO: 1175631 - protein, 9 aa, Homo Sapiens
RRSVPLAIT

SEQ ID NO: 1175632 - protein, 9 aa, Homo Sapiens
APQTPSMRT

SEQ ID NO: 1175633 - protein, 9 aa, Homo Sapiens
HRTSLRALH

SEQ ID NO: 1175634 - protein, 9 aa, Homo Sapiens
TLDSSSRGR

SEQ ID NO: 1175635 - protein, 9 aa, Homo Sapiens
PSASPFSAT

SEQ ID NO: 1175636 - protein, 9 aa, Homo Sapiens
PDIVGSIPV

SEQ ID NO: 1175637 - protein, 9 aa, Homo Sapiens
CGAPPIRDK

SEQ ID NO: 1175638 - protein, 9 aa, Homo Sapiens
VHIHCWLSP

SEQ ID NO: 1175639 - protein, 9 aa, Homo Sapiens
ECKQCGRTF

SEQ ID NO: 1175640 - protein, 9 aa, Homo Sapiens
LSIRRLRRR

SEQ ID NO: 1175641 - protein, 9 aa, Homo Sapiens
LQRSGSLLC

SEQ ID NO: 1175642 - protein, 9 aa, Homo Sapiens
RVGSNGSKK

SEQ ID NO: 1175643 - protein, 9 aa, Homo Sapiens
CAECCKSFK

SEQ ID NO: 1175644 - protein, 9 aa, Homo Sapiens
PLETPARWA

SEQ ID NO: 1175645 - protein, 9 aa, Homo Sapiens
PHPHKPEPG

SEQ ID NO: 1175646 - protein, 9 aa, Homo Sapiens
AQPSQAPQA

SEQ ID NO: 1175647 - protein, 9 aa, Homo Sapiens
TSVGLCSCS

SEQ ID NO: 1175648 - protein, 9 aa, Homo Sapiens
PPLLHPQWA

SEQ ID NO: 1175649 - protein, 9 aa, Homo Sapiens
HQQRLSGNV

SEQ ID NO: 1175650 - protein, 9 aa, Homo Sapiens
VASMLLGEC

SEQ ID NO: 1175651 - protein, 9 aa, Homo Sapiens
LCTVASPPR

SEQ ID NO: 1175652 - protein, 9 aa, Homo Sapiens
FESPYPMTT

SEQ ID NO: 1175653 - protein, 9 aa, Homo Sapiens
SITSMHPFT

SEQ ID NO: 1175654 - protein, 9 aa, Homo Sapiens
ISLKISLRP

SEQ ID NO: 1175655 - protein, 9 aa, Homo Sapiens
DSALSLVAA

SEQ ID NO: 1175656 - protein, 9 aa, Homo Sapiens
HVPLRPGGL

SEQ ID NO: 1175657 - protein, 9 aa, Homo Sapiens
LWKVHYQCL

SEQ ID NO: 1175658 - protein, 9 aa, Homo Sapiens
PAPGPPAAA

SEQ ID NO: 1175659 - protein, 9 aa, Homo Sapiens
PFKTIRATT

SEQ ID NO: 1175660 - protein, 9 aa, Homo Sapiens
PHRTSENTH

SEQ ID NO: 1175661 - protein, 9 aa, Homo Sapiens
GAGEALLAR

SEQ ID NO: 1175662 - protein, 9 aa, Homo Sapiens
HLDDINFDI

SEQ ID NO: 1175663 - protein, 9 aa, Homo Sapiens
LCLQTMKMS

SEQ ID NO: 1175664 - protein, 9 aa, Homo Sapiens
GSGRRAEME

SEQ ID NO: 1175665 - protein, 9 aa, Homo Sapiens
QPPPPPQQL

SEQ ID NO: 1175666 - protein, 9 aa, Homo Sapiens
ENTPETVVS

SEQ ID NO: 1175667 - protein, 9 aa, Homo Sapiens
NTTKNFSCQ

SEQ ID NO: 1175668 - protein, 9 aa, Homo Sapiens
SVKKKSARD

SEQ ID NO: 1175669 - protein, 9 aa, Homo Sapiens
KFHIPVDTM

SEQ ID NO: 1175670 - protein, 9 aa, Homo Sapiens
HHSTPFSTQ

SEQ ID NO: 1175671 - protein, 9 aa, Homo Sapiens
SYTESVKEC

SEQ ID NO: 1175672 - protein, 9 aa, Homo Sapiens
LAIWTCIVA

SEQ ID NO: 1175673 - protein, 9 aa, Homo Sapiens
QESLFATGS

SEQ ID NO: 1175674 - protein, 9 aa, Homo Sapiens
DLTQSHRPL

SEQ ID NO: 1175675 - protein, 9 aa, Homo Sapiens
PSRDRDPVS

SEQ ID NO: 1175676 - protein, 9 aa, Homo Sapiens
AQLSGPVLA

SEQ ID NO: 1175677 - protein, 9 aa, Homo Sapiens
IATTRPPAF

SEQ ID NO: 1175678 - protein, 9 aa, Homo Sapiens
ILKLQEDQI

SEQ ID NO: 1175679 - protein, 9 aa, Homo Sapiens
CGAANCADC

SEQ ID NO: 1175680 - protein, 9 aa, Homo Sapiens
MAFESIVKK

SEQ ID NO: 1175681 - protein, 9 aa, Homo Sapiens
SCRSPRSTW

SEQ ID NO: 1175682 - protein, 9 aa, Homo Sapiens
RPAQPTVPR

SEQ ID NO: 1175683 - protein, 9 aa, Homo Sapiens
QFRPPWIEA

SEQ ID NO: 1175684 - protein, 9 aa, Homo Sapiens
PSPQGGPFN

SEQ ID NO: 1175685 - protein, 9 aa, Homo Sapiens
GLPLLPLQG

SEQ ID NO: 1175686 - protein, 9 aa, Homo Sapiens
GAPTIMPLL

SEQ ID NO: 1175687 - protein, 9 aa, Homo Sapiens
TVPRKTLKM

SEQ ID NO: 1175688 - protein, 9 aa, Homo Sapiens
TGITVFLTG

SEQ ID NO: 1175689 - protein, 9 aa, Homo Sapiens
RGVPAIALV

SEQ ID NO: 1175690 - protein, 9 aa, Homo Sapiens
RTQHNYLVQ

SEQ ID NO: 1175691 - protein, 9 aa, Homo Sapiens
EGALVALGS

SEQ ID NO: 1175692 - protein, 9 aa, Homo Sapiens
RAPPRSGRG

SEQ ID NO: 1175693 - protein, 9 aa, Homo Sapiens
RRSSLGFED

SEQ ID NO: 1175694 - protein, 9 aa, Homo Sapiens
SSAASACAT

SEQ ID NO: 1175695 - protein, 9 aa, Homo Sapiens
AAPGQPGRH

SEQ ID NO: 1175696 - protein, 9 aa, Homo Sapiens
HAGPEDGRA

SEQ ID NO: 1175697 - protein, 9 aa, Homo Sapiens
PAPRTRMSP

SEQ ID NO: 1175698 - protein, 9 aa, Homo Sapiens
RSAFPSRSL

SEQ ID NO: 1175699 - protein, 9 aa, Homo Sapiens
EDAPGARPE

SEQ ID NO: 1175700 - protein, 9 aa, Homo Sapiens
EPMICSLHQ

SEQ ID NO: 1175701 - protein, 9 aa, Homo Sapiens
YKLTGDCGK

SEQ ID NO: 1175702 - protein, 9 aa, Homo Sapiens
GQRCWGSYA

SEQ ID NO: 1175703 - protein, 9 aa, Homo Sapiens
HPTGRRPAS

SEQ ID NO: 1175704 - protein, 9 aa, Homo Sapiens
TKATPPVSV

SEQ ID NO: 1175705 - protein, 9 aa, Homo Sapiens
PKNPSQLPA

SEQ ID NO: 1175706 - protein, 9 aa, Homo Sapiens
RPGTPPMPA

SEQ ID NO: 1175707 - protein, 9 aa, Homo Sapiens
EMVPPGGQQ

SEQ ID NO: 1175708 - protein, 9 aa, Homo Sapiens
LVCHERHRN

SEQ ID NO: 1175709 - protein, 9 aa, Homo Sapiens
LPSQPLDRQ

SEQ ID NO: 1175710 - protein, 9 aa, Homo Sapiens
LPVPQSCLI

SEQ ID NO: 1175711 - protein, 9 aa, Homo Sapiens
TSIPPPPGL

SEQ ID NO: 1175712 - protein, 9 aa, Homo Sapiens
RRLQEFGGA

SEQ ID NO: 1175713 - protein, 9 aa, Homo Sapiens
LCCHRRRQL

SEQ ID NO: 1175714 - protein, 9 aa, Homo Sapiens
TLVAHTQAI

SEQ ID NO: 1175715 - protein, 9 aa, Homo Sapiens
YVELFKDVE

SEQ ID NO: 1175716 - protein, 9 aa, Homo Sapiens
STRGSGGYG

SEQ ID NO: 1175717 - protein, 9 aa, Homo Sapiens
PEPGDPDAV

SEQ ID NO: 1175718 - protein, 9 aa, Homo Sapiens
YRMPSSHSQ

SEQ ID NO: 1175719 - protein, 9 aa, Homo Sapiens
LRDSGIYDS

SEQ ID NO: 1175720 - protein, 9 aa, Homo Sapiens
SLIFLEGVQ

SEQ ID NO: 1175721 - protein, 9 aa, Homo Sapiens
RKPKNFRLR

SEQ ID NO: 1175722 - protein, 9 aa, Homo Sapiens
PQLNYKTKQ

SEQ ID NO: 1175723 - protein, 9 aa, Homo Sapiens
IKTIEMVIP

SEQ ID NO: 1175724 - protein, 9 aa, Homo Sapiens
FLQFMMVML

SEQ ID NO: 1175725 - protein, 9 aa, Homo Sapiens
HTQEEDMPR

SEQ ID NO: 1175726 - protein, 9 aa, Homo Sapiens
PHTLLQLLD

SEQ ID NO: 1175727 - protein, 9 aa, Homo Sapiens
LQTKHRART

SEQ ID NO: 1175728 - protein, 9 aa, Homo Sapiens
EALGGQAIY

SEQ ID NO: 1175729 - protein, 9 aa, Homo Sapiens
LYKRFTGKI

SEQ ID NO: 1175730 - protein, 9 aa, Homo Sapiens
SPPTSAPTQ

SEQ ID NO: 1175731 - protein, 9 aa, Homo Sapiens
TIHTQEEDM

SEQ ID NO: 1175732 - protein, 9 aa, Homo Sapiens
TPQDASCTR

SEQ ID NO: 1175733 - protein, 9 aa, Homo Sapiens
VAVLVPLLR

SEQ ID NO: 1175734 - protein, 9 aa, Homo Sapiens
WSWAAGPPS

SEQ ID NO: 1175735 - protein, 9 aa, Homo Sapiens
LVYKKHFWN

SEQ ID NO: 1175736 - protein, 9 aa, Homo Sapiens
IEVEIVEGT

SEQ ID NO: 1175737 - protein, 9 aa, Homo Sapiens
THSGNNVVS

SEQ ID NO: 1175738 - protein, 9 aa, Homo Sapiens
QSIRRFITS

SEQ ID NO: 1175739 - protein, 9 aa, Homo Sapiens
QHRFGDDVI

SEQ ID NO: 1175740 - protein, 9 aa, Homo Sapiens
GGRCLQVNQ

SEQ ID NO: 1175741 - protein, 9 aa, Homo Sapiens
WSRTSRSPD

SEQ ID NO: 1175742 - protein, 9 aa, Homo Sapiens
ASCATSSKV

SEQ ID NO: 1175743 - protein, 9 aa, Homo Sapiens
DLPSVPPLG

SEQ ID NO: 1175744 - protein, 9 aa, Homo Sapiens
NDTTDVNDA

SEQ ID NO: 1175745 - protein, 9 aa, Homo Sapiens
TRAANVITK

SEQ ID NO: 1175746 - protein, 9 aa, Homo Sapiens
MQCRKKSHC

SEQ ID NO: 1175747 - protein, 9 aa, Homo Sapiens
TSLLQALDF

SEQ ID NO: 1175748 - protein, 9 aa, Homo Sapiens
AIRFISAPQ

SEQ ID NO: 1175749 - protein, 9 aa, Homo Sapiens
GSALGGRPP

SEQ ID NO: 1175750 - protein, 9 aa, Homo Sapiens
GERALTRVG

SEQ ID NO: 1175751 - protein, 9 aa, Homo Sapiens
APACSSTSF

SEQ ID NO: 1175752 - protein, 9 aa, Homo Sapiens
PSQSPHSPK

SEQ ID NO: 1175753 - protein, 9 aa, Homo Sapiens
LVKAARRGA

SEQ ID NO: 1175754 - protein, 9 aa, Homo Sapiens
FMKLYHSLV

SEQ ID NO: 1175755 - protein, 9 aa, Homo Sapiens
ISVVHIHCW

SEQ ID NO: 1175756 - protein, 9 aa, Homo Sapiens
VSGGVASNF

SEQ ID NO: 1175757 - protein, 9 aa, Homo Sapiens
RNYHLGVMS

SEQ ID NO: 1175758 - protein, 9 aa, Homo Sapiens
AILTGTIEV

SEQ ID NO: 1175759 - protein, 9 aa, Homo Sapiens
ESPVIPLLE

SEQ ID NO: 1175760 - protein, 9 aa, Homo Sapiens
RKQFFSFSF

SEQ ID NO: 1175761 - protein, 9 aa, Homo Sapiens
AHHEDDDED

SEQ ID NO: 1175762 - protein, 9 aa, Homo Sapiens
SQVDEEMFS

SEQ ID NO: 1175763 - protein, 9 aa, Homo Sapiens
MGIWPAGLQ

SEQ ID NO: 1175764 - protein, 9 aa, Homo Sapiens
THTFSTLFP

SEQ ID NO: 1175765 - protein, 9 aa, Homo Sapiens
ALFIWPQHS

SEQ ID NO: 1175766 - protein, 9 aa, Homo Sapiens
AGTTPSCRN

SEQ ID NO: 1175767 - protein, 9 aa, Homo Sapiens
RCWYFPPPP

SEQ ID NO: 1175768 - protein, 9 aa, Homo Sapiens
NYRGGEIRV

SEQ ID NO: 1175769 - protein, 9 aa, Homo Sapiens
YVIPEPPPL

SEQ ID NO: 1175770 - protein, 9 aa, Homo Sapiens
ISRPTSRAR

SEQ ID NO: 1175771 - protein, 9 aa, Homo Sapiens
RRRHLGRLM

SEQ ID NO: 1175772 - protein, 9 aa, Homo Sapiens
REPVPEEKP

SEQ ID NO: 1175773 - protein, 9 aa, Homo Sapiens
FTELSRILW

SEQ ID NO: 1175774 - protein, 9 aa, Homo Sapiens
APRLWLLWR

SEQ ID NO: 1175775 - protein, 9 aa, Homo Sapiens
RGRASQTRV

SEQ ID NO: 1175776 - protein, 9 aa, Homo Sapiens
LVSGWHCFM

SEQ ID NO: 1175777 - protein, 9 aa, Homo Sapiens
TQARSPSSA

SEQ ID NO: 1175778 - protein, 9 aa, Homo Sapiens
PITGGWGLL

SEQ ID NO: 1175779 - protein, 9 aa, Homo Sapiens
GMWAAMDIC

SEQ ID NO: 1175780 - protein, 9 aa, Homo Sapiens
QASKALKET

SEQ ID NO: 1175781 - protein, 9 aa, Homo Sapiens
SPPRCWGSA

SEQ ID NO: 1175782 - protein, 9 aa, Homo Sapiens
CCITWMAVV

SEQ ID NO: 1175783 - protein, 9 aa, Homo Sapiens
SSAGPEVDV

SEQ ID NO: 1175784 - protein, 9 aa, Homo Sapiens
WLVSSCFFL

SEQ ID NO: 1175785 - protein, 9 aa, Homo Sapiens
APVRAWRTS

SEQ ID NO: 1175786 - protein, 9 aa, Homo Sapiens
PPAPRLLPL

SEQ ID NO: 1175787 - protein, 9 aa, Homo Sapiens
PQTPQKVAD

SEQ ID NO: 1175788 - protein, 9 aa, Homo Sapiens
RPPGPQCPS

SEQ ID NO: 1175789 - protein, 9 aa, Homo Sapiens
SVRLVHLEY

SEQ ID NO: 1175790 - protein, 9 aa, Homo Sapiens
WLVLSPVRS

SEQ ID NO: 1175791 - protein, 9 aa, Homo Sapiens
VCAASERLN

SEQ ID NO: 1175792 - protein, 9 aa, Homo Sapiens
SLVEGGRKS

SEQ ID NO: 1175793 - protein, 9 aa, Homo Sapiens
TGVVRVGKA

SEQ ID NO: 1175794 - protein, 9 aa, Homo Sapiens
DTRRVQPIK

SEQ ID NO: 1175795 - protein, 9 aa, Homo Sapiens
HNQVPAQME

SEQ ID NO: 1175796 - protein, 9 aa, Homo Sapiens
GPLASGQAS

SEQ ID NO: 1175797 - protein, 9 aa, Homo Sapiens
PLSPSVALA

SEQ ID NO: 1175798 - protein, 9 aa, Homo Sapiens
WHWGWRTAV

SEQ ID NO: 1175799 - protein, 9 aa, Homo Sapiens
VQEACGKGL

SEQ ID NO: 1175800 - protein, 9 aa, Homo Sapiens
FFIEHKTIS

SEQ ID NO: 1175801 - protein, 9 aa, Homo Sapiens
WEPSQPQAP

SEQ ID NO: 1175802 - protein, 9 aa, Homo Sapiens
LPACLNLRQ

SEQ ID NO: 1175803 - protein, 9 aa, Homo Sapiens
CCRRRRCCG

SEQ ID NO: 1175804 - protein, 9 aa, Homo Sapiens
KEECERIGA

SEQ ID NO: 1175805 - protein, 9 aa, Homo Sapiens
TGFIMLRND

SEQ ID NO: 1175806 - protein, 9 aa, Homo Sapiens
ANHPHSTGP

SEQ ID NO: 1175807 - protein, 9 aa, Homo Sapiens
ATSPPATAT

SEQ ID NO: 1175808 - protein, 9 aa, Homo Sapiens
LLRCSPSPN

SEQ ID NO: 1175809 - protein, 9 aa, Homo Sapiens
VSFPQAPDG

SEQ ID NO: 1175810 - protein, 9 aa, Homo Sapiens
KWPVPPHPG

SEQ ID NO: 1175811 - protein, 9 aa, Homo Sapiens
RPAQTCCGQ

SEQ ID NO: 1175812 - protein, 9 aa, Homo Sapiens
LRWAVFDEY

SEQ ID NO: 1175813 - protein, 9 aa, Homo Sapiens
KYRNYQFFI

SEQ ID NO: 1175814 - protein, 9 aa, Homo Sapiens
AWHPHQGSG

SEQ ID NO: 1175815 - protein, 9 aa, Homo Sapiens
GENPYKCKC

SEQ ID NO: 1175816 - protein, 9 aa, Homo Sapiens
SIMCPLNPA

SEQ ID NO: 1175817 - protein, 9 aa, Homo Sapiens
PRETDPCWA

SEQ ID NO: 1175818 - protein, 9 aa, Homo Sapiens
MAVSTSNLA

SEQ ID NO: 1175819 - protein, 9 aa, Homo Sapiens
KRRNTELFQ

SEQ ID NO: 1175820 - protein, 9 aa, Homo Sapiens
VGQRLSAQS

SEQ ID NO: 1175821 - protein, 9 aa, Homo Sapiens
GGPTAAAAA

SEQ ID NO: 1175822 - protein, 9 aa, Homo Sapiens
LLAREGRAR

SEQ ID NO: 1175823 - protein, 9 aa, Homo Sapiens
VEQVLVDAV

SEQ ID NO: 1175824 - protein, 9 aa, Homo Sapiens
VELSKVKYS

SEQ ID NO: 1175825 - protein, 9 aa, Homo Sapiens
EGPAPGGRR

SEQ ID NO: 1175826 - protein, 9 aa, Homo Sapiens
MVAESCGCR

SEQ ID NO: 1175827 - protein, 9 aa, Homo Sapiens
RPACTCISM

SEQ ID NO: 1175828 - protein, 9 aa, Homo Sapiens
CAPSSSVCA

SEQ ID NO: 1175829 - protein, 9 aa, Homo Sapiens
PPLKDTERF

SEQ ID NO: 1175830 - protein, 9 aa, Homo Sapiens
EEEEGCEDE

SEQ ID NO: 1175831 - protein, 9 aa, Homo Sapiens
PTACLANHP

SEQ ID NO: 1175832 - protein, 9 aa, Homo Sapiens
VFVGLQNIL

SEQ ID NO: 1175833 - protein, 9 aa, Homo Sapiens
YGHQAPQVA

SEQ ID NO: 1175834 - protein, 9 aa, Homo Sapiens
PPPPVTAWH

SEQ ID NO: 1175835 - protein, 9 aa, Homo Sapiens
LGRWSITSP

SEQ ID NO: 1175836 - protein, 9 aa, Homo Sapiens
STGNGPPTW

SEQ ID NO: 1175837 - protein, 9 aa, Homo Sapiens
WTLNYGGIT

SEQ ID NO: 1175838 - protein, 9 aa, Homo Sapiens
ATDGGILQL

SEQ ID NO: 1175839 - protein, 9 aa, Homo Sapiens
TFVVFVQVK

SEQ ID NO: 1175840 - protein, 9 aa, Homo Sapiens
RGCQGPGAW

SEQ ID NO: 1175841 - protein, 9 aa, Homo Sapiens
LSHLYCQPL

SEQ ID NO: 1175842 - protein, 9 aa, Homo Sapiens
YLQIVVDVA

SEQ ID NO: 1175843 - protein, 9 aa, Homo Sapiens
LKKVWNLQG

SEQ ID NO: 1175844 - protein, 9 aa, Homo Sapiens
PVLMLHLKR

SEQ ID NO: 1175845 - protein, 9 aa, Homo Sapiens
YQILWGLKY

SEQ ID NO: 1175846 - protein, 9 aa, Homo Sapiens
KSSGHNPFL

SEQ ID NO: 1175847 - protein, 9 aa, Homo Sapiens
SQKPSVGPQ

SEQ ID NO: 1175848 - protein, 9 aa, Homo Sapiens
VLHLGVTLV

SEQ ID NO: 1175849 - protein, 9 aa, Homo Sapiens
VDAVVQAVG

SEQ ID NO: 1175850 - protein, 9 aa, Homo Sapiens
VSRDCPRYD

SEQ ID NO: 1175851 - protein, 9 aa, Homo Sapiens
SPHSGELSY

SEQ ID NO: 1175852 - protein, 9 aa, Homo Sapiens
PSQKHFNIC

SEQ ID NO: 1175853 - protein, 9 aa, Homo Sapiens
LVRLKAVDN

SEQ ID NO: 1175854 - protein, 9 aa, Homo Sapiens
SCPAFVAFT

SEQ ID NO: 1175855 - protein, 9 aa, Homo Sapiens
SMSSERYLH

SEQ ID NO: 1175856 - protein, 9 aa, Homo Sapiens
FRKGLGWKW

SEQ ID NO: 1175857 - protein, 9 aa, Homo Sapiens
FLSHLVQGN

SEQ ID NO: 1175858 - protein, 9 aa, Homo Sapiens
MPNFPPHGT

SEQ ID NO: 1175859 - protein, 9 aa, Homo Sapiens
PAGQRGRAD

SEQ ID NO: 1175860 - protein, 9 aa, Homo Sapiens
QLLDQLVQA

SEQ ID NO: 1175861 - protein, 9 aa, Homo Sapiens
MLVATSACR

SEQ ID NO: 1175862 - protein, 9 aa, Homo Sapiens
SGRLTPSPQ

SEQ ID NO: 1175863 - protein, 9 aa, Homo Sapiens
CRPFLSHLV

SEQ ID NO: 1175864 - protein, 9 aa, Homo Sapiens
SEITGAPGN

SEQ ID NO: 1175865 - protein, 9 aa, Homo Sapiens
RESPWEAAL

SEQ ID NO: 1175866 - protein, 9 aa, Homo Sapiens
GSMLAVAFL

SEQ ID NO: 1175867 - protein, 9 aa, Homo Sapiens
LSPHFQPPL

SEQ ID NO: 1175868 - protein, 9 aa, Homo Sapiens
LAGMGLQLL

SEQ ID NO: 1175869 - protein, 9 aa, Homo Sapiens
FSIASGTFQ

SEQ ID NO: 1175870 - protein, 9 aa, Homo Sapiens
QITAQNNVV

SEQ ID NO: 1175871 - protein, 9 aa, Homo Sapiens
EKQATELVL

SEQ ID NO: 1175872 - protein, 9 aa, Homo Sapiens
PATPPQAQP

SEQ ID NO: 1175873 - protein, 9 aa, Homo Sapiens
AIPGYQLWF

SEQ ID NO: 1175874 - protein, 9 aa, Homo Sapiens
YHVVYVLVC

SEQ ID NO: 1175875 - protein, 9 aa, Homo Sapiens
INLLEELSL

SEQ ID NO: 1175876 - protein, 9 aa, Homo Sapiens
SPRRLLTSI

SEQ ID NO: 1175877 - protein, 9 aa, Homo Sapiens
QDPCTALAS

SEQ ID NO: 1175878 - protein, 9 aa, Homo Sapiens
FSIICLKTQ

SEQ ID NO: 1175879 - protein, 9 aa, Homo Sapiens
GRIKWKVAF

SEQ ID NO: 1175880 - protein, 9 aa, Homo Sapiens
LPESEFVPF

SEQ ID NO: 1175881 - protein, 9 aa, Homo Sapiens
WFLVSFQPF

SEQ ID NO: 1175882 - protein, 9 aa, Homo Sapiens
GAPQARQQS

SEQ ID NO: 1175883 - protein, 9 aa, Homo Sapiens
PVCEHAAAP

SEQ ID NO: 1175884 - protein, 9 aa, Homo Sapiens
GSSCKKEAV

SEQ ID NO: 1175885 - protein, 9 aa, Homo Sapiens
GGQPAHAEP

SEQ ID NO: 1175886 - protein, 9 aa, Homo Sapiens
YWDNNAGTN

SEQ ID NO: 1175887 - protein, 9 aa, Homo Sapiens
SCSPRAAES

SEQ ID NO: 1175888 - protein, 9 aa, Homo Sapiens
EETHDCNKP

SEQ ID NO: 1175889 - protein, 9 aa, Homo Sapiens
DLYELIKKI

SEQ ID NO: 1175890 - protein, 9 aa, Homo Sapiens
SIRRFITSV

SEQ ID NO: 1175891 - protein, 9 aa, Homo Sapiens
SLASPALPD

SEQ ID NO: 1175892 - protein, 9 aa, Homo Sapiens
SSLHAWNLR

SEQ ID NO: 1175893 - protein, 9 aa, Homo Sapiens
GTCAMASNT

SEQ ID NO: 1175894 - protein, 9 aa, Homo Sapiens
PVTKAGRQP

SEQ ID NO: 1175895 - protein, 9 aa, Homo Sapiens
SSSGDPPVN

SEQ ID NO: 1175896 - protein, 9 aa, Homo Sapiens
EECWETCHI

SEQ ID NO: 1175897 - protein, 9 aa, Homo Sapiens
TRAPALRSG

SEQ ID NO: 1175898 - protein, 9 aa, Homo Sapiens
WKKRFGQWA

SEQ ID NO: 1175899 - protein, 9 aa, Homo Sapiens
THSAKRCGC

SEQ ID NO: 1175900 - protein, 9 aa, Homo Sapiens
RILVFPTSS

SEQ ID NO: 1175901 - protein, 9 aa, Homo Sapiens
FFSPEDMKR

SEQ ID NO: 1175902 - protein, 9 aa, Homo Sapiens
SPLQRSGSL

SEQ ID NO: 1175903 - protein, 9 aa, Homo Sapiens
HLYGSYPPA

SEQ ID NO: 1175904 - protein, 9 aa, Homo Sapiens
CAWAWSASA

SEQ ID NO: 1175905 - protein, 9 aa, Homo Sapiens
KVIAECTLE

SEQ ID NO: 1175906 - protein, 9 aa, Homo Sapiens
SIGSSIQSW

SEQ ID NO: 1175907 - protein, 9 aa, Homo Sapiens
ANVNHVVIL

SEQ ID NO: 1175908 - protein, 9 aa, Homo Sapiens
GEAGVIERV

SEQ ID NO: 1175909 - protein, 9 aa, Homo Sapiens
TPRPPRPPC

SEQ ID NO: 1175910 - protein, 9 aa, Homo Sapiens
DDFFHDRST

SEQ ID NO: 1175911 - protein, 9 aa, Homo Sapiens
QKTWRVILP

SEQ ID NO: 1175912 - protein, 9 aa, Homo Sapiens
APRQLGQGL

SEQ ID NO: 1175913 - protein, 9 aa, Homo Sapiens
LPGKMNQQL

SEQ ID NO: 1175914 - protein, 9 aa, Homo Sapiens
SRCRMTSWR

SEQ ID NO: 1175915 - protein, 9 aa, Homo Sapiens
CVPSARRSP

SEQ ID NO: 1175916 - protein, 9 aa, Homo Sapiens
SNFNRDPLP

SEQ ID NO: 1175917 - protein, 9 aa, Homo Sapiens
CSGNDGRTR

SEQ ID NO: 1175918 - protein, 9 aa, Homo Sapiens
PAHTPHMAT

SEQ ID NO: 1175919 - protein, 9 aa, Homo Sapiens
LGRALGYSI

SEQ ID NO: 1175920 - protein, 9 aa, Homo Sapiens
FWKGTESPF

SEQ ID NO: 1175921 - protein, 9 aa, Homo Sapiens
TPSWRPPWW

SEQ ID NO: 1175922 - protein, 9 aa, Homo Sapiens
PDSWVPLAS

SEQ ID NO: 1175923 - protein, 9 aa, Homo Sapiens
TAPEAPGCW

SEQ ID NO: 1175924 - protein, 9 aa, Homo Sapiens
TSNSRHPPG

SEQ ID NO: 1175925 - protein, 9 aa, Homo Sapiens
PGMPNSLNQ

SEQ ID NO: 1175926 - protein, 9 aa, Homo Sapiens
ADDLFCYRW

SEQ ID NO: 1175927 - protein, 9 aa, Homo Sapiens
SKWCRPWLE

SEQ ID NO: 1175928 - protein, 9 aa, Homo Sapiens
ASKPTMASS

SEQ ID NO: 1175929 - protein, 9 aa, Homo Sapiens
GVWSPGLPP

SEQ ID NO: 1175930 - protein, 9 aa, Homo Sapiens
KKIITWALQ

SEQ ID NO: 1175931 - protein, 9 aa, Homo Sapiens
ISVHKFFNV

SEQ ID NO: 1175932 - protein, 9 aa, Homo Sapiens
PAGPSALPS

SEQ ID NO: 1175933 - protein, 9 aa, Homo Sapiens
ATNASCSGR

SEQ ID NO: 1175934 - protein, 9 aa, Homo Sapiens
LVPMRFFET

SEQ ID NO: 1175935 - protein, 9 aa, Homo Sapiens
SHVGKTSYH

SEQ ID NO: 1175936 - protein, 9 aa, Homo Sapiens
NLNLAWLLE

SEQ ID NO: 1175937 - protein, 9 aa, Homo Sapiens
SSRTPTRRP

SEQ ID NO: 1175938 - protein, 9 aa, Homo Sapiens
INSQLQPMM

SEQ ID NO: 1175939 - protein, 9 aa, Homo Sapiens
NQNMRGNAH

SEQ ID NO: 1175940 - protein, 9 aa, Homo Sapiens
TTSSYNLSC

SEQ ID NO: 1175941 - protein, 9 aa, Homo Sapiens
SAQSAISTQ

SEQ ID NO: 1175942 - protein, 9 aa, Homo Sapiens
PRGSDNTVA

SEQ ID NO: 1175943 - protein, 9 aa, Homo Sapiens
TAPSLSTAT

SEQ ID NO: 1175944 - protein, 9 aa, Homo Sapiens
ELQGACEQQ

SEQ ID NO: 1175945 - protein, 9 aa, Homo Sapiens
SLGKGLHRR

SEQ ID NO: 1175946 - protein, 9 aa, Homo Sapiens
AVGQRLSAQ

SEQ ID NO: 1175947 - protein, 9 aa, Homo Sapiens
PWKPSRPRW

SEQ ID NO: 1175948 - protein, 9 aa, Homo Sapiens
GRIGKVVKV

SEQ ID NO: 1175949 - protein, 9 aa, Homo Sapiens
SSGSQPLLN

SEQ ID NO: 1175950 - protein, 9 aa, Homo Sapiens
NLTLDQMIH

SEQ ID NO: 1175951 - protein, 9 aa, Homo Sapiens
INHCDWPIF

SEQ ID NO: 1175952 - protein, 9 aa, Homo Sapiens
VLSPVTALA

SEQ ID NO: 1175953 - protein, 9 aa, Homo Sapiens
LYGPKKCGP

SEQ ID NO: 1175954 - protein, 9 aa, Homo Sapiens
QLVRQHVQK

SEQ ID NO: 1175955 - protein, 9 aa, Homo Sapiens
LGLWCSPRR

SEQ ID NO: 1175956 - protein, 9 aa, Homo Sapiens
FHLLINSRK

SEQ ID NO: 1175957 - protein, 9 aa, Homo Sapiens
KPTMASSSP

SEQ ID NO: 1175958 - protein, 9 aa, Homo Sapiens
CLRHPVGRS

SEQ ID NO: 1175959 - protein, 9 aa, Homo Sapiens
KAGSPSDML

SEQ ID NO: 1175960 - protein, 9 aa, Homo Sapiens
VLADASFHG

SEQ ID NO: 1175961 - protein, 9 aa, Homo Sapiens
SSPLPASLG

SEQ ID NO: 1175962 - protein, 9 aa, Homo Sapiens
SSLPWTTPA

SEQ ID NO: 1175963 - protein, 9 aa, Homo Sapiens
FSCTPDGQS

SEQ ID NO: 1175964 - protein, 9 aa, Homo Sapiens
PGRGLPLTL

SEQ ID NO: 1175965 - protein, 9 aa, Homo Sapiens
SAASCSAAL

SEQ ID NO: 1175966 - protein, 9 aa, Homo Sapiens
PVSVSKNVN

SEQ ID NO: 1175967 - protein, 9 aa, Homo Sapiens
GGRTAAVGK

SEQ ID NO: 1175968 - protein, 9 aa, Homo Sapiens
DMAFLYHVV

SEQ ID NO: 1175969 - protein, 9 aa, Homo Sapiens
RAGVLKQDL

SEQ ID NO: 1175970 - protein, 9 aa, Homo Sapiens
YDGEVCAAS

SEQ ID NO: 1175971 - protein, 9 aa, Homo Sapiens
GAWEAVAVR

SEQ ID NO: 1175972 - protein, 9 aa, Homo Sapiens
VMRAPRWKT

SEQ ID NO: 1175973 - protein, 9 aa, Homo Sapiens
VIGDDTCQV

SEQ ID NO: 1175974 - protein, 9 aa, Homo Sapiens
PYMYIRHQG

SEQ ID NO: 1175975 - protein, 9 aa, Homo Sapiens
LPLIHPRPP

SEQ ID NO: 1175976 - protein, 9 aa, Homo Sapiens
QTKVLWPLR

SEQ ID NO: 1175977 - protein, 9 aa, Homo Sapiens
RPPSISKNV

SEQ ID NO: 1175978 - protein, 9 aa, Homo Sapiens
CLPPEPGDP

SEQ ID NO: 1175979 - protein, 9 aa, Homo Sapiens
QQQHKVHVP

SEQ ID NO: 1175980 - protein, 9 aa, Homo Sapiens
MTAQGSSEL

SEQ ID NO: 1175981 - protein, 9 aa, Homo Sapiens
MRRPRQGDG

SEQ ID NO: 1175982 - protein, 9 aa, Homo Sapiens
HIQVSRGVG

SEQ ID NO: 1175983 - protein, 9 aa, Homo Sapiens
SIPSIGSSI

SEQ ID NO: 1175984 - protein, 9 aa, Homo Sapiens
GIVGKVKIN

SEQ ID NO: 1175985 - protein, 9 aa, Homo Sapiens
GPTAGAARA

SEQ ID NO: 1175986 - protein, 9 aa, Homo Sapiens
DLFGPSEPV

SEQ ID NO: 1175987 - protein, 9 aa, Homo Sapiens
KPLTKSQSC

SEQ ID NO: 1175988 - protein, 9 aa, Homo Sapiens
GPHPTGRRP

SEQ ID NO: 1175989 - protein, 9 aa, Homo Sapiens
IPTSTRSLP

SEQ ID NO: 1175990 - protein, 9 aa, Homo Sapiens
KRVALLTMW

SEQ ID NO: 1175991 - protein, 9 aa, Homo Sapiens
AAILFFVMS

SEQ ID NO: 1175992 - protein, 9 aa, Homo Sapiens
FIMLRNDLL

SEQ ID NO: 1175993 - protein, 9 aa, Homo Sapiens
AMLQDTQKQ

SEQ ID NO: 1175994 - protein, 9 aa, Homo Sapiens
SAPASTRDS

SEQ ID NO: 1175995 - protein, 9 aa, Homo Sapiens
QYEQLADQN

SEQ ID NO: 1175996 - protein, 9 aa, Homo Sapiens
AIPPRSCRR

SEQ ID NO: 1175997 - protein, 9 aa, Homo Sapiens
SSQNPHRLR

SEQ ID NO: 1175998 - protein, 9 aa, Homo Sapiens
PDDLETYAS

SEQ ID NO: 1175999 - protein, 9 aa, Homo Sapiens
LAWLLEFPG

SEQ ID NO: 1176000 - protein, 9 aa, Homo Sapiens
FRSIVSTLK

SEQ ID NO: 1176001 - protein, 9 aa, Homo Sapiens
RGGGPWDWL

SEQ ID NO: 1176002 - protein, 9 aa, Homo Sapiens
ITWENDQVT

SEQ ID NO: 1176003 - protein, 9 aa, Homo Sapiens
RISSPMHPV

SEQ ID NO: 1176004 - protein, 9 aa, Homo Sapiens
YAQLSYLLF

SEQ ID NO: 1176005 - protein, 9 aa, Homo Sapiens
LPPICIEYI

SEQ ID NO: 1176006 - protein, 9 aa, Homo Sapiens
EGYAADTFF

SEQ ID NO: 1176007 - protein, 9 aa, Homo Sapiens
QLMVTMPLL

SEQ ID NO: 1176008 - protein, 9 aa, Homo Sapiens
EQSQVELFV

SEQ ID NO: 1176009 - protein, 9 aa, Homo Sapiens
GQRPVQREH

SEQ ID NO: 1176010 - protein, 9 aa, Homo Sapiens
SMLAVAFLL

SEQ ID NO: 1176011 - protein, 9 aa, Homo Sapiens
EPFEVPNPC

SEQ ID NO: 1176012 - protein, 9 aa, Homo Sapiens
EKKCRLFYK

SEQ ID NO: 1176013 - protein, 9 aa, Homo Sapiens
AAGGSDPEA

SEQ ID NO: 1176014 - protein, 9 aa, Homo Sapiens
ARLWMANAR

SEQ ID NO: 1176015 - protein, 9 aa, Homo Sapiens
RRTTSASTA

SEQ ID NO: 1176016 - protein, 9 aa, Homo Sapiens
TSTTRTCGR

SEQ ID NO: 1176017 - protein, 9 aa, Homo Sapiens
YMGQRHRLE

SEQ ID NO: 1176018 - protein, 9 aa, Homo Sapiens
MPCGVPSGS

SEQ ID NO: 1176019 - protein, 9 aa, Homo Sapiens
GAPMGSSRT

SEQ ID NO: 1176020 - protein, 9 aa, Homo Sapiens
SRGQPSPPF

SEQ ID NO: 1176021 - protein, 9 aa, Homo Sapiens
DGRPLTMAT

SEQ ID NO: 1176022 - protein, 9 aa, Homo Sapiens
ALRPTASSA

SEQ ID NO: 1176023 - protein, 9 aa, Homo Sapiens
CGPQEATCR

SEQ ID NO: 1176024 - protein, 9 aa, Homo Sapiens
DSHPVAKKS

SEQ ID NO: 1176025 - protein, 9 aa, Homo Sapiens
AVTDFTSEA

SEQ ID NO: 1176026 - protein, 9 aa, Homo Sapiens
TATTTVLVS

SEQ ID NO: 1176027 - protein, 9 aa, Homo Sapiens
CSKNFTNPN

SEQ ID NO: 1176028 - protein, 9 aa, Homo Sapiens
WWLASRPSR

SEQ ID NO: 1176029 - protein, 9 aa, Homo Sapiens
CYLQQAACK

SEQ ID NO: 1176030 - protein, 9 aa, Homo Sapiens
LVVSGGVAS

SEQ ID NO: 1176031 - protein, 9 aa, Homo Sapiens
FLYQILWGL

SEQ ID NO: 1176032 - protein, 9 aa, Homo Sapiens
HYFLEETGP

SEQ ID NO: 1176033 - protein, 9 aa, Homo Sapiens
SRGRIQTWR

SEQ ID NO: 1176034 - protein, 9 aa, Homo Sapiens
ESNAGRYYC

SEQ ID NO: 1176035 - protein, 9 aa, Homo Sapiens
ARPPQPPPA

SEQ ID NO: 1176036 - protein, 9 aa, Homo Sapiens
LLELPTTEH

SEQ ID NO: 1176037 - protein, 9 aa, Homo Sapiens
VIRNDGALL

SEQ ID NO: 1176038 - protein, 9 aa, Homo Sapiens
FQGPVPRCK

SEQ ID NO: 1176039 - protein, 9 aa, Homo Sapiens
PCPPPVTPL

SEQ ID NO: 1176040 - protein, 9 aa, Homo Sapiens
TLQQRHPQG

SEQ ID NO: 1176041 - protein, 9 aa, Homo Sapiens
SFLSLRQND

SEQ ID NO: 1176042 - protein, 9 aa, Homo Sapiens
VEWPWGLAG

SEQ ID NO: 1176043 - protein, 9 aa, Homo Sapiens
GVGSKDAGC

SEQ ID NO: 1176044 - protein, 9 aa, Homo Sapiens
HWLITWGRL

SEQ ID NO: 1176045 - protein, 9 aa, Homo Sapiens
PTLGTRSCL

SEQ ID NO: 1176046 - protein, 9 aa, Homo Sapiens
EGDRPERVQ

SEQ ID NO: 1176047 - protein, 9 aa, Homo Sapiens
SPIPVAEIK

SEQ ID NO: 1176048 - protein, 9 aa, Homo Sapiens
SVKDHRTSQ

SEQ ID NO: 1176049 - protein, 9 aa, Homo Sapiens
ILNLQVLKK

SEQ ID NO: 1176050 - protein, 9 aa, Homo Sapiens
GGLCPGSPP

SEQ ID NO: 1176051 - protein, 9 aa, Homo Sapiens
GSAASSRQM

SEQ ID NO: 1176052 - protein, 9 aa, Homo Sapiens
NPCRSSWAA

SEQ ID NO: 1176053 - protein, 9 aa, Homo Sapiens
ETHDLFKLP

SEQ ID NO: 1176054 - protein, 9 aa, Homo Sapiens
PQDSRVRVG

SEQ ID NO: 1176055 - protein, 9 aa, Homo Sapiens
NCVQSRLHL

SEQ ID NO: 1176056 - protein, 9 aa, Homo Sapiens
HLALGHAQR

SEQ ID NO: 1176057 - protein, 9 aa, Homo Sapiens
LHRYLSLCI

SEQ ID NO: 1176058 - protein, 9 aa, Homo Sapiens
GDDTCQVGQ

SEQ ID NO: 1176059 - protein, 9 aa, Homo Sapiens
QGLAQVSWP

SEQ ID NO: 1176060 - protein, 9 aa, Homo Sapiens
EGLAGQRPD

SEQ ID NO: 1176061 - protein, 9 aa, Homo Sapiens
ASRGSKGSR

SEQ ID NO: 1176062 - protein, 9 aa, Homo Sapiens
GPFPPHGPV

SEQ ID NO: 1176063 - protein, 9 aa, Homo Sapiens
AIMSGCRPS

SEQ ID NO: 1176064 - protein, 9 aa, Homo Sapiens
PAPEETIAT

SEQ ID NO: 1176065 - protein, 9 aa, Homo Sapiens
EVSVAALVA

SEQ ID NO: 1176066 - protein, 9 aa, Homo Sapiens
VHGLALRVV

SEQ ID NO: 1176067 - protein, 9 aa, Homo Sapiens
PIMPNFPPH

SEQ ID NO: 1176068 - protein, 9 aa, Homo Sapiens
EQLSPKKIR

SEQ ID NO: 1176069 - protein, 9 aa, Homo Sapiens
IKKQVYLLL

SEQ ID NO: 1176070 - protein, 9 aa, Homo Sapiens
TSPLMKPPR

SEQ ID NO: 1176071 - protein, 9 aa, Homo Sapiens
TVILHSPLM

SEQ ID NO: 1176072 - protein, 9 aa, Homo Sapiens
RPPTPPAPR

SEQ ID NO: 1176073 - protein, 9 aa, Homo Sapiens
EAKPWLAIC

SEQ ID NO: 1176074 - protein, 9 aa, Homo Sapiens
MLEVDDEGD

SEQ ID NO: 1176075 - protein, 9 aa, Homo Sapiens
RWRFKTAPM

SEQ ID NO: 1176076 - protein, 9 aa, Homo Sapiens
FLYYEKLAD

SEQ ID NO: 1176077 - protein, 9 aa, Homo Sapiens
KENEKLRSL

SEQ ID NO: 1176078 - protein, 9 aa, Homo Sapiens
NHCAQPLAL

SEQ ID NO: 1176079 - protein, 9 aa, Homo Sapiens
QPKTAPSLS

SEQ ID NO: 1176080 - protein, 9 aa, Homo Sapiens
WLWCRPSWK

SEQ ID NO: 1176081 - protein, 9 aa, Homo Sapiens
DCSKNFTNP

SEQ ID NO: 1176082 - protein, 9 aa, Homo Sapiens
RAYTILRHH

SEQ ID NO: 1176083 - protein, 9 aa, Homo Sapiens
WLHKKRGGS

SEQ ID NO: 1176084 - protein, 9 aa, Homo Sapiens
DCGDLRGLV

SEQ ID NO: 1176085 - protein, 9 aa, Homo Sapiens
TATWWACAT

SEQ ID NO: 1176086 - protein, 9 aa, Homo Sapiens
TRSSPTRKN

SEQ ID NO: 1176087 - protein, 9 aa, Homo Sapiens
MPSTKIRLF

SEQ ID NO: 1176088 - protein, 9 aa, Homo Sapiens
PPQGKSTLR

SEQ ID NO: 1176089 - protein, 9 aa, Homo Sapiens
QKPSVGPQR

SEQ ID NO: 1176090 - protein, 9 aa, Homo Sapiens
PTVPRKTLK

SEQ ID NO: 1176091 - protein, 9 aa, Homo Sapiens
PALPSRPAQ

SEQ ID NO: 1176092 - protein, 9 aa, Homo Sapiens
QAAFPGTFS

SEQ ID NO: 1176093 - protein, 9 aa, Homo Sapiens
RSEPEFIEG

SEQ ID NO: 1176094 - protein, 9 aa, Homo Sapiens
EVDIPSIQI

SEQ ID NO: 1176095 - protein, 9 aa, Homo Sapiens
RRFQKPLIQ

SEQ ID NO: 1176096 - protein, 9 aa, Homo Sapiens
RGQVQEPVG

SEQ ID NO: 1176097 - protein, 9 aa, Homo Sapiens
IEYIIGGLI

SEQ ID NO: 1176098 - protein, 9 aa, Homo Sapiens
AVVSTPAHT

SEQ ID NO: 1176099 - protein, 9 aa, Homo Sapiens
QNMGAVASS

SEQ ID NO: 1176100 - protein, 9 aa, Homo Sapiens
PLLESELLA

SEQ ID NO: 1176101 - protein, 9 aa, Homo Sapiens
PPIECVNTP

SEQ ID NO: 1176102 - protein, 9 aa, Homo Sapiens
ALGRGSTCF

SEQ ID NO: 1176103 - protein, 9 aa, Homo Sapiens
ALHHAGPED

SEQ ID NO: 1176104 - protein, 9 aa, Homo Sapiens
LTGLQGFPG

SEQ ID NO: 1176105 - protein, 9 aa, Homo Sapiens
VLASSWYAS

SEQ ID NO: 1176106 - protein, 9 aa, Homo Sapiens
KRPPRAIST

SEQ ID NO: 1176107 - protein, 9 aa, Homo Sapiens
ITAQNNVVW

SEQ ID NO: 1176108 - protein, 9 aa, Homo Sapiens
RTKPAMGLA

SEQ ID NO: 1176109 - protein, 9 aa, Homo Sapiens
IPTLSSFQM

SEQ ID NO: 1176110 - protein, 9 aa, Homo Sapiens
APMGEAPTY

SEQ ID NO: 1176111 - protein, 9 aa, Homo Sapiens
PPGPQCPSG

SEQ ID NO: 1176112 - protein, 9 aa, Homo Sapiens
TLRFTDAPA

SEQ ID NO: 1176113 - protein, 9 aa, Homo Sapiens
FSAVNGLGS

SEQ ID NO: 1176114 - protein, 9 aa, Homo Sapiens
EACCSLQKT

SEQ ID NO: 1176115 - protein, 9 aa, Homo Sapiens
ECDSISRLD

SEQ ID NO: 1176116 - protein, 9 aa, Homo Sapiens
RKRKQLMVT

SEQ ID NO: 1176117 - protein, 9 aa, Homo Sapiens
KKRGKPLEN

SEQ ID NO: 1176118 - protein, 9 aa, Homo Sapiens
LEHKYWKNL

SEQ ID NO: 1176119 - protein, 9 aa, Homo Sapiens
VHPVLRAPG

SEQ ID NO: 1176120 - protein, 9 aa, Homo Sapiens
GSVHRMVTN

SEQ ID NO: 1176121 - protein, 9 aa, Homo Sapiens
DMAFESIVK

SEQ ID NO: 1176122 - protein, 9 aa, Homo Sapiens
DLRKEDEFV

SEQ ID NO: 1176123 - protein, 9 aa, Homo Sapiens
GRCGPAGWG

SEQ ID NO: 1176124 - protein, 9 aa, Homo Sapiens
NLIHLVPRT

SEQ ID NO: 1176125 - protein, 9 aa, Homo Sapiens
GRHHCPPGG

SEQ ID NO: 1176126 - protein, 9 aa, Homo Sapiens
PYWCSQQRL

SEQ ID NO: 1176127 - protein, 9 aa, Homo Sapiens
VGRTPPPTA

SEQ ID NO: 1176128 - protein, 9 aa, Homo Sapiens
LSIPWTQIP

SEQ ID NO: 1176129 - protein, 9 aa, Homo Sapiens
EKHLKTLKN

SEQ ID NO: 1176130 - protein, 9 aa, Homo Sapiens
LNHMLPSQP

SEQ ID NO: 1176131 - protein, 9 aa, Homo Sapiens
SRGSSDPLC

SEQ ID NO: 1176132 - protein, 9 aa, Homo Sapiens
LCRAPPSRP

SEQ ID NO: 1176133 - protein, 9 aa, Homo Sapiens
YIDFRKGLG

SEQ ID NO: 1176134 - protein, 9 aa, Homo Sapiens
EGIDFEDII

SEQ ID NO: 1176135 - protein, 9 aa, Homo Sapiens
MAFLGMTLL

SEQ ID NO: 1176136 - protein, 9 aa, Homo Sapiens
PTVIASMSN

SEQ ID NO: 1176137 - protein, 9 aa, Homo Sapiens
DEELNKLLD

SEQ ID NO: 1176138 - protein, 9 aa, Homo Sapiens
ALQGAVHIV

SEQ ID NO: 1176139 - protein, 9 aa, Homo Sapiens
KVADVEQVL

SEQ ID NO: 1176140 - protein, 9 aa, Homo Sapiens
SQPQAPFPA

SEQ ID NO: 1176141 - protein, 9 aa, Homo Sapiens
HPPLIHCYM

SEQ ID NO: 1176142 - protein, 9 aa, Homo Sapiens
ACLLPMLSV

SEQ ID NO: 1176143 - protein, 9 aa, Homo Sapiens
VRYLQSNMM

SEQ ID NO: 1176144 - protein, 9 aa, Homo Sapiens
IVGGVSTSW

SEQ ID NO: 1176145 - protein, 9 aa, Homo Sapiens
EPHPHKPEP

SEQ ID NO: 1176146 - protein, 9 aa, Homo Sapiens
YQTTDNYQP

SEQ ID NO: 1176147 - protein, 9 aa, Homo Sapiens
MSAVSQSQA

SEQ ID NO: 1176148 - protein, 9 aa, Homo Sapiens
VTKAGRQPR

SEQ ID NO: 1176149 - protein, 9 aa, Homo Sapiens
GSPPQGKST

SEQ ID NO: 1176150 - protein, 9 aa, Homo Sapiens
SSCHNGTCA

SEQ ID NO: 1176151 - protein, 9 aa, Homo Sapiens
RGQILHRGG

SEQ ID NO: 1176152 - protein, 9 aa, Homo Sapiens
SWKFIETKT

SEQ ID NO: 1176153 - protein, 9 aa, Homo Sapiens
CIRSAKCRG

SEQ ID NO: 1176154 - protein, 9 aa, Homo Sapiens
LSTLQQRHP

SEQ ID NO: 1176155 - protein, 9 aa, Homo Sapiens
SPLLSPHFQ

SEQ ID NO: 1176156 - protein, 9 aa, Homo Sapiens
GPLSPKHST

SEQ ID NO: 1176157 - protein, 9 aa, Homo Sapiens
VRQPPPGPS

SEQ ID NO: 1176158 - protein, 9 aa, Homo Sapiens
PVEIEVEIV

SEQ ID NO: 1176159 - protein, 9 aa, Homo Sapiens
MTCWKATWA

SEQ ID NO: 1176160 - protein, 9 aa, Homo Sapiens
SASSHDVDL

SEQ ID NO: 1176161 - protein, 9 aa, Homo Sapiens
GPEDGRAPR

SEQ ID NO: 1176162 - protein, 9 aa, Homo Sapiens
YTGCADLNG

SEQ ID NO: 1176163 - protein, 9 aa, Homo Sapiens
SCPQAIPRS

SEQ ID NO: 1176164 - protein, 9 aa, Homo Sapiens
EVTFPPGTA

SEQ ID NO: 1176165 - protein, 9 aa, Homo Sapiens
TVATVFRGC

SEQ ID NO: 1176166 - protein, 9 aa, Homo Sapiens
PTSTTRTCG

SEQ ID NO: 1176167 - protein, 9 aa, Homo Sapiens
HHISVKNHS

SEQ ID NO: 1176168 - protein, 9 aa, Homo Sapiens
VRLLELPTT

SEQ ID NO: 1176169 - protein, 9 aa, Homo Sapiens
EESLPGAMN

SEQ ID NO: 1176170 - protein, 9 aa, Homo Sapiens
TLPPYWCSQ

SEQ ID NO: 1176171 - protein, 9 aa, Homo Sapiens
FAYHFFCHY

SEQ ID NO: 1176172 - protein, 9 aa, Homo Sapiens
ASDEAACEN

SEQ ID NO: 1176173 - protein, 9 aa, Homo Sapiens
QSRRATCWL

SEQ ID NO: 1176174 - protein, 9 aa, Homo Sapiens
PRWKTCYIQ

SEQ ID NO: 1176175 - protein, 9 aa, Homo Sapiens
PLRGAMYWS

SEQ ID NO: 1176176 - protein, 9 aa, Homo Sapiens
TVAELPRDE

SEQ ID NO: 1176177 - protein, 9 aa, Homo Sapiens
ERLELTVVV

SEQ ID NO: 1176178 - protein, 9 aa, Homo Sapiens
GAARPRPLR

SEQ ID NO: 1176179 - protein, 9 aa, Homo Sapiens
NAPCVARTS

SEQ ID NO: 1176180 - protein, 9 aa, Homo Sapiens
RHPPPHPPQ

SEQ ID NO: 1176181 - protein, 9 aa, Homo Sapiens
RETMGTLAP

SEQ ID NO: 1176182 - protein, 9 aa, Homo Sapiens
EIAREIQSV

SEQ ID NO: 1176183 - protein, 9 aa, Homo Sapiens
GHNPFLASC

SEQ ID NO: 1176184 - protein, 9 aa, Homo Sapiens
LEVLLIRTE

SEQ ID NO: 1176185 - protein, 9 aa, Homo Sapiens
LGAHWLGGP

SEQ ID NO: 1176186 - protein, 9 aa, Homo Sapiens
EREGLAGQR

SEQ ID NO: 1176187 - protein, 9 aa, Homo Sapiens
PGVWSQVAV

SEQ ID NO: 1176188 - protein, 9 aa, Homo Sapiens
NMGAVASSG

SEQ ID NO: 1176189 - protein, 9 aa, Homo Sapiens
SDTSLAQKP

SEQ ID NO: 1176190 - protein, 9 aa, Homo Sapiens
KFFNVLKEI

SEQ ID NO: 1176191 - protein, 9 aa, Homo Sapiens
RRFQCVSVL

SEQ ID NO: 1176192 - protein, 9 aa, Homo Sapiens
PPQPPPALP

SEQ ID NO: 1176193 - protein, 9 aa, Homo Sapiens
SSSASSLVA

SEQ ID NO: 1176194 - protein, 9 aa, Homo Sapiens
GILQLTSLR

SEQ ID NO: 1176195 - protein, 9 aa, Homo Sapiens
DFLGRECLG

SEQ ID NO: 1176196 - protein, 9 aa, Homo Sapiens
GSLKKTSRI

SEQ ID NO: 1176197 - protein, 9 aa, Homo Sapiens
AERQKHIEE

SEQ ID NO: 1176198 - protein, 9 aa, Homo Sapiens
LSSPKEAMG

SEQ ID NO: 1176199 - protein, 9 aa, Homo Sapiens
GKRSHSSMS

SEQ ID NO: 1176200 - protein, 9 aa, Homo Sapiens
SGWTAMLVA

SEQ ID NO: 1176201 - protein, 9 aa, Homo Sapiens
HIYPLCSTT

SEQ ID NO: 1176202 - protein, 9 aa, Homo Sapiens
DCCGRSFSD

SEQ ID NO: 1176203 - protein, 9 aa, Homo Sapiens
RHLDALARG

SEQ ID NO: 1176204 - protein, 9 aa, Homo Sapiens
PGISPGAWK

SEQ ID NO: 1176205 - protein, 9 aa, Homo Sapiens
PLLLLQNIT

SEQ ID NO: 1176206 - protein, 9 aa, Homo Sapiens
SKGRIQQQL

SEQ ID NO: 1176207 - protein, 9 aa, Homo Sapiens
SYQQQHKVH

SEQ ID NO: 1176208 - protein, 9 aa, Homo Sapiens
NHVGKNTHK

SEQ ID NO: 1176209 - protein, 9 aa, Homo Sapiens
RTACGAASP

SEQ ID NO: 1176210 - protein, 9 aa, Homo Sapiens
APQARQQSQ

SEQ ID NO: 1176211 - protein, 9 aa, Homo Sapiens
HPVAKKSQV

SEQ ID NO: 1176212 - protein, 9 aa, Homo Sapiens
AHAMEARAM

SEQ ID NO: 1176213 - protein, 9 aa, Homo Sapiens
RNRVRGLLR

SEQ ID NO: 1176214 - protein, 9 aa, Homo Sapiens
VFRSGEERV

SEQ ID NO: 1176215 - protein, 9 aa, Homo Sapiens
KSTSPHHPQ

SEQ ID NO: 1176216 - protein, 9 aa, Homo Sapiens
LGDLSPLLS

SEQ ID NO: 1176217 - protein, 9 aa, Homo Sapiens
AGSGGGRRP

SEQ ID NO: 1176218 - protein, 9 aa, Homo Sapiens
MVLELKCKH

SEQ ID NO: 1176219 - protein, 9 aa, Homo Sapiens
YKALLLPVQ

SEQ ID NO: 1176220 - protein, 9 aa, Homo Sapiens
PVYCPNGQK

SEQ ID NO: 1176221 - protein, 9 aa, Homo Sapiens
VCSQSTPGR

SEQ ID NO: 1176222 - protein, 9 aa, Homo Sapiens
RMDPPAPTQ

SEQ ID NO: 1176223 - protein, 9 aa, Homo Sapiens
PLSAAGRPN

SEQ ID NO: 1176224 - protein, 9 aa, Homo Sapiens
HMRRRTTST

SEQ ID NO: 1176225 - protein, 9 aa, Homo Sapiens
DACQADRHS

SEQ ID NO: 1176226 - protein, 9 aa, Homo Sapiens
RCQEYENEL

SEQ ID NO: 1176227 - protein, 9 aa, Homo Sapiens
VIAAGPLYS

SEQ ID NO: 1176228 - protein, 9 aa, Homo Sapiens
VRPVVAGQL

SEQ ID NO: 1176229 - protein, 9 aa, Homo Sapiens
LFRMLMVAW

SEQ ID NO: 1176230 - protein, 9 aa, Homo Sapiens
VVSDVPEEL

SEQ ID NO: 1176231 - protein, 9 aa, Homo Sapiens
VVPPSAAPS

SEQ ID NO: 1176232 - protein, 9 aa, Homo Sapiens
PWHSCRLAG

SEQ ID NO: 1176233 - protein, 9 aa, Homo Sapiens
LHLFCYIGI

SEQ ID NO: 1176234 - protein, 9 aa, Homo Sapiens
PREPVPEEK

SEQ ID NO: 1176235 - protein, 9 aa, Homo Sapiens
HQGSGAAWH

SEQ ID NO: 1176236 - protein, 9 aa, Homo Sapiens
QRCWGSYAA

SEQ ID NO: 1176237 - protein, 9 aa, Homo Sapiens
HKQLNMIQQ

SEQ ID NO: 1176238 - protein, 9 aa, Homo Sapiens
EITWKNDTK

SEQ ID NO: 1176239 - protein, 9 aa, Homo Sapiens
AAGGMVEGG

SEQ ID NO: 1176240 - protein, 9 aa, Homo Sapiens
PEASLSITK

SEQ ID NO: 1176241 - protein, 9 aa, Homo Sapiens
ATYCHTQLL

SEQ ID NO: 1176242 - protein, 9 aa, Homo Sapiens
AICWRSPTH

SEQ ID NO: 1176243 - protein, 9 aa, Homo Sapiens
PGARPEGTP

SEQ ID NO: 1176244 - protein, 9 aa, Homo Sapiens
IDNLEKNSG

SEQ ID NO: 1176245 - protein, 9 aa, Homo Sapiens
RLAQQDPQL

SEQ ID NO: 1176246 - protein, 9 aa, Homo Sapiens
ETTHPSPSP

SEQ ID NO: 1176247 - protein, 9 aa, Homo Sapiens
SPREARALS

SEQ ID NO: 1176248 - protein, 9 aa, Homo Sapiens
RSERYVCAM

SEQ ID NO: 1176249 - protein, 9 aa, Homo Sapiens
PLRSWWLAS

SEQ ID NO: 1176250 - protein, 9 aa, Homo Sapiens
PPATATWRM

SEQ ID NO: 1176251 - protein, 9 aa, Homo Sapiens
GPATTAPEA

SEQ ID NO: 1176252 - protein, 9 aa, Homo Sapiens
KEKKILSGK

SEQ ID NO: 1176253 - protein, 9 aa, Homo Sapiens
DDTVRERAK

SEQ ID NO: 1176254 - protein, 9 aa, Homo Sapiens
IGVWASGKW

SEQ ID NO: 1176255 - protein, 9 aa, Homo Sapiens
SYGGSRRYD

SEQ ID NO: 1176256 - protein, 9 aa, Homo Sapiens
DLETYASPP

SEQ ID NO: 1176257 - protein, 9 aa, Homo Sapiens
CVGALLKLP

SEQ ID NO: 1176258 - protein, 9 aa, Homo Sapiens
NGYCTPRES

SEQ ID NO: 1176259 - protein, 9 aa, Homo Sapiens
LLQFQVSAS

SEQ ID NO: 1176260 - protein, 9 aa, Homo Sapiens
ELLEEIYMD

SEQ ID NO: 1176261 - protein, 9 aa, Homo Sapiens
KGPPVKPNM

SEQ ID NO: 1176262 - protein, 9 aa, Homo Sapiens
CKVKMCGSN

SEQ ID NO: 1176263 - protein, 9 aa, Homo Sapiens
PTGSMPPTA

SEQ ID NO: 1176264 - protein, 9 aa, Homo Sapiens
GPSASAQLW

SEQ ID NO: 1176265 - protein, 9 aa, Homo Sapiens
HLFYKVASP

SEQ ID NO: 1176266 - protein, 9 aa, Homo Sapiens
PPIYKTKQT

SEQ ID NO: 1176267 - protein, 9 aa, Homo Sapiens
QSCLTSFNS

SEQ ID NO: 1176268 - protein, 9 aa, Homo Sapiens
SGGLGGGPR

SEQ ID NO: 1176269 - protein, 9 aa, Homo Sapiens
APPSCLRFV

SEQ ID NO: 1176270 - protein, 9 aa, Homo Sapiens
EKTSLLQAL

SEQ ID NO: 1176271 - protein, 9 aa, Homo Sapiens
DFGVIVGSA

SEQ ID NO: 1176272 - protein, 9 aa, Homo Sapiens
ASDAGVPPL

SEQ ID NO: 1176273 - protein, 9 aa, Homo Sapiens
SRASLDQMG

SEQ ID NO: 1176274 - protein, 9 aa, Homo Sapiens
VETCNPELN

SEQ ID NO: 1176275 - protein, 9 aa, Homo Sapiens
DLSDYEKRE

SEQ ID NO: 1176276 - protein, 9 aa, Homo Sapiens
AKTPCPYGP

SEQ ID NO: 1176277 - protein, 9 aa, Homo Sapiens
LTRTEKLIS

SEQ ID NO: 1176278 - protein, 9 aa, Homo Sapiens
FGELVQPFF

SEQ ID NO: 1176279 - protein, 9 aa, Homo Sapiens
SCTPDGQSY

SEQ ID NO: 1176280 - protein, 9 aa, Homo Sapiens
PPGLRPCRC

SEQ ID NO: 1176281 - protein, 9 aa, Homo Sapiens
DGQQHMGIW

SEQ ID NO: 1176282 - protein, 9 aa, Homo Sapiens
MGPLPLPHW

SEQ ID NO: 1176283 - protein, 9 aa, Homo Sapiens
AVCVLHLGV

SEQ ID NO: 1176284 - protein, 9 aa, Homo Sapiens
QAPDAPPEL

SEQ ID NO: 1176285 - protein, 9 aa, Homo Sapiens
TPPCGSTPY

SEQ ID NO: 1176286 - protein, 9 aa, Homo Sapiens
RHPRPAHAA

SEQ ID NO: 1176287 - protein, 9 aa, Homo Sapiens
TSSQPSRME

SEQ ID NO: 1176288 - protein, 9 aa, Homo Sapiens
VFVTQFFIR

SEQ ID NO: 1176289 - protein, 9 aa, Homo Sapiens
WEQEVAEER

SEQ ID NO: 1176290 - protein, 9 aa, Homo Sapiens
KAAAAAREE

SEQ ID NO: 1176291 - protein, 9 aa, Homo Sapiens
DSADPVVTS

SEQ ID NO: 1176292 - protein, 9 aa, Homo Sapiens
QANCTSTGI

SEQ ID NO: 1176293 - protein, 9 aa, Homo Sapiens
PRNCVQSRL

SEQ ID NO: 1176294 - protein, 9 aa, Homo Sapiens
EQEKKCRLF

SEQ ID NO: 1176295 - protein, 9 aa, Homo Sapiens
KQSAAEMYG

SEQ ID NO: 1176296 - protein, 9 aa, Homo Sapiens
MQLLNEADH

SEQ ID NO: 1176297 - protein, 9 aa, Homo Sapiens
LFHTDRHTG

SEQ ID NO: 1176298 - protein, 9 aa, Homo Sapiens
KPSTNNTML

SEQ ID NO: 1176299 - protein, 9 aa, Homo Sapiens
PRPAHAAGP

SEQ ID NO: 1176300 - protein, 9 aa, Homo Sapiens
SPMHPVLEV

SEQ ID NO: 1176301 - protein, 9 aa, Homo Sapiens
PVTALARPR

SEQ ID NO: 1176302 - protein, 9 aa, Homo Sapiens
GPANPSAAP

SEQ ID NO: 1176303 - protein, 9 aa, Homo Sapiens
FTLWTSDLW

SEQ ID NO: 1176304 - protein, 9 aa, Homo Sapiens
VVMEVSVLD

SEQ ID NO: 1176305 - protein, 9 aa, Homo Sapiens
ASASPSSEP

SEQ ID NO: 1176306 - protein, 9 aa, Homo Sapiens
RPGSCISYP

SEQ ID NO: 1176307 - protein, 9 aa, Homo Sapiens
SWWVVDCPE

SEQ ID NO: 1176308 - protein, 9 aa, Homo Sapiens
ERRTESPPC

SEQ ID NO: 1176309 - protein, 9 aa, Homo Sapiens
HGPTRSTSV

SEQ ID NO: 1176310 - protein, 9 aa, Homo Sapiens
FVVFVQVKR

SEQ ID NO: 1176311 - protein, 9 aa, Homo Sapiens
QQQLEITGK

SEQ ID NO: 1176312 - protein, 9 aa, Homo Sapiens
DTPDEPQKS

SEQ ID NO: 1176313 - protein, 9 aa, Homo Sapiens
ADAVTKTHV

SEQ ID NO: 1176314 - protein, 9 aa, Homo Sapiens
VHCGAPPIR

SEQ ID NO: 1176315 - protein, 9 aa, Homo Sapiens
YLTLVLIRV

SEQ ID NO: 1176316 - protein, 9 aa, Homo Sapiens
PQIKSTSFL

SEQ ID NO: 1176317 - protein, 9 aa, Homo Sapiens
MWAGLALLS

SEQ ID NO: 1176318 - protein, 9 aa, Homo Sapiens
AGGRREPVE

SEQ ID NO: 1176319 - protein, 9 aa, Homo Sapiens
HYMDGQIPC

SEQ ID NO: 1176320 - protein, 9 aa, Homo Sapiens
PNIPYMYIR

SEQ ID NO: 1176321 - protein, 9 aa, Homo Sapiens
DEYKKTYME

SEQ ID NO: 1176322 - protein, 9 aa, Homo Sapiens
YLDYEDLEH

SEQ ID NO: 1176323 - protein, 9 aa, Homo Sapiens
EPEVLQDPL

SEQ ID NO: 1176324 - protein, 9 aa, Homo Sapiens
CTSVKRGTM

SEQ ID NO: 1176325 - protein, 9 aa, Homo Sapiens
RQNASLICH

SEQ ID NO: 1176326 - protein, 9 aa, Homo Sapiens
YKADTLKVV

SEQ ID NO: 1176327 - protein, 9 aa, Homo Sapiens
ADVEQVLVD

SEQ ID NO: 1176328 - protein, 9 aa, Homo Sapiens
FMEICLCKE

SEQ ID NO: 1176329 - protein, 9 aa, Homo Sapiens
FWHKKWISP

SEQ ID NO: 1176330 - protein, 9 aa, Homo Sapiens
LSFLSLRQN

SEQ ID NO: 1176331 - protein, 9 aa, Homo Sapiens
SEWHGWMVS

SEQ ID NO: 1176332 - protein, 9 aa, Homo Sapiens
ESISLSLEG

SEQ ID NO: 1176333 - protein, 9 aa, Homo Sapiens
VLLPAAPGV

SEQ ID NO: 1176334 - protein, 9 aa, Homo Sapiens
KRIHTRENL

SEQ ID NO: 1176335 - protein, 9 aa, Homo Sapiens
WWWRWGPSL

SEQ ID NO: 1176336 - protein, 9 aa, Homo Sapiens
CGRGFQHRA

SEQ ID NO: 1176337 - protein, 9 aa, Homo Sapiens
PAAAQGPAE

SEQ ID NO: 1176338 - protein, 9 aa, Homo Sapiens
HKSKKGPPV

SEQ ID NO: 1176339 - protein, 9 aa, Homo Sapiens
HERHRNHPH

SEQ ID NO: 1176340 - protein, 9 aa, Homo Sapiens
AGLGRWDLF

SEQ ID NO: 1176341 - protein, 9 aa, Homo Sapiens
FHVLALEVT

SEQ ID NO: 1176342 - protein, 9 aa, Homo Sapiens
VRDMVRSMD

SEQ ID NO: 1176343 - protein, 9 aa, Homo Sapiens
YLQQAACKQ

SEQ ID NO: 1176344 - protein, 9 aa, Homo Sapiens
RGRDKSPLT

SEQ ID NO: 1176345 - protein, 9 aa, Homo Sapiens
HVKPPSCPQ

SEQ ID NO: 1176346 - protein, 9 aa, Homo Sapiens
PPRGPLPMG

SEQ ID NO: 1176347 - protein, 9 aa, Homo Sapiens
KVIWPILQQ

SEQ ID NO: 1176348 - protein, 9 aa, Homo Sapiens
QPLDRQFRP

SEQ ID NO: 1176349 - protein, 9 aa, Homo Sapiens
IFNQFSVTS

SEQ ID NO: 1176350 - protein, 9 aa, Homo Sapiens
LAWSKQGPV

SEQ ID NO: 1176351 - protein, 9 aa, Homo Sapiens
VNAIDIWMA

SEQ ID NO: 1176352 - protein, 9 aa, Homo Sapiens
PPGSAPSMP

SEQ ID NO: 1176353 - protein, 9 aa, Homo Sapiens
EDHMDGLAI

SEQ ID NO: 1176354 - protein, 9 aa, Homo Sapiens
SLRALHRGA

SEQ ID NO: 1176355 - protein, 9 aa, Homo Sapiens
RTPWKHSDY

SEQ ID NO: 1176356 - protein, 9 aa, Homo Sapiens
VTKGTAWTC

SEQ ID NO: 1176357 - protein, 9 aa, Homo Sapiens
LAIMQDLIS

SEQ ID NO: 1176358 - protein, 9 aa, Homo Sapiens
NADKAPSRS

SEQ ID NO: 1176359 - protein, 9 aa, Homo Sapiens
WPSSPCPTS

SEQ ID NO: 1176360 - protein, 9 aa, Homo Sapiens
VPMPKNYLR

SEQ ID NO: 1176361 - protein, 9 aa, Homo Sapiens
SMPWHSCRL

SEQ ID NO: 1176362 - protein, 9 aa, Homo Sapiens
PAQIPTSTR

SEQ ID NO: 1176363 - protein, 9 aa, Homo Sapiens
KTETILKTC

SEQ ID NO: 1176364 - protein, 9 aa, Homo Sapiens
AGWGPPARP

SEQ ID NO: 1176365 - protein, 9 aa, Homo Sapiens
NAMQIVGFV

SEQ ID NO: 1176366 - protein, 9 aa, Homo Sapiens
QHGCREKID

SEQ ID NO: 1176367 - protein, 9 aa, Homo Sapiens
AEVAQHIRP

SEQ ID NO: 1176368 - protein, 9 aa, Homo Sapiens
TYAHLAQLL

SEQ ID NO: 1176369 - protein, 9 aa, Homo Sapiens
LPVAFFFSG

SEQ ID NO: 1176370 - protein, 9 aa, Homo Sapiens
PPSISKNVA

SEQ ID NO: 1176371 - protein, 9 aa, Homo Sapiens
KRFTGKINT

SEQ ID NO: 1176372 - protein, 9 aa, Homo Sapiens
DLILVSMSS

SEQ ID NO: 1176373 - protein, 9 aa, Homo Sapiens
PQGKSTLRG

SEQ ID NO: 1176374 - protein, 9 aa, Homo Sapiens
ILLEETPPR

SEQ ID NO: 1176375 - protein, 9 aa, Homo Sapiens
VAPMGEAPT

SEQ ID NO: 1176376 - protein, 9 aa, Homo Sapiens
CGAARPRRT

SEQ ID NO: 1176377 - protein, 9 aa, Homo Sapiens
NLCVRLGDV

SEQ ID NO: 1176378 - protein, 9 aa, Homo Sapiens
LTEAKTRLS

SEQ ID NO: 1176379 - protein, 9 aa, Homo Sapiens
SCSRVTRSG

SEQ ID NO: 1176380 - protein, 9 aa, Homo Sapiens
GLQALGSRS

SEQ ID NO: 1176381 - protein, 9 aa, Homo Sapiens
GGGPSGFPG

SEQ ID NO: 1176382 - protein, 9 aa, Homo Sapiens
QWVLTTAHC

SEQ ID NO: 1176383 - protein, 9 aa, Homo Sapiens
RATKFKQLY

SEQ ID NO: 1176384 - protein, 9 aa, Homo Sapiens
KTPCPYGPR

SEQ ID NO: 1176385 - protein, 9 aa, Homo Sapiens
ARRALDDTV

SEQ ID NO: 1176386 - protein, 9 aa, Homo Sapiens
VSVYGLVGV

SEQ ID NO: 1176387 - protein, 9 aa, Homo Sapiens
MLGGMGFLT

SEQ ID NO: 1176388 - protein, 9 aa, Homo Sapiens
RHGPTRSTS

SEQ ID NO: 1176389 - protein, 9 aa, Homo Sapiens
AGQDDGWGV

SEQ ID NO: 1176390 - protein, 9 aa, Homo Sapiens
IHTQEEDMP

SEQ ID NO: 1176391 - protein, 9 aa, Homo Sapiens
CQYRSPRRK

SEQ ID NO: 1176392 - protein, 9 aa, Homo Sapiens
PTTAWTRAS

SEQ ID NO: 1176393 - protein, 9 aa, Homo Sapiens
LWKKRFGQW

SEQ ID NO: 1176394 - protein, 9 aa, Homo Sapiens
WRSGGSGWS

SEQ ID NO: 1176395 - protein, 9 aa, Homo Sapiens
LKEICDDKV

SEQ ID NO: 1176396 - protein, 9 aa, Homo Sapiens
ALNSHRMVN

SEQ ID NO: 1176397 - protein, 9 aa, Homo Sapiens
TIINICPKY

SEQ ID NO: 1176398 - protein, 9 aa, Homo Sapiens
RRRGWGKGA

SEQ ID NO: 1176399 - protein, 9 aa, Homo Sapiens
HLRFTIFGT

SEQ ID NO: 1176400 - protein, 9 aa, Homo Sapiens
GSWKFIETK

SEQ ID NO: 1176401 - protein, 9 aa, Homo Sapiens
MSLITLAFL

SEQ ID NO: 1176402 - protein, 9 aa, Homo Sapiens
LDSYLSAGH

SEQ ID NO: 1176403 - protein, 9 aa, Homo Sapiens
DVRHGFRSS

SEQ ID NO: 1176404 - protein, 9 aa, Homo Sapiens
PWPLPSTQM

SEQ ID NO: 1176405 - protein, 9 aa, Homo Sapiens
WVVDCPESC

SEQ ID NO: 1176406 - protein, 9 aa, Homo Sapiens
RPQAHSAAK

SEQ ID NO: 1176407 - protein, 9 aa, Homo Sapiens
VPYSIPSIG

SEQ ID NO: 1176408 - protein, 9 aa, Homo Sapiens
RTSPRPRTC

SEQ ID NO: 1176409 - protein, 9 aa, Homo Sapiens
IIINLQFPI

SEQ ID NO: 1176410 - protein, 9 aa, Homo Sapiens
VIPHGQHTQ

SEQ ID NO: 1176411 - protein, 9 aa, Homo Sapiens
QDAVTQRPP

SEQ ID NO: 1176412 - protein, 9 aa, Homo Sapiens
EPLEVQNIP

SEQ ID NO: 1176413 - protein, 9 aa, Homo Sapiens
CDTDGTPHP

SEQ ID NO: 1176414 - protein, 9 aa, Homo Sapiens
RRRVRKYTL

SEQ ID NO: 1176415 - protein, 9 aa, Homo Sapiens
VVLYMPSAQ

SEQ ID NO: 1176416 - protein, 9 aa, Homo Sapiens
FSNLAGPPW

SEQ ID NO: 1176417 - protein, 9 aa, Homo Sapiens
MWTCMDMLP

SEQ ID NO: 1176418 - protein, 9 aa, Homo Sapiens
GDDLILVSM

SEQ ID NO: 1176419 - protein, 9 aa, Homo Sapiens
AGGQRDGGR

SEQ ID NO: 1176420 - protein, 9 aa, Homo Sapiens
RWGWFPPCG

SEQ ID NO: 1176421 - protein, 9 aa, Homo Sapiens
ACTDSWWVV

SEQ ID NO: 1176422 - protein, 9 aa, Homo Sapiens
AGSALGGRP

SEQ ID NO: 1176423 - protein, 9 aa, Homo Sapiens
GSSQRMSRQ

SEQ ID NO: 1176424 - protein, 9 aa, Homo Sapiens
GISPGAWKQ

SEQ ID NO: 1176425 - protein, 9 aa, Homo Sapiens
RAAEKCPAE

SEQ ID NO: 1176426 - protein, 9 aa, Homo Sapiens
AHARGHNQV

SEQ ID NO: 1176427 - protein, 9 aa, Homo Sapiens
NWNQVAVIG

SEQ ID NO: 1176428 - protein, 9 aa, Homo Sapiens
LLSGRKLTV

SEQ ID NO: 1176429 - protein, 9 aa, Homo Sapiens
FKTAPMKMG

SEQ ID NO: 1176430 - protein, 9 aa, Homo Sapiens
RASLEMLTP

SEQ ID NO: 1176431 - protein, 9 aa, Homo Sapiens
EDDSKGVRM

SEQ ID NO: 1176432 - protein, 9 aa, Homo Sapiens
DKDGATAVH

SEQ ID NO: 1176433 - protein, 9 aa, Homo Sapiens
HQARVLAQA

SEQ ID NO: 1176434 - protein, 9 aa, Homo Sapiens
EGGPERGAV

SEQ ID NO: 1176435 - protein, 9 aa, Homo Sapiens
ASETKMSPS

SEQ ID NO: 1176436 - protein, 9 aa, Homo Sapiens
PDGQSYCCE

SEQ ID NO: 1176437 - protein, 9 aa, Homo Sapiens
FPELPESEF

SEQ ID NO: 1176438 - protein, 9 aa, Homo Sapiens
IVKNVFPNM

SEQ ID NO: 1176439 - protein, 9 aa, Homo Sapiens
VNFCCYYWI

SEQ ID NO: 1176440 - protein, 9 aa, Homo Sapiens
LGSRSGGRS

SEQ ID NO: 1176441 - protein, 9 aa, Homo Sapiens
SPHGCQSAR

SEQ ID NO: 1176442 - protein, 9 aa, Homo Sapiens
LYQLMLNCW

SEQ ID NO: 1176443 - protein, 9 aa, Homo Sapiens
LESDRDLGV

SEQ ID NO: 1176444 - protein, 9 aa, Homo Sapiens
RCRPAVASR

SEQ ID NO: 1176445 - protein, 9 aa, Homo Sapiens
HVVYVLVCM

SEQ ID NO: 1176446 - protein, 9 aa, Homo Sapiens
YFSVNEACI

SEQ ID NO: 1176447 - protein, 9 aa, Homo Sapiens
WEWYHLRFT

SEQ ID NO: 1176448 - protein, 9 aa, Homo Sapiens
HVPPLLRGL

SEQ ID NO: 1176449 - protein, 9 aa, Homo Sapiens
YQDTDSDVL

SEQ ID NO: 1176450 - protein, 9 aa, Homo Sapiens
ESPADGQGA

SEQ ID NO: 1176451 - protein, 9 aa, Homo Sapiens
QRSNRSLPG

SEQ ID NO: 1176452 - protein, 9 aa, Homo Sapiens
QRDGGRGAA

SEQ ID NO: 1176453 - protein, 9 aa, Homo Sapiens
RPTATLGLC

SEQ ID NO: 1176454 - protein, 9 aa, Homo Sapiens
KVQDIIVSP

SEQ ID NO: 1176455 - protein, 9 aa, Homo Sapiens
VGVVGVCRM

SEQ ID NO: 1176456 - protein, 9 aa, Homo Sapiens
CHLVHDFTN

SEQ ID NO: 1176457 - protein, 9 aa, Homo Sapiens
QTLLPVEKS

SEQ ID NO: 1176458 - protein, 9 aa, Homo Sapiens
ATFVADRRN

SEQ ID NO: 1176459 - protein, 9 aa, Homo Sapiens
NLITNLSGC

SEQ ID NO: 1176460 - protein, 9 aa, Homo Sapiens
AQIPTSTRS

SEQ ID NO: 1176461 - protein, 9 aa, Homo Sapiens
PRASLNPRK

SEQ ID NO: 1176462 - protein, 9 aa, Homo Sapiens
PRCFLTLPL

SEQ ID NO: 1176463 - protein, 9 aa, Homo Sapiens
GTCTAQVDA

SEQ ID NO: 1176464 - protein, 9 aa, Homo Sapiens
RWILIEYQK

SEQ ID NO: 1176465 - protein, 9 aa, Homo Sapiens
LVSRFPSSM

SEQ ID NO: 1176466 - protein, 9 aa, Homo Sapiens
CPPPVTPLR

SEQ ID NO: 1176467 - protein, 9 aa, Homo Sapiens
GGRCPPHRW

SEQ ID NO: 1176468 - protein, 9 aa, Homo Sapiens
DRAVGGGGP

SEQ ID NO: 1176469 - protein, 9 aa, Homo Sapiens
PPKRLKASL

SEQ ID NO: 1176470 - protein, 9 aa, Homo Sapiens
IMSGCRPSN

SEQ ID NO: 1176471 - protein, 9 aa, Homo Sapiens
PPGRRRNPG

SEQ ID NO: 1176472 - protein, 9 aa, Homo Sapiens
LAKATYEHL

SEQ ID NO: 1176473 - protein, 9 aa, Homo Sapiens
ILKTCSLDY

SEQ ID NO: 1176474 - protein, 9 aa, Homo Sapiens
NLPQPHLTW

SEQ ID NO: 1176475 - protein, 9 aa, Homo Sapiens
SQCLPRPQG

SEQ ID NO: 1176476 - protein, 9 aa, Homo Sapiens
SCCDPQGTR

SEQ ID NO: 1176477 - protein, 9 aa, Homo Sapiens
ASINLSTIK

SEQ ID NO: 1176478 - protein, 9 aa, Homo Sapiens
TGAQRSFTC

SEQ ID NO: 1176479 - protein, 9 aa, Homo Sapiens
MHPVLEVSV

SEQ ID NO: 1176480 - protein, 9 aa, Homo Sapiens
TASSAASSS

SEQ ID NO: 1176481 - protein, 9 aa, Homo Sapiens
WQGAWWVLA

SEQ ID NO: 1176482 - protein, 9 aa, Homo Sapiens
FFLDASQHI

SEQ ID NO: 1176483 - protein, 9 aa, Homo Sapiens
TPPPSPGSG

SEQ ID NO: 1176484 - protein, 9 aa, Homo Sapiens
KVVQTGQDL

SEQ ID NO: 1176485 - protein, 9 aa, Homo Sapiens
HRCTAWCCQ

SEQ ID NO: 1176486 - protein, 9 aa, Homo Sapiens
VMPKEMVPP

SEQ ID NO: 1176487 - protein, 9 aa, Homo Sapiens
RMRRFADVE

SEQ ID NO: 1176488 - protein, 9 aa, Homo Sapiens
PPLLRGLPA

SEQ ID NO: 1176489 - protein, 9 aa, Homo Sapiens
APRHCLWLW

SEQ ID NO: 1176490 - protein, 9 aa, Homo Sapiens
EKLVRFYPA

SEQ ID NO: 1176491 - protein, 9 aa, Homo Sapiens
PSLCGALRS

SEQ ID NO: 1176492 - protein, 9 aa, Homo Sapiens
RVKAVSEKE

SEQ ID NO: 1176493 - protein, 9 aa, Homo Sapiens
PPVTAWHPH

SEQ ID NO: 1176494 - protein, 9 aa, Homo Sapiens
LEEAIYTGC

SEQ ID NO: 1176495 - protein, 9 aa, Homo Sapiens
QPRLALSPA

SEQ ID NO: 1176496 - protein, 9 aa, Homo Sapiens
KFMECDPDE

SEQ ID NO: 1176497 - protein, 9 aa, Homo Sapiens
TQAAAALRR

SEQ ID NO: 1176498 - protein, 9 aa, Homo Sapiens
RRGVLLQPW

SEQ ID NO: 1176499 - protein, 9 aa, Homo Sapiens
LGGMGFLTS

SEQ ID NO: 1176500 - protein, 9 aa, Homo Sapiens
RSLAMARPM

SEQ ID NO: 1176501 - protein, 9 aa, Homo Sapiens
CTPVPVACP

SEQ ID NO: 1176502 - protein, 9 aa, Homo Sapiens
RKTLKMIRR

SEQ ID NO: 1176503 - protein, 9 aa, Homo Sapiens
QVAVIGDER

SEQ ID NO: 1176504 - protein, 9 aa, Homo Sapiens
MAISPTGHL

SEQ ID NO: 1176505 - protein, 9 aa, Homo Sapiens
SILSDLRVY

SEQ ID NO: 1176506 - protein, 9 aa, Homo Sapiens
LRGHFPGCW

SEQ ID NO: 1176507 - protein, 9 aa, Homo Sapiens
GGTPLSISR

SEQ ID NO: 1176508 - protein, 9 aa, Homo Sapiens
RVTNSNANT

SEQ ID NO: 1176509 - protein, 9 aa, Homo Sapiens
WAAGPPSAG

SEQ ID NO: 1176510 - protein, 9 aa, Homo Sapiens
WPGWRWRRG

SEQ ID NO: 1176511 - protein, 9 aa, Homo Sapiens
ERVFGRGGG

SEQ ID NO: 1176512 - protein, 9 aa, Homo Sapiens
LQASGGPRY

SEQ ID NO: 1176513 - protein, 9 aa, Homo Sapiens
LPSRPAQPT

SEQ ID NO: 1176514 - protein, 9 aa, Homo Sapiens
RTTSASTAS

SEQ ID NO: 1176515 - protein, 9 aa, Homo Sapiens
LYRKEMRAK

SEQ ID NO: 1176516 - protein, 9 aa, Homo Sapiens
ILSYRWLSL

SEQ ID NO: 1176517 - protein, 9 aa, Homo Sapiens
ADHIYDLNI

SEQ ID NO: 1176518 - protein, 9 aa, Homo Sapiens
YTQLNHCIF

SEQ ID NO: 1176519 - protein, 9 aa, Homo Sapiens
SGATGTTAS

SEQ ID NO: 1176520 - protein, 9 aa, Homo Sapiens
QLQALAMWE

SEQ ID NO: 1176521 - protein, 9 aa, Homo Sapiens
GFPDITEGD

SEQ ID NO: 1176522 - protein, 9 aa, Homo Sapiens
AAAPAGPHP

SEQ ID NO: 1176523 - protein, 9 aa, Homo Sapiens
PTFLARPLP

SEQ ID NO: 1176524 - protein, 9 aa, Homo Sapiens
QSGQVLRTS

SEQ ID NO: 1176525 - protein, 9 aa, Homo Sapiens
LPLPPQPRL

SEQ ID NO: 1176526 - protein, 9 aa, Homo Sapiens
IMDKTVRFQ

SEQ ID NO: 1176527 - protein, 9 aa, Homo Sapiens
SGLKKTPKR

SEQ ID NO: 1176528 - protein, 9 aa, Homo Sapiens
VPPSAAPSM

SEQ ID NO: 1176529 - protein, 9 aa, Homo Sapiens
QINLRIREQ

SEQ ID NO: 1176530 - protein, 9 aa, Homo Sapiens
RGCVIPHGQ

SEQ ID NO: 1176531 - protein, 9 aa, Homo Sapiens
KSQYTKPYL

SEQ ID NO: 1176532 - protein, 9 aa, Homo Sapiens
RARDNYRAN

SEQ ID NO: 1176533 - protein, 9 aa, Homo Sapiens
WTCMDMLPK

SEQ ID NO: 1176534 - protein, 9 aa, Homo Sapiens
LNASRDKIK

SEQ ID NO: 1176535 - protein, 9 aa, Homo Sapiens
LLLAAARRM

SEQ ID NO: 1176536 - protein, 9 aa, Homo Sapiens
KAMALQSNQ

SEQ ID NO: 1176537 - protein, 9 aa, Homo Sapiens
SHSKLRPGF

SEQ ID NO: 1176538 - protein, 9 aa, Homo Sapiens
IRFVWENGR

SEQ ID NO: 1176539 - protein, 9 aa, Homo Sapiens
AWDPPRSCR

SEQ ID NO: 1176540 - protein, 9 aa, Homo Sapiens
PSIGSSIQS

SEQ ID NO: 1176541 - protein, 9 aa, Homo Sapiens
EDTSTTEMD

SEQ ID NO: 1176542 - protein, 9 aa, Homo Sapiens
RGYRVGRMR

SEQ ID NO: 1176543 - protein, 9 aa, Homo Sapiens
LLERVLFYR

SEQ ID NO: 1176544 - protein, 9 aa, Homo Sapiens
RCTAWCCQS

SEQ ID NO: 1176545 - protein, 9 aa, Homo Sapiens
SYGTYVTLT

SEQ ID NO: 1176546 - protein, 9 aa, Homo Sapiens
CEGIDFEDI

SEQ ID NO: 1176547 - protein, 9 aa, Homo Sapiens
RRSCSGLVR

SEQ ID NO: 1176548 - protein, 9 aa, Homo Sapiens
SSFLIFFIP

SEQ ID NO: 1176549 - protein, 9 aa, Homo Sapiens
PCRCHRGGR

SEQ ID NO: 1176550 - protein, 9 aa, Homo Sapiens
SDNTVAIDL

SEQ ID NO: 1176551 - protein, 9 aa, Homo Sapiens
NDRTPLLAA

SEQ ID NO: 1176552 - protein, 9 aa, Homo Sapiens
NKCALEDER

SEQ ID NO: 1176553 - protein, 9 aa, Homo Sapiens
ASPPRRWPP

SEQ ID NO: 1176554 - protein, 9 aa, Homo Sapiens
NFCCYYWIN

SEQ ID NO: 1176555 - protein, 9 aa, Homo Sapiens
RALARTSTC

SEQ ID NO: 1176556 - protein, 9 aa, Homo Sapiens
VQAHWRFTP

SEQ ID NO: 1176557 - protein, 9 aa, Homo Sapiens
RPQGCWPPP

SEQ ID NO: 1176558 - protein, 9 aa, Homo Sapiens
CPRIHKVPL

SEQ ID NO: 1176559 - protein, 9 aa, Homo Sapiens
NTALSCCDP

SEQ ID NO: 1176560 - protein, 9 aa, Homo Sapiens
HRRETLCLQ

SEQ ID NO: 1176561 - protein, 9 aa, Homo Sapiens
APWALVGAR

SEQ ID NO: 1176562 - protein, 9 aa, Homo Sapiens
DNLCCMDPA

SEQ ID NO: 1176563 - protein, 9 aa, Homo Sapiens
DKRRNTELF

SEQ ID NO: 1176564 - protein, 9 aa, Homo Sapiens
NCADCQPGT

SEQ ID NO: 1176565 - protein, 9 aa, Homo Sapiens
TNASCSGRS

SEQ ID NO: 1176566 - protein, 9 aa, Homo Sapiens
YLGPAPEET

SEQ ID NO: 1176567 - protein, 9 aa, Homo Sapiens
RSNNCIQVF

SEQ ID NO: 1176568 - protein, 9 aa, Homo Sapiens
DFTNAVIQE

SEQ ID NO: 1176569 - protein, 9 aa, Homo Sapiens
YYHWAMSFL

SEQ ID NO: 1176570 - protein, 9 aa, Homo Sapiens
LLAMLQDTQ

SEQ ID NO: 1176571 - protein, 9 aa, Homo Sapiens
ATCRNGHCI

SEQ ID NO: 1176572 - protein, 9 aa, Homo Sapiens
GILPAAEPM

SEQ ID NO: 1176573 - protein, 9 aa, Homo Sapiens
GIFTTSKTL

SEQ ID NO: 1176574 - protein, 9 aa, Homo Sapiens
KDAGCAIGA

SEQ ID NO: 1176575 - protein, 9 aa, Homo Sapiens
EDANAATCF

SEQ ID NO: 1176576 - protein, 9 aa, Homo Sapiens
LAERQKHIE

SEQ ID NO: 1176577 - protein, 9 aa, Homo Sapiens
TNYTLRYAR

SEQ ID NO: 1176578 - protein, 9 aa, Homo Sapiens
GTAGQGLSY

SEQ ID NO: 1176579 - protein, 9 aa, Homo Sapiens
LCFSGTYPG

SEQ ID NO: 1176580 - protein, 9 aa, Homo Sapiens
NKWFAETSI

SEQ ID NO: 1176581 - protein, 9 aa, Homo Sapiens
DTKGSPIDV

SEQ ID NO: 1176582 - protein, 9 aa, Homo Sapiens
AVVQAVGFQ

SEQ ID NO: 1176583 - protein, 9 aa, Homo Sapiens
GESPPASLK

SEQ ID NO: 1176584 - protein, 9 aa, Homo Sapiens
VVVVGAPWK

SEQ ID NO: 1176585 - protein, 9 aa, Homo Sapiens
KKSVWQRRR

SEQ ID NO: 1176586 - protein, 9 aa, Homo Sapiens
TFSFRHAAG

SEQ ID NO: 1176587 - protein, 9 aa, Homo Sapiens
YSFFTNVVP

SEQ ID NO: 1176588 - protein, 9 aa, Homo Sapiens
FSAPDTQAY

SEQ ID NO: 1176589 - protein, 9 aa, Homo Sapiens
VGNLRDVVY

SEQ ID NO: 1176590 - protein, 9 aa, Homo Sapiens
PPCIAPPTP

SEQ ID NO: 1176591 - protein, 9 aa, Homo Sapiens
IHSPQSYSV

SEQ ID NO: 1176592 - protein, 9 aa, Homo Sapiens
GRMCFLLPQ

SEQ ID NO: 1176593 - protein, 9 aa, Homo Sapiens
CLTWLIGGG

SEQ ID NO: 1176594 - protein, 9 aa, Homo Sapiens
RPRRTRSAW

SEQ ID NO: 1176595 - protein, 9 aa, Homo Sapiens
TRGSGGYGG

SEQ ID NO: 1176596 - protein, 9 aa, Homo Sapiens
TEPGPRVGP

SEQ ID NO: 1176597 - protein, 9 aa, Homo Sapiens
HNLLVHKAV

SEQ ID NO: 1176598 - protein, 9 aa, Homo Sapiens
SRGRLQGWQ

SEQ ID NO: 1176599 - protein, 9 aa, Homo Sapiens
GQQHMGIWP

SEQ ID NO: 1176600 - protein, 9 aa, Homo Sapiens
SPEPPRPHA

SEQ ID NO: 1176601 - protein, 9 aa, Homo Sapiens
WLEEVQPAC

SEQ ID NO: 1176602 - protein, 9 aa, Homo Sapiens
RPPCHCPTD

SEQ ID NO: 1176603 - protein, 9 aa, Homo Sapiens
APDFLAHVC

SEQ ID NO: 1176604 - protein, 9 aa, Homo Sapiens
EEVQPACLD

SEQ ID NO: 1176605 - protein, 9 aa, Homo Sapiens
VKGTQNYIP

SEQ ID NO: 1176606 - protein, 9 aa, Homo Sapiens
PPGWLPRLT

SEQ ID NO: 1176607 - protein, 9 aa, Homo Sapiens
ESSLRPRPP

SEQ ID NO: 1176608 - protein, 9 aa, Homo Sapiens
ITLNLLVIF

SEQ ID NO: 1176609 - protein, 9 aa, Homo Sapiens
GSKKFSNVL

SEQ ID NO: 1176610 - protein, 9 aa, Homo Sapiens
PQMQLQALA

SEQ ID NO: 1176611 - protein, 9 aa, Homo Sapiens
MEMHYGHQA

SEQ ID NO: 1176612 - protein, 9 aa, Homo Sapiens
ARGRAQADQ

SEQ ID NO: 1176613 - protein, 9 aa, Homo Sapiens
RGVLLQPWL

SEQ ID NO: 1176614 - protein, 9 aa, Homo Sapiens
IDSLERYLD

SEQ ID NO: 1176615 - protein, 9 aa, Homo Sapiens
ELSHRSGSQ

SEQ ID NO: 1176616 - protein, 9 aa, Homo Sapiens
SSQDLQVEI

SEQ ID NO: 1176617 - protein, 9 aa, Homo Sapiens
KDIGSERYT

SEQ ID NO: 1176618 - protein, 9 aa, Homo Sapiens
ASQHILEAP

SEQ ID NO: 1176619 - protein, 9 aa, Homo Sapiens
DVWVVGCIM

SEQ ID NO: 1176620 - protein, 9 aa, Homo Sapiens
RMEEERKRR

SEQ ID NO: 1176621 - protein, 9 aa, Homo Sapiens
ELRRIASQA

SEQ ID NO: 1176622 - protein, 9 aa, Homo Sapiens
GPRAPGCSL

SEQ ID NO: 1176623 - protein, 9 aa, Homo Sapiens
RRRRVRKYT

SEQ ID NO: 1176624 - protein, 9 aa, Homo Sapiens
TEKLISPCA

SEQ ID NO: 1176625 - protein, 9 aa, Homo Sapiens
RAWGLLRPA

SEQ ID NO: 1176626 - protein, 9 aa, Homo Sapiens
IFLEGVQLV

SEQ ID NO: 1176627 - protein, 9 aa, Homo Sapiens
TFLARPLPW

SEQ ID NO: 1176628 - protein, 9 aa, Homo Sapiens
DHEAIEANS

SEQ ID NO: 1176629 - protein, 9 aa, Homo Sapiens
HRYLSLCIR

SEQ ID NO: 1176630 - protein, 9 aa, Homo Sapiens
YIECLVWRT

SEQ ID NO: 1176631 - protein, 9 aa, Homo Sapiens
PSTLDSSSR

SEQ ID NO: 1176632 - protein, 9 aa, Homo Sapiens
HWRFTPEIP

SEQ ID NO: 1176633 - protein, 9 aa, Homo Sapiens
QKYPIRMSP

SEQ ID NO: 1176634 - protein, 9 aa, Homo Sapiens
ACCGTRRSC

SEQ ID NO: 1176635 - protein, 9 aa, Homo Sapiens
HIWHNICHQ

SEQ ID NO: 1176636 - protein, 9 aa, Homo Sapiens
APRWKTCYI

SEQ ID NO: 1176637 - protein, 9 aa, Homo Sapiens
IECVNTPGS

SEQ ID NO: 1176638 - protein, 9 aa, Homo Sapiens
WFPVVGLPR

SEQ ID NO: 1176639 - protein, 9 aa, Homo Sapiens
RPPAYIPPR

SEQ ID NO: 1176640 - protein, 9 aa, Homo Sapiens
PASSTSRST

SEQ ID NO: 1176641 - protein, 9 aa, Homo Sapiens
SDELTVTNA

SEQ ID NO: 1176642 - protein, 9 aa, Homo Sapiens
RFITSVVRR

SEQ ID NO: 1176643 - protein, 9 aa, Homo Sapiens
KDSALSLVA

SEQ ID NO: 1176644 - protein, 9 aa, Homo Sapiens
RKSSSASSL

SEQ ID NO: 1176645 - protein, 9 aa, Homo Sapiens
FKQRTHLIA

SEQ ID NO: 1176646 - protein, 9 aa, Homo Sapiens
AAQDGARCP

SEQ ID NO: 1176647 - protein, 9 aa, Homo Sapiens
HHMEPGNNP

SEQ ID NO: 1176648 - protein, 9 aa, Homo Sapiens
QLHQGGERN

SEQ ID NO: 1176649 - protein, 9 aa, Homo Sapiens
VGRMRPSAL

SEQ ID NO: 1176650 - protein, 9 aa, Homo Sapiens
QTPGFKGHF

SEQ ID NO: 1176651 - protein, 9 aa, Homo Sapiens
AAAQELLGH

SEQ ID NO: 1176652 - protein, 9 aa, Homo Sapiens
LPLWRSRSF

SEQ ID NO: 1176653 - protein, 9 aa, Homo Sapiens
AAVKAFWGG

SEQ ID NO: 1176654 - protein, 9 aa, Homo Sapiens
DTPTPTTID

SEQ ID NO: 1176655 - protein, 9 aa, Homo Sapiens
ERASQTQNC

SEQ ID NO: 1176656 - protein, 9 aa, Homo Sapiens
ITGGKKVLN

SEQ ID NO: 1176657 - protein, 9 aa, Homo Sapiens
WACRQQKTL

SEQ ID NO: 1176658 - protein, 9 aa, Homo Sapiens
SGLMWAGLA

SEQ ID NO: 1176659 - protein, 9 aa, Homo Sapiens
SRFPSSMSG

SEQ ID NO: 1176660 - protein, 9 aa, Homo Sapiens
MAFLYHVVY

SEQ ID NO: 1176661 - protein, 9 aa, Homo Sapiens
NQYCNLVSF

SEQ ID NO: 1176662 - protein, 9 aa, Homo Sapiens
KQYEDMVAE

SEQ ID NO: 1176663 - protein, 9 aa, Homo Sapiens
YTILRHHGL

SEQ ID NO: 1176664 - protein, 9 aa, Homo Sapiens
KYSDFASNC

SEQ ID NO: 1176665 - protein, 9 aa, Homo Sapiens
AHTGERHHE

SEQ ID NO: 1176666 - protein, 9 aa, Homo Sapiens
KKPHRYMPG

SEQ ID NO: 1176667 - protein, 9 aa, Homo Sapiens
GLSYGMVGV

SEQ ID NO: 1176668 - protein, 9 aa, Homo Sapiens
TPHPAPPPS

SEQ ID NO: 1176669 - protein, 9 aa, Homo Sapiens
PSWKGKGAS

SEQ ID NO: 1176670 - protein, 9 aa, Homo Sapiens
LCSPVARLT

SEQ ID NO: 1176671 - protein, 9 aa, Homo Sapiens
VTVPRNCVQ

SEQ ID NO: 1176672 - protein, 9 aa, Homo Sapiens
RLWSWCGTS

SEQ ID NO: 1176673 - protein, 9 aa, Homo Sapiens
GRPTAALVR

SEQ ID NO: 1176674 - protein, 9 aa, Homo Sapiens
AAPAGPHPT

SEQ ID NO: 1176675 - protein, 9 aa, Homo Sapiens
RREPVEPGQ

SEQ ID NO: 1176676 - protein, 9 aa, Homo Sapiens
SPLFACCSL

SEQ ID NO: 1176677 - protein, 9 aa, Homo Sapiens
TTIDLSILT

SEQ ID NO: 1176678 - protein, 9 aa, Homo Sapiens
ARTSTCGSA

SEQ ID NO: 1176679 - protein, 9 aa, Homo Sapiens
VCHERHRNH

SEQ ID NO: 1176680 - protein, 9 aa, Homo Sapiens
RLQGEVVTF

SEQ ID NO: 1176681 - protein, 9 aa, Homo Sapiens
QRRRGWRRT

SEQ ID NO: 1176682 - protein, 9 aa, Homo Sapiens
KPSLRPSSW

SEQ ID NO: 1176683 - protein, 9 aa, Homo Sapiens
SHRSGSQCL

SEQ ID NO: 1176684 - protein, 9 aa, Homo Sapiens
LLLNLDTHI

SEQ ID NO: 1176685 - protein, 9 aa, Homo Sapiens
VAWVLGWLP

SEQ ID NO: 1176686 - protein, 9 aa, Homo Sapiens
IDGAEPSKG

SEQ ID NO: 1176687 - protein, 9 aa, Homo Sapiens
PVVRPGGMP

SEQ ID NO: 1176688 - protein, 9 aa, Homo Sapiens
SWVPLASEE

SEQ ID NO: 1176689 - protein, 9 aa, Homo Sapiens
FLVMCILTV

SEQ ID NO: 1176690 - protein, 9 aa, Homo Sapiens
GARACTPWP

SEQ ID NO: 1176691 - protein, 9 aa, Homo Sapiens
RGFWKGTES

SEQ ID NO: 1176692 - protein, 9 aa, Homo Sapiens
KNTSVVTGT

SEQ ID NO: 1176693 - protein, 9 aa, Homo Sapiens
RPSCWSMRM

SEQ ID NO: 1176694 - protein, 9 aa, Homo Sapiens
FLAGTGKQD

SEQ ID NO: 1176695 - protein, 9 aa, Homo Sapiens
WEATPHSIH

SEQ ID NO: 1176696 - protein, 9 aa, Homo Sapiens
RVLGERHTM

SEQ ID NO: 1176697 - protein, 9 aa, Homo Sapiens
MPPPGLRPC

SEQ ID NO: 1176698 - protein, 9 aa, Homo Sapiens
VEDTTAIDM

SEQ ID NO: 1176699 - protein, 9 aa, Homo Sapiens
LSYDGPLRH

SEQ ID NO: 1176700 - protein, 9 aa, Homo Sapiens
CFKRISGTS

SEQ ID NO: 1176701 - protein, 9 aa, Homo Sapiens
VGNSTLSWA

SEQ ID NO: 1176702 - protein, 9 aa, Homo Sapiens
LLVTQNGRA

SEQ ID NO: 1176703 - protein, 9 aa, Homo Sapiens
IKIINYKIL

SEQ ID NO: 1176704 - protein, 9 aa, Homo Sapiens
DLLKKFHIP

SEQ ID NO: 1176705 - protein, 9 aa, Homo Sapiens
SAASACATS

SEQ ID NO: 1176706 - protein, 9 aa, Homo Sapiens
SPADRVRQV

SEQ ID NO: 1176707 - protein, 9 aa, Homo Sapiens
GAPAQSPGR

SEQ ID NO: 1176708 - protein, 9 aa, Homo Sapiens
LLPTHTFST

SEQ ID NO: 1176709 - protein, 9 aa, Homo Sapiens
PPPSAPPTP

SEQ ID NO: 1176710 - protein, 9 aa, Homo Sapiens
SQAPQAWST

SEQ ID NO: 1176711 - protein, 9 aa, Homo Sapiens
WISGSEATS

SEQ ID NO: 1176712 - protein, 9 aa, Homo Sapiens
TTHTGENPY

SEQ ID NO: 1176713 - protein, 9 aa, Homo Sapiens
SLHAWNLRA

SEQ ID NO: 1176714 - protein, 9 aa, Homo Sapiens
FRGSYSYMQ

SEQ ID NO: 1176715 - protein, 9 aa, Homo Sapiens
GMKLQKKIW

SEQ ID NO: 1176716 - protein, 9 aa, Homo Sapiens
PPRASSAGD

SEQ ID NO: 1176717 - protein, 9 aa, Homo Sapiens
RVAQLEQAY

SEQ ID NO: 1176718 - protein, 9 aa, Homo Sapiens
PLLRGLPAS

SEQ ID NO: 1176719 - protein, 9 aa, Homo Sapiens
LASPTWRRT

SEQ ID NO: 1176720 - protein, 9 aa, Homo Sapiens
CSPSPNCGL

SEQ ID NO: 1176721 - protein, 9 aa, Homo Sapiens
CIFIIIHRS

SEQ ID NO: 1176722 - protein, 9 aa, Homo Sapiens
TKRLTVPYA

SEQ ID NO: 1176723 - protein, 9 aa, Homo Sapiens
MDDPDIVGS

SEQ ID NO: 1176724 - protein, 9 aa, Homo Sapiens
LPPVLMLHL

SEQ ID NO: 1176725 - protein, 9 aa, Homo Sapiens
PTRSTSVGL

SEQ ID NO: 1176726 - protein, 9 aa, Homo Sapiens
EKGEAAPPA

SEQ ID NO: 1176727 - protein, 9 aa, Homo Sapiens
APGCWSCRR

SEQ ID NO: 1176728 - protein, 9 aa, Homo Sapiens
DEEIISLKI

SEQ ID NO: 1176729 - protein, 9 aa, Homo Sapiens
RTKAVIFCL

SEQ ID NO: 1176730 - protein, 9 aa, Homo Sapiens
TVKGTQNYI

SEQ ID NO: 1176731 - protein, 9 aa, Homo Sapiens
RVGQAMAYT

SEQ ID NO: 1176732 - protein, 9 aa, Homo Sapiens
KALVKTWTQ

SEQ ID NO: 1176733 - protein, 9 aa, Homo Sapiens
LLCPRVLPV

SEQ ID NO: 1176734 - protein, 9 aa, Homo Sapiens
VIGINHCDW

SEQ ID NO: 1176735 - protein, 9 aa, Homo Sapiens
ASSVSPPQA

SEQ ID NO: 1176736 - protein, 9 aa, Homo Sapiens
EETPPRETD

SEQ ID NO: 1176737 - protein, 9 aa, Homo Sapiens
QLARHIRGE

SEQ ID NO: 1176738 - protein, 9 aa, Homo Sapiens
SICNNKWFA

SEQ ID NO: 1176739 - protein, 9 aa, Homo Sapiens
VRRGSSALW

SEQ ID NO: 1176740 - protein, 9 aa, Homo Sapiens
GDDDRFLVG

SEQ ID NO: 1176741 - protein, 9 aa, Homo Sapiens
EDEDEDADI

SEQ ID NO: 1176742 - protein, 9 aa, Homo Sapiens
YQKRITQQL

SEQ ID NO: 1176743 - protein, 9 aa, Homo Sapiens
REITWKNDT

SEQ ID NO: 1176744 - protein, 9 aa, Homo Sapiens
HELRHSLCD

SEQ ID NO: 1176745 - protein, 9 aa, Homo Sapiens
YMALCSGPR

SEQ ID NO: 1176746 - protein, 9 aa, Homo Sapiens
ARWRTRCWA

SEQ ID NO: 1176747 - protein, 9 aa, Homo Sapiens
LSLIFSVFV

SEQ ID NO: 1176748 - protein, 9 aa, Homo Sapiens
GPWDWLPPC

SEQ ID NO: 1176749 - protein, 9 aa, Homo Sapiens
NSRSLARCL

SEQ ID NO: 1176750 - protein, 9 aa, Homo Sapiens
GQHRSSSGH

SEQ ID NO: 1176751 - protein, 9 aa, Homo Sapiens
SRDCFFCGP

SEQ ID NO: 1176752 - protein, 9 aa, Homo Sapiens
RSLFFCGAA

SEQ ID NO: 1176753 - protein, 9 aa, Homo Sapiens
RSGWRSVRM

SEQ ID NO: 1176754 - protein, 9 aa, Homo Sapiens
AFEYGAKQG

SEQ ID NO: 1176755 - protein, 9 aa, Homo Sapiens
HTWAYREEP

SEQ ID NO: 1176756 - protein, 9 aa, Homo Sapiens
CLCRAPPSR

SEQ ID NO: 1176757 - protein, 9 aa, Homo Sapiens
LEQRDSKCK

SEQ ID NO: 1176758 - protein, 9 aa, Homo Sapiens
RQPPPAFPL

SEQ ID NO: 1176759 - protein, 9 aa, Homo Sapiens
REAVRTLVA

SEQ ID NO: 1176760 - protein, 9 aa, Homo Sapiens
LKRTPWKHS

SEQ ID NO: 1176761 - protein, 9 aa, Homo Sapiens
VVHVASCEE

SEQ ID NO: 1176762 - protein, 9 aa, Homo Sapiens
PGRRRNPGS

SEQ ID NO: 1176763 - protein, 9 aa, Homo Sapiens
MRSARTFVP

SEQ ID NO: 1176764 - protein, 9 aa, Homo Sapiens
WGKVWCLNE

SEQ ID NO: 1176765 - protein, 9 aa, Homo Sapiens
RLLPLIHPR

SEQ ID NO: 1176766 - protein, 9 aa, Homo Sapiens
NGHHVLGLI

SEQ ID NO: 1176767 - protein, 9 aa, Homo Sapiens
YYLPDVGQQ

SEQ ID NO: 1176768 - protein, 9 aa, Homo Sapiens
VILGLFCTI

SEQ ID NO: 1176769 - protein, 9 aa, Homo Sapiens
LAQPSQAPQ

SEQ ID NO: 1176770 - protein, 9 aa, Homo Sapiens
AWQQLHWLQ

SEQ ID NO: 1176771 - protein, 9 aa, Homo Sapiens
MLAVAFLLQ

SEQ ID NO: 1176772 - protein, 9 aa, Homo Sapiens
QRHPQGPCP

SEQ ID NO: 1176773 - protein, 9 aa, Homo Sapiens
IVAPSQDPC

SEQ ID NO: 1176774 - protein, 9 aa, Homo Sapiens
VGGVSTSWG

SEQ ID NO: 1176775 - protein, 9 aa, Homo Sapiens
FVVEVSHLE

SEQ ID NO: 1176776 - protein, 9 aa, Homo Sapiens
PQYTPRVLT

SEQ ID NO: 1176777 - protein, 9 aa, Homo Sapiens
AQHEAEAGG

SEQ ID NO: 1176778 - protein, 9 aa, Homo Sapiens
GQEWYRQQV

SEQ ID NO: 1176779 - protein, 9 aa, Homo Sapiens
IEHGFEGKF

SEQ ID NO: 1176780 - protein, 9 aa, Homo Sapiens
GEELGAAHD

SEQ ID NO: 1176781 - protein, 9 aa, Homo Sapiens
GPWAAAWGP

SEQ ID NO: 1176782 - protein, 9 aa, Homo Sapiens
QSRWTRMSL

SEQ ID NO: 1176783 - protein, 9 aa, Homo Sapiens
RSHSSMSGQ

SEQ ID NO: 1176784 - protein, 9 aa, Homo Sapiens
AGRHSPARP

SEQ ID NO: 1176785 - protein, 9 aa, Homo Sapiens
LTISFPCSK

SEQ ID NO: 1176786 - protein, 9 aa, Homo Sapiens
QHGSPAIGG

SEQ ID NO: 1176787 - protein, 9 aa, Homo Sapiens
LVDFFIEHK

SEQ ID NO: 1176788 - protein, 9 aa, Homo Sapiens
WNINPHPSA

SEQ ID NO: 1176789 - protein, 9 aa, Homo Sapiens
SVSVGCVAS

SEQ ID NO: 1176790 - protein, 9 aa, Homo Sapiens
PWTSLHSGA

SEQ ID NO: 1176791 - protein, 9 aa, Homo Sapiens
RKRRRRKMT

SEQ ID NO: 1176792 - protein, 9 aa, Homo Sapiens
PTPSAPPQG

SEQ ID NO: 1176793 - protein, 9 aa, Homo Sapiens
DGLGGNSLC

SEQ ID NO: 1176794 - protein, 9 aa, Homo Sapiens
AHACCRPSR

SEQ ID NO: 1176795 - protein, 9 aa, Homo Sapiens
PSPNLPQPH

SEQ ID NO: 1176796 - protein, 9 aa, Homo Sapiens
ADLTFVATL

SEQ ID NO: 1176797 - protein, 9 aa, Homo Sapiens
HRHCCDIYK

SEQ ID NO: 1176798 - protein, 9 aa, Homo Sapiens
PRARCLRVP

SEQ ID NO: 1176799 - protein, 9 aa, Homo Sapiens
EEPQSRWTR

SEQ ID NO: 1176800 - protein, 9 aa, Homo Sapiens
LGLFCTIQY

SEQ ID NO: 1176801 - protein, 9 aa, Homo Sapiens
PAGPHPTGR

SEQ ID NO: 1176802 - protein, 9 aa, Homo Sapiens
INQVTLGRW

SEQ ID NO: 1176803 - protein, 9 aa, Homo Sapiens
CGPCMLCFI

SEQ ID NO: 1176804 - protein, 9 aa, Homo Sapiens
GGSHFFSPE

SEQ ID NO: 1176805 - protein, 9 aa, Homo Sapiens
HSCTPVPVA

SEQ ID NO: 1176806 - protein, 9 aa, Homo Sapiens
EDQTALLPA

SEQ ID NO: 1176807 - protein, 9 aa, Homo Sapiens
FGKGVSWGA

SEQ ID NO: 1176808 - protein, 9 aa, Homo Sapiens
TPGREGRDV

SEQ ID NO: 1176809 - protein, 9 aa, Homo Sapiens
NLDTHIVEI

SEQ ID NO: 1176810 - protein, 9 aa, Homo Sapiens
LSRTGRRPT

SEQ ID NO: 1176811 - protein, 9 aa, Homo Sapiens
PLAVPGTKG

SEQ ID NO: 1176812 - protein, 9 aa, Homo Sapiens
QRLLGLARP

SEQ ID NO: 1176813 - protein, 9 aa, Homo Sapiens
VGGLSDHIA

SEQ ID NO: 1176814 - protein, 9 aa, Homo Sapiens
KRRRRVRKY

SEQ ID NO: 1176815 - protein, 9 aa, Homo Sapiens
RQEEKIWEQ

SEQ ID NO: 1176816 - protein, 9 aa, Homo Sapiens
FDVHDDMRL

SEQ ID NO: 1176817 - protein, 9 aa, Homo Sapiens
TAEIDQLKN

SEQ ID NO: 1176818 - protein, 9 aa, Homo Sapiens
DASCARWRT

SEQ ID NO: 1176819 - protein, 9 aa, Homo Sapiens
NGLLFKGRG

SEQ ID NO: 1176820 - protein, 9 aa, Homo Sapiens
KEVNSRSLA

SEQ ID NO: 1176821 - protein, 9 aa, Homo Sapiens
ASSLPWTTP

SEQ ID NO: 1176822 - protein, 9 aa, Homo Sapiens
TCRNGHCIP

SEQ ID NO: 1176823 - protein, 9 aa, Homo Sapiens
PRPPRPPCH

SEQ ID NO: 1176824 - protein, 9 aa, Homo Sapiens
EAQYRCACG

SEQ ID NO: 1176825 - protein, 9 aa, Homo Sapiens
EARGGPWPR

SEQ ID NO: 1176826 - protein, 9 aa, Homo Sapiens
VGLEVRRLV

SEQ ID NO: 1176827 - protein, 9 aa, Homo Sapiens
NRCRGKNEN

SEQ ID NO: 1176828 - protein, 9 aa, Homo Sapiens
EAKTSGLMW

SEQ ID NO: 1176829 - protein, 9 aa, Homo Sapiens
DLHLALGHA

SEQ ID NO: 1176830 - protein, 9 aa, Homo Sapiens
KSLLKRNMK

SEQ ID NO: 1176831 - protein, 9 aa, Homo Sapiens
SKLLDKMTM

SEQ ID NO: 1176832 - protein, 9 aa, Homo Sapiens
HRSMDPMDG

SEQ ID NO: 1176833 - protein, 9 aa, Homo Sapiens
HMLPSQPLD

SEQ ID NO: 1176834 - protein, 9 aa, Homo Sapiens
TSRQSHIQM

SEQ ID NO: 1176835 - protein, 9 aa, Homo Sapiens
ECLVWRTPG

SEQ ID NO: 1176836 - protein, 9 aa, Homo Sapiens
VQDGLSVVR

SEQ ID NO: 1176837 - protein, 9 aa, Homo Sapiens
LCGALRSGS

SEQ ID NO: 1176838 - protein, 9 aa, Homo Sapiens
EPKCPHIAQ

SEQ ID NO: 1176839 - protein, 9 aa, Homo Sapiens
QGVLQNARF

SEQ ID NO: 1176840 - protein, 9 aa, Homo Sapiens
FQNDGLKAS

SEQ ID NO: 1176841 - protein, 9 aa, Homo Sapiens
YSDFASNCC

SEQ ID NO: 1176842 - protein, 9 aa, Homo Sapiens
LQWSPSILA

SEQ ID NO: 1176843 - protein, 9 aa, Homo Sapiens
EAVAVDFRN

SEQ ID NO: 1176844 - protein, 9 aa, Homo Sapiens
ASRSTAPSP

SEQ ID NO: 1176845 - protein, 9 aa, Homo Sapiens
AELYWASGK

SEQ ID NO: 1176846 - protein, 9 aa, Homo Sapiens
TQQDPEMPK

SEQ ID NO: 1176847 - protein, 9 aa, Homo Sapiens
DEESINWTK

SEQ ID NO: 1176848 - protein, 9 aa, Homo Sapiens
EGVSPTSGH

SEQ ID NO: 1176849 - protein, 9 aa, Homo Sapiens
CDFIDNLDS

SEQ ID NO: 1176850 - protein, 9 aa, Homo Sapiens
FLTIYNVTV

SEQ ID NO: 1176851 - protein, 9 aa, Homo Sapiens
TEELFLLVS

SEQ ID NO: 1176852 - protein, 9 aa, Homo Sapiens
RPMESRPGP

SEQ ID NO: 1176853 - protein, 9 aa, Homo Sapiens
LTPRLSVPN

SEQ ID NO: 1176854 - protein, 9 aa, Homo Sapiens
EIQSEMPGD

SEQ ID NO: 1176855 - protein, 9 aa, Homo Sapiens
TYVEEIVNI

SEQ ID NO: 1176856 - protein, 9 aa, Homo Sapiens
ETSRTSRGQ

SEQ ID NO: 1176857 - protein, 9 aa, Homo Sapiens
RPPWIEACC

SEQ ID NO: 1176858 - protein, 9 aa, Homo Sapiens
SIDMDDFAG

SEQ ID NO: 1176859 - protein, 9 aa, Homo Sapiens
AIKQQMEKD

SEQ ID NO: 1176860 - protein, 9 aa, Homo Sapiens
PKQVDTWQT

SEQ ID NO: 1176861 - protein, 9 aa, Homo Sapiens
WLRRWRFKT

SEQ ID NO: 1176862 - protein, 9 aa, Homo Sapiens
RSGLKKTPK

SEQ ID NO: 1176863 - protein, 9 aa, Homo Sapiens
AHLAQLLEG

SEQ ID NO: 1176864 - protein, 9 aa, Homo Sapiens
LWTSDLWER

SEQ ID NO: 1176865 - protein, 9 aa, Homo Sapiens
AWGGSCPAF

SEQ ID NO: 1176866 - protein, 9 aa, Homo Sapiens
NMKSACEKC

SEQ ID NO: 1176867 - protein, 9 aa, Homo Sapiens
VFFSIINGQ

SEQ ID NO: 1176868 - protein, 9 aa, Homo Sapiens
GDPATTAAP

SEQ ID NO: 1176869 - protein, 9 aa, Homo Sapiens
RKEDEFVKG

SEQ ID NO: 1176870 - protein, 9 aa, Homo Sapiens
VQNPQYNPG

SEQ ID NO: 1176871 - protein, 9 aa, Homo Sapiens
IVEGTIEVE

SEQ ID NO: 1176872 - protein, 9 aa, Homo Sapiens
PSEAEQRFW

SEQ ID NO: 1176873 - protein, 9 aa, Homo Sapiens
LAAHYSRAD

SEQ ID NO: 1176874 - protein, 9 aa, Homo Sapiens
ESRHHHSEH

SEQ ID NO: 1176875 - protein, 9 aa, Homo Sapiens
TKPGAEKAK

SEQ ID NO: 1176876 - protein, 9 aa, Homo Sapiens
FCCYYWINS

SEQ ID NO: 1176877 - protein, 9 aa, Homo Sapiens
MNKQRGTSE

SEQ ID NO: 1176878 - protein, 9 aa, Homo Sapiens
ASQSQNANA

SEQ ID NO: 1176879 - protein, 9 aa, Homo Sapiens
WIGLNNRIV

SEQ ID NO: 1176880 - protein, 9 aa, Homo Sapiens
PLLLQAPDA

SEQ ID NO: 1176881 - protein, 9 aa, Homo Sapiens
HIAHGRCHL

SEQ ID NO: 1176882 - protein, 9 aa, Homo Sapiens
DGATTYEEN

SEQ ID NO: 1176883 - protein, 9 aa, Homo Sapiens
VFVASMLLG

SEQ ID NO: 1176884 - protein, 9 aa, Homo Sapiens
AIFDFRVAP

SEQ ID NO: 1176885 - protein, 9 aa, Homo Sapiens
FHYIPVGII

SEQ ID NO: 1176886 - protein, 9 aa, Homo Sapiens
PATTWRPPT

SEQ ID NO: 1176887 - protein, 9 aa, Homo Sapiens
QVVVVGAPW

SEQ ID NO: 1176888 - protein, 9 aa, Homo Sapiens
AKAQSENED

SEQ ID NO: 1176889 - protein, 9 aa, Homo Sapiens
NCTSTGIGY

SEQ ID NO: 1176890 - protein, 9 aa, Homo Sapiens
GQPSPPFGG

SEQ ID NO: 1176891 - protein, 9 aa, Homo Sapiens
GVGLGDESI

SEQ ID NO: 1176892 - protein, 9 aa, Homo Sapiens
QDDGWGVFV

SEQ ID NO: 1176893 - protein, 9 aa, Homo Sapiens
WLSKKENTI

SEQ ID NO: 1176894 - protein, 9 aa, Homo Sapiens
RRGSRACRG

SEQ ID NO: 1176895 - protein, 9 aa, Homo Sapiens
LAPWALLGR

SEQ ID NO: 1176896 - protein, 9 aa, Homo Sapiens
RTGRQHPPP

SEQ ID NO: 1176897 - protein, 9 aa, Homo Sapiens
LLDKYVACG

SEQ ID NO: 1176898 - protein, 9 aa, Homo Sapiens
RGNLGPLET

SEQ ID NO: 1176899 - protein, 9 aa, Homo Sapiens
SSYVCFAKG

SEQ ID NO: 1176900 - protein, 9 aa, Homo Sapiens
AEIDQLKNC

SEQ ID NO: 1176901 - protein, 9 aa, Homo Sapiens
ESPPCSRGL

SEQ ID NO: 1176902 - protein, 9 aa, Homo Sapiens
ASPGPKPSL

SEQ ID NO: 1176903 - protein, 9 aa, Homo Sapiens
KFFCHSTHL

SEQ ID NO: 1176904 - protein, 9 aa, Homo Sapiens
FLDPLADAV

SEQ ID NO: 1176905 - protein, 9 aa, Homo Sapiens
CQEYENELG

SEQ ID NO: 1176906 - protein, 9 aa, Homo Sapiens
ETMTKQLGA

SEQ ID NO: 1176907 - protein, 9 aa, Homo Sapiens
LPIQRVPRD

SEQ ID NO: 1176908 - protein, 9 aa, Homo Sapiens
RRTAAPGQP

SEQ ID NO: 1176909 - protein, 9 aa, Homo Sapiens
LLLQAPDAP

SEQ ID NO: 1176910 - protein, 9 aa, Homo Sapiens
KKNALTQYQ

SEQ ID NO: 1176911 - protein, 9 aa, Homo Sapiens
IIEQLVESA

SEQ ID NO: 1176912 - protein, 9 aa, Homo Sapiens
TQGPAAPSE

SEQ ID NO: 1176913 - protein, 9 aa, Homo Sapiens
MAAWPEWRI

SEQ ID NO: 1176914 - protein, 9 aa, Homo Sapiens
LYPEVTPHR

SEQ ID NO: 1176915 - protein, 9 aa, Homo Sapiens
VSTPAHTPH

SEQ ID NO: 1176916 - protein, 9 aa, Homo Sapiens
TLLSGDYHP

SEQ ID NO: 1176917 - protein, 9 aa, Homo Sapiens
GNRNHNYLP

SEQ ID NO: 1176918 - protein, 9 aa, Homo Sapiens
RGSPTLGTR

SEQ ID NO: 1176919 - protein, 9 aa, Homo Sapiens
GSDPEAGDS

SEQ ID NO: 1176920 - protein, 9 aa, Homo Sapiens
LALLLSLGP

SEQ ID NO: 1176921 - protein, 9 aa, Homo Sapiens
CAYVRRNSV

SEQ ID NO: 1176922 - protein, 9 aa, Homo Sapiens
AILFFVMSC

SEQ ID NO: 1176923 - protein, 9 aa, Homo Sapiens
CQCVEEIER

SEQ ID NO: 1176924 - protein, 9 aa, Homo Sapiens
AEGTPIDWG

SEQ ID NO: 1176925 - protein, 9 aa, Homo Sapiens
SCRQTPPGS

SEQ ID NO: 1176926 - protein, 9 aa, Homo Sapiens
SCSATRQPP

SEQ ID NO: 1176927 - protein, 9 aa, Homo Sapiens
TQEAQYRCA

SEQ ID NO: 1176928 - protein, 9 aa, Homo Sapiens
LLLGVPQTA

SEQ ID NO: 1176929 - protein, 9 aa, Homo Sapiens
EMEKTPTFS

SEQ ID NO: 1176930 - protein, 9 aa, Homo Sapiens
ASPSSEPDP

SEQ ID NO: 1176931 - protein, 9 aa, Homo Sapiens
SPLMKPPRL

SEQ ID NO: 1176932 - protein, 9 aa, Homo Sapiens
RAAPPSLRA

SEQ ID NO: 1176933 - protein, 9 aa, Homo Sapiens
ATATWRMRS

SEQ ID NO: 1176934 - protein, 9 aa, Homo Sapiens
CWSPAPTPP

SEQ ID NO: 1176935 - protein, 9 aa, Homo Sapiens
GSTLFSINI

SEQ ID NO: 1176936 - protein, 9 aa, Homo Sapiens
QACICPSYL

SEQ ID NO: 1176937 - protein, 9 aa, Homo Sapiens
EQECREQQQ

SEQ ID NO: 1176938 - protein, 9 aa, Homo Sapiens
AADTFFITD

SEQ ID NO: 1176939 - protein, 9 aa, Homo Sapiens
LLRQIEFLK

SEQ ID NO: 1176940 - protein, 9 aa, Homo Sapiens
CFMTSGIQA

SEQ ID NO: 1176941 - protein, 9 aa, Homo Sapiens
GEALLARVR

SEQ ID NO: 1176942 - protein, 9 aa, Homo Sapiens
RGGRCLQVN

SEQ ID NO: 1176943 - protein, 9 aa, Homo Sapiens
KQQRRSRGR

SEQ ID NO: 1176944 - protein, 9 aa, Homo Sapiens
GLPQWRKRP

SEQ ID NO: 1176945 - protein, 9 aa, Homo Sapiens
PSSACLPSL

SEQ ID NO: 1176946 - protein, 9 aa, Homo Sapiens
ELGARWDAG

SEQ ID NO: 1176947 - protein, 9 aa, Homo Sapiens
QQKKLQEMV

SEQ ID NO: 1176948 - protein, 9 aa, Homo Sapiens
GKVWCLNEA

SEQ ID NO: 1176949 - protein, 9 aa, Homo Sapiens
HIKNYHPQC

SEQ ID NO: 1176950 - protein, 9 aa, Homo Sapiens
EAPYSHSKL

SEQ ID NO: 1176951 - protein, 9 aa, Homo Sapiens
EAQKAAHKG

SEQ ID NO: 1176952 - protein, 9 aa, Homo Sapiens
LCVGRTPPP

SEQ ID NO: 1176953 - protein, 9 aa, Homo Sapiens
CSATRQPPP

SEQ ID NO: 1176954 - protein, 9 aa, Homo Sapiens
LPPNTCTRP

SEQ ID NO: 1176955 - protein, 9 aa, Homo Sapiens
MGSSRTLGL

SEQ ID NO: 1176956 - protein, 9 aa, Homo Sapiens
ASLQLHAAV

SEQ ID NO: 1176957 - protein, 9 aa, Homo Sapiens
TISQVMPLL

SEQ ID NO: 1176958 - protein, 9 aa, Homo Sapiens
RRRRMRGFW

SEQ ID NO: 1176959 - protein, 9 aa, Homo Sapiens
AGPPWPQAA

SEQ ID NO: 1176960 - protein, 9 aa, Homo Sapiens
MGAWGDYDD

SEQ ID NO: 1176961 - protein, 9 aa, Homo Sapiens
PIKEGYFGA

SEQ ID NO: 1176962 - protein, 9 aa, Homo Sapiens
RRNSNRYPA

SEQ ID NO: 1176963 - protein, 9 aa, Homo Sapiens
NPERNHWQY

SEQ ID NO: 1176964 - protein, 9 aa, Homo Sapiens
VCPQGFGGR

SEQ ID NO: 1176965 - protein, 9 aa, Homo Sapiens
HNQVGRAGD

SEQ ID NO: 1176966 - protein, 9 aa, Homo Sapiens
KDIQLARHI

SEQ ID NO: 1176967 - protein, 9 aa, Homo Sapiens
RPSKTPPTN

SEQ ID NO: 1176968 - protein, 9 aa, Homo Sapiens
RASRAGTTT

SEQ ID NO: 1176969 - protein, 9 aa, Homo Sapiens
INPVVQAQA

SEQ ID NO: 1176970 - protein, 9 aa, Homo Sapiens
SIVKKQIVK

SEQ ID NO: 1176971 - protein, 9 aa, Homo Sapiens
WLQRLGWWL

SEQ ID NO: 1176972 - protein, 9 aa, Homo Sapiens
EKPTAALGW

SEQ ID NO: 1176973 - protein, 9 aa, Homo Sapiens
GFSLFYYKL

SEQ ID NO: 1176974 - protein, 9 aa, Homo Sapiens
LVVADLVAH

SEQ ID NO: 1176975 - protein, 9 aa, Homo Sapiens
TYYLPDVGQ

SEQ ID NO: 1176976 - protein, 9 aa, Homo Sapiens
STPRPAPSL

SEQ ID NO: 1176977 - protein, 9 aa, Homo Sapiens
KIIVACIEP

SEQ ID NO: 1176978 - protein, 9 aa, Homo Sapiens
IRAGTTPSC

SEQ ID NO: 1176979 - protein, 9 aa, Homo Sapiens
YTVLSMGPG

SEQ ID NO: 1176980 - protein, 9 aa, Homo Sapiens
NDILKKMPL

SEQ ID NO: 1176981 - protein, 9 aa, Homo Sapiens
GKGSTTSNW

SEQ ID NO: 1176982 - protein, 9 aa, Homo Sapiens
PGAPRRAPH

SEQ ID NO: 1176983 - protein, 9 aa, Homo Sapiens
RGGGPWDWF

SEQ ID NO: 1176984 - protein, 9 aa, Homo Sapiens
VQLRQRIIL

SEQ ID NO: 1176985 - protein, 9 aa, Homo Sapiens
KNGNFLETL

SEQ ID NO: 1176986 - protein, 9 aa, Homo Sapiens
ADPEQPQAG

SEQ ID NO: 1176987 - protein, 9 aa, Homo Sapiens
DPFKTIRAT

SEQ ID NO: 1176988 - protein, 9 aa, Homo Sapiens
TNTQCKNGK

SEQ ID NO: 1176989 - protein, 9 aa, Homo Sapiens
GKPKADMTG

SEQ ID NO: 1176990 - protein, 9 aa, Homo Sapiens
TETILKTCS

SEQ ID NO: 1176991 - protein, 9 aa, Homo Sapiens
SPNSLLICD

SEQ ID NO: 1176992 - protein, 9 aa, Homo Sapiens
WSPWKPSRP

SEQ ID NO: 1176993 - protein, 9 aa, Homo Sapiens
RPSCHRCTA

SEQ ID NO: 1176994 - protein, 9 aa, Homo Sapiens
TLYHIELLR

SEQ ID NO: 1176995 - protein, 9 aa, Homo Sapiens
PSSFLLRQI

SEQ ID NO: 1176996 - protein, 9 aa, Homo Sapiens
SLELEHARS

SEQ ID NO: 1176997 - protein, 9 aa, Homo Sapiens
LITNLSGCT

SEQ ID NO: 1176998 - protein, 9 aa, Homo Sapiens
TTENTPETV

SEQ ID NO: 1176999 - protein, 9 aa, Homo Sapiens
ASQCLTSTT

SEQ ID NO: 1177000 - protein, 9 aa, Homo Sapiens
ACNLCTCPS

SEQ ID NO: 1177001 - protein, 9 aa, Homo Sapiens
LTPSGSASL

SEQ ID NO: 1177002 - protein, 9 aa, Homo Sapiens
PYKCAECCK

SEQ ID NO: 1177003 - protein, 9 aa, Homo Sapiens
KAEAESPAD

SEQ ID NO: 1177004 - protein, 9 aa, Homo Sapiens
RSSRQTGAK

SEQ ID NO: 1177005 - protein, 9 aa, Homo Sapiens
GSPMTSAWR

SEQ ID NO: 1177006 - protein, 9 aa, Homo Sapiens
PPPGPSWTW

SEQ ID NO: 1177007 - protein, 9 aa, Homo Sapiens
LCYLNVIPS

SEQ ID NO: 1177008 - protein, 9 aa, Homo Sapiens
ALLITASYD

SEQ ID NO: 1177009 - protein, 9 aa, Homo Sapiens
CRPSWKGKG

SEQ ID NO: 1177010 - protein, 9 aa, Homo Sapiens
ACTCPVGMA

SEQ ID NO: 1177011 - protein, 9 aa, Homo Sapiens
YYVAYSSMI

SEQ ID NO: 1177012 - protein, 9 aa, Homo Sapiens
QNHTPTVRL

SEQ ID NO: 1177013 - protein, 9 aa, Homo Sapiens
GSYSYMQVG

SEQ ID NO: 1177014 - protein, 9 aa, Homo Sapiens
SERYVCAMT

SEQ ID NO: 1177015 - protein, 9 aa, Homo Sapiens
TREEPCGLA

SEQ ID NO: 1177016 - protein, 9 aa, Homo Sapiens
PRPAARLSM

SEQ ID NO: 1177017 - protein, 9 aa, Homo Sapiens
AYPPNGVEY

SEQ ID NO: 1177018 - protein, 9 aa, Homo Sapiens
GGRAEGALR

SEQ ID NO: 1177019 - protein, 9 aa, Homo Sapiens
NKVQLLHEQ

SEQ ID NO: 1177020 - protein, 9 aa, Homo Sapiens
SAGDLQCQA

SEQ ID NO: 1177021 - protein, 9 aa, Homo Sapiens
RVSLCQNRP

SEQ ID NO: 1177022 - protein, 9 aa, Homo Sapiens
QNEEYNKSV

SEQ ID NO: 1177023 - protein, 9 aa, Homo Sapiens
GAPDALWTE

SEQ ID NO: 1177024 - protein, 9 aa, Homo Sapiens
VSEDQTALL

SEQ ID NO: 1177025 - protein, 9 aa, Homo Sapiens
QVKRGPGNQ

SEQ ID NO: 1177026 - protein, 9 aa, Homo Sapiens
PPPWLSPLQ

SEQ ID NO: 1177027 - protein, 9 aa, Homo Sapiens
AKHSSSQCT

SEQ ID NO: 1177028 - protein, 9 aa, Homo Sapiens
LGFGGNFAQ

SEQ ID NO: 1177029 - protein, 9 aa, Homo Sapiens
VTEVDIPSI

SEQ ID NO: 1177030 - protein, 9 aa, Homo Sapiens
KVWAIPDTE

SEQ ID NO: 1177031 - protein, 9 aa, Homo Sapiens
SWTWGRAPR

SEQ ID NO: 1177032 - protein, 9 aa, Homo Sapiens
KNYLRLTIV

SEQ ID NO: 1177033 - protein, 9 aa, Homo Sapiens
VIASMSNPY

SEQ ID NO: 1177034 - protein, 9 aa, Homo Sapiens
STSEENIEI

SEQ ID NO: 1177035 - protein, 9 aa, Homo Sapiens
LLQNITGFM

SEQ ID NO: 1177036 - protein, 9 aa, Homo Sapiens
RPGAAGHPC

SEQ ID NO: 1177037 - protein, 9 aa, Homo Sapiens
GLVVADLVA

SEQ ID NO: 1177038 - protein, 9 aa, Homo Sapiens
PGRLIRGGG

SEQ ID NO: 1177039 - protein, 9 aa, Homo Sapiens
ATIVLKNHH

SEQ ID NO: 1177040 - protein, 9 aa, Homo Sapiens
RSHGNGEGR

SEQ ID NO: 1177041 - protein, 9 aa, Homo Sapiens
PALTATTTV

SEQ ID NO: 1177042 - protein, 9 aa, Homo Sapiens
ASSTRAPAL

SEQ ID NO: 1177043 - protein, 9 aa, Homo Sapiens
RGNAGVKQS

SEQ ID NO: 1177044 - protein, 9 aa, Homo Sapiens
TAAIPGYQL

SEQ ID NO: 1177045 - protein, 9 aa, Homo Sapiens
QNRTDSNGI

SEQ ID NO: 1177046 - protein, 9 aa, Homo Sapiens
GRILRALWG

SEQ ID NO: 1177047 - protein, 9 aa, Homo Sapiens
EDPTLPPLK

SEQ ID NO: 1177048 - protein, 9 aa, Homo Sapiens
LASSWYASL

SEQ ID NO: 1177049 - protein, 9 aa, Homo Sapiens
SVEEAPAND

SEQ ID NO: 1177050 - protein, 9 aa, Homo Sapiens
HALRLLHDL

SEQ ID NO: 1177051 - protein, 9 aa, Homo Sapiens
NEDFIVWMC

SEQ ID NO: 1177052 - protein, 9 aa, Homo Sapiens
AVASLSVSI

SEQ ID NO: 1177053 - protein, 9 aa, Homo Sapiens
IMPNFPPHG

SEQ ID NO: 1177054 - protein, 9 aa, Homo Sapiens
YAQKEELLE

SEQ ID NO: 1177055 - protein, 9 aa, Homo Sapiens
KMMERMVEQ

SEQ ID NO: 1177056 - protein, 9 aa, Homo Sapiens
RSRTSTSAP

SEQ ID NO: 1177057 - protein, 9 aa, Homo Sapiens
YYSHWCKLC

SEQ ID NO: 1177058 - protein, 9 aa, Homo Sapiens
HHHQQRLSG

SEQ ID NO: 1177059 - protein, 9 aa, Homo Sapiens
DPPRSCRQT

SEQ ID NO: 1177060 - protein, 9 aa, Homo Sapiens
RGVGSKDAG

SEQ ID NO: 1177061 - protein, 9 aa, Homo Sapiens
TPWKHSDYA

SEQ ID NO: 1177062 - protein, 9 aa, Homo Sapiens
GGLSDHIAA

SEQ ID NO: 1177063 - protein, 9 aa, Homo Sapiens
DLPEGEKNQ

SEQ ID NO: 1177064 - protein, 9 aa, Homo Sapiens
IKQSNTAIV

SEQ ID NO: 1177065 - protein, 9 aa, Homo Sapiens
RIFSLNLTF

SEQ ID NO: 1177066 - protein, 9 aa, Homo Sapiens
ENDGYMDMS

SEQ ID NO: 1177067 - protein, 9 aa, Homo Sapiens
QLHWLQRLG

SEQ ID NO: 1177068 - protein, 9 aa, Homo Sapiens
NPELVIPEV

SEQ ID NO: 1177069 - protein, 9 aa, Homo Sapiens
FGELLLFLP

SEQ ID NO: 1177070 - protein, 9 aa, Homo Sapiens
PPGSSPPRC

SEQ ID NO: 1177071 - protein, 9 aa, Homo Sapiens
PPNGVEYYS

SEQ ID NO: 1177072 - protein, 9 aa, Homo Sapiens
YRGGEIRVQ

SEQ ID NO: 1177073 - protein, 9 aa, Homo Sapiens
PEVVFLGDS

SEQ ID NO: 1177074 - protein, 9 aa, Homo Sapiens
STGIGYNII

SEQ ID NO: 1177075 - protein, 9 aa, Homo Sapiens
PALTRRWPL

SEQ ID NO: 1177076 - protein, 9 aa, Homo Sapiens
QRVSPEPPR

SEQ ID NO: 1177077 - protein, 9 aa, Homo Sapiens
SQYTKPYLK

SEQ ID NO: 1177078 - protein, 9 aa, Homo Sapiens
RPPRASSAG

SEQ ID NO: 1177079 - protein, 9 aa, Homo Sapiens
YHEEIIINL

SEQ ID NO: 1177080 - protein, 9 aa, Homo Sapiens
EKKNWSGGR

SEQ ID NO: 1177081 - protein, 9 aa, Homo Sapiens
RATVRVGRM

SEQ ID NO: 1177082 - protein, 9 aa, Homo Sapiens
FFHDRSTAT

SEQ ID NO: 1177083 - protein, 9 aa, Homo Sapiens
RRSYQQQHK

SEQ ID NO: 1177084 - protein, 9 aa, Homo Sapiens
QRRSYQQQH

SEQ ID NO: 1177085 - protein, 9 aa, Homo Sapiens
KILVLHLFC

SEQ ID NO: 1177086 - protein, 9 aa, Homo Sapiens
WLGAVGLRV

SEQ ID NO: 1177087 - protein, 9 aa, Homo Sapiens
PLTLQESPT

SEQ ID NO: 1177088 - protein, 9 aa, Homo Sapiens
GLPHLEFYR

SEQ ID NO: 1177089 - protein, 9 aa, Homo Sapiens
ACPSSPPQG

SEQ ID NO: 1177090 - protein, 9 aa, Homo Sapiens
PGAEKAKPS

SEQ ID NO: 1177091 - protein, 9 aa, Homo Sapiens
RSSQRRFWE

SEQ ID NO: 1177092 - protein, 9 aa, Homo Sapiens
AASSAASAC

SEQ ID NO: 1177093 - protein, 9 aa, Homo Sapiens
AASCTETAL

SEQ ID NO: 1177094 - protein, 9 aa, Homo Sapiens
EWHGWMVSS

SEQ ID NO: 1177095 - protein, 9 aa, Homo Sapiens
KTCSLDYAG

SEQ ID NO: 1177096 - protein, 9 aa, Homo Sapiens
DEYIECLVW

SEQ ID NO: 1177097 - protein, 9 aa, Homo Sapiens
LCVRLGDVI

SEQ ID NO: 1177098 - protein, 9 aa, Homo Sapiens
FWHIWHNIC

SEQ ID NO: 1177099 - protein, 9 aa, Homo Sapiens
PECTQLLPA

SEQ ID NO: 1177100 - protein, 9 aa, Homo Sapiens
THRRETLCL

SEQ ID NO: 1177101 - protein, 9 aa, Homo Sapiens
AKLVQSILS

SEQ ID NO: 1177102 - protein, 9 aa, Homo Sapiens
FWRPPTREL

SEQ ID NO: 1177103 - protein, 9 aa, Homo Sapiens
RSVAAGAMA

SEQ ID NO: 1177104 - protein, 9 aa, Homo Sapiens
WGSTLFSIN

SEQ ID NO: 1177105 - protein, 9 aa, Homo Sapiens
TRSRTGAAG

SEQ ID NO: 1177106 - protein, 9 aa, Homo Sapiens
SWDSFWGAR

SEQ ID NO: 1177107 - protein, 9 aa, Homo Sapiens
YSLFNSSAH

SEQ ID NO: 1177108 - protein, 9 aa, Homo Sapiens
ARWLVLSPV

SEQ ID NO: 1177109 - protein, 9 aa, Homo Sapiens
RAPPSRPSG

SEQ ID NO: 1177110 - protein, 9 aa, Homo Sapiens
SRACRGCQG

SEQ ID NO: 1177111 - protein, 9 aa, Homo Sapiens
HFFCHYKLF

SEQ ID NO: 1177112 - protein, 9 aa, Homo Sapiens
RGEDTSMNF

SEQ ID NO: 1177113 - protein, 9 aa, Homo Sapiens
LRPPAQIPT

SEQ ID NO: 1177114 - protein, 9 aa, Homo Sapiens
PWWATRWSA

SEQ ID NO: 1177115 - protein, 9 aa, Homo Sapiens
KSVVSDVPE

SEQ ID NO: 1177116 - protein, 9 aa, Homo Sapiens
EDADSSYVC

SEQ ID NO: 1177117 - protein, 9 aa, Homo Sapiens
SPPSRVEAS

SEQ ID NO: 1177118 - protein, 9 aa, Homo Sapiens
WGPTAGAAR

SEQ ID NO: 1177119 - protein, 9 aa, Homo Sapiens
KASLPPSPA

SEQ ID NO: 1177120 - protein, 9 aa, Homo Sapiens
PTPPAPRLL

SEQ ID NO: 1177121 - protein, 9 aa, Homo Sapiens
RFLCPTIMS

SEQ ID NO: 1177122 - protein, 9 aa, Homo Sapiens
PTTPSPASG

SEQ ID NO: 1177123 - protein, 9 aa, Homo Sapiens
FTAFIPGHH

SEQ ID NO: 1177124 - protein, 9 aa, Homo Sapiens
MLLRLAQQD

SEQ ID NO: 1177125 - protein, 9 aa, Homo Sapiens
PITVTGARV

SEQ ID NO: 1177126 - protein, 9 aa, Homo Sapiens
QFLAPPGAH

SEQ ID NO: 1177127 - protein, 9 aa, Homo Sapiens
QRSHVGKTS

SEQ ID NO: 1177128 - protein, 9 aa, Homo Sapiens
KHRARTVTC

SEQ ID NO: 1177129 - protein, 9 aa, Homo Sapiens
AGTQMLEPG

SEQ ID NO: 1177130 - protein, 9 aa, Homo Sapiens
SALGGRPPC

SEQ ID NO: 1177131 - protein, 9 aa, Homo Sapiens
IRRTTQAAA

SEQ ID NO: 1177132 - protein, 9 aa, Homo Sapiens
RTVTCKSTA

SEQ ID NO: 1177133 - protein, 9 aa, Homo Sapiens
ALRSGANRT

SEQ ID NO: 1177134 - protein, 9 aa, Homo Sapiens
IPGIPFSSL

SEQ ID NO: 1177135 - protein, 9 aa, Homo Sapiens
WGPNCSLSC

SEQ ID NO: 1177136 - protein, 9 aa, Homo Sapiens
QRESHHQPQ

SEQ ID NO: 1177137 - protein, 9 aa, Homo Sapiens
NMVGEWVLP

SEQ ID NO: 1177138 - protein, 9 aa, Homo Sapiens
GQVLRTSAN

SEQ ID NO: 1177139 - protein, 9 aa, Homo Sapiens
LSCYCKNGA

SEQ ID NO: 1177140 - protein, 9 aa, Homo Sapiens
LPQAVYYFH

SEQ ID NO: 1177141 - protein, 9 aa, Homo Sapiens
DMQVGLLYE

SEQ ID NO: 1177142 - protein, 9 aa, Homo Sapiens
PQTPCWGWH

SEQ ID NO: 1177143 - protein, 9 aa, Homo Sapiens
RNIPLLLLQ

SEQ ID NO: 1177144 - protein, 9 aa, Homo Sapiens
IVRRNRGGR

SEQ ID NO: 1177145 - protein, 9 aa, Homo Sapiens
PSRRRAPPR

SEQ ID NO: 1177146 - protein, 9 aa, Homo Sapiens
NGNFLETLP

SEQ ID NO: 1177147 - protein, 9 aa, Homo Sapiens
YYNKQHVLE

SEQ ID NO: 1177148 - protein, 9 aa, Homo Sapiens
WSASFTVAK

SEQ ID NO: 1177149 - protein, 9 aa, Homo Sapiens
GGGGGSGRR

SEQ ID NO: 1177150 - protein, 9 aa, Homo Sapiens
HLWASKNGH

SEQ ID NO: 1177151 - protein, 9 aa, Homo Sapiens
APTSCSWAA

SEQ ID NO: 1177152 - protein, 9 aa, Homo Sapiens
GRSRAEKPT

SEQ ID NO: 1177153 - protein, 9 aa, Homo Sapiens
RVTFTRALR

SEQ ID NO: 1177154 - protein, 9 aa, Homo Sapiens
RGVDANRSW

SEQ ID NO: 1177155 - protein, 9 aa, Homo Sapiens
FTPEIPAPP

SEQ ID NO: 1177156 - protein, 9 aa, Homo Sapiens
SGHSGEQNL

SEQ ID NO: 1177157 - protein, 9 aa, Homo Sapiens
VEYGANVAM

SEQ ID NO: 1177158 - protein, 9 aa, Homo Sapiens
HRQEAEPPG

SEQ ID NO: 1177159 - protein, 9 aa, Homo Sapiens
NCGPTLEVV

SEQ ID NO: 1177160 - protein, 9 aa, Homo Sapiens
DLSILTETA

SEQ ID NO: 1177161 - protein, 9 aa, Homo Sapiens
TTTKEEMER

SEQ ID NO: 1177162 - protein, 9 aa, Homo Sapiens
QEEIVKLRK

SEQ ID NO: 1177163 - protein, 9 aa, Homo Sapiens
GLVDALLMS

SEQ ID NO: 1177164 - protein, 9 aa, Homo Sapiens
SALPLRCPR

SEQ ID NO: 1177165 - protein, 9 aa, Homo Sapiens
KRNRVRGLL

SEQ ID NO: 1177166 - protein, 9 aa, Homo Sapiens
YSAAPKKKC

SEQ ID NO: 1177167 - protein, 9 aa, Homo Sapiens
AVDPAAWGN

SEQ ID NO: 1177168 - protein, 9 aa, Homo Sapiens
LRAIPPRSC

SEQ ID NO: 1177169 - protein, 9 aa, Homo Sapiens
SASKPTMAS

SEQ ID NO: 1177170 - protein, 9 aa, Homo Sapiens
PPPPGWLPR

SEQ ID NO: 1177171 - protein, 9 aa, Homo Sapiens
SLVGGMWAA

SEQ ID NO: 1177172 - protein, 9 aa, Homo Sapiens
VLDRDSGTN

SEQ ID NO: 1177173 - protein, 9 aa, Homo Sapiens
LSPTPSAPP

SEQ ID NO: 1177174 - protein, 9 aa, Homo Sapiens
RRMLSPVHT

SEQ ID NO: 1177175 - protein, 9 aa, Homo Sapiens
SRSEPEFIE

SEQ ID NO: 1177176 - protein, 9 aa, Homo Sapiens
APSMPACAR

SEQ ID NO: 1177177 - protein, 9 aa, Homo Sapiens
PLPGRGAPA

SEQ ID NO: 1177178 - protein, 9 aa, Homo Sapiens
EISPEKAPS

SEQ ID NO: 1177179 - protein, 9 aa, Homo Sapiens
QPPSTLLGA

SEQ ID NO: 1177180 - protein, 9 aa, Homo Sapiens
SLKKTSRIL

SEQ ID NO: 1177181 - protein, 9 aa, Homo Sapiens
ANCADCQPG

SEQ ID NO: 1177182 - protein, 9 aa, Homo Sapiens
IIEYFHWNW

SEQ ID NO: 1177183 - protein, 9 aa, Homo Sapiens
GTAWTCQTQ

SEQ ID NO: 1177184 - protein, 9 aa, Homo Sapiens
CCCLAVGAR

SEQ ID NO: 1177185 - protein, 9 aa, Homo Sapiens
SATRLYCSL

SEQ ID NO: 1177186 - protein, 9 aa, Homo Sapiens
DNPPMFSQS

SEQ ID NO: 1177187 - protein, 9 aa, Homo Sapiens
HPQWVLTTA

SEQ ID NO: 1177188 - protein, 9 aa, Homo Sapiens
PRAWGLLRP

SEQ ID NO: 1177189 - protein, 9 aa, Homo Sapiens
HWRIGGGTP

SEQ ID NO: 1177190 - protein, 9 aa, Homo Sapiens
PQLGRSRTS

SEQ ID NO: 1177191 - protein, 9 aa, Homo Sapiens
TKNFSCQWP

SEQ ID NO: 1177192 - protein, 9 aa, Homo Sapiens
YGAKQGRQG

SEQ ID NO: 1177193 - protein, 9 aa, Homo Sapiens
RQAAASKLG

SEQ ID NO: 1177194 - protein, 9 aa, Homo Sapiens
HKCKIPLLQ

SEQ ID NO: 1177195 - protein, 9 aa, Homo Sapiens
WNLNNMLVL

SEQ ID NO: 1177196 - protein, 9 aa, Homo Sapiens
ETDPCWALR

SEQ ID NO: 1177197 - protein, 9 aa, Homo Sapiens
PSVFCPHPA

SEQ ID NO: 1177198 - protein, 9 aa, Homo Sapiens
VEIEVEIVE

SEQ ID NO: 1177199 - protein, 9 aa, Homo Sapiens
GLAFSLAAT

SEQ ID NO: 1177200 - protein, 9 aa, Homo Sapiens
ERINRSLPS

SEQ ID NO: 1177201 - protein, 9 aa, Homo Sapiens
LGIAYLVVA

SEQ ID NO: 1177202 - protein, 9 aa, Homo Sapiens
KRQATFDPK

SEQ ID NO: 1177203 - protein, 9 aa, Homo Sapiens
IKKISFRVL

SEQ ID NO: 1177204 - protein, 9 aa, Homo Sapiens
EHVQARLCF

SEQ ID NO: 1177205 - protein, 9 aa, Homo Sapiens
NHMLPSQPL

SEQ ID NO: 1177206 - protein, 9 aa, Homo Sapiens
YLCCHRRRQ

SEQ ID NO: 1177207 - protein, 9 aa, Homo Sapiens
RPVSEDLWE

SEQ ID NO: 1177208 - protein, 9 aa, Homo Sapiens
LGHSRTELT

SEQ ID NO: 1177209 - protein, 9 aa, Homo Sapiens
PTPTTIDPI

SEQ ID NO: 1177210 - protein, 9 aa, Homo Sapiens
KNEPQRPPR

SEQ ID NO: 1177211 - protein, 9 aa, Homo Sapiens
DSSDSKLEL

SEQ ID NO: 1177212 - protein, 9 aa, Homo Sapiens
LWKKGLSLS

SEQ ID NO: 1177213 - protein, 9 aa, Homo Sapiens
SQLQPMMSE

SEQ ID NO: 1177214 - protein, 9 aa, Homo Sapiens
NINPHPSAR

SEQ ID NO: 1177215 - protein, 9 aa, Homo Sapiens
ISVSFPQAP

SEQ ID NO: 1177216 - protein, 9 aa, Homo Sapiens
PYQPGRQPA

SEQ ID NO: 1177217 - protein, 9 aa, Homo Sapiens
QVWPAYLEH

SEQ ID NO: 1177218 - protein, 9 aa, Homo Sapiens
DNTSCLYVG

SEQ ID NO: 1177219 - protein, 9 aa, Homo Sapiens
TIGRLHSHV

SEQ ID NO: 1177220 - protein, 9 aa, Homo Sapiens
SSMSGQGKP

SEQ ID NO: 1177221 - protein, 9 aa, Homo Sapiens
RGPQRAHPL

SEQ ID NO: 1177222 - protein, 9 aa, Homo Sapiens
VADRSNNCI

SEQ ID NO: 1177223 - protein, 9 aa, Homo Sapiens
CPPPSPLPA

SEQ ID NO: 1177224 - protein, 9 aa, Homo Sapiens
EIEVEIVEG

SEQ ID NO: 1177225 - protein, 9 aa, Homo Sapiens
LERFRPPIV

SEQ ID NO: 1177226 - protein, 9 aa, Homo Sapiens
QTKHRARTV

SEQ ID NO: 1177227 - protein, 9 aa, Homo Sapiens
PLYWGVDRS

SEQ ID NO: 1177228 - protein, 9 aa, Homo Sapiens
RLLTSIVIG

SEQ ID NO: 1177229 - protein, 9 aa, Homo Sapiens
FTGLTITDQ

SEQ ID NO: 1177230 - protein, 9 aa, Homo Sapiens
GAAAPAGPH

SEQ ID NO: 1177231 - protein, 9 aa, Homo Sapiens
VPPGGQQQP

SEQ ID NO: 1177232 - protein, 9 aa, Homo Sapiens
PLLQEMQES

SEQ ID NO: 1177233 - protein, 9 aa, Homo Sapiens
IFTQRKITR

SEQ ID NO: 1177234 - protein, 9 aa, Homo Sapiens
ALALLLSLG

SEQ ID NO: 1177235 - protein, 9 aa, Homo Sapiens
PQRAHPLRR

SEQ ID NO: 1177236 - protein, 9 aa, Homo Sapiens
TVRERAKLQ

SEQ ID NO: 1177237 - protein, 9 aa, Homo Sapiens
RPTARSRPR

SEQ ID NO: 1177238 - protein, 9 aa, Homo Sapiens
PQNNAVLVV

SEQ ID NO: 1177239 - protein, 9 aa, Homo Sapiens
ESHCKEGDR

SEQ ID NO: 1177240 - protein, 9 aa, Homo Sapiens
ACLNLRQGF

SEQ ID NO: 1177241 - protein, 9 aa, Homo Sapiens
HIAQHRFGD

SEQ ID NO: 1177242 - protein, 9 aa, Homo Sapiens
AMQCRKKSH

SEQ ID NO: 1177243 - protein, 9 aa, Homo Sapiens
PREHPASSS

SEQ ID NO: 1177244 - protein, 9 aa, Homo Sapiens
DNIHAMTAQ

SEQ ID NO: 1177245 - protein, 9 aa, Homo Sapiens
FFCGPCMLC

SEQ ID NO: 1177246 - protein, 9 aa, Homo Sapiens
CPTMRTLPP

SEQ ID NO: 1177247 - protein, 9 aa, Homo Sapiens
SSSPRSMSP

SEQ ID NO: 1177248 - protein, 9 aa, Homo Sapiens
CARWRTRCW

SEQ ID NO: 1177249 - protein, 9 aa, Homo Sapiens
MWVHSSMTP

SEQ ID NO: 1177250 - protein, 9 aa, Homo Sapiens
EIRNVVEMM

SEQ ID NO: 1177251 - protein, 9 aa, Homo Sapiens
GGEGGPERG

SEQ ID NO: 1177252 - protein, 9 aa, Homo Sapiens
EEQSQVELF

SEQ ID NO: 1177253 - protein, 9 aa, Homo Sapiens
HLEAVAGQD

SEQ ID NO: 1177254 - protein, 9 aa, Homo Sapiens
RRWRMSTWP

SEQ ID NO: 1177255 - protein, 9 aa, Homo Sapiens
GPRLSIRRL

SEQ ID NO: 1177256 - protein, 9 aa, Homo Sapiens
FACVCSFAY

SEQ ID NO: 1177257 - protein, 9 aa, Homo Sapiens
ITWKNDTKE

SEQ ID NO: 1177258 - protein, 9 aa, Homo Sapiens
QCLPRPQGA

SEQ ID NO: 1177259 - protein, 9 aa, Homo Sapiens
FGKECLTIS

SEQ ID NO: 1177260 - protein, 9 aa, Homo Sapiens
PSPVPQYTP

SEQ ID NO: 1177261 - protein, 9 aa, Homo Sapiens
APPTPSPAL

SEQ ID NO: 1177262 - protein, 9 aa, Homo Sapiens
LSLFDFLSV

SEQ ID NO: 1177263 - protein, 9 aa, Homo Sapiens
VIFLKGNCT

SEQ ID NO: 1177264 - protein, 9 aa, Homo Sapiens
QPYIEVICQ

SEQ ID NO: 1177265 - protein, 9 aa, Homo Sapiens
PDPGQPPLS

SEQ ID NO: 1177266 - protein, 9 aa, Homo Sapiens
SYQCSQFAI

SEQ ID NO: 1177267 - protein, 9 aa, Homo Sapiens
GGAVRAGDP

SEQ ID NO: 1177268 - protein, 9 aa, Homo Sapiens
YPAGLGRWD

SEQ ID NO: 1177269 - protein, 9 aa, Homo Sapiens
TRYRWVAGV

SEQ ID NO: 1177270 - protein, 9 aa, Homo Sapiens
LLNTTKNFS

SEQ ID NO: 1177271 - protein, 9 aa, Homo Sapiens
RDCKAQQVF

SEQ ID NO: 1177272 - protein, 9 aa, Homo Sapiens
NGVCFKRIS

SEQ ID NO: 1177273 - protein, 9 aa, Homo Sapiens
KRIPVATGL

SEQ ID NO: 1177274 - protein, 9 aa, Homo Sapiens
LVRICKEDT

SEQ ID NO: 1177275 - protein, 9 aa, Homo Sapiens
YVYSYTCIC

SEQ ID NO: 1177276 - protein, 9 aa, Homo Sapiens
TWGRAPRTE

SEQ ID NO: 1177277 - protein, 9 aa, Homo Sapiens
QQVIHLLNG

SEQ ID NO: 1177278 - protein, 9 aa, Homo Sapiens
GSLGPKASR

SEQ ID NO: 1177279 - protein, 9 aa, Homo Sapiens
GVTVHLRKK

SEQ ID NO: 1177280 - protein, 9 aa, Homo Sapiens
PLIQWEKDG

SEQ ID NO: 1177281 - protein, 9 aa, Homo Sapiens
SGTLLSGDY

SEQ ID NO: 1177282 - protein, 9 aa, Homo Sapiens
PVRAWRTSS

SEQ ID NO: 1177283 - protein, 9 aa, Homo Sapiens
WRPPTRELG

SEQ ID NO: 1177284 - protein, 9 aa, Homo Sapiens
LLAEGTPID

SEQ ID NO: 1177285 - protein, 9 aa, Homo Sapiens
RLKPSAPNS

SEQ ID NO: 1177286 - protein, 9 aa, Homo Sapiens
LRTVAFWTG

SEQ ID NO: 1177287 - protein, 9 aa, Homo Sapiens
REGMCQYGE

SEQ ID NO: 1177288 - protein, 9 aa, Homo Sapiens
AAFPGTFSF

SEQ ID NO: 1177289 - protein, 9 aa, Homo Sapiens
EPQAKPQLG

SEQ ID NO: 1177290 - protein, 9 aa, Homo Sapiens
NLAENISCV

SEQ ID NO: 1177291 - protein, 9 aa, Homo Sapiens
THERPPPEP

SEQ ID NO: 1177292 - protein, 9 aa, Homo Sapiens
PGTGFFRDI

SEQ ID NO: 1177293 - protein, 9 aa, Homo Sapiens
HPAHQPLGS

SEQ ID NO: 1177294 - protein, 9 aa, Homo Sapiens
NVAMQNHAG

SEQ ID NO: 1177295 - protein, 9 aa, Homo Sapiens
GWISGSEAT

SEQ ID NO: 1177296 - protein, 9 aa, Homo Sapiens
SAQLSGPVL

SEQ ID NO: 1177297 - protein, 9 aa, Homo Sapiens
RRKTFSQKS

SEQ ID NO: 1177298 - protein, 9 aa, Homo Sapiens
KITMKGYSK

SEQ ID NO: 1177299 - protein, 9 aa, Homo Sapiens
FDIEQLIHS

SEQ ID NO: 1177300 - protein, 9 aa, Homo Sapiens
MALLTGQRN

SEQ ID NO: 1177301 - protein, 9 aa, Homo Sapiens
HRVPIRVSP

SEQ ID NO: 1177302 - protein, 9 aa, Homo Sapiens
ARSDAPWAS

SEQ ID NO: 1177303 - protein, 9 aa, Homo Sapiens
LWAPLHHST

SEQ ID NO: 1177304 - protein, 9 aa, Homo Sapiens
TAALGWSPC

SEQ ID NO: 1177305 - protein, 9 aa, Homo Sapiens
PTWSRTSRS

SEQ ID NO: 1177306 - protein, 9 aa, Homo Sapiens
LLLPVPQSC

SEQ ID NO: 1177307 - protein, 9 aa, Homo Sapiens
DGLTRNYCR

SEQ ID NO: 1177308 - protein, 9 aa, Homo Sapiens
ACTCISMTT

SEQ ID NO: 1177309 - protein, 9 aa, Homo Sapiens
PHWPMRLHP

SEQ ID NO: 1177310 - protein, 9 aa, Homo Sapiens
PIVRVIDVS

SEQ ID NO: 1177311 - protein, 9 aa, Homo Sapiens
DFDYVGIDS

SEQ ID NO: 1177312 - protein, 9 aa, Homo Sapiens
HVVPPSAAP

SEQ ID NO: 1177313 - protein, 9 aa, Homo Sapiens
DDRSPQAPL

SEQ ID NO: 1177314 - protein, 9 aa, Homo Sapiens
LLLFSHLGD

SEQ ID NO: 1177315 - protein, 9 aa, Homo Sapiens
RYAYRFDSQ

SEQ ID NO: 1177316 - protein, 9 aa, Homo Sapiens
APPDPSEEP

SEQ ID NO: 1177317 - protein, 9 aa, Homo Sapiens
EKREVLQFQ

SEQ ID NO: 1177318 - protein, 9 aa, Homo Sapiens
HGFEGKFKE

SEQ ID NO: 1177319 - protein, 9 aa, Homo Sapiens
SASASSCSL

SEQ ID NO: 1177320 - protein, 9 aa, Homo Sapiens
VEPGQPPRR

SEQ ID NO: 1177321 - protein, 9 aa, Homo Sapiens
GTSLQHSFL

SEQ ID NO: 1177322 - protein, 9 aa, Homo Sapiens
AFESIVKKQ

SEQ ID NO: 1177323 - protein, 9 aa, Homo Sapiens
ATWSSSTRS

SEQ ID NO: 1177324 - protein, 9 aa, Homo Sapiens
PAGGAAAAR

SEQ ID NO: 1177325 - protein, 9 aa, Homo Sapiens
PPTSCSATR

SEQ ID NO: 1177326 - protein, 9 aa, Homo Sapiens
TTLRPPAQI

SEQ ID NO: 1177327 - protein, 9 aa, Homo Sapiens
GTLQQQPGC

SEQ ID NO: 1177328 - protein, 9 aa, Homo Sapiens
GTQMLEPGT

SEQ ID NO: 1177329 - protein, 9 aa, Homo Sapiens
PNCSLSCYC

SEQ ID NO: 1177330 - protein, 9 aa, Homo Sapiens
VVFLGDSLV

SEQ ID NO: 1177331 - protein, 9 aa, Homo Sapiens
HLLNGLLFK

SEQ ID NO: 1177332 - protein, 9 aa, Homo Sapiens
YRLKHSLTT

SEQ ID NO: 1177333 - protein, 9 aa, Homo Sapiens
TCPSFIPTT

SEQ ID NO: 1177334 - protein, 9 aa, Homo Sapiens
YRFDSQGLA

SEQ ID NO: 1177335 - protein, 9 aa, Homo Sapiens
RRHLGRLMT

SEQ ID NO: 1177336 - protein, 9 aa, Homo Sapiens
AARGIRACR

SEQ ID NO: 1177337 - protein, 9 aa, Homo Sapiens
ASQEWQVSS

SEQ ID NO: 1177338 - protein, 9 aa, Homo Sapiens
AENVAKNGK

SEQ ID NO: 1177339 - protein, 9 aa, Homo Sapiens
TCSLDYAGY

SEQ ID NO: 1177340 - protein, 9 aa, Homo Sapiens
LSLEALEGT

SEQ ID NO: 1177341 - protein, 9 aa, Homo Sapiens
ISCVLYPND

SEQ ID NO: 1177342 - protein, 9 aa, Homo Sapiens
SGGHRPRRA

SEQ ID NO: 1177343 - protein, 9 aa, Homo Sapiens
EHTPEVLEE

SEQ ID NO: 1177344 - protein, 9 aa, Homo Sapiens
FVLVNLEVT

SEQ ID NO: 1177345 - protein, 9 aa, Homo Sapiens
SVPKKIITW

SEQ ID NO: 1177346 - protein, 9 aa, Homo Sapiens
GGKEEAQEA

SEQ ID NO: 1177347 - protein, 9 aa, Homo Sapiens
RPAPSLWKT

SEQ ID NO: 1177348 - protein, 9 aa, Homo Sapiens
KVMTPVRSH

SEQ ID NO: 1177349 - protein, 9 aa, Homo Sapiens
GCNLSCLVT

SEQ ID NO: 1177350 - protein, 9 aa, Homo Sapiens
MEAKEVNSR

SEQ ID NO: 1177351 - protein, 9 aa, Homo Sapiens
DKGFLPPLI

SEQ ID NO: 1177352 - protein, 9 aa, Homo Sapiens
ALHLAAHYS

SEQ ID NO: 1177353 - protein, 9 aa, Homo Sapiens
YCRTRIYAS

SEQ ID NO: 1177354 - protein, 9 aa, Homo Sapiens
VTSAWKNSW

SEQ ID NO: 1177355 - protein, 9 aa, Homo Sapiens
PMFSQSVVE

SEQ ID NO: 1177356 - protein, 9 aa, Homo Sapiens
PSYGGSRRY

SEQ ID NO: 1177357 - protein, 9 aa, Homo Sapiens
LYCQPLLWK

SEQ ID NO: 1177358 - protein, 9 aa, Homo Sapiens
NRSQKRVSE

SEQ ID NO: 1177359 - protein, 9 aa, Homo Sapiens
QEAQGILWT

SEQ ID NO: 1177360 - protein, 9 aa, Homo Sapiens
ARPPPTAQA

SEQ ID NO: 1177361 - protein, 9 aa, Homo Sapiens
TGIPFPRSS

SEQ ID NO: 1177362 - protein, 9 aa, Homo Sapiens
FFSFSFGTG

SEQ ID NO: 1177363 - protein, 9 aa, Homo Sapiens
LGLWAYIRK

SEQ ID NO: 1177364 - protein, 9 aa, Homo Sapiens
ASAYAPPRS

SEQ ID NO: 1177365 - protein, 9 aa, Homo Sapiens
HPPGRRRNP

SEQ ID NO: 1177366 - protein, 9 aa, Homo Sapiens
KVGEGGLRR

SEQ ID NO: 1177367 - protein, 9 aa, Homo Sapiens
ERNHWQYRD

SEQ ID NO: 1177368 - protein, 9 aa, Homo Sapiens
PLSIEEIEA

SEQ ID NO: 1177369 - protein, 9 aa, Homo Sapiens
HQAPQVAML

SEQ ID NO: 1177370 - protein, 9 aa, Homo Sapiens
GCSCFLPVF

SEQ ID NO: 1177371 - protein, 9 aa, Homo Sapiens
GERTCTMRS

SEQ ID NO: 1177372 - protein, 9 aa, Homo Sapiens
TQYQEMEKK

SEQ ID NO: 1177373 - protein, 9 aa, Homo Sapiens
RRGRDKSPL

SEQ ID NO: 1177374 - protein, 9 aa, Homo Sapiens
FTGFVEWPW

SEQ ID NO: 1177375 - protein, 9 aa, Homo Sapiens
HGGGEGGPE

SEQ ID NO: 1177376 - protein, 9 aa, Homo Sapiens
TETALVMRA

SEQ ID NO: 1177377 - protein, 9 aa, Homo Sapiens
SATIVLKNH

SEQ ID NO: 1177378 - protein, 9 aa, Homo Sapiens
TCTAQVDAL

SEQ ID NO: 1177379 - protein, 9 aa, Homo Sapiens
SPSRPPPPL

SEQ ID NO: 1177380 - protein, 9 aa, Homo Sapiens
GRRPASGHH

SEQ ID NO: 1177381 - protein, 9 aa, Homo Sapiens
RECRGCVIP

SEQ ID NO: 1177382 - protein, 9 aa, Homo Sapiens
FTCTQSEWH

SEQ ID NO: 1177383 - protein, 9 aa, Homo Sapiens
ALARPRWSR

SEQ ID NO: 1177384 - protein, 9 aa, Homo Sapiens
MVRQAAASK

SEQ ID NO: 1177385 - protein, 9 aa, Homo Sapiens
DSLRESHTI

SEQ ID NO: 1177386 - protein, 9 aa, Homo Sapiens
IKSILIHDR

SEQ ID NO: 1177387 - protein, 9 aa, Homo Sapiens
NFAQQRYED

SEQ ID NO: 1177388 - protein, 9 aa, Homo Sapiens
RAGDKGFLP

SEQ ID NO: 1177389 - protein, 9 aa, Homo Sapiens
LRPSTSSRI

SEQ ID NO: 1177390 - protein, 9 aa, Homo Sapiens
LGWWLLELP

SEQ ID NO: 1177391 - protein, 9 aa, Homo Sapiens
WPRQASRLK

SEQ ID NO: 1177392 - protein, 9 aa, Homo Sapiens
TEVQAPPPV

SEQ ID NO: 1177393 - protein, 9 aa, Homo Sapiens
CSSRNSPRR

SEQ ID NO: 1177394 - protein, 9 aa, Homo Sapiens
LGCKYQVDL

SEQ ID NO: 1177395 - protein, 9 aa, Homo Sapiens
LTIYNVTVL

SEQ ID NO: 1177396 - protein, 9 aa, Homo Sapiens
HLREQTALV

SEQ ID NO: 1177397 - protein, 9 aa, Homo Sapiens
IDKRGSPTL

SEQ ID NO: 1177398 - protein, 9 aa, Homo Sapiens
FSHNSYLQG

SEQ ID NO: 1177399 - protein, 9 aa, Homo Sapiens
HSCCITWMA

SEQ ID NO: 1177400 - protein, 9 aa, Homo Sapiens
QRRGHAQHP

SEQ ID NO: 1177401 - protein, 9 aa, Homo Sapiens
QVSRTSGGP

SEQ ID NO: 1177402 - protein, 9 aa, Homo Sapiens
RCWACCGTR

SEQ ID NO: 1177403 - protein, 9 aa, Homo Sapiens
YQKMALTAF

SEQ ID NO: 1177404 - protein, 9 aa, Homo Sapiens
PPHPVLLSI

SEQ ID NO: 1177405 - protein, 9 aa, Homo Sapiens
EHKYWKNLT

SEQ ID NO: 1177406 - protein, 9 aa, Homo Sapiens
NVWLAERLG

SEQ ID NO: 1177407 - protein, 9 aa, Homo Sapiens
GATTYEENR

SEQ ID NO: 1177408 - protein, 9 aa, Homo Sapiens
HPSAHFQRP

SEQ ID NO: 1177409 - protein, 9 aa, Homo Sapiens
AVLVPLLRD

SEQ ID NO: 1177410 - protein, 9 aa, Homo Sapiens
APPRRTLLG

SEQ ID NO: 1177411 - protein, 9 aa, Homo Sapiens
TRSSGWMPG

SEQ ID NO: 1177412 - protein, 9 aa, Homo Sapiens
ALGHAQRVG

SEQ ID NO: 1177413 - protein, 9 aa, Homo Sapiens
DASCTRILV

SEQ ID NO: 1177414 - protein, 9 aa, Homo Sapiens
MEAKPWLAI

SEQ ID NO: 1177415 - protein, 9 aa, Homo Sapiens
SRPSGRPRP

SEQ ID NO: 1177416 - protein, 9 aa, Homo Sapiens
QHFSFSVAT

SEQ ID NO: 1177417 - protein, 9 aa, Homo Sapiens
DPRACESLV

SEQ ID NO: 1177418 - protein, 9 aa, Homo Sapiens
SSSSTGTRA

SEQ ID NO: 1177419 - protein, 9 aa, Homo Sapiens
KGRPEPVAM

SEQ ID NO: 1177420 - protein, 9 aa, Homo Sapiens
FMGLRSITH

SEQ ID NO: 1177421 - protein, 9 aa, Homo Sapiens
KVKERYGTL

SEQ ID NO: 1177422 - protein, 9 aa, Homo Sapiens
SECGEVRFH

SEQ ID NO: 1177423 - protein, 9 aa, Homo Sapiens
LSLSQWPWC

SEQ ID NO: 1177424 - protein, 9 aa, Homo Sapiens
NNPIGDQDD

SEQ ID NO: 1177425 - protein, 9 aa, Homo Sapiens
TFPNIARAT

SEQ ID NO: 1177426 - protein, 9 aa, Homo Sapiens
CEECWETCH

SEQ ID NO: 1177427 - protein, 9 aa, Homo Sapiens
LRNDLLTIP

SEQ ID NO: 1177428 - protein, 9 aa, Homo Sapiens
CDEECMHCS

SEQ ID NO: 1177429 - protein, 9 aa, Homo Sapiens
SHRMVNTGE

SEQ ID NO: 1177430 - protein, 9 aa, Homo Sapiens
NNAVLVVSG

SEQ ID NO: 1177431 - protein, 9 aa, Homo Sapiens
SVAGRCKAF

SEQ ID NO: 1177432 - protein, 9 aa, Homo Sapiens
IHCYMALCS

SEQ ID NO: 1177433 - protein, 9 aa, Homo Sapiens
LSASSTRAP

SEQ ID NO: 1177434 - protein, 9 aa, Homo Sapiens
DALLMSPNK

SEQ ID NO: 1177435 - protein, 9 aa, Homo Sapiens
CGVPSGSCA

SEQ ID NO: 1177436 - protein, 9 aa, Homo Sapiens
LQVLLPEEE

SEQ ID NO: 1177437 - protein, 9 aa, Homo Sapiens
SAGLSPGAC

SEQ ID NO: 1177438 - protein, 9 aa, Homo Sapiens
LTWRRPGPK

SEQ ID NO: 1177439 - protein, 9 aa, Homo Sapiens
YPEYDGRGG

SEQ ID NO: 1177440 - protein, 9 aa, Homo Sapiens
RAEAETEPH

SEQ ID NO: 1177441 - protein, 9 aa, Homo Sapiens
SSSTRSSPT

SEQ ID NO: 1177442 - protein, 9 aa, Homo Sapiens
WWSPWKPSR

SEQ ID NO: 1177443 - protein, 9 aa, Homo Sapiens
PRPPCHCPT

SEQ ID NO: 1177444 - protein, 9 aa, Homo Sapiens
ECEKTSLLQ

SEQ ID NO: 1177445 - protein, 9 aa, Homo Sapiens
KNWSGGRGI

SEQ ID NO: 1177446 - protein, 9 aa, Homo Sapiens
LLKCDRTCW

SEQ ID NO: 1177447 - protein, 9 aa, Homo Sapiens
AVNKYDPPL

SEQ ID NO: 1177448 - protein, 9 aa, Homo Sapiens
PGGHPAPQR

SEQ ID NO: 1177449 - protein, 9 aa, Homo Sapiens
ANPPPPPTA

SEQ ID NO: 1177450 - protein, 9 aa, Homo Sapiens
QQMEKDPID

SEQ ID NO: 1177451 - protein, 9 aa, Homo Sapiens
GPAPGGRRG

SEQ ID NO: 1177452 - protein, 9 aa, Homo Sapiens
GSASPDPGQ

SEQ ID NO: 1177453 - protein, 9 aa, Homo Sapiens
PMGPSHPGQ

SEQ ID NO: 1177454 - protein, 9 aa, Homo Sapiens
DCCSWPSSP

SEQ ID NO: 1177455 - protein, 9 aa, Homo Sapiens
DNPVRSWDL

SEQ ID NO: 1177456 - protein, 9 aa, Homo Sapiens
LLLLRPTGP

SEQ ID NO: 1177457 - protein, 9 aa, Homo Sapiens
GGRECRGCV

SEQ ID NO: 1177458 - protein, 9 aa, Homo Sapiens
TPVPVACPD

SEQ ID NO: 1177459 - protein, 9 aa, Homo Sapiens
DDSRISQTA

SEQ ID NO: 1177460 - protein, 9 aa, Homo Sapiens
ISTEVQAPP

SEQ ID NO: 1177461 - protein, 9 aa, Homo Sapiens
IRLPTAIVP

SEQ ID NO: 1177462 - protein, 9 aa, Homo Sapiens
SQDDNCTLE

SEQ ID NO: 1177463 - protein, 9 aa, Homo Sapiens
FFSIASGTF

SEQ ID NO: 1177464 - protein, 9 aa, Homo Sapiens
IQSEMPGDA

SEQ ID NO: 1177465 - protein, 9 aa, Homo Sapiens
DAIMSGCRP

SEQ ID NO: 1177466 - protein, 9 aa, Homo Sapiens
IWRWHLARY

SEQ ID NO: 1177467 - protein, 9 aa, Homo Sapiens
MFKKRRRRV

SEQ ID NO: 1177468 - protein, 9 aa, Homo Sapiens
NGSRSLFFC

SEQ ID NO: 1177469 - protein, 9 aa, Homo Sapiens
GPGAWGRCG

SEQ ID NO: 1177470 - protein, 9 aa, Homo Sapiens
RVFGRGGGV

SEQ ID NO: 1177471 - protein, 9 aa, Homo Sapiens
GKISPVKFS

SEQ ID NO: 1177472 - protein, 9 aa, Homo Sapiens
RKPEEGDDE

SEQ ID NO: 1177473 - protein, 9 aa, Homo Sapiens
CCGRAERDG

SEQ ID NO: 1177474 - protein, 9 aa, Homo Sapiens
APPATAWTS

SEQ ID NO: 1177475 - protein, 9 aa, Homo Sapiens
VIALITVLD

SEQ ID NO: 1177476 - protein, 9 aa, Homo Sapiens
CGPQLPVEV

SEQ ID NO: 1177477 - protein, 9 aa, Homo Sapiens
ELVIPEVLQ

SEQ ID NO: 1177478 - protein, 9 aa, Homo Sapiens
GPPSAGVLS

SEQ ID NO: 1177479 - protein, 9 aa, Homo Sapiens
TLARWASQE

SEQ ID NO: 1177480 - protein, 9 aa, Homo Sapiens
CRSLAMARP

SEQ ID NO: 1177481 - protein, 9 aa, Homo Sapiens
LAPQRVGEK

SEQ ID NO: 1177482 - protein, 9 aa, Homo Sapiens
VDLTGGVTT

SEQ ID NO: 1177483 - protein, 9 aa, Homo Sapiens
SVLQNLHTA

SEQ ID NO: 1177484 - protein, 9 aa, Homo Sapiens
HQQQQQQKA

SEQ ID NO: 1177485 - protein, 9 aa, Homo Sapiens
VLGWLPQWA

SEQ ID NO: 1177486 - protein, 9 aa, Homo Sapiens
LSGRKLTVQ

SEQ ID NO: 1177487 - protein, 9 aa, Homo Sapiens
ERESVLRWE

SEQ ID NO: 1177488 - protein, 9 aa, Homo Sapiens
VWPIYPAGL

SEQ ID NO: 1177489 - protein, 9 aa, Homo Sapiens
QDKDGATAV

SEQ ID NO: 1177490 - protein, 9 aa, Homo Sapiens
TFWFFQRHK

SEQ ID NO: 1177491 - protein, 9 aa, Homo Sapiens
VPKPIVAPT

SEQ ID NO: 1177492 - protein, 9 aa, Homo Sapiens
GGKNGQGSL

SEQ ID NO: 1177493 - protein, 9 aa, Homo Sapiens
ASRNSSSVW

SEQ ID NO: 1177494 - protein, 9 aa, Homo Sapiens
ALGSALQGL

SEQ ID NO: 1177495 - protein, 9 aa, Homo Sapiens
EECEFYSSQ

SEQ ID NO: 1177496 - protein, 9 aa, Homo Sapiens
AGKKWDHEA

SEQ ID NO: 1177497 - protein, 9 aa, Homo Sapiens
APSMVARSG

SEQ ID NO: 1177498 - protein, 9 aa, Homo Sapiens
AGPWSGTSA

SEQ ID NO: 1177499 - protein, 9 aa, Homo Sapiens
AAVASLSVS

SEQ ID NO: 1177500 - protein, 9 aa, Homo Sapiens
IAIQKPLCS

SEQ ID NO: 1177501 - protein, 9 aa, Homo Sapiens
AAPGVWSQV

SEQ ID NO: 1177502 - protein, 9 aa, Homo Sapiens
SVPLAITIS

SEQ ID NO: 1177503 - protein, 9 aa, Homo Sapiens
VDHTDNNDR

SEQ ID NO: 1177504 - protein, 9 aa, Homo Sapiens
AMGLCKAQI

SEQ ID NO: 1177505 - protein, 9 aa, Homo Sapiens
HHPGRAGGA

SEQ ID NO: 1177506 - protein, 9 aa, Homo Sapiens
TPPPACTSK

SEQ ID NO: 1177507 - protein, 9 aa, Homo Sapiens
ATCARLSAS

SEQ ID NO: 1177508 - protein, 9 aa, Homo Sapiens
TVLDRDSGT

SEQ ID NO: 1177509 - protein, 9 aa, Homo Sapiens
EPTTPLSHS

SEQ ID NO: 1177510 - protein, 9 aa, Homo Sapiens
PHGTEREME

SEQ ID NO: 1177511 - protein, 9 aa, Homo Sapiens
PVARLTWRR

SEQ ID NO: 1177512 - protein, 9 aa, Homo Sapiens
AQEEQGAPL

SEQ ID NO: 1177513 - protein, 9 aa, Homo Sapiens
PAMGLAREK

SEQ ID NO: 1177514 - protein, 9 aa, Homo Sapiens
TQDPRISPS

SEQ ID NO: 1177515 - protein, 9 aa, Homo Sapiens
GTNLSPVFS

SEQ ID NO: 1177516 - protein, 9 aa, Homo Sapiens
EEGTWGGTP

SEQ ID NO: 1177517 - protein, 9 aa, Homo Sapiens
LKAEQGSFE

SEQ ID NO: 1177518 - protein, 9 aa, Homo Sapiens
ELVVTVRDG

SEQ ID NO: 1177519 - protein, 9 aa, Homo Sapiens
RPRRQRAPR

SEQ ID NO: 1177520 - protein, 9 aa, Homo Sapiens
LLIRTELSL

SEQ ID NO: 1177521 - protein, 9 aa, Homo Sapiens
ESAGITLRS

SEQ ID NO: 1177522 - protein, 9 aa, Homo Sapiens
SWAARVTCV

SEQ ID NO: 1177523 - protein, 9 aa, Homo Sapiens
AAALPGSMP

SEQ ID NO: 1177524 - protein, 9 aa, Homo Sapiens
SGKGVRRLG

SEQ ID NO: 1177525 - protein, 9 aa, Homo Sapiens
IAASPAPTS

SEQ ID NO: 1177526 - protein, 9 aa, Homo Sapiens
KNQPHNKQM

SEQ ID NO: 1177527 - protein, 9 aa, Homo Sapiens
LLGWPAAHV

SEQ ID NO: 1177528 - protein, 9 aa, Homo Sapiens
LIATTRPPA

SEQ ID NO: 1177529 - protein, 9 aa, Homo Sapiens
RSTSPRPPS

SEQ ID NO: 1177530 - protein, 9 aa, Homo Sapiens
CHRCTAWCC

SEQ ID NO: 1177531 - protein, 9 aa, Homo Sapiens
ALRPSTSSR

SEQ ID NO: 1177532 - protein, 9 aa, Homo Sapiens
RQEEQRKRM

SEQ ID NO: 1177533 - protein, 9 aa, Homo Sapiens
PLDLVRVRM

SEQ ID NO: 1177534 - protein, 9 aa, Homo Sapiens
RILNLQVLK

SEQ ID NO: 1177535 - protein, 9 aa, Homo Sapiens
CKLCDWEIQ

SEQ ID NO: 1177536 - protein, 9 aa, Homo Sapiens
LLITASYDT

SEQ ID NO: 1177537 - protein, 9 aa, Homo Sapiens
SKPRASLNP

SEQ ID NO: 1177538 - protein, 9 aa, Homo Sapiens
PLPPAPSPN

SEQ ID NO: 1177539 - protein, 9 aa, Homo Sapiens
PSSSENTAL

SEQ ID NO: 1177540 - protein, 9 aa, Homo Sapiens
EPGQPPRRP

SEQ ID NO: 1177541 - protein, 9 aa, Homo Sapiens
TPIPAPVPV

SEQ ID NO: 1177542 - protein, 9 aa, Homo Sapiens
RQSNRTVRM

SEQ ID NO: 1177543 - protein, 9 aa, Homo Sapiens
VMVRVGSCV

SEQ ID NO: 1177544 - protein, 9 aa, Homo Sapiens
MCEGIDFED

SEQ ID NO: 1177545 - protein, 9 aa, Homo Sapiens
RMALAGWPG

SEQ ID NO: 1177546 - protein, 9 aa, Homo Sapiens
TAVEQWHNL

SEQ ID NO: 1177547 - protein, 9 aa, Homo Sapiens
LSTGPPAEP

SEQ ID NO: 1177548 - protein, 9 aa, Homo Sapiens
VPGTKGRPE

SEQ ID NO: 1177549 - protein, 9 aa, Homo Sapiens
RVRVGYPDS

SEQ ID NO: 1177550 - protein, 9 aa, Homo Sapiens
ECCKSFKGS

SEQ ID NO: 1177551 - protein, 9 aa, Homo Sapiens
RNDLLTIPV

SEQ ID NO: 1177552 - protein, 9 aa, Homo Sapiens
RPGHRSASP

SEQ ID NO: 1177553 - protein, 9 aa, Homo Sapiens
ASIMCPLNP

SEQ ID NO: 1177554 - protein, 9 aa, Homo Sapiens
TELGPLLLL

SEQ ID NO: 1177555 - protein, 9 aa, Homo Sapiens
HARSEAGEA

SEQ ID NO: 1177556 - protein, 9 aa, Homo Sapiens
VHFAASRGH

SEQ ID NO: 1177557 - protein, 9 aa, Homo Sapiens
ILARSPDGS

SEQ ID NO: 1177558 - protein, 9 aa, Homo Sapiens
TSASTASLR

SEQ ID NO: 1177559 - protein, 9 aa, Homo Sapiens
HLRKKVGLL

SEQ ID NO: 1177560 - protein, 9 aa, Homo Sapiens
RVLAIMQDL

SEQ ID NO: 1177561 - protein, 9 aa, Homo Sapiens
KTFSAVNGL

SEQ ID NO: 1177562 - protein, 9 aa, Homo Sapiens
QAKYAGSQV

SEQ ID NO: 1177563 - protein, 9 aa, Homo Sapiens
VVKQKKTAT

SEQ ID NO: 1177564 - protein, 9 aa, Homo Sapiens
PAIRGLTVA

SEQ ID NO: 1177565 - protein, 9 aa, Homo Sapiens
INFDIRFET

SEQ ID NO: 1177566 - protein, 9 aa, Homo Sapiens
EAVLLGSQS

SEQ ID NO: 1177567 - protein, 9 aa, Homo Sapiens
SSTPAEEAT

SEQ ID NO: 1177568 - protein, 9 aa, Homo Sapiens
VPMRFFETT

SEQ ID NO: 1177569 - protein, 9 aa, Homo Sapiens
SKLLPYQTC

SEQ ID NO: 1177570 - protein, 9 aa, Homo Sapiens
WASSGLCVP

SEQ ID NO: 1177571 - protein, 9 aa, Homo Sapiens
LVNDILKKM

SEQ ID NO: 1177572 - protein, 9 aa, Homo Sapiens
GRASQTRVP

SEQ ID NO: 1177573 - protein, 9 aa, Homo Sapiens
RGDVPQTVK

SEQ ID NO: 1177574 - protein, 9 aa, Homo Sapiens
LSPSPAGGP

SEQ ID NO: 1177575 - protein, 9 aa, Homo Sapiens
MGKPLYWGV

SEQ ID NO: 1177576 - protein, 9 aa, Homo Sapiens
QMSASPSST

SEQ ID NO: 1177577 - protein, 9 aa, Homo Sapiens
EECERIGAK

SEQ ID NO: 1177578 - protein, 9 aa, Homo Sapiens
GSCPAFVAF

SEQ ID NO: 1177579 - protein, 9 aa, Homo Sapiens
FRNSPVGVK

SEQ ID NO: 1177580 - protein, 9 aa, Homo Sapiens
VLMDPTHCP

SEQ ID NO: 1177581 - protein, 9 aa, Homo Sapiens
ADAQAAATE

SEQ ID NO: 1177582 - protein, 9 aa, Homo Sapiens
PKDIQLARH

SEQ ID NO: 1177583 - protein, 9 aa, Homo Sapiens
PPARPPPTA

SEQ ID NO: 1177584 - protein, 9 aa, Homo Sapiens
PAAAPEEYS

SEQ ID NO: 1177585 - protein, 9 aa, Homo Sapiens
NSLNQGIPG

SEQ ID NO: 1177586 - protein, 9 aa, Homo Sapiens
HCLWLWCRP

SEQ ID NO: 1177587 - protein, 9 aa, Homo Sapiens
KGASAPRGP

SEQ ID NO: 1177588 - protein, 9 aa, Homo Sapiens
SVGRYLAIT

SEQ ID NO: 1177589 - protein, 9 aa, Homo Sapiens
YLVVASLCI

SEQ ID NO: 1177590 - protein, 9 aa, Homo Sapiens
STTSSGPAC

SEQ ID NO: 1177591 - protein, 9 aa, Homo Sapiens
KHSLTTYKI

SEQ ID NO: 1177592 - protein, 9 aa, Homo Sapiens
SHNSYLQGH

SEQ ID NO: 1177593 - protein, 9 aa, Homo Sapiens
SLQDAVTQR

SEQ ID NO: 1177594 - protein, 9 aa, Homo Sapiens
RLVHLEYGL

SEQ ID NO: 1177595 - protein, 9 aa, Homo Sapiens
KKDILVLNV

SEQ ID NO: 1177596 - protein, 9 aa, Homo Sapiens
VLNLCLLPF

SEQ ID NO: 1177597 - protein, 9 aa, Homo Sapiens
LPAAEPMIC

SEQ ID NO: 1177598 - protein, 9 aa, Homo Sapiens
LFKDVEGKS

SEQ ID NO: 1177599 - protein, 9 aa, Homo Sapiens
ELPGKMNQQ

SEQ ID NO: 1177600 - protein, 9 aa, Homo Sapiens
ALEDERVVP

SEQ ID NO: 1177601 - protein, 9 aa, Homo Sapiens
MAPALGRIG

SEQ ID NO: 1177602 - protein, 9 aa, Homo Sapiens
RLLRERTLK

SEQ ID NO: 1177603 - protein, 9 aa, Homo Sapiens
GRTAGRLES

SEQ ID NO: 1177604 - protein, 9 aa, Homo Sapiens
GKSTLRGHF

SEQ ID NO: 1177605 - protein, 9 aa, Homo Sapiens
TDNNDRTPL

SEQ ID NO: 1177606 - protein, 9 aa, Homo Sapiens
WRRTRPLTT

SEQ ID NO: 1177607 - protein, 9 aa, Homo Sapiens
HGSTLDSCS

SEQ ID NO: 1177608 - protein, 9 aa, Homo Sapiens
NEAPQCPSC

SEQ ID NO: 1177609 - protein, 9 aa, Homo Sapiens
AGARGEIAV

SEQ ID NO: 1177610 - protein, 9 aa, Homo Sapiens
SGRGSLRKW

SEQ ID NO: 1177611 - protein, 9 aa, Homo Sapiens
NNLCVRLGD

SEQ ID NO: 1177612 - protein, 9 aa, Homo Sapiens
WSWAAMRSA

SEQ ID NO: 1177613 - protein, 9 aa, Homo Sapiens
AGSLMLICK

SEQ ID NO: 1177614 - protein, 9 aa, Homo Sapiens
HEEIIINLQ

SEQ ID NO: 1177615 - protein, 9 aa, Homo Sapiens
FLARPLPWP

SEQ ID NO: 1177616 - protein, 9 aa, Homo Sapiens
DMYTDNRSQ

SEQ ID NO: 1177617 - protein, 9 aa, Homo Sapiens
PPFGGTPQW

SEQ ID NO: 1177618 - protein, 9 aa, Homo Sapiens
GPAPRTRMS

SEQ ID NO: 1177619 - protein, 9 aa, Homo Sapiens
TSSPCSRAT

SEQ ID NO: 1177620 - protein, 9 aa, Homo Sapiens
ILWFKVVTS

SEQ ID NO: 1177621 - protein, 9 aa, Homo Sapiens
PTRSSSRTA

SEQ ID NO: 1177622 - protein, 9 aa, Homo Sapiens
SYAAWRALG

SEQ ID NO: 1177623 - protein, 9 aa, Homo Sapiens
SLSLQERGG

SEQ ID NO: 1177624 - protein, 9 aa, Homo Sapiens
GDAPQPQPA

SEQ ID NO: 1177625 - protein, 9 aa, Homo Sapiens
VTVAELPRD

SEQ ID NO: 1177626 - protein, 9 aa, Homo Sapiens
MTQKVQNII

SEQ ID NO: 1177627 - protein, 9 aa, Homo Sapiens
QRMKFSMWD

SEQ ID NO: 1177628 - protein, 9 aa, Homo Sapiens
TQHNYLVQT

SEQ ID NO: 1177629 - protein, 9 aa, Homo Sapiens
HAAGPEPVP

SEQ ID NO: 1177630 - protein, 9 aa, Homo Sapiens
GNLGPLETP

SEQ ID NO: 1177631 - protein, 9 aa, Homo Sapiens
ARHIRGERA

SEQ ID NO: 1177632 - protein, 9 aa, Homo Sapiens
RAGRQAWGS

SEQ ID NO: 1177633 - protein, 9 aa, Homo Sapiens
GGEQRKRRR

SEQ ID NO: 1177634 - protein, 9 aa, Homo Sapiens
QVPYSIPSI

SEQ ID NO: 1177635 - protein, 9 aa, Homo Sapiens
LQLRYNAPT

SEQ ID NO: 1177636 - protein, 9 aa, Homo Sapiens
VACIEPLRK

SEQ ID NO: 1177637 - protein, 9 aa, Homo Sapiens
RTRTRITDD

SEQ ID NO: 1177638 - protein, 9 aa, Homo Sapiens
LRPGAQEVQ

SEQ ID NO: 1177639 - protein, 9 aa, Homo Sapiens
HISSLRDDE

SEQ ID NO: 1177640 - protein, 9 aa, Homo Sapiens
LDRDSGTNG

SEQ ID NO: 1177641 - protein, 9 aa, Homo Sapiens
DPCWALRFQ

SEQ ID NO: 1177642 - protein, 9 aa, Homo Sapiens
FRSGEERVR

SEQ ID NO: 1177643 - protein, 9 aa, Homo Sapiens
SPMTSAWRS

SEQ ID NO: 1177644 - protein, 9 aa, Homo Sapiens
GTRKLLVAV

SEQ ID NO: 1177645 - protein, 9 aa, Homo Sapiens
AGAQHEAEA

SEQ ID NO: 1177646 - protein, 9 aa, Homo Sapiens
SAPQPSSST

SEQ ID NO: 1177647 - protein, 9 aa, Homo Sapiens
ALAKATYEH

SEQ ID NO: 1177648 - protein, 9 aa, Homo Sapiens
MPNSLNQGI

SEQ ID NO: 1177649 - protein, 9 aa, Homo Sapiens
LKGGRAEGA

SEQ ID NO: 1177650 - protein, 9 aa, Homo Sapiens
QGGFMAAWP

SEQ ID NO: 1177651 - protein, 9 aa, Homo Sapiens
YHTPAGFNC

SEQ ID NO: 1177652 - protein, 9 aa, Homo Sapiens
KPTAALGWS

SEQ ID NO: 1177653 - protein, 9 aa, Homo Sapiens
TATWRMRSS

SEQ ID NO: 1177654 - protein, 9 aa, Homo Sapiens
GGVGEPRHC

SEQ ID NO: 1177655 - protein, 9 aa, Homo Sapiens
RIHPATPPQ

SEQ ID NO: 1177656 - protein, 9 aa, Homo Sapiens
RPFLSHLVQ

SEQ ID NO: 1177657 - protein, 9 aa, Homo Sapiens
PCLREAVLL

SEQ ID NO: 1177658 - protein, 9 aa, Homo Sapiens
KRPVSLRRR

SEQ ID NO: 1177659 - protein, 9 aa, Homo Sapiens
GDRPERVQP

SEQ ID NO: 1177660 - protein, 9 aa, Homo Sapiens
ASPSSTPAE

SEQ ID NO: 1177661 - protein, 9 aa, Homo Sapiens
PEVTPHRTS

SEQ ID NO: 1177662 - protein, 9 aa, Homo Sapiens
MGKVPCNVT

SEQ ID NO: 1177663 - protein, 9 aa, Homo Sapiens
EALYSVPKN

SEQ ID NO: 1177664 - protein, 9 aa, Homo Sapiens
GTSVGTIHA

SEQ ID NO: 1177665 - protein, 9 aa, Homo Sapiens
HTDRHTGFS

SEQ ID NO: 1177666 - protein, 9 aa, Homo Sapiens
TGFVEWPWG

SEQ ID NO: 1177667 - protein, 9 aa, Homo Sapiens
WLGTDSHLL

SEQ ID NO: 1177668 - protein, 9 aa, Homo Sapiens
GTKYRMPSS

SEQ ID NO: 1177669 - protein, 9 aa, Homo Sapiens
VRGLLRIIK

SEQ ID NO: 1177670 - protein, 9 aa, Homo Sapiens
QFFIRFLQM

SEQ ID NO: 1177671 - protein, 9 aa, Homo Sapiens
PECCSSWLR

SEQ ID NO: 1177672 - protein, 9 aa, Homo Sapiens
VSIGQRPVQ

SEQ ID NO: 1177673 - protein, 9 aa, Homo Sapiens
QGHCLASPS

SEQ ID NO: 1177674 - protein, 9 aa, Homo Sapiens
KPSAPNSFL

SEQ ID NO: 1177675 - protein, 9 aa, Homo Sapiens
GWASGRITY

SEQ ID NO: 1177676 - protein, 9 aa, Homo Sapiens
ETSRQSHIQ

SEQ ID NO: 1177677 - protein, 9 aa, Homo Sapiens
PPPSPLPAP

SEQ ID NO: 1177678 - protein, 9 aa, Homo Sapiens
AGLGPEHLS

SEQ ID NO: 1177679 - protein, 9 aa, Homo Sapiens
CDRSWLPCR

SEQ ID NO: 1177680 - protein, 9 aa, Homo Sapiens
AGGCHDNTS

SEQ ID NO: 1177681 - protein, 9 aa, Homo Sapiens
QATELVLLQ

SEQ ID NO: 1177682 - protein, 9 aa, Homo Sapiens
KFDMRVYIL

SEQ ID NO: 1177683 - protein, 9 aa, Homo Sapiens
SNSRHPPGR

SEQ ID NO: 1177684 - protein, 9 aa, Homo Sapiens
NCIFIIIHR

SEQ ID NO: 1177685 - protein, 9 aa, Homo Sapiens
YEFLQAHFN

SEQ ID NO: 1177686 - protein, 9 aa, Homo Sapiens
FPNLYPLIR

SEQ ID NO: 1177687 - protein, 9 aa, Homo Sapiens
TWEATPHSI

SEQ ID NO: 1177688 - protein, 9 aa, Homo Sapiens
SWRPPWWRR

SEQ ID NO: 1177689 - protein, 9 aa, Homo Sapiens
ETGLTRKCG

SEQ ID NO: 1177690 - protein, 9 aa, Homo Sapiens
CPRAPTAPR

SEQ ID NO: 1177691 - protein, 9 aa, Homo Sapiens
AVDPDSGHN

SEQ ID NO: 1177692 - protein, 9 aa, Homo Sapiens
GGWPGWRWR

SEQ ID NO: 1177693 - protein, 9 aa, Homo Sapiens
HRTLNISHD

SEQ ID NO: 1177694 - protein, 9 aa, Homo Sapiens
GRIQQQLEI

SEQ ID NO: 1177695 - protein, 9 aa, Homo Sapiens
LQTMKMSFS

SEQ ID NO: 1177696 - protein, 9 aa, Homo Sapiens
TTSTRECPS

SEQ ID NO: 1177697 - protein, 9 aa, Homo Sapiens
PGPGSSLLS

SEQ ID NO: 1177698 - protein, 9 aa, Homo Sapiens
ISTTLRPPA

SEQ ID NO: 1177699 - protein, 9 aa, Homo Sapiens
TFTYSSTLI

SEQ ID NO: 1177700 - protein, 9 aa, Homo Sapiens
HCNRIAAVI

SEQ ID NO: 1177701 - protein, 9 aa, Homo Sapiens
GPTAAAAAT

SEQ ID NO: 1177702 - protein, 9 aa, Homo Sapiens
HGKKVPTSF

SEQ ID NO: 1177703 - protein, 9 aa, Homo Sapiens
LGDWPALTR

SEQ ID NO: 1177704 - protein, 9 aa, Homo Sapiens
AEAETEPHG

SEQ ID NO: 1177705 - protein, 9 aa, Homo Sapiens
EHRNFLVSG

SEQ ID NO: 1177706 - protein, 9 aa, Homo Sapiens
LWPPSSRRS

SEQ ID NO: 1177707 - protein, 9 aa, Homo Sapiens
ARVFTGFVE

SEQ ID NO: 1177708 - protein, 9 aa, Homo Sapiens
DRLEAGLEH

SEQ ID NO: 1177709 - protein, 9 aa, Homo Sapiens
HSECGEVRF

SEQ ID NO: 1177710 - protein, 9 aa, Homo Sapiens
CQPGTGFFR

SEQ ID NO: 1177711 - protein, 9 aa, Homo Sapiens
GDRMFLRVL

SEQ ID NO: 1177712 - protein, 9 aa, Homo Sapiens
IHKVPLLEP

SEQ ID NO: 1177713 - protein, 9 aa, Homo Sapiens
IHCNRIAAV

SEQ ID NO: 1177714 - protein, 9 aa, Homo Sapiens
TYETVMTFL

SEQ ID NO: 1177715 - protein, 9 aa, Homo Sapiens
IADFLLWQW

SEQ ID NO: 1177716 - protein, 9 aa, Homo Sapiens
TISQVDEEM

SEQ ID NO: 1177717 - protein, 9 aa, Homo Sapiens
CRTRIYASM

SEQ ID NO: 1177718 - protein, 9 aa, Homo Sapiens
LVALSWRGA

SEQ ID NO: 1177719 - protein, 9 aa, Homo Sapiens
CISMTTISR

SEQ ID NO: 1177720 - protein, 9 aa, Homo Sapiens
LGPEHLSPE

SEQ ID NO: 1177721 - protein, 9 aa, Homo Sapiens
AEACHERSH

SEQ ID NO: 1177722 - protein, 9 aa, Homo Sapiens
QDPEMPKSL

SEQ ID NO: 1177723 - protein, 9 aa, Homo Sapiens
EPQKSSLSP

SEQ ID NO: 1177724 - protein, 9 aa, Homo Sapiens
LTRPRLLPL

SEQ ID NO: 1177725 - protein, 9 aa, Homo Sapiens
RSFMKLYHS

SEQ ID NO: 1177726 - protein, 9 aa, Homo Sapiens
LKEKMMQLG

SEQ ID NO: 1177727 - protein, 9 aa, Homo Sapiens
QLGAGAAAG

SEQ ID NO: 1177728 - protein, 9 aa, Homo Sapiens
RKFGSQGWN

SEQ ID NO: 1177729 - protein, 9 aa, Homo Sapiens
DVYRVLGGW

SEQ ID NO: 1177730 - protein, 9 aa, Homo Sapiens
GKVLIMHGD

SEQ ID NO: 1177731 - protein, 9 aa, Homo Sapiens
TFSLLLLRP

SEQ ID NO: 1177732 - protein, 9 aa, Homo Sapiens
KWLGTDSHL

SEQ ID NO: 1177733 - protein, 9 aa, Homo Sapiens
GWHCFMTSG

SEQ ID NO: 1177734 - protein, 9 aa, Homo Sapiens
PTVASSIVS

SEQ ID NO: 1177735 - protein, 9 aa, Homo Sapiens
VGGRECRGC

SEQ ID NO: 1177736 - protein, 9 aa, Homo Sapiens
SRESQMAIE

SEQ ID NO: 1177737 - protein, 9 aa, Homo Sapiens
CLCQGGLPT

SEQ ID NO: 1177738 - protein, 9 aa, Homo Sapiens
RTEGSPMTL

SEQ ID NO: 1177739 - protein, 9 aa, Homo Sapiens
THLSYQCSQ

SEQ ID NO: 1177740 - protein, 9 aa, Homo Sapiens
GGSGHAGYN

SEQ ID NO: 1177741 - protein, 9 aa, Homo Sapiens
PSPALRAAA

SEQ ID NO: 1177742 - protein, 9 aa, Homo Sapiens
GQAMAYTEE

SEQ ID NO: 1177743 - protein, 9 aa, Homo Sapiens
TLQESPTCK

SEQ ID NO: 1177744 - protein, 9 aa, Homo Sapiens
NLCCMDPAW

SEQ ID NO: 1177745 - protein, 9 aa, Homo Sapiens
LVVHVASCE

SEQ ID NO: 1177746 - protein, 9 aa, Homo Sapiens
EAEARGGPW

SEQ ID NO: 1177747 - protein, 9 aa, Homo Sapiens
VTAAPSGQY

SEQ ID NO: 1177748 - protein, 9 aa, Homo Sapiens
WTSWPTATW

SEQ ID NO: 1177749 - protein, 9 aa, Homo Sapiens
LVITALGRF

SEQ ID NO: 1177750 - protein, 9 aa, Homo Sapiens
RSGILARSP

SEQ ID NO: 1177751 - protein, 9 aa, Homo Sapiens
QRAGHTIPC

SEQ ID NO: 1177752 - protein, 9 aa, Homo Sapiens
GTGATAESH

SEQ ID NO: 1177753 - protein, 9 aa, Homo Sapiens
NHVVILQIL

SEQ ID NO: 1177754 - protein, 9 aa, Homo Sapiens
SGGRTAAVG

SEQ ID NO: 1177755 - protein, 9 aa, Homo Sapiens
KIFFCTGSS

SEQ ID NO: 1177756 - protein, 9 aa, Homo Sapiens
PLCSEDKDV

SEQ ID NO: 1177757 - protein, 9 aa, Homo Sapiens
WFYIASAFQ

SEQ ID NO: 1177758 - protein, 9 aa, Homo Sapiens
GSLMLICKS

SEQ ID NO: 1177759 - protein, 9 aa, Homo Sapiens
VILKQLNSL

SEQ ID NO: 1177760 - protein, 9 aa, Homo Sapiens
CSALPRRKV

SEQ ID NO: 1177761 - protein, 9 aa, Homo Sapiens
CRNPGDDAH

SEQ ID NO: 1177762 - protein, 9 aa, Homo Sapiens
GLGVAARHS

SEQ ID NO: 1177763 - protein, 9 aa, Homo Sapiens
VLDDFELPQ

SEQ ID NO: 1177764 - protein, 9 aa, Homo Sapiens
LREQTALVM

SEQ ID NO: 1177765 - protein, 9 aa, Homo Sapiens
ALKETRGNL

SEQ ID NO: 1177766 - protein, 9 aa, Homo Sapiens
GNSLCSPHN

SEQ ID NO: 1177767 - protein, 9 aa, Homo Sapiens
SAGLGPEHL

SEQ ID NO: 1177768 - protein, 9 aa, Homo Sapiens
ATGSEWRQR

SEQ ID NO: 1177769 - protein, 9 aa, Homo Sapiens
CLCKEITCP

SEQ ID NO: 1177770 - protein, 9 aa, Homo Sapiens
LVIDYFQNR

SEQ ID NO: 1177771 - protein, 9 aa, Homo Sapiens
IPRSTCGRR

SEQ ID NO: 1177772 - protein, 9 aa, Homo Sapiens
HLFHTDRHT

SEQ ID NO: 1177773 - protein, 9 aa, Homo Sapiens
SAGALKPAG

SEQ ID NO: 1177774 - protein, 9 aa, Homo Sapiens
AQKAFEYGA

SEQ ID NO: 1177775 - protein, 9 aa, Homo Sapiens
EADHAFTDD

SEQ ID NO: 1177776 - protein, 9 aa, Homo Sapiens
IQVSSLSVL

SEQ ID NO: 1177777 - protein, 9 aa, Homo Sapiens
AMGLAREKV

SEQ ID NO: 1177778 - protein, 9 aa, Homo Sapiens
GLQSLTGAH

SEQ ID NO: 1177779 - protein, 9 aa, Homo Sapiens
REGGVGGRG

SEQ ID NO: 1177780 - protein, 9 aa, Homo Sapiens
LACVLWKKG

SEQ ID NO: 1177781 - protein, 9 aa, Homo Sapiens
SAESAGITL

SEQ ID NO: 1177782 - protein, 9 aa, Homo Sapiens
RAIPPRSCR

SEQ ID NO: 1177783 - protein, 9 aa, Homo Sapiens
ALLTGQRNP

SEQ ID NO: 1177784 - protein, 9 aa, Homo Sapiens
HWGWRTAVF

SEQ ID NO: 1177785 - protein, 9 aa, Homo Sapiens
GCHDNTSCL

SEQ ID NO: 1177786 - protein, 9 aa, Homo Sapiens
AVIEASASP

SEQ ID NO: 1177787 - protein, 9 aa, Homo Sapiens
ICQPSWATR

SEQ ID NO: 1177788 - protein, 9 aa, Homo Sapiens
RPRLLPLIH

SEQ ID NO: 1177789 - protein, 9 aa, Homo Sapiens
RNSRGLVWG

SEQ ID NO: 1177790 - protein, 9 aa, Homo Sapiens
QLFGLRSDW

SEQ ID NO: 1177791 - protein, 9 aa, Homo Sapiens
LNYGGITLM

SEQ ID NO: 1177792 - protein, 9 aa, Homo Sapiens
GWQSYLLPQ

SEQ ID NO: 1177793 - protein, 9 aa, Homo Sapiens
KIILKVRAM

SEQ ID NO: 1177794 - protein, 9 aa, Homo Sapiens
SFIRSPRIN

SEQ ID NO: 1177795 - protein, 9 aa, Homo Sapiens
LEGPNILPI

SEQ ID NO: 1177796 - protein, 9 aa, Homo Sapiens
DPLDRCYST

SEQ ID NO: 1177797 - protein, 9 aa, Homo Sapiens
LAFGQLNSP

SEQ ID NO: 1177798 - protein, 9 aa, Homo Sapiens
NLIKHQRAH

SEQ ID NO: 1177799 - protein, 9 aa, Homo Sapiens
PSKGQLKTK

SEQ ID NO: 1177800 - protein, 9 aa, Homo Sapiens
CDWEIQLEI

SEQ ID NO: 1177801 - protein, 9 aa, Homo Sapiens
LLPAALEGC

SEQ ID NO: 1177802 - protein, 9 aa, Homo Sapiens
LRALWGAAT

SEQ ID NO: 1177803 - protein, 9 aa, Homo Sapiens
LLCTPPGSC

SEQ ID NO: 1177804 - protein, 9 aa, Homo Sapiens
RDADAQENV

SEQ ID NO: 1177805 - protein, 9 aa, Homo Sapiens
QEVHLGSFL

SEQ ID NO: 1177806 - protein, 9 aa, Homo Sapiens
IRFISAPQP

SEQ ID NO: 1177807 - protein, 9 aa, Homo Sapiens
RHSQFKRTR

SEQ ID NO: 1177808 - protein, 9 aa, Homo Sapiens
RPGSTPRPA

SEQ ID NO: 1177809 - protein, 9 aa, Homo Sapiens
SLLLLRPTG

SEQ ID NO: 1177810 - protein, 9 aa, Homo Sapiens
RKEMRAKVV

SEQ ID NO: 1177811 - protein, 9 aa, Homo Sapiens
APGQPGRHR

SEQ ID NO: 1177812 - protein, 9 aa, Homo Sapiens
CCGRSFSDP

SEQ ID NO: 1177813 - protein, 9 aa, Homo Sapiens
SQVRQPQEG

SEQ ID NO: 1177814 - protein, 9 aa, Homo Sapiens
HADAQNMGA

SEQ ID NO: 1177815 - protein, 9 aa, Homo Sapiens
ARGHNQVPA

SEQ ID NO: 1177816 - protein, 9 aa, Homo Sapiens
PPCHCPTDT

SEQ ID NO: 1177817 - protein, 9 aa, Homo Sapiens
RRLRRTSPL

SEQ ID NO: 1177818 - protein, 9 aa, Homo Sapiens
ESKTISQYA

SEQ ID NO: 1177819 - protein, 9 aa, Homo Sapiens
RPRPHQPRI

SEQ ID NO: 1177820 - protein, 9 aa, Homo Sapiens
PKLLCRQML

SEQ ID NO: 1177821 - protein, 9 aa, Homo Sapiens
IEETPLEEN

SEQ ID NO: 1177822 - protein, 9 aa, Homo Sapiens
GAVRPGSTP

SEQ ID NO: 1177823 - protein, 9 aa, Homo Sapiens
SFSVATGQP

SEQ ID NO: 1177824 - protein, 9 aa, Homo Sapiens
MFINLGLGS

SEQ ID NO: 1177825 - protein, 9 aa, Homo Sapiens
CSGVTSAAN

SEQ ID NO: 1177826 - protein, 9 aa, Homo Sapiens
SSTSPAARP

SEQ ID NO: 1177827 - protein, 9 aa, Homo Sapiens
EPECTEILT

SEQ ID NO: 1177828 - protein, 9 aa, Homo Sapiens
VPQSCLIIA

SEQ ID NO: 1177829 - protein, 9 aa, Homo Sapiens
EDQIKEKRK

SEQ ID NO: 1177830 - protein, 9 aa, Homo Sapiens
QKPPPPLPA

SEQ ID NO: 1177831 - protein, 9 aa, Homo Sapiens
GITLMWRGG

SEQ ID NO: 1177832 - protein, 9 aa, Homo Sapiens
QLLNGPPIM

SEQ ID NO: 1177833 - protein, 9 aa, Homo Sapiens
WGAATPVAR

SEQ ID NO: 1177834 - protein, 9 aa, Homo Sapiens
PTATNASCS

SEQ ID NO: 1177835 - protein, 9 aa, Homo Sapiens
MEVQKSLLK

SEQ ID NO: 1177836 - protein, 9 aa, Homo Sapiens
RREGDAPFS

SEQ ID NO: 1177837 - protein, 9 aa, Homo Sapiens
RSSCHLRMS

SEQ ID NO: 1177838 - protein, 9 aa, Homo Sapiens
SACSAGGDA

SEQ ID NO: 1177839 - protein, 9 aa, Homo Sapiens
AVIGINHCD

SEQ ID NO: 1177840 - protein, 9 aa, Homo Sapiens
GGPAEWGQR

SEQ ID NO: 1177841 - protein, 9 aa, Homo Sapiens
LACMSPPLR

SEQ ID NO: 1177842 - protein, 9 aa, Homo Sapiens
SHGNGEGRR

SEQ ID NO: 1177843 - protein, 9 aa, Homo Sapiens
ENTWIGLNN

SEQ ID NO: 1177844 - protein, 9 aa, Homo Sapiens
IGFGAAREG

SEQ ID NO: 1177845 - protein, 9 aa, Homo Sapiens
IIFACVCSF

SEQ ID NO: 1177846 - protein, 9 aa, Homo Sapiens
HQIPWKLGL

SEQ ID NO: 1177847 - protein, 9 aa, Homo Sapiens
TVCCMHLHE

SEQ ID NO: 1177848 - protein, 9 aa, Homo Sapiens
FVHGLFLDG

SEQ ID NO: 1177849 - protein, 9 aa, Homo Sapiens
QGAIHERDQ

SEQ ID NO: 1177850 - protein, 9 aa, Homo Sapiens
GIRWSPLPA

SEQ ID NO: 1177851 - protein, 9 aa, Homo Sapiens
ATLARWASQ

SEQ ID NO: 1177852 - protein, 9 aa, Homo Sapiens
TLTPKVLVF

SEQ ID NO: 1177853 - protein, 9 aa, Homo Sapiens
CDGEKRGLG

SEQ ID NO: 1177854 - protein, 9 aa, Homo Sapiens
PPRSWGCTS

SEQ ID NO: 1177855 - protein, 9 aa, Homo Sapiens
LPWPLPSTQ

SEQ ID NO: 1177856 - protein, 9 aa, Homo Sapiens
EELSLNYFL

SEQ ID NO: 1177857 - protein, 9 aa, Homo Sapiens
RSHVGKTSY

SEQ ID NO: 1177858 - protein, 9 aa, Homo Sapiens
IQSWGSTLF

SEQ ID NO: 1177859 - protein, 9 aa, Homo Sapiens
RNSSSVWPN

SEQ ID NO: 1177860 - protein, 9 aa, Homo Sapiens
RPDWEIAIQ

SEQ ID NO: 1177861 - protein, 9 aa, Homo Sapiens
PGSQHHMEP

SEQ ID NO: 1177862 - protein, 9 aa, Homo Sapiens
MIPGSQHHM

SEQ ID NO: 1177863 - protein, 9 aa, Homo Sapiens
SARTFVPSS

SEQ ID NO: 1177864 - protein, 9 aa, Homo Sapiens
LGLYHTASL

SEQ ID NO: 1177865 - protein, 9 aa, Homo Sapiens
LAGLLFRML

SEQ ID NO: 1177866 - protein, 9 aa, Homo Sapiens
RFSPRPGNA

SEQ ID NO: 1177867 - protein, 9 aa, Homo Sapiens
CGLMANYHY

SEQ ID NO: 1177868 - protein, 9 aa, Homo Sapiens
SGSRGCPTW

SEQ ID NO: 1177869 - protein, 9 aa, Homo Sapiens
FVVDPHGRC

SEQ ID NO: 1177870 - protein, 9 aa, Homo Sapiens
YEAFNWHHG

SEQ ID NO: 1177871 - protein, 9 aa, Homo Sapiens
VFCPHPAPP

SEQ ID NO: 1177872 - protein, 9 aa, Homo Sapiens
CPVYCPNGQ

SEQ ID NO: 1177873 - protein, 9 aa, Homo Sapiens
HLRPPVPQL

SEQ ID NO: 1177874 - protein, 9 aa, Homo Sapiens
VASSLPWTT

SEQ ID NO: 1177875 - protein, 9 aa, Homo Sapiens
VPPGIRWSP

SEQ ID NO: 1177876 - protein, 9 aa, Homo Sapiens
LIERLEDVP

SEQ ID NO: 1177877 - protein, 9 aa, Homo Sapiens
QPPTPTPRP

SEQ ID NO: 1177878 - protein, 9 aa, Homo Sapiens
EPRQQHRHP

SEQ ID NO: 1177879 - protein, 9 aa, Homo Sapiens
ALLGAEKRK

SEQ ID NO: 1177880 - protein, 9 aa, Homo Sapiens
WWLLELPWG

SEQ ID NO: 1177881 - protein, 9 aa, Homo Sapiens
KPLYWGVDR

SEQ ID NO: 1177882 - protein, 9 aa, Homo Sapiens
LQGAPTIMP

SEQ ID NO: 1177883 - protein, 9 aa, Homo Sapiens
EFLLLSNLD

SEQ ID NO: 1177884 - protein, 9 aa, Homo Sapiens
VQAAFPGTF

SEQ ID NO: 1177885 - protein, 9 aa, Homo Sapiens
GLVRDCGAW

SEQ ID NO: 1177886 - protein, 9 aa, Homo Sapiens
LRMKTSRRS

SEQ ID NO: 1177887 - protein, 9 aa, Homo Sapiens
GAQDGQMTS

SEQ ID NO: 1177888 - protein, 9 aa, Homo Sapiens
QEWQVSSDP

SEQ ID NO: 1177889 - protein, 9 aa, Homo Sapiens
RAVFNHTED

SEQ ID NO: 1177890 - protein, 9 aa, Homo Sapiens
EVPLTIVRG

SEQ ID NO: 1177891 - protein, 9 aa, Homo Sapiens
LSPAPQQVP

SEQ ID NO: 1177892 - protein, 9 aa, Homo Sapiens
PHTLCSDHS

SEQ ID NO: 1177893 - protein, 9 aa, Homo Sapiens
ALLPFLDVQ

SEQ ID NO: 1177894 - protein, 9 aa, Homo Sapiens
VLRTGNPLS

SEQ ID NO: 1177895 - protein, 9 aa, Homo Sapiens
RSRDCFFCG

SEQ ID NO: 1177896 - protein, 9 aa, Homo Sapiens
GAAQNLAVH

SEQ ID NO: 1177897 - protein, 9 aa, Homo Sapiens
WGCTSLRLP

SEQ ID NO: 1177898 - protein, 9 aa, Homo Sapiens
EAPQCPSCM

SEQ ID NO: 1177899 - protein, 9 aa, Homo Sapiens
SQSQNANAP

SEQ ID NO: 1177900 - protein, 9 aa, Homo Sapiens
SSLLSSPMH

SEQ ID NO: 1177901 - protein, 9 aa, Homo Sapiens
VEQWHNLRS

SEQ ID NO: 1177902 - protein, 9 aa, Homo Sapiens
PHIYPLCST

SEQ ID NO: 1177903 - protein, 9 aa, Homo Sapiens
SFTCTQSEW

SEQ ID NO: 1177904 - protein, 9 aa, Homo Sapiens
KRSSPSGAS

SEQ ID NO: 1177905 - protein, 9 aa, Homo Sapiens
PGFKGHFLS

SEQ ID NO: 1177906 - protein, 9 aa, Homo Sapiens
PVLRAPGPP

SEQ ID NO: 1177907 - protein, 9 aa, Homo Sapiens
PPENEAPQC

SEQ ID NO: 1177908 - protein, 9 aa, Homo Sapiens
QRAKSLPLS

SEQ ID NO: 1177909 - protein, 9 aa, Homo Sapiens
AARARTCSP

SEQ ID NO: 1177910 - protein, 9 aa, Homo Sapiens
KPPSCPQAI

SEQ ID NO: 1177911 - protein, 9 aa, Homo Sapiens
YVWPGGPAD

SEQ ID NO: 1177912 - protein, 9 aa, Homo Sapiens
CTNKEDTWK

SEQ ID NO: 1177913 - protein, 9 aa, Homo Sapiens
KTSRRSLMS

SEQ ID NO: 1177914 - protein, 9 aa, Homo Sapiens
LGWLPQWAA

SEQ ID NO: 1177915 - protein, 9 aa, Homo Sapiens
SPDTRACNL

SEQ ID NO: 1177916 - protein, 9 aa, Homo Sapiens
REDGDRDED

SEQ ID NO: 1177917 - protein, 9 aa, Homo Sapiens
SGNDGRTRS

SEQ ID NO: 1177918 - protein, 9 aa, Homo Sapiens
TGGQGVGVV

SEQ ID NO: 1177919 - protein, 9 aa, Homo Sapiens
SKVGKEIKE

SEQ ID NO: 1177920 - protein, 9 aa, Homo Sapiens
GYQCVCPQG

SEQ ID NO: 1177921 - protein, 9 aa, Homo Sapiens
SMEDFLKTR

SEQ ID NO: 1177922 - protein, 9 aa, Homo Sapiens
AQPFAMPHS

SEQ ID NO: 1177923 - protein, 9 aa, Homo Sapiens
LNHFLAPGA

SEQ ID NO: 1177924 - protein, 9 aa, Homo Sapiens
KTCKEDLPR

SEQ ID NO: 1177925 - protein, 9 aa, Homo Sapiens
VLWPLRPPP

SEQ ID NO: 1177926 - protein, 9 aa, Homo Sapiens
LQNAATGSF

SEQ ID NO: 1177927 - protein, 9 aa, Homo Sapiens
LMTCWKATW

SEQ ID NO: 1177928 - protein, 9 aa, Homo Sapiens
SFWGARVIA

SEQ ID NO: 1177929 - protein, 9 aa, Homo Sapiens
GHLSFVRSV

SEQ ID NO: 1177930 - protein, 9 aa, Homo Sapiens
HASPTSTPG

SEQ ID NO: 1177931 - protein, 9 aa, Homo Sapiens
DPVVTSRQI

SEQ ID NO: 1177932 - protein, 9 aa, Homo Sapiens
AVSTSNLAK

SEQ ID NO: 1177933 - protein, 9 aa, Homo Sapiens
LPPIRDPAR

SEQ ID NO: 1177934 - protein, 9 aa, Homo Sapiens
QKVADVEQV

SEQ ID NO: 1177935 - protein, 9 aa, Homo Sapiens
CVYDSVQII

SEQ ID NO: 1177936 - protein, 9 aa, Homo Sapiens
PGSCGFTQD

SEQ ID NO: 1177937 - protein, 9 aa, Homo Sapiens
SSSTVTAAP

SEQ ID NO: 1177938 - protein, 9 aa, Homo Sapiens
GAWKQAWLP

SEQ ID NO: 1177939 - protein, 9 aa, Homo Sapiens
QAPRCCLCQ

SEQ ID NO: 1177940 - protein, 9 aa, Homo Sapiens
HHPQRCGRT

SEQ ID NO: 1177941 - protein, 9 aa, Homo Sapiens
PPSSRSKLR

SEQ ID NO: 1177942 - protein, 9 aa, Homo Sapiens
RGPDGVMVR

SEQ ID NO: 1177943 - protein, 9 aa, Homo Sapiens
CTCISMTTI

SEQ ID NO: 1177944 - protein, 9 aa, Homo Sapiens
CGQRMKEGA

SEQ ID NO: 1177945 - protein, 9 aa, Homo Sapiens
MALCPSCRS

SEQ ID NO: 1177946 - protein, 9 aa, Homo Sapiens
TLGTRSCLA

SEQ ID NO: 1177947 - protein, 9 aa, Homo Sapiens
IARATKFKQ

SEQ ID NO: 1177948 - protein, 9 aa, Homo Sapiens
FRQNASLIC

SEQ ID NO: 1177949 - protein, 9 aa, Homo Sapiens
TSSVSFKSE

SEQ ID NO: 1177950 - protein, 9 aa, Homo Sapiens
VEIVEGTIE

SEQ ID NO: 1177951 - protein, 9 aa, Homo Sapiens
LEEHEPGAI

SEQ ID NO: 1177952 - protein, 9 aa, Homo Sapiens
RRRLRVGSN

SEQ ID NO: 1177953 - protein, 9 aa, Homo Sapiens
VTLSQAVGP

SEQ ID NO: 1177954 - protein, 9 aa, Homo Sapiens
ADSSYVCFA

SEQ ID NO: 1177955 - protein, 9 aa, Homo Sapiens
VAVTAGPEE

SEQ ID NO: 1177956 - protein, 9 aa, Homo Sapiens
HLGRLMTCW

SEQ ID NO: 1177957 - protein, 9 aa, Homo Sapiens
KLQGAPPRS

SEQ ID NO: 1177958 - protein, 9 aa, Homo Sapiens
MDEEGNLSM

SEQ ID NO: 1177959 - protein, 9 aa, Homo Sapiens
LEAVAGQDD

SEQ ID NO: 1177960 - protein, 9 aa, Homo Sapiens
AGRSWGQIL

SEQ ID NO: 1177961 - protein, 9 aa, Homo Sapiens
EHVHLALKA

SEQ ID NO: 1177962 - protein, 9 aa, Homo Sapiens
AGPEVDVFL

SEQ ID NO: 1177963 - protein, 9 aa, Homo Sapiens
GGKNRCRGK

SEQ ID NO: 1177964 - protein, 9 aa, Homo Sapiens
GWMVSSRSS

SEQ ID NO: 1177965 - protein, 9 aa, Homo Sapiens
STASLRCIW

SEQ ID NO: 1177966 - protein, 9 aa, Homo Sapiens
SSDPLCCCL

SEQ ID NO: 1177967 - protein, 9 aa, Homo Sapiens
LVQDAAGRG

SEQ ID NO: 1177968 - protein, 9 aa, Homo Sapiens
GRADPGGRC

SEQ ID NO: 1177969 - protein, 9 aa, Homo Sapiens
HFPGCWARV

SEQ ID NO: 1177970 - protein, 9 aa, Homo Sapiens
RERAAAALR

SEQ ID NO: 1177971 - protein, 9 aa, Homo Sapiens
RTSENTHRR

SEQ ID NO: 1177972 - protein, 9 aa, Homo Sapiens
AATTSPPTS

SEQ ID NO: 1177973 - protein, 9 aa, Homo Sapiens
SCTPVPVAC

SEQ ID NO: 1177974 - protein, 9 aa, Homo Sapiens
VDLIHRDIL

SEQ ID NO: 1177975 - protein, 9 aa, Homo Sapiens
MALHLAAHY

SEQ ID NO: 1177976 - protein, 9 aa, Homo Sapiens
FAFPAPVQP

SEQ ID NO: 1177977 - protein, 9 aa, Homo Sapiens
VHYQMCHRH

SEQ ID NO: 1177978 - protein, 9 aa, Homo Sapiens
TWAFGTPSW

SEQ ID NO: 1177979 - protein, 9 aa, Homo Sapiens
SWPVAQRMG

SEQ ID NO: 1177980 - protein, 9 aa, Homo Sapiens
AAALRAVGT

SEQ ID NO: 1177981 - protein, 9 aa, Homo Sapiens
AGALKPAGP

SEQ ID NO: 1177982 - protein, 9 aa, Homo Sapiens
DCGAAPGVW

SEQ ID NO: 1177983 - protein, 9 aa, Homo Sapiens
HAAMATRQV

SEQ ID NO: 1177984 - protein, 9 aa, Homo Sapiens
GSFEKKIRQ

SEQ ID NO: 1177985 - protein, 9 aa, Homo Sapiens
TRQPPPAFP

SEQ ID NO: 1177986 - protein, 9 aa, Homo Sapiens
LSLGAHANF

SEQ ID NO: 1177987 - protein, 9 aa, Homo Sapiens
GTSYHAAMA

SEQ ID NO: 1177988 - protein, 9 aa, Homo Sapiens
ISMTTISRA

SEQ ID NO: 1177989 - protein, 9 aa, Homo Sapiens
VAQLEQAYI

SEQ ID NO: 1177990 - protein, 9 aa, Homo Sapiens
PPGTAMPQM

SEQ ID NO: 1177991 - protein, 9 aa, Homo Sapiens
PCSPTTPSP

SEQ ID NO: 1177992 - protein, 9 aa, Homo Sapiens
PVVAGQLVG

SEQ ID NO: 1177993 - protein, 9 aa, Homo Sapiens
WMSPSVQVA

SEQ ID NO: 1177994 - protein, 9 aa, Homo Sapiens
GTPVPEKPK

SEQ ID NO: 1177995 - protein, 9 aa, Homo Sapiens
YFLYQILWG

SEQ ID NO: 1177996 - protein, 9 aa, Homo Sapiens
VAPRGLLCP

SEQ ID NO: 1177997 - protein, 9 aa, Homo Sapiens
SSNSHETET

SEQ ID NO: 1177998 - protein, 9 aa, Homo Sapiens
PGAWGRCGP

SEQ ID NO: 1177999 - protein, 9 aa, Homo Sapiens
SWRPGLKSS

SEQ ID NO: 1178000 - protein, 9 aa, Homo Sapiens
PQKINCPLM

SEQ ID NO: 1178001 - protein, 9 aa, Homo Sapiens
AEKNSQNLK

SEQ ID NO: 1178002 - protein, 9 aa, Homo Sapiens
YPVLNLATV

SEQ ID NO: 1178003 - protein, 9 aa, Homo Sapiens
RISQTATKQ

SEQ ID NO: 1178004 - protein, 9 aa, Homo Sapiens
FNILQSCKD

SEQ ID NO: 1178005 - protein, 9 aa, Homo Sapiens
GVYTEPYYY

SEQ ID NO: 1178006 - protein, 9 aa, Homo Sapiens
RCVVPCWPP

SEQ ID NO: 1178007 - protein, 9 aa, Homo Sapiens
WWGDRASRA

SEQ ID NO: 1178008 - protein, 9 aa, Homo Sapiens
RREVYTSNN

SEQ ID NO: 1178009 - protein, 9 aa, Homo Sapiens
PYIVCQCVE

SEQ ID NO: 1178010 - protein, 9 aa, Homo Sapiens
AENISCVLY

SEQ ID NO: 1178011 - protein, 9 aa, Homo Sapiens
GEVCAASER

SEQ ID NO: 1178012 - protein, 9 aa, Homo Sapiens
NLEEPTSPA

SEQ ID NO: 1178013 - protein, 9 aa, Homo Sapiens
GKPPEEVLK

SEQ ID NO: 1178014 - protein, 9 aa, Homo Sapiens
GPTEPGPRV

SEQ ID NO: 1178015 - protein, 9 aa, Homo Sapiens
LMSDHLSEF

SEQ ID NO: 1178016 - protein, 9 aa, Homo Sapiens
TPFSTQIPL

SEQ ID NO: 1178017 - protein, 9 aa, Homo Sapiens
SHSRSHSKT

SEQ ID NO: 1178018 - protein, 9 aa, Homo Sapiens
IVGSAFEVV

SEQ ID NO: 1178019 - protein, 9 aa, Homo Sapiens
CRSPRSTWP

SEQ ID NO: 1178020 - protein, 9 aa, Homo Sapiens
PYQCDCCGR

SEQ ID NO: 1178021 - protein, 9 aa, Homo Sapiens
MERRLITSA

SEQ ID NO: 1178022 - protein, 9 aa, Homo Sapiens
KPTTGHAPR

SEQ ID NO: 1178023 - protein, 9 aa, Homo Sapiens
APRGPEQTH

SEQ ID NO: 1178024 - protein, 9 aa, Homo Sapiens
AALQDHDQS

SEQ ID NO: 1178025 - protein, 9 aa, Homo Sapiens
LVVFRIVLM

SEQ ID NO: 1178026 - protein, 9 aa, Homo Sapiens
PAPPEIYYT

SEQ ID NO: 1178027 - protein, 9 aa, Homo Sapiens
TWTIFAPSL

SEQ ID NO: 1178028 - protein, 9 aa, Homo Sapiens
AASSRQMWD

SEQ ID NO: 1178029 - protein, 9 aa, Homo Sapiens
PSRALRGSG

SEQ ID NO: 1178030 - protein, 9 aa, Homo Sapiens
ESRESQMAI

SEQ ID NO: 1178031 - protein, 9 aa, Homo Sapiens
SADPYEREG

SEQ ID NO: 1178032 - protein, 9 aa, Homo Sapiens
AQQDPQLHP

SEQ ID NO: 1178033 - protein, 9 aa, Homo Sapiens
PAWGIPGSL

SEQ ID NO: 1178034 - protein, 9 aa, Homo Sapiens
PPTPPAPRL

SEQ ID NO: 1178035 - protein, 9 aa, Homo Sapiens
NTWIGLNNR

SEQ ID NO: 1178036 - protein, 9 aa, Homo Sapiens
LTLDQMIHI

SEQ ID NO: 1178037 - protein, 9 aa, Homo Sapiens
GSRRCCLRT

SEQ ID NO: 1178038 - protein, 9 aa, Homo Sapiens
SFQHISSLR

SEQ ID NO: 1178039 - protein, 9 aa, Homo Sapiens
FNEAETRST

SEQ ID NO: 1178040 - protein, 9 aa, Homo Sapiens
KPRARDNYR

SEQ ID NO: 1178041 - protein, 9 aa, Homo Sapiens
FISVWEFFY

SEQ ID NO: 1178042 - protein, 9 aa, Homo Sapiens
PISGSPMTS

SEQ ID NO: 1178043 - protein, 9 aa, Homo Sapiens
LHSSGNVLN

SEQ ID NO: 1178044 - protein, 9 aa, Homo Sapiens
MADIIEYFH

SEQ ID NO: 1178045 - protein, 9 aa, Homo Sapiens
KGLTEAKTR

SEQ ID NO: 1178046 - protein, 9 aa, Homo Sapiens
KGDVTYTKA

SEQ ID NO: 1178047 - protein, 9 aa, Homo Sapiens
CCSHMEHAQ

SEQ ID NO: 1178048 - protein, 9 aa, Homo Sapiens
EEDMPRPSI

SEQ ID NO: 1178049 - protein, 9 aa, Homo Sapiens
CKQCGRTFR

SEQ ID NO: 1178050 - protein, 9 aa, Homo Sapiens
WHPHQGSGA

SEQ ID NO: 1178051 - protein, 9 aa, Homo Sapiens
SQVELFVKA

SEQ ID NO: 1178052 - protein, 9 aa, Homo Sapiens
KDYDFPPSM

SEQ ID NO: 1178053 - protein, 9 aa, Homo Sapiens
TAPSPRAGS

SEQ ID NO: 1178054 - protein, 9 aa, Homo Sapiens
DTFFITDGR

SEQ ID NO: 1178055 - protein, 9 aa, Homo Sapiens
SSGKGVRRL

SEQ ID NO: 1178056 - protein, 9 aa, Homo Sapiens
GHPCRCHRG

SEQ ID NO: 1178057 - protein, 9 aa, Homo Sapiens
PRPTHPLCT

SEQ ID NO: 1178058 - protein, 9 aa, Homo Sapiens
EASVIKERV

SEQ ID NO: 1178059 - protein, 9 aa, Homo Sapiens
ALSLEAHTC

SEQ ID NO: 1178060 - protein, 9 aa, Homo Sapiens
ARGLQVPVK

SEQ ID NO: 1178061 - protein, 9 aa, Homo Sapiens
RLHLPRLKD

SEQ ID NO: 1178062 - protein, 9 aa, Homo Sapiens
QVNHKDARA

SEQ ID NO: 1178063 - protein, 9 aa, Homo Sapiens
RSRAEKPTA

SEQ ID NO: 1178064 - protein, 9 aa, Homo Sapiens
QGAVARAAS

SEQ ID NO: 1178065 - protein, 9 aa, Homo Sapiens
GISWDSFWG

SEQ ID NO: 1178066 - protein, 9 aa, Homo Sapiens
NKSWLSAKC

SEQ ID NO: 1178067 - protein, 9 aa, Homo Sapiens
RSGTGGQGV

SEQ ID NO: 1178068 - protein, 9 aa, Homo Sapiens
PKEAAGDVS

SEQ ID NO: 1178069 - protein, 9 aa, Homo Sapiens
LFFCGAANC

SEQ ID NO: 1178070 - protein, 9 aa, Homo Sapiens
RLALSPAPQ

SEQ ID NO: 1178071 - protein, 9 aa, Homo Sapiens
QGGLPTSGS

SEQ ID NO: 1178072 - protein, 9 aa, Homo Sapiens
VHSSMTPNT

SEQ ID NO: 1178073 - protein, 9 aa, Homo Sapiens
HSAGLSPGA

SEQ ID NO: 1178074 - protein, 9 aa, Homo Sapiens
DVCDFIDNL

SEQ ID NO: 1178075 - protein, 9 aa, Homo Sapiens
IPVAEIKSL

SEQ ID NO: 1178076 - protein, 9 aa, Homo Sapiens
PCPQTPCWG

SEQ ID NO: 1178077 - protein, 9 aa, Homo Sapiens
YYATYCHTQ

SEQ ID NO: 1178078 - protein, 9 aa, Homo Sapiens
FPSRNCSLS

SEQ ID NO: 1178079 - protein, 9 aa, Homo Sapiens
ETMGTLAPW

SEQ ID NO: 1178080 - protein, 9 aa, Homo Sapiens
NRMCAYVRR

SEQ ID NO: 1178081 - protein, 9 aa, Homo Sapiens
REKRGTHPE

SEQ ID NO: 1178082 - protein, 9 aa, Homo Sapiens
CGSTPPPPP

SEQ ID NO: 1178083 - protein, 9 aa, Homo Sapiens
KRLFIEHPE

SEQ ID NO: 1178084 - protein, 9 aa, Homo Sapiens
GFIRYGWHW

SEQ ID NO: 1178085 - protein, 9 aa, Homo Sapiens
SRLGSRMFW

SEQ ID NO: 1178086 - protein, 9 aa, Homo Sapiens
KTLKMIRRG

SEQ ID NO: 1178087 - protein, 9 aa, Homo Sapiens
RVRPRERSY

SEQ ID NO: 1178088 - protein, 9 aa, Homo Sapiens
GAMNARGIP

SEQ ID NO: 1178089 - protein, 9 aa, Homo Sapiens
EKMMQLGGR

SEQ ID NO: 1178090 - protein, 9 aa, Homo Sapiens
QWSPSILAA

SEQ ID NO: 1178091 - protein, 9 aa, Homo Sapiens
RVTRSGLKK

SEQ ID NO: 1178092 - protein, 9 aa, Homo Sapiens
GVPFAPCPP

SEQ ID NO: 1178093 - protein, 9 aa, Homo Sapiens
KQVYLLLLN

SEQ ID NO: 1178094 - protein, 9 aa, Homo Sapiens
PSAHFQRPP

SEQ ID NO: 1178095 - protein, 9 aa, Homo Sapiens
VRRREREKA

SEQ ID NO: 1178096 - protein, 9 aa, Homo Sapiens
YSAPHTETA

SEQ ID NO: 1178097 - protein, 9 aa, Homo Sapiens
AEKELKVVD

SEQ ID NO: 1178098 - protein, 9 aa, Homo Sapiens
DTDGTPHPA

SEQ ID NO: 1178099 - protein, 9 aa, Homo Sapiens
CAASERLQA

SEQ ID NO: 1178100 - protein, 9 aa, Homo Sapiens
MSLPRLTGA

SEQ ID NO: 1178101 - protein, 9 aa, Homo Sapiens
PPCGGRPSG

SEQ ID NO: 1178102 - protein, 9 aa, Homo Sapiens
LQGGTRVIF

SEQ ID NO: 1178103 - protein, 9 aa, Homo Sapiens
FESIVKKQI

SEQ ID NO: 1178104 - protein, 9 aa, Homo Sapiens
CWYFPPPPC

SEQ ID NO: 1178105 - protein, 9 aa, Homo Sapiens
AFNWHHGVF

SEQ ID NO: 1178106 - protein, 9 aa, Homo Sapiens
GATWSSSTR

SEQ ID NO: 1178107 - protein, 9 aa, Homo Sapiens
KSYRLKHSL

SEQ ID NO: 1178108 - protein, 9 aa, Homo Sapiens
EQFNAFLGC

SEQ ID NO: 1178109 - protein, 9 aa, Homo Sapiens
RSWGCTSLR

SEQ ID NO: 1178110 - protein, 9 aa, Homo Sapiens
MSFLGMSLC

SEQ ID NO: 1178111 - protein, 9 aa, Homo Sapiens
GRSRTSTSA

SEQ ID NO: 1178112 - protein, 9 aa, Homo Sapiens
STHDKAITL

SEQ ID NO: 1178113 - protein, 9 aa, Homo Sapiens
GYNIYGIES

SEQ ID NO: 1178114 - protein, 9 aa, Homo Sapiens
GRFRSSGLS

SEQ ID NO: 1178115 - protein, 9 aa, Homo Sapiens
QRCVQRCVQ

SEQ ID NO: 1178116 - protein, 9 aa, Homo Sapiens
QLLNEADHA

SEQ ID NO: 1178117 - protein, 9 aa, Homo Sapiens
CPSYLHSHG

SEQ ID NO: 1178118 - protein, 9 aa, Homo Sapiens
KGVLDDSER

SEQ ID NO: 1178119 - protein, 9 aa, Homo Sapiens
PSAPPQGFR

SEQ ID NO: 1178120 - protein, 9 aa, Homo Sapiens
VNSPPPSPP

SEQ ID NO: 1178121 - protein, 9 aa, Homo Sapiens
CRLFYKDML

SEQ ID NO: 1178122 - protein, 9 aa, Homo Sapiens
GAWWGDRAS

SEQ ID NO: 1178123 - protein, 9 aa, Homo Sapiens
VVEQVVTSA

SEQ ID NO: 1178124 - protein, 9 aa, Homo Sapiens
IAQHRFGDD

SEQ ID NO: 1178125 - protein, 9 aa, Homo Sapiens
DKEPEVVFL

SEQ ID NO: 1178126 - protein, 9 aa, Homo Sapiens
STRDSLTPT

SEQ ID NO: 1178127 - protein, 9 aa, Homo Sapiens
APPTPTSPR

SEQ ID NO: 1178128 - protein, 9 aa, Homo Sapiens
SSKVPIMEC

SEQ ID NO: 1178129 - protein, 9 aa, Homo Sapiens
DAGCAIGAR

SEQ ID NO: 1178130 - protein, 9 aa, Homo Sapiens
AWSRGAARP

SEQ ID NO: 1178131 - protein, 9 aa, Homo Sapiens
RLPAGTRRS

SEQ ID NO: 1178132 - protein, 9 aa, Homo Sapiens
KTPTFSLKE

SEQ ID NO: 1178133 - protein, 9 aa, Homo Sapiens
PLEVQNIPD

SEQ ID NO: 1178134 - protein, 9 aa, Homo Sapiens
ASLQPKTAP

SEQ ID NO: 1178135 - protein, 9 aa, Homo Sapiens
SDSTMLIHS

SEQ ID NO: 1178136 - protein, 9 aa, Homo Sapiens
RSIQDFKLV

SEQ ID NO: 1178137 - protein, 9 aa, Homo Sapiens
LQDHDQSQA

SEQ ID NO: 1178138 - protein, 9 aa, Homo Sapiens
RWTCCVPSC

SEQ ID NO: 1178139 - protein, 9 aa, Homo Sapiens
QSILSDLRV

SEQ ID NO: 1178140 - protein, 9 aa, Homo Sapiens
PPQPGNQRS

SEQ ID NO: 1178141 - protein, 9 aa, Homo Sapiens
SVTAMQCRK

SEQ ID NO: 1178142 - protein, 9 aa, Homo Sapiens
GRARTRGQA

SEQ ID NO: 1178143 - protein, 9 aa, Homo Sapiens
RRVQPIKLA

SEQ ID NO: 1178144 - protein, 9 aa, Homo Sapiens
SKTPPTNAL

SEQ ID NO: 1178145 - protein, 9 aa, Homo Sapiens
CSPVARLTW

SEQ ID NO: 1178146 - protein, 9 aa, Homo Sapiens
SGESHLQHS

SEQ ID NO: 1178147 - protein, 9 aa, Homo Sapiens
QLVLTSDSW

SEQ ID NO: 1178148 - protein, 9 aa, Homo Sapiens
LPLSPSVAL

SEQ ID NO: 1178149 - protein, 9 aa, Homo Sapiens
RQNGGSGRR

SEQ ID NO: 1178150 - protein, 9 aa, Homo Sapiens
HPAPPPSSL

SEQ ID NO: 1178151 - protein, 9 aa, Homo Sapiens
KAFIPGLPA

SEQ ID NO: 1178152 - protein, 9 aa, Homo Sapiens
IPAKLVQSI

SEQ ID NO: 1178153 - protein, 9 aa, Homo Sapiens
ALPLRCPRA

SEQ ID NO: 1178154 - protein, 9 aa, Homo Sapiens
PKARRKCYI

SEQ ID NO: 1178155 - protein, 9 aa, Homo Sapiens
IHPQWVLTT

SEQ ID NO: 1178156 - protein, 9 aa, Homo Sapiens
ETRGAAAKR

SEQ ID NO: 1178157 - protein, 9 aa, Homo Sapiens
NIDWETSHV

SEQ ID NO: 1178158 - protein, 9 aa, Homo Sapiens
WARARAATR

SEQ ID NO: 1178159 - protein, 9 aa, Homo Sapiens
RLKASLPPS

SEQ ID NO: 1178160 - protein, 9 aa, Homo Sapiens
LRERGPPSH

SEQ ID NO: 1178161 - protein, 9 aa, Homo Sapiens
HRSSSGHSS

SEQ ID NO: 1178162 - protein, 9 aa, Homo Sapiens
VFFGPCSPC

SEQ ID NO: 1178163 - protein, 9 aa, Homo Sapiens
ENTTYFEFF

SEQ ID NO: 1178164 - protein, 9 aa, Homo Sapiens
AKTSGLMWA

SEQ ID NO: 1178165 - protein, 9 aa, Homo Sapiens
QVYVNRSLT

SEQ ID NO: 1178166 - protein, 9 aa, Homo Sapiens
ELDAPEGKE

SEQ ID NO: 1178167 - protein, 9 aa, Homo Sapiens
QGAPPRSPL

SEQ ID NO: 1178168 - protein, 9 aa, Homo Sapiens
TQQGPRLWA

SEQ ID NO: 1178169 - protein, 9 aa, Homo Sapiens
AACPPGAPR

SEQ ID NO: 1178170 - protein, 9 aa, Homo Sapiens
TMHAINGKI

SEQ ID NO: 1178171 - protein, 9 aa, Homo Sapiens
PSDMLRDSG

SEQ ID NO: 1178172 - protein, 9 aa, Homo Sapiens
CVPPEDAER

SEQ ID NO: 1178173 - protein, 9 aa, Homo Sapiens
VQLPRRSSL

SEQ ID NO: 1178174 - protein, 9 aa, Homo Sapiens
DQGPRSTLA

SEQ ID NO: 1178175 - protein, 9 aa, Homo Sapiens
HRVLAGEGA

SEQ ID NO: 1178176 - protein, 9 aa, Homo Sapiens
CWALRFQRL

SEQ ID NO: 1178177 - protein, 9 aa, Homo Sapiens
EPRHCIEFR

SEQ ID NO: 1178178 - protein, 9 aa, Homo Sapiens
PQWAAWRRR

SEQ ID NO: 1178179 - protein, 9 aa, Homo Sapiens
LGIYLVTVL

SEQ ID NO: 1178180 - protein, 9 aa, Homo Sapiens
SIGRARTRG

SEQ ID NO: 1178181 - protein, 9 aa, Homo Sapiens
KQTVMVLPG

SEQ ID NO: 1178182 - protein, 9 aa, Homo Sapiens
PPAPPRRTL

SEQ ID NO: 1178183 - protein, 9 aa, Homo Sapiens
KNDTKENNM

SEQ ID NO: 1178184 - protein, 9 aa, Homo Sapiens
SWGQILLLG

SEQ ID NO: 1178185 - protein, 9 aa, Homo Sapiens
WPSCPIPRR

SEQ ID NO: 1178186 - protein, 9 aa, Homo Sapiens
VHDFTNAVI

SEQ ID NO: 1178187 - protein, 9 aa, Homo Sapiens
WAGFLNEIA

SEQ ID NO: 1178188 - protein, 9 aa, Homo Sapiens
ESLYPEVTP

SEQ ID NO: 1178189 - protein, 9 aa, Homo Sapiens
QARDMLGGM

SEQ ID NO: 1178190 - protein, 9 aa, Homo Sapiens
YDRVTGVSF

SEQ ID NO: 1178191 - protein, 9 aa, Homo Sapiens
RQFRPPWIE

SEQ ID NO: 1178192 - protein, 9 aa, Homo Sapiens
FPPCGGCPS

SEQ ID NO: 1178193 - protein, 9 aa, Homo Sapiens
DWYHTLHPA

SEQ ID NO: 1178194 - protein, 9 aa, Homo Sapiens
PTPTPRPIR

SEQ ID NO: 1178195 - protein, 9 aa, Homo Sapiens
CSSHQGLMG

SEQ ID NO: 1178196 - protein, 9 aa, Homo Sapiens
QASHSHSGD

SEQ ID NO: 1178197 - protein, 9 aa, Homo Sapiens
LELERLREL

SEQ ID NO: 1178198 - protein, 9 aa, Homo Sapiens
GTSVVKRRC

SEQ ID NO: 1178199 - protein, 9 aa, Homo Sapiens
FSKAKLVAL

SEQ ID NO: 1178200 - protein, 9 aa, Homo Sapiens
GALDEDAPV

SEQ ID NO: 1178201 - protein, 9 aa, Homo Sapiens
LVGGMWAAM

SEQ ID NO: 1178202 - protein, 9 aa, Homo Sapiens
ATCWLCTAR

SEQ ID NO: 1178203 - protein, 9 aa, Homo Sapiens
GVFIYEMAV

SEQ ID NO: 1178204 - protein, 9 aa, Homo Sapiens
PTTENTPET

SEQ ID NO: 1178205 - protein, 9 aa, Homo Sapiens
GRPRMSLMP

SEQ ID NO: 1178206 - protein, 9 aa, Homo Sapiens
LKRLFIEHP

SEQ ID NO: 1178207 - protein, 9 aa, Homo Sapiens
EIIGKVEKV

SEQ ID NO: 1178208 - protein, 9 aa, Homo Sapiens
ASRTTLSSG

SEQ ID NO: 1178209 - protein, 9 aa, Homo Sapiens
GTNYTLRYA

SEQ ID NO: 1178210 - protein, 9 aa, Homo Sapiens
PRPHASPTS

SEQ ID NO: 1178211 - protein, 9 aa, Homo Sapiens
KSVWQRRRR

SEQ ID NO: 1178212 - protein, 9 aa, Homo Sapiens
EIISLKISL

SEQ ID NO: 1178213 - protein, 9 aa, Homo Sapiens
KRLTVPYAG

SEQ ID NO: 1178214 - protein, 9 aa, Homo Sapiens
GRGGAHRSP

SEQ ID NO: 1178215 - protein, 9 aa, Homo Sapiens
TTLPQWKQS

SEQ ID NO: 1178216 - protein, 9 aa, Homo Sapiens
SIVILQDCP

SEQ ID NO: 1178217 - protein, 9 aa, Homo Sapiens
ALRAVGTQI

SEQ ID NO: 1178218 - protein, 9 aa, Homo Sapiens
TVVRPGNTA

SEQ ID NO: 1178219 - protein, 9 aa, Homo Sapiens
PPSCSGARA

SEQ ID NO: 1178220 - protein, 9 aa, Homo Sapiens
SGSCAPRPP

SEQ ID NO: 1178221 - protein, 9 aa, Homo Sapiens
VDANRSWKV

SEQ ID NO: 1178222 - protein, 9 aa, Homo Sapiens
HAHHPGRAG

SEQ ID NO: 1178223 - protein, 9 aa, Homo Sapiens
AAAAAREEP

SEQ ID NO: 1178224 - protein, 9 aa, Homo Sapiens
GSDTDIWKT

SEQ ID NO: 1178225 - protein, 9 aa, Homo Sapiens
EGNLSMEDF

SEQ ID NO: 1178226 - protein, 9 aa, Homo Sapiens
VYDSVQIIS

SEQ ID NO: 1178227 - protein, 9 aa, Homo Sapiens
RRPTARSRP

SEQ ID NO: 1178228 - protein, 9 aa, Homo Sapiens
RVLLLPVLV

SEQ ID NO: 1178229 - protein, 9 aa, Homo Sapiens
AFQAPPSCL

SEQ ID NO: 1178230 - protein, 9 aa, Homo Sapiens
TSCPESFAI

SEQ ID NO: 1178231 - protein, 9 aa, Homo Sapiens
PSCCGCSGV

SEQ ID NO: 1178232 - protein, 9 aa, Homo Sapiens
CPSGKSACP

SEQ ID NO: 1178233 - protein, 9 aa, Homo Sapiens
DTCVESSMT

SEQ ID NO: 1178234 - protein, 9 aa, Homo Sapiens
WRICSTTSR

SEQ ID NO: 1178235 - protein, 9 aa, Homo Sapiens
FYLEQCETN

SEQ ID NO: 1178236 - protein, 9 aa, Homo Sapiens
WTPRKLVGR

SEQ ID NO: 1178237 - protein, 9 aa, Homo Sapiens
LDQDINTTK

SEQ ID NO: 1178238 - protein, 9 aa, Homo Sapiens
DWCLLQAPD

SEQ ID NO: 1178239 - protein, 9 aa, Homo Sapiens
GSSIEHPDH

SEQ ID NO: 1178240 - protein, 9 aa, Homo Sapiens
LSIEEIEAA

SEQ ID NO: 1178241 - protein, 9 aa, Homo Sapiens
ATRQPPPAF

SEQ ID NO: 1178242 - protein, 9 aa, Homo Sapiens
TESRESQMA

SEQ ID NO: 1178243 - protein, 9 aa, Homo Sapiens
SISRESPWE

SEQ ID NO: 1178244 - protein, 9 aa, Homo Sapiens
IFLDTLVRL

SEQ ID NO: 1178245 - protein, 9 aa, Homo Sapiens
PPCGGGPSG

SEQ ID NO: 1178246 - protein, 9 aa, Homo Sapiens
PEDGRAPRQ

SEQ ID NO: 1178247 - protein, 9 aa, Homo Sapiens
RWGPNCSLS

SEQ ID NO: 1178248 - protein, 9 aa, Homo Sapiens
CQGAWCFSC

SEQ ID NO: 1178249 - protein, 9 aa, Homo Sapiens
WHWLITWGR

SEQ ID NO: 1178250 - protein, 9 aa, Homo Sapiens
APDTQAYGH

SEQ ID NO: 1178251 - protein, 9 aa, Homo Sapiens
WPSWGWGWA

SEQ ID NO: 1178252 - protein, 9 aa, Homo Sapiens
RVPDTHVTL

SEQ ID NO: 1178253 - protein, 9 aa, Homo Sapiens
RIYDHWVKK

SEQ ID NO: 1178254 - protein, 9 aa, Homo Sapiens
ELEHARSEA

SEQ ID NO: 1178255 - protein, 9 aa, Homo Sapiens
SSHSPRRSS

SEQ ID NO: 1178256 - protein, 9 aa, Homo Sapiens
PDTKGSPID

SEQ ID NO: 1178257 - protein, 9 aa, Homo Sapiens
HWLRASSVV

SEQ ID NO: 1178258 - protein, 9 aa, Homo Sapiens
VLRRCLCTG

SEQ ID NO: 1178259 - protein, 9 aa, Homo Sapiens
SVSIGQRPV

SEQ ID NO: 1178260 - protein, 9 aa, Homo Sapiens
SFLLIPTLS

SEQ ID NO: 1178261 - protein, 9 aa, Homo Sapiens
VSWPSRLGS

SEQ ID NO: 1178262 - protein, 9 aa, Homo Sapiens
GTAAAEASQ

SEQ ID NO: 1178263 - protein, 9 aa, Homo Sapiens
LSENCVYDS

SEQ ID NO: 1178264 - protein, 9 aa, Homo Sapiens
YELVVTVRD

SEQ ID NO: 1178265 - protein, 9 aa, Homo Sapiens
SSPCRRKRI

SEQ ID NO: 1178266 - protein, 9 aa, Homo Sapiens
FINDTTDVN

SEQ ID NO: 1178267 - protein, 9 aa, Homo Sapiens
VSPPQAAGA

SEQ ID NO: 1178268 - protein, 9 aa, Homo Sapiens
KLYHSLVMC

SEQ ID NO: 1178269 - protein, 9 aa, Homo Sapiens
LSEKVVDAW

SEQ ID NO: 1178270 - protein, 9 aa, Homo Sapiens
EAPSTRAAP

SEQ ID NO: 1178271 - protein, 9 aa, Homo Sapiens
KGIQKYFVV

SEQ ID NO: 1178272 - protein, 9 aa, Homo Sapiens
WSTLWPPAQ

SEQ ID NO: 1178273 - protein, 9 aa, Homo Sapiens
CLYRLRVLG

SEQ ID NO: 1178274 - protein, 9 aa, Homo Sapiens
PRHPPPHPP

SEQ ID NO: 1178275 - protein, 9 aa, Homo Sapiens
VMPLLLIVA

SEQ ID NO: 1178276 - protein, 9 aa, Homo Sapiens
SRTSGGPGA

SEQ ID NO: 1178277 - protein, 9 aa, Homo Sapiens
AEKLSATIV

SEQ ID NO: 1178278 - protein, 9 aa, Homo Sapiens
VGSVHRMVT

SEQ ID NO: 1178279 - protein, 9 aa, Homo Sapiens
FGVVTTRYR

SEQ ID NO: 1178280 - protein, 9 aa, Homo Sapiens
ASGRRREGD

SEQ ID NO: 1178281 - protein, 9 aa, Homo Sapiens
EAGQQHPLL

SEQ ID NO: 1178282 - protein, 9 aa, Homo Sapiens
RLGGEQRKR

SEQ ID NO: 1178283 - protein, 9 aa, Homo Sapiens
GIYLVTVLG

SEQ ID NO: 1178284 - protein, 9 aa, Homo Sapiens
PPHTHPLCP

SEQ ID NO: 1178285 - protein, 9 aa, Homo Sapiens
MELLPTHTF

SEQ ID NO: 1178286 - protein, 9 aa, Homo Sapiens
ARHMLEKKN

SEQ ID NO: 1178287 - protein, 9 aa, Homo Sapiens
DFELPQAVY

SEQ ID NO: 1178288 - protein, 9 aa, Homo Sapiens
TILKTCSLD

SEQ ID NO: 1178289 - protein, 9 aa, Homo Sapiens
DALWTEARE

SEQ ID NO: 1178290 - protein, 9 aa, Homo Sapiens
NEVDFAINI

SEQ ID NO: 1178291 - protein, 9 aa, Homo Sapiens
PSRASAGAV

SEQ ID NO: 1178292 - protein, 9 aa, Homo Sapiens
NTMHAINGK

SEQ ID NO: 1178293 - protein, 9 aa, Homo Sapiens
QDSRGSRET

SEQ ID NO: 1178294 - protein, 9 aa, Homo Sapiens
AAFRAQAPR

SEQ ID NO: 1178295 - protein, 9 aa, Homo Sapiens
HAEKLSATI

SEQ ID NO: 1178296 - protein, 9 aa, Homo Sapiens
PRRPGAAGH

SEQ ID NO: 1178297 - protein, 9 aa, Homo Sapiens
ISGSEATSQ

SEQ ID NO: 1178298 - protein, 9 aa, Homo Sapiens
STVQLPRRS

SEQ ID NO: 1178299 - protein, 9 aa, Homo Sapiens
NLGPLETPA

SEQ ID NO: 1178300 - protein, 9 aa, Homo Sapiens
DHRTSQNHS

SEQ ID NO: 1178301 - protein, 9 aa, Homo Sapiens
LHNPRPGRL

SEQ ID NO: 1178302 - protein, 9 aa, Homo Sapiens
TTAAGIVQN

SEQ ID NO: 1178303 - protein, 9 aa, Homo Sapiens
RGPEVNAGG

SEQ ID NO: 1178304 - protein, 9 aa, Homo Sapiens
PTAPRPGSP

SEQ ID NO: 1178305 - protein, 9 aa, Homo Sapiens
RNLSPPTDL

SEQ ID NO: 1178306 - protein, 9 aa, Homo Sapiens
PSPRAGSRR

SEQ ID NO: 1178307 - protein, 9 aa, Homo Sapiens
PNTGITVFL

SEQ ID NO: 1178308 - protein, 9 aa, Homo Sapiens
SPPRCTSSA

SEQ ID NO: 1178309 - protein, 9 aa, Homo Sapiens
GGVRRRRRP

SEQ ID NO: 1178310 - protein, 9 aa, Homo Sapiens
NEAETRSTL

SEQ ID NO: 1178311 - protein, 9 aa, Homo Sapiens
LTPKQVDTW

SEQ ID NO: 1178312 - protein, 9 aa, Homo Sapiens
GWIKKSSGA

SEQ ID NO: 1178313 - protein, 9 aa, Homo Sapiens
CCGLFLALL

SEQ ID NO: 1178314 - protein, 9 aa, Homo Sapiens
LQHSFLVPS

SEQ ID NO: 1178315 - protein, 9 aa, Homo Sapiens
GAASCTETA

SEQ ID NO: 1178316 - protein, 9 aa, Homo Sapiens
DFSKELKKL

SEQ ID NO: 1178317 - protein, 9 aa, Homo Sapiens
TPAGFNCKD

SEQ ID NO: 1178318 - protein, 9 aa, Homo Sapiens
PQPPPPPGS

SEQ ID NO: 1178319 - protein, 9 aa, Homo Sapiens
RRMKLRSWL

SEQ ID NO: 1178320 - protein, 9 aa, Homo Sapiens
SCIKISLIF

SEQ ID NO: 1178321 - protein, 9 aa, Homo Sapiens
TENTPETVV

SEQ ID NO: 1178322 - protein, 9 aa, Homo Sapiens
PGFPSRNCS

SEQ ID NO: 1178323 - protein, 9 aa, Homo Sapiens
KKKSVWQRR

SEQ ID NO: 1178324 - protein, 9 aa, Homo Sapiens
LNRIILVPM

SEQ ID NO: 1178325 - protein, 9 aa, Homo Sapiens
KNGHHVLGL

SEQ ID NO: 1178326 - protein, 9 aa, Homo Sapiens
CRRRRCCGC

SEQ ID NO: 1178327 - protein, 9 aa, Homo Sapiens
LKENQRGCF

SEQ ID NO: 1178328 - protein, 9 aa, Homo Sapiens
WMFAKIFNQ

SEQ ID NO: 1178329 - protein, 9 aa, Homo Sapiens
RAGRHHCPP

SEQ ID NO: 1178330 - protein, 9 aa, Homo Sapiens
SRARQSCCL

SEQ ID NO: 1178331 - protein, 9 aa, Homo Sapiens
GPAAAPRGP

SEQ ID NO: 1178332 - protein, 9 aa, Homo Sapiens
YILVRIFSL

SEQ ID NO: 1178333 - protein, 9 aa, Homo Sapiens
ARLAKVVSL

SEQ ID NO: 1178334 - protein, 9 aa, Homo Sapiens
AGDVSDQST

SEQ ID NO: 1178335 - protein, 9 aa, Homo Sapiens
ACPDDQGGA

SEQ ID NO: 1178336 - protein, 9 aa, Homo Sapiens
VVGPHPLVA

SEQ ID NO: 1178337 - protein, 9 aa, Homo Sapiens
SMRYFLVKR

SEQ ID NO: 1178338 - protein, 9 aa, Homo Sapiens
TTFDDCLYA

SEQ ID NO: 1178339 - protein, 9 aa, Homo Sapiens
RRRCSISRA

SEQ ID NO: 1178340 - protein, 9 aa, Homo Sapiens
RASSVVPRM

SEQ ID NO: 1178341 - protein, 9 aa, Homo Sapiens
FSVTSAWKN

SEQ ID NO: 1178342 - protein, 9 aa, Homo Sapiens
QLKTKERMG

SEQ ID NO: 1178343 - protein, 9 aa, Homo Sapiens
IRLCTHIKE

SEQ ID NO: 1178344 - protein, 9 aa, Homo Sapiens
VPPPFGTMP

SEQ ID NO: 1178345 - protein, 9 aa, Homo Sapiens
GLKPRARDN

SEQ ID NO: 1178346 - protein, 9 aa, Homo Sapiens
DTMDDPDIV

SEQ ID NO: 1178347 - protein, 9 aa, Homo Sapiens
GAQEVQISW

SEQ ID NO: 1178348 - protein, 9 aa, Homo Sapiens
SKAMALQSN

SEQ ID NO: 1178349 - protein, 9 aa, Homo Sapiens
KPSSVTWSG

SEQ ID NO: 1178350 - protein, 9 aa, Homo Sapiens
LPPPPPTPM

SEQ ID NO: 1178351 - protein, 9 aa, Homo Sapiens
THSALSSAS

SEQ ID NO: 1178352 - protein, 9 aa, Homo Sapiens
YHTASLGTG

SEQ ID NO: 1178353 - protein, 9 aa, Homo Sapiens
GGGGVRWGW

SEQ ID NO: 1178354 - protein, 9 aa, Homo Sapiens
SGQCQVWVL

SEQ ID NO: 1178355 - protein, 9 aa, Homo Sapiens
FATGSEWRQ

SEQ ID NO: 1178356 - protein, 9 aa, Homo Sapiens
GKPLYWGVD

SEQ ID NO: 1178357 - protein, 9 aa, Homo Sapiens
SAVNGLGSG

SEQ ID NO: 1178358 - protein, 9 aa, Homo Sapiens
YNLSCKLHT

SEQ ID NO: 1178359 - protein, 9 aa, Homo Sapiens
PVVVVAAIV

SEQ ID NO: 1178360 - protein, 9 aa, Homo Sapiens
VHGGGEGGP

SEQ ID NO: 1178361 - protein, 9 aa, Homo Sapiens
TAVPVELRR

SEQ ID NO: 1178362 - protein, 9 aa, Homo Sapiens
HMVSEGGPE

SEQ ID NO: 1178363 - protein, 9 aa, Homo Sapiens
RMSRQPSAT

SEQ ID NO: 1178364 - protein, 9 aa, Homo Sapiens
RSPGHGGRP

SEQ ID NO: 1178365 - protein, 9 aa, Homo Sapiens
TTTPSANTA

SEQ ID NO: 1178366 - protein, 9 aa, Homo Sapiens
WTCCVPSCS

SEQ ID NO: 1178367 - protein, 9 aa, Homo Sapiens
EYGAKQGRQ

SEQ ID NO: 1178368 - protein, 9 aa, Homo Sapiens
GCPTQAPPY

SEQ ID NO: 1178369 - protein, 9 aa, Homo Sapiens
IWFAYHFFC

SEQ ID NO: 1178370 - protein, 9 aa, Homo Sapiens
SCPESFAIY

SEQ ID NO: 1178371 - protein, 9 aa, Homo Sapiens
AQRVGETRA

SEQ ID NO: 1178372 - protein, 9 aa, Homo Sapiens
MLNARLAKV

SEQ ID NO: 1178373 - protein, 9 aa, Homo Sapiens
RLLFTGTPV

SEQ ID NO: 1178374 - protein, 9 aa, Homo Sapiens
PRTPLFPLL

SEQ ID NO: 1178375 - protein, 9 aa, Homo Sapiens
REKIMKLSL

SEQ ID NO: 1178376 - protein, 9 aa, Homo Sapiens
ASAGAVRPG

SEQ ID NO: 1178377 - protein, 9 aa, Homo Sapiens
TGRPRMSLM

SEQ ID NO: 1178378 - protein, 9 aa, Homo Sapiens
DSSSGKSVV

SEQ ID NO: 1178379 - protein, 9 aa, Homo Sapiens
GALRSAKSE

SEQ ID NO: 1178380 - protein, 9 aa, Homo Sapiens
DHPEDQDKM

SEQ ID NO: 1178381 - protein, 9 aa, Homo Sapiens
FLKGNCTNK

SEQ ID NO: 1178382 - protein, 9 aa, Homo Sapiens
RSQELVCIV

SEQ ID NO: 1178383 - protein, 9 aa, Homo Sapiens
QVLVDAVVQ

SEQ ID NO: 1178384 - protein, 9 aa, Homo Sapiens
IPWFMEICL

SEQ ID NO: 1178385 - protein, 9 aa, Homo Sapiens
MSGVPLRSW

SEQ ID NO: 1178386 - protein, 9 aa, Homo Sapiens
DWSFLQFMM

SEQ ID NO: 1178387 - protein, 9 aa, Homo Sapiens
PRACAASER

SEQ ID NO: 1178388 - protein, 9 aa, Homo Sapiens
TVDLELDAP

SEQ ID NO: 1178389 - protein, 9 aa, Homo Sapiens
PDTRACNLC

SEQ ID NO: 1178390 - protein, 9 aa, Homo Sapiens
DIIKNDGAL

SEQ ID NO: 1178391 - protein, 9 aa, Homo Sapiens
PCPPGRGLP

SEQ ID NO: 1178392 - protein, 9 aa, Homo Sapiens
QHTTEVVRR

SEQ ID NO: 1178393 - protein, 9 aa, Homo Sapiens
GVWASGKWE

SEQ ID NO: 1178394 - protein, 9 aa, Homo Sapiens
PRPGLPGKA

SEQ ID NO: 1178395 - protein, 9 aa, Homo Sapiens
DNNAGTNYT

SEQ ID NO: 1178396 - protein, 9 aa, Homo Sapiens
ERASRTLYH

SEQ ID NO: 1178397 - protein, 9 aa, Homo Sapiens
GHRSASPGP

SEQ ID NO: 1178398 - protein, 9 aa, Homo Sapiens
SHSDTRPFA

SEQ ID NO: 1178399 - protein, 9 aa, Homo Sapiens
APLNSWRSG

SEQ ID NO: 1178400 - protein, 9 aa, Homo Sapiens
RCCLRTSCG

SEQ ID NO: 1178401 - protein, 9 aa, Homo Sapiens
THVTLQQVI

SEQ ID NO: 1178402 - protein, 9 aa, Homo Sapiens
RLPRKEENQ

SEQ ID NO: 1178403 - protein, 9 aa, Homo Sapiens
VDIPSIQIL

SEQ ID NO: 1178404 - protein, 9 aa, Homo Sapiens
VRKPLGPRP

SEQ ID NO: 1178405 - protein, 9 aa, Homo Sapiens
LEHARSEAG

SEQ ID NO: 1178406 - protein, 9 aa, Homo Sapiens
ELWNQGTGL

SEQ ID NO: 1178407 - protein, 9 aa, Homo Sapiens
EKVRPRKVP

SEQ ID NO: 1178408 - protein, 9 aa, Homo Sapiens
SGGRGISSH

SEQ ID NO: 1178409 - protein, 9 aa, Homo Sapiens
AVQAGRGTS

SEQ ID NO: 1178410 - protein, 9 aa, Homo Sapiens
PWDQFVPPA

SEQ ID NO: 1178411 - protein, 9 aa, Homo Sapiens
WEVMPRTLE

SEQ ID NO: 1178412 - protein, 9 aa, Homo Sapiens
QTWTRLPRR

SEQ ID NO: 1178413 - protein, 9 aa, Homo Sapiens
VMPQYHSSV

SEQ ID NO: 1178414 - protein, 9 aa, Homo Sapiens
GSQSGTKMK

SEQ ID NO: 1178415 - protein, 9 aa, Homo Sapiens
PEGKELMQD

SEQ ID NO: 1178416 - protein, 9 aa, Homo Sapiens
RLGWASGRI

SEQ ID NO: 1178417 - protein, 9 aa, Homo Sapiens
CKATIPIFF

SEQ ID NO: 1178418 - protein, 9 aa, Homo Sapiens
QNGCVGALL

SEQ ID NO: 1178419 - protein, 9 aa, Homo Sapiens
THPSPSPTW

SEQ ID NO: 1178420 - protein, 9 aa, Homo Sapiens
PRPGPLAGP

SEQ ID NO: 1178421 - protein, 9 aa, Homo Sapiens
KLQKKIWES

SEQ ID NO: 1178422 - protein, 9 aa, Homo Sapiens
THVPLRPGG

SEQ ID NO: 1178423 - protein, 9 aa, Homo Sapiens
STPRGRTSG

SEQ ID NO: 1178424 - protein, 9 aa, Homo Sapiens
DPECTQLLP

SEQ ID NO: 1178425 - protein, 9 aa, Homo Sapiens
SLAPPPREH

SEQ ID NO: 1178426 - protein, 9 aa, Homo Sapiens
NEVLLSLMS

SEQ ID NO: 1178427 - protein, 9 aa, Homo Sapiens
YKILVLHLF

SEQ ID NO: 1178428 - protein, 9 aa, Homo Sapiens
VPLPPPPVT

SEQ ID NO: 1178429 - protein, 9 aa, Homo Sapiens
LCGDVHVQL

SEQ ID NO: 1178430 - protein, 9 aa, Homo Sapiens
GSCAPRPPS

SEQ ID NO: 1178431 - protein, 9 aa, Homo Sapiens
RHPPGRRRN

SEQ ID NO: 1178432 - protein, 9 aa, Homo Sapiens
KEENQAVKG

SEQ ID NO: 1178433 - protein, 9 aa, Homo Sapiens
MPKNYLRLT

SEQ ID NO: 1178434 - protein, 9 aa, Homo Sapiens
RLTPTSAGM

SEQ ID NO: 1178435 - protein, 9 aa, Homo Sapiens
GIKWQNFVE

SEQ ID NO: 1178436 - protein, 9 aa, Homo Sapiens
RSASSHDVD

SEQ ID NO: 1178437 - protein, 9 aa, Homo Sapiens
YETVMTFLR

SEQ ID NO: 1178438 - protein, 9 aa, Homo Sapiens
FSQPVYDAY

SEQ ID NO: 1178439 - protein, 9 aa, Homo Sapiens
IHILLCLKN

SEQ ID NO: 1178440 - protein, 9 aa, Homo Sapiens
LHPCPPGGP

SEQ ID NO: 1178441 - protein, 9 aa, Homo Sapiens
AGLSGRKAP

SEQ ID NO: 1178442 - protein, 9 aa, Homo Sapiens
PGSQGAARG

SEQ ID NO: 1178443 - protein, 9 aa, Homo Sapiens
RTRAVFNHT

SEQ ID NO: 1178444 - protein, 9 aa, Homo Sapiens
FKNNPEIVA

SEQ ID NO: 1178445 - protein, 9 aa, Homo Sapiens
RTFRSASHL

SEQ ID NO: 1178446 - protein, 9 aa, Homo Sapiens
PVAEIKSLP

SEQ ID NO: 1178447 - protein, 9 aa, Homo Sapiens
PAGPTSQLK

SEQ ID NO: 1178448 - protein, 9 aa, Homo Sapiens
AWGDWVASP

SEQ ID NO: 1178449 - protein, 9 aa, Homo Sapiens
AWPSSPCPT

SEQ ID NO: 1178450 - protein, 9 aa, Homo Sapiens
SAFAASTAS

SEQ ID NO: 1178451 - protein, 9 aa, Homo Sapiens
KAEQGSFEK

SEQ ID NO: 1178452 - protein, 9 aa, Homo Sapiens
LLKEFLHLG

SEQ ID NO: 1178453 - protein, 9 aa, Homo Sapiens
RESAAAVQA

SEQ ID NO: 1178454 - protein, 9 aa, Homo Sapiens
TRTEKLISP

SEQ ID NO: 1178455 - protein, 9 aa, Homo Sapiens
RTYPKKPGA

SEQ ID NO: 1178456 - protein, 9 aa, Homo Sapiens
SRATLARWA

SEQ ID NO: 1178457 - protein, 9 aa, Homo Sapiens
LSCIKISLI

SEQ ID NO: 1178458 - protein, 9 aa, Homo Sapiens
HAWNLRAWR

SEQ ID NO: 1178459 - protein, 9 aa, Homo Sapiens
EEIEAAPPK

SEQ ID NO: 1178460 - protein, 9 aa, Homo Sapiens
WTLYFYLCL

SEQ ID NO: 1178461 - protein, 9 aa, Homo Sapiens
TLYFYLCLA

SEQ ID NO: 1178462 - protein, 9 aa, Homo Sapiens
AAPRGPEQT

SEQ ID NO: 1178463 - protein, 9 aa, Homo Sapiens
KGANVNEKI

SEQ ID NO: 1178464 - protein, 9 aa, Homo Sapiens
KRREQRERR

SEQ ID NO: 1178465 - protein, 9 aa, Homo Sapiens
ARPMESRPG

SEQ ID NO: 1178466 - protein, 9 aa, Homo Sapiens
PVAETHDLF

SEQ ID NO: 1178467 - protein, 9 aa, Homo Sapiens
EQNQPEYKA

SEQ ID NO: 1178468 - protein, 9 aa, Homo Sapiens
ACCSLATCC

SEQ ID NO: 1178469 - protein, 9 aa, Homo Sapiens
ESKQLRKYL

SEQ ID NO: 1178470 - protein, 9 aa, Homo Sapiens
SGDPPVNYV

SEQ ID NO: 1178471 - protein, 9 aa, Homo Sapiens
VRHTEKKLK

SEQ ID NO: 1178472 - protein, 9 aa, Homo Sapiens
GGGWPGWRW

SEQ ID NO: 1178473 - protein, 9 aa, Homo Sapiens
ERPDIREKV

SEQ ID NO: 1178474 - protein, 9 aa, Homo Sapiens
SIREITWKN

SEQ ID NO: 1178475 - protein, 9 aa, Homo Sapiens
TTSKTLSDS

SEQ ID NO: 1178476 - protein, 9 aa, Homo Sapiens
QYCDTKSGS

SEQ ID NO: 1178477 - protein, 9 aa, Homo Sapiens
HPLCPPPSP

SEQ ID NO: 1178478 - protein, 9 aa, Homo Sapiens
AAQKCHKKT

SEQ ID NO: 1178479 - protein, 9 aa, Homo Sapiens
VTFTRALRP

SEQ ID NO: 1178480 - protein, 9 aa, Homo Sapiens
SASSCSLAS

SEQ ID NO: 1178481 - protein, 9 aa, Homo Sapiens
NSPGSLKIK

SEQ ID NO: 1178482 - protein, 9 aa, Homo Sapiens
TLIPETELC

SEQ ID NO: 1178483 - protein, 9 aa, Homo Sapiens
GLFCTIQYR

SEQ ID NO: 1178484 - protein, 9 aa, Homo Sapiens
KAGDGVGQA

SEQ ID NO: 1178485 - protein, 9 aa, Homo Sapiens
HTLGAHWLG

SEQ ID NO: 1178486 - protein, 9 aa, Homo Sapiens
SSSSPSKIH

SEQ ID NO: 1178487 - protein, 9 aa, Homo Sapiens
EKREELRKS

SEQ ID NO: 1178488 - protein, 9 aa, Homo Sapiens
ICFTMAVST

SEQ ID NO: 1178489 - protein, 9 aa, Homo Sapiens
FLPTLQSIT

SEQ ID NO: 1178490 - protein, 9 aa, Homo Sapiens
ESDRDLGVS

SEQ ID NO: 1178491 - protein, 9 aa, Homo Sapiens
QTSSVSFKS

SEQ ID NO: 1178492 - protein, 9 aa, Homo Sapiens
GGAHRSPGH

SEQ ID NO: 1178493 - protein, 9 aa, Homo Sapiens
SSSRGRIQT

SEQ ID NO: 1178494 - protein, 9 aa, Homo Sapiens
TTLTLMTGL

SEQ ID NO: 1178495 - protein, 9 aa, Homo Sapiens
LKKIHMSPD

SEQ ID NO: 1178496 - protein, 9 aa, Homo Sapiens
SPTLGTRSC

SEQ ID NO: 1178497 - protein, 9 aa, Homo Sapiens
NGQGSLPGS

SEQ ID NO: 1178498 - protein, 9 aa, Homo Sapiens
ETGKKRQSR

SEQ ID NO: 1178499 - protein, 9 aa, Homo Sapiens
SLSPPHPVL

SEQ ID NO: 1178500 - protein, 9 aa, Homo Sapiens
THKQLNMIQ

SEQ ID NO: 1178501 - protein, 9 aa, Homo Sapiens
KNQLTRDWK

SEQ ID NO: 1178502 - protein, 9 aa, Homo Sapiens
VFVHGLFLD

SEQ ID NO: 1178503 - protein, 9 aa, Homo Sapiens
SQNHTPTVR

SEQ ID NO: 1178504 - protein, 9 aa, Homo Sapiens
WMSLLERVL

SEQ ID NO: 1178505 - protein, 9 aa, Homo Sapiens
TTLPTVLRT

SEQ ID NO: 1178506 - protein, 9 aa, Homo Sapiens
LTRLSPESV

SEQ ID NO: 1178507 - protein, 9 aa, Homo Sapiens
QSPPSRVEA

SEQ ID NO: 1178508 - protein, 9 aa, Homo Sapiens
TVAAEACHE

SEQ ID NO: 1178509 - protein, 9 aa, Homo Sapiens
NSRHPPGRR

SEQ ID NO: 1178510 - protein, 9 aa, Homo Sapiens
GLASAASCS

SEQ ID NO: 1178511 - protein, 9 aa, Homo Sapiens
TMPCTYLQI

SEQ ID NO: 1178512 - protein, 9 aa, Homo Sapiens
PCPPTGSMP

SEQ ID NO: 1178513 - protein, 9 aa, Homo Sapiens
FTNPNGTIE

SEQ ID NO: 1178514 - protein, 9 aa, Homo Sapiens
TCGSATSMA

SEQ ID NO: 1178515 - protein, 9 aa, Homo Sapiens
WYRQQVSRA

SEQ ID NO: 1178516 - protein, 9 aa, Homo Sapiens
SVPPGIRWS

SEQ ID NO: 1178517 - protein, 9 aa, Homo Sapiens
TRVMVPLPV

SEQ ID NO: 1178518 - protein, 9 aa, Homo Sapiens
WKLWPPSSR

SEQ ID NO: 1178519 - protein, 9 aa, Homo Sapiens
DTVSGTSRQ

SEQ ID NO: 1178520 - protein, 9 aa, Homo Sapiens
RGTSEPECT

SEQ ID NO: 1178521 - protein, 9 aa, Homo Sapiens
IKGGKKFIK

SEQ ID NO: 1178522 - protein, 9 aa, Homo Sapiens
EVAQHIRPE

SEQ ID NO: 1178523 - protein, 9 aa, Homo Sapiens
SQINLRIRE

SEQ ID NO: 1178524 - protein, 9 aa, Homo Sapiens
QARLCFSIN

SEQ ID NO: 1178525 - protein, 9 aa, Homo Sapiens
RRPVSLIES

SEQ ID NO: 1178526 - protein, 9 aa, Homo Sapiens
PPVNYVPQQ

SEQ ID NO: 1178527 - protein, 9 aa, Homo Sapiens
PQGCWPPPA

SEQ ID NO: 1178528 - protein, 9 aa, Homo Sapiens
LNLCLLPFL

SEQ ID NO: 1178529 - protein, 9 aa, Homo Sapiens
NAGGRREPV

SEQ ID NO: 1178530 - protein, 9 aa, Homo Sapiens
EEEVKTKRQ

SEQ ID NO: 1178531 - protein, 9 aa, Homo Sapiens
LHIGLKPRA

SEQ ID NO: 1178532 - protein, 9 aa, Homo Sapiens
TPSEGAGRH

SEQ ID NO: 1178533 - protein, 9 aa, Homo Sapiens
PKKIITWAL

SEQ ID NO: 1178534 - protein, 9 aa, Homo Sapiens
SWKVKWCDE

SEQ ID NO: 1178535 - protein, 9 aa, Homo Sapiens
KKMTLKALV

SEQ ID NO: 1178536 - protein, 9 aa, Homo Sapiens
ACENTRVAL

SEQ ID NO: 1178537 - protein, 9 aa, Homo Sapiens
LSKNNIAAF

SEQ ID NO: 1178538 - protein, 9 aa, Homo Sapiens
GRPRPDPAL

SEQ ID NO: 1178539 - protein, 9 aa, Homo Sapiens
AAMATRQVL

SEQ ID NO: 1178540 - protein, 9 aa, Homo Sapiens
RVGEKRFGF

SEQ ID NO: 1178541 - protein, 9 aa, Homo Sapiens
WASVTPPTR

SEQ ID NO: 1178542 - protein, 9 aa, Homo Sapiens
AGRGRASQT

SEQ ID NO: 1178543 - protein, 9 aa, Homo Sapiens
GQFIPWNFP

SEQ ID NO: 1178544 - protein, 9 aa, Homo Sapiens
FRMLMVAWI

SEQ ID NO: 1178545 - protein, 9 aa, Homo Sapiens
PPAWGIPGS

SEQ ID NO: 1178546 - protein, 9 aa, Homo Sapiens
FRVLASSWY

SEQ ID NO: 1178547 - protein, 9 aa, Homo Sapiens
GLLCPALHL

SEQ ID NO: 1178548 - protein, 9 aa, Homo Sapiens
LESEEFQRI

SEQ ID NO: 1178549 - protein, 9 aa, Homo Sapiens
CCSTPSMYF

SEQ ID NO: 1178550 - protein, 9 aa, Homo Sapiens
ASRRFQCVS

SEQ ID NO: 1178551 - protein, 9 aa, Homo Sapiens
WPALAWCAW

SEQ ID NO: 1178552 - protein, 9 aa, Homo Sapiens
RHVWFREPP

SEQ ID NO: 1178553 - protein, 9 aa, Homo Sapiens
GTPRVPLPP

SEQ ID NO: 1178554 - protein, 9 aa, Homo Sapiens
PLSQITAQN

SEQ ID NO: 1178555 - protein, 9 aa, Homo Sapiens
CTPDGQSYC

SEQ ID NO: 1178556 - protein, 9 aa, Homo Sapiens
MVGEWVLPE

SEQ ID NO: 1178557 - protein, 9 aa, Homo Sapiens
TSQVVTLSQ

SEQ ID NO: 1178558 - protein, 9 aa, Homo Sapiens
IPGYQLWFL

SEQ ID NO: 1178559 - protein, 9 aa, Homo Sapiens
MVPASIADM

SEQ ID NO: 1178560 - protein, 9 aa, Homo Sapiens
QLMLNCWQK

SEQ ID NO: 1178561 - protein, 9 aa, Homo Sapiens
REEIQVWPA

SEQ ID NO: 1178562 - protein, 9 aa, Homo Sapiens
LSGKRSLNG

SEQ ID NO: 1178563 - protein, 9 aa, Homo Sapiens
FDSVGGLSD

SEQ ID NO: 1178564 - protein, 9 aa, Homo Sapiens
SPVARLTWR

SEQ ID NO: 1178565 - protein, 9 aa, Homo Sapiens
LIHDRSVSR

SEQ ID NO: 1178566 - protein, 9 aa, Homo Sapiens
GLAPRGRGV

SEQ ID NO: 1178567 - protein, 9 aa, Homo Sapiens
HKDARACVI

SEQ ID NO: 1178568 - protein, 9 aa, Homo Sapiens
PCRALARTS

SEQ ID NO: 1178569 - protein, 9 aa, Homo Sapiens
QKYNHCCVK

SEQ ID NO: 1178570 - protein, 9 aa, Homo Sapiens
GVREDEPAS

SEQ ID NO: 1178571 - protein, 9 aa, Homo Sapiens
SRISSSSHP

SEQ ID NO: 1178572 - protein, 9 aa, Homo Sapiens
GPLSHCTLT

SEQ ID NO: 1178573 - protein, 9 aa, Homo Sapiens
VNYVPQQEI

SEQ ID NO: 1178574 - protein, 9 aa, Homo Sapiens
RVSTNAMLI

SEQ ID NO: 1178575 - protein, 9 aa, Homo Sapiens
EPGAITEES

SEQ ID NO: 1178576 - protein, 9 aa, Homo Sapiens
PACARGPRA

SEQ ID NO: 1178577 - protein, 9 aa, Homo Sapiens
HSTGPPTSC

SEQ ID NO: 1178578 - protein, 9 aa, Homo Sapiens
VEHSETSRQ

SEQ ID NO: 1178579 - protein, 9 aa, Homo Sapiens
GNPNFCWLS

SEQ ID NO: 1178580 - protein, 9 aa, Homo Sapiens
AITLNLLVI

SEQ ID NO: 1178581 - protein, 9 aa, Homo Sapiens
WHKNGVKIE

SEQ ID NO: 1178582 - protein, 9 aa, Homo Sapiens
ESGFSLRME

SEQ ID NO: 1178583 - protein, 9 aa, Homo Sapiens
MATRQVLEE

SEQ ID NO: 1178584 - protein, 9 aa, Homo Sapiens
VEDGHREIL

SEQ ID NO: 1178585 - protein, 9 aa, Homo Sapiens
ASERLQAAT

SEQ ID NO: 1178586 - protein, 9 aa, Homo Sapiens
SSLSLRVGS

SEQ ID NO: 1178587 - protein, 9 aa, Homo Sapiens
SRSFPCWKT

SEQ ID NO: 1178588 - protein, 9 aa, Homo Sapiens
AGDPFKTIR

SEQ ID NO: 1178589 - protein, 9 aa, Homo Sapiens
TSDWVSFAV

SEQ ID NO: 1178590 - protein, 9 aa, Homo Sapiens
FLVFLTIYN

SEQ ID NO: 1178591 - protein, 9 aa, Homo Sapiens
VKRKADTPT

SEQ ID NO: 1178592 - protein, 9 aa, Homo Sapiens
PSGGMPRAL

SEQ ID NO: 1178593 - protein, 9 aa, Homo Sapiens
TSTTEMDIF

SEQ ID NO: 1178594 - protein, 9 aa, Homo Sapiens
ARALSRGSP

SEQ ID NO: 1178595 - protein, 9 aa, Homo Sapiens
GNISKKQNA

SEQ ID NO: 1178596 - protein, 9 aa, Homo Sapiens
VWASGKWEC

SEQ ID NO: 1178597 - protein, 9 aa, Homo Sapiens
FFPTLPRFC

SEQ ID NO: 1178598 - protein, 9 aa, Homo Sapiens
CQGPGAWWG

SEQ ID NO: 1178599 - protein, 9 aa, Homo Sapiens
ASHSHSGDY

SEQ ID NO: 1178600 - protein, 9 aa, Homo Sapiens
YHTLHPAPA

SEQ ID NO: 1178601 - protein, 9 aa, Homo Sapiens
RPAHAAGPE

SEQ ID NO: 1178602 - protein, 9 aa, Homo Sapiens
PLSLLFFWR

SEQ ID NO: 1178603 - protein, 9 aa, Homo Sapiens
TLCSDHSVP

SEQ ID NO: 1178604 - protein, 9 aa, Homo Sapiens
DMEEEDEDS

SEQ ID NO: 1178605 - protein, 9 aa, Homo Sapiens
LRVVSLGEE

SEQ ID NO: 1178606 - protein, 9 aa, Homo Sapiens
GLGPEHLSP

SEQ ID NO: 1178607 - protein, 9 aa, Homo Sapiens
PPAIRGLTV

SEQ ID NO: 1178608 - protein, 9 aa, Homo Sapiens
MVNTGEKRY

SEQ ID NO: 1178609 - protein, 9 aa, Homo Sapiens
DVQMRAAIN

SEQ ID NO: 1178610 - protein, 9 aa, Homo Sapiens
PPDPSEEPV

SEQ ID NO: 1178611 - protein, 9 aa, Homo Sapiens
DFCVTAPRH

SEQ ID NO: 1178612 - protein, 9 aa, Homo Sapiens
SKRSSPSGA

SEQ ID NO: 1178613 - protein, 9 aa, Homo Sapiens
MTPSQPITT

SEQ ID NO: 1178614 - protein, 9 aa, Homo Sapiens
GKLHVAPMG

SEQ ID NO: 1178615 - protein, 9 aa, Homo Sapiens
QPTVIASMS

SEQ ID NO: 1178616 - protein, 9 aa, Homo Sapiens
YGIIFACVC

SEQ ID NO: 1178617 - protein, 9 aa, Homo Sapiens
TALQADPPQ

SEQ ID NO: 1178618 - protein, 9 aa, Homo Sapiens
PPARQPSRP

SEQ ID NO: 1178619 - protein, 9 aa, Homo Sapiens
RRIASQAKY

SEQ ID NO: 1178620 - protein, 9 aa, Homo Sapiens
LKCKHSKSF

SEQ ID NO: 1178621 - protein, 9 aa, Homo Sapiens
TIGAVSELA

SEQ ID NO: 1178622 - protein, 9 aa, Homo Sapiens
RGSKGSRGP

SEQ ID NO: 1178623 - protein, 9 aa, Homo Sapiens
DIDVSGPKM

SEQ ID NO: 1178624 - protein, 9 aa, Homo Sapiens
NYHYFLEET

SEQ ID NO: 1178625 - protein, 9 aa, Homo Sapiens
HRQLHTAGT

SEQ ID NO: 1178626 - protein, 9 aa, Homo Sapiens
SRVVPNTAN

SEQ ID NO: 1178627 - protein, 9 aa, Homo Sapiens
RLLRCSPSP

SEQ ID NO: 1178628 - protein, 9 aa, Homo Sapiens
LSLQERGGA

SEQ ID NO: 1178629 - protein, 9 aa, Homo Sapiens
SVSTMDALW

SEQ ID NO: 1178630 - protein, 9 aa, Homo Sapiens
SLEALEGTV

SEQ ID NO: 1178631 - protein, 9 aa, Homo Sapiens
KEGDRPERV

SEQ ID NO: 1178632 - protein, 9 aa, Homo Sapiens
LKTCSLDYA

SEQ ID NO: 1178633 - protein, 9 aa, Homo Sapiens
VEEGKGIFT

SEQ ID NO: 1178634 - protein, 9 aa, Homo Sapiens
RSFTCTQSE

SEQ ID NO: 1178635 - protein, 9 aa, Homo Sapiens
AKAFGPARV

SEQ ID NO: 1178636 - protein, 9 aa, Homo Sapiens
VRRLVIGFG

SEQ ID NO: 1178637 - protein, 9 aa, Homo Sapiens
STTCTHRSP

SEQ ID NO: 1178638 - protein, 9 aa, Homo Sapiens
EVVFLGDSL

SEQ ID NO: 1178639 - protein, 9 aa, Homo Sapiens
YMQVGSSGA

SEQ ID NO: 1178640 - protein, 9 aa, Homo Sapiens
APLTPPLPP

SEQ ID NO: 1178641 - protein, 9 aa, Homo Sapiens
PPRGASTRG

SEQ ID NO: 1178642 - protein, 9 aa, Homo Sapiens
CHTQLLIHS

SEQ ID NO: 1178643 - protein, 9 aa, Homo Sapiens
MDGQIPCLF

SEQ ID NO: 1178644 - protein, 9 aa, Homo Sapiens
RGGLCPGSP

SEQ ID NO: 1178645 - protein, 9 aa, Homo Sapiens
VKKKSARDQ

SEQ ID NO: 1178646 - protein, 9 aa, Homo Sapiens
TTEHCPLTS

SEQ ID NO: 1178647 - protein, 9 aa, Homo Sapiens
DKAPSRSES

SEQ ID NO: 1178648 - protein, 9 aa, Homo Sapiens
PVLVKEKEM

SEQ ID NO: 1178649 - protein, 9 aa, Homo Sapiens
DEFVKGQIV

SEQ ID NO: 1178650 - protein, 9 aa, Homo Sapiens
CSLSCYCKN

SEQ ID NO: 1178651 - protein, 9 aa, Homo Sapiens
PGDVRHGFR

SEQ ID NO: 1178652 - protein, 9 aa, Homo Sapiens
MGTLAPWAL

SEQ ID NO: 1178653 - protein, 9 aa, Homo Sapiens
IFWTCLKMS

SEQ ID NO: 1178654 - protein, 9 aa, Homo Sapiens
NSSHRQEAE

SEQ ID NO: 1178655 - protein, 9 aa, Homo Sapiens
GHESYELQI

SEQ ID NO: 1178656 - protein, 9 aa, Homo Sapiens
RRPASGHHP

SEQ ID NO: 1178657 - protein, 9 aa, Homo Sapiens
RGAMYWSDW

SEQ ID NO: 1178658 - protein, 9 aa, Homo Sapiens
KYVGTGGIY

SEQ ID NO: 1178659 - protein, 9 aa, Homo Sapiens
AVAGISVVS

SEQ ID NO: 1178660 - protein, 9 aa, Homo Sapiens
QAHARGHNQ

SEQ ID NO: 1178661 - protein, 9 aa, Homo Sapiens
TLAIRFISA

SEQ ID NO: 1178662 - protein, 9 aa, Homo Sapiens
FPNIARATK

SEQ ID NO: 1178663 - protein, 9 aa, Homo Sapiens
GDWPALTRR

SEQ ID NO: 1178664 - protein, 9 aa, Homo Sapiens
RSPQAPLRL

SEQ ID NO: 1178665 - protein, 9 aa, Homo Sapiens
SGIPNLGIW

SEQ ID NO: 1178666 - protein, 9 aa, Homo Sapiens
GEMVHQARV

SEQ ID NO: 1178667 - protein, 9 aa, Homo Sapiens
ACMSPPLRE

SEQ ID NO: 1178668 - protein, 9 aa, Homo Sapiens
SNAVGRRGP

SEQ ID NO: 1178669 - protein, 9 aa, Homo Sapiens
EYKVKERYG

SEQ ID NO: 1178670 - protein, 9 aa, Homo Sapiens
MGDAGEMVH

SEQ ID NO: 1178671 - protein, 9 aa, Homo Sapiens
EVLQDPLDR

SEQ ID NO: 1178672 - protein, 9 aa, Homo Sapiens
QRKRRRRKM

SEQ ID NO: 1178673 - protein, 9 aa, Homo Sapiens
SPVPQYTPR

SEQ ID NO: 1178674 - protein, 9 aa, Homo Sapiens
RTRPLTTPP

SEQ ID NO: 1178675 - protein, 9 aa, Homo Sapiens
PVPTAWRPG

SEQ ID NO: 1178676 - protein, 9 aa, Homo Sapiens
DGPLRHKFL

SEQ ID NO: 1178677 - protein, 9 aa, Homo Sapiens
RRSSGSVLC

SEQ ID NO: 1178678 - protein, 9 aa, Homo Sapiens
RESQMAIEE

SEQ ID NO: 1178679 - protein, 9 aa, Homo Sapiens
FVDHEAESV

SEQ ID NO: 1178680 - protein, 9 aa, Homo Sapiens
WVLTTAHCV

SEQ ID NO: 1178681 - protein, 9 aa, Homo Sapiens
SAELSTGPP

SEQ ID NO: 1178682 - protein, 9 aa, Homo Sapiens
HARTFVVFV

SEQ ID NO: 1178683 - protein, 9 aa, Homo Sapiens
SWRGASFIL

SEQ ID NO: 1178684 - protein, 9 aa, Homo Sapiens
LHWRIGGGT

SEQ ID NO: 1178685 - protein, 9 aa, Homo Sapiens
MQGVAGIGK

SEQ ID NO: 1178686 - protein, 9 aa, Homo Sapiens
RKLVGRAVR

SEQ ID NO: 1178687 - protein, 9 aa, Homo Sapiens
GNPRPAARL

SEQ ID NO: 1178688 - protein, 9 aa, Homo Sapiens
GFLQREDLL

SEQ ID NO: 1178689 - protein, 9 aa, Homo Sapiens
VHVASCEEE

SEQ ID NO: 1178690 - protein, 9 aa, Homo Sapiens
RTRMSPPCL

SEQ ID NO: 1178691 - protein, 9 aa, Homo Sapiens
ASARRAGRH

SEQ ID NO: 1178692 - protein, 9 aa, Homo Sapiens
EGGRKSQTK

SEQ ID NO: 1178693 - protein, 9 aa, Homo Sapiens
SQICLQWII

SEQ ID NO: 1178694 - protein, 9 aa, Homo Sapiens
AAREEPSSG

SEQ ID NO: 1178695 - protein, 9 aa, Homo Sapiens
NLYPLIRSA

SEQ ID NO: 1178696 - protein, 9 aa, Homo Sapiens
PPGPPPPTP

SEQ ID NO: 1178697 - protein, 9 aa, Homo Sapiens
RIRQPILQY

SEQ ID NO: 1178698 - protein, 9 aa, Homo Sapiens
ERAYTILRH

SEQ ID NO: 1178699 - protein, 9 aa, Homo Sapiens
AFGQLNSPG

SEQ ID NO: 1178700 - protein, 9 aa, Homo Sapiens
ELRHSLCDA

SEQ ID NO: 1178701 - protein, 9 aa, Homo Sapiens
DSWVPLASE

SEQ ID NO: 1178702 - protein, 9 aa, Homo Sapiens
QENFLYYEK

SEQ ID NO: 1178703 - protein, 9 aa, Homo Sapiens
TIRKEDFNN

SEQ ID NO: 1178704 - protein, 9 aa, Homo Sapiens
FRNYHLGVM

SEQ ID NO: 1178705 - protein, 9 aa, Homo Sapiens
EAWRRSSWP

SEQ ID NO: 1178706 - protein, 9 aa, Homo Sapiens
DPEQPQAGL

SEQ ID NO: 1178707 - protein, 9 aa, Homo Sapiens
VWSQVAVQK

SEQ ID NO: 1178708 - protein, 9 aa, Homo Sapiens
MPPQVCFLL

SEQ ID NO: 1178709 - protein, 9 aa, Homo Sapiens
QHIRPEDLW

SEQ ID NO: 1178710 - protein, 9 aa, Homo Sapiens
TEDKKNGIW

SEQ ID NO: 1178711 - protein, 9 aa, Homo Sapiens
LNQQGTHSA

SEQ ID NO: 1178712 - protein, 9 aa, Homo Sapiens
TCYRIMEHS

SEQ ID NO: 1178713 - protein, 9 aa, Homo Sapiens
QRVCCLRCC

SEQ ID NO: 1178714 - protein, 9 aa, Homo Sapiens
LRPTASSAA

SEQ ID NO: 1178715 - protein, 9 aa, Homo Sapiens
SLFATGSEW

SEQ ID NO: 1178716 - protein, 9 aa, Homo Sapiens
DTSTTEMDI

SEQ ID NO: 1178717 - protein, 9 aa, Homo Sapiens
HSKCITECV

SEQ ID NO: 1178718 - protein, 9 aa, Homo Sapiens
IWRGLGSIN

SEQ ID NO: 1178719 - protein, 9 aa, Homo Sapiens
GCSLRAAAA

SEQ ID NO: 1178720 - protein, 9 aa, Homo Sapiens
DGVFVHGLF

SEQ ID NO: 1178721 - protein, 9 aa, Homo Sapiens
CGKFFCHST

SEQ ID NO: 1178722 - protein, 9 aa, Homo Sapiens
SPTCSTTTA

SEQ ID NO: 1178723 - protein, 9 aa, Homo Sapiens
VASPPRRWP

SEQ ID NO: 1178724 - protein, 9 aa, Homo Sapiens
PPERRRPAR

SEQ ID NO: 1178725 - protein, 9 aa, Homo Sapiens
RGFIRYGWH

SEQ ID NO: 1178726 - protein, 9 aa, Homo Sapiens
SGGGRRPRA

SEQ ID NO: 1178727 - protein, 9 aa, Homo Sapiens
DPQDSRVRV

SEQ ID NO: 1178728 - protein, 9 aa, Homo Sapiens
HKKRGGSST

SEQ ID NO: 1178729 - protein, 9 aa, Homo Sapiens
LSVHPPVYL

SEQ ID NO: 1178730 - protein, 9 aa, Homo Sapiens
VFVQVKRGP

SEQ ID NO: 1178731 - protein, 9 aa, Homo Sapiens
ADGSSSGAT

SEQ ID NO: 1178732 - protein, 9 aa, Homo Sapiens
DPTLPPLKD

SEQ ID NO: 1178733 - protein, 9 aa, Homo Sapiens
QHHMEPGNN

SEQ ID NO: 1178734 - protein, 9 aa, Homo Sapiens
KKRLRTMKI

SEQ ID NO: 1178735 - protein, 9 aa, Homo Sapiens
APAGPHPTG

SEQ ID NO: 1178736 - protein, 9 aa, Homo Sapiens
DMRLLSDAT

SEQ ID NO: 1178737 - protein, 9 aa, Homo Sapiens
VFENYYVAY

SEQ ID NO: 1178738 - protein, 9 aa, Homo Sapiens
SCLTSFNSV

SEQ ID NO: 1178739 - protein, 9 aa, Homo Sapiens
CNTRRKTFS

SEQ ID NO: 1178740 - protein, 9 aa, Homo Sapiens
LQELERLLE

SEQ ID NO: 1178741 - protein, 9 aa, Homo Sapiens
HLSPEELVR

SEQ ID NO: 1178742 - protein, 9 aa, Homo Sapiens
CKPFSDIIE

SEQ ID NO: 1178743 - protein, 9 aa, Homo Sapiens
HLQPPFCPR

SEQ ID NO: 1178744 - protein, 9 aa, Homo Sapiens
DLKKKEVVE

SEQ ID NO: 1178745 - protein, 9 aa, Homo Sapiens
RDPRPGHRS

SEQ ID NO: 1178746 - protein, 9 aa, Homo Sapiens
TSKNIIRLS

SEQ ID NO: 1178747 - protein, 9 aa, Homo Sapiens
QRLTPTSAG

SEQ ID NO: 1178748 - protein, 9 aa, Homo Sapiens
SQGAARGLQ

SEQ ID NO: 1178749 - protein, 9 aa, Homo Sapiens
HQNLDPTSS

SEQ ID NO: 1178750 - protein, 9 aa, Homo Sapiens
DTKSGSVLP

SEQ ID NO: 1178751 - protein, 9 aa, Homo Sapiens
QHPEVPPPF

SEQ ID NO: 1178752 - protein, 9 aa, Homo Sapiens
CVPSCSSLS

SEQ ID NO: 1178753 - protein, 9 aa, Homo Sapiens
SILTETASP

SEQ ID NO: 1178754 - protein, 9 aa, Homo Sapiens
VCFKRISGT

SEQ ID NO: 1178755 - protein, 9 aa, Homo Sapiens
SLTADSRKR

SEQ ID NO: 1178756 - protein, 9 aa, Homo Sapiens
CCSLQKTGI

SEQ ID NO: 1178757 - protein, 9 aa, Homo Sapiens
ILAPPAPGV

SEQ ID NO: 1178758 - protein, 9 aa, Homo Sapiens
SMTTISRAT

SEQ ID NO: 1178759 - protein, 9 aa, Homo Sapiens
SPGAPRRAP

SEQ ID NO: 1178760 - protein, 9 aa, Homo Sapiens
PRCTSSASS

SEQ ID NO: 1178761 - protein, 9 aa, Homo Sapiens
LCKPFSDII

SEQ ID NO: 1178762 - protein, 9 aa, Homo Sapiens
TYTQLNHCI

SEQ ID NO: 1178763 - protein, 9 aa, Homo Sapiens
RMLSPVHTD

SEQ ID NO: 1178764 - protein, 9 aa, Homo Sapiens
HLLAWDLDD

SEQ ID NO: 1178765 - protein, 9 aa, Homo Sapiens
LFDNLTSSY

SEQ ID NO: 1178766 - protein, 9 aa, Homo Sapiens
CCVPSCSSL

SEQ ID NO: 1178767 - protein, 9 aa, Homo Sapiens
CSLASPALP

SEQ ID NO: 1178768 - protein, 9 aa, Homo Sapiens
SGTYPGDVR

SEQ ID NO: 1178769 - protein, 9 aa, Homo Sapiens
LGVGLGDES

SEQ ID NO: 1178770 - protein, 9 aa, Homo Sapiens
LVEGGRKSQ

SEQ ID NO: 1178771 - protein, 9 aa, Homo Sapiens
DEGDRMFLR

SEQ ID NO: 1178772 - protein, 9 aa, Homo Sapiens
ICVEEDPRA

SEQ ID NO: 1178773 - protein, 9 aa, Homo Sapiens
SRDGGWGWR

SEQ ID NO: 1178774 - protein, 9 aa, Homo Sapiens
NITEELFLL

SEQ ID NO: 1178775 - protein, 9 aa, Homo Sapiens
PAAPLAPPA

SEQ ID NO: 1178776 - protein, 9 aa, Homo Sapiens
HPRPAHAAG

SEQ ID NO: 1178777 - protein, 9 aa, Homo Sapiens
LSKIQKNIK

SEQ ID NO: 1178778 - protein, 9 aa, Homo Sapiens
FPHELRHSL

SEQ ID NO: 1178779 - protein, 9 aa, Homo Sapiens
KQLWGKHVT

SEQ ID NO: 1178780 - protein, 9 aa, Homo Sapiens
LGPGQISTE

SEQ ID NO: 1178781 - protein, 9 aa, Homo Sapiens
TECVRTALN

SEQ ID NO: 1178782 - protein, 9 aa, Homo Sapiens
RPTGRTPTT

SEQ ID NO: 1178783 - protein, 9 aa, Homo Sapiens
IVITVFMLN

SEQ ID NO: 1178784 - protein, 9 aa, Homo Sapiens
FLNEIAREI

SEQ ID NO: 1178785 - protein, 9 aa, Homo Sapiens
SFPCWKTCL

SEQ ID NO: 1178786 - protein, 9 aa, Homo Sapiens
NTTYFEFFN

SEQ ID NO: 1178787 - protein, 9 aa, Homo Sapiens
QWWELFDSN

SEQ ID NO: 1178788 - protein, 9 aa, Homo Sapiens
GRCLQVNQL

SEQ ID NO: 1178789 - protein, 9 aa, Homo Sapiens
CTWSRWLIA

SEQ ID NO: 1178790 - protein, 9 aa, Homo Sapiens
TPDGQSYCC

SEQ ID NO: 1178791 - protein, 9 aa, Homo Sapiens
HARGHNQVP

SEQ ID NO: 1178792 - protein, 9 aa, Homo Sapiens
AACCGGKRS

SEQ ID NO: 1178793 - protein, 9 aa, Homo Sapiens
SSGKSVVSD

SEQ ID NO: 1178794 - protein, 9 aa, Homo Sapiens
DTDSDVLEQ

SEQ ID NO: 1178795 - protein, 9 aa, Homo Sapiens
MGLAREKVG

SEQ ID NO: 1178796 - protein, 9 aa, Homo Sapiens
CPRHGPTRS

SEQ ID NO: 1178797 - protein, 9 aa, Homo Sapiens
LEDHMDGLA

SEQ ID NO: 1178798 - protein, 9 aa, Homo Sapiens
VMYAPVKHS

SEQ ID NO: 1178799 - protein, 9 aa, Homo Sapiens
CHERHRNHP

SEQ ID NO: 1178800 - protein, 9 aa, Homo Sapiens
PAKPSSVTW

SEQ ID NO: 1178801 - protein, 9 aa, Homo Sapiens
VRSMVSSVT

SEQ ID NO: 1178802 - protein, 9 aa, Homo Sapiens
FQHSPNCWY

SEQ ID NO: 1178803 - protein, 9 aa, Homo Sapiens
VRQVVVRPQ

SEQ ID NO: 1178804 - protein, 9 aa, Homo Sapiens
PPPCIAPPT

SEQ ID NO: 1178805 - protein, 9 aa, Homo Sapiens
QPLRQAKDF

SEQ ID NO: 1178806 - protein, 9 aa, Homo Sapiens
QERREQEQR

SEQ ID NO: 1178807 - protein, 9 aa, Homo Sapiens
AGPGSDELT

SEQ ID NO: 1178808 - protein, 9 aa, Homo Sapiens
FHDRSTATS

SEQ ID NO: 1178809 - protein, 9 aa, Homo Sapiens
AAGDVSDQS

SEQ ID NO: 1178810 - protein, 9 aa, Homo Sapiens
YVLDRHRTL

SEQ ID NO: 1178811 - protein, 9 aa, Homo Sapiens
GGAASSSST

SEQ ID NO: 1178812 - protein, 9 aa, Homo Sapiens
LVRQHVQKY

SEQ ID NO: 1178813 - protein, 9 aa, Homo Sapiens
MPAWPGVPP

SEQ ID NO: 1178814 - protein, 9 aa, Homo Sapiens
WAAMRSART

SEQ ID NO: 1178815 - protein, 9 aa, Homo Sapiens
SNTVMPRLL

SEQ ID NO: 1178816 - protein, 9 aa, Homo Sapiens
YCRNPGDDA

SEQ ID NO: 1178817 - protein, 9 aa, Homo Sapiens
RGGGCLPPE

SEQ ID NO: 1178818 - protein, 9 aa, Homo Sapiens
WHCFMTSGI

SEQ ID NO: 1178819 - protein, 9 aa, Homo Sapiens
GGAAAQALP

SEQ ID NO: 1178820 - protein, 9 aa, Homo Sapiens
QIEETPLEE

SEQ ID NO: 1178821 - protein, 9 aa, Homo Sapiens
SPNYKLWYL

SEQ ID NO: 1178822 - protein, 9 aa, Homo Sapiens
PSRPRWPTP

SEQ ID NO: 1178823 - protein, 9 aa, Homo Sapiens
VPGLYFFSP

SEQ ID NO: 1178824 - protein, 9 aa, Homo Sapiens
GAAAQALPA

SEQ ID NO: 1178825 - protein, 9 aa, Homo Sapiens
LDKVTIAQG

SEQ ID NO: 1178826 - protein, 9 aa, Homo Sapiens
SPLPASLGR

SEQ ID NO: 1178827 - protein, 9 aa, Homo Sapiens
PSCPQAIPR

SEQ ID NO: 1178828 - protein, 9 aa, Homo Sapiens
RKWRPGASR

SEQ ID NO: 1178829 - protein, 9 aa, Homo Sapiens
MNLVKAARR

SEQ ID NO: 1178830 - protein, 9 aa, Homo Sapiens
SSRGRIQTW

SEQ ID NO: 1178831 - protein, 9 aa, Homo Sapiens
SQPVVVVAA

SEQ ID NO: 1178832 - protein, 9 aa, Homo Sapiens
RKDIGSERY

SEQ ID NO: 1178833 - protein, 9 aa, Homo Sapiens
PAGSALGGR

SEQ ID NO: 1178834 - protein, 9 aa, Homo Sapiens
VLVSVSVIM

SEQ ID NO: 1178835 - protein, 9 aa, Homo Sapiens
TPSPASGST

SEQ ID NO: 1178836 - protein, 9 aa, Homo Sapiens
GFVLYAMAA

SEQ ID NO: 1178837 - protein, 9 aa, Homo Sapiens
HPQWAPHSA

SEQ ID NO: 1178838 - protein, 9 aa, Homo Sapiens
PRTSPRPRT

SEQ ID NO: 1178839 - protein, 9 aa, Homo Sapiens
SFPQAPDGF

SEQ ID NO: 1178840 - protein, 9 aa, Homo Sapiens
PSAQGRKPK

SEQ ID NO: 1178841 - protein, 9 aa, Homo Sapiens
TDICSSARP

SEQ ID NO: 1178842 - protein, 9 aa, Homo Sapiens
RVGSCVDSA

SEQ ID NO: 1178843 - protein, 9 aa, Homo Sapiens
LAGVQDGLS

SEQ ID NO: 1178844 - protein, 9 aa, Homo Sapiens
AQKEELLEE

SEQ ID NO: 1178845 - protein, 9 aa, Homo Sapiens
PPEEVLKKY

SEQ ID NO: 1178846 - protein, 9 aa, Homo Sapiens
QQLHWLQRL

SEQ ID NO: 1178847 - protein, 9 aa, Homo Sapiens
ISKKQNALA

SEQ ID NO: 1178848 - protein, 9 aa, Homo Sapiens
GKKVLNLCL

SEQ ID NO: 1178849 - protein, 9 aa, Homo Sapiens
FALKLVLVS

SEQ ID NO: 1178850 - protein, 9 aa, Homo Sapiens
RSICSTTNT

SEQ ID NO: 1178851 - protein, 9 aa, Homo Sapiens
FAVLLILLL

SEQ ID NO: 1178852 - protein, 9 aa, Homo Sapiens
GAQRSFTCT

SEQ ID NO: 1178853 - protein, 9 aa, Homo Sapiens
LKISLRPRS

SEQ ID NO: 1178854 - protein, 9 aa, Homo Sapiens
VDTWQTRLS

SEQ ID NO: 1178855 - protein, 9 aa, Homo Sapiens
GQKHRRRGW

SEQ ID NO: 1178856 - protein, 9 aa, Homo Sapiens
WTCIVAPSQ

SEQ ID NO: 1178857 - protein, 9 aa, Homo Sapiens
KEPREFGWR

SEQ ID NO: 1178858 - protein, 9 aa, Homo Sapiens
VDPAAWGNP

SEQ ID NO: 1178859 - protein, 9 aa, Homo Sapiens
ALLMPPPGL

SEQ ID NO: 1178860 - protein, 9 aa, Homo Sapiens
GHRVPIRVS

SEQ ID NO: 1178861 - protein, 9 aa, Homo Sapiens
SVTSAWKNS

SEQ ID NO: 1178862 - protein, 9 aa, Homo Sapiens
SPPPSSRSK

SEQ ID NO: 1178863 - protein, 9 aa, Homo Sapiens
SRDCPRYDP

SEQ ID NO: 1178864 - protein, 9 aa, Homo Sapiens
APPAPGVPF

SEQ ID NO: 1178865 - protein, 9 aa, Homo Sapiens
KKHFWNSTK

SEQ ID NO: 1178866 - protein, 9 aa, Homo Sapiens
IVKLRKDLE

SEQ ID NO: 1178867 - protein, 9 aa, Homo Sapiens
ENTRVALTS

SEQ ID NO: 1178868 - protein, 9 aa, Homo Sapiens
CVENSNPTA

SEQ ID NO: 1178869 - protein, 9 aa, Homo Sapiens
YLNLITNLS

SEQ ID NO: 1178870 - protein, 9 aa, Homo Sapiens
GCWPFHLIS

SEQ ID NO: 1178871 - protein, 9 aa, Homo Sapiens
LLTGQRNPY

SEQ ID NO: 1178872 - protein, 9 aa, Homo Sapiens
AFVIMLLAH

SEQ ID NO: 1178873 - protein, 9 aa, Homo Sapiens
LSYSFFTNV

SEQ ID NO: 1178874 - protein, 9 aa, Homo Sapiens
TRSATSNSR

SEQ ID NO: 1178875 - protein, 9 aa, Homo Sapiens
LRGLPASLL

SEQ ID NO: 1178876 - protein, 9 aa, Homo Sapiens
QGWQNCVWQ

SEQ ID NO: 1178877 - protein, 9 aa, Homo Sapiens
TLSQAVGPL

SEQ ID NO: 1178878 - protein, 9 aa, Homo Sapiens
LPTHTFSTL

SEQ ID NO: 1178879 - protein, 9 aa, Homo Sapiens
TPHSIHDGV

SEQ ID NO: 1178880 - protein, 9 aa, Homo Sapiens
DGGEEEMEE

SEQ ID NO: 1178881 - protein, 9 aa, Homo Sapiens
TYAAGGMVE

SEQ ID NO: 1178882 - protein, 9 aa, Homo Sapiens
VRTLVAHTQ

SEQ ID NO: 1178883 - protein, 9 aa, Homo Sapiens
LRAARAHQR

SEQ ID NO: 1178884 - protein, 9 aa, Homo Sapiens
EMVIPVRQV

SEQ ID NO: 1178885 - protein, 9 aa, Homo Sapiens
KKALNYSAA

SEQ ID NO: 1178886 - protein, 9 aa, Homo Sapiens
STFDLVAIS

SEQ ID NO: 1178887 - protein, 9 aa, Homo Sapiens
LKHSLTTYK

SEQ ID NO: 1178888 - protein, 9 aa, Homo Sapiens
SQHTTEVVR

SEQ ID NO: 1178889 - protein, 9 aa, Homo Sapiens
MLDPEWQIT

SEQ ID NO: 1178890 - protein, 9 aa, Homo Sapiens
TANENDGYM

SEQ ID NO: 1178891 - protein, 9 aa, Homo Sapiens
QPGNQRSNR

SEQ ID NO: 1178892 - protein, 9 aa, Homo Sapiens
RSRPSWPSC

SEQ ID NO: 1178893 - protein, 9 aa, Homo Sapiens
PAVRPRPGP

SEQ ID NO: 1178894 - protein, 9 aa, Homo Sapiens
AWSWAAGPP

SEQ ID NO: 1178895 - protein, 9 aa, Homo Sapiens
TQCKNGKMN

SEQ ID NO: 1178896 - protein, 9 aa, Homo Sapiens
LYQKRALTI

SEQ ID NO: 1178897 - protein, 9 aa, Homo Sapiens
VSTPSAEKG

SEQ ID NO: 1178898 - protein, 9 aa, Homo Sapiens
ISVVSRGPR

SEQ ID NO: 1178899 - protein, 9 aa, Homo Sapiens
HKGKISPVK

SEQ ID NO: 1178900 - protein, 9 aa, Homo Sapiens
IEVICQNLR

SEQ ID NO: 1178901 - protein, 9 aa, Homo Sapiens
PSPLPAPRP

SEQ ID NO: 1178902 - protein, 9 aa, Homo Sapiens
RGRHAHHPG

SEQ ID NO: 1178903 - protein, 9 aa, Homo Sapiens
LFFVMSCLL

SEQ ID NO: 1178904 - protein, 9 aa, Homo Sapiens
KEFVCHWGA

SEQ ID NO: 1178905 - protein, 9 aa, Homo Sapiens
SICSTTNTQ

SEQ ID NO: 1178906 - protein, 9 aa, Homo Sapiens
PPGRSLPAG

SEQ ID NO: 1178907 - protein, 9 aa, Homo Sapiens
PTEGRIQMV

SEQ ID NO: 1178908 - protein, 9 aa, Homo Sapiens
AQTCCGQIP

SEQ ID NO: 1178909 - protein, 9 aa, Homo Sapiens
CMTSKHYLS

SEQ ID NO: 1178910 - protein, 9 aa, Homo Sapiens
ASVGHIITL

SEQ ID NO: 1178911 - protein, 9 aa, Homo Sapiens
SDLELHPPA

SEQ ID NO: 1178912 - protein, 9 aa, Homo Sapiens
EKAKPSAAG

SEQ ID NO: 1178913 - protein, 9 aa, Homo Sapiens
ADGHFHTVI

SEQ ID NO: 1178914 - protein, 9 aa, Homo Sapiens
KENTIRIVD

SEQ ID NO: 1178915 - protein, 9 aa, Homo Sapiens
HRLRCWHKS

SEQ ID NO: 1178916 - protein, 9 aa, Homo Sapiens
PPWIEACCS

SEQ ID NO: 1178917 - protein, 9 aa, Homo Sapiens
SRGSKGSRG

SEQ ID NO: 1178918 - protein, 9 aa, Homo Sapiens
TNKEDTWKF

SEQ ID NO: 1178919 - protein, 9 aa, Homo Sapiens
NMPFIVSMR

SEQ ID NO: 1178920 - protein, 9 aa, Homo Sapiens
EWFSRGKNL

SEQ ID NO: 1178921 - protein, 9 aa, Homo Sapiens
TGTRASSPT

SEQ ID NO: 1178922 - protein, 9 aa, Homo Sapiens
FDIRFETFQ

SEQ ID NO: 1178923 - protein, 9 aa, Homo Sapiens
SDIHVEAVM

SEQ ID NO: 1178924 - protein, 9 aa, Homo Sapiens
QQRLEKMKI

SEQ ID NO: 1178925 - protein, 9 aa, Homo Sapiens
EPVPRRGLL

SEQ ID NO: 1178926 - protein, 9 aa, Homo Sapiens
YSGHSGEQN

SEQ ID NO: 1178927 - protein, 9 aa, Homo Sapiens
TSVEESLPG

SEQ ID NO: 1178928 - protein, 9 aa, Homo Sapiens
VTSAANVAK

SEQ ID NO: 1178929 - protein, 9 aa, Homo Sapiens
GRDWCLLQA

SEQ ID NO: 1178930 - protein, 9 aa, Homo Sapiens
DKFSTMKYE

SEQ ID NO: 1178931 - protein, 9 aa, Homo Sapiens
RAPALRSGA

SEQ ID NO: 1178932 - protein, 9 aa, Homo Sapiens
VCPHHCGHS

SEQ ID NO: 1178933 - protein, 9 aa, Homo Sapiens
KSSWMFAKI

SEQ ID NO: 1178934 - protein, 9 aa, Homo Sapiens
WRWMVLAQA

SEQ ID NO: 1178935 - protein, 9 aa, Homo Sapiens
ASHPPGCHC

SEQ ID NO: 1178936 - protein, 9 aa, Homo Sapiens
YTSKLVRIC

SEQ ID NO: 1178937 - protein, 9 aa, Homo Sapiens
LFIEHPEDE

SEQ ID NO: 1178938 - protein, 9 aa, Homo Sapiens
KQFFSFSFG

SEQ ID NO: 1178939 - protein, 9 aa, Homo Sapiens
RTTLSSGLA

SEQ ID NO: 1178940 - protein, 9 aa, Homo Sapiens
RVPAGPRLS

SEQ ID NO: 1178941 - protein, 9 aa, Homo Sapiens
ACSAAGRAA

SEQ ID NO: 1178942 - protein, 9 aa, Homo Sapiens
NKYSDFASN

SEQ ID NO: 1178943 - protein, 9 aa, Homo Sapiens
LRQTLQGLQ

SEQ ID NO: 1178944 - protein, 9 aa, Homo Sapiens
LLRIIKPCN

SEQ ID NO: 1178945 - protein, 9 aa, Homo Sapiens
FNVLKEIDT

SEQ ID NO: 1178946 - protein, 9 aa, Homo Sapiens
QCETNLTTL

SEQ ID NO: 1178947 - protein, 9 aa, Homo Sapiens
CSGARACTP

SEQ ID NO: 1178948 - protein, 9 aa, Homo Sapiens
DPLPSASPF

SEQ ID NO: 1178949 - protein, 9 aa, Homo Sapiens
EELNKLLDK

SEQ ID NO: 1178950 - protein, 9 aa, Homo Sapiens
NPCLREPQE

SEQ ID NO: 1178951 - protein, 9 aa, Homo Sapiens
RHFGVVTTR

SEQ ID NO: 1178952 - protein, 9 aa, Homo Sapiens
TQENDLALQ

SEQ ID NO: 1178953 - protein, 9 aa, Homo Sapiens
QAPRTKPAM

SEQ ID NO: 1178954 - protein, 9 aa, Homo Sapiens
FGHRSMDPM

SEQ ID NO: 1178955 - protein, 9 aa, Homo Sapiens
DSHASKGVP

SEQ ID NO: 1178956 - protein, 9 aa, Homo Sapiens
GRRPPPPLP

SEQ ID NO: 1178957 - protein, 9 aa, Homo Sapiens
KCAECCKSF

SEQ ID NO: 1178958 - protein, 9 aa, Homo Sapiens
HIGVWASGK

SEQ ID NO: 1178959 - protein, 9 aa, Homo Sapiens
SKNNIAAFP

SEQ ID NO: 1178960 - protein, 9 aa, Homo Sapiens
KSACEKCLG

SEQ ID NO: 1178961 - protein, 9 aa, Homo Sapiens
PRPRVQAHW

SEQ ID NO: 1178962 - protein, 9 aa, Homo Sapiens
SQSGYCSMQ

SEQ ID NO: 1178963 - protein, 9 aa, Homo Sapiens
MAVLQHHDT

SEQ ID NO: 1178964 - protein, 9 aa, Homo Sapiens
PHLQPPFCP

SEQ ID NO: 1178965 - protein, 9 aa, Homo Sapiens
LEEVQPACL

SEQ ID NO: 1178966 - protein, 9 aa, Homo Sapiens
PPPPVLRPR

SEQ ID NO: 1178967 - protein, 9 aa, Homo Sapiens
EAAAFPHEL

SEQ ID NO: 1178968 - protein, 9 aa, Homo Sapiens
LNSPGSLKI

SEQ ID NO: 1178969 - protein, 9 aa, Homo Sapiens
CTALASGCP

SEQ ID NO: 1178970 - protein, 9 aa, Homo Sapiens
PWAGPTTCS

SEQ ID NO: 1178971 - protein, 9 aa, Homo Sapiens
LCQQLREIT

SEQ ID NO: 1178972 - protein, 9 aa, Homo Sapiens
GPNILPIQR

SEQ ID NO: 1178973 - protein, 9 aa, Homo Sapiens
ILEEHEPGA

SEQ ID NO: 1178974 - protein, 9 aa, Homo Sapiens
DQLKNCGCL

SEQ ID NO: 1178975 - protein, 9 aa, Homo Sapiens
LLDLQQVGD

SEQ ID NO: 1178976 - protein, 9 aa, Homo Sapiens
KRLKASLPP

SEQ ID NO: 1178977 - protein, 9 aa, Homo Sapiens
CFSPIPVAE

SEQ ID NO: 1178978 - protein, 9 aa, Homo Sapiens
RMSVGTSSS

SEQ ID NO: 1178979 - protein, 9 aa, Homo Sapiens
LSVKKKSAR

SEQ ID NO: 1178980 - protein, 9 aa, Homo Sapiens
HPVGRSRCR

SEQ ID NO: 1178981 - protein, 9 aa, Homo Sapiens
PPPAHVEKQ

SEQ ID NO: 1178982 - protein, 9 aa, Homo Sapiens
FGFVRYLQS

SEQ ID NO: 1178983 - protein, 9 aa, Homo Sapiens
SRRRAPPRS

SEQ ID NO: 1178984 - protein, 9 aa, Homo Sapiens
SACEKCLGC

SEQ ID NO: 1178985 - protein, 9 aa, Homo Sapiens
QRTGRQHPP

SEQ ID NO: 1178986 - protein, 9 aa, Homo Sapiens
FLDASQHIL

SEQ ID NO: 1178987 - protein, 9 aa, Homo Sapiens
GGAVEDFLK

SEQ ID NO: 1178988 - protein, 9 aa, Homo Sapiens
GRPGRRGGQ

SEQ ID NO: 1178989 - protein, 9 aa, Homo Sapiens
APVVERPGA

SEQ ID NO: 1178990 - protein, 9 aa, Homo Sapiens
PPPPPGWLP

SEQ ID NO: 1178991 - protein, 9 aa, Homo Sapiens
FLGRECLGS

SEQ ID NO: 1178992 - protein, 9 aa, Homo Sapiens
SSHCSPAIN

SEQ ID NO: 1178993 - protein, 9 aa, Homo Sapiens
VYRVLGGWA

SEQ ID NO: 1178994 - protein, 9 aa, Homo Sapiens
TMDALWGLL

SEQ ID NO: 1178995 - protein, 9 aa, Homo Sapiens
IPLLLLQNI

SEQ ID NO: 1178996 - protein, 9 aa, Homo Sapiens
LETLPRSKI

SEQ ID NO: 1178997 - protein, 9 aa, Homo Sapiens
DMPRPSISA

SEQ ID NO: 1178998 - protein, 9 aa, Homo Sapiens
GHTSTVCCM

SEQ ID NO: 1178999 - protein, 9 aa, Homo Sapiens
LARPLPWPL

SEQ ID NO: 1179000 - protein, 9 aa, Homo Sapiens
ISRESPWEA

SEQ ID NO: 1179001 - protein, 9 aa, Homo Sapiens
VITKNNDLV

SEQ ID NO: 1179002 - protein, 9 aa, Homo Sapiens
NLPPICIEY

SEQ ID NO: 1179003 - protein, 9 aa, Homo Sapiens
ECEFYSSQS

SEQ ID NO: 1179004 - protein, 9 aa, Homo Sapiens
LPMSPPRPQ

SEQ ID NO: 1179005 - protein, 9 aa, Homo Sapiens
TGQPRPSHS

SEQ ID NO: 1179006 - protein, 9 aa, Homo Sapiens
VEAQQKKLQ

SEQ ID NO: 1179007 - protein, 9 aa, Homo Sapiens
TVRLLELPT

SEQ ID NO: 1179008 - protein, 9 aa, Homo Sapiens
RQHVQKYPI

SEQ ID NO: 1179009 - protein, 9 aa, Homo Sapiens
AKLVALELL

SEQ ID NO: 1179010 - protein, 9 aa, Homo Sapiens
QKRREQRER

SEQ ID NO: 1179011 - protein, 9 aa, Homo Sapiens
FTMAVSTSN

SEQ ID NO: 1179012 - protein, 9 aa, Homo Sapiens
PLPLPPQPR

SEQ ID NO: 1179013 - protein, 9 aa, Homo Sapiens
CSIYKSTVN

SEQ ID NO: 1179014 - protein, 9 aa, Homo Sapiens
SSASSSGNT

SEQ ID NO: 1179015 - protein, 9 aa, Homo Sapiens
FSGTYPGDV

SEQ ID NO: 1179016 - protein, 9 aa, Homo Sapiens
ESEFVPFLT

SEQ ID NO: 1179017 - protein, 9 aa, Homo Sapiens
DFLKTRVSL

SEQ ID NO: 1179018 - protein, 9 aa, Homo Sapiens
QGSPCLGSQ

SEQ ID NO: 1179019 - protein, 9 aa, Homo Sapiens
KHSSSQCTQ

SEQ ID NO: 1179020 - protein, 9 aa, Homo Sapiens
GLLGCSSHQ

SEQ ID NO: 1179021 - protein, 9 aa, Homo Sapiens
QTLQGLQLD

SEQ ID NO: 1179022 - protein, 9 aa, Homo Sapiens
KTQSGQVLR

SEQ ID NO: 1179023 - protein, 9 aa, Homo Sapiens
HGLEATPSD

SEQ ID NO: 1179024 - protein, 9 aa, Homo Sapiens
HTVDMLRCL

SEQ ID NO: 1179025 - protein, 9 aa, Homo Sapiens
TSVKEMDEE

SEQ ID NO: 1179026 - protein, 9 aa, Homo Sapiens
PPVLVKEKE

SEQ ID NO: 1179027 - protein, 9 aa, Homo Sapiens
CSPAHWLRA

SEQ ID NO: 1179028 - protein, 9 aa, Homo Sapiens
SPPATATWR

SEQ ID NO: 1179029 - protein, 9 aa, Homo Sapiens
SGFPGGGGV

SEQ ID NO: 1179030 - protein, 9 aa, Homo Sapiens
LLLPVQLLC

SEQ ID NO: 1179031 - protein, 9 aa, Homo Sapiens
RLEAGLEHV

SEQ ID NO: 1179032 - protein, 9 aa, Homo Sapiens
APAPKMCAP

SEQ ID NO: 1179033 - protein, 9 aa, Homo Sapiens
RSKKEDWGK

SEQ ID NO: 1179034 - protein, 9 aa, Homo Sapiens
SSTSRSTCA

SEQ ID NO: 1179035 - protein, 9 aa, Homo Sapiens
PSRGSPPSR

SEQ ID NO: 1179036 - protein, 9 aa, Homo Sapiens
QSPGRAEAR

SEQ ID NO: 1179037 - protein, 9 aa, Homo Sapiens
HLVHDFTNA

SEQ ID NO: 1179038 - protein, 9 aa, Homo Sapiens
VSVIMNLVK

SEQ ID NO: 1179039 - protein, 9 aa, Homo Sapiens
AAGPPSAGV

SEQ ID NO: 1179040 - protein, 9 aa, Homo Sapiens
CYLYQEFLL

SEQ ID NO: 1179041 - protein, 9 aa, Homo Sapiens
ELRRTVNTL

SEQ ID NO: 1179042 - protein, 9 aa, Homo Sapiens
PQACIQLSG

SEQ ID NO: 1179043 - protein, 9 aa, Homo Sapiens
KKNWSGGRG

SEQ ID NO: 1179044 - protein, 9 aa, Homo Sapiens
MPQMQLQAL

SEQ ID NO: 1179045 - protein, 9 aa, Homo Sapiens
GVGGRGRGQ

SEQ ID NO: 1179046 - protein, 9 aa, Homo Sapiens
PICFTMAVS

SEQ ID NO: 1179047 - protein, 9 aa, Homo Sapiens
DYSLKIQVS

SEQ ID NO: 1179048 - protein, 9 aa, Homo Sapiens
VKIYITVQN

SEQ ID NO: 1179049 - protein, 9 aa, Homo Sapiens
SETLAARQE

SEQ ID NO: 1179050 - protein, 9 aa, Homo Sapiens
VCCLRCCFS

SEQ ID NO: 1179051 - protein, 9 aa, Homo Sapiens
PRPPPPRSW

SEQ ID NO: 1179052 - protein, 9 aa, Homo Sapiens
LIFLEGVQL

SEQ ID NO: 1179053 - protein, 9 aa, Homo Sapiens
TPTSQPKSK

SEQ ID NO: 1179054 - protein, 9 aa, Homo Sapiens
ASRPASPLF

SEQ ID NO: 1179055 - protein, 9 aa, Homo Sapiens
RTTLRKSSS

SEQ ID NO: 1179056 - protein, 9 aa, Homo Sapiens
SMQRTREGP

SEQ ID NO: 1179057 - protein, 9 aa, Homo Sapiens
ILFFVMSCL

SEQ ID NO: 1179058 - protein, 9 aa, Homo Sapiens
CQSGTCSGR

SEQ ID NO: 1179059 - protein, 9 aa, Homo Sapiens
GASTSHKHD

SEQ ID NO: 1179060 - protein, 9 aa, Homo Sapiens
AHQRTGRQH

SEQ ID NO: 1179061 - protein, 9 aa, Homo Sapiens
KMTLKALVK

SEQ ID NO: 1179062 - protein, 9 aa, Homo Sapiens
PRCRPAVAS

SEQ ID NO: 1179063 - protein, 9 aa, Homo Sapiens
KDTSTIKVN

SEQ ID NO: 1179064 - protein, 9 aa, Homo Sapiens
PPPQPGNQR

SEQ ID NO: 1179065 - protein, 9 aa, Homo Sapiens
LTEKIHQMG

SEQ ID NO: 1179066 - protein, 9 aa, Homo Sapiens
TKRSRAREE

SEQ ID NO: 1179067 - protein, 9 aa, Homo Sapiens
RSWLPCRGP

SEQ ID NO: 1179068 - protein, 9 aa, Homo Sapiens
HSPRRSSGS

SEQ ID NO: 1179069 - protein, 9 aa, Homo Sapiens
QRYTKPGAE

SEQ ID NO: 1179070 - protein, 9 aa, Homo Sapiens
VNTGEKRYK

SEQ ID NO: 1179071 - protein, 9 aa, Homo Sapiens
NQLRNHYII

SEQ ID NO: 1179072 - protein, 9 aa, Homo Sapiens
QNASLICHR

SEQ ID NO: 1179073 - protein, 9 aa, Homo Sapiens
FRVLAIMQD

SEQ ID NO: 1179074 - protein, 9 aa, Homo Sapiens
CWQRRTAAP

SEQ ID NO: 1179075 - protein, 9 aa, Homo Sapiens
PKRLKASLP

SEQ ID NO: 1179076 - protein, 9 aa, Homo Sapiens
YYQFHRSLW

SEQ ID NO: 1179077 - protein, 9 aa, Homo Sapiens
SRAEKPTAA

SEQ ID NO: 1179078 - protein, 9 aa, Homo Sapiens
AVNGLGSGH

SEQ ID NO: 1179079 - protein, 9 aa, Homo Sapiens
TTSPSRCCP

SEQ ID NO: 1179080 - protein, 9 aa, Homo Sapiens
QKNKDREHY

SEQ ID NO: 1179081 - protein, 9 aa, Homo Sapiens
LAREKVGPL

SEQ ID NO: 1179082 - protein, 9 aa, Homo Sapiens
GQEVHLGSF

SEQ ID NO: 1179083 - protein, 9 aa, Homo Sapiens
HEPGAITEE

SEQ ID NO: 1179084 - protein, 9 aa, Homo Sapiens
IWPRQASRL

SEQ ID NO: 1179085 - protein, 9 aa, Homo Sapiens
PTPNHTGCH

SEQ ID NO: 1179086 - protein, 9 aa, Homo Sapiens
ENFLYYEKL

SEQ ID NO: 1179087 - protein, 9 aa, Homo Sapiens
RGSFQNDGL

SEQ ID NO: 1179088 - protein, 9 aa, Homo Sapiens
LWLNASRDK

SEQ ID NO: 1179089 - protein, 9 aa, Homo Sapiens
GAVRQEPVQ

SEQ ID NO: 1179090 - protein, 9 aa, Homo Sapiens
PSSPVPQPQ

SEQ ID NO: 1179091 - protein, 9 aa, Homo Sapiens
TSRRARFSP

SEQ ID NO: 1179092 - protein, 9 aa, Homo Sapiens
GEQRLTPTS

SEQ ID NO: 1179093 - protein, 9 aa, Homo Sapiens
FSKWCRPWL

SEQ ID NO: 1179094 - protein, 9 aa, Homo Sapiens
ERYGTLKTP

SEQ ID NO: 1179095 - protein, 9 aa, Homo Sapiens
SPNVHTWNQ

SEQ ID NO: 1179096 - protein, 9 aa, Homo Sapiens
IQLSHANCM

SEQ ID NO: 1179097 - protein, 9 aa, Homo Sapiens
DHNQVGRAG

SEQ ID NO: 1179098 - protein, 9 aa, Homo Sapiens
GLKSSSFWS

SEQ ID NO: 1179099 - protein, 9 aa, Homo Sapiens
LLLKIMGQA

SEQ ID NO: 1179100 - protein, 9 aa, Homo Sapiens
TKAVIFCLS

SEQ ID NO: 1179101 - protein, 9 aa, Homo Sapiens
GELVQPFFE

SEQ ID NO: 1179102 - protein, 9 aa, Homo Sapiens
PPGPSWTWG

SEQ ID NO: 1179103 - protein, 9 aa, Homo Sapiens
KFGSQGWNR

SEQ ID NO: 1179104 - protein, 9 aa, Homo Sapiens
LLLLNLDTH

SEQ ID NO: 1179105 - protein, 9 aa, Homo Sapiens
CRGKNENES

SEQ ID NO: 1179106 - protein, 9 aa, Homo Sapiens
TRVALTSSS

SEQ ID NO: 1179107 - protein, 9 aa, Homo Sapiens
PRAMRPSGG

SEQ ID NO: 1179108 - protein, 9 aa, Homo Sapiens
DLVELSKVK

SEQ ID NO: 1179109 - protein, 9 aa, Homo Sapiens
FLAHVCGSS

SEQ ID NO: 1179110 - protein, 9 aa, Homo Sapiens
TGMVAHTWN

SEQ ID NO: 1179111 - protein, 9 aa, Homo Sapiens
CPKHWFQLC

SEQ ID NO: 1179112 - protein, 9 aa, Homo Sapiens
PLMKPPRLT

SEQ ID NO: 1179113 - protein, 9 aa, Homo Sapiens
GPLWLGVAW

SEQ ID NO: 1179114 - protein, 9 aa, Homo Sapiens
GRAEGALRS

SEQ ID NO: 1179115 - protein, 9 aa, Homo Sapiens
GLLNRCRGV

SEQ ID NO: 1179116 - protein, 9 aa, Homo Sapiens
PPRETDPCW

SEQ ID NO: 1179117 - protein, 9 aa, Homo Sapiens
DTSLAQKPN

SEQ ID NO: 1179118 - protein, 9 aa, Homo Sapiens
VGDSMEAGQ

SEQ ID NO: 1179119 - protein, 9 aa, Homo Sapiens
IPSVAGRCK

SEQ ID NO: 1179120 - protein, 9 aa, Homo Sapiens
HGSKDEWRW

SEQ ID NO: 1179121 - protein, 9 aa, Homo Sapiens
PVAPPPQPG

SEQ ID NO: 1179122 - protein, 9 aa, Homo Sapiens
ATPPACQGM

SEQ ID NO: 1179123 - protein, 9 aa, Homo Sapiens
LEKNSGSQS

SEQ ID NO: 1179124 - protein, 9 aa, Homo Sapiens
NFNVAGKIH

SEQ ID NO: 1179125 - protein, 9 aa, Homo Sapiens
KKQVYLLLL

SEQ ID NO: 1179126 - protein, 9 aa, Homo Sapiens
RLSPSPAGG

SEQ ID NO: 1179127 - protein, 9 aa, Homo Sapiens
KPPLVPVVS

SEQ ID NO: 1179128 - protein, 9 aa, Homo Sapiens
AMWEKGWDK

SEQ ID NO: 1179129 - protein, 9 aa, Homo Sapiens
RICSTTSRR

SEQ ID NO: 1179130 - protein, 9 aa, Homo Sapiens
VGQSATRLY

SEQ ID NO: 1179131 - protein, 9 aa, Homo Sapiens
RQVVVRPQS

SEQ ID NO: 1179132 - protein, 9 aa, Homo Sapiens
QSVLLLGVP

SEQ ID NO: 1179133 - protein, 9 aa, Homo Sapiens
PNTANGWAG

SEQ ID NO: 1179134 - protein, 9 aa, Homo Sapiens
FCELYGDRK

SEQ ID NO: 1179135 - protein, 9 aa, Homo Sapiens
TTEYYPNDG

SEQ ID NO: 1179136 - protein, 9 aa, Homo Sapiens
PCTPRRRLR

SEQ ID NO: 1179137 - protein, 9 aa, Homo Sapiens
NQGEPSGHR

SEQ ID NO: 1179138 - protein, 9 aa, Homo Sapiens
MFAKIFNQF

SEQ ID NO: 1179139 - protein, 9 aa, Homo Sapiens
VSPEASLSI

SEQ ID NO: 1179140 - protein, 9 aa, Homo Sapiens
FTLFLLYGM

SEQ ID NO: 1179141 - protein, 9 aa, Homo Sapiens
SACSAAGRA

SEQ ID NO: 1179142 - protein, 9 aa, Homo Sapiens
QNPHRLRRR

SEQ ID NO: 1179143 - protein, 9 aa, Homo Sapiens
SSDASDGHG

SEQ ID NO: 1179144 - protein, 9 aa, Homo Sapiens
HSHPLLLAL

SEQ ID NO: 1179145 - protein, 9 aa, Homo Sapiens
SCPIPRRDP

SEQ ID NO: 1179146 - protein, 9 aa, Homo Sapiens
ASAILSLRQ

SEQ ID NO: 1179147 - protein, 9 aa, Homo Sapiens
KKHSISTQL

SEQ ID NO: 1179148 - protein, 9 aa, Homo Sapiens
RKRIPVATG

SEQ ID NO: 1179149 - protein, 9 aa, Homo Sapiens
SDEAACENT

SEQ ID NO: 1179150 - protein, 9 aa, Homo Sapiens
TTDNATTTS

SEQ ID NO: 1179151 - protein, 9 aa, Homo Sapiens
CTHRSPSCT

SEQ ID NO: 1179152 - protein, 9 aa, Homo Sapiens
SAYSAKTPC

SEQ ID NO: 1179153 - protein, 9 aa, Homo Sapiens
GPWPRTSPR

SEQ ID NO: 1179154 - protein, 9 aa, Homo Sapiens
SPTPSAPPQ

SEQ ID NO: 1179155 - protein, 9 aa, Homo Sapiens
TPLFPLLSR

SEQ ID NO: 1179156 - protein, 9 aa, Homo Sapiens
FKDVEGKSR

SEQ ID NO: 1179157 - protein, 9 aa, Homo Sapiens
DSAVTVAVG

SEQ ID NO: 1179158 - protein, 9 aa, Homo Sapiens
PRLSLNGVC

SEQ ID NO: 1179159 - protein, 9 aa, Homo Sapiens
GSSQNPHRL

SEQ ID NO: 1179160 - protein, 9 aa, Homo Sapiens
GKGVSWGAG

SEQ ID NO: 1179161 - protein, 9 aa, Homo Sapiens
AVTAAAEAD

SEQ ID NO: 1179162 - protein, 9 aa, Homo Sapiens
EKVGPLSHC

SEQ ID NO: 1179163 - protein, 9 aa, Homo Sapiens
YPPARQPSR

SEQ ID NO: 1179164 - protein, 9 aa, Homo Sapiens
HKVFSDYLR

SEQ ID NO: 1179165 - protein, 9 aa, Homo Sapiens
CPSAQGRKP

SEQ ID NO: 1179166 - protein, 9 aa, Homo Sapiens
RFRIRQPIL

SEQ ID NO: 1179167 - protein, 9 aa, Homo Sapiens
GRTFRSASH

SEQ ID NO: 1179168 - protein, 9 aa, Homo Sapiens
PRAALSVLL

SEQ ID NO: 1179169 - protein, 9 aa, Homo Sapiens
ALGSRCDRP

SEQ ID NO: 1179170 - protein, 9 aa, Homo Sapiens
ARPRWSRPL

SEQ ID NO: 1179171 - protein, 9 aa, Homo Sapiens
DPVSEITGA

SEQ ID NO: 1179172 - protein, 9 aa, Homo Sapiens
QPPFCPRAR

SEQ ID NO: 1179173 - protein, 9 aa, Homo Sapiens
SPHHPQRCG

SEQ ID NO: 1179174 - protein, 9 aa, Homo Sapiens
RLAGMGLQL

SEQ ID NO: 1179175 - protein, 9 aa, Homo Sapiens
LMQLLNEAD

SEQ ID NO: 1179176 - protein, 9 aa, Homo Sapiens
TTTVLVSLV

SEQ ID NO: 1179177 - protein, 9 aa, Homo Sapiens
SRGLVWGVD

SEQ ID NO: 1179178 - protein, 9 aa, Homo Sapiens
PLQTSTGGI

SEQ ID NO: 1179179 - protein, 9 aa, Homo Sapiens
WWALGVFIY

SEQ ID NO: 1179180 - protein, 9 aa, Homo Sapiens
ETAPWALVG

SEQ ID NO: 1179181 - protein, 9 aa, Homo Sapiens
RMRPSALSF

SEQ ID NO: 1179182 - protein, 9 aa, Homo Sapiens
PLLHPQWAP

SEQ ID NO: 1179183 - protein, 9 aa, Homo Sapiens
MVTMPLLPV

SEQ ID NO: 1179184 - protein, 9 aa, Homo Sapiens
FLTEDKKNG

SEQ ID NO: 1179185 - protein, 9 aa, Homo Sapiens
MTRDSLSNA

SEQ ID NO: 1179186 - protein, 9 aa, Homo Sapiens
GKECLTISF

SEQ ID NO: 1179187 - protein, 9 aa, Homo Sapiens
VQRKDYPSN

SEQ ID NO: 1179188 - protein, 9 aa, Homo Sapiens
PSEVSFPSE

SEQ ID NO: 1179189 - protein, 9 aa, Homo Sapiens
RAWRTSSAC

SEQ ID NO: 1179190 - protein, 9 aa, Homo Sapiens
LGPHPSSPV

SEQ ID NO: 1179191 - protein, 9 aa, Homo Sapiens
AQEAQGILW

SEQ ID NO: 1179192 - protein, 9 aa, Homo Sapiens
YSMPWHSCR

SEQ ID NO: 1179193 - protein, 9 aa, Homo Sapiens
RLFIEHPED

SEQ ID NO: 1179194 - protein, 9 aa, Homo Sapiens
ECGKTFTYS

SEQ ID NO: 1179195 - protein, 9 aa, Homo Sapiens
SRKRHLIFP

SEQ ID NO: 1179196 - protein, 9 aa, Homo Sapiens
AKGDDTYLY

SEQ ID NO: 1179197 - protein, 9 aa, Homo Sapiens
PWDWFPPCG

SEQ ID NO: 1179198 - protein, 9 aa, Homo Sapiens
EMPGDAQGS

SEQ ID NO: 1179199 - protein, 9 aa, Homo Sapiens
RFGELLLFL

SEQ ID NO: 1179200 - protein, 9 aa, Homo Sapiens
SHRRRLPAG

SEQ ID NO: 1179201 - protein, 9 aa, Homo Sapiens
HLRWAVFDE

SEQ ID NO: 1179202 - protein, 9 aa, Homo Sapiens
SPADSSNSH

SEQ ID NO: 1179203 - protein, 9 aa, Homo Sapiens
ILTEKKTQS

SEQ ID NO: 1179204 - protein, 9 aa, Homo Sapiens
LLRLAQQDP

SEQ ID NO: 1179205 - protein, 9 aa, Homo Sapiens
PDVGIGTVH

SEQ ID NO: 1179206 - protein, 9 aa, Homo Sapiens
QKRVSEKNK

SEQ ID NO: 1179207 - protein, 9 aa, Homo Sapiens
NVEHSETSR

SEQ ID NO: 1179208 - protein, 9 aa, Homo Sapiens
HTHPLCPPP

SEQ ID NO: 1179209 - protein, 9 aa, Homo Sapiens
SFMKLYHSL

SEQ ID NO: 1179210 - protein, 9 aa, Homo Sapiens
PPAKHSSSQ

SEQ ID NO: 1179211 - protein, 9 aa, Homo Sapiens
MALTAFIEF

SEQ ID NO: 1179212 - protein, 9 aa, Homo Sapiens
IYQKARQTP

SEQ ID NO: 1179213 - protein, 9 aa, Homo Sapiens
VIERVLRDY

SEQ ID NO: 1179214 - protein, 9 aa, Homo Sapiens
WSGGRGISS

SEQ ID NO: 1179215 - protein, 9 aa, Homo Sapiens
AGVTVHLRK

SEQ ID NO: 1179216 - protein, 9 aa, Homo Sapiens
CHWGAAPGS

SEQ ID NO: 1179217 - protein, 9 aa, Homo Sapiens
GGCHPAWLS

SEQ ID NO: 1179218 - protein, 9 aa, Homo Sapiens
IMVASAQIS

SEQ ID NO: 1179219 - protein, 9 aa, Homo Sapiens
QPTTENTPE

SEQ ID NO: 1179220 - protein, 9 aa, Homo Sapiens
LTVVVLVAV

SEQ ID NO: 1179221 - protein, 9 aa, Homo Sapiens
PRPIRTGPS

SEQ ID NO: 1179222 - protein, 9 aa, Homo Sapiens
GYASCATSS

SEQ ID NO: 1179223 - protein, 9 aa, Homo Sapiens
LVPLLRDPA

SEQ ID NO: 1179224 - protein, 9 aa, Homo Sapiens
GGPTARPAR

SEQ ID NO: 1179225 - protein, 9 aa, Homo Sapiens
FLLAFSSGS

SEQ ID NO: 1179226 - protein, 9 aa, Homo Sapiens
GRLMTCWKA

SEQ ID NO: 1179227 - protein, 9 aa, Homo Sapiens
KEDWGKRSE

SEQ ID NO: 1179228 - protein, 9 aa, Homo Sapiens
RFEPVFFEE

SEQ ID NO: 1179229 - protein, 9 aa, Homo Sapiens
NFTNPNGTI

SEQ ID NO: 1179230 - protein, 9 aa, Homo Sapiens
IKENTTYFE

SEQ ID NO: 1179231 - protein, 9 aa, Homo Sapiens
QGPAEPDVH

SEQ ID NO: 1179232 - protein, 9 aa, Homo Sapiens
WKNSWIQLF

SEQ ID NO: 1179233 - protein, 9 aa, Homo Sapiens
SLKIQVSSL

SEQ ID NO: 1179234 - protein, 9 aa, Homo Sapiens
LDAAALPGS

SEQ ID NO: 1179235 - protein, 9 aa, Homo Sapiens
LLCARLHAT

SEQ ID NO: 1179236 - protein, 9 aa, Homo Sapiens
GTNLKKIHM

SEQ ID NO: 1179237 - protein, 9 aa, Homo Sapiens
TTAPEAPGC

SEQ ID NO: 1179238 - protein, 9 aa, Homo Sapiens
HVVLAQSSH

SEQ ID NO: 1179239 - protein, 9 aa, Homo Sapiens
IYNLIHLVP

SEQ ID NO: 1179240 - protein, 9 aa, Homo Sapiens
RPGASRRWR

SEQ ID NO: 1179241 - protein, 9 aa, Homo Sapiens
INSKSIFCS

SEQ ID NO: 1179242 - protein, 9 aa, Homo Sapiens
FNHCAQPLA

SEQ ID NO: 1179243 - protein, 9 aa, Homo Sapiens
PNLGIWPNR

SEQ ID NO: 1179244 - protein, 9 aa, Homo Sapiens
PSPSEVSFP

SEQ ID NO: 1179245 - protein, 9 aa, Homo Sapiens
VRLFVNRFG

SEQ ID NO: 1179246 - protein, 9 aa, Homo Sapiens
KSLGSASPD

SEQ ID NO: 1179247 - protein, 9 aa, Homo Sapiens
LLSLMSDHL

SEQ ID NO: 1179248 - protein, 9 aa, Homo Sapiens
REPPQSRRA

SEQ ID NO: 1179249 - protein, 9 aa, Homo Sapiens
MELYGPKKC

SEQ ID NO: 1179250 - protein, 9 aa, Homo Sapiens
HSSSQCTQG

SEQ ID NO: 1179251 - protein, 9 aa, Homo Sapiens
WDQFVPPAL

SEQ ID NO: 1179252 - protein, 9 aa, Homo Sapiens
LPHIYPLCS

SEQ ID NO: 1179253 - protein, 9 aa, Homo Sapiens
LQLLDQLVQ

SEQ ID NO: 1179254 - protein, 9 aa, Homo Sapiens
AADFGKIVK

SEQ ID NO: 1179255 - protein, 9 aa, Homo Sapiens
TAENVAKNG

SEQ ID NO: 1179256 - protein, 9 aa, Homo Sapiens
SLGPKASRA

SEQ ID NO: 1179257 - protein, 9 aa, Homo Sapiens
GAHWLGGPT

SEQ ID NO: 1179258 - protein, 9 aa, Homo Sapiens
GHCSGCRPG

SEQ ID NO: 1179259 - protein, 9 aa, Homo Sapiens
VTWSGCSSA

SEQ ID NO: 1179260 - protein, 9 aa, Homo Sapiens
RSDILDLCQ

SEQ ID NO: 1179261 - protein, 9 aa, Homo Sapiens
AAWGNPSWC

SEQ ID NO: 1179262 - protein, 9 aa, Homo Sapiens
ARAEYNITI

SEQ ID NO: 1179263 - protein, 9 aa, Homo Sapiens
GGGPWDWLP

SEQ ID NO: 1179264 - protein, 9 aa, Homo Sapiens
WSGTSAARG

SEQ ID NO: 1179265 - protein, 9 aa, Homo Sapiens
SVATGQPRP

SEQ ID NO: 1179266 - protein, 9 aa, Homo Sapiens
QMLPTLSTL

SEQ ID NO: 1179267 - protein, 9 aa, Homo Sapiens
SVGHIITLL

SEQ ID NO: 1179268 - protein, 9 aa, Homo Sapiens
QKRALTITG

SEQ ID NO: 1179269 - protein, 9 aa, Homo Sapiens
ISQVMPLLL

SEQ ID NO: 1179270 - protein, 9 aa, Homo Sapiens
ADPYEREGL

SEQ ID NO: 1179271 - protein, 9 aa, Homo Sapiens
AWAQHGSPA

SEQ ID NO: 1179272 - protein, 9 aa, Homo Sapiens
PSRVEASVI

SEQ ID NO: 1179273 - protein, 9 aa, Homo Sapiens
SLATCCSSL

SEQ ID NO: 1179274 - protein, 9 aa, Homo Sapiens
QNAATGSFA

SEQ ID NO: 1179275 - protein, 9 aa, Homo Sapiens
RRLPCCVPP

SEQ ID NO: 1179276 - protein, 9 aa, Homo Sapiens
VIVGSAFEV

SEQ ID NO: 1179277 - protein, 9 aa, Homo Sapiens
GALMLAGGF

SEQ ID NO: 1179278 - protein, 9 aa, Homo Sapiens
ANRSWKVKW

SEQ ID NO: 1179279 - protein, 9 aa, Homo Sapiens
RKQTKVLWP

SEQ ID NO: 1179280 - protein, 9 aa, Homo Sapiens
RAGGAVPTY

SEQ ID NO: 1179281 - protein, 9 aa, Homo Sapiens
IRDPARGPA

SEQ ID NO: 1179282 - protein, 9 aa, Homo Sapiens
CIEPLRKAL

SEQ ID NO: 1179283 - protein, 9 aa, Homo Sapiens
KSPAPAWWR

SEQ ID NO: 1179284 - protein, 9 aa, Homo Sapiens
PHPGQEVHL

SEQ ID NO: 1179285 - protein, 9 aa, Homo Sapiens
SVCAPQTTG

SEQ ID NO: 1179286 - protein, 9 aa, Homo Sapiens
SLLNTTKNF

SEQ ID NO: 1179287 - protein, 9 aa, Homo Sapiens
PPRPQGCWP

SEQ ID NO: 1179288 - protein, 9 aa, Homo Sapiens
FLLWQWPFG

SEQ ID NO: 1179289 - protein, 9 aa, Homo Sapiens
LQSLTGAHA

SEQ ID NO: 1179290 - protein, 9 aa, Homo Sapiens
VTAGPEEAA

SEQ ID NO: 1179291 - protein, 9 aa, Homo Sapiens
GVVEQVVTS

SEQ ID NO: 1179292 - protein, 9 aa, Homo Sapiens
PLPAPRPTH

SEQ ID NO: 1179293 - protein, 9 aa, Homo Sapiens
GIYQKPRTL

SEQ ID NO: 1179294 - protein, 9 aa, Homo Sapiens
KNIDWETSH

SEQ ID NO: 1179295 - protein, 9 aa, Homo Sapiens
FILEEHEPG

SEQ ID NO: 1179296 - protein, 9 aa, Homo Sapiens
PPTATNASC

SEQ ID NO: 1179297 - protein, 9 aa, Homo Sapiens
GPPTSCSAT

SEQ ID NO: 1179298 - protein, 9 aa, Homo Sapiens
PFGSIAYCV

SEQ ID NO: 1179299 - protein, 9 aa, Homo Sapiens
ELSENCVYD

SEQ ID NO: 1179300 - protein, 9 aa, Homo Sapiens
KMKEECERI

SEQ ID NO: 1179301 - protein, 9 aa, Homo Sapiens
EVQISWQYL

SEQ ID NO: 1179302 - protein, 9 aa, Homo Sapiens
HQSEDWYHT

SEQ ID NO: 1179303 - protein, 9 aa, Homo Sapiens
VHIAHGRCH

SEQ ID NO: 1179304 - protein, 9 aa, Homo Sapiens
PRLGSRTAT

SEQ ID NO: 1179305 - protein, 9 aa, Homo Sapiens
LFLVFLTIY

SEQ ID NO: 1179306 - protein, 9 aa, Homo Sapiens
SPHDIRIEH

SEQ ID NO: 1179307 - protein, 9 aa, Homo Sapiens
TMVNFCCYY

SEQ ID NO: 1179308 - protein, 9 aa, Homo Sapiens
PPSAAPSMV

SEQ ID NO: 1179309 - protein, 9 aa, Homo Sapiens
ARRKCYISQ

SEQ ID NO: 1179310 - protein, 9 aa, Homo Sapiens
CQFRLTGPG

SEQ ID NO: 1179311 - protein, 9 aa, Homo Sapiens
SLRQTLQGL

SEQ ID NO: 1179312 - protein, 9 aa, Homo Sapiens
WATQGPAAP

SEQ ID NO: 1179313 - protein, 9 aa, Homo Sapiens
RGQGHIDDE

SEQ ID NO: 1179314 - protein, 9 aa, Homo Sapiens
HSTRSSGVW

SEQ ID NO: 1179315 - protein, 9 aa, Homo Sapiens
SLPAGPSAL

SEQ ID NO: 1179316 - protein, 9 aa, Homo Sapiens
KHLKTLKNW

SEQ ID NO: 1179317 - protein, 9 aa, Homo Sapiens
RNYQFFIDT

SEQ ID NO: 1179318 - protein, 9 aa, Homo Sapiens
DYVRTCTLH

SEQ ID NO: 1179319 - protein, 9 aa, Homo Sapiens
AGVLKQDLV

SEQ ID NO: 1179320 - protein, 9 aa, Homo Sapiens
LPALSRTGR

SEQ ID NO: 1179321 - protein, 9 aa, Homo Sapiens
VTAWHPHQG

SEQ ID NO: 1179322 - protein, 9 aa, Homo Sapiens
PVFSGQLAG

SEQ ID NO: 1179323 - protein, 9 aa, Homo Sapiens
AVDVGDSME

SEQ ID NO: 1179324 - protein, 9 aa, Homo Sapiens
AWTRASRCC

SEQ ID NO: 1179325 - protein, 9 aa, Homo Sapiens
RCRGKNENE

SEQ ID NO: 1179326 - protein, 9 aa, Homo Sapiens
CDFCVTAPR

SEQ ID NO: 1179327 - protein, 9 aa, Homo Sapiens
INAGKQTVM

SEQ ID NO: 1179328 - protein, 9 aa, Homo Sapiens
AFIILEKNP

SEQ ID NO: 1179329 - protein, 9 aa, Homo Sapiens
ISFHLLINS

SEQ ID NO: 1179330 - protein, 9 aa, Homo Sapiens
SLLSSPMHG

SEQ ID NO: 1179331 - protein, 9 aa, Homo Sapiens
RTIQANCTS

SEQ ID NO: 1179332 - protein, 9 aa, Homo Sapiens
HDQSQASKR

SEQ ID NO: 1179333 - protein, 9 aa, Homo Sapiens
NANNRLLFT

SEQ ID NO: 1179334 - protein, 9 aa, Homo Sapiens
VPGGESEKT

SEQ ID NO: 1179335 - protein, 9 aa, Homo Sapiens
TVLGGMVYT

SEQ ID NO: 1179336 - protein, 9 aa, Homo Sapiens
PEQKCNPIC

SEQ ID NO: 1179337 - protein, 9 aa, Homo Sapiens
STSPRPPST

SEQ ID NO: 1179338 - protein, 9 aa, Homo Sapiens
PAGSAADPE

SEQ ID NO: 1179339 - protein, 9 aa, Homo Sapiens
HWLQRLGWW

SEQ ID NO: 1179340 - protein, 9 aa, Homo Sapiens
VFVVGVVEQ

SEQ ID NO: 1179341 - protein, 9 aa, Homo Sapiens
ELFDSNTSR

SEQ ID NO: 1179342 - protein, 9 aa, Homo Sapiens
VIHLLNGLL

SEQ ID NO: 1179343 - protein, 9 aa, Homo Sapiens
SPAHWLRAS

SEQ ID NO: 1179344 - protein, 9 aa, Homo Sapiens
HRGGRACPH

SEQ ID NO: 1179345 - protein, 9 aa, Homo Sapiens
LASKASRAL

SEQ ID NO: 1179346 - protein, 9 aa, Homo Sapiens
QELERLLEL

SEQ ID NO: 1179347 - protein, 9 aa, Homo Sapiens
STEVQAPPP

SEQ ID NO: 1179348 - protein, 9 aa, Homo Sapiens
VQDIIVSPD

SEQ ID NO: 1179349 - protein, 9 aa, Homo Sapiens
HCGAPPIRD

SEQ ID NO: 1179350 - protein, 9 aa, Homo Sapiens
VVNKPYMTQ

SEQ ID NO: 1179351 - protein, 9 aa, Homo Sapiens
EELGAAHDV

SEQ ID NO: 1179352 - protein, 9 aa, Homo Sapiens
AHYSRADAA

SEQ ID NO: 1179353 - protein, 9 aa, Homo Sapiens
CGRAERDGH

SEQ ID NO: 1179354 - protein, 9 aa, Homo Sapiens
LMERPDWEI

SEQ ID NO: 1179355 - protein, 9 aa, Homo Sapiens
LEPRSSRLW

SEQ ID NO: 1179356 - protein, 9 aa, Homo Sapiens
VAYSSMIYR

SEQ ID NO: 1179357 - protein, 9 aa, Homo Sapiens
SHRPLTSCT

SEQ ID NO: 1179358 - protein, 9 aa, Homo Sapiens
SGCRPSNPW

SEQ ID NO: 1179359 - protein, 9 aa, Homo Sapiens
RDANIKSPG

SEQ ID NO: 1179360 - protein, 9 aa, Homo Sapiens
PQDPPSDTT

SEQ ID NO: 1179361 - protein, 9 aa, Homo Sapiens
CRRRPSCHR

SEQ ID NO: 1179362 - protein, 9 aa, Homo Sapiens
CSARHREAV

SEQ ID NO: 1179363 - protein, 9 aa, Homo Sapiens
AFGTPSWRP

SEQ ID NO: 1179364 - protein, 9 aa, Homo Sapiens
DDKNVCRRF

SEQ ID NO: 1179365 - protein, 9 aa, Homo Sapiens
DSRKRHLIF

SEQ ID NO: 1179366 - protein, 9 aa, Homo Sapiens
KQACICPSY

SEQ ID NO: 1179367 - protein, 9 aa, Homo Sapiens
RTTPADSSA

SEQ ID NO: 1179368 - protein, 9 aa, Homo Sapiens
CCCRRRRCC

SEQ ID NO: 1179369 - protein, 9 aa, Homo Sapiens
PRAEPPPPP

SEQ ID NO: 1179370 - protein, 9 aa, Homo Sapiens
EHKTISFEG

SEQ ID NO: 1179371 - protein, 9 aa, Homo Sapiens
ETGSPPTKQ

SEQ ID NO: 1179372 - protein, 9 aa, Homo Sapiens
GSAESAGIT

SEQ ID NO: 1179373 - protein, 9 aa, Homo Sapiens
MWGPTAAPL

SEQ ID NO: 1179374 - protein, 9 aa, Homo Sapiens
VRAMLEFQL

SEQ ID NO: 1179375 - protein, 9 aa, Homo Sapiens
GNGCAGGGV

SEQ ID NO: 1179376 - protein, 9 aa, Homo Sapiens
LAQWSPVIA

SEQ ID NO: 1179377 - protein, 9 aa, Homo Sapiens
EELYQKRAL

SEQ ID NO: 1179378 - protein, 9 aa, Homo Sapiens
KPTPPPQSQ

SEQ ID NO: 1179379 - protein, 9 aa, Homo Sapiens
FFSPNVHTW

SEQ ID NO: 1179380 - protein, 9 aa, Homo Sapiens
GPQGPLWLG

SEQ ID NO: 1179381 - protein, 9 aa, Homo Sapiens
AQLMLMGSQ

SEQ ID NO: 1179382 - protein, 9 aa, Homo Sapiens
RSPKCIIHG

SEQ ID NO: 1179383 - protein, 9 aa, Homo Sapiens
RAPRTESSQ

SEQ ID NO: 1179384 - protein, 9 aa, Homo Sapiens
KSSEFLSEP

SEQ ID NO: 1179385 - protein, 9 aa, Homo Sapiens
HRPRRAPRR

SEQ ID NO: 1179386 - protein, 9 aa, Homo Sapiens
CTSKAWTPR

SEQ ID NO: 1179387 - protein, 9 aa, Homo Sapiens
PARVFTGFV

SEQ ID NO: 1179388 - protein, 9 aa, Homo Sapiens
DGVGQASLQ

SEQ ID NO: 1179389 - protein, 9 aa, Homo Sapiens
YRVLGGWAK

SEQ ID NO: 1179390 - protein, 9 aa, Homo Sapiens
TWAYREEPE

SEQ ID NO: 1179391 - protein, 9 aa, Homo Sapiens
SDPEAGDSD

SEQ ID NO: 1179392 - protein, 9 aa, Homo Sapiens
VTRSGLKKT

SEQ ID NO: 1179393 - protein, 9 aa, Homo Sapiens
STTSRRARF

SEQ ID NO: 1179394 - protein, 9 aa, Homo Sapiens
QRVGETRAL

SEQ ID NO: 1179395 - protein, 9 aa, Homo Sapiens
PPQSRRATC

SEQ ID NO: 1179396 - protein, 9 aa, Homo Sapiens
EGLEDAPQL

SEQ ID NO: 1179397 - protein, 9 aa, Homo Sapiens
LFYYKLAGF

SEQ ID NO: 1179398 - protein, 9 aa, Homo Sapiens
TIEMVIPVR

SEQ ID NO: 1179399 - protein, 9 aa, Homo Sapiens
LGREEIQVW

SEQ ID NO: 1179400 - protein, 9 aa, Homo Sapiens
WSEMLDITT

SEQ ID NO: 1179401 - protein, 9 aa, Homo Sapiens
EDLEHKYWK

SEQ ID NO: 1179402 - protein, 9 aa, Homo Sapiens
TYPGDVRHG

SEQ ID NO: 1179403 - protein, 9 aa, Homo Sapiens
VLLQRQHAL

SEQ ID NO: 1179404 - protein, 9 aa, Homo Sapiens
VASAYSAKT

SEQ ID NO: 1179405 - protein, 9 aa, Homo Sapiens
GRHGEQRLT

SEQ ID NO: 1179406 - protein, 9 aa, Homo Sapiens
KKVADGHFH

SEQ ID NO: 1179407 - protein, 9 aa, Homo Sapiens
VTLEVLLIR

SEQ ID NO: 1179408 - protein, 9 aa, Homo Sapiens
DHIYDLNIP

SEQ ID NO: 1179409 - protein, 9 aa, Homo Sapiens
LQNVSQHVV

SEQ ID NO: 1179410 - protein, 9 aa, Homo Sapiens
VADRRNSNR

SEQ ID NO: 1179411 - protein, 9 aa, Homo Sapiens
ATPLPVADT

SEQ ID NO: 1179412 - protein, 9 aa, Homo Sapiens
SPSSTPAEE

SEQ ID NO: 1179413 - protein, 9 aa, Homo Sapiens
VASSSGGRT

SEQ ID NO: 1179414 - protein, 9 aa, Homo Sapiens
AASRDSFKN

SEQ ID NO: 1179415 - protein, 9 aa, Homo Sapiens
VVVKIPTGA

SEQ ID NO: 1179416 - protein, 9 aa, Homo Sapiens
HLACMSPPL

SEQ ID NO: 1179417 - protein, 9 aa, Homo Sapiens
SANVNHVVI

SEQ ID NO: 1179418 - protein, 9 aa, Homo Sapiens
AGITLRSLF

SEQ ID NO: 1179419 - protein, 9 aa, Homo Sapiens
STIKVNQVQ

SEQ ID NO: 1179420 - protein, 9 aa, Homo Sapiens
GESHLQHSP

SEQ ID NO: 1179421 - protein, 9 aa, Homo Sapiens
TNNTMLWNS

SEQ ID NO: 1179422 - protein, 9 aa, Homo Sapiens
SRLQGAIHE

SEQ ID NO: 1179423 - protein, 9 aa, Homo Sapiens
IFACVCSFA

SEQ ID NO: 1179424 - protein, 9 aa, Homo Sapiens
HWNWVGTIA

SEQ ID NO: 1179425 - protein, 9 aa, Homo Sapiens
KRLCILYIY

SEQ ID NO: 1179426 - protein, 9 aa, Homo Sapiens
ERANTCNSV

SEQ ID NO: 1179427 - protein, 9 aa, Homo Sapiens
LTGAHACCR

SEQ ID NO: 1179428 - protein, 9 aa, Homo Sapiens
STLDSSSRG

SEQ ID NO: 1179429 - protein, 9 aa, Homo Sapiens
CSCSPCRAL

SEQ ID NO: 1179430 - protein, 9 aa, Homo Sapiens
APSSGVPNA

SEQ ID NO: 1179431 - protein, 9 aa, Homo Sapiens
VLLGIYLVT

SEQ ID NO: 1179432 - protein, 9 aa, Homo Sapiens
PRRTRSAWG

SEQ ID NO: 1179433 - protein, 9 aa, Homo Sapiens
KDKKYKKRK

SEQ ID NO: 1179434 - protein, 9 aa, Homo Sapiens
AWWGDRASR

SEQ ID NO: 1179435 - protein, 9 aa, Homo Sapiens
RAMKVRGVP

SEQ ID NO: 1179436 - protein, 9 aa, Homo Sapiens
PLLPLQGAR

SEQ ID NO: 1179437 - protein, 9 aa, Homo Sapiens
KGGGALLYS

SEQ ID NO: 1179438 - protein, 9 aa, Homo Sapiens
APTGRPRMS

SEQ ID NO: 1179439 - protein, 9 aa, Homo Sapiens
IRWSPLPAL

SEQ ID NO: 1179440 - protein, 9 aa, Homo Sapiens
LAQVSWPQL

SEQ ID NO: 1179441 - protein, 9 aa, Homo Sapiens
DGYMDMSSF

SEQ ID NO: 1179442 - protein, 9 aa, Homo Sapiens
WRQRSIVIL

SEQ ID NO: 1179443 - protein, 9 aa, Homo Sapiens
PIITWENDQ

SEQ ID NO: 1179444 - protein, 9 aa, Homo Sapiens
NVNEKIKIS

SEQ ID NO: 1179445 - protein, 9 aa, Homo Sapiens
IRDCKAQQV

SEQ ID NO: 1179446 - protein, 9 aa, Homo Sapiens
CYRRGRDKS

SEQ ID NO: 1179447 - protein, 9 aa, Homo Sapiens
RCSPSPNCG

SEQ ID NO: 1179448 - protein, 9 aa, Homo Sapiens
HPHKPEPGG

SEQ ID NO: 1179449 - protein, 9 aa, Homo Sapiens
CSRATASHP

SEQ ID NO: 1179450 - protein, 9 aa, Homo Sapiens
TVHLRKKVG

SEQ ID NO: 1179451 - protein, 9 aa, Homo Sapiens
DEDQQRGHD

SEQ ID NO: 1179452 - protein, 9 aa, Homo Sapiens
LTPSPQGGP

SEQ ID NO: 1179453 - protein, 9 aa, Homo Sapiens
PDHNQVGRA

SEQ ID NO: 1179454 - protein, 9 aa, Homo Sapiens
RTGPSLSRW

SEQ ID NO: 1179455 - protein, 9 aa, Homo Sapiens
VAFIILEKN

SEQ ID NO: 1179456 - protein, 9 aa, Homo Sapiens
LSNYYVGSL

SEQ ID NO: 1179457 - protein, 9 aa, Homo Sapiens
EELLEEIYM

SEQ ID NO: 1179458 - protein, 9 aa, Homo Sapiens
NWKQLHSSG

SEQ ID NO: 1179459 - protein, 9 aa, Homo Sapiens
FLNEFKNNP

SEQ ID NO: 1179460 - protein, 9 aa, Homo Sapiens
DRGFVLYAM

SEQ ID NO: 1179461 - protein, 9 aa, Homo Sapiens
NGRAACGAS

SEQ ID NO: 1179462 - protein, 9 aa, Homo Sapiens
GPLETPARW

SEQ ID NO: 1179463 - protein, 9 aa, Homo Sapiens
GSSLLSSPM

SEQ ID NO: 1179464 - protein, 9 aa, Homo Sapiens
LGTTTKEEM

SEQ ID NO: 1179465 - protein, 9 aa, Homo Sapiens
QRMSRQPSA

SEQ ID NO: 1179466 - protein, 9 aa, Homo Sapiens
APAQSPGRA

SEQ ID NO: 1179467 - protein, 9 aa, Homo Sapiens
ELFLLVSLA

SEQ ID NO: 1179468 - protein, 9 aa, Homo Sapiens
LVDALLMSP

SEQ ID NO: 1179469 - protein, 9 aa, Homo Sapiens
VGSNGSKKF

SEQ ID NO: 1179470 - protein, 9 aa, Homo Sapiens
WSGDSACSP

SEQ ID NO: 1179471 - protein, 9 aa, Homo Sapiens
GGIYMGTDV

SEQ ID NO: 1179472 - protein, 9 aa, Homo Sapiens
AVHGLALRV

SEQ ID NO: 1179473 - protein, 9 aa, Homo Sapiens
MVTMPPQVC

SEQ ID NO: 1179474 - protein, 9 aa, Homo Sapiens
PLGMPSDIH

SEQ ID NO: 1179475 - protein, 9 aa, Homo Sapiens
SGRSAASSA

SEQ ID NO: 1179476 - protein, 9 aa, Homo Sapiens
VLVGCDGGV

SEQ ID NO: 1179477 - protein, 9 aa, Homo Sapiens
GSCRSPRST

SEQ ID NO: 1179478 - protein, 9 aa, Homo Sapiens
PPSTLLGAL

SEQ ID NO: 1179479 - protein, 9 aa, Homo Sapiens
QLSGGLLQC

SEQ ID NO: 1179480 - protein, 9 aa, Homo Sapiens
DTLEGPNIL

SEQ ID NO: 1179481 - protein, 9 aa, Homo Sapiens
APRTRMSPP

SEQ ID NO: 1179482 - protein, 9 aa, Homo Sapiens
GIPGSLPPI

SEQ ID NO: 1179483 - protein, 9 aa, Homo Sapiens
CAPKHARTF

SEQ ID NO: 1179484 - protein, 9 aa, Homo Sapiens
PCQTCMTRW

SEQ ID NO: 1179485 - protein, 9 aa, Homo Sapiens
QSPHSPKHT

SEQ ID NO: 1179486 - protein, 9 aa, Homo Sapiens
CPYGPRAPG

SEQ ID NO: 1179487 - protein, 9 aa, Homo Sapiens
PAWSRGAAR

SEQ ID NO: 1179488 - protein, 9 aa, Homo Sapiens
CTHIKEVHG

SEQ ID NO: 1179489 - protein, 9 aa, Homo Sapiens
VGEPRHCIE

SEQ ID NO: 1179490 - protein, 9 aa, Homo Sapiens
ACTPSRPGS

SEQ ID NO: 1179491 - protein, 9 aa, Homo Sapiens
MLLAHRLRR

SEQ ID NO: 1179492 - protein, 9 aa, Homo Sapiens
SPPQGARSD

SEQ ID NO: 1179493 - protein, 9 aa, Homo Sapiens
WSSRESEHN

SEQ ID NO: 1179494 - protein, 9 aa, Homo Sapiens
TCYIQSSSP

SEQ ID NO: 1179495 - protein, 9 aa, Homo Sapiens
ESQMAIEER

SEQ ID NO: 1179496 - protein, 9 aa, Homo Sapiens
TADSRKRHL

SEQ ID NO: 1179497 - protein, 9 aa, Homo Sapiens
PAPIITWEN

SEQ ID NO: 1179498 - protein, 9 aa, Homo Sapiens
RNLAENISC

SEQ ID NO: 1179499 - protein, 9 aa, Homo Sapiens
LPKGAASCT

SEQ ID NO: 1179500 - protein, 9 aa, Homo Sapiens
VRAQADLQL

SEQ ID NO: 1179501 - protein, 9 aa, Homo Sapiens
TCARLSASS

SEQ ID NO: 1179502 - protein, 9 aa, Homo Sapiens
SSSGATGTT

SEQ ID NO: 1179503 - protein, 9 aa, Homo Sapiens
PSAPNSFLT

SEQ ID NO: 1179504 - protein, 9 aa, Homo Sapiens
AWWVLAWQQ

SEQ ID NO: 1179505 - protein, 9 aa, Homo Sapiens
ASRALGGHL

SEQ ID NO: 1179506 - protein, 9 aa, Homo Sapiens
TRPRLLPLI

SEQ ID NO: 1179507 - protein, 9 aa, Homo Sapiens
AGGPVRLEY

SEQ ID NO: 1179508 - protein, 9 aa, Homo Sapiens
FERVFGRGG

SEQ ID NO: 1179509 - protein, 9 aa, Homo Sapiens
LGAVGLRVH

SEQ ID NO: 1179510 - protein, 9 aa, Homo Sapiens
ARRPVSLIE

SEQ ID NO: 1179511 - protein, 9 aa, Homo Sapiens
ELVKEAIDH

SEQ ID NO: 1179512 - protein, 9 aa, Homo Sapiens
PAHWLRASS

SEQ ID NO: 1179513 - protein, 9 aa, Homo Sapiens
CTSLRLPIS

SEQ ID NO: 1179514 - protein, 9 aa, Homo Sapiens
RCLQVNQLL

SEQ ID NO: 1179515 - protein, 9 aa, Homo Sapiens
TRPRLLPLT

SEQ ID NO: 1179516 - protein, 9 aa, Homo Sapiens
ASFFMVVGK

SEQ ID NO: 1179517 - protein, 9 aa, Homo Sapiens
SRRSWNRWK

SEQ ID NO: 1179518 - protein, 9 aa, Homo Sapiens
YQFFIDTDW

SEQ ID NO: 1179519 - protein, 9 aa, Homo Sapiens
KSITAMLEL

SEQ ID NO: 1179520 - protein, 9 aa, Homo Sapiens
DVTLELQGD

SEQ ID NO: 1179521 - protein, 9 aa, Homo Sapiens
QMTKRLTVP

SEQ ID NO: 1179522 - protein, 9 aa, Homo Sapiens
YFYLCLAIQ

SEQ ID NO: 1179523 - protein, 9 aa, Homo Sapiens
GRRRYLSGI

SEQ ID NO: 1179524 - protein, 9 aa, Homo Sapiens
KLVRHTEKK

SEQ ID NO: 1179525 - protein, 9 aa, Homo Sapiens
NCSLSLQER

SEQ ID NO: 1179526 - protein, 9 aa, Homo Sapiens
PSTQQISVD

SEQ ID NO: 1179527 - protein, 9 aa, Homo Sapiens
TDQITLLKA

SEQ ID NO: 1179528 - protein, 9 aa, Homo Sapiens
LKNWSVTLS

SEQ ID NO: 1179529 - protein, 9 aa, Homo Sapiens
PTPSRLRSG

SEQ ID NO: 1179530 - protein, 9 aa, Homo Sapiens
NKDVQMRAA

SEQ ID NO: 1179531 - protein, 9 aa, Homo Sapiens
VRRLGSLVL

SEQ ID NO: 1179532 - protein, 9 aa, Homo Sapiens
TCTMRSGQV

SEQ ID NO: 1179533 - protein, 9 aa, Homo Sapiens
RRAGPGSDE

SEQ ID NO: 1179534 - protein, 9 aa, Homo Sapiens
LASRPSRCV

SEQ ID NO: 1179535 - protein, 9 aa, Homo Sapiens
GTRVIFDDY

SEQ ID NO: 1179536 - protein, 9 aa, Homo Sapiens
RAERGSLET

SEQ ID NO: 1179537 - protein, 9 aa, Homo Sapiens
LRASSVVPR

SEQ ID NO: 1179538 - protein, 9 aa, Homo Sapiens
WACATRRMK

SEQ ID NO: 1179539 - protein, 9 aa, Homo Sapiens
RGSSRWCQG

SEQ ID NO: 1179540 - protein, 9 aa, Homo Sapiens
QASRGSKGS

SEQ ID NO: 1179541 - protein, 9 aa, Homo Sapiens
LQRESHHQP

SEQ ID NO: 1179542 - protein, 9 aa, Homo Sapiens
RKSVFDWHV

SEQ ID NO: 1179543 - protein, 9 aa, Homo Sapiens
ESALQVLLP

SEQ ID NO: 1179544 - protein, 9 aa, Homo Sapiens
VLQNARFVF

SEQ ID NO: 1179545 - protein, 9 aa, Homo Sapiens
SFPCSKILL

SEQ ID NO: 1179546 - protein, 9 aa, Homo Sapiens
VGKNTHKVE

SEQ ID NO: 1179547 - protein, 9 aa, Homo Sapiens
WRRRRMRGF

SEQ ID NO: 1179548 - protein, 9 aa, Homo Sapiens
YANSHQETK

SEQ ID NO: 1179549 - protein, 9 aa, Homo Sapiens
QGSLPGSAA

SEQ ID NO: 1179550 - protein, 9 aa, Homo Sapiens
FLKTRVSLL

SEQ ID NO: 1179551 - protein, 9 aa, Homo Sapiens
PTGRPRMSL

SEQ ID NO: 1179552 - protein, 9 aa, Homo Sapiens
NTAPALPMV

SEQ ID NO: 1179553 - protein, 9 aa, Homo Sapiens
GRPLRPPIR

SEQ ID NO: 1179554 - protein, 9 aa, Homo Sapiens
PVKDHVVHT

SEQ ID NO: 1179555 - protein, 9 aa, Homo Sapiens
SHFFSPEDM

SEQ ID NO: 1179556 - protein, 9 aa, Homo Sapiens
DFRKGLGWK

SEQ ID NO: 1179557 - protein, 9 aa, Homo Sapiens
KNSFQHISS

SEQ ID NO: 1179558 - protein, 9 aa, Homo Sapiens
QRLGPSPCN

SEQ ID NO: 1179559 - protein, 9 aa, Homo Sapiens
RQTLQGLQL

SEQ ID NO: 1179560 - protein, 9 aa, Homo Sapiens
WAWKAGTGA

SEQ ID NO: 1179561 - protein, 9 aa, Homo Sapiens
DTRACNLCT

SEQ ID NO: 1179562 - protein, 9 aa, Homo Sapiens
ADVVIRVKA

SEQ ID NO: 1179563 - protein, 9 aa, Homo Sapiens
PARWTCCVP

SEQ ID NO: 1179564 - protein, 9 aa, Homo Sapiens
ITALHIKLW

SEQ ID NO: 1179565 - protein, 9 aa, Homo Sapiens
WSSAPASTR

SEQ ID NO: 1179566 - protein, 9 aa, Homo Sapiens
SYSFFTNVV

SEQ ID NO: 1179567 - protein, 9 aa, Homo Sapiens
WKVHYQCLR

SEQ ID NO: 1179568 - protein, 9 aa, Homo Sapiens
KGLSLSYGP

SEQ ID NO: 1179569 - protein, 9 aa, Homo Sapiens
KTKRQRKSR

SEQ ID NO: 1179570 - protein, 9 aa, Homo Sapiens
SNNRLIKIH

SEQ ID NO: 1179571 - protein, 9 aa, Homo Sapiens
SRTATGTHR

SEQ ID NO: 1179572 - protein, 9 aa, Homo Sapiens
VLTYVWPGG

SEQ ID NO: 1179573 - protein, 9 aa, Homo Sapiens
SIVSTLKRE

SEQ ID NO: 1179574 - protein, 9 aa, Homo Sapiens
ATQSRLQGA

SEQ ID NO: 1179575 - protein, 9 aa, Homo Sapiens
GIDFEDIIK

SEQ ID NO: 1179576 - protein, 9 aa, Homo Sapiens
NAIDIWMAV

SEQ ID NO: 1179577 - protein, 9 aa, Homo Sapiens
PYAGVYLQM

SEQ ID NO: 1179578 - protein, 9 aa, Homo Sapiens
DAPGARPEG

SEQ ID NO: 1179579 - protein, 9 aa, Homo Sapiens
LEGCISVKD

SEQ ID NO: 1179580 - protein, 9 aa, Homo Sapiens
DSFEWSNSL

SEQ ID NO: 1179581 - protein, 9 aa, Homo Sapiens
LAPRLVGAG

SEQ ID NO: 1179582 - protein, 9 aa, Homo Sapiens
GEAAPPAPP

SEQ ID NO: 1179583 - protein, 9 aa, Homo Sapiens
RMGPLPLPH

SEQ ID NO: 1179584 - protein, 9 aa, Homo Sapiens
DDGLDQDEV

SEQ ID NO: 1179585 - protein, 9 aa, Homo Sapiens
ADMWVHSSM

SEQ ID NO: 1179586 - protein, 9 aa, Homo Sapiens
PALRAAAQG

SEQ ID NO: 1179587 - protein, 9 aa, Homo Sapiens
KEEEDSTFT

SEQ ID NO: 1179588 - protein, 9 aa, Homo Sapiens
TRMVLELKC

SEQ ID NO: 1179589 - protein, 9 aa, Homo Sapiens
EKTPPCGST

SEQ ID NO: 1179590 - protein, 9 aa, Homo Sapiens
CNSSFHLNS

SEQ ID NO: 1179591 - protein, 9 aa, Homo Sapiens
TTKESLTTR

SEQ ID NO: 1179592 - protein, 9 aa, Homo Sapiens
SLPGTTRMR

SEQ ID NO: 1179593 - protein, 9 aa, Homo Sapiens
TLATQPPST

SEQ ID NO: 1179594 - protein, 9 aa, Homo Sapiens
SSSLNQQGT

SEQ ID NO: 1179595 - protein, 9 aa, Homo Sapiens
TPGFKGHFL

SEQ ID NO: 1179596 - protein, 9 aa, Homo Sapiens
TWVDHSECG

SEQ ID NO: 1179597 - protein, 9 aa, Homo Sapiens
YKQYEDMVA

SEQ ID NO: 1179598 - protein, 9 aa, Homo Sapiens
GGGVSVYGL

SEQ ID NO: 1179599 - protein, 9 aa, Homo Sapiens
SWQPLRQAK

SEQ ID NO: 1179600 - protein, 9 aa, Homo Sapiens
ESSMTPLDT

SEQ ID NO: 1179601 - protein, 9 aa, Homo Sapiens
EEQGAPLCA

SEQ ID NO: 1179602 - protein, 9 aa, Homo Sapiens
NSGDETLMQ

SEQ ID NO: 1179603 - protein, 9 aa, Homo Sapiens
MQEQECREQ

SEQ ID NO: 1179604 - protein, 9 aa, Homo Sapiens
CRCYRSASP

SEQ ID NO: 1179605 - protein, 9 aa, Homo Sapiens
TATVTKGDV

SEQ ID NO: 1179606 - protein, 9 aa, Homo Sapiens
LGVFIYEMA

SEQ ID NO: 1179607 - protein, 9 aa, Homo Sapiens
GDWVCSQST

SEQ ID NO: 1179608 - protein, 9 aa, Homo Sapiens
EQDQESSEG

SEQ ID NO: 1179609 - protein, 9 aa, Homo Sapiens
TPPVSVSKN

SEQ ID NO: 1179610 - protein, 9 aa, Homo Sapiens
MRRLNYQTQ

SEQ ID NO: 1179611 - protein, 9 aa, Homo Sapiens
NADVVIRVK

SEQ ID NO: 1179612 - protein, 9 aa, Homo Sapiens
RGSSSCSAR

SEQ ID NO: 1179613 - protein, 9 aa, Homo Sapiens
AVHIVCPHH

SEQ ID NO: 1179614 - protein, 9 aa, Homo Sapiens
AAATTSPPT

SEQ ID NO: 1179615 - protein, 9 aa, Homo Sapiens
TCCVPSCSS

SEQ ID NO: 1179616 - protein, 9 aa, Homo Sapiens
FVELPTVAS

SEQ ID NO: 1179617 - protein, 9 aa, Homo Sapiens
PTSQVVTLS

SEQ ID NO: 1179618 - protein, 9 aa, Homo Sapiens
RCLRFPGLA

SEQ ID NO: 1179619 - protein, 9 aa, Homo Sapiens
ARVAGGGQP

SEQ ID NO: 1179620 - protein, 9 aa, Homo Sapiens
KVVDHRLEM

SEQ ID NO: 1179621 - protein, 9 aa, Homo Sapiens
RSSPTRKNR

SEQ ID NO: 1179622 - protein, 9 aa, Homo Sapiens
KLEDHMDGL

SEQ ID NO: 1179623 - protein, 9 aa, Homo Sapiens
AARKAASVL

SEQ ID NO: 1179624 - protein, 9 aa, Homo Sapiens
ISQRRFLVV

SEQ ID NO: 1179625 - protein, 9 aa, Homo Sapiens
IIAAILFFV

SEQ ID NO: 1179626 - protein, 9 aa, Homo Sapiens
KTRVSLLNT

SEQ ID NO: 1179627 - protein, 9 aa, Homo Sapiens
VDLRYETLS

SEQ ID NO: 1179628 - protein, 9 aa, Homo Sapiens
QLDQTLQVQ

SEQ ID NO: 1179629 - protein, 9 aa, Homo Sapiens
ISPTGHLGG

SEQ ID NO: 1179630 - protein, 9 aa, Homo Sapiens
EDWGKRSEG

SEQ ID NO: 1179631 - protein, 9 aa, Homo Sapiens
MFNILQSCK

SEQ ID NO: 1179632 - protein, 9 aa, Homo Sapiens
LPWTTPASG

SEQ ID NO: 1179633 - protein, 9 aa, Homo Sapiens
HGIGKNQPH

SEQ ID NO: 1179634 - protein, 9 aa, Homo Sapiens
CNALAGGLR

SEQ ID NO: 1179635 - protein, 9 aa, Homo Sapiens
PDWEIAIQK

SEQ ID NO: 1179636 - protein, 9 aa, Homo Sapiens
LWQWPFGEL

SEQ ID NO: 1179637 - protein, 9 aa, Homo Sapiens
SRPSRFRIH

SEQ ID NO: 1179638 - protein, 9 aa, Homo Sapiens
KAASVLEAP

SEQ ID NO: 1179639 - protein, 9 aa, Homo Sapiens
FFRDISNSS

SEQ ID NO: 1179640 - protein, 9 aa, Homo Sapiens
GHHCWVHIL

SEQ ID NO: 1179641 - protein, 9 aa, Homo Sapiens
APRLVGAGH

SEQ ID NO: 1179642 - protein, 9 aa, Homo Sapiens
VEGFGGRRQ

SEQ ID NO: 1179643 - protein, 9 aa, Homo Sapiens
SCGLMANYH

SEQ ID NO: 1179644 - protein, 9 aa, Homo Sapiens
GAQANPPPP

SEQ ID NO: 1179645 - protein, 9 aa, Homo Sapiens
GYRERGGGC

SEQ ID NO: 1179646 - protein, 9 aa, Homo Sapiens
MTSKHYLSA

SEQ ID NO: 1179647 - protein, 9 aa, Homo Sapiens
RRRLPAGTR

SEQ ID NO: 1179648 - protein, 9 aa, Homo Sapiens
QVVVRPQSV

SEQ ID NO: 1179649 - protein, 9 aa, Homo Sapiens
AVRTLVAHT

SEQ ID NO: 1179650 - protein, 9 aa, Homo Sapiens
EITTKDLKK

SEQ ID NO: 1179651 - protein, 9 aa, Homo Sapiens
LNRSLFMGL

SEQ ID NO: 1179652 - protein, 9 aa, Homo Sapiens
AEELYQKRA

SEQ ID NO: 1179653 - protein, 9 aa, Homo Sapiens
ITLRSLFCG

SEQ ID NO: 1179654 - protein, 9 aa, Homo Sapiens
LLPQGRRYY

SEQ ID NO: 1179655 - protein, 9 aa, Homo Sapiens
IEASASPSS

SEQ ID NO: 1179656 - protein, 9 aa, Homo Sapiens
ENYMGKVPC

SEQ ID NO: 1179657 - protein, 9 aa, Homo Sapiens
AQRSFTCTQ

SEQ ID NO: 1179658 - protein, 9 aa, Homo Sapiens
PAYIPPRPG

SEQ ID NO: 1179659 - protein, 9 aa, Homo Sapiens
SVSVIMNLV

SEQ ID NO: 1179660 - protein, 9 aa, Homo Sapiens
DLKENQRGC

SEQ ID NO: 1179661 - protein, 9 aa, Homo Sapiens
GPPRPPARR

SEQ ID NO: 1179662 - protein, 9 aa, Homo Sapiens
SPAPAWWRL

SEQ ID NO: 1179663 - protein, 9 aa, Homo Sapiens
VVHIHCWLS

SEQ ID NO: 1179664 - protein, 9 aa, Homo Sapiens
DTLYGLASA

SEQ ID NO: 1179665 - protein, 9 aa, Homo Sapiens
GGEEEMEED

SEQ ID NO: 1179666 - protein, 9 aa, Homo Sapiens
SGCRPGNVG

SEQ ID NO: 1179667 - protein, 9 aa, Homo Sapiens
LSSMTPTDQ

SEQ ID NO: 1179668 - protein, 9 aa, Homo Sapiens
SPKSTSPHH

SEQ ID NO: 1179669 - protein, 9 aa, Homo Sapiens
LLPYPFHVL

SEQ ID NO: 1179670 - protein, 9 aa, Homo Sapiens
YTEEKAYEI

SEQ ID NO: 1179671 - protein, 9 aa, Homo Sapiens
EDMPRPSIS

SEQ ID NO: 1179672 - protein, 9 aa, Homo Sapiens
SLMSVASAY

SEQ ID NO: 1179673 - protein, 9 aa, Homo Sapiens
LVYHILRTH

SEQ ID NO: 1179674 - protein, 9 aa, Homo Sapiens
EMHYGHQAP

SEQ ID NO: 1179675 - protein, 9 aa, Homo Sapiens
FVIMLLAHR

SEQ ID NO: 1179676 - protein, 9 aa, Homo Sapiens
AQHPPLIHC

SEQ ID NO: 1179677 - protein, 9 aa, Homo Sapiens
GRHAHHPGR

SEQ ID NO: 1179678 - protein, 9 aa, Homo Sapiens
AAAPEEYSD

SEQ ID NO: 1179679 - protein, 9 aa, Homo Sapiens
GAPPRSPLT

SEQ ID NO: 1179680 - protein, 9 aa, Homo Sapiens
HPVLLSIPW

SEQ ID NO: 1179681 - protein, 9 aa, Homo Sapiens
LRPPVPQLL

SEQ ID NO: 1179682 - protein, 9 aa, Homo Sapiens
TSPSRCCPS

SEQ ID NO: 1179683 - protein, 9 aa, Homo Sapiens
KYTCPTSNA

SEQ ID NO: 1179684 - protein, 9 aa, Homo Sapiens
TEKIHQMGL

SEQ ID NO: 1179685 - protein, 9 aa, Homo Sapiens
PWPQAAFAS

SEQ ID NO: 1179686 - protein, 9 aa, Homo Sapiens
LHAWNLRAW

SEQ ID NO: 1179687 - protein, 9 aa, Homo Sapiens
LIKKISFRV

SEQ ID NO: 1179688 - protein, 9 aa, Homo Sapiens
TVMPRLLSK

SEQ ID NO: 1179689 - protein, 9 aa, Homo Sapiens
YPPPMLEDV

SEQ ID NO: 1179690 - protein, 9 aa, Homo Sapiens
GPVPRCKTT

SEQ ID NO: 1179691 - protein, 9 aa, Homo Sapiens
PLPPPPVTA

SEQ ID NO: 1179692 - protein, 9 aa, Homo Sapiens
GLCIRSAKC

SEQ ID NO: 1179693 - protein, 9 aa, Homo Sapiens
CGHSVLWTL

SEQ ID NO: 1179694 - protein, 9 aa, Homo Sapiens
WAWSASASS

SEQ ID NO: 1179695 - protein, 9 aa, Homo Sapiens
LKKTPKRVT

SEQ ID NO: 1179696 - protein, 9 aa, Homo Sapiens
GLYSGHSGE

SEQ ID NO: 1179697 - protein, 9 aa, Homo Sapiens
PRRAPHPAR

SEQ ID NO: 1179698 - protein, 9 aa, Homo Sapiens
PGGNKYQTT

SEQ ID NO: 1179699 - protein, 9 aa, Homo Sapiens
HHAGPEDGR

SEQ ID NO: 1179700 - protein, 9 aa, Homo Sapiens
TTMKKVADG

SEQ ID NO: 1179701 - protein, 9 aa, Homo Sapiens
NSQLQPMMS

SEQ ID NO: 1179702 - protein, 9 aa, Homo Sapiens
PWGVVDLTQ

SEQ ID NO: 1179703 - protein, 9 aa, Homo Sapiens
NDLLTIPVP

SEQ ID NO: 1179704 - protein, 9 aa, Homo Sapiens
LVVILKQLN

SEQ ID NO: 1179705 - protein, 9 aa, Homo Sapiens
KAPRVALSR

SEQ ID NO: 1179706 - protein, 9 aa, Homo Sapiens
YNVVVKIPT

SEQ ID NO: 1179707 - protein, 9 aa, Homo Sapiens
CQPLLWKVH

SEQ ID NO: 1179708 - protein, 9 aa, Homo Sapiens
LENMVAETE

SEQ ID NO: 1179709 - protein, 9 aa, Homo Sapiens
NTPETVVSR

SEQ ID NO: 1179710 - protein, 9 aa, Homo Sapiens
LPRKEENQA

SEQ ID NO: 1179711 - protein, 9 aa, Homo Sapiens
TPPERRRPA

SEQ ID NO: 1179712 - protein, 9 aa, Homo Sapiens
FFITGGKKV

SEQ ID NO: 1179713 - protein, 9 aa, Homo Sapiens
NMNTVKGTQ

SEQ ID NO: 1179714 - protein, 9 aa, Homo Sapiens
MAWAQHGSP

SEQ ID NO: 1179715 - protein, 9 aa, Homo Sapiens
SWLRRWRFK

SEQ ID NO: 1179716 - protein, 9 aa, Homo Sapiens
YGMVGVLQF

SEQ ID NO: 1179717 - protein, 9 aa, Homo Sapiens
VADLTFVAT

SEQ ID NO: 1179718 - protein, 9 aa, Homo Sapiens
TAWRPGGPA

SEQ ID NO: 1179719 - protein, 9 aa, Homo Sapiens
AKAFGHRSM

SEQ ID NO: 1179720 - protein, 9 aa, Homo Sapiens
PATSASTQA

SEQ ID NO: 1179721 - protein, 9 aa, Homo Sapiens
FSSTEPCGL

SEQ ID NO: 1179722 - protein, 9 aa, Homo Sapiens
AHAEPASAR

SEQ ID NO: 1179723 - protein, 9 aa, Homo Sapiens
AGGILAYEL

SEQ ID NO: 1179724 - protein, 9 aa, Homo Sapiens
RPRGLLTRP

SEQ ID NO: 1179725 - protein, 9 aa, Homo Sapiens
KADMTGAQR

SEQ ID NO: 1179726 - protein, 9 aa, Homo Sapiens
SFPQLPVGN

SEQ ID NO: 1179727 - protein, 9 aa, Homo Sapiens
EQGSFEKKI

SEQ ID NO: 1179728 - protein, 9 aa, Homo Sapiens
GAGHPWTPL

SEQ ID NO: 1179729 - protein, 9 aa, Homo Sapiens
LWPLRPPPL

SEQ ID NO: 1179730 - protein, 9 aa, Homo Sapiens
PSAPPTPSP

SEQ ID NO: 1179731 - protein, 9 aa, Homo Sapiens
CGAWPPPWL

SEQ ID NO: 1179732 - protein, 9 aa, Homo Sapiens
LDTKATPPV

SEQ ID NO: 1179733 - protein, 9 aa, Homo Sapiens
SPSPATSVE

SEQ ID NO: 1179734 - protein, 9 aa, Homo Sapiens
FGFTTDLRS

SEQ ID NO: 1179735 - protein, 9 aa, Homo Sapiens
MGIMDKTVR

SEQ ID NO: 1179736 - protein, 9 aa, Homo Sapiens
VPDTHVTLQ

SEQ ID NO: 1179737 - protein, 9 aa, Homo Sapiens
LLARVRPVV

SEQ ID NO: 1179738 - protein, 9 aa, Homo Sapiens
SEDGVDASE

SEQ ID NO: 1179739 - protein, 9 aa, Homo Sapiens
ADFLLWQWP

SEQ ID NO: 1179740 - protein, 9 aa, Homo Sapiens
KGVPHLPRS

SEQ ID NO: 1179741 - protein, 9 aa, Homo Sapiens
ACGFSAVMN

SEQ ID NO: 1179742 - protein, 9 aa, Homo Sapiens
FIPTTTLAS

SEQ ID NO: 1179743 - protein, 9 aa, Homo Sapiens
TSKAWTPRK

SEQ ID NO: 1179744 - protein, 9 aa, Homo Sapiens
NKPYMTQKV

SEQ ID NO: 1179745 - protein, 9 aa, Homo Sapiens
AKDTSTIKV

SEQ ID NO: 1179746 - protein, 9 aa, Homo Sapiens
GCKYQVDLS

SEQ ID NO: 1179747 - protein, 9 aa, Homo Sapiens
VAHTWNPST

SEQ ID NO: 1179748 - protein, 9 aa, Homo Sapiens
QTSTGGIST

SEQ ID NO: 1179749 - protein, 9 aa, Homo Sapiens
FTMQGLPDL

SEQ ID NO: 1179750 - protein, 9 aa, Homo Sapiens
PEPPSPGTA

SEQ ID NO: 1179751 - protein, 9 aa, Homo Sapiens
RSLMSVASA

SEQ ID NO: 1179752 - protein, 9 aa, Homo Sapiens
TCKEDLPRE

SEQ ID NO: 1179753 - protein, 9 aa, Homo Sapiens
YNKQHVLET

SEQ ID NO: 1179754 - protein, 9 aa, Homo Sapiens
THLFHTDRH

SEQ ID NO: 1179755 - protein, 9 aa, Homo Sapiens
DTDIWKTIL

SEQ ID NO: 1179756 - protein, 9 aa, Homo Sapiens
IPNLGIWPN

SEQ ID NO: 1179757 - protein, 9 aa, Homo Sapiens
IWKTILSEV

SEQ ID NO: 1179758 - protein, 9 aa, Homo Sapiens
KRRRRKMTT

SEQ ID NO: 1179759 - protein, 9 aa, Homo Sapiens
ALVMQSFGA

SEQ ID NO: 1179760 - protein, 9 aa, Homo Sapiens
SSKSQQSIS

SEQ ID NO: 1179761 - protein, 9 aa, Homo Sapiens
TRPPPAPPR

SEQ ID NO: 1179762 - protein, 9 aa, Homo Sapiens
KKGKPPEEV

SEQ ID NO: 1179763 - protein, 9 aa, Homo Sapiens
ITGAQEVET

SEQ ID NO: 1179764 - protein, 9 aa, Homo Sapiens
PSQRAAAQE

SEQ ID NO: 1179765 - protein, 9 aa, Homo Sapiens
WASGKFELL

SEQ ID NO: 1179766 - protein, 9 aa, Homo Sapiens
ATSALWCLF

SEQ ID NO: 1179767 - protein, 9 aa, Homo Sapiens
TSSGVYPAS

SEQ ID NO: 1179768 - protein, 9 aa, Homo Sapiens
LDPEWQITA

SEQ ID NO: 1179769 - protein, 9 aa, Homo Sapiens
PWLAICWRS

SEQ ID NO: 1179770 - protein, 9 aa, Homo Sapiens
LRVSTNAML

SEQ ID NO: 1179771 - protein, 9 aa, Homo Sapiens
QAKPQLGLS

SEQ ID NO: 1179772 - protein, 9 aa, Homo Sapiens
LAHAAGQLV

SEQ ID NO: 1179773 - protein, 9 aa, Homo Sapiens
DQAEKNSQN

SEQ ID NO: 1179774 - protein, 9 aa, Homo Sapiens
DAAGVTVHL

SEQ ID NO: 1179775 - protein, 9 aa, Homo Sapiens
DPGGRCPPH

SEQ ID NO: 1179776 - protein, 9 aa, Homo Sapiens
RAHPLRRSH

SEQ ID NO: 1179777 - protein, 9 aa, Homo Sapiens
EAEEEEEDE

SEQ ID NO: 1179778 - protein, 9 aa, Homo Sapiens
PAARSHGNG

SEQ ID NO: 1179779 - protein, 9 aa, Homo Sapiens
PRLTRERAA

SEQ ID NO: 1179780 - protein, 9 aa, Homo Sapiens
IPTGATNVD

SEQ ID NO: 1179781 - protein, 9 aa, Homo Sapiens
VARSGTGGQ

SEQ ID NO: 1179782 - protein, 9 aa, Homo Sapiens
EGAALAFPG

SEQ ID NO: 1179783 - protein, 9 aa, Homo Sapiens
RLDPGAISD

SEQ ID NO: 1179784 - protein, 9 aa, Homo Sapiens
MLEFQLNHM

SEQ ID NO: 1179785 - protein, 9 aa, Homo Sapiens
RVEAAQETI

SEQ ID NO: 1179786 - protein, 9 aa, Homo Sapiens
GPSHPGQWA

SEQ ID NO: 1179787 - protein, 9 aa, Homo Sapiens
FQSECVGPF

SEQ ID NO: 1179788 - protein, 9 aa, Homo Sapiens
EGNGRAPGR

SEQ ID NO: 1179789 - protein, 9 aa, Homo Sapiens
QARDVIARD

SEQ ID NO: 1179790 - protein, 9 aa, Homo Sapiens
SGGPRYPVC

SEQ ID NO: 1179791 - protein, 9 aa, Homo Sapiens
CSLLTQPSP

SEQ ID NO: 1179792 - protein, 9 aa, Homo Sapiens
AVARAASHR

SEQ ID NO: 1179793 - protein, 9 aa, Homo Sapiens
LSPKSTSPH

SEQ ID NO: 1179794 - protein, 9 aa, Homo Sapiens
MCFLLPQAP

SEQ ID NO: 1179795 - protein, 9 aa, Homo Sapiens
DGAQFPLDY

SEQ ID NO: 1179796 - protein, 9 aa, Homo Sapiens
DSFWGARVI

SEQ ID NO: 1179797 - protein, 9 aa, Homo Sapiens
CGHLAAVGV

SEQ ID NO: 1179798 - protein, 9 aa, Homo Sapiens
LMLNCWQKD

SEQ ID NO: 1179799 - protein, 9 aa, Homo Sapiens
QPTIRKEDF

SEQ ID NO: 1179800 - protein, 9 aa, Homo Sapiens
WGKRSEGGH

SEQ ID NO: 1179801 - protein, 9 aa, Homo Sapiens
MTMSFWKRR

SEQ ID NO: 1179802 - protein, 9 aa, Homo Sapiens
PVLRTGNPL

SEQ ID NO: 1179803 - protein, 9 aa, Homo Sapiens
SPNLPQPHL

SEQ ID NO: 1179804 - protein, 9 aa, Homo Sapiens
CPVLWALAV

SEQ ID NO: 1179805 - protein, 9 aa, Homo Sapiens
SLSLSQWPW

SEQ ID NO: 1179806 - protein, 9 aa, Homo Sapiens
SANSCGDDD

SEQ ID NO: 1179807 - protein, 9 aa, Homo Sapiens
SVSRDGGWG

SEQ ID NO: 1179808 - protein, 9 aa, Homo Sapiens
KVSTSTPTF

SEQ ID NO: 1179809 - protein, 9 aa, Homo Sapiens
SERLQAATG

SEQ ID NO: 1179810 - protein, 9 aa, Homo Sapiens
WGWHWEGWW

SEQ ID NO: 1179811 - protein, 9 aa, Homo Sapiens
RRERRRAAK

SEQ ID NO: 1179812 - protein, 9 aa, Homo Sapiens
IPWTQIPQG

SEQ ID NO: 1179813 - protein, 9 aa, Homo Sapiens
MPKRQGDFC

SEQ ID NO: 1179814 - protein, 9 aa, Homo Sapiens
SDLQNAATG

SEQ ID NO: 1179815 - protein, 9 aa, Homo Sapiens
ICAFLLWKK

SEQ ID NO: 1179816 - protein, 9 aa, Homo Sapiens
YSVVTINHI

SEQ ID NO: 1179817 - protein, 9 aa, Homo Sapiens
TFTLSYDGP

SEQ ID NO: 1179818 - protein, 9 aa, Homo Sapiens
CSEDKDVVE

SEQ ID NO: 1179819 - protein, 9 aa, Homo Sapiens
LLPVEKSSE

SEQ ID NO: 1179820 - protein, 9 aa, Homo Sapiens
ALPSRPAQP

SEQ ID NO: 1179821 - protein, 9 aa, Homo Sapiens
PPPEPRQQH

SEQ ID NO: 1179822 - protein, 9 aa, Homo Sapiens
GPLPLPHWP

SEQ ID NO: 1179823 - protein, 9 aa, Homo Sapiens
GWNLNNMLV

SEQ ID NO: 1179824 - protein, 9 aa, Homo Sapiens
GWGLLCVGG

SEQ ID NO: 1179825 - protein, 9 aa, Homo Sapiens
FITGGKKVL

SEQ ID NO: 1179826 - protein, 9 aa, Homo Sapiens
LSSTWLFCP

SEQ ID NO: 1179827 - protein, 9 aa, Homo Sapiens
QTSVSCGSA

SEQ ID NO: 1179828 - protein, 9 aa, Homo Sapiens
TVTVPRNCV

SEQ ID NO: 1179829 - protein, 9 aa, Homo Sapiens
HRTSQNHSK

SEQ ID NO: 1179830 - protein, 9 aa, Homo Sapiens
TSTPTFLAR

SEQ ID NO: 1179831 - protein, 9 aa, Homo Sapiens
HASKGVPHL

SEQ ID NO: 1179832 - protein, 9 aa, Homo Sapiens
VLRFSSTEP

SEQ ID NO: 1179833 - protein, 9 aa, Homo Sapiens
SVPPAVRPR

SEQ ID NO: 1179834 - protein, 9 aa, Homo Sapiens
AAAAHQGVG

SEQ ID NO: 1179835 - protein, 9 aa, Homo Sapiens
ELPNPAAHA

SEQ ID NO: 1179836 - protein, 9 aa, Homo Sapiens
SLYNFKKHS

SEQ ID NO: 1179837 - protein, 9 aa, Homo Sapiens
KNWKQLHSS

SEQ ID NO: 1179838 - protein, 9 aa, Homo Sapiens
SRALEEECE

SEQ ID NO: 1179839 - protein, 9 aa, Homo Sapiens
IPATMSAIF

SEQ ID NO: 1179840 - protein, 9 aa, Homo Sapiens
GLADTGVRE

SEQ ID NO: 1179841 - protein, 9 aa, Homo Sapiens
SPGPKPSLR

SEQ ID NO: 1179842 - protein, 9 aa, Homo Sapiens
PQLGLSIDS

SEQ ID NO: 1179843 - protein, 9 aa, Homo Sapiens
TPAEEATEK

SEQ ID NO: 1179844 - protein, 9 aa, Homo Sapiens
LCFSPIPVA

SEQ ID NO: 1179845 - protein, 9 aa, Homo Sapiens
NVHDLKYGT

SEQ ID NO: 1179846 - protein, 9 aa, Homo Sapiens
LPPSPAPSS

SEQ ID NO: 1179847 - protein, 9 aa, Homo Sapiens
GKDITVTTT

SEQ ID NO: 1179848 - protein, 9 aa, Homo Sapiens
LFPLLSRPR

SEQ ID NO: 1179849 - protein, 9 aa, Homo Sapiens
LDHGLILQL

SEQ ID NO: 1179850 - protein, 9 aa, Homo Sapiens
APAPQHLAA

SEQ ID NO: 1179851 - protein, 9 aa, Homo Sapiens
SRSGGRSRA

SEQ ID NO: 1179852 - protein, 9 aa, Homo Sapiens
GQLVKGRLV

SEQ ID NO: 1179853 - protein, 9 aa, Homo Sapiens
TTYFEFFND

SEQ ID NO: 1179854 - protein, 9 aa, Homo Sapiens
LPSPSCNLW

SEQ ID NO: 1179855 - protein, 9 aa, Homo Sapiens
GVTTNIHLH

SEQ ID NO: 1179856 - protein, 9 aa, Homo Sapiens
SQTSVSCGS

SEQ ID NO: 1179857 - protein, 9 aa, Homo Sapiens
ADPGGRCPP

SEQ ID NO: 1179858 - protein, 9 aa, Homo Sapiens
PRCWGSAFA

SEQ ID NO: 1179859 - protein, 9 aa, Homo Sapiens
TLSPQLCRP

SEQ ID NO: 1179860 - protein, 9 aa, Homo Sapiens
RCACGFSAV

SEQ ID NO: 1179861 - protein, 9 aa, Homo Sapiens
QRAQARVGQ

SEQ ID NO: 1179862 - protein, 9 aa, Homo Sapiens
LSPPTDLYT

SEQ ID NO: 1179863 - protein, 9 aa, Homo Sapiens
GTPHQHGCR

SEQ ID NO: 1179864 - protein, 9 aa, Homo Sapiens
KYQTTDNYQ

SEQ ID NO: 1179865 - protein, 9 aa, Homo Sapiens
STPAHTPHM

SEQ ID NO: 1179866 - protein, 9 aa, Homo Sapiens
TGQRCWGSY

SEQ ID NO: 1179867 - protein, 9 aa, Homo Sapiens
ALCPRIHKV

SEQ ID NO: 1179868 - protein, 9 aa, Homo Sapiens
PERSKKEDW

SEQ ID NO: 1179869 - protein, 9 aa, Homo Sapiens
APAKMSVML

SEQ ID NO: 1179870 - protein, 9 aa, Homo Sapiens
VGVLQFEVL

SEQ ID NO: 1179871 - protein, 9 aa, Homo Sapiens
ADLGLGTAV

SEQ ID NO: 1179872 - protein, 9 aa, Homo Sapiens
ASGPWGVVD

SEQ ID NO: 1179873 - protein, 9 aa, Homo Sapiens
GGLDNPVRS

SEQ ID NO: 1179874 - protein, 9 aa, Homo Sapiens
VFDWHVVLS

SEQ ID NO: 1179875 - protein, 9 aa, Homo Sapiens
SGDCCSWPS

SEQ ID NO: 1179876 - protein, 9 aa, Homo Sapiens
SSLNQQGTH

SEQ ID NO: 1179877 - protein, 9 aa, Homo Sapiens
VNKYDPPLK

SEQ ID NO: 1179878 - protein, 9 aa, Homo Sapiens
SMSGVPLRS

SEQ ID NO: 1179879 - protein, 9 aa, Homo Sapiens
SAWGDWVAS

SEQ ID NO: 1179880 - protein, 9 aa, Homo Sapiens
KIGQTSSVS

SEQ ID NO: 1179881 - protein, 9 aa, Homo Sapiens
QTPCWGWHW

SEQ ID NO: 1179882 - protein, 9 aa, Homo Sapiens
LGMVVRTTS

SEQ ID NO: 1179883 - protein, 9 aa, Homo Sapiens
WGPGSWAWQ

SEQ ID NO: 1179884 - protein, 9 aa, Homo Sapiens
EEFQRILKA

SEQ ID NO: 1179885 - protein, 9 aa, Homo Sapiens
TDRHTGFSL

SEQ ID NO: 1179886 - protein, 9 aa, Homo Sapiens
PKSTSPHHP

SEQ ID NO: 1179887 - protein, 9 aa, Homo Sapiens
VHVQLRQRI

SEQ ID NO: 1179888 - protein, 9 aa, Homo Sapiens
SFVKWLGTD

SEQ ID NO: 1179889 - protein, 9 aa, Homo Sapiens
IRPEDLWVS

SEQ ID NO: 1179890 - protein, 9 aa, Homo Sapiens
VCGQFIPWN

SEQ ID NO: 1179891 - protein, 9 aa, Homo Sapiens
MMQLGGRLV

SEQ ID NO: 1179892 - protein, 9 aa, Homo Sapiens
LEQAYIRGS

SEQ ID NO: 1179893 - protein, 9 aa, Homo Sapiens
TSTKTRKAL

SEQ ID NO: 1179894 - protein, 9 aa, Homo Sapiens
PAPSLWKTK

SEQ ID NO: 1179895 - protein, 9 aa, Homo Sapiens
QAWSTLWPP

SEQ ID NO: 1179896 - protein, 9 aa, Homo Sapiens
AKRSKEKTL

SEQ ID NO: 1179897 - protein, 9 aa, Homo Sapiens
TWRTTSSAS

SEQ ID NO: 1179898 - protein, 9 aa, Homo Sapiens
LGTSLQHSF

SEQ ID NO: 1179899 - protein, 9 aa, Homo Sapiens
AEPTTPLSH

SEQ ID NO: 1179900 - protein, 9 aa, Homo Sapiens
PLPPQPRLA

SEQ ID NO: 1179901 - protein, 9 aa, Homo Sapiens
VGKQWHMRC

SEQ ID NO: 1179902 - protein, 9 aa, Homo Sapiens
APQLSYSFF

SEQ ID NO: 1179903 - protein, 9 aa, Homo Sapiens
RAALSVLLP

SEQ ID NO: 1179904 - protein, 9 aa, Homo Sapiens
LMTPSYSYM

SEQ ID NO: 1179905 - protein, 9 aa, Homo Sapiens
LMMLQLKKD

SEQ ID NO: 1179906 - protein, 9 aa, Homo Sapiens
ILVNGTWDK

SEQ ID NO: 1179907 - protein, 9 aa, Homo Sapiens
TSTLSPQLC

SEQ ID NO: 1179908 - protein, 9 aa, Homo Sapiens
GGSGRRAEM

SEQ ID NO: 1179909 - protein, 9 aa, Homo Sapiens
AGGGPSVFC

SEQ ID NO: 1179910 - protein, 9 aa, Homo Sapiens
QIPCLFVSS

SEQ ID NO: 1179911 - protein, 9 aa, Homo Sapiens
HANCMAAEA

SEQ ID NO: 1179912 - protein, 9 aa, Homo Sapiens
IEYQKMALT

SEQ ID NO: 1179913 - protein, 9 aa, Homo Sapiens
STRSSPTRK

SEQ ID NO: 1179914 - protein, 9 aa, Homo Sapiens
KSASLQPKT

SEQ ID NO: 1179915 - protein, 9 aa, Homo Sapiens
FEYDGPRFL

SEQ ID NO: 1179916 - protein, 9 aa, Homo Sapiens
KSHCLQDSY

SEQ ID NO: 1179917 - protein, 9 aa, Homo Sapiens
TAKHVFEKN

SEQ ID NO: 1179918 - protein, 9 aa, Homo Sapiens
FVASMLLGE

SEQ ID NO: 1179919 - protein, 9 aa, Homo Sapiens
LLDKVTIAQ

SEQ ID NO: 1179920 - protein, 9 aa, Homo Sapiens
AGSVKSITA

SEQ ID NO: 1179921 - protein, 9 aa, Homo Sapiens
LVMCLRLRT

SEQ ID NO: 1179922 - protein, 9 aa, Homo Sapiens
GRGGGPWDW

SEQ ID NO: 1179923 - protein, 9 aa, Homo Sapiens
GPACGRRAR

SEQ ID NO: 1179924 - protein, 9 aa, Homo Sapiens
GGAGARGEI

SEQ ID NO: 1179925 - protein, 9 aa, Homo Sapiens
ALPFTRYCF

SEQ ID NO: 1179926 - protein, 9 aa, Homo Sapiens
EGGVGGRGR

SEQ ID NO: 1179927 - protein, 9 aa, Homo Sapiens
TLMWRGGCI

SEQ ID NO: 1179928 - protein, 9 aa, Homo Sapiens
PRPQGCWPP

SEQ ID NO: 1179929 - protein, 9 aa, Homo Sapiens
IHLLNGLLF

SEQ ID NO: 1179930 - protein, 9 aa, Homo Sapiens
WLLEFPGRA

SEQ ID NO: 1179931 - protein, 9 aa, Homo Sapiens
TTPSPASGS

SEQ ID NO: 1179932 - protein, 9 aa, Homo Sapiens
MDPECTQLL

SEQ ID NO: 1179933 - protein, 9 aa, Homo Sapiens
TASLRCIWR

SEQ ID NO: 1179934 - protein, 9 aa, Homo Sapiens
GPQRAKSLP

SEQ ID NO: 1179935 - protein, 9 aa, Homo Sapiens
EAWKRFVTV

SEQ ID NO: 1179936 - protein, 9 aa, Homo Sapiens
DELDEVNPC

SEQ ID NO: 1179937 - protein, 9 aa, Homo Sapiens
SRSKLRKVS

SEQ ID NO: 1179938 - protein, 9 aa, Homo Sapiens
KDVEGKSRG

SEQ ID NO: 1179939 - protein, 9 aa, Homo Sapiens
WGQIKQSNT

SEQ ID NO: 1179940 - protein, 9 aa, Homo Sapiens
SFPSEEPSP

SEQ ID NO: 1179941 - protein, 9 aa, Homo Sapiens
RILVNGTWD

SEQ ID NO: 1179942 - protein, 9 aa, Homo Sapiens
KSDFSNNWN

SEQ ID NO: 1179943 - protein, 9 aa, Homo Sapiens
VCHVHNLML

SEQ ID NO: 1179944 - protein, 9 aa, Homo Sapiens
DLVEAQQKK

SEQ ID NO: 1179945 - protein, 9 aa, Homo Sapiens
SPDHRGGNP

SEQ ID NO: 1179946 - protein, 9 aa, Homo Sapiens
CPGSPPQGK

SEQ ID NO: 1179947 - protein, 9 aa, Homo Sapiens
VNHVVILQI

SEQ ID NO: 1179948 - protein, 9 aa, Homo Sapiens
ARHQIPWKL

SEQ ID NO: 1179949 - protein, 9 aa, Homo Sapiens
WLPPCGGRP

SEQ ID NO: 1179950 - protein, 9 aa, Homo Sapiens
EFLHLGLTA

SEQ ID NO: 1179951 - protein, 9 aa, Homo Sapiens
VESSMTPLD

SEQ ID NO: 1179952 - protein, 9 aa, Homo Sapiens
PCSKILLSL

SEQ ID NO: 1179953 - protein, 9 aa, Homo Sapiens
ECGRGFQHR

SEQ ID NO: 1179954 - protein, 9 aa, Homo Sapiens
LRAGGILAY

SEQ ID NO: 1179955 - protein, 9 aa, Homo Sapiens
LSPAETRGA

SEQ ID NO: 1179956 - protein, 9 aa, Homo Sapiens
LASQSRGPH

SEQ ID NO: 1179957 - protein, 9 aa, Homo Sapiens
CMDMLPKGA

SEQ ID NO: 1179958 - protein, 9 aa, Homo Sapiens
KCIIHGPAP

SEQ ID NO: 1179959 - protein, 9 aa, Homo Sapiens
VKSITAMLE

SEQ ID NO: 1179960 - protein, 9 aa, Homo Sapiens
VDHRLEMCL

SEQ ID NO: 1179961 - protein, 9 aa, Homo Sapiens
DRRNSNRYP

SEQ ID NO: 1179962 - protein, 9 aa, Homo Sapiens
RPPRPPCHC

SEQ ID NO: 1179963 - protein, 9 aa, Homo Sapiens
TPSPGPQAA

SEQ ID NO: 1179964 - protein, 9 aa, Homo Sapiens
TAHCVEPDI

SEQ ID NO: 1179965 - protein, 9 aa, Homo Sapiens
PEAPGCWSC

SEQ ID NO: 1179966 - protein, 9 aa, Homo Sapiens
LDEVNPCLR

SEQ ID NO: 1179967 - protein, 9 aa, Homo Sapiens
SSDSKLELS

SEQ ID NO: 1179968 - protein, 9 aa, Homo Sapiens
AGKQTVMVL

SEQ ID NO: 1179969 - protein, 9 aa, Homo Sapiens
DIWKTILSE

SEQ ID NO: 1179970 - protein, 9 aa, Homo Sapiens
VPLAPLGPA

SEQ ID NO: 1179971 - protein, 9 aa, Homo Sapiens
CVCKKSPAP

SEQ ID NO: 1179972 - protein, 9 aa, Homo Sapiens
CGDVHVQLR

SEQ ID NO: 1179973 - protein, 9 aa, Homo Sapiens
QGSGAAWHV

SEQ ID NO: 1179974 - protein, 9 aa, Homo Sapiens
SPLLSTHIL

SEQ ID NO: 1179975 - protein, 9 aa, Homo Sapiens
CYFLYQILW

SEQ ID NO: 1179976 - protein, 9 aa, Homo Sapiens
ISRCAPPAT

SEQ ID NO: 1179977 - protein, 9 aa, Homo Sapiens
FGVIVGSAF

SEQ ID NO: 1179978 - protein, 9 aa, Homo Sapiens
VLYPVCHVH

SEQ ID NO: 1179979 - protein, 9 aa, Homo Sapiens
CLARHSLGL

SEQ ID NO: 1179980 - protein, 9 aa, Homo Sapiens
LWLGVAWVL

SEQ ID NO: 1179981 - protein, 9 aa, Homo Sapiens
SWIQLFGLR

SEQ ID NO: 1179982 - protein, 9 aa, Homo Sapiens
QLHSSGNVL

SEQ ID NO: 1179983 - protein, 9 aa, Homo Sapiens
KDLKKKEVV

SEQ ID NO: 1179984 - protein, 9 aa, Homo Sapiens
SPALRAAAQ

SEQ ID NO: 1179985 - protein, 9 aa, Homo Sapiens
EKRKVEIAF

SEQ ID NO: 1179986 - protein, 9 aa, Homo Sapiens
TPVPEKPKR

SEQ ID NO: 1179987 - protein, 9 aa, Homo Sapiens
SQTSCFGPS

SEQ ID NO: 1179988 - protein, 9 aa, Homo Sapiens
ASKALKETR

SEQ ID NO: 1179989 - protein, 9 aa, Homo Sapiens
NANTASPLI

SEQ ID NO: 1179990 - protein, 9 aa, Homo Sapiens
LRAWRTCWS

SEQ ID NO: 1179991 - protein, 9 aa, Homo Sapiens
RVSREAAGS

SEQ ID NO: 1179992 - protein, 9 aa, Homo Sapiens
RGPEQTHER

SEQ ID NO: 1179993 - protein, 9 aa, Homo Sapiens
IPGRYLTGG

SEQ ID NO: 1179994 - protein, 9 aa, Homo Sapiens
FSFIRSPRI

SEQ ID NO: 1179995 - protein, 9 aa, Homo Sapiens
LTHVPLRPG

SEQ ID NO: 1179996 - protein, 9 aa, Homo Sapiens
GIKGGKKFI

SEQ ID NO: 1179997 - protein, 9 aa, Homo Sapiens
TPLSISRPT

SEQ ID NO: 1179998 - protein, 9 aa, Homo Sapiens
RAGTTTPSA

SEQ ID NO: 1179999 - protein, 9 aa, Homo Sapiens
NHWQYRDLE

SEQ ID NO: 1180000 - protein, 9 aa, Homo Sapiens
HYKRKGSFF

SEQ ID NO: 1180001 - protein, 9 aa, Homo Sapiens
RWTMAWAQH

SEQ ID NO: 1180002 - protein, 9 aa, Homo Sapiens
LPQGRRYYV

SEQ ID NO: 1180003 - protein, 9 aa, Homo Sapiens
TFHMKCFLN

SEQ ID NO: 1180004 - protein, 9 aa, Homo Sapiens
SASEQQLGA

SEQ ID NO: 1180005 - protein, 9 aa, Homo Sapiens
ESTHSGNNV

SEQ ID NO: 1180006 - protein, 9 aa, Homo Sapiens
ASRDSFKNQ

SEQ ID NO: 1180007 - protein, 9 aa, Homo Sapiens
GAVPTYVSV

SEQ ID NO: 1180008 - protein, 9 aa, Homo Sapiens
RICKEDTAF

SEQ ID NO: 1180009 - protein, 9 aa, Homo Sapiens
VQARLCFSI

SEQ ID NO: 1180010 - protein, 9 aa, Homo Sapiens
GVCRMGPLP

SEQ ID NO: 1180011 - protein, 9 aa, Homo Sapiens
PSAAGAQHE

SEQ ID NO: 1180012 - protein, 9 aa, Homo Sapiens
QTATSPATT

SEQ ID NO: 1180013 - protein, 9 aa, Homo Sapiens
IVCQCVEEI

SEQ ID NO: 1180014 - protein, 9 aa, Homo Sapiens
IPSSPQPWW

SEQ ID NO: 1180015 - protein, 9 aa, Homo Sapiens
TTNIHLHSS

SEQ ID NO: 1180016 - protein, 9 aa, Homo Sapiens
EDGDRDEDG

SEQ ID NO: 1180017 - protein, 9 aa, Homo Sapiens
LAQEEQGAP

SEQ ID NO: 1180018 - protein, 9 aa, Homo Sapiens
LCPPPSPLP

SEQ ID NO: 1180019 - protein, 9 aa, Homo Sapiens
EHTIHAGFD

SEQ ID NO: 1180020 - protein, 9 aa, Homo Sapiens
NLGGKPIAV

SEQ ID NO: 1180021 - protein, 9 aa, Homo Sapiens
CRPSNPWIT

SEQ ID NO: 1180022 - protein, 9 aa, Homo Sapiens
PSCNLWMPS

SEQ ID NO: 1180023 - protein, 9 aa, Homo Sapiens
AGRGQEEAG

SEQ ID NO: 1180024 - protein, 9 aa, Homo Sapiens
AEEEEEDEE

SEQ ID NO: 1180025 - protein, 9 aa, Homo Sapiens
VHIVCPHHC

SEQ ID NO: 1180026 - protein, 9 aa, Homo Sapiens
SSHDVDLCL

SEQ ID NO: 1180027 - protein, 9 aa, Homo Sapiens
GQETGKKRQ

SEQ ID NO: 1180028 - protein, 9 aa, Homo Sapiens
GAGSAPQTP

SEQ ID NO: 1180029 - protein, 9 aa, Homo Sapiens
WCQGAWCFS

SEQ ID NO: 1180030 - protein, 9 aa, Homo Sapiens
FEYGAKQGR

SEQ ID NO: 1180031 - protein, 9 aa, Homo Sapiens
SMGPGGLRS

SEQ ID NO: 1180032 - protein, 9 aa, Homo Sapiens
PVEGTDFPR

SEQ ID NO: 1180033 - protein, 9 aa, Homo Sapiens
ATTAPEAPG

SEQ ID NO: 1180034 - protein, 9 aa, Homo Sapiens
KKAAAAARE

SEQ ID NO: 1180035 - protein, 9 aa, Homo Sapiens
GQMTSSGSD

SEQ ID NO: 1180036 - protein, 9 aa, Homo Sapiens
KLLPYQTCS

SEQ ID NO: 1180037 - protein, 9 aa, Homo Sapiens
HTPAPGPPA

SEQ ID NO: 1180038 - protein, 9 aa, Homo Sapiens
SVELSEPLQ

SEQ ID NO: 1180039 - protein, 9 aa, Homo Sapiens
APGCWPFHL

SEQ ID NO: 1180040 - protein, 9 aa, Homo Sapiens
LASPSPIRT

SEQ ID NO: 1180041 - protein, 9 aa, Homo Sapiens
LRGPQRAHP

SEQ ID NO: 1180042 - protein, 9 aa, Homo Sapiens
FGGPDSTPR

SEQ ID NO: 1180043 - protein, 9 aa, Homo Sapiens
CAKVECAQD

SEQ ID NO: 1180044 - protein, 9 aa, Homo Sapiens
RTAGTQMLE

SEQ ID NO: 1180045 - protein, 9 aa, Homo Sapiens
FPDRKDIGS

SEQ ID NO: 1180046 - protein, 9 aa, Homo Sapiens
VGTIHAMKY

SEQ ID NO: 1180047 - protein, 9 aa, Homo Sapiens
GLALRVVSL

SEQ ID NO: 1180048 - protein, 9 aa, Homo Sapiens
SHLEEKQGV

SEQ ID NO: 1180049 - protein, 9 aa, Homo Sapiens
PAQTCCGQI

SEQ ID NO: 1180050 - protein, 9 aa, Homo Sapiens
VTLFFFHSQ

SEQ ID NO: 1180051 - protein, 9 aa, Homo Sapiens
GVMVRVGSC

SEQ ID NO: 1180052 - protein, 9 aa, Homo Sapiens
STLHALRLL

SEQ ID NO: 1180053 - protein, 9 aa, Homo Sapiens
AFAASTASG

SEQ ID NO: 1180054 - protein, 9 aa, Homo Sapiens
SQKRVSEKN

SEQ ID NO: 1180055 - protein, 9 aa, Homo Sapiens
WCRPSWKGK

SEQ ID NO: 1180056 - protein, 9 aa, Homo Sapiens
SKPTTGHAP

SEQ ID NO: 1180057 - protein, 9 aa, Homo Sapiens
RFRIHLDPL

SEQ ID NO: 1180058 - protein, 9 aa, Homo Sapiens
TTEMDIFEL

SEQ ID NO: 1180059 - protein, 9 aa, Homo Sapiens
TIPPKRVAL

SEQ ID NO: 1180060 - protein, 9 aa, Homo Sapiens
TLNLLVIFY

SEQ ID NO: 1180061 - protein, 9 aa, Homo Sapiens
SSTRSSPTR

SEQ ID NO: 1180062 - protein, 9 aa, Homo Sapiens
KALSGHHSP

SEQ ID NO: 1180063 - protein, 9 aa, Homo Sapiens
REELRKSKS

SEQ ID NO: 1180064 - protein, 9 aa, Homo Sapiens
VEVSHLEEK

SEQ ID NO: 1180065 - protein, 9 aa, Homo Sapiens
ELIKKISFR

SEQ ID NO: 1180066 - protein, 9 aa, Homo Sapiens
DSTTSDTSL

SEQ ID NO: 1180067 - protein, 9 aa, Homo Sapiens
HIPVDTMVT

SEQ ID NO: 1180068 - protein, 9 aa, Homo Sapiens
PDTPYFWPQ

SEQ ID NO: 1180069 - protein, 9 aa, Homo Sapiens
KKRDDEEEE

SEQ ID NO: 1180070 - protein, 9 aa, Homo Sapiens
AKVECAQDE

SEQ ID NO: 1180071 - protein, 9 aa, Homo Sapiens
VILPDDVCD

SEQ ID NO: 1180072 - protein, 9 aa, Homo Sapiens
PRTLEGCIS

SEQ ID NO: 1180073 - protein, 9 aa, Homo Sapiens
YDGPRFLRL

SEQ ID NO: 1180074 - protein, 9 aa, Homo Sapiens
VVPKPIVAP

SEQ ID NO: 1180075 - protein, 9 aa, Homo Sapiens
AGKSCNQGP

SEQ ID NO: 1180076 - protein, 9 aa, Homo Sapiens
LVMRAPRWK

SEQ ID NO: 1180077 - protein, 9 aa, Homo Sapiens
PCTSVKRGT

SEQ ID NO: 1180078 - protein, 9 aa, Homo Sapiens
RELKIKFLQ

SEQ ID NO: 1180079 - protein, 9 aa, Homo Sapiens
CSAGWEPSQ

SEQ ID NO: 1180080 - protein, 9 aa, Homo Sapiens
VSRYISRCA

SEQ ID NO: 1180081 - protein, 9 aa, Homo Sapiens
NLKSEGFYS

SEQ ID NO: 1180082 - protein, 9 aa, Homo Sapiens
ATWRMRSST

SEQ ID NO: 1180083 - protein, 9 aa, Homo Sapiens
WAPSKYTCP

SEQ ID NO: 1180084 - protein, 9 aa, Homo Sapiens
RHLGRLMTC

SEQ ID NO: 1180085 - protein, 9 aa, Homo Sapiens
RDRLLRERT

SEQ ID NO: 1180086 - protein, 9 aa, Homo Sapiens
LYQILWGLK

SEQ ID NO: 1180087 - protein, 9 aa, Homo Sapiens
DPIDAITGE

SEQ ID NO: 1180088 - protein, 9 aa, Homo Sapiens
ALLLPVQLL

SEQ ID NO: 1180089 - protein, 9 aa, Homo Sapiens
WTAMLVATS

SEQ ID NO: 1180090 - protein, 9 aa, Homo Sapiens
ATTTSPSRC

SEQ ID NO: 1180091 - protein, 9 aa, Homo Sapiens
MKTIHCNRI

SEQ ID NO: 1180092 - protein, 9 aa, Homo Sapiens
GGGGAPDAL

SEQ ID NO: 1180093 - protein, 9 aa, Homo Sapiens
LPQWRKRPV

SEQ ID NO: 1180094 - protein, 9 aa, Homo Sapiens
YCDTKSGSV

SEQ ID NO: 1180095 - protein, 9 aa, Homo Sapiens
GWARLSAAS

SEQ ID NO: 1180096 - protein, 9 aa, Homo Sapiens
IFLKLVNDI

SEQ ID NO: 1180097 - protein, 9 aa, Homo Sapiens
HRGGAPGSE

SEQ ID NO: 1180098 - protein, 9 aa, Homo Sapiens
WHKKWISPR

SEQ ID NO: 1180099 - protein, 9 aa, Homo Sapiens
LNKVQLLHE

SEQ ID NO: 1180100 - protein, 9 aa, Homo Sapiens
VGEKRFGFW

SEQ ID NO: 1180101 - protein, 9 aa, Homo Sapiens
GGRGPGRGL

SEQ ID NO: 1180102 - protein, 9 aa, Homo Sapiens
VGLGDESIS

SEQ ID NO: 1180103 - protein, 9 aa, Homo Sapiens
MGAVASSGS

SEQ ID NO: 1180104 - protein, 9 aa, Homo Sapiens
VIMLLAHRL

SEQ ID NO: 1180105 - protein, 9 aa, Homo Sapiens
YKPQLNYKT

SEQ ID NO: 1180106 - protein, 9 aa, Homo Sapiens
RGCSAGGGR

SEQ ID NO: 1180107 - protein, 9 aa, Homo Sapiens
ALVKTWTQF

SEQ ID NO: 1180108 - protein, 9 aa, Homo Sapiens
LPITVTGAR

SEQ ID NO: 1180109 - protein, 9 aa, Homo Sapiens
RLRSGILAR

SEQ ID NO: 1180110 - protein, 9 aa, Homo Sapiens
ETLASKASR

SEQ ID NO: 1180111 - protein, 9 aa, Homo Sapiens
GRAPGRGRG

SEQ ID NO: 1180112 - protein, 9 aa, Homo Sapiens
TSAWRSLRM

SEQ ID NO: 1180113 - protein, 9 aa, Homo Sapiens
EPDVHGGGE

SEQ ID NO: 1180114 - protein, 9 aa, Homo Sapiens
KAPSSGVPN

SEQ ID NO: 1180115 - protein, 9 aa, Homo Sapiens
VADVEQVLV

SEQ ID NO: 1180116 - protein, 9 aa, Homo Sapiens
PHDCMPIAV

SEQ ID NO: 1180117 - protein, 9 aa, Homo Sapiens
TVVMQGVAG

SEQ ID NO: 1180118 - protein, 9 aa, Homo Sapiens
WDSFWGARV

SEQ ID NO: 1180119 - protein, 9 aa, Homo Sapiens
VMTFLRAFL

SEQ ID NO: 1180120 - protein, 9 aa, Homo Sapiens
GPLGGRKKR

SEQ ID NO: 1180121 - protein, 9 aa, Homo Sapiens
TSCSATRQP

SEQ ID NO: 1180122 - protein, 9 aa, Homo Sapiens
PALPSTQQI

SEQ ID NO: 1180123 - protein, 9 aa, Homo Sapiens
WPQAAFASR

SEQ ID NO: 1180124 - protein, 9 aa, Homo Sapiens
QPPPALPSR

SEQ ID NO: 1180125 - protein, 9 aa, Homo Sapiens
HSSRFSRIP

SEQ ID NO: 1180126 - protein, 9 aa, Homo Sapiens
GAKQGRQGK

SEQ ID NO: 1180127 - protein, 9 aa, Homo Sapiens
NLAWLLEFP

SEQ ID NO: 1180128 - protein, 9 aa, Homo Sapiens
ILDNAQSSE

SEQ ID NO: 1180129 - protein, 9 aa, Homo Sapiens
AAGHPCRCH

SEQ ID NO: 1180130 - protein, 9 aa, Homo Sapiens
SKEKTLGIR

SEQ ID NO: 1180131 - protein, 9 aa, Homo Sapiens
SVASAYSAK

SEQ ID NO: 1180132 - protein, 9 aa, Homo Sapiens
QPVTKAGRQ

SEQ ID NO: 1180133 - protein, 9 aa, Homo Sapiens
RHCLWLWCR

SEQ ID NO: 1180134 - protein, 9 aa, Homo Sapiens
RPSGFPDIT

SEQ ID NO: 1180135 - protein, 9 aa, Homo Sapiens
RCFVVRDAP

SEQ ID NO: 1180136 - protein, 9 aa, Homo Sapiens
VLLSLMSDH

SEQ ID NO: 1180137 - protein, 9 aa, Homo Sapiens
PVGNGCAGG

SEQ ID NO: 1180138 - protein, 9 aa, Homo Sapiens
WHIWHNICH

SEQ ID NO: 1180139 - protein, 9 aa, Homo Sapiens
ASASSCSLA

SEQ ID NO: 1180140 - protein, 9 aa, Homo Sapiens
LPWTSLHSG

SEQ ID NO: 1180141 - protein, 9 aa, Homo Sapiens
VSGKTDICS

SEQ ID NO: 1180142 - protein, 9 aa, Homo Sapiens
PSCRSLAMA

SEQ ID NO: 1180143 - protein, 9 aa, Homo Sapiens
RALWGAATP

SEQ ID NO: 1180144 - protein, 9 aa, Homo Sapiens
DDHSNLARK

SEQ ID NO: 1180145 - protein, 9 aa, Homo Sapiens
CITEDTPPP

SEQ ID NO: 1180146 - protein, 9 aa, Homo Sapiens
QKKLQEMVS

SEQ ID NO: 1180147 - protein, 9 aa, Homo Sapiens
SCGFTQDRG

SEQ ID NO: 1180148 - protein, 9 aa, Homo Sapiens
WREAWRRSS

SEQ ID NO: 1180149 - protein, 9 aa, Homo Sapiens
RESEHNLLV

SEQ ID NO: 1180150 - protein, 9 aa, Homo Sapiens
EEIISLKIS

SEQ ID NO: 1180151 - protein, 9 aa, Homo Sapiens
APGVQHPAG

SEQ ID NO: 1180152 - protein, 9 aa, Homo Sapiens
PWCLFIGIG

SEQ ID NO: 1180153 - protein, 9 aa, Homo Sapiens
MNHHQQQQQ

SEQ ID NO: 1180154 - protein, 9 aa, Homo Sapiens
QPPSLCGAL

SEQ ID NO: 1180155 - protein, 9 aa, Homo Sapiens
KEKEKELRV

SEQ ID NO: 1180156 - protein, 9 aa, Homo Sapiens
RPRWPTPSS

SEQ ID NO: 1180157 - protein, 9 aa, Homo Sapiens
VQLLCPRVL

SEQ ID NO: 1180158 - protein, 9 aa, Homo Sapiens
ALRARQVLG

SEQ ID NO: 1180159 - protein, 9 aa, Homo Sapiens
GPGMPNSLN

SEQ ID NO: 1180160 - protein, 9 aa, Homo Sapiens
TAARKAASV

SEQ ID NO: 1180161 - protein, 9 aa, Homo Sapiens
FEDDKPFDL

SEQ ID NO: 1180162 - protein, 9 aa, Homo Sapiens
PRRRAAPRT

SEQ ID NO: 1180163 - protein, 9 aa, Homo Sapiens
GVDASEPMY

SEQ ID NO: 1180164 - protein, 9 aa, Homo Sapiens
PPLVPVVST

SEQ ID NO: 1180165 - protein, 9 aa, Homo Sapiens
SRDSFKNQL

SEQ ID NO: 1180166 - protein, 9 aa, Homo Sapiens
KTPPCGSTP

SEQ ID NO: 1180167 - protein, 9 aa, Homo Sapiens
AGPEPVPTA

SEQ ID NO: 1180168 - protein, 9 aa, Homo Sapiens
DSDVLEQRD

SEQ ID NO: 1180169 - protein, 9 aa, Homo Sapiens
AKGKLKSQY

SEQ ID NO: 1180170 - protein, 9 aa, Homo Sapiens
TVTGARVLS

SEQ ID NO: 1180171 - protein, 9 aa, Homo Sapiens
KEMVPPGGQ

SEQ ID NO: 1180172 - protein, 9 aa, Homo Sapiens
QQDPEMPKS

SEQ ID NO: 1180173 - protein, 9 aa, Homo Sapiens
STTRTCGRP

SEQ ID NO: 1180174 - protein, 9 aa, Homo Sapiens
AAGAQHEAE

SEQ ID NO: 1180175 - protein, 9 aa, Homo Sapiens
TSTSAPGRS

SEQ ID NO: 1180176 - protein, 9 aa, Homo Sapiens
SSAGRSWGQ

SEQ ID NO: 1180177 - protein, 9 aa, Homo Sapiens
KVHYQCLRH

SEQ ID NO: 1180178 - protein, 9 aa, Homo Sapiens
VPLRSWWLA

SEQ ID NO: 1180179 - protein, 9 aa, Homo Sapiens
WESLYPEVT

SEQ ID NO: 1180180 - protein, 9 aa, Homo Sapiens
ARTRGQARA

SEQ ID NO: 1180181 - protein, 9 aa, Homo Sapiens
RSPDGSQSG

SEQ ID NO: 1180182 - protein, 9 aa, Homo Sapiens
ARRPPVAGP

SEQ ID NO: 1180183 - protein, 9 aa, Homo Sapiens
NTGTLQQQP

SEQ ID NO: 1180184 - protein, 9 aa, Homo Sapiens
HRWTAHREP

SEQ ID NO: 1180185 - protein, 9 aa, Homo Sapiens
ATTLTLMTG

SEQ ID NO: 1180186 - protein, 9 aa, Homo Sapiens
TEHCPLTSA

SEQ ID NO: 1180187 - protein, 9 aa, Homo Sapiens
EEASGPWGV

SEQ ID NO: 1180188 - protein, 9 aa, Homo Sapiens
ITASYDTNV

SEQ ID NO: 1180189 - protein, 9 aa, Homo Sapiens
GGAAQLNVF

SEQ ID NO: 1180190 - protein, 9 aa, Homo Sapiens
GGGTPLSIS

SEQ ID NO: 1180191 - protein, 9 aa, Homo Sapiens
LFCYRWLLL

SEQ ID NO: 1180192 - protein, 9 aa, Homo Sapiens
DLIFALKLV

SEQ ID NO: 1180193 - protein, 9 aa, Homo Sapiens
SNVRIDKVG

SEQ ID NO: 1180194 - protein, 9 aa, Homo Sapiens
GKIVKNVFP

SEQ ID NO: 1180195 - protein, 9 aa, Homo Sapiens
GGGRRPRAA

SEQ ID NO: 1180196 - protein, 9 aa, Homo Sapiens
NGAPPECCS

SEQ ID NO: 1180197 - protein, 9 aa, Homo Sapiens
SVTLSCIKI

SEQ ID NO: 1180198 - protein, 9 aa, Homo Sapiens
LQQAACKQQ

SEQ ID NO: 1180199 - protein, 9 aa, Homo Sapiens
DRSTATSQA

SEQ ID NO: 1180200 - protein, 9 aa, Homo Sapiens
LRAFLRTVA

SEQ ID NO: 1180201 - protein, 9 aa, Homo Sapiens
QQISVDSVF

SEQ ID NO: 1180202 - protein, 9 aa, Homo Sapiens
SFDVHDDMR

SEQ ID NO: 1180203 - protein, 9 aa, Homo Sapiens
KHGTCTAQV

SEQ ID NO: 1180204 - protein, 9 aa, Homo Sapiens
PVPVACPDD

SEQ ID NO: 1180205 - protein, 9 aa, Homo Sapiens
RMKFLFYAY

SEQ ID NO: 1180206 - protein, 9 aa, Homo Sapiens
SPGASRESP

SEQ ID NO: 1180207 - protein, 9 aa, Homo Sapiens
RVIRLHQLQ

SEQ ID NO: 1180208 - protein, 9 aa, Homo Sapiens
CVQRCVQWP

SEQ ID NO: 1180209 - protein, 9 aa, Homo Sapiens
RYTLGALGR

SEQ ID NO: 1180210 - protein, 9 aa, Homo Sapiens
GQEEAGGAS

SEQ ID NO: 1180211 - protein, 9 aa, Homo Sapiens
MVPPGGQQQ

SEQ ID NO: 1180212 - protein, 9 aa, Homo Sapiens
LSRPPGPQC

SEQ ID NO: 1180213 - protein, 9 aa, Homo Sapiens
CYLGLPHLE

SEQ ID NO: 1180214 - protein, 9 aa, Homo Sapiens
QHRHPRPAH

SEQ ID NO: 1180215 - protein, 9 aa, Homo Sapiens
YQTCSAGWE

SEQ ID NO: 1180216 - protein, 9 aa, Homo Sapiens
QHTQVVASP

SEQ ID NO: 1180217 - protein, 9 aa, Homo Sapiens
DFIVWMCTA

SEQ ID NO: 1180218 - protein, 9 aa, Homo Sapiens
LKIGQTSSV

SEQ ID NO: 1180219 - protein, 9 aa, Homo Sapiens
GLEATPSDS

SEQ ID NO: 1180220 - protein, 9 aa, Homo Sapiens
GPSALPSPP

SEQ ID NO: 1180221 - protein, 9 aa, Homo Sapiens
HGCQSAREK

SEQ ID NO: 1180222 - protein, 9 aa, Homo Sapiens
TYSHSPPRG

SEQ ID NO: 1180223 - protein, 9 aa, Homo Sapiens
LSLDELGCK

SEQ ID NO: 1180224 - protein, 9 aa, Homo Sapiens
RPPVPQLLL

SEQ ID NO: 1180225 - protein, 9 aa, Homo Sapiens
ATSSKVPIM

SEQ ID NO: 1180226 - protein, 9 aa, Homo Sapiens
RSPPLQSKF

SEQ ID NO: 1180227 - protein, 9 aa, Homo Sapiens
VDVEEGTWG

SEQ ID NO: 1180228 - protein, 9 aa, Homo Sapiens
PQAAPEPKC

SEQ ID NO: 1180229 - protein, 9 aa, Homo Sapiens
ERRRPARIQ

SEQ ID NO: 1180230 - protein, 9 aa, Homo Sapiens
VVSRGPRGG

SEQ ID NO: 1180231 - protein, 9 aa, Homo Sapiens
SNRSLPGTT

SEQ ID NO: 1180232 - protein, 9 aa, Homo Sapiens
GCAIGARNK

SEQ ID NO: 1180233 - protein, 9 aa, Homo Sapiens
NGGGSGGGS

SEQ ID NO: 1180234 - protein, 9 aa, Homo Sapiens
DCGRLSPSP

SEQ ID NO: 1180235 - protein, 9 aa, Homo Sapiens
PPLFSQSMA

SEQ ID NO: 1180236 - protein, 9 aa, Homo Sapiens
GALVGLEVR

SEQ ID NO: 1180237 - protein, 9 aa, Homo Sapiens
KKSHCLQDS

SEQ ID NO: 1180238 - protein, 9 aa, Homo Sapiens
TVYANSHQE

SEQ ID NO: 1180239 - protein, 9 aa, Homo Sapiens
PTSSGVYPA

SEQ ID NO: 1180240 - protein, 9 aa, Homo Sapiens
AKGKSSTQE

SEQ ID NO: 1180241 - protein, 9 aa, Homo Sapiens
VQDAAGRGR

SEQ ID NO: 1180242 - protein, 9 aa, Homo Sapiens
CKHKVFSDY

SEQ ID NO: 1180243 - protein, 9 aa, Homo Sapiens
ELLGKMDYR

SEQ ID NO: 1180244 - protein, 9 aa, Homo Sapiens
WFPPCGRRP

SEQ ID NO: 1180245 - protein, 9 aa, Homo Sapiens
ADEYIECLV

SEQ ID NO: 1180246 - protein, 9 aa, Homo Sapiens
PSPSPTWRT

SEQ ID NO: 1180247 - protein, 9 aa, Homo Sapiens
GVKHRLRGS

SEQ ID NO: 1180248 - protein, 9 aa, Homo Sapiens
KEPEVLQDP

SEQ ID NO: 1180249 - protein, 9 aa, Homo Sapiens
WSRPLQGQR

SEQ ID NO: 1180250 - protein, 9 aa, Homo Sapiens
LWTMSYRGT

SEQ ID NO: 1180251 - protein, 9 aa, Homo Sapiens
QPPPAFPLT

SEQ ID NO: 1180252 - protein, 9 aa, Homo Sapiens
IQKYFVVIN

SEQ ID NO: 1180253 - protein, 9 aa, Homo Sapiens
PVDQVNHKD

SEQ ID NO: 1180254 - protein, 9 aa, Homo Sapiens
PTPTAWSWA

SEQ ID NO: 1180255 - protein, 9 aa, Homo Sapiens
LRCLGLWCS

SEQ ID NO: 1180256 - protein, 9 aa, Homo Sapiens
YPVCHVHNL

SEQ ID NO: 1180257 - protein, 9 aa, Homo Sapiens
SPSRKRDKQ

SEQ ID NO: 1180258 - protein, 9 aa, Homo Sapiens
GRSLPAGPS

SEQ ID NO: 1180259 - protein, 9 aa, Homo Sapiens
KGRLVLLIE

SEQ ID NO: 1180260 - protein, 9 aa, Homo Sapiens
AHFQRPPTP

SEQ ID NO: 1180261 - protein, 9 aa, Homo Sapiens
LLDDFFHDR

SEQ ID NO: 1180262 - protein, 9 aa, Homo Sapiens
NCWQKDRNN

SEQ ID NO: 1180263 - protein, 9 aa, Homo Sapiens
LLNLSSMTP

SEQ ID NO: 1180264 - protein, 9 aa, Homo Sapiens
LWRSRSFPC

SEQ ID NO: 1180265 - protein, 9 aa, Homo Sapiens
IPTSPEGVS

SEQ ID NO: 1180266 - protein, 9 aa, Homo Sapiens
SGEERVRRG

SEQ ID NO: 1180267 - protein, 9 aa, Homo Sapiens
QPAAGVPCT

SEQ ID NO: 1180268 - protein, 9 aa, Homo Sapiens
VPRMSSPRR

SEQ ID NO: 1180269 - protein, 9 aa, Homo Sapiens
LSPKHSTRS

SEQ ID NO: 1180270 - protein, 9 aa, Homo Sapiens
ILPDDVCDF

SEQ ID NO: 1180271 - protein, 9 aa, Homo Sapiens
KFQHSPNCW

SEQ ID NO: 1180272 - protein, 9 aa, Homo Sapiens
GAWQGGSHT

SEQ ID NO: 1180273 - protein, 9 aa, Homo Sapiens
LKKMTLKAL

SEQ ID NO: 1180274 - protein, 9 aa, Homo Sapiens
TISFPCSKI

SEQ ID NO: 1180275 - protein, 9 aa, Homo Sapiens
QALQERLGQ

SEQ ID NO: 1180276 - protein, 9 aa, Homo Sapiens
PRRRLRRTS

SEQ ID NO: 1180277 - protein, 9 aa, Homo Sapiens
QRILKAKSK

SEQ ID NO: 1180278 - protein, 9 aa, Homo Sapiens
LFMLFLVMC

SEQ ID NO: 1180279 - protein, 9 aa, Homo Sapiens
KGKISPVKF

SEQ ID NO: 1180280 - protein, 9 aa, Homo Sapiens
FHATPEEFL

SEQ ID NO: 1180281 - protein, 9 aa, Homo Sapiens
TQPSPASAC

SEQ ID NO: 1180282 - protein, 9 aa, Homo Sapiens
DAMDFINDT

SEQ ID NO: 1180283 - protein, 9 aa, Homo Sapiens
GPRYGHSRT

SEQ ID NO: 1180284 - protein, 9 aa, Homo Sapiens
QLLIHSMCT

SEQ ID NO: 1180285 - protein, 9 aa, Homo Sapiens
KKVPTSFGD

SEQ ID NO: 1180286 - protein, 9 aa, Homo Sapiens
RRTTQAAAA

SEQ ID NO: 1180287 - protein, 9 aa, Homo Sapiens
WASKNGHHV

SEQ ID NO: 1180288 - protein, 9 aa, Homo Sapiens
GTAARKAAS

SEQ ID NO: 1180289 - protein, 9 aa, Homo Sapiens
PNASTWTIF

SEQ ID NO: 1180290 - protein, 9 aa, Homo Sapiens
LTEDKKNGI

SEQ ID NO: 1180291 - protein, 9 aa, Homo Sapiens
SRATASHPP

SEQ ID NO: 1180292 - protein, 9 aa, Homo Sapiens
VQGSAASSR

SEQ ID NO: 1180293 - protein, 9 aa, Homo Sapiens
DSLVGGMWA

SEQ ID NO: 1180294 - protein, 9 aa, Homo Sapiens
SGTGGQGVG

SEQ ID NO: 1180295 - protein, 9 aa, Homo Sapiens
PTAALVRAQ

SEQ ID NO: 1180296 - protein, 9 aa, Homo Sapiens
EAISASTRR

SEQ ID NO: 1180297 - protein, 9 aa, Homo Sapiens
SCKKEAVLP

SEQ ID NO: 1180298 - protein, 9 aa, Homo Sapiens
IFTTSKTLS

SEQ ID NO: 1180299 - protein, 9 aa, Homo Sapiens
GAWWVLAWQ

SEQ ID NO: 1180300 - protein, 9 aa, Homo Sapiens
IHMSPDFKT

SEQ ID NO: 1180301 - protein, 9 aa, Homo Sapiens
LSDHIAALK

SEQ ID NO: 1180302 - protein, 9 aa, Homo Sapiens
PPFCPRARQ

SEQ ID NO: 1180303 - protein, 9 aa, Homo Sapiens
DKRGSPTLG

SEQ ID NO: 1180304 - protein, 9 aa, Homo Sapiens
ASKGVPHLP

SEQ ID NO: 1180305 - protein, 9 aa, Homo Sapiens
LIHVPPLLR

SEQ ID NO: 1180306 - protein, 9 aa, Homo Sapiens
RPGSSWEKV

SEQ ID NO: 1180307 - protein, 9 aa, Homo Sapiens
AGALSLSCS

SEQ ID NO: 1180308 - protein, 9 aa, Homo Sapiens
NWHHGVFVG

SEQ ID NO: 1180309 - protein, 9 aa, Homo Sapiens
PSGFPDITE

SEQ ID NO: 1180310 - protein, 9 aa, Homo Sapiens
RSSCHNGTC

SEQ ID NO: 1180311 - protein, 9 aa, Homo Sapiens
PAPPDPSEE

SEQ ID NO: 1180312 - protein, 9 aa, Homo Sapiens
PRRYTVLSM

SEQ ID NO: 1180313 - protein, 9 aa, Homo Sapiens
LGLARPLSA

SEQ ID NO: 1180314 - protein, 9 aa, Homo Sapiens
IDDGLDQDE

SEQ ID NO: 1180315 - protein, 9 aa, Homo Sapiens
ARGPAPRTR

SEQ ID NO: 1180316 - protein, 9 aa, Homo Sapiens
HPQCLVLTG

SEQ ID NO: 1180317 - protein, 9 aa, Homo Sapiens
GEGGLRRAS

SEQ ID NO: 1180318 - protein, 9 aa, Homo Sapiens
LEAHTCWQR

SEQ ID NO: 1180319 - protein, 9 aa, Homo Sapiens
IFSVFVTQF

SEQ ID NO: 1180320 - protein, 9 aa, Homo Sapiens
TLEVLLIRT

SEQ ID NO: 1180321 - protein, 9 aa, Homo Sapiens
LPNGCVYYV

SEQ ID NO: 1180322 - protein, 9 aa, Homo Sapiens
SSFLLRQIE

SEQ ID NO: 1180323 - protein, 9 aa, Homo Sapiens
HVVHTLGAH

SEQ ID NO: 1180324 - protein, 9 aa, Homo Sapiens
QTKIILKVR

SEQ ID NO: 1180325 - protein, 9 aa, Homo Sapiens
VRFQQQSNP

SEQ ID NO: 1180326 - protein, 9 aa, Homo Sapiens
GFQVHLEAV

SEQ ID NO: 1180327 - protein, 9 aa, Homo Sapiens
GAAAGSGGG

SEQ ID NO: 1180328 - protein, 9 aa, Homo Sapiens
ATQPPSTLL

SEQ ID NO: 1180329 - protein, 9 aa, Homo Sapiens
VPSSSENTA

SEQ ID NO: 1180330 - protein, 9 aa, Homo Sapiens
RLGQRRRGW

SEQ ID NO: 1180331 - protein, 9 aa, Homo Sapiens
AGLFTVCLL

SEQ ID NO: 1180332 - protein, 9 aa, Homo Sapiens
VRTGFLLLS

SEQ ID NO: 1180333 - protein, 9 aa, Homo Sapiens
PFLLSLFPR

SEQ ID NO: 1180334 - protein, 9 aa, Homo Sapiens
EKRGTHPEA

SEQ ID NO: 1180335 - protein, 9 aa, Homo Sapiens
REAVLLGSQ

SEQ ID NO: 1180336 - protein, 9 aa, Homo Sapiens
SSFSKWCRP

SEQ ID NO: 1180337 - protein, 9 aa, Homo Sapiens
LMCAPKHAR

SEQ ID NO: 1180338 - protein, 9 aa, Homo Sapiens
MSPDFKTYV

SEQ ID NO: 1180339 - protein, 9 aa, Homo Sapiens
RLRVLGERH

SEQ ID NO: 1180340 - protein, 9 aa, Homo Sapiens
LVPRTREGF

SEQ ID NO: 1180341 - protein, 9 aa, Homo Sapiens
SHSPRRSSG

SEQ ID NO: 1180342 - protein, 9 aa, Homo Sapiens
NASTWTIFA

SEQ ID NO: 1180343 - protein, 9 aa, Homo Sapiens
FGSIAYCVN

SEQ ID NO: 1180344 - protein, 9 aa, Homo Sapiens
LKPSAPNSF

SEQ ID NO: 1180345 - protein, 9 aa, Homo Sapiens
RLTWRRPGP

SEQ ID NO: 1180346 - protein, 9 aa, Homo Sapiens
RKGLGWKWI

SEQ ID NO: 1180347 - protein, 9 aa, Homo Sapiens
DRTPLLAAA

SEQ ID NO: 1180348 - protein, 9 aa, Homo Sapiens
VAVDFRNYH

SEQ ID NO: 1180349 - protein, 9 aa, Homo Sapiens
GATAESHLF

SEQ ID NO: 1180350 - protein, 9 aa, Homo Sapiens
SPPSSPLPA

SEQ ID NO: 1180351 - protein, 9 aa, Homo Sapiens
WWEWYHLRF

SEQ ID NO: 1180352 - protein, 9 aa, Homo Sapiens
KHKVFSDYL

SEQ ID NO: 1180353 - protein, 9 aa, Homo Sapiens
WYSDQCNMI

SEQ ID NO: 1180354 - protein, 9 aa, Homo Sapiens
SCLSQYFEK

SEQ ID NO: 1180355 - protein, 9 aa, Homo Sapiens
LCTPPGSCG

SEQ ID NO: 1180356 - protein, 9 aa, Homo Sapiens
RGPPSHCQL

SEQ ID NO: 1180357 - protein, 9 aa, Homo Sapiens
GCSAGGGRN

SEQ ID NO: 1180358 - protein, 9 aa, Homo Sapiens
GARAPWPSS

SEQ ID NO: 1180359 - protein, 9 aa, Homo Sapiens
SAAPHTLCS

SEQ ID NO: 1180360 - protein, 9 aa, Homo Sapiens
PLLSPHFQP

SEQ ID NO: 1180361 - protein, 9 aa, Homo Sapiens
LRHLLAWDL

SEQ ID NO: 1180362 - protein, 9 aa, Homo Sapiens
QGARSDAPW

SEQ ID NO: 1180363 - protein, 9 aa, Homo Sapiens
QILWGLKYI

SEQ ID NO: 1180364 - protein, 9 aa, Homo Sapiens
PPPGPANPS

SEQ ID NO: 1180365 - protein, 9 aa, Homo Sapiens
CSKTFSAVN

SEQ ID NO: 1180366 - protein, 9 aa, Homo Sapiens
MAVAAAMAE

SEQ ID NO: 1180367 - protein, 9 aa, Homo Sapiens
KGKPPEEVL

SEQ ID NO: 1180368 - protein, 9 aa, Homo Sapiens
EDYEDKERE

SEQ ID NO: 1180369 - protein, 9 aa, Homo Sapiens
AGQLVGTRK

SEQ ID NO: 1180370 - protein, 9 aa, Homo Sapiens
HGSCSWDSN

SEQ ID NO: 1180371 - protein, 9 aa, Homo Sapiens
SYRWLSLFD

SEQ ID NO: 1180372 - protein, 9 aa, Homo Sapiens
GDLFSEDGV

SEQ ID NO: 1180373 - protein, 9 aa, Homo Sapiens
MSRQPSATR

SEQ ID NO: 1180374 - protein, 9 aa, Homo Sapiens
VANMYFATG

SEQ ID NO: 1180375 - protein, 9 aa, Homo Sapiens
LLFTGTPVQ

SEQ ID NO: 1180376 - protein, 9 aa, Homo Sapiens
NKGRDWCLL

SEQ ID NO: 1180377 - protein, 9 aa, Homo Sapiens
PPPLPACLN

SEQ ID NO: 1180378 - protein, 9 aa, Homo Sapiens
AMATRQVLE

SEQ ID NO: 1180379 - protein, 9 aa, Homo Sapiens
IKIFFCTGS

SEQ ID NO: 1180380 - protein, 9 aa, Homo Sapiens
EPPPLASSH

SEQ ID NO: 1180381 - protein, 9 aa, Homo Sapiens
RLRTMKIKC

SEQ ID NO: 1180382 - protein, 9 aa, Homo Sapiens
ARQSCCLPG

SEQ ID NO: 1180383 - protein, 9 aa, Homo Sapiens
GLSGRKAPR

SEQ ID NO: 1180384 - protein, 9 aa, Homo Sapiens
APDDQDHGA

SEQ ID NO: 1180385 - protein, 9 aa, Homo Sapiens
TLRGHFPGC

SEQ ID NO: 1180386 - protein, 9 aa, Homo Sapiens
WTTPASGGV

SEQ ID NO: 1180387 - protein, 9 aa, Homo Sapiens
PRKEENQAV

SEQ ID NO: 1180388 - protein, 9 aa, Homo Sapiens
KNGIWEVMP

SEQ ID NO: 1180389 - protein, 9 aa, Homo Sapiens
RYKGGTRSQ

SEQ ID NO: 1180390 - protein, 9 aa, Homo Sapiens
EIVNILQEL

SEQ ID NO: 1180391 - protein, 9 aa, Homo Sapiens
VKVVPKPIV

SEQ ID NO: 1180392 - protein, 9 aa, Homo Sapiens
QIYNLIHLV

SEQ ID NO: 1180393 - protein, 9 aa, Homo Sapiens
SVVTGTSEV

SEQ ID NO: 1180394 - protein, 9 aa, Homo Sapiens
KGRDWCLLQ

SEQ ID NO: 1180395 - protein, 9 aa, Homo Sapiens
AIYTGCADL

SEQ ID NO: 1180396 - protein, 9 aa, Homo Sapiens
EDPDAAKKE

SEQ ID NO: 1180397 - protein, 9 aa, Homo Sapiens
GEKRGLGTA

SEQ ID NO: 1180398 - protein, 9 aa, Homo Sapiens
PCGPQEATC

SEQ ID NO: 1180399 - protein, 9 aa, Homo Sapiens
LDQTLQVQE

SEQ ID NO: 1180400 - protein, 9 aa, Homo Sapiens
PSTRAAPPS

SEQ ID NO: 1180401 - protein, 9 aa, Homo Sapiens
LLGALHRLS

SEQ ID NO: 1180402 - protein, 9 aa, Homo Sapiens
CGRTFRSAS

SEQ ID NO: 1180403 - protein, 9 aa, Homo Sapiens
IAREIQSVK

SEQ ID NO: 1180404 - protein, 9 aa, Homo Sapiens
RPRPPEPLE

SEQ ID NO: 1180405 - protein, 9 aa, Homo Sapiens
QPEGLLDLQ

SEQ ID NO: 1180406 - protein, 9 aa, Homo Sapiens
SFTELSRIL

SEQ ID NO: 1180407 - protein, 9 aa, Homo Sapiens
SVWDAYGTS

SEQ ID NO: 1180408 - protein, 9 aa, Homo Sapiens
ELEECASEL

SEQ ID NO: 1180409 - protein, 9 aa, Homo Sapiens
ALSALFIWP

SEQ ID NO: 1180410 - protein, 9 aa, Homo Sapiens
PSDIHVEAV

SEQ ID NO: 1180411 - protein, 9 aa, Homo Sapiens
KLLDKMTMS

SEQ ID NO: 1180412 - protein, 9 aa, Homo Sapiens
RPRSTSPRP

SEQ ID NO: 1180413 - protein, 9 aa, Homo Sapiens
PCQFRLTGP

SEQ ID NO: 1180414 - protein, 9 aa, Homo Sapiens
LFATGSEWR

SEQ ID NO: 1180415 - protein, 9 aa, Homo Sapiens
LLSSPMHGP

SEQ ID NO: 1180416 - protein, 9 aa, Homo Sapiens
GIPRSTCGR

SEQ ID NO: 1180417 - protein, 9 aa, Homo Sapiens
WHSCRLAGM

SEQ ID NO: 1180418 - protein, 9 aa, Homo Sapiens
WFMEICLCK

SEQ ID NO: 1180419 - protein, 9 aa, Homo Sapiens
LCLLRAPLL

SEQ ID NO: 1180420 - protein, 9 aa, Homo Sapiens
SLSSFLIFF

SEQ ID NO: 1180421 - protein, 9 aa, Homo Sapiens
PSCTWSRWL

SEQ ID NO: 1180422 - protein, 9 aa, Homo Sapiens
SVALAERGR

SEQ ID NO: 1180423 - protein, 9 aa, Homo Sapiens
NKGVFREKP

SEQ ID NO: 1180424 - protein, 9 aa, Homo Sapiens
RALHAHRVP

SEQ ID NO: 1180425 - protein, 9 aa, Homo Sapiens
IDGDNTLGG

SEQ ID NO: 1180426 - protein, 9 aa, Homo Sapiens
PCIFQAVVQ

SEQ ID NO: 1180427 - protein, 9 aa, Homo Sapiens
LRHSLCDAV

SEQ ID NO: 1180428 - protein, 9 aa, Homo Sapiens
DYGYGCGCG

SEQ ID NO: 1180429 - protein, 9 aa, Homo Sapiens
ASSSSTGTR

SEQ ID NO: 1180430 - protein, 9 aa, Homo Sapiens
NYGNNFWNS

SEQ ID NO: 1180431 - protein, 9 aa, Homo Sapiens
PRARRSASS

SEQ ID NO: 1180432 - protein, 9 aa, Homo Sapiens
LQESLFATG

SEQ ID NO: 1180433 - protein, 9 aa, Homo Sapiens
LAVGKQWHM

SEQ ID NO: 1180434 - protein, 9 aa, Homo Sapiens
HTEKKLKEI

SEQ ID NO: 1180435 - protein, 9 aa, Homo Sapiens
QVVTLSQAV

SEQ ID NO: 1180436 - protein, 9 aa, Homo Sapiens
QTPPGSAPS

SEQ ID NO: 1180437 - protein, 9 aa, Homo Sapiens
ASLSVSIGQ

SEQ ID NO: 1180438 - protein, 9 aa, Homo Sapiens
TETASPSLS

SEQ ID NO: 1180439 - protein, 9 aa, Homo Sapiens
TSSPATSAS

SEQ ID NO: 1180440 - protein, 9 aa, Homo Sapiens
LEGFLTALQ

SEQ ID NO: 1180441 - protein, 9 aa, Homo Sapiens
STTSNWKKT

SEQ ID NO: 1180442 - protein, 9 aa, Homo Sapiens
SSLVAASPR

SEQ ID NO: 1180443 - protein, 9 aa, Homo Sapiens
SMKEPLEVQ

SEQ ID NO: 1180444 - protein, 9 aa, Homo Sapiens
PLNAFMLYR

SEQ ID NO: 1180445 - protein, 9 aa, Homo Sapiens
HPLCTVASP

SEQ ID NO: 1180446 - protein, 9 aa, Homo Sapiens
GENEQEKKC

SEQ ID NO: 1180447 - protein, 9 aa, Homo Sapiens
DGDNTLGGL

SEQ ID NO: 1180448 - protein, 9 aa, Homo Sapiens
QFFSFSFGT

SEQ ID NO: 1180449 - protein, 9 aa, Homo Sapiens
LNNRIVERD

SEQ ID NO: 1180450 - protein, 9 aa, Homo Sapiens
PERNHWQYR

SEQ ID NO: 1180451 - protein, 9 aa, Homo Sapiens
PQQEISVVH

SEQ ID NO: 1180452 - protein, 9 aa, Homo Sapiens
HCTFVDQMV

SEQ ID NO: 1180453 - protein, 9 aa, Homo Sapiens
EPVASRELK

SEQ ID NO: 1180454 - protein, 9 aa, Homo Sapiens
LVAASPRRM

SEQ ID NO: 1180455 - protein, 9 aa, Homo Sapiens
EQRKSVFDW

SEQ ID NO: 1180456 - protein, 9 aa, Homo Sapiens
DNTVAIDLI

SEQ ID NO: 1180457 - protein, 9 aa, Homo Sapiens
KCLGCCSSP

SEQ ID NO: 1180458 - protein, 9 aa, Homo Sapiens
YASPPGLAG

SEQ ID NO: 1180459 - protein, 9 aa, Homo Sapiens
RKCHSSGGS

SEQ ID NO: 1180460 - protein, 9 aa, Homo Sapiens
GTTTKEEME

SEQ ID NO: 1180461 - protein, 9 aa, Homo Sapiens
RYFSVNEAC

SEQ ID NO: 1180462 - protein, 9 aa, Homo Sapiens
GTSEVSLAQ

SEQ ID NO: 1180463 - protein, 9 aa, Homo Sapiens
SGQLAGRTA

SEQ ID NO: 1180464 - protein, 9 aa, Homo Sapiens
LAEGTPIDW

SEQ ID NO: 1180465 - protein, 9 aa, Homo Sapiens
VLAVDVGDS

SEQ ID NO: 1180466 - protein, 9 aa, Homo Sapiens
SFILSYRWL

SEQ ID NO: 1180467 - protein, 9 aa, Homo Sapiens
FLGSCWWHW

SEQ ID NO: 1180468 - protein, 9 aa, Homo Sapiens
YNKLQWSPS

SEQ ID NO: 1180469 - protein, 9 aa, Homo Sapiens
RNTELFQTL

SEQ ID NO: 1180470 - protein, 9 aa, Homo Sapiens
LKQDLVRPW

SEQ ID NO: 1180471 - protein, 9 aa, Homo Sapiens
QCQVWVLPP

SEQ ID NO: 1180472 - protein, 9 aa, Homo Sapiens
PGSCRSPRS

SEQ ID NO: 1180473 - protein, 9 aa, Homo Sapiens
SPARSVAAG

SEQ ID NO: 1180474 - protein, 9 aa, Homo Sapiens
FIIIHRSTT

SEQ ID NO: 1180475 - protein, 9 aa, Homo Sapiens
LGPAPEETI

SEQ ID NO: 1180476 - protein, 9 aa, Homo Sapiens
AALYQLMLN

SEQ ID NO: 1180477 - protein, 9 aa, Homo Sapiens
VRIFSLNLT

SEQ ID NO: 1180478 - protein, 9 aa, Homo Sapiens
VCGGNRGAG

SEQ ID NO: 1180479 - protein, 9 aa, Homo Sapiens
PDSGHNAWL

SEQ ID NO: 1180480 - protein, 9 aa, Homo Sapiens
TWVRDMVRS

SEQ ID NO: 1180481 - protein, 9 aa, Homo Sapiens
SGRRREGDA

SEQ ID NO: 1180482 - protein, 9 aa, Homo Sapiens
ATGLADTGV

SEQ ID NO: 1180483 - protein, 9 aa, Homo Sapiens
ALSLIATTR

SEQ ID NO: 1180484 - protein, 9 aa, Homo Sapiens
WYEFRVLAI

SEQ ID NO: 1180485 - protein, 9 aa, Homo Sapiens
GKQTVMVLP

SEQ ID NO: 1180486 - protein, 9 aa, Homo Sapiens
SFTVAKGKS

SEQ ID NO: 1180487 - protein, 9 aa, Homo Sapiens
RVSPRSTTA

SEQ ID NO: 1180488 - protein, 9 aa, Homo Sapiens
QGTRSATSN

SEQ ID NO: 1180489 - protein, 9 aa, Homo Sapiens
GSKDEWRWM

SEQ ID NO: 1180490 - protein, 9 aa, Homo Sapiens
VESAYTARI

SEQ ID NO: 1180491 - protein, 9 aa, Homo Sapiens
RSARMSSWS

SEQ ID NO: 1180492 - protein, 9 aa, Homo Sapiens
KAGTGAQRV

SEQ ID NO: 1180493 - protein, 9 aa, Homo Sapiens
LHKKKSVWQ

SEQ ID NO: 1180494 - protein, 9 aa, Homo Sapiens
GLMWAGLAL

SEQ ID NO: 1180495 - protein, 9 aa, Homo Sapiens
RDEQLQALQ

SEQ ID NO: 1180496 - protein, 9 aa, Homo Sapiens
GLTRKCGAE

SEQ ID NO: 1180497 - protein, 9 aa, Homo Sapiens
HQVRENQQK

SEQ ID NO: 1180498 - protein, 9 aa, Homo Sapiens
PRVALSRPP

SEQ ID NO: 1180499 - protein, 9 aa, Homo Sapiens
MALQSNQNM

SEQ ID NO: 1180500 - protein, 9 aa, Homo Sapiens
MRALYDYDG

SEQ ID NO: 1180501 - protein, 9 aa, Homo Sapiens
GGAPAAAQG

SEQ ID NO: 1180502 - protein, 9 aa, Homo Sapiens
HSLTTYKII

SEQ ID NO: 1180503 - protein, 9 aa, Homo Sapiens
PDAWPSSPC

SEQ ID NO: 1180504 - protein, 9 aa, Homo Sapiens
AGAQDGQMT

SEQ ID NO: 1180505 - protein, 9 aa, Homo Sapiens
AGSSRKMKI

SEQ ID NO: 1180506 - protein, 9 aa, Homo Sapiens
GIYMGTDVI

SEQ ID NO: 1180507 - protein, 9 aa, Homo Sapiens
IKIHEKVGS

SEQ ID NO: 1180508 - protein, 9 aa, Homo Sapiens
HLEYGLPSL

SEQ ID NO: 1180509 - protein, 9 aa, Homo Sapiens
LGLSIDSLD

SEQ ID NO: 1180510 - protein, 9 aa, Homo Sapiens
LSLYNFKKH

SEQ ID NO: 1180511 - protein, 9 aa, Homo Sapiens
QGGERNLKV

SEQ ID NO: 1180512 - protein, 9 aa, Homo Sapiens
LPRRKVMTP

SEQ ID NO: 1180513 - protein, 9 aa, Homo Sapiens
AFVAFTLWT

SEQ ID NO: 1180514 - protein, 9 aa, Homo Sapiens
QGKPKADMT

SEQ ID NO: 1180515 - protein, 9 aa, Homo Sapiens
HQHGCREKI

SEQ ID NO: 1180516 - protein, 9 aa, Homo Sapiens
ASGHHPPAQ

SEQ ID NO: 1180517 - protein, 9 aa, Homo Sapiens
VARAASHRR

SEQ ID NO: 1180518 - protein, 9 aa, Homo Sapiens
WKAGTGAQR

SEQ ID NO: 1180519 - protein, 9 aa, Homo Sapiens
LSCGDDVLV

SEQ ID NO: 1180520 - protein, 9 aa, Homo Sapiens
QEFLLLSNL

SEQ ID NO: 1180521 - protein, 9 aa, Homo Sapiens
ARAMEAHAM

SEQ ID NO: 1180522 - protein, 9 aa, Homo Sapiens
YQKARQTPE

SEQ ID NO: 1180523 - protein, 9 aa, Homo Sapiens
PPAQIPTST

SEQ ID NO: 1180524 - protein, 9 aa, Homo Sapiens
LLFKGRGQI

SEQ ID NO: 1180525 - protein, 9 aa, Homo Sapiens
VHIVKDENC

SEQ ID NO: 1180526 - protein, 9 aa, Homo Sapiens
EKLPPVLML

SEQ ID NO: 1180527 - protein, 9 aa, Homo Sapiens
DDRYVAICH

SEQ ID NO: 1180528 - protein, 9 aa, Homo Sapiens
TPQKVADVE

SEQ ID NO: 1180529 - protein, 9 aa, Homo Sapiens
HLINPVKRL

SEQ ID NO: 1180530 - protein, 9 aa, Homo Sapiens
PLNSWRSGG

SEQ ID NO: 1180531 - protein, 9 aa, Homo Sapiens
PLGPHPSSP

SEQ ID NO: 1180532 - protein, 9 aa, Homo Sapiens
PATTAAPRG

SEQ ID NO: 1180533 - protein, 9 aa, Homo Sapiens
SRELKAPRA

SEQ ID NO: 1180534 - protein, 9 aa, Homo Sapiens
KLEQCMTSK

SEQ ID NO: 1180535 - protein, 9 aa, Homo Sapiens
CQTQDSARR

SEQ ID NO: 1180536 - protein, 9 aa, Homo Sapiens
EKEKELRVS

SEQ ID NO: 1180537 - protein, 9 aa, Homo Sapiens
HPLVANMYF

SEQ ID NO: 1180538 - protein, 9 aa, Homo Sapiens
LTENINAVT

SEQ ID NO: 1180539 - protein, 9 aa, Homo Sapiens
PVVTSRQII

SEQ ID NO: 1180540 - protein, 9 aa, Homo Sapiens
VVERPGAMA

SEQ ID NO: 1180541 - protein, 9 aa, Homo Sapiens
MAFSFPQLP

SEQ ID NO: 1180542 - protein, 9 aa, Homo Sapiens
KQSQHTTEV

SEQ ID NO: 1180543 - protein, 9 aa, Homo Sapiens
LMLAGGFFL

SEQ ID NO: 1180544 - protein, 9 aa, Homo Sapiens
PLDRCYSTP

SEQ ID NO: 1180545 - protein, 9 aa, Homo Sapiens
LEKALSALF

SEQ ID NO: 1180546 - protein, 9 aa, Homo Sapiens
MGPRMANLS

SEQ ID NO: 1180547 - protein, 9 aa, Homo Sapiens
AFLRTVAFW

SEQ ID NO: 1180548 - protein, 9 aa, Homo Sapiens
IHEKVGSQL

SEQ ID NO: 1180549 - protein, 9 aa, Homo Sapiens
SRLKPSAPN

SEQ ID NO: 1180550 - protein, 9 aa, Homo Sapiens
DSACSPSEA

SEQ ID NO: 1180551 - protein, 9 aa, Homo Sapiens
YVGSLIGHE

SEQ ID NO: 1180552 - protein, 9 aa, Homo Sapiens
RLCNFRNAS

SEQ ID NO: 1180553 - protein, 9 aa, Homo Sapiens
SGFPGRGGG

SEQ ID NO: 1180554 - protein, 9 aa, Homo Sapiens
ASTRDSLTP

SEQ ID NO: 1180555 - protein, 9 aa, Homo Sapiens
VKINSKSIF

SEQ ID NO: 1180556 - protein, 9 aa, Homo Sapiens
RSWNRWKTS

SEQ ID NO: 1180557 - protein, 9 aa, Homo Sapiens
PYPFHVLAL

SEQ ID NO: 1180558 - protein, 9 aa, Homo Sapiens
SPNIPYMYI

SEQ ID NO: 1180559 - protein, 9 aa, Homo Sapiens
AQAVCARGR

SEQ ID NO: 1180560 - protein, 9 aa, Homo Sapiens
NIKENIQDN

SEQ ID NO: 1180561 - protein, 9 aa, Homo Sapiens
SPTGHLGGA

SEQ ID NO: 1180562 - protein, 9 aa, Homo Sapiens
RQPSRPTGR

SEQ ID NO: 1180563 - protein, 9 aa, Homo Sapiens
ENTALSCCD

SEQ ID NO: 1180564 - protein, 9 aa, Homo Sapiens
KPHRYMPGT

SEQ ID NO: 1180565 - protein, 9 aa, Homo Sapiens
APLGPAVLE

SEQ ID NO: 1180566 - protein, 9 aa, Homo Sapiens
NFLNEFKNN

SEQ ID NO: 1180567 - protein, 9 aa, Homo Sapiens
LPDAWPSSP

SEQ ID NO: 1180568 - protein, 9 aa, Homo Sapiens
SILIHDRSV

SEQ ID NO: 1180569 - protein, 9 aa, Homo Sapiens
MVPLPVWMS

SEQ ID NO: 1180570 - protein, 9 aa, Homo Sapiens
TDPCWALRF

SEQ ID NO: 1180571 - protein, 9 aa, Homo Sapiens
GLTGLQGFP

SEQ ID NO: 1180572 - protein, 9 aa, Homo Sapiens
TTAIGGGWP

SEQ ID NO: 1180573 - protein, 9 aa, Homo Sapiens
VDRSSQVSS

SEQ ID NO: 1180574 - protein, 9 aa, Homo Sapiens
STCARLWMA

SEQ ID NO: 1180575 - protein, 9 aa, Homo Sapiens
NASLICHRR

SEQ ID NO: 1180576 - protein, 9 aa, Homo Sapiens
CSSARPSCW

SEQ ID NO: 1180577 - protein, 9 aa, Homo Sapiens
GPAAPSEPV

SEQ ID NO: 1180578 - protein, 9 aa, Homo Sapiens
SIVITVFML

SEQ ID NO: 1180579 - protein, 9 aa, Homo Sapiens
GGGGGGAPD

SEQ ID NO: 1180580 - protein, 9 aa, Homo Sapiens
PSLWKTKKS

SEQ ID NO: 1180581 - protein, 9 aa, Homo Sapiens
AGEGPAPGG

SEQ ID NO: 1180582 - protein, 9 aa, Homo Sapiens
RSSGWMPGM

SEQ ID NO: 1180583 - protein, 9 aa, Homo Sapiens
TRSAWGDWV

SEQ ID NO: 1180584 - protein, 9 aa, Homo Sapiens
EEAIYTGCA

SEQ ID NO: 1180585 - protein, 9 aa, Homo Sapiens
TGAVKVGTI

SEQ ID NO: 1180586 - protein, 9 aa, Homo Sapiens
LRHPVGRSR

SEQ ID NO: 1180587 - protein, 9 aa, Homo Sapiens
AILLHVQPS

SEQ ID NO: 1180588 - protein, 9 aa, Homo Sapiens
VDALLMSPN

SEQ ID NO: 1180589 - protein, 9 aa, Homo Sapiens
AEAGGGGPG

SEQ ID NO: 1180590 - protein, 9 aa, Homo Sapiens
SVILPFVNK

SEQ ID NO: 1180591 - protein, 9 aa, Homo Sapiens
DVGQQPNVF

SEQ ID NO: 1180592 - protein, 9 aa, Homo Sapiens
SLGPVAETH

SEQ ID NO: 1180593 - protein, 9 aa, Homo Sapiens
SPPWREAWR

SEQ ID NO: 1180594 - protein, 9 aa, Homo Sapiens
CRLAGMGLQ

SEQ ID NO: 1180595 - protein, 9 aa, Homo Sapiens
PEGEKNQLT

SEQ ID NO: 1180596 - protein, 9 aa, Homo Sapiens
MPHSAMLFV

SEQ ID NO: 1180597 - protein, 9 aa, Homo Sapiens
GAARPRRTR

SEQ ID NO: 1180598 - protein, 9 aa, Homo Sapiens
GSQDPRTMS

SEQ ID NO: 1180599 - protein, 9 aa, Homo Sapiens
ELGPLLLLD

SEQ ID NO: 1180600 - protein, 9 aa, Homo Sapiens
EAPDCGRLS

SEQ ID NO: 1180601 - protein, 9 aa, Homo Sapiens
AHAAGPEPV

SEQ ID NO: 1180602 - protein, 9 aa, Homo Sapiens
ATCCSSLSL

SEQ ID NO: 1180603 - protein, 9 aa, Homo Sapiens
PKYLTYDPN

SEQ ID NO: 1180604 - protein, 9 aa, Homo Sapiens
AGPLYSDGA

SEQ ID NO: 1180605 - protein, 9 aa, Homo Sapiens
EGSSQRMSR

SEQ ID NO: 1180606 - protein, 9 aa, Homo Sapiens
GWHWGWRTA

SEQ ID NO: 1180607 - protein, 9 aa, Homo Sapiens
LINPVKRLI

SEQ ID NO: 1180608 - protein, 9 aa, Homo Sapiens
PSAAPSMVA

SEQ ID NO: 1180609 - protein, 9 aa, Homo Sapiens
VSVAALVAQ

SEQ ID NO: 1180610 - protein, 9 aa, Homo Sapiens
VGTSVGTIH

SEQ ID NO: 1180611 - protein, 9 aa, Homo Sapiens
AVKAFWGGK

SEQ ID NO: 1180612 - protein, 9 aa, Homo Sapiens
PHNKQMEAE

SEQ ID NO: 1180613 - protein, 9 aa, Homo Sapiens
PPLASSHTT

SEQ ID NO: 1180614 - protein, 9 aa, Homo Sapiens
GGSGWSGRS

SEQ ID NO: 1180615 - protein, 9 aa, Homo Sapiens
LLSLIFSVF

SEQ ID NO: 1180616 - protein, 9 aa, Homo Sapiens
QLGQGLGVA

SEQ ID NO: 1180617 - protein, 9 aa, Homo Sapiens
IDFEDIIKN

SEQ ID NO: 1180618 - protein, 9 aa, Homo Sapiens
SPAGQRGRA

SEQ ID NO: 1180619 - protein, 9 aa, Homo Sapiens
KIQVSSLSV

SEQ ID NO: 1180620 - protein, 9 aa, Homo Sapiens
SASPGPKPS

SEQ ID NO: 1180621 - protein, 9 aa, Homo Sapiens
HWQYRDLEA

SEQ ID NO: 1180622 - protein, 9 aa, Homo Sapiens
QMGLKVVRL

SEQ ID NO: 1180623 - protein, 9 aa, Homo Sapiens
GHSGEQNLL

SEQ ID NO: 1180624 - protein, 9 aa, Homo Sapiens
NSQCLPRPQ

SEQ ID NO: 1180625 - protein, 9 aa, Homo Sapiens
GHRSMDPMD

SEQ ID NO: 1180626 - protein, 9 aa, Homo Sapiens
SQVMPLLLI

SEQ ID NO: 1180627 - protein, 9 aa, Homo Sapiens
AGAGRGQEE

SEQ ID NO: 1180628 - protein, 9 aa, Homo Sapiens
NSSSSCLSQ

SEQ ID NO: 1180629 - protein, 9 aa, Homo Sapiens
PGSLPPIRD

SEQ ID NO: 1180630 - protein, 9 aa, Homo Sapiens
VGSGYRFWT

SEQ ID NO: 1180631 - protein, 9 aa, Homo Sapiens
LQAATGHHH

SEQ ID NO: 1180632 - protein, 9 aa, Homo Sapiens
ATCRLFNLR

SEQ ID NO: 1180633 - protein, 9 aa, Homo Sapiens
EVGNFAAYA

SEQ ID NO: 1180634 - protein, 9 aa, Homo Sapiens
TTLDSGVYT

SEQ ID NO: 1180635 - protein, 9 aa, Homo Sapiens
VAGQLVGTR

SEQ ID NO: 1180636 - protein, 9 aa, Homo Sapiens
SSTVTAAPS

SEQ ID NO: 1180637 - protein, 9 aa, Homo Sapiens
DKMTMSFWK

SEQ ID NO: 1180638 - protein, 9 aa, Homo Sapiens
SPRPPSTSS

SEQ ID NO: 1180639 - protein, 9 aa, Homo Sapiens
VDHSECGEV

SEQ ID NO: 1180640 - protein, 9 aa, Homo Sapiens
DAGLSGRKA

SEQ ID NO: 1180641 - protein, 9 aa, Homo Sapiens
GSGGGSHFF

SEQ ID NO: 1180642 - protein, 9 aa, Homo Sapiens
SPSWSAAPT

SEQ ID NO: 1180643 - protein, 9 aa, Homo Sapiens
QTQVCETTH

SEQ ID NO: 1180644 - protein, 9 aa, Homo Sapiens
CTEILTFPG

SEQ ID NO: 1180645 - protein, 9 aa, Homo Sapiens
PGASRRWRM

SEQ ID NO: 1180646 - protein, 9 aa, Homo Sapiens
AGSPRKCSA

SEQ ID NO: 1180647 - protein, 9 aa, Homo Sapiens
MRPGEGPHP

SEQ ID NO: 1180648 - protein, 9 aa, Homo Sapiens
SEDKDVVEN

SEQ ID NO: 1180649 - protein, 9 aa, Homo Sapiens
LRIMFNILQ

SEQ ID NO: 1180650 - protein, 9 aa, Homo Sapiens
HAGSNGTRA

SEQ ID NO: 1180651 - protein, 9 aa, Homo Sapiens
IGLRQDVTL

SEQ ID NO: 1180652 - protein, 9 aa, Homo Sapiens
KMDYRLMML

SEQ ID NO: 1180653 - protein, 9 aa, Homo Sapiens
PDLPSQRGI

SEQ ID NO: 1180654 - protein, 9 aa, Homo Sapiens
PGSDELTVT

SEQ ID NO: 1180655 - protein, 9 aa, Homo Sapiens
CCSWPSSPP

SEQ ID NO: 1180656 - protein, 9 aa, Homo Sapiens
ASRLTYAHL

SEQ ID NO: 1180657 - protein, 9 aa, Homo Sapiens
DGGNTAAAL

SEQ ID NO: 1180658 - protein, 9 aa, Homo Sapiens
DAVVQAVGF

SEQ ID NO: 1180659 - protein, 9 aa, Homo Sapiens
LASAASCSA

SEQ ID NO: 1180660 - protein, 9 aa, Homo Sapiens
SGVFPVLMD

SEQ ID NO: 1180661 - protein, 9 aa, Homo Sapiens
NKLQWSPSI

SEQ ID NO: 1180662 - protein, 9 aa, Homo Sapiens
SCTRILVFP

SEQ ID NO: 1180663 - protein, 9 aa, Homo Sapiens
SNLARKVLT

SEQ ID NO: 1180664 - protein, 9 aa, Homo Sapiens
AHLRWAVFD

SEQ ID NO: 1180665 - protein, 9 aa, Homo Sapiens
RGMALCPSC

SEQ ID NO: 1180666 - protein, 9 aa, Homo Sapiens
YIDSLERYL

SEQ ID NO: 1180667 - protein, 9 aa, Homo Sapiens
HSTPFSTQI

SEQ ID NO: 1180668 - protein, 9 aa, Homo Sapiens
CRPACTCIS

SEQ ID NO: 1180669 - protein, 9 aa, Homo Sapiens
QPEAAGGQR

SEQ ID NO: 1180670 - protein, 9 aa, Homo Sapiens
IVILQDCPA

SEQ ID NO: 1180671 - protein, 9 aa, Homo Sapiens
SSGHNPFLA

SEQ ID NO: 1180672 - protein, 9 aa, Homo Sapiens
QWRLRKFKM

SEQ ID NO: 1180673 - protein, 9 aa, Homo Sapiens
KPHMPMEFD

SEQ ID NO: 1180674 - protein, 9 aa, Homo Sapiens
GAARARTCS

SEQ ID NO: 1180675 - protein, 9 aa, Homo Sapiens
AFIPGHHCW

SEQ ID NO: 1180676 - protein, 9 aa, Homo Sapiens
RQPPPGPSW

SEQ ID NO: 1180677 - protein, 9 aa, Homo Sapiens
GVQDGLSVV

SEQ ID NO: 1180678 - protein, 9 aa, Homo Sapiens
MLPSQPLDR

SEQ ID NO: 1180679 - protein, 9 aa, Homo Sapiens
QDESEEEEG

SEQ ID NO: 1180680 - protein, 9 aa, Homo Sapiens
MLLGECRQM

SEQ ID NO: 1180681 - protein, 9 aa, Homo Sapiens
RDLPKGCPP

SEQ ID NO: 1180682 - protein, 9 aa, Homo Sapiens
WKTCYIQSS

SEQ ID NO: 1180683 - protein, 9 aa, Homo Sapiens
DWEIAIQKP

SEQ ID NO: 1180684 - protein, 9 aa, Homo Sapiens
LSTKSEHTP

SEQ ID NO: 1180685 - protein, 9 aa, Homo Sapiens
SNQNMRGNA

SEQ ID NO: 1180686 - protein, 9 aa, Homo Sapiens
HAGGKGPGV

SEQ ID NO: 1180687 - protein, 9 aa, Homo Sapiens
EAEQRFWKK

SEQ ID NO: 1180688 - protein, 9 aa, Homo Sapiens
WKKRRRSQR

SEQ ID NO: 1180689 - protein, 9 aa, Homo Sapiens
RNFLVSGWH

SEQ ID NO: 1180690 - protein, 9 aa, Homo Sapiens
KLKSQYTKP

SEQ ID NO: 1180691 - protein, 9 aa, Homo Sapiens
EHEPGAITE

SEQ ID NO: 1180692 - protein, 9 aa, Homo Sapiens
MHYGHQAPQ

SEQ ID NO: 1180693 - protein, 9 aa, Homo Sapiens
IRKEDFNNV

SEQ ID NO: 1180694 - protein, 9 aa, Homo Sapiens
DELGPQPIL

SEQ ID NO: 1180695 - protein, 9 aa, Homo Sapiens
PRGQHTPAP

SEQ ID NO: 1180696 - protein, 9 aa, Homo Sapiens
SCQWPTEGR

SEQ ID NO: 1180697 - protein, 9 aa, Homo Sapiens
QPGGWFEVV

SEQ ID NO: 1180698 - protein, 9 aa, Homo Sapiens
QREQERQLA

SEQ ID NO: 1180699 - protein, 9 aa, Homo Sapiens
LRPRGLLTR

SEQ ID NO: 1180700 - protein, 9 aa, Homo Sapiens
ATLGLCIRS

SEQ ID NO: 1180701 - protein, 9 aa, Homo Sapiens
LSMGPGGLR

SEQ ID NO: 1180702 - protein, 9 aa, Homo Sapiens
LKWPVPPHP

SEQ ID NO: 1180703 - protein, 9 aa, Homo Sapiens
RCCPSGKSA

SEQ ID NO: 1180704 - protein, 9 aa, Homo Sapiens
VCSGVTSAA

SEQ ID NO: 1180705 - protein, 9 aa, Homo Sapiens
KGTMEAKEV

SEQ ID NO: 1180706 - protein, 9 aa, Homo Sapiens
LGNDNIHAM

SEQ ID NO: 1180707 - protein, 9 aa, Homo Sapiens
STRSLPSIS

SEQ ID NO: 1180708 - protein, 9 aa, Homo Sapiens
NAVLVVSGG

SEQ ID NO: 1180709 - protein, 9 aa, Homo Sapiens
LVYEAFNWH

SEQ ID NO: 1180710 - protein, 9 aa, Homo Sapiens
SVRSMVSSV

SEQ ID NO: 1180711 - protein, 9 aa, Homo Sapiens
EDWLIFTQN

SEQ ID NO: 1180712 - protein, 9 aa, Homo Sapiens
PPGPGSSLL

SEQ ID NO: 1180713 - protein, 9 aa, Homo Sapiens
ILRSFMKLY

SEQ ID NO: 1180714 - protein, 9 aa, Homo Sapiens
RGPGNQLRN

SEQ ID NO: 1180715 - protein, 9 aa, Homo Sapiens
TLLAMYNSW

SEQ ID NO: 1180716 - protein, 9 aa, Homo Sapiens
ELGAAHDVG

SEQ ID NO: 1180717 - protein, 9 aa, Homo Sapiens
SRVEASVIK

SEQ ID NO: 1180718 - protein, 9 aa, Homo Sapiens
GLRQDVTLE

SEQ ID NO: 1180719 - protein, 9 aa, Homo Sapiens
ATGTHRDPP

SEQ ID NO: 1180720 - protein, 9 aa, Homo Sapiens
KEKESPGAP

SEQ ID NO: 1180721 - protein, 9 aa, Homo Sapiens
VLKQDLVRP

SEQ ID NO: 1180722 - protein, 9 aa, Homo Sapiens
AHLGYSVVT

SEQ ID NO: 1180723 - protein, 9 aa, Homo Sapiens
IHAMKYPLP

SEQ ID NO: 1180724 - protein, 9 aa, Homo Sapiens
AWGNPSWCP

SEQ ID NO: 1180725 - protein, 9 aa, Homo Sapiens
GGGGGVSVY

SEQ ID NO: 1180726 - protein, 9 aa, Homo Sapiens
LFILEEHEP

SEQ ID NO: 1180727 - protein, 9 aa, Homo Sapiens
STSRRTRPN

SEQ ID NO: 1180728 - protein, 9 aa, Homo Sapiens
ALGRALGYS

SEQ ID NO: 1180729 - protein, 9 aa, Homo Sapiens
LDYEDLEHK

SEQ ID NO: 1180730 - protein, 9 aa, Homo Sapiens
YTFERVFGR

SEQ ID NO: 1180731 - protein, 9 aa, Homo Sapiens
TMKMSFSAI

SEQ ID NO: 1180732 - protein, 9 aa, Homo Sapiens
RGAGPNHGN

SEQ ID NO: 1180733 - protein, 9 aa, Homo Sapiens
SAGHVRLHR

SEQ ID NO: 1180734 - protein, 9 aa, Homo Sapiens
VRMDPPAPT

SEQ ID NO: 1180735 - protein, 9 aa, Homo Sapiens
PICIEYIIG

SEQ ID NO: 1180736 - protein, 9 aa, Homo Sapiens
RPSTSRSSC

SEQ ID NO: 1180737 - protein, 9 aa, Homo Sapiens
KGRGQILHR

SEQ ID NO: 1180738 - protein, 9 aa, Homo Sapiens
VPPALALLQ

SEQ ID NO: 1180739 - protein, 9 aa, Homo Sapiens
WPRTSPRPR

SEQ ID NO: 1180740 - protein, 9 aa, Homo Sapiens
RSTSVGLCS

SEQ ID NO: 1180741 - protein, 9 aa, Homo Sapiens
AYREEPEDG

SEQ ID NO: 1180742 - protein, 9 aa, Homo Sapiens
QGVGVSSAA

SEQ ID NO: 1180743 - protein, 9 aa, Homo Sapiens
SIVIGERTE

SEQ ID NO: 1180744 - protein, 9 aa, Homo Sapiens
RNPGDDAHG

SEQ ID NO: 1180745 - protein, 9 aa, Homo Sapiens
NKFIEMKNC

SEQ ID NO: 1180746 - protein, 9 aa, Homo Sapiens
YQCDCCGRS

SEQ ID NO: 1180747 - protein, 9 aa, Homo Sapiens
DIQLARHIR

SEQ ID NO: 1180748 - protein, 9 aa, Homo Sapiens
GGCLVVHVA

SEQ ID NO: 1180749 - protein, 9 aa, Homo Sapiens
AVPTYVSVD

SEQ ID NO: 1180750 - protein, 9 aa, Homo Sapiens
CVKIYTFNQ

SEQ ID NO: 1180751 - protein, 9 aa, Homo Sapiens
NKHAGSNGT

SEQ ID NO: 1180752 - protein, 9 aa, Homo Sapiens
FWGGKSLYT

SEQ ID NO: 1180753 - protein, 9 aa, Homo Sapiens
DFLGSCWWH

SEQ ID NO: 1180754 - protein, 9 aa, Homo Sapiens
QPSPQTPTS

SEQ ID NO: 1180755 - protein, 9 aa, Homo Sapiens
QGCWPPPAP

SEQ ID NO: 1180756 - protein, 9 aa, Homo Sapiens
LKKFHIPVD

SEQ ID NO: 1180757 - protein, 9 aa, Homo Sapiens
PSSRSKLRK

SEQ ID NO: 1180758 - protein, 9 aa, Homo Sapiens
NQVGRAGDK

SEQ ID NO: 1180759 - protein, 9 aa, Homo Sapiens
TLSSFQMPP

SEQ ID NO: 1180760 - protein, 9 aa, Homo Sapiens
AARPRPLRM

SEQ ID NO: 1180761 - protein, 9 aa, Homo Sapiens
QMIHILLCL

SEQ ID NO: 1180762 - protein, 9 aa, Homo Sapiens
RRRGWRRTR

SEQ ID NO: 1180763 - protein, 9 aa, Homo Sapiens
CNASIMCPL

SEQ ID NO: 1180764 - protein, 9 aa, Homo Sapiens
PQKSSLSPP

SEQ ID NO: 1180765 - protein, 9 aa, Homo Sapiens
HSLSTGQTA

SEQ ID NO: 1180766 - protein, 9 aa, Homo Sapiens
LRQIEFLKG

SEQ ID NO: 1180767 - protein, 9 aa, Homo Sapiens
RLKPSQKHF

SEQ ID NO: 1180768 - protein, 9 aa, Homo Sapiens
AQSENEDVC

SEQ ID NO: 1180769 - protein, 9 aa, Homo Sapiens
TDIWKTILS

SEQ ID NO: 1180770 - protein, 9 aa, Homo Sapiens
TAVLTYHLV

SEQ ID NO: 1180771 - protein, 9 aa, Homo Sapiens
PIRTGPSLS

SEQ ID NO: 1180772 - protein, 9 aa, Homo Sapiens
TRGAAAKRY

SEQ ID NO: 1180773 - protein, 9 aa, Homo Sapiens
PMEFDFDDE

SEQ ID NO: 1180774 - protein, 9 aa, Homo Sapiens
LNGPPIMKT

SEQ ID NO: 1180775 - protein, 9 aa, Homo Sapiens
TSSRISSSS

SEQ ID NO: 1180776 - protein, 9 aa, Homo Sapiens
ACATSAAAT

SEQ ID NO: 1180777 - protein, 9 aa, Homo Sapiens
FIRIELRSL

SEQ ID NO: 1180778 - protein, 9 aa, Homo Sapiens
CTGYFKNVA

SEQ ID NO: 1180779 - protein, 9 aa, Homo Sapiens
YAMAASVMV

SEQ ID NO: 1180780 - protein, 9 aa, Homo Sapiens
TPAQGEEAV

SEQ ID NO: 1180781 - protein, 9 aa, Homo Sapiens
RPRPPPPRS

SEQ ID NO: 1180782 - protein, 9 aa, Homo Sapiens
GSPPSSPLP

SEQ ID NO: 1180783 - protein, 9 aa, Homo Sapiens
FYKGEDIFW

SEQ ID NO: 1180784 - protein, 9 aa, Homo Sapiens
ANKLVRHTE

SEQ ID NO: 1180785 - protein, 9 aa, Homo Sapiens
PVSLIESEL

SEQ ID NO: 1180786 - protein, 9 aa, Homo Sapiens
KTVRQWSPR

SEQ ID NO: 1180787 - protein, 9 aa, Homo Sapiens
KVADGHFHT

SEQ ID NO: 1180788 - protein, 9 aa, Homo Sapiens
VALTSSSAS

SEQ ID NO: 1180789 - protein, 9 aa, Homo Sapiens
TNLEEAIYT

SEQ ID NO: 1180790 - protein, 9 aa, Homo Sapiens
LKTQSGQVL

SEQ ID NO: 1180791 - protein, 9 aa, Homo Sapiens
LVGCLTWLI

SEQ ID NO: 1180792 - protein, 9 aa, Homo Sapiens
LTTLATQPP

SEQ ID NO: 1180793 - protein, 9 aa, Homo Sapiens
EFQRILKAK

SEQ ID NO: 1180794 - protein, 9 aa, Homo Sapiens
HWEGWWSAQ

SEQ ID NO: 1180795 - protein, 9 aa, Homo Sapiens
NLTNVKHLI

SEQ ID NO: 1180796 - protein, 9 aa, Homo Sapiens
WGCLCRAPP

SEQ ID NO: 1180797 - protein, 9 aa, Homo Sapiens
MGLCKAQIT

SEQ ID NO: 1180798 - protein, 9 aa, Homo Sapiens
ARAAGAGSA

SEQ ID NO: 1180799 - protein, 9 aa, Homo Sapiens
SSVCAPQTT

SEQ ID NO: 1180800 - protein, 9 aa, Homo Sapiens
VKVEEYYRN

SEQ ID NO: 1180801 - protein, 9 aa, Homo Sapiens
CCGQIPGIP

SEQ ID NO: 1180802 - protein, 9 aa, Homo Sapiens
PPAPCSWPS

SEQ ID NO: 1180803 - protein, 9 aa, Homo Sapiens
AQGPAEPDV

SEQ ID NO: 1180804 - protein, 9 aa, Homo Sapiens
KEKLVRFYP

SEQ ID NO: 1180805 - protein, 9 aa, Homo Sapiens
LRREVYTSN

SEQ ID NO: 1180806 - protein, 9 aa, Homo Sapiens
QRPPVLDES

SEQ ID NO: 1180807 - protein, 9 aa, Homo Sapiens
ALAFPGSFL

SEQ ID NO: 1180808 - protein, 9 aa, Homo Sapiens
QAGEYECSV

SEQ ID NO: 1180809 - protein, 9 aa, Homo Sapiens
LAPPALVAP

SEQ ID NO: 1180810 - protein, 9 aa, Homo Sapiens
PRGPGMPNS

SEQ ID NO: 1180811 - protein, 9 aa, Homo Sapiens
SLICHRRYY

SEQ ID NO: 1180812 - protein, 9 aa, Homo Sapiens
PGLAFSLAA

SEQ ID NO: 1180813 - protein, 9 aa, Homo Sapiens
ALVRAQADL

SEQ ID NO: 1180814 - protein, 9 aa, Homo Sapiens
PVPGGESEK

SEQ ID NO: 1180815 - protein, 9 aa, Homo Sapiens
TLWPPAQPH

SEQ ID NO: 1180816 - protein, 9 aa, Homo Sapiens
HWRGRYGRH

SEQ ID NO: 1180817 - protein, 9 aa, Homo Sapiens
LITFLTQRQ

SEQ ID NO: 1180818 - protein, 9 aa, Homo Sapiens
EVNSPPPSP

SEQ ID NO: 1180819 - protein, 9 aa, Homo Sapiens
VRPGNTARD

SEQ ID NO: 1180820 - protein, 9 aa, Homo Sapiens
SRHLDALAR

SEQ ID NO: 1180821 - protein, 9 aa, Homo Sapiens
PCCVPPEDA

SEQ ID NO: 1180822 - protein, 9 aa, Homo Sapiens
EEAGGASQS

SEQ ID NO: 1180823 - protein, 9 aa, Homo Sapiens
TTLSSGLAP

SEQ ID NO: 1180824 - protein, 9 aa, Homo Sapiens
ESGTRAVRA

SEQ ID NO: 1180825 - protein, 9 aa, Homo Sapiens
GITGFFTPC

SEQ ID NO: 1180826 - protein, 9 aa, Homo Sapiens
GCVGALLKL

SEQ ID NO: 1180827 - protein, 9 aa, Homo Sapiens
YYYKDQWRL

SEQ ID NO: 1180828 - protein, 9 aa, Homo Sapiens
GWSPCDRSW

SEQ ID NO: 1180829 - protein, 9 aa, Homo Sapiens
PCSWPSWGW

SEQ ID NO: 1180830 - protein, 9 aa, Homo Sapiens
PPPAPPRRT

SEQ ID NO: 1180831 - protein, 9 aa, Homo Sapiens
WPWCLFIGI

SEQ ID NO: 1180832 - protein, 9 aa, Homo Sapiens
FMHADAQNM

SEQ ID NO: 1180833 - protein, 9 aa, Homo Sapiens
ALRVLYVMC

SEQ ID NO: 1180834 - protein, 9 aa, Homo Sapiens
SLTKRSRAR

SEQ ID NO: 1180835 - protein, 9 aa, Homo Sapiens
SAPGCWPFH

SEQ ID NO: 1180836 - protein, 9 aa, Homo Sapiens
KPNMPFIVS

SEQ ID NO: 1180837 - protein, 9 aa, Homo Sapiens
TCSRWASSG

SEQ ID NO: 1180838 - protein, 9 aa, Homo Sapiens
LSLNYFLMC

SEQ ID NO: 1180839 - protein, 9 aa, Homo Sapiens
HLKTLKNWS

SEQ ID NO: 1180840 - protein, 9 aa, Homo Sapiens
KRGGSSTLS

SEQ ID NO: 1180841 - protein, 9 aa, Homo Sapiens
RKGSFFPLT

SEQ ID NO: 1180842 - protein, 9 aa, Homo Sapiens
PEPMPEEGS

SEQ ID NO: 1180843 - protein, 9 aa, Homo Sapiens
VWMSLLERV

SEQ ID NO: 1180844 - protein, 9 aa, Homo Sapiens
QGEKKNALT

SEQ ID NO: 1180845 - protein, 9 aa, Homo Sapiens
TPPTRGSSR

SEQ ID NO: 1180846 - protein, 9 aa, Homo Sapiens
PCHCPTDTQ

SEQ ID NO: 1180847 - protein, 9 aa, Homo Sapiens
ADAQENVLV

SEQ ID NO: 1180848 - protein, 9 aa, Homo Sapiens
WSFLQFMMV

SEQ ID NO: 1180849 - protein, 9 aa, Homo Sapiens
SEQQLGAGA

SEQ ID NO: 1180850 - protein, 9 aa, Homo Sapiens
RPPIVRVID

SEQ ID NO: 1180851 - protein, 9 aa, Homo Sapiens
VALSWRGAS

SEQ ID NO: 1180852 - protein, 9 aa, Homo Sapiens
GNSTLSWAT

SEQ ID NO: 1180853 - protein, 9 aa, Homo Sapiens
QLRKYLFQI

SEQ ID NO: 1180854 - protein, 9 aa, Homo Sapiens
ARPSCWSMR

SEQ ID NO: 1180855 - protein, 9 aa, Homo Sapiens
PVGRSRCRM

SEQ ID NO: 1180856 - protein, 9 aa, Homo Sapiens
GAPAAAQGP

SEQ ID NO: 1180857 - protein, 9 aa, Homo Sapiens
DGATAVHFA

SEQ ID NO: 1180858 - protein, 9 aa, Homo Sapiens
GCLYRLRVL

SEQ ID NO: 1180859 - protein, 9 aa, Homo Sapiens
FTPDMAFES

SEQ ID NO: 1180860 - protein, 9 aa, Homo Sapiens
AESRPLCLQ

SEQ ID NO: 1180861 - protein, 9 aa, Homo Sapiens
LNRLKENEK

SEQ ID NO: 1180862 - protein, 9 aa, Homo Sapiens
PSEPVASRE

SEQ ID NO: 1180863 - protein, 9 aa, Homo Sapiens
ILIEYQKMA

SEQ ID NO: 1180864 - protein, 9 aa, Homo Sapiens
LSLIATTRP

SEQ ID NO: 1180865 - protein, 9 aa, Homo Sapiens
RCCFSPLKK

SEQ ID NO: 1180866 - protein, 9 aa, Homo Sapiens
RAVGGGGPA

SEQ ID NO: 1180867 - protein, 9 aa, Homo Sapiens
QCYLYQEFL

SEQ ID NO: 1180868 - protein, 9 aa, Homo Sapiens
SLKISLRPR

SEQ ID NO: 1180869 - protein, 9 aa, Homo Sapiens
DVHVQLRQR

SEQ ID NO: 1180870 - protein, 9 aa, Homo Sapiens
MTSSGSDTD

SEQ ID NO: 1180871 - protein, 9 aa, Homo Sapiens
SASSTRAPA

SEQ ID NO: 1180872 - protein, 9 aa, Homo Sapiens
GGPSVFCPH

SEQ ID NO: 1180873 - protein, 9 aa, Homo Sapiens
QVDTWQTRL

SEQ ID NO: 1180874 - protein, 9 aa, Homo Sapiens
LVKGRLVLL

SEQ ID NO: 1180875 - protein, 9 aa, Homo Sapiens
VEEGNGRAP

SEQ ID NO: 1180876 - protein, 9 aa, Homo Sapiens
KQATELVLL

SEQ ID NO: 1180877 - protein, 9 aa, Homo Sapiens
LGVPCLREA

SEQ ID NO: 1180878 - protein, 9 aa, Homo Sapiens
VLSQLHHGG

SEQ ID NO: 1180879 - protein, 9 aa, Homo Sapiens
REIQSVKVE

SEQ ID NO: 1180880 - protein, 9 aa, Homo Sapiens
RPSRGMALC

SEQ ID NO: 1180881 - protein, 9 aa, Homo Sapiens
ECGSSIEHP

SEQ ID NO: 1180882 - protein, 9 aa, Homo Sapiens
SGSQPLLNS

SEQ ID NO: 1180883 - protein, 9 aa, Homo Sapiens
LFIVLLGIY

SEQ ID NO: 1180884 - protein, 9 aa, Homo Sapiens
SMGAGEVGN

SEQ ID NO: 1180885 - protein, 9 aa, Homo Sapiens
LKGNCTNKE

SEQ ID NO: 1180886 - protein, 9 aa, Homo Sapiens
EQRELPNGC

SEQ ID NO: 1180887 - protein, 9 aa, Homo Sapiens
EHHSCTPVP

SEQ ID NO: 1180888 - protein, 9 aa, Homo Sapiens
RVRQPPPGP

SEQ ID NO: 1180889 - protein, 9 aa, Homo Sapiens
DVEEGTWGG

SEQ ID NO: 1180890 - protein, 9 aa, Homo Sapiens
SASLQPKTA

SEQ ID NO: 1180891 - protein, 9 aa, Homo Sapiens
SMPPTACLA

SEQ ID NO: 1180892 - protein, 9 aa, Homo Sapiens
TSVSVSTFD

SEQ ID NO: 1180893 - protein, 9 aa, Homo Sapiens
RHTEKKLKE

SEQ ID NO: 1180894 - protein, 9 aa, Homo Sapiens
AACGASWRP

SEQ ID NO: 1180895 - protein, 9 aa, Homo Sapiens
CTLENEDVQ

SEQ ID NO: 1180896 - protein, 9 aa, Homo Sapiens
TSRGQPSPP

SEQ ID NO: 1180897 - protein, 9 aa, Homo Sapiens
EKLISPCAL

SEQ ID NO: 1180898 - protein, 9 aa, Homo Sapiens
AVEQWHNLR

SEQ ID NO: 1180899 - protein, 9 aa, Homo Sapiens
DMRVYILIT

SEQ ID NO: 1180900 - protein, 9 aa, Homo Sapiens
LLVTLFFFH

SEQ ID NO: 1180901 - protein, 9 aa, Homo Sapiens
PPPHTHPLC

SEQ ID NO: 1180902 - protein, 9 aa, Homo Sapiens
TQMLEPGTE

SEQ ID NO: 1180903 - protein, 9 aa, Homo Sapiens
SSKRSSPSG

SEQ ID NO: 1180904 - protein, 9 aa, Homo Sapiens
LLKIMGQAA

SEQ ID NO: 1180905 - protein, 9 aa, Homo Sapiens
IHQWRTQDH

SEQ ID NO: 1180906 - protein, 9 aa, Homo Sapiens
EPVAGERAL

SEQ ID NO: 1180907 - protein, 9 aa, Homo Sapiens
KGRIQQQLE

SEQ ID NO: 1180908 - protein, 9 aa, Homo Sapiens
HGASGAGHP

SEQ ID NO: 1180909 - protein, 9 aa, Homo Sapiens
ADGPPRPPA

SEQ ID NO: 1180910 - protein, 9 aa, Homo Sapiens
APVGNGCAG

SEQ ID NO: 1180911 - protein, 9 aa, Homo Sapiens
RGLQVPVKD

SEQ ID NO: 1180912 - protein, 9 aa, Homo Sapiens
RQQHRHPRP

SEQ ID NO: 1180913 - protein, 9 aa, Homo Sapiens
VGRMCFLLP

SEQ ID NO: 1180914 - protein, 9 aa, Homo Sapiens
AGGAPAAAQ

SEQ ID NO: 1180915 - protein, 9 aa, Homo Sapiens
LYWGVDRSS

SEQ ID NO: 1180916 - protein, 9 aa, Homo Sapiens
VMQSGGILT

SEQ ID NO: 1180917 - protein, 9 aa, Homo Sapiens
VYKKHFWNS

SEQ ID NO: 1180918 - protein, 9 aa, Homo Sapiens
CQSAREKGL

SEQ ID NO: 1180919 - protein, 9 aa, Homo Sapiens
EKELKVVDH

SEQ ID NO: 1180920 - protein, 9 aa, Homo Sapiens
HLAAHYSRA

SEQ ID NO: 1180921 - protein, 9 aa, Homo Sapiens
LCSCSPCRA

SEQ ID NO: 1180922 - protein, 9 aa, Homo Sapiens
VRDLPKGCP

SEQ ID NO: 1180923 - protein, 9 aa, Homo Sapiens
EASAVIAAG

SEQ ID NO: 1180924 - protein, 9 aa, Homo Sapiens
GHFLSTPRA

SEQ ID NO: 1180925 - protein, 9 aa, Homo Sapiens
WDAGLSGRK

SEQ ID NO: 1180926 - protein, 9 aa, Homo Sapiens
GGTRVIFDD

SEQ ID NO: 1180927 - protein, 9 aa, Homo Sapiens
PLWLGVAWV

SEQ ID NO: 1180928 - protein, 9 aa, Homo Sapiens
PGQPGRHRQ

SEQ ID NO: 1180929 - protein, 9 aa, Homo Sapiens
IIRLSIWPR

SEQ ID NO: 1180930 - protein, 9 aa, Homo Sapiens
YTCPTSNAR

SEQ ID NO: 1180931 - protein, 9 aa, Homo Sapiens
GPGHGSGGG

SEQ ID NO: 1180932 - protein, 9 aa, Homo Sapiens
ACPRLLPYP

SEQ ID NO: 1180933 - protein, 9 aa, Homo Sapiens
YAYRFDSQG

SEQ ID NO: 1180934 - protein, 9 aa, Homo Sapiens
PFPPHGPVV

SEQ ID NO: 1180935 - protein, 9 aa, Homo Sapiens
TLAQVLSGD

SEQ ID NO: 1180936 - protein, 9 aa, Homo Sapiens
GVSVYGLVG

SEQ ID NO: 1180937 - protein, 9 aa, Homo Sapiens
SPGPQAAAL

SEQ ID NO: 1180938 - protein, 9 aa, Homo Sapiens
ERLEDVPPV

SEQ ID NO: 1180939 - protein, 9 aa, Homo Sapiens
ESHLQHSPS

SEQ ID NO: 1180940 - protein, 9 aa, Homo Sapiens
GRKPKNFRL

SEQ ID NO: 1180941 - protein, 9 aa, Homo Sapiens
AQKAAHKGK

SEQ ID NO: 1180942 - protein, 9 aa, Homo Sapiens
LSGGLLQCS

SEQ ID NO: 1180943 - protein, 9 aa, Homo Sapiens
GVFVGLQNI

SEQ ID NO: 1180944 - protein, 9 aa, Homo Sapiens
ASELSHRSG

SEQ ID NO: 1180945 - protein, 9 aa, Homo Sapiens
GYFGAVRQE

SEQ ID NO: 1180946 - protein, 9 aa, Homo Sapiens
HDHFIHIEK

SEQ ID NO: 1180947 - protein, 9 aa, Homo Sapiens
GVKTPLVEE

SEQ ID NO: 1180948 - protein, 9 aa, Homo Sapiens
EGRRPQRYT

SEQ ID NO: 1180949 - protein, 9 aa, Homo Sapiens
HHQQQQQQK

SEQ ID NO: 1180950 - protein, 9 aa, Homo Sapiens
FLPVFSNLA

SEQ ID NO: 1180951 - protein, 9 aa, Homo Sapiens
YVRSGCRAP

SEQ ID NO: 1180952 - protein, 9 aa, Homo Sapiens
RQDCGDLRG

SEQ ID NO: 1180953 - protein, 9 aa, Homo Sapiens
RSDWLIRAV

SEQ ID NO: 1180954 - protein, 9 aa, Homo Sapiens
RAPRWKTCY

SEQ ID NO: 1180955 - protein, 9 aa, Homo Sapiens
SPASGSTSR

SEQ ID NO: 1180956 - protein, 9 aa, Homo Sapiens
VERANTCNS

SEQ ID NO: 1180957 - protein, 9 aa, Homo Sapiens
NDADPSLDP

SEQ ID NO: 1180958 - protein, 9 aa, Homo Sapiens
GRMRPSALS

SEQ ID NO: 1180959 - protein, 9 aa, Homo Sapiens
PATSVEESL

SEQ ID NO: 1180960 - protein, 9 aa, Homo Sapiens
PVYDAYVTE

SEQ ID NO: 1180961 - protein, 9 aa, Homo Sapiens
ESEHNLLVH

SEQ ID NO: 1180962 - protein, 9 aa, Homo Sapiens
PPCGGCPSG

SEQ ID NO: 1180963 - protein, 9 aa, Homo Sapiens
LRRRHLGRL

SEQ ID NO: 1180964 - protein, 9 aa, Homo Sapiens
NGYQCVCPQ

SEQ ID NO: 1180965 - protein, 9 aa, Homo Sapiens
AAMRSARTF

SEQ ID NO: 1180966 - protein, 9 aa, Homo Sapiens
RMKQSRSEP

SEQ ID NO: 1180967 - protein, 9 aa, Homo Sapiens
LCDWEIQLE

SEQ ID NO: 1180968 - protein, 9 aa, Homo Sapiens
FSSLHAWNL

SEQ ID NO: 1180969 - protein, 9 aa, Homo Sapiens
PQLCRPPTP

SEQ ID NO: 1180970 - protein, 9 aa, Homo Sapiens
PPTNALTLA

SEQ ID NO: 1180971 - protein, 9 aa, Homo Sapiens
GCSSHQGLM

SEQ ID NO: 1180972 - protein, 9 aa, Homo Sapiens
MLHSCRIQK

SEQ ID NO: 1180973 - protein, 9 aa, Homo Sapiens
DGDFHVPQI

SEQ ID NO: 1180974 - protein, 9 aa, Homo Sapiens
IHAGFDAVT

SEQ ID NO: 1180975 - protein, 9 aa, Homo Sapiens
VTPHRTSEN

SEQ ID NO: 1180976 - protein, 9 aa, Homo Sapiens
DTHVTLQQV

SEQ ID NO: 1180977 - protein, 9 aa, Homo Sapiens
VDLELDAPE

SEQ ID NO: 1180978 - protein, 9 aa, Homo Sapiens
GSCISYPEQ

SEQ ID NO: 1180979 - protein, 9 aa, Homo Sapiens
QRVSREAAG

SEQ ID NO: 1180980 - protein, 9 aa, Homo Sapiens
RPRRRAAPR

SEQ ID NO: 1180981 - protein, 9 aa, Homo Sapiens
RIQMVHSSS

SEQ ID NO: 1180982 - protein, 9 aa, Homo Sapiens
WPIYPAGLG

SEQ ID NO: 1180983 - protein, 9 aa, Homo Sapiens
IFNGLYSGH

SEQ ID NO: 1180984 - protein, 9 aa, Homo Sapiens
MIGSFSVRL

SEQ ID NO: 1180985 - protein, 9 aa, Homo Sapiens
HVHAAANGQ

SEQ ID NO: 1180986 - protein, 9 aa, Homo Sapiens
RYLSLCIRA

SEQ ID NO: 1180987 - protein, 9 aa, Homo Sapiens
IVGFVDHEA

SEQ ID NO: 1180988 - protein, 9 aa, Homo Sapiens
STTRKVNTG

SEQ ID NO: 1180989 - protein, 9 aa, Homo Sapiens
AMEKTPPCG

SEQ ID NO: 1180990 - protein, 9 aa, Homo Sapiens
ARWATQGPA

SEQ ID NO: 1180991 - protein, 9 aa, Homo Sapiens
LRLRSGGLP

SEQ ID NO: 1180992 - protein, 9 aa, Homo Sapiens
NTGEKRYKC

SEQ ID NO: 1180993 - protein, 9 aa, Homo Sapiens
SFSFGTGHR

SEQ ID NO: 1180994 - protein, 9 aa, Homo Sapiens
MMLQLKKDL

SEQ ID NO: 1180995 - protein, 9 aa, Homo Sapiens
MALPTLPPY

SEQ ID NO: 1180996 - protein, 9 aa, Homo Sapiens
PRYPVCLLV

SEQ ID NO: 1180997 - protein, 9 aa, Homo Sapiens
PDKLNDLWS

SEQ ID NO: 1180998 - protein, 9 aa, Homo Sapiens
NGGTCAMAS

SEQ ID NO: 1180999 - protein, 9 aa, Homo Sapiens
VIGFGAARE

SEQ ID NO: 1181000 - protein, 9 aa, Homo Sapiens
TKNGNFLET

SEQ ID NO: 1181001 - protein, 9 aa, Homo Sapiens
TTRKVNTGF

SEQ ID NO: 1181002 - protein, 9 aa, Homo Sapiens
TNEEKRQCR

SEQ ID NO: 1181003 - protein, 9 aa, Homo Sapiens
EIDDGLDQD

SEQ ID NO: 1181004 - protein, 9 aa, Homo Sapiens
DIEQICSRA

SEQ ID NO: 1181005 - protein, 9 aa, Homo Sapiens
FLTLPLTIN

SEQ ID NO: 1181006 - protein, 9 aa, Homo Sapiens
DKNVCRRFR

SEQ ID NO: 1181007 - protein, 9 aa, Homo Sapiens
KDSSKSLSM

SEQ ID NO: 1181008 - protein, 9 aa, Homo Sapiens
GYPDSWVPL

SEQ ID NO: 1181009 - protein, 9 aa, Homo Sapiens
KNRCRGKNE

SEQ ID NO: 1181010 - protein, 9 aa, Homo Sapiens
GERNLKVAK

SEQ ID NO: 1181011 - protein, 9 aa, Homo Sapiens
PAPQTPSMR

SEQ ID NO: 1181012 - protein, 9 aa, Homo Sapiens
SAGGCHDNT

SEQ ID NO: 1181013 - protein, 9 aa, Homo Sapiens
CSCGQGSCS

SEQ ID NO: 1181014 - protein, 9 aa, Homo Sapiens
LWCRPSWKG

SEQ ID NO: 1181015 - protein, 9 aa, Homo Sapiens
KRSHSSMSG

SEQ ID NO: 1181016 - protein, 9 aa, Homo Sapiens
RGEEASGPW

SEQ ID NO: 1181017 - protein, 9 aa, Homo Sapiens
SRHTVDMLR

SEQ ID NO: 1181018 - protein, 9 aa, Homo Sapiens
LVKKLQGAP

SEQ ID NO: 1181019 - protein, 9 aa, Homo Sapiens
VHVVLAQSS

SEQ ID NO: 1181020 - protein, 9 aa, Homo Sapiens
SDYEKREEL

SEQ ID NO: 1181021 - protein, 9 aa, Homo Sapiens
APYSHSKLR

SEQ ID NO: 1181022 - protein, 9 aa, Homo Sapiens
ADQNRKDAE

SEQ ID NO: 1181023 - protein, 9 aa, Homo Sapiens
SGSLLCARL

SEQ ID NO: 1181024 - protein, 9 aa, Homo Sapiens
QIPTSTRSL

SEQ ID NO: 1181025 - protein, 9 aa, Homo Sapiens
WGKGASQGE

SEQ ID NO: 1181026 - protein, 9 aa, Homo Sapiens
PPPREHPAS

SEQ ID NO: 1181027 - protein, 9 aa, Homo Sapiens
HLGLTAPIP

SEQ ID NO: 1181028 - protein, 9 aa, Homo Sapiens
GAQMGVPLA

SEQ ID NO: 1181029 - protein, 9 aa, Homo Sapiens
NSYLQGHPK

SEQ ID NO: 1181030 - protein, 9 aa, Homo Sapiens
TPLEENILA

SEQ ID NO: 1181031 - protein, 9 aa, Homo Sapiens
NRIAAVISV

SEQ ID NO: 1181032 - protein, 9 aa, Homo Sapiens
SQNLKSEGF

SEQ ID NO: 1181033 - protein, 9 aa, Homo Sapiens
SRRPTARSR

SEQ ID NO: 1181034 - protein, 9 aa, Homo Sapiens
ELKKLKTFH

SEQ ID NO: 1181035 - protein, 9 aa, Homo Sapiens
HRSPSCTWS

SEQ ID NO: 1181036 - protein, 9 aa, Homo Sapiens
RGAGEGPAP

SEQ ID NO: 1181037 - protein, 9 aa, Homo Sapiens
LQDSLDRCC

SEQ ID NO: 1181038 - protein, 9 aa, Homo Sapiens
VVVTATRTT

SEQ ID NO: 1181039 - protein, 9 aa, Homo Sapiens
SFGTGHRLV

SEQ ID NO: 1181040 - protein, 9 aa, Homo Sapiens
PQKVADVEQ

SEQ ID NO: 1181041 - protein, 9 aa, Homo Sapiens
ALIHVPPLL

SEQ ID NO: 1181042 - protein, 9 aa, Homo Sapiens
PLVANMYFA

SEQ ID NO: 1181043 - protein, 9 aa, Homo Sapiens
CLTISFPCS

SEQ ID NO: 1181044 - protein, 9 aa, Homo Sapiens
SPVPQPQSG

SEQ ID NO: 1181045 - protein, 9 aa, Homo Sapiens
TSGQCQVWV

SEQ ID NO: 1181046 - protein, 9 aa, Homo Sapiens
PWTTPASGG

SEQ ID NO: 1181047 - protein, 9 aa, Homo Sapiens
EPREFGWRD

SEQ ID NO: 1181048 - protein, 9 aa, Homo Sapiens
ALAERGRAT

SEQ ID NO: 1181049 - protein, 9 aa, Homo Sapiens
AVMYAPVKH

SEQ ID NO: 1181050 - protein, 9 aa, Homo Sapiens
PADRVRQVH

SEQ ID NO: 1181051 - protein, 9 aa, Homo Sapiens
PSPRPPPLV

SEQ ID NO: 1181052 - protein, 9 aa, Homo Sapiens
SPHFQPPLP

SEQ ID NO: 1181053 - protein, 9 aa, Homo Sapiens
LLPLQGARA

SEQ ID NO: 1181054 - protein, 9 aa, Homo Sapiens
WTRMSLGTK

SEQ ID NO: 1181055 - protein, 9 aa, Homo Sapiens
PELLGKMDY

SEQ ID NO: 1181056 - protein, 9 aa, Homo Sapiens
VRWGWFPPC

SEQ ID NO: 1181057 - protein, 9 aa, Homo Sapiens
LQNLHTAMR

SEQ ID NO: 1181058 - protein, 9 aa, Homo Sapiens
GLYFFSPNV

SEQ ID NO: 1181059 - protein, 9 aa, Homo Sapiens
KSEGFYSIQ

SEQ ID NO: 1181060 - protein, 9 aa, Homo Sapiens
QTPEEELFG

SEQ ID NO: 1181061 - protein, 9 aa, Homo Sapiens
DMSLFSFIR

SEQ ID NO: 1181062 - protein, 9 aa, Homo Sapiens
FLVVILKQL

SEQ ID NO: 1181063 - protein, 9 aa, Homo Sapiens
RWLIAFWQA

SEQ ID NO: 1181064 - protein, 9 aa, Homo Sapiens
TEWAGFLNE

SEQ ID NO: 1181065 - protein, 9 aa, Homo Sapiens
WPTQTWTRL

SEQ ID NO: 1181066 - protein, 9 aa, Homo Sapiens
EEDPDAAKK

SEQ ID NO: 1181067 - protein, 9 aa, Homo Sapiens
PACGRRARG

SEQ ID NO: 1181068 - protein, 9 aa, Homo Sapiens
RGSRETMGT

SEQ ID NO: 1181069 - protein, 9 aa, Homo Sapiens
GGRNFPDTF

SEQ ID NO: 1181070 - protein, 9 aa, Homo Sapiens
GLLAMLQDT

SEQ ID NO: 1181071 - protein, 9 aa, Homo Sapiens
SQTATKQKT

SEQ ID NO: 1181072 - protein, 9 aa, Homo Sapiens
LGIWPNRIH

SEQ ID NO: 1181073 - protein, 9 aa, Homo Sapiens
YVGTGGIYQ

SEQ ID NO: 1181074 - protein, 9 aa, Homo Sapiens
TRSTLMFGQ

SEQ ID NO: 1181075 - protein, 9 aa, Homo Sapiens
PPAAAGAAA

SEQ ID NO: 1181076 - protein, 9 aa, Homo Sapiens
RAALEGFLT

SEQ ID NO: 1181077 - protein, 9 aa, Homo Sapiens
VRRFQKPLI

SEQ ID NO: 1181078 - protein, 9 aa, Homo Sapiens
NCVYDSVQI

SEQ ID NO: 1181079 - protein, 9 aa, Homo Sapiens
YRCACGFSA

SEQ ID NO: 1181080 - protein, 9 aa, Homo Sapiens
TFLRAFLRT

SEQ ID NO: 1181081 - protein, 9 aa, Homo Sapiens
VAETHDLFK

SEQ ID NO: 1181082 - protein, 9 aa, Homo Sapiens
TMPPLLHPQ

SEQ ID NO: 1181083 - protein, 9 aa, Homo Sapiens
RTFVVFVQV

SEQ ID NO: 1181084 - protein, 9 aa, Homo Sapiens
PRMSSPRRA

SEQ ID NO: 1181085 - protein, 9 aa, Homo Sapiens
RRDPRPGHR

SEQ ID NO: 1181086 - protein, 9 aa, Homo Sapiens
KAWTPRKLV

SEQ ID NO: 1181087 - protein, 9 aa, Homo Sapiens
IRIDGDNTL

SEQ ID NO: 1181088 - protein, 9 aa, Homo Sapiens
APRPTHPLC

SEQ ID NO: 1181089 - protein, 9 aa, Homo Sapiens
RSSLGFEDS

SEQ ID NO: 1181090 - protein, 9 aa, Homo Sapiens
ALLGREEIQ

SEQ ID NO: 1181091 - protein, 9 aa, Homo Sapiens
QGEEAVPEA

SEQ ID NO: 1181092 - protein, 9 aa, Homo Sapiens
TWRMRSSTS

SEQ ID NO: 1181093 - protein, 9 aa, Homo Sapiens
PMPAWPGVP

SEQ ID NO: 1181094 - protein, 9 aa, Homo Sapiens
VFPVLMDPT

SEQ ID NO: 1181095 - protein, 9 aa, Homo Sapiens
FYSIQIFNG

SEQ ID NO: 1181096 - protein, 9 aa, Homo Sapiens
RRCCLRTSC

SEQ ID NO: 1181097 - protein, 9 aa, Homo Sapiens
FSVRLFVNR

SEQ ID NO: 1181098 - protein, 9 aa, Homo Sapiens
ASSAPTWGC

SEQ ID NO: 1181099 - protein, 9 aa, Homo Sapiens
MASNTARGF

SEQ ID NO: 1181100 - protein, 9 aa, Homo Sapiens
REHPASSSS

SEQ ID NO: 1181101 - protein, 9 aa, Homo Sapiens
RARFSPRPG

SEQ ID NO: 1181102 - protein, 9 aa, Homo Sapiens
PGRALHHAG

SEQ ID NO: 1181103 - protein, 9 aa, Homo Sapiens
MNGKLFDNL

SEQ ID NO: 1181104 - protein, 9 aa, Homo Sapiens
VLTRVEGLK

SEQ ID NO: 1181105 - protein, 9 aa, Homo Sapiens
PPWDQFVPP

SEQ ID NO: 1181106 - protein, 9 aa, Homo Sapiens
PSVGPQRAK

SEQ ID NO: 1181107 - protein, 9 aa, Homo Sapiens
PHPLVANMY

SEQ ID NO: 1181108 - protein, 9 aa, Homo Sapiens
FQRILKAKS

SEQ ID NO: 1181109 - protein, 9 aa, Homo Sapiens
GRQVHRTRA

SEQ ID NO: 1181110 - protein, 9 aa, Homo Sapiens
NSHEASEDG

SEQ ID NO: 1181111 - protein, 9 aa, Homo Sapiens
LMVTMPLLP

SEQ ID NO: 1181112 - protein, 9 aa, Homo Sapiens
IYDHWVKKG

SEQ ID NO: 1181113 - protein, 9 aa, Homo Sapiens
PSCHRCTAW

SEQ ID NO: 1181114 - protein, 9 aa, Homo Sapiens
SDMLRDSGI

SEQ ID NO: 1181115 - protein, 9 aa, Homo Sapiens
TLKNWSVTL

SEQ ID NO: 1181116 - protein, 9 aa, Homo Sapiens
MARPPKQWL

SEQ ID NO: 1181117 - protein, 9 aa, Homo Sapiens
SASPSSEPD

SEQ ID NO: 1181118 - protein, 9 aa, Homo Sapiens
KNWSVTLSC

SEQ ID NO: 1181119 - protein, 9 aa, Homo Sapiens
ERDGHWYKE

SEQ ID NO: 1181120 - protein, 9 aa, Homo Sapiens
RPTAALVRA

SEQ ID NO: 1181121 - protein, 9 aa, Homo Sapiens
FPSPQSHRP

SEQ ID NO: 1181122 - protein, 9 aa, Homo Sapiens
VSTHLHEWI

SEQ ID NO: 1181123 - protein, 9 aa, Homo Sapiens
SSSGKSVVS

SEQ ID NO: 1181124 - protein, 9 aa, Homo Sapiens
IALITVLDR

SEQ ID NO: 1181125 - protein, 9 aa, Homo Sapiens
SGKAPSSGV

SEQ ID NO: 1181126 - protein, 9 aa, Homo Sapiens
TVMTFLRAF

SEQ ID NO: 1181127 - protein, 9 aa, Homo Sapiens
CLLLPVPQS

SEQ ID NO: 1181128 - protein, 9 aa, Homo Sapiens
YVRRNSVER

SEQ ID NO: 1181129 - protein, 9 aa, Homo Sapiens
HKPEPGGPT

SEQ ID NO: 1181130 - protein, 9 aa, Homo Sapiens
HFQRPPTPF

SEQ ID NO: 1181131 - protein, 9 aa, Homo Sapiens
RRLNYQTQV

SEQ ID NO: 1181132 - protein, 9 aa, Homo Sapiens
KTCYIQSSS

SEQ ID NO: 1181133 - protein, 9 aa, Homo Sapiens
DPGAISDVP

SEQ ID NO: 1181134 - protein, 9 aa, Homo Sapiens
IPTTTLASP

SEQ ID NO: 1181135 - protein, 9 aa, Homo Sapiens
PPPPPTPMC

SEQ ID NO: 1181136 - protein, 9 aa, Homo Sapiens
RGCSCFLPV

SEQ ID NO: 1181137 - protein, 9 aa, Homo Sapiens
DGQGAAGAG

SEQ ID NO: 1181138 - protein, 9 aa, Homo Sapiens
QKKKRDDEE

SEQ ID NO: 1181139 - protein, 9 aa, Homo Sapiens
QGARAPPPG

SEQ ID NO: 1181140 - protein, 9 aa, Homo Sapiens
GGGAPDALW

SEQ ID NO: 1181141 - protein, 9 aa, Homo Sapiens
YLGLPHLEF

SEQ ID NO: 1181142 - protein, 9 aa, Homo Sapiens
SILDNAQSS

SEQ ID NO: 1181143 - protein, 9 aa, Homo Sapiens
VQARGRAQA

SEQ ID NO: 1181144 - protein, 9 aa, Homo Sapiens
TDYSKLLPY

SEQ ID NO: 1181145 - protein, 9 aa, Homo Sapiens
FFMEAKPWL

SEQ ID NO: 1181146 - protein, 9 aa, Homo Sapiens
NDTKENNMK

SEQ ID NO: 1181147 - protein, 9 aa, Homo Sapiens
TIPWFMEIC

SEQ ID NO: 1181148 - protein, 9 aa, Homo Sapiens
RKDYPSNSF

SEQ ID NO: 1181149 - protein, 9 aa, Homo Sapiens
ATRQLWQAP

SEQ ID NO: 1181150 - protein, 9 aa, Homo Sapiens
RISPSLAIW

SEQ ID NO: 1181151 - protein, 9 aa, Homo Sapiens
VADLVAHHE

SEQ ID NO: 1181152 - protein, 9 aa, Homo Sapiens
ASPDPGQPP

SEQ ID NO: 1181153 - protein, 9 aa, Homo Sapiens
EKKNALTQY

SEQ ID NO: 1181154 - protein, 9 aa, Homo Sapiens
DGEKRGLGT

SEQ ID NO: 1181155 - protein, 9 aa, Homo Sapiens
VSFTELSRI

SEQ ID NO: 1181156 - protein, 9 aa, Homo Sapiens
AQHRFGDDV

SEQ ID NO: 1181157 - protein, 9 aa, Homo Sapiens
SSSCAPSSS

SEQ ID NO: 1181158 - protein, 9 aa, Homo Sapiens
DNCTLENED

SEQ ID NO: 1181159 - protein, 9 aa, Homo Sapiens
PPQAAGAER

SEQ ID NO: 1181160 - protein, 9 aa, Homo Sapiens
GKSNMGAWG

SEQ ID NO: 1181161 - protein, 9 aa, Homo Sapiens
ASTSSSLLL

SEQ ID NO: 1181162 - protein, 9 aa, Homo Sapiens
RAAPPTDYS

SEQ ID NO: 1181163 - protein, 9 aa, Homo Sapiens
SLQHSFLVP

SEQ ID NO: 1181164 - protein, 9 aa, Homo Sapiens
RRYTVLSMG

SEQ ID NO: 1181165 - protein, 9 aa, Homo Sapiens
GGWGWRSPK

SEQ ID NO: 1181166 - protein, 9 aa, Homo Sapiens
NPLSVELGP

SEQ ID NO: 1181167 - protein, 9 aa, Homo Sapiens
IPSIGSSIQ

SEQ ID NO: 1181168 - protein, 9 aa, Homo Sapiens
ELDRMKENY

SEQ ID NO: 1181169 - protein, 9 aa, Homo Sapiens
QGSPHDIRI

SEQ ID NO: 1181170 - protein, 9 aa, Homo Sapiens
ILRGSWKFI

SEQ ID NO: 1181171 - protein, 9 aa, Homo Sapiens
TSPATTWRP

SEQ ID NO: 1181172 - protein, 9 aa, Homo Sapiens
KTWTQFRNY

SEQ ID NO: 1181173 - protein, 9 aa, Homo Sapiens
IPFSSLHAW

SEQ ID NO: 1181174 - protein, 9 aa, Homo Sapiens
ATTTVLVSL

SEQ ID NO: 1181175 - protein, 9 aa, Homo Sapiens
QEAEPPGGA

SEQ ID NO: 1181176 - protein, 9 aa, Homo Sapiens
LNLAWLLEF

SEQ ID NO: 1181177 - protein, 9 aa, Homo Sapiens
SQNPHRLRR

SEQ ID NO: 1181178 - protein, 9 aa, Homo Sapiens
ILGPVCEHA

SEQ ID NO: 1181179 - protein, 9 aa, Homo Sapiens
ENCGPTLEV

SEQ ID NO: 1181180 - protein, 9 aa, Homo Sapiens
ECDPDELRF

SEQ ID NO: 1181181 - protein, 9 aa, Homo Sapiens
ILHQRVRPR

SEQ ID NO: 1181182 - protein, 9 aa, Homo Sapiens
AAHKGKISP

SEQ ID NO: 1181183 - protein, 9 aa, Homo Sapiens
LSLSCSCSS

SEQ ID NO: 1181184 - protein, 9 aa, Homo Sapiens
RRPRPQLGR

SEQ ID NO: 1181185 - protein, 9 aa, Homo Sapiens
RSCRQTPPG

SEQ ID NO: 1181186 - protein, 9 aa, Homo Sapiens
AEKAKPSAA

SEQ ID NO: 1181187 - protein, 9 aa, Homo Sapiens
EGSLKKTSR

SEQ ID NO: 1181188 - protein, 9 aa, Homo Sapiens
GACEQQKIR

SEQ ID NO: 1181189 - protein, 9 aa, Homo Sapiens
AQNMGAVAS

SEQ ID NO: 1181190 - protein, 9 aa, Homo Sapiens
KISLIFLEG

SEQ ID NO: 1181191 - protein, 9 aa, Homo Sapiens
ARVRPVVAG

SEQ ID NO: 1181192 - protein, 9 aa, Homo Sapiens
PSLAIWTCI

SEQ ID NO: 1181193 - protein, 9 aa, Homo Sapiens
KPRVLHQNL

SEQ ID NO: 1181194 - protein, 9 aa, Homo Sapiens
LVLTSDSWL

SEQ ID NO: 1181195 - protein, 9 aa, Homo Sapiens
SPATSVEES

SEQ ID NO: 1181196 - protein, 9 aa, Homo Sapiens
QSKFTNLEE

SEQ ID NO: 1181197 - protein, 9 aa, Homo Sapiens
LAAARRMLS

SEQ ID NO: 1181198 - protein, 9 aa, Homo Sapiens
RERINRSLP

SEQ ID NO: 1181199 - protein, 9 aa, Homo Sapiens
LRFTIFGTL

SEQ ID NO: 1181200 - protein, 9 aa, Homo Sapiens
MCGSNLQGP

SEQ ID NO: 1181201 - protein, 9 aa, Homo Sapiens
KTWRVILPD

SEQ ID NO: 1181202 - protein, 9 aa, Homo Sapiens
WKVAFSEIT

SEQ ID NO: 1181203 - protein, 9 aa, Homo Sapiens
WRTCWSPAP

SEQ ID NO: 1181204 - protein, 9 aa, Homo Sapiens
PLIHCYMAL

SEQ ID NO: 1181205 - protein, 9 aa, Homo Sapiens
MLFLVMCIL

SEQ ID NO: 1181206 - protein, 9 aa, Homo Sapiens
CGKTFTYSS

SEQ ID NO: 1181207 - protein, 9 aa, Homo Sapiens
PSARSLSWY

SEQ ID NO: 1181208 - protein, 9 aa, Homo Sapiens
LWQRSPHRR

SEQ ID NO: 1181209 - protein, 9 aa, Homo Sapiens
PALKIWEEL

SEQ ID NO: 1181210 - protein, 9 aa, Homo Sapiens
PLGLHSSIQ

SEQ ID NO: 1181211 - protein, 9 aa, Homo Sapiens
RGARGREGG

SEQ ID NO: 1181212 - protein, 9 aa, Homo Sapiens
LAGTGKQDS

SEQ ID NO: 1181213 - protein, 9 aa, Homo Sapiens
PLSVPPGIR

SEQ ID NO: 1181214 - protein, 9 aa, Homo Sapiens
ISDVPEAIK

SEQ ID NO: 1181215 - protein, 9 aa, Homo Sapiens
DTPYFWPQL

SEQ ID NO: 1181216 - protein, 9 aa, Homo Sapiens
NFLYYEKLA

SEQ ID NO: 1181217 - protein, 9 aa, Homo Sapiens
CPQGFGGRH

SEQ ID NO: 1181218 - protein, 9 aa, Homo Sapiens
AGTERGQGH

SEQ ID NO: 1181219 - protein, 9 aa, Homo Sapiens
APGRRGSRA

SEQ ID NO: 1181220 - protein, 9 aa, Homo Sapiens
HRPFIWALS

SEQ ID NO: 1181221 - protein, 9 aa, Homo Sapiens
TRRWPLPQG

SEQ ID NO: 1181222 - protein, 9 aa, Homo Sapiens
DRVTGVSFR

SEQ ID NO: 1181223 - protein, 9 aa, Homo Sapiens
RNPGSKPSM

SEQ ID NO: 1181224 - protein, 9 aa, Homo Sapiens
AHVCGSSCF

SEQ ID NO: 1181225 - protein, 9 aa, Homo Sapiens
FAQPFAMPH

SEQ ID NO: 1181226 - protein, 9 aa, Homo Sapiens
PDITEGDSS

SEQ ID NO: 1181227 - protein, 9 aa, Homo Sapiens
GPYQPGRQP

SEQ ID NO: 1181228 - protein, 9 aa, Homo Sapiens
DRSNNCIQV

SEQ ID NO: 1181229 - protein, 9 aa, Homo Sapiens
DGEVCAASE

SEQ ID NO: 1181230 - protein, 9 aa, Homo Sapiens
LYCSLGVQG

SEQ ID NO: 1181231 - protein, 9 aa, Homo Sapiens
LGCPTMRTL

SEQ ID NO: 1181232 - protein, 9 aa, Homo Sapiens
ALSWRGASF

SEQ ID NO: 1181233 - protein, 9 aa, Homo Sapiens
LRKSSSASS

SEQ ID NO: 1181234 - protein, 9 aa, Homo Sapiens
EQAYIRGSK

SEQ ID NO: 1181235 - protein, 9 aa, Homo Sapiens
PTSGSPREA

SEQ ID NO: 1181236 - protein, 9 aa, Homo Sapiens
FDLSDYEKR

SEQ ID NO: 1181237 - protein, 9 aa, Homo Sapiens
CGLDGIPFT

SEQ ID NO: 1181238 - protein, 9 aa, Homo Sapiens
TDGGEEEME

SEQ ID NO: 1181239 - protein, 9 aa, Homo Sapiens
LLALQNGCV

SEQ ID NO: 1181240 - protein, 9 aa, Homo Sapiens
NPYADIIPS

SEQ ID NO: 1181241 - protein, 9 aa, Homo Sapiens
GQGVGVVGV

SEQ ID NO: 1181242 - protein, 9 aa, Homo Sapiens
MSPSVQVAL

SEQ ID NO: 1181243 - protein, 9 aa, Homo Sapiens
HSLELEHAR

SEQ ID NO: 1181244 - protein, 9 aa, Homo Sapiens
RPHPRGSPA

SEQ ID NO: 1181245 - protein, 9 aa, Homo Sapiens
PRAFHLACM

SEQ ID NO: 1181246 - protein, 9 aa, Homo Sapiens
SPDHRASLL

SEQ ID NO: 1181247 - protein, 9 aa, Homo Sapiens
HMDPDKLND

SEQ ID NO: 1181248 - protein, 9 aa, Homo Sapiens
TTSRRARFS

SEQ ID NO: 1181249 - protein, 9 aa, Homo Sapiens
GKPLENDTG

SEQ ID NO: 1181250 - protein, 9 aa, Homo Sapiens
QDGQMTSSG

SEQ ID NO: 1181251 - protein, 9 aa, Homo Sapiens
KYDPPLKWL

SEQ ID NO: 1181252 - protein, 9 aa, Homo Sapiens
HCIEFRPVD

SEQ ID NO: 1181253 - protein, 9 aa, Homo Sapiens
WSMRMRMIR

SEQ ID NO: 1181254 - protein, 9 aa, Homo Sapiens
PSEEPVPRR

SEQ ID NO: 1181255 - protein, 9 aa, Homo Sapiens
PPEPRQQHR

SEQ ID NO: 1181256 - protein, 9 aa, Homo Sapiens
PSCSSLSSQ

SEQ ID NO: 1181257 - protein, 9 aa, Homo Sapiens
SITADPYER

SEQ ID NO: 1181258 - protein, 9 aa, Homo Sapiens
SRPLQGQRN

SEQ ID NO: 1181259 - protein, 9 aa, Homo Sapiens
GQPEAAGGQ

SEQ ID NO: 1181260 - protein, 9 aa, Homo Sapiens
NLSTIKSIL

SEQ ID NO: 1181261 - protein, 9 aa, Homo Sapiens
WLNENYMGK

SEQ ID NO: 1181262 - protein, 9 aa, Homo Sapiens
PRGWCSAAW

SEQ ID NO: 1181263 - protein, 9 aa, Homo Sapiens
DDLILVSMS

SEQ ID NO: 1181264 - protein, 9 aa, Homo Sapiens
LDPVRRRER

SEQ ID NO: 1181265 - protein, 9 aa, Homo Sapiens
NIYGIESVK

SEQ ID NO: 1181266 - protein, 9 aa, Homo Sapiens
SAPSMPACA

SEQ ID NO: 1181267 - protein, 9 aa, Homo Sapiens
GPQEMVKNH

SEQ ID NO: 1181268 - protein, 9 aa, Homo Sapiens
QILHRGGAP

SEQ ID NO: 1181269 - protein, 9 aa, Homo Sapiens
SPDSALLIT

SEQ ID NO: 1181270 - protein, 9 aa, Homo Sapiens
CLFCNGSQP

SEQ ID NO: 1181271 - protein, 9 aa, Homo Sapiens
SLAGLLFRM

SEQ ID NO: 1181272 - protein, 9 aa, Homo Sapiens
GRRWGAWHP

SEQ ID NO: 1181273 - protein, 9 aa, Homo Sapiens
RKTCYRIME

SEQ ID NO: 1181274 - protein, 9 aa, Homo Sapiens
LKRNMKSSW

SEQ ID NO: 1181275 - protein, 9 aa, Homo Sapiens
SRPRGGPTA

SEQ ID NO: 1181276 - protein, 9 aa, Homo Sapiens
PGAPCLADG

SEQ ID NO: 1181277 - protein, 9 aa, Homo Sapiens
SSWAALSGD

SEQ ID NO: 1181278 - protein, 9 aa, Homo Sapiens
AAEACHERS

SEQ ID NO: 1181279 - protein, 9 aa, Homo Sapiens
PAPPTRDAN

SEQ ID NO: 1181280 - protein, 9 aa, Homo Sapiens
MAMAFSFPQ

SEQ ID NO: 1181281 - protein, 9 aa, Homo Sapiens
RWSRPLQGQ

SEQ ID NO: 1181282 - protein, 9 aa, Homo Sapiens
TALCPRIHK

SEQ ID NO: 1181283 - protein, 9 aa, Homo Sapiens
GRMRRFADV

SEQ ID NO: 1181284 - protein, 9 aa, Homo Sapiens
SRCCPSGKS

SEQ ID NO: 1181285 - protein, 9 aa, Homo Sapiens
EKTPTFSLK

SEQ ID NO: 1181286 - protein, 9 aa, Homo Sapiens
PSRCVVPCW

SEQ ID NO: 1181287 - protein, 9 aa, Homo Sapiens
NLCSMRKGS

SEQ ID NO: 1181288 - protein, 9 aa, Homo Sapiens
IKEGYFGAV

SEQ ID NO: 1181289 - protein, 9 aa, Homo Sapiens
RGPLPMGPS

SEQ ID NO: 1181290 - protein, 9 aa, Homo Sapiens
GTLAIRFIS

SEQ ID NO: 1181291 - protein, 9 aa, Homo Sapiens
NSIRIDGDN

SEQ ID NO: 1181292 - protein, 9 aa, Homo Sapiens
TDHIRSCGG

SEQ ID NO: 1181293 - protein, 9 aa, Homo Sapiens
SQPLDRQFR

SEQ ID NO: 1181294 - protein, 9 aa, Homo Sapiens
QEMQESAQP

SEQ ID NO: 1181295 - protein, 9 aa, Homo Sapiens
STQQISVDS

SEQ ID NO: 1181296 - protein, 9 aa, Homo Sapiens
ALYSVPKNP

SEQ ID NO: 1181297 - protein, 9 aa, Homo Sapiens
LKLQEDQIK

SEQ ID NO: 1181298 - protein, 9 aa, Homo Sapiens
NSCGDDDRF

SEQ ID NO: 1181299 - protein, 9 aa, Homo Sapiens
CSWPMTTQW

SEQ ID NO: 1181300 - protein, 9 aa, Homo Sapiens
AAVVEVDVS

SEQ ID NO: 1181301 - protein, 9 aa, Homo Sapiens
NPEELPGNR

SEQ ID NO: 1181302 - protein, 9 aa, Homo Sapiens
FWPQLEGPR

SEQ ID NO: 1181303 - protein, 9 aa, Homo Sapiens
NELRHQVRE

SEQ ID NO: 1181304 - protein, 9 aa, Homo Sapiens
FSAGDPFKT

SEQ ID NO: 1181305 - protein, 9 aa, Homo Sapiens
PIDVWVVGC

SEQ ID NO: 1181306 - protein, 9 aa, Homo Sapiens
AVPQYAQCT

SEQ ID NO: 1181307 - protein, 9 aa, Homo Sapiens
CATSAAATT

SEQ ID NO: 1181308 - protein, 9 aa, Homo Sapiens
PDSALLITA

SEQ ID NO: 1181309 - protein, 9 aa, Homo Sapiens
GGGGSGRRA

SEQ ID NO: 1181310 - protein, 9 aa, Homo Sapiens
IRFWHIWHN

SEQ ID NO: 1181311 - protein, 9 aa, Homo Sapiens
DICSSARPS

SEQ ID NO: 1181312 - protein, 9 aa, Homo Sapiens
HRMVNTGEK

SEQ ID NO: 1181313 - protein, 9 aa, Homo Sapiens
ELLMMLQLK

SEQ ID NO: 1181314 - protein, 9 aa, Homo Sapiens
NSQPLYRFL

SEQ ID NO: 1181315 - protein, 9 aa, Homo Sapiens
LQGHCLASP

SEQ ID NO: 1181316 - protein, 9 aa, Homo Sapiens
PYGPRAPGC

SEQ ID NO: 1181317 - protein, 9 aa, Homo Sapiens
CPVEKKIRS

SEQ ID NO: 1181318 - protein, 9 aa, Homo Sapiens
DHGLILQLQ

SEQ ID NO: 1181319 - protein, 9 aa, Homo Sapiens
KATWAFGTP

SEQ ID NO: 1181320 - protein, 9 aa, Homo Sapiens
QECREQQQK

SEQ ID NO: 1181321 - protein, 9 aa, Homo Sapiens
EQRKRRRRK

SEQ ID NO: 1181322 - protein, 9 aa, Homo Sapiens
HRPGTPPMP

SEQ ID NO: 1181323 - protein, 9 aa, Homo Sapiens
ARSGTGGQG

SEQ ID NO: 1181324 - protein, 9 aa, Homo Sapiens
HRMKQSRSE

SEQ ID NO: 1181325 - protein, 9 aa, Homo Sapiens
ILAPQRVGE

SEQ ID NO: 1181326 - protein, 9 aa, Homo Sapiens
VSRAVNQAI

SEQ ID NO: 1181327 - protein, 9 aa, Homo Sapiens
RWASQEWQV

SEQ ID NO: 1181328 - protein, 9 aa, Homo Sapiens
SVWLFSITA

SEQ ID NO: 1181329 - protein, 9 aa, Homo Sapiens
KKEAVLPRL

SEQ ID NO: 1181330 - protein, 9 aa, Homo Sapiens
SVHKFFNVL

SEQ ID NO: 1181331 - protein, 9 aa, Homo Sapiens
VKEKEMVGA

SEQ ID NO: 1181332 - protein, 9 aa, Homo Sapiens
VSAGKGSTT

SEQ ID NO: 1181333 - protein, 9 aa, Homo Sapiens
LESSLRPRP

SEQ ID NO: 1181334 - protein, 9 aa, Homo Sapiens
IQLARHIRG

SEQ ID NO: 1181335 - protein, 9 aa, Homo Sapiens
RARHQIPWK

SEQ ID NO: 1181336 - protein, 9 aa, Homo Sapiens
PHHYYHSGP

SEQ ID NO: 1181337 - protein, 9 aa, Homo Sapiens
LSQAVGPLQ

SEQ ID NO: 1181338 - protein, 9 aa, Homo Sapiens
GCHPTPVVR

SEQ ID NO: 1181339 - protein, 9 aa, Homo Sapiens
MRYFLVKRP

SEQ ID NO: 1181340 - protein, 9 aa, Homo Sapiens
ADKAPSRSE

SEQ ID NO: 1181341 - protein, 9 aa, Homo Sapiens
SLAIWTCIV

SEQ ID NO: 1181342 - protein, 9 aa, Homo Sapiens
CDPDELRFN

SEQ ID NO: 1181343 - protein, 9 aa, Homo Sapiens
IFTQNYHEE

SEQ ID NO: 1181344 - protein, 9 aa, Homo Sapiens
PRKPEEGDD

SEQ ID NO: 1181345 - protein, 9 aa, Homo Sapiens
GSLLCTPPG

SEQ ID NO: 1181346 - protein, 9 aa, Homo Sapiens
IHGRALEKC

SEQ ID NO: 1181347 - protein, 9 aa, Homo Sapiens
AAAVQAGRG

SEQ ID NO: 1181348 - protein, 9 aa, Homo Sapiens
QCVSVLLTV

SEQ ID NO: 1181349 - protein, 9 aa, Homo Sapiens
SLVAASPRR

SEQ ID NO: 1181350 - protein, 9 aa, Homo Sapiens
TFTFSAVVP

SEQ ID NO: 1181351 - protein, 9 aa, Homo Sapiens
MSFWKRRNW

SEQ ID NO: 1181352 - protein, 9 aa, Homo Sapiens
GYRFWTMPI

SEQ ID NO: 1181353 - protein, 9 aa, Homo Sapiens
ASPTSTPGP

SEQ ID NO: 1181354 - protein, 9 aa, Homo Sapiens
EFENAESEV

SEQ ID NO: 1181355 - protein, 9 aa, Homo Sapiens
ESLVLLRHL

SEQ ID NO: 1181356 - protein, 9 aa, Homo Sapiens
AKKGKPPEE

SEQ ID NO: 1181357 - protein, 9 aa, Homo Sapiens
LFIWPQHSY

SEQ ID NO: 1181358 - protein, 9 aa, Homo Sapiens
RRDGLKAIV

SEQ ID NO: 1181359 - protein, 9 aa, Homo Sapiens
TEMDIFELL

SEQ ID NO: 1181360 - protein, 9 aa, Homo Sapiens
NSATSALWC

SEQ ID NO: 1181361 - protein, 9 aa, Homo Sapiens
NNAGTNYTL

SEQ ID NO: 1181362 - protein, 9 aa, Homo Sapiens
CEDEDEDSG

SEQ ID NO: 1181363 - protein, 9 aa, Homo Sapiens
ACARGPRAP

SEQ ID NO: 1181364 - protein, 9 aa, Homo Sapiens
PRSCRRRPS

SEQ ID NO: 1181365 - protein, 9 aa, Homo Sapiens
ESPGAPRRA

SEQ ID NO: 1181366 - protein, 9 aa, Homo Sapiens
IGAVSELAP

SEQ ID NO: 1181367 - protein, 9 aa, Homo Sapiens
AALGWSPCD

SEQ ID NO: 1181368 - protein, 9 aa, Homo Sapiens
LPEGEKNQL

SEQ ID NO: 1181369 - protein, 9 aa, Homo Sapiens
ACIQLSGGL

SEQ ID NO: 1181370 - protein, 9 aa, Homo Sapiens
SGTQRGRVI

SEQ ID NO: 1181371 - protein, 9 aa, Homo Sapiens
AASPAPTSS

SEQ ID NO: 1181372 - protein, 9 aa, Homo Sapiens
NRQGPGCPT

SEQ ID NO: 1181373 - protein, 9 aa, Homo Sapiens
PHHCGHSVL

SEQ ID NO: 1181374 - protein, 9 aa, Homo Sapiens
QLRYNAPTH

SEQ ID NO: 1181375 - protein, 9 aa, Homo Sapiens
AMQIVGFVD

SEQ ID NO: 1181376 - protein, 9 aa, Homo Sapiens
PMSPPRPQG

SEQ ID NO: 1181377 - protein, 9 aa, Homo Sapiens
SVDHTFDLF

SEQ ID NO: 1181378 - protein, 9 aa, Homo Sapiens
FQHRASLVQ

SEQ ID NO: 1181379 - protein, 9 aa, Homo Sapiens
FITSVVRRS

SEQ ID NO: 1181380 - protein, 9 aa, Homo Sapiens
GVSSAACTP

SEQ ID NO: 1181381 - protein, 9 aa, Homo Sapiens
CDRPPPGRL

SEQ ID NO: 1181382 - protein, 9 aa, Homo Sapiens
TGTHRDPPH

SEQ ID NO: 1181383 - protein, 9 aa, Homo Sapiens
CYKALLLPV

SEQ ID NO: 1181384 - protein, 9 aa, Homo Sapiens
GSNGTRATN

SEQ ID NO: 1181385 - protein, 9 aa, Homo Sapiens
LMSVASAYS

SEQ ID NO: 1181386 - protein, 9 aa, Homo Sapiens
VGVSSAACT

SEQ ID NO: 1181387 - protein, 9 aa, Homo Sapiens
SPFRAEAET

SEQ ID NO: 1181388 - protein, 9 aa, Homo Sapiens
YFLRLCNFR

SEQ ID NO: 1181389 - protein, 9 aa, Homo Sapiens
VPAGPRLSI

SEQ ID NO: 1181390 - protein, 9 aa, Homo Sapiens
TYGTSRLCW

SEQ ID NO: 1181391 - protein, 9 aa, Homo Sapiens
DEPSSACLP

SEQ ID NO: 1181392 - protein, 9 aa, Homo Sapiens
GAAPGVWSQ

SEQ ID NO: 1181393 - protein, 9 aa, Homo Sapiens
LPCGPQEAT

SEQ ID NO: 1181394 - protein, 9 aa, Homo Sapiens
HAPRLWLLW

SEQ ID NO: 1181395 - protein, 9 aa, Homo Sapiens
RRKAEAESP

SEQ ID NO: 1181396 - protein, 9 aa, Homo Sapiens
LPRKPEEGD

SEQ ID NO: 1181397 - protein, 9 aa, Homo Sapiens
PSLEMLLVE

SEQ ID NO: 1181398 - protein, 9 aa, Homo Sapiens
SHSPPRGWC

SEQ ID NO: 1181399 - protein, 9 aa, Homo Sapiens
HRRRLPAGT

SEQ ID NO: 1181400 - protein, 9 aa, Homo Sapiens
IPLSKNNIA

SEQ ID NO: 1181401 - protein, 9 aa, Homo Sapiens
TRAVFNHTE

SEQ ID NO: 1181402 - protein, 9 aa, Homo Sapiens
LLAVGKQWH

SEQ ID NO: 1181403 - protein, 9 aa, Homo Sapiens
APPPQPGNQ

SEQ ID NO: 1181404 - protein, 9 aa, Homo Sapiens
TSIVIGDDT

SEQ ID NO: 1181405 - protein, 9 aa, Homo Sapiens
TSNSQCLPR

SEQ ID NO: 1181406 - protein, 9 aa, Homo Sapiens
RHRGLGGHL

SEQ ID NO: 1181407 - protein, 9 aa, Homo Sapiens
ALPSTQQIS

SEQ ID NO: 1181408 - protein, 9 aa, Homo Sapiens
GGGSGRRAE

SEQ ID NO: 1181409 - protein, 9 aa, Homo Sapiens
VGALLKLPF

SEQ ID NO: 1181410 - protein, 9 aa, Homo Sapiens
ALVGLEVRR

SEQ ID NO: 1181411 - protein, 9 aa, Homo Sapiens
LAERGRATV

SEQ ID NO: 1181412 - protein, 9 aa, Homo Sapiens
QSATRLYCS

SEQ ID NO: 1181413 - protein, 9 aa, Homo Sapiens
DTIPPKRVA

SEQ ID NO: 1181414 - protein, 9 aa, Homo Sapiens
VGETRALRA

SEQ ID NO: 1181415 - protein, 9 aa, Homo Sapiens
LESELLADI

SEQ ID NO: 1181416 - protein, 9 aa, Homo Sapiens
FWNSTKKRL

SEQ ID NO: 1181417 - protein, 9 aa, Homo Sapiens
GTQIEETPL

SEQ ID NO: 1181418 - protein, 9 aa, Homo Sapiens
GPSSCEKVR

SEQ ID NO: 1181419 - protein, 9 aa, Homo Sapiens
SLSDSTMLI

SEQ ID NO: 1181420 - protein, 9 aa, Homo Sapiens
SEFVPFLTR

SEQ ID NO: 1181421 - protein, 9 aa, Homo Sapiens
CSNSFSHNS

SEQ ID NO: 1181422 - protein, 9 aa, Homo Sapiens
RIRDCKAQQ

SEQ ID NO: 1181423 - protein, 9 aa, Homo Sapiens
AAQELLGHP

SEQ ID NO: 1181424 - protein, 9 aa, Homo Sapiens
PLLPASTSS

SEQ ID NO: 1181425 - protein, 9 aa, Homo Sapiens
RLAKVVSLR

SEQ ID NO: 1181426 - protein, 9 aa, Homo Sapiens
KPQRTSRHV

SEQ ID NO: 1181427 - protein, 9 aa, Homo Sapiens
MSPNKPYSF

SEQ ID NO: 1181428 - protein, 9 aa, Homo Sapiens
GRGGPAEWG

SEQ ID NO: 1181429 - protein, 9 aa, Homo Sapiens
AFPGSFLGR

SEQ ID NO: 1181430 - protein, 9 aa, Homo Sapiens
FEVPNPCRS

SEQ ID NO: 1181431 - protein, 9 aa, Homo Sapiens
GRGFQHRAS

SEQ ID NO: 1181432 - protein, 9 aa, Homo Sapiens
CGTRRSCSG

SEQ ID NO: 1181433 - protein, 9 aa, Homo Sapiens
MCKHKVFSD

SEQ ID NO: 1181434 - protein, 9 aa, Homo Sapiens
DGIPGPFGP

SEQ ID NO: 1181435 - protein, 9 aa, Homo Sapiens
PHSAGLSPG

SEQ ID NO: 1181436 - protein, 9 aa, Homo Sapiens
WPWGLAGVQ

SEQ ID NO: 1181437 - protein, 9 aa, Homo Sapiens
VVSTPAHTP

SEQ ID NO: 1181438 - protein, 9 aa, Homo Sapiens
VLPVFEEII

SEQ ID NO: 1181439 - protein, 9 aa, Homo Sapiens
YYLYKFQHS

SEQ ID NO: 1181440 - protein, 9 aa, Homo Sapiens
GGHPAPQRR

SEQ ID NO: 1181441 - protein, 9 aa, Homo Sapiens
VLNRSLFMG

SEQ ID NO: 1181442 - protein, 9 aa, Homo Sapiens
REPVEPGQP

SEQ ID NO: 1181443 - protein, 9 aa, Homo Sapiens
SLPPIRDPA

SEQ ID NO: 1181444 - protein, 9 aa, Homo Sapiens
SGAAWHVVP

SEQ ID NO: 1181445 - protein, 9 aa, Homo Sapiens
PVNYVPQQE

SEQ ID NO: 1181446 - protein, 9 aa, Homo Sapiens
PGRGRGARG

SEQ ID NO: 1181447 - protein, 9 aa, Homo Sapiens
GGGEDAPGA

SEQ ID NO: 1181448 - protein, 9 aa, Homo Sapiens
DLVAISLER

SEQ ID NO: 1181449 - protein, 9 aa, Homo Sapiens
MEKGPCQTC

SEQ ID NO: 1181450 - protein, 9 aa, Homo Sapiens
NARLAKVVS

SEQ ID NO: 1181451 - protein, 9 aa, Homo Sapiens
QAPACSSTS

SEQ ID NO: 1181452 - protein, 9 aa, Homo Sapiens
ENMESVPWT

SEQ ID NO: 1181453 - protein, 9 aa, Homo Sapiens
TSLHSGAFL

SEQ ID NO: 1181454 - protein, 9 aa, Homo Sapiens
RDVAGAPMG

SEQ ID NO: 1181455 - protein, 9 aa, Homo Sapiens
YKEGYNIYG

SEQ ID NO: 1181456 - protein, 9 aa, Homo Sapiens
TAAAEADAQ

SEQ ID NO: 1181457 - protein, 9 aa, Homo Sapiens
PSPCNRSSS

SEQ ID NO: 1181458 - protein, 9 aa, Homo Sapiens
RPGRLLGAP

SEQ ID NO: 1181459 - protein, 9 aa, Homo Sapiens
PPEYMGQRH

SEQ ID NO: 1181460 - protein, 9 aa, Homo Sapiens
VGSLIGHEG

SEQ ID NO: 1181461 - protein, 9 aa, Homo Sapiens
RPPIHQWRT

SEQ ID NO: 1181462 - protein, 9 aa, Homo Sapiens
VLVSYSLVE

SEQ ID NO: 1181463 - protein, 9 aa, Homo Sapiens
HRARTVTCK

SEQ ID NO: 1181464 - protein, 9 aa, Homo Sapiens
WGATWSSST

SEQ ID NO: 1181465 - protein, 9 aa, Homo Sapiens
RGRAQADQS

SEQ ID NO: 1181466 - protein, 9 aa, Homo Sapiens
DSMEAGQQH

SEQ ID NO: 1181467 - protein, 9 aa, Homo Sapiens
GQGLSYSKS

SEQ ID NO: 1181468 - protein, 9 aa, Homo Sapiens
VGRAGDKGF

SEQ ID NO: 1181469 - protein, 9 aa, Homo Sapiens
STSNSQCLP

SEQ ID NO: 1181470 - protein, 9 aa, Homo Sapiens
KEQLSPKKI

SEQ ID NO: 1181471 - protein, 9 aa, Homo Sapiens
TQEEDMPRP

SEQ ID NO: 1181472 - protein, 9 aa, Homo Sapiens
QAAGAEREH

SEQ ID NO: 1181473 - protein, 9 aa, Homo Sapiens
HSIHDGVAA

SEQ ID NO: 1181474 - protein, 9 aa, Homo Sapiens
SLSLPAIIR

SEQ ID NO: 1181475 - protein, 9 aa, Homo Sapiens
AGGASQSQN

SEQ ID NO: 1181476 - protein, 9 aa, Homo Sapiens
VMFFLMFIN

SEQ ID NO: 1181477 - protein, 9 aa, Homo Sapiens
RTTVHVTRR

SEQ ID NO: 1181478 - protein, 9 aa, Homo Sapiens
PSMRTVTVP

SEQ ID NO: 1181479 - protein, 9 aa, Homo Sapiens
VTLWYRPSD

SEQ ID NO: 1181480 - protein, 9 aa, Homo Sapiens
PPGRLIRGG

SEQ ID NO: 1181481 - protein, 9 aa, Homo Sapiens
KINSKSIFC

SEQ ID NO: 1181482 - protein, 9 aa, Homo Sapiens
HKKWISPRM

SEQ ID NO: 1181483 - protein, 9 aa, Homo Sapiens
GPNCSLSCY

SEQ ID NO: 1181484 - protein, 9 aa, Homo Sapiens
VPTAWRPGG

SEQ ID NO: 1181485 - protein, 9 aa, Homo Sapiens
TSTHLSYQC

SEQ ID NO: 1181486 - protein, 9 aa, Homo Sapiens
WNSSTQWGS

SEQ ID NO: 1181487 - protein, 9 aa, Homo Sapiens
IEQICSRAS

SEQ ID NO: 1181488 - protein, 9 aa, Homo Sapiens
MANARRSPR

SEQ ID NO: 1181489 - protein, 9 aa, Homo Sapiens
RILNHVGKN

SEQ ID NO: 1181490 - protein, 9 aa, Homo Sapiens
TRGSSRWCQ

SEQ ID NO: 1181491 - protein, 9 aa, Homo Sapiens
QLSYSFFTN

SEQ ID NO: 1181492 - protein, 9 aa, Homo Sapiens
ASACATSAA

SEQ ID NO: 1181493 - protein, 9 aa, Homo Sapiens
VLGERHTMD

SEQ ID NO: 1181494 - protein, 9 aa, Homo Sapiens
FNQFSVTSA

SEQ ID NO: 1181495 - protein, 9 aa, Homo Sapiens
FSTMKYEQG

SEQ ID NO: 1181496 - protein, 9 aa, Homo Sapiens
CRLFNLRAD

SEQ ID NO: 1181497 - protein, 9 aa, Homo Sapiens
CDYVSTHLH

SEQ ID NO: 1181498 - protein, 9 aa, Homo Sapiens
QILLLGVPC

SEQ ID NO: 1181499 - protein, 9 aa, Homo Sapiens
SYPPARQPS

SEQ ID NO: 1181500 - protein, 9 aa, Homo Sapiens
CWSSAPAST

SEQ ID NO: 1181501 - protein, 9 aa, Homo Sapiens
FLGRTREEP

SEQ ID NO: 1181502 - protein, 9 aa, Homo Sapiens
RPRMSLMPC

SEQ ID NO: 1181503 - protein, 9 aa, Homo Sapiens
EELCKIQKV

SEQ ID NO: 1181504 - protein, 9 aa, Homo Sapiens
TPQWGATWS

SEQ ID NO: 1181505 - protein, 9 aa, Homo Sapiens
YVPVAPPPQ

SEQ ID NO: 1181506 - protein, 9 aa, Homo Sapiens
VCETTHPSP

SEQ ID NO: 1181507 - protein, 9 aa, Homo Sapiens
VAFTLWTSD

SEQ ID NO: 1181508 - protein, 9 aa, Homo Sapiens
TSAARGIRA

SEQ ID NO: 1181509 - protein, 9 aa, Homo Sapiens
GRAGGAPAA

SEQ ID NO: 1181510 - protein, 9 aa, Homo Sapiens
CARGPRAPV

SEQ ID NO: 1181511 - protein, 9 aa, Homo Sapiens
GTWDKALDI

SEQ ID NO: 1181512 - protein, 9 aa, Homo Sapiens
PGTTRMRHR

SEQ ID NO: 1181513 - protein, 9 aa, Homo Sapiens
KRDKQSRHL

SEQ ID NO: 1181514 - protein, 9 aa, Homo Sapiens
NVNKWTETS

SEQ ID NO: 1181515 - protein, 9 aa, Homo Sapiens
CSGPRPRCR

SEQ ID NO: 1181516 - protein, 9 aa, Homo Sapiens
GYSKLGVHD

SEQ ID NO: 1181517 - protein, 9 aa, Homo Sapiens
LRVGSGYRF

SEQ ID NO: 1181518 - protein, 9 aa, Homo Sapiens
ELGMVVRTT

SEQ ID NO: 1181519 - protein, 9 aa, Homo Sapiens
NRGSDTDIW

SEQ ID NO: 1181520 - protein, 9 aa, Homo Sapiens
MKEPLEVQN

SEQ ID NO: 1181521 - protein, 9 aa, Homo Sapiens
RPTHPLCTV

SEQ ID NO: 1181522 - protein, 9 aa, Homo Sapiens
AMKVRGVPA

SEQ ID NO: 1181523 - protein, 9 aa, Homo Sapiens
LRQDVTLEL

SEQ ID NO: 1181524 - protein, 9 aa, Homo Sapiens
WALVGARAP

SEQ ID NO: 1181525 - protein, 9 aa, Homo Sapiens
LPVFSNLAG

SEQ ID NO: 1181526 - protein, 9 aa, Homo Sapiens
DWPALTRRW

SEQ ID NO: 1181527 - protein, 9 aa, Homo Sapiens
SQNANAPCV

SEQ ID NO: 1181528 - protein, 9 aa, Homo Sapiens
RRKCYISQN

SEQ ID NO: 1181529 - protein, 9 aa, Homo Sapiens
VNKWTETSA

SEQ ID NO: 1181530 - protein, 9 aa, Homo Sapiens
ASCTAPRTC

SEQ ID NO: 1181531 - protein, 9 aa, Homo Sapiens
PSKYTCPTS

SEQ ID NO: 1181532 - protein, 9 aa, Homo Sapiens
SRLTGHSTH

SEQ ID NO: 1181533 - protein, 9 aa, Homo Sapiens
RTRCWACCG

SEQ ID NO: 1181534 - protein, 9 aa, Homo Sapiens
KAPDMLGMS

SEQ ID NO: 1181535 - protein, 9 aa, Homo Sapiens
KKGPPVKPN

SEQ ID NO: 1181536 - protein, 9 aa, Homo Sapiens
DLFQPYIEV

SEQ ID NO: 1181537 - protein, 9 aa, Homo Sapiens
HCLQDSYIT

SEQ ID NO: 1181538 - protein, 9 aa, Homo Sapiens
EPQRPPRSI

SEQ ID NO: 1181539 - protein, 9 aa, Homo Sapiens
PALHLVKPR

SEQ ID NO: 1181540 - protein, 9 aa, Homo Sapiens
TVTCKSTAE

SEQ ID NO: 1181541 - protein, 9 aa, Homo Sapiens
PFGGTPQWG

SEQ ID NO: 1181542 - protein, 9 aa, Homo Sapiens
TGDCGKIKI

SEQ ID NO: 1181543 - protein, 9 aa, Homo Sapiens
FTSEATYDP

SEQ ID NO: 1181544 - protein, 9 aa, Homo Sapiens
SGSTSRRTR

SEQ ID NO: 1181545 - protein, 9 aa, Homo Sapiens
STSFMVSWP

SEQ ID NO: 1181546 - protein, 9 aa, Homo Sapiens
LEQQLKDSS

SEQ ID NO: 1181547 - protein, 9 aa, Homo Sapiens
TAAPSGQYF

SEQ ID NO: 1181548 - protein, 9 aa, Homo Sapiens
RPGNTARDT

SEQ ID NO: 1181549 - protein, 9 aa, Homo Sapiens
AEPPGGAVR

SEQ ID NO: 1181550 - protein, 9 aa, Homo Sapiens
GVLQNARFV

SEQ ID NO: 1181551 - protein, 9 aa, Homo Sapiens
VATSPPATA

SEQ ID NO: 1181552 - protein, 9 aa, Homo Sapiens
LVSFQPFCS

SEQ ID NO: 1181553 - protein, 9 aa, Homo Sapiens
IFTKIWRWH

SEQ ID NO: 1181554 - protein, 9 aa, Homo Sapiens
GGPTEPGPR

SEQ ID NO: 1181555 - protein, 9 aa, Homo Sapiens
WRGDPEDGA

SEQ ID NO: 1181556 - protein, 9 aa, Homo Sapiens
KRMEEERKR

SEQ ID NO: 1181557 - protein, 9 aa, Homo Sapiens
APTQAKSPS

SEQ ID NO: 1181558 - protein, 9 aa, Homo Sapiens
PGSWPVAQR

SEQ ID NO: 1181559 - protein, 9 aa, Homo Sapiens
AGAEREHHS

SEQ ID NO: 1181560 - protein, 9 aa, Homo Sapiens
RGAGCRPRC

SEQ ID NO: 1181561 - protein, 9 aa, Homo Sapiens
AQADLQLEA

SEQ ID NO: 1181562 - protein, 9 aa, Homo Sapiens
TFSKAKLVA

SEQ ID NO: 1181563 - protein, 9 aa, Homo Sapiens
KPSMKGLTE

SEQ ID NO: 1181564 - protein, 9 aa, Homo Sapiens
GVRMRALYD

SEQ ID NO: 1181565 - protein, 9 aa, Homo Sapiens
SDTDIWKTI

SEQ ID NO: 1181566 - protein, 9 aa, Homo Sapiens
LCVPSARRS

SEQ ID NO: 1181567 - protein, 9 aa, Homo Sapiens
SASPDPGQP

SEQ ID NO: 1181568 - protein, 9 aa, Homo Sapiens
VPLFLVFLT

SEQ ID NO: 1181569 - protein, 9 aa, Homo Sapiens
GGPACALPD

SEQ ID NO: 1181570 - protein, 9 aa, Homo Sapiens
HRRTRSRTG

SEQ ID NO: 1181571 - protein, 9 aa, Homo Sapiens
SAPQTPQKV

SEQ ID NO: 1181572 - protein, 9 aa, Homo Sapiens
PHMRRRTTS

SEQ ID NO: 1181573 - protein, 9 aa, Homo Sapiens
TVPYAGVYL

SEQ ID NO: 1181574 - protein, 9 aa, Homo Sapiens
HEWAHLRWA

SEQ ID NO: 1181575 - protein, 9 aa, Homo Sapiens
RNSPVGVKH

SEQ ID NO: 1181576 - protein, 9 aa, Homo Sapiens
PGSKPSMKG

SEQ ID NO: 1181577 - protein, 9 aa, Homo Sapiens
GNRGAGASC

SEQ ID NO: 1181578 - protein, 9 aa, Homo Sapiens
GRACPHGAA

SEQ ID NO: 1181579 - protein, 9 aa, Homo Sapiens
FAKIFNQFS

SEQ ID NO: 1181580 - protein, 9 aa, Homo Sapiens
TSEPECTEI

SEQ ID NO: 1181581 - protein, 9 aa, Homo Sapiens
FPCRVIRLH

SEQ ID NO: 1181582 - protein, 9 aa, Homo Sapiens
LSEAKNQLL

SEQ ID NO: 1181583 - protein, 9 aa, Homo Sapiens
SSRKESALQ

SEQ ID NO: 1181584 - protein, 9 aa, Homo Sapiens
ALRSAKSEE

SEQ ID NO: 1181585 - protein, 9 aa, Homo Sapiens
RGPPILAPP

SEQ ID NO: 1181586 - protein, 9 aa, Homo Sapiens
TGLADTGVR

SEQ ID NO: 1181587 - protein, 9 aa, Homo Sapiens
NISHSRSHS

SEQ ID NO: 1181588 - protein, 9 aa, Homo Sapiens
MVVRTTSSP

SEQ ID NO: 1181589 - protein, 9 aa, Homo Sapiens
SSARRPVSL

SEQ ID NO: 1181590 - protein, 9 aa, Homo Sapiens
LHALRLLHD

SEQ ID NO: 1181591 - protein, 9 aa, Homo Sapiens
LPTTEHCPL

SEQ ID NO: 1181592 - protein, 9 aa, Homo Sapiens
SPTWRRTTS

SEQ ID NO: 1181593 - protein, 9 aa, Homo Sapiens
AFAQPFAMP

SEQ ID NO: 1181594 - protein, 9 aa, Homo Sapiens
EETPLEENI

SEQ ID NO: 1181595 - protein, 9 aa, Homo Sapiens
QQCKKCLKA

SEQ ID NO: 1181596 - protein, 9 aa, Homo Sapiens
PRPPIHQWR

SEQ ID NO: 1181597 - protein, 9 aa, Homo Sapiens
RRAPLNSWR

SEQ ID NO: 1181598 - protein, 9 aa, Homo Sapiens
EGTWGGTPR

SEQ ID NO: 1181599 - protein, 9 aa, Homo Sapiens
SRKESALQV

SEQ ID NO: 1181600 - protein, 9 aa, Homo Sapiens
PQEATCRNG

SEQ ID NO: 1181601 - protein, 9 aa, Homo Sapiens
HVWFREPPA

SEQ ID NO: 1181602 - protein, 9 aa, Homo Sapiens
ALKIWEELL

SEQ ID NO: 1181603 - protein, 9 aa, Homo Sapiens
SPPRGWCSA

SEQ ID NO: 1181604 - protein, 9 aa, Homo Sapiens
DRTTFGELV

SEQ ID NO: 1181605 - protein, 9 aa, Homo Sapiens
NHCIFTQRK

SEQ ID NO: 1181606 - protein, 9 aa, Homo Sapiens
PLDRQFRPP

SEQ ID NO: 1181607 - protein, 9 aa, Homo Sapiens
REEPCGLAW

SEQ ID NO: 1181608 - protein, 9 aa, Homo Sapiens
TRQLWQAPR

SEQ ID NO: 1181609 - protein, 9 aa, Homo Sapiens
HRKRWITES

SEQ ID NO: 1181610 - protein, 9 aa, Homo Sapiens
LGVSTQESQ

SEQ ID NO: 1181611 - protein, 9 aa, Homo Sapiens
GPDHDKFST

SEQ ID NO: 1181612 - protein, 9 aa, Homo Sapiens
VKMMERMVE

SEQ ID NO: 1181613 - protein, 9 aa, Homo Sapiens
EAAVVEVDV

SEQ ID NO: 1181614 - protein, 9 aa, Homo Sapiens
EKQLWGKHV

SEQ ID NO: 1181615 - protein, 9 aa, Homo Sapiens
KPRASLNPR

SEQ ID NO: 1181616 - protein, 9 aa, Homo Sapiens
MDEHNRSIH

SEQ ID NO: 1181617 - protein, 9 aa, Homo Sapiens
AQETSRTSR

SEQ ID NO: 1181618 - protein, 9 aa, Homo Sapiens
SRTGAAGTR

SEQ ID NO: 1181619 - protein, 9 aa, Homo Sapiens
AMARPMESR

SEQ ID NO: 1181620 - protein, 9 aa, Homo Sapiens
CGEVRFHSV

SEQ ID NO: 1181621 - protein, 9 aa, Homo Sapiens
KPGAPCLAD

SEQ ID NO: 1181622 - protein, 9 aa, Homo Sapiens
AKQGRQGKG

SEQ ID NO: 1181623 - protein, 9 aa, Homo Sapiens
FILSYRWLS

SEQ ID NO: 1181624 - protein, 9 aa, Homo Sapiens
LRREGMCQY

SEQ ID NO: 1181625 - protein, 9 aa, Homo Sapiens
ECFFLWESL

SEQ ID NO: 1181626 - protein, 9 aa, Homo Sapiens
RERRERRRA

SEQ ID NO: 1181627 - protein, 9 aa, Homo Sapiens
GLSVSVGCV

SEQ ID NO: 1181628 - protein, 9 aa, Homo Sapiens
GTRTLAQVL

SEQ ID NO: 1181629 - protein, 9 aa, Homo Sapiens
PLASGQASK

SEQ ID NO: 1181630 - protein, 9 aa, Homo Sapiens
MTPSYSYMT

SEQ ID NO: 1181631 - protein, 9 aa, Homo Sapiens
PVVERPGAM

SEQ ID NO: 1181632 - protein, 9 aa, Homo Sapiens
DTVSAADLR

SEQ ID NO: 1181633 - protein, 9 aa, Homo Sapiens
IFLSVYQAL

SEQ ID NO: 1181634 - protein, 9 aa, Homo Sapiens
HRGGNPRPA

SEQ ID NO: 1181635 - protein, 9 aa, Homo Sapiens
EALEGTVEG

SEQ ID NO: 1181636 - protein, 9 aa, Homo Sapiens
ASRDKIKSD

SEQ ID NO: 1181637 - protein, 9 aa, Homo Sapiens
SEAGGPVRL

SEQ ID NO: 1181638 - protein, 9 aa, Homo Sapiens
PPAARSHGN

SEQ ID NO: 1181639 - protein, 9 aa, Homo Sapiens
IQIFNGLYS

SEQ ID NO: 1181640 - protein, 9 aa, Homo Sapiens
MAPVGSVMS

SEQ ID NO: 1181641 - protein, 9 aa, Homo Sapiens
LFYKDMLQE

SEQ ID NO: 1181642 - protein, 9 aa, Homo Sapiens
AARWLVLSP

SEQ ID NO: 1181643 - protein, 9 aa, Homo Sapiens
ACRRRMALA

SEQ ID NO: 1181644 - protein, 9 aa, Homo Sapiens
ELYWASGKF

SEQ ID NO: 1181645 - protein, 9 aa, Homo Sapiens
CMPIAVLTT

SEQ ID NO: 1181646 - protein, 9 aa, Homo Sapiens
SPRLPLWRS

SEQ ID NO: 1181647 - protein, 9 aa, Homo Sapiens
FLPHYFKGM

SEQ ID NO: 1181648 - protein, 9 aa, Homo Sapiens
NELGRLAAE

SEQ ID NO: 1181649 - protein, 9 aa, Homo Sapiens
DLPKGCPPG

SEQ ID NO: 1181650 - protein, 9 aa, Homo Sapiens
YMYIRHQGE

SEQ ID NO: 1181651 - protein, 9 aa, Homo Sapiens
SGTKMKATH

SEQ ID NO: 1181652 - protein, 9 aa, Homo Sapiens
VVRPGNTAR

SEQ ID NO: 1181653 - protein, 9 aa, Homo Sapiens
VELPFSILR

SEQ ID NO: 1181654 - protein, 9 aa, Homo Sapiens
NRPSKTPPT

SEQ ID NO: 1181655 - protein, 9 aa, Homo Sapiens
SEAKTSGLM

SEQ ID NO: 1181656 - protein, 9 aa, Homo Sapiens
VSRDGGWGW

SEQ ID NO: 1181657 - protein, 9 aa, Homo Sapiens
VRGGVRKPL

SEQ ID NO: 1181658 - protein, 9 aa, Homo Sapiens
QFMMVMLDP

SEQ ID NO: 1181659 - protein, 9 aa, Homo Sapiens
SAKTPCPYG

SEQ ID NO: 1181660 - protein, 9 aa, Homo Sapiens
PLRNLGGKP

SEQ ID NO: 1181661 - protein, 9 aa, Homo Sapiens
SVGGLSDHI

SEQ ID NO: 1181662 - protein, 9 aa, Homo Sapiens
SENCVYDSV

SEQ ID NO: 1181663 - protein, 9 aa, Homo Sapiens
AGEMVHQAR

SEQ ID NO: 1181664 - protein, 9 aa, Homo Sapiens
MRTVTVPRN

SEQ ID NO: 1181665 - protein, 9 aa, Homo Sapiens
PNFPPHGTE

SEQ ID NO: 1181666 - protein, 9 aa, Homo Sapiens
PYSIPSIGS

SEQ ID NO: 1181667 - protein, 9 aa, Homo Sapiens
PFSATTRAA

SEQ ID NO: 1181668 - protein, 9 aa, Homo Sapiens
ARFVFGTTP

SEQ ID NO: 1181669 - protein, 9 aa, Homo Sapiens
TWGCLCRAP

SEQ ID NO: 1181670 - protein, 9 aa, Homo Sapiens
NALVGLLGC

SEQ ID NO: 1181671 - protein, 9 aa, Homo Sapiens
LQALQERLG

SEQ ID NO: 1181672 - protein, 9 aa, Homo Sapiens
LFSITADPY

SEQ ID NO: 1181673 - protein, 9 aa, Homo Sapiens
NPGDDAHGP

SEQ ID NO: 1181674 - protein, 9 aa, Homo Sapiens
TAPRTCAGR

SEQ ID NO: 1181675 - protein, 9 aa, Homo Sapiens
PEYMGQRHR

SEQ ID NO: 1181676 - protein, 9 aa, Homo Sapiens
PVLLSIPWT

SEQ ID NO: 1181677 - protein, 9 aa, Homo Sapiens
FNRDPLPPL

SEQ ID NO: 1181678 - protein, 9 aa, Homo Sapiens
LRASLEMLT

SEQ ID NO: 1181679 - protein, 9 aa, Homo Sapiens
KELRVSTNA

SEQ ID NO: 1181680 - protein, 9 aa, Homo Sapiens
GYCTPRESA

SEQ ID NO: 1181681 - protein, 9 aa, Homo Sapiens
LCQNRPHLP

SEQ ID NO: 1181682 - protein, 9 aa, Homo Sapiens
NAQSSELRT

SEQ ID NO: 1181683 - protein, 9 aa, Homo Sapiens
PQPGNQRSN

SEQ ID NO: 1181684 - protein, 9 aa, Homo Sapiens
PSLRPSSWQ

SEQ ID NO: 1181685 - protein, 9 aa, Homo Sapiens
KIADFGFVR

SEQ ID NO: 1181686 - protein, 9 aa, Homo Sapiens
QSRLHLPRL

SEQ ID NO: 1181687 - protein, 9 aa, Homo Sapiens
CGRTAGRLE

SEQ ID NO: 1181688 - protein, 9 aa, Homo Sapiens
DAPQPQPAC

SEQ ID NO: 1181689 - protein, 9 aa, Homo Sapiens
GVAWVLGWL

SEQ ID NO: 1181690 - protein, 9 aa, Homo Sapiens
QRCGRTAGR

SEQ ID NO: 1181691 - protein, 9 aa, Homo Sapiens
ETCNPELNV

SEQ ID NO: 1181692 - protein, 9 aa, Homo Sapiens
AMYNSWKNN

SEQ ID NO: 1181693 - protein, 9 aa, Homo Sapiens
ASKPAPPPP

SEQ ID NO: 1181694 - protein, 9 aa, Homo Sapiens
SLRAAAARG

SEQ ID NO: 1181695 - protein, 9 aa, Homo Sapiens
SPCDRSWLP

SEQ ID NO: 1181696 - protein, 9 aa, Homo Sapiens
QSEGKPDKS

SEQ ID NO: 1181697 - protein, 9 aa, Homo Sapiens
MFSQSVVEV

SEQ ID NO: 1181698 - protein, 9 aa, Homo Sapiens
GVSTQESQF

SEQ ID NO: 1181699 - protein, 9 aa, Homo Sapiens
RPPRSILSL

SEQ ID NO: 1181700 - protein, 9 aa, Homo Sapiens
IINICPKYL

SEQ ID NO: 1181701 - protein, 9 aa, Homo Sapiens
LSSGLAPRG

SEQ ID NO: 1181702 - protein, 9 aa, Homo Sapiens
GPRFLRLLD

SEQ ID NO: 1181703 - protein, 9 aa, Homo Sapiens
GAASPPARS

SEQ ID NO: 1181704 - protein, 9 aa, Homo Sapiens
RREGMCQYG

SEQ ID NO: 1181705 - protein, 9 aa, Homo Sapiens
ETLSPVPSP

SEQ ID NO: 1181706 - protein, 9 aa, Homo Sapiens
SKPLHKKKS

SEQ ID NO: 1181707 - protein, 9 aa, Homo Sapiens
NLAGPPWPQ

SEQ ID NO: 1181708 - protein, 9 aa, Homo Sapiens
NARRSPRSC

SEQ ID NO: 1181709 - protein, 9 aa, Homo Sapiens
PAWLSPISA

SEQ ID NO: 1181710 - protein, 9 aa, Homo Sapiens
KQSRHLGAD

SEQ ID NO: 1181711 - protein, 9 aa, Homo Sapiens
CTMRSGQVR

SEQ ID NO: 1181712 - protein, 9 aa, Homo Sapiens
EDSDTYGTS

SEQ ID NO: 1181713 - protein, 9 aa, Homo Sapiens
PHFQPPLPS

SEQ ID NO: 1181714 - protein, 9 aa, Homo Sapiens
YSIQQRATS

SEQ ID NO: 1181715 - protein, 9 aa, Homo Sapiens
PIPAPVPVP

SEQ ID NO: 1181716 - protein, 9 aa, Homo Sapiens
TAPRPGSPA

SEQ ID NO: 1181717 - protein, 9 aa, Homo Sapiens
NVYNSGQRW

SEQ ID NO: 1181718 - protein, 9 aa, Homo Sapiens
EVNPCLREP

SEQ ID NO: 1181719 - protein, 9 aa, Homo Sapiens
HAAGQLVKG

SEQ ID NO: 1181720 - protein, 9 aa, Homo Sapiens
FPPCGRRPS

SEQ ID NO: 1181721 - protein, 9 aa, Homo Sapiens
ASWVSGKTD

SEQ ID NO: 1181722 - protein, 9 aa, Homo Sapiens
GRECLGSFG

SEQ ID NO: 1181723 - protein, 9 aa, Homo Sapiens
AAARRMLSP

SEQ ID NO: 1181724 - protein, 9 aa, Homo Sapiens
AQMGVPLAA

SEQ ID NO: 1181725 - protein, 9 aa, Homo Sapiens
ISTFGPSAS

SEQ ID NO: 1181726 - protein, 9 aa, Homo Sapiens
VRPRPGPLA

SEQ ID NO: 1181727 - protein, 9 aa, Homo Sapiens
LLMMLQLKK

SEQ ID NO: 1181728 - protein, 9 aa, Homo Sapiens
LTLAQWSPV

SEQ ID NO: 1181729 - protein, 9 aa, Homo Sapiens
MAYTEEKAY

SEQ ID NO: 1181730 - protein, 9 aa, Homo Sapiens
HGFVVEVSH

SEQ ID NO: 1181731 - protein, 9 aa, Homo Sapiens
EKIPLSKNN

SEQ ID NO: 1181732 - protein, 9 aa, Homo Sapiens
TATDGGILQ

SEQ ID NO: 1181733 - protein, 9 aa, Homo Sapiens
HCSGCRPGN

SEQ ID NO: 1181734 - protein, 9 aa, Homo Sapiens
MQIVGFVDH

SEQ ID NO: 1181735 - protein, 9 aa, Homo Sapiens
PANGSGADH

SEQ ID NO: 1181736 - protein, 9 aa, Homo Sapiens
PGRPLGPPT

SEQ ID NO: 1181737 - protein, 9 aa, Homo Sapiens
TTVLTRVEG

SEQ ID NO: 1181738 - protein, 9 aa, Homo Sapiens
TPWAGPTTC

SEQ ID NO: 1181739 - protein, 9 aa, Homo Sapiens
RERGGGCLP

SEQ ID NO: 1181740 - protein, 9 aa, Homo Sapiens
SGVYTEPYY

SEQ ID NO: 1181741 - protein, 9 aa, Homo Sapiens
ALTRVGALV

SEQ ID NO: 1181742 - protein, 9 aa, Homo Sapiens
NPFLASCRW

SEQ ID NO: 1181743 - protein, 9 aa, Homo Sapiens
VLSLQEEIV

SEQ ID NO: 1181744 - protein, 9 aa, Homo Sapiens
KPYQCDCCG

SEQ ID NO: 1181745 - protein, 9 aa, Homo Sapiens
ETYASPPGL

SEQ ID NO: 1181746 - protein, 9 aa, Homo Sapiens
CFAKGEVPK

SEQ ID NO: 1181747 - protein, 9 aa, Homo Sapiens
LSRWPWRGR

SEQ ID NO: 1181748 - protein, 9 aa, Homo Sapiens
SPSSEPDPD

SEQ ID NO: 1181749 - protein, 9 aa, Homo Sapiens
EPVFFEEKN

SEQ ID NO: 1181750 - protein, 9 aa, Homo Sapiens
HRASLVQHL

SEQ ID NO: 1181751 - protein, 9 aa, Homo Sapiens
SRTGRRPTG

SEQ ID NO: 1181752 - protein, 9 aa, Homo Sapiens
PQDDHSNLA

SEQ ID NO: 1181753 - protein, 9 aa, Homo Sapiens
RFTDAPAKM

SEQ ID NO: 1181754 - protein, 9 aa, Homo Sapiens
LALGHTWAY

SEQ ID NO: 1181755 - protein, 9 aa, Homo Sapiens
SPTRKNRTR

SEQ ID NO: 1181756 - protein, 9 aa, Homo Sapiens
LKLVNDILK

SEQ ID NO: 1181757 - protein, 9 aa, Homo Sapiens
RAFLRTVAF

SEQ ID NO: 1181758 - protein, 9 aa, Homo Sapiens
SPNCGLWQR

SEQ ID NO: 1181759 - protein, 9 aa, Homo Sapiens
PSGFPGGGG

SEQ ID NO: 1181760 - protein, 9 aa, Homo Sapiens
FGGNFAQQR

SEQ ID NO: 1181761 - protein, 9 aa, Homo Sapiens
GKVKINSKS

SEQ ID NO: 1181762 - protein, 9 aa, Homo Sapiens
GDPEDGAQF

SEQ ID NO: 1181763 - protein, 9 aa, Homo Sapiens
ARGPGRILR

SEQ ID NO: 1181764 - protein, 9 aa, Homo Sapiens
PSLNLTPRL

SEQ ID NO: 1181765 - protein, 9 aa, Homo Sapiens
PKNTSVVTG

SEQ ID NO: 1181766 - protein, 9 aa, Homo Sapiens
PAETRGAAA

SEQ ID NO: 1181767 - protein, 9 aa, Homo Sapiens
GSCGFTQDR

SEQ ID NO: 1181768 - protein, 9 aa, Homo Sapiens
RLESSLRPR

SEQ ID NO: 1181769 - protein, 9 aa, Homo Sapiens
SENTALSCC

SEQ ID NO: 1181770 - protein, 9 aa, Homo Sapiens
RRRAPPRSG

SEQ ID NO: 1181771 - protein, 9 aa, Homo Sapiens
EDGRAPRQL

SEQ ID NO: 1181772 - protein, 9 aa, Homo Sapiens
WQRSPHRRT

SEQ ID NO: 1181773 - protein, 9 aa, Homo Sapiens
SFQSECVGP

SEQ ID NO: 1181774 - protein, 9 aa, Homo Sapiens
ERAAAALRA

SEQ ID NO: 1181775 - protein, 9 aa, Homo Sapiens
GVEYYSCVG

SEQ ID NO: 1181776 - protein, 9 aa, Homo Sapiens
TMAWAQHGS

SEQ ID NO: 1181777 - protein, 9 aa, Homo Sapiens
WQAPRAMRP

SEQ ID NO: 1181778 - protein, 9 aa, Homo Sapiens
ECYLQQAAC

SEQ ID NO: 1181779 - protein, 9 aa, Homo Sapiens
QSVKVEEYY

SEQ ID NO: 1181780 - protein, 9 aa, Homo Sapiens
SPASACTMP

SEQ ID NO: 1181781 - protein, 9 aa, Homo Sapiens
AAAATAATT

SEQ ID NO: 1181782 - protein, 9 aa, Homo Sapiens
HLGDGLGHV

SEQ ID NO: 1181783 - protein, 9 aa, Homo Sapiens
MRRRTTSTR

SEQ ID NO: 1181784 - protein, 9 aa, Homo Sapiens
CGGRPSGFP

SEQ ID NO: 1181785 - protein, 9 aa, Homo Sapiens
GQASRGSKG

SEQ ID NO: 1181786 - protein, 9 aa, Homo Sapiens
TPLFPRYTL

SEQ ID NO: 1181787 - protein, 9 aa, Homo Sapiens
RSKGRIQQQ

SEQ ID NO: 1181788 - protein, 9 aa, Homo Sapiens
RDPQDSRVR

SEQ ID NO: 1181789 - protein, 9 aa, Homo Sapiens
GRKKRRRHQ

SEQ ID NO: 1181790 - protein, 9 aa, Homo Sapiens
QLLLAHAAG

SEQ ID NO: 1181791 - protein, 9 aa, Homo Sapiens
DRCCSTPSM

SEQ ID NO: 1181792 - protein, 9 aa, Homo Sapiens
GKWECTVSM

SEQ ID NO: 1181793 - protein, 9 aa, Homo Sapiens
GARPEGTPR

SEQ ID NO: 1181794 - protein, 9 aa, Homo Sapiens
CSAAWPPRH

SEQ ID NO: 1181795 - protein, 9 aa, Homo Sapiens
CPRPRCRPA

SEQ ID NO: 1181796 - protein, 9 aa, Homo Sapiens
GPGNQLRNH

SEQ ID NO: 1181797 - protein, 9 aa, Homo Sapiens
FVLPHIYPL

SEQ ID NO: 1181798 - protein, 9 aa, Homo Sapiens
AMPQMQLQA

SEQ ID NO: 1181799 - protein, 9 aa, Homo Sapiens
VMLDPEWQI

SEQ ID NO: 1181800 - protein, 9 aa, Homo Sapiens
ADLNGRTRE

SEQ ID NO: 1181801 - protein, 9 aa, Homo Sapiens
RNMKSSWMF

SEQ ID NO: 1181802 - protein, 9 aa, Homo Sapiens
DVSEDQTAL

SEQ ID NO: 1181803 - protein, 9 aa, Homo Sapiens
PTMASSSPR

SEQ ID NO: 1181804 - protein, 9 aa, Homo Sapiens
DKKPYTCEC

SEQ ID NO: 1181805 - protein, 9 aa, Homo Sapiens
DALYGYKLT

SEQ ID NO: 1181806 - protein, 9 aa, Homo Sapiens
GQPPRRPPP

SEQ ID NO: 1181807 - protein, 9 aa, Homo Sapiens
PTQQLLPPT

SEQ ID NO: 1181808 - protein, 9 aa, Homo Sapiens
EFLRSLCKP

SEQ ID NO: 1181809 - protein, 9 aa, Homo Sapiens
KLNDLWSRI

SEQ ID NO: 1181810 - protein, 9 aa, Homo Sapiens
NTKRKNHGL

SEQ ID NO: 1181811 - protein, 9 aa, Homo Sapiens
GTELGPLLL

SEQ ID NO: 1181812 - protein, 9 aa, Homo Sapiens
NAVIQERRC

SEQ ID NO: 1181813 - protein, 9 aa, Homo Sapiens
TLASPTWRR

SEQ ID NO: 1181814 - protein, 9 aa, Homo Sapiens
AQISMNHVM

SEQ ID NO: 1181815 - protein, 9 aa, Homo Sapiens
PMPKNYLRL

SEQ ID NO: 1181816 - protein, 9 aa, Homo Sapiens
HLEFYRYYQ

SEQ ID NO: 1181817 - protein, 9 aa, Homo Sapiens
RTSANVNHV

SEQ ID NO: 1181818 - protein, 9 aa, Homo Sapiens
TTRTCGRPS

SEQ ID NO: 1181819 - protein, 9 aa, Homo Sapiens
STSVGLCSC

SEQ ID NO: 1181820 - protein, 9 aa, Homo Sapiens
SGCEEEEGC

SEQ ID NO: 1181821 - protein, 9 aa, Homo Sapiens
LPGTTRMRH

SEQ ID NO: 1181822 - protein, 9 aa, Homo Sapiens
ALKPAGPCS

SEQ ID NO: 1181823 - protein, 9 aa, Homo Sapiens
ICLKTQSGQ

SEQ ID NO: 1181824 - protein, 9 aa, Homo Sapiens
SKNGHHVLG

SEQ ID NO: 1181825 - protein, 9 aa, Homo Sapiens
IIVILGLFC

SEQ ID NO: 1181826 - protein, 9 aa, Homo Sapiens
AESEVDFSI

SEQ ID NO: 1181827 - protein, 9 aa, Homo Sapiens
SSQTSVSCG

SEQ ID NO: 1181828 - protein, 9 aa, Homo Sapiens
IMGQAANPQ

SEQ ID NO: 1181829 - protein, 9 aa, Homo Sapiens
IILAICSDT

SEQ ID NO: 1181830 - protein, 9 aa, Homo Sapiens
KVVTSVKEM

SEQ ID NO: 1181831 - protein, 9 aa, Homo Sapiens
QNARFVFGT

SEQ ID NO: 1181832 - protein, 9 aa, Homo Sapiens
PQLSYSFFT

SEQ ID NO: 1181833 - protein, 9 aa, Homo Sapiens
CKSFKGSSG

SEQ ID NO: 1181834 - protein, 9 aa, Homo Sapiens
GAWHPGSWP

SEQ ID NO: 1181835 - protein, 9 aa, Homo Sapiens
VDEEMFSVF

SEQ ID NO: 1181836 - protein, 9 aa, Homo Sapiens
PPKRVALLT

SEQ ID NO: 1181837 - protein, 9 aa, Homo Sapiens
LNMIQQFIQ

SEQ ID NO: 1181838 - protein, 9 aa, Homo Sapiens
MTTLPTVLR

SEQ ID NO: 1181839 - protein, 9 aa, Homo Sapiens
RVGRMRPSA

SEQ ID NO: 1181840 - protein, 9 aa, Homo Sapiens
YYPNDGLTR

SEQ ID NO: 1181841 - protein, 9 aa, Homo Sapiens
DQMGFLAGT

SEQ ID NO: 1181842 - protein, 9 aa, Homo Sapiens
IVASEMEKT

SEQ ID NO: 1181843 - protein, 9 aa, Homo Sapiens
GDASCARWR

SEQ ID NO: 1181844 - protein, 9 aa, Homo Sapiens
ALWGLLPVL

SEQ ID NO: 1181845 - protein, 9 aa, Homo Sapiens
WQPLRQAKD

SEQ ID NO: 1181846 - protein, 9 aa, Homo Sapiens
CLACISVGR

SEQ ID NO: 1181847 - protein, 9 aa, Homo Sapiens
PSSVTWSGC

SEQ ID NO: 1181848 - protein, 9 aa, Homo Sapiens
QPLLWKVHY

SEQ ID NO: 1181849 - protein, 9 aa, Homo Sapiens
SNNYGNNFW

SEQ ID NO: 1181850 - protein, 9 aa, Homo Sapiens
LRMSPPAKP

SEQ ID NO: 1181851 - protein, 9 aa, Homo Sapiens
SRGMALCPS

SEQ ID NO: 1181852 - protein, 9 aa, Homo Sapiens
GRGRASQTR

SEQ ID NO: 1181853 - protein, 9 aa, Homo Sapiens
ATVRVGRMC

SEQ ID NO: 1181854 - protein, 9 aa, Homo Sapiens
STTVVNGRM

SEQ ID NO: 1181855 - protein, 9 aa, Homo Sapiens
LDITTKESL

SEQ ID NO: 1181856 - protein, 9 aa, Homo Sapiens
VYHILRTHS

SEQ ID NO: 1181857 - protein, 9 aa, Homo Sapiens
SPSKIHGRA

SEQ ID NO: 1181858 - protein, 9 aa, Homo Sapiens
RKVYTCSHC

SEQ ID NO: 1181859 - protein, 9 aa, Homo Sapiens
KRWITESGF

SEQ ID NO: 1181860 - protein, 9 aa, Homo Sapiens
CFSPLKKVW

SEQ ID NO: 1181861 - protein, 9 aa, Homo Sapiens
VPCTQACGR

SEQ ID NO: 1181862 - protein, 9 aa, Homo Sapiens
ATRWSAWPC

SEQ ID NO: 1181863 - protein, 9 aa, Homo Sapiens
AAGRPNSSH

SEQ ID NO: 1181864 - protein, 9 aa, Homo Sapiens
NRMIPGSQH

SEQ ID NO: 1181865 - protein, 9 aa, Homo Sapiens
EDIFWTCLK

SEQ ID NO: 1181866 - protein, 9 aa, Homo Sapiens
QTPGQGSPC

SEQ ID NO: 1181867 - protein, 9 aa, Homo Sapiens
ALEEECEFY

SEQ ID NO: 1181868 - protein, 9 aa, Homo Sapiens
TLVLIRVTS

SEQ ID NO: 1181869 - protein, 9 aa, Homo Sapiens
YQNGIKWQN

SEQ ID NO: 1181870 - protein, 9 aa, Homo Sapiens
TRTTLRKSS

SEQ ID NO: 1181871 - protein, 9 aa, Homo Sapiens
SKIQKNIKE

SEQ ID NO: 1181872 - protein, 9 aa, Homo Sapiens
NEKTETTFA

SEQ ID NO: 1181873 - protein, 9 aa, Homo Sapiens
RLSIWPRQA

SEQ ID NO: 1181874 - protein, 9 aa, Homo Sapiens
RVTCVPRWC

SEQ ID NO: 1181875 - protein, 9 aa, Homo Sapiens
WGLLCVGGG

SEQ ID NO: 1181876 - protein, 9 aa, Homo Sapiens
HFLRIGSPN

SEQ ID NO: 1181877 - protein, 9 aa, Homo Sapiens
CISVKDHRT

SEQ ID NO: 1181878 - protein, 9 aa, Homo Sapiens
VRGVPAIAL

SEQ ID NO: 1181879 - protein, 9 aa, Homo Sapiens
LRTGAGGGG

SEQ ID NO: 1181880 - protein, 9 aa, Homo Sapiens
QDVTLELQG

SEQ ID NO: 1181881 - protein, 9 aa, Homo Sapiens
CLSQYFEKF

SEQ ID NO: 1181882 - protein, 9 aa, Homo Sapiens
ISPEKAPSS

SEQ ID NO: 1181883 - protein, 9 aa, Homo Sapiens
EKKTQSLMI

SEQ ID NO: 1181884 - protein, 9 aa, Homo Sapiens
TMATTFDDC

SEQ ID NO: 1181885 - protein, 9 aa, Homo Sapiens
HLRMSVGTS

SEQ ID NO: 1181886 - protein, 9 aa, Homo Sapiens
DLKFWHKKW

SEQ ID NO: 1181887 - protein, 9 aa, Homo Sapiens
RAPRQLGQG

SEQ ID NO: 1181888 - protein, 9 aa, Homo Sapiens
GLAGQRPDV

SEQ ID NO: 1181889 - protein, 9 aa, Homo Sapiens
IRVATTLTL

SEQ ID NO: 1181890 - protein, 9 aa, Homo Sapiens
GGEIRVQNG

SEQ ID NO: 1181891 - protein, 9 aa, Homo Sapiens
AAAAREEPS

SEQ ID NO: 1181892 - protein, 9 aa, Homo Sapiens
TRILVFPTS

SEQ ID NO: 1181893 - protein, 9 aa, Homo Sapiens
GKSYRLKHS

SEQ ID NO: 1181894 - protein, 9 aa, Homo Sapiens
AAAARGQRL

SEQ ID NO: 1181895 - protein, 9 aa, Homo Sapiens
EDFIVWMCT

SEQ ID NO: 1181896 - protein, 9 aa, Homo Sapiens
LRPALRIGM

SEQ ID NO: 1181897 - protein, 9 aa, Homo Sapiens
VVTATRTTL

SEQ ID NO: 1181898 - protein, 9 aa, Homo Sapiens
GKSVWLFSI

SEQ ID NO: 1181899 - protein, 9 aa, Homo Sapiens
VFLTIYNVT

SEQ ID NO: 1181900 - protein, 9 aa, Homo Sapiens
VMCILTVSG

SEQ ID NO: 1181901 - protein, 9 aa, Homo Sapiens
ARIRDCKAQ

SEQ ID NO: 1181902 - protein, 9 aa, Homo Sapiens
TTPWAGPTT

SEQ ID NO: 1181903 - protein, 9 aa, Homo Sapiens
KTWLQGGTR

SEQ ID NO: 1181904 - protein, 9 aa, Homo Sapiens
GTSVILPFV

SEQ ID NO: 1181905 - protein, 9 aa, Homo Sapiens
PSPSCNLWM

SEQ ID NO: 1181906 - protein, 9 aa, Homo Sapiens
SPLKKVWNL

SEQ ID NO: 1181907 - protein, 9 aa, Homo Sapiens
SISKNVAME

SEQ ID NO: 1181908 - protein, 9 aa, Homo Sapiens
GSAGLGPEH

SEQ ID NO: 1181909 - protein, 9 aa, Homo Sapiens
AFASRVILA

SEQ ID NO: 1181910 - protein, 9 aa, Homo Sapiens
FQNEEYNKS

SEQ ID NO: 1181911 - protein, 9 aa, Homo Sapiens
LNGLLFKGR

SEQ ID NO: 1181912 - protein, 9 aa, Homo Sapiens
QIAIIDFLL

SEQ ID NO: 1181913 - protein, 9 aa, Homo Sapiens
GIQAPACSS

SEQ ID NO: 1181914 - protein, 9 aa, Homo Sapiens
NTKLLSTTG

SEQ ID NO: 1181915 - protein, 9 aa, Homo Sapiens
LGLHSSIQA

SEQ ID NO: 1181916 - protein, 9 aa, Homo Sapiens
GGIYLLYLQ

SEQ ID NO: 1181917 - protein, 9 aa, Homo Sapiens
WRPGLKSSS

SEQ ID NO: 1181918 - protein, 9 aa, Homo Sapiens
CCDPQGTRS

SEQ ID NO: 1181919 - protein, 9 aa, Homo Sapiens
LCRPPTPPA

SEQ ID NO: 1181920 - protein, 9 aa, Homo Sapiens
QKMALTAFI

SEQ ID NO: 1181921 - protein, 9 aa, Homo Sapiens
SRWASSGLC

SEQ ID NO: 1181922 - protein, 9 aa, Homo Sapiens
AGTPHHISV

SEQ ID NO: 1181923 - protein, 9 aa, Homo Sapiens
TGATAESHL

SEQ ID NO: 1181924 - protein, 9 aa, Homo Sapiens
AQASCWTSH

SEQ ID NO: 1181925 - protein, 9 aa, Homo Sapiens
CVLVAGHIA

SEQ ID NO: 1181926 - protein, 9 aa, Homo Sapiens
EYKPLCSED

SEQ ID NO: 1181927 - protein, 9 aa, Homo Sapiens
TCSPPWREA

SEQ ID NO: 1181928 - protein, 9 aa, Homo Sapiens
WVGIIASTT

SEQ ID NO: 1181929 - protein, 9 aa, Homo Sapiens
QKVWAIPDT

SEQ ID NO: 1181930 - protein, 9 aa, Homo Sapiens
PHGPVVRPG

SEQ ID NO: 1181931 - protein, 9 aa, Homo Sapiens
LGPRPRVQA

SEQ ID NO: 1181932 - protein, 9 aa, Homo Sapiens
DQMIHILLC

SEQ ID NO: 1181933 - protein, 9 aa, Homo Sapiens
EVETMTKQL

SEQ ID NO: 1181934 - protein, 9 aa, Homo Sapiens
LWTGGLDNP

SEQ ID NO: 1181935 - protein, 9 aa, Homo Sapiens
DGIHEFQDT

SEQ ID NO: 1181936 - protein, 9 aa, Homo Sapiens
IDEYKKTYM

SEQ ID NO: 1181937 - protein, 9 aa, Homo Sapiens
PPGSGSLLC

SEQ ID NO: 1181938 - protein, 9 aa, Homo Sapiens
APTSSPATS

SEQ ID NO: 1181939 - protein, 9 aa, Homo Sapiens
KKIKIFFCT

SEQ ID NO: 1181940 - protein, 9 aa, Homo Sapiens
NTSVVTGTS

SEQ ID NO: 1181941 - protein, 9 aa, Homo Sapiens
PGCPTQAPP

SEQ ID NO: 1181942 - protein, 9 aa, Homo Sapiens
VVRPGGMPG

SEQ ID NO: 1181943 - protein, 9 aa, Homo Sapiens
TLKIREERS

SEQ ID NO: 1181944 - protein, 9 aa, Homo Sapiens
RGHNQVPAQ

SEQ ID NO: 1181945 - protein, 9 aa, Homo Sapiens
PEDSDTYGT

SEQ ID NO: 1181946 - protein, 9 aa, Homo Sapiens
RTRTTPADS

SEQ ID NO: 1181947 - protein, 9 aa, Homo Sapiens
MHPFTATTK

SEQ ID NO: 1181948 - protein, 9 aa, Homo Sapiens
KRITQQLER

SEQ ID NO: 1181949 - protein, 9 aa, Homo Sapiens
VVPRGSDNT

SEQ ID NO: 1181950 - protein, 9 aa, Homo Sapiens
SSRLKELLM

SEQ ID NO: 1181951 - protein, 9 aa, Homo Sapiens
PAAEPMICS

SEQ ID NO: 1181952 - protein, 9 aa, Homo Sapiens
TVLTRVEGL

SEQ ID NO: 1181953 - protein, 9 aa, Homo Sapiens
LSDSTMLIH

SEQ ID NO: 1181954 - protein, 9 aa, Homo Sapiens
GRSARMSSW

SEQ ID NO: 1181955 - protein, 9 aa, Homo Sapiens
PLRCPRAPT

SEQ ID NO: 1181956 - protein, 9 aa, Homo Sapiens
ETYVEEIVN

SEQ ID NO: 1181957 - protein, 9 aa, Homo Sapiens
VLQFQFTAW

SEQ ID NO: 1181958 - protein, 9 aa, Homo Sapiens
SVKECDSIS

SEQ ID NO: 1181959 - protein, 9 aa, Homo Sapiens
PFHLISASA

SEQ ID NO: 1181960 - protein, 9 aa, Homo Sapiens
KLVYKKHFW

SEQ ID NO: 1181961 - protein, 9 aa, Homo Sapiens
GRRREGDAP

SEQ ID NO: 1181962 - protein, 9 aa, Homo Sapiens
TWRRTTSAS

SEQ ID NO: 1181963 - protein, 9 aa, Homo Sapiens
PSSMSGVPL

SEQ ID NO: 1181964 - protein, 9 aa, Homo Sapiens
SAIFDFRVA

SEQ ID NO: 1181965 - protein, 9 aa, Homo Sapiens
DNGCCIEMM

SEQ ID NO: 1181966 - protein, 9 aa, Homo Sapiens
RLTRSQRMT

SEQ ID NO: 1181967 - protein, 9 aa, Homo Sapiens
PLAITISLA

SEQ ID NO: 1181968 - protein, 9 aa, Homo Sapiens
WRTRCWACC

SEQ ID NO: 1181969 - protein, 9 aa, Homo Sapiens
LHYVPFEDD

SEQ ID NO: 1181970 - protein, 9 aa, Homo Sapiens
AWGQIKQSN

SEQ ID NO: 1181971 - protein, 9 aa, Homo Sapiens
FFIDTDWQG

SEQ ID NO: 1181972 - protein, 9 aa, Homo Sapiens
LARWASQEW

SEQ ID NO: 1181973 - protein, 9 aa, Homo Sapiens
SKVRILVNG

SEQ ID NO: 1181974 - protein, 9 aa, Homo Sapiens
HSGWTAMLV

SEQ ID NO: 1181975 - protein, 9 aa, Homo Sapiens
GRWSITSPP

SEQ ID NO: 1181976 - protein, 9 aa, Homo Sapiens
QTHHSTPFS

SEQ ID NO: 1181977 - protein, 9 aa, Homo Sapiens
VGGGGGVSV

SEQ ID NO: 1181978 - protein, 9 aa, Homo Sapiens
LNLQVLKKI

SEQ ID NO: 1181979 - protein, 9 aa, Homo Sapiens
GPQEATCRN

SEQ ID NO: 1181980 - protein, 9 aa, Homo Sapiens
RHHGLLFLH

SEQ ID NO: 1181981 - protein, 9 aa, Homo Sapiens
PPSPPSPSS

SEQ ID NO: 1181982 - protein, 9 aa, Homo Sapiens
YGNNFWNSS

SEQ ID NO: 1181983 - protein, 9 aa, Homo Sapiens
AQHDSSAGP

SEQ ID NO: 1181984 - protein, 9 aa, Homo Sapiens
SVSTFDLVA

SEQ ID NO: 1181985 - protein, 9 aa, Homo Sapiens
MQEGDSADP

SEQ ID NO: 1181986 - protein, 9 aa, Homo Sapiens
ALIFFSIAS

SEQ ID NO: 1181987 - protein, 9 aa, Homo Sapiens
GRKSQTKII

SEQ ID NO: 1181988 - protein, 9 aa, Homo Sapiens
CGQIPGIPF

SEQ ID NO: 1181989 - protein, 9 aa, Homo Sapiens
TMKKVADGH

SEQ ID NO: 1181990 - protein, 9 aa, Homo Sapiens
VEAAQETIA

SEQ ID NO: 1181991 - protein, 9 aa, Homo Sapiens
SKHWSFEKV

SEQ ID NO: 1181992 - protein, 9 aa, Homo Sapiens
GRHSPARPA

SEQ ID NO: 1181993 - protein, 9 aa, Homo Sapiens
SQITAQNNV

SEQ ID NO: 1181994 - protein, 9 aa, Homo Sapiens
STEEIQSEM

SEQ ID NO: 1181995 - protein, 9 aa, Homo Sapiens
SMKGLTEAK

SEQ ID NO: 1181996 - protein, 9 aa, Homo Sapiens
MRTLPPGTR

SEQ ID NO: 1181997 - protein, 9 aa, Homo Sapiens
PRRAPLNSW

SEQ ID NO: 1181998 - protein, 9 aa, Homo Sapiens
SINWTKIEP

SEQ ID NO: 1181999 - protein, 9 aa, Homo Sapiens
WHHGVFVGS

SEQ ID NO: 1182000 - protein, 9 aa, Homo Sapiens
SSSPSKIHG

SEQ ID NO: 1182001 - protein, 9 aa, Homo Sapiens
VDFRNYHLG

SEQ ID NO: 1182002 - protein, 9 aa, Homo Sapiens
TINHIVDFK

SEQ ID NO: 1182003 - protein, 9 aa, Homo Sapiens
VCPVLWALA

SEQ ID NO: 1182004 - protein, 9 aa, Homo Sapiens
ARAHQRTGR

SEQ ID NO: 1182005 - protein, 9 aa, Homo Sapiens
PFRAEAETE

SEQ ID NO: 1182006 - protein, 9 aa, Homo Sapiens
SFLQQCKKC

SEQ ID NO: 1182007 - protein, 9 aa, Homo Sapiens
FTGTPVQNN

SEQ ID NO: 1182008 - protein, 9 aa, Homo Sapiens
TEGRIQMVH

SEQ ID NO: 1182009 - protein, 9 aa, Homo Sapiens
VLELKCKHS

SEQ ID NO: 1182010 - protein, 9 aa, Homo Sapiens
YVLNEDKEW

SEQ ID NO: 1182011 - protein, 9 aa, Homo Sapiens
LGSRMFWYS

SEQ ID NO: 1182012 - protein, 9 aa, Homo Sapiens
ESLGKGLHR

SEQ ID NO: 1182013 - protein, 9 aa, Homo Sapiens
EDTTAIDMQ

SEQ ID NO: 1182014 - protein, 9 aa, Homo Sapiens
KVRMDPPAP

SEQ ID NO: 1182015 - protein, 9 aa, Homo Sapiens
AVSELAPRL

SEQ ID NO: 1182016 - protein, 9 aa, Homo Sapiens
KNQKKKRDD

SEQ ID NO: 1182017 - protein, 9 aa, Homo Sapiens
SRPLCLQTM

SEQ ID NO: 1182018 - protein, 9 aa, Homo Sapiens
KCSKTSRKK

SEQ ID NO: 1182019 - protein, 9 aa, Homo Sapiens
TVLDCGPQL

SEQ ID NO: 1182020 - protein, 9 aa, Homo Sapiens
RGALSPTCV

SEQ ID NO: 1182021 - protein, 9 aa, Homo Sapiens
PSSAGRSWG

SEQ ID NO: 1182022 - protein, 9 aa, Homo Sapiens
RHLIFPQPN

SEQ ID NO: 1182023 - protein, 9 aa, Homo Sapiens
EEHEPGAIT

SEQ ID NO: 1182024 - protein, 9 aa, Homo Sapiens
QAGRGTSAE

SEQ ID NO: 1182025 - protein, 9 aa, Homo Sapiens
AAVGKARRR

SEQ ID NO: 1182026 - protein, 9 aa, Homo Sapiens
ASRELKAPR

SEQ ID NO: 1182027 - protein, 9 aa, Homo Sapiens
SGQGKPKAD

SEQ ID NO: 1182028 - protein, 9 aa, Homo Sapiens
RGGEIRVQN

SEQ ID NO: 1182029 - protein, 9 aa, Homo Sapiens
AASHRRRLP

SEQ ID NO: 1182030 - protein, 9 aa, Homo Sapiens
SEGEEGEEG

SEQ ID NO: 1182031 - protein, 9 aa, Homo Sapiens
MRKGSLQCE

SEQ ID NO: 1182032 - protein, 9 aa, Homo Sapiens
EEEKPHMPM

SEQ ID NO: 1182033 - protein, 9 aa, Homo Sapiens
TVQRKDYPS

SEQ ID NO: 1182034 - protein, 9 aa, Homo Sapiens
TSSISTFLL

SEQ ID NO: 1182035 - protein, 9 aa, Homo Sapiens
EDVCRLINL

SEQ ID NO: 1182036 - protein, 9 aa, Homo Sapiens
SSGGGAASS

SEQ ID NO: 1182037 - protein, 9 aa, Homo Sapiens
KSRKCSKTS

SEQ ID NO: 1182038 - protein, 9 aa, Homo Sapiens
YNHCCVKIY

SEQ ID NO: 1182039 - protein, 9 aa, Homo Sapiens
GTAVPVELR

SEQ ID NO: 1182040 - protein, 9 aa, Homo Sapiens
DDLDYGYGC

SEQ ID NO: 1182041 - protein, 9 aa, Homo Sapiens
AAHDVGGRE

SEQ ID NO: 1182042 - protein, 9 aa, Homo Sapiens
GGQASRGSK

SEQ ID NO: 1182043 - protein, 9 aa, Homo Sapiens
IIHGPAPAP

SEQ ID NO: 1182044 - protein, 9 aa, Homo Sapiens
GDKGFLPPL

SEQ ID NO: 1182045 - protein, 9 aa, Homo Sapiens
MVTRGRRAE

SEQ ID NO: 1182046 - protein, 9 aa, Homo Sapiens
SSKSLSMFQ

SEQ ID NO: 1182047 - protein, 9 aa, Homo Sapiens
EVQNIPDNF

SEQ ID NO: 1182048 - protein, 9 aa, Homo Sapiens
APSEPVASR

SEQ ID NO: 1182049 - protein, 9 aa, Homo Sapiens
KQVDTWQTR

SEQ ID NO: 1182050 - protein, 9 aa, Homo Sapiens
PGGSGHAGY

SEQ ID NO: 1182051 - protein, 9 aa, Homo Sapiens
AVAGQDDGW

SEQ ID NO: 1182052 - protein, 9 aa, Homo Sapiens
PLPPPAPCS

SEQ ID NO: 1182053 - protein, 9 aa, Homo Sapiens
RGKPLENDT

SEQ ID NO: 1182054 - protein, 9 aa, Homo Sapiens
RSLPSISRE

SEQ ID NO: 1182055 - protein, 9 aa, Homo Sapiens
PAQGEEAVP

SEQ ID NO: 1182056 - protein, 9 aa, Homo Sapiens
TIATQILAC

SEQ ID NO: 1182057 - protein, 9 aa, Homo Sapiens
SRLTYAHLA

SEQ ID NO: 1182058 - protein, 9 aa, Homo Sapiens
ENELGRLAA

SEQ ID NO: 1182059 - protein, 9 aa, Homo Sapiens
VIGFATEQN

SEQ ID NO: 1182060 - protein, 9 aa, Homo Sapiens
SAFPSRSLS

SEQ ID NO: 1182061 - protein, 9 aa, Homo Sapiens
VSTMDALWG

SEQ ID NO: 1182062 - protein, 9 aa, Homo Sapiens
MYIRHQGEV

SEQ ID NO: 1182063 - protein, 9 aa, Homo Sapiens
SLRRRHLGR

SEQ ID NO: 1182064 - protein, 9 aa, Homo Sapiens
QGRSQELVC

SEQ ID NO: 1182065 - protein, 9 aa, Homo Sapiens
NEIAREIQS

SEQ ID NO: 1182066 - protein, 9 aa, Homo Sapiens
LGASTSHKH

SEQ ID NO: 1182067 - protein, 9 aa, Homo Sapiens
CRRFRASNY

SEQ ID NO: 1182068 - protein, 9 aa, Homo Sapiens
QENVLVSYS

SEQ ID NO: 1182069 - protein, 9 aa, Homo Sapiens
SACTMPPLL

SEQ ID NO: 1182070 - protein, 9 aa, Homo Sapiens
ASIADMLLE

SEQ ID NO: 1182071 - protein, 9 aa, Homo Sapiens
DFPPSMRQA

SEQ ID NO: 1182072 - protein, 9 aa, Homo Sapiens
ALYQLMLNC

SEQ ID NO: 1182073 - protein, 9 aa, Homo Sapiens
DGQMTSSGS

SEQ ID NO: 1182074 - protein, 9 aa, Homo Sapiens
LQKKIWESW

SEQ ID NO: 1182075 - protein, 9 aa, Homo Sapiens
RIQKSDFSN

SEQ ID NO: 1182076 - protein, 9 aa, Homo Sapiens
THSHIPLCP

SEQ ID NO: 1182077 - protein, 9 aa, Homo Sapiens
LVAAAAKLS

SEQ ID NO: 1182078 - protein, 9 aa, Homo Sapiens
PCLREPQEL

SEQ ID NO: 1182079 - protein, 9 aa, Homo Sapiens
DGTPHPAPP

SEQ ID NO: 1182080 - protein, 9 aa, Homo Sapiens
RGLGRGGPA

SEQ ID NO: 1182081 - protein, 9 aa, Homo Sapiens
LASSHTTHC

SEQ ID NO: 1182082 - protein, 9 aa, Homo Sapiens
GPPLRGPQR

SEQ ID NO: 1182083 - protein, 9 aa, Homo Sapiens
RGSPPSRAS

SEQ ID NO: 1182084 - protein, 9 aa, Homo Sapiens
LEPDLHLAL

SEQ ID NO: 1182085 - protein, 9 aa, Homo Sapiens
EGPGSGESH

SEQ ID NO: 1182086 - protein, 9 aa, Homo Sapiens
QWGATWSSS

SEQ ID NO: 1182087 - protein, 9 aa, Homo Sapiens
DELPATSAV

SEQ ID NO: 1182088 - protein, 9 aa, Homo Sapiens
GGLGGGPRP

SEQ ID NO: 1182089 - protein, 9 aa, Homo Sapiens
LDQMIHILL

SEQ ID NO: 1182090 - protein, 9 aa, Homo Sapiens
AELQNVSQH

SEQ ID NO: 1182091 - protein, 9 aa, Homo Sapiens
YLLPQGRRY

SEQ ID NO: 1182092 - protein, 9 aa, Homo Sapiens
PNSRLTGHS

SEQ ID NO: 1182093 - protein, 9 aa, Homo Sapiens
ASSTSRSTC

SEQ ID NO: 1182094 - protein, 9 aa, Homo Sapiens
VLLIEGHYV

SEQ ID NO: 1182095 - protein, 9 aa, Homo Sapiens
QNNVVWALT

SEQ ID NO: 1182096 - protein, 9 aa, Homo Sapiens
LEDAPQLSY

SEQ ID NO: 1182097 - protein, 9 aa, Homo Sapiens
RCCCRRRRC

SEQ ID NO: 1182098 - protein, 9 aa, Homo Sapiens
RRGDVPQTV

SEQ ID NO: 1182099 - protein, 9 aa, Homo Sapiens
LNGKPTPPP

SEQ ID NO: 1182100 - protein, 9 aa, Homo Sapiens
DTRPFACEM

SEQ ID NO: 1182101 - protein, 9 aa, Homo Sapiens
QNRPHLPHH

SEQ ID NO: 1182102 - protein, 9 aa, Homo Sapiens
TTVVNGRMR

SEQ ID NO: 1182103 - protein, 9 aa, Homo Sapiens
SLKRLFIEH

SEQ ID NO: 1182104 - protein, 9 aa, Homo Sapiens
GSPGASRES

SEQ ID NO: 1182105 - protein, 9 aa, Homo Sapiens
RWRTRCWAC

SEQ ID NO: 1182106 - protein, 9 aa, Homo Sapiens
YLSGIKDNN

SEQ ID NO: 1182107 - protein, 9 aa, Homo Sapiens
WAAWRRRRM

SEQ ID NO: 1182108 - protein, 9 aa, Homo Sapiens
TATGTHRDP

SEQ ID NO: 1182109 - protein, 9 aa, Homo Sapiens
SPADGQGAA

SEQ ID NO: 1182110 - protein, 9 aa, Homo Sapiens
CSCSSSLAF

SEQ ID NO: 1182111 - protein, 9 aa, Homo Sapiens
DWLIFTQNY

SEQ ID NO: 1182112 - protein, 9 aa, Homo Sapiens
MWDRDHDNY

SEQ ID NO: 1182113 - protein, 9 aa, Homo Sapiens
MLPKLLCRQ

SEQ ID NO: 1182114 - protein, 9 aa, Homo Sapiens
CSAGGGRNF

SEQ ID NO: 1182115 - protein, 9 aa, Homo Sapiens
PGLKSSSFW

SEQ ID NO: 1182116 - protein, 9 aa, Homo Sapiens
RALRARQVL

SEQ ID NO: 1182117 - protein, 9 aa, Homo Sapiens
VSVLDRTSA

SEQ ID NO: 1182118 - protein, 9 aa, Homo Sapiens
GFPGRGGGP

SEQ ID NO: 1182119 - protein, 9 aa, Homo Sapiens
GAPHEAPCT

SEQ ID NO: 1182120 - protein, 9 aa, Homo Sapiens
QGIPSSPQP

SEQ ID NO: 1182121 - protein, 9 aa, Homo Sapiens
PACLNLRQG

SEQ ID NO: 1182122 - protein, 9 aa, Homo Sapiens
RGREGGVGG

SEQ ID NO: 1182123 - protein, 9 aa, Homo Sapiens
EIFLKLVND

SEQ ID NO: 1182124 - protein, 9 aa, Homo Sapiens
TQQSSLHIT

SEQ ID NO: 1182125 - protein, 9 aa, Homo Sapiens
KKCGPKPKT

SEQ ID NO: 1182126 - protein, 9 aa, Homo Sapiens
RFSQPVYDA

SEQ ID NO: 1182127 - protein, 9 aa, Homo Sapiens
IRLLKCDRT

SEQ ID NO: 1182128 - protein, 9 aa, Homo Sapiens
LRRIASQAK

SEQ ID NO: 1182129 - protein, 9 aa, Homo Sapiens
HTPDEESIN

SEQ ID NO: 1182130 - protein, 9 aa, Homo Sapiens
CQWPTEGRI

SEQ ID NO: 1182131 - protein, 9 aa, Homo Sapiens
GHCMDKPAN

SEQ ID NO: 1182132 - protein, 9 aa, Homo Sapiens
PNPCRSSWA

SEQ ID NO: 1182133 - protein, 9 aa, Homo Sapiens
VGHIITLLL

SEQ ID NO: 1182134 - protein, 9 aa, Homo Sapiens
KPKSEDYED

SEQ ID NO: 1182135 - protein, 9 aa, Homo Sapiens
IDMQVGLLY

SEQ ID NO: 1182136 - protein, 9 aa, Homo Sapiens
IEHKTISFE

SEQ ID NO: 1182137 - protein, 9 aa, Homo Sapiens
GFTQDRGLQ

SEQ ID NO: 1182138 - protein, 9 aa, Homo Sapiens
YSLLTKNGN

SEQ ID NO: 1182139 - protein, 9 aa, Homo Sapiens
VTINHIVDF

SEQ ID NO: 1182140 - protein, 9 aa, Homo Sapiens
RASRASLDQ

SEQ ID NO: 1182141 - protein, 9 aa, Homo Sapiens
TLATFVADR

SEQ ID NO: 1182142 - protein, 9 aa, Homo Sapiens
APSQDPCTA

SEQ ID NO: 1182143 - protein, 9 aa, Homo Sapiens
TGSEWRQRS

SEQ ID NO: 1182144 - protein, 9 aa, Homo Sapiens
MKTSRRSLM

SEQ ID NO: 1182145 - protein, 9 aa, Homo Sapiens
RGSLRKWRP

SEQ ID NO: 1182146 - protein, 9 aa, Homo Sapiens
LRPRPPEPL

SEQ ID NO: 1182147 - protein, 9 aa, Homo Sapiens
PAAALSPAG

SEQ ID NO: 1182148 - protein, 9 aa, Homo Sapiens
FTRALRPTA

SEQ ID NO: 1182149 - protein, 9 aa, Homo Sapiens
IPLLESELL

SEQ ID NO: 1182150 - protein, 9 aa, Homo Sapiens
PSAELSTGP

SEQ ID NO: 1182151 - protein, 9 aa, Homo Sapiens
ASPRRMCLA

SEQ ID NO: 1182152 - protein, 9 aa, Homo Sapiens
RNSFQSECV

SEQ ID NO: 1182153 - protein, 9 aa, Homo Sapiens
PGLDAAALP

SEQ ID NO: 1182154 - protein, 9 aa, Homo Sapiens
DYSKLLPYQ

SEQ ID NO: 1182155 - protein, 9 aa, Homo Sapiens
EDKKNGIWE

SEQ ID NO: 1182156 - protein, 9 aa, Homo Sapiens
RRKFGSQGW

SEQ ID NO: 1182157 - protein, 9 aa, Homo Sapiens
QDINTTKAD

SEQ ID NO: 1182158 - protein, 9 aa, Homo Sapiens
FTFSAVVPA

SEQ ID NO: 1182159 - protein, 9 aa, Homo Sapiens
QRAAAQELL

SEQ ID NO: 1182160 - protein, 9 aa, Homo Sapiens
MANYHYFLE

SEQ ID NO: 1182161 - protein, 9 aa, Homo Sapiens
YKRFTGKIN

SEQ ID NO: 1182162 - protein, 9 aa, Homo Sapiens
SRLGWASGR

SEQ ID NO: 1182163 - protein, 9 aa, Homo Sapiens
SGDETLMQR

SEQ ID NO: 1182164 - protein, 9 aa, Homo Sapiens
RSYTTPWAG

SEQ ID NO: 1182165 - protein, 9 aa, Homo Sapiens
DIDEYKKTY

SEQ ID NO: 1182166 - protein, 9 aa, Homo Sapiens
YSQDDNCTL

SEQ ID NO: 1182167 - protein, 9 aa, Homo Sapiens
DHLTLLAMY

SEQ ID NO: 1182168 - protein, 9 aa, Homo Sapiens
PGIPFSSLH

SEQ ID NO: 1182169 - protein, 9 aa, Homo Sapiens
IVVIIPYFI

SEQ ID NO: 1182170 - protein, 9 aa, Homo Sapiens
DIPSIQILN

SEQ ID NO: 1182171 - protein, 9 aa, Homo Sapiens
GDWVASPPT

SEQ ID NO: 1182172 - protein, 9 aa, Homo Sapiens
PTMPCTYLQ

SEQ ID NO: 1182173 - protein, 9 aa, Homo Sapiens
SARPSCWSM

SEQ ID NO: 1182174 - protein, 9 aa, Homo Sapiens
TSTHDKAIT

SEQ ID NO: 1182175 - protein, 9 aa, Homo Sapiens
DPATTAAPR

SEQ ID NO: 1182176 - protein, 9 aa, Homo Sapiens
KNIKENIQD

SEQ ID NO: 1182177 - protein, 9 aa, Homo Sapiens
DPVRRRERE

SEQ ID NO: 1182178 - protein, 9 aa, Homo Sapiens
LRCSPSPNC

SEQ ID NO: 1182179 - protein, 9 aa, Homo Sapiens
CEREEKHLK

SEQ ID NO: 1182180 - protein, 9 aa, Homo Sapiens
LRPPPLSLP

SEQ ID NO: 1182181 - protein, 9 aa, Homo Sapiens
EQQRLEKMK

SEQ ID NO: 1182182 - protein, 9 aa, Homo Sapiens
NMKSSWMFA

SEQ ID NO: 1182183 - protein, 9 aa, Homo Sapiens
LPHLEFYRY

SEQ ID NO: 1182184 - protein, 9 aa, Homo Sapiens
NLQAKGRML

SEQ ID NO: 1182185 - protein, 9 aa, Homo Sapiens
RPRVQAHWR

SEQ ID NO: 1182186 - protein, 9 aa, Homo Sapiens
AGAARARTC

SEQ ID NO: 1182187 - protein, 9 aa, Homo Sapiens
GKLFDNLTS

SEQ ID NO: 1182188 - protein, 9 aa, Homo Sapiens
PLGTPHQHG

SEQ ID NO: 1182189 - protein, 9 aa, Homo Sapiens
TEDTPPPAC

SEQ ID NO: 1182190 - protein, 9 aa, Homo Sapiens
TKQQRRSRG

SEQ ID NO: 1182191 - protein, 9 aa, Homo Sapiens
SVLLPAAPG

SEQ ID NO: 1182192 - protein, 9 aa, Homo Sapiens
WENGRALET

SEQ ID NO: 1182193 - protein, 9 aa, Homo Sapiens
SFKEPLTLQ

SEQ ID NO: 1182194 - protein, 9 aa, Homo Sapiens
GKALSGHHS

SEQ ID NO: 1182195 - protein, 9 aa, Homo Sapiens
DLLAREGRA

SEQ ID NO: 1182196 - protein, 9 aa, Homo Sapiens
HTDKKPYTC

SEQ ID NO: 1182197 - protein, 9 aa, Homo Sapiens
GPPTWPTQT

SEQ ID NO: 1182198 - protein, 9 aa, Homo Sapiens
PKGCPPGFP

SEQ ID NO: 1182199 - protein, 9 aa, Homo Sapiens
DYEDKEREK

SEQ ID NO: 1182200 - protein, 9 aa, Homo Sapiens
TATNASCSG

SEQ ID NO: 1182201 - protein, 9 aa, Homo Sapiens
SQPQHRVLA

SEQ ID NO: 1182202 - protein, 9 aa, Homo Sapiens
RTCTMRSGQ

SEQ ID NO: 1182203 - protein, 9 aa, Homo Sapiens
KKDKKYKKR

SEQ ID NO: 1182204 - protein, 9 aa, Homo Sapiens
CEVDVEEGT

SEQ ID NO: 1182205 - protein, 9 aa, Homo Sapiens
GPHMPPATS

SEQ ID NO: 1182206 - protein, 9 aa, Homo Sapiens
ATTFDDCLY

SEQ ID NO: 1182207 - protein, 9 aa, Homo Sapiens
VVASLCILT

SEQ ID NO: 1182208 - protein, 9 aa, Homo Sapiens
GSETLAARQ

SEQ ID NO: 1182209 - protein, 9 aa, Homo Sapiens
ERPGAMATH

SEQ ID NO: 1182210 - protein, 9 aa, Homo Sapiens
YLNVIPSLG

SEQ ID NO: 1182211 - protein, 9 aa, Homo Sapiens
TYPLDLVRV

SEQ ID NO: 1182212 - protein, 9 aa, Homo Sapiens
ATPEEFLQL

SEQ ID NO: 1182213 - protein, 9 aa, Homo Sapiens
SRSLARCLI

SEQ ID NO: 1182214 - protein, 9 aa, Homo Sapiens
RNPYADIIP

SEQ ID NO: 1182215 - protein, 9 aa, Homo Sapiens
SPGAWKQAW

SEQ ID NO: 1182216 - protein, 9 aa, Homo Sapiens
MPFIVSMRY

SEQ ID NO: 1182217 - protein, 9 aa, Homo Sapiens
PGIRWSPLP

SEQ ID NO: 1182218 - protein, 9 aa, Homo Sapiens
LTTAHCVEP

SEQ ID NO: 1182219 - protein, 9 aa, Homo Sapiens
ISNSSNWKQ

SEQ ID NO: 1182220 - protein, 9 aa, Homo Sapiens
EKGPCQTCM

SEQ ID NO: 1182221 - protein, 9 aa, Homo Sapiens
SLEMLLVEN

SEQ ID NO: 1182222 - protein, 9 aa, Homo Sapiens
HAMTAQGSS

SEQ ID NO: 1182223 - protein, 9 aa, Homo Sapiens
FPSLQGAPT

SEQ ID NO: 1182224 - protein, 9 aa, Homo Sapiens
GSTTSNWKK

SEQ ID NO: 1182225 - protein, 9 aa, Homo Sapiens
KPPEEVLKK

SEQ ID NO: 1182226 - protein, 9 aa, Homo Sapiens
PERGAVGLP

SEQ ID NO: 1182227 - protein, 9 aa, Homo Sapiens
AAQGAVARA

SEQ ID NO: 1182228 - protein, 9 aa, Homo Sapiens
VKAARRGAP

SEQ ID NO: 1182229 - protein, 9 aa, Homo Sapiens
QNDGLKASD

SEQ ID NO: 1182230 - protein, 9 aa, Homo Sapiens
STRAAPPSL

SEQ ID NO: 1182231 - protein, 9 aa, Homo Sapiens
VKWLGTDSH

SEQ ID NO: 1182232 - protein, 9 aa, Homo Sapiens
SADPVVTSR

SEQ ID NO: 1182233 - protein, 9 aa, Homo Sapiens
CWETCHISN

SEQ ID NO: 1182234 - protein, 9 aa, Homo Sapiens
QGLKFVGVM

SEQ ID NO: 1182235 - protein, 9 aa, Homo Sapiens
EGHYVHVVL

SEQ ID NO: 1182236 - protein, 9 aa, Homo Sapiens
GNTAAALVD

SEQ ID NO: 1182237 - protein, 9 aa, Homo Sapiens
RYISRCAPP

SEQ ID NO: 1182238 - protein, 9 aa, Homo Sapiens
RGGQASRGS

SEQ ID NO: 1182239 - protein, 9 aa, Homo Sapiens
ADPPLGLPA

SEQ ID NO: 1182240 - protein, 9 aa, Homo Sapiens
SNSQCLPRP

SEQ ID NO: 1182241 - protein, 9 aa, Homo Sapiens
MASVGHIIT

SEQ ID NO: 1182242 - protein, 9 aa, Homo Sapiens
RLTRERAAA

SEQ ID NO: 1182243 - protein, 9 aa, Homo Sapiens
PFTRYCFQH

SEQ ID NO: 1182244 - protein, 9 aa, Homo Sapiens
GSVDSFEWS

SEQ ID NO: 1182245 - protein, 9 aa, Homo Sapiens
PLFFMEAKP

SEQ ID NO: 1182246 - protein, 9 aa, Homo Sapiens
NLSPPTDLY

SEQ ID NO: 1182247 - protein, 9 aa, Homo Sapiens
GFIMLRNDL

SEQ ID NO: 1182248 - protein, 9 aa, Homo Sapiens
LKASLPPSP

SEQ ID NO: 1182249 - protein, 9 aa, Homo Sapiens
MTFLRAFLR

SEQ ID NO: 1182250 - protein, 9 aa, Homo Sapiens
LDAPEGKEL

SEQ ID NO: 1182251 - protein, 9 aa, Homo Sapiens
NFEEIQHFY

SEQ ID NO: 1182252 - protein, 9 aa, Homo Sapiens
LRESHTIVY

SEQ ID NO: 1182253 - protein, 9 aa, Homo Sapiens
KNENLKTRS

SEQ ID NO: 1182254 - protein, 9 aa, Homo Sapiens
NESFGFTTD

SEQ ID NO: 1182255 - protein, 9 aa, Homo Sapiens
QPPPPPGSS

SEQ ID NO: 1182256 - protein, 9 aa, Homo Sapiens
TTKEEMERF

SEQ ID NO: 1182257 - protein, 9 aa, Homo Sapiens
GKRSSRLGW

SEQ ID NO: 1182258 - protein, 9 aa, Homo Sapiens
AHWLGGPTA

SEQ ID NO: 1182259 - protein, 9 aa, Homo Sapiens
IIDLSHCSW

SEQ ID NO: 1182260 - protein, 9 aa, Homo Sapiens
RETDPCWAL

SEQ ID NO: 1182261 - protein, 9 aa, Homo Sapiens
MASSSPRSM

SEQ ID NO: 1182262 - protein, 9 aa, Homo Sapiens
RRYDDYSSS

SEQ ID NO: 1182263 - protein, 9 aa, Homo Sapiens
GWGVFVGLQ

SEQ ID NO: 1182264 - protein, 9 aa, Homo Sapiens
SSSQCTQGR

SEQ ID NO: 1182265 - protein, 9 aa, Homo Sapiens
PPVLMLHLK

SEQ ID NO: 1182266 - protein, 9 aa, Homo Sapiens
LPGSAARTC

SEQ ID NO: 1182267 - protein, 9 aa, Homo Sapiens
SWQECDEAP

SEQ ID NO: 1182268 - protein, 9 aa, Homo Sapiens
GARGEIAVM

SEQ ID NO: 1182269 - protein, 9 aa, Homo Sapiens
PFIVSMRYF

SEQ ID NO: 1182270 - protein, 9 aa, Homo Sapiens
ANYHYFLEE

SEQ ID NO: 1182271 - protein, 9 aa, Homo Sapiens
SGWSGRSAR

SEQ ID NO: 1182272 - protein, 9 aa, Homo Sapiens
SLPSISRES

SEQ ID NO: 1182273 - protein, 9 aa, Homo Sapiens
LMPPPGLRP

SEQ ID NO: 1182274 - protein, 9 aa, Homo Sapiens
TDAPAKMSV

SEQ ID NO: 1182275 - protein, 9 aa, Homo Sapiens
PSEGAGRHS

SEQ ID NO: 1182276 - protein, 9 aa, Homo Sapiens
KSLTAEIDQ

SEQ ID NO: 1182277 - protein, 9 aa, Homo Sapiens
KGGKKFIKV

SEQ ID NO: 1182278 - protein, 9 aa, Homo Sapiens
SAASPCSSI

SEQ ID NO: 1182279 - protein, 9 aa, Homo Sapiens
NDDYTLSVH

SEQ ID NO: 1182280 - protein, 9 aa, Homo Sapiens
QLGTSLQHS

SEQ ID NO: 1182281 - protein, 9 aa, Homo Sapiens
EDHIKNYHP

SEQ ID NO: 1182282 - protein, 9 aa, Homo Sapiens
LGQGLGVAA

SEQ ID NO: 1182283 - protein, 9 aa, Homo Sapiens
CFFPTLPRF

SEQ ID NO: 1182284 - protein, 9 aa, Homo Sapiens
PLRKALSEF

SEQ ID NO: 1182285 - protein, 9 aa, Homo Sapiens
TPRLSVPNP

SEQ ID NO: 1182286 - protein, 9 aa, Homo Sapiens
SMPACARGP

SEQ ID NO: 1182287 - protein, 9 aa, Homo Sapiens
RQRSIVILQ

SEQ ID NO: 1182288 - protein, 9 aa, Homo Sapiens
RVSPEPPRP

SEQ ID NO: 1182289 - protein, 9 aa, Homo Sapiens
RFQRLVRDL

SEQ ID NO: 1182290 - protein, 9 aa, Homo Sapiens
PGCWSCRRR

SEQ ID NO: 1182291 - protein, 9 aa, Homo Sapiens
SPLPALSRT

SEQ ID NO: 1182292 - protein, 9 aa, Homo Sapiens
PLTTSPLMK

SEQ ID NO: 1182293 - protein, 9 aa, Homo Sapiens
SISRPTSRA

SEQ ID NO: 1182294 - protein, 9 aa, Homo Sapiens
YKGGTRSQA

SEQ ID NO: 1182295 - protein, 9 aa, Homo Sapiens
DRTSASVKK

SEQ ID NO: 1182296 - protein, 9 aa, Homo Sapiens
ASGAGHPWT

SEQ ID NO: 1182297 - protein, 9 aa, Homo Sapiens
EDVPPVNQM

SEQ ID NO: 1182298 - protein, 9 aa, Homo Sapiens
QVLGLLEGF

SEQ ID NO: 1182299 - protein, 9 aa, Homo Sapiens
QVSSDPRAR

SEQ ID NO: 1182300 - protein, 9 aa, Homo Sapiens
KRIRKQFFS

SEQ ID NO: 1182301 - protein, 9 aa, Homo Sapiens
LSSPMHGPP

SEQ ID NO: 1182302 - protein, 9 aa, Homo Sapiens
HQPRPGLPG

SEQ ID NO: 1182303 - protein, 9 aa, Homo Sapiens
MLWLNASRD

SEQ ID NO: 1182304 - protein, 9 aa, Homo Sapiens
YECKQCGRT

SEQ ID NO: 1182305 - protein, 9 aa, Homo Sapiens
PVPQPQSGG

SEQ ID NO: 1182306 - protein, 9 aa, Homo Sapiens
ILSLRQTLQ

SEQ ID NO: 1182307 - protein, 9 aa, Homo Sapiens
QWHNLRSRA

SEQ ID NO: 1182308 - protein, 9 aa, Homo Sapiens
GCRCYRSAS

SEQ ID NO: 1182309 - protein, 9 aa, Homo Sapiens
EGTPIDWGE

SEQ ID NO: 1182310 - protein, 9 aa, Homo Sapiens
VSNLEEPTS

SEQ ID NO: 1182311 - protein, 9 aa, Homo Sapiens
EGQETGKKR

SEQ ID NO: 1182312 - protein, 9 aa, Homo Sapiens
SKALKETRG

SEQ ID NO: 1182313 - protein, 9 aa, Homo Sapiens
DYVSTHLHE

SEQ ID NO: 1182314 - protein, 9 aa, Homo Sapiens
VKPNMPFIV

SEQ ID NO: 1182315 - protein, 9 aa, Homo Sapiens
ESGIPNLGI

SEQ ID NO: 1182316 - protein, 9 aa, Homo Sapiens
AETRGAAAK

SEQ ID NO: 1182317 - protein, 9 aa, Homo Sapiens
ADHAFTDDH

SEQ ID NO: 1182318 - protein, 9 aa, Homo Sapiens
AQHPRRPGA

SEQ ID NO: 1182319 - protein, 9 aa, Homo Sapiens
GRSRPSWPS

SEQ ID NO: 1182320 - protein, 9 aa, Homo Sapiens
APPPTSSPS

SEQ ID NO: 1182321 - protein, 9 aa, Homo Sapiens
LRPTGPLFF

SEQ ID NO: 1182322 - protein, 9 aa, Homo Sapiens
VPSCSSLSS

SEQ ID NO: 1182323 - protein, 9 aa, Homo Sapiens
IVSTLKREA

SEQ ID NO: 1182324 - protein, 9 aa, Homo Sapiens
FGKIVKNVF

SEQ ID NO: 1182325 - protein, 9 aa, Homo Sapiens
CLGCCSSPH

SEQ ID NO: 1182326 - protein, 9 aa, Homo Sapiens
YGPKKCGPK

SEQ ID NO: 1182327 - protein, 9 aa, Homo Sapiens
GLSVPADYP

SEQ ID NO: 1182328 - protein, 9 aa, Homo Sapiens
ATPAQGEEA

SEQ ID NO: 1182329 - protein, 9 aa, Homo Sapiens
SLDQMGFLA

SEQ ID NO: 1182330 - protein, 9 aa, Homo Sapiens
FPDITEGDS

SEQ ID NO: 1182331 - protein, 9 aa, Homo Sapiens
STSHKHDLR

SEQ ID NO: 1182332 - protein, 9 aa, Homo Sapiens
TIVLKNHHS

SEQ ID NO: 1182333 - protein, 9 aa, Homo Sapiens
GAALAFPGS

SEQ ID NO: 1182334 - protein, 9 aa, Homo Sapiens
SREPPQSRR

SEQ ID NO: 1182335 - protein, 9 aa, Homo Sapiens
EKELRVSTN

SEQ ID NO: 1182336 - protein, 9 aa, Homo Sapiens
KKGTMEAKE

SEQ ID NO: 1182337 - protein, 9 aa, Homo Sapiens
SLARCLILA

SEQ ID NO: 1182338 - protein, 9 aa, Homo Sapiens
MGTDVISIR

SEQ ID NO: 1182339 - protein, 9 aa, Homo Sapiens
STLSPQLCR

SEQ ID NO: 1182340 - protein, 9 aa, Homo Sapiens
TQFFIRFLQ

SEQ ID NO: 1182341 - protein, 9 aa, Homo Sapiens
CPTQAPPYP

SEQ ID NO: 1182342 - protein, 9 aa, Homo Sapiens
LKLSCGDDV

SEQ ID NO: 1182343 - protein, 9 aa, Homo Sapiens
VTMPPQVCF

SEQ ID NO: 1182344 - protein, 9 aa, Homo Sapiens
WGWFPPCGR

SEQ ID NO: 1182345 - protein, 9 aa, Homo Sapiens
ITEGDSSWL

SEQ ID NO: 1182346 - protein, 9 aa, Homo Sapiens
AVTVAVGCR

SEQ ID NO: 1182347 - protein, 9 aa, Homo Sapiens
NFQGVLQNA

SEQ ID NO: 1182348 - protein, 9 aa, Homo Sapiens
DHSECGEVR

SEQ ID NO: 1182349 - protein, 9 aa, Homo Sapiens
QDPLDRCYS

SEQ ID NO: 1182350 - protein, 9 aa, Homo Sapiens
PVKPNMPFI

SEQ ID NO: 1182351 - protein, 9 aa, Homo Sapiens
CSDTRLQTP

SEQ ID NO: 1182352 - protein, 9 aa, Homo Sapiens
DTGVREDEP

SEQ ID NO: 1182353 - protein, 9 aa, Homo Sapiens
LQFQVSASD

SEQ ID NO: 1182354 - protein, 9 aa, Homo Sapiens
ASGGVSRYI

SEQ ID NO: 1182355 - protein, 9 aa, Homo Sapiens
EFKNNPEIV

SEQ ID NO: 1182356 - protein, 9 aa, Homo Sapiens
FLMFINLGL

SEQ ID NO: 1182357 - protein, 9 aa, Homo Sapiens
PHPQASTPS

SEQ ID NO: 1182358 - protein, 9 aa, Homo Sapiens
HWSFEKVEK

SEQ ID NO: 1182359 - protein, 9 aa, Homo Sapiens
PLFPLLSRP

SEQ ID NO: 1182360 - protein, 9 aa, Homo Sapiens
RKALITFLT

SEQ ID NO: 1182361 - protein, 9 aa, Homo Sapiens
RPPPTAQAS

SEQ ID NO: 1182362 - protein, 9 aa, Homo Sapiens
RQRDEQLQA

SEQ ID NO: 1182363 - protein, 9 aa, Homo Sapiens
AWNLRAWRT

SEQ ID NO: 1182364 - protein, 9 aa, Homo Sapiens
PAVDPAAWG

SEQ ID NO: 1182365 - protein, 9 aa, Homo Sapiens
AAGPEPVPT

SEQ ID NO: 1182366 - protein, 9 aa, Homo Sapiens
WQECDEAPS

SEQ ID NO: 1182367 - protein, 9 aa, Homo Sapiens
AQEVQISWQ

SEQ ID NO: 1182368 - protein, 9 aa, Homo Sapiens
PSPPSPSSL

SEQ ID NO: 1182369 - protein, 9 aa, Homo Sapiens
APSQTHHST

SEQ ID NO: 1182370 - protein, 9 aa, Homo Sapiens
IVGKVKINS

SEQ ID NO: 1182371 - protein, 9 aa, Homo Sapiens
QRTHLIAHQ

SEQ ID NO: 1182372 - protein, 9 aa, Homo Sapiens
TIKSILIHD

SEQ ID NO: 1182373 - protein, 9 aa, Homo Sapiens
RVREIRNVV

SEQ ID NO: 1182374 - protein, 9 aa, Homo Sapiens
PGDPDAVVA

SEQ ID NO: 1182375 - protein, 9 aa, Homo Sapiens
DGRTRSSGW

SEQ ID NO: 1182376 - protein, 9 aa, Homo Sapiens
QAPFPAPQT

SEQ ID NO: 1182377 - protein, 9 aa, Homo Sapiens
GAVSELAPR

SEQ ID NO: 1182378 - protein, 9 aa, Homo Sapiens
TPTSPRLPL

SEQ ID NO: 1182379 - protein, 9 aa, Homo Sapiens
ILAICSDTR

SEQ ID NO: 1182380 - protein, 9 aa, Homo Sapiens
SPAINSTGE

SEQ ID NO: 1182381 - protein, 9 aa, Homo Sapiens
GAADKGDLR

SEQ ID NO: 1182382 - protein, 9 aa, Homo Sapiens
LVQGNEDCV

SEQ ID NO: 1182383 - protein, 9 aa, Homo Sapiens
PSGAAPRPH

SEQ ID NO: 1182384 - protein, 9 aa, Homo Sapiens
IPSLGRQTS

SEQ ID NO: 1182385 - protein, 9 aa, Homo Sapiens
LQHANELRH

SEQ ID NO: 1182386 - protein, 9 aa, Homo Sapiens
NEEGHESYE

SEQ ID NO: 1182387 - protein, 9 aa, Homo Sapiens
CALEDERVV

SEQ ID NO: 1182388 - protein, 9 aa, Homo Sapiens
RRLKPSQKH

SEQ ID NO: 1182389 - protein, 9 aa, Homo Sapiens
VSGVFPVLM

SEQ ID NO: 1182390 - protein, 9 aa, Homo Sapiens
AAESRPLCL

SEQ ID NO: 1182391 - protein, 9 aa, Homo Sapiens
ERPDWEIAI

SEQ ID NO: 1182392 - protein, 9 aa, Homo Sapiens
WLIAFWQAF

SEQ ID NO: 1182393 - protein, 9 aa, Homo Sapiens
TSEATYDPA

SEQ ID NO: 1182394 - protein, 9 aa, Homo Sapiens
PMPEEGSED

SEQ ID NO: 1182395 - protein, 9 aa, Homo Sapiens
AWCAWAWSA

SEQ ID NO: 1182396 - protein, 9 aa, Homo Sapiens
RTCSPCSPT

SEQ ID NO: 1182397 - protein, 9 aa, Homo Sapiens
VRQWSPRAW

SEQ ID NO: 1182398 - protein, 9 aa, Homo Sapiens
HERSHVAIK

SEQ ID NO: 1182399 - protein, 9 aa, Homo Sapiens
HNLRSRAEC

SEQ ID NO: 1182400 - protein, 9 aa, Homo Sapiens
VAGISVVSR

SEQ ID NO: 1182401 - protein, 9 aa, Homo Sapiens
RRSSQRRFW

SEQ ID NO: 1182402 - protein, 9 aa, Homo Sapiens
KNGQGSLPG

SEQ ID NO: 1182403 - protein, 9 aa, Homo Sapiens
INICPKYLT

SEQ ID NO: 1182404 - protein, 9 aa, Homo Sapiens
CQVWVLPPV

SEQ ID NO: 1182405 - protein, 9 aa, Homo Sapiens
TRLPTSVQG

SEQ ID NO: 1182406 - protein, 9 aa, Homo Sapiens
ECASELSRQ

SEQ ID NO: 1182407 - protein, 9 aa, Homo Sapiens
KCITECVRT

SEQ ID NO: 1182408 - protein, 9 aa, Homo Sapiens
GPEQTHERP

SEQ ID NO: 1182409 - protein, 9 aa, Homo Sapiens
DTVRERAKL

SEQ ID NO: 1182410 - protein, 9 aa, Homo Sapiens
LHVLISLLC

SEQ ID NO: 1182411 - protein, 9 aa, Homo Sapiens
VVSKMNKDV

SEQ ID NO: 1182412 - protein, 9 aa, Homo Sapiens
GPEVDVFLG

SEQ ID NO: 1182413 - protein, 9 aa, Homo Sapiens
WFFQRHKLK

SEQ ID NO: 1182414 - protein, 9 aa, Homo Sapiens
NCIQVFKPC

SEQ ID NO: 1182415 - protein, 9 aa, Homo Sapiens
GGALWAPLH

SEQ ID NO: 1182416 - protein, 9 aa, Homo Sapiens
MKKVADGHF

SEQ ID NO: 1182417 - protein, 9 aa, Homo Sapiens
SLERYLDGL

SEQ ID NO: 1182418 - protein, 9 aa, Homo Sapiens
FRSDILDLC

SEQ ID NO: 1182419 - protein, 9 aa, Homo Sapiens
PLPMGPSHP

SEQ ID NO: 1182420 - protein, 9 aa, Homo Sapiens
LALSPAPQQ

SEQ ID NO: 1182421 - protein, 9 aa, Homo Sapiens
QPQAPFPAP

SEQ ID NO: 1182422 - protein, 9 aa, Homo Sapiens
CWRSPTHLF

SEQ ID NO: 1182423 - protein, 9 aa, Homo Sapiens
TLSYDGPLR

SEQ ID NO: 1182424 - protein, 9 aa, Homo Sapiens
SWLSAKCQI

SEQ ID NO: 1182425 - protein, 9 aa, Homo Sapiens
AATCFKRAV

SEQ ID NO: 1182426 - protein, 9 aa, Homo Sapiens
LHVAPMGEA

SEQ ID NO: 1182427 - protein, 9 aa, Homo Sapiens
EWQDVHQRC

SEQ ID NO: 1182428 - protein, 9 aa, Homo Sapiens
FACCSLATC

SEQ ID NO: 1182429 - protein, 9 aa, Homo Sapiens
ASSCSLASP

SEQ ID NO: 1182430 - protein, 9 aa, Homo Sapiens
RVVRNNLCV

SEQ ID NO: 1182431 - protein, 9 aa, Homo Sapiens
PPHRCFLIS

SEQ ID NO: 1182432 - protein, 9 aa, Homo Sapiens
RSSSGHSST

SEQ ID NO: 1182433 - protein, 9 aa, Homo Sapiens
LQGQRNPTT

SEQ ID NO: 1182434 - protein, 9 aa, Homo Sapiens
CPKYLTYDP

SEQ ID NO: 1182435 - protein, 9 aa, Homo Sapiens
TDKKPYTCE

SEQ ID NO: 1182436 - protein, 9 aa, Homo Sapiens
TWKLWPPSS

SEQ ID NO: 1182437 - protein, 9 aa, Homo Sapiens
PPGGHPAPQ

SEQ ID NO: 1182438 - protein, 9 aa, Homo Sapiens
SLRVGSGYR

SEQ ID NO: 1182439 - protein, 9 aa, Homo Sapiens
FCTIQYRLR

SEQ ID NO: 1182440 - protein, 9 aa, Homo Sapiens
YTGAVKVGT

SEQ ID NO: 1182441 - protein, 9 aa, Homo Sapiens
VIPSLGRQT

SEQ ID NO: 1182442 - protein, 9 aa, Homo Sapiens
KRKADTPTP

SEQ ID NO: 1182443 - protein, 9 aa, Homo Sapiens
PQDASCTRI

SEQ ID NO: 1182444 - protein, 9 aa, Homo Sapiens
PTSQPKSKP

SEQ ID NO: 1182445 - protein, 9 aa, Homo Sapiens
LDFLGSCWW

SEQ ID NO: 1182446 - protein, 9 aa, Homo Sapiens
TNALTLAQW

SEQ ID NO: 1182447 - protein, 9 aa, Homo Sapiens
RRSPRSCSP

SEQ ID NO: 1182448 - protein, 9 aa, Homo Sapiens
PSLRCLGLW

SEQ ID NO: 1182449 - protein, 9 aa, Homo Sapiens
PQPPPALPS

SEQ ID NO: 1182450 - protein, 9 aa, Homo Sapiens
AGGGRNFPD

SEQ ID NO: 1182451 - protein, 9 aa, Homo Sapiens
RPIRTGPSL

SEQ ID NO: 1182452 - protein, 9 aa, Homo Sapiens
GTIEVGTGA

SEQ ID NO: 1182453 - protein, 9 aa, Homo Sapiens
SPQSHRPPR

SEQ ID NO: 1182454 - protein, 9 aa, Homo Sapiens
VNILQELGA

SEQ ID NO: 1182455 - protein, 9 aa, Homo Sapiens
QDQESSEGE

SEQ ID NO: 1182456 - protein, 9 aa, Homo Sapiens
CTPRRRLRR

SEQ ID NO: 1182457 - protein, 9 aa, Homo Sapiens
PSWSAAPTS

SEQ ID NO: 1182458 - protein, 9 aa, Homo Sapiens
LLRSQIEKH

SEQ ID NO: 1182459 - protein, 9 aa, Homo Sapiens
ACSSTSFMV

SEQ ID NO: 1182460 - protein, 9 aa, Homo Sapiens
SVLLLGVPQ

SEQ ID NO: 1182461 - protein, 9 aa, Homo Sapiens
PQWGATWSS

SEQ ID NO: 1182462 - protein, 9 aa, Homo Sapiens
ARVTCVPRW

SEQ ID NO: 1182463 - protein, 9 aa, Homo Sapiens
YECNTRRKT

SEQ ID NO: 1182464 - protein, 9 aa, Homo Sapiens
MTKRLTVPY

SEQ ID NO: 1182465 - protein, 9 aa, Homo Sapiens
NPVRSWDLR

SEQ ID NO: 1182466 - protein, 9 aa, Homo Sapiens
RQPQEGAAQ

SEQ ID NO: 1182467 - protein, 9 aa, Homo Sapiens
KGNCTNKED

SEQ ID NO: 1182468 - protein, 9 aa, Homo Sapiens
TLLGALHRL

SEQ ID NO: 1182469 - protein, 9 aa, Homo Sapiens
VPLASEEQR

SEQ ID NO: 1182470 - protein, 9 aa, Homo Sapiens
PRPGHRSAS

SEQ ID NO: 1182471 - protein, 9 aa, Homo Sapiens
GSFSVRLFV

SEQ ID NO: 1182472 - protein, 9 aa, Homo Sapiens
KKVGLLSHL

SEQ ID NO: 1182473 - protein, 9 aa, Homo Sapiens
LTITDQITL

SEQ ID NO: 1182474 - protein, 9 aa, Homo Sapiens
SWVSGKTDI

SEQ ID NO: 1182475 - protein, 9 aa, Homo Sapiens
TCNPELNVW

SEQ ID NO: 1182476 - protein, 9 aa, Homo Sapiens
MKLRSWLRR

SEQ ID NO: 1182477 - protein, 9 aa, Homo Sapiens
EVDDEGDRM

SEQ ID NO: 1182478 - protein, 9 aa, Homo Sapiens
QIFNGLYSG

SEQ ID NO: 1182479 - protein, 9 aa, Homo Sapiens
SSWPRWTMA

SEQ ID NO: 1182480 - protein, 9 aa, Homo Sapiens
CDKVFSQTS

SEQ ID NO: 1182481 - protein, 9 aa, Homo Sapiens
PGRILRALW

SEQ ID NO: 1182482 - protein, 9 aa, Homo Sapiens
SEVINWNQV

SEQ ID NO: 1182483 - protein, 9 aa, Homo Sapiens
LPAGSAADP

SEQ ID NO: 1182484 - protein, 9 aa, Homo Sapiens
CSQCTGPLG

SEQ ID NO: 1182485 - protein, 9 aa, Homo Sapiens
RWGAWHPGS

SEQ ID NO: 1182486 - protein, 9 aa, Homo Sapiens
MTDEKKREK

SEQ ID NO: 1182487 - protein, 9 aa, Homo Sapiens
SSPQPWWWR

SEQ ID NO: 1182488 - protein, 9 aa, Homo Sapiens
HTTHCTFVD

SEQ ID NO: 1182489 - protein, 9 aa, Homo Sapiens
GGVRWGWFP

SEQ ID NO: 1182490 - protein, 9 aa, Homo Sapiens
VMCLARHSL

SEQ ID NO: 1182491 - protein, 9 aa, Homo Sapiens
SRGPLASGQ

SEQ ID NO: 1182492 - protein, 9 aa, Homo Sapiens
GPRTRAANV

SEQ ID NO: 1182493 - protein, 9 aa, Homo Sapiens
RRPGPKEAI

SEQ ID NO: 1182494 - protein, 9 aa, Homo Sapiens
IHLDPLPSA

SEQ ID NO: 1182495 - protein, 9 aa, Homo Sapiens
KHLINPVKR

SEQ ID NO: 1182496 - protein, 9 aa, Homo Sapiens
TSTTSSGPA

SEQ ID NO: 1182497 - protein, 9 aa, Homo Sapiens
FQWRNMNTV

SEQ ID NO: 1182498 - protein, 9 aa, Homo Sapiens
ALRERGPPS

SEQ ID NO: 1182499 - protein, 9 aa, Homo Sapiens
MAASVMVLG

SEQ ID NO: 1182500 - protein, 9 aa, Homo Sapiens
QGIPGRYLT

SEQ ID NO: 1182501 - protein, 9 aa, Homo Sapiens
VQPVTKAGR

SEQ ID NO: 1182502 - protein, 9 aa, Homo Sapiens
PAASRDSFK

SEQ ID NO: 1182503 - protein, 9 aa, Homo Sapiens
PRAGRQAWG

SEQ ID NO: 1182504 - protein, 9 aa, Homo Sapiens
RISSSSHPS

SEQ ID NO: 1182505 - protein, 9 aa, Homo Sapiens
SRAGTTTPS

SEQ ID NO: 1182506 - protein, 9 aa, Homo Sapiens
PPAQPHLQP

SEQ ID NO: 1182507 - protein, 9 aa, Homo Sapiens
VLPEEMVDN

SEQ ID NO: 1182508 - protein, 9 aa, Homo Sapiens
EKALSALFI

SEQ ID NO: 1182509 - protein, 9 aa, Homo Sapiens
VAFFFSGWI

SEQ ID NO: 1182510 - protein, 9 aa, Homo Sapiens
IQPGGWFEV

SEQ ID NO: 1182511 - protein, 9 aa, Homo Sapiens
TKAGRQPRH

SEQ ID NO: 1182512 - protein, 9 aa, Homo Sapiens
GGNKYQTTD

SEQ ID NO: 1182513 - protein, 9 aa, Homo Sapiens
DPPAPTQQL

SEQ ID NO: 1182514 - protein, 9 aa, Homo Sapiens
KKELTENIN

SEQ ID NO: 1182515 - protein, 9 aa, Homo Sapiens
QAVGFQVHL

SEQ ID NO: 1182516 - protein, 9 aa, Homo Sapiens
VICQNLRGD

SEQ ID NO: 1182517 - protein, 9 aa, Homo Sapiens
KASRATLAR

SEQ ID NO: 1182518 - protein, 9 aa, Homo Sapiens
RLPISGSPM

SEQ ID NO: 1182519 - protein, 9 aa, Homo Sapiens
RPRAWGLLR

SEQ ID NO: 1182520 - protein, 9 aa, Homo Sapiens
KKTQSLMIA

SEQ ID NO: 1182521 - protein, 9 aa, Homo Sapiens
AEEQSQVEL

SEQ ID NO: 1182522 - protein, 9 aa, Homo Sapiens
HVLVGCDGG

SEQ ID NO: 1182523 - protein, 9 aa, Homo Sapiens
FQAPPSCLR

SEQ ID NO: 1182524 - protein, 9 aa, Homo Sapiens
LSLLFFWRP

SEQ ID NO: 1182525 - protein, 9 aa, Homo Sapiens
VTTNIHLHS

SEQ ID NO: 1182526 - protein, 9 aa, Homo Sapiens
PTLSTLQQR

SEQ ID NO: 1182527 - protein, 9 aa, Homo Sapiens
DFHVPQILQ

SEQ ID NO: 1182528 - protein, 9 aa, Homo Sapiens
LRRWRFKTA

SEQ ID NO: 1182529 - protein, 9 aa, Homo Sapiens
FKTNEEKRQ

SEQ ID NO: 1182530 - protein, 9 aa, Homo Sapiens
PAPAPKMCA

SEQ ID NO: 1182531 - protein, 9 aa, Homo Sapiens
PKCPHIAQV

SEQ ID NO: 1182532 - protein, 9 aa, Homo Sapiens
EFQDTTGDI

SEQ ID NO: 1182533 - protein, 9 aa, Homo Sapiens
HQRIHTDKK

SEQ ID NO: 1182534 - protein, 9 aa, Homo Sapiens
KYYHWAMSF

SEQ ID NO: 1182535 - protein, 9 aa, Homo Sapiens
GPSWTWGRA

SEQ ID NO: 1182536 - protein, 9 aa, Homo Sapiens
YCQPLLWKV

SEQ ID NO: 1182537 - protein, 9 aa, Homo Sapiens
EQRFWKKRR

SEQ ID NO: 1182538 - protein, 9 aa, Homo Sapiens
FTFSKAKLV

SEQ ID NO: 1182539 - protein, 9 aa, Homo Sapiens
AQANPPPPP

SEQ ID NO: 1182540 - protein, 9 aa, Homo Sapiens
SNATTQSPL

SEQ ID NO: 1182541 - protein, 9 aa, Homo Sapiens
RHRTDEVEV

SEQ ID NO: 1182542 - protein, 9 aa, Homo Sapiens
RGLLCPALH

SEQ ID NO: 1182543 - protein, 9 aa, Homo Sapiens
YMDGQIPCL

SEQ ID NO: 1182544 - protein, 9 aa, Homo Sapiens
SPRAAESGT

SEQ ID NO: 1182545 - protein, 9 aa, Homo Sapiens
VQSIHGVRH

SEQ ID NO: 1182546 - protein, 9 aa, Homo Sapiens
PELRPSVDH

SEQ ID NO: 1182547 - protein, 9 aa, Homo Sapiens
FNLRADQEL

SEQ ID NO: 1182548 - protein, 9 aa, Homo Sapiens
KEMDEEGNL

SEQ ID NO: 1182549 - protein, 9 aa, Homo Sapiens
HGPVVRPGG

SEQ ID NO: 1182550 - protein, 9 aa, Homo Sapiens
LCSMRKGSL

SEQ ID NO: 1182551 - protein, 9 aa, Homo Sapiens
PNDGLTRNY

SEQ ID NO: 1182552 - protein, 9 aa, Homo Sapiens
CGCSGVAPE

SEQ ID NO: 1182553 - protein, 9 aa, Homo Sapiens
LIFFSIASG

SEQ ID NO: 1182554 - protein, 9 aa, Homo Sapiens
TGFLLLSTW

SEQ ID NO: 1182555 - protein, 9 aa, Homo Sapiens
SKYTCPTSN

SEQ ID NO: 1182556 - protein, 9 aa, Homo Sapiens
VDFSIHFNR

SEQ ID NO: 1182557 - protein, 9 aa, Homo Sapiens
PNHTGCHPT

SEQ ID NO: 1182558 - protein, 9 aa, Homo Sapiens
SGWISGSEA

SEQ ID NO: 1182559 - protein, 9 aa, Homo Sapiens
VWPNLTSQE

SEQ ID NO: 1182560 - protein, 9 aa, Homo Sapiens
SARWCLGRC

SEQ ID NO: 1182561 - protein, 9 aa, Homo Sapiens
SSEGEEGEE

SEQ ID NO: 1182562 - protein, 9 aa, Homo Sapiens
TELPGKMNQ

SEQ ID NO: 1182563 - protein, 9 aa, Homo Sapiens
QHEAEAGGG

SEQ ID NO: 1182564 - protein, 9 aa, Homo Sapiens
HCSWQPLRQ

SEQ ID NO: 1182565 - protein, 9 aa, Homo Sapiens
NNVVSENEA

SEQ ID NO: 1182566 - protein, 9 aa, Homo Sapiens
QAIDGAEPS

SEQ ID NO: 1182567 - protein, 9 aa, Homo Sapiens
LSDLQNAAT

SEQ ID NO: 1182568 - protein, 9 aa, Homo Sapiens
VRLVHLEYG

SEQ ID NO: 1182569 - protein, 9 aa, Homo Sapiens
DNNDRTPLL

SEQ ID NO: 1182570 - protein, 9 aa, Homo Sapiens
NEDVCFIVL

SEQ ID NO: 1182571 - protein, 9 aa, Homo Sapiens
GTGFFRDIS

SEQ ID NO: 1182572 - protein, 9 aa, Homo Sapiens
GSGGGRGPG

SEQ ID NO: 1182573 - protein, 9 aa, Homo Sapiens
AAPKKKCIQ

SEQ ID NO: 1182574 - protein, 9 aa, Homo Sapiens
DKGLKKMTL

SEQ ID NO: 1182575 - protein, 9 aa, Homo Sapiens
DITTKESLT

SEQ ID NO: 1182576 - protein, 9 aa, Homo Sapiens
FLLSLFPRA

SEQ ID NO: 1182577 - protein, 9 aa, Homo Sapiens
YYSCVGLSR

SEQ ID NO: 1182578 - protein, 9 aa, Homo Sapiens
HHGGRQLRV

SEQ ID NO: 1182579 - protein, 9 aa, Homo Sapiens
NAFMLYRKE

SEQ ID NO: 1182580 - protein, 9 aa, Homo Sapiens
ALLTMWTCM

SEQ ID NO: 1182581 - protein, 9 aa, Homo Sapiens
TAFSDAAFN

SEQ ID NO: 1182582 - protein, 9 aa, Homo Sapiens
PSQDPCTAL

SEQ ID NO: 1182583 - protein, 9 aa, Homo Sapiens
SRILNLQVL

SEQ ID NO: 1182584 - protein, 9 aa, Homo Sapiens
PGAHYQQPG

SEQ ID NO: 1182585 - protein, 9 aa, Homo Sapiens
VSIAVIKGM

SEQ ID NO: 1182586 - protein, 9 aa, Homo Sapiens
TALARPRWS

SEQ ID NO: 1182587 - protein, 9 aa, Homo Sapiens
GASWVSGKT

SEQ ID NO: 1182588 - protein, 9 aa, Homo Sapiens
TPEEFLQLW

SEQ ID NO: 1182589 - protein, 9 aa, Homo Sapiens
FSLLLLRPT

SEQ ID NO: 1182590 - protein, 9 aa, Homo Sapiens
PVTTVLTRV

SEQ ID NO: 1182591 - protein, 9 aa, Homo Sapiens
QQRYEDLVL

SEQ ID NO: 1182592 - protein, 9 aa, Homo Sapiens
EQQLKDSSK

SEQ ID NO: 1182593 - protein, 9 aa, Homo Sapiens
RAPWPSSAG

SEQ ID NO: 1182594 - protein, 9 aa, Homo Sapiens
KILRSFMKL

SEQ ID NO: 1182595 - protein, 9 aa, Homo Sapiens
SNSSSSCLS

SEQ ID NO: 1182596 - protein, 9 aa, Homo Sapiens
GVSDPDTKG

SEQ ID NO: 1182597 - protein, 9 aa, Homo Sapiens
GSRETMGTL

SEQ ID NO: 1182598 - protein, 9 aa, Homo Sapiens
PPMLEDVCR

SEQ ID NO: 1182599 - protein, 9 aa, Homo Sapiens
GTPSWRPPW

SEQ ID NO: 1182600 - protein, 9 aa, Homo Sapiens
LGRGSTCFF

SEQ ID NO: 1182601 - protein, 9 aa, Homo Sapiens
MLHLKRFVY

SEQ ID NO: 1182602 - protein, 9 aa, Homo Sapiens
VDWWALGVF

SEQ ID NO: 1182603 - protein, 9 aa, Homo Sapiens
TSDSWLCLK

SEQ ID NO: 1182604 - protein, 9 aa, Homo Sapiens
APGSEPQGP

SEQ ID NO: 1182605 - protein, 9 aa, Homo Sapiens
AREEQVPQA

SEQ ID NO: 1182606 - protein, 9 aa, Homo Sapiens
SEMLDITTK

SEQ ID NO: 1182607 - protein, 9 aa, Homo Sapiens
KVVPKPIVA

SEQ ID NO: 1182608 - protein, 9 aa, Homo Sapiens
ISFPCSKIL

SEQ ID NO: 1182609 - protein, 9 aa, Homo Sapiens
AALVAQVAA

SEQ ID NO: 1182610 - protein, 9 aa, Homo Sapiens
KSSSFWSLS

SEQ ID NO: 1182611 - protein, 9 aa, Homo Sapiens
TDEKKREKV

SEQ ID NO: 1182612 - protein, 9 aa, Homo Sapiens
ETGLVAAAA

SEQ ID NO: 1182613 - protein, 9 aa, Homo Sapiens
APPPREHPA

SEQ ID NO: 1182614 - protein, 9 aa, Homo Sapiens
KLVGRAVRR

SEQ ID NO: 1182615 - protein, 9 aa, Homo Sapiens
PPGRGLPLT

SEQ ID NO: 1182616 - protein, 9 aa, Homo Sapiens
RSTCARLWM

SEQ ID NO: 1182617 - protein, 9 aa, Homo Sapiens
MVHQARVLA

SEQ ID NO: 1182618 - protein, 9 aa, Homo Sapiens
YCHTQLLIH

SEQ ID NO: 1182619 - protein, 9 aa, Homo Sapiens
SFAMEKTPP

SEQ ID NO: 1182620 - protein, 9 aa, Homo Sapiens
PHRWTAHRE

SEQ ID NO: 1182621 - protein, 9 aa, Homo Sapiens
AREMALRAS

SEQ ID NO: 1182622 - protein, 9 aa, Homo Sapiens
VTTVLTRVE

SEQ ID NO: 1182623 - protein, 9 aa, Homo Sapiens
ALHHKDSAL

SEQ ID NO: 1182624 - protein, 9 aa, Homo Sapiens
PGAWKQAWL

SEQ ID NO: 1182625 - protein, 9 aa, Homo Sapiens
NRDPLPPLR

SEQ ID NO: 1182626 - protein, 9 aa, Homo Sapiens
TLVRLKAVD

SEQ ID NO: 1182627 - protein, 9 aa, Homo Sapiens
RKKVGLLSH

SEQ ID NO: 1182628 - protein, 9 aa, Homo Sapiens
SGRRLGGEQ

SEQ ID NO: 1182629 - protein, 9 aa, Homo Sapiens
LLHSSRFSR

SEQ ID NO: 1182630 - protein, 9 aa, Homo Sapiens
VLKKILRSF

SEQ ID NO: 1182631 - protein, 9 aa, Homo Sapiens
ILVSVPKKI

SEQ ID NO: 1182632 - protein, 9 aa, Homo Sapiens
PNRMCAYVR

SEQ ID NO: 1182633 - protein, 9 aa, Homo Sapiens
EVGNLNLAW

SEQ ID NO: 1182634 - protein, 9 aa, Homo Sapiens
KEWNNLGTG

SEQ ID NO: 1182635 - protein, 9 aa, Homo Sapiens
TIMSPSLFN

SEQ ID NO: 1182636 - protein, 9 aa, Homo Sapiens
GPSPCNRSS

SEQ ID NO: 1182637 - protein, 9 aa, Homo Sapiens
DLGYQNGIK

SEQ ID NO: 1182638 - protein, 9 aa, Homo Sapiens
FEESNTMHA

SEQ ID NO: 1182639 - protein, 9 aa, Homo Sapiens
AGEGAALAF

SEQ ID NO: 1182640 - protein, 9 aa, Homo Sapiens
AGAAAPAGP

SEQ ID NO: 1182641 - protein, 9 aa, Homo Sapiens
DVLSSDGWL

SEQ ID NO: 1182642 - protein, 9 aa, Homo Sapiens
MFFLMFINL

SEQ ID NO: 1182643 - protein, 9 aa, Homo Sapiens
GCSSASARC

SEQ ID NO: 1182644 - protein, 9 aa, Homo Sapiens
RLLELPTTE

SEQ ID NO: 1182645 - protein, 9 aa, Homo Sapiens
PKRVALLTM

SEQ ID NO: 1182646 - protein, 9 aa, Homo Sapiens
YHYFLEETG

SEQ ID NO: 1182647 - protein, 9 aa, Homo Sapiens
LVWVPTVMP

SEQ ID NO: 1182648 - protein, 9 aa, Homo Sapiens
LSGRKAPRV

SEQ ID NO: 1182649 - protein, 9 aa, Homo Sapiens
GGPWDWFPP

SEQ ID NO: 1182650 - protein, 9 aa, Homo Sapiens
QAAFASRVI

SEQ ID NO: 1182651 - protein, 9 aa, Homo Sapiens
KKENTIRIV

SEQ ID NO: 1182652 - protein, 9 aa, Homo Sapiens
LPAPRPTHP

SEQ ID NO: 1182653 - protein, 9 aa, Homo Sapiens
NWSVTLSCI

SEQ ID NO: 1182654 - protein, 9 aa, Homo Sapiens
SAAAAAAAE

SEQ ID NO: 1182655 - protein, 9 aa, Homo Sapiens
REHVLVGCD

SEQ ID NO: 1182656 - protein, 9 aa, Homo Sapiens
PGPQCPSGC

SEQ ID NO: 1182657 - protein, 9 aa, Homo Sapiens
RSAIIHKAA

SEQ ID NO: 1182658 - protein, 9 aa, Homo Sapiens
PSARRSPSW

SEQ ID NO: 1182659 - protein, 9 aa, Homo Sapiens
STISQNHTP

SEQ ID NO: 1182660 - protein, 9 aa, Homo Sapiens
PQYCDTKSG

SEQ ID NO: 1182661 - protein, 9 aa, Homo Sapiens
KGSLQCECE

SEQ ID NO: 1182662 - protein, 9 aa, Homo Sapiens
RPASGHHPP

SEQ ID NO: 1182663 - protein, 9 aa, Homo Sapiens
CPSCRSLAM

SEQ ID NO: 1182664 - protein, 9 aa, Homo Sapiens
TGPPTSCSA

SEQ ID NO: 1182665 - protein, 9 aa, Homo Sapiens
CTPRESAAA

SEQ ID NO: 1182666 - protein, 9 aa, Homo Sapiens
PRAPGCSLR

SEQ ID NO: 1182667 - protein, 9 aa, Homo Sapiens
IYKQSQHTT

SEQ ID NO: 1182668 - protein, 9 aa, Homo Sapiens
ASGKWECTV

SEQ ID NO: 1182669 - protein, 9 aa, Homo Sapiens
QKYFVVINI

SEQ ID NO: 1182670 - protein, 9 aa, Homo Sapiens
RASAGAVRP

SEQ ID NO: 1182671 - protein, 9 aa, Homo Sapiens
LSTATSTLS

SEQ ID NO: 1182672 - protein, 9 aa, Homo Sapiens
VCQCVEEIE

SEQ ID NO: 1182673 - protein, 9 aa, Homo Sapiens
HRSASPGPK

SEQ ID NO: 1182674 - protein, 9 aa, Homo Sapiens
GSVMSCSLL

SEQ ID NO: 1182675 - protein, 9 aa, Homo Sapiens
PGSPADRVR

SEQ ID NO: 1182676 - protein, 9 aa, Homo Sapiens
HSSMTPNTP

SEQ ID NO: 1182677 - protein, 9 aa, Homo Sapiens
SGQVRGPPI

SEQ ID NO: 1182678 - protein, 9 aa, Homo Sapiens
LFCTIQYRL

SEQ ID NO: 1182679 - protein, 9 aa, Homo Sapiens
GGAPDALWT

SEQ ID NO: 1182680 - protein, 9 aa, Homo Sapiens
QHSFLVPSP

SEQ ID NO: 1182681 - protein, 9 aa, Homo Sapiens
HHQQRLSGN

SEQ ID NO: 1182682 - protein, 9 aa, Homo Sapiens
QKAFEYGAK

SEQ ID NO: 1182683 - protein, 9 aa, Homo Sapiens
NRTRTTPAD

SEQ ID NO: 1182684 - protein, 9 aa, Homo Sapiens
LTQSHRPLT

SEQ ID NO: 1182685 - protein, 9 aa, Homo Sapiens
EIQSVKVEE

SEQ ID NO: 1182686 - protein, 9 aa, Homo Sapiens
VSTIINICP

SEQ ID NO: 1182687 - protein, 9 aa, Homo Sapiens
LQVEIEPVS

SEQ ID NO: 1182688 - protein, 9 aa, Homo Sapiens
PTGHLGGAG

SEQ ID NO: 1182689 - protein, 9 aa, Homo Sapiens
KATPPVSVS

SEQ ID NO: 1182690 - protein, 9 aa, Homo Sapiens
RPPPAAPTG

SEQ ID NO: 1182691 - protein, 9 aa, Homo Sapiens
RATCWLCTA

SEQ ID NO: 1182692 - protein, 9 aa, Homo Sapiens
NKAGDGVGQ

SEQ ID NO: 1182693 - protein, 9 aa, Homo Sapiens
GVWSQVAVQ

SEQ ID NO: 1182694 - protein, 9 aa, Homo Sapiens
GHCLASPSP

SEQ ID NO: 1182695 - protein, 9 aa, Homo Sapiens
PLSNATTQS

SEQ ID NO: 1182696 - protein, 9 aa, Homo Sapiens
PVWMSLLER

SEQ ID NO: 1182697 - protein, 9 aa, Homo Sapiens
TSGGPLSPK

SEQ ID NO: 1182698 - protein, 9 aa, Homo Sapiens
KAKPSAAGA

SEQ ID NO: 1182699 - protein, 9 aa, Homo Sapiens
RKSLEKAQS

SEQ ID NO: 1182700 - protein, 9 aa, Homo Sapiens
CPPLPWTSL

SEQ ID NO: 1182701 - protein, 9 aa, Homo Sapiens
HQWRTQDHN

SEQ ID NO: 1182702 - protein, 9 aa, Homo Sapiens
LWASSSSSC

SEQ ID NO: 1182703 - protein, 9 aa, Homo Sapiens
SPRRSSGSV

SEQ ID NO: 1182704 - protein, 9 aa, Homo Sapiens
LEQCMTSKH

SEQ ID NO: 1182705 - protein, 9 aa, Homo Sapiens
GPLPMGPSH

SEQ ID NO: 1182706 - protein, 9 aa, Homo Sapiens
SHRPRCWYF

SEQ ID NO: 1182707 - protein, 9 aa, Homo Sapiens
CVPRWCSSR

SEQ ID NO: 1182708 - protein, 9 aa, Homo Sapiens
QWPWCLFIG

SEQ ID NO: 1182709 - protein, 9 aa, Homo Sapiens
RFRPPIVRV

SEQ ID NO: 1182710 - protein, 9 aa, Homo Sapiens
SVLAGAWQG

SEQ ID NO: 1182711 - protein, 9 aa, Homo Sapiens
GPPARPPPT

SEQ ID NO: 1182712 - protein, 9 aa, Homo Sapiens
NRIILVPMR

SEQ ID NO: 1182713 - protein, 9 aa, Homo Sapiens
ENCVYDSVQ

SEQ ID NO: 1182714 - protein, 9 aa, Homo Sapiens
PPAKPSSVT

SEQ ID NO: 1182715 - protein, 9 aa, Homo Sapiens
RLSAASPCS

SEQ ID NO: 1182716 - protein, 9 aa, Homo Sapiens
TFSAVVPAA

SEQ ID NO: 1182717 - protein, 9 aa, Homo Sapiens
APQAWSTLW

SEQ ID NO: 1182718 - protein, 9 aa, Homo Sapiens
NLEKNSGSQ

SEQ ID NO: 1182719 - protein, 9 aa, Homo Sapiens
VATPLFPRY

SEQ ID NO: 1182720 - protein, 9 aa, Homo Sapiens
FPPAASRDS

SEQ ID NO: 1182721 - protein, 9 aa, Homo Sapiens
SSPTRKNRT

SEQ ID NO: 1182722 - protein, 9 aa, Homo Sapiens
GLLTRPPPA

SEQ ID NO: 1182723 - protein, 9 aa, Homo Sapiens
EMCLGLPLL

SEQ ID NO: 1182724 - protein, 9 aa, Homo Sapiens
GLGSGHLRP

SEQ ID NO: 1182725 - protein, 9 aa, Homo Sapiens
RADPGGRCP

SEQ ID NO: 1182726 - protein, 9 aa, Homo Sapiens
RDLPYHSNL

SEQ ID NO: 1182727 - protein, 9 aa, Homo Sapiens
QPQEGAAQL

SEQ ID NO: 1182728 - protein, 9 aa, Homo Sapiens
RRFEYDGPR

SEQ ID NO: 1182729 - protein, 9 aa, Homo Sapiens
HAAVASLSV

SEQ ID NO: 1182730 - protein, 9 aa, Homo Sapiens
GQRDGGRGA

SEQ ID NO: 1182731 - protein, 9 aa, Homo Sapiens
LVRTGFLLL

SEQ ID NO: 1182732 - protein, 9 aa, Homo Sapiens
LPALKIWEE

SEQ ID NO: 1182733 - protein, 9 aa, Homo Sapiens
VALGSRCDR

SEQ ID NO: 1182734 - protein, 9 aa, Homo Sapiens
SLLFFWRPP

SEQ ID NO: 1182735 - protein, 9 aa, Homo Sapiens
PVASRELKA

SEQ ID NO: 1182736 - protein, 9 aa, Homo Sapiens
HPEDQDKMT

SEQ ID NO: 1182737 - protein, 9 aa, Homo Sapiens
IMLRNDLLT

SEQ ID NO: 1182738 - protein, 9 aa, Homo Sapiens
TQLKTKERM

SEQ ID NO: 1182739 - protein, 9 aa, Homo Sapiens
VPDVGIGTV

SEQ ID NO: 1182740 - protein, 9 aa, Homo Sapiens
ADTSSVSTA

SEQ ID NO: 1182741 - protein, 9 aa, Homo Sapiens
ALSPAGQRG

SEQ ID NO: 1182742 - protein, 9 aa, Homo Sapiens
KPPRGASTR

SEQ ID NO: 1182743 - protein, 9 aa, Homo Sapiens
VLYVMCLAR

SEQ ID NO: 1182744 - protein, 9 aa, Homo Sapiens
CSAGGDASC

SEQ ID NO: 1182745 - protein, 9 aa, Homo Sapiens
RGPRAPVRA

SEQ ID NO: 1182746 - protein, 9 aa, Homo Sapiens
PPPTATNAS

SEQ ID NO: 1182747 - protein, 9 aa, Homo Sapiens
TGTSEVTLE

SEQ ID NO: 1182748 - protein, 9 aa, Homo Sapiens
HGRCCMGLI

SEQ ID NO: 1182749 - protein, 9 aa, Homo Sapiens
GSDNTVAID

SEQ ID NO: 1182750 - protein, 9 aa, Homo Sapiens
VGVKHRLRG

SEQ ID NO: 1182751 - protein, 9 aa, Homo Sapiens
VALDSVETC

SEQ ID NO: 1182752 - protein, 9 aa, Homo Sapiens
GNPLSVELG

SEQ ID NO: 1182753 - protein, 9 aa, Homo Sapiens
VGRRGPDGV

SEQ ID NO: 1182754 - protein, 9 aa, Homo Sapiens
NGTWDKALD

SEQ ID NO: 1182755 - protein, 9 aa, Homo Sapiens
CGRPSTSRS

SEQ ID NO: 1182756 - protein, 9 aa, Homo Sapiens
LVAVCVLHL

SEQ ID NO: 1182757 - protein, 9 aa, Homo Sapiens
LPPCGGRPS

SEQ ID NO: 1182758 - protein, 9 aa, Homo Sapiens
YGPRAPGCS

SEQ ID NO: 1182759 - protein, 9 aa, Homo Sapiens
SSLLSPCNA

SEQ ID NO: 1182760 - protein, 9 aa, Homo Sapiens
ARIQPRARC

SEQ ID NO: 1182761 - protein, 9 aa, Homo Sapiens
KGLGWKWIH

SEQ ID NO: 1182762 - protein, 9 aa, Homo Sapiens
VCCMHLHEK

SEQ ID NO: 1182763 - protein, 9 aa, Homo Sapiens
CPHGAACPP

SEQ ID NO: 1182764 - protein, 9 aa, Homo Sapiens
DTVCKRGNL

SEQ ID NO: 1182765 - protein, 9 aa, Homo Sapiens
SLNGVCFKR

SEQ ID NO: 1182766 - protein, 9 aa, Homo Sapiens
YNLPPICIE

SEQ ID NO: 1182767 - protein, 9 aa, Homo Sapiens
ISSHSPRRS

SEQ ID NO: 1182768 - protein, 9 aa, Homo Sapiens
RPSNPWITD

SEQ ID NO: 1182769 - protein, 9 aa, Homo Sapiens
WGVDCPYQA

SEQ ID NO: 1182770 - protein, 9 aa, Homo Sapiens
QPRGSSSCS

SEQ ID NO: 1182771 - protein, 9 aa, Homo Sapiens
QWIIQCFWN

SEQ ID NO: 1182772 - protein, 9 aa, Homo Sapiens
VPKKIITWA

SEQ ID NO: 1182773 - protein, 9 aa, Homo Sapiens
EQKCNPICQ

SEQ ID NO: 1182774 - protein, 9 aa, Homo Sapiens
CAFLLWKKR

SEQ ID NO: 1182775 - protein, 9 aa, Homo Sapiens
RGSDNTVAI

SEQ ID NO: 1182776 - protein, 9 aa, Homo Sapiens
HDVGGRECR

SEQ ID NO: 1182777 - protein, 9 aa, Homo Sapiens
ASLLRAGGI

SEQ ID NO: 1182778 - protein, 9 aa, Homo Sapiens
SPVGVKHRL

SEQ ID NO: 1182779 - protein, 9 aa, Homo Sapiens
GERTEGSPM

SEQ ID NO: 1182780 - protein, 9 aa, Homo Sapiens
PQRPPRSIL

SEQ ID NO: 1182781 - protein, 9 aa, Homo Sapiens
NDLWSRISH

SEQ ID NO: 1182782 - protein, 9 aa, Homo Sapiens
TLLHTQSLE

SEQ ID NO: 1182783 - protein, 9 aa, Homo Sapiens
VVRVGKAFI

SEQ ID NO: 1182784 - protein, 9 aa, Homo Sapiens
GSGAAWHVV

SEQ ID NO: 1182785 - protein, 9 aa, Homo Sapiens
VGKAFIPGL

SEQ ID NO: 1182786 - protein, 9 aa, Homo Sapiens
LSPAGQRGR

SEQ ID NO: 1182787 - protein, 9 aa, Homo Sapiens
PRMANLSEC

SEQ ID NO: 1182788 - protein, 9 aa, Homo Sapiens
LGAAHDVGG

SEQ ID NO: 1182789 - protein, 9 aa, Homo Sapiens
FLTAVVQRT

SEQ ID NO: 1182790 - protein, 9 aa, Homo Sapiens
RVGPPLRGP

SEQ ID NO: 1182791 - protein, 9 aa, Homo Sapiens
FKFDMRVYI

SEQ ID NO: 1182792 - protein, 9 aa, Homo Sapiens
KQMKGVLDD

SEQ ID NO: 1182793 - protein, 9 aa, Homo Sapiens
AAPEPKCPH

SEQ ID NO: 1182794 - protein, 9 aa, Homo Sapiens
FQNRTDSNG

SEQ ID NO: 1182795 - protein, 9 aa, Homo Sapiens
RKVPTASQC

SEQ ID NO: 1182796 - protein, 9 aa, Homo Sapiens
VASLSVSIG

SEQ ID NO: 1182797 - protein, 9 aa, Homo Sapiens
AYIPPRPGG

SEQ ID NO: 1182798 - protein, 9 aa, Homo Sapiens
QCDCCGRSF

SEQ ID NO: 1182799 - protein, 9 aa, Homo Sapiens
QEKERRERA

SEQ ID NO: 1182800 - protein, 9 aa, Homo Sapiens
LLCYLNVIP

SEQ ID NO: 1182801 - protein, 9 aa, Homo Sapiens
GRLESSLRP

SEQ ID NO: 1182802 - protein, 9 aa, Homo Sapiens
RLIKIHEKV

SEQ ID NO: 1182803 - protein, 9 aa, Homo Sapiens
SAFQNEEYN

SEQ ID NO: 1182804 - protein, 9 aa, Homo Sapiens
LGHAQRVGE

SEQ ID NO: 1182805 - protein, 9 aa, Homo Sapiens
EAAGGQRDG

SEQ ID NO: 1182806 - protein, 9 aa, Homo Sapiens
HHGVFVGSA

SEQ ID NO: 1182807 - protein, 9 aa, Homo Sapiens
MHRKRWITE

SEQ ID NO: 1182808 - protein, 9 aa, Homo Sapiens
IHEFQDTTG

SEQ ID NO: 1182809 - protein, 9 aa, Homo Sapiens
PALGRIGKV

SEQ ID NO: 1182810 - protein, 9 aa, Homo Sapiens
AQDGQMTSS

SEQ ID NO: 1182811 - protein, 9 aa, Homo Sapiens
LGGEQRKRR

SEQ ID NO: 1182812 - protein, 9 aa, Homo Sapiens
PQCPSCMPS

SEQ ID NO: 1182813 - protein, 9 aa, Homo Sapiens
TDVKMMERM

SEQ ID NO: 1182814 - protein, 9 aa, Homo Sapiens
QEKKCRLFY

SEQ ID NO: 1182815 - protein, 9 aa, Homo Sapiens
SAILSLRQT

SEQ ID NO: 1182816 - protein, 9 aa, Homo Sapiens
SDILDLCQQ

SEQ ID NO: 1182817 - protein, 9 aa, Homo Sapiens
AAAPRGPEQ

SEQ ID NO: 1182818 - protein, 9 aa, Homo Sapiens
VRNNLCVRL

SEQ ID NO: 1182819 - protein, 9 aa, Homo Sapiens
PWWWRWGPS

SEQ ID NO: 1182820 - protein, 9 aa, Homo Sapiens
EEECEFYSS

SEQ ID NO: 1182821 - protein, 9 aa, Homo Sapiens
FMAAWPEWR

SEQ ID NO: 1182822 - protein, 9 aa, Homo Sapiens
VSTFDLVAI

SEQ ID NO: 1182823 - protein, 9 aa, Homo Sapiens
GMCQYGECL

SEQ ID NO: 1182824 - protein, 9 aa, Homo Sapiens
ILVPMRFFE

SEQ ID NO: 1182825 - protein, 9 aa, Homo Sapiens
LLNRIILVP

SEQ ID NO: 1182826 - protein, 9 aa, Homo Sapiens
NTELFQTLI

SEQ ID NO: 1182827 - protein, 9 aa, Homo Sapiens
ALGSETLAA

SEQ ID NO: 1182828 - protein, 9 aa, Homo Sapiens
DESLVLLRH

SEQ ID NO: 1182829 - protein, 9 aa, Homo Sapiens
RLCTHIKEV

SEQ ID NO: 1182830 - protein, 9 aa, Homo Sapiens
PAYLEHRDP

SEQ ID NO: 1182831 - protein, 9 aa, Homo Sapiens
RRATCWLCT

SEQ ID NO: 1182832 - protein, 9 aa, Homo Sapiens
FREKPNLPE

SEQ ID NO: 1182833 - protein, 9 aa, Homo Sapiens
PAAAGAAAP

SEQ ID NO: 1182834 - protein, 9 aa, Homo Sapiens
FPPGTAMPQ

SEQ ID NO: 1182835 - protein, 9 aa, Homo Sapiens
SLSWGKRSH

SEQ ID NO: 1182836 - protein, 9 aa, Homo Sapiens
TSCELGMVV

SEQ ID NO: 1182837 - protein, 9 aa, Homo Sapiens
DAVTKTHVM

SEQ ID NO: 1182838 - protein, 9 aa, Homo Sapiens
LVGTRKLLV

SEQ ID NO: 1182839 - protein, 9 aa, Homo Sapiens
AAPRTSTTS

SEQ ID NO: 1182840 - protein, 9 aa, Homo Sapiens
KWKVAFSEI

SEQ ID NO: 1182841 - protein, 9 aa, Homo Sapiens
NLSCKLHTF

SEQ ID NO: 1182842 - protein, 9 aa, Homo Sapiens
SKVERANTC

SEQ ID NO: 1182843 - protein, 9 aa, Homo Sapiens
SITAMLELS

SEQ ID NO: 1182844 - protein, 9 aa, Homo Sapiens
CSGLSVSVG

SEQ ID NO: 1182845 - protein, 9 aa, Homo Sapiens
SVDSFEWSN

SEQ ID NO: 1182846 - protein, 9 aa, Homo Sapiens
RREQEQREQ

SEQ ID NO: 1182847 - protein, 9 aa, Homo Sapiens
ITSTKTRKA

SEQ ID NO: 1182848 - protein, 9 aa, Homo Sapiens
YYRNHVSFS

SEQ ID NO: 1182849 - protein, 9 aa, Homo Sapiens
AKQLVSPEA

SEQ ID NO: 1182850 - protein, 9 aa, Homo Sapiens
TPPGSCGFT

SEQ ID NO: 1182851 - protein, 9 aa, Homo Sapiens
GSRACRGCQ

SEQ ID NO: 1182852 - protein, 9 aa, Homo Sapiens
TCSTTTAPA

SEQ ID NO: 1182853 - protein, 9 aa, Homo Sapiens
ECATVILHS

SEQ ID NO: 1182854 - protein, 9 aa, Homo Sapiens
LPPPAPCSW

SEQ ID NO: 1182855 - protein, 9 aa, Homo Sapiens
FTFPNIARA

SEQ ID NO: 1182856 - protein, 9 aa, Homo Sapiens
YKLWYLDPD

SEQ ID NO: 1182857 - protein, 9 aa, Homo Sapiens
ACLANHPHS

SEQ ID NO: 1182858 - protein, 9 aa, Homo Sapiens
GSYPPARQP

SEQ ID NO: 1182859 - protein, 9 aa, Homo Sapiens
TCRLFNLRA

SEQ ID NO: 1182860 - protein, 9 aa, Homo Sapiens
VVEEPQSRW

SEQ ID NO: 1182861 - protein, 9 aa, Homo Sapiens
AMAISPTGH

SEQ ID NO: 1182862 - protein, 9 aa, Homo Sapiens
ACRGCQGPG

SEQ ID NO: 1182863 - protein, 9 aa, Homo Sapiens
HPPPAKHSS

SEQ ID NO: 1182864 - protein, 9 aa, Homo Sapiens
SLMLICKSL

SEQ ID NO: 1182865 - protein, 9 aa, Homo Sapiens
WASNAMMNN

SEQ ID NO: 1182866 - protein, 9 aa, Homo Sapiens
LRFQRLVRD

SEQ ID NO: 1182867 - protein, 9 aa, Homo Sapiens
GVGEPRHCI

SEQ ID NO: 1182868 - protein, 9 aa, Homo Sapiens
RQSCCLPGL

SEQ ID NO: 1182869 - protein, 9 aa, Homo Sapiens
PVAGERALT

SEQ ID NO: 1182870 - protein, 9 aa, Homo Sapiens
PRTVVMQGV

SEQ ID NO: 1182871 - protein, 9 aa, Homo Sapiens
RGASFILSY

SEQ ID NO: 1182872 - protein, 9 aa, Homo Sapiens
GTLLSGDYH

SEQ ID NO: 1182873 - protein, 9 aa, Homo Sapiens
PRKVPTASQ

SEQ ID NO: 1182874 - protein, 9 aa, Homo Sapiens
SRPTSRARQ

SEQ ID NO: 1182875 - protein, 9 aa, Homo Sapiens
HTIVYLLSR

SEQ ID NO: 1182876 - protein, 9 aa, Homo Sapiens
SPATSASTQ

SEQ ID NO: 1182877 - protein, 9 aa, Homo Sapiens
AGGGVGEPR

SEQ ID NO: 1182878 - protein, 9 aa, Homo Sapiens
CNRSSSLFN

SEQ ID NO: 1182879 - protein, 9 aa, Homo Sapiens
PPVTPLRVQ

SEQ ID NO: 1182880 - protein, 9 aa, Homo Sapiens
RASLNPRKV

SEQ ID NO: 1182881 - protein, 9 aa, Homo Sapiens
VGFVDHEAE

SEQ ID NO: 1182882 - protein, 9 aa, Homo Sapiens
FNGLYSGHS

SEQ ID NO: 1182883 - protein, 9 aa, Homo Sapiens
TKKSPSRVS

SEQ ID NO: 1182884 - protein, 9 aa, Homo Sapiens
ERPDAPVPG

SEQ ID NO: 1182885 - protein, 9 aa, Homo Sapiens
FVTVAELPR

SEQ ID NO: 1182886 - protein, 9 aa, Homo Sapiens
NSGSQSGTK

SEQ ID NO: 1182887 - protein, 9 aa, Homo Sapiens
PEVNAGGRR

SEQ ID NO: 1182888 - protein, 9 aa, Homo Sapiens
AWLLEFPGR

SEQ ID NO: 1182889 - protein, 9 aa, Homo Sapiens
PADSSNSHE

SEQ ID NO: 1182890 - protein, 9 aa, Homo Sapiens
GSPADRVRQ

SEQ ID NO: 1182891 - protein, 9 aa, Homo Sapiens
QRERRERRR

SEQ ID NO: 1182892 - protein, 9 aa, Homo Sapiens
NRSWKVKWC

SEQ ID NO: 1182893 - protein, 9 aa, Homo Sapiens
HSEHMQHVV

SEQ ID NO: 1182894 - protein, 9 aa, Homo Sapiens
GGMVEGGVS

SEQ ID NO: 1182895 - protein, 9 aa, Homo Sapiens
WVRDMVRSM

SEQ ID NO: 1182896 - protein, 9 aa, Homo Sapiens
DQVNHKDAR

SEQ ID NO: 1182897 - protein, 9 aa, Homo Sapiens
QGPCPPPVT

SEQ ID NO: 1182898 - protein, 9 aa, Homo Sapiens
VRGPPILAP

SEQ ID NO: 1182899 - protein, 9 aa, Homo Sapiens
RLVIGFGAA

SEQ ID NO: 1182900 - protein, 9 aa, Homo Sapiens
VAAEACHER

SEQ ID NO: 1182901 - protein, 9 aa, Homo Sapiens
IWNINPHPS

SEQ ID NO: 1182902 - protein, 9 aa, Homo Sapiens
GTERGQGHI

SEQ ID NO: 1182903 - protein, 9 aa, Homo Sapiens
QMCHRHCCD

SEQ ID NO: 1182904 - protein, 9 aa, Homo Sapiens
AGHPCRCHR

SEQ ID NO: 1182905 - protein, 9 aa, Homo Sapiens
YDGRGGAHR

SEQ ID NO: 1182906 - protein, 9 aa, Homo Sapiens
PLPLKVIWP

SEQ ID NO: 1182907 - protein, 9 aa, Homo Sapiens
PNVHTWNQK

SEQ ID NO: 1182908 - protein, 9 aa, Homo Sapiens
WPTATWWAC

SEQ ID NO: 1182909 - protein, 9 aa, Homo Sapiens
KSTELPGKM

SEQ ID NO: 1182910 - protein, 9 aa, Homo Sapiens
IIASTTLPQ

SEQ ID NO: 1182911 - protein, 9 aa, Homo Sapiens
GWEPSQPQA

SEQ ID NO: 1182912 - protein, 9 aa, Homo Sapiens
SRCAPPATA

SEQ ID NO: 1182913 - protein, 9 aa, Homo Sapiens
YHIELLRRL

SEQ ID NO: 1182914 - protein, 9 aa, Homo Sapiens
GTGKQDSRG

SEQ ID NO: 1182915 - protein, 9 aa, Homo Sapiens
GSQSGYCSM

SEQ ID NO: 1182916 - protein, 9 aa, Homo Sapiens
RPDPALSLE

SEQ ID NO: 1182917 - protein, 9 aa, Homo Sapiens
IAFWQAFLR

SEQ ID NO: 1182918 - protein, 9 aa, Homo Sapiens
TREGPSSCE

SEQ ID NO: 1182919 - protein, 9 aa, Homo Sapiens
CDKSFKQRT

SEQ ID NO: 1182920 - protein, 9 aa, Homo Sapiens
PSRPSGRPR

SEQ ID NO: 1182921 - protein, 9 aa, Homo Sapiens
KEFLHLGLT

SEQ ID NO: 1182922 - protein, 9 aa, Homo Sapiens
GSLPGSAAR

SEQ ID NO: 1182923 - protein, 9 aa, Homo Sapiens
SGANRTPTP

SEQ ID NO: 1182924 - protein, 9 aa, Homo Sapiens
LLIEGHYVH

SEQ ID NO: 1182925 - protein, 9 aa, Homo Sapiens
CLTSTTPRA

SEQ ID NO: 1182926 - protein, 9 aa, Homo Sapiens
LKAWAQAEA

SEQ ID NO: 1182927 - protein, 9 aa, Homo Sapiens
SELPSDERF

SEQ ID NO: 1182928 - protein, 9 aa, Homo Sapiens
VVVGAPWKA

SEQ ID NO: 1182929 - protein, 9 aa, Homo Sapiens
APWASVTPP

SEQ ID NO: 1182930 - protein, 9 aa, Homo Sapiens
RATLARWAS

SEQ ID NO: 1182931 - protein, 9 aa, Homo Sapiens
QGACEQQKI

SEQ ID NO: 1182932 - protein, 9 aa, Homo Sapiens
KADTLKVVQ

SEQ ID NO: 1182933 - protein, 9 aa, Homo Sapiens
GSYKLTLME

SEQ ID NO: 1182934 - protein, 9 aa, Homo Sapiens
PRSTSPRPP

SEQ ID NO: 1182935 - protein, 9 aa, Homo Sapiens
SGPRYGHSR

SEQ ID NO: 1182936 - protein, 9 aa, Homo Sapiens
QAPRAMRPS

SEQ ID NO: 1182937 - protein, 9 aa, Homo Sapiens
TEMDEHNRS

SEQ ID NO: 1182938 - protein, 9 aa, Homo Sapiens
ALRRVDACQ

SEQ ID NO: 1182939 - protein, 9 aa, Homo Sapiens
GWSGDSACS

SEQ ID NO: 1182940 - protein, 9 aa, Homo Sapiens
ISASAMLLC

SEQ ID NO: 1182941 - protein, 9 aa, Homo Sapiens
SSACSAGGD

SEQ ID NO: 1182942 - protein, 9 aa, Homo Sapiens
ARGGAAAQA

SEQ ID NO: 1182943 - protein, 9 aa, Homo Sapiens
AMRPSGGMP

SEQ ID NO: 1182944 - protein, 9 aa, Homo Sapiens
KQDSRGSRE

SEQ ID NO: 1182945 - protein, 9 aa, Homo Sapiens
AVGNLRDVV

SEQ ID NO: 1182946 - protein, 9 aa, Homo Sapiens
HDCMPIAVL

SEQ ID NO: 1182947 - protein, 9 aa, Homo Sapiens
YTRMVLELK

SEQ ID NO: 1182948 - protein, 9 aa, Homo Sapiens
NSHRMVNTG

SEQ ID NO: 1182949 - protein, 9 aa, Homo Sapiens
WSPLPALSR

SEQ ID NO: 1182950 - protein, 9 aa, Homo Sapiens
LDNPVRSWD

SEQ ID NO: 1182951 - protein, 9 aa, Homo Sapiens
AAQKNIDWE

SEQ ID NO: 1182952 - protein, 9 aa, Homo Sapiens
SIPWTQIPQ

SEQ ID NO: 1182953 - protein, 9 aa, Homo Sapiens
WAILLHVQP

SEQ ID NO: 1182954 - protein, 9 aa, Homo Sapiens
EPPRPHASP

SEQ ID NO: 1182955 - protein, 9 aa, Homo Sapiens
AASAYAPPR

SEQ ID NO: 1182956 - protein, 9 aa, Homo Sapiens
LPLTLSALP

SEQ ID NO: 1182957 - protein, 9 aa, Homo Sapiens
CSSLSLRVG

SEQ ID NO: 1182958 - protein, 9 aa, Homo Sapiens
WMPSTKIRL

SEQ ID NO: 1182959 - protein, 9 aa, Homo Sapiens
ERSKKEDWG

SEQ ID NO: 1182960 - protein, 9 aa, Homo Sapiens
TRATNGAPS

SEQ ID NO: 1182961 - protein, 9 aa, Homo Sapiens
SDGWLSPAL

SEQ ID NO: 1182962 - protein, 9 aa, Homo Sapiens
MGPSHPGQW

SEQ ID NO: 1182963 - protein, 9 aa, Homo Sapiens
RTSASVKKD

SEQ ID NO: 1182964 - protein, 9 aa, Homo Sapiens
KHARTFVVF

SEQ ID NO: 1182965 - protein, 9 aa, Homo Sapiens
PPPTWSRTS

SEQ ID NO: 1182966 - protein, 9 aa, Homo Sapiens
GETAPWALV

SEQ ID NO: 1182967 - protein, 9 aa, Homo Sapiens
SRLHLPRLK

SEQ ID NO: 1182968 - protein, 9 aa, Homo Sapiens
HREAVGNLR

SEQ ID NO: 1182969 - protein, 9 aa, Homo Sapiens
PGSWAWQGA

SEQ ID NO: 1182970 - protein, 9 aa, Homo Sapiens
YVACGSPEE

SEQ ID NO: 1182971 - protein, 9 aa, Homo Sapiens
PRPQLGRSR

SEQ ID NO: 1182972 - protein, 9 aa, Homo Sapiens
TMASSSPRS

SEQ ID NO: 1182973 - protein, 9 aa, Homo Sapiens
HIKLWATGG

SEQ ID NO: 1182974 - protein, 9 aa, Homo Sapiens
QCLRHPVGR

SEQ ID NO: 1182975 - protein, 9 aa, Homo Sapiens
NEADHAFTD

SEQ ID NO: 1182976 - protein, 9 aa, Homo Sapiens
ARATKFKQL

SEQ ID NO: 1182977 - protein, 9 aa, Homo Sapiens
SLGEELGAA

SEQ ID NO: 1182978 - protein, 9 aa, Homo Sapiens
TPIDWGEEY

SEQ ID NO: 1182979 - protein, 9 aa, Homo Sapiens
ERALTRVGA

SEQ ID NO: 1182980 - protein, 9 aa, Homo Sapiens
DETYVEEIV

SEQ ID NO: 1182981 - protein, 9 aa, Homo Sapiens
MRRFADVEM

SEQ ID NO: 1182982 - protein, 9 aa, Homo Sapiens
LLYMVTMPP

SEQ ID NO: 1182983 - protein, 9 aa, Homo Sapiens
TLPPGTRPQ

SEQ ID NO: 1182984 - protein, 9 aa, Homo Sapiens
STTLPQWKQ

SEQ ID NO: 1182985 - protein, 9 aa, Homo Sapiens
VSMRYFLVK

SEQ ID NO: 1182986 - protein, 9 aa, Homo Sapiens
HPADPPLGL

SEQ ID NO: 1182987 - protein, 9 aa, Homo Sapiens
PESTLHALR

SEQ ID NO: 1182988 - protein, 9 aa, Homo Sapiens
LHSSRFSRI

SEQ ID NO: 1182989 - protein, 9 aa, Homo Sapiens
ENYYQKTWR

SEQ ID NO: 1182990 - protein, 9 aa, Homo Sapiens
CHRGGRACP

SEQ ID NO: 1182991 - protein, 9 aa, Homo Sapiens
ILRTHSAKR

SEQ ID NO: 1182992 - protein, 9 aa, Homo Sapiens
QHRERINRS

SEQ ID NO: 1182993 - protein, 9 aa, Homo Sapiens
ISHSRSHSK

SEQ ID NO: 1182994 - protein, 9 aa, Homo Sapiens
ALQPPGGCH

SEQ ID NO: 1182995 - protein, 9 aa, Homo Sapiens
ALAGWPGLW

SEQ ID NO: 1182996 - protein, 9 aa, Homo Sapiens
HRHPRPAHA

SEQ ID NO: 1182997 - protein, 9 aa, Homo Sapiens
GDSMEAGQQ

SEQ ID NO: 1182998 - protein, 9 aa, Homo Sapiens
SSASSLVAA

SEQ ID NO: 1182999 - protein, 9 aa, Homo Sapiens
REDLLAREG

SEQ ID NO: 1183000 - protein, 9 aa, Homo Sapiens
CPPGFPSRN

SEQ ID NO: 1183001 - protein, 9 aa, Homo Sapiens
VKHRLRGSL

SEQ ID NO: 1183002 - protein, 9 aa, Homo Sapiens
HVPPLLKLS

SEQ ID NO: 1183003 - protein, 9 aa, Homo Sapiens
PTPPPTWSR

SEQ ID NO: 1183004 - protein, 9 aa, Homo Sapiens
NLVKAARRG

SEQ ID NO: 1183005 - protein, 9 aa, Homo Sapiens
CPESFAIYK

SEQ ID NO: 1183006 - protein, 9 aa, Homo Sapiens
EKDYDFPPS

SEQ ID NO: 1183007 - protein, 9 aa, Homo Sapiens
PRGRTSGRS

SEQ ID NO: 1183008 - protein, 9 aa, Homo Sapiens
IWVDYSITK

SEQ ID NO: 1183009 - protein, 9 aa, Homo Sapiens
SKGVPHLPR

SEQ ID NO: 1183010 - protein, 9 aa, Homo Sapiens
PECSVEFAL

SEQ ID NO: 1183011 - protein, 9 aa, Homo Sapiens
DWLPPCGGR

SEQ ID NO: 1183012 - protein, 9 aa, Homo Sapiens
VSSCFFLVY

SEQ ID NO: 1183013 - protein, 9 aa, Homo Sapiens
ISGSPMTSA

SEQ ID NO: 1183014 - protein, 9 aa, Homo Sapiens
GRPGGSGHA

SEQ ID NO: 1183015 - protein, 9 aa, Homo Sapiens
IEAAPPKAH

SEQ ID NO: 1183016 - protein, 9 aa, Homo Sapiens
HIRTQHNYL

SEQ ID NO: 1183017 - protein, 9 aa, Homo Sapiens
ELGPQPILQ

SEQ ID NO: 1183018 - protein, 9 aa, Homo Sapiens
QLASQSRGP

SEQ ID NO: 1183019 - protein, 9 aa, Homo Sapiens
LKAIVRICQ

SEQ ID NO: 1183020 - protein, 9 aa, Homo Sapiens
RTDSNGICM

SEQ ID NO: 1183021 - protein, 9 aa, Homo Sapiens
HRRRQLRPD

SEQ ID NO: 1183022 - protein, 9 aa, Homo Sapiens
KLQCQYRSP

SEQ ID NO: 1183023 - protein, 9 aa, Homo Sapiens
ASPCSSISE

SEQ ID NO: 1183024 - protein, 9 aa, Homo Sapiens
QKTGIASYL

SEQ ID NO: 1183025 - protein, 9 aa, Homo Sapiens
WSWCGTSQT

SEQ ID NO: 1183026 - protein, 9 aa, Homo Sapiens
PAPCSLFPY

SEQ ID NO: 1183027 - protein, 9 aa, Homo Sapiens
EWQITAQHI

SEQ ID NO: 1183028 - protein, 9 aa, Homo Sapiens
MERMVEQMC

SEQ ID NO: 1183029 - protein, 9 aa, Homo Sapiens
LRPSVDHTF

SEQ ID NO: 1183030 - protein, 9 aa, Homo Sapiens
VTATDGGIL

SEQ ID NO: 1183031 - protein, 9 aa, Homo Sapiens
LKVELREVT

SEQ ID NO: 1183032 - protein, 9 aa, Homo Sapiens
VLQAREGPC

SEQ ID NO: 1183033 - protein, 9 aa, Homo Sapiens
EESNTMHAI

SEQ ID NO: 1183034 - protein, 9 aa, Homo Sapiens
SVSPRPPIH

SEQ ID NO: 1183035 - protein, 9 aa, Homo Sapiens
CSKTSRKKK

SEQ ID NO: 1183036 - protein, 9 aa, Homo Sapiens
SAGDPFKTI

SEQ ID NO: 1183037 - protein, 9 aa, Homo Sapiens
HERPPPEPR

SEQ ID NO: 1183038 - protein, 9 aa, Homo Sapiens
VGCLTWLIG

SEQ ID NO: 1183039 - protein, 9 aa, Homo Sapiens
ELTENINAV

SEQ ID NO: 1183040 - protein, 9 aa, Homo Sapiens
LGAGAAAGN

SEQ ID NO: 1183041 - protein, 9 aa, Homo Sapiens
CVFLAFVIM

SEQ ID NO: 1183042 - protein, 9 aa, Homo Sapiens
DEEDSVQSI

SEQ ID NO: 1183043 - protein, 9 aa, Homo Sapiens
GFPNLYPLI

SEQ ID NO: 1183044 - protein, 9 aa, Homo Sapiens
VRKGSKRGG

SEQ ID NO: 1183045 - protein, 9 aa, Homo Sapiens
VAGGGQPAH

SEQ ID NO: 1183046 - protein, 9 aa, Homo Sapiens
KEQCNPETC

SEQ ID NO: 1183047 - protein, 9 aa, Homo Sapiens
GWSGRSARM

SEQ ID NO: 1183048 - protein, 9 aa, Homo Sapiens
RSWWLASRP

SEQ ID NO: 1183049 - protein, 9 aa, Homo Sapiens
NGPPIMKTS

SEQ ID NO: 1183050 - protein, 9 aa, Homo Sapiens
GKEEAQEAQ

SEQ ID NO: 1183051 - protein, 9 aa, Homo Sapiens
GRTRSSGWM

SEQ ID NO: 1183052 - protein, 9 aa, Homo Sapiens
RLSAQSAIS

SEQ ID NO: 1183053 - protein, 9 aa, Homo Sapiens
VKRGPGNQL

SEQ ID NO: 1183054 - protein, 9 aa, Homo Sapiens
DILECDEEC

SEQ ID NO: 1183055 - protein, 9 aa, Homo Sapiens
SDIDEYKKT

SEQ ID NO: 1183056 - protein, 9 aa, Homo Sapiens
PEYDGRGGA

SEQ ID NO: 1183057 - protein, 9 aa, Homo Sapiens
QSYLLPQGR

SEQ ID NO: 1183058 - protein, 9 aa, Homo Sapiens
MLAGGFFLL

SEQ ID NO: 1183059 - protein, 9 aa, Homo Sapiens
PHGQHTQVV

SEQ ID NO: 1183060 - protein, 9 aa, Homo Sapiens
SCSLLTQPS

SEQ ID NO: 1183061 - protein, 9 aa, Homo Sapiens
HIVCPHHCG

SEQ ID NO: 1183062 - protein, 9 aa, Homo Sapiens
CVEEDPRAC

SEQ ID NO: 1183063 - protein, 9 aa, Homo Sapiens
GWGPPARPP

SEQ ID NO: 1183064 - protein, 9 aa, Homo Sapiens
MQSGGILTW

SEQ ID NO: 1183065 - protein, 9 aa, Homo Sapiens
LRSFMKLYH

SEQ ID NO: 1183066 - protein, 9 aa, Homo Sapiens
LMPCGVPSG

SEQ ID NO: 1183067 - protein, 9 aa, Homo Sapiens
QKPLIQWEK

SEQ ID NO: 1183068 - protein, 9 aa, Homo Sapiens
SAPGRSCRN

SEQ ID NO: 1183069 - protein, 9 aa, Homo Sapiens
LPSPPSPSR

SEQ ID NO: 1183070 - protein, 9 aa, Homo Sapiens
GGWGLLCVG

SEQ ID NO: 1183071 - protein, 9 aa, Homo Sapiens
EQTHERPPP

SEQ ID NO: 1183072 - protein, 9 aa, Homo Sapiens
ERRWILIEY

SEQ ID NO: 1183073 - protein, 9 aa, Homo Sapiens
RPLQGQRNP

SEQ ID NO: 1183074 - protein, 9 aa, Homo Sapiens
LVWGVDCPY

SEQ ID NO: 1183075 - protein, 9 aa, Homo Sapiens
RRRRKMTTL

SEQ ID NO: 1183076 - protein, 9 aa, Homo Sapiens
VVFRIVLMA

SEQ ID NO: 1183077 - protein, 9 aa, Homo Sapiens
FADDPCTSV

SEQ ID NO: 1183078 - protein, 9 aa, Homo Sapiens
PGRGAPAQS

SEQ ID NO: 1183079 - protein, 9 aa, Homo Sapiens
RLSPESVEL

SEQ ID NO: 1183080 - protein, 9 aa, Homo Sapiens
GPQRAHPLR

SEQ ID NO: 1183081 - protein, 9 aa, Homo Sapiens
RLQAATGHH

SEQ ID NO: 1183082 - protein, 9 aa, Homo Sapiens
PASPLFACC

SEQ ID NO: 1183083 - protein, 9 aa, Homo Sapiens
HAEPASARR

SEQ ID NO: 1183084 - protein, 9 aa, Homo Sapiens
RVLLQLRYN

SEQ ID NO: 1183085 - protein, 9 aa, Homo Sapiens
SSRRSWNRW

SEQ ID NO: 1183086 - protein, 9 aa, Homo Sapiens
MKFSMWDRD

SEQ ID NO: 1183087 - protein, 9 aa, Homo Sapiens
VMRPGEGPH

SEQ ID NO: 1183088 - protein, 9 aa, Homo Sapiens
ESRGRLQGW

SEQ ID NO: 1183089 - protein, 9 aa, Homo Sapiens
GLAPKLQCQ

SEQ ID NO: 1183090 - protein, 9 aa, Homo Sapiens
TPSSCSPRA

SEQ ID NO: 1183091 - protein, 9 aa, Homo Sapiens
MRLHPCPPG

SEQ ID NO: 1183092 - protein, 9 aa, Homo Sapiens
RTELTHVPL

SEQ ID NO: 1183093 - protein, 9 aa, Homo Sapiens
YSSPIDVWV

SEQ ID NO: 1183094 - protein, 9 aa, Homo Sapiens
AVGLPRACA

SEQ ID NO: 1183095 - protein, 9 aa, Homo Sapiens
VDCRAFGHY

SEQ ID NO: 1183096 - protein, 9 aa, Homo Sapiens
VDHTFDLFK

SEQ ID NO: 1183097 - protein, 9 aa, Homo Sapiens
PLPACLNLR

SEQ ID NO: 1183098 - protein, 9 aa, Homo Sapiens
KVPTSFGDA

SEQ ID NO: 1183099 - protein, 9 aa, Homo Sapiens
LKCDRTCWS

SEQ ID NO: 1183100 - protein, 9 aa, Homo Sapiens
TSRARQSCC

SEQ ID NO: 1183101 - protein, 9 aa, Homo Sapiens
RTSANRGEA

SEQ ID NO: 1183102 - protein, 9 aa, Homo Sapiens
FAYAQLSYL

SEQ ID NO: 1183103 - protein, 9 aa, Homo Sapiens
PHPADPPLG

SEQ ID NO: 1183104 - protein, 9 aa, Homo Sapiens
GSSSCSARW

SEQ ID NO: 1183105 - protein, 9 aa, Homo Sapiens
CIVAPSQDP

SEQ ID NO: 1183106 - protein, 9 aa, Homo Sapiens
TRYCFQHIL

SEQ ID NO: 1183107 - protein, 9 aa, Homo Sapiens
GVKKPHRYM

SEQ ID NO: 1183108 - protein, 9 aa, Homo Sapiens
KSQSCLTSF

SEQ ID NO: 1183109 - protein, 9 aa, Homo Sapiens
PCSWPMTTQ

SEQ ID NO: 1183110 - protein, 9 aa, Homo Sapiens
QAVCARGRH

SEQ ID NO: 1183111 - protein, 9 aa, Homo Sapiens
TASQCLTST

SEQ ID NO: 1183112 - protein, 9 aa, Homo Sapiens
WSRIPPCRT

SEQ ID NO: 1183113 - protein, 9 aa, Homo Sapiens
VVPCWPPCS

SEQ ID NO: 1183114 - protein, 9 aa, Homo Sapiens
PSSPPQGAR

SEQ ID NO: 1183115 - protein, 9 aa, Homo Sapiens
WPSSPPRCT

SEQ ID NO: 1183116 - protein, 9 aa, Homo Sapiens
WASQEWQVS

SEQ ID NO: 1183117 - protein, 9 aa, Homo Sapiens
SRTPTRRPR

SEQ ID NO: 1183118 - protein, 9 aa, Homo Sapiens
PGHGGRPGG

SEQ ID NO: 1183119 - protein, 9 aa, Homo Sapiens
QHADLTQSH

SEQ ID NO: 1183120 - protein, 9 aa, Homo Sapiens
CTGPLGMPS

SEQ ID NO: 1183121 - protein, 9 aa, Homo Sapiens
PHSIHDGVA

SEQ ID NO: 1183122 - protein, 9 aa, Homo Sapiens
PASACTMPP

SEQ ID NO: 1183123 - protein, 9 aa, Homo Sapiens
GSALQGLAQ

SEQ ID NO: 1183124 - protein, 9 aa, Homo Sapiens
QVPVKDHVV

SEQ ID NO: 1183125 - protein, 9 aa, Homo Sapiens
RAAAALRAV

SEQ ID NO: 1183126 - protein, 9 aa, Homo Sapiens
EQVLVDAVV

SEQ ID NO: 1183127 - protein, 9 aa, Homo Sapiens
SSQCTQGRR

SEQ ID NO: 1183128 - protein, 9 aa, Homo Sapiens
CRNGYCTPR

SEQ ID NO: 1183129 - protein, 9 aa, Homo Sapiens
ARSPSSAAS

SEQ ID NO: 1183130 - protein, 9 aa, Homo Sapiens
QARSPSSAA

SEQ ID NO: 1183131 - protein, 9 aa, Homo Sapiens
MAYTFERVF

SEQ ID NO: 1183132 - protein, 9 aa, Homo Sapiens
PHGAACPPG

SEQ ID NO: 1183133 - protein, 9 aa, Homo Sapiens
KPIVAPTLS

SEQ ID NO: 1183134 - protein, 9 aa, Homo Sapiens
SCSARWCLG

SEQ ID NO: 1183135 - protein, 9 aa, Homo Sapiens
RQPLPLPPQ

SEQ ID NO: 1183136 - protein, 9 aa, Homo Sapiens
PVCHVHNLM

SEQ ID NO: 1183137 - protein, 9 aa, Homo Sapiens
SLNHFLAPG

SEQ ID NO: 1183138 - protein, 9 aa, Homo Sapiens
TPPGPPPPT

SEQ ID NO: 1183139 - protein, 9 aa, Homo Sapiens
LNLTPRLSV

SEQ ID NO: 1183140 - protein, 9 aa, Homo Sapiens
AMLEFQLNH

SEQ ID NO: 1183141 - protein, 9 aa, Homo Sapiens
IKHQRAHTG

SEQ ID NO: 1183142 - protein, 9 aa, Homo Sapiens
MKCFLNLSQ

SEQ ID NO: 1183143 - protein, 9 aa, Homo Sapiens
HILRTHSAK

SEQ ID NO: 1183144 - protein, 9 aa, Homo Sapiens
RSDAPWASV

SEQ ID NO: 1183145 - protein, 9 aa, Homo Sapiens
RFQKPLIQW

SEQ ID NO: 1183146 - protein, 9 aa, Homo Sapiens
TIRCCCRRR

SEQ ID NO: 1183147 - protein, 9 aa, Homo Sapiens
NVITKNNDL

SEQ ID NO: 1183148 - protein, 9 aa, Homo Sapiens
SRRSLMSVA

SEQ ID NO: 1183149 - protein, 9 aa, Homo Sapiens
ITVQRKDYP

SEQ ID NO: 1183150 - protein, 9 aa, Homo Sapiens
QGHIDDEAA

SEQ ID NO: 1183151 - protein, 9 aa, Homo Sapiens
RTSTTSSGP

SEQ ID NO: 1183152 - protein, 9 aa, Homo Sapiens
RPGRRGGQA

SEQ ID NO: 1183153 - protein, 9 aa, Homo Sapiens
VTPLRVQSV

SEQ ID NO: 1183154 - protein, 9 aa, Homo Sapiens
FLETLPRSK

SEQ ID NO: 1183155 - protein, 9 aa, Homo Sapiens
AQALPADAQ

SEQ ID NO: 1183156 - protein, 9 aa, Homo Sapiens
EGFPNLYPL

SEQ ID NO: 1183157 - protein, 9 aa, Homo Sapiens
RGHDDAPDD

SEQ ID NO: 1183158 - protein, 9 aa, Homo Sapiens
SRPPGPQCP

SEQ ID NO: 1183159 - protein, 9 aa, Homo Sapiens
INRDNWLVT

SEQ ID NO: 1183160 - protein, 9 aa, Homo Sapiens
DPDLVEAQQ

SEQ ID NO: 1183161 - protein, 9 aa, Homo Sapiens
CPDDQGGAA

SEQ ID NO: 1183162 - protein, 9 aa, Homo Sapiens
RCSKTFSAV

SEQ ID NO: 1183163 - protein, 9 aa, Homo Sapiens
LMAAEPTTP

SEQ ID NO: 1183164 - protein, 9 aa, Homo Sapiens
LLDQLVQAL

SEQ ID NO: 1183165 - protein, 9 aa, Homo Sapiens
TPTPIQPKA

SEQ ID NO: 1183166 - protein, 9 aa, Homo Sapiens
LLNEADHAF

SEQ ID NO: 1183167 - protein, 9 aa, Homo Sapiens
CHSGWTAML

SEQ ID NO: 1183168 - protein, 9 aa, Homo Sapiens
FSNISHSRS

SEQ ID NO: 1183169 - protein, 9 aa, Homo Sapiens
GQTSSVSFK

SEQ ID NO: 1183170 - protein, 9 aa, Homo Sapiens
NKPPIYKTK

SEQ ID NO: 1183171 - protein, 9 aa, Homo Sapiens
QSEMPGDAQ

SEQ ID NO: 1183172 - protein, 9 aa, Homo Sapiens
SRAREEQVP

SEQ ID NO: 1183173 - protein, 9 aa, Homo Sapiens
RQQVSRAVN

SEQ ID NO: 1183174 - protein, 9 aa, Homo Sapiens
FCPHPAPPT

SEQ ID NO: 1183175 - protein, 9 aa, Homo Sapiens
GWLPQWAAW

SEQ ID NO: 1183176 - protein, 9 aa, Homo Sapiens
LPRELKIKF

SEQ ID NO: 1183177 - protein, 9 aa, Homo Sapiens
CTCPVGMAC

SEQ ID NO: 1183178 - protein, 9 aa, Homo Sapiens
YPGDVRHGF

SEQ ID NO: 1183179 - protein, 9 aa, Homo Sapiens
ATYEHLFRW

SEQ ID NO: 1183180 - protein, 9 aa, Homo Sapiens
GTRSATSNS

SEQ ID NO: 1183181 - protein, 9 aa, Homo Sapiens
ALSRPPGPQ

SEQ ID NO: 1183182 - protein, 9 aa, Homo Sapiens
HSGPESGRS

SEQ ID NO: 1183183 - protein, 9 aa, Homo Sapiens
LFACCSLAT

SEQ ID NO: 1183184 - protein, 9 aa, Homo Sapiens
TCALRMSPP

SEQ ID NO: 1183185 - protein, 9 aa, Homo Sapiens
STCGSATSM

SEQ ID NO: 1183186 - protein, 9 aa, Homo Sapiens
RTGNPLSVE

SEQ ID NO: 1183187 - protein, 9 aa, Homo Sapiens
PLLGWPAAH

SEQ ID NO: 1183188 - protein, 9 aa, Homo Sapiens
DEVNPCLRE

SEQ ID NO: 1183189 - protein, 9 aa, Homo Sapiens
WAVFDEYNE

SEQ ID NO: 1183190 - protein, 9 aa, Homo Sapiens
LNENYMGKV

SEQ ID NO: 1183191 - protein, 9 aa, Homo Sapiens
PSYLHSHGR

SEQ ID NO: 1183192 - protein, 9 aa, Homo Sapiens
KVQRPRCFL

SEQ ID NO: 1183193 - protein, 9 aa, Homo Sapiens
SVVTINHIV

SEQ ID NO: 1183194 - protein, 9 aa, Homo Sapiens
KPSQKHFNI

SEQ ID NO: 1183195 - protein, 9 aa, Homo Sapiens
PHRPGTPPM

SEQ ID NO: 1183196 - protein, 9 aa, Homo Sapiens
QVIGFATEQ

SEQ ID NO: 1183197 - protein, 9 aa, Homo Sapiens
PSSARRPVS

SEQ ID NO: 1183198 - protein, 9 aa, Homo Sapiens
HWSFVKWLG

SEQ ID NO: 1183199 - protein, 9 aa, Homo Sapiens
DANIKSPGL

SEQ ID NO: 1183200 - protein, 9 aa, Homo Sapiens
APHEAPCTP

SEQ ID NO: 1183201 - protein, 9 aa, Homo Sapiens
ELCKIQKVW

SEQ ID NO: 1183202 - protein, 9 aa, Homo Sapiens
LSCLVTIGR

SEQ ID NO: 1183203 - protein, 9 aa, Homo Sapiens
RMASLRQDC

SEQ ID NO: 1183204 - protein, 9 aa, Homo Sapiens
LLHPQWAPH

SEQ ID NO: 1183205 - protein, 9 aa, Homo Sapiens
NHKDARACV

SEQ ID NO: 1183206 - protein, 9 aa, Homo Sapiens
LVIPEVLQA

SEQ ID NO: 1183207 - protein, 9 aa, Homo Sapiens
VLFSPVFFS

SEQ ID NO: 1183208 - protein, 9 aa, Homo Sapiens
SAYAPPRSS

SEQ ID NO: 1183209 - protein, 9 aa, Homo Sapiens
NTSCLYVGP

SEQ ID NO: 1183210 - protein, 9 aa, Homo Sapiens
TLGIRAGSL

SEQ ID NO: 1183211 - protein, 9 aa, Homo Sapiens
NDGYMDMSS

SEQ ID NO: 1183212 - protein, 9 aa, Homo Sapiens
SSPCSRATA

SEQ ID NO: 1183213 - protein, 9 aa, Homo Sapiens
MKVQARDVI

SEQ ID NO: 1183214 - protein, 9 aa, Homo Sapiens
QGTGLLAAC

SEQ ID NO: 1183215 - protein, 9 aa, Homo Sapiens
WLSLFDFLS

SEQ ID NO: 1183216 - protein, 9 aa, Homo Sapiens
PDPSEEPVP

SEQ ID NO: 1183217 - protein, 9 aa, Homo Sapiens
TCWSPAPTP

SEQ ID NO: 1183218 - protein, 9 aa, Homo Sapiens
FFSNISHSR

SEQ ID NO: 1183219 - protein, 9 aa, Homo Sapiens
DKGDLRTGA

SEQ ID NO: 1183220 - protein, 9 aa, Homo Sapiens
TWLIGGGGA

SEQ ID NO: 1183221 - protein, 9 aa, Homo Sapiens
GFFLDASQH

SEQ ID NO: 1183222 - protein, 9 aa, Homo Sapiens
GLLRPALRI

SEQ ID NO: 1183223 - protein, 9 aa, Homo Sapiens
TAWMSPSVQ

SEQ ID NO: 1183224 - protein, 9 aa, Homo Sapiens
TDNYQPYPC

SEQ ID NO: 1183225 - protein, 9 aa, Homo Sapiens
PKMCAPVGN

SEQ ID NO: 1183226 - protein, 9 aa, Homo Sapiens
LAGEGAALA

SEQ ID NO: 1183227 - protein, 9 aa, Homo Sapiens
YAGVYLQMI

SEQ ID NO: 1183228 - protein, 9 aa, Homo Sapiens
KFTNLEEAI

SEQ ID NO: 1183229 - protein, 9 aa, Homo Sapiens
PTPPPQSQS

SEQ ID NO: 1183230 - protein, 9 aa, Homo Sapiens
GWFPPCGRR

SEQ ID NO: 1183231 - protein, 9 aa, Homo Sapiens
DPCTALASG

SEQ ID NO: 1183232 - protein, 9 aa, Homo Sapiens
LCTCPSFIP

SEQ ID NO: 1183233 - protein, 9 aa, Homo Sapiens
PEPLEPPGP

SEQ ID NO: 1183234 - protein, 9 aa, Homo Sapiens
LSCCPRPRC

SEQ ID NO: 1183235 - protein, 9 aa, Homo Sapiens
CYISQNDMI

SEQ ID NO: 1183236 - protein, 9 aa, Homo Sapiens
KREVLQFQF

SEQ ID NO: 1183237 - protein, 9 aa, Homo Sapiens
GRYGRHRPF

SEQ ID NO: 1183238 - protein, 9 aa, Homo Sapiens
PPVSVWDAY

SEQ ID NO: 1183239 - protein, 9 aa, Homo Sapiens
KEKELRVST

SEQ ID NO: 1183240 - protein, 9 aa, Homo Sapiens
DLIHRDILR

SEQ ID NO: 1183241 - protein, 9 aa, Homo Sapiens
VHQARVLAQ

SEQ ID NO: 1183242 - protein, 9 aa, Homo Sapiens
RGWCSAAWP

SEQ ID NO: 1183243 - protein, 9 aa, Homo Sapiens
CRMTSWRPG

SEQ ID NO: 1183244 - protein, 9 aa, Homo Sapiens
TIGGEKDSM

SEQ ID NO: 1183245 - protein, 9 aa, Homo Sapiens
IYDGEVCAA

SEQ ID NO: 1183246 - protein, 9 aa, Homo Sapiens
TRKLLVAVE

SEQ ID NO: 1183247 - protein, 9 aa, Homo Sapiens
GHGSGGGRG

SEQ ID NO: 1183248 - protein, 9 aa, Homo Sapiens
GASQSQNAN

SEQ ID NO: 1183249 - protein, 9 aa, Homo Sapiens
EMVKNHIFQ

SEQ ID NO: 1183250 - protein, 9 aa, Homo Sapiens
NASCSGRSA

SEQ ID NO: 1183251 - protein, 9 aa, Homo Sapiens
HFIHVKPPS

SEQ ID NO: 1183252 - protein, 9 aa, Homo Sapiens
RGGPWPRTS

SEQ ID NO: 1183253 - protein, 9 aa, Homo Sapiens
GGPCPQTPC

SEQ ID NO: 1183254 - protein, 9 aa, Homo Sapiens
GPKASRATL

SEQ ID NO: 1183255 - protein, 9 aa, Homo Sapiens
QRHRTDEVE

SEQ ID NO: 1183256 - protein, 9 aa, Homo Sapiens
FFHSQPTQN

SEQ ID NO: 1183257 - protein, 9 aa, Homo Sapiens
WPILQQVAT

SEQ ID NO: 1183258 - protein, 9 aa, Homo Sapiens
THTGENPYK

SEQ ID NO: 1183259 - protein, 9 aa, Homo Sapiens
MTSAWRSLR

SEQ ID NO: 1183260 - protein, 9 aa, Homo Sapiens
HEAEAGGGG

SEQ ID NO: 1183261 - protein, 9 aa, Homo Sapiens
PPPGRLIRG

SEQ ID NO: 1183262 - protein, 9 aa, Homo Sapiens
ARRMLSPVH

SEQ ID NO: 1183263 - protein, 9 aa, Homo Sapiens
EYLVERSGH

SEQ ID NO: 1183264 - protein, 9 aa, Homo Sapiens
HSPKHTRPA

SEQ ID NO: 1183265 - protein, 9 aa, Homo Sapiens
RILKAKSKH

SEQ ID NO: 1183266 - protein, 9 aa, Homo Sapiens
YFFSPNVHT

SEQ ID NO: 1183267 - protein, 9 aa, Homo Sapiens
LEPAPPAWG

SEQ ID NO: 1183268 - protein, 9 aa, Homo Sapiens
RFQCVSVLL

SEQ ID NO: 1183269 - protein, 9 aa, Homo Sapiens
LFNSSAHVH

SEQ ID NO: 1183270 - protein, 9 aa, Homo Sapiens
SVPWTPRPP

SEQ ID NO: 1183271 - protein, 9 aa, Homo Sapiens
KGGRAEGAL

SEQ ID NO: 1183272 - protein, 9 aa, Homo Sapiens
FQVHLEAVA

SEQ ID NO: 1183273 - protein, 9 aa, Homo Sapiens
SSPRRAPLN

SEQ ID NO: 1183274 - protein, 9 aa, Homo Sapiens
SWGSTLFSI

SEQ ID NO: 1183275 - protein, 9 aa, Homo Sapiens
AGPCRAAFR

SEQ ID NO: 1183276 - protein, 9 aa, Homo Sapiens
SSDPRARLE

SEQ ID NO: 1183277 - protein, 9 aa, Homo Sapiens
AISPTGHLG

SEQ ID NO: 1183278 - protein, 9 aa, Homo Sapiens
TESPPCSRG

SEQ ID NO: 1183279 - protein, 9 aa, Homo Sapiens
RVQNGDSLV

SEQ ID NO: 1183280 - protein, 9 aa, Homo Sapiens
PLTPPLPPP

SEQ ID NO: 1183281 - protein, 9 aa, Homo Sapiens
KIWESWQMK

SEQ ID NO: 1183282 - protein, 9 aa, Homo Sapiens
EAADLGLGT

SEQ ID NO: 1183283 - protein, 9 aa, Homo Sapiens
DLQQVGDYC

SEQ ID NO: 1183284 - protein, 9 aa, Homo Sapiens
WCSAAWPPR

SEQ ID NO: 1183285 - protein, 9 aa, Homo Sapiens
WGGSCPAFV

SEQ ID NO: 1183286 - protein, 9 aa, Homo Sapiens
KALKETRGN

SEQ ID NO: 1183287 - protein, 9 aa, Homo Sapiens
PQLEGPREN

SEQ ID NO: 1183288 - protein, 9 aa, Homo Sapiens
VILAPQRVG

SEQ ID NO: 1183289 - protein, 9 aa, Homo Sapiens
SHIVPREPV

SEQ ID NO: 1183290 - protein, 9 aa, Homo Sapiens
MTPTDQESM

SEQ ID NO: 1183291 - protein, 9 aa, Homo Sapiens
GYGQHRSSS

SEQ ID NO: 1183292 - protein, 9 aa, Homo Sapiens
KLWPPSSRR

SEQ ID NO: 1183293 - protein, 9 aa, Homo Sapiens
PNILPIQRV

SEQ ID NO: 1183294 - protein, 9 aa, Homo Sapiens
QGRKPKNFR

SEQ ID NO: 1183295 - protein, 9 aa, Homo Sapiens
VLYMPSAQL

SEQ ID NO: 1183296 - protein, 9 aa, Homo Sapiens
PLQGARAPP

SEQ ID NO: 1183297 - protein, 9 aa, Homo Sapiens
VIGERTEGS

SEQ ID NO: 1183298 - protein, 9 aa, Homo Sapiens
DRDPVSEIT

SEQ ID NO: 1183299 - protein, 9 aa, Homo Sapiens
GRARVLLLP

SEQ ID NO: 1183300 - protein, 9 aa, Homo Sapiens
LVKEKEMVG

SEQ ID NO: 1183301 - protein, 9 aa, Homo Sapiens
HRFEPVFFE

SEQ ID NO: 1183302 - protein, 9 aa, Homo Sapiens
ARRSPRSCS

SEQ ID NO: 1183303 - protein, 9 aa, Homo Sapiens
PPHRWTAHR

SEQ ID NO: 1183304 - protein, 9 aa, Homo Sapiens
LTSATSCEL

SEQ ID NO: 1183305 - protein, 9 aa, Homo Sapiens
QPSTSNSQC

SEQ ID NO: 1183306 - protein, 9 aa, Homo Sapiens
PPPAVAERV

SEQ ID NO: 1183307 - protein, 9 aa, Homo Sapiens
GGMPRALWA

SEQ ID NO: 1183308 - protein, 9 aa, Homo Sapiens
YSNNRLIKI

SEQ ID NO: 1183309 - protein, 9 aa, Homo Sapiens
PSSHGAPQA

SEQ ID NO: 1183310 - protein, 9 aa, Homo Sapiens
RFNELPNPA

SEQ ID NO: 1183311 - protein, 9 aa, Homo Sapiens
ETVMTFLRA

SEQ ID NO: 1183312 - protein, 9 aa, Homo Sapiens
SCEKVRPRK

SEQ ID NO: 1183313 - protein, 9 aa, Homo Sapiens
PRSSLHPQQ

SEQ ID NO: 1183314 - protein, 9 aa, Homo Sapiens
RCFLTLPLT

SEQ ID NO: 1183315 - protein, 9 aa, Homo Sapiens
MDPDKLNDL

SEQ ID NO: 1183316 - protein, 9 aa, Homo Sapiens
WEAPYSHSK

SEQ ID NO: 1183317 - protein, 9 aa, Homo Sapiens
HGLILQLQG

SEQ ID NO: 1183318 - protein, 9 aa, Homo Sapiens
GASRRWRMS

SEQ ID NO: 1183319 - protein, 9 aa, Homo Sapiens
LLIYGECCS

SEQ ID NO: 1183320 - protein, 9 aa, Homo Sapiens
LRFSSTEPC

SEQ ID NO: 1183321 - protein, 9 aa, Homo Sapiens
TVLSMGPGG

SEQ ID NO: 1183322 - protein, 9 aa, Homo Sapiens
RALRRVDAC

SEQ ID NO: 1183323 - protein, 9 aa, Homo Sapiens
KPPPPLPAC

SEQ ID NO: 1183324 - protein, 9 aa, Homo Sapiens
VISVTAMQC

SEQ ID NO: 1183325 - protein, 9 aa, Homo Sapiens
GGRGRGQPE

SEQ ID NO: 1183326 - protein, 9 aa, Homo Sapiens
RARGPGRIL

SEQ ID NO: 1183327 - protein, 9 aa, Homo Sapiens
RAPLNSWRS

SEQ ID NO: 1183328 - protein, 9 aa, Homo Sapiens
YKTQEEEET

SEQ ID NO: 1183329 - protein, 9 aa, Homo Sapiens
LTQRQDTSK

SEQ ID NO: 1183330 - protein, 9 aa, Homo Sapiens
GVGVSSAAC

SEQ ID NO: 1183331 - protein, 9 aa, Homo Sapiens
SQSGTKMKA

SEQ ID NO: 1183332 - protein, 9 aa, Homo Sapiens
PPPSYGGSR

SEQ ID NO: 1183333 - protein, 9 aa, Homo Sapiens
RADGATTYE

SEQ ID NO: 1183334 - protein, 9 aa, Homo Sapiens
SIHGVRHPQ

SEQ ID NO: 1183335 - protein, 9 aa, Homo Sapiens
LLNLDTHIV

SEQ ID NO: 1183336 - protein, 9 aa, Homo Sapiens
KRKQLMVTM

SEQ ID NO: 1183337 - protein, 9 aa, Homo Sapiens
TIYNVTVLG

SEQ ID NO: 1183338 - protein, 9 aa, Homo Sapiens
EVEIVEGTI

SEQ ID NO: 1183339 - protein, 9 aa, Homo Sapiens
PQAWSTLWP

SEQ ID NO: 1183340 - protein, 9 aa, Homo Sapiens
RAERDGHWY

SEQ ID NO: 1183341 - protein, 9 aa, Homo Sapiens
GILQNIPME

SEQ ID NO: 1183342 - protein, 9 aa, Homo Sapiens
KEPLTLQES

SEQ ID NO: 1183343 - protein, 9 aa, Homo Sapiens
PQHLAASAL

SEQ ID NO: 1183344 - protein, 9 aa, Homo Sapiens
ALITVLDRD

SEQ ID NO: 1183345 - protein, 9 aa, Homo Sapiens
RACRGCQGP

SEQ ID NO: 1183346 - protein, 9 aa, Homo Sapiens
FFQGPVPRC

SEQ ID NO: 1183347 - protein, 9 aa, Homo Sapiens
YPLSQITAQ

SEQ ID NO: 1183348 - protein, 9 aa, Homo Sapiens
TLENEDVQF

SEQ ID NO: 1183349 - protein, 9 aa, Homo Sapiens
PPTPSPALR

SEQ ID NO: 1183350 - protein, 9 aa, Homo Sapiens
VAVCVLHLG

SEQ ID NO: 1183351 - protein, 9 aa, Homo Sapiens
HIQMTKRLT

SEQ ID NO: 1183352 - protein, 9 aa, Homo Sapiens
IPLCPKHWF

SEQ ID NO: 1183353 - protein, 9 aa, Homo Sapiens
VQAGRGTSA

SEQ ID NO: 1183354 - protein, 9 aa, Homo Sapiens
VSASDAGVP

SEQ ID NO: 1183355 - protein, 9 aa, Homo Sapiens
KLFQDEPSS

SEQ ID NO: 1183356 - protein, 9 aa, Homo Sapiens
SLDELGCKY

SEQ ID NO: 1183357 - protein, 9 aa, Homo Sapiens
PPPAAPTGR

SEQ ID NO: 1183358 - protein, 9 aa, Homo Sapiens
TSTTPRAST

SEQ ID NO: 1183359 - protein, 9 aa, Homo Sapiens
LGEELGAAH

SEQ ID NO: 1183360 - protein, 9 aa, Homo Sapiens
ALHIKLWAT

SEQ ID NO: 1183361 - protein, 9 aa, Homo Sapiens
RFNLILMMY

SEQ ID NO: 1183362 - protein, 9 aa, Homo Sapiens
RPPTPFLPF

SEQ ID NO: 1183363 - protein, 9 aa, Homo Sapiens
GRTAAVGKA

SEQ ID NO: 1183364 - protein, 9 aa, Homo Sapiens
PSWTWGRAP

SEQ ID NO: 1183365 - protein, 9 aa, Homo Sapiens
QENDLALQL

SEQ ID NO: 1183366 - protein, 9 aa, Homo Sapiens
FGSQGWNRS

SEQ ID NO: 1183367 - protein, 9 aa, Homo Sapiens
NTANGWAGQ

SEQ ID NO: 1183368 - protein, 9 aa, Homo Sapiens
KAAPTPIPA

SEQ ID NO: 1183369 - protein, 9 aa, Homo Sapiens
SSSENTALS

SEQ ID NO: 1183370 - protein, 9 aa, Homo Sapiens
AIRVATTLT

SEQ ID NO: 1183371 - protein, 9 aa, Homo Sapiens
ISACPRLLP

SEQ ID NO: 1183372 - protein, 9 aa, Homo Sapiens
LYGYKLTGD

SEQ ID NO: 1183373 - protein, 9 aa, Homo Sapiens
WSQTSCFGP

SEQ ID NO: 1183374 - protein, 9 aa, Homo Sapiens
AAPLAPPAL

SEQ ID NO: 1183375 - protein, 9 aa, Homo Sapiens
KCFLNLSQM

SEQ ID NO: 1183376 - protein, 9 aa, Homo Sapiens
RRRHQPPTP

SEQ ID NO: 1183377 - protein, 9 aa, Homo Sapiens
ITVQNPQYN

SEQ ID NO: 1183378 - protein, 9 aa, Homo Sapiens
PVPTMAPST

SEQ ID NO: 1183379 - protein, 9 aa, Homo Sapiens
AFWQAFLRE

SEQ ID NO: 1183380 - protein, 9 aa, Homo Sapiens
PRAISTFGP

SEQ ID NO: 1183381 - protein, 9 aa, Homo Sapiens
RKRHLIFPQ

SEQ ID NO: 1183382 - protein, 9 aa, Homo Sapiens
RTSGRSLSC

SEQ ID NO: 1183383 - protein, 9 aa, Homo Sapiens
ECVQEIALR

SEQ ID NO: 1183384 - protein, 9 aa, Homo Sapiens
ASTASLRCI

SEQ ID NO: 1183385 - protein, 9 aa, Homo Sapiens
MKSSWMFAK

SEQ ID NO: 1183386 - protein, 9 aa, Homo Sapiens
QDTSKNIIR

SEQ ID NO: 1183387 - protein, 9 aa, Homo Sapiens
VQREHVLVG

SEQ ID NO: 1183388 - protein, 9 aa, Homo Sapiens
TPSAEKGEA

SEQ ID NO: 1183389 - protein, 9 aa, Homo Sapiens
LRFLCPTIM

SEQ ID NO: 1183390 - protein, 9 aa, Homo Sapiens
CRAPPSRPS

SEQ ID NO: 1183391 - protein, 9 aa, Homo Sapiens
SCHNGTCAT

SEQ ID NO: 1183392 - protein, 9 aa, Homo Sapiens
AREIQSVKV

SEQ ID NO: 1183393 - protein, 9 aa, Homo Sapiens
AEQRVSREA

SEQ ID NO: 1183394 - protein, 9 aa, Homo Sapiens
AEPMICSLH

SEQ ID NO: 1183395 - protein, 9 aa, Homo Sapiens
EIVEGTIEV

SEQ ID NO: 1183396 - protein, 9 aa, Homo Sapiens
SGGGRGPGR

SEQ ID NO: 1183397 - protein, 9 aa, Homo Sapiens
LTGLLLFSH

SEQ ID NO: 1183398 - protein, 9 aa, Homo Sapiens
NRSMGGSWN

SEQ ID NO: 1183399 - protein, 9 aa, Homo Sapiens
RYLTGGLWA

SEQ ID NO: 1183400 - protein, 9 aa, Homo Sapiens
TSRILNLQV

SEQ ID NO: 1183401 - protein, 9 aa, Homo Sapiens
LRIGSPNSL

SEQ ID NO: 1183402 - protein, 9 aa, Homo Sapiens
AVRPGSTPR

SEQ ID NO: 1183403 - protein, 9 aa, Homo Sapiens
RMKTSRRSL

SEQ ID NO: 1183404 - protein, 9 aa, Homo Sapiens
TSVGTIHAM

SEQ ID NO: 1183405 - protein, 9 aa, Homo Sapiens
LTALDYHTP

SEQ ID NO: 1183406 - protein, 9 aa, Homo Sapiens
VQVKRGPGN

SEQ ID NO: 1183407 - protein, 9 aa, Homo Sapiens
DTYLYILLI

SEQ ID NO: 1183408 - protein, 9 aa, Homo Sapiens
SLNYFLMCA

SEQ ID NO: 1183409 - protein, 9 aa, Homo Sapiens
SLSCYCKNG

SEQ ID NO: 1183410 - protein, 9 aa, Homo Sapiens
IQVSRGVGS

SEQ ID NO: 1183411 - protein, 9 aa, Homo Sapiens
SLEIAQINQ

SEQ ID NO: 1183412 - protein, 9 aa, Homo Sapiens
PPPPSAPPT

SEQ ID NO: 1183413 - protein, 9 aa, Homo Sapiens
PSVALAERG

SEQ ID NO: 1183414 - protein, 9 aa, Homo Sapiens
SRSTAPSPR

SEQ ID NO: 1183415 - protein, 9 aa, Homo Sapiens
RGLLLGHSR

SEQ ID NO: 1183416 - protein, 9 aa, Homo Sapiens
GPTHYPPPR

SEQ ID NO: 1183417 - protein, 9 aa, Homo Sapiens
PLGPGQIST

SEQ ID NO: 1183418 - protein, 9 aa, Homo Sapiens
EHYLELLVQ

SEQ ID NO: 1183419 - protein, 9 aa, Homo Sapiens
RGSLETRGS

SEQ ID NO: 1183420 - protein, 9 aa, Homo Sapiens
VLRAPGPPS

SEQ ID NO: 1183421 - protein, 9 aa, Homo Sapiens
TPTAWSWAA

SEQ ID NO: 1183422 - protein, 9 aa, Homo Sapiens
LTYAHLAQL

SEQ ID NO: 1183423 - protein, 9 aa, Homo Sapiens
YVNRSLTVQ

SEQ ID NO: 1183424 - protein, 9 aa, Homo Sapiens
VHKFFNVLK

SEQ ID NO: 1183425 - protein, 9 aa, Homo Sapiens
SSGTPRVPL

SEQ ID NO: 1183426 - protein, 9 aa, Homo Sapiens
SRKEEEDST

SEQ ID NO: 1183427 - protein, 9 aa, Homo Sapiens
PNSSHRQEA

SEQ ID NO: 1183428 - protein, 9 aa, Homo Sapiens
ELPQAVYYF

SEQ ID NO: 1183429 - protein, 9 aa, Homo Sapiens
QTALVMQSF

SEQ ID NO: 1183430 - protein, 9 aa, Homo Sapiens
SLRPRPPEP

SEQ ID NO: 1183431 - protein, 9 aa, Homo Sapiens
RLGPSPCNR

SEQ ID NO: 1183432 - protein, 9 aa, Homo Sapiens
CGPSPHSGE

SEQ ID NO: 1183433 - protein, 9 aa, Homo Sapiens
NPEIVAVYS

SEQ ID NO: 1183434 - protein, 9 aa, Homo Sapiens
TRPRTAPAL

SEQ ID NO: 1183435 - protein, 9 aa, Homo Sapiens
VEGLKYYRM

SEQ ID NO: 1183436 - protein, 9 aa, Homo Sapiens
CRKKSHCLQ

SEQ ID NO: 1183437 - protein, 9 aa, Homo Sapiens
TKSEHTPEV

SEQ ID NO: 1183438 - protein, 9 aa, Homo Sapiens
CFTMAVSTS

SEQ ID NO: 1183439 - protein, 9 aa, Homo Sapiens
SAIIHKAAS

SEQ ID NO: 1183440 - protein, 9 aa, Homo Sapiens
RGRYGRHRP

SEQ ID NO: 1183441 - protein, 9 aa, Homo Sapiens
GGSYKLTLM

SEQ ID NO: 1183442 - protein, 9 aa, Homo Sapiens
QQCQAPGAT

SEQ ID NO: 1183443 - protein, 9 aa, Homo Sapiens
GSTSGARVL

SEQ ID NO: 1183444 - protein, 9 aa, Homo Sapiens
TTTAPASCT

SEQ ID NO: 1183445 - protein, 9 aa, Homo Sapiens
FGTSVVKRR

SEQ ID NO: 1183446 - protein, 9 aa, Homo Sapiens
VVRTTSSPC

SEQ ID NO: 1183447 - protein, 9 aa, Homo Sapiens
KISFRVLAS

SEQ ID NO: 1183448 - protein, 9 aa, Homo Sapiens
PAPGVPFAP

SEQ ID NO: 1183449 - protein, 9 aa, Homo Sapiens
PPSRASAGA

SEQ ID NO: 1183450 - protein, 9 aa, Homo Sapiens
SVFENYYVA

SEQ ID NO: 1183451 - protein, 9 aa, Homo Sapiens
LPWGPQGPL

SEQ ID NO: 1183452 - protein, 9 aa, Homo Sapiens
ELLKRTPWK

SEQ ID NO: 1183453 - protein, 9 aa, Homo Sapiens
HYIPVGIII

SEQ ID NO: 1183454 - protein, 9 aa, Homo Sapiens
RTTQAAAAL

SEQ ID NO: 1183455 - protein, 9 aa, Homo Sapiens
NNPEIVAVY

SEQ ID NO: 1183456 - protein, 9 aa, Homo Sapiens
REGLAGQRP

SEQ ID NO: 1183457 - protein, 9 aa, Homo Sapiens
LSVPQTQVI

SEQ ID NO: 1183458 - protein, 9 aa, Homo Sapiens
VRIDKVGGI

SEQ ID NO: 1183459 - protein, 9 aa, Homo Sapiens
HLYCQPLLW

SEQ ID NO: 1183460 - protein, 9 aa, Homo Sapiens
IYPVGYCRT

SEQ ID NO: 1183461 - protein, 9 aa, Homo Sapiens
LVSQVRQPQ

SEQ ID NO: 1183462 - protein, 9 aa, Homo Sapiens
LGALGRGST

SEQ ID NO: 1183463 - protein, 9 aa, Homo Sapiens
WVSGKTDIC

SEQ ID NO: 1183464 - protein, 9 aa, Homo Sapiens
ICSTTNTQC

SEQ ID NO: 1183465 - protein, 9 aa, Homo Sapiens
SAGGGRNFP

SEQ ID NO: 1183466 - protein, 9 aa, Homo Sapiens
PTLPPYWCS

SEQ ID NO: 1183467 - protein, 9 aa, Homo Sapiens
DKKYKKRKH

SEQ ID NO: 1183468 - protein, 9 aa, Homo Sapiens
PTATLGLCI

SEQ ID NO: 1183469 - protein, 9 aa, Homo Sapiens
LMFINLGLG

SEQ ID NO: 1183470 - protein, 9 aa, Homo Sapiens
PVAGPWSGT

SEQ ID NO: 1183471 - protein, 9 aa, Homo Sapiens
YLESEEFQR

SEQ ID NO: 1183472 - protein, 9 aa, Homo Sapiens
YAAWRALGA

SEQ ID NO: 1183473 - protein, 9 aa, Homo Sapiens
RPPVAGPWS

SEQ ID NO: 1183474 - protein, 9 aa, Homo Sapiens
PTVRLLELP

SEQ ID NO: 1183475 - protein, 9 aa, Homo Sapiens
KRSLNGKQE

SEQ ID NO: 1183476 - protein, 9 aa, Homo Sapiens
PGQEVHLGS

SEQ ID NO: 1183477 - protein, 9 aa, Homo Sapiens
LAMYNSWKN

SEQ ID NO: 1183478 - protein, 9 aa, Homo Sapiens
SRGGLCPGS

SEQ ID NO: 1183479 - protein, 9 aa, Homo Sapiens
DVTYTKAKR

SEQ ID NO: 1183480 - protein, 9 aa, Homo Sapiens
QNLKSEGFY

SEQ ID NO: 1183481 - protein, 9 aa, Homo Sapiens
VAVIGDERL

SEQ ID NO: 1183482 - protein, 9 aa, Homo Sapiens
SGYGQHRSS

SEQ ID NO: 1183483 - protein, 9 aa, Homo Sapiens
QRLEKMKIN

SEQ ID NO: 1183484 - protein, 9 aa, Homo Sapiens
TSGGPGAWG

SEQ ID NO: 1183485 - protein, 9 aa, Homo Sapiens
LKPRARDNY

SEQ ID NO: 1183486 - protein, 9 aa, Homo Sapiens
SWWLASRPS

SEQ ID NO: 1183487 - protein, 9 aa, Homo Sapiens
PRPAVDPAA

SEQ ID NO: 1183488 - protein, 9 aa, Homo Sapiens
TEGSPMTLN

SEQ ID NO: 1183489 - protein, 9 aa, Homo Sapiens
MPKEMVPPG

SEQ ID NO: 1183490 - protein, 9 aa, Homo Sapiens
FFNVLKEID

SEQ ID NO: 1183491 - protein, 9 aa, Homo Sapiens
EDWSFLQFM

SEQ ID NO: 1183492 - protein, 9 aa, Homo Sapiens
LPPYWCSQQ

SEQ ID NO: 1183493 - protein, 9 aa, Homo Sapiens
ITVTTTQSR

SEQ ID NO: 1183494 - protein, 9 aa, Homo Sapiens
QSQVELFVK

SEQ ID NO: 1183495 - protein, 9 aa, Homo Sapiens
SSALYPATT

SEQ ID NO: 1183496 - protein, 9 aa, Homo Sapiens
RPNSSHRQE

SEQ ID NO: 1183497 - protein, 9 aa, Homo Sapiens
GTHSALSSA

SEQ ID NO: 1183498 - protein, 9 aa, Homo Sapiens
TSQNHSKCI

SEQ ID NO: 1183499 - protein, 9 aa, Homo Sapiens
GPPEYMGQR

SEQ ID NO: 1183500 - protein, 9 aa, Homo Sapiens
SALPRRKVM

SEQ ID NO: 1183501 - protein, 9 aa, Homo Sapiens
ESINWTKIE

SEQ ID NO: 1183502 - protein, 9 aa, Homo Sapiens
VVVRPQSVF

SEQ ID NO: 1183503 - protein, 9 aa, Homo Sapiens
LISASAMLL

SEQ ID NO: 1183504 - protein, 9 aa, Homo Sapiens
AAALVDFTG

SEQ ID NO: 1183505 - protein, 9 aa, Homo Sapiens
SEAAAFPHE

SEQ ID NO: 1183506 - protein, 9 aa, Homo Sapiens
SEHRNFLVS

SEQ ID NO: 1183507 - protein, 9 aa, Homo Sapiens
FLVSGWHCF

SEQ ID NO: 1183508 - protein, 9 aa, Homo Sapiens
FKLLKEGHC

SEQ ID NO: 1183509 - protein, 9 aa, Homo Sapiens
PWPRTSPRP

SEQ ID NO: 1183510 - protein, 9 aa, Homo Sapiens
ADSRKRHLI

SEQ ID NO: 1183511 - protein, 9 aa, Homo Sapiens
STHILGKEK

SEQ ID NO: 1183512 - protein, 9 aa, Homo Sapiens
SGRKAPRVA

SEQ ID NO: 1183513 - protein, 9 aa, Homo Sapiens
EICDDKVST

SEQ ID NO: 1183514 - protein, 9 aa, Homo Sapiens
VTVAVGCRR

SEQ ID NO: 1183515 - protein, 9 aa, Homo Sapiens
LNKGVFREK

SEQ ID NO: 1183516 - protein, 9 aa, Homo Sapiens
PALPMVVVT

SEQ ID NO: 1183517 - protein, 9 aa, Homo Sapiens
TGNPLSVEL

SEQ ID NO: 1183518 - protein, 9 aa, Homo Sapiens
GTRRSCSGL

SEQ ID NO: 1183519 - protein, 9 aa, Homo Sapiens
AKKIKIFFC

SEQ ID NO: 1183520 - protein, 9 aa, Homo Sapiens
GACRPACTC

SEQ ID NO: 1183521 - protein, 9 aa, Homo Sapiens
APALRSGAN

SEQ ID NO: 1183522 - protein, 9 aa, Homo Sapiens
VEGKSRGCG

SEQ ID NO: 1183523 - protein, 9 aa, Homo Sapiens
SLFNSSAHV

SEQ ID NO: 1183524 - protein, 9 aa, Homo Sapiens
AADLGLGTA

SEQ ID NO: 1183525 - protein, 9 aa, Homo Sapiens
ATMSAIFDF

SEQ ID NO: 1183526 - protein, 9 aa, Homo Sapiens
AREGRARVL

SEQ ID NO: 1183527 - protein, 9 aa, Homo Sapiens
AFMLYRKEM

SEQ ID NO: 1183528 - protein, 9 aa, Homo Sapiens
FGPCSPCQF

SEQ ID NO: 1183529 - protein, 9 aa, Homo Sapiens
YYFRIASSV

SEQ ID NO: 1183530 - protein, 9 aa, Homo Sapiens
SLLNRIILV

SEQ ID NO: 1183531 - protein, 9 aa, Homo Sapiens
AAAEADAQA

SEQ ID NO: 1183532 - protein, 9 aa, Homo Sapiens
RAGSLMLIC

SEQ ID NO: 1183533 - protein, 9 aa, Homo Sapiens
GPKKCGPKP

SEQ ID NO: 1183534 - protein, 9 aa, Homo Sapiens
VDVLSSDGW

SEQ ID NO: 1183535 - protein, 9 aa, Homo Sapiens
RRAGRHHCP

SEQ ID NO: 1183536 - protein, 9 aa, Homo Sapiens
EAQEAQGIL

SEQ ID NO: 1183537 - protein, 9 aa, Homo Sapiens
PYVVVSRDC

SEQ ID NO: 1183538 - protein, 9 aa, Homo Sapiens
CHERSHVAI

SEQ ID NO: 1183539 - protein, 9 aa, Homo Sapiens
LGTAGQGLS

SEQ ID NO: 1183540 - protein, 9 aa, Homo Sapiens
AKSPSPATS

SEQ ID NO: 1183541 - protein, 9 aa, Homo Sapiens
FPRSSLHPQ

SEQ ID NO: 1183542 - protein, 9 aa, Homo Sapiens
HDSSAGPEV

SEQ ID NO: 1183543 - protein, 9 aa, Homo Sapiens
AEHDAVCNA

SEQ ID NO: 1183544 - protein, 9 aa, Homo Sapiens
KKMMEVQKS

SEQ ID NO: 1183545 - protein, 9 aa, Homo Sapiens
LLPVPQSCL

SEQ ID NO: 1183546 - protein, 9 aa, Homo Sapiens
LPLLPLQGA

SEQ ID NO: 1183547 - protein, 9 aa, Homo Sapiens
SCTWSRWLI

SEQ ID NO: 1183548 - protein, 9 aa, Homo Sapiens
YKVQDIIVS

SEQ ID NO: 1183549 - protein, 9 aa, Homo Sapiens
RGHFPGCWA

SEQ ID NO: 1183550 - protein, 9 aa, Homo Sapiens
LAQQDPQLH

SEQ ID NO: 1183551 - protein, 9 aa, Homo Sapiens
PKKPGAPCL

SEQ ID NO: 1183552 - protein, 9 aa, Homo Sapiens
LKMNFTGGT

SEQ ID NO: 1183553 - protein, 9 aa, Homo Sapiens
EACHERSHV

SEQ ID NO: 1183554 - protein, 9 aa, Homo Sapiens
YATYCHTQL

SEQ ID NO: 1183555 - protein, 9 aa, Homo Sapiens
VQRTTVHVT

SEQ ID NO: 1183556 - protein, 9 aa, Homo Sapiens
KQRTHLIAH

SEQ ID NO: 1183557 - protein, 9 aa, Homo Sapiens
HTIHAGFDA

SEQ ID NO: 1183558 - protein, 9 aa, Homo Sapiens
SPAARPPQP

SEQ ID NO: 1183559 - protein, 9 aa, Homo Sapiens
AIYPVGYCR

SEQ ID NO: 1183560 - protein, 9 aa, Homo Sapiens
LALEVTFPP

SEQ ID NO: 1183561 - protein, 9 aa, Homo Sapiens
RIMFNILQS

SEQ ID NO: 1183562 - protein, 9 aa, Homo Sapiens
SCARWRTRC

SEQ ID NO: 1183563 - protein, 9 aa, Homo Sapiens
EYYSCVGLS

SEQ ID NO: 1183564 - protein, 9 aa, Homo Sapiens
TSTVCCMHL

SEQ ID NO: 1183565 - protein, 9 aa, Homo Sapiens
HGLEDWSFL

SEQ ID NO: 1183566 - protein, 9 aa, Homo Sapiens
KGKGGKNRC

SEQ ID NO: 1183567 - protein, 9 aa, Homo Sapiens
SSSLSLPAI

SEQ ID NO: 1183568 - protein, 9 aa, Homo Sapiens
SVAAGAMAG

SEQ ID NO: 1183569 - protein, 9 aa, Homo Sapiens
GATAVHFAA

SEQ ID NO: 1183570 - protein, 9 aa, Homo Sapiens
VASAQISMN

SEQ ID NO: 1183571 - protein, 9 aa, Homo Sapiens
SIHTYQVCN

SEQ ID NO: 1183572 - protein, 9 aa, Homo Sapiens
RPDTPYFWP

SEQ ID NO: 1183573 - protein, 9 aa, Homo Sapiens
RPLVLTYVW

SEQ ID NO: 1183574 - protein, 9 aa, Homo Sapiens
LPCCVPPED

SEQ ID NO: 1183575 - protein, 9 aa, Homo Sapiens
AGCRLEEEY

SEQ ID NO: 1183576 - protein, 9 aa, Homo Sapiens
LKEMFSSKF

SEQ ID NO: 1183577 - protein, 9 aa, Homo Sapiens
LNEIAREIQ

SEQ ID NO: 1183578 - protein, 9 aa, Homo Sapiens
KLEKALSAL

SEQ ID NO: 1183579 - protein, 9 aa, Homo Sapiens
SKSLSMFQQ

SEQ ID NO: 1183580 - protein, 9 aa, Homo Sapiens
ILPFVNKAG

SEQ ID NO: 1183581 - protein, 9 aa, Homo Sapiens
TFERVFGRG

SEQ ID NO: 1183582 - protein, 9 aa, Homo Sapiens
LSVLWKLCL

SEQ ID NO: 1183583 - protein, 9 aa, Homo Sapiens
SSGVYPASA

SEQ ID NO: 1183584 - protein, 9 aa, Homo Sapiens
PRWCSSRNS

SEQ ID NO: 1183585 - protein, 9 aa, Homo Sapiens
YHSGPESGR

SEQ ID NO: 1183586 - protein, 9 aa, Homo Sapiens
RVLSKVGGS

SEQ ID NO: 1183587 - protein, 9 aa, Homo Sapiens
GTGLLAACF

SEQ ID NO: 1183588 - protein, 9 aa, Homo Sapiens
ISLIFLEGV

SEQ ID NO: 1183589 - protein, 9 aa, Homo Sapiens
QSGYCSMQR

SEQ ID NO: 1183590 - protein, 9 aa, Homo Sapiens
TLFSINIFT

SEQ ID NO: 1183591 - protein, 9 aa, Homo Sapiens
WKATAWMSP

SEQ ID NO: 1183592 - protein, 9 aa, Homo Sapiens
HGWMVSSRS

SEQ ID NO: 1183593 - protein, 9 aa, Homo Sapiens
TWENDQVTL

SEQ ID NO: 1183594 - protein, 9 aa, Homo Sapiens
PPVPQLLLA

SEQ ID NO: 1183595 - protein, 9 aa, Homo Sapiens
STHLHEWID

SEQ ID NO: 1183596 - protein, 9 aa, Homo Sapiens
LGLPHLEFY

SEQ ID NO: 1183597 - protein, 9 aa, Homo Sapiens
GRLSPSPAG

SEQ ID NO: 1183598 - protein, 9 aa, Homo Sapiens
PEPRQQHRH

SEQ ID NO: 1183599 - protein, 9 aa, Homo Sapiens
QRSPHRRTR

SEQ ID NO: 1183600 - protein, 9 aa, Homo Sapiens
SWAALSGDC

SEQ ID NO: 1183601 - protein, 9 aa, Homo Sapiens
GEQNLLGRS

SEQ ID NO: 1183602 - protein, 9 aa, Homo Sapiens
PRLTRSQRM

SEQ ID NO: 1183603 - protein, 9 aa, Homo Sapiens
GTMEAKEVN

SEQ ID NO: 1183604 - protein, 9 aa, Homo Sapiens
HSSMSGQGK

SEQ ID NO: 1183605 - protein, 9 aa, Homo Sapiens
MRRLGTRGN

SEQ ID NO: 1183606 - protein, 9 aa, Homo Sapiens
PRPPSISKN

SEQ ID NO: 1183607 - protein, 9 aa, Homo Sapiens
SASLMILVI

SEQ ID NO: 1183608 - protein, 9 aa, Homo Sapiens
FSSSGKGVR

SEQ ID NO: 1183609 - protein, 9 aa, Homo Sapiens
TVAVGCRRC

SEQ ID NO: 1183610 - protein, 9 aa, Homo Sapiens
HNICHQVPY

SEQ ID NO: 1183611 - protein, 9 aa, Homo Sapiens
LPYQTCSAG

SEQ ID NO: 1183612 - protein, 9 aa, Homo Sapiens
FWLKRQATF

SEQ ID NO: 1183613 - protein, 9 aa, Homo Sapiens
PPILAPPAP

SEQ ID NO: 1183614 - protein, 9 aa, Homo Sapiens
RFSSTEPCG

SEQ ID NO: 1183615 - protein, 9 aa, Homo Sapiens
CIKISLIFL

SEQ ID NO: 1183616 - protein, 9 aa, Homo Sapiens
WKQLHSSGN

SEQ ID NO: 1183617 - protein, 9 aa, Homo Sapiens
ETPARWATQ

SEQ ID NO: 1183618 - protein, 9 aa, Homo Sapiens
RARLETLAS

SEQ ID NO: 1183619 - protein, 9 aa, Homo Sapiens
WSSSTRSSP

SEQ ID NO: 1183620 - protein, 9 aa, Homo Sapiens
TLGLCIRSA

SEQ ID NO: 1183621 - protein, 9 aa, Homo Sapiens
PELVIPEVL

SEQ ID NO: 1183622 - protein, 9 aa, Homo Sapiens
IPHGQHTQV

SEQ ID NO: 1183623 - protein, 9 aa, Homo Sapiens
SRTACGAAS

SEQ ID NO: 1183624 - protein, 9 aa, Homo Sapiens
VRRNRGGRC

SEQ ID NO: 1183625 - protein, 9 aa, Homo Sapiens
WYQRSSCHL

SEQ ID NO: 1183626 - protein, 9 aa, Homo Sapiens
WATGGNRTK

SEQ ID NO: 1183627 - protein, 9 aa, Homo Sapiens
LQREDLLAR

SEQ ID NO: 1183628 - protein, 9 aa, Homo Sapiens
TTDVNDALG

SEQ ID NO: 1183629 - protein, 9 aa, Homo Sapiens
LSAGHVRLH

SEQ ID NO: 1183630 - protein, 9 aa, Homo Sapiens
LGSVDSFEW

SEQ ID NO: 1183631 - protein, 9 aa, Homo Sapiens
GMVYTIGGE

SEQ ID NO: 1183632 - protein, 9 aa, Homo Sapiens
TPTRRPRSP

SEQ ID NO: 1183633 - protein, 9 aa, Homo Sapiens
WRKRPVSLR

SEQ ID NO: 1183634 - protein, 9 aa, Homo Sapiens
VKEAIDHIQ

SEQ ID NO: 1183635 - protein, 9 aa, Homo Sapiens
AWMSPSVQV

SEQ ID NO: 1183636 - protein, 9 aa, Homo Sapiens
PPPAKHSSS

SEQ ID NO: 1183637 - protein, 9 aa, Homo Sapiens
TRVPPGRAL

SEQ ID NO: 1183638 - protein, 9 aa, Homo Sapiens
WPPSSRRSW

SEQ ID NO: 1183639 - protein, 9 aa, Homo Sapiens
PGASRESPS

SEQ ID NO: 1183640 - protein, 9 aa, Homo Sapiens
DSTMLIHSS

SEQ ID NO: 1183641 - protein, 9 aa, Homo Sapiens
EAGLEHVHL

SEQ ID NO: 1183642 - protein, 9 aa, Homo Sapiens
QHPRRPGAA

SEQ ID NO: 1183643 - protein, 9 aa, Homo Sapiens
SQANSQPLY

SEQ ID NO: 1183644 - protein, 9 aa, Homo Sapiens
AMSFLGMSL

SEQ ID NO: 1183645 - protein, 9 aa, Homo Sapiens
PWIEACCSL

SEQ ID NO: 1183646 - protein, 9 aa, Homo Sapiens
GGPEAPSTR

SEQ ID NO: 1183647 - protein, 9 aa, Homo Sapiens
QLNSPGSLK

SEQ ID NO: 1183648 - protein, 9 aa, Homo Sapiens
SANRGEAAL

SEQ ID NO: 1183649 - protein, 9 aa, Homo Sapiens
SGQADGSSS

SEQ ID NO: 1183650 - protein, 9 aa, Homo Sapiens
GAPLVRTGF

SEQ ID NO: 1183651 - protein, 9 aa, Homo Sapiens
DILDLCQQL

SEQ ID NO: 1183652 - protein, 9 aa, Homo Sapiens
ALVAPRGLL

SEQ ID NO: 1183653 - protein, 9 aa, Homo Sapiens
VKKDILVLN

SEQ ID NO: 1183654 - protein, 9 aa, Homo Sapiens
DTPPPACTS

SEQ ID NO: 1183655 - protein, 9 aa, Homo Sapiens
PSSPCPTSR

SEQ ID NO: 1183656 - protein, 9 aa, Homo Sapiens
DHRGGNPRP

SEQ ID NO: 1183657 - protein, 9 aa, Homo Sapiens
GAAGAGRGQ

SEQ ID NO: 1183658 - protein, 9 aa, Homo Sapiens
TLTIRCCCR

SEQ ID NO: 1183659 - protein, 9 aa, Homo Sapiens
EREAVRTLV

SEQ ID NO: 1183660 - protein, 9 aa, Homo Sapiens
ASLNPRKVC

SEQ ID NO: 1183661 - protein, 9 aa, Homo Sapiens
LFSINIFTK

SEQ ID NO: 1183662 - protein, 9 aa, Homo Sapiens
EDEDSKQNI

SEQ ID NO: 1183663 - protein, 9 aa, Homo Sapiens
GHYQLRVQL

SEQ ID NO: 1183664 - protein, 9 aa, Homo Sapiens
SVKEMDEEG

SEQ ID NO: 1183665 - protein, 9 aa, Homo Sapiens
LLPLTRPRL

SEQ ID NO: 1183666 - protein, 9 aa, Homo Sapiens
GPWDWFPPC

SEQ ID NO: 1183667 - protein, 9 aa, Homo Sapiens
VSPRPPIHQ

SEQ ID NO: 1183668 - protein, 9 aa, Homo Sapiens
EVLAIPQLP

SEQ ID NO: 1183669 - protein, 9 aa, Homo Sapiens
ELLYLSTES

SEQ ID NO: 1183670 - protein, 9 aa, Homo Sapiens
STHSGNNVV

SEQ ID NO: 1183671 - protein, 9 aa, Homo Sapiens
VRQVHPVLR

SEQ ID NO: 1183672 - protein, 9 aa, Homo Sapiens
SRSSCHNGT

SEQ ID NO: 1183673 - protein, 9 aa, Homo Sapiens
GNQLRNHYI

SEQ ID NO: 1183674 - protein, 9 aa, Homo Sapiens
CERIGAKHQ

SEQ ID NO: 1183675 - protein, 9 aa, Homo Sapiens
VLVVSGGVA

SEQ ID NO: 1183676 - protein, 9 aa, Homo Sapiens
LLPLIHPRP

SEQ ID NO: 1183677 - protein, 9 aa, Homo Sapiens
ARQESTTDH

SEQ ID NO: 1183678 - protein, 9 aa, Homo Sapiens
PLRPGGLSQ

SEQ ID NO: 1183679 - protein, 9 aa, Homo Sapiens
YGRHRPFIW

SEQ ID NO: 1183680 - protein, 9 aa, Homo Sapiens
ALGWSPCDR

SEQ ID NO: 1183681 - protein, 9 aa, Homo Sapiens
TFLTQRQDT

SEQ ID NO: 1183682 - protein, 9 aa, Homo Sapiens
WLVAPLITR

SEQ ID NO: 1183683 - protein, 9 aa, Homo Sapiens
WTIFAPSLE

SEQ ID NO: 1183684 - protein, 9 aa, Homo Sapiens
LLFSHLGDG

SEQ ID NO: 1183685 - protein, 9 aa, Homo Sapiens
KNFTNPNGT

SEQ ID NO: 1183686 - protein, 9 aa, Homo Sapiens
IGDDTCQVG

SEQ ID NO: 1183687 - protein, 9 aa, Homo Sapiens
SLAGLELVV

SEQ ID NO: 1183688 - protein, 9 aa, Homo Sapiens
PEHLSPEEL

SEQ ID NO: 1183689 - protein, 9 aa, Homo Sapiens
RSLSWYQRS

SEQ ID NO: 1183690 - protein, 9 aa, Homo Sapiens
QQCFKKMKF

SEQ ID NO: 1183691 - protein, 9 aa, Homo Sapiens
LVPVVSTST

SEQ ID NO: 1183692 - protein, 9 aa, Homo Sapiens
HKKKSVWQR

SEQ ID NO: 1183693 - protein, 9 aa, Homo Sapiens
HIKENTTYF

SEQ ID NO: 1183694 - protein, 9 aa, Homo Sapiens
PWLEQMLHS

SEQ ID NO: 1183695 - protein, 9 aa, Homo Sapiens
GTPPMPAWP

SEQ ID NO: 1183696 - protein, 9 aa, Homo Sapiens
AEGSLKKTS

SEQ ID NO: 1183697 - protein, 9 aa, Homo Sapiens
RGAPAQSPG

SEQ ID NO: 1183698 - protein, 9 aa, Homo Sapiens
GVDANRSWK

SEQ ID NO: 1183699 - protein, 9 aa, Homo Sapiens
LSTHILGKE

SEQ ID NO: 1183700 - protein, 9 aa, Homo Sapiens
QVHLEAVAG

SEQ ID NO: 1183701 - protein, 9 aa, Homo Sapiens
RPRLLPLTR

SEQ ID NO: 1183702 - protein, 9 aa, Homo Sapiens
SPHMRRRTT

SEQ ID NO: 1183703 - protein, 9 aa, Homo Sapiens
LEVDDEGDR

SEQ ID NO: 1183704 - protein, 9 aa, Homo Sapiens
EDENYYQKT

SEQ ID NO: 1183705 - protein, 9 aa, Homo Sapiens
QSGTKMKAT

SEQ ID NO: 1183706 - protein, 9 aa, Homo Sapiens
IRNDGALLL

SEQ ID NO: 1183707 - protein, 9 aa, Homo Sapiens
AGRSSKRSS

SEQ ID NO: 1183708 - protein, 9 aa, Homo Sapiens
RPLCLQTMK

SEQ ID NO: 1183709 - protein, 9 aa, Homo Sapiens
DEIFLKLVN

SEQ ID NO: 1183710 - protein, 9 aa, Homo Sapiens
HLGGAGARG

SEQ ID NO: 1183711 - protein, 9 aa, Homo Sapiens
HVCGSSCFE

SEQ ID NO: 1183712 - protein, 9 aa, Homo Sapiens
ISAPQPSSS

SEQ ID NO: 1183713 - protein, 9 aa, Homo Sapiens
GHPLLPAST

SEQ ID NO: 1183714 - protein, 9 aa, Homo Sapiens
PPQPPPPPG

SEQ ID NO: 1183715 - protein, 9 aa, Homo Sapiens
EDIIKNDGA

SEQ ID NO: 1183716 - protein, 9 aa, Homo Sapiens
GKLKSQYTK

SEQ ID NO: 1183717 - protein, 9 aa, Homo Sapiens
LICKSLTEQ

SEQ ID NO: 1183718 - protein, 9 aa, Homo Sapiens
ISVDSVFVL

SEQ ID NO: 1183719 - protein, 9 aa, Homo Sapiens
QTVMVLPGG

SEQ ID NO: 1183720 - protein, 9 aa, Homo Sapiens
APWWGRRPR

SEQ ID NO: 1183721 - protein, 9 aa, Homo Sapiens
LRTAGTQML

SEQ ID NO: 1183722 - protein, 9 aa, Homo Sapiens
DAGEMVHQA

SEQ ID NO: 1183723 - protein, 9 aa, Homo Sapiens
ANAATCFKR

SEQ ID NO: 1183724 - protein, 9 aa, Homo Sapiens
LERLLELER

SEQ ID NO: 1183725 - protein, 9 aa, Homo Sapiens
LSADKKCIM

SEQ ID NO: 1183726 - protein, 9 aa, Homo Sapiens
HSSGGSPEW

SEQ ID NO: 1183727 - protein, 9 aa, Homo Sapiens
SGGPWPALA

SEQ ID NO: 1183728 - protein, 9 aa, Homo Sapiens
MVAHTWNPS

SEQ ID NO: 1183729 - protein, 9 aa, Homo Sapiens
SACQGGFMA

SEQ ID NO: 1183730 - protein, 9 aa, Homo Sapiens
AEGVSDTNS

SEQ ID NO: 1183731 - protein, 9 aa, Homo Sapiens
CDSISRLDQ

SEQ ID NO: 1183732 - protein, 9 aa, Homo Sapiens
LSTTGESEK

SEQ ID NO: 1183733 - protein, 9 aa, Homo Sapiens
SAACTPSRP

SEQ ID NO: 1183734 - protein, 9 aa, Homo Sapiens
LSPVFSGQL

SEQ ID NO: 1183735 - protein, 9 aa, Homo Sapiens
QQLEITGKK

SEQ ID NO: 1183736 - protein, 9 aa, Homo Sapiens
LTLVLIRVT

SEQ ID NO: 1183737 - protein, 9 aa, Homo Sapiens
SVPQTQVIE

SEQ ID NO: 1183738 - protein, 9 aa, Homo Sapiens
REEQVPQAW

SEQ ID NO: 1183739 - protein, 9 aa, Homo Sapiens
AYHFFCHYK

SEQ ID NO: 1183740 - protein, 9 aa, Homo Sapiens
LGCSSHQGL

SEQ ID NO: 1183741 - protein, 9 aa, Homo Sapiens
PSTKIRLFT

SEQ ID NO: 1183742 - protein, 9 aa, Homo Sapiens
PHLEFYRYY

SEQ ID NO: 1183743 - protein, 9 aa, Homo Sapiens
RGHAQHPRR

SEQ ID NO: 1183744 - protein, 9 aa, Homo Sapiens
LKKKEVVEE

SEQ ID NO: 1183745 - protein, 9 aa, Homo Sapiens
PCSRGLPTT

SEQ ID NO: 1183746 - protein, 9 aa, Homo Sapiens
KVLNLCLLP

SEQ ID NO: 1183747 - protein, 9 aa, Homo Sapiens
PKASRATLA

SEQ ID NO: 1183748 - protein, 9 aa, Homo Sapiens
SEHTPEVLE

SEQ ID NO: 1183749 - protein, 9 aa, Homo Sapiens
RLKENEKLR

SEQ ID NO: 1183750 - protein, 9 aa, Homo Sapiens
YFGAVRQEP

SEQ ID NO: 1183751 - protein, 9 aa, Homo Sapiens
SMGGSWNFG

SEQ ID NO: 1183752 - protein, 9 aa, Homo Sapiens
GSFLGRTRE

SEQ ID NO: 1183753 - protein, 9 aa, Homo Sapiens
PAPKMCAPV

SEQ ID NO: 1183754 - protein, 9 aa, Homo Sapiens
VLAIMQDLI

SEQ ID NO: 1183755 - protein, 9 aa, Homo Sapiens
ENDLALQLQ

SEQ ID NO: 1183756 - protein, 9 aa, Homo Sapiens
GEIRRTTQA

SEQ ID NO: 1183757 - protein, 9 aa, Homo Sapiens
DKKNGIWEV

SEQ ID NO: 1183758 - protein, 9 aa, Homo Sapiens
TIHCNRIAA

SEQ ID NO: 1183759 - protein, 9 aa, Homo Sapiens
STCGRRTRK

SEQ ID NO: 1183760 - protein, 9 aa, Homo Sapiens
RGPAEKELK

SEQ ID NO: 1183761 - protein, 9 aa, Homo Sapiens
SSMTPLDTN

SEQ ID NO: 1183762 - protein, 9 aa, Homo Sapiens
FVAFTLWTS

SEQ ID NO: 1183763 - protein, 9 aa, Homo Sapiens
GVGETAPWA

SEQ ID NO: 1183764 - protein, 9 aa, Homo Sapiens
PSAVMQSGG

SEQ ID NO: 1183765 - protein, 9 aa, Homo Sapiens
SCEREEKHL

SEQ ID NO: 1183766 - protein, 9 aa, Homo Sapiens
RWTAHREPH

SEQ ID NO: 1183767 - protein, 9 aa, Homo Sapiens
AWFLTLCTW

SEQ ID NO: 1183768 - protein, 9 aa, Homo Sapiens
DWVSFAVLL

SEQ ID NO: 1183769 - protein, 9 aa, Homo Sapiens
AAPTPIPAP

SEQ ID NO: 1183770 - protein, 9 aa, Homo Sapiens
ITAKLDEKT

SEQ ID NO: 1183771 - protein, 9 aa, Homo Sapiens
QNLAVHGLA

SEQ ID NO: 1183772 - protein, 9 aa, Homo Sapiens
WYSMPWHSC

SEQ ID NO: 1183773 - protein, 9 aa, Homo Sapiens
CQRNIPLLL

SEQ ID NO: 1183774 - protein, 9 aa, Homo Sapiens
SPPSPSRRR

SEQ ID NO: 1183775 - protein, 9 aa, Homo Sapiens
FFSGWISGS

SEQ ID NO: 1183776 - protein, 9 aa, Homo Sapiens
LHPPAIRGL

SEQ ID NO: 1183777 - protein, 9 aa, Homo Sapiens
NSKSIFCSD

SEQ ID NO: 1183778 - protein, 9 aa, Homo Sapiens
QVTLGRWSI

SEQ ID NO: 1183779 - protein, 9 aa, Homo Sapiens
KIPTGATNV

SEQ ID NO: 1183780 - protein, 9 aa, Homo Sapiens
IEKHKACSG

SEQ ID NO: 1183781 - protein, 9 aa, Homo Sapiens
VSSDPRARL

SEQ ID NO: 1183782 - protein, 9 aa, Homo Sapiens
LCKIQKVWA

SEQ ID NO: 1183783 - protein, 9 aa, Homo Sapiens
WSGCSSASA

SEQ ID NO: 1183784 - protein, 9 aa, Homo Sapiens
KRGSPTLGT

SEQ ID NO: 1183785 - protein, 9 aa, Homo Sapiens
PQGPCPPPV

SEQ ID NO: 1183786 - protein, 9 aa, Homo Sapiens
WWATRWSAW

SEQ ID NO: 1183787 - protein, 9 aa, Homo Sapiens
GRCSCGQGS

SEQ ID NO: 1183788 - protein, 9 aa, Homo Sapiens
SASALGYPH

SEQ ID NO: 1183789 - protein, 9 aa, Homo Sapiens
TATSPATTW

SEQ ID NO: 1183790 - protein, 9 aa, Homo Sapiens
TMPPQVCFL

SEQ ID NO: 1183791 - protein, 9 aa, Homo Sapiens
FPFGSIAYC

SEQ ID NO: 1183792 - protein, 9 aa, Homo Sapiens
TEVDIPSIQ

SEQ ID NO: 1183793 - protein, 9 aa, Homo Sapiens
TCCSSLSLR

SEQ ID NO: 1183794 - protein, 9 aa, Homo Sapiens
QWAPSKYTC

SEQ ID NO: 1183795 - protein, 9 aa, Homo Sapiens
VEASVIKER

SEQ ID NO: 1183796 - protein, 9 aa, Homo Sapiens
PANGAPPEC

SEQ ID NO: 1183797 - protein, 9 aa, Homo Sapiens
SVMFFLMFI

SEQ ID NO: 1183798 - protein, 9 aa, Homo Sapiens
QWAAWRRRR

SEQ ID NO: 1183799 - protein, 9 aa, Homo Sapiens
PAPAAALSP

SEQ ID NO: 1183800 - protein, 9 aa, Homo Sapiens
SQCLTSTTP

SEQ ID NO: 1183801 - protein, 9 aa, Homo Sapiens
LAHRLRCWH

SEQ ID NO: 1183802 - protein, 9 aa, Homo Sapiens
LQFMMVMLD

SEQ ID NO: 1183803 - protein, 9 aa, Homo Sapiens
SNLEKKRKK

SEQ ID NO: 1183804 - protein, 9 aa, Homo Sapiens
PDEESINWT

SEQ ID NO: 1183805 - protein, 9 aa, Homo Sapiens
STCFFPTLP

SEQ ID NO: 1183806 - protein, 9 aa, Homo Sapiens
SHPVAKKSQ

SEQ ID NO: 1183807 - protein, 9 aa, Homo Sapiens
MASRRFQCV

SEQ ID NO: 1183808 - protein, 9 aa, Homo Sapiens
TQDRGLQAL

SEQ ID NO: 1183809 - protein, 9 aa, Homo Sapiens
RIHKVPLLE

SEQ ID NO: 1183810 - protein, 9 aa, Homo Sapiens
DIRFETFQT

SEQ ID NO: 1183811 - protein, 9 aa, Homo Sapiens
SLEAHTCWQ

SEQ ID NO: 1183812 - protein, 9 aa, Homo Sapiens
VINIQNKKL

SEQ ID NO: 1183813 - protein, 9 aa, Homo Sapiens
SPVFFSIIN

SEQ ID NO: 1183814 - protein, 9 aa, Homo Sapiens
PHSTGPPTS

SEQ ID NO: 1183815 - protein, 9 aa, Homo Sapiens
TQNYHEEII

SEQ ID NO: 1183816 - protein, 9 aa, Homo Sapiens
SEPEFIEGG

SEQ ID NO: 1183817 - protein, 9 aa, Homo Sapiens
KQKKTATKI

SEQ ID NO: 1183818 - protein, 9 aa, Homo Sapiens
VFLCGPQKI

SEQ ID NO: 1183819 - protein, 9 aa, Homo Sapiens
WQNCVWQVW

SEQ ID NO: 1183820 - protein, 9 aa, Homo Sapiens
LSATIVLKN

SEQ ID NO: 1183821 - protein, 9 aa, Homo Sapiens
EDKEWNNLG

SEQ ID NO: 1183822 - protein, 9 aa, Homo Sapiens
SSPLTTSPL

SEQ ID NO: 1183823 - protein, 9 aa, Homo Sapiens
SCSGRSAAS

SEQ ID NO: 1183824 - protein, 9 aa, Homo Sapiens
AADLRKSLE

SEQ ID NO: 1183825 - protein, 9 aa, Homo Sapiens
LLPPTSTTR

SEQ ID NO: 1183826 - protein, 9 aa, Homo Sapiens
NQRAQARVG

SEQ ID NO: 1183827 - protein, 9 aa, Homo Sapiens
MKLVYKKHF

SEQ ID NO: 1183828 - protein, 9 aa, Homo Sapiens
QLIHSPQSY

SEQ ID NO: 1183829 - protein, 9 aa, Homo Sapiens
IHPRPPPHT

SEQ ID NO: 1183830 - protein, 9 aa, Homo Sapiens
CKEDLPREL

SEQ ID NO: 1183831 - protein, 9 aa, Homo Sapiens
RPGLPGKAE

SEQ ID NO: 1183832 - protein, 9 aa, Homo Sapiens
VKDENCGPT

SEQ ID NO: 1183833 - protein, 9 aa, Homo Sapiens
RSSIHFEME

SEQ ID NO: 1183834 - protein, 9 aa, Homo Sapiens
YIVCQCVEE

SEQ ID NO: 1183835 - protein, 9 aa, Homo Sapiens
PRTCSRRPT

SEQ ID NO: 1183836 - protein, 9 aa, Homo Sapiens
KALDIRPVS

SEQ ID NO: 1183837 - protein, 9 aa, Homo Sapiens
SQHHMEPGN

SEQ ID NO: 1183838 - protein, 9 aa, Homo Sapiens
LYIDFRKGL

SEQ ID NO: 1183839 - protein, 9 aa, Homo Sapiens
CDELGPQPI

SEQ ID NO: 1183840 - protein, 9 aa, Homo Sapiens
RANPRFCNS

SEQ ID NO: 1183841 - protein, 9 aa, Homo Sapiens
PGVPFAPCP

SEQ ID NO: 1183842 - protein, 9 aa, Homo Sapiens
GDPVLRTGN

SEQ ID NO: 1183843 - protein, 9 aa, Homo Sapiens
CWLCTARGW

SEQ ID NO: 1183844 - protein, 9 aa, Homo Sapiens
ETNLTTLTN

SEQ ID NO: 1183845 - protein, 9 aa, Homo Sapiens
EDFLKTRVS

SEQ ID NO: 1183846 - protein, 9 aa, Homo Sapiens
CSTTNTQCK

SEQ ID NO: 1183847 - protein, 9 aa, Homo Sapiens
LGGPTARPA

SEQ ID NO: 1183848 - protein, 9 aa, Homo Sapiens
QSEDWYHTL

SEQ ID NO: 1183849 - protein, 9 aa, Homo Sapiens
ASRASLDQM

SEQ ID NO: 1183850 - protein, 9 aa, Homo Sapiens
PSSTPAEEA

SEQ ID NO: 1183851 - protein, 9 aa, Homo Sapiens
TDSWWVVDC

SEQ ID NO: 1183852 - protein, 9 aa, Homo Sapiens
TGENPYKCK

SEQ ID NO: 1183853 - protein, 9 aa, Homo Sapiens
GPEAPSTRA

SEQ ID NO: 1183854 - protein, 9 aa, Homo Sapiens
RNGYCTPRE

SEQ ID NO: 1183855 - protein, 9 aa, Homo Sapiens
GAGARGEIA

SEQ ID NO: 1183856 - protein, 9 aa, Homo Sapiens
GPAPPPTSS

SEQ ID NO: 1183857 - protein, 9 aa, Homo Sapiens
TPASGGVSR

SEQ ID NO: 1183858 - protein, 9 aa, Homo Sapiens
GSTLDSCSG

SEQ ID NO: 1183859 - protein, 9 aa, Homo Sapiens
VEPVAGERA

SEQ ID NO: 1183860 - protein, 9 aa, Homo Sapiens
EHLSPEELV

SEQ ID NO: 1183861 - protein, 9 aa, Homo Sapiens
LGRECLGSF

SEQ ID NO: 1183862 - protein, 9 aa, Homo Sapiens
TCCGQIPGI

SEQ ID NO: 1183863 - protein, 9 aa, Homo Sapiens
VVGVVEQVV

SEQ ID NO: 1183864 - protein, 9 aa, Homo Sapiens
ATSMAGRKA

SEQ ID NO: 1183865 - protein, 9 aa, Homo Sapiens
RGRRPPPPL

SEQ ID NO: 1183866 - protein, 9 aa, Homo Sapiens
KVRPRKVPT

SEQ ID NO: 1183867 - protein, 9 aa, Homo Sapiens
RPTWNPAAG

SEQ ID NO: 1183868 - protein, 9 aa, Homo Sapiens
WSRGAARPR

SEQ ID NO: 1183869 - protein, 9 aa, Homo Sapiens
HIRSCGGVG

SEQ ID NO: 1183870 - protein, 9 aa, Homo Sapiens
YVEEIVNIL

SEQ ID NO: 1183871 - protein, 9 aa, Homo Sapiens
PDDQGGAAQ

SEQ ID NO: 1183872 - protein, 9 aa, Homo Sapiens
FQDEPSSAC

SEQ ID NO: 1183873 - protein, 9 aa, Homo Sapiens
MSSPRRAPL

SEQ ID NO: 1183874 - protein, 9 aa, Homo Sapiens
QKLEQCMTS

SEQ ID NO: 1183875 - protein, 9 aa, Homo Sapiens
SYITSTKTR

SEQ ID NO: 1183876 - protein, 9 aa, Homo Sapiens
TVRVQPVTK

SEQ ID NO: 1183877 - protein, 9 aa, Homo Sapiens
EESTAWGGS

SEQ ID NO: 1183878 - protein, 9 aa, Homo Sapiens
RRPPPAAPT

SEQ ID NO: 1183879 - protein, 9 aa, Homo Sapiens
RFWKKRRRS

SEQ ID NO: 1183880 - protein, 9 aa, Homo Sapiens
ANSCGDDDR

SEQ ID NO: 1183881 - protein, 9 aa, Homo Sapiens
PPPLFSQSM

SEQ ID NO: 1183882 - protein, 9 aa, Homo Sapiens
KVQARDVIA

SEQ ID NO: 1183883 - protein, 9 aa, Homo Sapiens
PDEPQKSSL

SEQ ID NO: 1183884 - protein, 9 aa, Homo Sapiens
VEKQLWGKH

SEQ ID NO: 1183885 - protein, 9 aa, Homo Sapiens
ANMCKHKVF

SEQ ID NO: 1183886 - protein, 9 aa, Homo Sapiens
RRSHSDTRP

SEQ ID NO: 1183887 - protein, 9 aa, Homo Sapiens
ASCSGRSAA

SEQ ID NO: 1183888 - protein, 9 aa, Homo Sapiens
FWGARVIAL

SEQ ID NO: 1183889 - protein, 9 aa, Homo Sapiens
HRASLLTSL

SEQ ID NO: 1183890 - protein, 9 aa, Homo Sapiens
EEGHESYEL

SEQ ID NO: 1183891 - protein, 9 aa, Homo Sapiens
ALGGRPPCP

SEQ ID NO: 1183892 - protein, 9 aa, Homo Sapiens
TKTRKALIT

SEQ ID NO: 1183893 - protein, 9 aa, Homo Sapiens
CHRRRQLRP

SEQ ID NO: 1183894 - protein, 9 aa, Homo Sapiens
LRKSLEKAQ

SEQ ID NO: 1183895 - protein, 9 aa, Homo Sapiens
RRAAPRTST

SEQ ID NO: 1183896 - protein, 9 aa, Homo Sapiens
QNVSQHVVM

SEQ ID NO: 1183897 - protein, 9 aa, Homo Sapiens
KHQVVYKTQ

SEQ ID NO: 1183898 - protein, 9 aa, Homo Sapiens
LATHVHSHP

SEQ ID NO: 1183899 - protein, 9 aa, Homo Sapiens
VVTVRDGGS

SEQ ID NO: 1183900 - protein, 9 aa, Homo Sapiens
NIPYMYIRH

SEQ ID NO: 1183901 - protein, 9 aa, Homo Sapiens
LHSGAFLLS

SEQ ID NO: 1183902 - protein, 9 aa, Homo Sapiens
FPGGGGVRW

SEQ ID NO: 1183903 - protein, 9 aa, Homo Sapiens
LLSHLYCQP

SEQ ID NO: 1183904 - protein, 9 aa, Homo Sapiens
EVATPLFPR

SEQ ID NO: 1183905 - protein, 9 aa, Homo Sapiens
RVPPGRALH

SEQ ID NO: 1183906 - protein, 9 aa, Homo Sapiens
TVKTVYANS

SEQ ID NO: 1183907 - protein, 9 aa, Homo Sapiens
QQGTHSALS

SEQ ID NO: 1183908 - protein, 9 aa, Homo Sapiens
QNANAPCVA

SEQ ID NO: 1183909 - protein, 9 aa, Homo Sapiens
AETRSTLMF

SEQ ID NO: 1183910 - protein, 9 aa, Homo Sapiens
MCLGLPLLP

SEQ ID NO: 1183911 - protein, 9 aa, Homo Sapiens
NQVTLGRWS

SEQ ID NO: 1183912 - protein, 9 aa, Homo Sapiens
VAGQDDGWG

SEQ ID NO: 1183913 - protein, 9 aa, Homo Sapiens
PTRGAGEGP

SEQ ID NO: 1183914 - protein, 9 aa, Homo Sapiens
VSMSSERYL

SEQ ID NO: 1183915 - protein, 9 aa, Homo Sapiens
GSKHWSFEK

SEQ ID NO: 1183916 - protein, 9 aa, Homo Sapiens
DPELLGKMD

SEQ ID NO: 1183917 - protein, 9 aa, Homo Sapiens
HMQHVVQLP

SEQ ID NO: 1183918 - protein, 9 aa, Homo Sapiens
SHLGDGLGH

SEQ ID NO: 1183919 - protein, 9 aa, Homo Sapiens
GRGQEEAGG

SEQ ID NO: 1183920 - protein, 9 aa, Homo Sapiens
PCRAAFRAQ

SEQ ID NO: 1183921 - protein, 9 aa, Homo Sapiens
GAPLCAGSP

SEQ ID NO: 1183922 - protein, 9 aa, Homo Sapiens
ARPRRTRSA

SEQ ID NO: 1183923 - protein, 9 aa, Homo Sapiens
PPCSWPMTT

SEQ ID NO: 1183924 - protein, 9 aa, Homo Sapiens
TVDAYHNNP

SEQ ID NO: 1183925 - protein, 9 aa, Homo Sapiens
PPCGRRPSG

SEQ ID NO: 1183926 - protein, 9 aa, Homo Sapiens
SAVIAAGPL

SEQ ID NO: 1183927 - protein, 9 aa, Homo Sapiens
YGLVGVKAS

SEQ ID NO: 1183928 - protein, 9 aa, Homo Sapiens
IEKNTKRKN

SEQ ID NO: 1183929 - protein, 9 aa, Homo Sapiens
KNNPEIVAV

SEQ ID NO: 1183930 - protein, 9 aa, Homo Sapiens
LCQGGLPTS

SEQ ID NO: 1183931 - protein, 9 aa, Homo Sapiens
WKHSDYAAV

SEQ ID NO: 1183932 - protein, 9 aa, Homo Sapiens
MYNSWKNNK

SEQ ID NO: 1183933 - protein, 9 aa, Homo Sapiens
QALPADAQA

SEQ ID NO: 1183934 - protein, 9 aa, Homo Sapiens
GLCLLRAPL

SEQ ID NO: 1183935 - protein, 9 aa, Homo Sapiens
FIVSMRYFL

SEQ ID NO: 1183936 - protein, 9 aa, Homo Sapiens
TAGTQMLEP

SEQ ID NO: 1183937 - protein, 9 aa, Homo Sapiens
CSLGVQGSA

SEQ ID NO: 1183938 - protein, 9 aa, Homo Sapiens
QQPPAAPPP

SEQ ID NO: 1183939 - protein, 9 aa, Homo Sapiens
APRPPSAGA

SEQ ID NO: 1183940 - protein, 9 aa, Homo Sapiens
IGLNNRIVE

SEQ ID NO: 1183941 - protein, 9 aa, Homo Sapiens
LLRPTGPLF

SEQ ID NO: 1183942 - protein, 9 aa, Homo Sapiens
PNIARATKF

SEQ ID NO: 1183943 - protein, 9 aa, Homo Sapiens
ASQTQNCGQ

SEQ ID NO: 1183944 - protein, 9 aa, Homo Sapiens
TDNRSQKRV

SEQ ID NO: 1183945 - protein, 9 aa, Homo Sapiens
VWGVDCPYQ

SEQ ID NO: 1183946 - protein, 9 aa, Homo Sapiens
VPRTREGFT

SEQ ID NO: 1183947 - protein, 9 aa, Homo Sapiens
WRRRRCSIS

SEQ ID NO: 1183948 - protein, 9 aa, Homo Sapiens
ASALGYPHH

SEQ ID NO: 1183949 - protein, 9 aa, Homo Sapiens
LLAHAAGQL

SEQ ID NO: 1183950 - protein, 9 aa, Homo Sapiens
LQNGCVGAL

SEQ ID NO: 1183951 - protein, 9 aa, Homo Sapiens
VPLPVWMSL

SEQ ID NO: 1183952 - protein, 9 aa, Homo Sapiens
RLRKFKMRQ

SEQ ID NO: 1183953 - protein, 9 aa, Homo Sapiens
ALPGLGLYH

SEQ ID NO: 1183954 - protein, 9 aa, Homo Sapiens
GTPRDAGLC

SEQ ID NO: 1183955 - protein, 9 aa, Homo Sapiens
VSPLLSTHI

SEQ ID NO: 1183956 - protein, 9 aa, Homo Sapiens
WAPHSAGLS

SEQ ID NO: 1183957 - protein, 9 aa, Homo Sapiens
AAEPTTPLS

SEQ ID NO: 1183958 - protein, 9 aa, Homo Sapiens
LLPASTSSS

SEQ ID NO: 1183959 - protein, 9 aa, Homo Sapiens
VVQAVGFQV

SEQ ID NO: 1183960 - protein, 9 aa, Homo Sapiens
SDIRAGTTP

SEQ ID NO: 1183961 - protein, 9 aa, Homo Sapiens
SWSAAPTSC

SEQ ID NO: 1183962 - protein, 9 aa, Homo Sapiens
VYTSKLVRI

SEQ ID NO: 1183963 - protein, 9 aa, Homo Sapiens
SLFPRALPV

SEQ ID NO: 1183964 - protein, 9 aa, Homo Sapiens
LLCVGGGGG

SEQ ID NO: 1183965 - protein, 9 aa, Homo Sapiens
HCPTDTQDT

SEQ ID NO: 1183966 - protein, 9 aa, Homo Sapiens
TTPASGGVS

SEQ ID NO: 1183967 - protein, 9 aa, Homo Sapiens
LLAEHDAVC

SEQ ID NO: 1183968 - protein, 9 aa, Homo Sapiens
SAPRGPGMP

SEQ ID NO: 1183969 - protein, 9 aa, Homo Sapiens
SGTCSGRSR

SEQ ID NO: 1183970 - protein, 9 aa, Homo Sapiens
CINRDNWLV

SEQ ID NO: 1183971 - protein, 9 aa, Homo Sapiens
TLAAREMAL

SEQ ID NO: 1183972 - protein, 9 aa, Homo Sapiens
PKEAISAST

SEQ ID NO: 1183973 - protein, 9 aa, Homo Sapiens
PEKAPSSPR

SEQ ID NO: 1183974 - protein, 9 aa, Homo Sapiens
PPSRPSGRP

SEQ ID NO: 1183975 - protein, 9 aa, Homo Sapiens
QHPAGGAAA

SEQ ID NO: 1183976 - protein, 9 aa, Homo Sapiens
SAPPTPSPA

SEQ ID NO: 1183977 - protein, 9 aa, Homo Sapiens
WWRWGPSLP

SEQ ID NO: 1183978 - protein, 9 aa, Homo Sapiens
PRPRTCSRR

SEQ ID NO: 1183979 - protein, 9 aa, Homo Sapiens
QSAAEMYGS

SEQ ID NO: 1183980 - protein, 9 aa, Homo Sapiens
GREGGVGGR

SEQ ID NO: 1183981 - protein, 9 aa, Homo Sapiens
ACHERSHVA

SEQ ID NO: 1183982 - protein, 9 aa, Homo Sapiens
QDEELIHLD

SEQ ID NO: 1183983 - protein, 9 aa, Homo Sapiens
VPRNCVQSR

SEQ ID NO: 1183984 - protein, 9 aa, Homo Sapiens
SMNFVQKYL

SEQ ID NO: 1183985 - protein, 9 aa, Homo Sapiens
HDKFSTMKY

SEQ ID NO: 1183986 - protein, 9 aa, Homo Sapiens
GSGRRLGGE

SEQ ID NO: 1183987 - protein, 9 aa, Homo Sapiens
ARKVLTRVG

SEQ ID NO: 1183988 - protein, 9 aa, Homo Sapiens
RRRMRGFWK

SEQ ID NO: 1183989 - protein, 9 aa, Homo Sapiens
ILEKNPPLR

SEQ ID NO: 1183990 - protein, 9 aa, Homo Sapiens
DISNSSNWK

SEQ ID NO: 1183991 - protein, 9 aa, Homo Sapiens
MQLQALAMW

SEQ ID NO: 1183992 - protein, 9 aa, Homo Sapiens
SGCPRHGPT

SEQ ID NO: 1183993 - protein, 9 aa, Homo Sapiens
WPLPSTQMS

SEQ ID NO: 1183994 - protein, 9 aa, Homo Sapiens
WLVTFWTSC

SEQ ID NO: 1183995 - protein, 9 aa, Homo Sapiens
SSRKMKISF

SEQ ID NO: 1183996 - protein, 9 aa, Homo Sapiens
GMNMKMKTF

SEQ ID NO: 1183997 - protein, 9 aa, Homo Sapiens
GSTVQLPRR

SEQ ID NO: 1183998 - protein, 9 aa, Homo Sapiens
IYVYSYTCI

SEQ ID NO: 1183999 - protein, 9 aa, Homo Sapiens
RGCMSMKEV

SEQ ID NO: 1184000 - protein, 9 aa, Homo Sapiens
VFREKPNLP

SEQ ID NO: 1184001 - protein, 9 aa, Homo Sapiens
DLGLGTAVP

SEQ ID NO: 1184002 - protein, 9 aa, Homo Sapiens
PWGPQGPLW

SEQ ID NO: 1184003 - protein, 9 aa, Homo Sapiens
SLLCARLHA

SEQ ID NO: 1184004 - protein, 9 aa, Homo Sapiens
TPGGSSCKK

SEQ ID NO: 1184005 - protein, 9 aa, Homo Sapiens
QKINCPLME

SEQ ID NO: 1184006 - protein, 9 aa, Homo Sapiens
CGGGPSGFP

SEQ ID NO: 1184007 - protein, 9 aa, Homo Sapiens
QETSRTSRG

SEQ ID NO: 1184008 - protein, 9 aa, Homo Sapiens
YVMCLARHS

SEQ ID NO: 1184009 - protein, 9 aa, Homo Sapiens
AASVLEAPP

SEQ ID NO: 1184010 - protein, 9 aa, Homo Sapiens
GLMVTRGRR

SEQ ID NO: 1184011 - protein, 9 aa, Homo Sapiens
TSKLVRICK

SEQ ID NO: 1184012 - protein, 9 aa, Homo Sapiens
GFWKGTESP

SEQ ID NO: 1184013 - protein, 9 aa, Homo Sapiens
HRRMGPLSV

SEQ ID NO: 1184014 - protein, 9 aa, Homo Sapiens
SDVLEQRDS

SEQ ID NO: 1184015 - protein, 9 aa, Homo Sapiens
AQENVLVSY

SEQ ID NO: 1184016 - protein, 9 aa, Homo Sapiens
GVQLVRQHV

SEQ ID NO: 1184017 - protein, 9 aa, Homo Sapiens
CPGCLRRRL

SEQ ID NO: 1184018 - protein, 9 aa, Homo Sapiens
LVLVSVSVI

SEQ ID NO: 1184019 - protein, 9 aa, Homo Sapiens
GAHACCRPS

SEQ ID NO: 1184020 - protein, 9 aa, Homo Sapiens
YASETKMSP

SEQ ID NO: 1184021 - protein, 9 aa, Homo Sapiens
FFTNVVPAR

SEQ ID NO: 1184022 - protein, 9 aa, Homo Sapiens
GRCCCSGND

SEQ ID NO: 1184023 - protein, 9 aa, Homo Sapiens
LQNARFVFG

SEQ ID NO: 1184024 - protein, 9 aa, Homo Sapiens
EGYNIYGIE

SEQ ID NO: 1184025 - protein, 9 aa, Homo Sapiens
AVFPSLQGA

SEQ ID NO: 1184026 - protein, 9 aa, Homo Sapiens
HTPAGFNCK

SEQ ID NO: 1184027 - protein, 9 aa, Homo Sapiens
GYCSMQRTR

SEQ ID NO: 1184028 - protein, 9 aa, Homo Sapiens
PSRKRDKQS

SEQ ID NO: 1184029 - protein, 9 aa, Homo Sapiens
RVLHQNLDP

SEQ ID NO: 1184030 - protein, 9 aa, Homo Sapiens
AGAASAYAP

SEQ ID NO: 1184031 - protein, 9 aa, Homo Sapiens
VLWGHRFFL

SEQ ID NO: 1184032 - protein, 9 aa, Homo Sapiens
ENPYKCKCG

SEQ ID NO: 1184033 - protein, 9 aa, Homo Sapiens
TFVADRRNS

SEQ ID NO: 1184034 - protein, 9 aa, Homo Sapiens
HTPHMATMN

SEQ ID NO: 1184035 - protein, 9 aa, Homo Sapiens
FVGVMPQYH

SEQ ID NO: 1184036 - protein, 9 aa, Homo Sapiens
DSVETCNPE

SEQ ID NO: 1184037 - protein, 9 aa, Homo Sapiens
FDFLSVGPM

SEQ ID NO: 1184038 - protein, 9 aa, Homo Sapiens
RKRPVSLRR

SEQ ID NO: 1184039 - protein, 9 aa, Homo Sapiens
PDLVEAQQK

SEQ ID NO: 1184040 - protein, 9 aa, Homo Sapiens
SHPLLLALH

SEQ ID NO: 1184041 - protein, 9 aa, Homo Sapiens
WGPPARPPP

SEQ ID NO: 1184042 - protein, 9 aa, Homo Sapiens
LLAAARRML

SEQ ID NO: 1184043 - protein, 9 aa, Homo Sapiens
HCSPAINST

SEQ ID NO: 1184044 - protein, 9 aa, Homo Sapiens
CFSCSRVTR

SEQ ID NO: 1184045 - protein, 9 aa, Homo Sapiens
QVLKKILRS

SEQ ID NO: 1184046 - protein, 9 aa, Homo Sapiens
SWEKVPGGL

SEQ ID NO: 1184047 - protein, 9 aa, Homo Sapiens
PGAQEVQIS

SEQ ID NO: 1184048 - protein, 9 aa, Homo Sapiens
SGSASLMIL

SEQ ID NO: 1184049 - protein, 9 aa, Homo Sapiens
PCCTTSCCA

SEQ ID NO: 1184050 - protein, 9 aa, Homo Sapiens
WGWARLSAA

SEQ ID NO: 1184051 - protein, 9 aa, Homo Sapiens
TRENLTNVK

SEQ ID NO: 1184052 - protein, 9 aa, Homo Sapiens
YQKRALTIT

SEQ ID NO: 1184053 - protein, 9 aa, Homo Sapiens
AVTQRPPVL

SEQ ID NO: 1184054 - protein, 9 aa, Homo Sapiens
SPCSRATAS

SEQ ID NO: 1184055 - protein, 9 aa, Homo Sapiens
SSSGKGVRR

SEQ ID NO: 1184056 - protein, 9 aa, Homo Sapiens
TGLTRKCGA

SEQ ID NO: 1184057 - protein, 9 aa, Homo Sapiens
LPPPPSRCL

SEQ ID NO: 1184058 - protein, 9 aa, Homo Sapiens
CAPVGNGCA

SEQ ID NO: 1184059 - protein, 9 aa, Homo Sapiens
VVSRDCPRY

SEQ ID NO: 1184060 - protein, 9 aa, Homo Sapiens
DPPVNYVPQ

SEQ ID NO: 1184061 - protein, 9 aa, Homo Sapiens
TCGRRTRKQ

SEQ ID NO: 1184062 - protein, 9 aa, Homo Sapiens
QLVESAYTA

SEQ ID NO: 1184063 - protein, 9 aa, Homo Sapiens
VVEVSHLEE

SEQ ID NO: 1184064 - protein, 9 aa, Homo Sapiens
CSLATCCSS

SEQ ID NO: 1184065 - protein, 9 aa, Homo Sapiens
LNKLLDKVT

SEQ ID NO: 1184066 - protein, 9 aa, Homo Sapiens
RIWVDYSIT

SEQ ID NO: 1184067 - protein, 9 aa, Homo Sapiens
AKYAGSQVA

SEQ ID NO: 1184068 - protein, 9 aa, Homo Sapiens
RWKTCYIQS

SEQ ID NO: 1184069 - protein, 9 aa, Homo Sapiens
RWLCAGALM

SEQ ID NO: 1184070 - protein, 9 aa, Homo Sapiens
RIQQQLEIT

SEQ ID NO: 1184071 - protein, 9 aa, Homo Sapiens
VEIEPVSAV

SEQ ID NO: 1184072 - protein, 9 aa, Homo Sapiens
VTFPPGTAM

SEQ ID NO: 1184073 - protein, 9 aa, Homo Sapiens
VVASSSGGR

SEQ ID NO: 1184074 - protein, 9 aa, Homo Sapiens
QPQHRVLAG

SEQ ID NO: 1184075 - protein, 9 aa, Homo Sapiens
PPGAPRGQH

SEQ ID NO: 1184076 - protein, 9 aa, Homo Sapiens
VSEITGAPG

SEQ ID NO: 1184077 - protein, 9 aa, Homo Sapiens
APGRQLASQ

SEQ ID NO: 1184078 - protein, 9 aa, Homo Sapiens
LSWGKRSHS

SEQ ID NO: 1184079 - protein, 9 aa, Homo Sapiens
ALLLQALTR

SEQ ID NO: 1184080 - protein, 9 aa, Homo Sapiens
KGIRKVYTC

SEQ ID NO: 1184081 - protein, 9 aa, Homo Sapiens
WGHRFEPVF

SEQ ID NO: 1184082 - protein, 9 aa, Homo Sapiens
YMVTMPPQV

SEQ ID NO: 1184083 - protein, 9 aa, Homo Sapiens
FVADEYIEC

SEQ ID NO: 1184084 - protein, 9 aa, Homo Sapiens
PLRFNLILM

SEQ ID NO: 1184085 - protein, 9 aa, Homo Sapiens
GLARPLSAA

SEQ ID NO: 1184086 - protein, 9 aa, Homo Sapiens
LQDAVTQRP

SEQ ID NO: 1184087 - protein, 9 aa, Homo Sapiens
HQRVRPRER

SEQ ID NO: 1184088 - protein, 9 aa, Homo Sapiens
DPLADAVTK

SEQ ID NO: 1184089 - protein, 9 aa, Homo Sapiens
PLSHCTLTG

SEQ ID NO: 1184090 - protein, 9 aa, Homo Sapiens
MWDLDFLGS

SEQ ID NO: 1184091 - protein, 9 aa, Homo Sapiens
STKTRKALI

SEQ ID NO: 1184092 - protein, 9 aa, Homo Sapiens
HSGRGPEVN

SEQ ID NO: 1184093 - protein, 9 aa, Homo Sapiens
KVLCDELGP

SEQ ID NO: 1184094 - protein, 9 aa, Homo Sapiens
GYGGFDDLD

SEQ ID NO: 1184095 - protein, 9 aa, Homo Sapiens
KLISPCALS

SEQ ID NO: 1184096 - protein, 9 aa, Homo Sapiens
ADLPEGEKN

SEQ ID NO: 1184097 - protein, 9 aa, Homo Sapiens
RLTPSPQGG

SEQ ID NO: 1184098 - protein, 9 aa, Homo Sapiens
LIHPRPPPH

SEQ ID NO: 1184099 - protein, 9 aa, Homo Sapiens
RRFLVVILK

SEQ ID NO: 1184100 - protein, 9 aa, Homo Sapiens
GSGADHIYD

SEQ ID NO: 1184101 - protein, 9 aa, Homo Sapiens
TRSSSRTAC

SEQ ID NO: 1184102 - protein, 9 aa, Homo Sapiens
LHAHRVPGP

SEQ ID NO: 1184103 - protein, 9 aa, Homo Sapiens
IPGSQHHME

SEQ ID NO: 1184104 - protein, 9 aa, Homo Sapiens
EKIHQMGLK

SEQ ID NO: 1184105 - protein, 9 aa, Homo Sapiens
GMTLLHTQS

SEQ ID NO: 1184106 - protein, 9 aa, Homo Sapiens
STRPTWNPA

SEQ ID NO: 1184107 - protein, 9 aa, Homo Sapiens
HDKAITLQG

SEQ ID NO: 1184108 - protein, 9 aa, Homo Sapiens
STLDSCSGH

SEQ ID NO: 1184109 - protein, 9 aa, Homo Sapiens
WGLAGVQDG

SEQ ID NO: 1184110 - protein, 9 aa, Homo Sapiens
QHRSSSGHS

SEQ ID NO: 1184111 - protein, 9 aa, Homo Sapiens
WESWQMKTI

SEQ ID NO: 1184112 - protein, 9 aa, Homo Sapiens
VYPICFTMA

SEQ ID NO: 1184113 - protein, 9 aa, Homo Sapiens
DYCDILECD

SEQ ID NO: 1184114 - protein, 9 aa, Homo Sapiens
TNLTTLTNA

SEQ ID NO: 1184115 - protein, 9 aa, Homo Sapiens
SCFGPSKIS

SEQ ID NO: 1184116 - protein, 9 aa, Homo Sapiens
PLVLTYVWP

SEQ ID NO: 1184117 - protein, 9 aa, Homo Sapiens
ASLYKRFTG

SEQ ID NO: 1184118 - protein, 9 aa, Homo Sapiens
RNNLCVRLG

SEQ ID NO: 1184119 - protein, 9 aa, Homo Sapiens
KVLAVIGIN

SEQ ID NO: 1184120 - protein, 9 aa, Homo Sapiens
PAALEGCRC

SEQ ID NO: 1184121 - protein, 9 aa, Homo Sapiens
RRMGPLSVP

SEQ ID NO: 1184122 - protein, 9 aa, Homo Sapiens
LNNMLVLEQ

SEQ ID NO: 1184123 - protein, 9 aa, Homo Sapiens
EDDDEDQQR

SEQ ID NO: 1184124 - protein, 9 aa, Homo Sapiens
DFAINICTL

SEQ ID NO: 1184125 - protein, 9 aa, Homo Sapiens
RRCQEYENE

SEQ ID NO: 1184126 - protein, 9 aa, Homo Sapiens
LGPSPCNRS

SEQ ID NO: 1184127 - protein, 9 aa, Homo Sapiens
STSGARVLI

SEQ ID NO: 1184128 - protein, 9 aa, Homo Sapiens
ATQGPAAPS

SEQ ID NO: 1184129 - protein, 9 aa, Homo Sapiens
YDGPLRHKF

SEQ ID NO: 1184130 - protein, 9 aa, Homo Sapiens
YAAGGMVEG

SEQ ID NO: 1184131 - protein, 9 aa, Homo Sapiens
VPTPVWSPR

SEQ ID NO: 1184132 - protein, 9 aa, Homo Sapiens
LVRDLPKGC

SEQ ID NO: 1184133 - protein, 9 aa, Homo Sapiens
ELRVSTNAM

SEQ ID NO: 1184134 - protein, 9 aa, Homo Sapiens
ASQSRGPHP

SEQ ID NO: 1184135 - protein, 9 aa, Homo Sapiens
QEEQGAPLC

SEQ ID NO: 1184136 - protein, 9 aa, Homo Sapiens
SAWRSLRMK

SEQ ID NO: 1184137 - protein, 9 aa, Homo Sapiens
RNCSLSLQE

SEQ ID NO: 1184138 - protein, 9 aa, Homo Sapiens
STTLRPPAQ

SEQ ID NO: 1184139 - protein, 9 aa, Homo Sapiens
SSPRRLLTS

SEQ ID NO: 1184140 - protein, 9 aa, Homo Sapiens
TQDTRPRTA

SEQ ID NO: 1184141 - protein, 9 aa, Homo Sapiens
TLDSGVYTE

SEQ ID NO: 1184142 - protein, 9 aa, Homo Sapiens
VCIVSGDRR

SEQ ID NO: 1184143 - protein, 9 aa, Homo Sapiens
SWAWQGAWW

SEQ ID NO: 1184144 - protein, 9 aa, Homo Sapiens
CNPICQPSW

SEQ ID NO: 1184145 - protein, 9 aa, Homo Sapiens
LKIMGQAAN

SEQ ID NO: 1184146 - protein, 9 aa, Homo Sapiens
AYTILRHHG

SEQ ID NO: 1184147 - protein, 9 aa, Homo Sapiens
RQHCQHRER

SEQ ID NO: 1184148 - protein, 9 aa, Homo Sapiens
SEGKPDKSE

SEQ ID NO: 1184149 - protein, 9 aa, Homo Sapiens
GQLNSPGSL

SEQ ID NO: 1184150 - protein, 9 aa, Homo Sapiens
LWQAPRAMR

SEQ ID NO: 1184151 - protein, 9 aa, Homo Sapiens
LLTKNGNFL

SEQ ID NO: 1184152 - protein, 9 aa, Homo Sapiens
RGGNPRPAA

SEQ ID NO: 1184153 - protein, 9 aa, Homo Sapiens
CNPELNVWR

SEQ ID NO: 1184154 - protein, 9 aa, Homo Sapiens
VQKSLLKRN

SEQ ID NO: 1184155 - protein, 9 aa, Homo Sapiens
TAAEQRVSR

SEQ ID NO: 1184156 - protein, 9 aa, Homo Sapiens
DLLTIPVPI

SEQ ID NO: 1184157 - protein, 9 aa, Homo Sapiens
APPTDYSKL

SEQ ID NO: 1184158 - protein, 9 aa, Homo Sapiens
GRGTQIEET

SEQ ID NO: 1184159 - protein, 9 aa, Homo Sapiens
TRKCGAEIL

SEQ ID NO: 1184160 - protein, 9 aa, Homo Sapiens
LHHGGRQLR

SEQ ID NO: 1184161 - protein, 9 aa, Homo Sapiens
TRLYCSLGV

SEQ ID NO: 1184162 - protein, 9 aa, Homo Sapiens
VLRPRGLLT

SEQ ID NO: 1184163 - protein, 9 aa, Homo Sapiens
IWPNRIHTT

SEQ ID NO: 1184164 - protein, 9 aa, Homo Sapiens
RLLPYPFHV

SEQ ID NO: 1184165 - protein, 9 aa, Homo Sapiens
TQSPLPILS

SEQ ID NO: 1184166 - protein, 9 aa, Homo Sapiens
ATSTLSPQL

SEQ ID NO: 1184167 - protein, 9 aa, Homo Sapiens
EAKEVNSRS

SEQ ID NO: 1184168 - protein, 9 aa, Homo Sapiens
TPRKLVGRA

SEQ ID NO: 1184169 - protein, 9 aa, Homo Sapiens
FHLISASAM

SEQ ID NO: 1184170 - protein, 9 aa, Homo Sapiens
ERGGGCLPP

SEQ ID NO: 1184171 - protein, 9 aa, Homo Sapiens
GPAAPLAPP

SEQ ID NO: 1184172 - protein, 9 aa, Homo Sapiens
SIRGWSGDS

SEQ ID NO: 1184173 - protein, 9 aa, Homo Sapiens
SEGGPEAPS

SEQ ID NO: 1184174 - protein, 9 aa, Homo Sapiens
SSSVWPNLT

SEQ ID NO: 1184175 - protein, 9 aa, Homo Sapiens
QWPTEGRIQ

SEQ ID NO: 1184176 - protein, 9 aa, Homo Sapiens
MEICLCKEI

SEQ ID NO: 1184177 - protein, 9 aa, Homo Sapiens
PLPMSPPRP

SEQ ID NO: 1184178 - protein, 9 aa, Homo Sapiens
LRRVDACQA

SEQ ID NO: 1184179 - protein, 9 aa, Homo Sapiens
TLHALRLLH

SEQ ID NO: 1184180 - protein, 9 aa, Homo Sapiens
DYTPMRNIM

SEQ ID NO: 1184181 - protein, 9 aa, Homo Sapiens
GPCPPPVTP

SEQ ID NO: 1184182 - protein, 9 aa, Homo Sapiens
KDSHASKGV

SEQ ID NO: 1184183 - protein, 9 aa, Homo Sapiens
SGGPGAWGR

SEQ ID NO: 1184184 - protein, 9 aa, Homo Sapiens
SAADFGKIV

SEQ ID NO: 1184185 - protein, 9 aa, Homo Sapiens
FGFWRDEES

SEQ ID NO: 1184186 - protein, 9 aa, Homo Sapiens
YYIHDHFIH

SEQ ID NO: 1184187 - protein, 9 aa, Homo Sapiens
ARGQRLLGL

SEQ ID NO: 1184188 - protein, 9 aa, Homo Sapiens
HESYELQIC

SEQ ID NO: 1184189 - protein, 9 aa, Homo Sapiens
ADTFFITDG

SEQ ID NO: 1184190 - protein, 9 aa, Homo Sapiens
ETRGSLGPK

SEQ ID NO: 1184191 - protein, 9 aa, Homo Sapiens
SSIQSWGST

SEQ ID NO: 1184192 - protein, 9 aa, Homo Sapiens
ITGGWGLLC

SEQ ID NO: 1184193 - protein, 9 aa, Homo Sapiens
PRFCNSSFH

SEQ ID NO: 1184194 - protein, 9 aa, Homo Sapiens
TSVKRGTMV

SEQ ID NO: 1184195 - protein, 9 aa, Homo Sapiens
SMRKGSLQC

SEQ ID NO: 1184196 - protein, 9 aa, Homo Sapiens
SQAVGPLQL

SEQ ID NO: 1184197 - protein, 9 aa, Homo Sapiens
PAPQRRGHA

SEQ ID NO: 1184198 - protein, 9 aa, Homo Sapiens
GWCSAAWPP

SEQ ID NO: 1184199 - protein, 9 aa, Homo Sapiens
DMVAESCGC

SEQ ID NO: 1184200 - protein, 9 aa, Homo Sapiens
GGDASCARW

SEQ ID NO: 1184201 - protein, 9 aa, Homo Sapiens
GKNGQGSLP

SEQ ID NO: 1184202 - protein, 9 aa, Homo Sapiens
SIWPRQASR

SEQ ID NO: 1184203 - protein, 9 aa, Homo Sapiens
THPAHQPLG

SEQ ID NO: 1184204 - protein, 9 aa, Homo Sapiens
RDGGRGAAA

SEQ ID NO: 1184205 - protein, 9 aa, Homo Sapiens
IQIQVIGFA

SEQ ID NO: 1184206 - protein, 9 aa, Homo Sapiens
GRRDEAGGG

SEQ ID NO: 1184207 - protein, 9 aa, Homo Sapiens
NSELPSDER

SEQ ID NO: 1184208 - protein, 9 aa, Homo Sapiens
EERLKAEQG

SEQ ID NO: 1184209 - protein, 9 aa, Homo Sapiens
SIDSIQKEP

SEQ ID NO: 1184210 - protein, 9 aa, Homo Sapiens
WDWFPPCGG

SEQ ID NO: 1184211 - protein, 9 aa, Homo Sapiens
AECCKSFKG

SEQ ID NO: 1184212 - protein, 9 aa, Homo Sapiens
GGSRRYDDY

SEQ ID NO: 1184213 - protein, 9 aa, Homo Sapiens
LRMRRLGTR

SEQ ID NO: 1184214 - protein, 9 aa, Homo Sapiens
EEGNLSMED

SEQ ID NO: 1184215 - protein, 9 aa, Homo Sapiens
ANMYFATGF

SEQ ID NO: 1184216 - protein, 9 aa, Homo Sapiens
VPPLGLSVP

SEQ ID NO: 1184217 - protein, 9 aa, Homo Sapiens
RYTKPGAEK

SEQ ID NO: 1184218 - protein, 9 aa, Homo Sapiens
EAAPPKAHE

SEQ ID NO: 1184219 - protein, 9 aa, Homo Sapiens
ASSAASSSS

SEQ ID NO: 1184220 - protein, 9 aa, Homo Sapiens
SVFALALLL

SEQ ID NO: 1184221 - protein, 9 aa, Homo Sapiens
LSALFIWPQ

SEQ ID NO: 1184222 - protein, 9 aa, Homo Sapiens
VAERVLRAI

SEQ ID NO: 1184223 - protein, 9 aa, Homo Sapiens
ANELRHQVR

SEQ ID NO: 1184224 - protein, 9 aa, Homo Sapiens
HHSCCITWM

SEQ ID NO: 1184225 - protein, 9 aa, Homo Sapiens
PRAAEKCPA

SEQ ID NO: 1184226 - protein, 9 aa, Homo Sapiens
QRPPTPFLP

SEQ ID NO: 1184227 - protein, 9 aa, Homo Sapiens
QGAARGLQV

SEQ ID NO: 1184228 - protein, 9 aa, Homo Sapiens
IRVVSFTEL

SEQ ID NO: 1184229 - protein, 9 aa, Homo Sapiens
HWLGGPTAR

SEQ ID NO: 1184230 - protein, 9 aa, Homo Sapiens
RVPLPPPPV

SEQ ID NO: 1184231 - protein, 9 aa, Homo Sapiens
TQKVQNIIF

SEQ ID NO: 1184232 - protein, 9 aa, Homo Sapiens
PPPPTPTAW

SEQ ID NO: 1184233 - protein, 9 aa, Homo Sapiens
VPSARRSPS

SEQ ID NO: 1184234 - protein, 9 aa, Homo Sapiens
KIHEKVGSQ

SEQ ID NO: 1184235 - protein, 9 aa, Homo Sapiens
EPQSRWTRM

SEQ ID NO: 1184236 - protein, 9 aa, Homo Sapiens
ASSLVAASP

SEQ ID NO: 1184237 - protein, 9 aa, Homo Sapiens
RLLKCDRTC

SEQ ID NO: 1184238 - protein, 9 aa, Homo Sapiens
GGGALLYSV

SEQ ID NO: 1184239 - protein, 9 aa, Homo Sapiens
EPYVVVSRD

SEQ ID NO: 1184240 - protein, 9 aa, Homo Sapiens
VHNLMLWSA

SEQ ID NO: 1184241 - protein, 9 aa, Homo Sapiens
LMLICKSLT

SEQ ID NO: 1184242 - protein, 9 aa, Homo Sapiens
VKHQVVYKT

SEQ ID NO: 1184243 - protein, 9 aa, Homo Sapiens
TQNGRAACG

SEQ ID NO: 1184244 - protein, 9 aa, Homo Sapiens
HYQMCHRHC

SEQ ID NO: 1184245 - protein, 9 aa, Homo Sapiens
DGLSVVRGG

SEQ ID NO: 1184246 - protein, 9 aa, Homo Sapiens
SEEETTDDS

SEQ ID NO: 1184247 - protein, 9 aa, Homo Sapiens
ENISCVLYP

SEQ ID NO: 1184248 - protein, 9 aa, Homo Sapiens
EPEVVFLGD

SEQ ID NO: 1184249 - protein, 9 aa, Homo Sapiens
SDFSNNWNS

SEQ ID NO: 1184250 - protein, 9 aa, Homo Sapiens
RAGHTIPCI

SEQ ID NO: 1184251 - protein, 9 aa, Homo Sapiens
SPVRSGALR

SEQ ID NO: 1184252 - protein, 9 aa, Homo Sapiens
SRTSRGQPS

SEQ ID NO: 1184253 - protein, 9 aa, Homo Sapiens
PRQLGQGLG

SEQ ID NO: 1184254 - protein, 9 aa, Homo Sapiens
GSRCDRPPP

SEQ ID NO: 1184255 - protein, 9 aa, Homo Sapiens
VEEGTWGGT

SEQ ID NO: 1184256 - protein, 9 aa, Homo Sapiens
CRVIRLHQL

SEQ ID NO: 1184257 - protein, 9 aa, Homo Sapiens
CHLAGGLVV

SEQ ID NO: 1184258 - protein, 9 aa, Homo Sapiens
YQNRQGPGC

SEQ ID NO: 1184259 - protein, 9 aa, Homo Sapiens
FLSLRQNDI

SEQ ID NO: 1184260 - protein, 9 aa, Homo Sapiens
PGCSLRAAA

SEQ ID NO: 1184261 - protein, 9 aa, Homo Sapiens
VVFVQVKRG

SEQ ID NO: 1184262 - protein, 9 aa, Homo Sapiens
MAWFLTLCT

SEQ ID NO: 1184263 - protein, 9 aa, Homo Sapiens
TTSCCAPAP

SEQ ID NO: 1184264 - protein, 9 aa, Homo Sapiens
RVPLAPLGP

SEQ ID NO: 1184265 - protein, 9 aa, Homo Sapiens
LLAACCGGK

SEQ ID NO: 1184266 - protein, 9 aa, Homo Sapiens
EPLRKALSE

SEQ ID NO: 1184267 - protein, 9 aa, Homo Sapiens
RHSPARPAT

SEQ ID NO: 1184268 - protein, 9 aa, Homo Sapiens
RARCLRVPA

SEQ ID NO: 1184269 - protein, 9 aa, Homo Sapiens
GGSDPEAGD

SEQ ID NO: 1184270 - protein, 9 aa, Homo Sapiens
LRHSQFKRT

SEQ ID NO: 1184271 - protein, 9 aa, Homo Sapiens
WNQVAVIGD

SEQ ID NO: 1184272 - protein, 9 aa, Homo Sapiens
TTPSPGPQA

SEQ ID NO: 1184273 - protein, 9 aa, Homo Sapiens
NGAELYWAS

SEQ ID NO: 1184274 - protein, 9 aa, Homo Sapiens
GQVQEPVGS

SEQ ID NO: 1184275 - protein, 9 aa, Homo Sapiens
LRVLYVMCL

SEQ ID NO: 1184276 - protein, 9 aa, Homo Sapiens
WSPVIAASP

SEQ ID NO: 1184277 - protein, 9 aa, Homo Sapiens
RGPGRILRA

SEQ ID NO: 1184278 - protein, 9 aa, Homo Sapiens
RGKDITVTT

SEQ ID NO: 1184279 - protein, 9 aa, Homo Sapiens
RRTCALRMS

SEQ ID NO: 1184280 - protein, 9 aa, Homo Sapiens
TLLPVEKSS

SEQ ID NO: 1184281 - protein, 9 aa, Homo Sapiens
ELLPTHTFS

SEQ ID NO: 1184282 - protein, 9 aa, Homo Sapiens
QVTYVRSGC

SEQ ID NO: 1184283 - protein, 9 aa, Homo Sapiens
GTRRSSQRR

SEQ ID NO: 1184284 - protein, 9 aa, Homo Sapiens
QRLDGLLNR

SEQ ID NO: 1184285 - protein, 9 aa, Homo Sapiens
GPGSAVAAP

SEQ ID NO: 1184286 - protein, 9 aa, Homo Sapiens
PSAQLSGPV

SEQ ID NO: 1184287 - protein, 9 aa, Homo Sapiens
PAQSPGRAE

SEQ ID NO: 1184288 - protein, 9 aa, Homo Sapiens
LCCMDPAWH

SEQ ID NO: 1184289 - protein, 9 aa, Homo Sapiens
SPASGRRRE

SEQ ID NO: 1184290 - protein, 9 aa, Homo Sapiens
MDPSGSRGC

SEQ ID NO: 1184291 - protein, 9 aa, Homo Sapiens
TCMTRWFFN

SEQ ID NO: 1184292 - protein, 9 aa, Homo Sapiens
VEYYSCVGL

SEQ ID NO: 1184293 - protein, 9 aa, Homo Sapiens
LPPVDLIHR

SEQ ID NO: 1184294 - protein, 9 aa, Homo Sapiens
APHTLCSDH

SEQ ID NO: 1184295 - protein, 9 aa, Homo Sapiens
KTDICSSAR

SEQ ID NO: 1184296 - protein, 9 aa, Homo Sapiens
HNNPIGDQD

SEQ ID NO: 1184297 - protein, 9 aa, Homo Sapiens
GVAGIGKSM

SEQ ID NO: 1184298 - protein, 9 aa, Homo Sapiens
TAPALGCWS

SEQ ID NO: 1184299 - protein, 9 aa, Homo Sapiens
LGCWSSAPA

SEQ ID NO: 1184300 - protein, 9 aa, Homo Sapiens
CPNGQKGEP

SEQ ID NO: 1184301 - protein, 9 aa, Homo Sapiens
LKRQATFDP

SEQ ID NO: 1184302 - protein, 9 aa, Homo Sapiens
SSPSGASTR

SEQ ID NO: 1184303 - protein, 9 aa, Homo Sapiens
EYDGRGGAH

SEQ ID NO: 1184304 - protein, 9 aa, Homo Sapiens
GSGKSNMGA

SEQ ID NO: 1184305 - protein, 9 aa, Homo Sapiens
DQQRGHDDA

SEQ ID NO: 1184306 - protein, 9 aa, Homo Sapiens
KPSRPRWPT

SEQ ID NO: 1184307 - protein, 9 aa, Homo Sapiens
LLGECRQMS

SEQ ID NO: 1184308 - protein, 9 aa, Homo Sapiens
CPPGRGLPL

SEQ ID NO: 1184309 - protein, 9 aa, Homo Sapiens
FFAYAQLSY

SEQ ID NO: 1184310 - protein, 9 aa, Homo Sapiens
ASLDQMGFL

SEQ ID NO: 1184311 - protein, 9 aa, Homo Sapiens
ANNCIFIII

SEQ ID NO: 1184312 - protein, 9 aa, Homo Sapiens
GNRRLQILR

SEQ ID NO: 1184313 - protein, 9 aa, Homo Sapiens
GPKPSLRPS

SEQ ID NO: 1184314 - protein, 9 aa, Homo Sapiens
GPPIMKTSP

SEQ ID NO: 1184315 - protein, 9 aa, Homo Sapiens
HFVVDPHGR

SEQ ID NO: 1184316 - protein, 9 aa, Homo Sapiens
LGPWSLSFL

SEQ ID NO: 1184317 - protein, 9 aa, Homo Sapiens
RKAPRVALS

SEQ ID NO: 1184318 - protein, 9 aa, Homo Sapiens
ANPRFCNSS

SEQ ID NO: 1184319 - protein, 9 aa, Homo Sapiens
RRGWRRTRP

SEQ ID NO: 1184320 - protein, 9 aa, Homo Sapiens
EQWHNLRSR

SEQ ID NO: 1184321 - protein, 9 aa, Homo Sapiens
VVPRMSSPR

SEQ ID NO: 1184322 - protein, 9 aa, Homo Sapiens
CPEPPSPGT

SEQ ID NO: 1184323 - protein, 9 aa, Homo Sapiens
DGSSSGATG

SEQ ID NO: 1184324 - protein, 9 aa, Homo Sapiens
SRPSRCVVP

SEQ ID NO: 1184325 - protein, 9 aa, Homo Sapiens
CAGSPRKCS

SEQ ID NO: 1184326 - protein, 9 aa, Homo Sapiens
WCGTSQTYF

SEQ ID NO: 1184327 - protein, 9 aa, Homo Sapiens
RLTYAHLAQ

SEQ ID NO: 1184328 - protein, 9 aa, Homo Sapiens
GPAGWGPPA

SEQ ID NO: 1184329 - protein, 9 aa, Homo Sapiens
YIIRVVSFT

SEQ ID NO: 1184330 - protein, 9 aa, Homo Sapiens
GFVVEVSHL

SEQ ID NO: 1184331 - protein, 9 aa, Homo Sapiens
RRPQRYTKP

SEQ ID NO: 1184332 - protein, 9 aa, Homo Sapiens
SYLHSHGRT

SEQ ID NO: 1184333 - protein, 9 aa, Homo Sapiens
LLWQWPFGE

SEQ ID NO: 1184334 - protein, 9 aa, Homo Sapiens
HRPPRASSA

SEQ ID NO: 1184335 - protein, 9 aa, Homo Sapiens
ASSSSSCAP

SEQ ID NO: 1184336 - protein, 9 aa, Homo Sapiens
SRGSPPSRA

SEQ ID NO: 1184337 - protein, 9 aa, Homo Sapiens
LPNRMCAYV

SEQ ID NO: 1184338 - protein, 9 aa, Homo Sapiens
STLFSINIF

SEQ ID NO: 1184339 - protein, 9 aa, Homo Sapiens
RPGPKEAIS

SEQ ID NO: 1184340 - protein, 9 aa, Homo Sapiens
LDRGSFQND

SEQ ID NO: 1184341 - protein, 9 aa, Homo Sapiens
DLSPLLSPH

SEQ ID NO: 1184342 - protein, 9 aa, Homo Sapiens
TRKNRTRTT

SEQ ID NO: 1184343 - protein, 9 aa, Homo Sapiens
AWGLLRPAL

SEQ ID NO: 1184344 - protein, 9 aa, Homo Sapiens
LRLLSLGAH

SEQ ID NO: 1184345 - protein, 9 aa, Homo Sapiens
TDISPRETS

SEQ ID NO: 1184346 - protein, 9 aa, Homo Sapiens
ANGSGADHI

SEQ ID NO: 1184347 - protein, 9 aa, Homo Sapiens
CRAAFRAQA

SEQ ID NO: 1184348 - protein, 9 aa, Homo Sapiens
RSPNSTTWP

SEQ ID NO: 1184349 - protein, 9 aa, Homo Sapiens
GTSAARGIR

SEQ ID NO: 1184350 - protein, 9 aa, Homo Sapiens
RLAAALQDH

SEQ ID NO: 1184351 - protein, 9 aa, Homo Sapiens
AGDPATTAA

SEQ ID NO: 1184352 - protein, 9 aa, Homo Sapiens
AYLEHRDPQ

SEQ ID NO: 1184353 - protein, 9 aa, Homo Sapiens
CSPRAAESG

SEQ ID NO: 1184354 - protein, 9 aa, Homo Sapiens
LAWCAWAWS

SEQ ID NO: 1184355 - protein, 9 aa, Homo Sapiens
LITNCSSWP

SEQ ID NO: 1184356 - protein, 9 aa, Homo Sapiens
TSTIKVNQV

SEQ ID NO: 1184357 - protein, 9 aa, Homo Sapiens
INLSTIKSI

SEQ ID NO: 1184358 - protein, 9 aa, Homo Sapiens
VATLPLWAT

SEQ ID NO: 1184359 - protein, 9 aa, Homo Sapiens
VFEEIIGKV

SEQ ID NO: 1184360 - protein, 9 aa, Homo Sapiens
SWCGTSQTY

SEQ ID NO: 1184361 - protein, 9 aa, Homo Sapiens
GLWAYIRKQ

SEQ ID NO: 1184362 - protein, 9 aa, Homo Sapiens
PVPQYTPRV

SEQ ID NO: 1184363 - protein, 9 aa, Homo Sapiens
PPPSPPSPS

SEQ ID NO: 1184364 - protein, 9 aa, Homo Sapiens
DAEGLMVTR

SEQ ID NO: 1184365 - protein, 9 aa, Homo Sapiens
RSLNGKQEK

SEQ ID NO: 1184366 - protein, 9 aa, Homo Sapiens
NALTQYQEM

SEQ ID NO: 1184367 - protein, 9 aa, Homo Sapiens
LDYHTPAGF

SEQ ID NO: 1184368 - protein, 9 aa, Homo Sapiens
FRADGATTY

SEQ ID NO: 1184369 - protein, 9 aa, Homo Sapiens
PPPAPGRQL

SEQ ID NO: 1184370 - protein, 9 aa, Homo Sapiens
TTVHVTRRP

SEQ ID NO: 1184371 - protein, 9 aa, Homo Sapiens
IIDIVVIIP

SEQ ID NO: 1184372 - protein, 9 aa, Homo Sapiens
HLAGGLVVA

SEQ ID NO: 1184373 - protein, 9 aa, Homo Sapiens
HVHNLMLWS

SEQ ID NO: 1184374 - protein, 9 aa, Homo Sapiens
KPEEGDDEV

SEQ ID NO: 1184375 - protein, 9 aa, Homo Sapiens
QREHVLVGC

SEQ ID NO: 1184376 - protein, 9 aa, Homo Sapiens
QRNPYADII

SEQ ID NO: 1184377 - protein, 9 aa, Homo Sapiens
IASGTFQLV

SEQ ID NO: 1184378 - protein, 9 aa, Homo Sapiens
VLMAVGGEA

SEQ ID NO: 1184379 - protein, 9 aa, Homo Sapiens
GQILLLGVP

SEQ ID NO: 1184380 - protein, 9 aa, Homo Sapiens
YTPRVLTQA

SEQ ID NO: 1184381 - protein, 9 aa, Homo Sapiens
QGAAGAGRG

SEQ ID NO: 1184382 - protein, 9 aa, Homo Sapiens
PPHGTEREM

SEQ ID NO: 1184383 - protein, 9 aa, Homo Sapiens
RHQIPWKLG

SEQ ID NO: 1184384 - protein, 9 aa, Homo Sapiens
PADAQAVCA

SEQ ID NO: 1184385 - protein, 9 aa, Homo Sapiens
GRRGGQASR

SEQ ID NO: 1184386 - protein, 9 aa, Homo Sapiens
YKFKLEDHM

SEQ ID NO: 1184387 - protein, 9 aa, Homo Sapiens
SEDYEDKER

SEQ ID NO: 1184388 - protein, 9 aa, Homo Sapiens
RAGPGSDEL

SEQ ID NO: 1184389 - protein, 9 aa, Homo Sapiens
GTIHAMKYP

SEQ ID NO: 1184390 - protein, 9 aa, Homo Sapiens
SLQKTGIAS

SEQ ID NO: 1184391 - protein, 9 aa, Homo Sapiens
EQPELRPSV

SEQ ID NO: 1184392 - protein, 9 aa, Homo Sapiens
PASTSSSLL

SEQ ID NO: 1184393 - protein, 9 aa, Homo Sapiens
FTNLEEAIY

SEQ ID NO: 1184394 - protein, 9 aa, Homo Sapiens
FQLNHMLPS

SEQ ID NO: 1184395 - protein, 9 aa, Homo Sapiens
SSPMHPVLE

SEQ ID NO: 1184396 - protein, 9 aa, Homo Sapiens
YPNDGLTRN

SEQ ID NO: 1184397 - protein, 9 aa, Homo Sapiens
HLARYFSVN

SEQ ID NO: 1184398 - protein, 9 aa, Homo Sapiens
ITVFMLNVH

SEQ ID NO: 1184399 - protein, 9 aa, Homo Sapiens
AGGMVEGGV

SEQ ID NO: 1184400 - protein, 9 aa, Homo Sapiens
ILVITALGR

SEQ ID NO: 1184401 - protein, 9 aa, Homo Sapiens
GGRQLRVPD

SEQ ID NO: 1184402 - protein, 9 aa, Homo Sapiens
FPLTTLATQ

SEQ ID NO: 1184403 - protein, 9 aa, Homo Sapiens
QHIAQHRFG

SEQ ID NO: 1184404 - protein, 9 aa, Homo Sapiens
LPTTGPATT

SEQ ID NO: 1184405 - protein, 9 aa, Homo Sapiens
APDMLGMSL

SEQ ID NO: 1184406 - protein, 9 aa, Homo Sapiens
YTDNRSQKR

SEQ ID NO: 1184407 - protein, 9 aa, Homo Sapiens
VETMTKQLG

SEQ ID NO: 1184408 - protein, 9 aa, Homo Sapiens
KQLMVTMPL

SEQ ID NO: 1184409 - protein, 9 aa, Homo Sapiens
IQLSGGLLQ

SEQ ID NO: 1184410 - protein, 9 aa, Homo Sapiens
MLSFLSLRQ

SEQ ID NO: 1184411 - protein, 9 aa, Homo Sapiens
DGAEPSKGQ

SEQ ID NO: 1184412 - protein, 9 aa, Homo Sapiens
GLPPNTCTR

SEQ ID NO: 1184413 - protein, 9 aa, Homo Sapiens
KKFMECDPD

SEQ ID NO: 1184414 - protein, 9 aa, Homo Sapiens
IETYYLPDV

SEQ ID NO: 1184415 - protein, 9 aa, Homo Sapiens
PSAAPHTLC

SEQ ID NO: 1184416 - protein, 9 aa, Homo Sapiens
PQSGGALWA

SEQ ID NO: 1184417 - protein, 9 aa, Homo Sapiens
VDIRKDLCA

SEQ ID NO: 1184418 - protein, 9 aa, Homo Sapiens
VHIVRVGSV

SEQ ID NO: 1184419 - protein, 9 aa, Homo Sapiens
AALSVLLPA

SEQ ID NO: 1184420 - protein, 9 aa, Homo Sapiens
KAKLVALEL

SEQ ID NO: 1184421 - protein, 9 aa, Homo Sapiens
HRVPLAPLG

SEQ ID NO: 1184422 - protein, 9 aa, Homo Sapiens
DGVMVRVGS

SEQ ID NO: 1184423 - protein, 9 aa, Homo Sapiens
PWWRRPRRQ

SEQ ID NO: 1184424 - protein, 9 aa, Homo Sapiens
SSRSSRQTG

SEQ ID NO: 1184425 - protein, 9 aa, Homo Sapiens
TVASSIVSL

SEQ ID NO: 1184426 - protein, 9 aa, Homo Sapiens
NAKRSKEKT

SEQ ID NO: 1184427 - protein, 9 aa, Homo Sapiens
PKSEDYEDK

SEQ ID NO: 1184428 - protein, 9 aa, Homo Sapiens
GCLRRRLRV

SEQ ID NO: 1184429 - protein, 9 aa, Homo Sapiens
NTYAAGGMV

SEQ ID NO: 1184430 - protein, 9 aa, Homo Sapiens
RARRSASSH

SEQ ID NO: 1184431 - protein, 9 aa, Homo Sapiens
MERQKQKAD

SEQ ID NO: 1184432 - protein, 9 aa, Homo Sapiens
MILVITALG

SEQ ID NO: 1184433 - protein, 9 aa, Homo Sapiens
VSDPDTKGS

SEQ ID NO: 1184434 - protein, 9 aa, Homo Sapiens
FQLHQGGER

SEQ ID NO: 1184435 - protein, 9 aa, Homo Sapiens
TLAPWALLG

SEQ ID NO: 1184436 - protein, 9 aa, Homo Sapiens
CLNEASFDL

SEQ ID NO: 1184437 - protein, 9 aa, Homo Sapiens
CATSSKVPI

SEQ ID NO: 1184438 - protein, 9 aa, Homo Sapiens
ILCCGLFLA

SEQ ID NO: 1184439 - protein, 9 aa, Homo Sapiens
ESLFATGSE

SEQ ID NO: 1184440 - protein, 9 aa, Homo Sapiens
KALITFLTQ

SEQ ID NO: 1184441 - protein, 9 aa, Homo Sapiens
TRRSSQRRF

SEQ ID NO: 1184442 - protein, 9 aa, Homo Sapiens
GKMDYRLMM

SEQ ID NO: 1184443 - protein, 9 aa, Homo Sapiens
NDGLTRNYC

SEQ ID NO: 1184444 - protein, 9 aa, Homo Sapiens
IGSSIQSWG

SEQ ID NO: 1184445 - protein, 9 aa, Homo Sapiens
YIYVYSYTC

SEQ ID NO: 1184446 - protein, 9 aa, Homo Sapiens
RHPEPMPEE

SEQ ID NO: 1184447 - protein, 9 aa, Homo Sapiens
RRQRAPRSL

SEQ ID NO: 1184448 - protein, 9 aa, Homo Sapiens
SLYKRFTGK

SEQ ID NO: 1184449 - protein, 9 aa, Homo Sapiens
TVTAAPSGQ

SEQ ID NO: 1184450 - protein, 9 aa, Homo Sapiens
IRRFITSVV

SEQ ID NO: 1184451 - protein, 9 aa, Homo Sapiens
FDSQGLAQA

SEQ ID NO: 1184452 - protein, 9 aa, Homo Sapiens
IMEHSWFES

SEQ ID NO: 1184453 - protein, 9 aa, Homo Sapiens
SCSGLVRDC

SEQ ID NO: 1184454 - protein, 9 aa, Homo Sapiens
PPGPANPSA

SEQ ID NO: 1184455 - protein, 9 aa, Homo Sapiens
ALQGLAQVS

SEQ ID NO: 1184456 - protein, 9 aa, Homo Sapiens
RMLIPCYEE

SEQ ID NO: 1184457 - protein, 9 aa, Homo Sapiens
FVQKYLENY

SEQ ID NO: 1184458 - protein, 9 aa, Homo Sapiens
AGSNGTRAT

SEQ ID NO: 1184459 - protein, 9 aa, Homo Sapiens
AHKVCPVLW

SEQ ID NO: 1184460 - protein, 9 aa, Homo Sapiens
KPQLGLSID

SEQ ID NO: 1184461 - protein, 9 aa, Homo Sapiens
SGGSGWSGR

SEQ ID NO: 1184462 - protein, 9 aa, Homo Sapiens
LQQCKKCLK

SEQ ID NO: 1184463 - protein, 9 aa, Homo Sapiens
GAWPPPWLS

SEQ ID NO: 1184464 - protein, 9 aa, Homo Sapiens
QLSPKKIRL

SEQ ID NO: 1184465 - protein, 9 aa, Homo Sapiens
EQNLLGRSP

SEQ ID NO: 1184466 - protein, 9 aa, Homo Sapiens
CTCSPPWRE

SEQ ID NO: 1184467 - protein, 9 aa, Homo Sapiens
LRSQIEKHK

SEQ ID NO: 1184468 - protein, 9 aa, Homo Sapiens
LTVAAEACH

SEQ ID NO: 1184469 - protein, 9 aa, Homo Sapiens
PRPPARRRR

SEQ ID NO: 1184470 - protein, 9 aa, Homo Sapiens
EAASSALAG

SEQ ID NO: 1184471 - protein, 9 aa, Homo Sapiens
GSCSTISQN

SEQ ID NO: 1184472 - protein, 9 aa, Homo Sapiens
SPPARSWSA

SEQ ID NO: 1184473 - protein, 9 aa, Homo Sapiens
KQDLVRPWG

SEQ ID NO: 1184474 - protein, 9 aa, Homo Sapiens
LELEHARSE

SEQ ID NO: 1184475 - protein, 9 aa, Homo Sapiens
RGQEEAGGA

SEQ ID NO: 1184476 - protein, 9 aa, Homo Sapiens
TAPASCTAP

SEQ ID NO: 1184477 - protein, 9 aa, Homo Sapiens
ERNTDQATT

SEQ ID NO: 1184478 - protein, 9 aa, Homo Sapiens
WAQAEALRI

SEQ ID NO: 1184479 - protein, 9 aa, Homo Sapiens
PPPPRSWGC

SEQ ID NO: 1184480 - protein, 9 aa, Homo Sapiens
RLTIVSCFC

SEQ ID NO: 1184481 - protein, 9 aa, Homo Sapiens
TVVVLVAVP

SEQ ID NO: 1184482 - protein, 9 aa, Homo Sapiens
TQAKSPSPA

SEQ ID NO: 1184483 - protein, 9 aa, Homo Sapiens
HRGLGGHLS

SEQ ID NO: 1184484 - protein, 9 aa, Homo Sapiens
DCNKPPIYK

SEQ ID NO: 1184485 - protein, 9 aa, Homo Sapiens
SMSGQGKPK

SEQ ID NO: 1184486 - protein, 9 aa, Homo Sapiens
AAGTRALHA

SEQ ID NO: 1184487 - protein, 9 aa, Homo Sapiens
LGGRKKRRR

SEQ ID NO: 1184488 - protein, 9 aa, Homo Sapiens
CHLRMSVGT

SEQ ID NO: 1184489 - protein, 9 aa, Homo Sapiens
VVRNNLCVR

SEQ ID NO: 1184490 - protein, 9 aa, Homo Sapiens
NAGTNYTLR

SEQ ID NO: 1184491 - protein, 9 aa, Homo Sapiens
VPPLLKLSC

SEQ ID NO: 1184492 - protein, 9 aa, Homo Sapiens
HYQQPGKER

SEQ ID NO: 1184493 - protein, 9 aa, Homo Sapiens
LSVSIGQRP

SEQ ID NO: 1184494 - protein, 9 aa, Homo Sapiens
LCTARGWSW

SEQ ID NO: 1184495 - protein, 9 aa, Homo Sapiens
SWAAGPPSA

SEQ ID NO: 1184496 - protein, 9 aa, Homo Sapiens
PGNTARDTL

SEQ ID NO: 1184497 - protein, 9 aa, Homo Sapiens
ACLACISVG

SEQ ID NO: 1184498 - protein, 9 aa, Homo Sapiens
IRGWSGDSA

SEQ ID NO: 1184499 - protein, 9 aa, Homo Sapiens
IEQLVESAY

SEQ ID NO: 1184500 - protein, 9 aa, Homo Sapiens
QTLQVQEVL

SEQ ID NO: 1184501 - protein, 9 aa, Homo Sapiens
SRRARFSPR

SEQ ID NO: 1184502 - protein, 9 aa, Homo Sapiens
ALQDHDQSQ

SEQ ID NO: 1184503 - protein, 9 aa, Homo Sapiens
LESKQLRKY

SEQ ID NO: 1184504 - protein, 9 aa, Homo Sapiens
FKYYHWAMS

SEQ ID NO: 1184505 - protein, 9 aa, Homo Sapiens
LGSDLGGPC

SEQ ID NO: 1184506 - protein, 9 aa, Homo Sapiens
GAQHEAEAG

SEQ ID NO: 1184507 - protein, 9 aa, Homo Sapiens
ELPGNRRLQ

SEQ ID NO: 1184508 - protein, 9 aa, Homo Sapiens
GALKPAGPC

SEQ ID NO: 1184509 - protein, 9 aa, Homo Sapiens
TPKKKRSAF

SEQ ID NO: 1184510 - protein, 9 aa, Homo Sapiens
SWPSCPIPR

SEQ ID NO: 1184511 - protein, 9 aa, Homo Sapiens
PLADAVTKT

SEQ ID NO: 1184512 - protein, 9 aa, Homo Sapiens
PMESRPGPC

SEQ ID NO: 1184513 - protein, 9 aa, Homo Sapiens
PGSPPQGKS

SEQ ID NO: 1184514 - protein, 9 aa, Homo Sapiens
VRRALRRVD

SEQ ID NO: 1184515 - protein, 9 aa, Homo Sapiens
ESPSSHGAP

SEQ ID NO: 1184516 - protein, 9 aa, Homo Sapiens
LTETASPSL

SEQ ID NO: 1184517 - protein, 9 aa, Homo Sapiens
RRARIRDCK

SEQ ID NO: 1184518 - protein, 9 aa, Homo Sapiens
LLWKVHYQC

SEQ ID NO: 1184519 - protein, 9 aa, Homo Sapiens
RALEEECEF

SEQ ID NO: 1184520 - protein, 9 aa, Homo Sapiens
CCVKIYTFN

SEQ ID NO: 1184521 - protein, 9 aa, Homo Sapiens
PPSTSSPCR

SEQ ID NO: 1184522 - protein, 9 aa, Homo Sapiens
NQRGCFLRI

SEQ ID NO: 1184523 - protein, 9 aa, Homo Sapiens
RRRRPRRRA

SEQ ID NO: 1184524 - protein, 9 aa, Homo Sapiens
SCCPRPRCR

SEQ ID NO: 1184525 - protein, 9 aa, Homo Sapiens
DANRSWKVK

SEQ ID NO: 1184526 - protein, 9 aa, Homo Sapiens
TMWTCMDML

SEQ ID NO: 1184527 - protein, 9 aa, Homo Sapiens
GMGFLTSIT

SEQ ID NO: 1184528 - protein, 9 aa, Homo Sapiens
VCKKFMECD

SEQ ID NO: 1184529 - protein, 9 aa, Homo Sapiens
TVQNPQYNP

SEQ ID NO: 1184530 - protein, 9 aa, Homo Sapiens
LNGVCFKRI

SEQ ID NO: 1184531 - protein, 9 aa, Homo Sapiens
LWFKVVTSV

SEQ ID NO: 1184532 - protein, 9 aa, Homo Sapiens
GTTRMRHRV

SEQ ID NO: 1184533 - protein, 9 aa, Homo Sapiens
LPIKEGYFG

SEQ ID NO: 1184534 - protein, 9 aa, Homo Sapiens
LLNGLLFKG

SEQ ID NO: 1184535 - protein, 9 aa, Homo Sapiens
GQADGSSSG

SEQ ID NO: 1184536 - protein, 9 aa, Homo Sapiens
QRELPNGCV

SEQ ID NO: 1184537 - protein, 9 aa, Homo Sapiens
TSPAARPPQ

SEQ ID NO: 1184538 - protein, 9 aa, Homo Sapiens
AGVPCTQAC

SEQ ID NO: 1184539 - protein, 9 aa, Homo Sapiens
RPPENEAPQ

SEQ ID NO: 1184540 - protein, 9 aa, Homo Sapiens
RPPSAGALK

SEQ ID NO: 1184541 - protein, 9 aa, Homo Sapiens
GKTFTYSST

SEQ ID NO: 1184542 - protein, 9 aa, Homo Sapiens
SMTPLDTNC

SEQ ID NO: 1184543 - protein, 9 aa, Homo Sapiens
ANCMAAEAQ

SEQ ID NO: 1184544 - protein, 9 aa, Homo Sapiens
YGGIYMGTD

SEQ ID NO: 1184545 - protein, 9 aa, Homo Sapiens
RAMRPSGGM

SEQ ID NO: 1184546 - protein, 9 aa, Homo Sapiens
TYHLVWVPT

SEQ ID NO: 1184547 - protein, 9 aa, Homo Sapiens
PVPRCKTTC

SEQ ID NO: 1184548 - protein, 9 aa, Homo Sapiens
CTLESAAIN

SEQ ID NO: 1184549 - protein, 9 aa, Homo Sapiens
MTYEFLQAH

SEQ ID NO: 1184550 - protein, 9 aa, Homo Sapiens
GRAACGASW

SEQ ID NO: 1184551 - protein, 9 aa, Homo Sapiens
FSPRPGNAT

SEQ ID NO: 1184552 - protein, 9 aa, Homo Sapiens
RSGPTDGGE

SEQ ID NO: 1184553 - protein, 9 aa, Homo Sapiens
DLTPKQVDT

SEQ ID NO: 1184554 - protein, 9 aa, Homo Sapiens
YVPFEDDKP

SEQ ID NO: 1184555 - protein, 9 aa, Homo Sapiens
MKMKTFMKA

SEQ ID NO: 1184556 - protein, 9 aa, Homo Sapiens
ASLPQLSPT

SEQ ID NO: 1184557 - protein, 9 aa, Homo Sapiens
REKAGLLAM

SEQ ID NO: 1184558 - protein, 9 aa, Homo Sapiens
RFEYDGPRF

SEQ ID NO: 1184559 - protein, 9 aa, Homo Sapiens
FRDISNSSN

SEQ ID NO: 1184560 - protein, 9 aa, Homo Sapiens
SGNNVVSEN

SEQ ID NO: 1184561 - protein, 9 aa, Homo Sapiens
KVSYVNAID

SEQ ID NO: 1184562 - protein, 9 aa, Homo Sapiens
GGRACPHGA

SEQ ID NO: 1184563 - protein, 9 aa, Homo Sapiens
VAELPRDEA

SEQ ID NO: 1184564 - protein, 9 aa, Homo Sapiens
SLPGAMNAR

SEQ ID NO: 1184565 - protein, 9 aa, Homo Sapiens
QKCNPICQP

SEQ ID NO: 1184566 - protein, 9 aa, Homo Sapiens
PSMRQAGRP

SEQ ID NO: 1184567 - protein, 9 aa, Homo Sapiens
QPRARCLRV

SEQ ID NO: 1184568 - protein, 9 aa, Homo Sapiens
QRLGWWLLE

SEQ ID NO: 1184569 - protein, 9 aa, Homo Sapiens
RIRKQFFSF

SEQ ID NO: 1184570 - protein, 9 aa, Homo Sapiens
ELAKITMKG

SEQ ID NO: 1184571 - protein, 9 aa, Homo Sapiens
LQPPGGCHP

SEQ ID NO: 1184572 - protein, 9 aa, Homo Sapiens
RTAAVGKAR

SEQ ID NO: 1184573 - protein, 9 aa, Homo Sapiens
LNPRKVCTG

SEQ ID NO: 1184574 - protein, 9 aa, Homo Sapiens
SKGVRMRAL

SEQ ID NO: 1184575 - protein, 9 aa, Homo Sapiens
PVTPLRVQS

SEQ ID NO: 1184576 - protein, 9 aa, Homo Sapiens
TDDFEESNT

SEQ ID NO: 1184577 - protein, 9 aa, Homo Sapiens
CPKEAAGDV

SEQ ID NO: 1184578 - protein, 9 aa, Homo Sapiens
DIRFVWENG

SEQ ID NO: 1184579 - protein, 9 aa, Homo Sapiens
CLVTIGRLH

SEQ ID NO: 1184580 - protein, 9 aa, Homo Sapiens
TSRSSCHNG

SEQ ID NO: 1184581 - protein, 9 aa, Homo Sapiens
IRVKAVSEK

SEQ ID NO: 1184582 - protein, 9 aa, Homo Sapiens
CWSMRMRMI

SEQ ID NO: 1184583 - protein, 9 aa, Homo Sapiens
EVQPACLDP

SEQ ID NO: 1184584 - protein, 9 aa, Homo Sapiens
CFLPVFSNL

SEQ ID NO: 1184585 - protein, 9 aa, Homo Sapiens
PWDWLPPCG

SEQ ID NO: 1184586 - protein, 9 aa, Homo Sapiens
TDQATTPDN

SEQ ID NO: 1184587 - protein, 9 aa, Homo Sapiens
YLDEIEHGF

SEQ ID NO: 1184588 - protein, 9 aa, Homo Sapiens
CGAAPGVWS

SEQ ID NO: 1184589 - protein, 9 aa, Homo Sapiens
QKNIDWETS

SEQ ID NO: 1184590 - protein, 9 aa, Homo Sapiens
KELLMMLQL

SEQ ID NO: 1184591 - protein, 9 aa, Homo Sapiens
DWGKRSEGG

SEQ ID NO: 1184592 - protein, 9 aa, Homo Sapiens
LNSWRSGGS

SEQ ID NO: 1184593 - protein, 9 aa, Homo Sapiens
LYPVLNLAT

SEQ ID NO: 1184594 - protein, 9 aa, Homo Sapiens
ALSPTCVEA

SEQ ID NO: 1184595 - protein, 9 aa, Homo Sapiens
RLDGLLNRC

SEQ ID NO: 1184596 - protein, 9 aa, Homo Sapiens
WSPCDRSWL

SEQ ID NO: 1184597 - protein, 9 aa, Homo Sapiens
EHPDHNQVG

SEQ ID NO: 1184598 - protein, 9 aa, Homo Sapiens
SPLTDLGVL

SEQ ID NO: 1184599 - protein, 9 aa, Homo Sapiens
GSGVGGAAW

SEQ ID NO: 1184600 - protein, 9 aa, Homo Sapiens
RAPRRRTCA

SEQ ID NO: 1184601 - protein, 9 aa, Homo Sapiens
VVRGGVRKP

SEQ ID NO: 1184602 - protein, 9 aa, Homo Sapiens
FSHLGDGLG

SEQ ID NO: 1184603 - protein, 9 aa, Homo Sapiens
MVMLDPEWQ

SEQ ID NO: 1184604 - protein, 9 aa, Homo Sapiens
LPTVASSIV

SEQ ID NO: 1184605 - protein, 9 aa, Homo Sapiens
SYMQVGSSG

SEQ ID NO: 1184606 - protein, 9 aa, Homo Sapiens
TGQTATSPA

SEQ ID NO: 1184607 - protein, 9 aa, Homo Sapiens
SGVTQRHRT

SEQ ID NO: 1184608 - protein, 9 aa, Homo Sapiens
VKDHVVHTL

SEQ ID NO: 1184609 - protein, 9 aa, Homo Sapiens
PALAWCAWA

SEQ ID NO: 1184610 - protein, 9 aa, Homo Sapiens
PRLPLWRSR

SEQ ID NO: 1184611 - protein, 9 aa, Homo Sapiens
PPLPWTSLH

SEQ ID NO: 1184612 - protein, 9 aa, Homo Sapiens
LRNLGGKPI

SEQ ID NO: 1184613 - protein, 9 aa, Homo Sapiens
PSRPAQPTV

SEQ ID NO: 1184614 - protein, 9 aa, Homo Sapiens
CVQEIALRV

SEQ ID NO: 1184615 - protein, 9 aa, Homo Sapiens
RDEESTAWG

SEQ ID NO: 1184616 - protein, 9 aa, Homo Sapiens
VKQKKTATK

SEQ ID NO: 1184617 - protein, 9 aa, Homo Sapiens
PRVQAHWRF

SEQ ID NO: 1184618 - protein, 9 aa, Homo Sapiens
GFVEWPWGL

SEQ ID NO: 1184619 - protein, 9 aa, Homo Sapiens
RLRYKGGTR

SEQ ID NO: 1184620 - protein, 9 aa, Homo Sapiens
PRLKDGVWS

SEQ ID NO: 1184621 - protein, 9 aa, Homo Sapiens
LSYLLFGTQ

SEQ ID NO: 1184622 - protein, 9 aa, Homo Sapiens
LEETPPRET

SEQ ID NO: 1184623 - protein, 9 aa, Homo Sapiens
CGPKPKTFL

SEQ ID NO: 1184624 - protein, 9 aa, Homo Sapiens
SWGCTSLRL

SEQ ID NO: 1184625 - protein, 9 aa, Homo Sapiens
PLPHWPMRL

SEQ ID NO: 1184626 - protein, 9 aa, Homo Sapiens
EVTSTLEVL

SEQ ID NO: 1184627 - protein, 9 aa, Homo Sapiens
MNIIDIVVI

SEQ ID NO: 1184628 - protein, 9 aa, Homo Sapiens
LNEADHAFT

SEQ ID NO: 1184629 - protein, 9 aa, Homo Sapiens
TPGQGSPCL

SEQ ID NO: 1184630 - protein, 9 aa, Homo Sapiens
SSARPSCWS

SEQ ID NO: 1184631 - protein, 9 aa, Homo Sapiens
SFAVLLILL

SEQ ID NO: 1184632 - protein, 9 aa, Homo Sapiens
IGQTSSVSF

SEQ ID NO: 1184633 - protein, 9 aa, Homo Sapiens
GAGRGQEEA

SEQ ID NO: 1184634 - protein, 9 aa, Homo Sapiens
SWPRWTMAW

SEQ ID NO: 1184635 - protein, 9 aa, Homo Sapiens
FPGTFSFRH

SEQ ID NO: 1184636 - protein, 9 aa, Homo Sapiens
FYLTLVLIR

SEQ ID NO: 1184637 - protein, 9 aa, Homo Sapiens
QDRIEKNTK

SEQ ID NO: 1184638 - protein, 9 aa, Homo Sapiens
ISFRVLASS

SEQ ID NO: 1184639 - protein, 9 aa, Homo Sapiens
RAANVITKN

SEQ ID NO: 1184640 - protein, 9 aa, Homo Sapiens
ILRHHGLLF

SEQ ID NO: 1184641 - protein, 9 aa, Homo Sapiens
MERPDWEIA

SEQ ID NO: 1184642 - protein, 9 aa, Homo Sapiens
SRDKIKSDH

SEQ ID NO: 1184643 - protein, 9 aa, Homo Sapiens
SYSYMQVGS

SEQ ID NO: 1184644 - protein, 9 aa, Homo Sapiens
PFCPRARQP

SEQ ID NO: 1184645 - protein, 9 aa, Homo Sapiens
APAWWRLCV

SEQ ID NO: 1184646 - protein, 9 aa, Homo Sapiens
PQCPSAQGR

SEQ ID NO: 1184647 - protein, 9 aa, Homo Sapiens
DSSAGPEVD

SEQ ID NO: 1184648 - protein, 9 aa, Homo Sapiens
VREDEPASL

SEQ ID NO: 1184649 - protein, 9 aa, Homo Sapiens
CIEFRPVDC

SEQ ID NO: 1184650 - protein, 9 aa, Homo Sapiens
VSGLITNCS

SEQ ID NO: 1184651 - protein, 9 aa, Homo Sapiens
GCVASINLS

SEQ ID NO: 1184652 - protein, 9 aa, Homo Sapiens
TSVSCGSAP

SEQ ID NO: 1184653 - protein, 9 aa, Homo Sapiens
RPGEGPHPQ

SEQ ID NO: 1184654 - protein, 9 aa, Homo Sapiens
PPWPQAAFA

SEQ ID NO: 1184655 - protein, 9 aa, Homo Sapiens
RAAAQELLG

SEQ ID NO: 1184656 - protein, 9 aa, Homo Sapiens
EFADDPCTS

SEQ ID NO: 1184657 - protein, 9 aa, Homo Sapiens
TPCPYGPRA

SEQ ID NO: 1184658 - protein, 9 aa, Homo Sapiens
SNNCIQVFK

SEQ ID NO: 1184659 - protein, 9 aa, Homo Sapiens
HANFFHPEK

SEQ ID NO: 1184660 - protein, 9 aa, Homo Sapiens
YSYMQVGSS

SEQ ID NO: 1184661 - protein, 9 aa, Homo Sapiens
MPRALWASS

SEQ ID NO: 1184662 - protein, 9 aa, Homo Sapiens
CSVAPPIEC

SEQ ID NO: 1184663 - protein, 9 aa, Homo Sapiens
GPWPALAWC

SEQ ID NO: 1184664 - protein, 9 aa, Homo Sapiens
LLKRNMKSS

SEQ ID NO: 1184665 - protein, 9 aa, Homo Sapiens
VRYYNKQHV

SEQ ID NO: 1184666 - protein, 9 aa, Homo Sapiens
IPCIFQAVV

SEQ ID NO: 1184667 - protein, 9 aa, Homo Sapiens
RASGTLLSG

SEQ ID NO: 1184668 - protein, 9 aa, Homo Sapiens
VTNSNANTA

SEQ ID NO: 1184669 - protein, 9 aa, Homo Sapiens
YQCLRHPVG

SEQ ID NO: 1184670 - protein, 9 aa, Homo Sapiens
AALEGFLTA

SEQ ID NO: 1184671 - protein, 9 aa, Homo Sapiens
VCVLHLGVT

SEQ ID NO: 1184672 - protein, 9 aa, Homo Sapiens
VIIPYFITL

SEQ ID NO: 1184673 - protein, 9 aa, Homo Sapiens
GKTDICSSA

SEQ ID NO: 1184674 - protein, 9 aa, Homo Sapiens
TDLRSNTGG

SEQ ID NO: 1184675 - protein, 9 aa, Homo Sapiens
FISAPQPSS

SEQ ID NO: 1184676 - protein, 9 aa, Homo Sapiens
LECDEECMH

SEQ ID NO: 1184677 - protein, 9 aa, Homo Sapiens
AERRKFGSQ

SEQ ID NO: 1184678 - protein, 9 aa, Homo Sapiens
AGGAVPTYV

SEQ ID NO: 1184679 - protein, 9 aa, Homo Sapiens
VVVLVAVPG

SEQ ID NO: 1184680 - protein, 9 aa, Homo Sapiens
GGAVPTYVS

SEQ ID NO: 1184681 - protein, 9 aa, Homo Sapiens
RLFNLRADQ

SEQ ID NO: 1184682 - protein, 9 aa, Homo Sapiens
LTSIVIGDD

SEQ ID NO: 1184683 - protein, 9 aa, Homo Sapiens
VRPGSSWEK

SEQ ID NO: 1184684 - protein, 9 aa, Homo Sapiens
DSWWVVDCP

SEQ ID NO: 1184685 - protein, 9 aa, Homo Sapiens
IINLQFPIE

SEQ ID NO: 1184686 - protein, 9 aa, Homo Sapiens
IPISKVGKE

SEQ ID NO: 1184687 - protein, 9 aa, Homo Sapiens
SIRRLRRRL

SEQ ID NO: 1184688 - protein, 9 aa, Homo Sapiens
TCVEAASSA

SEQ ID NO: 1184689 - protein, 9 aa, Homo Sapiens
SPSRRRAPP

SEQ ID NO: 1184690 - protein, 9 aa, Homo Sapiens
GGTPRDAGL

SEQ ID NO: 1184691 - protein, 9 aa, Homo Sapiens
LCANTVLSG

SEQ ID NO: 1184692 - protein, 9 aa, Homo Sapiens
NVHYQMCHR

SEQ ID NO: 1184693 - protein, 9 aa, Homo Sapiens
VTGTSEVTL

SEQ ID NO: 1184694 - protein, 9 aa, Homo Sapiens
NCPLMEVLR

SEQ ID NO: 1184695 - protein, 9 aa, Homo Sapiens
GLCPGSPPQ

SEQ ID NO: 1184696 - protein, 9 aa, Homo Sapiens
EPPRGPLPM

SEQ ID NO: 1184697 - protein, 9 aa, Homo Sapiens
DTPMVRQAA

SEQ ID NO: 1184698 - protein, 9 aa, Homo Sapiens
SASAQLWAR

SEQ ID NO: 1184699 - protein, 9 aa, Homo Sapiens
ELEKMKEEC

SEQ ID NO: 1184700 - protein, 9 aa, Homo Sapiens
LKALVKTWT

SEQ ID NO: 1184701 - protein, 9 aa, Homo Sapiens
SIEHPDHNQ

SEQ ID NO: 1184702 - protein, 9 aa, Homo Sapiens
LLKRTPWKH

SEQ ID NO: 1184703 - protein, 9 aa, Homo Sapiens
SKNVAMEAV

SEQ ID NO: 1184704 - protein, 9 aa, Homo Sapiens
RVHCGAPPI

SEQ ID NO: 1184705 - protein, 9 aa, Homo Sapiens
AASPRRMCL

SEQ ID NO: 1184706 - protein, 9 aa, Homo Sapiens
VVPARWTCC

SEQ ID NO: 1184707 - protein, 9 aa, Homo Sapiens
SGWMPGMNM

SEQ ID NO: 1184708 - protein, 9 aa, Homo Sapiens
ITSVVRRSH

SEQ ID NO: 1184709 - protein, 9 aa, Homo Sapiens
AELLRSQIE

SEQ ID NO: 1184710 - protein, 9 aa, Homo Sapiens
HSQFKRTRT

SEQ ID NO: 1184711 - protein, 9 aa, Homo Sapiens
NQLLDVLDH

SEQ ID NO: 1184712 - protein, 9 aa, Homo Sapiens
LVRVRMAVT

SEQ ID NO: 1184713 - protein, 9 aa, Homo Sapiens
ERLLIYGEC

SEQ ID NO: 1184714 - protein, 9 aa, Homo Sapiens
RKKAAAAAR

SEQ ID NO: 1184715 - protein, 9 aa, Homo Sapiens
NTRIPISKV

SEQ ID NO: 1184716 - protein, 9 aa, Homo Sapiens
YPPPRHPPP

SEQ ID NO: 1184717 - protein, 9 aa, Homo Sapiens
LEEEYEDDA

SEQ ID NO: 1184718 - protein, 9 aa, Homo Sapiens
PEVDVFLGA

SEQ ID NO: 1184719 - protein, 9 aa, Homo Sapiens
VAGERALTR

SEQ ID NO: 1184720 - protein, 9 aa, Homo Sapiens
QPFAMPHSA

SEQ ID NO: 1184721 - protein, 9 aa, Homo Sapiens
RSIVSTLKR

SEQ ID NO: 1184722 - protein, 9 aa, Homo Sapiens
IPFPRSSLH

SEQ ID NO: 1184723 - protein, 9 aa, Homo Sapiens
GSPCLGSQD

SEQ ID NO: 1184724 - protein, 9 aa, Homo Sapiens
RRRRPAQTC

SEQ ID NO: 1184725 - protein, 9 aa, Homo Sapiens
WMVSSRSSR

SEQ ID NO: 1184726 - protein, 9 aa, Homo Sapiens
SPPFGGTPQ

SEQ ID NO: 1184727 - protein, 9 aa, Homo Sapiens
ALQGPPAPA

SEQ ID NO: 1184728 - protein, 9 aa, Homo Sapiens
WDNNAGTNY

SEQ ID NO: 1184729 - protein, 9 aa, Homo Sapiens
RPSVDHTFD

SEQ ID NO: 1184730 - protein, 9 aa, Homo Sapiens
LITRLPTSV

SEQ ID NO: 1184731 - protein, 9 aa, Homo Sapiens
GGTELGPLL

SEQ ID NO: 1184732 - protein, 9 aa, Homo Sapiens
FFCHYKLFQ

SEQ ID NO: 1184733 - protein, 9 aa, Homo Sapiens
HPSFLQPSP

SEQ ID NO: 1184734 - protein, 9 aa, Homo Sapiens
PLPLPHWPM

SEQ ID NO: 1184735 - protein, 9 aa, Homo Sapiens
PIPRRDPRP

SEQ ID NO: 1184736 - protein, 9 aa, Homo Sapiens
LDGLLNRCR

SEQ ID NO: 1184737 - protein, 9 aa, Homo Sapiens
PPPPPGSSP

SEQ ID NO: 1184738 - protein, 9 aa, Homo Sapiens
VSVLLTVLE

SEQ ID NO: 1184739 - protein, 9 aa, Homo Sapiens
CGSAPGCWP

SEQ ID NO: 1184740 - protein, 9 aa, Homo Sapiens
AATGSFASA

SEQ ID NO: 1184741 - protein, 9 aa, Homo Sapiens
WPALTRRWP

SEQ ID NO: 1184742 - protein, 9 aa, Homo Sapiens
LRSGSPGSG

SEQ ID NO: 1184743 - protein, 9 aa, Homo Sapiens
DPTRVMVPL

SEQ ID NO: 1184744 - protein, 9 aa, Homo Sapiens
STTEMDIFE

SEQ ID NO: 1184745 - protein, 9 aa, Homo Sapiens
AAARGQRLL

SEQ ID NO: 1184746 - protein, 9 aa, Homo Sapiens
TSRHVWFRE

SEQ ID NO: 1184747 - protein, 9 aa, Homo Sapiens
REVLQFQFT

SEQ ID NO: 1184748 - protein, 9 aa, Homo Sapiens
WGVDRSSQV

SEQ ID NO: 1184749 - protein, 9 aa, Homo Sapiens
PAFPLTTLA

SEQ ID NO: 1184750 - protein, 9 aa, Homo Sapiens
SYSAPHTET

SEQ ID NO: 1184751 - protein, 9 aa, Homo Sapiens
YDFPPSMRQ

SEQ ID NO: 1184752 - protein, 9 aa, Homo Sapiens
QPACLDPSS

SEQ ID NO: 1184753 - protein, 9 aa, Homo Sapiens
TCPVGMACD

SEQ ID NO: 1184754 - protein, 9 aa, Homo Sapiens
WAFGTPSWR

SEQ ID NO: 1184755 - protein, 9 aa, Homo Sapiens
FHTSCPESF

SEQ ID NO: 1184756 - protein, 9 aa, Homo Sapiens
TLKMIRRGD

SEQ ID NO: 1184757 - protein, 9 aa, Homo Sapiens
LCPKHWFQL

SEQ ID NO: 1184758 - protein, 9 aa, Homo Sapiens
TPRGRTSGR

SEQ ID NO: 1184759 - protein, 9 aa, Homo Sapiens
PSTSSPCRR

SEQ ID NO: 1184760 - protein, 9 aa, Homo Sapiens
SPQPEGLLD

SEQ ID NO: 1184761 - protein, 9 aa, Homo Sapiens
YGNPNFCWL

SEQ ID NO: 1184762 - protein, 9 aa, Homo Sapiens
ALSVLLPAA

SEQ ID NO: 1184763 - protein, 9 aa, Homo Sapiens
PDGSQSGYC

SEQ ID NO: 1184764 - protein, 9 aa, Homo Sapiens
SSSSHPSFL

SEQ ID NO: 1184765 - protein, 9 aa, Homo Sapiens
HLVPRTREG

SEQ ID NO: 1184766 - protein, 9 aa, Homo Sapiens
AITVQRKDY

SEQ ID NO: 1184767 - protein, 9 aa, Homo Sapiens
RGRATVRVG

SEQ ID NO: 1184768 - protein, 9 aa, Homo Sapiens
ALTVVRPGN

SEQ ID NO: 1184769 - protein, 9 aa, Homo Sapiens
ALSRTGRRP

SEQ ID NO: 1184770 - protein, 9 aa, Homo Sapiens
SPRRSPDHR

SEQ ID NO: 1184771 - protein, 9 aa, Homo Sapiens
HNLMLWSAV

SEQ ID NO: 1184772 - protein, 9 aa, Homo Sapiens
LPAGPSALP

SEQ ID NO: 1184773 - protein, 9 aa, Homo Sapiens
SVLCFSGTY

SEQ ID NO: 1184774 - protein, 9 aa, Homo Sapiens
VTLTPKVLV

SEQ ID NO: 1184775 - protein, 9 aa, Homo Sapiens
STAPSPRAG

SEQ ID NO: 1184776 - protein, 9 aa, Homo Sapiens
SDGIPGPFG

SEQ ID NO: 1184777 - protein, 9 aa, Homo Sapiens
SEVSFPSEE

SEQ ID NO: 1184778 - protein, 9 aa, Homo Sapiens
VFFEEKNQY

SEQ ID NO: 1184779 - protein, 9 aa, Homo Sapiens
HHGLLFLHL

SEQ ID NO: 1184780 - protein, 9 aa, Homo Sapiens
GKSPNIPYM

SEQ ID NO: 1184781 - protein, 9 aa, Homo Sapiens
HGCPLRIMF

SEQ ID NO: 1184782 - protein, 9 aa, Homo Sapiens
PNSLLICDP

SEQ ID NO: 1184783 - protein, 9 aa, Homo Sapiens
CRIQKSDFS

SEQ ID NO: 1184784 - protein, 9 aa, Homo Sapiens
WCCQSGTCS

SEQ ID NO: 1184785 - protein, 9 aa, Homo Sapiens
CTPPGSCGF

SEQ ID NO: 1184786 - protein, 9 aa, Homo Sapiens
SRKRDKQSR

SEQ ID NO: 1184787 - protein, 9 aa, Homo Sapiens
SVLRWEQEV

SEQ ID NO: 1184788 - protein, 9 aa, Homo Sapiens
LPKGCPPGF

SEQ ID NO: 1184789 - protein, 9 aa, Homo Sapiens
PLQGQRNPT

SEQ ID NO: 1184790 - protein, 9 aa, Homo Sapiens
LPPQPRLAL

SEQ ID NO: 1184791 - protein, 9 aa, Homo Sapiens
CPISTTLRP

SEQ ID NO: 1184792 - protein, 9 aa, Homo Sapiens
RRRLRRTSP

SEQ ID NO: 1184793 - protein, 9 aa, Homo Sapiens
QSECVGPFS

SEQ ID NO: 1184794 - protein, 9 aa, Homo Sapiens
FSGQLAGRT

SEQ ID NO: 1184795 - protein, 9 aa, Homo Sapiens
VIWPILQQV

SEQ ID NO: 1184796 - protein, 9 aa, Homo Sapiens
NVAGKIHTV

SEQ ID NO: 1184797 - protein, 9 aa, Homo Sapiens
TQLLIHSMC

SEQ ID NO: 1184798 - protein, 9 aa, Homo Sapiens
SSCELLYLS

SEQ ID NO: 1184799 - protein, 9 aa, Homo Sapiens
KADTPTPTT

SEQ ID NO: 1184800 - protein, 9 aa, Homo Sapiens
AERGSLETR

SEQ ID NO: 1184801 - protein, 9 aa, Homo Sapiens
HIYDLNIPA

SEQ ID NO: 1184802 - protein, 9 aa, Homo Sapiens
LGQRRRGWR

SEQ ID NO: 1184803 - protein, 9 aa, Homo Sapiens
IFFSIASGT

SEQ ID NO: 1184804 - protein, 9 aa, Homo Sapiens
SRASAGAVR

SEQ ID NO: 1184805 - protein, 9 aa, Homo Sapiens
LLTQPSPAS

SEQ ID NO: 1184806 - protein, 9 aa, Homo Sapiens
LSAKCQIAS

SEQ ID NO: 1184807 - protein, 9 aa, Homo Sapiens
HQSEGKPDK

SEQ ID NO: 1184808 - protein, 9 aa, Homo Sapiens
ADAQAVCAR

SEQ ID NO: 1184809 - protein, 9 aa, Homo Sapiens
LSPDHRASL

SEQ ID NO: 1184810 - protein, 9 aa, Homo Sapiens
KCPAEDYVP

SEQ ID NO: 1184811 - protein, 9 aa, Homo Sapiens
QGPPGPQDP

SEQ ID NO: 1184812 - protein, 9 aa, Homo Sapiens
MCHRHCCDI

SEQ ID NO: 1184813 - protein, 9 aa, Homo Sapiens
RKNHGLEAT

SEQ ID NO: 1184814 - protein, 9 aa, Homo Sapiens
EARALSRGS

SEQ ID NO: 1184815 - protein, 9 aa, Homo Sapiens
LGSETLAAR

SEQ ID NO: 1184816 - protein, 9 aa, Homo Sapiens
HTLCSDHSV

SEQ ID NO: 1184817 - protein, 9 aa, Homo Sapiens
RAPGPPSTS

SEQ ID NO: 1184818 - protein, 9 aa, Homo Sapiens
SRSPDTRAC

SEQ ID NO: 1184819 - protein, 9 aa, Homo Sapiens
GSAFAASTA

SEQ ID NO: 1184820 - protein, 9 aa, Homo Sapiens
VSLQDAVTQ

SEQ ID NO: 1184821 - protein, 9 aa, Homo Sapiens
TRPLTTPPE

SEQ ID NO: 1184822 - protein, 9 aa, Homo Sapiens
KSEDYEDKE

SEQ ID NO: 1184823 - protein, 9 aa, Homo Sapiens
GKKWDHEAI

SEQ ID NO: 1184824 - protein, 9 aa, Homo Sapiens
KPPRLTRSQ

SEQ ID NO: 1184825 - protein, 9 aa, Homo Sapiens
TVSGTSRQH

SEQ ID NO: 1184826 - protein, 9 aa, Homo Sapiens
LAENISCVL

SEQ ID NO: 1184827 - protein, 9 aa, Homo Sapiens
GLKFVGVMP

SEQ ID NO: 1184828 - protein, 9 aa, Homo Sapiens
PLTTPPERR

SEQ ID NO: 1184829 - protein, 9 aa, Homo Sapiens
FRIVLMAVG

SEQ ID NO: 1184830 - protein, 9 aa, Homo Sapiens
PIGVCGQFI

SEQ ID NO: 1184831 - protein, 9 aa, Homo Sapiens
AAIPGYQLW

SEQ ID NO: 1184832 - protein, 9 aa, Homo Sapiens
RLEEEYEDD

SEQ ID NO: 1184833 - protein, 9 aa, Homo Sapiens
ALLEHYLEL

SEQ ID NO: 1184834 - protein, 9 aa, Homo Sapiens
AGGLVVADL

SEQ ID NO: 1184835 - protein, 9 aa, Homo Sapiens
GCRLEEEYE

SEQ ID NO: 1184836 - protein, 9 aa, Homo Sapiens
CSRGLPTTG

SEQ ID NO: 1184837 - protein, 9 aa, Homo Sapiens
EAVAGQDDG

SEQ ID NO: 1184838 - protein, 9 aa, Homo Sapiens
GTHPEAHLR

SEQ ID NO: 1184839 - protein, 9 aa, Homo Sapiens
RDMLGGMGF

SEQ ID NO: 1184840 - protein, 9 aa, Homo Sapiens
QQDPQLHPE

SEQ ID NO: 1184841 - protein, 9 aa, Homo Sapiens
SFRVLASSW

SEQ ID NO: 1184842 - protein, 9 aa, Homo Sapiens
AGPEDGRAP

SEQ ID NO: 1184843 - protein, 9 aa, Homo Sapiens
AAVAVTAGP

SEQ ID NO: 1184844 - protein, 9 aa, Homo Sapiens
AGCRPRCCR

SEQ ID NO: 1184845 - protein, 9 aa, Homo Sapiens
RLVRDLPKG

SEQ ID NO: 1184846 - protein, 9 aa, Homo Sapiens
TWIGLNNRI

SEQ ID NO: 1184847 - protein, 9 aa, Homo Sapiens
NHCCVKIYT

SEQ ID NO: 1184848 - protein, 9 aa, Homo Sapiens
DQIKEKRKH

SEQ ID NO: 1184849 - protein, 9 aa, Homo Sapiens
HTDNNDRTP

SEQ ID NO: 1184850 - protein, 9 aa, Homo Sapiens
ASISPVTKG

SEQ ID NO: 1184851 - protein, 9 aa, Homo Sapiens
GGWFEVVSQ

SEQ ID NO: 1184852 - protein, 9 aa, Homo Sapiens
EAMGLCKAQ

SEQ ID NO: 1184853 - protein, 9 aa, Homo Sapiens
LFLVMCILT

SEQ ID NO: 1184854 - protein, 9 aa, Homo Sapiens
IRIELRSLT

SEQ ID NO: 1184855 - protein, 9 aa, Homo Sapiens
LGYQNGIKW

SEQ ID NO: 1184856 - protein, 9 aa, Homo Sapiens
FGAVRQEPV

SEQ ID NO: 1184857 - protein, 9 aa, Homo Sapiens
FFGPCSPCQ

SEQ ID NO: 1184858 - protein, 9 aa, Homo Sapiens
FMAYTFERV

SEQ ID NO: 1184859 - protein, 9 aa, Homo Sapiens
TYVTLTPKV

SEQ ID NO: 1184860 - protein, 9 aa, Homo Sapiens
PRAGSRRCC

SEQ ID NO: 1184861 - protein, 9 aa, Homo Sapiens
FPQLPVGNS

SEQ ID NO: 1184862 - protein, 9 aa, Homo Sapiens
SVFDWHVVL

SEQ ID NO: 1184863 - protein, 9 aa, Homo Sapiens
PLGGRKKRR

SEQ ID NO: 1184864 - protein, 9 aa, Homo Sapiens
SSLSSQTSV

SEQ ID NO: 1184865 - protein, 9 aa, Homo Sapiens
QHRASLVQH

SEQ ID NO: 1184866 - protein, 9 aa, Homo Sapiens
ESTGNGPPT

SEQ ID NO: 1184867 - protein, 9 aa, Homo Sapiens
GNLIKHQRA

SEQ ID NO: 1184868 - protein, 9 aa, Homo Sapiens
NRTVRMTQE

SEQ ID NO: 1184869 - protein, 9 aa, Homo Sapiens
EPCGLAWSK

SEQ ID NO: 1184870 - protein, 9 aa, Homo Sapiens
LLHEQIGPE

SEQ ID NO: 1184871 - protein, 9 aa, Homo Sapiens
GAVGLRVHI

SEQ ID NO: 1184872 - protein, 9 aa, Homo Sapiens
PGSPPSSPL

SEQ ID NO: 1184873 - protein, 9 aa, Homo Sapiens
ALNGKPTPP

SEQ ID NO: 1184874 - protein, 9 aa, Homo Sapiens
QKAAHKGKI

SEQ ID NO: 1184875 - protein, 9 aa, Homo Sapiens
FALDVRCNE

SEQ ID NO: 1184876 - protein, 9 aa, Homo Sapiens
TWTRLPRRS

SEQ ID NO: 1184877 - protein, 9 aa, Homo Sapiens
HTASLGTGG

SEQ ID NO: 1184878 - protein, 9 aa, Homo Sapiens
PHQHGCREK

SEQ ID NO: 1184879 - protein, 9 aa, Homo Sapiens
LRSAIIHKA

SEQ ID NO: 1184880 - protein, 9 aa, Homo Sapiens
AKAPSRCFV

SEQ ID NO: 1184881 - protein, 9 aa, Homo Sapiens
SDSGVTQRH

SEQ ID NO: 1184882 - protein, 9 aa, Homo Sapiens
QSSGYGQHR

SEQ ID NO: 1184883 - protein, 9 aa, Homo Sapiens
CSAKQLVSP

SEQ ID NO: 1184884 - protein, 9 aa, Homo Sapiens
VASRSTAPS

SEQ ID NO: 1184885 - protein, 9 aa, Homo Sapiens
GSREPPQSR

SEQ ID NO: 1184886 - protein, 9 aa, Homo Sapiens
HIELLRRLR

SEQ ID NO: 1184887 - protein, 9 aa, Homo Sapiens
VSPEPPRPH

SEQ ID NO: 1184888 - protein, 9 aa, Homo Sapiens
TTSSQPSRM

SEQ ID NO: 1184889 - protein, 9 aa, Homo Sapiens
CRRKRIPVA

SEQ ID NO: 1184890 - protein, 9 aa, Homo Sapiens
LRVPAGPRL

SEQ ID NO: 1184891 - protein, 9 aa, Homo Sapiens
TKKGTMEAK

SEQ ID NO: 1184892 - protein, 9 aa, Homo Sapiens
LSPLPPGGK

SEQ ID NO: 1184893 - protein, 9 aa, Homo Sapiens
HGPHMPPAT

SEQ ID NO: 1184894 - protein, 9 aa, Homo Sapiens
PSWRPPWWR

SEQ ID NO: 1184895 - protein, 9 aa, Homo Sapiens
LRTHSAKRC

SEQ ID NO: 1184896 - protein, 9 aa, Homo Sapiens
AVPLGTTTK

SEQ ID NO: 1184897 - protein, 9 aa, Homo Sapiens
PQERGDLGC

SEQ ID NO: 1184898 - protein, 9 aa, Homo Sapiens
GPVAETHDL

SEQ ID NO: 1184899 - protein, 9 aa, Homo Sapiens
SASRHPEPM

SEQ ID NO: 1184900 - protein, 9 aa, Homo Sapiens
TSPRPRTCS

SEQ ID NO: 1184901 - protein, 9 aa, Homo Sapiens
DIPKARRKC

SEQ ID NO: 1184902 - protein, 9 aa, Homo Sapiens
FGLRSDWLI

SEQ ID NO: 1184903 - protein, 9 aa, Homo Sapiens
AGMGLQLLR

SEQ ID NO: 1184904 - protein, 9 aa, Homo Sapiens
NTCTRPLKV

SEQ ID NO: 1184905 - protein, 9 aa, Homo Sapiens
VRRRRRPAQ

SEQ ID NO: 1184906 - protein, 9 aa, Homo Sapiens
AMLPKLLCR

SEQ ID NO: 1184907 - protein, 9 aa, Homo Sapiens
LDIRPVSED

SEQ ID NO: 1184908 - protein, 9 aa, Homo Sapiens
QTWWRRRRC

SEQ ID NO: 1184909 - protein, 9 aa, Homo Sapiens
SLSVSIGQR

SEQ ID NO: 1184910 - protein, 9 aa, Homo Sapiens
ATRTTLRKS

SEQ ID NO: 1184911 - protein, 9 aa, Homo Sapiens
DQDHGAAQN

SEQ ID NO: 1184912 - protein, 9 aa, Homo Sapiens
PFHVLALEV

SEQ ID NO: 1184913 - protein, 9 aa, Homo Sapiens
DRGLQALGS

SEQ ID NO: 1184914 - protein, 9 aa, Homo Sapiens
VGMACDSVS

SEQ ID NO: 1184915 - protein, 9 aa, Homo Sapiens
PRGLLTRPP

SEQ ID NO: 1184916 - protein, 9 aa, Homo Sapiens
PPTGSMPPT

SEQ ID NO: 1184917 - protein, 9 aa, Homo Sapiens
LSVEEAPAN

SEQ ID NO: 1184918 - protein, 9 aa, Homo Sapiens
RAACGASWR

SEQ ID NO: 1184919 - protein, 9 aa, Homo Sapiens
EKKREKVIS

SEQ ID NO: 1184920 - protein, 9 aa, Homo Sapiens
GWPAAHVHH

SEQ ID NO: 1184921 - protein, 9 aa, Homo Sapiens
QRLVRDLPK

SEQ ID NO: 1184922 - protein, 9 aa, Homo Sapiens
SALPSPPSP

SEQ ID NO: 1184923 - protein, 9 aa, Homo Sapiens
LGGGPRPRP

SEQ ID NO: 1184924 - protein, 9 aa, Homo Sapiens
PKRVTFTRA

SEQ ID NO: 1184925 - protein, 9 aa, Homo Sapiens
SHVGGVRRR

SEQ ID NO: 1184926 - protein, 9 aa, Homo Sapiens
PARGPAPRT

SEQ ID NO: 1184927 - protein, 9 aa, Homo Sapiens
TQACGRLFV

SEQ ID NO: 1184928 - protein, 9 aa, Homo Sapiens
HPAWLSPIS

SEQ ID NO: 1184929 - protein, 9 aa, Homo Sapiens
IVLMAVGGE

SEQ ID NO: 1184930 - protein, 9 aa, Homo Sapiens
TDNATTTSS

SEQ ID NO: 1184931 - protein, 9 aa, Homo Sapiens
CCGTRRSCS

SEQ ID NO: 1184932 - protein, 9 aa, Homo Sapiens
NQVAVIGDE

SEQ ID NO: 1184933 - protein, 9 aa, Homo Sapiens
SSQPRGSSS

SEQ ID NO: 1184934 - protein, 9 aa, Homo Sapiens
NGCAGGGVG

SEQ ID NO: 1184935 - protein, 9 aa, Homo Sapiens
RPSGGMPRA

SEQ ID NO: 1184936 - protein, 9 aa, Homo Sapiens
HDRSVSRDG

SEQ ID NO: 1184937 - protein, 9 aa, Homo Sapiens
AAQGPAEPD

SEQ ID NO: 1184938 - protein, 9 aa, Homo Sapiens
PSQPQAPFP

SEQ ID NO: 1184939 - protein, 9 aa, Homo Sapiens
DHDQSQASK

SEQ ID NO: 1184940 - protein, 9 aa, Homo Sapiens
PWEAALRPS

SEQ ID NO: 1184941 - protein, 9 aa, Homo Sapiens
TSSASKPTM

SEQ ID NO: 1184942 - protein, 9 aa, Homo Sapiens
RSWKVKWCD

SEQ ID NO: 1184943 - protein, 9 aa, Homo Sapiens
DFLAEKESN

SEQ ID NO: 1184944 - protein, 9 aa, Homo Sapiens
RNKSWLSAK

SEQ ID NO: 1184945 - protein, 9 aa, Homo Sapiens
DQLVSRFPS

SEQ ID NO: 1184946 - protein, 9 aa, Homo Sapiens
ADMLLEGNV

SEQ ID NO: 1184947 - protein, 9 aa, Homo Sapiens
EAGGGGPGH

SEQ ID NO: 1184948 - protein, 9 aa, Homo Sapiens
PAPGGRRGV

SEQ ID NO: 1184949 - protein, 9 aa, Homo Sapiens
LPFSGFHAT

SEQ ID NO: 1184950 - protein, 9 aa, Homo Sapiens
TFDLVAISL

SEQ ID NO: 1184951 - protein, 9 aa, Homo Sapiens
SPIDVWVVG

SEQ ID NO: 1184952 - protein, 9 aa, Homo Sapiens
AADPEQPQA

SEQ ID NO: 1184953 - protein, 9 aa, Homo Sapiens
LLMSPNKPY

SEQ ID NO: 1184954 - protein, 9 aa, Homo Sapiens
RRLRRRLLR

SEQ ID NO: 1184955 - protein, 9 aa, Homo Sapiens
SGGPLSPKH

SEQ ID NO: 1184956 - protein, 9 aa, Homo Sapiens
EGCEDEDED

SEQ ID NO: 1184957 - protein, 9 aa, Homo Sapiens
DSALLITAS

SEQ ID NO: 1184958 - protein, 9 aa, Homo Sapiens
TVRQWSPRA

SEQ ID NO: 1184959 - protein, 9 aa, Homo Sapiens
RAMLEFQLN

SEQ ID NO: 1184960 - protein, 9 aa, Homo Sapiens
TTRAAPPTD

SEQ ID NO: 1184961 - protein, 9 aa, Homo Sapiens
LTGHSTHLS

SEQ ID NO: 1184962 - protein, 9 aa, Homo Sapiens
LRTSANVNH

SEQ ID NO: 1184963 - protein, 9 aa, Homo Sapiens
SCVDSAVTV

SEQ ID NO: 1184964 - protein, 9 aa, Homo Sapiens
HNRSIHTYQ

SEQ ID NO: 1184965 - protein, 9 aa, Homo Sapiens
QAYIRGSKI

SEQ ID NO: 1184966 - protein, 9 aa, Homo Sapiens
ATAVHFAAS

SEQ ID NO: 1184967 - protein, 9 aa, Homo Sapiens
VCRMGPLPL

SEQ ID NO: 1184968 - protein, 9 aa, Homo Sapiens
PESVELSEP

SEQ ID NO: 1184969 - protein, 9 aa, Homo Sapiens
STELPGKMN

SEQ ID NO: 1184970 - protein, 9 aa, Homo Sapiens
MALRASLEM

SEQ ID NO: 1184971 - protein, 9 aa, Homo Sapiens
YHILRTHSA

SEQ ID NO: 1184972 - protein, 9 aa, Homo Sapiens
EYKPPKNPL

SEQ ID NO: 1184973 - protein, 9 aa, Homo Sapiens
RKVMTPVRS

SEQ ID NO: 1184974 - protein, 9 aa, Homo Sapiens
RKCSALPRR

SEQ ID NO: 1184975 - protein, 9 aa, Homo Sapiens
FAMPHSAML

SEQ ID NO: 1184976 - protein, 9 aa, Homo Sapiens
LEELSLNYF

SEQ ID NO: 1184977 - protein, 9 aa, Homo Sapiens
EAGVIERVL

SEQ ID NO: 1184978 - protein, 9 aa, Homo Sapiens
TGATNVDIR

SEQ ID NO: 1184979 - protein, 9 aa, Homo Sapiens
RAWRTCWSP

SEQ ID NO: 1184980 - protein, 9 aa, Homo Sapiens
ALNTGTLQQ

SEQ ID NO: 1184981 - protein, 9 aa, Homo Sapiens
NTHRRETLC

SEQ ID NO: 1184982 - protein, 9 aa, Homo Sapiens
PRKCSALPR

SEQ ID NO: 1184983 - protein, 9 aa, Homo Sapiens
IINYKILVL

SEQ ID NO: 1184984 - protein, 9 aa, Homo Sapiens
AQALLGAEK

SEQ ID NO: 1184985 - protein, 9 aa, Homo Sapiens
VPFAPCPPT

SEQ ID NO: 1184986 - protein, 9 aa, Homo Sapiens
GGDEEDPDA

SEQ ID NO: 1184987 - protein, 9 aa, Homo Sapiens
HYIIRVVSF

SEQ ID NO: 1184988 - protein, 9 aa, Homo Sapiens
LSPISACPR

SEQ ID NO: 1184989 - protein, 9 aa, Homo Sapiens
YAADTFFIT

SEQ ID NO: 1184990 - protein, 9 aa, Homo Sapiens
APPSLRAAR

SEQ ID NO: 1184991 - protein, 9 aa, Homo Sapiens
PPSCPQAIP

SEQ ID NO: 1184992 - protein, 9 aa, Homo Sapiens
KVCPVLWAL

SEQ ID NO: 1184993 - protein, 9 aa, Homo Sapiens
NPRFCNSSF

SEQ ID NO: 1184994 - protein, 9 aa, Homo Sapiens
NQQGTHSAL

SEQ ID NO: 1184995 - protein, 9 aa, Homo Sapiens
PATSIPPPP

SEQ ID NO: 1184996 - protein, 9 aa, Homo Sapiens
SMLLGECRQ

SEQ ID NO: 1184997 - protein, 9 aa, Homo Sapiens
EVSVLDRTS

SEQ ID NO: 1184998 - protein, 9 aa, Homo Sapiens
NAVPLGTTT

SEQ ID NO: 1184999 - protein, 9 aa, Homo Sapiens
AREDGDRDE

SEQ ID NO: 1185000 - protein, 9 aa, Homo Sapiens
RGWRRTRPL

SEQ ID NO: 1185001 - protein, 9 aa, Homo Sapiens
HKHDLRLLR

SEQ ID NO: 1185002 - protein, 9 aa, Homo Sapiens
TSLQHSFLV

SEQ ID NO: 1185003 - protein, 9 aa, Homo Sapiens
LNHVGKNTH

SEQ ID NO: 1185004 - protein, 9 aa, Homo Sapiens
TRRMKLRSW

SEQ ID NO: 1185005 - protein, 9 aa, Homo Sapiens
SAPWWGRRP

SEQ ID NO: 1185006 - protein, 9 aa, Homo Sapiens
LIKHQRAHT

SEQ ID NO: 1185007 - protein, 9 aa, Homo Sapiens
KESALQVLL

SEQ ID NO: 1185008 - protein, 9 aa, Homo Sapiens
YHNNPIGDQ

SEQ ID NO: 1185009 - protein, 9 aa, Homo Sapiens
SVSFPQAPD

SEQ ID NO: 1185010 - protein, 9 aa, Homo Sapiens
PQPSSSTVT

SEQ ID NO: 1185011 - protein, 9 aa, Homo Sapiens
GDSSWLTSS

SEQ ID NO: 1185012 - protein, 9 aa, Homo Sapiens
RSFPCWKTC

SEQ ID NO: 1185013 - protein, 9 aa, Homo Sapiens
DIIEYFHWN

SEQ ID NO: 1185014 - protein, 9 aa, Homo Sapiens
HKQKTIQIA

SEQ ID NO: 1185015 - protein, 9 aa, Homo Sapiens
MDFINDTTD

SEQ ID NO: 1185016 - protein, 9 aa, Homo Sapiens
GLLRIIKPC

SEQ ID NO: 1185017 - protein, 9 aa, Homo Sapiens
RRPSCHRCT

SEQ ID NO: 1185018 - protein, 9 aa, Homo Sapiens
TPYFIRSIQ

SEQ ID NO: 1185019 - protein, 9 aa, Homo Sapiens
PPPACTSKA

SEQ ID NO: 1185020 - protein, 9 aa, Homo Sapiens
LPMGPSHPG

SEQ ID NO: 1185021 - protein, 9 aa, Homo Sapiens
WGLLPVLGQ

SEQ ID NO: 1185022 - protein, 9 aa, Homo Sapiens
QCTGPLGMP

SEQ ID NO: 1185023 - protein, 9 aa, Homo Sapiens
QSENEDVCF

SEQ ID NO: 1185024 - protein, 9 aa, Homo Sapiens
MFWYSMPWH

SEQ ID NO: 1185025 - protein, 9 aa, Homo Sapiens
VLRPPAYIP

SEQ ID NO: 1185026 - protein, 9 aa, Homo Sapiens
GHRFEPVFF

SEQ ID NO: 1185027 - protein, 9 aa, Homo Sapiens
GSPPSRASA

SEQ ID NO: 1185028 - protein, 9 aa, Homo Sapiens
VNRGSDTDI

SEQ ID NO: 1185029 - protein, 9 aa, Homo Sapiens
FMLYRKEMR

SEQ ID NO: 1185030 - protein, 9 aa, Homo Sapiens
KKFHIPVDT

SEQ ID NO: 1185031 - protein, 9 aa, Homo Sapiens
KLSLDELGC

SEQ ID NO: 1185032 - protein, 9 aa, Homo Sapiens
SQSRGPHPA

SEQ ID NO: 1185033 - protein, 9 aa, Homo Sapiens
KGLHRRMGP

SEQ ID NO: 1185034 - protein, 9 aa, Homo Sapiens
RRRCQEYEN

SEQ ID NO: 1185035 - protein, 9 aa, Homo Sapiens
AKITMKGYS

SEQ ID NO: 1185036 - protein, 9 aa, Homo Sapiens
GGKRSSRLG

SEQ ID NO: 1185037 - protein, 9 aa, Homo Sapiens
QGPGCPTQA

SEQ ID NO: 1185038 - protein, 9 aa, Homo Sapiens
VQMRAAINQ

SEQ ID NO: 1185039 - protein, 9 aa, Homo Sapiens
FPGRGGGPW

SEQ ID NO: 1185040 - protein, 9 aa, Homo Sapiens
ARLSASSTR

SEQ ID NO: 1185041 - protein, 9 aa, Homo Sapiens
NCSLSCYCK

SEQ ID NO: 1185042 - protein, 9 aa, Homo Sapiens
SFEKVEKLW

SEQ ID NO: 1185043 - protein, 9 aa, Homo Sapiens
CVCSFAYQP

SEQ ID NO: 1185044 - protein, 9 aa, Homo Sapiens
KGTAWTCQT

SEQ ID NO: 1185045 - protein, 9 aa, Homo Sapiens
ASHRRRLPA

SEQ ID NO: 1185046 - protein, 9 aa, Homo Sapiens
RGPGRGLPG

SEQ ID NO: 1185047 - protein, 9 aa, Homo Sapiens
ALPMVVVTA

SEQ ID NO: 1185048 - protein, 9 aa, Homo Sapiens
LGGKPIAVD

SEQ ID NO: 1185049 - protein, 9 aa, Homo Sapiens
LYMVTMPPQ

SEQ ID NO: 1185050 - protein, 9 aa, Homo Sapiens
WLCAGALML

SEQ ID NO: 1185051 - protein, 9 aa, Homo Sapiens
ACGRRARGP

SEQ ID NO: 1185052 - protein, 9 aa, Homo Sapiens
SGGGSHFFS

SEQ ID NO: 1185053 - protein, 9 aa, Homo Sapiens
LATQPPSTL

SEQ ID NO: 1185054 - protein, 9 aa, Homo Sapiens
NLSCLVTIG

SEQ ID NO: 1185055 - protein, 9 aa, Homo Sapiens
LLLRPTGPL

SEQ ID NO: 1185056 - protein, 9 aa, Homo Sapiens
VPQYTPRVL

SEQ ID NO: 1185057 - protein, 9 aa, Homo Sapiens
LSSKSQQSI

SEQ ID NO: 1185058 - protein, 9 aa, Homo Sapiens
PGAISDVPE

SEQ ID NO: 1185059 - protein, 9 aa, Homo Sapiens
ARPLSAAGR

SEQ ID NO: 1185060 - protein, 9 aa, Homo Sapiens
RSPRINATG

SEQ ID NO: 1185061 - protein, 9 aa, Homo Sapiens
KFSMWDRDH

SEQ ID NO: 1185062 - protein, 9 aa, Homo Sapiens
KTFWFFQRH

SEQ ID NO: 1185063 - protein, 9 aa, Homo Sapiens
DLPSQRGII

SEQ ID NO: 1185064 - protein, 9 aa, Homo Sapiens
QLEALPTRG

SEQ ID NO: 1185065 - protein, 9 aa, Homo Sapiens
GSSWEKVPG

SEQ ID NO: 1185066 - protein, 9 aa, Homo Sapiens
RPVQREHVL

SEQ ID NO: 1185067 - protein, 9 aa, Homo Sapiens
HHSPHALVL

SEQ ID NO: 1185068 - protein, 9 aa, Homo Sapiens
SPGACRPAC

SEQ ID NO: 1185069 - protein, 9 aa, Homo Sapiens
QRGHDDAPD

SEQ ID NO: 1185070 - protein, 9 aa, Homo Sapiens
RGAVGLPRA

SEQ ID NO: 1185071 - protein, 9 aa, Homo Sapiens
NSTKKRLRT

SEQ ID NO: 1185072 - protein, 9 aa, Homo Sapiens
TCGRPSTSR

SEQ ID NO: 1185073 - protein, 9 aa, Homo Sapiens
THPLCTVAS

SEQ ID NO: 1185074 - protein, 9 aa, Homo Sapiens
ELRHQVREN

SEQ ID NO: 1185075 - protein, 9 aa, Homo Sapiens
RACPHGAAC

SEQ ID NO: 1185076 - protein, 9 aa, Homo Sapiens
ILGRRRYLS

SEQ ID NO: 1185077 - protein, 9 aa, Homo Sapiens
VVGVCRMGP

SEQ ID NO: 1185078 - protein, 9 aa, Homo Sapiens
SWKGKGASA

SEQ ID NO: 1185079 - protein, 9 aa, Homo Sapiens
YMEMHYGHQ

SEQ ID NO: 1185080 - protein, 9 aa, Homo Sapiens
VIEASASPS

SEQ ID NO: 1185081 - protein, 9 aa, Homo Sapiens
LAPPGAHYQ

SEQ ID NO: 1185082 - protein, 9 aa, Homo Sapiens
QRFWKKRRR

SEQ ID NO: 1185083 - protein, 9 aa, Homo Sapiens
HVGKTSYHS

SEQ ID NO: 1185084 - protein, 9 aa, Homo Sapiens
LINPVVQAQ

SEQ ID NO: 1185085 - protein, 9 aa, Homo Sapiens
GGRKSQTKI

SEQ ID NO: 1185086 - protein, 9 aa, Homo Sapiens
TRSTSVGLC

SEQ ID NO: 1185087 - protein, 9 aa, Homo Sapiens
MSQYFDFAQ

SEQ ID NO: 1185088 - protein, 9 aa, Homo Sapiens
QAKSPSPAT

SEQ ID NO: 1185089 - protein, 9 aa, Homo Sapiens
WSAWPCGGT

SEQ ID NO: 1185090 - protein, 9 aa, Homo Sapiens
RGEKIPLSK

SEQ ID NO: 1185091 - protein, 9 aa, Homo Sapiens
YPDSWVPLA

SEQ ID NO: 1185092 - protein, 9 aa, Homo Sapiens
VRKYTLVSY

SEQ ID NO: 1185093 - protein, 9 aa, Homo Sapiens
WNQGTGLLA

SEQ ID NO: 1185094 - protein, 9 aa, Homo Sapiens
VSKMNKDVQ

SEQ ID NO: 1185095 - protein, 9 aa, Homo Sapiens
ELGCKYQVD

SEQ ID NO: 1185096 - protein, 9 aa, Homo Sapiens
PGSSLLSSP

SEQ ID NO: 1185097 - protein, 9 aa, Homo Sapiens
MLSPVHTDL

SEQ ID NO: 1185098 - protein, 9 aa, Homo Sapiens
LPASLGRPE

SEQ ID NO: 1185099 - protein, 9 aa, Homo Sapiens
VVTTRYRWV

SEQ ID NO: 1185100 - protein, 9 aa, Homo Sapiens
TKPAMGLAR

SEQ ID NO: 1185101 - protein, 9 aa, Homo Sapiens
EVICQNLRG

SEQ ID NO: 1185102 - protein, 9 aa, Homo Sapiens
MLYRKEMRA

SEQ ID NO: 1185103 - protein, 9 aa, Homo Sapiens
LCLLQGHCL

SEQ ID NO: 1185104 - protein, 9 aa, Homo Sapiens
APSPRAGSR

SEQ ID NO: 1185105 - protein, 9 aa, Homo Sapiens
LQEMQESAQ

SEQ ID NO: 1185106 - protein, 9 aa, Homo Sapiens
PPGGKEEAQ

SEQ ID NO: 1185107 - protein, 9 aa, Homo Sapiens
FAPCPPTGS

SEQ ID NO: 1185108 - protein, 9 aa, Homo Sapiens
QLNHMLPSQ

SEQ ID NO: 1185109 - protein, 9 aa, Homo Sapiens
MSCSIYKST

SEQ ID NO: 1185110 - protein, 9 aa, Homo Sapiens
QFSVTSAWK

SEQ ID NO: 1185111 - protein, 9 aa, Homo Sapiens
LGKMDYRLM

SEQ ID NO: 1185112 - protein, 9 aa, Homo Sapiens
QNCGQRMKE

SEQ ID NO: 1185113 - protein, 9 aa, Homo Sapiens
SNYYVGSLI

SEQ ID NO: 1185114 - protein, 9 aa, Homo Sapiens
PQSRRATCW

SEQ ID NO: 1185115 - protein, 9 aa, Homo Sapiens
SLPGSAART

SEQ ID NO: 1185116 - protein, 9 aa, Homo Sapiens
SSRPRAWGL

SEQ ID NO: 1185117 - protein, 9 aa, Homo Sapiens
APPAWGIPG

SEQ ID NO: 1185118 - protein, 9 aa, Homo Sapiens
LAFWRCSKT

SEQ ID NO: 1185119 - protein, 9 aa, Homo Sapiens
HSPPRGWCS

SEQ ID NO: 1185120 - protein, 9 aa, Homo Sapiens
DFWIGRVHC

SEQ ID NO: 1185121 - protein, 9 aa, Homo Sapiens
VDAWKSTWH

SEQ ID NO: 1185122 - protein, 9 aa, Homo Sapiens
GVPSGSCAP

SEQ ID NO: 1185123 - protein, 9 aa, Homo Sapiens
LWCSPRRSP

SEQ ID NO: 1185124 - protein, 9 aa, Homo Sapiens
RTGFLLLST

SEQ ID NO: 1185125 - protein, 9 aa, Homo Sapiens
PPTRSSSRT

SEQ ID NO: 1185126 - protein, 9 aa, Homo Sapiens
CSTTTAPAS

SEQ ID NO: 1185127 - protein, 9 aa, Homo Sapiens
LLQGHCLAS

SEQ ID NO: 1185128 - protein, 9 aa, Homo Sapiens
VNLVGCLTW

SEQ ID NO: 1185129 - protein, 9 aa, Homo Sapiens
RGISSHSPR

SEQ ID NO: 1185130 - protein, 9 aa, Homo Sapiens
APRQGSREP

SEQ ID NO: 1185131 - protein, 9 aa, Homo Sapiens
WRRSSWPRW

SEQ ID NO: 1185132 - protein, 9 aa, Homo Sapiens
SEAEQRFWK

SEQ ID NO: 1185133 - protein, 9 aa, Homo Sapiens
VAAAAKLSQ

SEQ ID NO: 1185134 - protein, 9 aa, Homo Sapiens
HHHSEHMQH

SEQ ID NO: 1185135 - protein, 9 aa, Homo Sapiens
WFLTLCTWL

SEQ ID NO: 1185136 - protein, 9 aa, Homo Sapiens
TCTHRSPSC

SEQ ID NO: 1185137 - protein, 9 aa, Homo Sapiens
GRPPLPVPD

SEQ ID NO: 1185138 - protein, 9 aa, Homo Sapiens
SRVSLCQNR

SEQ ID NO: 1185139 - protein, 9 aa, Homo Sapiens
PRPPAPRQG

SEQ ID NO: 1185140 - protein, 9 aa, Homo Sapiens
DMDDFAGKS

SEQ ID NO: 1185141 - protein, 9 aa, Homo Sapiens
PPPVLRPRG

SEQ ID NO: 1185142 - protein, 9 aa, Homo Sapiens
RPRPDPALS

SEQ ID NO: 1185143 - protein, 9 aa, Homo Sapiens
WFAETSIIL

SEQ ID NO: 1185144 - protein, 9 aa, Homo Sapiens
PDAPPELFL

SEQ ID NO: 1185145 - protein, 9 aa, Homo Sapiens
WRFTPEIPA

SEQ ID NO: 1185146 - protein, 9 aa, Homo Sapiens
DGWGVFVGL

SEQ ID NO: 1185147 - protein, 9 aa, Homo Sapiens
IVIFLDTLV

SEQ ID NO: 1185148 - protein, 9 aa, Homo Sapiens
LSVVRGGVR

SEQ ID NO: 1185149 - protein, 9 aa, Homo Sapiens
GHHSPHALV

SEQ ID NO: 1185150 - protein, 9 aa, Homo Sapiens
GVVRVGKAF

SEQ ID NO: 1185151 - protein, 9 aa, Homo Sapiens
FRAQAPRCC

SEQ ID NO: 1185152 - protein, 9 aa, Homo Sapiens
TQSRLQGAI

SEQ ID NO: 1185153 - protein, 9 aa, Homo Sapiens
RLFYKDMLQ

SEQ ID NO: 1185154 - protein, 9 aa, Homo Sapiens
GFPGGGGVR

SEQ ID NO: 1185155 - protein, 9 aa, Homo Sapiens
TDGGILQLT

SEQ ID NO: 1185156 - protein, 9 aa, Homo Sapiens
VLLGSQSGL

SEQ ID NO: 1185157 - protein, 9 aa, Homo Sapiens
KEGYFGAVR

SEQ ID NO: 1185158 - protein, 9 aa, Homo Sapiens
AAGRGRASQ

SEQ ID NO: 1185159 - protein, 9 aa, Homo Sapiens
RYMPGTVAL

SEQ ID NO: 1185160 - protein, 9 aa, Homo Sapiens
LGAHANFFH

SEQ ID NO: 1185161 - protein, 9 aa, Homo Sapiens
VAAPPAARS

SEQ ID NO: 1185162 - protein, 9 aa, Homo Sapiens
YLEQCETNL

SEQ ID NO: 1185163 - protein, 9 aa, Homo Sapiens
TPSMRTVTV

SEQ ID NO: 1185164 - protein, 9 aa, Homo Sapiens
EHPASSSSS

SEQ ID NO: 1185165 - protein, 9 aa, Homo Sapiens
WWVVDCPES

SEQ ID NO: 1185166 - protein, 9 aa, Homo Sapiens
LPFSILRGS

SEQ ID NO: 1185167 - protein, 9 aa, Homo Sapiens
LEVSVAALV

SEQ ID NO: 1185168 - protein, 9 aa, Homo Sapiens
STLKREALV

SEQ ID NO: 1185169 - protein, 9 aa, Homo Sapiens
NNRLIKIHE

SEQ ID NO: 1185170 - protein, 9 aa, Homo Sapiens
IRNVVEMMI

SEQ ID NO: 1185171 - protein, 9 aa, Homo Sapiens
SENEDVCFI

SEQ ID NO: 1185172 - protein, 9 aa, Homo Sapiens
VGRAVRRKG

SEQ ID NO: 1185173 - protein, 9 aa, Homo Sapiens
RRLITSAAR

SEQ ID NO: 1185174 - protein, 9 aa, Homo Sapiens
NPPVSPGKL

SEQ ID NO: 1185175 - protein, 9 aa, Homo Sapiens
LHLVKPRVL

SEQ ID NO: 1185176 - protein, 9 aa, Homo Sapiens
CLRVPAGPR

SEQ ID NO: 1185177 - protein, 9 aa, Homo Sapiens
PDFLAHVCG

SEQ ID NO: 1185178 - protein, 9 aa, Homo Sapiens
GSAVAAPPA

SEQ ID NO: 1185179 - protein, 9 aa, Homo Sapiens
LLNRCRGVT

SEQ ID NO: 1185180 - protein, 9 aa, Homo Sapiens
RSMDPMDGN

SEQ ID NO: 1185181 - protein, 9 aa, Homo Sapiens
GGRPSGFPG

SEQ ID NO: 1185182 - protein, 9 aa, Homo Sapiens
PYQTCSAGW

SEQ ID NO: 1185183 - protein, 9 aa, Homo Sapiens
GPGSDELTV

SEQ ID NO: 1185184 - protein, 9 aa, Homo Sapiens
RHPQGPCPP

SEQ ID NO: 1185185 - protein, 9 aa, Homo Sapiens
PCPYGPRAP

SEQ ID NO: 1185186 - protein, 9 aa, Homo Sapiens
CKEGDRPER

SEQ ID NO: 1185187 - protein, 9 aa, Homo Sapiens
WSPGLPPNT

SEQ ID NO: 1185188 - protein, 9 aa, Homo Sapiens
HTQQDPEMP

SEQ ID NO: 1185189 - protein, 9 aa, Homo Sapiens
CQNRPHLPH

SEQ ID NO: 1185190 - protein, 9 aa, Homo Sapiens
LFSHLGDGL

SEQ ID NO: 1185191 - protein, 9 aa, Homo Sapiens
PPEPGDPDA

SEQ ID NO: 1185192 - protein, 9 aa, Homo Sapiens
FPSSMSGVP

SEQ ID NO: 1185193 - protein, 9 aa, Homo Sapiens
DLSTKSEHT

SEQ ID NO: 1185194 - protein, 9 aa, Homo Sapiens
QTPTSQPKS

SEQ ID NO: 1185195 - protein, 9 aa, Homo Sapiens
AEPASARRA

SEQ ID NO: 1185196 - protein, 9 aa, Homo Sapiens
LDNAQSSEL

SEQ ID NO: 1185197 - protein, 9 aa, Homo Sapiens
SQCTQGRRW

SEQ ID NO: 1185198 - protein, 9 aa, Homo Sapiens
SGVYPASAG

SEQ ID NO: 1185199 - protein, 9 aa, Homo Sapiens
PAARLSMGS

SEQ ID NO: 1185200 - protein, 9 aa, Homo Sapiens
AGGGPGSAV

SEQ ID NO: 1185201 - protein, 9 aa, Homo Sapiens
FSPLKKVWN

SEQ ID NO: 1185202 - protein, 9 aa, Homo Sapiens
RSLPAGPSA

SEQ ID NO: 1185203 - protein, 9 aa, Homo Sapiens
GGGCLPPEP

SEQ ID NO: 1185204 - protein, 9 aa, Homo Sapiens
PAPVVERPG

SEQ ID NO: 1185205 - protein, 9 aa, Homo Sapiens
QDPRISPSL

SEQ ID NO: 1185206 - protein, 9 aa, Homo Sapiens
PPRAISTFG

SEQ ID NO: 1185207 - protein, 9 aa, Homo Sapiens
IADMLLEGN

SEQ ID NO: 1185208 - protein, 9 aa, Homo Sapiens
LLCRQMLPT

SEQ ID NO: 1185209 - protein, 9 aa, Homo Sapiens
EVELPFSIL

SEQ ID NO: 1185210 - protein, 9 aa, Homo Sapiens
KHGVKTPLV

SEQ ID NO: 1185211 - protein, 9 aa, Homo Sapiens
SAQISMNHV

SEQ ID NO: 1185212 - protein, 9 aa, Homo Sapiens
TVASPPRRW

SEQ ID NO: 1185213 - protein, 9 aa, Homo Sapiens
EPVPTAWRP

SEQ ID NO: 1185214 - protein, 9 aa, Homo Sapiens
GCWSSAPAS

SEQ ID NO: 1185215 - protein, 9 aa, Homo Sapiens
TKESLTTRE

SEQ ID NO: 1185216 - protein, 9 aa, Homo Sapiens
AQSPGRAEA

SEQ ID NO: 1185217 - protein, 9 aa, Homo Sapiens
GRRPQRYTK

SEQ ID NO: 1185218 - protein, 9 aa, Homo Sapiens
PPSLRAARA

SEQ ID NO: 1185219 - protein, 9 aa, Homo Sapiens
DEDAPVPST

SEQ ID NO: 1185220 - protein, 9 aa, Homo Sapiens
ATTAAIPGY

SEQ ID NO: 1185221 - protein, 9 aa, Homo Sapiens
KPDKSEESQ

SEQ ID NO: 1185222 - protein, 9 aa, Homo Sapiens
GQLVGTRKL

SEQ ID NO: 1185223 - protein, 9 aa, Homo Sapiens
RPRPGPLAG

SEQ ID NO: 1185224 - protein, 9 aa, Homo Sapiens
LQAKGRMLI

SEQ ID NO: 1185225 - protein, 9 aa, Homo Sapiens
YKVKERYGT

SEQ ID NO: 1185226 - protein, 9 aa, Homo Sapiens
AWHVVPPSA

SEQ ID NO: 1185227 - protein, 9 aa, Homo Sapiens
SPLTTSPLM

SEQ ID NO: 1185228 - protein, 9 aa, Homo Sapiens
PPRPPCHCP

SEQ ID NO: 1185229 - protein, 9 aa, Homo Sapiens
TRGSLGPKA

SEQ ID NO: 1185230 - protein, 9 aa, Homo Sapiens
GCVIPHGQH

SEQ ID NO: 1185231 - protein, 9 aa, Homo Sapiens
DSKLELSTV

SEQ ID NO: 1185232 - protein, 9 aa, Homo Sapiens
VKRPSLHRY

SEQ ID NO: 1185233 - protein, 9 aa, Homo Sapiens
WYRPSDVLF

SEQ ID NO: 1185234 - protein, 9 aa, Homo Sapiens
SRVRVGYPD

SEQ ID NO: 1185235 - protein, 9 aa, Homo Sapiens
VPLTIVRGP

SEQ ID NO: 1185236 - protein, 9 aa, Homo Sapiens
PHTETAKMY

SEQ ID NO: 1185237 - protein, 9 aa, Homo Sapiens
CLGLWCSPR

SEQ ID NO: 1185238 - protein, 9 aa, Homo Sapiens
YGHTSTVCC

SEQ ID NO: 1185239 - protein, 9 aa, Homo Sapiens
SARRASRAG

SEQ ID NO: 1185240 - protein, 9 aa, Homo Sapiens
AETEPHGAS

SEQ ID NO: 1185241 - protein, 9 aa, Homo Sapiens
LLIPTLSSF

SEQ ID NO: 1185242 - protein, 9 aa, Homo Sapiens
PGEGPHPQA

SEQ ID NO: 1185243 - protein, 9 aa, Homo Sapiens
PQPEGLLDL

SEQ ID NO: 1185244 - protein, 9 aa, Homo Sapiens
FLKLVNDIL

SEQ ID NO: 1185245 - protein, 9 aa, Homo Sapiens
GRTPPPTAT

SEQ ID NO: 1185246 - protein, 9 aa, Homo Sapiens
CFEWASFFM

SEQ ID NO: 1185247 - protein, 9 aa, Homo Sapiens
PHPAPPTRD

SEQ ID NO: 1185248 - protein, 9 aa, Homo Sapiens
RFVTVAELP

SEQ ID NO: 1185249 - protein, 9 aa, Homo Sapiens
VSALHHKDS

SEQ ID NO: 1185250 - protein, 9 aa, Homo Sapiens
PPHPGQEVH

SEQ ID NO: 1185251 - protein, 9 aa, Homo Sapiens
KGSFFPLTE

SEQ ID NO: 1185252 - protein, 9 aa, Homo Sapiens
ECDKVFSQT

SEQ ID NO: 1185253 - protein, 9 aa, Homo Sapiens
TPRVPLPPP

SEQ ID NO: 1185254 - protein, 9 aa, Homo Sapiens
ACGASWRPF

SEQ ID NO: 1185255 - protein, 9 aa, Homo Sapiens
KGKLKSQYT

SEQ ID NO: 1185256 - protein, 9 aa, Homo Sapiens
TTRPPAFIT

SEQ ID NO: 1185257 - protein, 9 aa, Homo Sapiens
GCRLENETC

SEQ ID NO: 1185258 - protein, 9 aa, Homo Sapiens
DTITTKKYS

SEQ ID NO: 1185259 - protein, 9 aa, Homo Sapiens
HYSLLTKNG

SEQ ID NO: 1185260 - protein, 9 aa, Homo Sapiens
LEECASELS

SEQ ID NO: 1185261 - protein, 9 aa, Homo Sapiens
AVAAAMAEQ

SEQ ID NO: 1185262 - protein, 9 aa, Homo Sapiens
MRPSGGMPR

SEQ ID NO: 1185263 - protein, 9 aa, Homo Sapiens
SPHTLLQLL

SEQ ID NO: 1185264 - protein, 9 aa, Homo Sapiens
PVGYCRTRI

SEQ ID NO: 1185265 - protein, 9 aa, Homo Sapiens
VKNHIFQLC

SEQ ID NO: 1185266 - protein, 9 aa, Homo Sapiens
QGSCSTISQ

SEQ ID NO: 1185267 - protein, 9 aa, Homo Sapiens
NFRNASEVP

SEQ ID NO: 1185268 - protein, 9 aa, Homo Sapiens
VLVQDAAGR

SEQ ID NO: 1185269 - protein, 9 aa, Homo Sapiens
SIADMLLEG

SEQ ID NO: 1185270 - protein, 9 aa, Homo Sapiens
ELQNVSQHV

SEQ ID NO: 1185271 - protein, 9 aa, Homo Sapiens
ITTKDLKKK

SEQ ID NO: 1185272 - protein, 9 aa, Homo Sapiens
DPDTKGSPI

SEQ ID NO: 1185273 - protein, 9 aa, Homo Sapiens
TPSPQGGPF

SEQ ID NO: 1185274 - protein, 9 aa, Homo Sapiens
KSPLTDLGV

SEQ ID NO: 1185275 - protein, 9 aa, Homo Sapiens
LPNASTWTI

SEQ ID NO: 1185276 - protein, 9 aa, Homo Sapiens
CCSGNDGRT

SEQ ID NO: 1185277 - protein, 9 aa, Homo Sapiens
GPGSSLLSS

SEQ ID NO: 1185278 - protein, 9 aa, Homo Sapiens
TYASPPGLA

SEQ ID NO: 1185279 - protein, 9 aa, Homo Sapiens
EHKQKTIQI

SEQ ID NO: 1185280 - protein, 9 aa, Homo Sapiens
IAYLVVASL

SEQ ID NO: 1185281 - protein, 9 aa, Homo Sapiens
NIADFLLWQ

SEQ ID NO: 1185282 - protein, 9 aa, Homo Sapiens
TGYDWWAIL

SEQ ID NO: 1185283 - protein, 9 aa, Homo Sapiens
TAAGIVQNL

SEQ ID NO: 1185284 - protein, 9 aa, Homo Sapiens
SHQRMKFSM

SEQ ID NO: 1185285 - protein, 9 aa, Homo Sapiens
KTRKALITF

SEQ ID NO: 1185286 - protein, 9 aa, Homo Sapiens
RAVDPDSGH

SEQ ID NO: 1185287 - protein, 9 aa, Homo Sapiens
NLRAWRTCW

SEQ ID NO: 1185288 - protein, 9 aa, Homo Sapiens
EHSLELEHA

SEQ ID NO: 1185289 - protein, 9 aa, Homo Sapiens
PRPGNATCA

SEQ ID NO: 1185290 - protein, 9 aa, Homo Sapiens
SSQRMSRQP

SEQ ID NO: 1185291 - protein, 9 aa, Homo Sapiens
VPPHPGQEV

SEQ ID NO: 1185292 - protein, 9 aa, Homo Sapiens
PLVEEGNGR

SEQ ID NO: 1185293 - protein, 9 aa, Homo Sapiens
PPEPLEPPG

SEQ ID NO: 1185294 - protein, 9 aa, Homo Sapiens
TLNYGGITL

SEQ ID NO: 1185295 - protein, 9 aa, Homo Sapiens
PLLYMVTMP

SEQ ID NO: 1185296 - protein, 9 aa, Homo Sapiens
YHSNLEKKR

SEQ ID NO: 1185297 - protein, 9 aa, Homo Sapiens
PGQISTEVQ

SEQ ID NO: 1185298 - protein, 9 aa, Homo Sapiens
VLAQSSHCQ

SEQ ID NO: 1185299 - protein, 9 aa, Homo Sapiens
IQMTKRLTV

SEQ ID NO: 1185300 - protein, 9 aa, Homo Sapiens
PVRLEYYEN

SEQ ID NO: 1185301 - protein, 9 aa, Homo Sapiens
GFLTEDKKN

SEQ ID NO: 1185302 - protein, 9 aa, Homo Sapiens
GVCGQFIPW

SEQ ID NO: 1185303 - protein, 9 aa, Homo Sapiens
VFFAYAQLS

SEQ ID NO: 1185304 - protein, 9 aa, Homo Sapiens
SGKRSLNGK

SEQ ID NO: 1185305 - protein, 9 aa, Homo Sapiens
GDPFKTIRA

SEQ ID NO: 1185306 - protein, 9 aa, Homo Sapiens
YGTLKTPPK

SEQ ID NO: 1185307 - protein, 9 aa, Homo Sapiens
ESHTIVYLL

SEQ ID NO: 1185308 - protein, 9 aa, Homo Sapiens
SHWCKLCDW

SEQ ID NO: 1185309 - protein, 9 aa, Homo Sapiens
ISAEDDEEE

SEQ ID NO: 1185310 - protein, 9 aa, Homo Sapiens
SLQGAPTIM

SEQ ID NO: 1185311 - protein, 9 aa, Homo Sapiens
PNLLSHRPR

SEQ ID NO: 1185312 - protein, 9 aa, Homo Sapiens
IHKAASDAN

SEQ ID NO: 1185313 - protein, 9 aa, Homo Sapiens
SWATRQLWQ

SEQ ID NO: 1185314 - protein, 9 aa, Homo Sapiens
SLTAEIDQL

SEQ ID NO: 1185315 - protein, 9 aa, Homo Sapiens
ANCTSTGIG

SEQ ID NO: 1185316 - protein, 9 aa, Homo Sapiens
GGGPGHGSG

SEQ ID NO: 1185317 - protein, 9 aa, Homo Sapiens
PWTQIPQGC

SEQ ID NO: 1185318 - protein, 9 aa, Homo Sapiens
ECNTRRKTF

SEQ ID NO: 1185319 - protein, 9 aa, Homo Sapiens
NPSWCPCPP

SEQ ID NO: 1185320 - protein, 9 aa, Homo Sapiens
ELHPPAIRG

SEQ ID NO: 1185321 - protein, 9 aa, Homo Sapiens
RCAPPATAW

SEQ ID NO: 1185322 - protein, 9 aa, Homo Sapiens
PSIQILNLS

SEQ ID NO: 1185323 - protein, 9 aa, Homo Sapiens
KVLNRSLFM

SEQ ID NO: 1185324 - protein, 9 aa, Homo Sapiens
GNGRAPGRG

SEQ ID NO: 1185325 - protein, 9 aa, Homo Sapiens
HSGEQNLLG

SEQ ID NO: 1185326 - protein, 9 aa, Homo Sapiens
TGAQEVETM

SEQ ID NO: 1185327 - protein, 9 aa, Homo Sapiens
RMCFLLPQA

SEQ ID NO: 1185328 - protein, 9 aa, Homo Sapiens
LKWSLVEGG

SEQ ID NO: 1185329 - protein, 9 aa, Homo Sapiens
SCATSSKVP

SEQ ID NO: 1185330 - protein, 9 aa, Homo Sapiens
KQKNKDREH

SEQ ID NO: 1185331 - protein, 9 aa, Homo Sapiens
LDQGPRSTL

SEQ ID NO: 1185332 - protein, 9 aa, Homo Sapiens
DNTLGGLFP

SEQ ID NO: 1185333 - protein, 9 aa, Homo Sapiens
STVRVQPVT

SEQ ID NO: 1185334 - protein, 9 aa, Homo Sapiens
PGTALVKLP

SEQ ID NO: 1185335 - protein, 9 aa, Homo Sapiens
LGTRSCLAP

SEQ ID NO: 1185336 - protein, 9 aa, Homo Sapiens
MFISVWEFF

SEQ ID NO: 1185337 - protein, 9 aa, Homo Sapiens
LGRFRSSGL

SEQ ID NO: 1185338 - protein, 9 aa, Homo Sapiens
KCPHIAQVP

SEQ ID NO: 1185339 - protein, 9 aa, Homo Sapiens
ELPATSAVS

SEQ ID NO: 1185340 - protein, 9 aa, Homo Sapiens
ESSIVIGER

SEQ ID NO: 1185341 - protein, 9 aa, Homo Sapiens
PLRQAKDFD

SEQ ID NO: 1185342 - protein, 9 aa, Homo Sapiens
HMSPDFKTY

SEQ ID NO: 1185343 - protein, 9 aa, Homo Sapiens
QMLEPGTEK

SEQ ID NO: 1185344 - protein, 9 aa, Homo Sapiens
WIIQCFWNY

SEQ ID NO: 1185345 - protein, 9 aa, Homo Sapiens
PIAPWSRPS

SEQ ID NO: 1185346 - protein, 9 aa, Homo Sapiens
VKVGTIQRW

SEQ ID NO: 1185347 - protein, 9 aa, Homo Sapiens
SWPMTTQWR

SEQ ID NO: 1185348 - protein, 9 aa, Homo Sapiens
ADSSALYPA

SEQ ID NO: 1185349 - protein, 9 aa, Homo Sapiens
GRGRGARGR

SEQ ID NO: 1185350 - protein, 9 aa, Homo Sapiens
VFMLNVHYR

SEQ ID NO: 1185351 - protein, 9 aa, Homo Sapiens
FKGMLSIYK

SEQ ID NO: 1185352 - protein, 9 aa, Homo Sapiens
TAGTPVPEK

SEQ ID NO: 1185353 - protein, 9 aa, Homo Sapiens
FTTSKTLSD

SEQ ID NO: 1185354 - protein, 9 aa, Homo Sapiens
VTCVPRWCS

SEQ ID NO: 1185355 - protein, 9 aa, Homo Sapiens
ALQSNQNMR

SEQ ID NO: 1185356 - protein, 9 aa, Homo Sapiens
ETIADYQQT

SEQ ID NO: 1185357 - protein, 9 aa, Homo Sapiens
CLLQGHCLA

SEQ ID NO: 1185358 - protein, 9 aa, Homo Sapiens
AFRIYDHWV

SEQ ID NO: 1185359 - protein, 9 aa, Homo Sapiens
TNPNGTIES

SEQ ID NO: 1185360 - protein, 9 aa, Homo Sapiens
PRRPPPAAP

SEQ ID NO: 1185361 - protein, 9 aa, Homo Sapiens
VLQNLHTAM

SEQ ID NO: 1185362 - protein, 9 aa, Homo Sapiens
TSKHYLSAT

SEQ ID NO: 1185363 - protein, 9 aa, Homo Sapiens
RRGGQASRG

SEQ ID NO: 1185364 - protein, 9 aa, Homo Sapiens
PEKQATELV

SEQ ID NO: 1185365 - protein, 9 aa, Homo Sapiens
PAAPGVQHP

SEQ ID NO: 1185366 - protein, 9 aa, Homo Sapiens
DFPRAGRQA

SEQ ID NO: 1185367 - protein, 9 aa, Homo Sapiens
RGRGQPEAA

SEQ ID NO: 1185368 - protein, 9 aa, Homo Sapiens
QSNQNMRGN

SEQ ID NO: 1185369 - protein, 9 aa, Homo Sapiens
PPRRWPPRT

SEQ ID NO: 1185370 - protein, 9 aa, Homo Sapiens
KHAGSNGTR

SEQ ID NO: 1185371 - protein, 9 aa, Homo Sapiens
RPGLVCHER

SEQ ID NO: 1185372 - protein, 9 aa, Homo Sapiens
LILLLEDWL

SEQ ID NO: 1185373 - protein, 9 aa, Homo Sapiens
AALRPSTSS

SEQ ID NO: 1185374 - protein, 9 aa, Homo Sapiens
KLLKEGHCM

SEQ ID NO: 1185375 - protein, 9 aa, Homo Sapiens
ESFGFTTDL

SEQ ID NO: 1185376 - protein, 9 aa, Homo Sapiens
KWSLVEGGR

SEQ ID NO: 1185377 - protein, 9 aa, Homo Sapiens
VHNQGEPSG

SEQ ID NO: 1185378 - protein, 9 aa, Homo Sapiens
ACCSLQKTG

SEQ ID NO: 1185379 - protein, 9 aa, Homo Sapiens
SSTSFMVSW

SEQ ID NO: 1185380 - protein, 9 aa, Homo Sapiens
SQELVCIVS

SEQ ID NO: 1185381 - protein, 9 aa, Homo Sapiens
MANLSECMD

SEQ ID NO: 1185382 - protein, 9 aa, Homo Sapiens
LELLVQAVR

SEQ ID NO: 1185383 - protein, 9 aa, Homo Sapiens
PWLSPLQRS

SEQ ID NO: 1185384 - protein, 9 aa, Homo Sapiens
PLGDWPALT

SEQ ID NO: 1185385 - protein, 9 aa, Homo Sapiens
IWHNICHQV

SEQ ID NO: 1185386 - protein, 9 aa, Homo Sapiens
AYSAKTPCP

SEQ ID NO: 1185387 - protein, 9 aa, Homo Sapiens
VFALALLLS

SEQ ID NO: 1185388 - protein, 9 aa, Homo Sapiens
GGTCAMASN

SEQ ID NO: 1185389 - protein, 9 aa, Homo Sapiens
GCDGGVGET

SEQ ID NO: 1185390 - protein, 9 aa, Homo Sapiens
QDTDSDVLE

SEQ ID NO: 1185391 - protein, 9 aa, Homo Sapiens
CVGRTPPPT

SEQ ID NO: 1185392 - protein, 9 aa, Homo Sapiens
TTNTQCKNG

SEQ ID NO: 1185393 - protein, 9 aa, Homo Sapiens
ASSVVPRMS

SEQ ID NO: 1185394 - protein, 9 aa, Homo Sapiens
DIREKVIKG

SEQ ID NO: 1185395 - protein, 9 aa, Homo Sapiens
GVSTSWGPT

SEQ ID NO: 1185396 - protein, 9 aa, Homo Sapiens
NCFTFSKAK

SEQ ID NO: 1185397 - protein, 9 aa, Homo Sapiens
TRRLPCCVP

SEQ ID NO: 1185398 - protein, 9 aa, Homo Sapiens
PPPFGTMPS

SEQ ID NO: 1185399 - protein, 9 aa, Homo Sapiens
LVAQVAAVV

SEQ ID NO: 1185400 - protein, 9 aa, Homo Sapiens
PWWGRRPRP

SEQ ID NO: 1185401 - protein, 9 aa, Homo Sapiens
VAMQNHAGE

SEQ ID NO: 1185402 - protein, 9 aa, Homo Sapiens
KYVACGSPE

SEQ ID NO: 1185403 - protein, 9 aa, Homo Sapiens
KRGTHPEAH

SEQ ID NO: 1185404 - protein, 9 aa, Homo Sapiens
QGVGVVGVC

SEQ ID NO: 1185405 - protein, 9 aa, Homo Sapiens
QLLPPTSTT

SEQ ID NO: 1185406 - protein, 9 aa, Homo Sapiens
TNDNPPMFS

SEQ ID NO: 1185407 - protein, 9 aa, Homo Sapiens
LAGQELTDY

SEQ ID NO: 1185408 - protein, 9 aa, Homo Sapiens
RANTCNSVI

SEQ ID NO: 1185409 - protein, 9 aa, Homo Sapiens
PAPASSTSR

SEQ ID NO: 1185410 - protein, 9 aa, Homo Sapiens
FINLGLGSM

SEQ ID NO: 1185411 - protein, 9 aa, Homo Sapiens
APCPPTGSM

SEQ ID NO: 1185412 - protein, 9 aa, Homo Sapiens
LDPAMAISP

SEQ ID NO: 1185413 - protein, 9 aa, Homo Sapiens
RCPGCLRRR

SEQ ID NO: 1185414 - protein, 9 aa, Homo Sapiens
THVSITQEN

SEQ ID NO: 1185415 - protein, 9 aa, Homo Sapiens
AYELVVTVR

SEQ ID NO: 1185416 - protein, 9 aa, Homo Sapiens
TRVEGLKYY

SEQ ID NO: 1185417 - protein, 9 aa, Homo Sapiens
LRSGGLPQW

SEQ ID NO: 1185418 - protein, 9 aa, Homo Sapiens
TTDLRSNTG

SEQ ID NO: 1185419 - protein, 9 aa, Homo Sapiens
LWTLYFYLC

SEQ ID NO: 1185420 - protein, 9 aa, Homo Sapiens
WVLGWLPQW

SEQ ID NO: 1185421 - protein, 9 aa, Homo Sapiens
PQWAPHSAG

SEQ ID NO: 1185422 - protein, 9 aa, Homo Sapiens
PNFSIPQAS

SEQ ID NO: 1185423 - protein, 9 aa, Homo Sapiens
VMPRTLEGC

SEQ ID NO: 1185424 - protein, 9 aa, Homo Sapiens
IKQQMEKDP

SEQ ID NO: 1185425 - protein, 9 aa, Homo Sapiens
LCCCLAVGA

SEQ ID NO: 1185426 - protein, 9 aa, Homo Sapiens
PAGLGRWDL

SEQ ID NO: 1185427 - protein, 9 aa, Homo Sapiens
YLFLVKCTS

SEQ ID NO: 1185428 - protein, 9 aa, Homo Sapiens
RIPSVAGRC

SEQ ID NO: 1185429 - protein, 9 aa, Homo Sapiens
RPHASPTST

SEQ ID NO: 1185430 - protein, 9 aa, Homo Sapiens
SLHRYLSLC

SEQ ID NO: 1185431 - protein, 9 aa, Homo Sapiens
QSCCLPGLT

SEQ ID NO: 1185432 - protein, 9 aa, Homo Sapiens
EEKQMKGVL

SEQ ID NO: 1185433 - protein, 9 aa, Homo Sapiens
ERGQVQEPV

SEQ ID NO: 1185434 - protein, 9 aa, Homo Sapiens
GGRREPVEP

SEQ ID NO: 1185435 - protein, 9 aa, Homo Sapiens
RVALTSSSA

SEQ ID NO: 1185436 - protein, 9 aa, Homo Sapiens
CHNGTCATF

SEQ ID NO: 1185437 - protein, 9 aa, Homo Sapiens
GDDEVFYSP

SEQ ID NO: 1185438 - protein, 9 aa, Homo Sapiens
LQQCFKKMK

SEQ ID NO: 1185439 - protein, 9 aa, Homo Sapiens
LAVIKNVWL

SEQ ID NO: 1185440 - protein, 9 aa, Homo Sapiens
SKLVRICKE

SEQ ID NO: 1185441 - protein, 9 aa, Homo Sapiens
ISLRPRSTS

SEQ ID NO: 1185442 - protein, 9 aa, Homo Sapiens
EFRVLAIMQ

SEQ ID NO: 1185443 - protein, 9 aa, Homo Sapiens
GMLSIYKDP

SEQ ID NO: 1185444 - protein, 9 aa, Homo Sapiens
MTSGIQAPA

SEQ ID NO: 1185445 - protein, 9 aa, Homo Sapiens
IPPRPGGFG

SEQ ID NO: 1185446 - protein, 9 aa, Homo Sapiens
GANRTPTPA

SEQ ID NO: 1185447 - protein, 9 aa, Homo Sapiens
SGHYQLRVQ

SEQ ID NO: 1185448 - protein, 9 aa, Homo Sapiens
VPQTQVIEH

SEQ ID NO: 1185449 - protein, 9 aa, Homo Sapiens
PSHGVCVEN

SEQ ID NO: 1185450 - protein, 9 aa, Homo Sapiens
HPSSPVPQP

SEQ ID NO: 1185451 - protein, 9 aa, Homo Sapiens
KKGLSLSYG

SEQ ID NO: 1185452 - protein, 9 aa, Homo Sapiens
EAGGGPGSA

SEQ ID NO: 1185453 - protein, 9 aa, Homo Sapiens
CFFCGPCML

SEQ ID NO: 1185454 - protein, 9 aa, Homo Sapiens
IRQPILQYR

SEQ ID NO: 1185455 - protein, 9 aa, Homo Sapiens
IGGGTPLSI

SEQ ID NO: 1185456 - protein, 9 aa, Homo Sapiens
PGPQAAALT

SEQ ID NO: 1185457 - protein, 9 aa, Homo Sapiens
VHYQCLRHP

SEQ ID NO: 1185458 - protein, 9 aa, Homo Sapiens
SQYEQLADQ

SEQ ID NO: 1185459 - protein, 9 aa, Homo Sapiens
YCVNLLCGL

SEQ ID NO: 1185460 - protein, 9 aa, Homo Sapiens
TVRVGRMCF

SEQ ID NO: 1185461 - protein, 9 aa, Homo Sapiens
EDGVDASEP

SEQ ID NO: 1185462 - protein, 9 aa, Homo Sapiens
LPSLNLTPR

SEQ ID NO: 1185463 - protein, 9 aa, Homo Sapiens
PKLQCQYRS

SEQ ID NO: 1185464 - protein, 9 aa, Homo Sapiens
GSQGWNRSY

SEQ ID NO: 1185465 - protein, 9 aa, Homo Sapiens
CISVGRYLA

SEQ ID NO: 1185466 - protein, 9 aa, Homo Sapiens
PPAPTQQLL

SEQ ID NO: 1185467 - protein, 9 aa, Homo Sapiens
HHSEHMQHV

SEQ ID NO: 1185468 - protein, 9 aa, Homo Sapiens
REPHPHKPE

SEQ ID NO: 1185469 - protein, 9 aa, Homo Sapiens
SLLERVLFY

SEQ ID NO: 1185470 - protein, 9 aa, Homo Sapiens
SLCKPFSDI

SEQ ID NO: 1185471 - protein, 9 aa, Homo Sapiens
GPGQISTEV

SEQ ID NO: 1185472 - protein, 9 aa, Homo Sapiens
ASLRCIWRG

SEQ ID NO: 1185473 - protein, 9 aa, Homo Sapiens
RQVYVNRSL

SEQ ID NO: 1185474 - protein, 9 aa, Homo Sapiens
LQGARAPPP

SEQ ID NO: 1185475 - protein, 9 aa, Homo Sapiens
AIVRICQTV

SEQ ID NO: 1185476 - protein, 9 aa, Homo Sapiens
KLVNDILKK

SEQ ID NO: 1185477 - protein, 9 aa, Homo Sapiens
HYLELLVQA

SEQ ID NO: 1185478 - protein, 9 aa, Homo Sapiens
EDLPRELKI

SEQ ID NO: 1185479 - protein, 9 aa, Homo Sapiens
CTSTGIGYN

SEQ ID NO: 1185480 - protein, 9 aa, Homo Sapiens
ESVRLQRES

SEQ ID NO: 1185481 - protein, 9 aa, Homo Sapiens
TRASSPTCS

SEQ ID NO: 1185482 - protein, 9 aa, Homo Sapiens
KVERANTCN

SEQ ID NO: 1185483 - protein, 9 aa, Homo Sapiens
PTSRARQSC

SEQ ID NO: 1185484 - protein, 9 aa, Homo Sapiens
REAWRRSSW

SEQ ID NO: 1185485 - protein, 9 aa, Homo Sapiens
PEPKCPHIA

SEQ ID NO: 1185486 - protein, 9 aa, Homo Sapiens
DFAGKSCNQ

SEQ ID NO: 1185487 - protein, 9 aa, Homo Sapiens
IWESWQMKT

SEQ ID NO: 1185488 - protein, 9 aa, Homo Sapiens
GARWDAGLS

SEQ ID NO: 1185489 - protein, 9 aa, Homo Sapiens
AEALYSVPK

SEQ ID NO: 1185490 - protein, 9 aa, Homo Sapiens
LSWRGASFI

SEQ ID NO: 1185491 - protein, 9 aa, Homo Sapiens
DWRRGKDIT

SEQ ID NO: 1185492 - protein, 9 aa, Homo Sapiens
QLCSPVARL

SEQ ID NO: 1185493 - protein, 9 aa, Homo Sapiens
RPPAQIPTS

SEQ ID NO: 1185494 - protein, 9 aa, Homo Sapiens
AQSSELRTY

SEQ ID NO: 1185495 - protein, 9 aa, Homo Sapiens
HLSYQCSQF

SEQ ID NO: 1185496 - protein, 9 aa, Homo Sapiens
LDDTVRERA

SEQ ID NO: 1185497 - protein, 9 aa, Homo Sapiens
PGRRGSRAC

SEQ ID NO: 1185498 - protein, 9 aa, Homo Sapiens
PRPPEPLEP

SEQ ID NO: 1185499 - protein, 9 aa, Homo Sapiens
TRGAGEGPA

SEQ ID NO: 1185500 - protein, 9 aa, Homo Sapiens
MVNFCCYYW

SEQ ID NO: 1185501 - protein, 9 aa, Homo Sapiens
RLTWEATPH

SEQ ID NO: 1185502 - protein, 9 aa, Homo Sapiens
EFRPVDCAD

SEQ ID NO: 1185503 - protein, 9 aa, Homo Sapiens
FEEIQHFYY

SEQ ID NO: 1185504 - protein, 9 aa, Homo Sapiens
PRAAESGTR

SEQ ID NO: 1185505 - protein, 9 aa, Homo Sapiens
TYEFLQAHF

SEQ ID NO: 1185506 - protein, 9 aa, Homo Sapiens
KNIIRLSIW

SEQ ID NO: 1185507 - protein, 9 aa, Homo Sapiens
NIPWSRIPP

SEQ ID NO: 1185508 - protein, 9 aa, Homo Sapiens
TPVPTMAPS

SEQ ID NO: 1185509 - protein, 9 aa, Homo Sapiens
AHAAGQLVK

SEQ ID NO: 1185510 - protein, 9 aa, Homo Sapiens
PGGAVRAGD

SEQ ID NO: 1185511 - protein, 9 aa, Homo Sapiens
EQREQERQL

SEQ ID NO: 1185512 - protein, 9 aa, Homo Sapiens
WTSLHSGAF

SEQ ID NO: 1185513 - protein, 9 aa, Homo Sapiens
VKESNAGRY

SEQ ID NO: 1185514 - protein, 9 aa, Homo Sapiens
STQLKWSLV

SEQ ID NO: 1185515 - protein, 9 aa, Homo Sapiens
RRPKTPLQT

SEQ ID NO: 1185516 - protein, 9 aa, Homo Sapiens
EELNRLKEN

SEQ ID NO: 1185517 - protein, 9 aa, Homo Sapiens
LEVRRLVIG

SEQ ID NO: 1185518 - protein, 9 aa, Homo Sapiens
LQLEALPTR

SEQ ID NO: 1185519 - protein, 9 aa, Homo Sapiens
PPGGCHPAW

SEQ ID NO: 1185520 - protein, 9 aa, Homo Sapiens
AESPADGQG

SEQ ID NO: 1185521 - protein, 9 aa, Homo Sapiens
TGFSLFYYK

SEQ ID NO: 1185522 - protein, 9 aa, Homo Sapiens
VATGQPRPS

SEQ ID NO: 1185523 - protein, 9 aa, Homo Sapiens
CLPRKPEEG

SEQ ID NO: 1185524 - protein, 9 aa, Homo Sapiens
ARGPAEKEL

SEQ ID NO: 1185525 - protein, 9 aa, Homo Sapiens
TAWTSWPTA

SEQ ID NO: 1185526 - protein, 9 aa, Homo Sapiens
MLRDSGIYD

SEQ ID NO: 1185527 - protein, 9 aa, Homo Sapiens
SLTRTEKLI

SEQ ID NO: 1185528 - protein, 9 aa, Homo Sapiens
ALTLAQWSP

SEQ ID NO: 1185529 - protein, 9 aa, Homo Sapiens
KAFEYGAKQ

SEQ ID NO: 1185530 - protein, 9 aa, Homo Sapiens
RRNTELFQT

SEQ ID NO: 1185531 - protein, 9 aa, Homo Sapiens
ARYFSVNEA

SEQ ID NO: 1185532 - protein, 9 aa, Homo Sapiens
QERGDLGCP

SEQ ID NO: 1185533 - protein, 9 aa, Homo Sapiens
GGLRRASGT

SEQ ID NO: 1185534 - protein, 9 aa, Homo Sapiens
EPKVENFNV

SEQ ID NO: 1185535 - protein, 9 aa, Homo Sapiens
SRRATCWLC

SEQ ID NO: 1185536 - protein, 9 aa, Homo Sapiens
LTYVWPGGP

SEQ ID NO: 1185537 - protein, 9 aa, Homo Sapiens
LEVLAIPQL

SEQ ID NO: 1185538 - protein, 9 aa, Homo Sapiens
GPTTCSRWA

SEQ ID NO: 1185539 - protein, 9 aa, Homo Sapiens
ISERRWILI

SEQ ID NO: 1185540 - protein, 9 aa, Homo Sapiens
TSKTLSDSS

SEQ ID NO: 1185541 - protein, 9 aa, Homo Sapiens
QSWGSTLFS

SEQ ID NO: 1185542 - protein, 9 aa, Homo Sapiens
CCEPPCCTT

SEQ ID NO: 1185543 - protein, 9 aa, Homo Sapiens
TIQANCTST

SEQ ID NO: 1185544 - protein, 9 aa, Homo Sapiens
DSNTSRFYY

SEQ ID NO: 1185545 - protein, 9 aa, Homo Sapiens
GPPSHCQLC

SEQ ID NO: 1185546 - protein, 9 aa, Homo Sapiens
VFTGFVEWP

SEQ ID NO: 1185547 - protein, 9 aa, Homo Sapiens
YHPQCLVLT

SEQ ID NO: 1185548 - protein, 9 aa, Homo Sapiens
AAAHQGVGV

SEQ ID NO: 1185549 - protein, 9 aa, Homo Sapiens
VKTWTQFRN

SEQ ID NO: 1185550 - protein, 9 aa, Homo Sapiens
GEKNQLTRD

SEQ ID NO: 1185551 - protein, 9 aa, Homo Sapiens
STKSEHTPE

SEQ ID NO: 1185552 - protein, 9 aa, Homo Sapiens
PALRIGMKL

SEQ ID NO: 1185553 - protein, 9 aa, Homo Sapiens
MSLMPCGVP

SEQ ID NO: 1185554 - protein, 9 aa, Homo Sapiens
WPTPSSCSP

SEQ ID NO: 1185555 - protein, 9 aa, Homo Sapiens
LVKIRSGWR

SEQ ID NO: 1185556 - protein, 9 aa, Homo Sapiens
TQLNHCIFT

SEQ ID NO: 1185557 - protein, 9 aa, Homo Sapiens
GSLEIAQIN

SEQ ID NO: 1185558 - protein, 9 aa, Homo Sapiens
IHVKPPSCP

SEQ ID NO: 1185559 - protein, 9 aa, Homo Sapiens
YRQQVSRAV

SEQ ID NO: 1185560 - protein, 9 aa, Homo Sapiens
KGAASCTET

SEQ ID NO: 1185561 - protein, 9 aa, Homo Sapiens
AACENTRVA

SEQ ID NO: 1185562 - protein, 9 aa, Homo Sapiens
ERFRPPIVR

SEQ ID NO: 1185563 - protein, 9 aa, Homo Sapiens
AVASRSTAP

SEQ ID NO: 1185564 - protein, 9 aa, Homo Sapiens
HKGIRKVYT

SEQ ID NO: 1185565 - protein, 9 aa, Homo Sapiens
ERVLRAIRY

SEQ ID NO: 1185566 - protein, 9 aa, Homo Sapiens
FGPARVFTG

SEQ ID NO: 1185567 - protein, 9 aa, Homo Sapiens
LLAMYNSWK

SEQ ID NO: 1185568 - protein, 9 aa, Homo Sapiens
SGTVYEAAV

SEQ ID NO: 1185569 - protein, 9 aa, Homo Sapiens
AAAKRYACE

SEQ ID NO: 1185570 - protein, 9 aa, Homo Sapiens
RGASTRGSG

SEQ ID NO: 1185571 - protein, 9 aa, Homo Sapiens
HCSQCTGPL

SEQ ID NO: 1185572 - protein, 9 aa, Homo Sapiens
GQPAHAEPA

SEQ ID NO: 1185573 - protein, 9 aa, Homo Sapiens
AAALQDHDQ

SEQ ID NO: 1185574 - protein, 9 aa, Homo Sapiens
QRVRPRERS

SEQ ID NO: 1185575 - protein, 9 aa, Homo Sapiens
QQHPLLGWP

SEQ ID NO: 1185576 - protein, 9 aa, Homo Sapiens
PTPIPAPVP

SEQ ID NO: 1185577 - protein, 9 aa, Homo Sapiens
PSPNCGLWQ

SEQ ID NO: 1185578 - protein, 9 aa, Homo Sapiens
FCGAANCAD

SEQ ID NO: 1185579 - protein, 9 aa, Homo Sapiens
RMRRLGTRG

SEQ ID NO: 1185580 - protein, 9 aa, Homo Sapiens
YQLWFLVSF

SEQ ID NO: 1185581 - protein, 9 aa, Homo Sapiens
CGTSQTYFG

SEQ ID NO: 1185582 - protein, 9 aa, Homo Sapiens
VPVVSTSTA

SEQ ID NO: 1185583 - protein, 9 aa, Homo Sapiens
WARLSAASP

SEQ ID NO: 1185584 - protein, 9 aa, Homo Sapiens
EQMQEQECR

SEQ ID NO: 1185585 - protein, 9 aa, Homo Sapiens
AQQRYEDLV

SEQ ID NO: 1185586 - protein, 9 aa, Homo Sapiens
GVGQASLQL

SEQ ID NO: 1185587 - protein, 9 aa, Homo Sapiens
PAPTQQLLP

SEQ ID NO: 1185588 - protein, 9 aa, Homo Sapiens
ADLQLEALP

SEQ ID NO: 1185589 - protein, 9 aa, Homo Sapiens
MLIPCYEEY

SEQ ID NO: 1185590 - protein, 9 aa, Homo Sapiens
TSDTSLAQK

SEQ ID NO: 1185591 - protein, 9 aa, Homo Sapiens
SPPRRWPPR

SEQ ID NO: 1185592 - protein, 9 aa, Homo Sapiens
VLWKKGLSL

SEQ ID NO: 1185593 - protein, 9 aa, Homo Sapiens
HPTPVVRLS

SEQ ID NO: 1185594 - protein, 9 aa, Homo Sapiens
DFWYSDQCN

SEQ ID NO: 1185595 - protein, 9 aa, Homo Sapiens
VSRTSGGPG

SEQ ID NO: 1185596 - protein, 9 aa, Homo Sapiens
QRGRADPGG

SEQ ID NO: 1185597 - protein, 9 aa, Homo Sapiens
SRGVGSKDA

SEQ ID NO: 1185598 - protein, 9 aa, Homo Sapiens
ALDIRPVSE

SEQ ID NO: 1185599 - protein, 9 aa, Homo Sapiens
SIHDGDFHV

SEQ ID NO: 1185600 - protein, 9 aa, Homo Sapiens
EEAKAPSRC

SEQ ID NO: 1185601 - protein, 9 aa, Homo Sapiens
PQGTRSATS

SEQ ID NO: 1185602 - protein, 9 aa, Homo Sapiens
AASPCSSIS

SEQ ID NO: 1185603 - protein, 9 aa, Homo Sapiens
QGLSPDHRA

SEQ ID NO: 1185604 - protein, 9 aa, Homo Sapiens
WATRQLWQA

SEQ ID NO: 1185605 - protein, 9 aa, Homo Sapiens
EGPNILPIQ

SEQ ID NO: 1185606 - protein, 9 aa, Homo Sapiens
TSAANVAKG

SEQ ID NO: 1185607 - protein, 9 aa, Homo Sapiens
HYVHVVLAQ

SEQ ID NO: 1185608 - protein, 9 aa, Homo Sapiens
EHMQHVVQL

SEQ ID NO: 1185609 - protein, 9 aa, Homo Sapiens
YKFQHSPNC

SEQ ID NO: 1185610 - protein, 9 aa, Homo Sapiens
GIPSSPQPW

SEQ ID NO: 1185611 - protein, 9 aa, Homo Sapiens
DRLLRERTL

SEQ ID NO: 1185612 - protein, 9 aa, Homo Sapiens
KKQAKKGKP

SEQ ID NO: 1185613 - protein, 9 aa, Homo Sapiens
PWPRSYTTP

SEQ ID NO: 1185614 - protein, 9 aa, Homo Sapiens
ETRALRARQ

SEQ ID NO: 1185615 - protein, 9 aa, Homo Sapiens
PDHGTSVIL

SEQ ID NO: 1185616 - protein, 9 aa, Homo Sapiens
LARYFSVNE

SEQ ID NO: 1185617 - protein, 9 aa, Homo Sapiens
QVEIEPVSA

SEQ ID NO: 1185618 - protein, 9 aa, Homo Sapiens
PPMFSQSVV

SEQ ID NO: 1185619 - protein, 9 aa, Homo Sapiens
NRSLPGTTR

SEQ ID NO: 1185620 - protein, 9 aa, Homo Sapiens
WSPSILAAK

SEQ ID NO: 1185621 - protein, 9 aa, Homo Sapiens
TAHREPHPH

SEQ ID NO: 1185622 - protein, 9 aa, Homo Sapiens
GGCHDNTSC

SEQ ID NO: 1185623 - protein, 9 aa, Homo Sapiens
YLYQEFLLL

SEQ ID NO: 1185624 - protein, 9 aa, Homo Sapiens
PTTTLASPT

SEQ ID NO: 1185625 - protein, 9 aa, Homo Sapiens
STRAPALRS

SEQ ID NO: 1185626 - protein, 9 aa, Homo Sapiens
VGSCVDSAV

SEQ ID NO: 1185627 - protein, 9 aa, Homo Sapiens
LTFTFSAVV

SEQ ID NO: 1185628 - protein, 9 aa, Homo Sapiens
GGRRGVLLQ

SEQ ID NO: 1185629 - protein, 9 aa, Homo Sapiens
PGGRCPPHR

SEQ ID NO: 1185630 - protein, 9 aa, Homo Sapiens
IRAGSLMLI

SEQ ID NO: 1185631 - protein, 9 aa, Homo Sapiens
LNKVLRREV

SEQ ID NO: 1185632 - protein, 9 aa, Homo Sapiens
VGVLWGPGS

SEQ ID NO: 1185633 - protein, 9 aa, Homo Sapiens
SVLWKLCLR

SEQ ID NO: 1185634 - protein, 9 aa, Homo Sapiens
EDFNNVPDL

SEQ ID NO: 1185635 - protein, 9 aa, Homo Sapiens
LKTRVSLLN

SEQ ID NO: 1185636 - protein, 9 aa, Homo Sapiens
ARGRHAHHP

SEQ ID NO: 1185637 - protein, 9 aa, Homo Sapiens
PAPLTPPLP

SEQ ID NO: 1185638 - protein, 9 aa, Homo Sapiens
SGQRWKLLL

SEQ ID NO: 1185639 - protein, 9 aa, Homo Sapiens
EGVLVRSAM

SEQ ID NO: 1185640 - protein, 9 aa, Homo Sapiens
IAAVISVTA

SEQ ID NO: 1185641 - protein, 9 aa, Homo Sapiens
GIGDRGCSC

SEQ ID NO: 1185642 - protein, 9 aa, Homo Sapiens
VTATRTTLR

SEQ ID NO: 1185643 - protein, 9 aa, Homo Sapiens
LGIRAGSLM

SEQ ID NO: 1185644 - protein, 9 aa, Homo Sapiens
ATQVVVVGA

SEQ ID NO: 1185645 - protein, 9 aa, Homo Sapiens
TTGESEKQF

SEQ ID NO: 1185646 - protein, 9 aa, Homo Sapiens
HYQLRVQLG

SEQ ID NO: 1185647 - protein, 9 aa, Homo Sapiens
APSLSTATS

SEQ ID NO: 1185648 - protein, 9 aa, Homo Sapiens
FHVPQILQP

SEQ ID NO: 1185649 - protein, 9 aa, Homo Sapiens
LAILTGTIE

SEQ ID NO: 1185650 - protein, 9 aa, Homo Sapiens
VPEEKTKRR

SEQ ID NO: 1185651 - protein, 9 aa, Homo Sapiens
PVFSNLAGP

SEQ ID NO: 1185652 - protein, 9 aa, Homo Sapiens
ANGAPPECC

SEQ ID NO: 1185653 - protein, 9 aa, Homo Sapiens
SGVWSPFRA

SEQ ID NO: 1185654 - protein, 9 aa, Homo Sapiens
AGEAGVIER

SEQ ID NO: 1185655 - protein, 9 aa, Homo Sapiens
YRVGRMRPS

SEQ ID NO: 1185656 - protein, 9 aa, Homo Sapiens
CLREPQELF

SEQ ID NO: 1185657 - protein, 9 aa, Homo Sapiens
FLLLSNLDD

SEQ ID NO: 1185658 - protein, 9 aa, Homo Sapiens
STTNTQCKN

SEQ ID NO: 1185659 - protein, 9 aa, Homo Sapiens
YRLRVLGER

SEQ ID NO: 1185660 - protein, 9 aa, Homo Sapiens
YKKTYMEMH

SEQ ID NO: 1185661 - protein, 9 aa, Homo Sapiens
GQPGRHRQG

SEQ ID NO: 1185662 - protein, 9 aa, Homo Sapiens
PARIQPRAR

SEQ ID NO: 1185663 - protein, 9 aa, Homo Sapiens
AGHPWTPLP

SEQ ID NO: 1185664 - protein, 9 aa, Homo Sapiens
MLDITTKES

SEQ ID NO: 1185665 - protein, 9 aa, Homo Sapiens
LPGPAPASS

SEQ ID NO: 1185666 - protein, 9 aa, Homo Sapiens
YRRHRGALS

SEQ ID NO: 1185667 - protein, 9 aa, Homo Sapiens
LKKTSRILN

SEQ ID NO: 1185668 - protein, 9 aa, Homo Sapiens
ATGTNLSPV

SEQ ID NO: 1185669 - protein, 9 aa, Homo Sapiens
TTYEENRAE

SEQ ID NO: 1185670 - protein, 9 aa, Homo Sapiens
AIWTCIVAP

SEQ ID NO: 1185671 - protein, 9 aa, Homo Sapiens
ACEDGCRLE

SEQ ID NO: 1185672 - protein, 9 aa, Homo Sapiens
LAPLGPAVL

SEQ ID NO: 1185673 - protein, 9 aa, Homo Sapiens
LIPETELCK

SEQ ID NO: 1185674 - protein, 9 aa, Homo Sapiens
ASSPTCSTT

SEQ ID NO: 1185675 - protein, 9 aa, Homo Sapiens
GASTRPTWN

SEQ ID NO: 1185676 - protein, 9 aa, Homo Sapiens
VCSFAYQPS

SEQ ID NO: 1185677 - protein, 9 aa, Homo Sapiens
KKAKDTSTI

SEQ ID NO: 1185678 - protein, 9 aa, Homo Sapiens
VVVFVASML

SEQ ID NO: 1185679 - protein, 9 aa, Homo Sapiens
AFQNEEYNK

SEQ ID NO: 1185680 - protein, 9 aa, Homo Sapiens
TQIEETPLE

SEQ ID NO: 1185681 - protein, 9 aa, Homo Sapiens
VGPLSHCTL

SEQ ID NO: 1185682 - protein, 9 aa, Homo Sapiens
PSRNCSLSL

SEQ ID NO: 1185683 - protein, 9 aa, Homo Sapiens
ENGRALETC

SEQ ID NO: 1185684 - protein, 9 aa, Homo Sapiens
ITGFFTPCL

SEQ ID NO: 1185685 - protein, 9 aa, Homo Sapiens
DAPVPSTAI

SEQ ID NO: 1185686 - protein, 9 aa, Homo Sapiens
KVVDAWKST

SEQ ID NO: 1185687 - protein, 9 aa, Homo Sapiens
DDLFCYRWL

SEQ ID NO: 1185688 - protein, 9 aa, Homo Sapiens
DFCINRDNW

SEQ ID NO: 1185689 - protein, 9 aa, Homo Sapiens
PCSSISERR

SEQ ID NO: 1185690 - protein, 9 aa, Homo Sapiens
SGKSNMGAW

SEQ ID NO: 1185691 - protein, 9 aa, Homo Sapiens
PSRFRIHLD

SEQ ID NO: 1185692 - protein, 9 aa, Homo Sapiens
LVVLADASF

SEQ ID NO: 1185693 - protein, 9 aa, Homo Sapiens
RDWCLLQAP

SEQ ID NO: 1185694 - protein, 9 aa, Homo Sapiens
LKELLMMLQ

SEQ ID NO: 1185695 - protein, 9 aa, Homo Sapiens
STTSDTSLA

SEQ ID NO: 1185696 - protein, 9 aa, Homo Sapiens
RTLVAHTQA

SEQ ID NO: 1185697 - protein, 9 aa, Homo Sapiens
RLRCWHKSR

SEQ ID NO: 1185698 - protein, 9 aa, Homo Sapiens
WPPCSWPMT

SEQ ID NO: 1185699 - protein, 9 aa, Homo Sapiens
GTVYEAAVV

SEQ ID NO: 1185700 - protein, 9 aa, Homo Sapiens
GVQAAFPGT

SEQ ID NO: 1185701 - protein, 9 aa, Homo Sapiens
LTAEIDQLK

SEQ ID NO: 1185702 - protein, 9 aa, Homo Sapiens
VHTLGAHWL

SEQ ID NO: 1185703 - protein, 9 aa, Homo Sapiens
STPAEEATE

SEQ ID NO: 1185704 - protein, 9 aa, Homo Sapiens
AYSSMIYRQ

SEQ ID NO: 1185705 - protein, 9 aa, Homo Sapiens
NNPERNHWQ

SEQ ID NO: 1185706 - protein, 9 aa, Homo Sapiens
LVLSPVRSG

SEQ ID NO: 1185707 - protein, 9 aa, Homo Sapiens
PATMSAIFD

SEQ ID NO: 1185708 - protein, 9 aa, Homo Sapiens
RMRGFWKGT

SEQ ID NO: 1185709 - protein, 9 aa, Homo Sapiens
NLNNMLVLE

SEQ ID NO: 1185710 - protein, 9 aa, Homo Sapiens
DGGILQLTS

SEQ ID NO: 1185711 - protein, 9 aa, Homo Sapiens
QRKSVFDWH

SEQ ID NO: 1185712 - protein, 9 aa, Homo Sapiens
GRLVLLIEG

SEQ ID NO: 1185713 - protein, 9 aa, Homo Sapiens
TLGAHWLGG

SEQ ID NO: 1185714 - protein, 9 aa, Homo Sapiens
SQHVVMEVS

SEQ ID NO: 1185715 - protein, 9 aa, Homo Sapiens
VNGTWDKAL

SEQ ID NO: 1185716 - protein, 9 aa, Homo Sapiens
EEEGCEDED

SEQ ID NO: 1185717 - protein, 9 aa, Homo Sapiens
VYTCSHCPD

SEQ ID NO: 1185718 - protein, 9 aa, Homo Sapiens
ISVKNHSLD

SEQ ID NO: 1185719 - protein, 9 aa, Homo Sapiens
KIQKNIKEN

SEQ ID NO: 1185720 - protein, 9 aa, Homo Sapiens
FGAAREGAL

SEQ ID NO: 1185721 - protein, 9 aa, Homo Sapiens
HILLCLKNN

SEQ ID NO: 1185722 - protein, 9 aa, Homo Sapiens
LRAPLLQEM

SEQ ID NO: 1185723 - protein, 9 aa, Homo Sapiens
NRNHNYLPF

SEQ ID NO: 1185724 - protein, 9 aa, Homo Sapiens
EPALTATTT

SEQ ID NO: 1185725 - protein, 9 aa, Homo Sapiens
SSDGWLSPA

SEQ ID NO: 1185726 - protein, 9 aa, Homo Sapiens
LRKKVGLLS

SEQ ID NO: 1185727 - protein, 9 aa, Homo Sapiens
LKEFLHLGL

SEQ ID NO: 1185728 - protein, 9 aa, Homo Sapiens
PPSPSRRRA

SEQ ID NO: 1185729 - protein, 9 aa, Homo Sapiens
APVPSTAIS

SEQ ID NO: 1185730 - protein, 9 aa, Homo Sapiens
PPGWQSYLL

SEQ ID NO: 1185731 - protein, 9 aa, Homo Sapiens
DEAGGGPGS

SEQ ID NO: 1185732 - protein, 9 aa, Homo Sapiens
NTTKADVEK

SEQ ID NO: 1185733 - protein, 9 aa, Homo Sapiens
SVAALVAQV

SEQ ID NO: 1185734 - protein, 9 aa, Homo Sapiens
GAPWKATAW

SEQ ID NO: 1185735 - protein, 9 aa, Homo Sapiens
ETKKGTMEA

SEQ ID NO: 1185736 - protein, 9 aa, Homo Sapiens
TKVLWPLRP

SEQ ID NO: 1185737 - protein, 9 aa, Homo Sapiens
SPKEAMGLC

SEQ ID NO: 1185738 - protein, 9 aa, Homo Sapiens
WSWWSPWKP

SEQ ID NO: 1185739 - protein, 9 aa, Homo Sapiens
CAGGGVGEP

SEQ ID NO: 1185740 - protein, 9 aa, Homo Sapiens
NLLSHRPRC

SEQ ID NO: 1185741 - protein, 9 aa, Homo Sapiens
EKNSQNLKS

SEQ ID NO: 1185742 - protein, 9 aa, Homo Sapiens
SGRSARMSS

SEQ ID NO: 1185743 - protein, 9 aa, Homo Sapiens
PYHSNLEKK

SEQ ID NO: 1185744 - protein, 9 aa, Homo Sapiens
KPYMTQKVQ

SEQ ID NO: 1185745 - protein, 9 aa, Homo Sapiens
VDFWYSDQC

SEQ ID NO: 1185746 - protein, 9 aa, Homo Sapiens
YYQKTWRVI

SEQ ID NO: 1185747 - protein, 9 aa, Homo Sapiens
FDVAVLVPL

SEQ ID NO: 1185748 - protein, 9 aa, Homo Sapiens
QGILWTIRL

SEQ ID NO: 1185749 - protein, 9 aa, Homo Sapiens
IAHGRCHLA

SEQ ID NO: 1185750 - protein, 9 aa, Homo Sapiens
DHRLEMCLG

SEQ ID NO: 1185751 - protein, 9 aa, Homo Sapiens
IHTRENLTN

SEQ ID NO: 1185752 - protein, 9 aa, Homo Sapiens
AGGDASCAR

SEQ ID NO: 1185753 - protein, 9 aa, Homo Sapiens
IDWRRGKDI

SEQ ID NO: 1185754 - protein, 9 aa, Homo Sapiens
MSPSTLDSS

SEQ ID NO: 1185755 - protein, 9 aa, Homo Sapiens
GEIRVQNGD

SEQ ID NO: 1185756 - protein, 9 aa, Homo Sapiens
LQVQEVLST

SEQ ID NO: 1185757 - protein, 9 aa, Homo Sapiens
VGSAFEVVW

SEQ ID NO: 1185758 - protein, 9 aa, Homo Sapiens
FSGFHATPE

SEQ ID NO: 1185759 - protein, 9 aa, Homo Sapiens
DAYAFRIYD

SEQ ID NO: 1185760 - protein, 9 aa, Homo Sapiens
WHWEGWWSA

SEQ ID NO: 1185761 - protein, 9 aa, Homo Sapiens
WQMKTIHCN

SEQ ID NO: 1185762 - protein, 9 aa, Homo Sapiens
FLTALQADP

SEQ ID NO: 1185763 - protein, 9 aa, Homo Sapiens
RAEREAVRT

SEQ ID NO: 1185764 - protein, 9 aa, Homo Sapiens
PSSCEKVRP

SEQ ID NO: 1185765 - protein, 9 aa, Homo Sapiens
PKEAMGLCK

SEQ ID NO: 1185766 - protein, 9 aa, Homo Sapiens
PGQGSPCLG

SEQ ID NO: 1185767 - protein, 9 aa, Homo Sapiens
YQYILVRIF

SEQ ID NO: 1185768 - protein, 9 aa, Homo Sapiens
TSWPTATWW

SEQ ID NO: 1185769 - protein, 9 aa, Homo Sapiens
AGEVGNFAA

SEQ ID NO: 1185770 - protein, 9 aa, Homo Sapiens
WALLGREEI

SEQ ID NO: 1185771 - protein, 9 aa, Homo Sapiens
ADRSNNCIQ

SEQ ID NO: 1185772 - protein, 9 aa, Homo Sapiens
CTDSWWVVD

SEQ ID NO: 1185773 - protein, 9 aa, Homo Sapiens
AIEERKQLI

SEQ ID NO: 1185774 - protein, 9 aa, Homo Sapiens
SNAGRYYCA

SEQ ID NO: 1185775 - protein, 9 aa, Homo Sapiens
TGPPAEPAT

SEQ ID NO: 1185776 - protein, 9 aa, Homo Sapiens
LVPLSVPQT

SEQ ID NO: 1185777 - protein, 9 aa, Homo Sapiens
KAFGPARVF

SEQ ID NO: 1185778 - protein, 9 aa, Homo Sapiens
LMVTRGRRA

SEQ ID NO: 1185779 - protein, 9 aa, Homo Sapiens
RRARGPGRI

SEQ ID NO: 1185780 - protein, 9 aa, Homo Sapiens
RGGSSTLSR

SEQ ID NO: 1185781 - protein, 9 aa, Homo Sapiens
RDKQSRHLG

SEQ ID NO: 1185782 - protein, 9 aa, Homo Sapiens
FAETSIILF

SEQ ID NO: 1185783 - protein, 9 aa, Homo Sapiens
SSTGTRASS

SEQ ID NO: 1185784 - protein, 9 aa, Homo Sapiens
CHLTVEDGH

SEQ ID NO: 1185785 - protein, 9 aa, Homo Sapiens
LPSISRESP

SEQ ID NO: 1185786 - protein, 9 aa, Homo Sapiens
GPRPRPPPP

SEQ ID NO: 1185787 - protein, 9 aa, Homo Sapiens
GRNSRGLVW

SEQ ID NO: 1185788 - protein, 9 aa, Homo Sapiens
HIVRVGSVH

SEQ ID NO: 1185789 - protein, 9 aa, Homo Sapiens
APSTRAAPP

SEQ ID NO: 1185790 - protein, 9 aa, Homo Sapiens
SCCITWMAV

SEQ ID NO: 1185791 - protein, 9 aa, Homo Sapiens
PHSPKHTRP

SEQ ID NO: 1185792 - protein, 9 aa, Homo Sapiens
ERRGLGRGG

SEQ ID NO: 1185793 - protein, 9 aa, Homo Sapiens
YRARHQIPW

SEQ ID NO: 1185794 - protein, 9 aa, Homo Sapiens
PRKCHSSGG

SEQ ID NO: 1185795 - protein, 9 aa, Homo Sapiens
LLYGMSLIT

SEQ ID NO: 1185796 - protein, 9 aa, Homo Sapiens
MVRVGSCVD

SEQ ID NO: 1185797 - protein, 9 aa, Homo Sapiens
VVAAIVGLY

SEQ ID NO: 1185798 - protein, 9 aa, Homo Sapiens
KLSCGDDVL

SEQ ID NO: 1185799 - protein, 9 aa, Homo Sapiens
AYIAKIAEG

SEQ ID NO: 1185800 - protein, 9 aa, Homo Sapiens
VVHTLGAHW

SEQ ID NO: 1185801 - protein, 9 aa, Homo Sapiens
NNDRTPLLA

SEQ ID NO: 1185802 - protein, 9 aa, Homo Sapiens
QQRLSGNVS

SEQ ID NO: 1185803 - protein, 9 aa, Homo Sapiens
VVTLSQAVG

SEQ ID NO: 1185804 - protein, 9 aa, Homo Sapiens
DGKALSGHH

SEQ ID NO: 1185805 - protein, 9 aa, Homo Sapiens
LKSSSFWSL

SEQ ID NO: 1185806 - protein, 9 aa, Homo Sapiens
NKYQTTDNY

SEQ ID NO: 1185807 - protein, 9 aa, Homo Sapiens
SASTQARSP

SEQ ID NO: 1185808 - protein, 9 aa, Homo Sapiens
LVQSILSDL

SEQ ID NO: 1185809 - protein, 9 aa, Homo Sapiens
RSRCRMTSW

SEQ ID NO: 1185810 - protein, 9 aa, Homo Sapiens
HPLRRSHPG

SEQ ID NO: 1185811 - protein, 9 aa, Homo Sapiens
GRLIRGGGG

SEQ ID NO: 1185812 - protein, 9 aa, Homo Sapiens
LHAAVASLS

SEQ ID NO: 1185813 - protein, 9 aa, Homo Sapiens
PYPMTTALS

SEQ ID NO: 1185814 - protein, 9 aa, Homo Sapiens
WRQNGGSGR

SEQ ID NO: 1185815 - protein, 9 aa, Homo Sapiens
CSQSTPGRE

SEQ ID NO: 1185816 - protein, 9 aa, Homo Sapiens
GVLSPVTAL

SEQ ID NO: 1185817 - protein, 9 aa, Homo Sapiens
YKGEDIFWT

SEQ ID NO: 1185818 - protein, 9 aa, Homo Sapiens
RLLELERLR

SEQ ID NO: 1185819 - protein, 9 aa, Homo Sapiens
GDCCSWPSS

SEQ ID NO: 1185820 - protein, 9 aa, Homo Sapiens
HIGLKPRAR

SEQ ID NO: 1185821 - protein, 9 aa, Homo Sapiens
IGILQNIPM

SEQ ID NO: 1185822 - protein, 9 aa, Homo Sapiens
CCGGKRSSR

SEQ ID NO: 1185823 - protein, 9 aa, Homo Sapiens
PSYSYMTPS

SEQ ID NO: 1185824 - protein, 9 aa, Homo Sapiens
LEMLTPSGS

SEQ ID NO: 1185825 - protein, 9 aa, Homo Sapiens
SPIKKQVYL

SEQ ID NO: 1185826 - protein, 9 aa, Homo Sapiens
SVSVSTFDL

SEQ ID NO: 1185827 - protein, 9 aa, Homo Sapiens
PSISKNVAM

SEQ ID NO: 1185828 - protein, 9 aa, Homo Sapiens
LVHLEYGLP

SEQ ID NO: 1185829 - protein, 9 aa, Homo Sapiens
LTFVATLPL

SEQ ID NO: 1185830 - protein, 9 aa, Homo Sapiens
VSSAACTPS

SEQ ID NO: 1185831 - protein, 9 aa, Homo Sapiens
LAICWRSPT

SEQ ID NO: 1185832 - protein, 9 aa, Homo Sapiens
SRFRIHLDP

SEQ ID NO: 1185833 - protein, 9 aa, Homo Sapiens
VSDVPEELD

SEQ ID NO: 1185834 - protein, 9 aa, Homo Sapiens
LVRPWGLAP

SEQ ID NO: 1185835 - protein, 9 aa, Homo Sapiens
AAGAAAPAG

SEQ ID NO: 1185836 - protein, 9 aa, Homo Sapiens
RSVSRDGGW

SEQ ID NO: 1185837 - protein, 9 aa, Homo Sapiens
LVNKYSDFA

SEQ ID NO: 1185838 - protein, 9 aa, Homo Sapiens
KPSAAGAQH

SEQ ID NO: 1185839 - protein, 9 aa, Homo Sapiens
RCVQRCVQW

SEQ ID NO: 1185840 - protein, 9 aa, Homo Sapiens
PLRIMFNIL

SEQ ID NO: 1185841 - protein, 9 aa, Homo Sapiens
GRTREEPCG

SEQ ID NO: 1185842 - protein, 9 aa, Homo Sapiens
PCRRKRIPV

SEQ ID NO: 1185843 - protein, 9 aa, Homo Sapiens
PAPPAWGIP

SEQ ID NO: 1185844 - protein, 9 aa, Homo Sapiens
AGLSPGACR

SEQ ID NO: 1185845 - protein, 9 aa, Homo Sapiens
APASTRDSL

SEQ ID NO: 1185846 - protein, 9 aa, Homo Sapiens
YLVERSGHE

SEQ ID NO: 1185847 - protein, 9 aa, Homo Sapiens
PNTCTRPLK

SEQ ID NO: 1185848 - protein, 9 aa, Homo Sapiens
VQYQKVPVL

SEQ ID NO: 1185849 - protein, 9 aa, Homo Sapiens
ERRSGPTDG

SEQ ID NO: 1185850 - protein, 9 aa, Homo Sapiens
WDWLPPCGG

SEQ ID NO: 1185851 - protein, 9 aa, Homo Sapiens
HGTSVILPF

SEQ ID NO: 1185852 - protein, 9 aa, Homo Sapiens
EKYRARHQI

SEQ ID NO: 1185853 - protein, 9 aa, Homo Sapiens
CAGRSSKRS

SEQ ID NO: 1185854 - protein, 9 aa, Homo Sapiens
GPWSGTSAA

SEQ ID NO: 1185855 - protein, 9 aa, Homo Sapiens
PTAWRPGGP

SEQ ID NO: 1185856 - protein, 9 aa, Homo Sapiens
SMWDRDHDN

SEQ ID NO: 1185857 - protein, 9 aa, Homo Sapiens
FGAQANPPP

SEQ ID NO: 1185858 - protein, 9 aa, Homo Sapiens
TPYFWPQLE

SEQ ID NO: 1185859 - protein, 9 aa, Homo Sapiens
LSIWPRQAS

SEQ ID NO: 1185860 - protein, 9 aa, Homo Sapiens
YQYMLNARL

SEQ ID NO: 1185861 - protein, 9 aa, Homo Sapiens
ALASGCPRH

SEQ ID NO: 1185862 - protein, 9 aa, Homo Sapiens
APWKATAWM

SEQ ID NO: 1185863 - protein, 9 aa, Homo Sapiens
PLPPGGKEE

SEQ ID NO: 1185864 - protein, 9 aa, Homo Sapiens
QGPAAPSEP

SEQ ID NO: 1185865 - protein, 9 aa, Homo Sapiens
VAASPRRMC

SEQ ID NO: 1185866 - protein, 9 aa, Homo Sapiens
TTSNWKKTP

SEQ ID NO: 1185867 - protein, 9 aa, Homo Sapiens
AAAFPHELR

SEQ ID NO: 1185868 - protein, 9 aa, Homo Sapiens
TGAKSEHRN

SEQ ID NO: 1185869 - protein, 9 aa, Homo Sapiens
MKLSLPESL

SEQ ID NO: 1185870 - protein, 9 aa, Homo Sapiens
TERGQGHID

SEQ ID NO: 1185871 - protein, 9 aa, Homo Sapiens
RALPVQIRY

SEQ ID NO: 1185872 - protein, 9 aa, Homo Sapiens
RQMWDLDFL

SEQ ID NO: 1185873 - protein, 9 aa, Homo Sapiens
WRFNELPNP

SEQ ID NO: 1185874 - protein, 9 aa, Homo Sapiens
SRLSHKELL

SEQ ID NO: 1185875 - protein, 9 aa, Homo Sapiens
DGHERRKVV

SEQ ID NO: 1185876 - protein, 9 aa, Homo Sapiens
LPVAFQLVI

SEQ ID NO: 1185877 - protein, 9 aa, Homo Sapiens
HIKARYLPE

SEQ ID NO: 1185878 - protein, 9 aa, Homo Sapiens
PCCSRGATS

SEQ ID NO: 1185879 - protein, 9 aa, Homo Sapiens
TYLHCDAPA

SEQ ID NO: 1185880 - protein, 9 aa, Homo Sapiens
PSTWTEMQR

SEQ ID NO: 1185881 - protein, 9 aa, Homo Sapiens
SLARKCLTL

SEQ ID NO: 1185882 - protein, 9 aa, Homo Sapiens
NHPSRLRSV

SEQ ID NO: 1185883 - protein, 9 aa, Homo Sapiens
VSLHERPED

SEQ ID NO: 1185884 - protein, 9 aa, Homo Sapiens
ESESVSEKE

SEQ ID NO: 1185885 - protein, 9 aa, Homo Sapiens
DTTAEQRRM

SEQ ID NO: 1185886 - protein, 9 aa, Homo Sapiens
DGSGSGGVS

SEQ ID NO: 1185887 - protein, 9 aa, Homo Sapiens
VVIAAVKPL

SEQ ID NO: 1185888 - protein, 9 aa, Homo Sapiens
LGAKEAPEL

SEQ ID NO: 1185889 - protein, 9 aa, Homo Sapiens
RPLSLSRPH

SEQ ID NO: 1185890 - protein, 9 aa, Homo Sapiens
DMGEDASFS

SEQ ID NO: 1185891 - protein, 9 aa, Homo Sapiens
HTFQGRWVH

SEQ ID NO: 1185892 - protein, 9 aa, Homo Sapiens
SCLACWVVH

SEQ ID NO: 1185893 - protein, 9 aa, Homo Sapiens
NPCTKATPG

SEQ ID NO: 1185894 - protein, 9 aa, Homo Sapiens
CPLCSAQYE

SEQ ID NO: 1185895 - protein, 9 aa, Homo Sapiens
SDDLIGSEH

SEQ ID NO: 1185896 - protein, 9 aa, Homo Sapiens
LFCYIGCTV

SEQ ID NO: 1185897 - protein, 9 aa, Homo Sapiens
GSRRGGGGG

SEQ ID NO: 1185898 - protein, 9 aa, Homo Sapiens
VTARPARTC

SEQ ID NO: 1185899 - protein, 9 aa, Homo Sapiens
GEEKDSGGR

SEQ ID NO: 1185900 - protein, 9 aa, Homo Sapiens
QTNCPACTP

SEQ ID NO: 1185901 - protein, 9 aa, Homo Sapiens
DLSVPSAFS

SEQ ID NO: 1185902 - protein, 9 aa, Homo Sapiens
SWKKRISKM

SEQ ID NO: 1185903 - protein, 9 aa, Homo Sapiens
PEELRSLPL

SEQ ID NO: 1185904 - protein, 9 aa, Homo Sapiens
QPHFLLKFH

SEQ ID NO: 1185905 - protein, 9 aa, Homo Sapiens
CSRRPARPG

SEQ ID NO: 1185906 - protein, 9 aa, Homo Sapiens
KQLPNGDWL

SEQ ID NO: 1185907 - protein, 9 aa, Homo Sapiens
AWQLDGIRN

SEQ ID NO: 1185908 - protein, 9 aa, Homo Sapiens
DGVHAQLLE

SEQ ID NO: 1185909 - protein, 9 aa, Homo Sapiens
GGLRRRQLR

SEQ ID NO: 1185910 - protein, 9 aa, Homo Sapiens
QNFMIDTYR

SEQ ID NO: 1185911 - protein, 9 aa, Homo Sapiens
RHPHRSPPT

SEQ ID NO: 1185912 - protein, 9 aa, Homo Sapiens
EVVEGVLID

SEQ ID NO: 1185913 - protein, 9 aa, Homo Sapiens
AAQRRPIRV

SEQ ID NO: 1185914 - protein, 9 aa, Homo Sapiens
VTMTAKDCS

SEQ ID NO: 1185915 - protein, 9 aa, Homo Sapiens
FSLDRPSCD

SEQ ID NO: 1185916 - protein, 9 aa, Homo Sapiens
MRTRLEHSI

SEQ ID NO: 1185917 - protein, 9 aa, Homo Sapiens
GAGTGLEQS

SEQ ID NO: 1185918 - protein, 9 aa, Homo Sapiens
EASRSESRV

SEQ ID NO: 1185919 - protein, 9 aa, Homo Sapiens
EYYAPALKC

SEQ ID NO: 1185920 - protein, 9 aa, Homo Sapiens
QDGVHEVQV

SEQ ID NO: 1185921 - protein, 9 aa, Homo Sapiens
GQCLDVGLA

SEQ ID NO: 1185922 - protein, 9 aa, Homo Sapiens
SVRQIYSEH

SEQ ID NO: 1185923 - protein, 9 aa, Homo Sapiens
RSASWRSAS

SEQ ID NO: 1185924 - protein, 9 aa, Homo Sapiens
EETWASGQP

SEQ ID NO: 1185925 - protein, 9 aa, Homo Sapiens
LSLEAHTCW

SEQ ID NO: 1185926 - protein, 9 aa, Homo Sapiens
NTPVLLHIL

SEQ ID NO: 1185927 - protein, 9 aa, Homo Sapiens
VPLILTPSR

SEQ ID NO: 1185928 - protein, 9 aa, Homo Sapiens
AEKPTAALG

SEQ ID NO: 1185929 - protein, 9 aa, Homo Sapiens
PSWEVPPRS

SEQ ID NO: 1185930 - protein, 9 aa, Homo Sapiens
APEPSSAGT

SEQ ID NO: 1185931 - protein, 9 aa, Homo Sapiens
FLLHQPLPG

SEQ ID NO: 1185932 - protein, 9 aa, Homo Sapiens
QCDLYFEHG

SEQ ID NO: 1185933 - protein, 9 aa, Homo Sapiens
PPLHHYTTS

SEQ ID NO: 1185934 - protein, 9 aa, Homo Sapiens
IEENIKIEE

SEQ ID NO: 1185935 - protein, 9 aa, Homo Sapiens
CFSPLWLMT

SEQ ID NO: 1185936 - protein, 9 aa, Homo Sapiens
IDPFSKMGN

SEQ ID NO: 1185937 - protein, 9 aa, Homo Sapiens
LADYLHAMH

SEQ ID NO: 1185938 - protein, 9 aa, Homo Sapiens
YGNTPLRCA

SEQ ID NO: 1185939 - protein, 9 aa, Homo Sapiens
SLDHNFLSI

SEQ ID NO: 1185940 - protein, 9 aa, Homo Sapiens
AAEGGHVEV

SEQ ID NO: 1185941 - protein, 9 aa, Homo Sapiens
CSCQACGEE

SEQ ID NO: 1185942 - protein, 9 aa, Homo Sapiens
CRTRWPAPA

SEQ ID NO: 1185943 - protein, 9 aa, Homo Sapiens
LLAQDWVQE

SEQ ID NO: 1185944 - protein, 9 aa, Homo Sapiens
SQARLDVQC

SEQ ID NO: 1185945 - protein, 9 aa, Homo Sapiens
PSLLAQLVA

SEQ ID NO: 1185946 - protein, 9 aa, Homo Sapiens
ARARRTWPR

SEQ ID NO: 1185947 - protein, 9 aa, Homo Sapiens
GMCPLCSAQ

SEQ ID NO: 1185948 - protein, 9 aa, Homo Sapiens
QALARQHQA

SEQ ID NO: 1185949 - protein, 9 aa, Homo Sapiens
RGRARAGVC

SEQ ID NO: 1185950 - protein, 9 aa, Homo Sapiens
TFHFQAHDA

SEQ ID NO: 1185951 - protein, 9 aa, Homo Sapiens
QTPALGQAL

SEQ ID NO: 1185952 - protein, 9 aa, Homo Sapiens
HLVACSRVQ

SEQ ID NO: 1185953 - protein, 9 aa, Homo Sapiens
WTSLWSWSP

SEQ ID NO: 1185954 - protein, 9 aa, Homo Sapiens
VAMDVGDDL

SEQ ID NO: 1185955 - protein, 9 aa, Homo Sapiens
GYLVVWVCH

SEQ ID NO: 1185956 - protein, 9 aa, Homo Sapiens
STHCSFYRT

SEQ ID NO: 1185957 - protein, 9 aa, Homo Sapiens
TREWVSPAF

SEQ ID NO: 1185958 - protein, 9 aa, Homo Sapiens
TTTVATQVS

SEQ ID NO: 1185959 - protein, 9 aa, Homo Sapiens
KGKKRQYRG

SEQ ID NO: 1185960 - protein, 9 aa, Homo Sapiens
FSVRYTPLA

SEQ ID NO: 1185961 - protein, 9 aa, Homo Sapiens
LRKNLNPPT

SEQ ID NO: 1185962 - protein, 9 aa, Homo Sapiens
HVYLGCPNL

SEQ ID NO: 1185963 - protein, 9 aa, Homo Sapiens
VAVALAVCV

SEQ ID NO: 1185964 - protein, 9 aa, Homo Sapiens
EALEFYYHE

SEQ ID NO: 1185965 - protein, 9 aa, Homo Sapiens
LTPSWEVPP

SEQ ID NO: 1185966 - protein, 9 aa, Homo Sapiens
PSWPWTRCL

SEQ ID NO: 1185967 - protein, 9 aa, Homo Sapiens
LGQVPQDWR

SEQ ID NO: 1185968 - protein, 9 aa, Homo Sapiens
QLLRGPPTA

SEQ ID NO: 1185969 - protein, 9 aa, Homo Sapiens
IHNDLILWG

SEQ ID NO: 1185970 - protein, 9 aa, Homo Sapiens
NTSVVKKGG

SEQ ID NO: 1185971 - protein, 9 aa, Homo Sapiens
YLLQGSLVA

SEQ ID NO: 1185972 - protein, 9 aa, Homo Sapiens
VMLRSQSSV

SEQ ID NO: 1185973 - protein, 9 aa, Homo Sapiens
LHHCRTQPS

SEQ ID NO: 1185974 - protein, 9 aa, Homo Sapiens
NEGTDAAQA

SEQ ID NO: 1185975 - protein, 9 aa, Homo Sapiens
QQAWTVGWC

SEQ ID NO: 1185976 - protein, 9 aa, Homo Sapiens
WLSASHFTT

SEQ ID NO: 1185977 - protein, 9 aa, Homo Sapiens
AAGHVHGIA

SEQ ID NO: 1185978 - protein, 9 aa, Homo Sapiens
RIRVAALGQ

SEQ ID NO: 1185979 - protein, 9 aa, Homo Sapiens
TQRQDTSKN

SEQ ID NO: 1185980 - protein, 9 aa, Homo Sapiens
GRAVWLHFS

SEQ ID NO: 1185981 - protein, 9 aa, Homo Sapiens
AAARTAATP

SEQ ID NO: 1185982 - protein, 9 aa, Homo Sapiens
ARPRGRRGV

SEQ ID NO: 1185983 - protein, 9 aa, Homo Sapiens
LMALQCPRH

SEQ ID NO: 1185984 - protein, 9 aa, Homo Sapiens
GSARSCFPF

SEQ ID NO: 1185985 - protein, 9 aa, Homo Sapiens
EAHTCWQRR

SEQ ID NO: 1185986 - protein, 9 aa, Homo Sapiens
WRVSSSQST

SEQ ID NO: 1185987 - protein, 9 aa, Homo Sapiens
EFGVGGYVG

SEQ ID NO: 1185988 - protein, 9 aa, Homo Sapiens
NITMPLAMF

SEQ ID NO: 1185989 - protein, 9 aa, Homo Sapiens
LMMSNGCWG

SEQ ID NO: 1185990 - protein, 9 aa, Homo Sapiens
PKVPQRTHH

SEQ ID NO: 1185991 - protein, 9 aa, Homo Sapiens
HPTRARCCP

SEQ ID NO: 1185992 - protein, 9 aa, Homo Sapiens
YKFATGQWM

SEQ ID NO: 1185993 - protein, 9 aa, Homo Sapiens
TTRHGQSGQ

SEQ ID NO: 1185994 - protein, 9 aa, Homo Sapiens
CILVTNKCH

SEQ ID NO: 1185995 - protein, 9 aa, Homo Sapiens
CEDGCQTNC

SEQ ID NO: 1185996 - protein, 9 aa, Homo Sapiens
APISSDASP

SEQ ID NO: 1185997 - protein, 9 aa, Homo Sapiens
LGTECLVHR

SEQ ID NO: 1185998 - protein, 9 aa, Homo Sapiens
NTIIILVSR

SEQ ID NO: 1185999 - protein, 9 aa, Homo Sapiens
LAPFLRPCH

SEQ ID NO: 1186000 - protein, 9 aa, Homo Sapiens
ELKKLVETH

SEQ ID NO: 1186001 - protein, 9 aa, Homo Sapiens
CMEPQDQWG

SEQ ID NO: 1186002 - protein, 9 aa, Homo Sapiens
TLSQTKKTK

SEQ ID NO: 1186003 - protein, 9 aa, Homo Sapiens
LGSHTMDFL

SEQ ID NO: 1186004 - protein, 9 aa, Homo Sapiens
IHGPAPAPK

SEQ ID NO: 1186005 - protein, 9 aa, Homo Sapiens
LLFALFQEG

SEQ ID NO: 1186006 - protein, 9 aa, Homo Sapiens
RRQAGAPLG

SEQ ID NO: 1186007 - protein, 9 aa, Homo Sapiens
ASRLRCART

SEQ ID NO: 1186008 - protein, 9 aa, Homo Sapiens
HRAGPALPP

SEQ ID NO: 1186009 - protein, 9 aa, Homo Sapiens
ASQEEQDDE

SEQ ID NO: 1186010 - protein, 9 aa, Homo Sapiens
LSFLPLPWG

SEQ ID NO: 1186011 - protein, 9 aa, Homo Sapiens
LLAVGGASA

SEQ ID NO: 1186012 - protein, 9 aa, Homo Sapiens
WSHCPLLQR

SEQ ID NO: 1186013 - protein, 9 aa, Homo Sapiens
IVNLLKMWQ

SEQ ID NO: 1186014 - protein, 9 aa, Homo Sapiens
GLGPDPPTG

SEQ ID NO: 1186015 - protein, 9 aa, Homo Sapiens
ADSHVFLHH

SEQ ID NO: 1186016 - protein, 9 aa, Homo Sapiens
RGRTRLPTK

SEQ ID NO: 1186017 - protein, 9 aa, Homo Sapiens
TGAGVNLMK

SEQ ID NO: 1186018 - protein, 9 aa, Homo Sapiens
WTLCSSTPT

SEQ ID NO: 1186019 - protein, 9 aa, Homo Sapiens
TDKSHSKPS

SEQ ID NO: 1186020 - protein, 9 aa, Homo Sapiens
GAPRHPHRS

SEQ ID NO: 1186021 - protein, 9 aa, Homo Sapiens
SQGYRRWRG

SEQ ID NO: 1186022 - protein, 9 aa, Homo Sapiens
NAASCACMT

SEQ ID NO: 1186023 - protein, 9 aa, Homo Sapiens
TATAAAAAT

SEQ ID NO: 1186024 - protein, 9 aa, Homo Sapiens
KVLRPLEGA

SEQ ID NO: 1186025 - protein, 9 aa, Homo Sapiens
YLVLERLER

SEQ ID NO: 1186026 - protein, 9 aa, Homo Sapiens
EHVSFCATH

SEQ ID NO: 1186027 - protein, 9 aa, Homo Sapiens
RLQLFIHCP

SEQ ID NO: 1186028 - protein, 9 aa, Homo Sapiens
APPCQSAEC

SEQ ID NO: 1186029 - protein, 9 aa, Homo Sapiens
AVTHTEHAK

SEQ ID NO: 1186030 - protein, 9 aa, Homo Sapiens
FQGPSWCLT

SEQ ID NO: 1186031 - protein, 9 aa, Homo Sapiens
KSCSTHPLR

SEQ ID NO: 1186032 - protein, 9 aa, Homo Sapiens
SARPPSFLP

SEQ ID NO: 1186033 - protein, 9 aa, Homo Sapiens
SISLTKASI

SEQ ID NO: 1186034 - protein, 9 aa, Homo Sapiens
GGCGSTPPP

SEQ ID NO: 1186035 - protein, 9 aa, Homo Sapiens
VYRQQPQQQ

SEQ ID NO: 1186036 - protein, 9 aa, Homo Sapiens
AKAVAWSRL

SEQ ID NO: 1186037 - protein, 9 aa, Homo Sapiens
ACPACPLRA

SEQ ID NO: 1186038 - protein, 9 aa, Homo Sapiens
CIPAPRPVA

SEQ ID NO: 1186039 - protein, 9 aa, Homo Sapiens
ARPSHACRS

SEQ ID NO: 1186040 - protein, 9 aa, Homo Sapiens
VVRTEGSRI

SEQ ID NO: 1186041 - protein, 9 aa, Homo Sapiens
RSSRTWASP

SEQ ID NO: 1186042 - protein, 9 aa, Homo Sapiens
CGQLLAQLG

SEQ ID NO: 1186043 - protein, 9 aa, Homo Sapiens
QRDKQHFTT

SEQ ID NO: 1186044 - protein, 9 aa, Homo Sapiens
KLMAKTIRF

SEQ ID NO: 1186045 - protein, 9 aa, Homo Sapiens
EHDIQADGT

SEQ ID NO: 1186046 - protein, 9 aa, Homo Sapiens
AGRLASSAP

SEQ ID NO: 1186047 - protein, 9 aa, Homo Sapiens
GGGSRRGGG

SEQ ID NO: 1186048 - protein, 9 aa, Homo Sapiens
QDSDLTCLQ

SEQ ID NO: 1186049 - protein, 9 aa, Homo Sapiens
QLPEPILAD

SEQ ID NO: 1186050 - protein, 9 aa, Homo Sapiens
VAVQHLRPG

SEQ ID NO: 1186051 - protein, 9 aa, Homo Sapiens
HSSEQPPAE

SEQ ID NO: 1186052 - protein, 9 aa, Homo Sapiens
GEVHAVVEQ

SEQ ID NO: 1186053 - protein, 9 aa, Homo Sapiens
RARPPQARG

SEQ ID NO: 1186054 - protein, 9 aa, Homo Sapiens
LDRSEESTT

SEQ ID NO: 1186055 - protein, 9 aa, Homo Sapiens
VNPVNSNNV

SEQ ID NO: 1186056 - protein, 9 aa, Homo Sapiens
SIQLSYRKV

SEQ ID NO: 1186057 - protein, 9 aa, Homo Sapiens
ECQTDAFLG

SEQ ID NO: 1186058 - protein, 9 aa, Homo Sapiens
PGGKAAQAR

SEQ ID NO: 1186059 - protein, 9 aa, Homo Sapiens
GQSPAQEIV

SEQ ID NO: 1186060 - protein, 9 aa, Homo Sapiens
LVGHIGRNM

SEQ ID NO: 1186061 - protein, 9 aa, Homo Sapiens
QSGATGTDA

SEQ ID NO: 1186062 - protein, 9 aa, Homo Sapiens
GRSRELRTF

SEQ ID NO: 1186063 - protein, 9 aa, Homo Sapiens
GEKEKKEEG

SEQ ID NO: 1186064 - protein, 9 aa, Homo Sapiens
ASALPSPHK

SEQ ID NO: 1186065 - protein, 9 aa, Homo Sapiens
CWLSCGSAA

SEQ ID NO: 1186066 - protein, 9 aa, Homo Sapiens
CAVNCPSWR

SEQ ID NO: 1186067 - protein, 9 aa, Homo Sapiens
ILHSAISAP

SEQ ID NO: 1186068 - protein, 9 aa, Homo Sapiens
DRRKMRPAH

SEQ ID NO: 1186069 - protein, 9 aa, Homo Sapiens
NYTSSQEKL

SEQ ID NO: 1186070 - protein, 9 aa, Homo Sapiens
MPSLTSTPS

SEQ ID NO: 1186071 - protein, 9 aa, Homo Sapiens
LQMVYPQRN

SEQ ID NO: 1186072 - protein, 9 aa, Homo Sapiens
RGRGPGLFP

SEQ ID NO: 1186073 - protein, 9 aa, Homo Sapiens
SAVGRGPTI

SEQ ID NO: 1186074 - protein, 9 aa, Homo Sapiens
HSPPHRAAP

SEQ ID NO: 1186075 - protein, 9 aa, Homo Sapiens
TEEIASASN

SEQ ID NO: 1186076 - protein, 9 aa, Homo Sapiens
PVPNPPTSS

SEQ ID NO: 1186077 - protein, 9 aa, Homo Sapiens
WAHRAGPAL

SEQ ID NO: 1186078 - protein, 9 aa, Homo Sapiens
VWVSLPLPS

SEQ ID NO: 1186079 - protein, 9 aa, Homo Sapiens
DVQGQAVLL

SEQ ID NO: 1186080 - protein, 9 aa, Homo Sapiens
PHPRTASIT

SEQ ID NO: 1186081 - protein, 9 aa, Homo Sapiens
PRPPCSSTS

SEQ ID NO: 1186082 - protein, 9 aa, Homo Sapiens
RDCTLEYAP

SEQ ID NO: 1186083 - protein, 9 aa, Homo Sapiens
SSVSISFIS

SEQ ID NO: 1186084 - protein, 9 aa, Homo Sapiens
SLALRSRRR

SEQ ID NO: 1186085 - protein, 9 aa, Homo Sapiens
AHDCLTPSW

SEQ ID NO: 1186086 - protein, 9 aa, Homo Sapiens
EHENDDDAN

SEQ ID NO: 1186087 - protein, 9 aa, Homo Sapiens
QESDGQMKG

SEQ ID NO: 1186088 - protein, 9 aa, Homo Sapiens
DSTAAAAAG

SEQ ID NO: 1186089 - protein, 9 aa, Homo Sapiens
AWLTQYYTS

SEQ ID NO: 1186090 - protein, 9 aa, Homo Sapiens
RDRKVHHMH

SEQ ID NO: 1186091 - protein, 9 aa, Homo Sapiens
VPSKPEQEG

SEQ ID NO: 1186092 - protein, 9 aa, Homo Sapiens
TQACCSTKQ

SEQ ID NO: 1186093 - protein, 9 aa, Homo Sapiens
GMPVASTDR

SEQ ID NO: 1186094 - protein, 9 aa, Homo Sapiens
NNVFFSLHA

SEQ ID NO: 1186095 - protein, 9 aa, Homo Sapiens
ALQGARLEQ

SEQ ID NO: 1186096 - protein, 9 aa, Homo Sapiens
PPSFPAMLH

SEQ ID NO: 1186097 - protein, 9 aa, Homo Sapiens
VPSPLTPLS

SEQ ID NO: 1186098 - protein, 9 aa, Homo Sapiens
PVHSSGRLL

SEQ ID NO: 1186099 - protein, 9 aa, Homo Sapiens
PHPPHPHHT

SEQ ID NO: 1186100 - protein, 9 aa, Homo Sapiens
RYVWLRQRL

SEQ ID NO: 1186101 - protein, 9 aa, Homo Sapiens
CPMTTSADP

SEQ ID NO: 1186102 - protein, 9 aa, Homo Sapiens
SLTSTPSLV

SEQ ID NO: 1186103 - protein, 9 aa, Homo Sapiens
FEFQGPSWC

SEQ ID NO: 1186104 - protein, 9 aa, Homo Sapiens
LLVSLAMFR

SEQ ID NO: 1186105 - protein, 9 aa, Homo Sapiens
AHAGAIADV

SEQ ID NO: 1186106 - protein, 9 aa, Homo Sapiens
LLLLASLCT

SEQ ID NO: 1186107 - protein, 9 aa, Homo Sapiens
DDSLSVKMV

SEQ ID NO: 1186108 - protein, 9 aa, Homo Sapiens
RARCCSNRL

SEQ ID NO: 1186109 - protein, 9 aa, Homo Sapiens
TGNMRELIN

SEQ ID NO: 1186110 - protein, 9 aa, Homo Sapiens
PTRELGARW

SEQ ID NO: 1186111 - protein, 9 aa, Homo Sapiens
QWVGMVLLH

SEQ ID NO: 1186112 - protein, 9 aa, Homo Sapiens
LPAQSWCAK

SEQ ID NO: 1186113 - protein, 9 aa, Homo Sapiens
LLKSTHLLL

SEQ ID NO: 1186114 - protein, 9 aa, Homo Sapiens
VVELVQELQ

SEQ ID NO: 1186115 - protein, 9 aa, Homo Sapiens
NLQHVDSLR

SEQ ID NO: 1186116 - protein, 9 aa, Homo Sapiens
KLHLLILLV

SEQ ID NO: 1186117 - protein, 9 aa, Homo Sapiens
ESRQGWLLC

SEQ ID NO: 1186118 - protein, 9 aa, Homo Sapiens
SQQPGALRQ

SEQ ID NO: 1186119 - protein, 9 aa, Homo Sapiens
PRRALGFRS

SEQ ID NO: 1186120 - protein, 9 aa, Homo Sapiens
PHHTQGPPH

SEQ ID NO: 1186121 - protein, 9 aa, Homo Sapiens
IYIIILSTL

SEQ ID NO: 1186122 - protein, 9 aa, Homo Sapiens
RQTPGDPAP

SEQ ID NO: 1186123 - protein, 9 aa, Homo Sapiens
GALNIKCRI

SEQ ID NO: 1186124 - protein, 9 aa, Homo Sapiens
ASFLMALQC

SEQ ID NO: 1186125 - protein, 9 aa, Homo Sapiens
RRNILMIAQ

SEQ ID NO: 1186126 - protein, 9 aa, Homo Sapiens
FCRVLSLLK

SEQ ID NO: 1186127 - protein, 9 aa, Homo Sapiens
CHKCYSSVD

SEQ ID NO: 1186128 - protein, 9 aa, Homo Sapiens
ETMMLSLLE

SEQ ID NO: 1186129 - protein, 9 aa, Homo Sapiens
CRRTSSART

SEQ ID NO: 1186130 - protein, 9 aa, Homo Sapiens
GIEKDHLWT

SEQ ID NO: 1186131 - protein, 9 aa, Homo Sapiens
AVDGHEQQL

SEQ ID NO: 1186132 - protein, 9 aa, Homo Sapiens
LCGRGARPE

SEQ ID NO: 1186133 - protein, 9 aa, Homo Sapiens
QFLRPASSG

SEQ ID NO: 1186134 - protein, 9 aa, Homo Sapiens
LVCPVTQDH

SEQ ID NO: 1186135 - protein, 9 aa, Homo Sapiens
QQGKQEENN

SEQ ID NO: 1186136 - protein, 9 aa, Homo Sapiens
EGLGPDPPT

SEQ ID NO: 1186137 - protein, 9 aa, Homo Sapiens
VGHKAVYRI

SEQ ID NO: 1186138 - protein, 9 aa, Homo Sapiens
CCSSTNSIS

SEQ ID NO: 1186139 - protein, 9 aa, Homo Sapiens
FGIAFLLRR

SEQ ID NO: 1186140 - protein, 9 aa, Homo Sapiens
SARSSARTT

SEQ ID NO: 1186141 - protein, 9 aa, Homo Sapiens
TEASRSESR

SEQ ID NO: 1186142 - protein, 9 aa, Homo Sapiens
TSCLERTAW

SEQ ID NO: 1186143 - protein, 9 aa, Homo Sapiens
LPSDFQECV

SEQ ID NO: 1186144 - protein, 9 aa, Homo Sapiens
GRGARPNHV

SEQ ID NO: 1186145 - protein, 9 aa, Homo Sapiens
KASMTKKSI

SEQ ID NO: 1186146 - protein, 9 aa, Homo Sapiens
APQGCRCWK

SEQ ID NO: 1186147 - protein, 9 aa, Homo Sapiens
VAWRASFLM

SEQ ID NO: 1186148 - protein, 9 aa, Homo Sapiens
YCPEYLINL

SEQ ID NO: 1186149 - protein, 9 aa, Homo Sapiens
QMVYPQRNL

SEQ ID NO: 1186150 - protein, 9 aa, Homo Sapiens
KKLENNMCG

SEQ ID NO: 1186151 - protein, 9 aa, Homo Sapiens
VNLQHVDSL

SEQ ID NO: 1186152 - protein, 9 aa, Homo Sapiens
TTLDRSEES

SEQ ID NO: 1186153 - protein, 9 aa, Homo Sapiens
VPPVHHPQP

SEQ ID NO: 1186154 - protein, 9 aa, Homo Sapiens
WASPCSLSA

SEQ ID NO: 1186155 - protein, 9 aa, Homo Sapiens
GFGKNGFSQ

SEQ ID NO: 1186156 - protein, 9 aa, Homo Sapiens
EHPFACDWQ

SEQ ID NO: 1186157 - protein, 9 aa, Homo Sapiens
LKYSKAEYA

SEQ ID NO: 1186158 - protein, 9 aa, Homo Sapiens
AWSRLLLPR

SEQ ID NO: 1186159 - protein, 9 aa, Homo Sapiens
HPNYKKMES

SEQ ID NO: 1186160 - protein, 9 aa, Homo Sapiens
SIFLGALEA

SEQ ID NO: 1186161 - protein, 9 aa, Homo Sapiens
FGSGSAVGR

SEQ ID NO: 1186162 - protein, 9 aa, Homo Sapiens
STPTCLRTC

SEQ ID NO: 1186163 - protein, 9 aa, Homo Sapiens
EPSRLGGGR

SEQ ID NO: 1186164 - protein, 9 aa, Homo Sapiens
RAEGIPCIY

SEQ ID NO: 1186165 - protein, 9 aa, Homo Sapiens
QQLWLALWA

SEQ ID NO: 1186166 - protein, 9 aa, Homo Sapiens
GHLLVQDVV

SEQ ID NO: 1186167 - protein, 9 aa, Homo Sapiens
QGLFHKLPS

SEQ ID NO: 1186168 - protein, 9 aa, Homo Sapiens
TTEMLEEWR

SEQ ID NO: 1186169 - protein, 9 aa, Homo Sapiens
LPASHPLFG

SEQ ID NO: 1186170 - protein, 9 aa, Homo Sapiens
LQESDGQMK

SEQ ID NO: 1186171 - protein, 9 aa, Homo Sapiens
GRLLPPLLS

SEQ ID NO: 1186172 - protein, 9 aa, Homo Sapiens
RKKLKLRRN

SEQ ID NO: 1186173 - protein, 9 aa, Homo Sapiens
SSGSRSLWP

SEQ ID NO: 1186174 - protein, 9 aa, Homo Sapiens
FKRRLCSHT

SEQ ID NO: 1186175 - protein, 9 aa, Homo Sapiens
AGSVSGSGS

SEQ ID NO: 1186176 - protein, 9 aa, Homo Sapiens
ILVNGRSRE

SEQ ID NO: 1186177 - protein, 9 aa, Homo Sapiens
PSARSSART

SEQ ID NO: 1186178 - protein, 9 aa, Homo Sapiens
PIAQGDHQS

SEQ ID NO: 1186179 - protein, 9 aa, Homo Sapiens
DNTNQPNFM

SEQ ID NO: 1186180 - protein, 9 aa, Homo Sapiens
YLCEDGCQT

SEQ ID NO: 1186181 - protein, 9 aa, Homo Sapiens
CCGVPDSGG

SEQ ID NO: 1186182 - protein, 9 aa, Homo Sapiens
LHRWSWRMG

SEQ ID NO: 1186183 - protein, 9 aa, Homo Sapiens
LTRERAAAA

SEQ ID NO: 1186184 - protein, 9 aa, Homo Sapiens
THRGEQPPD

SEQ ID NO: 1186185 - protein, 9 aa, Homo Sapiens
GRQCIEHYH

SEQ ID NO: 1186186 - protein, 9 aa, Homo Sapiens
LSGSMVLGC

SEQ ID NO: 1186187 - protein, 9 aa, Homo Sapiens
SARDVHVVA

SEQ ID NO: 1186188 - protein, 9 aa, Homo Sapiens
LPGAELQLP

SEQ ID NO: 1186189 - protein, 9 aa, Homo Sapiens
TVNLIVVLV

SEQ ID NO: 1186190 - protein, 9 aa, Homo Sapiens
RALAPALCR

SEQ ID NO: 1186191 - protein, 9 aa, Homo Sapiens
AGSISCSVR

SEQ ID NO: 1186192 - protein, 9 aa, Homo Sapiens
GQKCMVSIN

SEQ ID NO: 1186193 - protein, 9 aa, Homo Sapiens
KAPGVCRVD

SEQ ID NO: 1186194 - protein, 9 aa, Homo Sapiens
SWLLIFNIL

SEQ ID NO: 1186195 - protein, 9 aa, Homo Sapiens
TLCFATGAG

SEQ ID NO: 1186196 - protein, 9 aa, Homo Sapiens
LVGNTIIIL

SEQ ID NO: 1186197 - protein, 9 aa, Homo Sapiens
SSVRSWCCR

SEQ ID NO: 1186198 - protein, 9 aa, Homo Sapiens
LNRVHSAIW

SEQ ID NO: 1186199 - protein, 9 aa, Homo Sapiens
MWSFCFSPL

SEQ ID NO: 1186200 - protein, 9 aa, Homo Sapiens
LQDSYITST

SEQ ID NO: 1186201 - protein, 9 aa, Homo Sapiens
ALDRALRCI

SEQ ID NO: 1186202 - protein, 9 aa, Homo Sapiens
RGELSMCDS

SEQ ID NO: 1186203 - protein, 9 aa, Homo Sapiens
RARPGQLRG

SEQ ID NO: 1186204 - protein, 9 aa, Homo Sapiens
KNGFSQSRS

SEQ ID NO: 1186205 - protein, 9 aa, Homo Sapiens
SSCQSGFGG

SEQ ID NO: 1186206 - protein, 9 aa, Homo Sapiens
VSLSGSMVL

SEQ ID NO: 1186207 - protein, 9 aa, Homo Sapiens
DTSCGQVII

SEQ ID NO: 1186208 - protein, 9 aa, Homo Sapiens
TLVRARRAC

SEQ ID NO: 1186209 - protein, 9 aa, Homo Sapiens
AFEIKKACI

SEQ ID NO: 1186210 - protein, 9 aa, Homo Sapiens
EGEVHAVVE

SEQ ID NO: 1186211 - protein, 9 aa, Homo Sapiens
GFKRRLCSH

SEQ ID NO: 1186212 - protein, 9 aa, Homo Sapiens
DKSNLLNHQ

SEQ ID NO: 1186213 - protein, 9 aa, Homo Sapiens
TMMMVDPLV

SEQ ID NO: 1186214 - protein, 9 aa, Homo Sapiens
KKVVVVKNG

SEQ ID NO: 1186215 - protein, 9 aa, Homo Sapiens
SPPMMRNST

SEQ ID NO: 1186216 - protein, 9 aa, Homo Sapiens
DAAQAAIAF

SEQ ID NO: 1186217 - protein, 9 aa, Homo Sapiens
PWQWRGMGC

SEQ ID NO: 1186218 - protein, 9 aa, Homo Sapiens
ASIARNLQA

SEQ ID NO: 1186219 - protein, 9 aa, Homo Sapiens
TLLFLIKSL

SEQ ID NO: 1186220 - protein, 9 aa, Homo Sapiens
AMAGLQLHQ

SEQ ID NO: 1186221 - protein, 9 aa, Homo Sapiens
NLLASSDHE

SEQ ID NO: 1186222 - protein, 9 aa, Homo Sapiens
AVGPPSPLL

SEQ ID NO: 1186223 - protein, 9 aa, Homo Sapiens
SPTHSTHCS

SEQ ID NO: 1186224 - protein, 9 aa, Homo Sapiens
RPCQLHART

SEQ ID NO: 1186225 - protein, 9 aa, Homo Sapiens
SMHGDGVLF

SEQ ID NO: 1186226 - protein, 9 aa, Homo Sapiens
VGQLFAVWK

SEQ ID NO: 1186227 - protein, 9 aa, Homo Sapiens
YLGSVRERQ

SEQ ID NO: 1186228 - protein, 9 aa, Homo Sapiens
TRLPRRSCC

SEQ ID NO: 1186229 - protein, 9 aa, Homo Sapiens
HSSLDPLAF

SEQ ID NO: 1186230 - protein, 9 aa, Homo Sapiens
HDQAIVRVA

SEQ ID NO: 1186231 - protein, 9 aa, Homo Sapiens
KGQPGFKSN

SEQ ID NO: 1186232 - protein, 9 aa, Homo Sapiens
GASRGTGGA

SEQ ID NO: 1186233 - protein, 9 aa, Homo Sapiens
PRAGPCLPS

SEQ ID NO: 1186234 - protein, 9 aa, Homo Sapiens
PELHGDAEV

SEQ ID NO: 1186235 - protein, 9 aa, Homo Sapiens
HSCFPSGDG

SEQ ID NO: 1186236 - protein, 9 aa, Homo Sapiens
EASAEECQL

SEQ ID NO: 1186237 - protein, 9 aa, Homo Sapiens
LTSGLPHGL

SEQ ID NO: 1186238 - protein, 9 aa, Homo Sapiens
SKLKNGFTF

SEQ ID NO: 1186239 - protein, 9 aa, Homo Sapiens
DVEYGTIKG

SEQ ID NO: 1186240 - protein, 9 aa, Homo Sapiens
CSGLVRDCG

SEQ ID NO: 1186241 - protein, 9 aa, Homo Sapiens
LMNTMGYNT

SEQ ID NO: 1186242 - protein, 9 aa, Homo Sapiens
ASSAAQLPG

SEQ ID NO: 1186243 - protein, 9 aa, Homo Sapiens
FFPDLMNML

SEQ ID NO: 1186244 - protein, 9 aa, Homo Sapiens
LAQLQYRPF

SEQ ID NO: 1186245 - protein, 9 aa, Homo Sapiens
VSNWHWTER

SEQ ID NO: 1186246 - protein, 9 aa, Homo Sapiens
CKRICRGAG

SEQ ID NO: 1186247 - protein, 9 aa, Homo Sapiens
DPRRRPSYR

SEQ ID NO: 1186248 - protein, 9 aa, Homo Sapiens
DVGLAGDTN

SEQ ID NO: 1186249 - protein, 9 aa, Homo Sapiens
DPMTLLARL

SEQ ID NO: 1186250 - protein, 9 aa, Homo Sapiens
ASSSGQHCS

SEQ ID NO: 1186251 - protein, 9 aa, Homo Sapiens
PVNSDVGML

SEQ ID NO: 1186252 - protein, 9 aa, Homo Sapiens
ARKCLTLAN

SEQ ID NO: 1186253 - protein, 9 aa, Homo Sapiens
GSQVSAPTC

SEQ ID NO: 1186254 - protein, 9 aa, Homo Sapiens
DLEEEEVSN

SEQ ID NO: 1186255 - protein, 9 aa, Homo Sapiens
LTRLCVALT

SEQ ID NO: 1186256 - protein, 9 aa, Homo Sapiens
VGYIRDLFI

SEQ ID NO: 1186257 - protein, 9 aa, Homo Sapiens
DGSFSDNFY

SEQ ID NO: 1186258 - protein, 9 aa, Homo Sapiens
KKFKSSFVN

SEQ ID NO: 1186259 - protein, 9 aa, Homo Sapiens
GAQQPGHIH

SEQ ID NO: 1186260 - protein, 9 aa, Homo Sapiens
LVCTCMCTH

SEQ ID NO: 1186261 - protein, 9 aa, Homo Sapiens
GVPCSMRTG

SEQ ID NO: 1186262 - protein, 9 aa, Homo Sapiens
KKSITTERY

SEQ ID NO: 1186263 - protein, 9 aa, Homo Sapiens
ITLEERRPI

SEQ ID NO: 1186264 - protein, 9 aa, Homo Sapiens
TFHGDYFAK

SEQ ID NO: 1186265 - protein, 9 aa, Homo Sapiens
GPSTGAPAR

SEQ ID NO: 1186266 - protein, 9 aa, Homo Sapiens
DVHVVAILG

SEQ ID NO: 1186267 - protein, 9 aa, Homo Sapiens
YKGEDIFWT

SEQ ID NO: 1186268 - protein, 9 aa, Homo Sapiens
LEHSIQMLT

SEQ ID NO: 1186269 - protein, 9 aa, Homo Sapiens
HTCWQRRTA

SEQ ID NO: 1186270 - protein, 9 aa, Homo Sapiens
KTPVPGKAH

SEQ ID NO: 1186271 - protein, 9 aa, Homo Sapiens
TLLARLHLL

SEQ ID NO: 1186272 - protein, 9 aa, Homo Sapiens
AAVLVPSGE

SEQ ID NO: 1186273 - protein, 9 aa, Homo Sapiens
AAGGSGGHR

SEQ ID NO: 1186274 - protein, 9 aa, Homo Sapiens
LFFNPIRAV

SEQ ID NO: 1186275 - protein, 9 aa, Homo Sapiens
KYRRKGKKA

SEQ ID NO: 1186276 - protein, 9 aa, Homo Sapiens
MRLSRTDQK

SEQ ID NO: 1186277 - protein, 9 aa, Homo Sapiens
PVHHPQPKS

SEQ ID NO: 1186278 - protein, 9 aa, Homo Sapiens
TDELSGLDE

SEQ ID NO: 1186279 - protein, 9 aa, Homo Sapiens
EQPPDQWCP

SEQ ID NO: 1186280 - protein, 9 aa, Homo Sapiens
ELVLGAGLV

SEQ ID NO: 1186281 - protein, 9 aa, Homo Sapiens
TVDVYYAVE

SEQ ID NO: 1186282 - protein, 9 aa, Homo Sapiens
HDSARVFWE

SEQ ID NO: 1186283 - protein, 9 aa, Homo Sapiens
RVHSAIWNG

SEQ ID NO: 1186284 - protein, 9 aa, Homo Sapiens
RARRTWPRS

SEQ ID NO: 1186285 - protein, 9 aa, Homo Sapiens
INPTLTRLF

SEQ ID NO: 1186286 - protein, 9 aa, Homo Sapiens
LNWNKDDQE

SEQ ID NO: 1186287 - protein, 9 aa, Homo Sapiens
DLGNGHNKL

SEQ ID NO: 1186288 - protein, 9 aa, Homo Sapiens
KEAAGTTTA

SEQ ID NO: 1186289 - protein, 9 aa, Homo Sapiens
LYCDYHLAW

SEQ ID NO: 1186290 - protein, 9 aa, Homo Sapiens
CGGGCEYLE

SEQ ID NO: 1186291 - protein, 9 aa, Homo Sapiens
DQPAGGELP

SEQ ID NO: 1186292 - protein, 9 aa, Homo Sapiens
PAPLSQQEW

SEQ ID NO: 1186293 - protein, 9 aa, Homo Sapiens
PGPRHPLLI

SEQ ID NO: 1186294 - protein, 9 aa, Homo Sapiens
CPRSAWKRR

SEQ ID NO: 1186295 - protein, 9 aa, Homo Sapiens
GCDGGNGPE

SEQ ID NO: 1186296 - protein, 9 aa, Homo Sapiens
KALARRLQK

SEQ ID NO: 1186297 - protein, 9 aa, Homo Sapiens
IEKDHLWTI

SEQ ID NO: 1186298 - protein, 9 aa, Homo Sapiens
GDELHGGKR

SEQ ID NO: 1186299 - protein, 9 aa, Homo Sapiens
GMIRDNGVT

SEQ ID NO: 1186300 - protein, 9 aa, Homo Sapiens
RHQNGTEDE

SEQ ID NO: 1186301 - protein, 9 aa, Homo Sapiens
TTVAGPRTG

SEQ ID NO: 1186302 - protein, 9 aa, Homo Sapiens
LGIFGIEKD

SEQ ID NO: 1186303 - protein, 9 aa, Homo Sapiens
LDNSYYEQC

SEQ ID NO: 1186304 - protein, 9 aa, Homo Sapiens
TCLWVFLWR

SEQ ID NO: 1186305 - protein, 9 aa, Homo Sapiens
VPLAFGYFG

SEQ ID NO: 1186306 - protein, 9 aa, Homo Sapiens
GSGLPARRG

SEQ ID NO: 1186307 - protein, 9 aa, Homo Sapiens
EKAKGPGKY

SEQ ID NO: 1186308 - protein, 9 aa, Homo Sapiens
VHSAIWNGN

SEQ ID NO: 1186309 - protein, 9 aa, Homo Sapiens
RRSYPEFQS

SEQ ID NO: 1186310 - protein, 9 aa, Homo Sapiens
ESAEPLGPV

SEQ ID NO: 1186311 - protein, 9 aa, Homo Sapiens
KKTTSQSQL

SEQ ID NO: 1186312 - protein, 9 aa, Homo Sapiens
LDEFLMGGC

SEQ ID NO: 1186313 - protein, 9 aa, Homo Sapiens
DPLCVLAPV

SEQ ID NO: 1186314 - protein, 9 aa, Homo Sapiens
TLLDRDALK

SEQ ID NO: 1186315 - protein, 9 aa, Homo Sapiens
FRRWKVADL

SEQ ID NO: 1186316 - protein, 9 aa, Homo Sapiens
GFTSSLPCL

SEQ ID NO: 1186317 - protein, 9 aa, Homo Sapiens
SCFILCSTH

SEQ ID NO: 1186318 - protein, 9 aa, Homo Sapiens
AHGCAMRWT

SEQ ID NO: 1186319 - protein, 9 aa, Homo Sapiens
ALQGLACRR

SEQ ID NO: 1186320 - protein, 9 aa, Homo Sapiens
DGQMKGAQS

SEQ ID NO: 1186321 - protein, 9 aa, Homo Sapiens
AFDRYTDAG

SEQ ID NO: 1186322 - protein, 9 aa, Homo Sapiens
QKMNMWFKH

SEQ ID NO: 1186323 - protein, 9 aa, Homo Sapiens
TLVWERGVL

SEQ ID NO: 1186324 - protein, 9 aa, Homo Sapiens
LYTDIISIF

SEQ ID NO: 1186325 - protein, 9 aa, Homo Sapiens
IAQKKGFTS

SEQ ID NO: 1186326 - protein, 9 aa, Homo Sapiens
PACPLRASR

SEQ ID NO: 1186327 - protein, 9 aa, Homo Sapiens
PTGGALQGL

SEQ ID NO: 1186328 - protein, 9 aa, Homo Sapiens
FVMASFYKH

SEQ ID NO: 1186329 - protein, 9 aa, Homo Sapiens
WTRLPRRSC

SEQ ID NO: 1186330 - protein, 9 aa, Homo Sapiens
VHRPPDADP

SEQ ID NO: 1186331 - protein, 9 aa, Homo Sapiens
RSSRRQTRP

SEQ ID NO: 1186332 - protein, 9 aa, Homo Sapiens
RQHQALEEE

SEQ ID NO: 1186333 - protein, 9 aa, Homo Sapiens
PAAPAARSP

SEQ ID NO: 1186334 - protein, 9 aa, Homo Sapiens
PIRAVPLAF

SEQ ID NO: 1186335 - protein, 9 aa, Homo Sapiens
MVVCSCGCH

SEQ ID NO: 1186336 - protein, 9 aa, Homo Sapiens
CICSSIGRP

SEQ ID NO: 1186337 - protein, 9 aa, Homo Sapiens
AEWQHSPNG

SEQ ID NO: 1186338 - protein, 9 aa, Homo Sapiens
PGRRQYILK

SEQ ID NO: 1186339 - protein, 9 aa, Homo Sapiens
KAHAQKPQQ

SEQ ID NO: 1186340 - protein, 9 aa, Homo Sapiens
LFLLVSLAM

SEQ ID NO: 1186341 - protein, 9 aa, Homo Sapiens
LAYAGFHLT

SEQ ID NO: 1186342 - protein, 9 aa, Homo Sapiens
KVVKVWMRV

SEQ ID NO: 1186343 - protein, 9 aa, Homo Sapiens
SSADLKAPH

SEQ ID NO: 1186344 - protein, 9 aa, Homo Sapiens
EPPLPTASG

SEQ ID NO: 1186345 - protein, 9 aa, Homo Sapiens
KMAGRKRRR

SEQ ID NO: 1186346 - protein, 9 aa, Homo Sapiens
WLQWPVLQR

SEQ ID NO: 1186347 - protein, 9 aa, Homo Sapiens
LAAVPVQPH

SEQ ID NO: 1186348 - protein, 9 aa, Homo Sapiens
MPCWTRPSF

SEQ ID NO: 1186349 - protein, 9 aa, Homo Sapiens
SEKVGVAEG

SEQ ID NO: 1186350 - protein, 9 aa, Homo Sapiens
PLQRSGSLL

SEQ ID NO: 1186351 - protein, 9 aa, Homo Sapiens
GRSNFRKVR

SEQ ID NO: 1186352 - protein, 9 aa, Homo Sapiens
GQALDRALR

SEQ ID NO: 1186353 - protein, 9 aa, Homo Sapiens
CEDLTDLTV

SEQ ID NO: 1186354 - protein, 9 aa, Homo Sapiens
QNYLPPVYS

SEQ ID NO: 1186355 - protein, 9 aa, Homo Sapiens
GTTRNCSST

SEQ ID NO: 1186356 - protein, 9 aa, Homo Sapiens
ARAGARGGA

SEQ ID NO: 1186357 - protein, 9 aa, Homo Sapiens
FVDQMWYEW

SEQ ID NO: 1186358 - protein, 9 aa, Homo Sapiens
RFEDTGFSN

SEQ ID NO: 1186359 - protein, 9 aa, Homo Sapiens
YGVKVILQA

SEQ ID NO: 1186360 - protein, 9 aa, Homo Sapiens
ESIPSCSSP

SEQ ID NO: 1186361 - protein, 9 aa, Homo Sapiens
PAEAPLPAF

SEQ ID NO: 1186362 - protein, 9 aa, Homo Sapiens
AALPWLSRR

SEQ ID NO: 1186363 - protein, 9 aa, Homo Sapiens
GCEAQEAVH

SEQ ID NO: 1186364 - protein, 9 aa, Homo Sapiens
NEPQRPPRS

SEQ ID NO: 1186365 - protein, 9 aa, Homo Sapiens
WHTRGCRTG

SEQ ID NO: 1186366 - protein, 9 aa, Homo Sapiens
HQITVQEQL

SEQ ID NO: 1186367 - protein, 9 aa, Homo Sapiens
DQQIRTPSV

SEQ ID NO: 1186368 - protein, 9 aa, Homo Sapiens
YTCWASQSI

SEQ ID NO: 1186369 - protein, 9 aa, Homo Sapiens
INNQKRFHQ

SEQ ID NO: 1186370 - protein, 9 aa, Homo Sapiens
IFGIEKDHL

SEQ ID NO: 1186371 - protein, 9 aa, Homo Sapiens
WWHPGRRRA

SEQ ID NO: 1186372 - protein, 9 aa, Homo Sapiens
ELSLPALKQ

SEQ ID NO: 1186373 - protein, 9 aa, Homo Sapiens
HHSWTSGVG

SEQ ID NO: 1186374 - protein, 9 aa, Homo Sapiens
TCASPRGPP

SEQ ID NO: 1186375 - protein, 9 aa, Homo Sapiens
RVKYTKEVI

SEQ ID NO: 1186376 - protein, 9 aa, Homo Sapiens
NQNNNFQTF

SEQ ID NO: 1186377 - protein, 9 aa, Homo Sapiens
PPGCDGGNG

SEQ ID NO: 1186378 - protein, 9 aa, Homo Sapiens
WKKFKSSFV

SEQ ID NO: 1186379 - protein, 9 aa, Homo Sapiens
AVFMPAMQF

SEQ ID NO: 1186380 - protein, 9 aa, Homo Sapiens
WSSRTLCSP

SEQ ID NO: 1186381 - protein, 9 aa, Homo Sapiens
LQPHLRLRL

SEQ ID NO: 1186382 - protein, 9 aa, Homo Sapiens
PTASGLKNI

SEQ ID NO: 1186383 - protein, 9 aa, Homo Sapiens
CKSSKSNSK

SEQ ID NO: 1186384 - protein, 9 aa, Homo Sapiens
VPVAPPPQP

SEQ ID NO: 1186385 - protein, 9 aa, Homo Sapiens
RGEIFRLLI

SEQ ID NO: 1186386 - protein, 9 aa, Homo Sapiens
EKGVEVIPE

SEQ ID NO: 1186387 - protein, 9 aa, Homo Sapiens
SARTCRALA

SEQ ID NO: 1186388 - protein, 9 aa, Homo Sapiens
RCPVGGPTM

SEQ ID NO: 1186389 - protein, 9 aa, Homo Sapiens
THTSEFKGA

SEQ ID NO: 1186390 - protein, 9 aa, Homo Sapiens
HHLPRPIQG

SEQ ID NO: 1186391 - protein, 9 aa, Homo Sapiens
RLEHSIQML

SEQ ID NO: 1186392 - protein, 9 aa, Homo Sapiens
AALVLRPPT

SEQ ID NO: 1186393 - protein, 9 aa, Homo Sapiens
SVYFRSMEG

SEQ ID NO: 1186394 - protein, 9 aa, Homo Sapiens
NGCWGWQQS

SEQ ID NO: 1186395 - protein, 9 aa, Homo Sapiens
FASPNQNSM

SEQ ID NO: 1186396 - protein, 9 aa, Homo Sapiens
LWLSHRLRL

SEQ ID NO: 1186397 - protein, 9 aa, Homo Sapiens
QIDKVSEKS

SEQ ID NO: 1186398 - protein, 9 aa, Homo Sapiens
GRSSARSWW

SEQ ID NO: 1186399 - protein, 9 aa, Homo Sapiens
GPLPASHPL

SEQ ID NO: 1186400 - protein, 9 aa, Homo Sapiens
ETEESIPSC

SEQ ID NO: 1186401 - protein, 9 aa, Homo Sapiens
TGPPWQWRG

SEQ ID NO: 1186402 - protein, 9 aa, Homo Sapiens
ARTKMAGGL

SEQ ID NO: 1186403 - protein, 9 aa, Homo Sapiens
LVPAVDGHE

SEQ ID NO: 1186404 - protein, 9 aa, Homo Sapiens
AEQAVFLDF

SEQ ID NO: 1186405 - protein, 9 aa, Homo Sapiens
RADATNVSN

SEQ ID NO: 1186406 - protein, 9 aa, Homo Sapiens
SRRAQRRCQ

SEQ ID NO: 1186407 - protein, 9 aa, Homo Sapiens
LLSPYSPIL

SEQ ID NO: 1186408 - protein, 9 aa, Homo Sapiens
LTTTSRKSR

SEQ ID NO: 1186409 - protein, 9 aa, Homo Sapiens
TSVPNEALG

SEQ ID NO: 1186410 - protein, 9 aa, Homo Sapiens
QLKGSSASC

SEQ ID NO: 1186411 - protein, 9 aa, Homo Sapiens
QAAQDGRVD

SEQ ID NO: 1186412 - protein, 9 aa, Homo Sapiens
FTVPGPIAC

SEQ ID NO: 1186413 - protein, 9 aa, Homo Sapiens
WRGRGPGLF

SEQ ID NO: 1186414 - protein, 9 aa, Homo Sapiens
ILCHPDKVV

SEQ ID NO: 1186415 - protein, 9 aa, Homo Sapiens
AMTLGLWSG

SEQ ID NO: 1186416 - protein, 9 aa, Homo Sapiens
GNNDPSWNH

SEQ ID NO: 1186417 - protein, 9 aa, Homo Sapiens
IAARGLCSA

SEQ ID NO: 1186418 - protein, 9 aa, Homo Sapiens
LYGHLGLPL

SEQ ID NO: 1186419 - protein, 9 aa, Homo Sapiens
KDWPSAICR

SEQ ID NO: 1186420 - protein, 9 aa, Homo Sapiens
WRRSLPLRQ

SEQ ID NO: 1186421 - protein, 9 aa, Homo Sapiens
ISLLAAAGG

SEQ ID NO: 1186422 - protein, 9 aa, Homo Sapiens
LVRHQRIHM

SEQ ID NO: 1186423 - protein, 9 aa, Homo Sapiens
NLELKKVVK

SEQ ID NO: 1186424 - protein, 9 aa, Homo Sapiens
VVREENKVC

SEQ ID NO: 1186425 - protein, 9 aa, Homo Sapiens
TSPAQRYID

SEQ ID NO: 1186426 - protein, 9 aa, Homo Sapiens
GESGSSQAG

SEQ ID NO: 1186427 - protein, 9 aa, Homo Sapiens
PEPTDEGWE

SEQ ID NO: 1186428 - protein, 9 aa, Homo Sapiens
VLHKLHLTL

SEQ ID NO: 1186429 - protein, 9 aa, Homo Sapiens
VHAAGHVHG

SEQ ID NO: 1186430 - protein, 9 aa, Homo Sapiens
RILLQRNLL

SEQ ID NO: 1186431 - protein, 9 aa, Homo Sapiens
YQGAAVACP

SEQ ID NO: 1186432 - protein, 9 aa, Homo Sapiens
RRGELSMCD

SEQ ID NO: 1186433 - protein, 9 aa, Homo Sapiens
SPDYKDNYG

SEQ ID NO: 1186434 - protein, 9 aa, Homo Sapiens
NHVNSVRRK

SEQ ID NO: 1186435 - protein, 9 aa, Homo Sapiens
PSRLGGGRR

SEQ ID NO: 1186436 - protein, 9 aa, Homo Sapiens
GHSHGHGHT

SEQ ID NO: 1186437 - protein, 9 aa, Homo Sapiens
GKNWEKLEN

SEQ ID NO: 1186438 - protein, 9 aa, Homo Sapiens
PWIKKSKEA

SEQ ID NO: 1186439 - protein, 9 aa, Homo Sapiens
PFPSALGPW

SEQ ID NO: 1186440 - protein, 9 aa, Homo Sapiens
YYPGLSRPA

SEQ ID NO: 1186441 - protein, 9 aa, Homo Sapiens
VSIFLYGHL

SEQ ID NO: 1186442 - protein, 9 aa, Homo Sapiens
LPLHTQSLV

SEQ ID NO: 1186443 - protein, 9 aa, Homo Sapiens
PAYPYPWPP

SEQ ID NO: 1186444 - protein, 9 aa, Homo Sapiens
DGLMVIVTA

SEQ ID NO: 1186445 - protein, 9 aa, Homo Sapiens
CSRGATSRG

SEQ ID NO: 1186446 - protein, 9 aa, Homo Sapiens
FPDTDYKSV

SEQ ID NO: 1186447 - protein, 9 aa, Homo Sapiens
RGRRTQKKN

SEQ ID NO: 1186448 - protein, 9 aa, Homo Sapiens
GAGRLASSA

SEQ ID NO: 1186449 - protein, 9 aa, Homo Sapiens
TGPARCCRW

SEQ ID NO: 1186450 - protein, 9 aa, Homo Sapiens
VAEGTKLDD

SEQ ID NO: 1186451 - protein, 9 aa, Homo Sapiens
NETAEKIWE

SEQ ID NO: 1186452 - protein, 9 aa, Homo Sapiens
RVNAVASST

SEQ ID NO: 1186453 - protein, 9 aa, Homo Sapiens
VRGKCIDVD

SEQ ID NO: 1186454 - protein, 9 aa, Homo Sapiens
LQVIQCVFH

SEQ ID NO: 1186455 - protein, 9 aa, Homo Sapiens
ETQMPLQQT

SEQ ID NO: 1186456 - protein, 9 aa, Homo Sapiens
STIDYVDDG

SEQ ID NO: 1186457 - protein, 9 aa, Homo Sapiens
QSAECQPHC

SEQ ID NO: 1186458 - protein, 9 aa, Homo Sapiens
HGLHVALEA

SEQ ID NO: 1186459 - protein, 9 aa, Homo Sapiens
WHLVEIAPK

SEQ ID NO: 1186460 - protein, 9 aa, Homo Sapiens
PMFDLSLNF

SEQ ID NO: 1186461 - protein, 9 aa, Homo Sapiens
GATRATPGA

SEQ ID NO: 1186462 - protein, 9 aa, Homo Sapiens
LLNMLSEPN

SEQ ID NO: 1186463 - protein, 9 aa, Homo Sapiens
IPASTGAVK

SEQ ID NO: 1186464 - protein, 9 aa, Homo Sapiens
KTFALQQRQ

SEQ ID NO: 1186465 - protein, 9 aa, Homo Sapiens
GLGAAPLPP

SEQ ID NO: 1186466 - protein, 9 aa, Homo Sapiens
VIYWPHPSA

SEQ ID NO: 1186467 - protein, 9 aa, Homo Sapiens
RWRGRGQHR

SEQ ID NO: 1186468 - protein, 9 aa, Homo Sapiens
EENIKIEEE

SEQ ID NO: 1186469 - protein, 9 aa, Homo Sapiens
EIVFLACSC

SEQ ID NO: 1186470 - protein, 9 aa, Homo Sapiens
NGFTFRKED

SEQ ID NO: 1186471 - protein, 9 aa, Homo Sapiens
GVCCEPATC

SEQ ID NO: 1186472 - protein, 9 aa, Homo Sapiens
WSRLLLPRK

SEQ ID NO: 1186473 - protein, 9 aa, Homo Sapiens
DVLHLVHQL

SEQ ID NO: 1186474 - protein, 9 aa, Homo Sapiens
PRACARRCA

SEQ ID NO: 1186475 - protein, 9 aa, Homo Sapiens
RSSARSWWS

SEQ ID NO: 1186476 - protein, 9 aa, Homo Sapiens
MQIDKVSEK

SEQ ID NO: 1186477 - protein, 9 aa, Homo Sapiens
VFLYMWSFC

SEQ ID NO: 1186478 - protein, 9 aa, Homo Sapiens
GDALAQFGE

SEQ ID NO: 1186479 - protein, 9 aa, Homo Sapiens
VPTAASPCW

SEQ ID NO: 1186480 - protein, 9 aa, Homo Sapiens
AWRMLTALG

SEQ ID NO: 1186481 - protein, 9 aa, Homo Sapiens
PGAASASCC

SEQ ID NO: 1186482 - protein, 9 aa, Homo Sapiens
YGILLHLQS

SEQ ID NO: 1186483 - protein, 9 aa, Homo Sapiens
SQVFALGLQ

SEQ ID NO: 1186484 - protein, 9 aa, Homo Sapiens
KHKSGGHAA

SEQ ID NO: 1186485 - protein, 9 aa, Homo Sapiens
AKFLSANKM

SEQ ID NO: 1186486 - protein, 9 aa, Homo Sapiens
SLQLDEYRD

SEQ ID NO: 1186487 - protein, 9 aa, Homo Sapiens
GLGARAGAR

SEQ ID NO: 1186488 - protein, 9 aa, Homo Sapiens
SKGEEEEED

SEQ ID NO: 1186489 - protein, 9 aa, Homo Sapiens
AMELIMRHG

SEQ ID NO: 1186490 - protein, 9 aa, Homo Sapiens
EAVSTVLHL

SEQ ID NO: 1186491 - protein, 9 aa, Homo Sapiens
RPGTQAARR

SEQ ID NO: 1186492 - protein, 9 aa, Homo Sapiens
HLLDLYASG

SEQ ID NO: 1186493 - protein, 9 aa, Homo Sapiens
SRRARCCSN

SEQ ID NO: 1186494 - protein, 9 aa, Homo Sapiens
WNETFQHPC

SEQ ID NO: 1186495 - protein, 9 aa, Homo Sapiens
HPGPRHPLL

SEQ ID NO: 1186496 - protein, 9 aa, Homo Sapiens
LQPLDHEEP

SEQ ID NO: 1186497 - protein, 9 aa, Homo Sapiens
PMMSSMACG

SEQ ID NO: 1186498 - protein, 9 aa, Homo Sapiens
MTTFLGLWN

SEQ ID NO: 1186499 - protein, 9 aa, Homo Sapiens
TRHLASMRY

SEQ ID NO: 1186500 - protein, 9 aa, Homo Sapiens
IAISGFIPL

SEQ ID NO: 1186501 - protein, 9 aa, Homo Sapiens
GAYGTSNAA

SEQ ID NO: 1186502 - protein, 9 aa, Homo Sapiens
GMPEGKKLV

SEQ ID NO: 1186503 - protein, 9 aa, Homo Sapiens
IIPRAITHL

SEQ ID NO: 1186504 - protein, 9 aa, Homo Sapiens
APAPGGYGS

SEQ ID NO: 1186505 - protein, 9 aa, Homo Sapiens
RATVPRHSS

SEQ ID NO: 1186506 - protein, 9 aa, Homo Sapiens
AVLPRSRKF

SEQ ID NO: 1186507 - protein, 9 aa, Homo Sapiens
EKANPNDRC

SEQ ID NO: 1186508 - protein, 9 aa, Homo Sapiens
GRVDGNFLE

SEQ ID NO: 1186509 - protein, 9 aa, Homo Sapiens
GGCIPAPRP

SEQ ID NO: 1186510 - protein, 9 aa, Homo Sapiens
RMGPGRHRG

SEQ ID NO: 1186511 - protein, 9 aa, Homo Sapiens
EEFMVDKVI

SEQ ID NO: 1186512 - protein, 9 aa, Homo Sapiens
TTLYDLSSD

SEQ ID NO: 1186513 - protein, 9 aa, Homo Sapiens
YEMTSDTRL

SEQ ID NO: 1186514 - protein, 9 aa, Homo Sapiens
GHIGRNMVA

SEQ ID NO: 1186515 - protein, 9 aa, Homo Sapiens
SEVDRGEAA

SEQ ID NO: 1186516 - protein, 9 aa, Homo Sapiens
QNYTIELEN

SEQ ID NO: 1186517 - protein, 9 aa, Homo Sapiens
AQEIVFLAC

SEQ ID NO: 1186518 - protein, 9 aa, Homo Sapiens
TLCSSTPTC

SEQ ID NO: 1186519 - protein, 9 aa, Homo Sapiens
VDRTAERPV

SEQ ID NO: 1186520 - protein, 9 aa, Homo Sapiens
YDCGLGTEC

SEQ ID NO: 1186521 - protein, 9 aa, Homo Sapiens
DPTISQAPC

SEQ ID NO: 1186522 - protein, 9 aa, Homo Sapiens
SLGLAPSAT

SEQ ID NO: 1186523 - protein, 9 aa, Homo Sapiens
KAANKARDE

SEQ ID NO: 1186524 - protein, 9 aa, Homo Sapiens
PPTWPTQTW

SEQ ID NO: 1186525 - protein, 9 aa, Homo Sapiens
ALGGDSNSS

SEQ ID NO: 1186526 - protein, 9 aa, Homo Sapiens
VRDHLGLRK

SEQ ID NO: 1186527 - protein, 9 aa, Homo Sapiens
VSVDMGEDA

SEQ ID NO: 1186528 - protein, 9 aa, Homo Sapiens
PMGSLVPSS

SEQ ID NO: 1186529 - protein, 9 aa, Homo Sapiens
EFTSLAASV

SEQ ID NO: 1186530 - protein, 9 aa, Homo Sapiens
WSTCLTPDS

SEQ ID NO: 1186531 - protein, 9 aa, Homo Sapiens
HEHGGQKEG

SEQ ID NO: 1186532 - protein, 9 aa, Homo Sapiens
RYTHILNWV

SEQ ID NO: 1186533 - protein, 9 aa, Homo Sapiens
LKCRAQGQN

SEQ ID NO: 1186534 - protein, 9 aa, Homo Sapiens
GPEERPPAT

SEQ ID NO: 1186535 - protein, 9 aa, Homo Sapiens
VTPQQMPQT

SEQ ID NO: 1186536 - protein, 9 aa, Homo Sapiens
EDLRIRVAA

SEQ ID NO: 1186537 - protein, 9 aa, Homo Sapiens
APYRPCTHL

SEQ ID NO: 1186538 - protein, 9 aa, Homo Sapiens
ESCMCPIPP

SEQ ID NO: 1186539 - protein, 9 aa, Homo Sapiens
RSGCVPRRS

SEQ ID NO: 1186540 - protein, 9 aa, Homo Sapiens
LSESVVPDD

SEQ ID NO: 1186541 - protein, 9 aa, Homo Sapiens
AKGSRRCTK

SEQ ID NO: 1186542 - protein, 9 aa, Homo Sapiens
SDSRFQLEG

SEQ ID NO: 1186543 - protein, 9 aa, Homo Sapiens
SDSELLWDI

SEQ ID NO: 1186544 - protein, 9 aa, Homo Sapiens
TDKDDPGPT

SEQ ID NO: 1186545 - protein, 9 aa, Homo Sapiens
CSCRQDGLM

SEQ ID NO: 1186546 - protein, 9 aa, Homo Sapiens
SKPSQILQG

SEQ ID NO: 1186547 - protein, 9 aa, Homo Sapiens
ISEFEEEGE

SEQ ID NO: 1186548 - protein, 9 aa, Homo Sapiens
LGYLKNLAY

SEQ ID NO: 1186549 - protein, 9 aa, Homo Sapiens
TRCCPRPLG

SEQ ID NO: 1186550 - protein, 9 aa, Homo Sapiens
QGPWLHIDI

SEQ ID NO: 1186551 - protein, 9 aa, Homo Sapiens
RLLAAVPVQ

SEQ ID NO: 1186552 - protein, 9 aa, Homo Sapiens
CPPGVVPTC

SEQ ID NO: 1186553 - protein, 9 aa, Homo Sapiens
HQPALSWGK

SEQ ID NO: 1186554 - protein, 9 aa, Homo Sapiens
LTRCCLSRS

SEQ ID NO: 1186555 - protein, 9 aa, Homo Sapiens
VESGNAQAA

SEQ ID NO: 1186556 - protein, 9 aa, Homo Sapiens
LLLVTDKSH

SEQ ID NO: 1186557 - protein, 9 aa, Homo Sapiens
FPKPPEDGT

SEQ ID NO: 1186558 - protein, 9 aa, Homo Sapiens
VDKVIEPRA

SEQ ID NO: 1186559 - protein, 9 aa, Homo Sapiens
HLEDVVGGC

SEQ ID NO: 1186560 - protein, 9 aa, Homo Sapiens
FWMWSRDCL

SEQ ID NO: 1186561 - protein, 9 aa, Homo Sapiens
AAGGGPECV

SEQ ID NO: 1186562 - protein, 9 aa, Homo Sapiens
CPLVPTRAP

SEQ ID NO: 1186563 - protein, 9 aa, Homo Sapiens
IRRIQTHGE

SEQ ID NO: 1186564 - protein, 9 aa, Homo Sapiens
IFIKVTRSG

SEQ ID NO: 1186565 - protein, 9 aa, Homo Sapiens
EGSLYPPPF

SEQ ID NO: 1186566 - protein, 9 aa, Homo Sapiens
CQNCMVQII

SEQ ID NO: 1186567 - protein, 9 aa, Homo Sapiens
ESRHAYSSH

SEQ ID NO: 1186568 - protein, 9 aa, Homo Sapiens
ASGTPGLRA

SEQ ID NO: 1186569 - protein, 9 aa, Homo Sapiens
TAMQCRKKS

SEQ ID NO: 1186570 - protein, 9 aa, Homo Sapiens
LSAPAEATS

SEQ ID NO: 1186571 - protein, 9 aa, Homo Sapiens
KTRKIEAQV

SEQ ID NO: 1186572 - protein, 9 aa, Homo Sapiens
TRPPTKEKV

SEQ ID NO: 1186573 - protein, 9 aa, Homo Sapiens
FPRSASRAS

SEQ ID NO: 1186574 - protein, 9 aa, Homo Sapiens
IYHLPREFG

SEQ ID NO: 1186575 - protein, 9 aa, Homo Sapiens
FLSYADWFN

SEQ ID NO: 1186576 - protein, 9 aa, Homo Sapiens
AAAARAAGG

SEQ ID NO: 1186577 - protein, 9 aa, Homo Sapiens
RDNPDLGAA

SEQ ID NO: 1186578 - protein, 9 aa, Homo Sapiens
LARKVHLHE

SEQ ID NO: 1186579 - protein, 9 aa, Homo Sapiens
QLRGHAQMC

SEQ ID NO: 1186580 - protein, 9 aa, Homo Sapiens
CKRKIFLWT

SEQ ID NO: 1186581 - protein, 9 aa, Homo Sapiens
LQGSLVADH

SEQ ID NO: 1186582 - protein, 9 aa, Homo Sapiens
GEDIFWTCL

SEQ ID NO: 1186583 - protein, 9 aa, Homo Sapiens
SALRPHRVT

SEQ ID NO: 1186584 - protein, 9 aa, Homo Sapiens
PWLDAEVYK

SEQ ID NO: 1186585 - protein, 9 aa, Homo Sapiens
MSAASFHLC

SEQ ID NO: 1186586 - protein, 9 aa, Homo Sapiens
PSHVEERGA

SEQ ID NO: 1186587 - protein, 9 aa, Homo Sapiens
LAHLQEEEG

SEQ ID NO: 1186588 - protein, 9 aa, Homo Sapiens
CPVTQDHLG

SEQ ID NO: 1186589 - protein, 9 aa, Homo Sapiens
LSMCDSISE

SEQ ID NO: 1186590 - protein, 9 aa, Homo Sapiens
AGQHAGPPL

SEQ ID NO: 1186591 - protein, 9 aa, Homo Sapiens
IMFSCNNKE

SEQ ID NO: 1186592 - protein, 9 aa, Homo Sapiens
EDEGRGKRT

SEQ ID NO: 1186593 - protein, 9 aa, Homo Sapiens
CAFLLLHLL

SEQ ID NO: 1186594 - protein, 9 aa, Homo Sapiens
LLVVLAAVG

SEQ ID NO: 1186595 - protein, 9 aa, Homo Sapiens
LSAAGSPSV

SEQ ID NO: 1186596 - protein, 9 aa, Homo Sapiens
RHIGICHPG

SEQ ID NO: 1186597 - protein, 9 aa, Homo Sapiens
KTKDLIAHS

SEQ ID NO: 1186598 - protein, 9 aa, Homo Sapiens
FLSHIWVGI

SEQ ID NO: 1186599 - protein, 9 aa, Homo Sapiens
RRGRGARPN

SEQ ID NO: 1186600 - protein, 9 aa, Homo Sapiens
LRVAMELIM

SEQ ID NO: 1186601 - protein, 9 aa, Homo Sapiens
GIAFLLRRR

SEQ ID NO: 1186602 - protein, 9 aa, Homo Sapiens
DPGCVQAGS

SEQ ID NO: 1186603 - protein, 9 aa, Homo Sapiens
GQAVLLLCA

SEQ ID NO: 1186604 - protein, 9 aa, Homo Sapiens
GALEAHPFF

SEQ ID NO: 1186605 - protein, 9 aa, Homo Sapiens
KVILQAMYL

SEQ ID NO: 1186606 - protein, 9 aa, Homo Sapiens
AKGTPKPSK

SEQ ID NO: 1186607 - protein, 9 aa, Homo Sapiens
TLECPFCRR

SEQ ID NO: 1186608 - protein, 9 aa, Homo Sapiens
PTPARWGWC

SEQ ID NO: 1186609 - protein, 9 aa, Homo Sapiens
KAHKKSSCQ

SEQ ID NO: 1186610 - protein, 9 aa, Homo Sapiens
DELHIECSD

SEQ ID NO: 1186611 - protein, 9 aa, Homo Sapiens
IQNKRAMRQ

SEQ ID NO: 1186612 - protein, 9 aa, Homo Sapiens
RSCTNSNAS

SEQ ID NO: 1186613 - protein, 9 aa, Homo Sapiens
SGAPPRASQ

SEQ ID NO: 1186614 - protein, 9 aa, Homo Sapiens
RAMAGLQLH

SEQ ID NO: 1186615 - protein, 9 aa, Homo Sapiens
PCRGPMPGS

SEQ ID NO: 1186616 - protein, 9 aa, Homo Sapiens
GGRDRAQGG

SEQ ID NO: 1186617 - protein, 9 aa, Homo Sapiens
PLPRASLRA

SEQ ID NO: 1186618 - protein, 9 aa, Homo Sapiens
SCPTTSEGT

SEQ ID NO: 1186619 - protein, 9 aa, Homo Sapiens
LHSAISAPI

SEQ ID NO: 1186620 - protein, 9 aa, Homo Sapiens
IGTTKKGIR

SEQ ID NO: 1186621 - protein, 9 aa, Homo Sapiens
ADSLQQAWT

SEQ ID NO: 1186622 - protein, 9 aa, Homo Sapiens
STEIFPALS

SEQ ID NO: 1186623 - protein, 9 aa, Homo Sapiens
GLAARRRRL

SEQ ID NO: 1186624 - protein, 9 aa, Homo Sapiens
WHRPQLRRH

SEQ ID NO: 1186625 - protein, 9 aa, Homo Sapiens
AEAPLPAFG

SEQ ID NO: 1186626 - protein, 9 aa, Homo Sapiens
SRDGGWGWR

SEQ ID NO: 1186627 - protein, 9 aa, Homo Sapiens
ARDEDAGHL

SEQ ID NO: 1186628 - protein, 9 aa, Homo Sapiens
CQAPSCLSI

SEQ ID NO: 1186629 - protein, 9 aa, Homo Sapiens
KRTAFIKDQ

SEQ ID NO: 1186630 - protein, 9 aa, Homo Sapiens
RASGTPGLR

SEQ ID NO: 1186631 - protein, 9 aa, Homo Sapiens
HVRPVGAFA

SEQ ID NO: 1186632 - protein, 9 aa, Homo Sapiens
CVDSAVTVA

SEQ ID NO: 1186633 - protein, 9 aa, Homo Sapiens
ILHVQHQPL

SEQ ID NO: 1186634 - protein, 9 aa, Homo Sapiens
TSDTRLSQQ

SEQ ID NO: 1186635 - protein, 9 aa, Homo Sapiens
SHPYEITLL

SEQ ID NO: 1186636 - protein, 9 aa, Homo Sapiens
AFLLWKKRF

SEQ ID NO: 1186637 - protein, 9 aa, Homo Sapiens
FWEGAIISR

SEQ ID NO: 1186638 - protein, 9 aa, Homo Sapiens
GEIGISNPL

SEQ ID NO: 1186639 - protein, 9 aa, Homo Sapiens
AAHDQEAAR

SEQ ID NO: 1186640 - protein, 9 aa, Homo Sapiens
CPWLKCSAA

SEQ ID NO: 1186641 - protein, 9 aa, Homo Sapiens
LLPGQALDR

SEQ ID NO: 1186642 - protein, 9 aa, Homo Sapiens
TPRGGSAGA

SEQ ID NO: 1186643 - protein, 9 aa, Homo Sapiens
KNLGEMHVP

SEQ ID NO: 1186644 - protein, 9 aa, Homo Sapiens
RESKSKKGT

SEQ ID NO: 1186645 - protein, 9 aa, Homo Sapiens
CTLEYAPVD

SEQ ID NO: 1186646 - protein, 9 aa, Homo Sapiens
RSRRWATWL

SEQ ID NO: 1186647 - protein, 9 aa, Homo Sapiens
PAGMQAKYL

SEQ ID NO: 1186648 - protein, 9 aa, Homo Sapiens
DNNEYDAYL

SEQ ID NO: 1186649 - protein, 9 aa, Homo Sapiens
IAGGLAGMR

SEQ ID NO: 1186650 - protein, 9 aa, Homo Sapiens
LVRDCGAWP

SEQ ID NO: 1186651 - protein, 9 aa, Homo Sapiens
GKAAQARVA

SEQ ID NO: 1186652 - protein, 9 aa, Homo Sapiens
PCLPSSTAT

SEQ ID NO: 1186653 - protein, 9 aa, Homo Sapiens
GYHARDEDA

SEQ ID NO: 1186654 - protein, 9 aa, Homo Sapiens
TKKGIRPTY

SEQ ID NO: 1186655 - protein, 9 aa, Homo Sapiens
ASCWPDAHL

SEQ ID NO: 1186656 - protein, 9 aa, Homo Sapiens
GRLRTLLLA

SEQ ID NO: 1186657 - protein, 9 aa, Homo Sapiens
AWALGCQAP

SEQ ID NO: 1186658 - protein, 9 aa, Homo Sapiens
AYGTSNAAV

SEQ ID NO: 1186659 - protein, 9 aa, Homo Sapiens
CQNFVMASF

SEQ ID NO: 1186660 - protein, 9 aa, Homo Sapiens
ELLTCSHPF

SEQ ID NO: 1186661 - protein, 9 aa, Homo Sapiens
TKIYIQRLS

SEQ ID NO: 1186662 - protein, 9 aa, Homo Sapiens
GDRCQNFVM

SEQ ID NO: 1186663 - protein, 9 aa, Homo Sapiens
GSGSANQPV

SEQ ID NO: 1186664 - protein, 9 aa, Homo Sapiens
SRTCSTETT

SEQ ID NO: 1186665 - protein, 9 aa, Homo Sapiens
WNHEVKLEI

SEQ ID NO: 1186666 - protein, 9 aa, Homo Sapiens
VGVFLRGFI

SEQ ID NO: 1186667 - protein, 9 aa, Homo Sapiens
EAKYNAFTM

SEQ ID NO: 1186668 - protein, 9 aa, Homo Sapiens
SCACMTGIP

SEQ ID NO: 1186669 - protein, 9 aa, Homo Sapiens
LVSTSRKRT

SEQ ID NO: 1186670 - protein, 9 aa, Homo Sapiens
PTIDWLSCL

SEQ ID NO: 1186671 - protein, 9 aa, Homo Sapiens
RLVAGAVLL

SEQ ID NO: 1186672 - protein, 9 aa, Homo Sapiens
WIIEVGRHL

SEQ ID NO: 1186673 - protein, 9 aa, Homo Sapiens
PPAPLSQQE

SEQ ID NO: 1186674 - protein, 9 aa, Homo Sapiens
GPGLFPRSA

SEQ ID NO: 1186675 - protein, 9 aa, Homo Sapiens
GLLLALFVP

SEQ ID NO: 1186676 - protein, 9 aa, Homo Sapiens
FLMVFIFSS

SEQ ID NO: 1186677 - protein, 9 aa, Homo Sapiens
AVGDHHVRD

SEQ ID NO: 1186678 - protein, 9 aa, Homo Sapiens
FSQSRSSSL

SEQ ID NO: 1186679 - protein, 9 aa, Homo Sapiens
LNRMQAVRA

SEQ ID NO: 1186680 - protein, 9 aa, Homo Sapiens
QDWRQRCLR

SEQ ID NO: 1186681 - protein, 9 aa, Homo Sapiens
KWHYYYQSA

SEQ ID NO: 1186682 - protein, 9 aa, Homo Sapiens
VATQVSVPL

SEQ ID NO: 1186683 - protein, 9 aa, Homo Sapiens
HAYSSHQLK

SEQ ID NO: 1186684 - protein, 9 aa, Homo Sapiens
ASKIPYSLW

SEQ ID NO: 1186685 - protein, 9 aa, Homo Sapiens
RAGQRGKAE

SEQ ID NO: 1186686 - protein, 9 aa, Homo Sapiens
CSSTSTTSA

SEQ ID NO: 1186687 - protein, 9 aa, Homo Sapiens
NQFRQRHPK

SEQ ID NO: 1186688 - protein, 9 aa, Homo Sapiens
SHLCNFNVI

SEQ ID NO: 1186689 - protein, 9 aa, Homo Sapiens
KCSLMRRVW

SEQ ID NO: 1186690 - protein, 9 aa, Homo Sapiens
DAPLEALTG

SEQ ID NO: 1186691 - protein, 9 aa, Homo Sapiens
NVIDHKIES

SEQ ID NO: 1186692 - protein, 9 aa, Homo Sapiens
ENGGLGWWR

SEQ ID NO: 1186693 - protein, 9 aa, Homo Sapiens
KKLRSLYDI

SEQ ID NO: 1186694 - protein, 9 aa, Homo Sapiens
TGEHPFACD

SEQ ID NO: 1186695 - protein, 9 aa, Homo Sapiens
YVGYIRDLF

SEQ ID NO: 1186696 - protein, 9 aa, Homo Sapiens
ASGLKNIPG

SEQ ID NO: 1186697 - protein, 9 aa, Homo Sapiens
VQHQPLGVL

SEQ ID NO: 1186698 - protein, 9 aa, Homo Sapiens
QNTLRHQVV

SEQ ID NO: 1186699 - protein, 9 aa, Homo Sapiens
GVCRVDERP

SEQ ID NO: 1186700 - protein, 9 aa, Homo Sapiens
SMSEDNSPE

SEQ ID NO: 1186701 - protein, 9 aa, Homo Sapiens
SSSGLTSQE

SEQ ID NO: 1186702 - protein, 9 aa, Homo Sapiens
LMGKRVNLE

SEQ ID NO: 1186703 - protein, 9 aa, Homo Sapiens
CNRIAAVIS

SEQ ID NO: 1186704 - protein, 9 aa, Homo Sapiens
TNSTEARSC

SEQ ID NO: 1186705 - protein, 9 aa, Homo Sapiens
EATTRLNVF

SEQ ID NO: 1186706 - protein, 9 aa, Homo Sapiens
EADGAAPSS

SEQ ID NO: 1186707 - protein, 9 aa, Homo Sapiens
RGGESGSSQ

SEQ ID NO: 1186708 - protein, 9 aa, Homo Sapiens
VSEKVGVAE

SEQ ID NO: 1186709 - protein, 9 aa, Homo Sapiens
SPLWLMTAM

SEQ ID NO: 1186710 - protein, 9 aa, Homo Sapiens
FEKTELSVL

SEQ ID NO: 1186711 - protein, 9 aa, Homo Sapiens
WCRARVDGR

SEQ ID NO: 1186712 - protein, 9 aa, Homo Sapiens
TGSPRTRGR

SEQ ID NO: 1186713 - protein, 9 aa, Homo Sapiens
AHGLAQRAA

SEQ ID NO: 1186714 - protein, 9 aa, Homo Sapiens
RSLPGTTRM

SEQ ID NO: 1186715 - protein, 9 aa, Homo Sapiens
LVADHDYIG

SEQ ID NO: 1186716 - protein, 9 aa, Homo Sapiens
VKDGAGART

SEQ ID NO: 1186717 - protein, 9 aa, Homo Sapiens
NLQWMRGLL

SEQ ID NO: 1186718 - protein, 9 aa, Homo Sapiens
STLTTHKIV

SEQ ID NO: 1186719 - protein, 9 aa, Homo Sapiens
GQPGGCSSS

SEQ ID NO: 1186720 - protein, 9 aa, Homo Sapiens
KDCDVLVGH

SEQ ID NO: 1186721 - protein, 9 aa, Homo Sapiens
GYFGILLSR

SEQ ID NO: 1186722 - protein, 9 aa, Homo Sapiens
LMVFIFSSS

SEQ ID NO: 1186723 - protein, 9 aa, Homo Sapiens
RDCGAWPPP

SEQ ID NO: 1186724 - protein, 9 aa, Homo Sapiens
TPNVQDILG

SEQ ID NO: 1186725 - protein, 9 aa, Homo Sapiens
CLPAAPGAK

SEQ ID NO: 1186726 - protein, 9 aa, Homo Sapiens
LRSRRRGLP

SEQ ID NO: 1186727 - protein, 9 aa, Homo Sapiens
WTRCLRMRP

SEQ ID NO: 1186728 - protein, 9 aa, Homo Sapiens
KSNSKNSSR

SEQ ID NO: 1186729 - protein, 9 aa, Homo Sapiens
SLKFKSMHG

SEQ ID NO: 1186730 - protein, 9 aa, Homo Sapiens
VDRHRVTRC

SEQ ID NO: 1186731 - protein, 9 aa, Homo Sapiens
TTDANGRVN

SEQ ID NO: 1186732 - protein, 9 aa, Homo Sapiens
LGCPQASSL

SEQ ID NO: 1186733 - protein, 9 aa, Homo Sapiens
LDRAPHLGQ

SEQ ID NO: 1186734 - protein, 9 aa, Homo Sapiens
TCSFPEHFI

SEQ ID NO: 1186735 - protein, 9 aa, Homo Sapiens
VGCRRCSGL

SEQ ID NO: 1186736 - protein, 9 aa, Homo Sapiens
EAVDCSDIL

SEQ ID NO: 1186737 - protein, 9 aa, Homo Sapiens
TDPTFTFSA

SEQ ID NO: 1186738 - protein, 9 aa, Homo Sapiens
KVQQYRVTM

SEQ ID NO: 1186739 - protein, 9 aa, Homo Sapiens
PLQGFLIPL

SEQ ID NO: 1186740 - protein, 9 aa, Homo Sapiens
KTIRFTVRT

SEQ ID NO: 1186741 - protein, 9 aa, Homo Sapiens
SCNNKELII

SEQ ID NO: 1186742 - protein, 9 aa, Homo Sapiens
LVDLEAFMK

SEQ ID NO: 1186743 - protein, 9 aa, Homo Sapiens
ALRSRRRGL

SEQ ID NO: 1186744 - protein, 9 aa, Homo Sapiens
AASISACNG

SEQ ID NO: 1186745 - protein, 9 aa, Homo Sapiens
MQKRHLHRS

SEQ ID NO: 1186746 - protein, 9 aa, Homo Sapiens
TILLPGHWV

SEQ ID NO: 1186747 - protein, 9 aa, Homo Sapiens
LVCPVHLVA

SEQ ID NO: 1186748 - protein, 9 aa, Homo Sapiens
KGCKNKQPQ

SEQ ID NO: 1186749 - protein, 9 aa, Homo Sapiens
LMATCHFDA

SEQ ID NO: 1186750 - protein, 9 aa, Homo Sapiens
RTQKKNMSC

SEQ ID NO: 1186751 - protein, 9 aa, Homo Sapiens
VGLINAGKS

SEQ ID NO: 1186752 - protein, 9 aa, Homo Sapiens
QAWTVGWCV

SEQ ID NO: 1186753 - protein, 9 aa, Homo Sapiens
LKMWQGEEV

SEQ ID NO: 1186754 - protein, 9 aa, Homo Sapiens
MYVCACICV

SEQ ID NO: 1186755 - protein, 9 aa, Homo Sapiens
TIEENIKIE

SEQ ID NO: 1186756 - protein, 9 aa, Homo Sapiens
RVLRRVCHA

SEQ ID NO: 1186757 - protein, 9 aa, Homo Sapiens
GMLKWRLQT

SEQ ID NO: 1186758 - protein, 9 aa, Homo Sapiens
LALWALGRP

SEQ ID NO: 1186759 - protein, 9 aa, Homo Sapiens
SQNVIDHKI

SEQ ID NO: 1186760 - protein, 9 aa, Homo Sapiens
LFAVWKLQL

SEQ ID NO: 1186761 - protein, 9 aa, Homo Sapiens
FMQLRDRLC

SEQ ID NO: 1186762 - protein, 9 aa, Homo Sapiens
ALVLRPPTL

SEQ ID NO: 1186763 - protein, 9 aa, Homo Sapiens
DGRRSRYVW

SEQ ID NO: 1186764 - protein, 9 aa, Homo Sapiens
THKALARRL

SEQ ID NO: 1186765 - protein, 9 aa, Homo Sapiens
KPRDKRLEK

SEQ ID NO: 1186766 - protein, 9 aa, Homo Sapiens
TRCWACCGT

SEQ ID NO: 1186767 - protein, 9 aa, Homo Sapiens
IRLGIAVRH

SEQ ID NO: 1186768 - protein, 9 aa, Homo Sapiens
SFGGAQAIP

SEQ ID NO: 1186769 - protein, 9 aa, Homo Sapiens
RDMKSAHLP

SEQ ID NO: 1186770 - protein, 9 aa, Homo Sapiens
KKKEKGTAN

SEQ ID NO: 1186771 - protein, 9 aa, Homo Sapiens
EEQLAQYQT

SEQ ID NO: 1186772 - protein, 9 aa, Homo Sapiens
RSSSMGHPG

SEQ ID NO: 1186773 - protein, 9 aa, Homo Sapiens
TFISQCTVE

SEQ ID NO: 1186774 - protein, 9 aa, Homo Sapiens
NHEVKLEIP

SEQ ID NO: 1186775 - protein, 9 aa, Homo Sapiens
WANFACTGN

SEQ ID NO: 1186776 - protein, 9 aa, Homo Sapiens
WAGAARAIL

SEQ ID NO: 1186777 - protein, 9 aa, Homo Sapiens
RRRRPPREA

SEQ ID NO: 1186778 - protein, 9 aa, Homo Sapiens
TTRLNVFAK

SEQ ID NO: 1186779 - protein, 9 aa, Homo Sapiens
EFLMGGCPG

SEQ ID NO: 1186780 - protein, 9 aa, Homo Sapiens
LSLYSVAVW

SEQ ID NO: 1186781 - protein, 9 aa, Homo Sapiens
STGAPARCG

SEQ ID NO: 1186782 - protein, 9 aa, Homo Sapiens
GLDGDDEVV

SEQ ID NO: 1186783 - protein, 9 aa, Homo Sapiens
WREEQMECL

SEQ ID NO: 1186784 - protein, 9 aa, Homo Sapiens
NSISRTCRS

SEQ ID NO: 1186785 - protein, 9 aa, Homo Sapiens
GCVQAGSEE

SEQ ID NO: 1186786 - protein, 9 aa, Homo Sapiens
PGPGAASAS

SEQ ID NO: 1186787 - protein, 9 aa, Homo Sapiens
QLPVPILYL

SEQ ID NO: 1186788 - protein, 9 aa, Homo Sapiens
SDVGMLKWR

SEQ ID NO: 1186789 - protein, 9 aa, Homo Sapiens
PPGPAPWWH

SEQ ID NO: 1186790 - protein, 9 aa, Homo Sapiens
KPDTGFTNQ

SEQ ID NO: 1186791 - protein, 9 aa, Homo Sapiens
DTLDIASIA

SEQ ID NO: 1186792 - protein, 9 aa, Homo Sapiens
PPVPLGPWN

SEQ ID NO: 1186793 - protein, 9 aa, Homo Sapiens
LQEEVAVGR

SEQ ID NO: 1186794 - protein, 9 aa, Homo Sapiens
RACARRCAE

SEQ ID NO: 1186795 - protein, 9 aa, Homo Sapiens
SLLAQLVAR

SEQ ID NO: 1186796 - protein, 9 aa, Homo Sapiens
LPPQAQTPA

SEQ ID NO: 1186797 - protein, 9 aa, Homo Sapiens
LAVFSMPFL

SEQ ID NO: 1186798 - protein, 9 aa, Homo Sapiens
PHALVAHRV

SEQ ID NO: 1186799 - protein, 9 aa, Homo Sapiens
STDRWSELT

SEQ ID NO: 1186800 - protein, 9 aa, Homo Sapiens
PSKPGKKHR

SEQ ID NO: 1186801 - protein, 9 aa, Homo Sapiens
LCVTRPSEV

SEQ ID NO: 1186802 - protein, 9 aa, Homo Sapiens
FESAKKSLW

SEQ ID NO: 1186803 - protein, 9 aa, Homo Sapiens
RICRGAGHK

SEQ ID NO: 1186804 - protein, 9 aa, Homo Sapiens
PRSPCPPTP

SEQ ID NO: 1186805 - protein, 9 aa, Homo Sapiens
PRRRSFLRA

SEQ ID NO: 1186806 - protein, 9 aa, Homo Sapiens
ERESKSKKG

SEQ ID NO: 1186807 - protein, 9 aa, Homo Sapiens
IALHFSILL

SEQ ID NO: 1186808 - protein, 9 aa, Homo Sapiens
TFDELHIEC

SEQ ID NO: 1186809 - protein, 9 aa, Homo Sapiens
ERKSKRKRK

SEQ ID NO: 1186810 - protein, 9 aa, Homo Sapiens
AGYNDFNCN

SEQ ID NO: 1186811 - protein, 9 aa, Homo Sapiens
KEEGKEQEE

SEQ ID NO: 1186812 - protein, 9 aa, Homo Sapiens
EYLEDGSHY

SEQ ID NO: 1186813 - protein, 9 aa, Homo Sapiens
GVKRSIPCE

SEQ ID NO: 1186814 - protein, 9 aa, Homo Sapiens
QHWHTTEAC

SEQ ID NO: 1186815 - protein, 9 aa, Homo Sapiens
GGGGNPCTK

SEQ ID NO: 1186816 - protein, 9 aa, Homo Sapiens
PAPQGPPRM

SEQ ID NO: 1186817 - protein, 9 aa, Homo Sapiens
GEWTSLWSW

SEQ ID NO: 1186818 - protein, 9 aa, Homo Sapiens
TTSADPRQR

SEQ ID NO: 1186819 - protein, 9 aa, Homo Sapiens
PPRGDQCCF

SEQ ID NO: 1186820 - protein, 9 aa, Homo Sapiens
EEFYYRGQV

SEQ ID NO: 1186821 - protein, 9 aa, Homo Sapiens
TARGRPASG

SEQ ID NO: 1186822 - protein, 9 aa, Homo Sapiens
GAVMFITLL

SEQ ID NO: 1186823 - protein, 9 aa, Homo Sapiens
KPRRACQKQ

SEQ ID NO: 1186824 - protein, 9 aa, Homo Sapiens
EPPSGVKRL

SEQ ID NO: 1186825 - protein, 9 aa, Homo Sapiens
CMCQLNPGI

SEQ ID NO: 1186826 - protein, 9 aa, Homo Sapiens
GGGPECVPG

SEQ ID NO: 1186827 - protein, 9 aa, Homo Sapiens
AEAMTTALG

SEQ ID NO: 1186828 - protein, 9 aa, Homo Sapiens
FVTCLMNTM

SEQ ID NO: 1186829 - protein, 9 aa, Homo Sapiens
DVEAQRLLA

SEQ ID NO: 1186830 - protein, 9 aa, Homo Sapiens
DLLDAHFDH

SEQ ID NO: 1186831 - protein, 9 aa, Homo Sapiens
LQQAQTAIP

SEQ ID NO: 1186832 - protein, 9 aa, Homo Sapiens
FRPAGQQTG

SEQ ID NO: 1186833 - protein, 9 aa, Homo Sapiens
MPLAMFCLD

SEQ ID NO: 1186834 - protein, 9 aa, Homo Sapiens
SACSAGGDA

SEQ ID NO: 1186835 - protein, 9 aa, Homo Sapiens
QETTTKLVP

SEQ ID NO: 1186836 - protein, 9 aa, Homo Sapiens
LLIFNILLV

SEQ ID NO: 1186837 - protein, 9 aa, Homo Sapiens
AESFEFFFA

SEQ ID NO: 1186838 - protein, 9 aa, Homo Sapiens
SKKSITTER

SEQ ID NO: 1186839 - protein, 9 aa, Homo Sapiens
LACRVTLDG

SEQ ID NO: 1186840 - protein, 9 aa, Homo Sapiens
AQLPGASHQ

SEQ ID NO: 1186841 - protein, 9 aa, Homo Sapiens
VEGEVHAVV

SEQ ID NO: 1186842 - protein, 9 aa, Homo Sapiens
CFRPAGQQT

SEQ ID NO: 1186843 - protein, 9 aa, Homo Sapiens
SPYSPILKF

SEQ ID NO: 1186844 - protein, 9 aa, Homo Sapiens
SCCQQTAIH

SEQ ID NO: 1186845 - protein, 9 aa, Homo Sapiens
LPLPARPLE

SEQ ID NO: 1186846 - protein, 9 aa, Homo Sapiens
KETAFLYVV

SEQ ID NO: 1186847 - protein, 9 aa, Homo Sapiens
QLDTTSFHI

SEQ ID NO: 1186848 - protein, 9 aa, Homo Sapiens
QVGQPHALV

SEQ ID NO: 1186849 - protein, 9 aa, Homo Sapiens
PPPTAAPMS

SEQ ID NO: 1186850 - protein, 9 aa, Homo Sapiens
DGNTFKILV

SEQ ID NO: 1186851 - protein, 9 aa, Homo Sapiens
PRTASITLP

SEQ ID NO: 1186852 - protein, 9 aa, Homo Sapiens
AGGSHVGAA

SEQ ID NO: 1186853 - protein, 9 aa, Homo Sapiens
VDLSAKDKT

SEQ ID NO: 1186854 - protein, 9 aa, Homo Sapiens
PGIGNGTQI

SEQ ID NO: 1186855 - protein, 9 aa, Homo Sapiens
RRSLLRRKL

SEQ ID NO: 1186856 - protein, 9 aa, Homo Sapiens
FGEGAVDAL

SEQ ID NO: 1186857 - protein, 9 aa, Homo Sapiens
SRRSGLESG

SEQ ID NO: 1186858 - protein, 9 aa, Homo Sapiens
QGLLRTHRP

SEQ ID NO: 1186859 - protein, 9 aa, Homo Sapiens
IKVSDDLIE

SEQ ID NO: 1186860 - protein, 9 aa, Homo Sapiens
HVVAILGSG

SEQ ID NO: 1186861 - protein, 9 aa, Homo Sapiens
TTLVCTCMC

SEQ ID NO: 1186862 - protein, 9 aa, Homo Sapiens
REGLVENGG

SEQ ID NO: 1186863 - protein, 9 aa, Homo Sapiens
VVKKGGIFS

SEQ ID NO: 1186864 - protein, 9 aa, Homo Sapiens
EILTEGRER

SEQ ID NO: 1186865 - protein, 9 aa, Homo Sapiens
YHLPREFGD

SEQ ID NO: 1186866 - protein, 9 aa, Homo Sapiens
KACIRQDET

SEQ ID NO: 1186867 - protein, 9 aa, Homo Sapiens
DFGEFGVGG

SEQ ID NO: 1186868 - protein, 9 aa, Homo Sapiens
RRGLPCPRT

SEQ ID NO: 1186869 - protein, 9 aa, Homo Sapiens
RVAMELIMR

SEQ ID NO: 1186870 - protein, 9 aa, Homo Sapiens
EDVGPSLGL

SEQ ID NO: 1186871 - protein, 9 aa, Homo Sapiens
NGIPPAHLS

SEQ ID NO: 1186872 - protein, 9 aa, Homo Sapiens
SAASISACN

SEQ ID NO: 1186873 - protein, 9 aa, Homo Sapiens
VHGYWFWEG

SEQ ID NO: 1186874 - protein, 9 aa, Homo Sapiens
DSSGSRSLW

SEQ ID NO: 1186875 - protein, 9 aa, Homo Sapiens
LKRQGESSG

SEQ ID NO: 1186876 - protein, 9 aa, Homo Sapiens
GTLSPRSRC

SEQ ID NO: 1186877 - protein, 9 aa, Homo Sapiens
NLYTDIISI

SEQ ID NO: 1186878 - protein, 9 aa, Homo Sapiens
NLILPYISG

SEQ ID NO: 1186879 - protein, 9 aa, Homo Sapiens
AVGRRGPDG

SEQ ID NO: 1186880 - protein, 9 aa, Homo Sapiens
TCAVNCPSW

SEQ ID NO: 1186881 - protein, 9 aa, Homo Sapiens
CLPAQSWCA

SEQ ID NO: 1186882 - protein, 9 aa, Homo Sapiens
VEPGHRAGH

SEQ ID NO: 1186883 - protein, 9 aa, Homo Sapiens
AARALHSLA

SEQ ID NO: 1186884 - protein, 9 aa, Homo Sapiens
HFSILPMSH

SEQ ID NO: 1186885 - protein, 9 aa, Homo Sapiens
RGHAHAGAI

SEQ ID NO: 1186886 - protein, 9 aa, Homo Sapiens
STTTNTTTV

SEQ ID NO: 1186887 - protein, 9 aa, Homo Sapiens
RRGLALPGA

SEQ ID NO: 1186888 - protein, 9 aa, Homo Sapiens
TGSARSCFP

SEQ ID NO: 1186889 - protein, 9 aa, Homo Sapiens
MNTDKQYFV

SEQ ID NO: 1186890 - protein, 9 aa, Homo Sapiens
TLSPRSRCG

SEQ ID NO: 1186891 - protein, 9 aa, Homo Sapiens
PREARKQRL

SEQ ID NO: 1186892 - protein, 9 aa, Homo Sapiens
GTGSGMGML

SEQ ID NO: 1186893 - protein, 9 aa, Homo Sapiens
AAPMMSSMA

SEQ ID NO: 1186894 - protein, 9 aa, Homo Sapiens
AEDKMLRTR

SEQ ID NO: 1186895 - protein, 9 aa, Homo Sapiens
YWANFACTG

SEQ ID NO: 1186896 - protein, 9 aa, Homo Sapiens
GSPSVNAVS

SEQ ID NO: 1186897 - protein, 9 aa, Homo Sapiens
LPTLQEKKS

SEQ ID NO: 1186898 - protein, 9 aa, Homo Sapiens
TFVVQGFGD

SEQ ID NO: 1186899 - protein, 9 aa, Homo Sapiens
PGLPAMGGA

SEQ ID NO: 1186900 - protein, 9 aa, Homo Sapiens
LHTGPVSSV

SEQ ID NO: 1186901 - protein, 9 aa, Homo Sapiens
TVAVCMGES

SEQ ID NO: 1186902 - protein, 9 aa, Homo Sapiens
GHTPAGMQA

SEQ ID NO: 1186903 - protein, 9 aa, Homo Sapiens
RCGVWRRRT

SEQ ID NO: 1186904 - protein, 9 aa, Homo Sapiens
RCCPRPLGL

SEQ ID NO: 1186905 - protein, 9 aa, Homo Sapiens
AAQLLRAVS

SEQ ID NO: 1186906 - protein, 9 aa, Homo Sapiens
YLQRFSVRY

SEQ ID NO: 1186907 - protein, 9 aa, Homo Sapiens
LVQTAISFQ

SEQ ID NO: 1186908 - protein, 9 aa, Homo Sapiens
RGPPTAPQR

SEQ ID NO: 1186909 - protein, 9 aa, Homo Sapiens
THCTFWTRL

SEQ ID NO: 1186910 - protein, 9 aa, Homo Sapiens
NLGEMHVPT

SEQ ID NO: 1186911 - protein, 9 aa, Homo Sapiens
IPGQGHSTY

SEQ ID NO: 1186912 - protein, 9 aa, Homo Sapiens
CSRVQIRHV

SEQ ID NO: 1186913 - protein, 9 aa, Homo Sapiens
SCWSRDQNT

SEQ ID NO: 1186914 - protein, 9 aa, Homo Sapiens
VPPTGTPRP

SEQ ID NO: 1186915 - protein, 9 aa, Homo Sapiens
HTLSEDTIR

SEQ ID NO: 1186916 - protein, 9 aa, Homo Sapiens
TSSTCGTLS

SEQ ID NO: 1186917 - protein, 9 aa, Homo Sapiens
YDGQHWHTT

SEQ ID NO: 1186918 - protein, 9 aa, Homo Sapiens
RRCCPPSSS

SEQ ID NO: 1186919 - protein, 9 aa, Homo Sapiens
GLWEDLIAW

SEQ ID NO: 1186920 - protein, 9 aa, Homo Sapiens
PASVHAICQ

SEQ ID NO: 1186921 - protein, 9 aa, Homo Sapiens
FGGKRGCGC

SEQ ID NO: 1186922 - protein, 9 aa, Homo Sapiens
HQFQLSDIR

SEQ ID NO: 1186923 - protein, 9 aa, Homo Sapiens
RASLRATVP

SEQ ID NO: 1186924 - protein, 9 aa, Homo Sapiens
SARLAADDF

SEQ ID NO: 1186925 - protein, 9 aa, Homo Sapiens
SLIPSQAHP

SEQ ID NO: 1186926 - protein, 9 aa, Homo Sapiens
GGCPGHLQE

SEQ ID NO: 1186927 - protein, 9 aa, Homo Sapiens
PLDHEEPEL

SEQ ID NO: 1186928 - protein, 9 aa, Homo Sapiens
LVPEEHVNT

SEQ ID NO: 1186929 - protein, 9 aa, Homo Sapiens
APKTTLPGL

SEQ ID NO: 1186930 - protein, 9 aa, Homo Sapiens
AHTVLSTSI

SEQ ID NO: 1186931 - protein, 9 aa, Homo Sapiens
QWMEWKIEG

SEQ ID NO: 1186932 - protein, 9 aa, Homo Sapiens
NVTPQQMPQ

SEQ ID NO: 1186933 - protein, 9 aa, Homo Sapiens
GAPARCGPW

SEQ ID NO: 1186934 - protein, 9 aa, Homo Sapiens
EVAEAAAVV

SEQ ID NO: 1186935 - protein, 9 aa, Homo Sapiens
LMTTFLGLW

SEQ ID NO: 1186936 - protein, 9 aa, Homo Sapiens
LAKTGGSRS

SEQ ID NO: 1186937 - protein, 9 aa, Homo Sapiens
AQMQIDKVS

SEQ ID NO: 1186938 - protein, 9 aa, Homo Sapiens
YTFESAKKS

SEQ ID NO: 1186939 - protein, 9 aa, Homo Sapiens
QQQLLRRKI

SEQ ID NO: 1186940 - protein, 9 aa, Homo Sapiens
VVVILQLRN

SEQ ID NO: 1186941 - protein, 9 aa, Homo Sapiens
GQAQGLDFG

SEQ ID NO: 1186942 - protein, 9 aa, Homo Sapiens
DAKEEQQQL

SEQ ID NO: 1186943 - protein, 9 aa, Homo Sapiens
CRKARLGSV

SEQ ID NO: 1186944 - protein, 9 aa, Homo Sapiens
KRFSLFGKR

SEQ ID NO: 1186945 - protein, 9 aa, Homo Sapiens
LQRFSVRYT

SEQ ID NO: 1186946 - protein, 9 aa, Homo Sapiens
APPKRCAAR

SEQ ID NO: 1186947 - protein, 9 aa, Homo Sapiens
LYYQRRHPE

SEQ ID NO: 1186948 - protein, 9 aa, Homo Sapiens
GQVSGSQVS

SEQ ID NO: 1186949 - protein, 9 aa, Homo Sapiens
MSAELQGGS

SEQ ID NO: 1186950 - protein, 9 aa, Homo Sapiens
GPAPWWHPG

SEQ ID NO: 1186951 - protein, 9 aa, Homo Sapiens
DAEVVVQGE

SEQ ID NO: 1186952 - protein, 9 aa, Homo Sapiens
GSSSANHVN

SEQ ID NO: 1186953 - protein, 9 aa, Homo Sapiens
DYKDNYGLT

SEQ ID NO: 1186954 - protein, 9 aa, Homo Sapiens
KETCMSCPF

SEQ ID NO: 1186955 - protein, 9 aa, Homo Sapiens
IFSIDPKGC

SEQ ID NO: 1186956 - protein, 9 aa, Homo Sapiens
DALDDGNTF

SEQ ID NO: 1186957 - protein, 9 aa, Homo Sapiens
DKVSEKSIR

SEQ ID NO: 1186958 - protein, 9 aa, Homo Sapiens
TCSVVSAHL

SEQ ID NO: 1186959 - protein, 9 aa, Homo Sapiens
TTTAAGTGG

SEQ ID NO: 1186960 - protein, 9 aa, Homo Sapiens
PPPPPHPLP

SEQ ID NO: 1186961 - protein, 9 aa, Homo Sapiens
GCFCPADPY

SEQ ID NO: 1186962 - protein, 9 aa, Homo Sapiens
GGSTSVFPD

SEQ ID NO: 1186963 - protein, 9 aa, Homo Sapiens
MGRLTEAAV

SEQ ID NO: 1186964 - protein, 9 aa, Homo Sapiens
KLEPPMLWT

SEQ ID NO: 1186965 - protein, 9 aa, Homo Sapiens
PMEVVVYQL

SEQ ID NO: 1186966 - protein, 9 aa, Homo Sapiens
AATFCPRNV

SEQ ID NO: 1186967 - protein, 9 aa, Homo Sapiens
MWYEWEVTF

SEQ ID NO: 1186968 - protein, 9 aa, Homo Sapiens
GVVNGTGRR

SEQ ID NO: 1186969 - protein, 9 aa, Homo Sapiens
DSTWTLYSS

SEQ ID NO: 1186970 - protein, 9 aa, Homo Sapiens
LMGMCPLCS

SEQ ID NO: 1186971 - protein, 9 aa, Homo Sapiens
TKTRKALIT

SEQ ID NO: 1186972 - protein, 9 aa, Homo Sapiens
DAMLETYGT

SEQ ID NO: 1186973 - protein, 9 aa, Homo Sapiens
TGPCCSRGA

SEQ ID NO: 1186974 - protein, 9 aa, Homo Sapiens
KSEGGVEGD

SEQ ID NO: 1186975 - protein, 9 aa, Homo Sapiens
GIAVRHPQC

SEQ ID NO: 1186976 - protein, 9 aa, Homo Sapiens
GSGVPGATV

SEQ ID NO: 1186977 - protein, 9 aa, Homo Sapiens
VFFFLFWFG

SEQ ID NO: 1186978 - protein, 9 aa, Homo Sapiens
RPASPARRR

SEQ ID NO: 1186979 - protein, 9 aa, Homo Sapiens
TLKRQGESS

SEQ ID NO: 1186980 - protein, 9 aa, Homo Sapiens
RPRWRQQNW

SEQ ID NO: 1186981 - protein, 9 aa, Homo Sapiens
RLVVNFVAL

SEQ ID NO: 1186982 - protein, 9 aa, Homo Sapiens
RDDVKVVPR

SEQ ID NO: 1186983 - protein, 9 aa, Homo Sapiens
PTATPPSTN

SEQ ID NO: 1186984 - protein, 9 aa, Homo Sapiens
WSDSPVPPG

SEQ ID NO: 1186985 - protein, 9 aa, Homo Sapiens
PRRPRGPWR

SEQ ID NO: 1186986 - protein, 9 aa, Homo Sapiens
TRATPGATT

SEQ ID NO: 1186987 - protein, 9 aa, Homo Sapiens
SWTIRHCTL

SEQ ID NO: 1186988 - protein, 9 aa, Homo Sapiens
RRQRRRRQR

SEQ ID NO: 1186989 - protein, 9 aa, Homo Sapiens
KKTKDLIAH

SEQ ID NO: 1186990 - protein, 9 aa, Homo Sapiens
VGADARLEK

SEQ ID NO: 1186991 - protein, 9 aa, Homo Sapiens
LFRVAMLLL

SEQ ID NO: 1186992 - protein, 9 aa, Homo Sapiens
ISWLLIFNI

SEQ ID NO: 1186993 - protein, 9 aa, Homo Sapiens
RVGARPGRG

SEQ ID NO: 1186994 - protein, 9 aa, Homo Sapiens
NAPLHCAAY

SEQ ID NO: 1186995 - protein, 9 aa, Homo Sapiens
ACMTGIPRL

SEQ ID NO: 1186996 - protein, 9 aa, Homo Sapiens
IVSWTPVSP

SEQ ID NO: 1186997 - protein, 9 aa, Homo Sapiens
LAWLLLAWA

SEQ ID NO: 1186998 - protein, 9 aa, Homo Sapiens
QHQALEEEI

SEQ ID NO: 1186999 - protein, 9 aa, Homo Sapiens
KGSSASCCV

SEQ ID NO: 1187000 - protein, 9 aa, Homo Sapiens
FAVWKLQLL

SEQ ID NO: 1187001 - protein, 9 aa, Homo Sapiens
WAMSMSLPS

SEQ ID NO: 1187002 - protein, 9 aa, Homo Sapiens
TAATPTLPA

SEQ ID NO: 1187003 - protein, 9 aa, Homo Sapiens
TKNGGLSGL

SEQ ID NO: 1187004 - protein, 9 aa, Homo Sapiens
QKFVPVDYS

SEQ ID NO: 1187005 - protein, 9 aa, Homo Sapiens
RCCLSRSVP

SEQ ID NO: 1187006 - protein, 9 aa, Homo Sapiens
SHACRSASW

SEQ ID NO: 1187007 - protein, 9 aa, Homo Sapiens
PRPTSAWQL

SEQ ID NO: 1187008 - protein, 9 aa, Homo Sapiens
SVCPETMML

SEQ ID NO: 1187009 - protein, 9 aa, Homo Sapiens
CVFHFSTAG

SEQ ID NO: 1187010 - protein, 9 aa, Homo Sapiens
PRGRVGARR

SEQ ID NO: 1187011 - protein, 9 aa, Homo Sapiens
HRQLHVGYL

SEQ ID NO: 1187012 - protein, 9 aa, Homo Sapiens
VISERCTDE

SEQ ID NO: 1187013 - protein, 9 aa, Homo Sapiens
RAGRQMGQG

SEQ ID NO: 1187014 - protein, 9 aa, Homo Sapiens
HFGQALVLQ

SEQ ID NO: 1187015 - protein, 9 aa, Homo Sapiens
SATSFSSLV

SEQ ID NO: 1187016 - protein, 9 aa, Homo Sapiens
DGRKERAQE

SEQ ID NO: 1187017 - protein, 9 aa, Homo Sapiens
KWHLVEIAP

SEQ ID NO: 1187018 - protein, 9 aa, Homo Sapiens
TGNGPPTWP

SEQ ID NO: 1187019 - protein, 9 aa, Homo Sapiens
TQLPSLEAL

SEQ ID NO: 1187020 - protein, 9 aa, Homo Sapiens
NMRGVCFDV

SEQ ID NO: 1187021 - protein, 9 aa, Homo Sapiens
QRPPRSILS

SEQ ID NO: 1187022 - protein, 9 aa, Homo Sapiens
WYNLEKRTY

SEQ ID NO: 1187023 - protein, 9 aa, Homo Sapiens
VVGAGDVGK

SEQ ID NO: 1187024 - protein, 9 aa, Homo Sapiens
ALGVRISAK

SEQ ID NO: 1187025 - protein, 9 aa, Homo Sapiens
RGSSSANHV

SEQ ID NO: 1187026 - protein, 9 aa, Homo Sapiens
SKCGMEPGA

SEQ ID NO: 1187027 - protein, 9 aa, Homo Sapiens
AAHSQPLAQ

SEQ ID NO: 1187028 - protein, 9 aa, Homo Sapiens
ICSSIGRPG

SEQ ID NO: 1187029 - protein, 9 aa, Homo Sapiens
TGSGMGMLL

SEQ ID NO: 1187030 - protein, 9 aa, Homo Sapiens
RPASGGCCS

SEQ ID NO: 1187031 - protein, 9 aa, Homo Sapiens
MRECQGFVP

SEQ ID NO: 1187032 - protein, 9 aa, Homo Sapiens
EGLVENGGL

SEQ ID NO: 1187033 - protein, 9 aa, Homo Sapiens
ACSRVQIRH

SEQ ID NO: 1187034 - protein, 9 aa, Homo Sapiens
EARAPLESV

SEQ ID NO: 1187035 - protein, 9 aa, Homo Sapiens
RNFLEAWRA

SEQ ID NO: 1187036 - protein, 9 aa, Homo Sapiens
LWAGAARAI

SEQ ID NO: 1187037 - protein, 9 aa, Homo Sapiens
AAHYSRSDA

SEQ ID NO: 1187038 - protein, 9 aa, Homo Sapiens
PQPGGTPTP

SEQ ID NO: 1187039 - protein, 9 aa, Homo Sapiens
GRPAGQVSG

SEQ ID NO: 1187040 - protein, 9 aa, Homo Sapiens
TTPAAGEWT

SEQ ID NO: 1187041 - protein, 9 aa, Homo Sapiens
SVDKGKCLG

SEQ ID NO: 1187042 - protein, 9 aa, Homo Sapiens
RVEALESAL

SEQ ID NO: 1187043 - protein, 9 aa, Homo Sapiens
KCLPAAPGA

SEQ ID NO: 1187044 - protein, 9 aa, Homo Sapiens
PGWMPRCTW

SEQ ID NO: 1187045 - protein, 9 aa, Homo Sapiens
FLGLQLVKM

SEQ ID NO: 1187046 - protein, 9 aa, Homo Sapiens
FSRSPPTLM

SEQ ID NO: 1187047 - protein, 9 aa, Homo Sapiens
TNCPACTPG

SEQ ID NO: 1187048 - protein, 9 aa, Homo Sapiens
NGLLLYYQR

SEQ ID NO: 1187049 - protein, 9 aa, Homo Sapiens
FGTIKSQEP

SEQ ID NO: 1187050 - protein, 9 aa, Homo Sapiens
PHVFHKKNR

SEQ ID NO: 1187051 - protein, 9 aa, Homo Sapiens
AATPTLPAT

SEQ ID NO: 1187052 - protein, 9 aa, Homo Sapiens
EERKPATQQ

SEQ ID NO: 1187053 - protein, 9 aa, Homo Sapiens
LIDVLHLVH

SEQ ID NO: 1187054 - protein, 9 aa, Homo Sapiens
CLERTAWSW

SEQ ID NO: 1187055 - protein, 9 aa, Homo Sapiens
SSNTGMPDI

SEQ ID NO: 1187056 - protein, 9 aa, Homo Sapiens
ASCTGAGVN

SEQ ID NO: 1187057 - protein, 9 aa, Homo Sapiens
AQVKTEAAG

SEQ ID NO: 1187058 - protein, 9 aa, Homo Sapiens
NRMWQRIAQ

SEQ ID NO: 1187059 - protein, 9 aa, Homo Sapiens
TAETRVPGA

SEQ ID NO: 1187060 - protein, 9 aa, Homo Sapiens
QAFNGLMSL

SEQ ID NO: 1187061 - protein, 9 aa, Homo Sapiens
PGSHGRRQV

SEQ ID NO: 1187062 - protein, 9 aa, Homo Sapiens
ISALIAARG

SEQ ID NO: 1187063 - protein, 9 aa, Homo Sapiens
PGRRQRRRR

SEQ ID NO: 1187064 - protein, 9 aa, Homo Sapiens
WHTTEACFS

SEQ ID NO: 1187065 - protein, 9 aa, Homo Sapiens
CEENMRGVC

SEQ ID NO: 1187066 - protein, 9 aa, Homo Sapiens
LIKSLLVTV

SEQ ID NO: 1187067 - protein, 9 aa, Homo Sapiens
STGQAYSAA

SEQ ID NO: 1187068 - protein, 9 aa, Homo Sapiens
MHTGKIPSV

SEQ ID NO: 1187069 - protein, 9 aa, Homo Sapiens
GKAHAQKPQ

SEQ ID NO: 1187070 - protein, 9 aa, Homo Sapiens
SRKFPSWRI

SEQ ID NO: 1187071 - protein, 9 aa, Homo Sapiens
VSGSQVSAP

SEQ ID NO: 1187072 - protein, 9 aa, Homo Sapiens
AHHVVALVG

SEQ ID NO: 1187073 - protein, 9 aa, Homo Sapiens
CTGNPNDGN

SEQ ID NO: 1187074 - protein, 9 aa, Homo Sapiens
PPVHHPQPK

SEQ ID NO: 1187075 - protein, 9 aa, Homo Sapiens
AFSCLACWV

SEQ ID NO: 1187076 - protein, 9 aa, Homo Sapiens
GAALVGAGA

SEQ ID NO: 1187077 - protein, 9 aa, Homo Sapiens
GHRQTPGDP

SEQ ID NO: 1187078 - protein, 9 aa, Homo Sapiens
PWGPPQSCR

SEQ ID NO: 1187079 - protein, 9 aa, Homo Sapiens
PSNENCHKT

SEQ ID NO: 1187080 - protein, 9 aa, Homo Sapiens
GGCCSPAGP

SEQ ID NO: 1187081 - protein, 9 aa, Homo Sapiens
TAMWLSASH

SEQ ID NO: 1187082 - protein, 9 aa, Homo Sapiens
TWPTQTWTR

SEQ ID NO: 1187083 - protein, 9 aa, Homo Sapiens
VCPRAGPCL

SEQ ID NO: 1187084 - protein, 9 aa, Homo Sapiens
KEPKVCEDL

SEQ ID NO: 1187085 - protein, 9 aa, Homo Sapiens
SSGQHCSSS

SEQ ID NO: 1187086 - protein, 9 aa, Homo Sapiens
PGLAARRRR

SEQ ID NO: 1187087 - protein, 9 aa, Homo Sapiens
ERCVVLNFH

SEQ ID NO: 1187088 - protein, 9 aa, Homo Sapiens
WGHAGKAQL

SEQ ID NO: 1187089 - protein, 9 aa, Homo Sapiens
KWPLQCLLH

SEQ ID NO: 1187090 - protein, 9 aa, Homo Sapiens
CRALAPALC

SEQ ID NO: 1187091 - protein, 9 aa, Homo Sapiens
LPIESQMAS

SEQ ID NO: 1187092 - protein, 9 aa, Homo Sapiens
KPVWVMWMW

SEQ ID NO: 1187093 - protein, 9 aa, Homo Sapiens
HSTYVVPTQ

SEQ ID NO: 1187094 - protein, 9 aa, Homo Sapiens
WQWRGMGCP

SEQ ID NO: 1187095 - protein, 9 aa, Homo Sapiens
ISYVFITCA

SEQ ID NO: 1187096 - protein, 9 aa, Homo Sapiens
LQQVGQPHA

SEQ ID NO: 1187097 - protein, 9 aa, Homo Sapiens
GAGDELVLG

SEQ ID NO: 1187098 - protein, 9 aa, Homo Sapiens
ATAFFPDLM

SEQ ID NO: 1187099 - protein, 9 aa, Homo Sapiens
AGHLLQPVR

SEQ ID NO: 1187100 - protein, 9 aa, Homo Sapiens
LPRLTRERA

SEQ ID NO: 1187101 - protein, 9 aa, Homo Sapiens
HALRALHLD

SEQ ID NO: 1187102 - protein, 9 aa, Homo Sapiens
HHVRDLVQR

SEQ ID NO: 1187103 - protein, 9 aa, Homo Sapiens
NEHLKCAGK

SEQ ID NO: 1187104 - protein, 9 aa, Homo Sapiens
TTCPTPARW

SEQ ID NO: 1187105 - protein, 9 aa, Homo Sapiens
PKASPPPAG

SEQ ID NO: 1187106 - protein, 9 aa, Homo Sapiens
LWSRLSLLA

SEQ ID NO: 1187107 - protein, 9 aa, Homo Sapiens
CRSLAITQG

SEQ ID NO: 1187108 - protein, 9 aa, Homo Sapiens
TDADGVWPC

SEQ ID NO: 1187109 - protein, 9 aa, Homo Sapiens
VDGPFLFFI

SEQ ID NO: 1187110 - protein, 9 aa, Homo Sapiens
LGQPRQLPR

SEQ ID NO: 1187111 - protein, 9 aa, Homo Sapiens
RAPVRAWRT

SEQ ID NO: 1187112 - protein, 9 aa, Homo Sapiens
KSSKSNSKN

SEQ ID NO: 1187113 - protein, 9 aa, Homo Sapiens
KMCAPVGNG

SEQ ID NO: 1187114 - protein, 9 aa, Homo Sapiens
EAVKKLIVN

SEQ ID NO: 1187115 - protein, 9 aa, Homo Sapiens
LVRARRACG

SEQ ID NO: 1187116 - protein, 9 aa, Homo Sapiens
KLRSLYDIP

SEQ ID NO: 1187117 - protein, 9 aa, Homo Sapiens
TWWLAHDCL

SEQ ID NO: 1187118 - protein, 9 aa, Homo Sapiens
QYGVKVILQ

SEQ ID NO: 1187119 - protein, 9 aa, Homo Sapiens
GWAGIIWEA

SEQ ID NO: 1187120 - protein, 9 aa, Homo Sapiens
KEAKRIPEN

SEQ ID NO: 1187121 - protein, 9 aa, Homo Sapiens
MWGEQEQQG

SEQ ID NO: 1187122 - protein, 9 aa, Homo Sapiens
KALAPLLKL

SEQ ID NO: 1187123 - protein, 9 aa, Homo Sapiens
LALHEGSLY

SEQ ID NO: 1187124 - protein, 9 aa, Homo Sapiens
VELVQELQK

SEQ ID NO: 1187125 - protein, 9 aa, Homo Sapiens
ALAAPDLAG

SEQ ID NO: 1187126 - protein, 9 aa, Homo Sapiens
PRTLFKFFW

SEQ ID NO: 1187127 - protein, 9 aa, Homo Sapiens
APNDSSGSS

SEQ ID NO: 1187128 - protein, 9 aa, Homo Sapiens
REARKQRLA

SEQ ID NO: 1187129 - protein, 9 aa, Homo Sapiens
TSVPWPVAT

SEQ ID NO: 1187130 - protein, 9 aa, Homo Sapiens
IHFAAHDQE

SEQ ID NO: 1187131 - protein, 9 aa, Homo Sapiens
LRTHTGEHP

SEQ ID NO: 1187132 - protein, 9 aa, Homo Sapiens
RLEILEIIE

SEQ ID NO: 1187133 - protein, 9 aa, Homo Sapiens
QFMGAVMFI

SEQ ID NO: 1187134 - protein, 9 aa, Homo Sapiens
VGSCVDSAV

SEQ ID NO: 1187135 - protein, 9 aa, Homo Sapiens
LLQRNLLRL

SEQ ID NO: 1187136 - protein, 9 aa, Homo Sapiens
AAPMSVGPR

SEQ ID NO: 1187137 - protein, 9 aa, Homo Sapiens
GEHPFACDW

SEQ ID NO: 1187138 - protein, 9 aa, Homo Sapiens
EEAPAKEST

SEQ ID NO: 1187139 - protein, 9 aa, Homo Sapiens
DLDEMNIKI

SEQ ID NO: 1187140 - protein, 9 aa, Homo Sapiens
CFKLDLSLN

SEQ ID NO: 1187141 - protein, 9 aa, Homo Sapiens
LGLHTGEVR

SEQ ID NO: 1187142 - protein, 9 aa, Homo Sapiens
NDRLTILLP

SEQ ID NO: 1187143 - protein, 9 aa, Homo Sapiens
RSASTARST

SEQ ID NO: 1187144 - protein, 9 aa, Homo Sapiens
PDNTNQPNF

SEQ ID NO: 1187145 - protein, 9 aa, Homo Sapiens
LPGGLFNMS

SEQ ID NO: 1187146 - protein, 9 aa, Homo Sapiens
NVTTCPELR

SEQ ID NO: 1187147 - protein, 9 aa, Homo Sapiens
STTCMVTAA

SEQ ID NO: 1187148 - protein, 9 aa, Homo Sapiens
ATLLFLIKS

SEQ ID NO: 1187149 - protein, 9 aa, Homo Sapiens
LWRLTGLEV

SEQ ID NO: 1187150 - protein, 9 aa, Homo Sapiens
SFFIYRKIQ

SEQ ID NO: 1187151 - protein, 9 aa, Homo Sapiens
RKSHLIFSI

SEQ ID NO: 1187152 - protein, 9 aa, Homo Sapiens
VTPGPPPCR

SEQ ID NO: 1187153 - protein, 9 aa, Homo Sapiens
DDNLKTRAK

SEQ ID NO: 1187154 - protein, 9 aa, Homo Sapiens
EAYKCQIVI

SEQ ID NO: 1187155 - protein, 9 aa, Homo Sapiens
FNAEAMTTA

SEQ ID NO: 1187156 - protein, 9 aa, Homo Sapiens
VDGQCICDN

SEQ ID NO: 1187157 - protein, 9 aa, Homo Sapiens
RTLTLECPF

SEQ ID NO: 1187158 - protein, 9 aa, Homo Sapiens
RESDCSSVQ

SEQ ID NO: 1187159 - protein, 9 aa, Homo Sapiens
ARATSPCTK

SEQ ID NO: 1187160 - protein, 9 aa, Homo Sapiens
MPASLCMVS

SEQ ID NO: 1187161 - protein, 9 aa, Homo Sapiens
PHPPQPTSG

SEQ ID NO: 1187162 - protein, 9 aa, Homo Sapiens
RARPSHACR

SEQ ID NO: 1187163 - protein, 9 aa, Homo Sapiens
SRTCTSSSS

SEQ ID NO: 1187164 - protein, 9 aa, Homo Sapiens
PKGSKTRVP

SEQ ID NO: 1187165 - protein, 9 aa, Homo Sapiens
VLRPLEGAV

SEQ ID NO: 1187166 - protein, 9 aa, Homo Sapiens
ALEAWGQPQ

SEQ ID NO: 1187167 - protein, 9 aa, Homo Sapiens
VAHPARTPA

SEQ ID NO: 1187168 - protein, 9 aa, Homo Sapiens
QTLKRQGES

SEQ ID NO: 1187169 - protein, 9 aa, Homo Sapiens
EGIPPTSRG

SEQ ID NO: 1187170 - protein, 9 aa, Homo Sapiens
LGQPHSCFP

SEQ ID NO: 1187171 - protein, 9 aa, Homo Sapiens
QDQWGPKDH

SEQ ID NO: 1187172 - protein, 9 aa, Homo Sapiens
NQPNFMQLR

SEQ ID NO: 1187173 - protein, 9 aa, Homo Sapiens
HSNSDNAET

SEQ ID NO: 1187174 - protein, 9 aa, Homo Sapiens
TNHHIVAPT

SEQ ID NO: 1187175 - protein, 9 aa, Homo Sapiens
SVKMVIVVM

SEQ ID NO: 1187176 - protein, 9 aa, Homo Sapiens
PAGSGQVAA

SEQ ID NO: 1187177 - protein, 9 aa, Homo Sapiens
GGLPCRLGL

SEQ ID NO: 1187178 - protein, 9 aa, Homo Sapiens
SGVPGATVS

SEQ ID NO: 1187179 - protein, 9 aa, Homo Sapiens
ECGKAFHQG

SEQ ID NO: 1187180 - protein, 9 aa, Homo Sapiens
GEEPSHEGL

SEQ ID NO: 1187181 - protein, 9 aa, Homo Sapiens
PTASPQWSP

SEQ ID NO: 1187182 - protein, 9 aa, Homo Sapiens
HNKLFRRSL

SEQ ID NO: 1187183 - protein, 9 aa, Homo Sapiens
RVWMVLGLM

SEQ ID NO: 1187184 - protein, 9 aa, Homo Sapiens
SQGGSQPQL

SEQ ID NO: 1187185 - protein, 9 aa, Homo Sapiens
ASASNSSRF

SEQ ID NO: 1187186 - protein, 9 aa, Homo Sapiens
RRRTGPPRL

SEQ ID NO: 1187187 - protein, 9 aa, Homo Sapiens
IVDVGLAGD

SEQ ID NO: 1187188 - protein, 9 aa, Homo Sapiens
PQQQKGGRG

SEQ ID NO: 1187189 - protein, 9 aa, Homo Sapiens
GVNLMKEAT

SEQ ID NO: 1187190 - protein, 9 aa, Homo Sapiens
VPRRSASRL

SEQ ID NO: 1187191 - protein, 9 aa, Homo Sapiens
RPRRSEPVV

SEQ ID NO: 1187192 - protein, 9 aa, Homo Sapiens
LFESLPRAV

SEQ ID NO: 1187193 - protein, 9 aa, Homo Sapiens
LSPRSRCGP

SEQ ID NO: 1187194 - protein, 9 aa, Homo Sapiens
GRRGPDGVM

SEQ ID NO: 1187195 - protein, 9 aa, Homo Sapiens
AILSRQTKR

SEQ ID NO: 1187196 - protein, 9 aa, Homo Sapiens
LAALMSLLA

SEQ ID NO: 1187197 - protein, 9 aa, Homo Sapiens
IGNTAVILV

SEQ ID NO: 1187198 - protein, 9 aa, Homo Sapiens
HPSRPSNSN

SEQ ID NO: 1187199 - protein, 9 aa, Homo Sapiens
GCAMRWTLC

SEQ ID NO: 1187200 - protein, 9 aa, Homo Sapiens
NNLAMLERQ

SEQ ID NO: 1187201 - protein, 9 aa, Homo Sapiens
MLALTSDAL

SEQ ID NO: 1187202 - protein, 9 aa, Homo Sapiens
KEKECMQAC

SEQ ID NO: 1187203 - protein, 9 aa, Homo Sapiens
INIFWMAMF

SEQ ID NO: 1187204 - protein, 9 aa, Homo Sapiens
YKKKTEAAE

SEQ ID NO: 1187205 - protein, 9 aa, Homo Sapiens
PFLRPCHLL

SEQ ID NO: 1187206 - protein, 9 aa, Homo Sapiens
YCDYHLAWL

SEQ ID NO: 1187207 - protein, 9 aa, Homo Sapiens
HGLAQGGSA

SEQ ID NO: 1187208 - protein, 9 aa, Homo Sapiens
LRHRFDCIS

SEQ ID NO: 1187209 - protein, 9 aa, Homo Sapiens
SWLSWRPRW

SEQ ID NO: 1187210 - protein, 9 aa, Homo Sapiens
ALACPAYPY

SEQ ID NO: 1187211 - protein, 9 aa, Homo Sapiens
SNSDNAETK

SEQ ID NO: 1187212 - protein, 9 aa, Homo Sapiens
LLHGVEPLA

SEQ ID NO: 1187213 - protein, 9 aa, Homo Sapiens
VLKCRNSRN

SEQ ID NO: 1187214 - protein, 9 aa, Homo Sapiens
YSLSNKEVT

SEQ ID NO: 1187215 - protein, 9 aa, Homo Sapiens
RRRTTCRRP

SEQ ID NO: 1187216 - protein, 9 aa, Homo Sapiens
STFLPAPSP

SEQ ID NO: 1187217 - protein, 9 aa, Homo Sapiens
DMMKKPCCG

SEQ ID NO: 1187218 - protein, 9 aa, Homo Sapiens
HYYYQSANS

SEQ ID NO: 1187219 - protein, 9 aa, Homo Sapiens
YKTAGDSGI

SEQ ID NO: 1187220 - protein, 9 aa, Homo Sapiens
TAWSHCPLL

SEQ ID NO: 1187221 - protein, 9 aa, Homo Sapiens
SSHILCMAI

SEQ ID NO: 1187222 - protein, 9 aa, Homo Sapiens
LRMSDLMPV

SEQ ID NO: 1187223 - protein, 9 aa, Homo Sapiens
STAIILRHT

SEQ ID NO: 1187224 - protein, 9 aa, Homo Sapiens
PCPPLEVHL

SEQ ID NO: 1187225 - protein, 9 aa, Homo Sapiens
MRSLEAHCP

SEQ ID NO: 1187226 - protein, 9 aa, Homo Sapiens
WIDPNPQPQ

SEQ ID NO: 1187227 - protein, 9 aa, Homo Sapiens
PLEALTGQG

SEQ ID NO: 1187228 - protein, 9 aa, Homo Sapiens
LWTIGVEMV

SEQ ID NO: 1187229 - protein, 9 aa, Homo Sapiens
HQKDKPGMR

SEQ ID NO: 1187230 - protein, 9 aa, Homo Sapiens
CRRKKKVRS

SEQ ID NO: 1187231 - protein, 9 aa, Homo Sapiens
RFQLEGASD

SEQ ID NO: 1187232 - protein, 9 aa, Homo Sapiens
LRSLYDIPY

SEQ ID NO: 1187233 - protein, 9 aa, Homo Sapiens
GHAAQLLRA

SEQ ID NO: 1187234 - protein, 9 aa, Homo Sapiens
PRGKRTQGT

SEQ ID NO: 1187235 - protein, 9 aa, Homo Sapiens
PDPDLDPDP

SEQ ID NO: 1187236 - protein, 9 aa, Homo Sapiens
RPLWSRLSL

SEQ ID NO: 1187237 - protein, 9 aa, Homo Sapiens
SSSSPLRVV

SEQ ID NO: 1187238 - protein, 9 aa, Homo Sapiens
PDVVLRLSC

SEQ ID NO: 1187239 - protein, 9 aa, Homo Sapiens
TLPTTSLKG

SEQ ID NO: 1187240 - protein, 9 aa, Homo Sapiens
RAAARAAAR

SEQ ID NO: 1187241 - protein, 9 aa, Homo Sapiens
FYPQGLWED

SEQ ID NO: 1187242 - protein, 9 aa, Homo Sapiens
CSSIGRPGI

SEQ ID NO: 1187243 - protein, 9 aa, Homo Sapiens
SGGGKGTES

SEQ ID NO: 1187244 - protein, 9 aa, Homo Sapiens
TEIFPALSR

SEQ ID NO: 1187245 - protein, 9 aa, Homo Sapiens
PTGCFCPAD

SEQ ID NO: 1187246 - protein, 9 aa, Homo Sapiens
SLLRRKLKR

SEQ ID NO: 1187247 - protein, 9 aa, Homo Sapiens
LTEGRERIL

SEQ ID NO: 1187248 - protein, 9 aa, Homo Sapiens
LHLVHQLHG

SEQ ID NO: 1187249 - protein, 9 aa, Homo Sapiens
GSVRERQAR

SEQ ID NO: 1187250 - protein, 9 aa, Homo Sapiens
HRVTRCRHE

SEQ ID NO: 1187251 - protein, 9 aa, Homo Sapiens
APGTPHSHI

SEQ ID NO: 1187252 - protein, 9 aa, Homo Sapiens
GSCGCSKGG

SEQ ID NO: 1187253 - protein, 9 aa, Homo Sapiens
EAAPDQADS

SEQ ID NO: 1187254 - protein, 9 aa, Homo Sapiens
VTSPISHLP

SEQ ID NO: 1187255 - protein, 9 aa, Homo Sapiens
PPKLVSSAD

SEQ ID NO: 1187256 - protein, 9 aa, Homo Sapiens
ASPPSFPAM

SEQ ID NO: 1187257 - protein, 9 aa, Homo Sapiens
EMLALTSDA

SEQ ID NO: 1187258 - protein, 9 aa, Homo Sapiens
QPLGVLALQ

SEQ ID NO: 1187259 - protein, 9 aa, Homo Sapiens
LRGHAQMCR

SEQ ID NO: 1187260 - protein, 9 aa, Homo Sapiens
GQAQDTSGH

SEQ ID NO: 1187261 - protein, 9 aa, Homo Sapiens
MCDSISEWV

SEQ ID NO: 1187262 - protein, 9 aa, Homo Sapiens
CQACGEEPS

SEQ ID NO: 1187263 - protein, 9 aa, Homo Sapiens
QGLACRRRR

SEQ ID NO: 1187264 - protein, 9 aa, Homo Sapiens
AAVWGAGRA

SEQ ID NO: 1187265 - protein, 9 aa, Homo Sapiens
ESSNCKNGS

SEQ ID NO: 1187266 - protein, 9 aa, Homo Sapiens
TPSLKPDIP

SEQ ID NO: 1187267 - protein, 9 aa, Homo Sapiens
LRGGCGHHR

SEQ ID NO: 1187268 - protein, 9 aa, Homo Sapiens
RIRHGQTLP

SEQ ID NO: 1187269 - protein, 9 aa, Homo Sapiens
TIRHCTLTW

SEQ ID NO: 1187270 - protein, 9 aa, Homo Sapiens
PTAPQRPPS

SEQ ID NO: 1187271 - protein, 9 aa, Homo Sapiens
FTSSLPCLK

SEQ ID NO: 1187272 - protein, 9 aa, Homo Sapiens
SRPATSPSP

SEQ ID NO: 1187273 - protein, 9 aa, Homo Sapiens
VCHANIIQL

SEQ ID NO: 1187274 - protein, 9 aa, Homo Sapiens
QRPSNSRKF

SEQ ID NO: 1187275 - protein, 9 aa, Homo Sapiens
LFSHSQVLC

SEQ ID NO: 1187276 - protein, 9 aa, Homo Sapiens
SLWSDSPVP

SEQ ID NO: 1187277 - protein, 9 aa, Homo Sapiens
RSRAASVGH

SEQ ID NO: 1187278 - protein, 9 aa, Homo Sapiens
YPPPYYPGI

SEQ ID NO: 1187279 - protein, 9 aa, Homo Sapiens
WSPCDRSWL

SEQ ID NO: 1187280 - protein, 9 aa, Homo Sapiens
DREASIVIL

SEQ ID NO: 1187281 - protein, 9 aa, Homo Sapiens
LLDTDPAHT

SEQ ID NO: 1187282 - protein, 9 aa, Homo Sapiens
QGDTSHLSV

SEQ ID NO: 1187283 - protein, 9 aa, Homo Sapiens
RALRGGCGH

SEQ ID NO: 1187284 - protein, 9 aa, Homo Sapiens
ADIPECKKS

SEQ ID NO: 1187285 - protein, 9 aa, Homo Sapiens
HEVAPKRIE

SEQ ID NO: 1187286 - protein, 9 aa, Homo Sapiens
GATGTDADG

SEQ ID NO: 1187287 - protein, 9 aa, Homo Sapiens
NLSFLTPPC

SEQ ID NO: 1187288 - protein, 9 aa, Homo Sapiens
TFEKKRGKN

SEQ ID NO: 1187289 - protein, 9 aa, Homo Sapiens
RKFGWQMRA

SEQ ID NO: 1187290 - protein, 9 aa, Homo Sapiens
ELINSPFRD

SEQ ID NO: 1187291 - protein, 9 aa, Homo Sapiens
YSKAEYAPP

SEQ ID NO: 1187292 - protein, 9 aa, Homo Sapiens
GVPLTCSVV

SEQ ID NO: 1187293 - protein, 9 aa, Homo Sapiens
LLRRRTSWK

SEQ ID NO: 1187294 - protein, 9 aa, Homo Sapiens
LQQTTGCSQ

SEQ ID NO: 1187295 - protein, 9 aa, Homo Sapiens
SNRSLPGTT

SEQ ID NO: 1187296 - protein, 9 aa, Homo Sapiens
LAPVPGSSA

SEQ ID NO: 1187297 - protein, 9 aa, Homo Sapiens
LKALAPLLK

SEQ ID NO: 1187298 - protein, 9 aa, Homo Sapiens
RPIASPWFA

SEQ ID NO: 1187299 - protein, 9 aa, Homo Sapiens
TSTKTRKAL

SEQ ID NO: 1187300 - protein, 9 aa, Homo Sapiens
TACLLILLI

SEQ ID NO: 1187301 - protein, 9 aa, Homo Sapiens
HRGTHELGV

SEQ ID NO: 1187302 - protein, 9 aa, Homo Sapiens
HSSPTASVL

SEQ ID NO: 1187303 - protein, 9 aa, Homo Sapiens
DALHTLQNY

SEQ ID NO: 1187304 - protein, 9 aa, Homo Sapiens
GKRAATVTR

SEQ ID NO: 1187305 - protein, 9 aa, Homo Sapiens
IIRLGIAVR

SEQ ID NO: 1187306 - protein, 9 aa, Homo Sapiens
CGSSCQSGF

SEQ ID NO: 1187307 - protein, 9 aa, Homo Sapiens
FREEQCRQC

SEQ ID NO: 1187308 - protein, 9 aa, Homo Sapiens
SQNVTTCPE

SEQ ID NO: 1187309 - protein, 9 aa, Homo Sapiens
LSEHSQLYG

SEQ ID NO: 1187310 - protein, 9 aa, Homo Sapiens
SQASHMLPQ

SEQ ID NO: 1187311 - protein, 9 aa, Homo Sapiens
SRQGWLLCK

SEQ ID NO: 1187312 - protein, 9 aa, Homo Sapiens
GSAPSMPAC

SEQ ID NO: 1187313 - protein, 9 aa, Homo Sapiens
LSNHNSKFH

SEQ ID NO: 1187314 - protein, 9 aa, Homo Sapiens
PSHSSPLPS

SEQ ID NO: 1187315 - protein, 9 aa, Homo Sapiens
DPSSPRRCD

SEQ ID NO: 1187316 - protein, 9 aa, Homo Sapiens
DGDDEVVAV

SEQ ID NO: 1187317 - protein, 9 aa, Homo Sapiens
PNLLQDRFP

SEQ ID NO: 1187318 - protein, 9 aa, Homo Sapiens
GRCGVWRRR

SEQ ID NO: 1187319 - protein, 9 aa, Homo Sapiens
VLWGCLLTT

SEQ ID NO: 1187320 - protein, 9 aa, Homo Sapiens
LHERRAAGA

SEQ ID NO: 1187321 - protein, 9 aa, Homo Sapiens
ATPGATTVA

SEQ ID NO: 1187322 - protein, 9 aa, Homo Sapiens
VEVAAGPPM

SEQ ID NO: 1187323 - protein, 9 aa, Homo Sapiens
CGRAPAQPP

SEQ ID NO: 1187324 - protein, 9 aa, Homo Sapiens
AMPQDQVAQ

SEQ ID NO: 1187325 - protein, 9 aa, Homo Sapiens
LPASMKLFC

SEQ ID NO: 1187326 - protein, 9 aa, Homo Sapiens
QQHLQEALG

SEQ ID NO: 1187327 - protein, 9 aa, Homo Sapiens
MTFFEVSHL

SEQ ID NO: 1187328 - protein, 9 aa, Homo Sapiens
DGAGARTAS

SEQ ID NO: 1187329 - protein, 9 aa, Homo Sapiens
EEAVKKLIV

SEQ ID NO: 1187330 - protein, 9 aa, Homo Sapiens
TCPTPARWG

SEQ ID NO: 1187331 - protein, 9 aa, Homo Sapiens
SKTRVPLKQ

SEQ ID NO: 1187332 - protein, 9 aa, Homo Sapiens
LLLPRKHRG

SEQ ID NO: 1187333 - protein, 9 aa, Homo Sapiens
LRTLLLALV

SEQ ID NO: 1187334 - protein, 9 aa, Homo Sapiens
GQLRGRARA

SEQ ID NO: 1187335 - protein, 9 aa, Homo Sapiens
GAPQGAVYM

SEQ ID NO: 1187336 - protein, 9 aa, Homo Sapiens
LHAMHTLSE

SEQ ID NO: 1187337 - protein, 9 aa, Homo Sapiens
HRLRRYCVF

SEQ ID NO: 1187338 - protein, 9 aa, Homo Sapiens
GRHPQWCWS

SEQ ID NO: 1187339 - protein, 9 aa, Homo Sapiens
QTMKVRSAG

SEQ ID NO: 1187340 - protein, 9 aa, Homo Sapiens
CQSEELRCW

SEQ ID NO: 1187341 - protein, 9 aa, Homo Sapiens
RPKATSQSG

SEQ ID NO: 1187342 - protein, 9 aa, Homo Sapiens
KLGVGVFNL

SEQ ID NO: 1187343 - protein, 9 aa, Homo Sapiens
KFSLDRPSC

SEQ ID NO: 1187344 - protein, 9 aa, Homo Sapiens
RHGQSGQGQ

SEQ ID NO: 1187345 - protein, 9 aa, Homo Sapiens
LDNLQLVLW

SEQ ID NO: 1187346 - protein, 9 aa, Homo Sapiens
SRATGSPRT

SEQ ID NO: 1187347 - protein, 9 aa, Homo Sapiens
PSSLTTANA

SEQ ID NO: 1187348 - protein, 9 aa, Homo Sapiens
WDILQKTVR

SEQ ID NO: 1187349 - protein, 9 aa, Homo Sapiens
QCLRCQHQH

SEQ ID NO: 1187350 - protein, 9 aa, Homo Sapiens
SASTARSTW

SEQ ID NO: 1187351 - protein, 9 aa, Homo Sapiens
LQTVLETIT

SEQ ID NO: 1187352 - protein, 9 aa, Homo Sapiens
LLAQQQRVQ

SEQ ID NO: 1187353 - protein, 9 aa, Homo Sapiens
GEKKNMKKK

SEQ ID NO: 1187354 - protein, 9 aa, Homo Sapiens
FRDKRIAKH

SEQ ID NO: 1187355 - protein, 9 aa, Homo Sapiens
EMKKTTSQS

SEQ ID NO: 1187356 - protein, 9 aa, Homo Sapiens
AGGDASCAR

SEQ ID NO: 1187357 - protein, 9 aa, Homo Sapiens
HHIVAPTRT

SEQ ID NO: 1187358 - protein, 9 aa, Homo Sapiens
HQDAEWQHS

SEQ ID NO: 1187359 - protein, 9 aa, Homo Sapiens
QCRKKSHCL

SEQ ID NO: 1187360 - protein, 9 aa, Homo Sapiens
KRYRALFRL

SEQ ID NO: 1187361 - protein, 9 aa, Homo Sapiens
GATPTGPSS

SEQ ID NO: 1187362 - protein, 9 aa, Homo Sapiens
ADDLIKVSD

SEQ ID NO: 1187363 - protein, 9 aa, Homo Sapiens
LGRPPTPLF

SEQ ID NO: 1187364 - protein, 9 aa, Homo Sapiens
FLPAPSPAP

SEQ ID NO: 1187365 - protein, 9 aa, Homo Sapiens
PLPCPPRVT

SEQ ID NO: 1187366 - protein, 9 aa, Homo Sapiens
QLVCPVTQD

SEQ ID NO: 1187367 - protein, 9 aa, Homo Sapiens
EALACPAYP

SEQ ID NO: 1187368 - protein, 9 aa, Homo Sapiens
WACCGTRRS

SEQ ID NO: 1187369 - protein, 9 aa, Homo Sapiens
ALAQFGEGA

SEQ ID NO: 1187370 - protein, 9 aa, Homo Sapiens
QKFSVMRRM

SEQ ID NO: 1187371 - protein, 9 aa, Homo Sapiens
NLWYTMDRP

SEQ ID NO: 1187372 - protein, 9 aa, Homo Sapiens
KKRETHKAL

SEQ ID NO: 1187373 - protein, 9 aa, Homo Sapiens
EVAWCEVQD

SEQ ID NO: 1187374 - protein, 9 aa, Homo Sapiens
SAGTQAAEE

SEQ ID NO: 1187375 - protein, 9 aa, Homo Sapiens
RLRQALVRC

SEQ ID NO: 1187376 - protein, 9 aa, Homo Sapiens
SFPAMLHAH

SEQ ID NO: 1187377 - protein, 9 aa, Homo Sapiens
APPWPRRSK

SEQ ID NO: 1187378 - protein, 9 aa, Homo Sapiens
RVSRKMGFH

SEQ ID NO: 1187379 - protein, 9 aa, Homo Sapiens
IRYERDNNL

SEQ ID NO: 1187380 - protein, 9 aa, Homo Sapiens
TETTTGRPL

SEQ ID NO: 1187381 - protein, 9 aa, Homo Sapiens
KYDSLSNHN

SEQ ID NO: 1187382 - protein, 9 aa, Homo Sapiens
PCLKIVIAV

SEQ ID NO: 1187383 - protein, 9 aa, Homo Sapiens
TGAPARCGP

SEQ ID NO: 1187384 - protein, 9 aa, Homo Sapiens
TLVCTCMCT

SEQ ID NO: 1187385 - protein, 9 aa, Homo Sapiens
LRATVPRHS

SEQ ID NO: 1187386 - protein, 9 aa, Homo Sapiens
QQTAIHQVP

SEQ ID NO: 1187387 - protein, 9 aa, Homo Sapiens
QGGPTIGAR

SEQ ID NO: 1187388 - protein, 9 aa, Homo Sapiens
VTHTEHAKR

SEQ ID NO: 1187389 - protein, 9 aa, Homo Sapiens
LLHDPMTLL

SEQ ID NO: 1187390 - protein, 9 aa, Homo Sapiens
RIYIIILST

SEQ ID NO: 1187391 - protein, 9 aa, Homo Sapiens
TQRIKEFRR

SEQ ID NO: 1187392 - protein, 9 aa, Homo Sapiens
MPQGYTMYE

SEQ ID NO: 1187393 - protein, 9 aa, Homo Sapiens
KGPAARDCT

SEQ ID NO: 1187394 - protein, 9 aa, Homo Sapiens
QALGSRSGG

SEQ ID NO: 1187395 - protein, 9 aa, Homo Sapiens
DVALDFWMS

SEQ ID NO: 1187396 - protein, 9 aa, Homo Sapiens
RPRPHPLYF

SEQ ID NO: 1187397 - protein, 9 aa, Homo Sapiens
AFDGAHPPP

SEQ ID NO: 1187398 - protein, 9 aa, Homo Sapiens
PSCCRRTSS

SEQ ID NO: 1187399 - protein, 9 aa, Homo Sapiens
CFPSGDGQL

SEQ ID NO: 1187400 - protein, 9 aa, Homo Sapiens
FLSIFKLDG

SEQ ID NO: 1187401 - protein, 9 aa, Homo Sapiens
THQKDKPGM

SEQ ID NO: 1187402 - protein, 9 aa, Homo Sapiens
GALPLHTQS

SEQ ID NO: 1187403 - protein, 9 aa, Homo Sapiens
SVKPQDPNV

SEQ ID NO: 1187404 - protein, 9 aa, Homo Sapiens
GQNFISPKK

SEQ ID NO: 1187405 - protein, 9 aa, Homo Sapiens
LFHPSLLFF

SEQ ID NO: 1187406 - protein, 9 aa, Homo Sapiens
GPARGTARS

SEQ ID NO: 1187407 - protein, 9 aa, Homo Sapiens
DVVLDVEAR

SEQ ID NO: 1187408 - protein, 9 aa, Homo Sapiens
GYFALGAKE

SEQ ID NO: 1187409 - protein, 9 aa, Homo Sapiens
ECIDPFSKM

SEQ ID NO: 1187410 - protein, 9 aa, Homo Sapiens
TAEKIWESW

SEQ ID NO: 1187411 - protein, 9 aa, Homo Sapiens
ALAVFSMPF

SEQ ID NO: 1187412 - protein, 9 aa, Homo Sapiens
PLHRWLQQT

SEQ ID NO: 1187413 - protein, 9 aa, Homo Sapiens
LKFQREEQP

SEQ ID NO: 1187414 - protein, 9 aa, Homo Sapiens
GPHAVSGCG

SEQ ID NO: 1187415 - protein, 9 aa, Homo Sapiens
LVIHSAVMW

SEQ ID NO: 1187416 - protein, 9 aa, Homo Sapiens
LQLPPLPPG

SEQ ID NO: 1187417 - protein, 9 aa, Homo Sapiens
ILRWQRLRY

SEQ ID NO: 1187418 - protein, 9 aa, Homo Sapiens
AVTFGKAQE

SEQ ID NO: 1187419 - protein, 9 aa, Homo Sapiens
PTARAPPST

SEQ ID NO: 1187420 - protein, 9 aa, Homo Sapiens
NYPPECTLK

SEQ ID NO: 1187421 - protein, 9 aa, Homo Sapiens
DNHPMNRAL

SEQ ID NO: 1187422 - protein, 9 aa, Homo Sapiens
DRRSSNRNS

SEQ ID NO: 1187423 - protein, 9 aa, Homo Sapiens
IEKVTSYGV

SEQ ID NO: 1187424 - protein, 9 aa, Homo Sapiens
RLPGHLNAV

SEQ ID NO: 1187425 - protein, 9 aa, Homo Sapiens
IHSQQPGAL

SEQ ID NO: 1187426 - protein, 9 aa, Homo Sapiens
DDDDDCKNL

SEQ ID NO: 1187427 - protein, 9 aa, Homo Sapiens
LSLLAPKTT

SEQ ID NO: 1187428 - protein, 9 aa, Homo Sapiens
RGDQCCFQN

SEQ ID NO: 1187429 - protein, 9 aa, Homo Sapiens
AVGLIGNTA

SEQ ID NO: 1187430 - protein, 9 aa, Homo Sapiens
LACSHVALL

SEQ ID NO: 1187431 - protein, 9 aa, Homo Sapiens
ESMLTQSLL

SEQ ID NO: 1187432 - protein, 9 aa, Homo Sapiens
AWSWCGMIR

SEQ ID NO: 1187433 - protein, 9 aa, Homo Sapiens
LQASVAAWP

SEQ ID NO: 1187434 - protein, 9 aa, Homo Sapiens
GPKDHQDIK

SEQ ID NO: 1187435 - protein, 9 aa, Homo Sapiens
ASGAFSGLD

SEQ ID NO: 1187436 - protein, 9 aa, Homo Sapiens
GVEVIPEGS

SEQ ID NO: 1187437 - protein, 9 aa, Homo Sapiens
CLLHSLGTT

SEQ ID NO: 1187438 - protein, 9 aa, Homo Sapiens
RSWTPPASR

SEQ ID NO: 1187439 - protein, 9 aa, Homo Sapiens
VDVYYAVEM

SEQ ID NO: 1187440 - protein, 9 aa, Homo Sapiens
PPGAHGLPV

SEQ ID NO: 1187441 - protein, 9 aa, Homo Sapiens
MPNRKASQN

SEQ ID NO: 1187442 - protein, 9 aa, Homo Sapiens
GPAHGLHVA

SEQ ID NO: 1187443 - protein, 9 aa, Homo Sapiens
SSSLKKHLW

SEQ ID NO: 1187444 - protein, 9 aa, Homo Sapiens
ALQREGEEK

SEQ ID NO: 1187445 - protein, 9 aa, Homo Sapiens
KMESCMCPI

SEQ ID NO: 1187446 - protein, 9 aa, Homo Sapiens
RRGPDGVMV

SEQ ID NO: 1187447 - protein, 9 aa, Homo Sapiens
GCGSTPPPP

SEQ ID NO: 1187448 - protein, 9 aa, Homo Sapiens
YLVPGPLAP

SEQ ID NO: 1187449 - protein, 9 aa, Homo Sapiens
KTIHCNRIA

SEQ ID NO: 1187450 - protein, 9 aa, Homo Sapiens
TVLHLTLGA

SEQ ID NO: 1187451 - protein, 9 aa, Homo Sapiens
ILEIIEAIY

SEQ ID NO: 1187452 - protein, 9 aa, Homo Sapiens
ATGSPRTRG

SEQ ID NO: 1187453 - protein, 9 aa, Homo Sapiens
GWHWGAAPM

SEQ ID NO: 1187454 - protein, 9 aa, Homo Sapiens
GPCLAQAPI

SEQ ID NO: 1187455 - protein, 9 aa, Homo Sapiens
FLYAMGGQD

SEQ ID NO: 1187456 - protein, 9 aa, Homo Sapiens
APHPPPAAA

SEQ ID NO: 1187457 - protein, 9 aa, Homo Sapiens
SGLGGFGGF

SEQ ID NO: 1187458 - protein, 9 aa, Homo Sapiens
AWYAAIDLA

SEQ ID NO: 1187459 - protein, 9 aa, Homo Sapiens
SVPNEALGY

SEQ ID NO: 1187460 - protein, 9 aa, Homo Sapiens
KPSPLMNNN

SEQ ID NO: 1187461 - protein, 9 aa, Homo Sapiens
NKGAEAFQT

SEQ ID NO: 1187462 - protein, 9 aa, Homo Sapiens
STPCCKPMA

SEQ ID NO: 1187463 - protein, 9 aa, Homo Sapiens
LKEMAPTID

SEQ ID NO: 1187464 - protein, 9 aa, Homo Sapiens
PPPYYPGIG

SEQ ID NO: 1187465 - protein, 9 aa, Homo Sapiens
TQQDVLQTR

SEQ ID NO: 1187466 - protein, 9 aa, Homo Sapiens
QTAIHQVPL

SEQ ID NO: 1187467 - protein, 9 aa, Homo Sapiens
LSERGAAKQ

SEQ ID NO: 1187468 - protein, 9 aa, Homo Sapiens
FIYRKIQLE

SEQ ID NO: 1187469 - protein, 9 aa, Homo Sapiens
KGKKCICSS

SEQ ID NO: 1187470 - protein, 9 aa, Homo Sapiens
SMLPWQFAQ

SEQ ID NO: 1187471 - protein, 9 aa, Homo Sapiens
TATVGLELP

SEQ ID NO: 1187472 - protein, 9 aa, Homo Sapiens
HGQTIKLLK

SEQ ID NO: 1187473 - protein, 9 aa, Homo Sapiens
QYSIALHFS

SEQ ID NO: 1187474 - protein, 9 aa, Homo Sapiens
TLTPGPEMP

SEQ ID NO: 1187475 - protein, 9 aa, Homo Sapiens
YPGIGNGTQ

SEQ ID NO: 1187476 - protein, 9 aa, Homo Sapiens
GPISAARKS

SEQ ID NO: 1187477 - protein, 9 aa, Homo Sapiens
GYLFRVAML

SEQ ID NO: 1187478 - protein, 9 aa, Homo Sapiens
CHALVFLGM

SEQ ID NO: 1187479 - protein, 9 aa, Homo Sapiens
SNITEELFL

SEQ ID NO: 1187480 - protein, 9 aa, Homo Sapiens
LCPKREGPR

SEQ ID NO: 1187481 - protein, 9 aa, Homo Sapiens
SAPWIDPNP

SEQ ID NO: 1187482 - protein, 9 aa, Homo Sapiens
AASSPAWPA

SEQ ID NO: 1187483 - protein, 9 aa, Homo Sapiens
TRRPRPPCS

SEQ ID NO: 1187484 - protein, 9 aa, Homo Sapiens
VTNHHIVAP

SEQ ID NO: 1187485 - protein, 9 aa, Homo Sapiens
NEVFWMWSR

SEQ ID NO: 1187486 - protein, 9 aa, Homo Sapiens
KLFRRSLLR

SEQ ID NO: 1187487 - protein, 9 aa, Homo Sapiens
AVGKDQPFM

SEQ ID NO: 1187488 - protein, 9 aa, Homo Sapiens
AQPPGPAPW

SEQ ID NO: 1187489 - protein, 9 aa, Homo Sapiens
RGSQRLAQA

SEQ ID NO: 1187490 - protein, 9 aa, Homo Sapiens
AGGAPARQG

SEQ ID NO: 1187491 - protein, 9 aa, Homo Sapiens
RCAVEKNQI

SEQ ID NO: 1187492 - protein, 9 aa, Homo Sapiens
HELKEKQRN

SEQ ID NO: 1187493 - protein, 9 aa, Homo Sapiens
ALNTAYVAI

SEQ ID NO: 1187494 - protein, 9 aa, Homo Sapiens
RELGCGGGA

SEQ ID NO: 1187495 - protein, 9 aa, Homo Sapiens
CVCWPSFSW

SEQ ID NO: 1187496 - protein, 9 aa, Homo Sapiens
QIIAIAAFI

SEQ ID NO: 1187497 - protein, 9 aa, Homo Sapiens
DPYIVSMEH

SEQ ID NO: 1187498 - protein, 9 aa, Homo Sapiens
CAGKRLTDL

SEQ ID NO: 1187499 - protein, 9 aa, Homo Sapiens
KMGNLRNLF

SEQ ID NO: 1187500 - protein, 9 aa, Homo Sapiens
SLTTANAPP

SEQ ID NO: 1187501 - protein, 9 aa, Homo Sapiens
ISSGWRHIG

SEQ ID NO: 1187502 - protein, 9 aa, Homo Sapiens
AERQVGRDV

SEQ ID NO: 1187503 - protein, 9 aa, Homo Sapiens
EENNVVEKL

SEQ ID NO: 1187504 - protein, 9 aa, Homo Sapiens
NDRVPYDIS

SEQ ID NO: 1187505 - protein, 9 aa, Homo Sapiens
SCWGGRRRQ

SEQ ID NO: 1187506 - protein, 9 aa, Homo Sapiens
THGEGYAKP

SEQ ID NO: 1187507 - protein, 9 aa, Homo Sapiens
HDSFEKTEL

SEQ ID NO: 1187508 - protein, 9 aa, Homo Sapiens
HYGFLHEVH

SEQ ID NO: 1187509 - protein, 9 aa, Homo Sapiens
LVVELLQLH

SEQ ID NO: 1187510 - protein, 9 aa, Homo Sapiens
AKNLLSTNL

SEQ ID NO: 1187511 - protein, 9 aa, Homo Sapiens
EVTTFCSEG

SEQ ID NO: 1187512 - protein, 9 aa, Homo Sapiens
VAAVGKDQP

SEQ ID NO: 1187513 - protein, 9 aa, Homo Sapiens
VMAEKNFVK

SEQ ID NO: 1187514 - protein, 9 aa, Homo Sapiens
SSWPGHMSE

SEQ ID NO: 1187515 - protein, 9 aa, Homo Sapiens
LLNHPSRLR

SEQ ID NO: 1187516 - protein, 9 aa, Homo Sapiens
PRSPSRTCS

SEQ ID NO: 1187517 - protein, 9 aa, Homo Sapiens
GRVDSQRGQ

SEQ ID NO: 1187518 - protein, 9 aa, Homo Sapiens
KFRCNLLRQ

SEQ ID NO: 1187519 - protein, 9 aa, Homo Sapiens
VGPGPHAVS

SEQ ID NO: 1187520 - protein, 9 aa, Homo Sapiens
GVDSTAAAA

SEQ ID NO: 1187521 - protein, 9 aa, Homo Sapiens
VSAVFLLAV

SEQ ID NO: 1187522 - protein, 9 aa, Homo Sapiens
PEKYPSSLE

SEQ ID NO: 1187523 - protein, 9 aa, Homo Sapiens
LGRLYMKTL

SEQ ID NO: 1187524 - protein, 9 aa, Homo Sapiens
YLSSNPSSF

SEQ ID NO: 1187525 - protein, 9 aa, Homo Sapiens
PQARCWMTS

SEQ ID NO: 1187526 - protein, 9 aa, Homo Sapiens
ASGPISAAR

SEQ ID NO: 1187527 - protein, 9 aa, Homo Sapiens
TESSLARGS

SEQ ID NO: 1187528 - protein, 9 aa, Homo Sapiens
YMKAQGICP

SEQ ID NO: 1187529 - protein, 9 aa, Homo Sapiens
PGCRGGLAG

SEQ ID NO: 1187530 - protein, 9 aa, Homo Sapiens
LVCPRAGPC

SEQ ID NO: 1187531 - protein, 9 aa, Homo Sapiens
MDIPAPEAA

SEQ ID NO: 1187532 - protein, 9 aa, Homo Sapiens
LLHEAVSTV

SEQ ID NO: 1187533 - protein, 9 aa, Homo Sapiens
HKVTGAHLL

SEQ ID NO: 1187534 - protein, 9 aa, Homo Sapiens
VRARRACGQ

SEQ ID NO: 1187535 - protein, 9 aa, Homo Sapiens
VQRGRAPAP

SEQ ID NO: 1187536 - protein, 9 aa, Homo Sapiens
NAVSMMTSW

SEQ ID NO: 1187537 - protein, 9 aa, Homo Sapiens
ENKKEHRVQ

SEQ ID NO: 1187538 - protein, 9 aa, Homo Sapiens
RERKIKYPK

SEQ ID NO: 1187539 - protein, 9 aa, Homo Sapiens
ELQVIQCVF

SEQ ID NO: 1187540 - protein, 9 aa, Homo Sapiens
RRSFLRAGR

SEQ ID NO: 1187541 - protein, 9 aa, Homo Sapiens
THHPHPKPK

SEQ ID NO: 1187542 - protein, 9 aa, Homo Sapiens
LFSVIKVTR

SEQ ID NO: 1187543 - protein, 9 aa, Homo Sapiens
LHGDAEVVV

SEQ ID NO: 1187544 - protein, 9 aa, Homo Sapiens
ITLLHLAQP

SEQ ID NO: 1187545 - protein, 9 aa, Homo Sapiens
VCACICVCA

SEQ ID NO: 1187546 - protein, 9 aa, Homo Sapiens
APCPLVPTR

SEQ ID NO: 1187547 - protein, 9 aa, Homo Sapiens
MPGSCRSPR

SEQ ID NO: 1187548 - protein, 9 aa, Homo Sapiens
ARETRGPRA

SEQ ID NO: 1187549 - protein, 9 aa, Homo Sapiens
TCHNHALHM

SEQ ID NO: 1187550 - protein, 9 aa, Homo Sapiens
DLTSPAQRY

SEQ ID NO: 1187551 - protein, 9 aa, Homo Sapiens
RHGQTLPLL

SEQ ID NO: 1187552 - protein, 9 aa, Homo Sapiens
QRRTAAPGQ

SEQ ID NO: 1187553 - protein, 9 aa, Homo Sapiens
RGKRTQGTP

SEQ ID NO: 1187554 - protein, 9 aa, Homo Sapiens
GVGVMVEIL

SEQ ID NO: 1187555 - protein, 9 aa, Homo Sapiens
GRCFYINSP

SEQ ID NO: 1187556 - protein, 9 aa, Homo Sapiens
LPPLPPGCR

SEQ ID NO: 1187557 - protein, 9 aa, Homo Sapiens
FRDKSNLLN

SEQ ID NO: 1187558 - protein, 9 aa, Homo Sapiens
SGHHTTPAQ

SEQ ID NO: 1187559 - protein, 9 aa, Homo Sapiens
VARPRGRRG

SEQ ID NO: 1187560 - protein, 9 aa, Homo Sapiens
IFVLNRMQA

SEQ ID NO: 1187561 - protein, 9 aa, Homo Sapiens
TACLIPPAG

SEQ ID NO: 1187562 - protein, 9 aa, Homo Sapiens
AKDDSQNVI

SEQ ID NO: 1187563 - protein, 9 aa, Homo Sapiens
LAQAPIPWL

SEQ ID NO: 1187564 - protein, 9 aa, Homo Sapiens
PSRLRSVLY

SEQ ID NO: 1187565 - protein, 9 aa, Homo Sapiens
LQPPAPQGP

SEQ ID NO: 1187566 - protein, 9 aa, Homo Sapiens
AGRQMGQGP

SEQ ID NO: 1187567 - protein, 9 aa, Homo Sapiens
GPGGCIPAP

SEQ ID NO: 1187568 - protein, 9 aa, Homo Sapiens
TSELTLLLD

SEQ ID NO: 1187569 - protein, 9 aa, Homo Sapiens
NQGLFHKLP

SEQ ID NO: 1187570 - protein, 9 aa, Homo Sapiens
VCSALPFDG

SEQ ID NO: 1187571 - protein, 9 aa, Homo Sapiens
GWELIKTVT

SEQ ID NO: 1187572 - protein, 9 aa, Homo Sapiens
GVQQHLQEA

SEQ ID NO: 1187573 - protein, 9 aa, Homo Sapiens
LGISVLLLK

SEQ ID NO: 1187574 - protein, 9 aa, Homo Sapiens
VMKVKKEIV

SEQ ID NO: 1187575 - protein, 9 aa, Homo Sapiens
WMAMFQQKT

SEQ ID NO: 1187576 - protein, 9 aa, Homo Sapiens
VKVVPRLSL

SEQ ID NO: 1187577 - protein, 9 aa, Homo Sapiens
PWLKCSAAH

SEQ ID NO: 1187578 - protein, 9 aa, Homo Sapiens
LPLGLGGEV

SEQ ID NO: 1187579 - protein, 9 aa, Homo Sapiens
RVYAGRLET

SEQ ID NO: 1187580 - protein, 9 aa, Homo Sapiens
SRAASVGHC

SEQ ID NO: 1187581 - protein, 9 aa, Homo Sapiens
PFVKDCLTK

SEQ ID NO: 1187582 - protein, 9 aa, Homo Sapiens
GFLHEVHWA

SEQ ID NO: 1187583 - protein, 9 aa, Homo Sapiens
AIIYMSAAS

SEQ ID NO: 1187584 - protein, 9 aa, Homo Sapiens
HSVPSTPPW

SEQ ID NO: 1187585 - protein, 9 aa, Homo Sapiens
HLPIECSEL

SEQ ID NO: 1187586 - protein, 9 aa, Homo Sapiens
RVDGRCGVW

SEQ ID NO: 1187587 - protein, 9 aa, Homo Sapiens
SHVEERGAS

SEQ ID NO: 1187588 - protein, 9 aa, Homo Sapiens
AISFQLPMC

SEQ ID NO: 1187589 - protein, 9 aa, Homo Sapiens
RPERSSSSP

SEQ ID NO: 1187590 - protein, 9 aa, Homo Sapiens
SSRQPRLPP

SEQ ID NO: 1187591 - protein, 9 aa, Homo Sapiens
LCRPVEERV

SEQ ID NO: 1187592 - protein, 9 aa, Homo Sapiens
PTLPATRKP

SEQ ID NO: 1187593 - protein, 9 aa, Homo Sapiens
RRKVVVILQ

SEQ ID NO: 1187594 - protein, 9 aa, Homo Sapiens
TPTGPSSLT

SEQ ID NO: 1187595 - protein, 9 aa, Homo Sapiens
YFRGRLPRH

SEQ ID NO: 1187596 - protein, 9 aa, Homo Sapiens
GALRQAPGY

SEQ ID NO: 1187597 - protein, 9 aa, Homo Sapiens
RFSLFGKRN

SEQ ID NO: 1187598 - protein, 9 aa, Homo Sapiens
PAPWWHPGR

SEQ ID NO: 1187599 - protein, 9 aa, Homo Sapiens
SAKSSKRSF

SEQ ID NO: 1187600 - protein, 9 aa, Homo Sapiens
GPIKMYKCL

SEQ ID NO: 1187601 - protein, 9 aa, Homo Sapiens
LQWPVLQRV

SEQ ID NO: 1187602 - protein, 9 aa, Homo Sapiens
VKGLLNMLS

SEQ ID NO: 1187603 - protein, 9 aa, Homo Sapiens
VVALVGGLD

SEQ ID NO: 1187604 - protein, 9 aa, Homo Sapiens
AGGRETAAG

SEQ ID NO: 1187605 - protein, 9 aa, Homo Sapiens
LYLPASMKL

SEQ ID NO: 1187606 - protein, 9 aa, Homo Sapiens
LERNGSSGG

SEQ ID NO: 1187607 - protein, 9 aa, Homo Sapiens
IDPNPQPQS

SEQ ID NO: 1187608 - protein, 9 aa, Homo Sapiens
PLRPQRGPR

SEQ ID NO: 1187609 - protein, 9 aa, Homo Sapiens
VSSADLKAP

SEQ ID NO: 1187610 - protein, 9 aa, Homo Sapiens
KPCRRKKKV

SEQ ID NO: 1187611 - protein, 9 aa, Homo Sapiens
PPGWMPRCT

SEQ ID NO: 1187612 - protein, 9 aa, Homo Sapiens
SLYLLQGSL

SEQ ID NO: 1187613 - protein, 9 aa, Homo Sapiens
SRSATGSAR

SEQ ID NO: 1187614 - protein, 9 aa, Homo Sapiens
GSRRCTKRM

SEQ ID NO: 1187615 - protein, 9 aa, Homo Sapiens
LRCWFIQQE

SEQ ID NO: 1187616 - protein, 9 aa, Homo Sapiens
PVAGQEAMT

SEQ ID NO: 1187617 - protein, 9 aa, Homo Sapiens
LASVRGIQG

SEQ ID NO: 1187618 - protein, 9 aa, Homo Sapiens
SVGGRRQMG

SEQ ID NO: 1187619 - protein, 9 aa, Homo Sapiens
FHDNKRHSP

SEQ ID NO: 1187620 - protein, 9 aa, Homo Sapiens
AFQLVIHSA

SEQ ID NO: 1187621 - protein, 9 aa, Homo Sapiens
LCNRFVHPS

SEQ ID NO: 1187622 - protein, 9 aa, Homo Sapiens
KVSEKSIRI

SEQ ID NO: 1187623 - protein, 9 aa, Homo Sapiens
SHCLQDSYI

SEQ ID NO: 1187624 - protein, 9 aa, Homo Sapiens
LRVIQLTSD

SEQ ID NO: 1187625 - protein, 9 aa, Homo Sapiens
MASALPSPH

SEQ ID NO: 1187626 - protein, 9 aa, Homo Sapiens
LAITQGRRV

SEQ ID NO: 1187627 - protein, 9 aa, Homo Sapiens
NFVKRRRNI

SEQ ID NO: 1187628 - protein, 9 aa, Homo Sapiens
GELSMCDSI

SEQ ID NO: 1187629 - protein, 9 aa, Homo Sapiens
QALEEEIRS

SEQ ID NO: 1187630 - protein, 9 aa, Homo Sapiens
AKTIRFTVR

SEQ ID NO: 1187631 - protein, 9 aa, Homo Sapiens
WQFFVGVRT

SEQ ID NO: 1187632 - protein, 9 aa, Homo Sapiens
LDLAKKKTC

SEQ ID NO: 1187633 - protein, 9 aa, Homo Sapiens
ENIREIEQN

SEQ ID NO: 1187634 - protein, 9 aa, Homo Sapiens
GSHSQASHM

SEQ ID NO: 1187635 - protein, 9 aa, Homo Sapiens
KRQWGPGEG

SEQ ID NO: 1187636 - protein, 9 aa, Homo Sapiens
TRRSYPEFQ

SEQ ID NO: 1187637 - protein, 9 aa, Homo Sapiens
QTRRSYPEF

SEQ ID NO: 1187638 - protein, 9 aa, Homo Sapiens
AGEKVGIIG

SEQ ID NO: 1187639 - protein, 9 aa, Homo Sapiens
RSPPLDLTL

SEQ ID NO: 1187640 - protein, 9 aa, Homo Sapiens
HGHGKVQVG

SEQ ID NO: 1187641 - protein, 9 aa, Homo Sapiens
VSKGKKCIC

SEQ ID NO: 1187642 - protein, 9 aa, Homo Sapiens
LESVRQIYS

SEQ ID NO: 1187643 - protein, 9 aa, Homo Sapiens
RKIQLEKEL

SEQ ID NO: 1187644 - protein, 9 aa, Homo Sapiens
GGKRAATVT

SEQ ID NO: 1187645 - protein, 9 aa, Homo Sapiens
PLPSRSLLI

SEQ ID NO: 1187646 - protein, 9 aa, Homo Sapiens
SHDSARVFW

SEQ ID NO: 1187647 - protein, 9 aa, Homo Sapiens
TPQGHLAVT

SEQ ID NO: 1187648 - protein, 9 aa, Homo Sapiens
EDGCQTNCP

SEQ ID NO: 1187649 - protein, 9 aa, Homo Sapiens
YRQQPQQQK

SEQ ID NO: 1187650 - protein, 9 aa, Homo Sapiens
TPFDRHPQM

SEQ ID NO: 1187651 - protein, 9 aa, Homo Sapiens
EMAPTIDWL

SEQ ID NO: 1187652 - protein, 9 aa, Homo Sapiens
RQGGYGKKV

SEQ ID NO: 1187653 - protein, 9 aa, Homo Sapiens
ARASSTSPR

SEQ ID NO: 1187654 - protein, 9 aa, Homo Sapiens
KMVIVVMTL

SEQ ID NO: 1187655 - protein, 9 aa, Homo Sapiens
LVSGLGGFG

SEQ ID NO: 1187656 - protein, 9 aa, Homo Sapiens
RAPRASRSR

SEQ ID NO: 1187657 - protein, 9 aa, Homo Sapiens
VLIPPLRPS

SEQ ID NO: 1187658 - protein, 9 aa, Homo Sapiens
YLFRVAMLL

SEQ ID NO: 1187659 - protein, 9 aa, Homo Sapiens
SRHAYSSHQ

SEQ ID NO: 1187660 - protein, 9 aa, Homo Sapiens
RPPATLPES

SEQ ID NO: 1187661 - protein, 9 aa, Homo Sapiens
KVPQRTHHP

SEQ ID NO: 1187662 - protein, 9 aa, Homo Sapiens
LILLIAISG

SEQ ID NO: 1187663 - protein, 9 aa, Homo Sapiens
CRLQRVGAR

SEQ ID NO: 1187664 - protein, 9 aa, Homo Sapiens
RPPVWGLPG

SEQ ID NO: 1187665 - protein, 9 aa, Homo Sapiens
LKTYVESGN

SEQ ID NO: 1187666 - protein, 9 aa, Homo Sapiens
EWIRHTIPW

SEQ ID NO: 1187667 - protein, 9 aa, Homo Sapiens
ILIHTPAEA

SEQ ID NO: 1187668 - protein, 9 aa, Homo Sapiens
ESAKKSLWE

SEQ ID NO: 1187669 - protein, 9 aa, Homo Sapiens
ILGIFGIEK

SEQ ID NO: 1187670 - protein, 9 aa, Homo Sapiens
SVSLSGSMV

SEQ ID NO: 1187671 - protein, 9 aa, Homo Sapiens
MAGGLHLHP

SEQ ID NO: 1187672 - protein, 9 aa, Homo Sapiens
AQGMILVYD

SEQ ID NO: 1187673 - protein, 9 aa, Homo Sapiens
SRTSCCPRS

SEQ ID NO: 1187674 - protein, 9 aa, Homo Sapiens
PAIPAAQRR

SEQ ID NO: 1187675 - protein, 9 aa, Homo Sapiens
NAETKDPAP

SEQ ID NO: 1187676 - protein, 9 aa, Homo Sapiens
REALSQTPE

SEQ ID NO: 1187677 - protein, 9 aa, Homo Sapiens
QRGTQPGRR

SEQ ID NO: 1187678 - protein, 9 aa, Homo Sapiens
PPSADMGAY

SEQ ID NO: 1187679 - protein, 9 aa, Homo Sapiens
SDGVPCSMR

SEQ ID NO: 1187680 - protein, 9 aa, Homo Sapiens
APCLTHCTF

SEQ ID NO: 1187681 - protein, 9 aa, Homo Sapiens
QARDMLGGM

SEQ ID NO: 1187682 - protein, 9 aa, Homo Sapiens
VAWCEVQDR

SEQ ID NO: 1187683 - protein, 9 aa, Homo Sapiens
PTNTSISAT

SEQ ID NO: 1187684 - protein, 9 aa, Homo Sapiens
KMFLTVIMR

SEQ ID NO: 1187685 - protein, 9 aa, Homo Sapiens
LGLLLALFV

SEQ ID NO: 1187686 - protein, 9 aa, Homo Sapiens
TTTGQAAAA

SEQ ID NO: 1187687 - protein, 9 aa, Homo Sapiens
CVSAHTANF

SEQ ID NO: 1187688 - protein, 9 aa, Homo Sapiens
WGAAPMMSS

SEQ ID NO: 1187689 - protein, 9 aa, Homo Sapiens
ALGWPGLKP

SEQ ID NO: 1187690 - protein, 9 aa, Homo Sapiens
ASTARSTWP

SEQ ID NO: 1187691 - protein, 9 aa, Homo Sapiens
IVSMEHHTD

SEQ ID NO: 1187692 - protein, 9 aa, Homo Sapiens
DCKNLQWMR

SEQ ID NO: 1187693 - protein, 9 aa, Homo Sapiens
SFHDNKRHS

SEQ ID NO: 1187694 - protein, 9 aa, Homo Sapiens
GYGSARTCR

SEQ ID NO: 1187695 - protein, 9 aa, Homo Sapiens
DDFLEKKWS

SEQ ID NO: 1187696 - protein, 9 aa, Homo Sapiens
AACVYDLCV

SEQ ID NO: 1187697 - protein, 9 aa, Homo Sapiens
GGNWGWPVE

SEQ ID NO: 1187698 - protein, 9 aa, Homo Sapiens
SPLSVCPET

SEQ ID NO: 1187699 - protein, 9 aa, Homo Sapiens
SGILAIIYM

SEQ ID NO: 1187700 - protein, 9 aa, Homo Sapiens
HISALIAAR

SEQ ID NO: 1187701 - protein, 9 aa, Homo Sapiens
QLKRKQKPL

SEQ ID NO: 1187702 - protein, 9 aa, Homo Sapiens
GHHKVRTAP

SEQ ID NO: 1187703 - protein, 9 aa, Homo Sapiens
SRLRSVLYE

SEQ ID NO: 1187704 - protein, 9 aa, Homo Sapiens
SQILQGHLS

SEQ ID NO: 1187705 - protein, 9 aa, Homo Sapiens
TVDRRLHSH

SEQ ID NO: 1187706 - protein, 9 aa, Homo Sapiens
EVFTLFLVM

SEQ ID NO: 1187707 - protein, 9 aa, Homo Sapiens
ILKFFMVKS

SEQ ID NO: 1187708 - protein, 9 aa, Homo Sapiens
TCPRASTQL

SEQ ID NO: 1187709 - protein, 9 aa, Homo Sapiens
GISVLLLKS

SEQ ID NO: 1187710 - protein, 9 aa, Homo Sapiens
YRCPVGGPT

SEQ ID NO: 1187711 - protein, 9 aa, Homo Sapiens
MGKVIFTNY

SEQ ID NO: 1187712 - protein, 9 aa, Homo Sapiens
DRSSSMGHP

SEQ ID NO: 1187713 - protein, 9 aa, Homo Sapiens
AFVHFSTEK

SEQ ID NO: 1187714 - protein, 9 aa, Homo Sapiens
FHDQAIVRV

SEQ ID NO: 1187715 - protein, 9 aa, Homo Sapiens
TGTCLMVTA

SEQ ID NO: 1187716 - protein, 9 aa, Homo Sapiens
GGRSRAEKP

SEQ ID NO: 1187717 - protein, 9 aa, Homo Sapiens
AVASDLGEA

SEQ ID NO: 1187718 - protein, 9 aa, Homo Sapiens
ERTRSPHPG

SEQ ID NO: 1187719 - protein, 9 aa, Homo Sapiens
IVHAGEKPY

SEQ ID NO: 1187720 - protein, 9 aa, Homo Sapiens
RGPRPLHRW

SEQ ID NO: 1187721 - protein, 9 aa, Homo Sapiens
SMKDRISLR

SEQ ID NO: 1187722 - protein, 9 aa, Homo Sapiens
PNKADIPEC

SEQ ID NO: 1187723 - protein, 9 aa, Homo Sapiens
VAPGPGPMN

SEQ ID NO: 1187724 - protein, 9 aa, Homo Sapiens
YDADAQEQR

SEQ ID NO: 1187725 - protein, 9 aa, Homo Sapiens
KQAGKSQQE

SEQ ID NO: 1187726 - protein, 9 aa, Homo Sapiens
EVIPEGSHI

SEQ ID NO: 1187727 - protein, 9 aa, Homo Sapiens
RLRCARTMV

SEQ ID NO: 1187728 - protein, 9 aa, Homo Sapiens
GLDSQQCTQ

SEQ ID NO: 1187729 - protein, 9 aa, Homo Sapiens
LTTYTLVLT

SEQ ID NO: 1187730 - protein, 9 aa, Homo Sapiens
QIDSARLAA

SEQ ID NO: 1187731 - protein, 9 aa, Homo Sapiens
NSKPVQEAP

SEQ ID NO: 1187732 - protein, 9 aa, Homo Sapiens
PGWASSRLC

SEQ ID NO: 1187733 - protein, 9 aa, Homo Sapiens
CPATTTCPT

SEQ ID NO: 1187734 - protein, 9 aa, Homo Sapiens
AKGPGKYIC

SEQ ID NO: 1187735 - protein, 9 aa, Homo Sapiens
GRWAEAEGL

SEQ ID NO: 1187736 - protein, 9 aa, Homo Sapiens
SPAQRYIDS

SEQ ID NO: 1187737 - protein, 9 aa, Homo Sapiens
ISEVLVCPV

SEQ ID NO: 1187738 - protein, 9 aa, Homo Sapiens
RRTGPPRLP

SEQ ID NO: 1187739 - protein, 9 aa, Homo Sapiens
AFLLRRRTS

SEQ ID NO: 1187740 - protein, 9 aa, Homo Sapiens
VPLLPRLVA

SEQ ID NO: 1187741 - protein, 9 aa, Homo Sapiens
EGRERILVI

SEQ ID NO: 1187742 - protein, 9 aa, Homo Sapiens
TSSGDSSSS

SEQ ID NO: 1187743 - protein, 9 aa, Homo Sapiens
WGGRRRQAG

SEQ ID NO: 1187744 - protein, 9 aa, Homo Sapiens
PKIFPYPLL

SEQ ID NO: 1187745 - protein, 9 aa, Homo Sapiens
SRATWAPCM

SEQ ID NO: 1187746 - protein, 9 aa, Homo Sapiens
DDELDHILS

SEQ ID NO: 1187747 - protein, 9 aa, Homo Sapiens
DHLGLRKQY

SEQ ID NO: 1187748 - protein, 9 aa, Homo Sapiens
VAPHFSILP

SEQ ID NO: 1187749 - protein, 9 aa, Homo Sapiens
ERKKRETHK

SEQ ID NO: 1187750 - protein, 9 aa, Homo Sapiens
GHLLQPVRG

SEQ ID NO: 1187751 - protein, 9 aa, Homo Sapiens
HNGGGGGKR

SEQ ID NO: 1187752 - protein, 9 aa, Homo Sapiens
VSSSQSTKG

SEQ ID NO: 1187753 - protein, 9 aa, Homo Sapiens
LQKCIFSFN

SEQ ID NO: 1187754 - protein, 9 aa, Homo Sapiens
REEQPLFPQ

SEQ ID NO: 1187755 - protein, 9 aa, Homo Sapiens
NDPSWNHEV

SEQ ID NO: 1187756 - protein, 9 aa, Homo Sapiens
GLEVTLIPV

SEQ ID NO: 1187757 - protein, 9 aa, Homo Sapiens
PLPSPPVPL

SEQ ID NO: 1187758 - protein, 9 aa, Homo Sapiens
QIRAWCRAR

SEQ ID NO: 1187759 - protein, 9 aa, Homo Sapiens
PGPASTGQA

SEQ ID NO: 1187760 - protein, 9 aa, Homo Sapiens
LDNYDTLDI

SEQ ID NO: 1187761 - protein, 9 aa, Homo Sapiens
NVNRALHSA

SEQ ID NO: 1187762 - protein, 9 aa, Homo Sapiens
PQRGTQPGR

SEQ ID NO: 1187763 - protein, 9 aa, Homo Sapiens
SLPALKQHS

SEQ ID NO: 1187764 - protein, 9 aa, Homo Sapiens
QTPNVQDIL

SEQ ID NO: 1187765 - protein, 9 aa, Homo Sapiens
LTQRQDTSK

SEQ ID NO: 1187766 - protein, 9 aa, Homo Sapiens
GVGGYVGDA

SEQ ID NO: 1187767 - protein, 9 aa, Homo Sapiens
EIKKKQFYH

SEQ ID NO: 1187768 - protein, 9 aa, Homo Sapiens
LDSTWTLYS

SEQ ID NO: 1187769 - protein, 9 aa, Homo Sapiens
LSRPHGRSS

SEQ ID NO: 1187770 - protein, 9 aa, Homo Sapiens
IRDRRSSNR

SEQ ID NO: 1187771 - protein, 9 aa, Homo Sapiens
GGLSGLMTT

SEQ ID NO: 1187772 - protein, 9 aa, Homo Sapiens
RRQTRPKSS

SEQ ID NO: 1187773 - protein, 9 aa, Homo Sapiens
VPPTGLVDN

SEQ ID NO: 1187774 - protein, 9 aa, Homo Sapiens
ILNWVLPPD

SEQ ID NO: 1187775 - protein, 9 aa, Homo Sapiens
CICDNEYSG

SEQ ID NO: 1187776 - protein, 9 aa, Homo Sapiens
VNLASCCVI

SEQ ID NO: 1187777 - protein, 9 aa, Homo Sapiens
LSKGISKKK

SEQ ID NO: 1187778 - protein, 9 aa, Homo Sapiens
TPPSCCRRT

SEQ ID NO: 1187779 - protein, 9 aa, Homo Sapiens
SYRPWRGTT

SEQ ID NO: 1187780 - protein, 9 aa, Homo Sapiens
LAAHRSTAK

SEQ ID NO: 1187781 - protein, 9 aa, Homo Sapiens
QISKYAMPS

SEQ ID NO: 1187782 - protein, 9 aa, Homo Sapiens
NEYFFDRNQ

SEQ ID NO: 1187783 - protein, 9 aa, Homo Sapiens
HRLRLRLPR

SEQ ID NO: 1187784 - protein, 9 aa, Homo Sapiens
RTCSTETTT

SEQ ID NO: 1187785 - protein, 9 aa, Homo Sapiens
KRRLREQFL

SEQ ID NO: 1187786 - protein, 9 aa, Homo Sapiens
LELHINGQH

SEQ ID NO: 1187787 - protein, 9 aa, Homo Sapiens
NHPMNRALG

SEQ ID NO: 1187788 - protein, 9 aa, Homo Sapiens
YRIGRSVEG

SEQ ID NO: 1187789 - protein, 9 aa, Homo Sapiens
SESVVPDDR

SEQ ID NO: 1187790 - protein, 9 aa, Homo Sapiens
RRRSRQSGA

SEQ ID NO: 1187791 - protein, 9 aa, Homo Sapiens
QIAESYCPE

SEQ ID NO: 1187792 - protein, 9 aa, Homo Sapiens
KAVEMHAVV

SEQ ID NO: 1187793 - protein, 9 aa, Homo Sapiens
MRPKVYRLI

SEQ ID NO: 1187794 - protein, 9 aa, Homo Sapiens
SAISAPISS

SEQ ID NO: 1187795 - protein, 9 aa, Homo Sapiens
VFLTTTSRK

SEQ ID NO: 1187796 - protein, 9 aa, Homo Sapiens
EEEGEIYHL

SEQ ID NO: 1187797 - protein, 9 aa, Homo Sapiens
LIFLDVTTG

SEQ ID NO: 1187798 - protein, 9 aa, Homo Sapiens
HQAGSPRYQ

SEQ ID NO: 1187799 - protein, 9 aa, Homo Sapiens
TCKQDLSNA

SEQ ID NO: 1187800 - protein, 9 aa, Homo Sapiens
QDPYIVSME

SEQ ID NO: 1187801 - protein, 9 aa, Homo Sapiens
TSFHIVIEA

SEQ ID NO: 1187802 - protein, 9 aa, Homo Sapiens
LTATSCLER

SEQ ID NO: 1187803 - protein, 9 aa, Homo Sapiens
VEIAPKWIN

SEQ ID NO: 1187804 - protein, 9 aa, Homo Sapiens
LFSRMSIQA

SEQ ID NO: 1187805 - protein, 9 aa, Homo Sapiens
HGRGALRDD

SEQ ID NO: 1187806 - protein, 9 aa, Homo Sapiens
RTRCCPRPL

SEQ ID NO: 1187807 - protein, 9 aa, Homo Sapiens
GREDGVHAQ

SEQ ID NO: 1187808 - protein, 9 aa, Homo Sapiens
LHSARDVHV

SEQ ID NO: 1187809 - protein, 9 aa, Homo Sapiens
KSKRKRKGK

SEQ ID NO: 1187810 - protein, 9 aa, Homo Sapiens
STWPRPSAP

SEQ ID NO: 1187811 - protein, 9 aa, Homo Sapiens
DQEHELKEK

SEQ ID NO: 1187812 - protein, 9 aa, Homo Sapiens
RRCTKRMFK

SEQ ID NO: 1187813 - protein, 9 aa, Homo Sapiens
GSPRYQGAA

SEQ ID NO: 1187814 - protein, 9 aa, Homo Sapiens
YMNIFNQSA

SEQ ID NO: 1187815 - protein, 9 aa, Homo Sapiens
HGADVEPDL

SEQ ID NO: 1187816 - protein, 9 aa, Homo Sapiens
KCRNSRNSL

SEQ ID NO: 1187817 - protein, 9 aa, Homo Sapiens
FTAGGSTSV

SEQ ID NO: 1187818 - protein, 9 aa, Homo Sapiens
QGHLAVTLQ

SEQ ID NO: 1187819 - protein, 9 aa, Homo Sapiens
IAESYCPEY

SEQ ID NO: 1187820 - protein, 9 aa, Homo Sapiens
YVVCVHSCV

SEQ ID NO: 1187821 - protein, 9 aa, Homo Sapiens
CPDGSHLGQ

SEQ ID NO: 1187822 - protein, 9 aa, Homo Sapiens
ARTPGASAG

SEQ ID NO: 1187823 - protein, 9 aa, Homo Sapiens
RGALTTRPS

SEQ ID NO: 1187824 - protein, 9 aa, Homo Sapiens
LFDWYRHQN

SEQ ID NO: 1187825 - protein, 9 aa, Homo Sapiens
FFVGVRTVE

SEQ ID NO: 1187826 - protein, 9 aa, Homo Sapiens
FSWTIRHCT

SEQ ID NO: 1187827 - protein, 9 aa, Homo Sapiens
TTFCSEGMS

SEQ ID NO: 1187828 - protein, 9 aa, Homo Sapiens
EQSPQLLRG

SEQ ID NO: 1187829 - protein, 9 aa, Homo Sapiens
QKEDIEKMK

SEQ ID NO: 1187830 - protein, 9 aa, Homo Sapiens
QETRSQLSV

SEQ ID NO: 1187831 - protein, 9 aa, Homo Sapiens
HMLERFVES

SEQ ID NO: 1187832 - protein, 9 aa, Homo Sapiens
RNMVVCSCG

SEQ ID NO: 1187833 - protein, 9 aa, Homo Sapiens
VVCVHSCVY

SEQ ID NO: 1187834 - protein, 9 aa, Homo Sapiens
WGEQEQQGT

SEQ ID NO: 1187835 - protein, 9 aa, Homo Sapiens
FRKVRSFLE

SEQ ID NO: 1187836 - protein, 9 aa, Homo Sapiens
EKYPSSLEC

SEQ ID NO: 1187837 - protein, 9 aa, Homo Sapiens
MESCMCPIP

SEQ ID NO: 1187838 - protein, 9 aa, Homo Sapiens
ADALHTLQN

SEQ ID NO: 1187839 - protein, 9 aa, Homo Sapiens
SPCSLSAPA

SEQ ID NO: 1187840 - protein, 9 aa, Homo Sapiens
AATSKFLRK

SEQ ID NO: 1187841 - protein, 9 aa, Homo Sapiens
FATGAGKDW

SEQ ID NO: 1187842 - protein, 9 aa, Homo Sapiens
GMGFLTSIT

SEQ ID NO: 1187843 - protein, 9 aa, Homo Sapiens
ALGCQAPSC

SEQ ID NO: 1187844 - protein, 9 aa, Homo Sapiens
QPVVSTVYA

SEQ ID NO: 1187845 - protein, 9 aa, Homo Sapiens
LRDDVKVVP

SEQ ID NO: 1187846 - protein, 9 aa, Homo Sapiens
VNTPVLLHI

SEQ ID NO: 1187847 - protein, 9 aa, Homo Sapiens
SARSWWSMS

SEQ ID NO: 1187848 - protein, 9 aa, Homo Sapiens
SLVQPGPYE

SEQ ID NO: 1187849 - protein, 9 aa, Homo Sapiens
PATTTCPTP

SEQ ID NO: 1187850 - protein, 9 aa, Homo Sapiens
GWCGGPWRS

SEQ ID NO: 1187851 - protein, 9 aa, Homo Sapiens
HIVAPTRTS

SEQ ID NO: 1187852 - protein, 9 aa, Homo Sapiens
HARVYAGRL

SEQ ID NO: 1187853 - protein, 9 aa, Homo Sapiens
PRTSHISAL

SEQ ID NO: 1187854 - protein, 9 aa, Homo Sapiens
KKHLWIHSD

SEQ ID NO: 1187855 - protein, 9 aa, Homo Sapiens
PAPGSSPRP

SEQ ID NO: 1187856 - protein, 9 aa, Homo Sapiens
ISPTSIQGK

SEQ ID NO: 1187857 - protein, 9 aa, Homo Sapiens
QQPQQQKGG

SEQ ID NO: 1187858 - protein, 9 aa, Homo Sapiens
EEQQQLLRR

SEQ ID NO: 1187859 - protein, 9 aa, Homo Sapiens
LHRARPPQA

SEQ ID NO: 1187860 - protein, 9 aa, Homo Sapiens
KFANSLSGA

SEQ ID NO: 1187861 - protein, 9 aa, Homo Sapiens
LSQTPEKGE

SEQ ID NO: 1187862 - protein, 9 aa, Homo Sapiens
SAVLRAVGG

SEQ ID NO: 1187863 - protein, 9 aa, Homo Sapiens
MQAKYLDVG

SEQ ID NO: 1187864 - protein, 9 aa, Homo Sapiens
TQISKYAMP

SEQ ID NO: 1187865 - protein, 9 aa, Homo Sapiens
STATVGLEL

SEQ ID NO: 1187866 - protein, 9 aa, Homo Sapiens
QPGGCSSSG

SEQ ID NO: 1187867 - protein, 9 aa, Homo Sapiens
EKDSGGRRP

SEQ ID NO: 1187868 - protein, 9 aa, Homo Sapiens
CNNKELIIN

SEQ ID NO: 1187869 - protein, 9 aa, Homo Sapiens
LGLWNTQYP

SEQ ID NO: 1187870 - protein, 9 aa, Homo Sapiens
LVVFLYMWS

SEQ ID NO: 1187871 - protein, 9 aa, Homo Sapiens
SRSRRWATW

SEQ ID NO: 1187872 - protein, 9 aa, Homo Sapiens
FWMSGKQRE

SEQ ID NO: 1187873 - protein, 9 aa, Homo Sapiens
WTEWKMHVS

SEQ ID NO: 1187874 - protein, 9 aa, Homo Sapiens
NLYCDYHLA

SEQ ID NO: 1187875 - protein, 9 aa, Homo Sapiens
STYFLRYKT

SEQ ID NO: 1187876 - protein, 9 aa, Homo Sapiens
VFIWCCLNL

SEQ ID NO: 1187877 - protein, 9 aa, Homo Sapiens
VLVGHKAVY

SEQ ID NO: 1187878 - protein, 9 aa, Homo Sapiens
SGAVVGLRP

SEQ ID NO: 1187879 - protein, 9 aa, Homo Sapiens
MRASTPAPC

SEQ ID NO: 1187880 - protein, 9 aa, Homo Sapiens
STEKMQWLP

SEQ ID NO: 1187881 - protein, 9 aa, Homo Sapiens
PTRPPTKEK

SEQ ID NO: 1187882 - protein, 9 aa, Homo Sapiens
GSVIRHLSH

SEQ ID NO: 1187883 - protein, 9 aa, Homo Sapiens
ICAFLLWKK

SEQ ID NO: 1187884 - protein, 9 aa, Homo Sapiens
VPILYLDLL

SEQ ID NO: 1187885 - protein, 9 aa, Homo Sapiens
NKDDQEGRF

SEQ ID NO: 1187886 - protein, 9 aa, Homo Sapiens
LQENIAGVF

SEQ ID NO: 1187887 - protein, 9 aa, Homo Sapiens
PTGCKSWKP

SEQ ID NO: 1187888 - protein, 9 aa, Homo Sapiens
YGKAHAQKP

SEQ ID NO: 1187889 - protein, 9 aa, Homo Sapiens
AKCKHRHLR

SEQ ID NO: 1187890 - protein, 9 aa, Homo Sapiens
LAFFYSPLL

SEQ ID NO: 1187891 - protein, 9 aa, Homo Sapiens
PPSPLLVEA

SEQ ID NO: 1187892 - protein, 9 aa, Homo Sapiens
LTTANAPPG

SEQ ID NO: 1187893 - protein, 9 aa, Homo Sapiens
VVAHLGFRL

SEQ ID NO: 1187894 - protein, 9 aa, Homo Sapiens
GGSQPQLMQ

SEQ ID NO: 1187895 - protein, 9 aa, Homo Sapiens
PPCSSTSTT

SEQ ID NO: 1187896 - protein, 9 aa, Homo Sapiens
KQDLSNATE

SEQ ID NO: 1187897 - protein, 9 aa, Homo Sapiens
LLSQKETLK

SEQ ID NO: 1187898 - protein, 9 aa, Homo Sapiens
QSLLLEVIE

SEQ ID NO: 1187899 - protein, 9 aa, Homo Sapiens
RNGKVLRPL

SEQ ID NO: 1187900 - protein, 9 aa, Homo Sapiens
CPFDCKLSN

SEQ ID NO: 1187901 - protein, 9 aa, Homo Sapiens
LDVFASGSP

SEQ ID NO: 1187902 - protein, 9 aa, Homo Sapiens
INQNNNFQT

SEQ ID NO: 1187903 - protein, 9 aa, Homo Sapiens
PSGALNIKC

SEQ ID NO: 1187904 - protein, 9 aa, Homo Sapiens
PGAGHVAGC

SEQ ID NO: 1187905 - protein, 9 aa, Homo Sapiens
RRWPGCRGG

SEQ ID NO: 1187906 - protein, 9 aa, Homo Sapiens
LRTCHLMPG

SEQ ID NO: 1187907 - protein, 9 aa, Homo Sapiens
CHLLPLSDL

SEQ ID NO: 1187908 - protein, 9 aa, Homo Sapiens
CLRMRPPRS

SEQ ID NO: 1187909 - protein, 9 aa, Homo Sapiens
VILQLRNKN

SEQ ID NO: 1187910 - protein, 9 aa, Homo Sapiens
LSHQFQLSD

SEQ ID NO: 1187911 - protein, 9 aa, Homo Sapiens
KYNAFTMYT

SEQ ID NO: 1187912 - protein, 9 aa, Homo Sapiens
YLDLLDAHF

SEQ ID NO: 1187913 - protein, 9 aa, Homo Sapiens
WLSSCQVQE

SEQ ID NO: 1187914 - protein, 9 aa, Homo Sapiens
SSERTPGLQ

SEQ ID NO: 1187915 - protein, 9 aa, Homo Sapiens
ASPSTAGEP

SEQ ID NO: 1187916 - protein, 9 aa, Homo Sapiens
LAARALHSL

SEQ ID NO: 1187917 - protein, 9 aa, Homo Sapiens
FQHPEIVVH

SEQ ID NO: 1187918 - protein, 9 aa, Homo Sapiens
LQNYLPPVY

SEQ ID NO: 1187919 - protein, 9 aa, Homo Sapiens
RQRRRRQRR

SEQ ID NO: 1187920 - protein, 9 aa, Homo Sapiens
TLSARAVAA

SEQ ID NO: 1187921 - protein, 9 aa, Homo Sapiens
QGFHTVGSC

SEQ ID NO: 1187922 - protein, 9 aa, Homo Sapiens
FMVEGGEKH

SEQ ID NO: 1187923 - protein, 9 aa, Homo Sapiens
LDGLQRIRH

SEQ ID NO: 1187924 - protein, 9 aa, Homo Sapiens
SAPPWPRRS

SEQ ID NO: 1187925 - protein, 9 aa, Homo Sapiens
LNFHKSPKR

SEQ ID NO: 1187926 - protein, 9 aa, Homo Sapiens
LEKRTYKSA

SEQ ID NO: 1187927 - protein, 9 aa, Homo Sapiens
TPNGIVFDL

SEQ ID NO: 1187928 - protein, 9 aa, Homo Sapiens
ALHFSILLC

SEQ ID NO: 1187929 - protein, 9 aa, Homo Sapiens
GHPHNPRTA

SEQ ID NO: 1187930 - protein, 9 aa, Homo Sapiens
TQMTYFNRS

SEQ ID NO: 1187931 - protein, 9 aa, Homo Sapiens
GAYDWEFSS

SEQ ID NO: 1187932 - protein, 9 aa, Homo Sapiens
TQTCAVNCP

SEQ ID NO: 1187933 - protein, 9 aa, Homo Sapiens
GYVRIIEAI

SEQ ID NO: 1187934 - protein, 9 aa, Homo Sapiens
PPPTPFDRH

SEQ ID NO: 1187935 - protein, 9 aa, Homo Sapiens
VNLECMEPQ

SEQ ID NO: 1187936 - protein, 9 aa, Homo Sapiens
QDDGSDAPL

SEQ ID NO: 1187937 - protein, 9 aa, Homo Sapiens
YDYVRRCLT

SEQ ID NO: 1187938 - protein, 9 aa, Homo Sapiens
CFCPADPYS

SEQ ID NO: 1187939 - protein, 9 aa, Homo Sapiens
SPCTKLMAK

SEQ ID NO: 1187940 - protein, 9 aa, Homo Sapiens
TIRFTVRTC

SEQ ID NO: 1187941 - protein, 9 aa, Homo Sapiens
CMQACLDKK

SEQ ID NO: 1187942 - protein, 9 aa, Homo Sapiens
EGTDAAQAA

SEQ ID NO: 1187943 - protein, 9 aa, Homo Sapiens
AVQHLRPGE

SEQ ID NO: 1187944 - protein, 9 aa, Homo Sapiens
VTWGNGSGE

SEQ ID NO: 1187945 - protein, 9 aa, Homo Sapiens
LDVWARLEC

SEQ ID NO: 1187946 - protein, 9 aa, Homo Sapiens
LTQSLLLEV

SEQ ID NO: 1187947 - protein, 9 aa, Homo Sapiens
LAVGGASAL

SEQ ID NO: 1187948 - protein, 9 aa, Homo Sapiens
TGSAVESIK

SEQ ID NO: 1187949 - protein, 9 aa, Homo Sapiens
VTVGIKPER

SEQ ID NO: 1187950 - protein, 9 aa, Homo Sapiens
VHMDLMRED

SEQ ID NO: 1187951 - protein, 9 aa, Homo Sapiens
PPPQPGNQR

SEQ ID NO: 1187952 - protein, 9 aa, Homo Sapiens
KLLCMCFQP

SEQ ID NO: 1187953 - protein, 9 aa, Homo Sapiens
AALIDRDQG

SEQ ID NO: 1187954 - protein, 9 aa, Homo Sapiens
RRLTADMQA

SEQ ID NO: 1187955 - protein, 9 aa, Homo Sapiens
EGVAAPHPR

SEQ ID NO: 1187956 - protein, 9 aa, Homo Sapiens
TRHGQSGQG

SEQ ID NO: 1187957 - protein, 9 aa, Homo Sapiens
WCGMIRDNG

SEQ ID NO: 1187958 - protein, 9 aa, Homo Sapiens
RLMGVDSTA

SEQ ID NO: 1187959 - protein, 9 aa, Homo Sapiens
TSIQGKADI

SEQ ID NO: 1187960 - protein, 9 aa, Homo Sapiens
PPPGWLPRL

SEQ ID NO: 1187961 - protein, 9 aa, Homo Sapiens
DYHLAWLSD

SEQ ID NO: 1187962 - protein, 9 aa, Homo Sapiens
FHKLPSIGE

SEQ ID NO: 1187963 - protein, 9 aa, Homo Sapiens
FPRDKSAGS

SEQ ID NO: 1187964 - protein, 9 aa, Homo Sapiens
TCRSPCKSS

SEQ ID NO: 1187965 - protein, 9 aa, Homo Sapiens
VGDTSCGQV

SEQ ID NO: 1187966 - protein, 9 aa, Homo Sapiens
PTRTSSTCG

SEQ ID NO: 1187967 - protein, 9 aa, Homo Sapiens
GHVHGIAPD

SEQ ID NO: 1187968 - protein, 9 aa, Homo Sapiens
HLMDISPFL

SEQ ID NO: 1187969 - protein, 9 aa, Homo Sapiens
DQFNLWYTM

SEQ ID NO: 1187970 - protein, 9 aa, Homo Sapiens
SLIFLDVTT

SEQ ID NO: 1187971 - protein, 9 aa, Homo Sapiens
TEWKMHVSF

SEQ ID NO: 1187972 - protein, 9 aa, Homo Sapiens
NQKRFHQQL

SEQ ID NO: 1187973 - protein, 9 aa, Homo Sapiens
FAGDDAPPG

SEQ ID NO: 1187974 - protein, 9 aa, Homo Sapiens
GGGKRAATV

SEQ ID NO: 1187975 - protein, 9 aa, Homo Sapiens
VVLDVEARR

SEQ ID NO: 1187976 - protein, 9 aa, Homo Sapiens
NNQKLRVCV

SEQ ID NO: 1187977 - protein, 9 aa, Homo Sapiens
YTQDVRGKC

SEQ ID NO: 1187978 - protein, 9 aa, Homo Sapiens
QILAYAGFH

SEQ ID NO: 1187979 - protein, 9 aa, Homo Sapiens
PQQQHHHHH

SEQ ID NO: 1187980 - protein, 9 aa, Homo Sapiens
NGFSQSRSS

SEQ ID NO: 1187981 - protein, 9 aa, Homo Sapiens
ESSMSEDNS

SEQ ID NO: 1187982 - protein, 9 aa, Homo Sapiens
MESPSHAHG

SEQ ID NO: 1187983 - protein, 9 aa, Homo Sapiens
LSQTKKTKD

SEQ ID NO: 1187984 - protein, 9 aa, Homo Sapiens
AWSHCPLLQ

SEQ ID NO: 1187985 - protein, 9 aa, Homo Sapiens
NTDCIWDWR

SEQ ID NO: 1187986 - protein, 9 aa, Homo Sapiens
CLVCVPVHG

SEQ ID NO: 1187987 - protein, 9 aa, Homo Sapiens
SNVFSMLPW

SEQ ID NO: 1187988 - protein, 9 aa, Homo Sapiens
NTMGYNTDR

SEQ ID NO: 1187989 - protein, 9 aa, Homo Sapiens
AHYSRSDAA

SEQ ID NO: 1187990 - protein, 9 aa, Homo Sapiens
WVAAVGKDQ

SEQ ID NO: 1187991 - protein, 9 aa, Homo Sapiens
LGQQRQPAA

SEQ ID NO: 1187992 - protein, 9 aa, Homo Sapiens
EVGIMEEAE

SEQ ID NO: 1187993 - protein, 9 aa, Homo Sapiens
AELQLPPLP

SEQ ID NO: 1187994 - protein, 9 aa, Homo Sapiens
VKALRRLGV

SEQ ID NO: 1187995 - protein, 9 aa, Homo Sapiens
MAPQGCRCW

SEQ ID NO: 1187996 - protein, 9 aa, Homo Sapiens
SVRGIQGRS

SEQ ID NO: 1187997 - protein, 9 aa, Homo Sapiens
PRASRSRRW

SEQ ID NO: 1187998 - protein, 9 aa, Homo Sapiens
LLVPAVDGH

SEQ ID NO: 1187999 - protein, 9 aa, Homo Sapiens
DAWWFGTIK

SEQ ID NO: 1188000 - protein, 9 aa, Homo Sapiens
PVAMDVGDD

SEQ ID NO: 1188001 - protein, 9 aa, Homo Sapiens
ALVRCGQLL

SEQ ID NO: 1188002 - protein, 9 aa, Homo Sapiens
EHNYCRLIL

SEQ ID NO: 1188003 - protein, 9 aa, Homo Sapiens
AACGCGCEA

SEQ ID NO: 1188004 - protein, 9 aa, Homo Sapiens
EWTSLWSWS

SEQ ID NO: 1188005 - protein, 9 aa, Homo Sapiens
GFLTVCSEA

SEQ ID NO: 1188006 - protein, 9 aa, Homo Sapiens
VPPQTGQAP

SEQ ID NO: 1188007 - protein, 9 aa, Homo Sapiens
SPILKFFMV

SEQ ID NO: 1188008 - protein, 9 aa, Homo Sapiens
LIPITNAAS

SEQ ID NO: 1188009 - protein, 9 aa, Homo Sapiens
ARGPRAPVR

SEQ ID NO: 1188010 - protein, 9 aa, Homo Sapiens
SCGSCGCSK

SEQ ID NO: 1188011 - protein, 9 aa, Homo Sapiens
ASAVQSLPY

SEQ ID NO: 1188012 - protein, 9 aa, Homo Sapiens
ALDFWMSGK

SEQ ID NO: 1188013 - protein, 9 aa, Homo Sapiens
ASAAARTAA

SEQ ID NO: 1188014 - protein, 9 aa, Homo Sapiens
TTEISAVVD

SEQ ID NO: 1188015 - protein, 9 aa, Homo Sapiens
HKALARRLQ

SEQ ID NO: 1188016 - protein, 9 aa, Homo Sapiens
ATWRRPVPN

SEQ ID NO: 1188017 - protein, 9 aa, Homo Sapiens
LLAPKTTLP

SEQ ID NO: 1188018 - protein, 9 aa, Homo Sapiens
RAKRYRALF

SEQ ID NO: 1188019 - protein, 9 aa, Homo Sapiens
EINFRGNKP

SEQ ID NO: 1188020 - protein, 9 aa, Homo Sapiens
DIVATGSAV

SEQ ID NO: 1188021 - protein, 9 aa, Homo Sapiens
EPKVCEDLT

SEQ ID NO: 1188022 - protein, 9 aa, Homo Sapiens
VVVVGVGVM

SEQ ID NO: 1188023 - protein, 9 aa, Homo Sapiens
LAFGYFGIL

SEQ ID NO: 1188024 - protein, 9 aa, Homo Sapiens
PRSPRSPSR

SEQ ID NO: 1188025 - protein, 9 aa, Homo Sapiens
RTDQKFVPV

SEQ ID NO: 1188026 - protein, 9 aa, Homo Sapiens
GRRQYILKN

SEQ ID NO: 1188027 - protein, 9 aa, Homo Sapiens
LGHWRRGGG

SEQ ID NO: 1188028 - protein, 9 aa, Homo Sapiens
MWQRIAQRL

SEQ ID NO: 1188029 - protein, 9 aa, Homo Sapiens
ISAVVDANG

SEQ ID NO: 1188030 - protein, 9 aa, Homo Sapiens
RPQQPPPRL

SEQ ID NO: 1188031 - protein, 9 aa, Homo Sapiens
PMYHILRYM

SEQ ID NO: 1188032 - protein, 9 aa, Homo Sapiens
LSRPPGPQC

SEQ ID NO: 1188033 - protein, 9 aa, Homo Sapiens
HTLTTYTLV

SEQ ID NO: 1188034 - protein, 9 aa, Homo Sapiens
HRHLRFPPM

SEQ ID NO: 1188035 - protein, 9 aa, Homo Sapiens
SMESPSHAH

SEQ ID NO: 1188036 - protein, 9 aa, Homo Sapiens
VGMVLLHCC

SEQ ID NO: 1188037 - protein, 9 aa, Homo Sapiens
MLKGGCPKA

SEQ ID NO: 1188038 - protein, 9 aa, Homo Sapiens
LMYPPPYYP

SEQ ID NO: 1188039 - protein, 9 aa, Homo Sapiens
ARGCPPFTV

SEQ ID NO: 1188040 - protein, 9 aa, Homo Sapiens
LKVPPGWMP

SEQ ID NO: 1188041 - protein, 9 aa, Homo Sapiens
LEVVEGVLI

SEQ ID NO: 1188042 - protein, 9 aa, Homo Sapiens
PPLPTASGL

SEQ ID NO: 1188043 - protein, 9 aa, Homo Sapiens
PLTCSVVSA

SEQ ID NO: 1188044 - protein, 9 aa, Homo Sapiens
SDVSHDSAR

SEQ ID NO: 1188045 - protein, 9 aa, Homo Sapiens
PTDEGWELI

SEQ ID NO: 1188046 - protein, 9 aa, Homo Sapiens
EFDCKLHLL

SEQ ID NO: 1188047 - protein, 9 aa, Homo Sapiens
FCPRNVPTA

SEQ ID NO: 1188048 - protein, 9 aa, Homo Sapiens
LCLPAQSWC

SEQ ID NO: 1188049 - protein, 9 aa, Homo Sapiens
GVHEVQVPP

SEQ ID NO: 1188050 - protein, 9 aa, Homo Sapiens
SGSANQPVV

SEQ ID NO: 1188051 - protein, 9 aa, Homo Sapiens
VGPPSPLLV

SEQ ID NO: 1188052 - protein, 9 aa, Homo Sapiens
ADDIVATGS

SEQ ID NO: 1188053 - protein, 9 aa, Homo Sapiens
YSLTCHNHA

SEQ ID NO: 1188054 - protein, 9 aa, Homo Sapiens
VSGSGSGGR

SEQ ID NO: 1188055 - protein, 9 aa, Homo Sapiens
GSLVADHDY

SEQ ID NO: 1188056 - protein, 9 aa, Homo Sapiens
SAGRRAAGA

SEQ ID NO: 1188057 - protein, 9 aa, Homo Sapiens
FCFYKLVTL

SEQ ID NO: 1188058 - protein, 9 aa, Homo Sapiens
QLRPPPSRH

SEQ ID NO: 1188059 - protein, 9 aa, Homo Sapiens
SPKPQAKAV

SEQ ID NO: 1188060 - protein, 9 aa, Homo Sapiens
REVRDSYTR

SEQ ID NO: 1188061 - protein, 9 aa, Homo Sapiens
AKHVAASLH

SEQ ID NO: 1188062 - protein, 9 aa, Homo Sapiens
RRRNILMIA

SEQ ID NO: 1188063 - protein, 9 aa, Homo Sapiens
ENEYQASSI

SEQ ID NO: 1188064 - protein, 9 aa, Homo Sapiens
SPRSRCGPS

SEQ ID NO: 1188065 - protein, 9 aa, Homo Sapiens
VTTSSLGKS

SEQ ID NO: 1188066 - protein, 9 aa, Homo Sapiens
RCNLLRQEN

SEQ ID NO: 1188067 - protein, 9 aa, Homo Sapiens
LPSRSLLIP

SEQ ID NO: 1188068 - protein, 9 aa, Homo Sapiens
SLCMVSRTA

SEQ ID NO: 1188069 - protein, 9 aa, Homo Sapiens
RMWQRIAQR

SEQ ID NO: 1188070 - protein, 9 aa, Homo Sapiens
VFWLADSLL

SEQ ID NO: 1188071 - protein, 9 aa, Homo Sapiens
AALGWSPCD

SEQ ID NO: 1188072 - protein, 9 aa, Homo Sapiens
CTCMCTHIH

SEQ ID NO: 1188073 - protein, 9 aa, Homo Sapiens
LVRSQVDKV

SEQ ID NO: 1188074 - protein, 9 aa, Homo Sapiens
KARGGLPCR

SEQ ID NO: 1188075 - protein, 9 aa, Homo Sapiens
AASCACMTG

SEQ ID NO: 1188076 - protein, 9 aa, Homo Sapiens
GLVDNDLCV

SEQ ID NO: 1188077 - protein, 9 aa, Homo Sapiens
AGRAIPRAS

SEQ ID NO: 1188078 - protein, 9 aa, Homo Sapiens
TRPLWSRLS

SEQ ID NO: 1188079 - protein, 9 aa, Homo Sapiens
DVEGLGQTA

SEQ ID NO: 1188080 - protein, 9 aa, Homo Sapiens
PIASPWFAA

SEQ ID NO: 1188081 - protein, 9 aa, Homo Sapiens
TAEQRRMER

SEQ ID NO: 1188082 - protein, 9 aa, Homo Sapiens
NHNSKFHPG

SEQ ID NO: 1188083 - protein, 9 aa, Homo Sapiens
RRRQAGAPL

SEQ ID NO: 1188084 - protein, 9 aa, Homo Sapiens
QDTSGHRGS

SEQ ID NO: 1188085 - protein, 9 aa, Homo Sapiens
YDPCLQDGI

SEQ ID NO: 1188086 - protein, 9 aa, Homo Sapiens
STDICSPST

SEQ ID NO: 1188087 - protein, 9 aa, Homo Sapiens
ANQTYLVLE

SEQ ID NO: 1188088 - protein, 9 aa, Homo Sapiens
RPKVYRLIN

SEQ ID NO: 1188089 - protein, 9 aa, Homo Sapiens
SCFPSGDGQ

SEQ ID NO: 1188090 - protein, 9 aa, Homo Sapiens
HLPRPIQGL

SEQ ID NO: 1188091 - protein, 9 aa, Homo Sapiens
NLLQDRFPL

SEQ ID NO: 1188092 - protein, 9 aa, Homo Sapiens
PARVVIPRG

SEQ ID NO: 1188093 - protein, 9 aa, Homo Sapiens
LGCQAPSCL

SEQ ID NO: 1188094 - protein, 9 aa, Homo Sapiens
RNTDKNGDE

SEQ ID NO: 1188095 - protein, 9 aa, Homo Sapiens
TTWSAPQPG

SEQ ID NO: 1188096 - protein, 9 aa, Homo Sapiens
RKERAQEDL

SEQ ID NO: 1188097 - protein, 9 aa, Homo Sapiens
VLDTCYGNI

SEQ ID NO: 1188098 - protein, 9 aa, Homo Sapiens
IECSDEKSP

SEQ ID NO: 1188099 - protein, 9 aa, Homo Sapiens
AQPGLVDRH

SEQ ID NO: 1188100 - protein, 9 aa, Homo Sapiens
SLLWLASRP

SEQ ID NO: 1188101 - protein, 9 aa, Homo Sapiens
LHLLPGQAL

SEQ ID NO: 1188102 - protein, 9 aa, Homo Sapiens
CGVWRRRTG

SEQ ID NO: 1188103 - protein, 9 aa, Homo Sapiens
KRVNLECME

SEQ ID NO: 1188104 - protein, 9 aa, Homo Sapiens
QLVKMLHIN

SEQ ID NO: 1188105 - protein, 9 aa, Homo Sapiens
SWLPCRGPM

SEQ ID NO: 1188106 - protein, 9 aa, Homo Sapiens
SGAQQQLQA

SEQ ID NO: 1188107 - protein, 9 aa, Homo Sapiens
QQNTLRHQV

SEQ ID NO: 1188108 - protein, 9 aa, Homo Sapiens
GLPCFHGQT

SEQ ID NO: 1188109 - protein, 9 aa, Homo Sapiens
VTTFCSEGM

SEQ ID NO: 1188110 - protein, 9 aa, Homo Sapiens
RNVPTAASP

SEQ ID NO: 1188111 - protein, 9 aa, Homo Sapiens
WCNEHLKCA

SEQ ID NO: 1188112 - protein, 9 aa, Homo Sapiens
SGVIRLYMS

SEQ ID NO: 1188113 - protein, 9 aa, Homo Sapiens
LQLRPPPSR

SEQ ID NO: 1188114 - protein, 9 aa, Homo Sapiens
RGSPWTGSA

SEQ ID NO: 1188115 - protein, 9 aa, Homo Sapiens
EWKMHVSFL

SEQ ID NO: 1188116 - protein, 9 aa, Homo Sapiens
SLLFFWRPP

SEQ ID NO: 1188117 - protein, 9 aa, Homo Sapiens
GDVEGLGQT

SEQ ID NO: 1188118 - protein, 9 aa, Homo Sapiens
LLTHRVQAG

SEQ ID NO: 1188119 - protein, 9 aa, Homo Sapiens
TNQPNFMQL

SEQ ID NO: 1188120 - protein, 9 aa, Homo Sapiens
FWRQEQSVY

SEQ ID NO: 1188121 - protein, 9 aa, Homo Sapiens
PWAWRATRR

SEQ ID NO: 1188122 - protein, 9 aa, Homo Sapiens
GGGGSWSSA

SEQ ID NO: 1188123 - protein, 9 aa, Homo Sapiens
FHFCTMKCD

SEQ ID NO: 1188124 - protein, 9 aa, Homo Sapiens
TTSLKGSRT

SEQ ID NO: 1188125 - protein, 9 aa, Homo Sapiens
GAAARSWAS

SEQ ID NO: 1188126 - protein, 9 aa, Homo Sapiens
FYHAKTGRT

SEQ ID NO: 1188127 - protein, 9 aa, Homo Sapiens
APLPPRAPH

SEQ ID NO: 1188128 - protein, 9 aa, Homo Sapiens
WPLQCLLHS

SEQ ID NO: 1188129 - protein, 9 aa, Homo Sapiens
AVSTVLHLT

SEQ ID NO: 1188130 - protein, 9 aa, Homo Sapiens
PKLLSMEVS

SEQ ID NO: 1188131 - protein, 9 aa, Homo Sapiens
SCPWLKCSA

SEQ ID NO: 1188132 - protein, 9 aa, Homo Sapiens
STEESSNCK

SEQ ID NO: 1188133 - protein, 9 aa, Homo Sapiens
GDVGLHSMR

SEQ ID NO: 1188134 - protein, 9 aa, Homo Sapiens
VAHRVAERQ

SEQ ID NO: 1188135 - protein, 9 aa, Homo Sapiens
GLGRVLRPH

SEQ ID NO: 1188136 - protein, 9 aa, Homo Sapiens
DLTHFVANS

SEQ ID NO: 1188137 - protein, 9 aa, Homo Sapiens
PLLVEARAV

SEQ ID NO: 1188138 - protein, 9 aa, Homo Sapiens
NKYLAKTGG

SEQ ID NO: 1188139 - protein, 9 aa, Homo Sapiens
LKTFALQQR

SEQ ID NO: 1188140 - protein, 9 aa, Homo Sapiens
WGAMALTRG

SEQ ID NO: 1188141 - protein, 9 aa, Homo Sapiens
LQDRFPLLP

SEQ ID NO: 1188142 - protein, 9 aa, Homo Sapiens
DEMNIKIIR

SEQ ID NO: 1188143 - protein, 9 aa, Homo Sapiens
RSAQHISFP

SEQ ID NO: 1188144 - protein, 9 aa, Homo Sapiens
LDLRFSGAP

SEQ ID NO: 1188145 - protein, 9 aa, Homo Sapiens
MSVILSVVH

SEQ ID NO: 1188146 - protein, 9 aa, Homo Sapiens
TFPHVQRGR

SEQ ID NO: 1188147 - protein, 9 aa, Homo Sapiens
DWYRHQNGT

SEQ ID NO: 1188148 - protein, 9 aa, Homo Sapiens
HVSMYRSAH

SEQ ID NO: 1188149 - protein, 9 aa, Homo Sapiens
DGIYTYIAV

SEQ ID NO: 1188150 - protein, 9 aa, Homo Sapiens
SQLLANEIK

SEQ ID NO: 1188151 - protein, 9 aa, Homo Sapiens
PHFLLKFHL

SEQ ID NO: 1188152 - protein, 9 aa, Homo Sapiens
YRGWAPRIK

SEQ ID NO: 1188153 - protein, 9 aa, Homo Sapiens
ALCISNVFS

SEQ ID NO: 1188154 - protein, 9 aa, Homo Sapiens
IHLVDDAFG

SEQ ID NO: 1188155 - protein, 9 aa, Homo Sapiens
TTPYGYAME

SEQ ID NO: 1188156 - protein, 9 aa, Homo Sapiens
GLGLGARAG

SEQ ID NO: 1188157 - protein, 9 aa, Homo Sapiens
SEPRPTSAW

SEQ ID NO: 1188158 - protein, 9 aa, Homo Sapiens
ETAEKIWES

SEQ ID NO: 1188159 - protein, 9 aa, Homo Sapiens
LLQLRPPPS

SEQ ID NO: 1188160 - protein, 9 aa, Homo Sapiens
PTHSTHCSF

SEQ ID NO: 1188161 - protein, 9 aa, Homo Sapiens
VVSKGKKCI

SEQ ID NO: 1188162 - protein, 9 aa, Homo Sapiens
AVVMVVRPV

SEQ ID NO: 1188163 - protein, 9 aa, Homo Sapiens
ASPARRRAG

SEQ ID NO: 1188164 - protein, 9 aa, Homo Sapiens
MATCHFDAV

SEQ ID NO: 1188165 - protein, 9 aa, Homo Sapiens
MSEFQHLMD

SEQ ID NO: 1188166 - protein, 9 aa, Homo Sapiens
VCHWGAAPG

SEQ ID NO: 1188167 - protein, 9 aa, Homo Sapiens
RDAVWRGAS

SEQ ID NO: 1188168 - protein, 9 aa, Homo Sapiens
AAVPVQPHS

SEQ ID NO: 1188169 - protein, 9 aa, Homo Sapiens
RVTPGPPPC

SEQ ID NO: 1188170 - protein, 9 aa, Homo Sapiens
GHPGRVKHV

SEQ ID NO: 1188171 - protein, 9 aa, Homo Sapiens
SNSRKFGWQ

SEQ ID NO: 1188172 - protein, 9 aa, Homo Sapiens
ARAILHVQH

SEQ ID NO: 1188173 - protein, 9 aa, Homo Sapiens
ERAAAALRA

SEQ ID NO: 1188174 - protein, 9 aa, Homo Sapiens
DVLVGHKAV

SEQ ID NO: 1188175 - protein, 9 aa, Homo Sapiens
STLERVSPG

SEQ ID NO: 1188176 - protein, 9 aa, Homo Sapiens
SAPGPAPST

SEQ ID NO: 1188177 - protein, 9 aa, Homo Sapiens
QMNDARHGG

SEQ ID NO: 1188178 - protein, 9 aa, Homo Sapiens
VSPGGAGRL

SEQ ID NO: 1188179 - protein, 9 aa, Homo Sapiens
VILGSGEEV

SEQ ID NO: 1188180 - protein, 9 aa, Homo Sapiens
VHGGLWAHR

SEQ ID NO: 1188181 - protein, 9 aa, Homo Sapiens
DFPKIFPYP

SEQ ID NO: 1188182 - protein, 9 aa, Homo Sapiens
KETLMATCH

SEQ ID NO: 1188183 - protein, 9 aa, Homo Sapiens
EKGPAARDC

SEQ ID NO: 1188184 - protein, 9 aa, Homo Sapiens
AGAAARSWA

SEQ ID NO: 1188185 - protein, 9 aa, Homo Sapiens
HLQEEEGEI

SEQ ID NO: 1188186 - protein, 9 aa, Homo Sapiens
QCPRLEGRL

SEQ ID NO: 1188187 - protein, 9 aa, Homo Sapiens
WTAASAPQA

SEQ ID NO: 1188188 - protein, 9 aa, Homo Sapiens
APPSTPPAA

SEQ ID NO: 1188189 - protein, 9 aa, Homo Sapiens
ICTVPNVRL

SEQ ID NO: 1188190 - protein, 9 aa, Homo Sapiens
SISRTCRSP

SEQ ID NO: 1188191 - protein, 9 aa, Homo Sapiens
PECTLKGDL

SEQ ID NO: 1188192 - protein, 9 aa, Homo Sapiens
QPGRRRSRQ

SEQ ID NO: 1188193 - protein, 9 aa, Homo Sapiens
AGGQRTRGG

SEQ ID NO: 1188194 - protein, 9 aa, Homo Sapiens
YSSVDPKRE

SEQ ID NO: 1188195 - protein, 9 aa, Homo Sapiens
QLFAVWKLQ

SEQ ID NO: 1188196 - protein, 9 aa, Homo Sapiens
GGTGSGMGM

SEQ ID NO: 1188197 - protein, 9 aa, Homo Sapiens
HSYLGSVRE

SEQ ID NO: 1188198 - protein, 9 aa, Homo Sapiens
KEVQKYPQC

SEQ ID NO: 1188199 - protein, 9 aa, Homo Sapiens
QLAPPGSLE

SEQ ID NO: 1188200 - protein, 9 aa, Homo Sapiens
CTKLMAKTI

SEQ ID NO: 1188201 - protein, 9 aa, Homo Sapiens
SQPQLMQNF

SEQ ID NO: 1188202 - protein, 9 aa, Homo Sapiens
SVIRHLSHR

SEQ ID NO: 1188203 - protein, 9 aa, Homo Sapiens
QGCLAPARV

SEQ ID NO: 1188204 - protein, 9 aa, Homo Sapiens
RKFLGEEQQ

SEQ ID NO: 1188205 - protein, 9 aa, Homo Sapiens
QTSKVAGLS

SEQ ID NO: 1188206 - protein, 9 aa, Homo Sapiens
AVGATSTTG

SEQ ID NO: 1188207 - protein, 9 aa, Homo Sapiens
GICALRLVV

SEQ ID NO: 1188208 - protein, 9 aa, Homo Sapiens
HGFLKVPPG

SEQ ID NO: 1188209 - protein, 9 aa, Homo Sapiens
VGTYILGIF

SEQ ID NO: 1188210 - protein, 9 aa, Homo Sapiens
HSLGTTGTL

SEQ ID NO: 1188211 - protein, 9 aa, Homo Sapiens
PLLCVTRPS

SEQ ID NO: 1188212 - protein, 9 aa, Homo Sapiens
NCSDQLGNA

SEQ ID NO: 1188213 - protein, 9 aa, Homo Sapiens
SWRSGCVPR

SEQ ID NO: 1188214 - protein, 9 aa, Homo Sapiens
CRPVEERVV

SEQ ID NO: 1188215 - protein, 9 aa, Homo Sapiens
DVVLRLSCP

SEQ ID NO: 1188216 - protein, 9 aa, Homo Sapiens
GAARAILHV

SEQ ID NO: 1188217 - protein, 9 aa, Homo Sapiens
TRIIQATEK

SEQ ID NO: 1188218 - protein, 9 aa, Homo Sapiens
SQLCRKARL

SEQ ID NO: 1188219 - protein, 9 aa, Homo Sapiens
QKPLEKNGQ

SEQ ID NO: 1188220 - protein, 9 aa, Homo Sapiens
TYTLVLTAF

SEQ ID NO: 1188221 - protein, 9 aa, Homo Sapiens
FPSGDGQLF

SEQ ID NO: 1188222 - protein, 9 aa, Homo Sapiens
KFFSTGPTR

SEQ ID NO: 1188223 - protein, 9 aa, Homo Sapiens
HALVAHRVA

SEQ ID NO: 1188224 - protein, 9 aa, Homo Sapiens
GIRPTYSSK

SEQ ID NO: 1188225 - protein, 9 aa, Homo Sapiens
AKEKECMQA

SEQ ID NO: 1188226 - protein, 9 aa, Homo Sapiens
LFSFRRRLG

SEQ ID NO: 1188227 - protein, 9 aa, Homo Sapiens
PPTGLVDND

SEQ ID NO: 1188228 - protein, 9 aa, Homo Sapiens
KRSFGTTNM

SEQ ID NO: 1188229 - protein, 9 aa, Homo Sapiens
RKVKKRKRR

SEQ ID NO: 1188230 - protein, 9 aa, Homo Sapiens
KAHEVAPKR

SEQ ID NO: 1188231 - protein, 9 aa, Homo Sapiens
ATRKPPSPS

SEQ ID NO: 1188232 - protein, 9 aa, Homo Sapiens
ARDCTLEYA

SEQ ID NO: 1188233 - protein, 9 aa, Homo Sapiens
HRSCPWLKC

SEQ ID NO: 1188234 - protein, 9 aa, Homo Sapiens
GPALPPACP

SEQ ID NO: 1188235 - protein, 9 aa, Homo Sapiens
CLPLGLGGE

SEQ ID NO: 1188236 - protein, 9 aa, Homo Sapiens
SYCPEYLIN

SEQ ID NO: 1188237 - protein, 9 aa, Homo Sapiens
RDRAQGGEP

SEQ ID NO: 1188238 - protein, 9 aa, Homo Sapiens
QRRRRQRRR

SEQ ID NO: 1188239 - protein, 9 aa, Homo Sapiens
TTTTTTTPS

SEQ ID NO: 1188240 - protein, 9 aa, Homo Sapiens
DLGVPFWVR

SEQ ID NO: 1188241 - protein, 9 aa, Homo Sapiens
KADGLGSKG

SEQ ID NO: 1188242 - protein, 9 aa, Homo Sapiens
RTVALANPG

SEQ ID NO: 1188243 - protein, 9 aa, Homo Sapiens
PGITRVYRI

SEQ ID NO: 1188244 - protein, 9 aa, Homo Sapiens
VHWAVRRGL

SEQ ID NO: 1188245 - protein, 9 aa, Homo Sapiens
VLSALQREG

SEQ ID NO: 1188246 - protein, 9 aa, Homo Sapiens
IGVEMVLLW

SEQ ID NO: 1188247 - protein, 9 aa, Homo Sapiens
RQDGLMVIV

SEQ ID NO: 1188248 - protein, 9 aa, Homo Sapiens
LGVAISEVL

SEQ ID NO: 1188249 - protein, 9 aa, Homo Sapiens
SCQPLPQPL

SEQ ID NO: 1188250 - protein, 9 aa, Homo Sapiens
PVAFQLVIH

SEQ ID NO: 1188251 - protein, 9 aa, Homo Sapiens
GKKHTSNNL

SEQ ID NO: 1188252 - protein, 9 aa, Homo Sapiens
PRKLEAFAE

SEQ ID NO: 1188253 - protein, 9 aa, Homo Sapiens
LPCDHVHYL

SEQ ID NO: 1188254 - protein, 9 aa, Homo Sapiens
LWTMDPSPE

SEQ ID NO: 1188255 - protein, 9 aa, Homo Sapiens
FLRPCHLLP

SEQ ID NO: 1188256 - protein, 9 aa, Homo Sapiens
MSQLLANEI

SEQ ID NO: 1188257 - protein, 9 aa, Homo Sapiens
PLGPVADLW

SEQ ID NO: 1188258 - protein, 9 aa, Homo Sapiens
AGAALVGAG

SEQ ID NO: 1188259 - protein, 9 aa, Homo Sapiens
LYVQKMNMW

SEQ ID NO: 1188260 - protein, 9 aa, Homo Sapiens
HGVEPLAKC

SEQ ID NO: 1188261 - protein, 9 aa, Homo Sapiens
SACRPPLPL

SEQ ID NO: 1188262 - protein, 9 aa, Homo Sapiens
AVGLINAGK

SEQ ID NO: 1188263 - protein, 9 aa, Homo Sapiens
FYYHEHFTL

SEQ ID NO: 1188264 - protein, 9 aa, Homo Sapiens
TAASAPQAR

SEQ ID NO: 1188265 - protein, 9 aa, Homo Sapiens
VMGQWDPSF

SEQ ID NO: 1188266 - protein, 9 aa, Homo Sapiens
ACRRRRSRR

SEQ ID NO: 1188267 - protein, 9 aa, Homo Sapiens
NAAQAQKKN

SEQ ID NO: 1188268 - protein, 9 aa, Homo Sapiens
MQAVRAQSA

SEQ ID NO: 1188269 - protein, 9 aa, Homo Sapiens
SRWRHPLPP

SEQ ID NO: 1188270 - protein, 9 aa, Homo Sapiens
WRRPVPNPP

SEQ ID NO: 1188271 - protein, 9 aa, Homo Sapiens
LCMVSRTAP

SEQ ID NO: 1188272 - protein, 9 aa, Homo Sapiens
PRGHLLVQD

SEQ ID NO: 1188273 - protein, 9 aa, Homo Sapiens
HGVGPGGCI

SEQ ID NO: 1188274 - protein, 9 aa, Homo Sapiens
RRGPPKDNK

SEQ ID NO: 1188275 - protein, 9 aa, Homo Sapiens
TPAEAPLPA

SEQ ID NO: 1188276 - protein, 9 aa, Homo Sapiens
GEVEAPSFE

SEQ ID NO: 1188277 - protein, 9 aa, Homo Sapiens
MADIESLEV

SEQ ID NO: 1188278 - protein, 9 aa, Homo Sapiens
TCRTRWPAP

SEQ ID NO: 1188279 - protein, 9 aa, Homo Sapiens
PPDQWCPDG

SEQ ID NO: 1188280 - protein, 9 aa, Homo Sapiens
CNAGCARLS

SEQ ID NO: 1188281 - protein, 9 aa, Homo Sapiens
EDGQNLVEW

SEQ ID NO: 1188282 - protein, 9 aa, Homo Sapiens
ESSGLNLGI

SEQ ID NO: 1188283 - protein, 9 aa, Homo Sapiens
SELPPGRAW

SEQ ID NO: 1188284 - protein, 9 aa, Homo Sapiens
RSWARSLAS

SEQ ID NO: 1188285 - protein, 9 aa, Homo Sapiens
PTLTPGPEM

SEQ ID NO: 1188286 - protein, 9 aa, Homo Sapiens
VASFVPRDV

SEQ ID NO: 1188287 - protein, 9 aa, Homo Sapiens
WLNWSSCWA

SEQ ID NO: 1188288 - protein, 9 aa, Homo Sapiens
KPYVCERCC

SEQ ID NO: 1188289 - protein, 9 aa, Homo Sapiens
RAGPCLPSS

SEQ ID NO: 1188290 - protein, 9 aa, Homo Sapiens
ARPPQARGP

SEQ ID NO: 1188291 - protein, 9 aa, Homo Sapiens
GSVKPQDPN

SEQ ID NO: 1188292 - protein, 9 aa, Homo Sapiens
PVEERVVEG

SEQ ID NO: 1188293 - protein, 9 aa, Homo Sapiens
LPTTSLKGS

SEQ ID NO: 1188294 - protein, 9 aa, Homo Sapiens
AAPAARSPL

SEQ ID NO: 1188295 - protein, 9 aa, Homo Sapiens
SRAQKLCAL

SEQ ID NO: 1188296 - protein, 9 aa, Homo Sapiens
NFLEAVKRH

SEQ ID NO: 1188297 - protein, 9 aa, Homo Sapiens
TQHIEELQV

SEQ ID NO: 1188298 - protein, 9 aa, Homo Sapiens
RTGPPRLPP

SEQ ID NO: 1188299 - protein, 9 aa, Homo Sapiens
SCPPAWILY

SEQ ID NO: 1188300 - protein, 9 aa, Homo Sapiens
DVEVVENED

SEQ ID NO: 1188301 - protein, 9 aa, Homo Sapiens
FNYVRCMFG

SEQ ID NO: 1188302 - protein, 9 aa, Homo Sapiens
GLFVKTMVC

SEQ ID NO: 1188303 - protein, 9 aa, Homo Sapiens
FPSALGPWG

SEQ ID NO: 1188304 - protein, 9 aa, Homo Sapiens
PPLPLRPSH

SEQ ID NO: 1188305 - protein, 9 aa, Homo Sapiens
VPRPRPSQP

SEQ ID NO: 1188306 - protein, 9 aa, Homo Sapiens
FLLLFALFQ

SEQ ID NO: 1188307 - protein, 9 aa, Homo Sapiens
HPLYFRGRL

SEQ ID NO: 1188308 - protein, 9 aa, Homo Sapiens
AGMSKPVRV

SEQ ID NO: 1188309 - protein, 9 aa, Homo Sapiens
RWDAGLSGR

SEQ ID NO: 1188310 - protein, 9 aa, Homo Sapiens
PTSSCMTPA

SEQ ID NO: 1188311 - protein, 9 aa, Homo Sapiens
MTPASVPPG

SEQ ID NO: 1188312 - protein, 9 aa, Homo Sapiens
LPAGRHPQW

SEQ ID NO: 1188313 - protein, 9 aa, Homo Sapiens
GASPDYKDN

SEQ ID NO: 1188314 - protein, 9 aa, Homo Sapiens
DGCQTNCPA

SEQ ID NO: 1188315 - protein, 9 aa, Homo Sapiens
CKPMAPQGC

SEQ ID NO: 1188316 - protein, 9 aa, Homo Sapiens
SLPPGPGRP

SEQ ID NO: 1188317 - protein, 9 aa, Homo Sapiens
SKKESVFSW

SEQ ID NO: 1188318 - protein, 9 aa, Homo Sapiens
PKPLGPEQL

SEQ ID NO: 1188319 - protein, 9 aa, Homo Sapiens
DCGIHTREW

SEQ ID NO: 1188320 - protein, 9 aa, Homo Sapiens
LIHTPAEAP

SEQ ID NO: 1188321 - protein, 9 aa, Homo Sapiens
FPAAHARVV

SEQ ID NO: 1188322 - protein, 9 aa, Homo Sapiens
QRPPSSWPG

SEQ ID NO: 1188323 - protein, 9 aa, Homo Sapiens
RQLHVGYLV

SEQ ID NO: 1188324 - protein, 9 aa, Homo Sapiens
RNKIGSLVQ

SEQ ID NO: 1188325 - protein, 9 aa, Homo Sapiens
GPHTAPAAL

SEQ ID NO: 1188326 - protein, 9 aa, Homo Sapiens
ETTTGRPLS

SEQ ID NO: 1188327 - protein, 9 aa, Homo Sapiens
GHKGTTTAD

SEQ ID NO: 1188328 - protein, 9 aa, Homo Sapiens
LTTHKIVHA

SEQ ID NO: 1188329 - protein, 9 aa, Homo Sapiens
HHVVALVGG

SEQ ID NO: 1188330 - protein, 9 aa, Homo Sapiens
RGKCIDVDE

SEQ ID NO: 1188331 - protein, 9 aa, Homo Sapiens
VWRRRTGPP

SEQ ID NO: 1188332 - protein, 9 aa, Homo Sapiens
GILPEEEDE

SEQ ID NO: 1188333 - protein, 9 aa, Homo Sapiens
MALTPAATT

SEQ ID NO: 1188334 - protein, 9 aa, Homo Sapiens
LLCPPRGKR

SEQ ID NO: 1188335 - protein, 9 aa, Homo Sapiens
KPSTWTEMQ

SEQ ID NO: 1188336 - protein, 9 aa, Homo Sapiens
AQAEPPVPL

SEQ ID NO: 1188337 - protein, 9 aa, Homo Sapiens
LRSAQHISF

SEQ ID NO: 1188338 - protein, 9 aa, Homo Sapiens
VGLELPASV

SEQ ID NO: 1188339 - protein, 9 aa, Homo Sapiens
NAEAMTTAL

SEQ ID NO: 1188340 - protein, 9 aa, Homo Sapiens
GKCLGGSTL

SEQ ID NO: 1188341 - protein, 9 aa, Homo Sapiens
RRRARPGQL

SEQ ID NO: 1188342 - protein, 9 aa, Homo Sapiens
DPTFTFSAV

SEQ ID NO: 1188343 - protein, 9 aa, Homo Sapiens
STAILSRQT

SEQ ID NO: 1188344 - protein, 9 aa, Homo Sapiens
GGASALHRA

SEQ ID NO: 1188345 - protein, 9 aa, Homo Sapiens
LLKTYVESG

SEQ ID NO: 1188346 - protein, 9 aa, Homo Sapiens
SPSRAAPQA

SEQ ID NO: 1188347 - protein, 9 aa, Homo Sapiens
TALCFVLVL

SEQ ID NO: 1188348 - protein, 9 aa, Homo Sapiens
RVAPHFSIL

SEQ ID NO: 1188349 - protein, 9 aa, Homo Sapiens
IRDAVTHTE

SEQ ID NO: 1188350 - protein, 9 aa, Homo Sapiens
GQEAMTLGL

SEQ ID NO: 1188351 - protein, 9 aa, Homo Sapiens
AVWRGASGA

SEQ ID NO: 1188352 - protein, 9 aa, Homo Sapiens
SVVAHLGFR

SEQ ID NO: 1188353 - protein, 9 aa, Homo Sapiens
ALNIKCRIC

SEQ ID NO: 1188354 - protein, 9 aa, Homo Sapiens
GIAWLTQYY

SEQ ID NO: 1188355 - protein, 9 aa, Homo Sapiens
RGTHELGVV

SEQ ID NO: 1188356 - protein, 9 aa, Homo Sapiens
TVAVGCRRC

SEQ ID NO: 1188357 - protein, 9 aa, Homo Sapiens
PKRIEEKIQ

SEQ ID NO: 1188358 - protein, 9 aa, Homo Sapiens
AHKTLTSSV

SEQ ID NO: 1188359 - protein, 9 aa, Homo Sapiens
TAFFPDLMN

SEQ ID NO: 1188360 - protein, 9 aa, Homo Sapiens
SLYSVAVWP

SEQ ID NO: 1188361 - protein, 9 aa, Homo Sapiens
PYFPADATT

SEQ ID NO: 1188362 - protein, 9 aa, Homo Sapiens
SFLRAGRQM

SEQ ID NO: 1188363 - protein, 9 aa, Homo Sapiens
NELSLPALK

SEQ ID NO: 1188364 - protein, 9 aa, Homo Sapiens
RRQVREPRA

SEQ ID NO: 1188365 - protein, 9 aa, Homo Sapiens
TGAGGGGGN

SEQ ID NO: 1188366 - protein, 9 aa, Homo Sapiens
CPTRAHSRS

SEQ ID NO: 1188367 - protein, 9 aa, Homo Sapiens
GKGEKKNMK

SEQ ID NO: 1188368 - protein, 9 aa, Homo Sapiens
VGDHHVRDL

SEQ ID NO: 1188369 - protein, 9 aa, Homo Sapiens
SWCGMIRDN

SEQ ID NO: 1188370 - protein, 9 aa, Homo Sapiens
HVHGIAPDV

SEQ ID NO: 1188371 - protein, 9 aa, Homo Sapiens
GATRPPPTP

SEQ ID NO: 1188372 - protein, 9 aa, Homo Sapiens
GWLGTQLPG

SEQ ID NO: 1188373 - protein, 9 aa, Homo Sapiens
HRFDCISRK

SEQ ID NO: 1188374 - protein, 9 aa, Homo Sapiens
DNMRCSVNV

SEQ ID NO: 1188375 - protein, 9 aa, Homo Sapiens
LPSPRSRWR

SEQ ID NO: 1188376 - protein, 9 aa, Homo Sapiens
VGLDAKNTD

SEQ ID NO: 1188377 - protein, 9 aa, Homo Sapiens
YKRFHVKDH

SEQ ID NO: 1188378 - protein, 9 aa, Homo Sapiens
CSTHQKDKP

SEQ ID NO: 1188379 - protein, 9 aa, Homo Sapiens
RLLAQQQRV

SEQ ID NO: 1188380 - protein, 9 aa, Homo Sapiens
PRQASRLKP

SEQ ID NO: 1188381 - protein, 9 aa, Homo Sapiens
QPLNIMSMG

SEQ ID NO: 1188382 - protein, 9 aa, Homo Sapiens
QSLLSLYSV

SEQ ID NO: 1188383 - protein, 9 aa, Homo Sapiens
GAHGLAQRA

SEQ ID NO: 1188384 - protein, 9 aa, Homo Sapiens
TAAGGGPEC

SEQ ID NO: 1188385 - protein, 9 aa, Homo Sapiens
FAAHDQEAA

SEQ ID NO: 1188386 - protein, 9 aa, Homo Sapiens
ATWLSLALR

SEQ ID NO: 1188387 - protein, 9 aa, Homo Sapiens
ARSSARTTV

SEQ ID NO: 1188388 - protein, 9 aa, Homo Sapiens
VWERGVLQM

SEQ ID NO: 1188389 - protein, 9 aa, Homo Sapiens
HTVGSCCKN

SEQ ID NO: 1188390 - protein, 9 aa, Homo Sapiens
SRVDGSGSG

SEQ ID NO: 1188391 - protein, 9 aa, Homo Sapiens
RVKKVWSWT

SEQ ID NO: 1188392 - protein, 9 aa, Homo Sapiens
YVQKMNMWF

SEQ ID NO: 1188393 - protein, 9 aa, Homo Sapiens
SRRRSRTCT

SEQ ID NO: 1188394 - protein, 9 aa, Homo Sapiens
YDHVRPVGA

SEQ ID NO: 1188395 - protein, 9 aa, Homo Sapiens
VRAWRTSSA

SEQ ID NO: 1188396 - protein, 9 aa, Homo Sapiens
CCSRGATSR

SEQ ID NO: 1188397 - protein, 9 aa, Homo Sapiens
PLRMSDLMP

SEQ ID NO: 1188398 - protein, 9 aa, Homo Sapiens
CTLVHEVWK

SEQ ID NO: 1188399 - protein, 9 aa, Homo Sapiens
PRDVVLDVE

SEQ ID NO: 1188400 - protein, 9 aa, Homo Sapiens
YYEQCILVT

SEQ ID NO: 1188401 - protein, 9 aa, Homo Sapiens
ICQAMCSRS

SEQ ID NO: 1188402 - protein, 9 aa, Homo Sapiens
VSRKMGFHV

SEQ ID NO: 1188403 - protein, 9 aa, Homo Sapiens
SPEYTCWAS

SEQ ID NO: 1188404 - protein, 9 aa, Homo Sapiens
RQMGQGPLP

SEQ ID NO: 1188405 - protein, 9 aa, Homo Sapiens
AKESTHTSE

SEQ ID NO: 1188406 - protein, 9 aa, Homo Sapiens
SPVSLHERP

SEQ ID NO: 1188407 - protein, 9 aa, Homo Sapiens
APQGPPRMG

SEQ ID NO: 1188408 - protein, 9 aa, Homo Sapiens
LREQEKELW

SEQ ID NO: 1188409 - protein, 9 aa, Homo Sapiens
GVKHVLDAL

SEQ ID NO: 1188410 - protein, 9 aa, Homo Sapiens
LASRLRCAR

SEQ ID NO: 1188411 - protein, 9 aa, Homo Sapiens
PGSARPPSF

SEQ ID NO: 1188412 - protein, 9 aa, Homo Sapiens
CFATGAGKD

SEQ ID NO: 1188413 - protein, 9 aa, Homo Sapiens
GGSPASPAP

SEQ ID NO: 1188414 - protein, 9 aa, Homo Sapiens
ASPPPAGHP

SEQ ID NO: 1188415 - protein, 9 aa, Homo Sapiens
QCRQCDLYF

SEQ ID NO: 1188416 - protein, 9 aa, Homo Sapiens
QGPPRMGPA

SEQ ID NO: 1188417 - protein, 9 aa, Homo Sapiens
ASCETGFKD

SEQ ID NO: 1188418 - protein, 9 aa, Homo Sapiens
SLSVKMVIV

SEQ ID NO: 1188419 - protein, 9 aa, Homo Sapiens
HSRSATGSA

SEQ ID NO: 1188420 - protein, 9 aa, Homo Sapiens
QRPGAPGPC

SEQ ID NO: 1188421 - protein, 9 aa, Homo Sapiens
FADLGTFHD

SEQ ID NO: 1188422 - protein, 9 aa, Homo Sapiens
PQSLPSLLS

SEQ ID NO: 1188423 - protein, 9 aa, Homo Sapiens
GEKVGIIGR

SEQ ID NO: 1188424 - protein, 9 aa, Homo Sapiens
IRTPSVQDL

SEQ ID NO: 1188425 - protein, 9 aa, Homo Sapiens
FQLVIHSAV

SEQ ID NO: 1188426 - protein, 9 aa, Homo Sapiens
DVGLQTPPA

SEQ ID NO: 1188427 - protein, 9 aa, Homo Sapiens
ELRCWFIQQ

SEQ ID NO: 1188428 - protein, 9 aa, Homo Sapiens
LLPGPAAGA

SEQ ID NO: 1188429 - protein, 9 aa, Homo Sapiens
EKECMQACL

SEQ ID NO: 1188430 - protein, 9 aa, Homo Sapiens
AGRLETRWQ

SEQ ID NO: 1188431 - protein, 9 aa, Homo Sapiens
QKFSFAEHQ

SEQ ID NO: 1188432 - protein, 9 aa, Homo Sapiens
PLGLGRQKK

SEQ ID NO: 1188433 - protein, 9 aa, Homo Sapiens
RGEQPPDQW

SEQ ID NO: 1188434 - protein, 9 aa, Homo Sapiens
VLVFSSCDL

SEQ ID NO: 1188435 - protein, 9 aa, Homo Sapiens
AAAALRAVG

SEQ ID NO: 1188436 - protein, 9 aa, Homo Sapiens
PGHLQEECA

SEQ ID NO: 1188437 - protein, 9 aa, Homo Sapiens
QLPIESQMA

SEQ ID NO: 1188438 - protein, 9 aa, Homo Sapiens
LQALGSRSG

SEQ ID NO: 1188439 - protein, 9 aa, Homo Sapiens
LPHLPIECS

SEQ ID NO: 1188440 - protein, 9 aa, Homo Sapiens
QSKGEEEEE

SEQ ID NO: 1188441 - protein, 9 aa, Homo Sapiens
GWQMRASTP

SEQ ID NO: 1188442 - protein, 9 aa, Homo Sapiens
TPAPCLTHC

SEQ ID NO: 1188443 - protein, 9 aa, Homo Sapiens
VTFGKAQED

SEQ ID NO: 1188444 - protein, 9 aa, Homo Sapiens
LEHDIQADG

SEQ ID NO: 1188445 - protein, 9 aa, Homo Sapiens
VLGLTYTRT

SEQ ID NO: 1188446 - protein, 9 aa, Homo Sapiens
PGVVPTCHN

SEQ ID NO: 1188447 - protein, 9 aa, Homo Sapiens
RPHGRSSRQ

SEQ ID NO: 1188448 - protein, 9 aa, Homo Sapiens
LDKSNSPLA

SEQ ID NO: 1188449 - protein, 9 aa, Homo Sapiens
MLGLNDTPF

SEQ ID NO: 1188450 - protein, 9 aa, Homo Sapiens
GLKPRRACQ

SEQ ID NO: 1188451 - protein, 9 aa, Homo Sapiens
VRLWPQKKC

SEQ ID NO: 1188452 - protein, 9 aa, Homo Sapiens
VGKDQPFMG

SEQ ID NO: 1188453 - protein, 9 aa, Homo Sapiens
VERALAAIE

SEQ ID NO: 1188454 - protein, 9 aa, Homo Sapiens
LERLEREER

SEQ ID NO: 1188455 - protein, 9 aa, Homo Sapiens
LRPGEAVGL

SEQ ID NO: 1188456 - protein, 9 aa, Homo Sapiens
FCTMKCDEE

SEQ ID NO: 1188457 - protein, 9 aa, Homo Sapiens
RPRRALGFR

SEQ ID NO: 1188458 - protein, 9 aa, Homo Sapiens
ASTDRWSEL

SEQ ID NO: 1188459 - protein, 9 aa, Homo Sapiens
GAPDPRRRP

SEQ ID NO: 1188460 - protein, 9 aa, Homo Sapiens
RPGVPLVRT

SEQ ID NO: 1188461 - protein, 9 aa, Homo Sapiens
IYSLSNKEV

SEQ ID NO: 1188462 - protein, 9 aa, Homo Sapiens
RCQHQHVYL

SEQ ID NO: 1188463 - protein, 9 aa, Homo Sapiens
EVFCFYKLV

SEQ ID NO: 1188464 - protein, 9 aa, Homo Sapiens
LSMRNTSVV

SEQ ID NO: 1188465 - protein, 9 aa, Homo Sapiens
QVFWLADSL

SEQ ID NO: 1188466 - protein, 9 aa, Homo Sapiens
MTGPARCCR

SEQ ID NO: 1188467 - protein, 9 aa, Homo Sapiens
LWIIEVGRH

SEQ ID NO: 1188468 - protein, 9 aa, Homo Sapiens
KVGQLFAVW

SEQ ID NO: 1188469 - protein, 9 aa, Homo Sapiens
MWFKHENYG

SEQ ID NO: 1188470 - protein, 9 aa, Homo Sapiens
LQKSCSTHP

SEQ ID NO: 1188471 - protein, 9 aa, Homo Sapiens
PPTAPQRPP

SEQ ID NO: 1188472 - protein, 9 aa, Homo Sapiens
ATSVDKGKC

SEQ ID NO: 1188473 - protein, 9 aa, Homo Sapiens
AHAQKPQQM

SEQ ID NO: 1188474 - protein, 9 aa, Homo Sapiens
GGVSPPSLP

SEQ ID NO: 1188475 - protein, 9 aa, Homo Sapiens
SLVTVMAEK

SEQ ID NO: 1188476 - protein, 9 aa, Homo Sapiens
SRGAQGMIL

SEQ ID NO: 1188477 - protein, 9 aa, Homo Sapiens
MKKPCCGVP

SEQ ID NO: 1188478 - protein, 9 aa, Homo Sapiens
IPPAGSGQV

SEQ ID NO: 1188479 - protein, 9 aa, Homo Sapiens
AICGLHYDV

SEQ ID NO: 1188480 - protein, 9 aa, Homo Sapiens
CPGHLQEEC

SEQ ID NO: 1188481 - protein, 9 aa, Homo Sapiens
AWLCSQLCR

SEQ ID NO: 1188482 - protein, 9 aa, Homo Sapiens
RGRIYIIIL

SEQ ID NO: 1188483 - protein, 9 aa, Homo Sapiens
GRRRRWHTR

SEQ ID NO: 1188484 - protein, 9 aa, Homo Sapiens
AVVGEEHSL

SEQ ID NO: 1188485 - protein, 9 aa, Homo Sapiens
LTHCTFWTR

SEQ ID NO: 1188486 - protein, 9 aa, Homo Sapiens
PLPPRPRPH

SEQ ID NO: 1188487 - protein, 9 aa, Homo Sapiens
VSNMGNDDP

SEQ ID NO: 1188488 - protein, 9 aa, Homo Sapiens
RAILHVQHQ

SEQ ID NO: 1188489 - protein, 9 aa, Homo Sapiens
TCWLHVSMY

SEQ ID NO: 1188490 - protein, 9 aa, Homo Sapiens
LIKVSDDLI

SEQ ID NO: 1188491 - protein, 9 aa, Homo Sapiens
PGPAAGAAV

SEQ ID NO: 1188492 - protein, 9 aa, Homo Sapiens
RGLLEVRLW

SEQ ID NO: 1188493 - protein, 9 aa, Homo Sapiens
DSFEKTELS

SEQ ID NO: 1188494 - protein, 9 aa, Homo Sapiens
PRAPPGACP

SEQ ID NO: 1188495 - protein, 9 aa, Homo Sapiens
AGCSWTCSQ

SEQ ID NO: 1188496 - protein, 9 aa, Homo Sapiens
MLWHGLAQG

SEQ ID NO: 1188497 - protein, 9 aa, Homo Sapiens
QWMRGLLEV

SEQ ID NO: 1188498 - protein, 9 aa, Homo Sapiens
KQGGPTIGA

SEQ ID NO: 1188499 - protein, 9 aa, Homo Sapiens
ATWRCCANY

SEQ ID NO: 1188500 - protein, 9 aa, Homo Sapiens
DHHVRDLVQ

SEQ ID NO: 1188501 - protein, 9 aa, Homo Sapiens
GPTRPPTKE

SEQ ID NO: 1188502 - protein, 9 aa, Homo Sapiens
CLLTTVHPE

SEQ ID NO: 1188503 - protein, 9 aa, Homo Sapiens
EPVAMDVGD

SEQ ID NO: 1188504 - protein, 9 aa, Homo Sapiens
LWGCLLTTV

SEQ ID NO: 1188505 - protein, 9 aa, Homo Sapiens
RRRPSYRPW

SEQ ID NO: 1188506 - protein, 9 aa, Homo Sapiens
PLTLQCNPR

SEQ ID NO: 1188507 - protein, 9 aa, Homo Sapiens
RLRSVLYEK

SEQ ID NO: 1188508 - protein, 9 aa, Homo Sapiens
QRRWPLAGW

SEQ ID NO: 1188509 - protein, 9 aa, Homo Sapiens
LPRAVLSAI

SEQ ID NO: 1188510 - protein, 9 aa, Homo Sapiens
GGDVVEGVK

SEQ ID NO: 1188511 - protein, 9 aa, Homo Sapiens
TCHNSKDTV

SEQ ID NO: 1188512 - protein, 9 aa, Homo Sapiens
MPRCTWAMS

SEQ ID NO: 1188513 - protein, 9 aa, Homo Sapiens
LQRIRHGQT

SEQ ID NO: 1188514 - protein, 9 aa, Homo Sapiens
SRLCHWEGL

SEQ ID NO: 1188515 - protein, 9 aa, Homo Sapiens
RTHRPRHRQ

SEQ ID NO: 1188516 - protein, 9 aa, Homo Sapiens
PSRRPLGVS

SEQ ID NO: 1188517 - protein, 9 aa, Homo Sapiens
SCCRRTSSA

SEQ ID NO: 1188518 - protein, 9 aa, Homo Sapiens
GLPVHQGLL

SEQ ID NO: 1188519 - protein, 9 aa, Homo Sapiens
PNQNSMLSQ

SEQ ID NO: 1188520 - protein, 9 aa, Homo Sapiens
SQMASKLPD

SEQ ID NO: 1188521 - protein, 9 aa, Homo Sapiens
PFRAGSVPQ

SEQ ID NO: 1188522 - protein, 9 aa, Homo Sapiens
ESVVPDDRS

SEQ ID NO: 1188523 - protein, 9 aa, Homo Sapiens
RHVVVVGVG

SEQ ID NO: 1188524 - protein, 9 aa, Homo Sapiens
LPCPPGGAE

SEQ ID NO: 1188525 - protein, 9 aa, Homo Sapiens
ILYDHVRPV

SEQ ID NO: 1188526 - protein, 9 aa, Homo Sapiens
GASLAGHRG

SEQ ID NO: 1188527 - protein, 9 aa, Homo Sapiens
GFRSRRSGL

SEQ ID NO: 1188528 - protein, 9 aa, Homo Sapiens
GTECLVHRA

SEQ ID NO: 1188529 - protein, 9 aa, Homo Sapiens
ALLSPPEPQ

SEQ ID NO: 1188530 - protein, 9 aa, Homo Sapiens
HRAAPATVR

SEQ ID NO: 1188531 - protein, 9 aa, Homo Sapiens
CMYVCACIC

SEQ ID NO: 1188532 - protein, 9 aa, Homo Sapiens
TEINQNNNF

SEQ ID NO: 1188533 - protein, 9 aa, Homo Sapiens
PRASCSDGR

SEQ ID NO: 1188534 - protein, 9 aa, Homo Sapiens
EGERSYSME

SEQ ID NO: 1188535 - protein, 9 aa, Homo Sapiens
AAGPKASRE

SEQ ID NO: 1188536 - protein, 9 aa, Homo Sapiens
LCVLAPVAV

SEQ ID NO: 1188537 - protein, 9 aa, Homo Sapiens
NLMKEATFV

SEQ ID NO: 1188538 - protein, 9 aa, Homo Sapiens
PVDFFRPPE

SEQ ID NO: 1188539 - protein, 9 aa, Homo Sapiens
TLTTHKIVH

SEQ ID NO: 1188540 - protein, 9 aa, Homo Sapiens
LDTGLPCFH

SEQ ID NO: 1188541 - protein, 9 aa, Homo Sapiens
DAPAEPLPA

SEQ ID NO: 1188542 - protein, 9 aa, Homo Sapiens
TVQEQLQLL

SEQ ID NO: 1188543 - protein, 9 aa, Homo Sapiens
FSCLACWVV

SEQ ID NO: 1188544 - protein, 9 aa, Homo Sapiens
QGWRARAWR

SEQ ID NO: 1188545 - protein, 9 aa, Homo Sapiens
NEAKYNAFT

SEQ ID NO: 1188546 - protein, 9 aa, Homo Sapiens
DAHLSAAGL

SEQ ID NO: 1188547 - protein, 9 aa, Homo Sapiens
SSPVTINQT

SEQ ID NO: 1188548 - protein, 9 aa, Homo Sapiens
DVGKSALTI

SEQ ID NO: 1188549 - protein, 9 aa, Homo Sapiens
GQGHRQTPG

SEQ ID NO: 1188550 - protein, 9 aa, Homo Sapiens
RVVGLGCGF

SEQ ID NO: 1188551 - protein, 9 aa, Homo Sapiens
VGVAEGTKL

SEQ ID NO: 1188552 - protein, 9 aa, Homo Sapiens
VPYDISAIE

SEQ ID NO: 1188553 - protein, 9 aa, Homo Sapiens
KREHLEDVV

SEQ ID NO: 1188554 - protein, 9 aa, Homo Sapiens
ISVLLLKSR

SEQ ID NO: 1188555 - protein, 9 aa, Homo Sapiens
ILQLRNKNH

SEQ ID NO: 1188556 - protein, 9 aa, Homo Sapiens
QVVTACLLI

SEQ ID NO: 1188557 - protein, 9 aa, Homo Sapiens
QISALAMHK

SEQ ID NO: 1188558 - protein, 9 aa, Homo Sapiens
RRCSGLSVS

SEQ ID NO: 1188559 - protein, 9 aa, Homo Sapiens
LFQEGGGSE

SEQ ID NO: 1188560 - protein, 9 aa, Homo Sapiens
EHGGQKEGD

SEQ ID NO: 1188561 - protein, 9 aa, Homo Sapiens
REQEKELWE

SEQ ID NO: 1188562 - protein, 9 aa, Homo Sapiens
RDNGVTCPA

SEQ ID NO: 1188563 - protein, 9 aa, Homo Sapiens
GPWGPPQSC

SEQ ID NO: 1188564 - protein, 9 aa, Homo Sapiens
HAICQAMCS

SEQ ID NO: 1188565 - protein, 9 aa, Homo Sapiens
VDNMYRFED

SEQ ID NO: 1188566 - protein, 9 aa, Homo Sapiens
AAGAFADLH

SEQ ID NO: 1188567 - protein, 9 aa, Homo Sapiens
NILMIAQKK

SEQ ID NO: 1188568 - protein, 9 aa, Homo Sapiens
LKCSAAHGC

SEQ ID NO: 1188569 - protein, 9 aa, Homo Sapiens
RDNNLAMLE

SEQ ID NO: 1188570 - protein, 9 aa, Homo Sapiens
GLRKQYGGD

SEQ ID NO: 1188571 - protein, 9 aa, Homo Sapiens
RHLRFPPMD

SEQ ID NO: 1188572 - protein, 9 aa, Homo Sapiens
GPGPGAASA

SEQ ID NO: 1188573 - protein, 9 aa, Homo Sapiens
GLRPCLPSP

SEQ ID NO: 1188574 - protein, 9 aa, Homo Sapiens
SNISSPVNL

SEQ ID NO: 1188575 - protein, 9 aa, Homo Sapiens
APSRGRGGV

SEQ ID NO: 1188576 - protein, 9 aa, Homo Sapiens
RLQRVGARP

SEQ ID NO: 1188577 - protein, 9 aa, Homo Sapiens
VDFQLAPPG

SEQ ID NO: 1188578 - protein, 9 aa, Homo Sapiens
PTSCPPLLE

SEQ ID NO: 1188579 - protein, 9 aa, Homo Sapiens
QVFALGLQE

SEQ ID NO: 1188580 - protein, 9 aa, Homo Sapiens
PSVIYWPHP

SEQ ID NO: 1188581 - protein, 9 aa, Homo Sapiens
ASSIPPTRL

SEQ ID NO: 1188582 - protein, 9 aa, Homo Sapiens
NLLKMWQGE

SEQ ID NO: 1188583 - protein, 9 aa, Homo Sapiens
RALGLAGPA

SEQ ID NO: 1188584 - protein, 9 aa, Homo Sapiens
GMQAKYLDV

SEQ ID NO: 1188585 - protein, 9 aa, Homo Sapiens
NWNKLAQKF

SEQ ID NO: 1188586 - protein, 9 aa, Homo Sapiens
RAGSPQSRV

SEQ ID NO: 1188587 - protein, 9 aa, Homo Sapiens
LSRPATSPS

SEQ ID NO: 1188588 - protein, 9 aa, Homo Sapiens
NDTPFQPAT

SEQ ID NO: 1188589 - protein, 9 aa, Homo Sapiens
CPACPLRAS

SEQ ID NO: 1188590 - protein, 9 aa, Homo Sapiens
DKVIYLSGY

SEQ ID NO: 1188591 - protein, 9 aa, Homo Sapiens
WEIVMETLQ

SEQ ID NO: 1188592 - protein, 9 aa, Homo Sapiens
STAACLLGQ

SEQ ID NO: 1188593 - protein, 9 aa, Homo Sapiens
GPAARDCTL

SEQ ID NO: 1188594 - protein, 9 aa, Homo Sapiens
TASITLPTT

SEQ ID NO: 1188595 - protein, 9 aa, Homo Sapiens
LRCARTMVD

SEQ ID NO: 1188596 - protein, 9 aa, Homo Sapiens
GQWMEWKIE

SEQ ID NO: 1188597 - protein, 9 aa, Homo Sapiens
TCMVTAATF

SEQ ID NO: 1188598 - protein, 9 aa, Homo Sapiens
PIDKRGISI

SEQ ID NO: 1188599 - protein, 9 aa, Homo Sapiens
STDQEHELK

SEQ ID NO: 1188600 - protein, 9 aa, Homo Sapiens
SHRCRQPAC

SEQ ID NO: 1188601 - protein, 9 aa, Homo Sapiens
GQRGKAEEI

SEQ ID NO: 1188602 - protein, 9 aa, Homo Sapiens
LGTVLSANQ

SEQ ID NO: 1188603 - protein, 9 aa, Homo Sapiens
GIAPDVVLR

SEQ ID NO: 1188604 - protein, 9 aa, Homo Sapiens
ARLSTKHKE

SEQ ID NO: 1188605 - protein, 9 aa, Homo Sapiens
DPALSLEAH

SEQ ID NO: 1188606 - protein, 9 aa, Homo Sapiens
TRLCQQTEA

SEQ ID NO: 1188607 - protein, 9 aa, Homo Sapiens
SVPPVHHPQ

SEQ ID NO: 1188608 - protein, 9 aa, Homo Sapiens
HSAIWNGNH

SEQ ID NO: 1188609 - protein, 9 aa, Homo Sapiens
PLQQRPGAP

SEQ ID NO: 1188610 - protein, 9 aa, Homo Sapiens
LFIHCPMVK

SEQ ID NO: 1188611 - protein, 9 aa, Homo Sapiens
WGPGEGEEG

SEQ ID NO: 1188612 - protein, 9 aa, Homo Sapiens
VHTTLFLSH

SEQ ID NO: 1188613 - protein, 9 aa, Homo Sapiens
SDLLTYTKI

SEQ ID NO: 1188614 - protein, 9 aa, Homo Sapiens
GRRGAPGHP

SEQ ID NO: 1188615 - protein, 9 aa, Homo Sapiens
VLGICALRL

SEQ ID NO: 1188616 - protein, 9 aa, Homo Sapiens
SPTLPQGPT

SEQ ID NO: 1188617 - protein, 9 aa, Homo Sapiens
YKDNYGLTP

SEQ ID NO: 1188618 - protein, 9 aa, Homo Sapiens
DKSNSPLAM

SEQ ID NO: 1188619 - protein, 9 aa, Homo Sapiens
EDCGNAFSY

SEQ ID NO: 1188620 - protein, 9 aa, Homo Sapiens
QNKRAMRQY

SEQ ID NO: 1188621 - protein, 9 aa, Homo Sapiens
EKFFSTGPT

SEQ ID NO: 1188622 - protein, 9 aa, Homo Sapiens
LFPAAAPND

SEQ ID NO: 1188623 - protein, 9 aa, Homo Sapiens
FHPNYKKME

SEQ ID NO: 1188624 - protein, 9 aa, Homo Sapiens
LGWPGLKPR

SEQ ID NO: 1188625 - protein, 9 aa, Homo Sapiens
CGRGARPEV

SEQ ID NO: 1188626 - protein, 9 aa, Homo Sapiens
STGPTPCAT

SEQ ID NO: 1188627 - protein, 9 aa, Homo Sapiens
SSAPTWGCL

SEQ ID NO: 1188628 - protein, 9 aa, Homo Sapiens
GEISLLAAA

SEQ ID NO: 1188629 - protein, 9 aa, Homo Sapiens
PPGCRLQRV

SEQ ID NO: 1188630 - protein, 9 aa, Homo Sapiens
AQYQTNANQ

SEQ ID NO: 1188631 - protein, 9 aa, Homo Sapiens
RDGWGAMAL

SEQ ID NO: 1188632 - protein, 9 aa, Homo Sapiens
VEGVLIDVL

SEQ ID NO: 1188633 - protein, 9 aa, Homo Sapiens
LVLITEAQH

SEQ ID NO: 1188634 - protein, 9 aa, Homo Sapiens
VCAVPTWAS

SEQ ID NO: 1188635 - protein, 9 aa, Homo Sapiens
PPWLSPLQR

SEQ ID NO: 1188636 - protein, 9 aa, Homo Sapiens
LFWQFFVGV

SEQ ID NO: 1188637 - protein, 9 aa, Homo Sapiens
VAPSTAIIL

SEQ ID NO: 1188638 - protein, 9 aa, Homo Sapiens
KMAGGLHLH

SEQ ID NO: 1188639 - protein, 9 aa, Homo Sapiens
LPLRQILGR

SEQ ID NO: 1188640 - protein, 9 aa, Homo Sapiens
GLVDGGGSG

SEQ ID NO: 1188641 - protein, 9 aa, Homo Sapiens
HVQDLTPAM

SEQ ID NO: 1188642 - protein, 9 aa, Homo Sapiens
WILYQGQWS

SEQ ID NO: 1188643 - protein, 9 aa, Homo Sapiens
RDVEYGTIK

SEQ ID NO: 1188644 - protein, 9 aa, Homo Sapiens
FIHKDSANL

SEQ ID NO: 1188645 - protein, 9 aa, Homo Sapiens
RHRQLHVGY

SEQ ID NO: 1188646 - protein, 9 aa, Homo Sapiens
ADCMPCVFL

SEQ ID NO: 1188647 - protein, 9 aa, Homo Sapiens
LKCRNSRNS

SEQ ID NO: 1188648 - protein, 9 aa, Homo Sapiens
PATWRRPVP

SEQ ID NO: 1188649 - protein, 9 aa, Homo Sapiens
PHVADFWWR

SEQ ID NO: 1188650 - protein, 9 aa, Homo Sapiens
CMVSINVLL

SEQ ID NO: 1188651 - protein, 9 aa, Homo Sapiens
TTTTTTPHP

SEQ ID NO: 1188652 - protein, 9 aa, Homo Sapiens
SEHTHRYEA

SEQ ID NO: 1188653 - protein, 9 aa, Homo Sapiens
GLPPGAHGL

SEQ ID NO: 1188654 - protein, 9 aa, Homo Sapiens
GNHLSHPPK

SEQ ID NO: 1188655 - protein, 9 aa, Homo Sapiens
SGGALPYDT

SEQ ID NO: 1188656 - protein, 9 aa, Homo Sapiens
LHEVHWAVR

SEQ ID NO: 1188657 - protein, 9 aa, Homo Sapiens
GWCPVGRHR

SEQ ID NO: 1188658 - protein, 9 aa, Homo Sapiens
PELVEPGHR

SEQ ID NO: 1188659 - protein, 9 aa, Homo Sapiens
QRSSKTMQL

SEQ ID NO: 1188660 - protein, 9 aa, Homo Sapiens
CQSGFGGRA

SEQ ID NO: 1188661 - protein, 9 aa, Homo Sapiens
ALVSLHISQ

SEQ ID NO: 1188662 - protein, 9 aa, Homo Sapiens
AAAQGRLIV

SEQ ID NO: 1188663 - protein, 9 aa, Homo Sapiens
LIGNTAVIL

SEQ ID NO: 1188664 - protein, 9 aa, Homo Sapiens
RAGMSKPVR

SEQ ID NO: 1188665 - protein, 9 aa, Homo Sapiens
RTPAPTPSA

SEQ ID NO: 1188666 - protein, 9 aa, Homo Sapiens
DLLKTYVES

SEQ ID NO: 1188667 - protein, 9 aa, Homo Sapiens
LALIGFVEF

SEQ ID NO: 1188668 - protein, 9 aa, Homo Sapiens
HQRIHMAEK

SEQ ID NO: 1188669 - protein, 9 aa, Homo Sapiens
GVGCFESCS

SEQ ID NO: 1188670 - protein, 9 aa, Homo Sapiens
PTAAAPTAR

SEQ ID NO: 1188671 - protein, 9 aa, Homo Sapiens
ALPLHTQSL

SEQ ID NO: 1188672 - protein, 9 aa, Homo Sapiens
NQMAELQGM

SEQ ID NO: 1188673 - protein, 9 aa, Homo Sapiens
LIFNILLVF

SEQ ID NO: 1188674 - protein, 9 aa, Homo Sapiens
WMLLGAASS

SEQ ID NO: 1188675 - protein, 9 aa, Homo Sapiens
ASMKLFCSV

SEQ ID NO: 1188676 - protein, 9 aa, Homo Sapiens
WGKWPVGMT

SEQ ID NO: 1188677 - protein, 9 aa, Homo Sapiens
LQHVDSLRV

SEQ ID NO: 1188678 - protein, 9 aa, Homo Sapiens
PPQPTSGSI

SEQ ID NO: 1188679 - protein, 9 aa, Homo Sapiens
PLAMALCGS

SEQ ID NO: 1188680 - protein, 9 aa, Homo Sapiens
RKVRSFLEG

SEQ ID NO: 1188681 - protein, 9 aa, Homo Sapiens
GGGVGEPRH

SEQ ID NO: 1188682 - protein, 9 aa, Homo Sapiens
DPGRGRPRA

SEQ ID NO: 1188683 - protein, 9 aa, Homo Sapiens
VRRDKNFSS

SEQ ID NO: 1188684 - protein, 9 aa, Homo Sapiens
TVMAEKNFV

SEQ ID NO: 1188685 - protein, 9 aa, Homo Sapiens
VCHALVFLG

SEQ ID NO: 1188686 - protein, 9 aa, Homo Sapiens
SGRRVMDSP

SEQ ID NO: 1188687 - protein, 9 aa, Homo Sapiens
KPQAKAVAW

SEQ ID NO: 1188688 - protein, 9 aa, Homo Sapiens
QQNWMSSVR

SEQ ID NO: 1188689 - protein, 9 aa, Homo Sapiens
STWTEMQRM

SEQ ID NO: 1188690 - protein, 9 aa, Homo Sapiens
RGNKPRDKR

SEQ ID NO: 1188691 - protein, 9 aa, Homo Sapiens
TTTPHPPLP

SEQ ID NO: 1188692 - protein, 9 aa, Homo Sapiens
DPPQSLPSL

SEQ ID NO: 1188693 - protein, 9 aa, Homo Sapiens
ALKNGVHSP

SEQ ID NO: 1188694 - protein, 9 aa, Homo Sapiens
EPVSLAPPR

SEQ ID NO: 1188695 - protein, 9 aa, Homo Sapiens
WVHSPLHYS

SEQ ID NO: 1188696 - protein, 9 aa, Homo Sapiens
SLLFFNPIR

SEQ ID NO: 1188697 - protein, 9 aa, Homo Sapiens
RRRRTFHGD

SEQ ID NO: 1188698 - protein, 9 aa, Homo Sapiens
ESSLARGSQ

SEQ ID NO: 1188699 - protein, 9 aa, Homo Sapiens
NVIHHFFCR

SEQ ID NO: 1188700 - protein, 9 aa, Homo Sapiens
DFHPRSSSG

SEQ ID NO: 1188701 - protein, 9 aa, Homo Sapiens
HIWVGIFRV

SEQ ID NO: 1188702 - protein, 9 aa, Homo Sapiens
EKVGVAEGT

SEQ ID NO: 1188703 - protein, 9 aa, Homo Sapiens
VLVCPVHLV

SEQ ID NO: 1188704 - protein, 9 aa, Homo Sapiens
CVTRPSEVE

SEQ ID NO: 1188705 - protein, 9 aa, Homo Sapiens
PAGHVCPWL

SEQ ID NO: 1188706 - protein, 9 aa, Homo Sapiens
EYLSSNPSS

SEQ ID NO: 1188707 - protein, 9 aa, Homo Sapiens
GPPTWPTQT

SEQ ID NO: 1188708 - protein, 9 aa, Homo Sapiens
YSRGAQGMI

SEQ ID NO: 1188709 - protein, 9 aa, Homo Sapiens
IPSLIFLDV

SEQ ID NO: 1188710 - protein, 9 aa, Homo Sapiens
RSLWPPQRP

SEQ ID NO: 1188711 - protein, 9 aa, Homo Sapiens
FTVRTCVCW

SEQ ID NO: 1188712 - protein, 9 aa, Homo Sapiens
LPAAQRRWP

SEQ ID NO: 1188713 - protein, 9 aa, Homo Sapiens
WAAVLVPSG

SEQ ID NO: 1188714 - protein, 9 aa, Homo Sapiens
CWGGRRRQA

SEQ ID NO: 1188715 - protein, 9 aa, Homo Sapiens
LCTTVIIFW

SEQ ID NO: 1188716 - protein, 9 aa, Homo Sapiens
RWAEAEGLA

SEQ ID NO: 1188717 - protein, 9 aa, Homo Sapiens
RTCHLMPGP

SEQ ID NO: 1188718 - protein, 9 aa, Homo Sapiens
MKKTTSQSQ

SEQ ID NO: 1188719 - protein, 9 aa, Homo Sapiens
QSPQLLRGP

SEQ ID NO: 1188720 - protein, 9 aa, Homo Sapiens
VWVMWMWGE

SEQ ID NO: 1188721 - protein, 9 aa, Homo Sapiens
AFFPDLMNM

SEQ ID NO: 1188722 - protein, 9 aa, Homo Sapiens
HRAQDKKRN

SEQ ID NO: 1188723 - protein, 9 aa, Homo Sapiens
GQHCSSSRQ

SEQ ID NO: 1188724 - protein, 9 aa, Homo Sapiens
CLRTCHLMP

SEQ ID NO: 1188725 - protein, 9 aa, Homo Sapiens
APKSSQNVT

SEQ ID NO: 1188726 - protein, 9 aa, Homo Sapiens
LVCVPVHGH

SEQ ID NO: 1188727 - protein, 9 aa, Homo Sapiens
YISGMNFVQ

SEQ ID NO: 1188728 - protein, 9 aa, Homo Sapiens
EVVVQGELV

SEQ ID NO: 1188729 - protein, 9 aa, Homo Sapiens
GQVPQDWRQ

SEQ ID NO: 1188730 - protein, 9 aa, Homo Sapiens
IARDVAGVT

SEQ ID NO: 1188731 - protein, 9 aa, Homo Sapiens
DGGGSGGGT

SEQ ID NO: 1188732 - protein, 9 aa, Homo Sapiens
APPSRPSGR

SEQ ID NO: 1188733 - protein, 9 aa, Homo Sapiens
PPRTKWPLQ

SEQ ID NO: 1188734 - protein, 9 aa, Homo Sapiens
PSRATWAPC

SEQ ID NO: 1188735 - protein, 9 aa, Homo Sapiens
GAVFLLSHE

SEQ ID NO: 1188736 - protein, 9 aa, Homo Sapiens
AVLVPSGEE

SEQ ID NO: 1188737 - protein, 9 aa, Homo Sapiens
LHTNTATVT

SEQ ID NO: 1188738 - protein, 9 aa, Homo Sapiens
YLDQTNTPL

SEQ ID NO: 1188739 - protein, 9 aa, Homo Sapiens
WLSPLQRSG

SEQ ID NO: 1188740 - protein, 9 aa, Homo Sapiens
VDGRCGVWR

SEQ ID NO: 1188741 - protein, 9 aa, Homo Sapiens
NRGFTYARY

SEQ ID NO: 1188742 - protein, 9 aa, Homo Sapiens
MKEREKQQV

SEQ ID NO: 1188743 - protein, 9 aa, Homo Sapiens
WKMAAVFLT

SEQ ID NO: 1188744 - protein, 9 aa, Homo Sapiens
KMGINAEHS

SEQ ID NO: 1188745 - protein, 9 aa, Homo Sapiens
MRRVWMVLG

SEQ ID NO: 1188746 - protein, 9 aa, Homo Sapiens
CPASGGGKG

SEQ ID NO: 1188747 - protein, 9 aa, Homo Sapiens
RSVSRDGGW

SEQ ID NO: 1188748 - protein, 9 aa, Homo Sapiens
EAPIDKRGI

SEQ ID NO: 1188749 - protein, 9 aa, Homo Sapiens
AHARFSGWC

SEQ ID NO: 1188750 - protein, 9 aa, Homo Sapiens
GNGPERQLC

SEQ ID NO: 1188751 - protein, 9 aa, Homo Sapiens
TVFSTMGYG

SEQ ID NO: 1188752 - protein, 9 aa, Homo Sapiens
AAVSNKFQD

SEQ ID NO: 1188753 - protein, 9 aa, Homo Sapiens
ATQMTYFNR

SEQ ID NO: 1188754 - protein, 9 aa, Homo Sapiens
FWVRPAGMT

SEQ ID NO: 1188755 - protein, 9 aa, Homo Sapiens
PSFSWTIRH

SEQ ID NO: 1188756 - protein, 9 aa, Homo Sapiens
REGERSYSM

SEQ ID NO: 1188757 - protein, 9 aa, Homo Sapiens
QTGQAPAGV

SEQ ID NO: 1188758 - protein, 9 aa, Homo Sapiens
AGEPPSGVK

SEQ ID NO: 1188759 - protein, 9 aa, Homo Sapiens
AHPGVISER

SEQ ID NO: 1188760 - protein, 9 aa, Homo Sapiens
SHLGQPRQL

SEQ ID NO: 1188761 - protein, 9 aa, Homo Sapiens
RLGLDRAPH

SEQ ID NO: 1188762 - protein, 9 aa, Homo Sapiens
RASSTSPRA

SEQ ID NO: 1188763 - protein, 9 aa, Homo Sapiens
PGRGGESGS

SEQ ID NO: 1188764 - protein, 9 aa, Homo Sapiens
VLCHQALQL

SEQ ID NO: 1188765 - protein, 9 aa, Homo Sapiens
CVHSCVYVC

SEQ ID NO: 1188766 - protein, 9 aa, Homo Sapiens
TVRPGTQAA

SEQ ID NO: 1188767 - protein, 9 aa, Homo Sapiens
QQYRVTMTA

SEQ ID NO: 1188768 - protein, 9 aa, Homo Sapiens
RAIQELGLD

SEQ ID NO: 1188769 - protein, 9 aa, Homo Sapiens
AAAAAVLGV

SEQ ID NO: 1188770 - protein, 9 aa, Homo Sapiens
RALAAIERQ

SEQ ID NO: 1188771 - protein, 9 aa, Homo Sapiens
EEGKEQEEE

SEQ ID NO: 1188772 - protein, 9 aa, Homo Sapiens
LIHTNMYVN

SEQ ID NO: 1188773 - protein, 9 aa, Homo Sapiens
PPGKRSTAR

SEQ ID NO: 1188774 - protein, 9 aa, Homo Sapiens
KDSANLLPL

SEQ ID NO: 1188775 - protein, 9 aa, Homo Sapiens
PRAVAALSS

SEQ ID NO: 1188776 - protein, 9 aa, Homo Sapiens
IDALHKLFD

SEQ ID NO: 1188777 - protein, 9 aa, Homo Sapiens
GFTFRKEDM

SEQ ID NO: 1188778 - protein, 9 aa, Homo Sapiens
SRRPLGVSP

SEQ ID NO: 1188779 - protein, 9 aa, Homo Sapiens
AAGGAAAAR

SEQ ID NO: 1188780 - protein, 9 aa, Homo Sapiens
FPFRWRVSS

SEQ ID NO: 1188781 - protein, 9 aa, Homo Sapiens
VLKKLLCPK

SEQ ID NO: 1188782 - protein, 9 aa, Homo Sapiens
ACNGLRGFF

SEQ ID NO: 1188783 - protein, 9 aa, Homo Sapiens
GHVAPSTAI

SEQ ID NO: 1188784 - protein, 9 aa, Homo Sapiens
NGQTWTGGT

SEQ ID NO: 1188785 - protein, 9 aa, Homo Sapiens
FLTVCSEAK

SEQ ID NO: 1188786 - protein, 9 aa, Homo Sapiens
EALESALKE

SEQ ID NO: 1188787 - protein, 9 aa, Homo Sapiens
ASSTTLDRS

SEQ ID NO: 1188788 - protein, 9 aa, Homo Sapiens
VGHCSVPEG

SEQ ID NO: 1188789 - protein, 9 aa, Homo Sapiens
KVSKKRLPK

SEQ ID NO: 1188790 - protein, 9 aa, Homo Sapiens
HLYMYSKNG

SEQ ID NO: 1188791 - protein, 9 aa, Homo Sapiens
QRIKEERKS

SEQ ID NO: 1188792 - protein, 9 aa, Homo Sapiens
TENIREIEQ

SEQ ID NO: 1188793 - protein, 9 aa, Homo Sapiens
AKEEQQQLL

SEQ ID NO: 1188794 - protein, 9 aa, Homo Sapiens
SFMATMMMV

SEQ ID NO: 1188795 - protein, 9 aa, Homo Sapiens
GPRGHLLVQ

SEQ ID NO: 1188796 - protein, 9 aa, Homo Sapiens
PPAWILYQG

SEQ ID NO: 1188797 - protein, 9 aa, Homo Sapiens
FAEHQRTHT

SEQ ID NO: 1188798 - protein, 9 aa, Homo Sapiens
PSGRPRPDP

SEQ ID NO: 1188799 - protein, 9 aa, Homo Sapiens
SALGPWGWL

SEQ ID NO: 1188800 - protein, 9 aa, Homo Sapiens
ERTGNMREL

SEQ ID NO: 1188801 - protein, 9 aa, Homo Sapiens
IIALSYVGI

SEQ ID NO: 1188802 - protein, 9 aa, Homo Sapiens
PATLPESTH

SEQ ID NO: 1188803 - protein, 9 aa, Homo Sapiens
EVRLFSHSQ

SEQ ID NO: 1188804 - protein, 9 aa, Homo Sapiens
TRWRWNEDG

SEQ ID NO: 1188805 - protein, 9 aa, Homo Sapiens
SWVHSPLHY

SEQ ID NO: 1188806 - protein, 9 aa, Homo Sapiens
ESLGGPRRR

SEQ ID NO: 1188807 - protein, 9 aa, Homo Sapiens
ELQGGSKWI

SEQ ID NO: 1188808 - protein, 9 aa, Homo Sapiens
AADMCTNAH

SEQ ID NO: 1188809 - protein, 9 aa, Homo Sapiens
RRVEDILTL

SEQ ID NO: 1188810 - protein, 9 aa, Homo Sapiens
QAEPPVPLL

SEQ ID NO: 1188811 - protein, 9 aa, Homo Sapiens
FSPLWLMTA

SEQ ID NO: 1188812 - protein, 9 aa, Homo Sapiens
FLGEEQQLR

SEQ ID NO: 1188813 - protein, 9 aa, Homo Sapiens
KSISLTKAS

SEQ ID NO: 1188814 - protein, 9 aa, Homo Sapiens
HLKCAGKRL

SEQ ID NO: 1188815 - protein, 9 aa, Homo Sapiens
QRVQSQRSV

SEQ ID NO: 1188816 - protein, 9 aa, Homo Sapiens
LSVSVGCVA

SEQ ID NO: 1188817 - protein, 9 aa, Homo Sapiens
ERGRRTQKK

SEQ ID NO: 1188818 - protein, 9 aa, Homo Sapiens
PVRGHAHAG

SEQ ID NO: 1188819 - protein, 9 aa, Homo Sapiens
IVIVQYPLS

SEQ ID NO: 1188820 - protein, 9 aa, Homo Sapiens
ERNGSSGGG

SEQ ID NO: 1188821 - protein, 9 aa, Homo Sapiens
LEAWGQPQM

SEQ ID NO: 1188822 - protein, 9 aa, Homo Sapiens
VAMELIMRH

SEQ ID NO: 1188823 - protein, 9 aa, Homo Sapiens
AAPGQPGRH

SEQ ID NO: 1188824 - protein, 9 aa, Homo Sapiens
HERRAAGAH

SEQ ID NO: 1188825 - protein, 9 aa, Homo Sapiens
MKDRISLRM

SEQ ID NO: 1188826 - protein, 9 aa, Homo Sapiens
SEIHFVKPD

SEQ ID NO: 1188827 - protein, 9 aa, Homo Sapiens
VLITEAQHR

SEQ ID NO: 1188828 - protein, 9 aa, Homo Sapiens
ISQAPCPLV

SEQ ID NO: 1188829 - protein, 9 aa, Homo Sapiens
RRCQPHQAG

SEQ ID NO: 1188830 - protein, 9 aa, Homo Sapiens
CPPAWILYQ

SEQ ID NO: 1188831 - protein, 9 aa, Homo Sapiens
KVVVILQLR

SEQ ID NO: 1188832 - protein, 9 aa, Homo Sapiens
YPSPITAAV

SEQ ID NO: 1188833 - protein, 9 aa, Homo Sapiens
WPRPSAPPW

SEQ ID NO: 1188834 - protein, 9 aa, Homo Sapiens
NLLSTNLIK

SEQ ID NO: 1188835 - protein, 9 aa, Homo Sapiens
QQQLSFLPL

SEQ ID NO: 1188836 - protein, 9 aa, Homo Sapiens
CATCRTRWP

SEQ ID NO: 1188837 - protein, 9 aa, Homo Sapiens
PRRCQIRAW

SEQ ID NO: 1188838 - protein, 9 aa, Homo Sapiens
SCQACGEEP

SEQ ID NO: 1188839 - protein, 9 aa, Homo Sapiens
LQYPSLIPI

SEQ ID NO: 1188840 - protein, 9 aa, Homo Sapiens
ALGLGRVLR

SEQ ID NO: 1188841 - protein, 9 aa, Homo Sapiens
LWYTMDRPP

SEQ ID NO: 1188842 - protein, 9 aa, Homo Sapiens
SCMTPASVP

SEQ ID NO: 1188843 - protein, 9 aa, Homo Sapiens
QLFEDIWGQ

SEQ ID NO: 1188844 - protein, 9 aa, Homo Sapiens
CYIGCTVFI

SEQ ID NO: 1188845 - protein, 9 aa, Homo Sapiens
RGTGGALSS

SEQ ID NO: 1188846 - protein, 9 aa, Homo Sapiens
GRRRSRQSG

SEQ ID NO: 1188847 - protein, 9 aa, Homo Sapiens
TRGLVDGGG

SEQ ID NO: 1188848 - protein, 9 aa, Homo Sapiens
SSTTLDRSE

SEQ ID NO: 1188849 - protein, 9 aa, Homo Sapiens
LDAKNTDCI

SEQ ID NO: 1188850 - protein, 9 aa, Homo Sapiens
ASGARETRG

SEQ ID NO: 1188851 - protein, 9 aa, Homo Sapiens
PDTGFTNQG

SEQ ID NO: 1188852 - protein, 9 aa, Homo Sapiens
GGEMGPGPG

SEQ ID NO: 1188853 - protein, 9 aa, Homo Sapiens
PGQAPMDSP

SEQ ID NO: 1188854 - protein, 9 aa, Homo Sapiens
MLGGMGFLT

SEQ ID NO: 1188855 - protein, 9 aa, Homo Sapiens
VAHHLPRPI

SEQ ID NO: 1188856 - protein, 9 aa, Homo Sapiens
VCPWLQWPV

SEQ ID NO: 1188857 - protein, 9 aa, Homo Sapiens
SPPTLMMSN

SEQ ID NO: 1188858 - protein, 9 aa, Homo Sapiens
CLACWVVHT

SEQ ID NO: 1188859 - protein, 9 aa, Homo Sapiens
NENCHKTYD

SEQ ID NO: 1188860 - protein, 9 aa, Homo Sapiens
TNCPRYASC

SEQ ID NO: 1188861 - protein, 9 aa, Homo Sapiens
VVYQLHNFS

SEQ ID NO: 1188862 - protein, 9 aa, Homo Sapiens
LRALRGGCG

SEQ ID NO: 1188863 - protein, 9 aa, Homo Sapiens
NSHCQERPS

SEQ ID NO: 1188864 - protein, 9 aa, Homo Sapiens
LFAFSLSMM

SEQ ID NO: 1188865 - protein, 9 aa, Homo Sapiens
YSPGPASTG

SEQ ID NO: 1188866 - protein, 9 aa, Homo Sapiens
TPPPPPRVP

SEQ ID NO: 1188867 - protein, 9 aa, Homo Sapiens
TPAQALHHP

SEQ ID NO: 1188868 - protein, 9 aa, Homo Sapiens
TRDVQGQAV

SEQ ID NO: 1188869 - protein, 9 aa, Homo Sapiens
FSMPFLDDD

SEQ ID NO: 1188870 - protein, 9 aa, Homo Sapiens
AEIHHSWTS

SEQ ID NO: 1188871 - protein, 9 aa, Homo Sapiens
VGCVASINL

SEQ ID NO: 1188872 - protein, 9 aa, Homo Sapiens
SRSAYLANH

SEQ ID NO: 1188873 - protein, 9 aa, Homo Sapiens
PQGPWLHID

SEQ ID NO: 1188874 - protein, 9 aa, Homo Sapiens
VGQWVGMVL

SEQ ID NO: 1188875 - protein, 9 aa, Homo Sapiens
DLIKHHRVH

SEQ ID NO: 1188876 - protein, 9 aa, Homo Sapiens
ARWRTRCWA

SEQ ID NO: 1188877 - protein, 9 aa, Homo Sapiens
IVGVPTGGA

SEQ ID NO: 1188878 - protein, 9 aa, Homo Sapiens
PPQGPWLHI

SEQ ID NO: 1188879 - protein, 9 aa, Homo Sapiens
LLAFPQGCY

SEQ ID NO: 1188880 - protein, 9 aa, Homo Sapiens
CPPPTAAPM

SEQ ID NO: 1188881 - protein, 9 aa, Homo Sapiens
TLPGPPAQL

SEQ ID NO: 1188882 - protein, 9 aa, Homo Sapiens
EGVGCFESC

SEQ ID NO: 1188883 - protein, 9 aa, Homo Sapiens
PRHRQLHVG

SEQ ID NO: 1188884 - protein, 9 aa, Homo Sapiens
CFPFRWRVS

SEQ ID NO: 1188885 - protein, 9 aa, Homo Sapiens
IHSPLATYA

SEQ ID NO: 1188886 - protein, 9 aa, Homo Sapiens
GDTSHLSVA

SEQ ID NO: 1188887 - protein, 9 aa, Homo Sapiens
VARGQGHRQ

SEQ ID NO: 1188888 - protein, 9 aa, Homo Sapiens
VATLSPGEA

SEQ ID NO: 1188889 - protein, 9 aa, Homo Sapiens
YERDNNLAM

SEQ ID NO: 1188890 - protein, 9 aa, Homo Sapiens
DEGGRDRAQ

SEQ ID NO: 1188891 - protein, 9 aa, Homo Sapiens
LPRLVAGAV

SEQ ID NO: 1188892 - protein, 9 aa, Homo Sapiens
VKYTKEVIM

SEQ ID NO: 1188893 - protein, 9 aa, Homo Sapiens
VPGPIACLM

SEQ ID NO: 1188894 - protein, 9 aa, Homo Sapiens
QEIVFLACS

SEQ ID NO: 1188895 - protein, 9 aa, Homo Sapiens
PGALTPLQQ

SEQ ID NO: 1188896 - protein, 9 aa, Homo Sapiens
FLIPLGDLS

SEQ ID NO: 1188897 - protein, 9 aa, Homo Sapiens
SSLKPGALT

SEQ ID NO: 1188898 - protein, 9 aa, Homo Sapiens
RCQPHQAGS

SEQ ID NO: 1188899 - protein, 9 aa, Homo Sapiens
TSETATWRC

SEQ ID NO: 1188900 - protein, 9 aa, Homo Sapiens
EQEKELWEQ

SEQ ID NO: 1188901 - protein, 9 aa, Homo Sapiens
YLVCPRAGP

SEQ ID NO: 1188902 - protein, 9 aa, Homo Sapiens
TPQPTATPP

SEQ ID NO: 1188903 - protein, 9 aa, Homo Sapiens
GFLFESLPR

SEQ ID NO: 1188904 - protein, 9 aa, Homo Sapiens
AGPRTGAPA

SEQ ID NO: 1188905 - protein, 9 aa, Homo Sapiens
LLFCYIGCT

SEQ ID NO: 1188906 - protein, 9 aa, Homo Sapiens
LPGQHLWLS

SEQ ID NO: 1188907 - protein, 9 aa, Homo Sapiens
LTLLLDFKE

SEQ ID NO: 1188908 - protein, 9 aa, Homo Sapiens
WLLSQKETL

SEQ ID NO: 1188909 - protein, 9 aa, Homo Sapiens
EGEEKDSGG

SEQ ID NO: 1188910 - protein, 9 aa, Homo Sapiens
LHTQSLVGA

SEQ ID NO: 1188911 - protein, 9 aa, Homo Sapiens
ERYMQETRS

SEQ ID NO: 1188912 - protein, 9 aa, Homo Sapiens
VASINLSTI

SEQ ID NO: 1188913 - protein, 9 aa, Homo Sapiens
VRVAETIFI

SEQ ID NO: 1188914 - protein, 9 aa, Homo Sapiens
SQVDKVIEP

SEQ ID NO: 1188915 - protein, 9 aa, Homo Sapiens
CRNSRNSLI

SEQ ID NO: 1188916 - protein, 9 aa, Homo Sapiens
RTRWPAPAA

SEQ ID NO: 1188917 - protein, 9 aa, Homo Sapiens
VKMLHINNN

SEQ ID NO: 1188918 - protein, 9 aa, Homo Sapiens
REGPRMKWK

SEQ ID NO: 1188919 - protein, 9 aa, Homo Sapiens
IAKEKTSAC

SEQ ID NO: 1188920 - protein, 9 aa, Homo Sapiens
ACCSTKQLV

SEQ ID NO: 1188921 - protein, 9 aa, Homo Sapiens
DSTSQSPQL

SEQ ID NO: 1188922 - protein, 9 aa, Homo Sapiens
IAWLTQYYT

SEQ ID NO: 1188923 - protein, 9 aa, Homo Sapiens
NYGLTPLYH

SEQ ID NO: 1188924 - protein, 9 aa, Homo Sapiens
GIVTVILRI

SEQ ID NO: 1188925 - protein, 9 aa, Homo Sapiens
WGPKDHQDI

SEQ ID NO: 1188926 - protein, 9 aa, Homo Sapiens
LADALHTLQ

SEQ ID NO: 1188927 - protein, 9 aa, Homo Sapiens
TWPRSVGGL

SEQ ID NO: 1188928 - protein, 9 aa, Homo Sapiens
IKIEEEEVE

SEQ ID NO: 1188929 - protein, 9 aa, Homo Sapiens
HLVGHIGRN

SEQ ID NO: 1188930 - protein, 9 aa, Homo Sapiens
SAEVKREHL

SEQ ID NO: 1188931 - protein, 9 aa, Homo Sapiens
RCSVNVTPQ

SEQ ID NO: 1188932 - protein, 9 aa, Homo Sapiens
RHPLPPRPR

SEQ ID NO: 1188933 - protein, 9 aa, Homo Sapiens
KRKRKGKGE

SEQ ID NO: 1188934 - protein, 9 aa, Homo Sapiens
APPRGPGPG

SEQ ID NO: 1188935 - protein, 9 aa, Homo Sapiens
NRIATQKSR

SEQ ID NO: 1188936 - protein, 9 aa, Homo Sapiens
LLHLQSQLA

SEQ ID NO: 1188937 - protein, 9 aa, Homo Sapiens
STTRPSWPP

SEQ ID NO: 1188938 - protein, 9 aa, Homo Sapiens
NNMCGVVLR

SEQ ID NO: 1188939 - protein, 9 aa, Homo Sapiens
GIAPGDTSR

SEQ ID NO: 1188940 - protein, 9 aa, Homo Sapiens
NGESRHAYS

SEQ ID NO: 1188941 - protein, 9 aa, Homo Sapiens
SLDHSHEMA

SEQ ID NO: 1188942 - protein, 9 aa, Homo Sapiens
GGGTTTGQA

SEQ ID NO: 1188943 - protein, 9 aa, Homo Sapiens
GQCPRLEGR

SEQ ID NO: 1188944 - protein, 9 aa, Homo Sapiens
CMTGIPRLP

SEQ ID NO: 1188945 - protein, 9 aa, Homo Sapiens
GGQRARGCP

SEQ ID NO: 1188946 - protein, 9 aa, Homo Sapiens
GPTLEETWA

SEQ ID NO: 1188947 - protein, 9 aa, Homo Sapiens
PQARTKMAG

SEQ ID NO: 1188948 - protein, 9 aa, Homo Sapiens
QDVWMLLGA

SEQ ID NO: 1188949 - protein, 9 aa, Homo Sapiens
DVIASDSEA

SEQ ID NO: 1188950 - protein, 9 aa, Homo Sapiens
EAMSSYLFI

SEQ ID NO: 1188951 - protein, 9 aa, Homo Sapiens
SRRCTKRMF

SEQ ID NO: 1188952 - protein, 9 aa, Homo Sapiens
PDTDYKSVP

SEQ ID NO: 1188953 - protein, 9 aa, Homo Sapiens
AVTLQGVRA

SEQ ID NO: 1188954 - protein, 9 aa, Homo Sapiens
AERVEALES

SEQ ID NO: 1188955 - protein, 9 aa, Homo Sapiens
IVILHSIVK

SEQ ID NO: 1188956 - protein, 9 aa, Homo Sapiens
RSCSGLVRD

SEQ ID NO: 1188957 - protein, 9 aa, Homo Sapiens
WSPKPQAKA

SEQ ID NO: 1188958 - protein, 9 aa, Homo Sapiens
PKSTSMLSA

SEQ ID NO: 1188959 - protein, 9 aa, Homo Sapiens
IMKELLTCS

SEQ ID NO: 1188960 - protein, 9 aa, Homo Sapiens
YFRSMEGLL

SEQ ID NO: 1188961 - protein, 9 aa, Homo Sapiens
PGAAHSQPL

SEQ ID NO: 1188962 - protein, 9 aa, Homo Sapiens
VSMEHHTDW

SEQ ID NO: 1188963 - protein, 9 aa, Homo Sapiens
LGRQKKAPP

SEQ ID NO: 1188964 - protein, 9 aa, Homo Sapiens
LLICISYVF

SEQ ID NO: 1188965 - protein, 9 aa, Homo Sapiens
FSSSIQVFS

SEQ ID NO: 1188966 - protein, 9 aa, Homo Sapiens
KLEGGQACI

SEQ ID NO: 1188967 - protein, 9 aa, Homo Sapiens
KMNGQPAFI

SEQ ID NO: 1188968 - protein, 9 aa, Homo Sapiens
PSLTSTPSL

SEQ ID NO: 1188969 - protein, 9 aa, Homo Sapiens
RRGAGAQDG

SEQ ID NO: 1188970 - protein, 9 aa, Homo Sapiens
QQAQTAIPR

SEQ ID NO: 1188971 - protein, 9 aa, Homo Sapiens
QRGRPRELR

SEQ ID NO: 1188972 - protein, 9 aa, Homo Sapiens
LIIAICTVS

SEQ ID NO: 1188973 - protein, 9 aa, Homo Sapiens
AHLPEHIFD

SEQ ID NO: 1188974 - protein, 9 aa, Homo Sapiens
EPRNLSFLT

SEQ ID NO: 1188975 - protein, 9 aa, Homo Sapiens
LGEAVGLIN

SEQ ID NO: 1188976 - protein, 9 aa, Homo Sapiens
TTGTLVWER

SEQ ID NO: 1188977 - protein, 9 aa, Homo Sapiens
PVDCADHWI

SEQ ID NO: 1188978 - protein, 9 aa, Homo Sapiens
TVPSHPYEI

SEQ ID NO: 1188979 - protein, 9 aa, Homo Sapiens
FDEFVRESD

SEQ ID NO: 1188980 - protein, 9 aa, Homo Sapiens
PSVGVARRR

SEQ ID NO: 1188981 - protein, 9 aa, Homo Sapiens
RQISLPLRG

SEQ ID NO: 1188982 - protein, 9 aa, Homo Sapiens
SGQVAAPGL

SEQ ID NO: 1188983 - protein, 9 aa, Homo Sapiens
LAPALCRAG

SEQ ID NO: 1188984 - protein, 9 aa, Homo Sapiens
LNQGCLAPA

SEQ ID NO: 1188985 - protein, 9 aa, Homo Sapiens
CAPGAGHVA

SEQ ID NO: 1188986 - protein, 9 aa, Homo Sapiens
RAAARAAGG

SEQ ID NO: 1188987 - protein, 9 aa, Homo Sapiens
LAQDWVQEN

SEQ ID NO: 1188988 - protein, 9 aa, Homo Sapiens
KYTKEVIMD

SEQ ID NO: 1188989 - protein, 9 aa, Homo Sapiens
EFRRLTADM

SEQ ID NO: 1188990 - protein, 9 aa, Homo Sapiens
QDPNVLDSF

SEQ ID NO: 1188991 - protein, 9 aa, Homo Sapiens
SCWPDAHLS

SEQ ID NO: 1188992 - protein, 9 aa, Homo Sapiens
QAQTAIPRS

SEQ ID NO: 1188993 - protein, 9 aa, Homo Sapiens
NKVCAVPTW

SEQ ID NO: 1188994 - protein, 9 aa, Homo Sapiens
PRDRRPRTS

SEQ ID NO: 1188995 - protein, 9 aa, Homo Sapiens
LFPRRRNFL

SEQ ID NO: 1188996 - protein, 9 aa, Homo Sapiens
TLTSSVTSP

SEQ ID NO: 1188997 - protein, 9 aa, Homo Sapiens
RRRRQRRRR

SEQ ID NO: 1188998 - protein, 9 aa, Homo Sapiens
QKASMTKKS

SEQ ID NO: 1188999 - protein, 9 aa, Homo Sapiens
HRWLQQTTG

SEQ ID NO: 1189000 - protein, 9 aa, Homo Sapiens
QQVPRPRPS

SEQ ID NO: 1189001 - protein, 9 aa, Homo Sapiens
CIRQDETFN

SEQ ID NO: 1189002 - protein, 9 aa, Homo Sapiens
TVGNVYTPG

SEQ ID NO: 1189003 - protein, 9 aa, Homo Sapiens
LCRKARLGS

SEQ ID NO: 1189004 - protein, 9 aa, Homo Sapiens
VPYPRIHSP

SEQ ID NO: 1189005 - protein, 9 aa, Homo Sapiens
VSEEASAEE

SEQ ID NO: 1189006 - protein, 9 aa, Homo Sapiens
ADPRQRRCC

SEQ ID NO: 1189007 - protein, 9 aa, Homo Sapiens
LKRKQKPLE

SEQ ID NO: 1189008 - protein, 9 aa, Homo Sapiens
AVTPHSLTS

SEQ ID NO: 1189009 - protein, 9 aa, Homo Sapiens
REKVKQQNT

SEQ ID NO: 1189010 - protein, 9 aa, Homo Sapiens
TVIPSNVSS

SEQ ID NO: 1189011 - protein, 9 aa, Homo Sapiens
QRRPIRVLS

SEQ ID NO: 1189012 - protein, 9 aa, Homo Sapiens
ATVTTYNTL

SEQ ID NO: 1189013 - protein, 9 aa, Homo Sapiens
LQKHHSAEH

SEQ ID NO: 1189014 - protein, 9 aa, Homo Sapiens
GGALKLRGS

SEQ ID NO: 1189015 - protein, 9 aa, Homo Sapiens
RKQYSIALH

SEQ ID NO: 1189016 - protein, 9 aa, Homo Sapiens
TNTPLSLTF

SEQ ID NO: 1189017 - protein, 9 aa, Homo Sapiens
PCRSSRTWA

SEQ ID NO: 1189018 - protein, 9 aa, Homo Sapiens
HILCMAISS

SEQ ID NO: 1189019 - protein, 9 aa, Homo Sapiens
NYDTLDIAS

SEQ ID NO: 1189020 - protein, 9 aa, Homo Sapiens
AAVGATSTT

SEQ ID NO: 1189021 - protein, 9 aa, Homo Sapiens
GFRYLVCPR

SEQ ID NO: 1189022 - protein, 9 aa, Homo Sapiens
IPAFMVEGG

SEQ ID NO: 1189023 - protein, 9 aa, Homo Sapiens
LRWMLRSRC

SEQ ID NO: 1189024 - protein, 9 aa, Homo Sapiens
RSASRASGT

SEQ ID NO: 1189025 - protein, 9 aa, Homo Sapiens
PECVPGRGG

SEQ ID NO: 1189026 - protein, 9 aa, Homo Sapiens
LSLLELNTV

SEQ ID NO: 1189027 - protein, 9 aa, Homo Sapiens
TSWKMWSTP

SEQ ID NO: 1189028 - protein, 9 aa, Homo Sapiens
EWYDFFYRE

SEQ ID NO: 1189029 - protein, 9 aa, Homo Sapiens
VPGRGGESG

SEQ ID NO: 1189030 - protein, 9 aa, Homo Sapiens
KCRAQGQNL

SEQ ID NO: 1189031 - protein, 9 aa, Homo Sapiens
KSDGHERRK

SEQ ID NO: 1189032 - protein, 9 aa, Homo Sapiens
PPPKMPPPR

SEQ ID NO: 1189033 - protein, 9 aa, Homo Sapiens
HGHGHTHSH

SEQ ID NO: 1189034 - protein, 9 aa, Homo Sapiens
HQPLGVLAL

SEQ ID NO: 1189035 - protein, 9 aa, Homo Sapiens
GYVGDALAQ

SEQ ID NO: 1189036 - protein, 9 aa, Homo Sapiens
PNFMQLRDR

SEQ ID NO: 1189037 - protein, 9 aa, Homo Sapiens
SQQEWPQRW

SEQ ID NO: 1189038 - protein, 9 aa, Homo Sapiens
LRVLRRVCH

SEQ ID NO: 1189039 - protein, 9 aa, Homo Sapiens
RAVWLHFSP

SEQ ID NO: 1189040 - protein, 9 aa, Homo Sapiens
DHEGTVILW

SEQ ID NO: 1189041 - protein, 9 aa, Homo Sapiens
GRHVPPTGL

SEQ ID NO: 1189042 - protein, 9 aa, Homo Sapiens
TQALGWPGL

SEQ ID NO: 1189043 - protein, 9 aa, Homo Sapiens
RNCSSTSCG

SEQ ID NO: 1189044 - protein, 9 aa, Homo Sapiens
MSWCNELSL

SEQ ID NO: 1189045 - protein, 9 aa, Homo Sapiens
EENKVCAVP

SEQ ID NO: 1189046 - protein, 9 aa, Homo Sapiens
ILVVELLQL

SEQ ID NO: 1189047 - protein, 9 aa, Homo Sapiens
CYERAGQRG

SEQ ID NO: 1189048 - protein, 9 aa, Homo Sapiens
QKNEVFWMW

SEQ ID NO: 1189049 - protein, 9 aa, Homo Sapiens
LPQEFVKGW

SEQ ID NO: 1189050 - protein, 9 aa, Homo Sapiens
AKGQPGFKS

SEQ ID NO: 1189051 - protein, 9 aa, Homo Sapiens
APRRPKATS

SEQ ID NO: 1189052 - protein, 9 aa, Homo Sapiens
GSGGGVPAG

SEQ ID NO: 1189053 - protein, 9 aa, Homo Sapiens
KKRQYRGKA

SEQ ID NO: 1189054 - protein, 9 aa, Homo Sapiens
DPVGPPCRS

SEQ ID NO: 1189055 - protein, 9 aa, Homo Sapiens
SGSLLCTPP

SEQ ID NO: 1189056 - protein, 9 aa, Homo Sapiens
NLQLVLWGW

SEQ ID NO: 1189057 - protein, 9 aa, Homo Sapiens
ASPCWLSCG

SEQ ID NO: 1189058 - protein, 9 aa, Homo Sapiens
WCCRPSASW

SEQ ID NO: 1189059 - protein, 9 aa, Homo Sapiens
SWWSMSRST

SEQ ID NO: 1189060 - protein, 9 aa, Homo Sapiens
HGDAEVVVQ

SEQ ID NO: 1189061 - protein, 9 aa, Homo Sapiens
GRILLQRNL

SEQ ID NO: 1189062 - protein, 9 aa, Homo Sapiens
PFKDMVKSF

SEQ ID NO: 1189063 - protein, 9 aa, Homo Sapiens
APAPTAAAP

SEQ ID NO: 1189064 - protein, 9 aa, Homo Sapiens
GGTTSRPWD

SEQ ID NO: 1189065 - protein, 9 aa, Homo Sapiens
PIKSFVQTK

SEQ ID NO: 1189066 - protein, 9 aa, Homo Sapiens
LGPWNGTTM

SEQ ID NO: 1189067 - protein, 9 aa, Homo Sapiens
SLLIPPPRL

SEQ ID NO: 1189068 - protein, 9 aa, Homo Sapiens
LWDILQKTV

SEQ ID NO: 1189069 - protein, 9 aa, Homo Sapiens
RTPSVQDLQ

SEQ ID NO: 1189070 - protein, 9 aa, Homo Sapiens
GHYNEVKSV

SEQ ID NO: 1189071 - protein, 9 aa, Homo Sapiens
EPGAEMPAS

SEQ ID NO: 1189072 - protein, 9 aa, Homo Sapiens
PLERLMGKR

SEQ ID NO: 1189073 - protein, 9 aa, Homo Sapiens
HLLCGATFP

SEQ ID NO: 1189074 - protein, 9 aa, Homo Sapiens
YSEHNYCRL

SEQ ID NO: 1189075 - protein, 9 aa, Homo Sapiens
VIHSAVMWG

SEQ ID NO: 1189076 - protein, 9 aa, Homo Sapiens
AAAAVLGVA

SEQ ID NO: 1189077 - protein, 9 aa, Homo Sapiens
GVFNLTLSM

SEQ ID NO: 1189078 - protein, 9 aa, Homo Sapiens
EPECSAAGA

SEQ ID NO: 1189079 - protein, 9 aa, Homo Sapiens
QFITSVTTL

SEQ ID NO: 1189080 - protein, 9 aa, Homo Sapiens
WLLLAWAPD

SEQ ID NO: 1189081 - protein, 9 aa, Homo Sapiens
GAVYMDIPA

SEQ ID NO: 1189082 - protein, 9 aa, Homo Sapiens
VWVCHPDVD

SEQ ID NO: 1189083 - protein, 9 aa, Homo Sapiens
FPGDLVAQD

SEQ ID NO: 1189084 - protein, 9 aa, Homo Sapiens
CWFIQQEMD

SEQ ID NO: 1189085 - protein, 9 aa, Homo Sapiens
PLMNNNNVV

SEQ ID NO: 1189086 - protein, 9 aa, Homo Sapiens
EVIWAVRHI

SEQ ID NO: 1189087 - protein, 9 aa, Homo Sapiens
LMSFLCLAV

SEQ ID NO: 1189088 - protein, 9 aa, Homo Sapiens
GDEGGRDRA

SEQ ID NO: 1189089 - protein, 9 aa, Homo Sapiens
CDAPAEPLP

SEQ ID NO: 1189090 - protein, 9 aa, Homo Sapiens
AGTQAAEEP

SEQ ID NO: 1189091 - protein, 9 aa, Homo Sapiens
SCLWTWKPS

SEQ ID NO: 1189092 - protein, 9 aa, Homo Sapiens
QDLAPPAPL

SEQ ID NO: 1189093 - protein, 9 aa, Homo Sapiens
RSMEGLLKQ

SEQ ID NO: 1189094 - protein, 9 aa, Homo Sapiens
KLVQHKGLL

SEQ ID NO: 1189095 - protein, 9 aa, Homo Sapiens
AAGGRETAA

SEQ ID NO: 1189096 - protein, 9 aa, Homo Sapiens
INRAIQELG

SEQ ID NO: 1189097 - protein, 9 aa, Homo Sapiens
GGESGSSQA

SEQ ID NO: 1189098 - protein, 9 aa, Homo Sapiens
STAGEPPSG

SEQ ID NO: 1189099 - protein, 9 aa, Homo Sapiens
VDAPGHADS

SEQ ID NO: 1189100 - protein, 9 aa, Homo Sapiens
TEYTCVKEK

SEQ ID NO: 1189101 - protein, 9 aa, Homo Sapiens
VGMLKWRLQ

SEQ ID NO: 1189102 - protein, 9 aa, Homo Sapiens
NCMVQIIAI

SEQ ID NO: 1189103 - protein, 9 aa, Homo Sapiens
RLAQTHRDT

SEQ ID NO: 1189104 - protein, 9 aa, Homo Sapiens
RAAAPGQAP

SEQ ID NO: 1189105 - protein, 9 aa, Homo Sapiens
AEQRRMERK

SEQ ID NO: 1189106 - protein, 9 aa, Homo Sapiens
PFLLICISY

SEQ ID NO: 1189107 - protein, 9 aa, Homo Sapiens
YQCGCGTFF

SEQ ID NO: 1189108 - protein, 9 aa, Homo Sapiens
LSPLQRSGS

SEQ ID NO: 1189109 - protein, 9 aa, Homo Sapiens
TGGALSSAP

SEQ ID NO: 1189110 - protein, 9 aa, Homo Sapiens
SNHVTNSLV

SEQ ID NO: 1189111 - protein, 9 aa, Homo Sapiens
VGPPCRSSR

SEQ ID NO: 1189112 - protein, 9 aa, Homo Sapiens
WYRHQNGTE

SEQ ID NO: 1189113 - protein, 9 aa, Homo Sapiens
AEVVVQGEL

SEQ ID NO: 1189114 - protein, 9 aa, Homo Sapiens
HVLIHNDLI

SEQ ID NO: 1189115 - protein, 9 aa, Homo Sapiens
AFFYSPLLL

SEQ ID NO: 1189116 - protein, 9 aa, Homo Sapiens
RDEDAGHLL

SEQ ID NO: 1189117 - protein, 9 aa, Homo Sapiens
SRLSLLAPK

SEQ ID NO: 1189118 - protein, 9 aa, Homo Sapiens
MNIKIIRNT

SEQ ID NO: 1189119 - protein, 9 aa, Homo Sapiens
TNAASCACM

SEQ ID NO: 1189120 - protein, 9 aa, Homo Sapiens
QQTGIPTVG

SEQ ID NO: 1189121 - protein, 9 aa, Homo Sapiens
EQERLKGCK

SEQ ID NO: 1189122 - protein, 9 aa, Homo Sapiens
VFQYGVKVI

SEQ ID NO: 1189123 - protein, 9 aa, Homo Sapiens
SITLPTTSL

SEQ ID NO: 1189124 - protein, 9 aa, Homo Sapiens
DRNPRPGCG

SEQ ID NO: 1189125 - protein, 9 aa, Homo Sapiens
GICHPGPGY

SEQ ID NO: 1189126 - protein, 9 aa, Homo Sapiens
AGGLAGMRG

SEQ ID NO: 1189127 - protein, 9 aa, Homo Sapiens
PAAACPTRA

SEQ ID NO: 1189128 - protein, 9 aa, Homo Sapiens
KTCFPEADG

SEQ ID NO: 1189129 - protein, 9 aa, Homo Sapiens
GEPRHCIEF

SEQ ID NO: 1189130 - protein, 9 aa, Homo Sapiens
TTGQAAAAG

SEQ ID NO: 1189131 - protein, 9 aa, Homo Sapiens
MAMLWHGLA

SEQ ID NO: 1189132 - protein, 9 aa, Homo Sapiens
YTMDRPPIG

SEQ ID NO: 1189133 - protein, 9 aa, Homo Sapiens
LGEYYAPAL

SEQ ID NO: 1189134 - protein, 9 aa, Homo Sapiens
GKSNWRQLC

SEQ ID NO: 1189135 - protein, 9 aa, Homo Sapiens
YTDIISIFL

SEQ ID NO: 1189136 - protein, 9 aa, Homo Sapiens
SDSPVPPGP

SEQ ID NO: 1189137 - protein, 9 aa, Homo Sapiens
GAQAIPKTW

SEQ ID NO: 1189138 - protein, 9 aa, Homo Sapiens
FYPVWSSRT

SEQ ID NO: 1189139 - protein, 9 aa, Homo Sapiens
RMGGRHPSW

SEQ ID NO: 1189140 - protein, 9 aa, Homo Sapiens
LHLEVVEGV

SEQ ID NO: 1189141 - protein, 9 aa, Homo Sapiens
RHQRIHMAE

SEQ ID NO: 1189142 - protein, 9 aa, Homo Sapiens
PTMMPRLRV

SEQ ID NO: 1189143 - protein, 9 aa, Homo Sapiens
SQQCTQRQR

SEQ ID NO: 1189144 - protein, 9 aa, Homo Sapiens
QLRGRARAG

SEQ ID NO: 1189145 - protein, 9 aa, Homo Sapiens
VLGEYYAPA

SEQ ID NO: 1189146 - protein, 9 aa, Homo Sapiens
LCHWEGLWG

SEQ ID NO: 1189147 - protein, 9 aa, Homo Sapiens
LTALGFRYL

SEQ ID NO: 1189148 - protein, 9 aa, Homo Sapiens
PCWLSCGSA

SEQ ID NO: 1189149 - protein, 9 aa, Homo Sapiens
ALAPLLKLA

SEQ ID NO: 1189150 - protein, 9 aa, Homo Sapiens
TKRMFKFHQ

SEQ ID NO: 1189151 - protein, 9 aa, Homo Sapiens
RLYMKTLLP

SEQ ID NO: 1189152 - protein, 9 aa, Homo Sapiens
QQRLQEGEE

SEQ ID NO: 1189153 - protein, 9 aa, Homo Sapiens
GYIRDLFID

SEQ ID NO: 1189154 - protein, 9 aa, Homo Sapiens
GRMGGRHPS

SEQ ID NO: 1189155 - protein, 9 aa, Homo Sapiens
KQFILFHPS

SEQ ID NO: 1189156 - protein, 9 aa, Homo Sapiens
YTMYETQMP

SEQ ID NO: 1189157 - protein, 9 aa, Homo Sapiens
GSHRCRQPA

SEQ ID NO: 1189158 - protein, 9 aa, Homo Sapiens
TIFCLPLGL

SEQ ID NO: 1189159 - protein, 9 aa, Homo Sapiens
AFSLSMMAA

SEQ ID NO: 1189160 - protein, 9 aa, Homo Sapiens
RSIPCESNE

SEQ ID NO: 1189161 - protein, 9 aa, Homo Sapiens
PVNSNNVFF

SEQ ID NO: 1189162 - protein, 9 aa, Homo Sapiens
VDDPKADGM

SEQ ID NO: 1189163 - protein, 9 aa, Homo Sapiens
ETAAGGGPE

SEQ ID NO: 1189164 - protein, 9 aa, Homo Sapiens
RRSGLESGE

SEQ ID NO: 1189165 - protein, 9 aa, Homo Sapiens
LLLKSRLYQ

SEQ ID NO: 1189166 - protein, 9 aa, Homo Sapiens
SLTCHNHAL

SEQ ID NO: 1189167 - protein, 9 aa, Homo Sapiens
RGRQCIRTA

SEQ ID NO: 1189168 - protein, 9 aa, Homo Sapiens
GGNRSICLT

SEQ ID NO: 1189169 - protein, 9 aa, Homo Sapiens
PMREVAEAA

SEQ ID NO: 1189170 - protein, 9 aa, Homo Sapiens
HAVVEQAAE

SEQ ID NO: 1189171 - protein, 9 aa, Homo Sapiens
RFVVYDLAG

SEQ ID NO: 1189172 - protein, 9 aa, Homo Sapiens
MECLEALDA

SEQ ID NO: 1189173 - protein, 9 aa, Homo Sapiens
LGEEQQLRR

SEQ ID NO: 1189174 - protein, 9 aa, Homo Sapiens
IFQNIATQA

SEQ ID NO: 1189175 - protein, 9 aa, Homo Sapiens
ALSYVGIVT

SEQ ID NO: 1189176 - protein, 9 aa, Homo Sapiens
LIPPPRLLA

SEQ ID NO: 1189177 - protein, 9 aa, Homo Sapiens
RRARPGQLR

SEQ ID NO: 1189178 - protein, 9 aa, Homo Sapiens
HLHFLKAVH

SEQ ID NO: 1189179 - protein, 9 aa, Homo Sapiens
RNILMIAQK

SEQ ID NO: 1189180 - protein, 9 aa, Homo Sapiens
VGRCPPGPW

SEQ ID NO: 1189181 - protein, 9 aa, Homo Sapiens
FQKWAAVLV

SEQ ID NO: 1189182 - protein, 9 aa, Homo Sapiens
AWAPAPPTR

SEQ ID NO: 1189183 - protein, 9 aa, Homo Sapiens
PNDSSGSSF

SEQ ID NO: 1189184 - protein, 9 aa, Homo Sapiens
YSYVEDGSG

SEQ ID NO: 1189185 - protein, 9 aa, Homo Sapiens
DQVAQSPKH

SEQ ID NO: 1189186 - protein, 9 aa, Homo Sapiens
QVLCHVTGS

SEQ ID NO: 1189187 - protein, 9 aa, Homo Sapiens
VQQYRVTMT

SEQ ID NO: 1189188 - protein, 9 aa, Homo Sapiens
PNTQACCST

SEQ ID NO: 1189189 - protein, 9 aa, Homo Sapiens
YKCEIKRLN

SEQ ID NO: 1189190 - protein, 9 aa, Homo Sapiens
VVDGEIMKT

SEQ ID NO: 1189191 - protein, 9 aa, Homo Sapiens
VRSWCCRPS

SEQ ID NO: 1189192 - protein, 9 aa, Homo Sapiens
ILSRQTKRR

SEQ ID NO: 1189193 - protein, 9 aa, Homo Sapiens
ASVHAICQA

SEQ ID NO: 1189194 - protein, 9 aa, Homo Sapiens
PLPWGDCSS

SEQ ID NO: 1189195 - protein, 9 aa, Homo Sapiens
IFLGALEAH

SEQ ID NO: 1189196 - protein, 9 aa, Homo Sapiens
IPAAQRRPI

SEQ ID NO: 1189197 - protein, 9 aa, Homo Sapiens
TTLLLKALA

SEQ ID NO: 1189198 - protein, 9 aa, Homo Sapiens
KESVFLLNH

SEQ ID NO: 1189199 - protein, 9 aa, Homo Sapiens
VFLDFDFVA

SEQ ID NO: 1189200 - protein, 9 aa, Homo Sapiens
FVLGHHKVR

SEQ ID NO: 1189201 - protein, 9 aa, Homo Sapiens
GSTPPPPPG

SEQ ID NO: 1189202 - protein, 9 aa, Homo Sapiens
DRSVSRDGG

SEQ ID NO: 1189203 - protein, 9 aa, Homo Sapiens
WEVIWAVRH

SEQ ID NO: 1189204 - protein, 9 aa, Homo Sapiens
KSCFPPKGY

SEQ ID NO: 1189205 - protein, 9 aa, Homo Sapiens
PHANAPRAH

SEQ ID NO: 1189206 - protein, 9 aa, Homo Sapiens
APMMSSMAC

SEQ ID NO: 1189207 - protein, 9 aa, Homo Sapiens
GRPPVWGLP

SEQ ID NO: 1189208 - protein, 9 aa, Homo Sapiens
LKGGCPKAP

SEQ ID NO: 1189209 - protein, 9 aa, Homo Sapiens
VKENWNKLA

SEQ ID NO: 1189210 - protein, 9 aa, Homo Sapiens
ACGEEPSHE

SEQ ID NO: 1189211 - protein, 9 aa, Homo Sapiens
LMMTQISKY

SEQ ID NO: 1189212 - protein, 9 aa, Homo Sapiens
DIFWTCLKM

SEQ ID NO: 1189213 - protein, 9 aa, Homo Sapiens
GTPGLRARV

SEQ ID NO: 1189214 - protein, 9 aa, Homo Sapiens
LPSGIYGKA

SEQ ID NO: 1189215 - protein, 9 aa, Homo Sapiens
PCPLVPTRA

SEQ ID NO: 1189216 - protein, 9 aa, Homo Sapiens
RGDTCPCPH

SEQ ID NO: 1189217 - protein, 9 aa, Homo Sapiens
CRFSKGGKT

SEQ ID NO: 1189218 - protein, 9 aa, Homo Sapiens
APCPPLEVH

SEQ ID NO: 1189219 - protein, 9 aa, Homo Sapiens
LKKLLCPKR

SEQ ID NO: 1189220 - protein, 9 aa, Homo Sapiens
KGVEVIPEG

SEQ ID NO: 1189221 - protein, 9 aa, Homo Sapiens
DTTEINQNN

SEQ ID NO: 1189222 - protein, 9 aa, Homo Sapiens
ILGVPLTCS

SEQ ID NO: 1189223 - protein, 9 aa, Homo Sapiens
EKIWESWQM

SEQ ID NO: 1189224 - protein, 9 aa, Homo Sapiens
EHYKCSECG

SEQ ID NO: 1189225 - protein, 9 aa, Homo Sapiens
VKRSIPCES

SEQ ID NO: 1189226 - protein, 9 aa, Homo Sapiens
VHQLHGKVG

SEQ ID NO: 1189227 - protein, 9 aa, Homo Sapiens
TLASSAAQL

SEQ ID NO: 1189228 - protein, 9 aa, Homo Sapiens
SAPTCASPR

SEQ ID NO: 1189229 - protein, 9 aa, Homo Sapiens
RGFISILPV

SEQ ID NO: 1189230 - protein, 9 aa, Homo Sapiens
FESLPRAVL

SEQ ID NO: 1189231 - protein, 9 aa, Homo Sapiens
PRLRVIQLT

SEQ ID NO: 1189232 - protein, 9 aa, Homo Sapiens
TWASGQPLD

SEQ ID NO: 1189233 - protein, 9 aa, Homo Sapiens
RVQVSVARG

SEQ ID NO: 1189234 - protein, 9 aa, Homo Sapiens
ASVGHCSVP

SEQ ID NO: 1189235 - protein, 9 aa, Homo Sapiens
RWNEDGAIC

SEQ ID NO: 1189236 - protein, 9 aa, Homo Sapiens
SSMACGSAE

SEQ ID NO: 1189237 - protein, 9 aa, Homo Sapiens
GRRAAGATP

SEQ ID NO: 1189238 - protein, 9 aa, Homo Sapiens
RGGLPPGAH

SEQ ID NO: 1189239 - protein, 9 aa, Homo Sapiens
CLWTWKPST

SEQ ID NO: 1189240 - protein, 9 aa, Homo Sapiens
RVQIRHVVV

SEQ ID NO: 1189241 - protein, 9 aa, Homo Sapiens
GALLVVVLC

SEQ ID NO: 1189242 - protein, 9 aa, Homo Sapiens
GNMRELINS

SEQ ID NO: 1189243 - protein, 9 aa, Homo Sapiens
NSAEVKREH

SEQ ID NO: 1189244 - protein, 9 aa, Homo Sapiens
GDHHVRDLV

SEQ ID NO: 1189245 - protein, 9 aa, Homo Sapiens
RIHMAEKSF

SEQ ID NO: 1189246 - protein, 9 aa, Homo Sapiens
AAAHRTGIR

SEQ ID NO: 1189247 - protein, 9 aa, Homo Sapiens
RKTVTAMAM

SEQ ID NO: 1189248 - protein, 9 aa, Homo Sapiens
IKLCQLSRG

SEQ ID NO: 1189249 - protein, 9 aa, Homo Sapiens
LKEPKVCED

SEQ ID NO: 1189250 - protein, 9 aa, Homo Sapiens
WRHIGICHP

SEQ ID NO: 1189251 - protein, 9 aa, Homo Sapiens
ATTAIGGGV

SEQ ID NO: 1189252 - protein, 9 aa, Homo Sapiens
ARGPGARRH

SEQ ID NO: 1189253 - protein, 9 aa, Homo Sapiens
DTGFTNQGL

SEQ ID NO: 1189254 - protein, 9 aa, Homo Sapiens
GVGGAWALG

SEQ ID NO: 1189255 - protein, 9 aa, Homo Sapiens
AHGLPVHQG

SEQ ID NO: 1189256 - protein, 9 aa, Homo Sapiens
KGTANIKRY

SEQ ID NO: 1189257 - protein, 9 aa, Homo Sapiens
ALSIAKEKT

SEQ ID NO: 1189258 - protein, 9 aa, Homo Sapiens
SPWTGSAVL

SEQ ID NO: 1189259 - protein, 9 aa, Homo Sapiens
SPVTINQTD

SEQ ID NO: 1189260 - protein, 9 aa, Homo Sapiens
VQGDTSHLS

SEQ ID NO: 1189261 - protein, 9 aa, Homo Sapiens
RRRQRRRRR

SEQ ID NO: 1189262 - protein, 9 aa, Homo Sapiens
AGKDWPSAI

SEQ ID NO: 1189263 - protein, 9 aa, Homo Sapiens
CPGPPKLVS

SEQ ID NO: 1189264 - protein, 9 aa, Homo Sapiens
ADLLKTYVE

SEQ ID NO: 1189265 - protein, 9 aa, Homo Sapiens
GGKRGCGCL

SEQ ID NO: 1189266 - protein, 9 aa, Homo Sapiens
DLVQRLPGH

SEQ ID NO: 1189267 - protein, 9 aa, Homo Sapiens
TGTLVWERG

SEQ ID NO: 1189268 - protein, 9 aa, Homo Sapiens
EQPPNPNSR

SEQ ID NO: 1189269 - protein, 9 aa, Homo Sapiens
KMHVSFLNE

SEQ ID NO: 1189270 - protein, 9 aa, Homo Sapiens
KNIIRLSIW

SEQ ID NO: 1189271 - protein, 9 aa, Homo Sapiens
ECMQACLDK

SEQ ID NO: 1189272 - protein, 9 aa, Homo Sapiens
GPPLGDIVG

SEQ ID NO: 1189273 - protein, 9 aa, Homo Sapiens
RIHSPLATY

SEQ ID NO: 1189274 - protein, 9 aa, Homo Sapiens
QQARLRDRG

SEQ ID NO: 1189275 - protein, 9 aa, Homo Sapiens
GNGCAGGGV

SEQ ID NO: 1189276 - protein, 9 aa, Homo Sapiens
PDGARTPGA

SEQ ID NO: 1189277 - protein, 9 aa, Homo Sapiens
APAPKMCAP

SEQ ID NO: 1189278 - protein, 9 aa, Homo Sapiens
VVVQGELVA

SEQ ID NO: 1189279 - protein, 9 aa, Homo Sapiens
QHISFPDLK

SEQ ID NO: 1189280 - protein, 9 aa, Homo Sapiens
GGQVPELHG

SEQ ID NO: 1189281 - protein, 9 aa, Homo Sapiens
LWNTQYPEK

SEQ ID NO: 1189282 - protein, 9 aa, Homo Sapiens
LSPYSPILK

SEQ ID NO: 1189283 - protein, 9 aa, Homo Sapiens
PGTQHIEEL

SEQ ID NO: 1189284 - protein, 9 aa, Homo Sapiens
TRLNVFAKP

SEQ ID NO: 1189285 - protein, 9 aa, Homo Sapiens
AESKSCFPP

SEQ ID NO: 1189286 - protein, 9 aa, Homo Sapiens
KVAFVLGHH

SEQ ID NO: 1189287 - protein, 9 aa, Homo Sapiens
LGGPRRRSF

SEQ ID NO: 1189288 - protein, 9 aa, Homo Sapiens
AFLYVVSSA

SEQ ID NO: 1189289 - protein, 9 aa, Homo Sapiens
RPQRGPRPL

SEQ ID NO: 1189290 - protein, 9 aa, Homo Sapiens
GGSMKDRIS

SEQ ID NO: 1189291 - protein, 9 aa, Homo Sapiens
LHEGSLYPP

SEQ ID NO: 1189292 - protein, 9 aa, Homo Sapiens
AYYIPGQGH

SEQ ID NO: 1189293 - protein, 9 aa, Homo Sapiens
PAPAPKMCA

SEQ ID NO: 1189294 - protein, 9 aa, Homo Sapiens
CKLYCKAES

SEQ ID NO: 1189295 - protein, 9 aa, Homo Sapiens
NFLEAWRAC

SEQ ID NO: 1189296 - protein, 9 aa, Homo Sapiens
RASRPLPGA

SEQ ID NO: 1189297 - protein, 9 aa, Homo Sapiens
ERAAQTRRS

SEQ ID NO: 1189298 - protein, 9 aa, Homo Sapiens
LSQVFWLAD

SEQ ID NO: 1189299 - protein, 9 aa, Homo Sapiens
GGLHLHPSP

SEQ ID NO: 1189300 - protein, 9 aa, Homo Sapiens
VEMHAVVIA

SEQ ID NO: 1189301 - protein, 9 aa, Homo Sapiens
QKLRVCVAT

SEQ ID NO: 1189302 - protein, 9 aa, Homo Sapiens
QGEIGISNP

SEQ ID NO: 1189303 - protein, 9 aa, Homo Sapiens
ISRAEIHHS

SEQ ID NO: 1189304 - protein, 9 aa, Homo Sapiens
TPRPLPCPP

SEQ ID NO: 1189305 - protein, 9 aa, Homo Sapiens
HQQLNSAAP

SEQ ID NO: 1189306 - protein, 9 aa, Homo Sapiens
GEFGVGGYV

SEQ ID NO: 1189307 - protein, 9 aa, Homo Sapiens
CLCNRFVHP

SEQ ID NO: 1189308 - protein, 9 aa, Homo Sapiens
DIKENLAFP

SEQ ID NO: 1189309 - protein, 9 aa, Homo Sapiens
ASLLWLASR

SEQ ID NO: 1189310 - protein, 9 aa, Homo Sapiens
TMKTSTNCP

SEQ ID NO: 1189311 - protein, 9 aa, Homo Sapiens
KTSTNCPMT

SEQ ID NO: 1189312 - protein, 9 aa, Homo Sapiens
FHGQTIKLL

SEQ ID NO: 1189313 - protein, 9 aa, Homo Sapiens
RRRVSRKMG

SEQ ID NO: 1189314 - protein, 9 aa, Homo Sapiens
WARSLASPR

SEQ ID NO: 1189315 - protein, 9 aa, Homo Sapiens
NPNKTAANI

SEQ ID NO: 1189316 - protein, 9 aa, Homo Sapiens
LDRLRSGAR

SEQ ID NO: 1189317 - protein, 9 aa, Homo Sapiens
ASILKDQWK

SEQ ID NO: 1189318 - protein, 9 aa, Homo Sapiens
AAIERQMAK

SEQ ID NO: 1189319 - protein, 9 aa, Homo Sapiens
PGGCSSSGT

SEQ ID NO: 1189320 - protein, 9 aa, Homo Sapiens
PGLFPRSAS

SEQ ID NO: 1189321 - protein, 9 aa, Homo Sapiens
AWLSSCQVQ

SEQ ID NO: 1189322 - protein, 9 aa, Homo Sapiens
PKFTSSWSG

SEQ ID NO: 1189323 - protein, 9 aa, Homo Sapiens
RGGRPPVWG

SEQ ID NO: 1189324 - protein, 9 aa, Homo Sapiens
LEFYYHEHF

SEQ ID NO: 1189325 - protein, 9 aa, Homo Sapiens
MACGSAESS

SEQ ID NO: 1189326 - protein, 9 aa, Homo Sapiens
QRSGSLLCT

SEQ ID NO: 1189327 - protein, 9 aa, Homo Sapiens
TRAHSRSAT

SEQ ID NO: 1189328 - protein, 9 aa, Homo Sapiens
DSLRVRTVA

SEQ ID NO: 1189329 - protein, 9 aa, Homo Sapiens
IPCIYVSAN

SEQ ID NO: 1189330 - protein, 9 aa, Homo Sapiens
NGQPAFIPA

SEQ ID NO: 1189331 - protein, 9 aa, Homo Sapiens
AGRKRRRPK

SEQ ID NO: 1189332 - protein, 9 aa, Homo Sapiens
PILADDLIK

SEQ ID NO: 1189333 - protein, 9 aa, Homo Sapiens
AALRAVGTQ

SEQ ID NO: 1189334 - protein, 9 aa, Homo Sapiens
ELPSDFQEC

SEQ ID NO: 1189335 - protein, 9 aa, Homo Sapiens
TAWSWCGMI

SEQ ID NO: 1189336 - protein, 9 aa, Homo Sapiens
TPGLRARVW

SEQ ID NO: 1189337 - protein, 9 aa, Homo Sapiens
NVSSPARRR

SEQ ID NO: 1189338 - protein, 9 aa, Homo Sapiens
NGQHLQHQT

SEQ ID NO: 1189339 - protein, 9 aa, Homo Sapiens
GGHRPAHAY

SEQ ID NO: 1189340 - protein, 9 aa, Homo Sapiens
DTPFQPATL

SEQ ID NO: 1189341 - protein, 9 aa, Homo Sapiens
NDDNNEYDA

SEQ ID NO: 1189342 - protein, 9 aa, Homo Sapiens
PTLSVVRTE

SEQ ID NO: 1189343 - protein, 9 aa, Homo Sapiens
AAVLGVAIS

SEQ ID NO: 1189344 - protein, 9 aa, Homo Sapiens
VTGESPPAS

SEQ ID NO: 1189345 - protein, 9 aa, Homo Sapiens
PPPTASPQW

SEQ ID NO: 1189346 - protein, 9 aa, Homo Sapiens
DNPRVARVN

SEQ ID NO: 1189347 - protein, 9 aa, Homo Sapiens
FSTAGTIFC

SEQ ID NO: 1189348 - protein, 9 aa, Homo Sapiens
TVWTAASAP

SEQ ID NO: 1189349 - protein, 9 aa, Homo Sapiens
RHRVTRCRH

SEQ ID NO: 1189350 - protein, 9 aa, Homo Sapiens
HQHVYLGCP

SEQ ID NO: 1189351 - protein, 9 aa, Homo Sapiens
VWKLQLLDR

SEQ ID NO: 1189352 - protein, 9 aa, Homo Sapiens
KHRGPWGPP

SEQ ID NO: 1189353 - protein, 9 aa, Homo Sapiens
YYPGIGNGT

SEQ ID NO: 1189354 - protein, 9 aa, Homo Sapiens
HRCRQPACA

SEQ ID NO: 1189355 - protein, 9 aa, Homo Sapiens
AEKIWESWQ

SEQ ID NO: 1189356 - protein, 9 aa, Homo Sapiens
QPHQAGSPR

SEQ ID NO: 1189357 - protein, 9 aa, Homo Sapiens
AGAARAILH

SEQ ID NO: 1189358 - protein, 9 aa, Homo Sapiens
ALPYDTRSR

SEQ ID NO: 1189359 - protein, 9 aa, Homo Sapiens
VGRHRSCPW

SEQ ID NO: 1189360 - protein, 9 aa, Homo Sapiens
FGAVLLVAV

SEQ ID NO: 1189361 - protein, 9 aa, Homo Sapiens
MLKWRLQTT

SEQ ID NO: 1189362 - protein, 9 aa, Homo Sapiens
AQTAIPRST

SEQ ID NO: 1189363 - protein, 9 aa, Homo Sapiens
RQVREPRAG

SEQ ID NO: 1189364 - protein, 9 aa, Homo Sapiens
SESMLTQSL

SEQ ID NO: 1189365 - protein, 9 aa, Homo Sapiens
NWNKDDQEG

SEQ ID NO: 1189366 - protein, 9 aa, Homo Sapiens
CFQPDLVTI

SEQ ID NO: 1189367 - protein, 9 aa, Homo Sapiens
ATTVAGPRT

SEQ ID NO: 1189368 - protein, 9 aa, Homo Sapiens
ELLAWDPPR

SEQ ID NO: 1189369 - protein, 9 aa, Homo Sapiens
ALAKMNGQP

SEQ ID NO: 1189370 - protein, 9 aa, Homo Sapiens
GTIEDASGA

SEQ ID NO: 1189371 - protein, 9 aa, Homo Sapiens
FLFWFGLVC

SEQ ID NO: 1189372 - protein, 9 aa, Homo Sapiens
CPSGSAPAP

SEQ ID NO: 1189373 - protein, 9 aa, Homo Sapiens
ATPTGPSSL

SEQ ID NO: 1189374 - protein, 9 aa, Homo Sapiens
KFKSSFVNS

SEQ ID NO: 1189375 - protein, 9 aa, Homo Sapiens
CTPGLRDAL

SEQ ID NO: 1189376 - protein, 9 aa, Homo Sapiens
VAPSTLMPS

SEQ ID NO: 1189377 - protein, 9 aa, Homo Sapiens
HVPPTGLVD

SEQ ID NO: 1189378 - protein, 9 aa, Homo Sapiens
AEKEYLKQL

SEQ ID NO: 1189379 - protein, 9 aa, Homo Sapiens
AQEAVHAHA

SEQ ID NO: 1189380 - protein, 9 aa, Homo Sapiens
VPMDKIFRQ

SEQ ID NO: 1189381 - protein, 9 aa, Homo Sapiens
ENWNKLAQK

SEQ ID NO: 1189382 - protein, 9 aa, Homo Sapiens
ARHGGWTTK

SEQ ID NO: 1189383 - protein, 9 aa, Homo Sapiens
RWVHGFNSG

SEQ ID NO: 1189384 - protein, 9 aa, Homo Sapiens
PAPYRPCTH

SEQ ID NO: 1189385 - protein, 9 aa, Homo Sapiens
DELHGGKRV

SEQ ID NO: 1189386 - protein, 9 aa, Homo Sapiens
DMKSAHLPE

SEQ ID NO: 1189387 - protein, 9 aa, Homo Sapiens
EIESGMGSP

SEQ ID NO: 1189388 - protein, 9 aa, Homo Sapiens
EVAPKRIEE

SEQ ID NO: 1189389 - protein, 9 aa, Homo Sapiens
AAPCALKCR

SEQ ID NO: 1189390 - protein, 9 aa, Homo Sapiens
QLAQYQTNA

SEQ ID NO: 1189391 - protein, 9 aa, Homo Sapiens
VLRLSCPYH

SEQ ID NO: 1189392 - protein, 9 aa, Homo Sapiens
YRPCTHLAF

SEQ ID NO: 1189393 - protein, 9 aa, Homo Sapiens
HGHTHSHTR

SEQ ID NO: 1189394 - protein, 9 aa, Homo Sapiens
LEKNGQEAD

SEQ ID NO: 1189395 - protein, 9 aa, Homo Sapiens
ARRRPVQRP

SEQ ID NO: 1189396 - protein, 9 aa, Homo Sapiens
VGHIGRNMV

SEQ ID NO: 1189397 - protein, 9 aa, Homo Sapiens
ERALAAIER

SEQ ID NO: 1189398 - protein, 9 aa, Homo Sapiens
TFFEVSHLC

SEQ ID NO: 1189399 - protein, 9 aa, Homo Sapiens
AAHARVVGL

SEQ ID NO: 1189400 - protein, 9 aa, Homo Sapiens
FHFSTAGTI

SEQ ID NO: 1189401 - protein, 9 aa, Homo Sapiens
MRNSTTCMV

SEQ ID NO: 1189402 - protein, 9 aa, Homo Sapiens
PTSIQGKAD

SEQ ID NO: 1189403 - protein, 9 aa, Homo Sapiens
DRGLQALGS

SEQ ID NO: 1189404 - protein, 9 aa, Homo Sapiens
VDALSPAPL

SEQ ID NO: 1189405 - protein, 9 aa, Homo Sapiens
FVKGWFEQR

SEQ ID NO: 1189406 - protein, 9 aa, Homo Sapiens
SCRQDGLMV

SEQ ID NO: 1189407 - protein, 9 aa, Homo Sapiens
NVFSMLPWQ

SEQ ID NO: 1189408 - protein, 9 aa, Homo Sapiens
PSYRPWRGT

SEQ ID NO: 1189409 - protein, 9 aa, Homo Sapiens
AAVQRLGLP

SEQ ID NO: 1189410 - protein, 9 aa, Homo Sapiens
TRGPRAPPG

SEQ ID NO: 1189411 - protein, 9 aa, Homo Sapiens
YPRIHSPLA

SEQ ID NO: 1189412 - protein, 9 aa, Homo Sapiens
SIALHFSIL

SEQ ID NO: 1189413 - protein, 9 aa, Homo Sapiens
PWTRCLRMR

SEQ ID NO: 1189414 - protein, 9 aa, Homo Sapiens
ISERCTDEK

SEQ ID NO: 1189415 - protein, 9 aa, Homo Sapiens
HPLPRSPRS

SEQ ID NO: 1189416 - protein, 9 aa, Homo Sapiens
TTEDTPEAE

SEQ ID NO: 1189417 - protein, 9 aa, Homo Sapiens
EEKQKEDIE

SEQ ID NO: 1189418 - protein, 9 aa, Homo Sapiens
FYSFIYFIL

SEQ ID NO: 1189419 - protein, 9 aa, Homo Sapiens
ETALHLAAH

SEQ ID NO: 1189420 - protein, 9 aa, Homo Sapiens
VDNVNRALH

SEQ ID NO: 1189421 - protein, 9 aa, Homo Sapiens
LSALQREGE

SEQ ID NO: 1189422 - protein, 9 aa, Homo Sapiens
WNSVADCMP

SEQ ID NO: 1189423 - protein, 9 aa, Homo Sapiens
PGTRDVQGQ

SEQ ID NO: 1189424 - protein, 9 aa, Homo Sapiens
AATVTRTPA

SEQ ID NO: 1189425 - protein, 9 aa, Homo Sapiens
CRGPMPGSC

SEQ ID NO: 1189426 - protein, 9 aa, Homo Sapiens
LVLKKLLCP

SEQ ID NO: 1189427 - protein, 9 aa, Homo Sapiens
SVADCMPCV

SEQ ID NO: 1189428 - protein, 9 aa, Homo Sapiens
SLWSWSPKP

SEQ ID NO: 1189429 - protein, 9 aa, Homo Sapiens
LMNSNISSP

SEQ ID NO: 1189430 - protein, 9 aa, Homo Sapiens
ALLNKGAEA

SEQ ID NO: 1189431 - protein, 9 aa, Homo Sapiens
LDPLAFFYS

SEQ ID NO: 1189432 - protein, 9 aa, Homo Sapiens
ISKCVYWVD

SEQ ID NO: 1189433 - protein, 9 aa, Homo Sapiens
HCAPPLHHY

SEQ ID NO: 1189434 - protein, 9 aa, Homo Sapiens
ASPQWSPSP

SEQ ID NO: 1189435 - protein, 9 aa, Homo Sapiens
LLAGYNDFN

SEQ ID NO: 1189436 - protein, 9 aa, Homo Sapiens
RQAAQDGRV

SEQ ID NO: 1189437 - protein, 9 aa, Homo Sapiens
FPEAIKAWG

SEQ ID NO: 1189438 - protein, 9 aa, Homo Sapiens
LTEAAVAGS

SEQ ID NO: 1189439 - protein, 9 aa, Homo Sapiens
DRFPLLPGH

SEQ ID NO: 1189440 - protein, 9 aa, Homo Sapiens
RFVHPSADE

SEQ ID NO: 1189441 - protein, 9 aa, Homo Sapiens
GFGGTTSRP

SEQ ID NO: 1189442 - protein, 9 aa, Homo Sapiens
EVRLWPQKK

SEQ ID NO: 1189443 - protein, 9 aa, Homo Sapiens
GHKPPRHQC

SEQ ID NO: 1189444 - protein, 9 aa, Homo Sapiens
GDSSSSGLT

SEQ ID NO: 1189445 - protein, 9 aa, Homo Sapiens
SGFGGDVVE

SEQ ID NO: 1189446 - protein, 9 aa, Homo Sapiens
FQGRHVPPT

SEQ ID NO: 1189447 - protein, 9 aa, Homo Sapiens
ALPAGRHPQ

SEQ ID NO: 1189448 - protein, 9 aa, Homo Sapiens
SASCCCPTA

SEQ ID NO: 1189449 - protein, 9 aa, Homo Sapiens
TPSARSSAR

SEQ ID NO: 1189450 - protein, 9 aa, Homo Sapiens
QIKSSFGQK

SEQ ID NO: 1189451 - protein, 9 aa, Homo Sapiens
HGPAPAPKM

SEQ ID NO: 1189452 - protein, 9 aa, Homo Sapiens
WKPSTWTEM

SEQ ID NO: 1189453 - protein, 9 aa, Homo Sapiens
LLPGPLPAS

SEQ ID NO: 1189454 - protein, 9 aa, Homo Sapiens
SSQNVTTCP

SEQ ID NO: 1189455 - protein, 9 aa, Homo Sapiens
ELRSPRPER

SEQ ID NO: 1189456 - protein, 9 aa, Homo Sapiens
HGLPLGPGA

SEQ ID NO: 1189457 - protein, 9 aa, Homo Sapiens
IERQMAKIS

SEQ ID NO: 1189458 - protein, 9 aa, Homo Sapiens
IKEERKSKR

SEQ ID NO: 1189459 - protein, 9 aa, Homo Sapiens
QMKTIHCNR

SEQ ID NO: 1189460 - protein, 9 aa, Homo Sapiens
PCAFLLLHL

SEQ ID NO: 1189461 - protein, 9 aa, Homo Sapiens
RAAPATVRP

SEQ ID NO: 1189462 - protein, 9 aa, Homo Sapiens
EEQTPNVQD

SEQ ID NO: 1189463 - protein, 9 aa, Homo Sapiens
VAHLGFRLQ

SEQ ID NO: 1189464 - protein, 9 aa, Homo Sapiens
QEGRFVLKN

SEQ ID NO: 1189465 - protein, 9 aa, Homo Sapiens
REEQCRQCD

SEQ ID NO: 1189466 - protein, 9 aa, Homo Sapiens
GATSTTGPG

SEQ ID NO: 1189467 - protein, 9 aa, Homo Sapiens
FFWRPPTRE

SEQ ID NO: 1189468 - protein, 9 aa, Homo Sapiens
GVLRTVAVC

SEQ ID NO: 1189469 - protein, 9 aa, Homo Sapiens
CWHRYLFPA

SEQ ID NO: 1189470 - protein, 9 aa, Homo Sapiens
CFHGQTIKL

SEQ ID NO: 1189471 - protein, 9 aa, Homo Sapiens
TDERSWVHS

SEQ ID NO: 1189472 - protein, 9 aa, Homo Sapiens
LDRALRCIS

SEQ ID NO: 1189473 - protein, 9 aa, Homo Sapiens
EVRDSYTRI

SEQ ID NO: 1189474 - protein, 9 aa, Homo Sapiens
ETLMATCHF

SEQ ID NO: 1189475 - protein, 9 aa, Homo Sapiens
DSSLGILPE

SEQ ID NO: 1189476 - protein, 9 aa, Homo Sapiens
NQPVVSTVY

SEQ ID NO: 1189477 - protein, 9 aa, Homo Sapiens
FGGAQAIPK

SEQ ID NO: 1189478 - protein, 9 aa, Homo Sapiens
SINLSTIKS

SEQ ID NO: 1189479 - protein, 9 aa, Homo Sapiens
GGPTMPHVP

SEQ ID NO: 1189480 - protein, 9 aa, Homo Sapiens
DLSNATELA

SEQ ID NO: 1189481 - protein, 9 aa, Homo Sapiens
RDKSAGSGV

SEQ ID NO: 1189482 - protein, 9 aa, Homo Sapiens
EELRCWFIQ

SEQ ID NO: 1189483 - protein, 9 aa, Homo Sapiens
GFHTVGSCC

SEQ ID NO: 1189484 - protein, 9 aa, Homo Sapiens
GSNAVGRRG

SEQ ID NO: 1189485 - protein, 9 aa, Homo Sapiens
WLHVSMYRS

SEQ ID NO: 1189486 - protein, 9 aa, Homo Sapiens
HKGLLEEDI

SEQ ID NO: 1189487 - protein, 9 aa, Homo Sapiens
RMGPAAACP

SEQ ID NO: 1189488 - protein, 9 aa, Homo Sapiens
APLRPSTRP

SEQ ID NO: 1189489 - protein, 9 aa, Homo Sapiens
GINNQKRFH

SEQ ID NO: 1189490 - protein, 9 aa, Homo Sapiens
LAARRRRLL

SEQ ID NO: 1189491 - protein, 9 aa, Homo Sapiens
PPGAPPCQS

SEQ ID NO: 1189492 - protein, 9 aa, Homo Sapiens
NWIVDNVNR

SEQ ID NO: 1189493 - protein, 9 aa, Homo Sapiens
QNARAKFRC

SEQ ID NO: 1189494 - protein, 9 aa, Homo Sapiens
TLPQGPTVP

SEQ ID NO: 1189495 - protein, 9 aa, Homo Sapiens
DCGAWPPPW

SEQ ID NO: 1189496 - protein, 9 aa, Homo Sapiens
QMSEPGWAS

SEQ ID NO: 1189497 - protein, 9 aa, Homo Sapiens
SYSYVEDGS

SEQ ID NO: 1189498 - protein, 9 aa, Homo Sapiens
VAPTLSVVR

SEQ ID NO: 1189499 - protein, 9 aa, Homo Sapiens
IGHVAPSTA

SEQ ID NO: 1189500 - protein, 9 aa, Homo Sapiens
TNCPMTTSA

SEQ ID NO: 1189501 - protein, 9 aa, Homo Sapiens
PGHRAGHLP

SEQ ID NO: 1189502 - protein, 9 aa, Homo Sapiens
KDLTSPAQR

SEQ ID NO: 1189503 - protein, 9 aa, Homo Sapiens
GLVENLQAL

SEQ ID NO: 1189504 - protein, 9 aa, Homo Sapiens
CPPRGKRTQ

SEQ ID NO: 1189505 - protein, 9 aa, Homo Sapiens
VKRRRNILM

SEQ ID NO: 1189506 - protein, 9 aa, Homo Sapiens
PKGKKRQYR

SEQ ID NO: 1189507 - protein, 9 aa, Homo Sapiens
HPGVISERC

SEQ ID NO: 1189508 - protein, 9 aa, Homo Sapiens
VFNLTLSML

SEQ ID NO: 1189509 - protein, 9 aa, Homo Sapiens
VGMTGPARC

SEQ ID NO: 1189510 - protein, 9 aa, Homo Sapiens
INFRGNKPR

SEQ ID NO: 1189511 - protein, 9 aa, Homo Sapiens
EEQDDELDH

SEQ ID NO: 1189512 - protein, 9 aa, Homo Sapiens
TTAEQRRME

SEQ ID NO: 1189513 - protein, 9 aa, Homo Sapiens
DASGAFSGL

SEQ ID NO: 1189514 - protein, 9 aa, Homo Sapiens
AYPYPWPPA

SEQ ID NO: 1189515 - protein, 9 aa, Homo Sapiens
DSLSVKMVI

SEQ ID NO: 1189516 - protein, 9 aa, Homo Sapiens
NVPDRGAAQ

SEQ ID NO: 1189517 - protein, 9 aa, Homo Sapiens
LLPPLLSCW

SEQ ID NO: 1189518 - protein, 9 aa, Homo Sapiens
PELLQFQVS

SEQ ID NO: 1189519 - protein, 9 aa, Homo Sapiens
DEEEEEEDL

SEQ ID NO: 1189520 - protein, 9 aa, Homo Sapiens
KRTYKSAVS

SEQ ID NO: 1189521 - protein, 9 aa, Homo Sapiens
DLPSLTSGL

SEQ ID NO: 1189522 - protein, 9 aa, Homo Sapiens
FNAGGSMKD

SEQ ID NO: 1189523 - protein, 9 aa, Homo Sapiens
QVSCCQQTA

SEQ ID NO: 1189524 - protein, 9 aa, Homo Sapiens
DKEGIPPTS

SEQ ID NO: 1189525 - protein, 9 aa, Homo Sapiens
VCLFMKRYT

SEQ ID NO: 1189526 - protein, 9 aa, Homo Sapiens
AICQAMCSR

SEQ ID NO: 1189527 - protein, 9 aa, Homo Sapiens
KGHRGHHHP

SEQ ID NO: 1189528 - protein, 9 aa, Homo Sapiens
HCPLQGFLI

SEQ ID NO: 1189529 - protein, 9 aa, Homo Sapiens
FCLDKVQVP

SEQ ID NO: 1189530 - protein, 9 aa, Homo Sapiens
CPAYPYPWP

SEQ ID NO: 1189531 - protein, 9 aa, Homo Sapiens
VWMLLGAAS

SEQ ID NO: 1189532 - protein, 9 aa, Homo Sapiens
DEEAVKKLI

SEQ ID NO: 1189533 - protein, 9 aa, Homo Sapiens
KRHPHKSLP

SEQ ID NO: 1189534 - protein, 9 aa, Homo Sapiens
PRPLPCPPR

SEQ ID NO: 1189535 - protein, 9 aa, Homo Sapiens
EPLGPVADL

SEQ ID NO: 1189536 - protein, 9 aa, Homo Sapiens
SGLRPCLPS

SEQ ID NO: 1189537 - protein, 9 aa, Homo Sapiens
DTTSFHIVI

SEQ ID NO: 1189538 - protein, 9 aa, Homo Sapiens
RARVDGRCG

SEQ ID NO: 1189539 - protein, 9 aa, Homo Sapiens
LCSHTLLRF

SEQ ID NO: 1189540 - protein, 9 aa, Homo Sapiens
EYTCVKEKE

SEQ ID NO: 1189541 - protein, 9 aa, Homo Sapiens
GHLQEECAE

SEQ ID NO: 1189542 - protein, 9 aa, Homo Sapiens
IDVWSCVCI

SEQ ID NO: 1189543 - protein, 9 aa, Homo Sapiens
AGYFALGAK

SEQ ID NO: 1189544 - protein, 9 aa, Homo Sapiens
LERLMGKRV

SEQ ID NO: 1189545 - protein, 9 aa, Homo Sapiens
APRVALSRP

SEQ ID NO: 1189546 - protein, 9 aa, Homo Sapiens
SKSCFPPKG

SEQ ID NO: 1189547 - protein, 9 aa, Homo Sapiens
SCSTHPLRT

SEQ ID NO: 1189548 - protein, 9 aa, Homo Sapiens
LPGAAHSQP

SEQ ID NO: 1189549 - protein, 9 aa, Homo Sapiens
SSARTTVWT

SEQ ID NO: 1189550 - protein, 9 aa, Homo Sapiens
TPAPTPSAR

SEQ ID NO: 1189551 - protein, 9 aa, Homo Sapiens
AMWLSASHF

SEQ ID NO: 1189552 - protein, 9 aa, Homo Sapiens
SRGLRFVVY

SEQ ID NO: 1189553 - protein, 9 aa, Homo Sapiens
TCGTLSPRS

SEQ ID NO: 1189554 - protein, 9 aa, Homo Sapiens
LPSLLSRHQ

SEQ ID NO: 1189555 - protein, 9 aa, Homo Sapiens
SDPGVCIFG

SEQ ID NO: 1189556 - protein, 9 aa, Homo Sapiens
ILPFPASLA

SEQ ID NO: 1189557 - protein, 9 aa, Homo Sapiens
TLLMGMCPL

SEQ ID NO: 1189558 - protein, 9 aa, Homo Sapiens
AESYCPEYL

SEQ ID NO: 1189559 - protein, 9 aa, Homo Sapiens
DFRSCTNSN

SEQ ID NO: 1189560 - protein, 9 aa, Homo Sapiens
KASQNAYYF

SEQ ID NO: 1189561 - protein, 9 aa, Homo Sapiens
RPCLPSPRS

SEQ ID NO: 1189562 - protein, 9 aa, Homo Sapiens
RACGQRRRA

SEQ ID NO: 1189563 - protein, 9 aa, Homo Sapiens
AAGGAGDEL

SEQ ID NO: 1189564 - protein, 9 aa, Homo Sapiens
RLQEGEEGL

SEQ ID NO: 1189565 - protein, 9 aa, Homo Sapiens
QTKKTKDLI

SEQ ID NO: 1189566 - protein, 9 aa, Homo Sapiens
MTARRRVSR

SEQ ID NO: 1189567 - protein, 9 aa, Homo Sapiens
YLEDGSHYV

SEQ ID NO: 1189568 - protein, 9 aa, Homo Sapiens
QDGRVDSQR

SEQ ID NO: 1189569 - protein, 9 aa, Homo Sapiens
AIPAAQRRP

SEQ ID NO: 1189570 - protein, 9 aa, Homo Sapiens
ARCCRWPRR

SEQ ID NO: 1189571 - protein, 9 aa, Homo Sapiens
AAFVKFSTL

SEQ ID NO: 1189572 - protein, 9 aa, Homo Sapiens
GILLSREGL

SEQ ID NO: 1189573 - protein, 9 aa, Homo Sapiens
SASSTTLDR

SEQ ID NO: 1189574 - protein, 9 aa, Homo Sapiens
KVGQWVGMV

SEQ ID NO: 1189575 - protein, 9 aa, Homo Sapiens
VGGNWGWPV

SEQ ID NO: 1189576 - protein, 9 aa, Homo Sapiens
HADSHVFLH

SEQ ID NO: 1189577 - protein, 9 aa, Homo Sapiens
ARVVIPRGS

SEQ ID NO: 1189578 - protein, 9 aa, Homo Sapiens
SAPVHSSGR

SEQ ID NO: 1189579 - protein, 9 aa, Homo Sapiens
NGSGPGRRR

SEQ ID NO: 1189580 - protein, 9 aa, Homo Sapiens
RCCKRFVQS

SEQ ID NO: 1189581 - protein, 9 aa, Homo Sapiens
EEAPLRGYG

SEQ ID NO: 1189582 - protein, 9 aa, Homo Sapiens
FALGVRISA

SEQ ID NO: 1189583 - protein, 9 aa, Homo Sapiens
GPGDFPKIF

SEQ ID NO: 1189584 - protein, 9 aa, Homo Sapiens
VFTTVIPSN

SEQ ID NO: 1189585 - protein, 9 aa, Homo Sapiens
GALRDDVKV

SEQ ID NO: 1189586 - protein, 9 aa, Homo Sapiens
AKRSQQAQK

SEQ ID NO: 1189587 - protein, 9 aa, Homo Sapiens
LSDGITILV

SEQ ID NO: 1189588 - protein, 9 aa, Homo Sapiens
EAMTLGLWS

SEQ ID NO: 1189589 - protein, 9 aa, Homo Sapiens
QVAAPGLAA

SEQ ID NO: 1189590 - protein, 9 aa, Homo Sapiens
RFAYNANQQ

SEQ ID NO: 1189591 - protein, 9 aa, Homo Sapiens
DTLTMSEDR

SEQ ID NO: 1189592 - protein, 9 aa, Homo Sapiens
SKPFFYVNM

SEQ ID NO: 1189593 - protein, 9 aa, Homo Sapiens
QILQGHLSH

SEQ ID NO: 1189594 - protein, 9 aa, Homo Sapiens
GRRARALGL

SEQ ID NO: 1189595 - protein, 9 aa, Homo Sapiens
RKCLPAAPG

SEQ ID NO: 1189596 - protein, 9 aa, Homo Sapiens
QSQLAPWPG

SEQ ID NO: 1189597 - protein, 9 aa, Homo Sapiens
GPLSFNASI

SEQ ID NO: 1189598 - protein, 9 aa, Homo Sapiens
QAALPWLSR

SEQ ID NO: 1189599 - protein, 9 aa, Homo Sapiens
SEHENDDDA

SEQ ID NO: 1189600 - protein, 9 aa, Homo Sapiens
WHYYYQSAN

SEQ ID NO: 1189601 - protein, 9 aa, Homo Sapiens
GDVGKSALT

SEQ ID NO: 1189602 - protein, 9 aa, Homo Sapiens
RGKLLSHRS

SEQ ID NO: 1189603 - protein, 9 aa, Homo Sapiens
SRASGTPGL

SEQ ID NO: 1189604 - protein, 9 aa, Homo Sapiens
GNKYLAKTG

SEQ ID NO: 1189605 - protein, 9 aa, Homo Sapiens
HLQDLVIHS

SEQ ID NO: 1189606 - protein, 9 aa, Homo Sapiens
LCRAGPTSP

SEQ ID NO: 1189607 - protein, 9 aa, Homo Sapiens
RVAVGDWVL

SEQ ID NO: 1189608 - protein, 9 aa, Homo Sapiens
GDPGRGRPR

SEQ ID NO: 1189609 - protein, 9 aa, Homo Sapiens
YRNGKVLRP

SEQ ID NO: 1189610 - protein, 9 aa, Homo Sapiens
LLDVWARLE

SEQ ID NO: 1189611 - protein, 9 aa, Homo Sapiens
SAEYSQPSS

SEQ ID NO: 1189612 - protein, 9 aa, Homo Sapiens
DGRITRLEI

SEQ ID NO: 1189613 - protein, 9 aa, Homo Sapiens
ILFSVIKVT

SEQ ID NO: 1189614 - protein, 9 aa, Homo Sapiens
GVLALQGAR

SEQ ID NO: 1189615 - protein, 9 aa, Homo Sapiens
TLYIDALHK

SEQ ID NO: 1189616 - protein, 9 aa, Homo Sapiens
SFIAFFIPL

SEQ ID NO: 1189617 - protein, 9 aa, Homo Sapiens
NHVTNSLVD

SEQ ID NO: 1189618 - protein, 9 aa, Homo Sapiens
HKDSANLLP

SEQ ID NO: 1189619 - protein, 9 aa, Homo Sapiens
QHQPQQQHH

SEQ ID NO: 1189620 - protein, 9 aa, Homo Sapiens
AAPSSRPRA

SEQ ID NO: 1189621 - protein, 9 aa, Homo Sapiens
DILAGMRMD

SEQ ID NO: 1189622 - protein, 9 aa, Homo Sapiens
LPSSTATVG

SEQ ID NO: 1189623 - protein, 9 aa, Homo Sapiens
RAWCRARVD

SEQ ID NO: 1189624 - protein, 9 aa, Homo Sapiens
MNMWFKHEN

SEQ ID NO: 1189625 - protein, 9 aa, Homo Sapiens
VRCGQLLAQ

SEQ ID NO: 1189626 - protein, 9 aa, Homo Sapiens
KCMVSINVL

SEQ ID NO: 1189627 - protein, 9 aa, Homo Sapiens
TNVSNWHWT

SEQ ID NO: 1189628 - protein, 9 aa, Homo Sapiens
THQITVQEQ

SEQ ID NO: 1189629 - protein, 9 aa, Homo Sapiens
YLMRPKVYR

SEQ ID NO: 1189630 - protein, 9 aa, Homo Sapiens
AVTTSSLGK

SEQ ID NO: 1189631 - protein, 9 aa, Homo Sapiens
DLDPDPSRL

SEQ ID NO: 1189632 - protein, 9 aa, Homo Sapiens
WLHFSPPLP

SEQ ID NO: 1189633 - protein, 9 aa, Homo Sapiens
RTGNFIPPQ

SEQ ID NO: 1189634 - protein, 9 aa, Homo Sapiens
PVTINQTDK

SEQ ID NO: 1189635 - protein, 9 aa, Homo Sapiens
GQFVIADSG

SEQ ID NO: 1189636 - protein, 9 aa, Homo Sapiens
FLPQRGTQP

SEQ ID NO: 1189637 - protein, 9 aa, Homo Sapiens
HVVVVGVGV

SEQ ID NO: 1189638 - protein, 9 aa, Homo Sapiens
SSWASVGVA

SEQ ID NO: 1189639 - protein, 9 aa, Homo Sapiens
GSVSGSGSG

SEQ ID NO: 1189640 - protein, 9 aa, Homo Sapiens
GAHLLHEAV

SEQ ID NO: 1189641 - protein, 9 aa, Homo Sapiens
GLRRRQLRR

SEQ ID NO: 1189642 - protein, 9 aa, Homo Sapiens
PLDRLRSGA

SEQ ID NO: 1189643 - protein, 9 aa, Homo Sapiens
KRSQQAQKE

SEQ ID NO: 1189644 - protein, 9 aa, Homo Sapiens
PPWGCPWAD

SEQ ID NO: 1189645 - protein, 9 aa, Homo Sapiens
VLGAGLVEN

SEQ ID NO: 1189646 - protein, 9 aa, Homo Sapiens
PATCPAVVQ

SEQ ID NO: 1189647 - protein, 9 aa, Homo Sapiens
DDYGNTPLR

SEQ ID NO: 1189648 - protein, 9 aa, Homo Sapiens
SAHTANFGQ

SEQ ID NO: 1189649 - protein, 9 aa, Homo Sapiens
SSPPQRSSK

SEQ ID NO: 1189650 - protein, 9 aa, Homo Sapiens
ILQASVAAW

SEQ ID NO: 1189651 - protein, 9 aa, Homo Sapiens
IVGIAWLTQ

SEQ ID NO: 1189652 - protein, 9 aa, Homo Sapiens
WATWLSLAL

SEQ ID NO: 1189653 - protein, 9 aa, Homo Sapiens
IFDLSSEFF

SEQ ID NO: 1189654 - protein, 9 aa, Homo Sapiens
LPPGPGRPA

SEQ ID NO: 1189655 - protein, 9 aa, Homo Sapiens
GTHELGVVK

SEQ ID NO: 1189656 - protein, 9 aa, Homo Sapiens
NGGLSGLMT

SEQ ID NO: 1189657 - protein, 9 aa, Homo Sapiens
PGEAVGLHE

SEQ ID NO: 1189658 - protein, 9 aa, Homo Sapiens
DPEAGHPHN

SEQ ID NO: 1189659 - protein, 9 aa, Homo Sapiens
VADCMPCVF

SEQ ID NO: 1189660 - protein, 9 aa, Homo Sapiens
VCERCCKRF

SEQ ID NO: 1189661 - protein, 9 aa, Homo Sapiens
TATVTTYNT

SEQ ID NO: 1189662 - protein, 9 aa, Homo Sapiens
SGSIFLGAL

SEQ ID NO: 1189663 - protein, 9 aa, Homo Sapiens
APSVGVARR

SEQ ID NO: 1189664 - protein, 9 aa, Homo Sapiens
GQAPKASSW

SEQ ID NO: 1189665 - protein, 9 aa, Homo Sapiens
IDSARLAAD

SEQ ID NO: 1189666 - protein, 9 aa, Homo Sapiens
KHLADAQVA

SEQ ID NO: 1189667 - protein, 9 aa, Homo Sapiens
QQRPGAPGP

SEQ ID NO: 1189668 - protein, 9 aa, Homo Sapiens
SEHSQLYGK

SEQ ID NO: 1189669 - protein, 9 aa, Homo Sapiens
AGPKASREQ

SEQ ID NO: 1189670 - protein, 9 aa, Homo Sapiens
KYLAKTGGS

SEQ ID NO: 1189671 - protein, 9 aa, Homo Sapiens
THRPRHRQL

SEQ ID NO: 1189672 - protein, 9 aa, Homo Sapiens
PEPVSVDMG

SEQ ID NO: 1189673 - protein, 9 aa, Homo Sapiens
MTLPGEDGQ

SEQ ID NO: 1189674 - protein, 9 aa, Homo Sapiens
DERSWVHSP

SEQ ID NO: 1189675 - protein, 9 aa, Homo Sapiens
SHLHTPMYS

SEQ ID NO: 1189676 - protein, 9 aa, Homo Sapiens
PGGCIPAPR

SEQ ID NO: 1189677 - protein, 9 aa, Homo Sapiens
DMSSICTVP

SEQ ID NO: 1189678 - protein, 9 aa, Homo Sapiens
EIKKACIRQ

SEQ ID NO: 1189679 - protein, 9 aa, Homo Sapiens
GFLKVPPGW

SEQ ID NO: 1189680 - protein, 9 aa, Homo Sapiens
WQRLRYGVY

SEQ ID NO: 1189681 - protein, 9 aa, Homo Sapiens
ILEKLEKKD

SEQ ID NO: 1189682 - protein, 9 aa, Homo Sapiens
NGNVSLFFR

SEQ ID NO: 1189683 - protein, 9 aa, Homo Sapiens
SERTPGLQP

SEQ ID NO: 1189684 - protein, 9 aa, Homo Sapiens
LRLSCPYHP

SEQ ID NO: 1189685 - protein, 9 aa, Homo Sapiens
YCCWEEYRV

SEQ ID NO: 1189686 - protein, 9 aa, Homo Sapiens
LSLPALKQH

SEQ ID NO: 1189687 - protein, 9 aa, Homo Sapiens
VFCFYKLVT

SEQ ID NO: 1189688 - protein, 9 aa, Homo Sapiens
APIDKRGIS

SEQ ID NO: 1189689 - protein, 9 aa, Homo Sapiens
TKKRGKSQG

SEQ ID NO: 1189690 - protein, 9 aa, Homo Sapiens
SGQHCSSSR

SEQ ID NO: 1189691 - protein, 9 aa, Homo Sapiens
CRRCSGLSV

SEQ ID NO: 1189692 - protein, 9 aa, Homo Sapiens
QGPLPRHPC

SEQ ID NO: 1189693 - protein, 9 aa, Homo Sapiens
TPLGQVPQD

SEQ ID NO: 1189694 - protein, 9 aa, Homo Sapiens
DICSPSTCQ

SEQ ID NO: 1189695 - protein, 9 aa, Homo Sapiens
GLPCRLGLD

SEQ ID NO: 1189696 - protein, 9 aa, Homo Sapiens
TGSAACGCG

SEQ ID NO: 1189697 - protein, 9 aa, Homo Sapiens
SWRMGPGRH

SEQ ID NO: 1189698 - protein, 9 aa, Homo Sapiens
PPTASPQWS

SEQ ID NO: 1189699 - protein, 9 aa, Homo Sapiens
TCAECGKAF

SEQ ID NO: 1189700 - protein, 9 aa, Homo Sapiens
MHRLMGVDS

SEQ ID NO: 1189701 - protein, 9 aa, Homo Sapiens
RQDETFNCT

SEQ ID NO: 1189702 - protein, 9 aa, Homo Sapiens
SEEASAEEC

SEQ ID NO: 1189703 - protein, 9 aa, Homo Sapiens
ARRHPPRNG

SEQ ID NO: 1189704 - protein, 9 aa, Homo Sapiens
ARLRDRGAA

SEQ ID NO: 1189705 - protein, 9 aa, Homo Sapiens
ADTTHPRSR

SEQ ID NO: 1189706 - protein, 9 aa, Homo Sapiens
GRERILVIQ

SEQ ID NO: 1189707 - protein, 9 aa, Homo Sapiens
PFQGRHVPP

SEQ ID NO: 1189708 - protein, 9 aa, Homo Sapiens
NVSLFFRRV

SEQ ID NO: 1189709 - protein, 9 aa, Homo Sapiens
MLLGAASSP

SEQ ID NO: 1189710 - protein, 9 aa, Homo Sapiens
SLAGHRGTH

SEQ ID NO: 1189711 - protein, 9 aa, Homo Sapiens
QRGGLPPGA

SEQ ID NO: 1189712 - protein, 9 aa, Homo Sapiens
ELFLLVSLA

SEQ ID NO: 1189713 - protein, 9 aa, Homo Sapiens
AGVVNGTGR

SEQ ID NO: 1189714 - protein, 9 aa, Homo Sapiens
NPKSPLLCV

SEQ ID NO: 1189715 - protein, 9 aa, Homo Sapiens
TARLLSERG

SEQ ID NO: 1189716 - protein, 9 aa, Homo Sapiens
SPAQEIVFL

SEQ ID NO: 1189717 - protein, 9 aa, Homo Sapiens
TRDFNLLHV

SEQ ID NO: 1189718 - protein, 9 aa, Homo Sapiens
KEEMKKTTS

SEQ ID NO: 1189719 - protein, 9 aa, Homo Sapiens
WVHGFNSGG

SEQ ID NO: 1189720 - protein, 9 aa, Homo Sapiens
PTQTWTRLP

SEQ ID NO: 1189721 - protein, 9 aa, Homo Sapiens
ARAKRYRAL

SEQ ID NO: 1189722 - protein, 9 aa, Homo Sapiens
QAGGQKCMV

SEQ ID NO: 1189723 - protein, 9 aa, Homo Sapiens
MMTQISKYA

SEQ ID NO: 1189724 - protein, 9 aa, Homo Sapiens
QQQSQQPYP

SEQ ID NO: 1189725 - protein, 9 aa, Homo Sapiens
CGKNWEKLE

SEQ ID NO: 1189726 - protein, 9 aa, Homo Sapiens
APQAQDPTI

SEQ ID NO: 1189727 - protein, 9 aa, Homo Sapiens
LGILPEEED

SEQ ID NO: 1189728 - protein, 9 aa, Homo Sapiens
DDQEGRFVL

SEQ ID NO: 1189729 - protein, 9 aa, Homo Sapiens
KALRRLGVG

SEQ ID NO: 1189730 - protein, 9 aa, Homo Sapiens
CDVLVGHKA

SEQ ID NO: 1189731 - protein, 9 aa, Homo Sapiens
RLLISRAEI

SEQ ID NO: 1189732 - protein, 9 aa, Homo Sapiens
PPPSADMGA

SEQ ID NO: 1189733 - protein, 9 aa, Homo Sapiens
NGFKDNSHI

SEQ ID NO: 1189734 - protein, 9 aa, Homo Sapiens
PPSRHCPPP

SEQ ID NO: 1189735 - protein, 9 aa, Homo Sapiens
WFIFTMDYL

SEQ ID NO: 1189736 - protein, 9 aa, Homo Sapiens
DHSHEMAEK

SEQ ID NO: 1189737 - protein, 9 aa, Homo Sapiens
AEDQPAGGE

SEQ ID NO: 1189738 - protein, 9 aa, Homo Sapiens
STARSTWPR

SEQ ID NO: 1189739 - protein, 9 aa, Homo Sapiens
SAPVPRGPD

SEQ ID NO: 1189740 - protein, 9 aa, Homo Sapiens
GKRVNLECM

SEQ ID NO: 1189741 - protein, 9 aa, Homo Sapiens
PGHDFRGEI

SEQ ID NO: 1189742 - protein, 9 aa, Homo Sapiens
QNRTPPRRR

SEQ ID NO: 1189743 - protein, 9 aa, Homo Sapiens
PAPGGYGSA

SEQ ID NO: 1189744 - protein, 9 aa, Homo Sapiens
SVIKVTRNL

SEQ ID NO: 1189745 - protein, 9 aa, Homo Sapiens
MELIMRHGG

SEQ ID NO: 1189746 - protein, 9 aa, Homo Sapiens
AYGIYCCWE

SEQ ID NO: 1189747 - protein, 9 aa, Homo Sapiens
YFPTISLSF

SEQ ID NO: 1189748 - protein, 9 aa, Homo Sapiens
RTSWKMWST

SEQ ID NO: 1189749 - protein, 9 aa, Homo Sapiens
SGATGTDAD

SEQ ID NO: 1189750 - protein, 9 aa, Homo Sapiens
LGPVADLWA

SEQ ID NO: 1189751 - protein, 9 aa, Homo Sapiens
YIDALHKLF

SEQ ID NO: 1189752 - protein, 9 aa, Homo Sapiens
SPAPTARAS

SEQ ID NO: 1189753 - protein, 9 aa, Homo Sapiens
CSTETTTGR

SEQ ID NO: 1189754 - protein, 9 aa, Homo Sapiens
PHQCLRCQH

SEQ ID NO: 1189755 - protein, 9 aa, Homo Sapiens
RSSSSPQPA

SEQ ID NO: 1189756 - protein, 9 aa, Homo Sapiens
RLDNLQLVL

SEQ ID NO: 1189757 - protein, 9 aa, Homo Sapiens
RLKGCKNKQ

SEQ ID NO: 1189758 - protein, 9 aa, Homo Sapiens
YQASSIPPT

SEQ ID NO: 1189759 - protein, 9 aa, Homo Sapiens
SLMMTQISK

SEQ ID NO: 1189760 - protein, 9 aa, Homo Sapiens
QDQVAQSPK

SEQ ID NO: 1189761 - protein, 9 aa, Homo Sapiens
AIILRHTIH

SEQ ID NO: 1189762 - protein, 9 aa, Homo Sapiens
CLWSPSLLA

SEQ ID NO: 1189763 - protein, 9 aa, Homo Sapiens
APAEATSWS

SEQ ID NO: 1189764 - protein, 9 aa, Homo Sapiens
CMVTAATFC

SEQ ID NO: 1189765 - protein, 9 aa, Homo Sapiens
AQGRLIVSW

SEQ ID NO: 1189766 - protein, 9 aa, Homo Sapiens
CPRSHPRLP

SEQ ID NO: 1189767 - protein, 9 aa, Homo Sapiens
RDGGWGWRS

SEQ ID NO: 1189768 - protein, 9 aa, Homo Sapiens
AVTVAVGCR

SEQ ID NO: 1189769 - protein, 9 aa, Homo Sapiens
RGGGGSRRG

SEQ ID NO: 1189770 - protein, 9 aa, Homo Sapiens
SSCSSYSYV

SEQ ID NO: 1189771 - protein, 9 aa, Homo Sapiens
SHRLRLRLP

SEQ ID NO: 1189772 - protein, 9 aa, Homo Sapiens
PVHRPPDAD

SEQ ID NO: 1189773 - protein, 9 aa, Homo Sapiens
PREGPNKGA

SEQ ID NO: 1189774 - protein, 9 aa, Homo Sapiens
MGGAWPRPL

SEQ ID NO: 1189775 - protein, 9 aa, Homo Sapiens
AKRARSCPR

SEQ ID NO: 1189776 - protein, 9 aa, Homo Sapiens
CSALPFDGS

SEQ ID NO: 1189777 - protein, 9 aa, Homo Sapiens
APKMCAPVG

SEQ ID NO: 1189778 - protein, 9 aa, Homo Sapiens
AGRRRRRSG

SEQ ID NO: 1189779 - protein, 9 aa, Homo Sapiens
ESWQMKTIH

SEQ ID NO: 1189780 - protein, 9 aa, Homo Sapiens
VPCSMRTGT

SEQ ID NO: 1189781 - protein, 9 aa, Homo Sapiens
SSGDSCVSA

SEQ ID NO: 1189782 - protein, 9 aa, Homo Sapiens
QLRASLTGP

SEQ ID NO: 1189783 - protein, 9 aa, Homo Sapiens
TWTEMQRML

SEQ ID NO: 1189784 - protein, 9 aa, Homo Sapiens
TWSRSSFTS

SEQ ID NO: 1189785 - protein, 9 aa, Homo Sapiens
SGSAVGRGP

SEQ ID NO: 1189786 - protein, 9 aa, Homo Sapiens
HAHAGAIAD

SEQ ID NO: 1189787 - protein, 9 aa, Homo Sapiens
PPTLLMGMC

SEQ ID NO: 1189788 - protein, 9 aa, Homo Sapiens
DEVVAVGDH

SEQ ID NO: 1189789 - protein, 9 aa, Homo Sapiens
SSAGTQAAE

SEQ ID NO: 1189790 - protein, 9 aa, Homo Sapiens
RGCGCLVLE

SEQ ID NO: 1189791 - protein, 9 aa, Homo Sapiens
RGTARSWTP

SEQ ID NO: 1189792 - protein, 9 aa, Homo Sapiens
VVSLVSTAA

SEQ ID NO: 1189793 - protein, 9 aa, Homo Sapiens
QLHQRVHAR

SEQ ID NO: 1189794 - protein, 9 aa, Homo Sapiens
PGATRATPG

SEQ ID NO: 1189795 - protein, 9 aa, Homo Sapiens
AYLVPGPLA

SEQ ID NO: 1189796 - protein, 9 aa, Homo Sapiens
SCSGLVRDC

SEQ ID NO: 1189797 - protein, 9 aa, Homo Sapiens
PPTKNGGLS

SEQ ID NO: 1189798 - protein, 9 aa, Homo Sapiens
SLSNHNSKF

SEQ ID NO: 1189799 - protein, 9 aa, Homo Sapiens
AVFLLSHEA

SEQ ID NO: 1189800 - protein, 9 aa, Homo Sapiens
RKRKGKGEK

SEQ ID NO: 1189801 - protein, 9 aa, Homo Sapiens
VSTEIFPAL

SEQ ID NO: 1189802 - protein, 9 aa, Homo Sapiens
TLHITVLRD

SEQ ID NO: 1189803 - protein, 9 aa, Homo Sapiens
NPQPQSLGL

SEQ ID NO: 1189804 - protein, 9 aa, Homo Sapiens
LLLPPPPPC

SEQ ID NO: 1189805 - protein, 9 aa, Homo Sapiens
LKTSCFKLD

SEQ ID NO: 1189806 - protein, 9 aa, Homo Sapiens
RCCSLTQGP

SEQ ID NO: 1189807 - protein, 9 aa, Homo Sapiens
SQPLAQLQY

SEQ ID NO: 1189808 - protein, 9 aa, Homo Sapiens
VGPRCSFCW

SEQ ID NO: 1189809 - protein, 9 aa, Homo Sapiens
QTVIAVEAP

SEQ ID NO: 1189810 - protein, 9 aa, Homo Sapiens
SHVGAADGL

SEQ ID NO: 1189811 - protein, 9 aa, Homo Sapiens
RDLDARAKR

SEQ ID NO: 1189812 - protein, 9 aa, Homo Sapiens
RTSRGQAQD

SEQ ID NO: 1189813 - protein, 9 aa, Homo Sapiens
INGCGSSCQ

SEQ ID NO: 1189814 - protein, 9 aa, Homo Sapiens
TKWPLQCLL

SEQ ID NO: 1189815 - protein, 9 aa, Homo Sapiens
SGLNRGFTY

SEQ ID NO: 1189816 - protein, 9 aa, Homo Sapiens
NGPPTWPTQ

SEQ ID NO: 1189817 - protein, 9 aa, Homo Sapiens
KTCLWVFLW

SEQ ID NO: 1189818 - protein, 9 aa, Homo Sapiens
LWEQKKLRE

SEQ ID NO: 1189819 - protein, 9 aa, Homo Sapiens
ANLQQSHLM

SEQ ID NO: 1189820 - protein, 9 aa, Homo Sapiens
RAVLSAIVI

SEQ ID NO: 1189821 - protein, 9 aa, Homo Sapiens
HKGTTTADH

SEQ ID NO: 1189822 - protein, 9 aa, Homo Sapiens
CPTARGRPA

SEQ ID NO: 1189823 - protein, 9 aa, Homo Sapiens
VLLWIIEVG

SEQ ID NO: 1189824 - protein, 9 aa, Homo Sapiens
GGGNPCTKA

SEQ ID NO: 1189825 - protein, 9 aa, Homo Sapiens
ISALAMHKR

SEQ ID NO: 1189826 - protein, 9 aa, Homo Sapiens
AWSPRAVAA

SEQ ID NO: 1189827 - protein, 9 aa, Homo Sapiens
EAPLRGYGL

SEQ ID NO: 1189828 - protein, 9 aa, Homo Sapiens
TNDDNNEYD

SEQ ID NO: 1189829 - protein, 9 aa, Homo Sapiens
NSLQLKIRL

SEQ ID NO: 1189830 - protein, 9 aa, Homo Sapiens
TGGSRSAIP

SEQ ID NO: 1189831 - protein, 9 aa, Homo Sapiens
QPHSPVRLG

SEQ ID NO: 1189832 - protein, 9 aa, Homo Sapiens
TFLPAPSPA

SEQ ID NO: 1189833 - protein, 9 aa, Homo Sapiens
EMHVPTAAD

SEQ ID NO: 1189834 - protein, 9 aa, Homo Sapiens
GLSGLMTTF

SEQ ID NO: 1189835 - protein, 9 aa, Homo Sapiens
PSTPDIGKQ

SEQ ID NO: 1189836 - protein, 9 aa, Homo Sapiens
IPPPRLLAP

SEQ ID NO: 1189837 - protein, 9 aa, Homo Sapiens
VPSLFEFQG

SEQ ID NO: 1189838 - protein, 9 aa, Homo Sapiens
GAGLVENLQ

SEQ ID NO: 1189839 - protein, 9 aa, Homo Sapiens
EERVVEGAG

SEQ ID NO: 1189840 - protein, 9 aa, Homo Sapiens
RYQTMKVRS

SEQ ID NO: 1189841 - protein, 9 aa, Homo Sapiens
MSQTQQILP

SEQ ID NO: 1189842 - protein, 9 aa, Homo Sapiens
SAPAPTAAA

SEQ ID NO: 1189843 - protein, 9 aa, Homo Sapiens
PKYRDRKVH

SEQ ID NO: 1189844 - protein, 9 aa, Homo Sapiens
LQLFIHCPM

SEQ ID NO: 1189845 - protein, 9 aa, Homo Sapiens
TPEHVSFCA

SEQ ID NO: 1189846 - protein, 9 aa, Homo Sapiens
SVFLLNHPS

SEQ ID NO: 1189847 - protein, 9 aa, Homo Sapiens
ELRWMLRSR

SEQ ID NO: 1189848 - protein, 9 aa, Homo Sapiens
EIYHLYHHP

SEQ ID NO: 1189849 - protein, 9 aa, Homo Sapiens
TCSQTRPLW

SEQ ID NO: 1189850 - protein, 9 aa, Homo Sapiens
EVLQDLSIS

SEQ ID NO: 1189851 - protein, 9 aa, Homo Sapiens
WNNVGLLGA

SEQ ID NO: 1189852 - protein, 9 aa, Homo Sapiens
KFKSIQLSY

SEQ ID NO: 1189853 - protein, 9 aa, Homo Sapiens
SARPPPRWP

SEQ ID NO: 1189854 - protein, 9 aa, Homo Sapiens
GVIRLYMSR

SEQ ID NO: 1189855 - protein, 9 aa, Homo Sapiens
SAGVMSVCL

SEQ ID NO: 1189856 - protein, 9 aa, Homo Sapiens
KCRICGDKA

SEQ ID NO: 1189857 - protein, 9 aa, Homo Sapiens
RTPGLQPPA

SEQ ID NO: 1189858 - protein, 9 aa, Homo Sapiens
QEERKPATQ

SEQ ID NO: 1189859 - protein, 9 aa, Homo Sapiens
CLAPARVVI

SEQ ID NO: 1189860 - protein, 9 aa, Homo Sapiens
VYYAVEMLY

SEQ ID NO: 1189861 - protein, 9 aa, Homo Sapiens
PPYYPGIGN

SEQ ID NO: 1189862 - protein, 9 aa, Homo Sapiens
GPPQGPWLH

SEQ ID NO: 1189863 - protein, 9 aa, Homo Sapiens
EVVGPLGEA

SEQ ID NO: 1189864 - protein, 9 aa, Homo Sapiens
LGICALRLV

SEQ ID NO: 1189865 - protein, 9 aa, Homo Sapiens
RVDGNFLEA

SEQ ID NO: 1189866 - protein, 9 aa, Homo Sapiens
LTLANASSL

SEQ ID NO: 1189867 - protein, 9 aa, Homo Sapiens
SALHRARPP

SEQ ID NO: 1189868 - protein, 9 aa, Homo Sapiens
HLRTHTGEH

SEQ ID NO: 1189869 - protein, 9 aa, Homo Sapiens
DSRFQLEGA

SEQ ID NO: 1189870 - protein, 9 aa, Homo Sapiens
AQLLRAVSL

SEQ ID NO: 1189871 - protein, 9 aa, Homo Sapiens
PGQHLWLSH

SEQ ID NO: 1189872 - protein, 9 aa, Homo Sapiens
RQLRRRPPR

SEQ ID NO: 1189873 - protein, 9 aa, Homo Sapiens
LLDFKEFDL

SEQ ID NO: 1189874 - protein, 9 aa, Homo Sapiens
VWMVLGLMS

SEQ ID NO: 1189875 - protein, 9 aa, Homo Sapiens
TWMTCTSLS

SEQ ID NO: 1189876 - protein, 9 aa, Homo Sapiens
AGRQGASLA

SEQ ID NO: 1189877 - protein, 9 aa, Homo Sapiens
VGINNQKRF

SEQ ID NO: 1189878 - protein, 9 aa, Homo Sapiens
PAQPPGPAP

SEQ ID NO: 1189879 - protein, 9 aa, Homo Sapiens
LPRASLRAT

SEQ ID NO: 1189880 - protein, 9 aa, Homo Sapiens
PSSWPGHMS

SEQ ID NO: 1189881 - protein, 9 aa, Homo Sapiens
PTTSLKGSR

SEQ ID NO: 1189882 - protein, 9 aa, Homo Sapiens
DSHVFLHHA

SEQ ID NO: 1189883 - protein, 9 aa, Homo Sapiens
PLAGWARDG

SEQ ID NO: 1189884 - protein, 9 aa, Homo Sapiens
VLCHVTGSA

SEQ ID NO: 1189885 - protein, 9 aa, Homo Sapiens
SAPTWGCLC

SEQ ID NO: 1189886 - protein, 9 aa, Homo Sapiens
DSNSSSSPL

SEQ ID NO: 1189887 - protein, 9 aa, Homo Sapiens
VFLRGFISI

SEQ ID NO: 1189888 - protein, 9 aa, Homo Sapiens
RICAFLLWK

SEQ ID NO: 1189889 - protein, 9 aa, Homo Sapiens
CDLYFEHGD

SEQ ID NO: 1189890 - protein, 9 aa, Homo Sapiens
REAPIDKRG

SEQ ID NO: 1189891 - protein, 9 aa, Homo Sapiens
QKHHSAEHK

SEQ ID NO: 1189892 - protein, 9 aa, Homo Sapiens
GRITRLEIL

SEQ ID NO: 1189893 - protein, 9 aa, Homo Sapiens
VSAFARTLR

SEQ ID NO: 1189894 - protein, 9 aa, Homo Sapiens
DGQAALVDA

SEQ ID NO: 1189895 - protein, 9 aa, Homo Sapiens
TTTNTTTVA

SEQ ID NO: 1189896 - protein, 9 aa, Homo Sapiens
CVASINLST

SEQ ID NO: 1189897 - protein, 9 aa, Homo Sapiens
SLLVTVGNV

SEQ ID NO: 1189898 - protein, 9 aa, Homo Sapiens
KPRLKSEGG

SEQ ID NO: 1189899 - protein, 9 aa, Homo Sapiens
VDRGEAAPS

SEQ ID NO: 1189900 - protein, 9 aa, Homo Sapiens
RDFNLLHVS

SEQ ID NO: 1189901 - protein, 9 aa, Homo Sapiens
CPALPAGHR

SEQ ID NO: 1189902 - protein, 9 aa, Homo Sapiens
LALPGAELQ

SEQ ID NO: 1189903 - protein, 9 aa, Homo Sapiens
LRASLTGPP

SEQ ID NO: 1189904 - protein, 9 aa, Homo Sapiens
LGGIASRLG

SEQ ID NO: 1189905 - protein, 9 aa, Homo Sapiens
KWREEQMEC

SEQ ID NO: 1189906 - protein, 9 aa, Homo Sapiens
QEDLRIRVA

SEQ ID NO: 1189907 - protein, 9 aa, Homo Sapiens
GRLDALHGP

SEQ ID NO: 1189908 - protein, 9 aa, Homo Sapiens
SVCLFMKRY

SEQ ID NO: 1189909 - protein, 9 aa, Homo Sapiens
HSQVLCHVT

SEQ ID NO: 1189910 - protein, 9 aa, Homo Sapiens
RPRTSHISA

SEQ ID NO: 1189911 - protein, 9 aa, Homo Sapiens
PGAPGPCLA

SEQ ID NO: 1189912 - protein, 9 aa, Homo Sapiens
FPGKNTWRK

SEQ ID NO: 1189913 - protein, 9 aa, Homo Sapiens
PAWPAVLPP

SEQ ID NO: 1189914 - protein, 9 aa, Homo Sapiens
EVKTCLWVF

SEQ ID NO: 1189915 - protein, 9 aa, Homo Sapiens
PAQEIVFLA

SEQ ID NO: 1189916 - protein, 9 aa, Homo Sapiens
LSMMAALTF

SEQ ID NO: 1189917 - protein, 9 aa, Homo Sapiens
AYFPTISLS

SEQ ID NO: 1189918 - protein, 9 aa, Homo Sapiens
LWLALWALG

SEQ ID NO: 1189919 - protein, 9 aa, Homo Sapiens
NTDKNGDEL

SEQ ID NO: 1189920 - protein, 9 aa, Homo Sapiens
MGEVEAPSF

SEQ ID NO: 1189921 - protein, 9 aa, Homo Sapiens
LLQDRFPLL

SEQ ID NO: 1189922 - protein, 9 aa, Homo Sapiens
GEADSGRPR

SEQ ID NO: 1189923 - protein, 9 aa, Homo Sapiens
DSWRTKEML

SEQ ID NO: 1189924 - protein, 9 aa, Homo Sapiens
PSGSGVWTT

SEQ ID NO: 1189925 - protein, 9 aa, Homo Sapiens
SSMSEDNSP

SEQ ID NO: 1189926 - protein, 9 aa, Homo Sapiens
RLLGLGAAA

SEQ ID NO: 1189927 - protein, 9 aa, Homo Sapiens
VIVVASELG

SEQ ID NO: 1189928 - protein, 9 aa, Homo Sapiens
VFIFSSSIQ

SEQ ID NO: 1189929 - protein, 9 aa, Homo Sapiens
LGGGYVSER

SEQ ID NO: 1189930 - protein, 9 aa, Homo Sapiens
RAKFRCNLL

SEQ ID NO: 1189931 - protein, 9 aa, Homo Sapiens
ALEFYYHEH

SEQ ID NO: 1189932 - protein, 9 aa, Homo Sapiens
PHRSPPTSC

SEQ ID NO: 1189933 - protein, 9 aa, Homo Sapiens
LENEGLVWV

SEQ ID NO: 1189934 - protein, 9 aa, Homo Sapiens
KHNGESRHA

SEQ ID NO: 1189935 - protein, 9 aa, Homo Sapiens
AVLGVAISE

SEQ ID NO: 1189936 - protein, 9 aa, Homo Sapiens
HILNWVLPP

SEQ ID NO: 1189937 - protein, 9 aa, Homo Sapiens
SLFEFQGPS

SEQ ID NO: 1189938 - protein, 9 aa, Homo Sapiens
KAQVKTEAA

SEQ ID NO: 1189939 - protein, 9 aa, Homo Sapiens
PMMRNSTTC

SEQ ID NO: 1189940 - protein, 9 aa, Homo Sapiens
RDSYTRIIQ

SEQ ID NO: 1189941 - protein, 9 aa, Homo Sapiens
SPPHRAAPA

SEQ ID NO: 1189942 - protein, 9 aa, Homo Sapiens
ELPPGRAWA

SEQ ID NO: 1189943 - protein, 9 aa, Homo Sapiens
AEAAAVVMV

SEQ ID NO: 1189944 - protein, 9 aa, Homo Sapiens
ALTPEHVSF

SEQ ID NO: 1189945 - protein, 9 aa, Homo Sapiens
VLRRVCHAN

SEQ ID NO: 1189946 - protein, 9 aa, Homo Sapiens
DKRGISITS

SEQ ID NO: 1189947 - protein, 9 aa, Homo Sapiens
VFQHPEIVV

SEQ ID NO: 1189948 - protein, 9 aa, Homo Sapiens
YMQETRSQL

SEQ ID NO: 1189949 - protein, 9 aa, Homo Sapiens
ISPKKPKTF

SEQ ID NO: 1189950 - protein, 9 aa, Homo Sapiens
SGLKNIPGI

SEQ ID NO: 1189951 - protein, 9 aa, Homo Sapiens
GHVEVREAH

SEQ ID NO: 1189952 - protein, 9 aa, Homo Sapiens
RSRLSHKEL

SEQ ID NO: 1189953 - protein, 9 aa, Homo Sapiens
ARGRPASGG

SEQ ID NO: 1189954 - protein, 9 aa, Homo Sapiens
HTMDFLKCV

SEQ ID NO: 1189955 - protein, 9 aa, Homo Sapiens
ITFLTQRQD

SEQ ID NO: 1189956 - protein, 9 aa, Homo Sapiens
NGIVFDLLN

SEQ ID NO: 1189957 - protein, 9 aa, Homo Sapiens
PLPLPRRPR

SEQ ID NO: 1189958 - protein, 9 aa, Homo Sapiens
LRAGRQMGQ

SEQ ID NO: 1189959 - protein, 9 aa, Homo Sapiens
QGESSGLNL

SEQ ID NO: 1189960 - protein, 9 aa, Homo Sapiens
LLLLVVLAA

SEQ ID NO: 1189961 - protein, 9 aa, Homo Sapiens
PHFSILPMS

SEQ ID NO: 1189962 - protein, 9 aa, Homo Sapiens
PFSKMGNLR

SEQ ID NO: 1189963 - protein, 9 aa, Homo Sapiens
RLRTLLLAL

SEQ ID NO: 1189964 - protein, 9 aa, Homo Sapiens
TWTGGTLSH

SEQ ID NO: 1189965 - protein, 9 aa, Homo Sapiens
LLFLGSNQL

SEQ ID NO: 1189966 - protein, 9 aa, Homo Sapiens
VDGPVETDG

SEQ ID NO: 1189967 - protein, 9 aa, Homo Sapiens
LSRHQDAEW

SEQ ID NO: 1189968 - protein, 9 aa, Homo Sapiens
VEQAVYCCK

SEQ ID NO: 1189969 - protein, 9 aa, Homo Sapiens
VKNLTDELS

SEQ ID NO: 1189970 - protein, 9 aa, Homo Sapiens
RLRDHLPQE

SEQ ID NO: 1189971 - protein, 9 aa, Homo Sapiens
CGNAFSYNS

SEQ ID NO: 1189972 - protein, 9 aa, Homo Sapiens
RSSRQPRLP

SEQ ID NO: 1189973 - protein, 9 aa, Homo Sapiens
NEYDAYLSY

SEQ ID NO: 1189974 - protein, 9 aa, Homo Sapiens
SRSLLIPPP

SEQ ID NO: 1189975 - protein, 9 aa, Homo Sapiens
EIHHSWTSG

SEQ ID NO: 1189976 - protein, 9 aa, Homo Sapiens
GGSRPGWKR

SEQ ID NO: 1189977 - protein, 9 aa, Homo Sapiens
CWGWQQSWE

SEQ ID NO: 1189978 - protein, 9 aa, Homo Sapiens
CPIPPTKNG

SEQ ID NO: 1189979 - protein, 9 aa, Homo Sapiens
VVELEPWLD

SEQ ID NO: 1189980 - protein, 9 aa, Homo Sapiens
DAEWQHSPN

SEQ ID NO: 1189981 - protein, 9 aa, Homo Sapiens
RTRSPHPGP

SEQ ID NO: 1189982 - protein, 9 aa, Homo Sapiens
SHGSNAVGR

SEQ ID NO: 1189983 - protein, 9 aa, Homo Sapiens
QEEVAVGRL

SEQ ID NO: 1189984 - protein, 9 aa, Homo Sapiens
CSLSAPAEA

SEQ ID NO: 1189985 - protein, 9 aa, Homo Sapiens
KSKKGTMKT

SEQ ID NO: 1189986 - protein, 9 aa, Homo Sapiens
LARQHQALE

SEQ ID NO: 1189987 - protein, 9 aa, Homo Sapiens
VNRALHSAV

SEQ ID NO: 1189988 - protein, 9 aa, Homo Sapiens
QTKCKKNLL

SEQ ID NO: 1189989 - protein, 9 aa, Homo Sapiens
SSTATVGLE

SEQ ID NO: 1189990 - protein, 9 aa, Homo Sapiens
AQRRPIRVL

SEQ ID NO: 1189991 - protein, 9 aa, Homo Sapiens
SCSSYSYVE

SEQ ID NO: 1189992 - protein, 9 aa, Homo Sapiens
VADLWADVD

SEQ ID NO: 1189993 - protein, 9 aa, Homo Sapiens
ASFVPRDVV

SEQ ID NO: 1189994 - protein, 9 aa, Homo Sapiens
QDLSISRRQ

SEQ ID NO: 1189995 - protein, 9 aa, Homo Sapiens
FLRYKTAGD

SEQ ID NO: 1189996 - protein, 9 aa, Homo Sapiens
FTTVIPSNV

SEQ ID NO: 1189997 - protein, 9 aa, Homo Sapiens
HEVKLEIPS

SEQ ID NO: 1189998 - protein, 9 aa, Homo Sapiens
TPAPPPCRP

SEQ ID NO: 1189999 - protein, 9 aa, Homo Sapiens
EDIWGQSDI

SEQ ID NO: 1190000 - protein, 9 aa, Homo Sapiens
TADALDDGN

SEQ ID NO: 1190001 - protein, 9 aa, Homo Sapiens
EHTLPILTT

SEQ ID NO: 1190002 - protein, 9 aa, Homo Sapiens
FRCNLLRQE

SEQ ID NO: 1190003 - protein, 9 aa, Homo Sapiens
QQLLELSSL

SEQ ID NO: 1190004 - protein, 9 aa, Homo Sapiens
PTCHNSKDT

SEQ ID NO: 1190005 - protein, 9 aa, Homo Sapiens
APGGYGSAR

SEQ ID NO: 1190006 - protein, 9 aa, Homo Sapiens
GAADTEPGP

SEQ ID NO: 1190007 - protein, 9 aa, Homo Sapiens
AQKFPLGSY

SEQ ID NO: 1190008 - protein, 9 aa, Homo Sapiens
KNMKKKRIL

SEQ ID NO: 1190009 - protein, 9 aa, Homo Sapiens
CLLILLIIW

SEQ ID NO: 1190010 - protein, 9 aa, Homo Sapiens
RKCSLMRRV

SEQ ID NO: 1190011 - protein, 9 aa, Homo Sapiens
ARSLASPRA

SEQ ID NO: 1190012 - protein, 9 aa, Homo Sapiens
LLLAWAPDA

SEQ ID NO: 1190013 - protein, 9 aa, Homo Sapiens
WVLKCRNSR

SEQ ID NO: 1190014 - protein, 9 aa, Homo Sapiens
GTPKPSKPG

SEQ ID NO: 1190015 - protein, 9 aa, Homo Sapiens
KGSRRCTKR

SEQ ID NO: 1190016 - protein, 9 aa, Homo Sapiens
PLHTQSLVG

SEQ ID NO: 1190017 - protein, 9 aa, Homo Sapiens
ELGCGGGAG

SEQ ID NO: 1190018 - protein, 9 aa, Homo Sapiens
HRYLFPAAA

SEQ ID NO: 1190019 - protein, 9 aa, Homo Sapiens
PGPPPCRPR

SEQ ID NO: 1190020 - protein, 9 aa, Homo Sapiens
DTTHPRSRL

SEQ ID NO: 1190021 - protein, 9 aa, Homo Sapiens
ARQHQALEE

SEQ ID NO: 1190022 - protein, 9 aa, Homo Sapiens
VEVAWCEVQ

SEQ ID NO: 1190023 - protein, 9 aa, Homo Sapiens
EAKVSTPPS

SEQ ID NO: 1190024 - protein, 9 aa, Homo Sapiens
PLRTVALAN

SEQ ID NO: 1190025 - protein, 9 aa, Homo Sapiens
PLAEDHPRI

SEQ ID NO: 1190026 - protein, 9 aa, Homo Sapiens
RSAGLGPTP

SEQ ID NO: 1190027 - protein, 9 aa, Homo Sapiens
FPALSRNKY

SEQ ID NO: 1190028 - protein, 9 aa, Homo Sapiens
LPSTGPTPC

SEQ ID NO: 1190029 - protein, 9 aa, Homo Sapiens
RPGRGGRPR

SEQ ID NO: 1190030 - protein, 9 aa, Homo Sapiens
PGEARAPLE

SEQ ID NO: 1190031 - protein, 9 aa, Homo Sapiens
TSSQEKLKP

SEQ ID NO: 1190032 - protein, 9 aa, Homo Sapiens
YVDDGKGIR

SEQ ID NO: 1190033 - protein, 9 aa, Homo Sapiens
SPTVEYNDG

SEQ ID NO: 1190034 - protein, 9 aa, Homo Sapiens
RAASVGHCS

SEQ ID NO: 1190035 - protein, 9 aa, Homo Sapiens
TLIHTNMYV

SEQ ID NO: 1190036 - protein, 9 aa, Homo Sapiens
GGIASRLGM

SEQ ID NO: 1190037 - protein, 9 aa, Homo Sapiens
RAQGGEPQQ

SEQ ID NO: 1190038 - protein, 9 aa, Homo Sapiens
GTAEATTRL

SEQ ID NO: 1190039 - protein, 9 aa, Homo Sapiens
RQWCTTSAP

SEQ ID NO: 1190040 - protein, 9 aa, Homo Sapiens
VSTSRKRTG

SEQ ID NO: 1190041 - protein, 9 aa, Homo Sapiens
GVPLAGWAR

SEQ ID NO: 1190042 - protein, 9 aa, Homo Sapiens
SGLPARRGA

SEQ ID NO: 1190043 - protein, 9 aa, Homo Sapiens
TDRFTPLTT

SEQ ID NO: 1190044 - protein, 9 aa, Homo Sapiens
HLQEECAES

SEQ ID NO: 1190045 - protein, 9 aa, Homo Sapiens
TQSLLLEVI

SEQ ID NO: 1190046 - protein, 9 aa, Homo Sapiens
CTLTWSRSS

SEQ ID NO: 1190047 - protein, 9 aa, Homo Sapiens
AGQEAMTLG

SEQ ID NO: 1190048 - protein, 9 aa, Homo Sapiens
PGQALDRAL

SEQ ID NO: 1190049 - protein, 9 aa, Homo Sapiens
AEKNFVKRR

SEQ ID NO: 1190050 - protein, 9 aa, Homo Sapiens
KELLTCSHP

SEQ ID NO: 1190051 - protein, 9 aa, Homo Sapiens
ALQDLAPPA

SEQ ID NO: 1190052 - protein, 9 aa, Homo Sapiens
REKQQVPRP

SEQ ID NO: 1190053 - protein, 9 aa, Homo Sapiens
CDGGNGPER

SEQ ID NO: 1190054 - protein, 9 aa, Homo Sapiens
QQCLVCVPV

SEQ ID NO: 1190055 - protein, 9 aa, Homo Sapiens
GSCPRSAWK

SEQ ID NO: 1190056 - protein, 9 aa, Homo Sapiens
LVRCGQLLA

SEQ ID NO: 1190057 - protein, 9 aa, Homo Sapiens
TSSQYSSGL

SEQ ID NO: 1190058 - protein, 9 aa, Homo Sapiens
PPTSSCMTP

SEQ ID NO: 1190059 - protein, 9 aa, Homo Sapiens
SCSVRHAHL

SEQ ID NO: 1190060 - protein, 9 aa, Homo Sapiens
WMRGLLEVR

SEQ ID NO: 1190061 - protein, 9 aa, Homo Sapiens
APLLKLARD

SEQ ID NO: 1190062 - protein, 9 aa, Homo Sapiens
GTPHSHIKP

SEQ ID NO: 1190063 - protein, 9 aa, Homo Sapiens
QPHALVAHR

SEQ ID NO: 1190064 - protein, 9 aa, Homo Sapiens
QAGTGGTPR

SEQ ID NO: 1190065 - protein, 9 aa, Homo Sapiens
GLHSARDVH

SEQ ID NO: 1190066 - protein, 9 aa, Homo Sapiens
AAAVVMVVR

SEQ ID NO: 1190067 - protein, 9 aa, Homo Sapiens
GTTTAAGTG

SEQ ID NO: 1190068 - protein, 9 aa, Homo Sapiens
TGYSGSVIR

SEQ ID NO: 1190069 - protein, 9 aa, Homo Sapiens
ITEELFLLV

SEQ ID NO: 1190070 - protein, 9 aa, Homo Sapiens
YETQMPLQQ

SEQ ID NO: 1190071 - protein, 9 aa, Homo Sapiens
LRPVAHHLP

SEQ ID NO: 1190072 - protein, 9 aa, Homo Sapiens
IPKTWRRSL

SEQ ID NO: 1190073 - protein, 9 aa, Homo Sapiens
EHYHRLRRY

SEQ ID NO: 1190074 - protein, 9 aa, Homo Sapiens
FQHPCNTLK

SEQ ID NO: 1190075 - protein, 9 aa, Homo Sapiens
PGAQQPGHI

SEQ ID NO: 1190076 - protein, 9 aa, Homo Sapiens
VPSNENCHK

SEQ ID NO: 1190077 - protein, 9 aa, Homo Sapiens
QFALVSLHI

SEQ ID NO: 1190078 - protein, 9 aa, Homo Sapiens
PWNGTTMMA

SEQ ID NO: 1190079 - protein, 9 aa, Homo Sapiens
RRPPREARK

SEQ ID NO: 1190080 - protein, 9 aa, Homo Sapiens
LLASIFNSS

SEQ ID NO: 1190081 - protein, 9 aa, Homo Sapiens
HDADEREKW

SEQ ID NO: 1190082 - protein, 9 aa, Homo Sapiens
MGVDSTAAA

SEQ ID NO: 1190083 - protein, 9 aa, Homo Sapiens
GGYVSERTV

SEQ ID NO: 1190084 - protein, 9 aa, Homo Sapiens
PEHFIGNML

SEQ ID NO: 1190085 - protein, 9 aa, Homo Sapiens
SLIPITNAA

SEQ ID NO: 1190086 - protein, 9 aa, Homo Sapiens
CACICVCAC

SEQ ID NO: 1190087 - protein, 9 aa, Homo Sapiens
DPDLDPDPS

SEQ ID NO: 1190088 - protein, 9 aa, Homo Sapiens
HWAVRRGLA

SEQ ID NO: 1190089 - protein, 9 aa, Homo Sapiens
RGRPRAGTR

SEQ ID NO: 1190090 - protein, 9 aa, Homo Sapiens
GWSPVLDTC

SEQ ID NO: 1190091 - protein, 9 aa, Homo Sapiens
AQGLDFGEF

SEQ ID NO: 1190092 - protein, 9 aa, Homo Sapiens
STADALDDG

SEQ ID NO: 1190093 - protein, 9 aa, Homo Sapiens
LRSRCPKST

SEQ ID NO: 1190094 - protein, 9 aa, Homo Sapiens
SEHTLPILT

SEQ ID NO: 1190095 - protein, 9 aa, Homo Sapiens
HQALEEEIR

SEQ ID NO: 1190096 - protein, 9 aa, Homo Sapiens
LWSPSLLAQ

SEQ ID NO: 1190097 - protein, 9 aa, Homo Sapiens
TWTLYSSAS

SEQ ID NO: 1190098 - protein, 9 aa, Homo Sapiens
SPLAPCPPL

SEQ ID NO: 1190099 - protein, 9 aa, Homo Sapiens
LDDGNTFKI

SEQ ID NO: 1190100 - protein, 9 aa, Homo Sapiens
PGPDSSGSR

SEQ ID NO: 1190101 - protein, 9 aa, Homo Sapiens
RTEASRSES

SEQ ID NO: 1190102 - protein, 9 aa, Homo Sapiens
PQLRKWLKR

SEQ ID NO: 1190103 - protein, 9 aa, Homo Sapiens
SEREHSLDH

SEQ ID NO: 1190104 - protein, 9 aa, Homo Sapiens
NPPTFPCSS

SEQ ID NO: 1190105 - protein, 9 aa, Homo Sapiens
APRASRSRR

SEQ ID NO: 1190106 - protein, 9 aa, Homo Sapiens
LLAVPLLKK

SEQ ID NO: 1190107 - protein, 9 aa, Homo Sapiens
GLLRTHRPR

SEQ ID NO: 1190108 - protein, 9 aa, Homo Sapiens
GLGTECLVH

SEQ ID NO: 1190109 - protein, 9 aa, Homo Sapiens
RAKCLLHPL

SEQ ID NO: 1190110 - protein, 9 aa, Homo Sapiens
WPVQPHPKG

SEQ ID NO: 1190111 - protein, 9 aa, Homo Sapiens
VCRVDERPV

SEQ ID NO: 1190112 - protein, 9 aa, Homo Sapiens
GAGAAARSW

SEQ ID NO: 1190113 - protein, 9 aa, Homo Sapiens
WKKRISKMF

SEQ ID NO: 1190114 - protein, 9 aa, Homo Sapiens
APCALKCRA

SEQ ID NO: 1190115 - protein, 9 aa, Homo Sapiens
LVTVMAEKN

SEQ ID NO: 1190116 - protein, 9 aa, Homo Sapiens
VCPETMMLS

SEQ ID NO: 1190117 - protein, 9 aa, Homo Sapiens
PQAKAVAWS

SEQ ID NO: 1190118 - protein, 9 aa, Homo Sapiens
EHEFDCKLH

SEQ ID NO: 1190119 - protein, 9 aa, Homo Sapiens
PGATTVAGP

SEQ ID NO: 1190120 - protein, 9 aa, Homo Sapiens
RRCLTAEDL

SEQ ID NO: 1190121 - protein, 9 aa, Homo Sapiens
QYPSLIPIT

SEQ ID NO: 1190122 - protein, 9 aa, Homo Sapiens
ACTGNPNDG

SEQ ID NO: 1190123 - protein, 9 aa, Homo Sapiens
GPGRRRRWH

SEQ ID NO: 1190124 - protein, 9 aa, Homo Sapiens
SNQLPVPIL

SEQ ID NO: 1190125 - protein, 9 aa, Homo Sapiens
LIPPAGSGQ

SEQ ID NO: 1190126 - protein, 9 aa, Homo Sapiens
PPAAAGCSW

SEQ ID NO: 1190127 - protein, 9 aa, Homo Sapiens
RFSGWCGGP

SEQ ID NO: 1190128 - protein, 9 aa, Homo Sapiens
RGLCSAAAS

SEQ ID NO: 1190129 - protein, 9 aa, Homo Sapiens
MPQDQVAQS

SEQ ID NO: 1190130 - protein, 9 aa, Homo Sapiens
CLIPPAGSG

SEQ ID NO: 1190131 - protein, 9 aa, Homo Sapiens
RSPTPTRRP

SEQ ID NO: 1190132 - protein, 9 aa, Homo Sapiens
PEFRRWKVA

SEQ ID NO: 1190133 - protein, 9 aa, Homo Sapiens
DAWTDFRSC

SEQ ID NO: 1190134 - protein, 9 aa, Homo Sapiens
HFDHKVTGA

SEQ ID NO: 1190135 - protein, 9 aa, Homo Sapiens
PSRGRGGVI

SEQ ID NO: 1190136 - protein, 9 aa, Homo Sapiens
LQRVGARPG

SEQ ID NO: 1190137 - protein, 9 aa, Homo Sapiens
RDRRSSNRN

SEQ ID NO: 1190138 - protein, 9 aa, Homo Sapiens
PPKCTPKCH

SEQ ID NO: 1190139 - protein, 9 aa, Homo Sapiens
LSHRLRLRL

SEQ ID NO: 1190140 - protein, 9 aa, Homo Sapiens
GEVLGICAL

SEQ ID NO: 1190141 - protein, 9 aa, Homo Sapiens
PGMYNMSAG

SEQ ID NO: 1190142 - protein, 9 aa, Homo Sapiens
RTSCCPRSH

SEQ ID NO: 1190143 - protein, 9 aa, Homo Sapiens
MAMVYVLKR

SEQ ID NO: 1190144 - protein, 9 aa, Homo Sapiens
AAVFLTTTS

SEQ ID NO: 1190145 - protein, 9 aa, Homo Sapiens
SGMGMLLIS

SEQ ID NO: 1190146 - protein, 9 aa, Homo Sapiens
DKNKKLRSL

SEQ ID NO: 1190147 - protein, 9 aa, Homo Sapiens
GAELQLPPL

SEQ ID NO: 1190148 - protein, 9 aa, Homo Sapiens
KCIDVDECT

SEQ ID NO: 1190149 - protein, 9 aa, Homo Sapiens
GQTGKISTT

SEQ ID NO: 1190150 - protein, 9 aa, Homo Sapiens
APAPPTRCV

SEQ ID NO: 1190151 - protein, 9 aa, Homo Sapiens
STESLGGPR

SEQ ID NO: 1190152 - protein, 9 aa, Homo Sapiens
HYKCEIKRL

SEQ ID NO: 1190153 - protein, 9 aa, Homo Sapiens
CTGAGVNLM

SEQ ID NO: 1190154 - protein, 9 aa, Homo Sapiens
LDSISHCQN

SEQ ID NO: 1190155 - protein, 9 aa, Homo Sapiens
KKSKEAPPI

SEQ ID NO: 1190156 - protein, 9 aa, Homo Sapiens
CSTHPLRTV

SEQ ID NO: 1190157 - protein, 9 aa, Homo Sapiens
QLLRRKINS

SEQ ID NO: 1190158 - protein, 9 aa, Homo Sapiens
AVAGSGSRA

SEQ ID NO: 1190159 - protein, 9 aa, Homo Sapiens
VLGHHKVRT

SEQ ID NO: 1190160 - protein, 9 aa, Homo Sapiens
VATRHLASM

SEQ ID NO: 1190161 - protein, 9 aa, Homo Sapiens
CCVLAGMES

SEQ ID NO: 1190162 - protein, 9 aa, Homo Sapiens
RKLKRHPHK

SEQ ID NO: 1190163 - protein, 9 aa, Homo Sapiens
QWGPGEGEE

SEQ ID NO: 1190164 - protein, 9 aa, Homo Sapiens
GCRGGLAGR

SEQ ID NO: 1190165 - protein, 9 aa, Homo Sapiens
TIKSQEPLQ

SEQ ID NO: 1190166 - protein, 9 aa, Homo Sapiens
LGAASSPAW

SEQ ID NO: 1190167 - protein, 9 aa, Homo Sapiens
YTYIAVNDM

SEQ ID NO: 1190168 - protein, 9 aa, Homo Sapiens
SFVPRDVVL

SEQ ID NO: 1190169 - protein, 9 aa, Homo Sapiens
SPRACARRC

SEQ ID NO: 1190170 - protein, 9 aa, Homo Sapiens
VILSIDDYF

SEQ ID NO: 1190171 - protein, 9 aa, Homo Sapiens
SLVALNTAY

SEQ ID NO: 1190172 - protein, 9 aa, Homo Sapiens
EPVSVDMGE

SEQ ID NO: 1190173 - protein, 9 aa, Homo Sapiens
FIPPQRGGL

SEQ ID NO: 1190174 - protein, 9 aa, Homo Sapiens
PVPILYLDL

SEQ ID NO: 1190175 - protein, 9 aa, Homo Sapiens
CRSASWRSA

SEQ ID NO: 1190176 - protein, 9 aa, Homo Sapiens
MVDKVIYLS

SEQ ID NO: 1190177 - protein, 9 aa, Homo Sapiens
VAERQVGRD

SEQ ID NO: 1190178 - protein, 9 aa, Homo Sapiens
SHPTRARCC

SEQ ID NO: 1190179 - protein, 9 aa, Homo Sapiens
CFESCSSDE

SEQ ID NO: 1190180 - protein, 9 aa, Homo Sapiens
ILAIIYMSA

SEQ ID NO: 1190181 - protein, 9 aa, Homo Sapiens
TSSCMTPAS

SEQ ID NO: 1190182 - protein, 9 aa, Homo Sapiens
ISEIESGMG

SEQ ID NO: 1190183 - protein, 9 aa, Homo Sapiens
PRLVHLYMY

SEQ ID NO: 1190184 - protein, 9 aa, Homo Sapiens
TPCCKPMAP

SEQ ID NO: 1190185 - protein, 9 aa, Homo Sapiens
RAWAPAPPT

SEQ ID NO: 1190186 - protein, 9 aa, Homo Sapiens
TEKSNYPPE

SEQ ID NO: 1190187 - protein, 9 aa, Homo Sapiens
GVHAQLLEM

SEQ ID NO: 1190188 - protein, 9 aa, Homo Sapiens
ERPPATLPE

SEQ ID NO: 1190189 - protein, 9 aa, Homo Sapiens
PDDRSVVTT

SEQ ID NO: 1190190 - protein, 9 aa, Homo Sapiens
YPYPWPPAP

SEQ ID NO: 1190191 - protein, 9 aa, Homo Sapiens
SAGGDASCA

SEQ ID NO: 1190192 - protein, 9 aa, Homo Sapiens
LMLHTNTAT

SEQ ID NO: 1190193 - protein, 9 aa, Homo Sapiens
CKKSSTVPS

SEQ ID NO: 1190194 - protein, 9 aa, Homo Sapiens
LGSVRERQA

SEQ ID NO: 1190195 - protein, 9 aa, Homo Sapiens
KGEDIFWTC

SEQ ID NO: 1190196 - protein, 9 aa, Homo Sapiens
FVFHCAPPL

SEQ ID NO: 1190197 - protein, 9 aa, Homo Sapiens
CIKECLCLY

SEQ ID NO: 1190198 - protein, 9 aa, Homo Sapiens
ILQGHLSHS

SEQ ID NO: 1190199 - protein, 9 aa, Homo Sapiens
RERILVIQN

SEQ ID NO: 1190200 - protein, 9 aa, Homo Sapiens
DYVDDGKGI

SEQ ID NO: 1190201 - protein, 9 aa, Homo Sapiens
PALPAGHRL

SEQ ID NO: 1190202 - protein, 9 aa, Homo Sapiens
RSHSGHCPL

SEQ ID NO: 1190203 - protein, 9 aa, Homo Sapiens
HSFYSFIYF

SEQ ID NO: 1190204 - protein, 9 aa, Homo Sapiens
GQPHALVAH

SEQ ID NO: 1190205 - protein, 9 aa, Homo Sapiens
KMNSGVKHV

SEQ ID NO: 1190206 - protein, 9 aa, Homo Sapiens
KNMSCLWTW

SEQ ID NO: 1190207 - protein, 9 aa, Homo Sapiens
PYECKQRGK

SEQ ID NO: 1190208 - protein, 9 aa, Homo Sapiens
GHLAVTLQG

SEQ ID NO: 1190209 - protein, 9 aa, Homo Sapiens
SSAPGPAPS

SEQ ID NO: 1190210 - protein, 9 aa, Homo Sapiens
ICALRLVVN

SEQ ID NO: 1190211 - protein, 9 aa, Homo Sapiens
PARRGELSM

SEQ ID NO: 1190212 - protein, 9 aa, Homo Sapiens
ERTPGLQPP

SEQ ID NO: 1190213 - protein, 9 aa, Homo Sapiens
TTANAPPGG

SEQ ID NO: 1190214 - protein, 9 aa, Homo Sapiens
CDLKENGDK

SEQ ID NO: 1190215 - protein, 9 aa, Homo Sapiens
APKASSWAS

SEQ ID NO: 1190216 - protein, 9 aa, Homo Sapiens
CLILSSKLH

SEQ ID NO: 1190217 - protein, 9 aa, Homo Sapiens
RPSFDSLGR

SEQ ID NO: 1190218 - protein, 9 aa, Homo Sapiens
VAGAALVGA

SEQ ID NO: 1190219 - protein, 9 aa, Homo Sapiens
PAARDCTLE

SEQ ID NO: 1190220 - protein, 9 aa, Homo Sapiens
VSLPLPSTS

SEQ ID NO: 1190221 - protein, 9 aa, Homo Sapiens
WRASFLMAL

SEQ ID NO: 1190222 - protein, 9 aa, Homo Sapiens
GLNDTPFQP

SEQ ID NO: 1190223 - protein, 9 aa, Homo Sapiens
PLSFNASIM

SEQ ID NO: 1190224 - protein, 9 aa, Homo Sapiens
RGQGHRQTP

SEQ ID NO: 1190225 - protein, 9 aa, Homo Sapiens
LGGALKLRG

SEQ ID NO: 1190226 - protein, 9 aa, Homo Sapiens
TYGTVVSLG

SEQ ID NO: 1190227 - protein, 9 aa, Homo Sapiens
VLERLEREE

SEQ ID NO: 1190228 - protein, 9 aa, Homo Sapiens
IDNHPMNRA

SEQ ID NO: 1190229 - protein, 9 aa, Homo Sapiens
GINIFWMAM

SEQ ID NO: 1190230 - protein, 9 aa, Homo Sapiens
PLQTFHLHH

SEQ ID NO: 1190231 - protein, 9 aa, Homo Sapiens
TPKCHPKCT

SEQ ID NO: 1190232 - protein, 9 aa, Homo Sapiens
RPLACSHVA

SEQ ID NO: 1190233 - protein, 9 aa, Homo Sapiens
AWRTSSACS

SEQ ID NO: 1190234 - protein, 9 aa, Homo Sapiens
VELLQLHAG

SEQ ID NO: 1190235 - protein, 9 aa, Homo Sapiens
LCRTFESDF

SEQ ID NO: 1190236 - protein, 9 aa, Homo Sapiens
RLDNYDTLD

SEQ ID NO: 1190237 - protein, 9 aa, Homo Sapiens
GARGSPWTG

SEQ ID NO: 1190238 - protein, 9 aa, Homo Sapiens
DPRQRRCCS

SEQ ID NO: 1190239 - protein, 9 aa, Homo Sapiens
MRCSVNVTP

SEQ ID NO: 1190240 - protein, 9 aa, Homo Sapiens
RTTWSAPQP

SEQ ID NO: 1190241 - protein, 9 aa, Homo Sapiens
EAVAAASLE

SEQ ID NO: 1190242 - protein, 9 aa, Homo Sapiens
QKSCSTHPL

SEQ ID NO: 1190243 - protein, 9 aa, Homo Sapiens
ECWNGHIKA

SEQ ID NO: 1190244 - protein, 9 aa, Homo Sapiens
GTAKRARSC

SEQ ID NO: 1190245 - protein, 9 aa, Homo Sapiens
WPCIVLWPK

SEQ ID NO: 1190246 - protein, 9 aa, Homo Sapiens
RCVVLNFHK

SEQ ID NO: 1190247 - protein, 9 aa, Homo Sapiens
TRWQARHLV

SEQ ID NO: 1190248 - protein, 9 aa, Homo Sapiens
LVQRLPGHL

SEQ ID NO: 1190249 - protein, 9 aa, Homo Sapiens
TSSVTSPIS

SEQ ID NO: 1190250 - protein, 9 aa, Homo Sapiens
MRVKYTKEV

SEQ ID NO: 1190251 - protein, 9 aa, Homo Sapiens
ARPPSFLPQ

SEQ ID NO: 1190252 - protein, 9 aa, Homo Sapiens
LAKMNGQPA

SEQ ID NO: 1190253 - protein, 9 aa, Homo Sapiens
ENILGKVSI

SEQ ID NO: 1190254 - protein, 9 aa, Homo Sapiens
KREHSSEQP

SEQ ID NO: 1190255 - protein, 9 aa, Homo Sapiens
HLLLLIALP

SEQ ID NO: 1190256 - protein, 9 aa, Homo Sapiens
PGQLRGRAR

SEQ ID NO: 1190257 - protein, 9 aa, Homo Sapiens
GAEMPASLC

SEQ ID NO: 1190258 - protein, 9 aa, Homo Sapiens
KDLIAHSLV

SEQ ID NO: 1190259 - protein, 9 aa, Homo Sapiens
ELSHQFQLS

SEQ ID NO: 1190260 - protein, 9 aa, Homo Sapiens
YADWFNASF

SEQ ID NO: 1190261 - protein, 9 aa, Homo Sapiens
IDKRGISIT

SEQ ID NO: 1190262 - protein, 9 aa, Homo Sapiens
RAWRMLTAL

SEQ ID NO: 1190263 - protein, 9 aa, Homo Sapiens
RRCQIRAWC

SEQ ID NO: 1190264 - protein, 9 aa, Homo Sapiens
NTTTVATQV

SEQ ID NO: 1190265 - protein, 9 aa, Homo Sapiens
LPCPRTTWS

SEQ ID NO: 1190266 - protein, 9 aa, Homo Sapiens
HAGRQGASL

SEQ ID NO: 1190267 - protein, 9 aa, Homo Sapiens
REHSSEQPP

SEQ ID NO: 1190268 - protein, 9 aa, Homo Sapiens
MHTLSEDTI

SEQ ID NO: 1190269 - protein, 9 aa, Homo Sapiens
THNIRHLPD

SEQ ID NO: 1190270 - protein, 9 aa, Homo Sapiens
RCAARRRTT

SEQ ID NO: 1190271 - protein, 9 aa, Homo Sapiens
GILAVIVVA

SEQ ID NO: 1190272 - protein, 9 aa, Homo Sapiens
PPPPPCPAH

SEQ ID NO: 1190273 - protein, 9 aa, Homo Sapiens
QGHRHHQEE

SEQ ID NO: 1190274 - protein, 9 aa, Homo Sapiens
ASKVPGGSR

SEQ ID NO: 1190275 - protein, 9 aa, Homo Sapiens
WECGWSPVL

SEQ ID NO: 1190276 - protein, 9 aa, Homo Sapiens
RPPPRWPRG

SEQ ID NO: 1190277 - protein, 9 aa, Homo Sapiens
PLRPSTRPE

SEQ ID NO: 1190278 - protein, 9 aa, Homo Sapiens
TQALARQHQ

SEQ ID NO: 1190279 - protein, 9 aa, Homo Sapiens
GGVPAGHVC

SEQ ID NO: 1190280 - protein, 9 aa, Homo Sapiens
TTPSTPAIR

SEQ ID NO: 1190281 - protein, 9 aa, Homo Sapiens
FARTLRRYT

SEQ ID NO: 1190282 - protein, 9 aa, Homo Sapiens
LDHEEPELL

SEQ ID NO: 1190283 - protein, 9 aa, Homo Sapiens
RLVHLYMYS

SEQ ID NO: 1190284 - protein, 9 aa, Homo Sapiens
QRIHMAEKS

SEQ ID NO: 1190285 - protein, 9 aa, Homo Sapiens
GTQHIEELQ

SEQ ID NO: 1190286 - protein, 9 aa, Homo Sapiens
KEMAPTIDW

SEQ ID NO: 1190287 - protein, 9 aa, Homo Sapiens
PGLGLGARA

SEQ ID NO: 1190288 - protein, 9 aa, Homo Sapiens
ETRVPGAKQ

SEQ ID NO: 1190289 - protein, 9 aa, Homo Sapiens
CGPSRATWA

SEQ ID NO: 1190290 - protein, 9 aa, Homo Sapiens
GASAGRRAA

SEQ ID NO: 1190291 - protein, 9 aa, Homo Sapiens
VKPTLIHTN

SEQ ID NO: 1190292 - protein, 9 aa, Homo Sapiens
PSPAPGSSP

SEQ ID NO: 1190293 - protein, 9 aa, Homo Sapiens
IRHVVVVGV

SEQ ID NO: 1190294 - protein, 9 aa, Homo Sapiens
DDGNTFKIL

SEQ ID NO: 1190295 - protein, 9 aa, Homo Sapiens
SIPSCSSPE

SEQ ID NO: 1190296 - protein, 9 aa, Homo Sapiens
RKRRRPKKM

SEQ ID NO: 1190297 - protein, 9 aa, Homo Sapiens
CAWYAAIDL

SEQ ID NO: 1190298 - protein, 9 aa, Homo Sapiens
KEKKKAEAT

SEQ ID NO: 1190299 - protein, 9 aa, Homo Sapiens
KNLLSTNLI

SEQ ID NO: 1190300 - protein, 9 aa, Homo Sapiens
QGLWEDLIA

SEQ ID NO: 1190301 - protein, 9 aa, Homo Sapiens
PLAFFYSPL

SEQ ID NO: 1190302 - protein, 9 aa, Homo Sapiens
WLYPGQRDK

SEQ ID NO: 1190303 - protein, 9 aa, Homo Sapiens
PQGAVYMDI

SEQ ID NO: 1190304 - protein, 9 aa, Homo Sapiens
SHQIKSSFG

SEQ ID NO: 1190305 - protein, 9 aa, Homo Sapiens
TTAIGGGVA

SEQ ID NO: 1190306 - protein, 9 aa, Homo Sapiens
NGRLCPALP

SEQ ID NO: 1190307 - protein, 9 aa, Homo Sapiens
AIPRASRPL

SEQ ID NO: 1190308 - protein, 9 aa, Homo Sapiens
SVMRRMRKT

SEQ ID NO: 1190309 - protein, 9 aa, Homo Sapiens
GADARLEKL

SEQ ID NO: 1190310 - protein, 9 aa, Homo Sapiens
ALDVATRHL

SEQ ID NO: 1190311 - protein, 9 aa, Homo Sapiens
EELFLLVSL

SEQ ID NO: 1190312 - protein, 9 aa, Homo Sapiens
KEHYKCEIK

SEQ ID NO: 1190313 - protein, 9 aa, Homo Sapiens
QIILVNLLA

SEQ ID NO: 1190314 - protein, 9 aa, Homo Sapiens
RLPGPLSHL

SEQ ID NO: 1190315 - protein, 9 aa, Homo Sapiens
LKIMFSCNN

SEQ ID NO: 1190316 - protein, 9 aa, Homo Sapiens
KKSLWECGW

SEQ ID NO: 1190317 - protein, 9 aa, Homo Sapiens
MRTGTLGSL

SEQ ID NO: 1190318 - protein, 9 aa, Homo Sapiens
NWRQLCGWR

SEQ ID NO: 1190319 - protein, 9 aa, Homo Sapiens
GKKRQYRGK

SEQ ID NO: 1190320 - protein, 9 aa, Homo Sapiens
DQKESEEEV

SEQ ID NO: 1190321 - protein, 9 aa, Homo Sapiens
MAPEDHGSS

SEQ ID NO: 1190322 - protein, 9 aa, Homo Sapiens
DANQTYLVL

SEQ ID NO: 1190323 - protein, 9 aa, Homo Sapiens
GGGGLCGYS

SEQ ID NO: 1190324 - protein, 9 aa, Homo Sapiens
CCQAPCWTC

SEQ ID NO: 1190325 - protein, 9 aa, Homo Sapiens
LKGSRTSCC

SEQ ID NO: 1190326 - protein, 9 aa, Homo Sapiens
MLNYGYVGY

SEQ ID NO: 1190327 - protein, 9 aa, Homo Sapiens
LAQFGEGAV

SEQ ID NO: 1190328 - protein, 9 aa, Homo Sapiens
GNNSKPVQE

SEQ ID NO: 1190329 - protein, 9 aa, Homo Sapiens
SMEGLLKQA

SEQ ID NO: 1190330 - protein, 9 aa, Homo Sapiens
LVAHRVAER

SEQ ID NO: 1190331 - protein, 9 aa, Homo Sapiens
CPLQGFLIP

SEQ ID NO: 1190332 - protein, 9 aa, Homo Sapiens
RARCCPGGL

SEQ ID NO: 1190333 - protein, 9 aa, Homo Sapiens
MPGARDVLC

SEQ ID NO: 1190334 - protein, 9 aa, Homo Sapiens
SQSPQLRGH

SEQ ID NO: 1190335 - protein, 9 aa, Homo Sapiens
PRTGAPARA

SEQ ID NO: 1190336 - protein, 9 aa, Homo Sapiens
PPGACPACP

SEQ ID NO: 1190337 - protein, 9 aa, Homo Sapiens
GVASSGELS

SEQ ID NO: 1190338 - protein, 9 aa, Homo Sapiens
WQVCPQVHC

SEQ ID NO: 1190339 - protein, 9 aa, Homo Sapiens
QEAGSKISC

SEQ ID NO: 1190340 - protein, 9 aa, Homo Sapiens
QEKKSHSLS

SEQ ID NO: 1190341 - protein, 9 aa, Homo Sapiens
LLVNMGGNR

SEQ ID NO: 1190342 - protein, 9 aa, Homo Sapiens
ADLGNGHNK

SEQ ID NO: 1190343 - protein, 9 aa, Homo Sapiens
ADGLDLLQL

SEQ ID NO: 1190344 - protein, 9 aa, Homo Sapiens
SPGGAGRLA

SEQ ID NO: 1190345 - protein, 9 aa, Homo Sapiens
RQPAARLLL

SEQ ID NO: 1190346 - protein, 9 aa, Homo Sapiens
HILGEGHLR

SEQ ID NO: 1190347 - protein, 9 aa, Homo Sapiens
RATPGATTV

SEQ ID NO: 1190348 - protein, 9 aa, Homo Sapiens
FVYPVCTPN

SEQ ID NO: 1190349 - protein, 9 aa, Homo Sapiens
SGMNFVQDL

SEQ ID NO: 1190350 - protein, 9 aa, Homo Sapiens
GPSEASIAR

SEQ ID NO: 1190351 - protein, 9 aa, Homo Sapiens
CLCFIYVAP

SEQ ID NO: 1190352 - protein, 9 aa, Homo Sapiens
NMRELINSP

SEQ ID NO: 1190353 - protein, 9 aa, Homo Sapiens
LQLHQRVHA

SEQ ID NO: 1190354 - protein, 9 aa, Homo Sapiens
QQHQPQQQH

SEQ ID NO: 1190355 - protein, 9 aa, Homo Sapiens
SYMKAQGIC

SEQ ID NO: 1190356 - protein, 9 aa, Homo Sapiens
AVGCRRCSG

SEQ ID NO: 1190357 - protein, 9 aa, Homo Sapiens
AVDALSPAP

SEQ ID NO: 1190358 - protein, 9 aa, Homo Sapiens
MSLPSGIYG

SEQ ID NO: 1190359 - protein, 9 aa, Homo Sapiens
KTELSVLEQ

SEQ ID NO: 1190360 - protein, 9 aa, Homo Sapiens
LDSQQCTQR

SEQ ID NO: 1190361 - protein, 9 aa, Homo Sapiens
LFLSHIWVG

SEQ ID NO: 1190362 - protein, 9 aa, Homo Sapiens
VPVQPHSPV

SEQ ID NO: 1190363 - protein, 9 aa, Homo Sapiens
LGLPAIVVV

SEQ ID NO: 1190364 - protein, 9 aa, Homo Sapiens
CYGNILWHQ

SEQ ID NO: 1190365 - protein, 9 aa, Homo Sapiens
YHARDEDAG

SEQ ID NO: 1190366 - protein, 9 aa, Homo Sapiens
LTGPPWQWR

SEQ ID NO: 1190367 - protein, 9 aa, Homo Sapiens
AAAVLGVAI

SEQ ID NO: 1190368 - protein, 9 aa, Homo Sapiens
PLTMPCWTR

SEQ ID NO: 1190369 - protein, 9 aa, Homo Sapiens
DDANQSATL

SEQ ID NO: 1190370 - protein, 9 aa, Homo Sapiens
WRATRRPLK

SEQ ID NO: 1190371 - protein, 9 aa, Homo Sapiens
PARPLEGEC

SEQ ID NO: 1190372 - protein, 9 aa, Homo Sapiens
QDADSLQQA

SEQ ID NO: 1190373 - protein, 9 aa, Homo Sapiens
MYQTPMEVV

SEQ ID NO: 1190374 - protein, 9 aa, Homo Sapiens
CPKREHSSE

SEQ ID NO: 1190375 - protein, 9 aa, Homo Sapiens
GDTCPCPHP

SEQ ID NO: 1190376 - protein, 9 aa, Homo Sapiens
ARLEKLGIF

SEQ ID NO: 1190377 - protein, 9 aa, Homo Sapiens
QEASGVTAA

SEQ ID NO: 1190378 - protein, 9 aa, Homo Sapiens
SWSPKPQAK

SEQ ID NO: 1190379 - protein, 9 aa, Homo Sapiens
FACTGNPND

SEQ ID NO: 1190380 - protein, 9 aa, Homo Sapiens
HKQDPYIVS

SEQ ID NO: 1190381 - protein, 9 aa, Homo Sapiens
DCSDILALL

SEQ ID NO: 1190382 - protein, 9 aa, Homo Sapiens
SCFKLDLSL

SEQ ID NO: 1190383 - protein, 9 aa, Homo Sapiens
RTFESDFPT

SEQ ID NO: 1190384 - protein, 9 aa, Homo Sapiens
RGYGLCTMH

SEQ ID NO: 1190385 - protein, 9 aa, Homo Sapiens
AGVTWGNGS

SEQ ID NO: 1190386 - protein, 9 aa, Homo Sapiens
PPMREVAEA

SEQ ID NO: 1190387 - protein, 9 aa, Homo Sapiens
LMRPKVYRL

SEQ ID NO: 1190388 - protein, 9 aa, Homo Sapiens
GWPNGWCQS

SEQ ID NO: 1190389 - protein, 9 aa, Homo Sapiens
VKHVLDALD

SEQ ID NO: 1190390 - protein, 9 aa, Homo Sapiens
PLAFGYFGI

SEQ ID NO: 1190391 - protein, 9 aa, Homo Sapiens
RHPPRNGSG

SEQ ID NO: 1190392 - protein, 9 aa, Homo Sapiens
ATCPAVVQR

SEQ ID NO: 1190393 - protein, 9 aa, Homo Sapiens
AGMRGIQNE

SEQ ID NO: 1190394 - protein, 9 aa, Homo Sapiens
EFYYHEHFT

SEQ ID NO: 1190395 - protein, 9 aa, Homo Sapiens
AMTTALGIP

SEQ ID NO: 1190396 - protein, 9 aa, Homo Sapiens
TKDKVLVFS

SEQ ID NO: 1190397 - protein, 9 aa, Homo Sapiens
PRQRRCCSL

SEQ ID NO: 1190398 - protein, 9 aa, Homo Sapiens
PAPQAQDPT

SEQ ID NO: 1190399 - protein, 9 aa, Homo Sapiens
TSSNTGMPD

SEQ ID NO: 1190400 - protein, 9 aa, Homo Sapiens
QRRTAWVEG

SEQ ID NO: 1190401 - protein, 9 aa, Homo Sapiens
FGGTTSRPW

SEQ ID NO: 1190402 - protein, 9 aa, Homo Sapiens
EEQCRQCDL

SEQ ID NO: 1190403 - protein, 9 aa, Homo Sapiens
KAGLSEHSQ

SEQ ID NO: 1190404 - protein, 9 aa, Homo Sapiens
HPHKSLPKR

SEQ ID NO: 1190405 - protein, 9 aa, Homo Sapiens
RMERKAPKK

SEQ ID NO: 1190406 - protein, 9 aa, Homo Sapiens
PQPDSSLGI

SEQ ID NO: 1190407 - protein, 9 aa, Homo Sapiens
ISFISSSSY

SEQ ID NO: 1190408 - protein, 9 aa, Homo Sapiens
KIRKVLPSS

SEQ ID NO: 1190409 - protein, 9 aa, Homo Sapiens
IHTPAEAPL

SEQ ID NO: 1190410 - protein, 9 aa, Homo Sapiens
PSGVILSID

SEQ ID NO: 1190411 - protein, 9 aa, Homo Sapiens
IIYNCTLVH

SEQ ID NO: 1190412 - protein, 9 aa, Homo Sapiens
WLSWRPRWR

SEQ ID NO: 1190413 - protein, 9 aa, Homo Sapiens
PPPWGCPWA

SEQ ID NO: 1190414 - protein, 9 aa, Homo Sapiens
ADARLEKLG

SEQ ID NO: 1190415 - protein, 9 aa, Homo Sapiens
SQNAYYFFV

SEQ ID NO: 1190416 - protein, 9 aa, Homo Sapiens
ISAARKSWA

SEQ ID NO: 1190417 - protein, 9 aa, Homo Sapiens
LPLTWWLAH

SEQ ID NO: 1190418 - protein, 9 aa, Homo Sapiens
LSRGRIYII

SEQ ID NO: 1190419 - protein, 9 aa, Homo Sapiens
QCICDNEYS

SEQ ID NO: 1190420 - protein, 9 aa, Homo Sapiens
SPLAMALCG

SEQ ID NO: 1190421 - protein, 9 aa, Homo Sapiens
CFPEAIKAW

SEQ ID NO: 1190422 - protein, 9 aa, Homo Sapiens
RQCAHAGAS

SEQ ID NO: 1190423 - protein, 9 aa, Homo Sapiens
GRPRPDPAL

SEQ ID NO: 1190424 - protein, 9 aa, Homo Sapiens
DGPVETDGR

SEQ ID NO: 1190425 - protein, 9 aa, Homo Sapiens
SEKETWITT

SEQ ID NO: 1190426 - protein, 9 aa, Homo Sapiens
SQQAGFCCP

SEQ ID NO: 1190427 - protein, 9 aa, Homo Sapiens
IYRKIQLEK

SEQ ID NO: 1190428 - protein, 9 aa, Homo Sapiens
ARRGELSMC

SEQ ID NO: 1190429 - protein, 9 aa, Homo Sapiens
APTIDWLSC

SEQ ID NO: 1190430 - protein, 9 aa, Homo Sapiens
MGAYGMQTC

SEQ ID NO: 1190431 - protein, 9 aa, Homo Sapiens
PCCKPMAPQ

SEQ ID NO: 1190432 - protein, 9 aa, Homo Sapiens
LLKSRLYQK

SEQ ID NO: 1190433 - protein, 9 aa, Homo Sapiens
RRTAWVEGE

SEQ ID NO: 1190434 - protein, 9 aa, Homo Sapiens
SILIHDRSV

SEQ ID NO: 1190435 - protein, 9 aa, Homo Sapiens
QQIRTPSVQ

SEQ ID NO: 1190436 - protein, 9 aa, Homo Sapiens
ALGYLKNLA

SEQ ID NO: 1190437 - protein, 9 aa, Homo Sapiens
RSRARPSHA

SEQ ID NO: 1190438 - protein, 9 aa, Homo Sapiens
PLPARPLEG

SEQ ID NO: 1190439 - protein, 9 aa, Homo Sapiens
PDQDSAPVP

SEQ ID NO: 1190440 - protein, 9 aa, Homo Sapiens
HCSCQACGE

SEQ ID NO: 1190441 - protein, 9 aa, Homo Sapiens
AAQAQKKNS

SEQ ID NO: 1190442 - protein, 9 aa, Homo Sapiens
SQEEQDDEL

SEQ ID NO: 1190443 - protein, 9 aa, Homo Sapiens
TESLGGPRR

SEQ ID NO: 1190444 - protein, 9 aa, Homo Sapiens
WYRGWAPRI

SEQ ID NO: 1190445 - protein, 9 aa, Homo Sapiens
PSLIPITNA

SEQ ID NO: 1190446 - protein, 9 aa, Homo Sapiens
CSDQLGNAP

SEQ ID NO: 1190447 - protein, 9 aa, Homo Sapiens
PRSRKFPSW

SEQ ID NO: 1190448 - protein, 9 aa, Homo Sapiens
TPPPWGCPW

SEQ ID NO: 1190449 - protein, 9 aa, Homo Sapiens
PLPRRPRGP

SEQ ID NO: 1190450 - protein, 9 aa, Homo Sapiens
WRGMGCPFQ

SEQ ID NO: 1190451 - protein, 9 aa, Homo Sapiens
CTPAGPHTA

SEQ ID NO: 1190452 - protein, 9 aa, Homo Sapiens
ALMSLLASI

SEQ ID NO: 1190453 - protein, 9 aa, Homo Sapiens
TSGLPHGLW

SEQ ID NO: 1190454 - protein, 9 aa, Homo Sapiens
PRPLHRWLQ

SEQ ID NO: 1190455 - protein, 9 aa, Homo Sapiens
VSGQAHAQV

SEQ ID NO: 1190456 - protein, 9 aa, Homo Sapiens
IDFEKIRKV

SEQ ID NO: 1190457 - protein, 9 aa, Homo Sapiens
IEAMSSYLF

SEQ ID NO: 1190458 - protein, 9 aa, Homo Sapiens
EQETTSSKT

SEQ ID NO: 1190459 - protein, 9 aa, Homo Sapiens
DLSLNFGRI

SEQ ID NO: 1190460 - protein, 9 aa, Homo Sapiens
GCIPAPRPV

SEQ ID NO: 1190461 - protein, 9 aa, Homo Sapiens
ILQIDSARL

SEQ ID NO: 1190462 - protein, 9 aa, Homo Sapiens
KEATFVLRG

SEQ ID NO: 1190463 - protein, 9 aa, Homo Sapiens
VDSAVTVAV

SEQ ID NO: 1190464 - protein, 9 aa, Homo Sapiens
GSQPQLMQN

SEQ ID NO: 1190465 - protein, 9 aa, Homo Sapiens
GYNDFNCNV

SEQ ID NO: 1190466 - protein, 9 aa, Homo Sapiens
SNATELATI

SEQ ID NO: 1190467 - protein, 9 aa, Homo Sapiens
RPGCGAPDP

SEQ ID NO: 1190468 - protein, 9 aa, Homo Sapiens
MPGPDSSGS

SEQ ID NO: 1190469 - protein, 9 aa, Homo Sapiens
ACIRQDETF

SEQ ID NO: 1190470 - protein, 9 aa, Homo Sapiens
GMGMLLISK

SEQ ID NO: 1190471 - protein, 9 aa, Homo Sapiens
VTAATFCPR

SEQ ID NO: 1190472 - protein, 9 aa, Homo Sapiens
QSHLMGPGF

SEQ ID NO: 1190473 - protein, 9 aa, Homo Sapiens
QFILFHPSL

SEQ ID NO: 1190474 - protein, 9 aa, Homo Sapiens
GESSGLNLG

SEQ ID NO: 1190475 - protein, 9 aa, Homo Sapiens
QPPDQWCPD

SEQ ID NO: 1190476 - protein, 9 aa, Homo Sapiens
SLQQAWTVG

SEQ ID NO: 1190477 - protein, 9 aa, Homo Sapiens
KSSQNVTTC

SEQ ID NO: 1190478 - protein, 9 aa, Homo Sapiens
SAAPQLRKW

SEQ ID NO: 1190479 - protein, 9 aa, Homo Sapiens
CTNAHRVVR

SEQ ID NO: 1190480 - protein, 9 aa, Homo Sapiens
DLMPVHFTP

SEQ ID NO: 1190481 - protein, 9 aa, Homo Sapiens
ARVAVGDWV

SEQ ID NO: 1190482 - protein, 9 aa, Homo Sapiens
SSPAWPAVL

SEQ ID NO: 1190483 - protein, 9 aa, Homo Sapiens
GVVKPGRGG

SEQ ID NO: 1190484 - protein, 9 aa, Homo Sapiens
IAVTTSSLG

SEQ ID NO: 1190485 - protein, 9 aa, Homo Sapiens
NTSTYLHCD

SEQ ID NO: 1190486 - protein, 9 aa, Homo Sapiens
VHLVACSRV

SEQ ID NO: 1190487 - protein, 9 aa, Homo Sapiens
STRSVAHPA

SEQ ID NO: 1190488 - protein, 9 aa, Homo Sapiens
SRHQDAEWQ

SEQ ID NO: 1190489 - protein, 9 aa, Homo Sapiens
RTPSLKPDI

SEQ ID NO: 1190490 - protein, 9 aa, Homo Sapiens
RADHLLDLY

SEQ ID NO: 1190491 - protein, 9 aa, Homo Sapiens
TDVALDFWM

SEQ ID NO: 1190492 - protein, 9 aa, Homo Sapiens
GMTGPARCC

SEQ ID NO: 1190493 - protein, 9 aa, Homo Sapiens
VKPQDPNVL

SEQ ID NO: 1190494 - protein, 9 aa, Homo Sapiens
RAWRTSSAC

SEQ ID NO: 1190495 - protein, 9 aa, Homo Sapiens
TDFRSCTNS

SEQ ID NO: 1190496 - protein, 9 aa, Homo Sapiens
TLQCNPRLD

SEQ ID NO: 1190497 - protein, 9 aa, Homo Sapiens
RPHRVTHTR

SEQ ID NO: 1190498 - protein, 9 aa, Homo Sapiens
QMGQGPLPR

SEQ ID NO: 1190499 - protein, 9 aa, Homo Sapiens
ASRSESRVE

SEQ ID NO: 1190500 - protein, 9 aa, Homo Sapiens
LQALNVGRV

SEQ ID NO: 1190501 - protein, 9 aa, Homo Sapiens
WSCVCILGE

SEQ ID NO: 1190502 - protein, 9 aa, Homo Sapiens
DDSPCPFTT

SEQ ID NO: 1190503 - protein, 9 aa, Homo Sapiens
PVHGYWFWE

SEQ ID NO: 1190504 - protein, 9 aa, Homo Sapiens
GLGMAYFPT

SEQ ID NO: 1190505 - protein, 9 aa, Homo Sapiens
PREFGDAEL

SEQ ID NO: 1190506 - protein, 9 aa, Homo Sapiens
TCLRTCHLM

SEQ ID NO: 1190507 - protein, 9 aa, Homo Sapiens
KYRVLACRV

SEQ ID NO: 1190508 - protein, 9 aa, Homo Sapiens
PPPPPTKKR

SEQ ID NO: 1190509 - protein, 9 aa, Homo Sapiens
AAPAPAPGG

SEQ ID NO: 1190510 - protein, 9 aa, Homo Sapiens
LLRTHRPRH

SEQ ID NO: 1190511 - protein, 9 aa, Homo Sapiens
KLVPEEHVN

SEQ ID NO: 1190512 - protein, 9 aa, Homo Sapiens
NCKNGSPQK

SEQ ID NO: 1190513 - protein, 9 aa, Homo Sapiens
RGAAKQRLV

SEQ ID NO: 1190514 - protein, 9 aa, Homo Sapiens
TFTFSAVAS

SEQ ID NO: 1190515 - protein, 9 aa, Homo Sapiens
FPKIFPYPL

SEQ ID NO: 1190516 - protein, 9 aa, Homo Sapiens
RVIVASYDK

SEQ ID NO: 1190517 - protein, 9 aa, Homo Sapiens
CSSTNSISR

SEQ ID NO: 1190518 - protein, 9 aa, Homo Sapiens
PCRLGLDRA

SEQ ID NO: 1190519 - protein, 9 aa, Homo Sapiens
GYRRWRGRG

SEQ ID NO: 1190520 - protein, 9 aa, Homo Sapiens
MPVASTDRW

SEQ ID NO: 1190521 - protein, 9 aa, Homo Sapiens
DSYITSTKT

SEQ ID NO: 1190522 - protein, 9 aa, Homo Sapiens
SFAEHQRTH

SEQ ID NO: 1190523 - protein, 9 aa, Homo Sapiens
RPLGVSPLA

SEQ ID NO: 1190524 - protein, 9 aa, Homo Sapiens
LPHVADFWW

SEQ ID NO: 1190525 - protein, 9 aa, Homo Sapiens
VLLVDFQLA

SEQ ID NO: 1190526 - protein, 9 aa, Homo Sapiens
ASDRNPRPG

SEQ ID NO: 1190527 - protein, 9 aa, Homo Sapiens
ARLRDHLPQ

SEQ ID NO: 1190528 - protein, 9 aa, Homo Sapiens
MGGRHPSWP

SEQ ID NO: 1190529 - protein, 9 aa, Homo Sapiens
LGFRSRRSG

SEQ ID NO: 1190530 - protein, 9 aa, Homo Sapiens
LSPGEARAP

SEQ ID NO: 1190531 - protein, 9 aa, Homo Sapiens
RLETRWQAR

SEQ ID NO: 1190532 - protein, 9 aa, Homo Sapiens
PTLMMSNGC

SEQ ID NO: 1190533 - protein, 9 aa, Homo Sapiens
GTIKSQEPL

SEQ ID NO: 1190534 - protein, 9 aa, Homo Sapiens
SSGLRPCLP

SEQ ID NO: 1190535 - protein, 9 aa, Homo Sapiens
EAPLPAFGR

SEQ ID NO: 1190536 - protein, 9 aa, Homo Sapiens
LLPGHARVY

SEQ ID NO: 1190537 - protein, 9 aa, Homo Sapiens
KHLWIHSDE

SEQ ID NO: 1190538 - protein, 9 aa, Homo Sapiens
TVRTCVCWP

SEQ ID NO: 1190539 - protein, 9 aa, Homo Sapiens
MKKDKLHHR

SEQ ID NO: 1190540 - protein, 9 aa, Homo Sapiens
TSVVKKGGI

SEQ ID NO: 1190541 - protein, 9 aa, Homo Sapiens
PLACSHVAL

SEQ ID NO: 1190542 - protein, 9 aa, Homo Sapiens
AEGIPCIYV

SEQ ID NO: 1190543 - protein, 9 aa, Homo Sapiens
PSLTSGLPH

SEQ ID NO: 1190544 - protein, 9 aa, Homo Sapiens
NSNNVFFSL

SEQ ID NO: 1190545 - protein, 9 aa, Homo Sapiens
APLLAVGGA

SEQ ID NO: 1190546 - protein, 9 aa, Homo Sapiens
TGLPCFHGQ

SEQ ID NO: 1190547 - protein, 9 aa, Homo Sapiens
FTQFMGAVM

SEQ ID NO: 1190548 - protein, 9 aa, Homo Sapiens
GVGPCKLSS

SEQ ID NO: 1190549 - protein, 9 aa, Homo Sapiens
VWSELPPGR

SEQ ID NO: 1190550 - protein, 9 aa, Homo Sapiens
DRTAERPVL

SEQ ID NO: 1190551 - protein, 9 aa, Homo Sapiens
FLGRPPTPL

SEQ ID NO: 1190552 - protein, 9 aa, Homo Sapiens
SRRPARPGA

SEQ ID NO: 1190553 - protein, 9 aa, Homo Sapiens
FTHDSFEKT

SEQ ID NO: 1190554 - protein, 9 aa, Homo Sapiens
PEVKTCLWV

SEQ ID NO: 1190555 - protein, 9 aa, Homo Sapiens
ERCCKRFVQ

SEQ ID NO: 1190556 - protein, 9 aa, Homo Sapiens
TFVLRGTIL

SEQ ID NO: 1190557 - protein, 9 aa, Homo Sapiens
CTSSSSSSR

SEQ ID NO: 1190558 - protein, 9 aa, Homo Sapiens
WGLPGWKSC

SEQ ID NO: 1190559 - protein, 9 aa, Homo Sapiens
GSMKDRISL

SEQ ID NO: 1190560 - protein, 9 aa, Homo Sapiens
PGRQLPHGE

SEQ ID NO: 1190561 - protein, 9 aa, Homo Sapiens
VLVCSALPF

SEQ ID NO: 1190562 - protein, 9 aa, Homo Sapiens
FIEAYKCQI

SEQ ID NO: 1190563 - protein, 9 aa, Homo Sapiens
GRGALRDDV

SEQ ID NO: 1190564 - protein, 9 aa, Homo Sapiens
AGGAGDELV

SEQ ID NO: 1190565 - protein, 9 aa, Homo Sapiens
NTWRKQYSI

SEQ ID NO: 1190566 - protein, 9 aa, Homo Sapiens
VSPLAPCPP

SEQ ID NO: 1190567 - protein, 9 aa, Homo Sapiens
AVRGAFVGP

SEQ ID NO: 1190568 - protein, 9 aa, Homo Sapiens
MGMLLISKV

SEQ ID NO: 1190569 - protein, 9 aa, Homo Sapiens
NSHISDTSF

SEQ ID NO: 1190570 - protein, 9 aa, Homo Sapiens
SAFSCLACW

SEQ ID NO: 1190571 - protein, 9 aa, Homo Sapiens
HQLVTVMNP

SEQ ID NO: 1190572 - protein, 9 aa, Homo Sapiens
AGTGGTPRG

SEQ ID NO: 1190573 - protein, 9 aa, Homo Sapiens
VCPVTQDHL

SEQ ID NO: 1190574 - protein, 9 aa, Homo Sapiens
GQPHSCFPS

SEQ ID NO: 1190575 - protein, 9 aa, Homo Sapiens
SVCDSHPHP

SEQ ID NO: 1190576 - protein, 9 aa, Homo Sapiens
TVLRDSGAA

SEQ ID NO: 1190577 - protein, 9 aa, Homo Sapiens
TCPCPHPSG

SEQ ID NO: 1190578 - protein, 9 aa, Homo Sapiens
TTSPSVIYW

SEQ ID NO: 1190579 - protein, 9 aa, Homo Sapiens
WLLIFNILL

SEQ ID NO: 1190580 - protein, 9 aa, Homo Sapiens
ATTRLNVFA

SEQ ID NO: 1190581 - protein, 9 aa, Homo Sapiens
ARGLCSAAA

SEQ ID NO: 1190582 - protein, 9 aa, Homo Sapiens
GKSDGHERR

SEQ ID NO: 1190583 - protein, 9 aa, Homo Sapiens
EVLGPGEAD

SEQ ID NO: 1190584 - protein, 9 aa, Homo Sapiens
KWKPSPLMN

SEQ ID NO: 1190585 - protein, 9 aa, Homo Sapiens
RLDVQCLLR

SEQ ID NO: 1190586 - protein, 9 aa, Homo Sapiens
TPATAAANE

SEQ ID NO: 1190587 - protein, 9 aa, Homo Sapiens
SLSSSCLCF

SEQ ID NO: 1190588 - protein, 9 aa, Homo Sapiens
LHEAVSTVL

SEQ ID NO: 1190589 - protein, 9 aa, Homo Sapiens
PLRGFLLHQ

SEQ ID NO: 1190590 - protein, 9 aa, Homo Sapiens
VWGAGRAIP

SEQ ID NO: 1190591 - protein, 9 aa, Homo Sapiens
VSAHLVGHI

SEQ ID NO: 1190592 - protein, 9 aa, Homo Sapiens
GDQCCFQNG

SEQ ID NO: 1190593 - protein, 9 aa, Homo Sapiens
ASPRGPPSP

SEQ ID NO: 1190594 - protein, 9 aa, Homo Sapiens
QARGPGARR

SEQ ID NO: 1190595 - protein, 9 aa, Homo Sapiens
VVGLGCGFG

SEQ ID NO: 1190596 - protein, 9 aa, Homo Sapiens
KLLCPKREH

SEQ ID NO: 1190597 - protein, 9 aa, Homo Sapiens
GGSGGGTTT

SEQ ID NO: 1190598 - protein, 9 aa, Homo Sapiens
TSHLSVAWR

SEQ ID NO: 1190599 - protein, 9 aa, Homo Sapiens
SAACGCGCE

SEQ ID NO: 1190600 - protein, 9 aa, Homo Sapiens
LASSAAQLP

SEQ ID NO: 1190601 - protein, 9 aa, Homo Sapiens
GWGWRSPKC

SEQ ID NO: 1190602 - protein, 9 aa, Homo Sapiens
AVAAASLEP

SEQ ID NO: 1190603 - protein, 9 aa, Homo Sapiens
QAVLLLCAH

SEQ ID NO: 1190604 - protein, 9 aa, Homo Sapiens
RFRKRQWGP

SEQ ID NO: 1190605 - protein, 9 aa, Homo Sapiens
ALCPKREGP

SEQ ID NO: 1190606 - protein, 9 aa, Homo Sapiens
QTEVFTLFL

SEQ ID NO: 1190607 - protein, 9 aa, Homo Sapiens
SCGFTQDRG

SEQ ID NO: 1190608 - protein, 9 aa, Homo Sapiens
QVDKVIEPR

SEQ ID NO: 1190609 - protein, 9 aa, Homo Sapiens
APGDVEGLG

SEQ ID NO: 1190610 - protein, 9 aa, Homo Sapiens
KNLLASSDH

SEQ ID NO: 1190611 - protein, 9 aa, Homo Sapiens
LAYLVPGPL

SEQ ID NO: 1190612 - protein, 9 aa, Homo Sapiens
NALLSPPEP

SEQ ID NO: 1190613 - protein, 9 aa, Homo Sapiens
LAQQQRVQS

SEQ ID NO: 1190614 - protein, 9 aa, Homo Sapiens
PVPGSSAPK

SEQ ID NO: 1190615 - protein, 9 aa, Homo Sapiens
PAPTPSARS

SEQ ID NO: 1190616 - protein, 9 aa, Homo Sapiens
ASISACNGL

SEQ ID NO: 1190617 - protein, 9 aa, Homo Sapiens
LLQLHAGRQ

SEQ ID NO: 1190618 - protein, 9 aa, Homo Sapiens
KDCDPSSPR

SEQ ID NO: 1190619 - protein, 9 aa, Homo Sapiens
GAGDVGKSA

SEQ ID NO: 1190620 - protein, 9 aa, Homo Sapiens
QPSFDGILY

SEQ ID NO: 1190621 - protein, 9 aa, Homo Sapiens
LDTTSFHIV

SEQ ID NO: 1190622 - protein, 9 aa, Homo Sapiens
WRMGPGRHR

SEQ ID NO: 1190623 - protein, 9 aa, Homo Sapiens
PKSPLLCVT

SEQ ID NO: 1190624 - protein, 9 aa, Homo Sapiens
MQACLDKKS

SEQ ID NO: 1190625 - protein, 9 aa, Homo Sapiens
IRKVLPSSE

SEQ ID NO: 1190626 - protein, 9 aa, Homo Sapiens
YRTQGVCSF

SEQ ID NO: 1190627 - protein, 9 aa, Homo Sapiens
RRTSWKMWS

SEQ ID NO: 1190628 - protein, 9 aa, Homo Sapiens
DRRLHSHMY

SEQ ID NO: 1190629 - protein, 9 aa, Homo Sapiens
KVYTDRFTP

SEQ ID NO: 1190630 - protein, 9 aa, Homo Sapiens
KHKKIHTAE

SEQ ID NO: 1190631 - protein, 9 aa, Homo Sapiens
LPRSRKFPS

SEQ ID NO: 1190632 - protein, 9 aa, Homo Sapiens
SKVPGGSRP

SEQ ID NO: 1190633 - protein, 9 aa, Homo Sapiens
WFWEGAIIS

SEQ ID NO: 1190634 - protein, 9 aa, Homo Sapiens
RGPWRAPRA

SEQ ID NO: 1190635 - protein, 9 aa, Homo Sapiens
FVRESDCSS

SEQ ID NO: 1190636 - protein, 9 aa, Homo Sapiens
GLDLLQLPE

SEQ ID NO: 1190637 - protein, 9 aa, Homo Sapiens
PAGGELPEP

SEQ ID NO: 1190638 - protein, 9 aa, Homo Sapiens
PAPPTRCVW

SEQ ID NO: 1190639 - protein, 9 aa, Homo Sapiens
AETIFIKVT

SEQ ID NO: 1190640 - protein, 9 aa, Homo Sapiens
WSWSPKPQA

SEQ ID NO: 1190641 - protein, 9 aa, Homo Sapiens
HKPEPTDEG

SEQ ID NO: 1190642 - protein, 9 aa, Homo Sapiens
VKREHLEDV

SEQ ID NO: 1190643 - protein, 9 aa, Homo Sapiens
KPLAAPGDV

SEQ ID NO: 1190644 - protein, 9 aa, Homo Sapiens
PPQRSSKTM

SEQ ID NO: 1190645 - protein, 9 aa, Homo Sapiens
LHLQSQLAP

SEQ ID NO: 1190646 - protein, 9 aa, Homo Sapiens
STHTSEFKG

SEQ ID NO: 1190647 - protein, 9 aa, Homo Sapiens
ATAAANELN

SEQ ID NO: 1190648 - protein, 9 aa, Homo Sapiens
MSRSTTRPS

SEQ ID NO: 1190649 - protein, 9 aa, Homo Sapiens
GCRSPPLDL

SEQ ID NO: 1190650 - protein, 9 aa, Homo Sapiens
QGMILVYDI

SEQ ID NO: 1190651 - protein, 9 aa, Homo Sapiens
GTGGTPRGG

SEQ ID NO: 1190652 - protein, 9 aa, Homo Sapiens
MEEAEPAPL

SEQ ID NO: 1190653 - protein, 9 aa, Homo Sapiens
WQARHLVIH

SEQ ID NO: 1190654 - protein, 9 aa, Homo Sapiens
LAIIYMSAA

SEQ ID NO: 1190655 - protein, 9 aa, Homo Sapiens
DSGVIRLYM

SEQ ID NO: 1190656 - protein, 9 aa, Homo Sapiens
STRPEAPAP

SEQ ID NO: 1190657 - protein, 9 aa, Homo Sapiens
RRAPKSSQN

SEQ ID NO: 1190658 - protein, 9 aa, Homo Sapiens
VLIHNDLIL

SEQ ID NO: 1190659 - protein, 9 aa, Homo Sapiens
VAGCRRWPG

SEQ ID NO: 1190660 - protein, 9 aa, Homo Sapiens
RSPLTGSKV

SEQ ID NO: 1190661 - protein, 9 aa, Homo Sapiens
LNDTPFQPA

SEQ ID NO: 1190662 - protein, 9 aa, Homo Sapiens
KSELSDGIT

SEQ ID NO: 1190663 - protein, 9 aa, Homo Sapiens
LLAQLVARP

SEQ ID NO: 1190664 - protein, 9 aa, Homo Sapiens
LGVRISAKE

SEQ ID NO: 1190665 - protein, 9 aa, Homo Sapiens
VGQCLDVGL

SEQ ID NO: 1190666 - protein, 9 aa, Homo Sapiens
ALAHPRTLT

SEQ ID NO: 1190667 - protein, 9 aa, Homo Sapiens
HNREKAKGP

SEQ ID NO: 1190668 - protein, 9 aa, Homo Sapiens
VDMGEDASF

SEQ ID NO: 1190669 - protein, 9 aa, Homo Sapiens
RLHSHMYYF

SEQ ID NO: 1190670 - protein, 9 aa, Homo Sapiens
GFQNPTLTP

SEQ ID NO: 1190671 - protein, 9 aa, Homo Sapiens
PRSTFLPAP

SEQ ID NO: 1190672 - protein, 9 aa, Homo Sapiens
AKPGPREGE

SEQ ID NO: 1190673 - protein, 9 aa, Homo Sapiens
WASAAARTA

SEQ ID NO: 1190674 - protein, 9 aa, Homo Sapiens
LSWRPRWRQ

SEQ ID NO: 1190675 - protein, 9 aa, Homo Sapiens
RNSLIQMTI

SEQ ID NO: 1190676 - protein, 9 aa, Homo Sapiens
QLLELSSLK

SEQ ID NO: 1190677 - protein, 9 aa, Homo Sapiens
TSLWSWSPK

SEQ ID NO: 1190678 - protein, 9 aa, Homo Sapiens
SAKDKTISY

SEQ ID NO: 1190679 - protein, 9 aa, Homo Sapiens
LEEFTSLAA

SEQ ID NO: 1190680 - protein, 9 aa, Homo Sapiens
LNDTTEINQ

SEQ ID NO: 1190681 - protein, 9 aa, Homo Sapiens
SAAQLPGAS

SEQ ID NO: 1190682 - protein, 9 aa, Homo Sapiens
YKQISALAM

SEQ ID NO: 1190683 - protein, 9 aa, Homo Sapiens
MPLGLGRQK

SEQ ID NO: 1190684 - protein, 9 aa, Homo Sapiens
SVDRTAERP

SEQ ID NO: 1190685 - protein, 9 aa, Homo Sapiens
AFPKPPEDG

SEQ ID NO: 1190686 - protein, 9 aa, Homo Sapiens
AVISVTAMQ

SEQ ID NO: 1190687 - protein, 9 aa, Homo Sapiens
PGVCIFGYP

SEQ ID NO: 1190688 - protein, 9 aa, Homo Sapiens
GGLPPGAHG

SEQ ID NO: 1190689 - protein, 9 aa, Homo Sapiens
QDLVIHSQQ

SEQ ID NO: 1190690 - protein, 9 aa, Homo Sapiens
LVIWVTNWK

SEQ ID NO: 1190691 - protein, 9 aa, Homo Sapiens
TTTTPHPPL

SEQ ID NO: 1190692 - protein, 9 aa, Homo Sapiens
RTTCRRPAS

SEQ ID NO: 1190693 - protein, 9 aa, Homo Sapiens
CVVSGQAHA

SEQ ID NO: 1190694 - protein, 9 aa, Homo Sapiens
CEVQDRKLT

SEQ ID NO: 1190695 - protein, 9 aa, Homo Sapiens
EEFTSLAAS

SEQ ID NO: 1190696 - protein, 9 aa, Homo Sapiens
AGGELPEPH

SEQ ID NO: 1190697 - protein, 9 aa, Homo Sapiens
IVNPGTKSK

SEQ ID NO: 1190698 - protein, 9 aa, Homo Sapiens
DHLWTIGVE

SEQ ID NO: 1190699 - protein, 9 aa, Homo Sapiens
VPNGCAAGP

SEQ ID NO: 1190700 - protein, 9 aa, Homo Sapiens
SCSDGRSSA

SEQ ID NO: 1190701 - protein, 9 aa, Homo Sapiens
LTSSVTSPI

SEQ ID NO: 1190702 - protein, 9 aa, Homo Sapiens
CPIFYPQGL

SEQ ID NO: 1190703 - protein, 9 aa, Homo Sapiens
HYSRSDAAK

SEQ ID NO: 1190704 - protein, 9 aa, Homo Sapiens
QVAGPEVVG

SEQ ID NO: 1190705 - protein, 9 aa, Homo Sapiens
GEEHSLTAA

SEQ ID NO: 1190706 - protein, 9 aa, Homo Sapiens
NPTLTPGPE

SEQ ID NO: 1190707 - protein, 9 aa, Homo Sapiens
KNGSPQKGR

SEQ ID NO: 1190708 - protein, 9 aa, Homo Sapiens
KNGVHSPIM

SEQ ID NO: 1190709 - protein, 9 aa, Homo Sapiens
LPQELADKR

SEQ ID NO: 1190710 - protein, 9 aa, Homo Sapiens
VAVFMPAMQ

SEQ ID NO: 1190711 - protein, 9 aa, Homo Sapiens
SGRLLPPLL

SEQ ID NO: 1190712 - protein, 9 aa, Homo Sapiens
KVCEDLTDL

SEQ ID NO: 1190713 - protein, 9 aa, Homo Sapiens
LISEFEEEG

SEQ ID NO: 1190714 - protein, 9 aa, Homo Sapiens
ANLLPLDGL

SEQ ID NO: 1190715 - protein, 9 aa, Homo Sapiens
PETMMLSLL

SEQ ID NO: 1190716 - protein, 9 aa, Homo Sapiens
PKSSQNVTT

SEQ ID NO: 1190717 - protein, 9 aa, Homo Sapiens
LFPDTDYKS

SEQ ID NO: 1190718 - protein, 9 aa, Homo Sapiens
TLGADLGHW

SEQ ID NO: 1190719 - protein, 9 aa, Homo Sapiens
NLFIYHLPR

SEQ ID NO: 1190720 - protein, 9 aa, Homo Sapiens
APSAPVHSS

SEQ ID NO: 1190721 - protein, 9 aa, Homo Sapiens
ADMPIVITV

SEQ ID NO: 1190722 - protein, 9 aa, Homo Sapiens
KIYIQRLSV

SEQ ID NO: 1190723 - protein, 9 aa, Homo Sapiens
MEGAVLPRS

SEQ ID NO: 1190724 - protein, 9 aa, Homo Sapiens
KKYDSLSNH

SEQ ID NO: 1190725 - protein, 9 aa, Homo Sapiens
LGRVLRPHI

SEQ ID NO: 1190726 - protein, 9 aa, Homo Sapiens
TVIMRLQLF

SEQ ID NO: 1190727 - protein, 9 aa, Homo Sapiens
PSPITAAVA

SEQ ID NO: 1190728 - protein, 9 aa, Homo Sapiens
QFNLWYTMD

SEQ ID NO: 1190729 - protein, 9 aa, Homo Sapiens
IKKACIRQD

SEQ ID NO: 1190730 - protein, 9 aa, Homo Sapiens
GWAPRIKAS

SEQ ID NO: 1190731 - protein, 9 aa, Homo Sapiens
ALAHLQEEE

SEQ ID NO: 1190732 - protein, 9 aa, Homo Sapiens
ATLEEFTSL

SEQ ID NO: 1190733 - protein, 9 aa, Homo Sapiens
RQASRLKPS

SEQ ID NO: 1190734 - protein, 9 aa, Homo Sapiens
NFACTGNPN

SEQ ID NO: 1190735 - protein, 9 aa, Homo Sapiens
PRPHPLYFR

SEQ ID NO: 1190736 - protein, 9 aa, Homo Sapiens
GHPGVGPGP

SEQ ID NO: 1190737 - protein, 9 aa, Homo Sapiens
QPAFIPAQM

SEQ ID NO: 1190738 - protein, 9 aa, Homo Sapiens
NAVHLQDLV

SEQ ID NO: 1190739 - protein, 9 aa, Homo Sapiens
SMLSAAGSP

SEQ ID NO: 1190740 - protein, 9 aa, Homo Sapiens
SGTIEDASG

SEQ ID NO: 1190741 - protein, 9 aa, Homo Sapiens
WRQQNWMSS

SEQ ID NO: 1190742 - protein, 9 aa, Homo Sapiens
DVQCLLRRC

SEQ ID NO: 1190743 - protein, 9 aa, Homo Sapiens
FEDTGFSNI

SEQ ID NO: 1190744 - protein, 9 aa, Homo Sapiens
EKEKKEEGK

SEQ ID NO: 1190745 - protein, 9 aa, Homo Sapiens
GGPTIGARI

SEQ ID NO: 1190746 - protein, 9 aa, Homo Sapiens
LAGMRMDLG

SEQ ID NO: 1190747 - protein, 9 aa, Homo Sapiens
FRLLISRAE

SEQ ID NO: 1190748 - protein, 9 aa, Homo Sapiens
PATRKPPSP

SEQ ID NO: 1190749 - protein, 9 aa, Homo Sapiens
KQKEDIEKM

SEQ ID NO: 1190750 - protein, 9 aa, Homo Sapiens
FTLINSFLY

SEQ ID NO: 1190751 - protein, 9 aa, Homo Sapiens
ARDVAGVTW

SEQ ID NO: 1190752 - protein, 9 aa, Homo Sapiens
RSHPRLPGP

SEQ ID NO: 1190753 - protein, 9 aa, Homo Sapiens
PRQLPRDRR

SEQ ID NO: 1190754 - protein, 9 aa, Homo Sapiens
LSFNASIMT

SEQ ID NO: 1190755 - protein, 9 aa, Homo Sapiens
SHSSPLPSR

SEQ ID NO: 1190756 - protein, 9 aa, Homo Sapiens
QQLFEDIWG

SEQ ID NO: 1190757 - protein, 9 aa, Homo Sapiens
RRRQLRRRP

SEQ ID NO: 1190758 - protein, 9 aa, Homo Sapiens
TANIKRYLR

SEQ ID NO: 1190759 - protein, 9 aa, Homo Sapiens
AQDGVHEVQ

SEQ ID NO: 1190760 - protein, 9 aa, Homo Sapiens
FVKPDTGFT

SEQ ID NO: 1190761 - protein, 9 aa, Homo Sapiens
AAARAAGGA

SEQ ID NO: 1190762 - protein, 9 aa, Homo Sapiens
RWLQQTTGC

SEQ ID NO: 1190763 - protein, 9 aa, Homo Sapiens
EPHGLPLGP

SEQ ID NO: 1190764 - protein, 9 aa, Homo Sapiens
HSARDVHVV

SEQ ID NO: 1190765 - protein, 9 aa, Homo Sapiens
DITLLHLAQ

SEQ ID NO: 1190766 - protein, 9 aa, Homo Sapiens
AVAWSRLLL

SEQ ID NO: 1190767 - protein, 9 aa, Homo Sapiens
SWKMWSTPC

SEQ ID NO: 1190768 - protein, 9 aa, Homo Sapiens
QALDRALRC

SEQ ID NO: 1190769 - protein, 9 aa, Homo Sapiens
LPPGRAWAP

SEQ ID NO: 1190770 - protein, 9 aa, Homo Sapiens
HRLQHGVGP

SEQ ID NO: 1190771 - protein, 9 aa, Homo Sapiens
NMADIESLE

SEQ ID NO: 1190772 - protein, 9 aa, Homo Sapiens
SAPISSDAS

SEQ ID NO: 1190773 - protein, 9 aa, Homo Sapiens
TLSEKLSGE

SEQ ID NO: 1190774 - protein, 9 aa, Homo Sapiens
CISNVFSML

SEQ ID NO: 1190775 - protein, 9 aa, Homo Sapiens
NNLYCDYHL

SEQ ID NO: 1190776 - protein, 9 aa, Homo Sapiens
VFLLAVPLL

SEQ ID NO: 1190777 - protein, 9 aa, Homo Sapiens
SSAGNNSKP

SEQ ID NO: 1190778 - protein, 9 aa, Homo Sapiens
GSGGHRPAH

SEQ ID NO: 1190779 - protein, 9 aa, Homo Sapiens
HFSTAGTIF

SEQ ID NO: 1190780 - protein, 9 aa, Homo Sapiens
QGSVGFLWR

SEQ ID NO: 1190781 - protein, 9 aa, Homo Sapiens
VGARPGRGG

SEQ ID NO: 1190782 - protein, 9 aa, Homo Sapiens
LVGHKAVYR

SEQ ID NO: 1190783 - protein, 9 aa, Homo Sapiens
LPRDRRPRT

SEQ ID NO: 1190784 - protein, 9 aa, Homo Sapiens
RNSTTCMVT

SEQ ID NO: 1190785 - protein, 9 aa, Homo Sapiens
SASSAYHHA

SEQ ID NO: 1190786 - protein, 9 aa, Homo Sapiens
IPRAITHLF

SEQ ID NO: 1190787 - protein, 9 aa, Homo Sapiens
RNTSVVKKG

SEQ ID NO: 1190788 - protein, 9 aa, Homo Sapiens
PPLDLTLHL

SEQ ID NO: 1190789 - protein, 9 aa, Homo Sapiens
LHFLLLFAL

SEQ ID NO: 1190790 - protein, 9 aa, Homo Sapiens
HTRGCRTGP

SEQ ID NO: 1190791 - protein, 9 aa, Homo Sapiens
GGAGCPRRC

SEQ ID NO: 1190792 - protein, 9 aa, Homo Sapiens
PLLLFTLIN

SEQ ID NO: 1190793 - protein, 9 aa, Homo Sapiens
CTHLAFPPE

SEQ ID NO: 1190794 - protein, 9 aa, Homo Sapiens
LNKGAEAFQ

SEQ ID NO: 1190795 - protein, 9 aa, Homo Sapiens
IAICTVSSL

SEQ ID NO: 1190796 - protein, 9 aa, Homo Sapiens
ADCPIFYPQ

SEQ ID NO: 1190797 - protein, 9 aa, Homo Sapiens
RLSLDHNFL

SEQ ID NO: 1190798 - protein, 9 aa, Homo Sapiens
WLHIDIPRV

SEQ ID NO: 1190799 - protein, 9 aa, Homo Sapiens
IVVASELGY

SEQ ID NO: 1190800 - protein, 9 aa, Homo Sapiens
QPPAEDQPA

SEQ ID NO: 1190801 - protein, 9 aa, Homo Sapiens
RERAAQTRR

SEQ ID NO: 1190802 - protein, 9 aa, Homo Sapiens
VILHSIVKR

SEQ ID NO: 1190803 - protein, 9 aa, Homo Sapiens
SSIGRPGIC

SEQ ID NO: 1190804 - protein, 9 aa, Homo Sapiens
AAVGKDQPF

SEQ ID NO: 1190805 - protein, 9 aa, Homo Sapiens
HFQAHDADE

SEQ ID NO: 1190806 - protein, 9 aa, Homo Sapiens
SCGSCPRSA

SEQ ID NO: 1190807 - protein, 9 aa, Homo Sapiens
HQAHEEQLG

SEQ ID NO: 1190808 - protein, 9 aa, Homo Sapiens
RKVVVILQL

SEQ ID NO: 1190809 - protein, 9 aa, Homo Sapiens
REGINIFWM

SEQ ID NO: 1190810 - protein, 9 aa, Homo Sapiens
VSMYRSAHF

SEQ ID NO: 1190811 - protein, 9 aa, Homo Sapiens
LADWACLWS

SEQ ID NO: 1190812 - protein, 9 aa, Homo Sapiens
LFFVLVNLE

SEQ ID NO: 1190813 - protein, 9 aa, Homo Sapiens
PRLSLDHNF

SEQ ID NO: 1190814 - protein, 9 aa, Homo Sapiens
TPMYSFLSN

SEQ ID NO: 1190815 - protein, 9 aa, Homo Sapiens
TSPSVIYWP

SEQ ID NO: 1190816 - protein, 9 aa, Homo Sapiens
QTTGCSQRR

SEQ ID NO: 1190817 - protein, 9 aa, Homo Sapiens
IYAIVGIAW

SEQ ID NO: 1190818 - protein, 9 aa, Homo Sapiens
WQHSPNGRL

SEQ ID NO: 1190819 - protein, 9 aa, Homo Sapiens
RAGRMGGRH

SEQ ID NO: 1190820 - protein, 9 aa, Homo Sapiens
MGEDASFSC

SEQ ID NO: 1190821 - protein, 9 aa, Homo Sapiens
LLASSDHEG

SEQ ID NO: 1190822 - protein, 9 aa, Homo Sapiens
SDGRSSARS

SEQ ID NO: 1190823 - protein, 9 aa, Homo Sapiens
HDLLLVTDK

SEQ ID NO: 1190824 - protein, 9 aa, Homo Sapiens
IFWMAMFQQ

SEQ ID NO: 1190825 - protein, 9 aa, Homo Sapiens
ESVRQIYSE

SEQ ID NO: 1190826 - protein, 9 aa, Homo Sapiens
APRPRRSEP

SEQ ID NO: 1190827 - protein, 9 aa, Homo Sapiens
SRKSRPCIW

SEQ ID NO: 1190828 - protein, 9 aa, Homo Sapiens
FRGRLPRHP

SEQ ID NO: 1190829 - protein, 9 aa, Homo Sapiens
LAFPQGCYS

SEQ ID NO: 1190830 - protein, 9 aa, Homo Sapiens
QDVRGKCID

SEQ ID NO: 1190831 - protein, 9 aa, Homo Sapiens
AGPTSPPMM

SEQ ID NO: 1190832 - protein, 9 aa, Homo Sapiens
AHPARTPAP

SEQ ID NO: 1190833 - protein, 9 aa, Homo Sapiens
YPSSLECTY

SEQ ID NO: 1190834 - protein, 9 aa, Homo Sapiens
RMLALQPHL

SEQ ID NO: 1190835 - protein, 9 aa, Homo Sapiens
PTSGSIFLG

SEQ ID NO: 1190836 - protein, 9 aa, Homo Sapiens
AGFHLTPEP

SEQ ID NO: 1190837 - protein, 9 aa, Homo Sapiens
ELRSLPLTW

SEQ ID NO: 1190838 - protein, 9 aa, Homo Sapiens
TTLVLKKLL

SEQ ID NO: 1190839 - protein, 9 aa, Homo Sapiens
KKSHCLQDS

SEQ ID NO: 1190840 - protein, 9 aa, Homo Sapiens
FCLEHDIQA

SEQ ID NO: 1190841 - protein, 9 aa, Homo Sapiens
GLDFGEFGV

SEQ ID NO: 1190842 - protein, 9 aa, Homo Sapiens
NGADPSLWD

SEQ ID NO: 1190843 - protein, 9 aa, Homo Sapiens
TLMATCHFD

SEQ ID NO: 1190844 - protein, 9 aa, Homo Sapiens
RPGATRATP

SEQ ID NO: 1190845 - protein, 9 aa, Homo Sapiens
VEMVLLWII

SEQ ID NO: 1190846 - protein, 9 aa, Homo Sapiens
SRGTGGALS

SEQ ID NO: 1190847 - protein, 9 aa, Homo Sapiens
PCATCRTRW

SEQ ID NO: 1190848 - protein, 9 aa, Homo Sapiens
LCLYAPVVN

SEQ ID NO: 1190849 - protein, 9 aa, Homo Sapiens
STCNAGCAR

SEQ ID NO: 1190850 - protein, 9 aa, Homo Sapiens
GGPARGTAR

SEQ ID NO: 1190851 - protein, 9 aa, Homo Sapiens
AHALRHRFD

SEQ ID NO: 1190852 - protein, 9 aa, Homo Sapiens
GKNGFSQSR

SEQ ID NO: 1190853 - protein, 9 aa, Homo Sapiens
DGAAPSSRP

SEQ ID NO: 1190854 - protein, 9 aa, Homo Sapiens
PPAESRQGW

SEQ ID NO: 1190855 - protein, 9 aa, Homo Sapiens
CACMTGIPR

SEQ ID NO: 1190856 - protein, 9 aa, Homo Sapiens
PSAFSCLAC

SEQ ID NO: 1190857 - protein, 9 aa, Homo Sapiens
AMTEDGFLT

SEQ ID NO: 1190858 - protein, 9 aa, Homo Sapiens
AYLANHQRI

SEQ ID NO: 1190859 - protein, 9 aa, Homo Sapiens
VALMNSNIS

SEQ ID NO: 1190860 - protein, 9 aa, Homo Sapiens
KMNEVGIME

SEQ ID NO: 1190861 - protein, 9 aa, Homo Sapiens
KKLKLRRNI

SEQ ID NO: 1190862 - protein, 9 aa, Homo Sapiens
AARRPWVVT

SEQ ID NO: 1190863 - protein, 9 aa, Homo Sapiens
DGSHLGQPR

SEQ ID NO: 1190864 - protein, 9 aa, Homo Sapiens
PSESMLTQS

SEQ ID NO: 1190865 - protein, 9 aa, Homo Sapiens
AKADGLGSK

SEQ ID NO: 1190866 - protein, 9 aa, Homo Sapiens
RRAKGTPKP

SEQ ID NO: 1190867 - protein, 9 aa, Homo Sapiens
RHVPPTGLV

SEQ ID NO: 1190868 - protein, 9 aa, Homo Sapiens
YVNMADIES

SEQ ID NO: 1190869 - protein, 9 aa, Homo Sapiens
PTRCVWQQP

SEQ ID NO: 1190870 - protein, 9 aa, Homo Sapiens
FHIVIEAHE

SEQ ID NO: 1190871 - protein, 9 aa, Homo Sapiens
PRRRSRARP

SEQ ID NO: 1190872 - protein, 9 aa, Homo Sapiens
KFSVMRRMR

SEQ ID NO: 1190873 - protein, 9 aa, Homo Sapiens
SLRATVPRH

SEQ ID NO: 1190874 - protein, 9 aa, Homo Sapiens
CPQASSLQK

SEQ ID NO: 1190875 - protein, 9 aa, Homo Sapiens
KLIVNPGTK

SEQ ID NO: 1190876 - protein, 9 aa, Homo Sapiens
AQAGGQKCM

SEQ ID NO: 1190877 - protein, 9 aa, Homo Sapiens
WQGEEVFQS

SEQ ID NO: 1190878 - protein, 9 aa, Homo Sapiens
ADETNDDNN

SEQ ID NO: 1190879 - protein, 9 aa, Homo Sapiens
AMSMSLPSG

SEQ ID NO: 1190880 - protein, 9 aa, Homo Sapiens
VASCWPDAH

SEQ ID NO: 1190881 - protein, 9 aa, Homo Sapiens
KRKRRRRKR

SEQ ID NO: 1190882 - protein, 9 aa, Homo Sapiens
PHGLPLGPG

SEQ ID NO: 1190883 - protein, 9 aa, Homo Sapiens
LPCFHGQTI

SEQ ID NO: 1190884 - protein, 9 aa, Homo Sapiens
PPGPWAWRA

SEQ ID NO: 1190885 - protein, 9 aa, Homo Sapiens
PIPWLNWSS

SEQ ID NO: 1190886 - protein, 9 aa, Homo Sapiens
MTAMWLSAS

SEQ ID NO: 1190887 - protein, 9 aa, Homo Sapiens
VPGKAHKKS

SEQ ID NO: 1190888 - protein, 9 aa, Homo Sapiens
LWSTCLTPD

SEQ ID NO: 1190889 - protein, 9 aa, Homo Sapiens
ILLQRNLLR

SEQ ID NO: 1190890 - protein, 9 aa, Homo Sapiens
TAAGTGGAT

SEQ ID NO: 1190891 - protein, 9 aa, Homo Sapiens
AAARAAARA

SEQ ID NO: 1190892 - protein, 9 aa, Homo Sapiens
NEGLVWVSL

SEQ ID NO: 1190893 - protein, 9 aa, Homo Sapiens
GIIRRIQTH

SEQ ID NO: 1190894 - protein, 9 aa, Homo Sapiens
RGCPPFTVP

SEQ ID NO: 1190895 - protein, 9 aa, Homo Sapiens
GKQSTCAPG

SEQ ID NO: 1190896 - protein, 9 aa, Homo Sapiens
AGWARDGGA

SEQ ID NO: 1190897 - protein, 9 aa, Homo Sapiens
LYIDALHKL

SEQ ID NO: 1190898 - protein, 9 aa, Homo Sapiens
QARLRDRGA

SEQ ID NO: 1190899 - protein, 9 aa, Homo Sapiens
WRSASTARS

SEQ ID NO: 1190900 - protein, 9 aa, Homo Sapiens
NMGGNRSIC

SEQ ID NO: 1190901 - protein, 9 aa, Homo Sapiens
ILIHDRSVS

SEQ ID NO: 1190902 - protein, 9 aa, Homo Sapiens
AKRIPENIL

SEQ ID NO: 1190903 - protein, 9 aa, Homo Sapiens
PAAQRRPIR

SEQ ID NO: 1190904 - protein, 9 aa, Homo Sapiens
DAKNTDCIW

SEQ ID NO: 1190905 - protein, 9 aa, Homo Sapiens
GPWGWLGTQ

SEQ ID NO: 1190906 - protein, 9 aa, Homo Sapiens
KPLRMSDLM

SEQ ID NO: 1190907 - protein, 9 aa, Homo Sapiens
KDNSHISDT

SEQ ID NO: 1190908 - protein, 9 aa, Homo Sapiens
QFSKFSLDR

SEQ ID NO: 1190909 - protein, 9 aa, Homo Sapiens
GSSFGGAQA

SEQ ID NO: 1190910 - protein, 9 aa, Homo Sapiens
PPRLPPKPL

SEQ ID NO: 1190911 - protein, 9 aa, Homo Sapiens
NFTAGGSTS

SEQ ID NO: 1190912 - protein, 9 aa, Homo Sapiens
SARSCFPFR

SEQ ID NO: 1190913 - protein, 9 aa, Homo Sapiens
TAALGWSPC

SEQ ID NO: 1190914 - protein, 9 aa, Homo Sapiens
VYAGRLETR

SEQ ID NO: 1190915 - protein, 9 aa, Homo Sapiens
GSNQLPVPI

SEQ ID NO: 1190916 - protein, 9 aa, Homo Sapiens
LKTENIREI

SEQ ID NO: 1190917 - protein, 9 aa, Homo Sapiens
RVTRLCQQT

SEQ ID NO: 1190918 - protein, 9 aa, Homo Sapiens
SLLSRHQDA

SEQ ID NO: 1190919 - protein, 9 aa, Homo Sapiens
TPTCLRTCH

SEQ ID NO: 1190920 - protein, 9 aa, Homo Sapiens
SISACNGLR

SEQ ID NO: 1190921 - protein, 9 aa, Homo Sapiens
PASLCMVSR

SEQ ID NO: 1190922 - protein, 9 aa, Homo Sapiens
RAMRQYLER

SEQ ID NO: 1190923 - protein, 9 aa, Homo Sapiens
QTGKISTTE

SEQ ID NO: 1190924 - protein, 9 aa, Homo Sapiens
RFDCISRKC

SEQ ID NO: 1190925 - protein, 9 aa, Homo Sapiens
KALITFLTQ

SEQ ID NO: 1190926 - protein, 9 aa, Homo Sapiens
YIVSMEHHT

SEQ ID NO: 1190927 - protein, 9 aa, Homo Sapiens
LALFVPGGG

SEQ ID NO: 1190928 - protein, 9 aa, Homo Sapiens
DCPIFYPQG

SEQ ID NO: 1190929 - protein, 9 aa, Homo Sapiens
ACPTRAHSR

SEQ ID NO: 1190930 - protein, 9 aa, Homo Sapiens
VNAVASSTE

SEQ ID NO: 1190931 - protein, 9 aa, Homo Sapiens
EAKRIPENI

SEQ ID NO: 1190932 - protein, 9 aa, Homo Sapiens
CDYHLAWLS

SEQ ID NO: 1190933 - protein, 9 aa, Homo Sapiens
PAPSPAPQA

SEQ ID NO: 1190934 - protein, 9 aa, Homo Sapiens
CCWEEYRVL

SEQ ID NO: 1190935 - protein, 9 aa, Homo Sapiens
SLKLMKLNP

SEQ ID NO: 1190936 - protein, 9 aa, Homo Sapiens
EVVAVGDHH

SEQ ID NO: 1190937 - protein, 9 aa, Homo Sapiens
GNQRSNRSL

SEQ ID NO: 1190938 - protein, 9 aa, Homo Sapiens
PHLRLRLPL

SEQ ID NO: 1190939 - protein, 9 aa, Homo Sapiens
TQPGRRRSR

SEQ ID NO: 1190940 - protein, 9 aa, Homo Sapiens
RGVSEVDRG

SEQ ID NO: 1190941 - protein, 9 aa, Homo Sapiens
LNSAAPQLR

SEQ ID NO: 1190942 - protein, 9 aa, Homo Sapiens
WYEWEVTFL

SEQ ID NO: 1190943 - protein, 9 aa, Homo Sapiens
SRHPSRPSN

SEQ ID NO: 1190944 - protein, 9 aa, Homo Sapiens
PGLPLPARP

SEQ ID NO: 1190945 - protein, 9 aa, Homo Sapiens
LVWERGVLQ

SEQ ID NO: 1190946 - protein, 9 aa, Homo Sapiens
RPVKDGAGA

SEQ ID NO: 1190947 - protein, 9 aa, Homo Sapiens
PRMKWKKEL

SEQ ID NO: 1190948 - protein, 9 aa, Homo Sapiens
NTQACCSTK

SEQ ID NO: 1190949 - protein, 9 aa, Homo Sapiens
VLYVLVCSA

SEQ ID NO: 1190950 - protein, 9 aa, Homo Sapiens
KGPPQGPWL

SEQ ID NO: 1190951 - protein, 9 aa, Homo Sapiens
AEVKREHLE

SEQ ID NO: 1190952 - protein, 9 aa, Homo Sapiens
GGVARVEVA

SEQ ID NO: 1190953 - protein, 9 aa, Homo Sapiens
WRGRGQHRR

SEQ ID NO: 1190954 - protein, 9 aa, Homo Sapiens
WVLPPDIRI

SEQ ID NO: 1190955 - protein, 9 aa, Homo Sapiens
SWCAKCNAS

SEQ ID NO: 1190956 - protein, 9 aa, Homo Sapiens
PSTPAIRVR

SEQ ID NO: 1190957 - protein, 9 aa, Homo Sapiens
DFFYREPGC

SEQ ID NO: 1190958 - protein, 9 aa, Homo Sapiens
TTHKIVHAG

SEQ ID NO: 1190959 - protein, 9 aa, Homo Sapiens
WEGAIISRD

SEQ ID NO: 1190960 - protein, 9 aa, Homo Sapiens
SRPHQCLRC

SEQ ID NO: 1190961 - protein, 9 aa, Homo Sapiens
AGRMGGRHP

SEQ ID NO: 1190962 - protein, 9 aa, Homo Sapiens
FSRSAYLAN

SEQ ID NO: 1190963 - protein, 9 aa, Homo Sapiens
VQSLPYGIL

SEQ ID NO: 1190964 - protein, 9 aa, Homo Sapiens
LDLTLHLLP

SEQ ID NO: 1190965 - protein, 9 aa, Homo Sapiens
PPTSRGSSL

SEQ ID NO: 1190966 - protein, 9 aa, Homo Sapiens
LPYGILLHL

SEQ ID NO: 1190967 - protein, 9 aa, Homo Sapiens
IKPRLKSEG

SEQ ID NO: 1190968 - protein, 9 aa, Homo Sapiens
AAASGPISA

SEQ ID NO: 1190969 - protein, 9 aa, Homo Sapiens
DMCTNAHRV

SEQ ID NO: 1190970 - protein, 9 aa, Homo Sapiens
TPPRRRSRA

SEQ ID NO: 1190971 - protein, 9 aa, Homo Sapiens
ELLVNMGGN

SEQ ID NO: 1190972 - protein, 9 aa, Homo Sapiens
YVWLRQRLC

SEQ ID NO: 1190973 - protein, 9 aa, Homo Sapiens
KTSGGGEMG

SEQ ID NO: 1190974 - protein, 9 aa, Homo Sapiens
RHPQCLCTL

SEQ ID NO: 1190975 - protein, 9 aa, Homo Sapiens
PSTNCSRRP

SEQ ID NO: 1190976 - protein, 9 aa, Homo Sapiens
EEHSLTAAG

SEQ ID NO: 1190977 - protein, 9 aa, Homo Sapiens
LRCQHQHVY

SEQ ID NO: 1190978 - protein, 9 aa, Homo Sapiens
RRSQQAGFC

SEQ ID NO: 1190979 - protein, 9 aa, Homo Sapiens
LRSPRPERS

SEQ ID NO: 1190980 - protein, 9 aa, Homo Sapiens
SKKGTMKTS

SEQ ID NO: 1190981 - protein, 9 aa, Homo Sapiens
FWTCLKMSI

SEQ ID NO: 1190982 - protein, 9 aa, Homo Sapiens
PRLTRCCLS

SEQ ID NO: 1190983 - protein, 9 aa, Homo Sapiens
VEGAGVGEH

SEQ ID NO: 1190984 - protein, 9 aa, Homo Sapiens
VFLLSHEAG

SEQ ID NO: 1190985 - protein, 9 aa, Homo Sapiens
TTGWIIRLG

SEQ ID NO: 1190986 - protein, 9 aa, Homo Sapiens
AAVISVTAM

SEQ ID NO: 1190987 - protein, 9 aa, Homo Sapiens
IKGVQQHLQ

SEQ ID NO: 1190988 - protein, 9 aa, Homo Sapiens
AKKKTCFPE

SEQ ID NO: 1190989 - protein, 9 aa, Homo Sapiens
NLKTRAKCL

SEQ ID NO: 1190990 - protein, 9 aa, Homo Sapiens
SCCVLAGME

SEQ ID NO: 1190991 - protein, 9 aa, Homo Sapiens
VQVSVARGQ

SEQ ID NO: 1190992 - protein, 9 aa, Homo Sapiens
RVTMTAKDC

SEQ ID NO: 1190993 - protein, 9 aa, Homo Sapiens
GILLHLQSQ

SEQ ID NO: 1190994 - protein, 9 aa, Homo Sapiens
QWGPKDHQD

SEQ ID NO: 1190995 - protein, 9 aa, Homo Sapiens
CRKKSHCLQ

SEQ ID NO: 1190996 - protein, 9 aa, Homo Sapiens
VIYLSGYRM

SEQ ID NO: 1190997 - protein, 9 aa, Homo Sapiens
SFEKTELSV

SEQ ID NO: 1190998 - protein, 9 aa, Homo Sapiens
YFNRSTNHG

SEQ ID NO: 1190999 - protein, 9 aa, Homo Sapiens
HRPRHRQLH

SEQ ID NO: 1191000 - protein, 9 aa, Homo Sapiens
VHSPIMATK

SEQ ID NO: 1191001 - protein, 9 aa, Homo Sapiens
AGKRLTDLQ

SEQ ID NO: 1191002 - protein, 9 aa, Homo Sapiens
IAPDVVLRL

SEQ ID NO: 1191003 - protein, 9 aa, Homo Sapiens
DLSISRRQS

SEQ ID NO: 1191004 - protein, 9 aa, Homo Sapiens
PGRPAGQVS

SEQ ID NO: 1191005 - protein, 9 aa, Homo Sapiens
QEADGAAPS

SEQ ID NO: 1191006 - protein, 9 aa, Homo Sapiens
EEAFLRVAM

SEQ ID NO: 1191007 - protein, 9 aa, Homo Sapiens
KDDPGPTGC

SEQ ID NO: 1191008 - protein, 9 aa, Homo Sapiens
RGRPKGSKT

SEQ ID NO: 1191009 - protein, 9 aa, Homo Sapiens
GIIPRAITH

SEQ ID NO: 1191010 - protein, 9 aa, Homo Sapiens
WCPDGSHLG

SEQ ID NO: 1191011 - protein, 9 aa, Homo Sapiens
RTGPCCSRG

SEQ ID NO: 1191012 - protein, 9 aa, Homo Sapiens
INGHRDRSH

SEQ ID NO: 1191013 - protein, 9 aa, Homo Sapiens
IGGADMPIV

SEQ ID NO: 1191014 - protein, 9 aa, Homo Sapiens
RCWMTSRTL

SEQ ID NO: 1191015 - protein, 9 aa, Homo Sapiens
GIFGIEKDH

SEQ ID NO: 1191016 - protein, 9 aa, Homo Sapiens
PCIYVSANS

SEQ ID NO: 1191017 - protein, 9 aa, Homo Sapiens
SEELRCWFI

SEQ ID NO: 1191018 - protein, 9 aa, Homo Sapiens
PGQRDKQHF

SEQ ID NO: 1191019 - protein, 9 aa, Homo Sapiens
FVCHWGAAP

SEQ ID NO: 1191020 - protein, 9 aa, Homo Sapiens
GDHADHLPP

SEQ ID NO: 1191021 - protein, 9 aa, Homo Sapiens
YSPLLLFCY

SEQ ID NO: 1191022 - protein, 9 aa, Homo Sapiens
GRRQRRRRQ

SEQ ID NO: 1191023 - protein, 9 aa, Homo Sapiens
GPSGSGVWT

SEQ ID NO: 1191024 - protein, 9 aa, Homo Sapiens
DRSEESTTV

SEQ ID NO: 1191025 - protein, 9 aa, Homo Sapiens
TQAAEEPSG

SEQ ID NO: 1191026 - protein, 9 aa, Homo Sapiens
EFSSVGPYS

SEQ ID NO: 1191027 - protein, 9 aa, Homo Sapiens
ANAPRAHTV

SEQ ID NO: 1191028 - protein, 9 aa, Homo Sapiens
RDVAGVTWG

SEQ ID NO: 1191029 - protein, 9 aa, Homo Sapiens
EVGRAVWLH

SEQ ID NO: 1191030 - protein, 9 aa, Homo Sapiens
VIQLTSDES

SEQ ID NO: 1191031 - protein, 9 aa, Homo Sapiens
FHLQYRPAQ

SEQ ID NO: 1191032 - protein, 9 aa, Homo Sapiens
GVARVEVAA

SEQ ID NO: 1191033 - protein, 9 aa, Homo Sapiens
VQIRHVVVV

SEQ ID NO: 1191034 - protein, 9 aa, Homo Sapiens
QALLTHRVQ

SEQ ID NO: 1191035 - protein, 9 aa, Homo Sapiens
ISLQMVYPQ

SEQ ID NO: 1191036 - protein, 9 aa, Homo Sapiens
PWLSRRMAS

SEQ ID NO: 1191037 - protein, 9 aa, Homo Sapiens
SHLPPRTKW

SEQ ID NO: 1191038 - protein, 9 aa, Homo Sapiens
NRFVHPSAD

SEQ ID NO: 1191039 - protein, 9 aa, Homo Sapiens
CPADPYSSC

SEQ ID NO: 1191040 - protein, 9 aa, Homo Sapiens
GPPQSCRRA

SEQ ID NO: 1191041 - protein, 9 aa, Homo Sapiens
EVRTARTLL

SEQ ID NO: 1191042 - protein, 9 aa, Homo Sapiens
PFLFYHAKT

SEQ ID NO: 1191043 - protein, 9 aa, Homo Sapiens
AEPPVPLLE

SEQ ID NO: 1191044 - protein, 9 aa, Homo Sapiens
DGITILVGS

SEQ ID NO: 1191045 - protein, 9 aa, Homo Sapiens
LPREFGDAE

SEQ ID NO: 1191046 - protein, 9 aa, Homo Sapiens
PLQCLLHSL

SEQ ID NO: 1191047 - protein, 9 aa, Homo Sapiens
RPPPTPFDR

SEQ ID NO: 1191048 - protein, 9 aa, Homo Sapiens
QFIHKDSAN

SEQ ID NO: 1191049 - protein, 9 aa, Homo Sapiens
VFWLMCMCQ

SEQ ID NO: 1191050 - protein, 9 aa, Homo Sapiens
PDPEAGHPH

SEQ ID NO: 1191051 - protein, 9 aa, Homo Sapiens
DELDHILSP

SEQ ID NO: 1191052 - protein, 9 aa, Homo Sapiens
LTVPSHPYE

SEQ ID NO: 1191053 - protein, 9 aa, Homo Sapiens
RCEGQVEEH

SEQ ID NO: 1191054 - protein, 9 aa, Homo Sapiens
PPGQFVIAD

SEQ ID NO: 1191055 - protein, 9 aa, Homo Sapiens
KAVGPPSPL

SEQ ID NO: 1191056 - protein, 9 aa, Homo Sapiens
EASRPHQCL

SEQ ID NO: 1191057 - protein, 9 aa, Homo Sapiens
PQVHCCSST

SEQ ID NO: 1191058 - protein, 9 aa, Homo Sapiens
HSSPLPSRS

SEQ ID NO: 1191059 - protein, 9 aa, Homo Sapiens
PSVNAVSMM

SEQ ID NO: 1191060 - protein, 9 aa, Homo Sapiens
ARRPPGVPL

SEQ ID NO: 1191061 - protein, 9 aa, Homo Sapiens
WTGGTLSHQ

SEQ ID NO: 1191062 - protein, 9 aa, Homo Sapiens
WLMTAMWLS

SEQ ID NO: 1191063 - protein, 9 aa, Homo Sapiens
PRPCRRGTL

SEQ ID NO: 1191064 - protein, 9 aa, Homo Sapiens
LSQQEWPQR

SEQ ID NO: 1191065 - protein, 9 aa, Homo Sapiens
VHDLLLVTD

SEQ ID NO: 1191066 - protein, 9 aa, Homo Sapiens
FFYSPLLLF

SEQ ID NO: 1191067 - protein, 9 aa, Homo Sapiens
EHLKCAGKR

SEQ ID NO: 1191068 - protein, 9 aa, Homo Sapiens
TDAAQAAIA

SEQ ID NO: 1191069 - protein, 9 aa, Homo Sapiens
SGVKHVLDA

SEQ ID NO: 1191070 - protein, 9 aa, Homo Sapiens
LLMGMCPLC

SEQ ID NO: 1191071 - protein, 9 aa, Homo Sapiens
HRDRSHSGH

SEQ ID NO: 1191072 - protein, 9 aa, Homo Sapiens
DLSAKDKTI

SEQ ID NO: 1191073 - protein, 9 aa, Homo Sapiens
EGINIFWMA

SEQ ID NO: 1191074 - protein, 9 aa, Homo Sapiens
DSRDGWGAM

SEQ ID NO: 1191075 - protein, 9 aa, Homo Sapiens
GWPVEVRLF

SEQ ID NO: 1191076 - protein, 9 aa, Homo Sapiens
TATSCLERT

SEQ ID NO: 1191077 - protein, 9 aa, Homo Sapiens
PVADLWADV

SEQ ID NO: 1191078 - protein, 9 aa, Homo Sapiens
TGPTRPPTK

SEQ ID NO: 1191079 - protein, 9 aa, Homo Sapiens
HTAPAALDT

SEQ ID NO: 1191080 - protein, 9 aa, Homo Sapiens
LCSRRYQKY

SEQ ID NO: 1191081 - protein, 9 aa, Homo Sapiens
KGKCLGGST

SEQ ID NO: 1191082 - protein, 9 aa, Homo Sapiens
LSPLSVCPE

SEQ ID NO: 1191083 - protein, 9 aa, Homo Sapiens
LQMRSLEAH

SEQ ID NO: 1191084 - protein, 9 aa, Homo Sapiens
LPSDPHLLA

SEQ ID NO: 1191085 - protein, 9 aa, Homo Sapiens
LLLALFVPG

SEQ ID NO: 1191086 - protein, 9 aa, Homo Sapiens
ICHPGPGYL

SEQ ID NO: 1191087 - protein, 9 aa, Homo Sapiens
MTLGLWSGP

SEQ ID NO: 1191088 - protein, 9 aa, Homo Sapiens
IFRLLISRA

SEQ ID NO: 1191089 - protein, 9 aa, Homo Sapiens
MGGQDGVSC

SEQ ID NO: 1191090 - protein, 9 aa, Homo Sapiens
SSTDQEHEL

SEQ ID NO: 1191091 - protein, 9 aa, Homo Sapiens
RCWFIQQEM

SEQ ID NO: 1191092 - protein, 9 aa, Homo Sapiens
PPMLWTMDP

SEQ ID NO: 1191093 - protein, 9 aa, Homo Sapiens
HDIQADGTF

SEQ ID NO: 1191094 - protein, 9 aa, Homo Sapiens
VAGPRTGAP

SEQ ID NO: 1191095 - protein, 9 aa, Homo Sapiens
PGCLPLHCG

SEQ ID NO: 1191096 - protein, 9 aa, Homo Sapiens
AEATSWSCQ

SEQ ID NO: 1191097 - protein, 9 aa, Homo Sapiens
FSVIFYDPC

SEQ ID NO: 1191098 - protein, 9 aa, Homo Sapiens
EEIASASNS

SEQ ID NO: 1191099 - protein, 9 aa, Homo Sapiens
SPNQNSMLS

SEQ ID NO: 1191100 - protein, 9 aa, Homo Sapiens
AGVGEHEFD

SEQ ID NO: 1191101 - protein, 9 aa, Homo Sapiens
RPGWKRTQQ

SEQ ID NO: 1191102 - protein, 9 aa, Homo Sapiens
DATNVSNWH

SEQ ID NO: 1191103 - protein, 9 aa, Homo Sapiens
AEDHPRILQ

SEQ ID NO: 1191104 - protein, 9 aa, Homo Sapiens
EPRPTSAWQ

SEQ ID NO: 1191105 - protein, 9 aa, Homo Sapiens
VGGFKRRLC

SEQ ID NO: 1191106 - protein, 9 aa, Homo Sapiens
DYLHAMHTL

SEQ ID NO: 1191107 - protein, 9 aa, Homo Sapiens
AACPQTSKV

SEQ ID NO: 1191108 - protein, 9 aa, Homo Sapiens
ANQSATLND

SEQ ID NO: 1191109 - protein, 9 aa, Homo Sapiens
RMLTALGFR

SEQ ID NO: 1191110 - protein, 9 aa, Homo Sapiens
VEILPMGSL

SEQ ID NO: 1191111 - protein, 9 aa, Homo Sapiens
QPLPGQHLW

SEQ ID NO: 1191112 - protein, 9 aa, Homo Sapiens
GSARTCRAL

SEQ ID NO: 1191113 - protein, 9 aa, Homo Sapiens
QIKRDVNRR

SEQ ID NO: 1191114 - protein, 9 aa, Homo Sapiens
QARVAVGDW

SEQ ID NO: 1191115 - protein, 9 aa, Homo Sapiens
QHIEELQVI

SEQ ID NO: 1191116 - protein, 9 aa, Homo Sapiens
LDVRKCLPA

SEQ ID NO: 1191117 - protein, 9 aa, Homo Sapiens
GHCPLQGFL

SEQ ID NO: 1191118 - protein, 9 aa, Homo Sapiens
VPLLKKLLK

SEQ ID NO: 1191119 - protein, 9 aa, Homo Sapiens
PAPLLAVGG

SEQ ID NO: 1191120 - protein, 9 aa, Homo Sapiens
MNSGVKHVL

SEQ ID NO: 1191121 - protein, 9 aa, Homo Sapiens
HQIKSSFGQ

SEQ ID NO: 1191122 - protein, 9 aa, Homo Sapiens
PECKKSSTV

SEQ ID NO: 1191123 - protein, 9 aa, Homo Sapiens
GAGPPGAGA

SEQ ID NO: 1191124 - protein, 9 aa, Homo Sapiens
LGEMHVPTA

SEQ ID NO: 1191125 - protein, 9 aa, Homo Sapiens
QRNLLRLQS

SEQ ID NO: 1191126 - protein, 9 aa, Homo Sapiens
TDEGWELIK

SEQ ID NO: 1191127 - protein, 9 aa, Homo Sapiens
VALGGDSNS

SEQ ID NO: 1191128 - protein, 9 aa, Homo Sapiens
CWNGHIKAR

SEQ ID NO: 1191129 - protein, 9 aa, Homo Sapiens
ASAEECQLL

SEQ ID NO: 1191130 - protein, 9 aa, Homo Sapiens
ATVTRTPAT

SEQ ID NO: 1191131 - protein, 9 aa, Homo Sapiens
CGSCPRSAW

SEQ ID NO: 1191132 - protein, 9 aa, Homo Sapiens
VCTGRAASW

SEQ ID NO: 1191133 - protein, 9 aa, Homo Sapiens
STQRTAVAP

SEQ ID NO: 1191134 - protein, 9 aa, Homo Sapiens
SDPVGPPCR

SEQ ID NO: 1191135 - protein, 9 aa, Homo Sapiens
LASCCVIPP

SEQ ID NO: 1191136 - protein, 9 aa, Homo Sapiens
QMQIDKVSE

SEQ ID NO: 1191137 - protein, 9 aa, Homo Sapiens
LKLRGSGLP

SEQ ID NO: 1191138 - protein, 9 aa, Homo Sapiens
NDDDANQSA

SEQ ID NO: 1191139 - protein, 9 aa, Homo Sapiens
VHAQLLEME

SEQ ID NO: 1191140 - protein, 9 aa, Homo Sapiens
AAKFLSANK

SEQ ID NO: 1191141 - protein, 9 aa, Homo Sapiens
HPHHTQGPP

SEQ ID NO: 1191142 - protein, 9 aa, Homo Sapiens
RDVVLDVEA

SEQ ID NO: 1191143 - protein, 9 aa, Homo Sapiens
DPDPSRLLL

SEQ ID NO: 1191144 - protein, 9 aa, Homo Sapiens
GPGAASASC

SEQ ID NO: 1191145 - protein, 9 aa, Homo Sapiens
HSPSRAAPQ

SEQ ID NO: 1191146 - protein, 9 aa, Homo Sapiens
LCGKNWEKL

SEQ ID NO: 1191147 - protein, 9 aa, Homo Sapiens
LHVQHQPLG

SEQ ID NO: 1191148 - protein, 9 aa, Homo Sapiens
QAAIAFSFF

SEQ ID NO: 1191149 - protein, 9 aa, Homo Sapiens
MKQMNDARH

SEQ ID NO: 1191150 - protein, 9 aa, Homo Sapiens
WLYVQKMNM

SEQ ID NO: 1191151 - protein, 9 aa, Homo Sapiens
TLANASSLR

SEQ ID NO: 1191152 - protein, 9 aa, Homo Sapiens
SVSEKETWI

SEQ ID NO: 1191153 - protein, 9 aa, Homo Sapiens
TMDRPPIGW

SEQ ID NO: 1191154 - protein, 9 aa, Homo Sapiens
FLHSSLDPL

SEQ ID NO: 1191155 - protein, 9 aa, Homo Sapiens
FISSSSYSY

SEQ ID NO: 1191156 - protein, 9 aa, Homo Sapiens
GGYGKKVVV

SEQ ID NO: 1191157 - protein, 9 aa, Homo Sapiens
EKNERINRA

SEQ ID NO: 1191158 - protein, 9 aa, Homo Sapiens
AQKKGFTSS

SEQ ID NO: 1191159 - protein, 9 aa, Homo Sapiens
FIFQNIATQ

SEQ ID NO: 1191160 - protein, 9 aa, Homo Sapiens
YKCEDCGNA

SEQ ID NO: 1191161 - protein, 9 aa, Homo Sapiens
VVTARPART

SEQ ID NO: 1191162 - protein, 9 aa, Homo Sapiens
LLLLLVVLA

SEQ ID NO: 1191163 - protein, 9 aa, Homo Sapiens
RKIEAQVSA

SEQ ID NO: 1191164 - protein, 9 aa, Homo Sapiens
VIFHFCTMK

SEQ ID NO: 1191165 - protein, 9 aa, Homo Sapiens
EVPQVGPSA

SEQ ID NO: 1191166 - protein, 9 aa, Homo Sapiens
VMVVRPVAT

SEQ ID NO: 1191167 - protein, 9 aa, Homo Sapiens
TADHTMSSG

SEQ ID NO: 1191168 - protein, 9 aa, Homo Sapiens
AGLSEHSQL

SEQ ID NO: 1191169 - protein, 9 aa, Homo Sapiens
SSNRNSIER

SEQ ID NO: 1191170 - protein, 9 aa, Homo Sapiens
CISSGWRHI

SEQ ID NO: 1191171 - protein, 9 aa, Homo Sapiens
LFFWRPPTR

SEQ ID NO: 1191172 - protein, 9 aa, Homo Sapiens
EAEDKMLRT

SEQ ID NO: 1191173 - protein, 9 aa, Homo Sapiens
QQQQQQSQQ

SEQ ID NO: 1191174 - protein, 9 aa, Homo Sapiens
AHGLSHLRG

SEQ ID NO: 1191175 - protein, 9 aa, Homo Sapiens
PPVRRDKNF

SEQ ID NO: 1191176 - protein, 9 aa, Homo Sapiens
QGFVPDAEL

SEQ ID NO: 1191177 - protein, 9 aa, Homo Sapiens
PPPLPLPRR

SEQ ID NO: 1191178 - protein, 9 aa, Homo Sapiens
SPLLLFCYI

SEQ ID NO: 1191179 - protein, 9 aa, Homo Sapiens
CCGTRRSCS

SEQ ID NO: 1191180 - protein, 9 aa, Homo Sapiens
RCFGILSNC

SEQ ID NO: 1191181 - protein, 9 aa, Homo Sapiens
QQCTQRQRW

SEQ ID NO: 1191182 - protein, 9 aa, Homo Sapiens
KRSIPCESN

SEQ ID NO: 1191183 - protein, 9 aa, Homo Sapiens
LTFITGQKA

SEQ ID NO: 1191184 - protein, 9 aa, Homo Sapiens
PRTRCCPRP

SEQ ID NO: 1191185 - protein, 9 aa, Homo Sapiens
RKCLTLANA

SEQ ID NO: 1191186 - protein, 9 aa, Homo Sapiens
GPRAPPGAC

SEQ ID NO: 1191187 - protein, 9 aa, Homo Sapiens
KKGFTSSLP

SEQ ID NO: 1191188 - protein, 9 aa, Homo Sapiens
VRLFSHSQV

SEQ ID NO: 1191189 - protein, 9 aa, Homo Sapiens
GPPGAGAAD

SEQ ID NO: 1191190 - protein, 9 aa, Homo Sapiens
VGNGCAGGG

SEQ ID NO: 1191191 - protein, 9 aa, Homo Sapiens
LPASVHAIC

SEQ ID NO: 1191192 - protein, 9 aa, Homo Sapiens
LVHLYMYSK

SEQ ID NO: 1191193 - protein, 9 aa, Homo Sapiens
VALAVFSMP

SEQ ID NO: 1191194 - protein, 9 aa, Homo Sapiens
TTPAQALHH

SEQ ID NO: 1191195 - protein, 9 aa, Homo Sapiens
GRAPAQPPG

SEQ ID NO: 1191196 - protein, 9 aa, Homo Sapiens
QPLPRSTCT

SEQ ID NO: 1191197 - protein, 9 aa, Homo Sapiens
GIGHVAPST

SEQ ID NO: 1191198 - protein, 9 aa, Homo Sapiens
MSKPVRVVQ

SEQ ID NO: 1191199 - protein, 9 aa, Homo Sapiens
LGLGGEVLG

SEQ ID NO: 1191200 - protein, 9 aa, Homo Sapiens
AACPSGSAP

SEQ ID NO: 1191201 - protein, 9 aa, Homo Sapiens
VLSYYHKKM

SEQ ID NO: 1191202 - protein, 9 aa, Homo Sapiens
NGKMGINAE

SEQ ID NO: 1191203 - protein, 9 aa, Homo Sapiens
LSSLKPGAL

SEQ ID NO: 1191204 - protein, 9 aa, Homo Sapiens
ISHCQNCMV

SEQ ID NO: 1191205 - protein, 9 aa, Homo Sapiens
FNASFGSTR

SEQ ID NO: 1191206 - protein, 9 aa, Homo Sapiens
QAGSEERSD

SEQ ID NO: 1191207 - protein, 9 aa, Homo Sapiens
PKCHPKCTP

SEQ ID NO: 1191208 - protein, 9 aa, Homo Sapiens
RRTQKKNMS

SEQ ID NO: 1191209 - protein, 9 aa, Homo Sapiens
LLTFITGQK

SEQ ID NO: 1191210 - protein, 9 aa, Homo Sapiens
GASGRRVMD

SEQ ID NO: 1191211 - protein, 9 aa, Homo Sapiens
SLLHDPMTL

SEQ ID NO: 1191212 - protein, 9 aa, Homo Sapiens
GRRSRYVWL

SEQ ID NO: 1191213 - protein, 9 aa, Homo Sapiens
GPVSSVGGR

SEQ ID NO: 1191214 - protein, 9 aa, Homo Sapiens
MGAVFLLSH

SEQ ID NO: 1191215 - protein, 9 aa, Homo Sapiens
ITNAASCAC

SEQ ID NO: 1191216 - protein, 9 aa, Homo Sapiens
SNWRQLCGW

SEQ ID NO: 1191217 - protein, 9 aa, Homo Sapiens
HDRADHLLD

SEQ ID NO: 1191218 - protein, 9 aa, Homo Sapiens
GEPQQQAPE

SEQ ID NO: 1191219 - protein, 9 aa, Homo Sapiens
FVQTKCKKN

SEQ ID NO: 1191220 - protein, 9 aa, Homo Sapiens
KWEPWIKKS

SEQ ID NO: 1191221 - protein, 9 aa, Homo Sapiens
TRKALITFL

SEQ ID NO: 1191222 - protein, 9 aa, Homo Sapiens
DGRCGVWRR

SEQ ID NO: 1191223 - protein, 9 aa, Homo Sapiens
TSNNLKAPP

SEQ ID NO: 1191224 - protein, 9 aa, Homo Sapiens
GGQPGGCSS

SEQ ID NO: 1191225 - protein, 9 aa, Homo Sapiens
SPKKPKTFL

SEQ ID NO: 1191226 - protein, 9 aa, Homo Sapiens
TKHKKIHTA

SEQ ID NO: 1191227 - protein, 9 aa, Homo Sapiens
LGLADWACL

SEQ ID NO: 1191228 - protein, 9 aa, Homo Sapiens
QCLDVGLAH

SEQ ID NO: 1191229 - protein, 9 aa, Homo Sapiens
NNSKPVQEA

SEQ ID NO: 1191230 - protein, 9 aa, Homo Sapiens
LHGPPRTGG

SEQ ID NO: 1191231 - protein, 9 aa, Homo Sapiens
VEEHFRGVW

SEQ ID NO: 1191232 - protein, 9 aa, Homo Sapiens
GGDSNSSSS

SEQ ID NO: 1191233 - protein, 9 aa, Homo Sapiens
GWRGRGPGL

SEQ ID NO: 1191234 - protein, 9 aa, Homo Sapiens
ESGSSQAGT

SEQ ID NO: 1191235 - protein, 9 aa, Homo Sapiens
ARRGAGAQD

SEQ ID NO: 1191236 - protein, 9 aa, Homo Sapiens
SLASPRACA

SEQ ID NO: 1191237 - protein, 9 aa, Homo Sapiens
AMLETYGTV

SEQ ID NO: 1191238 - protein, 9 aa, Homo Sapiens
SPPLDLTLH

SEQ ID NO: 1191239 - protein, 9 aa, Homo Sapiens
LKKLVETHI

SEQ ID NO: 1191240 - protein, 9 aa, Homo Sapiens
DLQESDGQM

SEQ ID NO: 1191241 - protein, 9 aa, Homo Sapiens
DTLYQCGCG

SEQ ID NO: 1191242 - protein, 9 aa, Homo Sapiens
SIHFAAHDQ

SEQ ID NO: 1191243 - protein, 9 aa, Homo Sapiens
SRSPPTLMM

SEQ ID NO: 1191244 - protein, 9 aa, Homo Sapiens
SVAAWPSRR

SEQ ID NO: 1191245 - protein, 9 aa, Homo Sapiens
HVSEPSEPC

SEQ ID NO: 1191246 - protein, 9 aa, Homo Sapiens
NIEAMSSYL

SEQ ID NO: 1191247 - protein, 9 aa, Homo Sapiens
CVCILGELF

SEQ ID NO: 1191248 - protein, 9 aa, Homo Sapiens
IAVRHPQCL

SEQ ID NO: 1191249 - protein, 9 aa, Homo Sapiens
HVAPSTAII

SEQ ID NO: 1191250 - protein, 9 aa, Homo Sapiens
QPQMQHSPH

SEQ ID NO: 1191251 - protein, 9 aa, Homo Sapiens
APPPCRPRV

SEQ ID NO: 1191252 - protein, 9 aa, Homo Sapiens
YKSAVSGAI

SEQ ID NO: 1191253 - protein, 9 aa, Homo Sapiens
FIRKQCVGH

SEQ ID NO: 1191254 - protein, 9 aa, Homo Sapiens
QRIKEFRRL

SEQ ID NO: 1191255 - protein, 9 aa, Homo Sapiens
KKVWSWTTM

SEQ ID NO: 1191256 - protein, 9 aa, Homo Sapiens
DISAIERNA

SEQ ID NO: 1191257 - protein, 9 aa, Homo Sapiens
QQLSFLPLP

SEQ ID NO: 1191258 - protein, 9 aa, Homo Sapiens
FQLAPPGSL

SEQ ID NO: 1191259 - protein, 9 aa, Homo Sapiens
TCVKEKEDL

SEQ ID NO: 1191260 - protein, 9 aa, Homo Sapiens
ECAKNLLST

SEQ ID NO: 1191261 - protein, 9 aa, Homo Sapiens
VRDLVQRLP

SEQ ID NO: 1191262 - protein, 9 aa, Homo Sapiens
KSKDLTSPA

SEQ ID NO: 1191263 - protein, 9 aa, Homo Sapiens
PTLIHTNMY

SEQ ID NO: 1191264 - protein, 9 aa, Homo Sapiens
CAHAGASRG

SEQ ID NO: 1191265 - protein, 9 aa, Homo Sapiens
SLYDIPYMF

SEQ ID NO: 1191266 - protein, 9 aa, Homo Sapiens
WACLWSPSL

SEQ ID NO: 1191267 - protein, 9 aa, Homo Sapiens
YDPNFAICG

SEQ ID NO: 1191268 - protein, 9 aa, Homo Sapiens
LRPQRGPRP

SEQ ID NO: 1191269 - protein, 9 aa, Homo Sapiens
RWLLSQKET

SEQ ID NO: 1191270 - protein, 9 aa, Homo Sapiens
GGALSSAPG

SEQ ID NO: 1191271 - protein, 9 aa, Homo Sapiens
QDRFPLLPG

SEQ ID NO: 1191272 - protein, 9 aa, Homo Sapiens
HTGEHPFAC

SEQ ID NO: 1191273 - protein, 9 aa, Homo Sapiens
PLGVLALQG

SEQ ID NO: 1191274 - protein, 9 aa, Homo Sapiens
HVNSVRRKS

SEQ ID NO: 1191275 - protein, 9 aa, Homo Sapiens
AGTRPGLGL

SEQ ID NO: 1191276 - protein, 9 aa, Homo Sapiens
ENNMCGVVL

SEQ ID NO: 1191277 - protein, 9 aa, Homo Sapiens
TEDVIASDS

SEQ ID NO: 1191278 - protein, 9 aa, Homo Sapiens
ARRRVSRKM

SEQ ID NO: 1191279 - protein, 9 aa, Homo Sapiens
CRQDGLMVI

SEQ ID NO: 1191280 - protein, 9 aa, Homo Sapiens
CAAEKCLAS

SEQ ID NO: 1191281 - protein, 9 aa, Homo Sapiens
AARAAARAA

SEQ ID NO: 1191282 - protein, 9 aa, Homo Sapiens
SPTAWSHCP

SEQ ID NO: 1191283 - protein, 9 aa, Homo Sapiens
SQGGRILLQ

SEQ ID NO: 1191284 - protein, 9 aa, Homo Sapiens
EGPRMKWKK

SEQ ID NO: 1191285 - protein, 9 aa, Homo Sapiens
HFLLLFALF

SEQ ID NO: 1191286 - protein, 9 aa, Homo Sapiens
ADSGGAAGQ

SEQ ID NO: 1191287 - protein, 9 aa, Homo Sapiens
RHCTLTWSR

SEQ ID NO: 1191288 - protein, 9 aa, Homo Sapiens
KKNSLKLMK

SEQ ID NO: 1191289 - protein, 9 aa, Homo Sapiens
FPEKYPSSL

SEQ ID NO: 1191290 - protein, 9 aa, Homo Sapiens
SSSSPQPAG

SEQ ID NO: 1191291 - protein, 9 aa, Homo Sapiens
AVPLAFGYF

SEQ ID NO: 1191292 - protein, 9 aa, Homo Sapiens
FVINYCIEK

SEQ ID NO: 1191293 - protein, 9 aa, Homo Sapiens
PALSLEAHT

SEQ ID NO: 1191294 - protein, 9 aa, Homo Sapiens
FHKKNRREV

SEQ ID NO: 1191295 - protein, 9 aa, Homo Sapiens
RASCSDGRS

SEQ ID NO: 1191296 - protein, 9 aa, Homo Sapiens
APDPRRRPS

SEQ ID NO: 1191297 - protein, 9 aa, Homo Sapiens
FRYLVCPRA

SEQ ID NO: 1191298 - protein, 9 aa, Homo Sapiens
RMFSKQGAL

SEQ ID NO: 1191299 - protein, 9 aa, Homo Sapiens
APARCGPWA

SEQ ID NO: 1191300 - protein, 9 aa, Homo Sapiens
PGEADSGRP

SEQ ID NO: 1191301 - protein, 9 aa, Homo Sapiens
SFYSFIYFI

SEQ ID NO: 1191302 - protein, 9 aa, Homo Sapiens
QAQGLDFGE

SEQ ID NO: 1191303 - protein, 9 aa, Homo Sapiens
PLDIKVYTD

SEQ ID NO: 1191304 - protein, 9 aa, Homo Sapiens
VKKLIVNPG

SEQ ID NO: 1191305 - protein, 9 aa, Homo Sapiens
YYAPALKCE

SEQ ID NO: 1191306 - protein, 9 aa, Homo Sapiens
RWQARHLVI

SEQ ID NO: 1191307 - protein, 9 aa, Homo Sapiens
PYPRIHSPL

SEQ ID NO: 1191308 - protein, 9 aa, Homo Sapiens
RAPAPLPFR

SEQ ID NO: 1191309 - protein, 9 aa, Homo Sapiens
DRGAAQMSW

SEQ ID NO: 1191310 - protein, 9 aa, Homo Sapiens
YRSAHFLPL

SEQ ID NO: 1191311 - protein, 9 aa, Homo Sapiens
VASYDKTVR

SEQ ID NO: 1191312 - protein, 9 aa, Homo Sapiens
RRSRARPSH

SEQ ID NO: 1191313 - protein, 9 aa, Homo Sapiens
VTINQTDKE

SEQ ID NO: 1191314 - protein, 9 aa, Homo Sapiens
HNDLILWGH

SEQ ID NO: 1191315 - protein, 9 aa, Homo Sapiens
RSPSRTCST

SEQ ID NO: 1191316 - protein, 9 aa, Homo Sapiens
REVAEAAAV

SEQ ID NO: 1191317 - protein, 9 aa, Homo Sapiens
SAVQSLPYG

SEQ ID NO: 1191318 - protein, 9 aa, Homo Sapiens
MLSAAGSPS

SEQ ID NO: 1191319 - protein, 9 aa, Homo Sapiens
QHKGLLEED

SEQ ID NO: 1191320 - protein, 9 aa, Homo Sapiens
QAKDDSQNV

SEQ ID NO: 1191321 - protein, 9 aa, Homo Sapiens
TCWQRRTAA

SEQ ID NO: 1191322 - protein, 9 aa, Homo Sapiens
ATVPRHSSV

SEQ ID NO: 1191323 - protein, 9 aa, Homo Sapiens
PISAARKSW

SEQ ID NO: 1191324 - protein, 9 aa, Homo Sapiens
DCKLSNWSS

SEQ ID NO: 1191325 - protein, 9 aa, Homo Sapiens
FDELHIECS

SEQ ID NO: 1191326 - protein, 9 aa, Homo Sapiens
GHIKARYLP

SEQ ID NO: 1191327 - protein, 9 aa, Homo Sapiens
PPPPTKKRG

SEQ ID NO: 1191328 - protein, 9 aa, Homo Sapiens
LQEECAESH

SEQ ID NO: 1191329 - protein, 9 aa, Homo Sapiens
CWACCGTRR

SEQ ID NO: 1191330 - protein, 9 aa, Homo Sapiens
SGICAVGLI

SEQ ID NO: 1191331 - protein, 9 aa, Homo Sapiens
SVSSTDQEH

SEQ ID NO: 1191332 - protein, 9 aa, Homo Sapiens
KFLGEEQQL

SEQ ID NO: 1191333 - protein, 9 aa, Homo Sapiens
ATSPCTKLM

SEQ ID NO: 1191334 - protein, 9 aa, Homo Sapiens
FVGVRTVED

SEQ ID NO: 1191335 - protein, 9 aa, Homo Sapiens
GRPASGGCC

SEQ ID NO: 1191336 - protein, 9 aa, Homo Sapiens
WRLTGLEVQ

SEQ ID NO: 1191337 - protein, 9 aa, Homo Sapiens
LGTPATAAA

SEQ ID NO: 1191338 - protein, 9 aa, Homo Sapiens
RGAFVGPRC

SEQ ID NO: 1191339 - protein, 9 aa, Homo Sapiens
TTSSLGKSD

SEQ ID NO: 1191340 - protein, 9 aa, Homo Sapiens
NVGLLGAGP

SEQ ID NO: 1191341 - protein, 9 aa, Homo Sapiens
ATGSAVESI

SEQ ID NO: 1191342 - protein, 9 aa, Homo Sapiens
QPFMGGQKP

SEQ ID NO: 1191343 - protein, 9 aa, Homo Sapiens
DSSDSELLW

SEQ ID NO: 1191344 - protein, 9 aa, Homo Sapiens
SPRASLLWL

SEQ ID NO: 1191345 - protein, 9 aa, Homo Sapiens
CMVQIIAIA

SEQ ID NO: 1191346 - protein, 9 aa, Homo Sapiens
TTTTTTPST

SEQ ID NO: 1191347 - protein, 9 aa, Homo Sapiens
CWVVHTTLF

SEQ ID NO: 1191348 - protein, 9 aa, Homo Sapiens
CCTVFSTMG

SEQ ID NO: 1191349 - protein, 9 aa, Homo Sapiens
AWWFGTIKS

SEQ ID NO: 1191350 - protein, 9 aa, Homo Sapiens
CSSCGSCGC

SEQ ID NO: 1191351 - protein, 9 aa, Homo Sapiens
VGLIGNTAV

SEQ ID NO: 1191352 - protein, 9 aa, Homo Sapiens
GYVDNPNKT

SEQ ID NO: 1191353 - protein, 9 aa, Homo Sapiens
RLKPSAPNS

SEQ ID NO: 1191354 - protein, 9 aa, Homo Sapiens
DRPSCDMME

SEQ ID NO: 1191355 - protein, 9 aa, Homo Sapiens
LVSSADLKA

SEQ ID NO: 1191356 - protein, 9 aa, Homo Sapiens
KEERKSKRK

SEQ ID NO: 1191357 - protein, 9 aa, Homo Sapiens
HWRRGGGQV

SEQ ID NO: 1191358 - protein, 9 aa, Homo Sapiens
ASCARWRTR

SEQ ID NO: 1191359 - protein, 9 aa, Homo Sapiens
EKIRKVLPS

SEQ ID NO: 1191360 - protein, 9 aa, Homo Sapiens
GRLASSAPT

SEQ ID NO: 1191361 - protein, 9 aa, Homo Sapiens
LDTDPAHTG

SEQ ID NO: 1191362 - protein, 9 aa, Homo Sapiens
SEPGWASSR

SEQ ID NO: 1191363 - protein, 9 aa, Homo Sapiens
NLAMLERQF

SEQ ID NO: 1191364 - protein, 9 aa, Homo Sapiens
MAYFPTISL

SEQ ID NO: 1191365 - protein, 9 aa, Homo Sapiens
WGQPQMQHS

SEQ ID NO: 1191366 - protein, 9 aa, Homo Sapiens
EQTPNVQDI

SEQ ID NO: 1191367 - protein, 9 aa, Homo Sapiens
FSKQGALTL

SEQ ID NO: 1191368 - protein, 9 aa, Homo Sapiens
RGAGTGLEQ

SEQ ID NO: 1191369 - protein, 9 aa, Homo Sapiens
RGKRTAFIK

SEQ ID NO: 1191370 - protein, 9 aa, Homo Sapiens
QGRWVHGFN

SEQ ID NO: 1191371 - protein, 9 aa, Homo Sapiens
AAAPGQAPM

SEQ ID NO: 1191372 - protein, 9 aa, Homo Sapiens
QLIQFALVS

SEQ ID NO: 1191373 - protein, 9 aa, Homo Sapiens
QMAELQGMN

SEQ ID NO: 1191374 - protein, 9 aa, Homo Sapiens
GAKADGLGS

SEQ ID NO: 1191375 - protein, 9 aa, Homo Sapiens
CLPCDHVHY

SEQ ID NO: 1191376 - protein, 9 aa, Homo Sapiens
PWRGTTRNC

SEQ ID NO: 1191377 - protein, 9 aa, Homo Sapiens
YALFPRRRN

SEQ ID NO: 1191378 - protein, 9 aa, Homo Sapiens
FLTVIMRLQ

SEQ ID NO: 1191379 - protein, 9 aa, Homo Sapiens
WSWTTMMEG

SEQ ID NO: 1191380 - protein, 9 aa, Homo Sapiens
GIYGKAHAQ

SEQ ID NO: 1191381 - protein, 9 aa, Homo Sapiens
AAAGAAPGS

SEQ ID NO: 1191382 - protein, 9 aa, Homo Sapiens
LFPVPGLPL

SEQ ID NO: 1191383 - protein, 9 aa, Homo Sapiens
HLQEALGMH

SEQ ID NO: 1191384 - protein, 9 aa, Homo Sapiens
MNEVGIMEE

SEQ ID NO: 1191385 - protein, 9 aa, Homo Sapiens
RAAQTRRSY

SEQ ID NO: 1191386 - protein, 9 aa, Homo Sapiens
GCEYLEDGS

SEQ ID NO: 1191387 - protein, 9 aa, Homo Sapiens
TLCQIKRDV

SEQ ID NO: 1191388 - protein, 9 aa, Homo Sapiens
ALRDDVKVV

SEQ ID NO: 1191389 - protein, 9 aa, Homo Sapiens
ILSSKLHQR

SEQ ID NO: 1191390 - protein, 9 aa, Homo Sapiens
GQLFAVWKL

SEQ ID NO: 1191391 - protein, 9 aa, Homo Sapiens
SCWHRYLFP

SEQ ID NO: 1191392 - protein, 9 aa, Homo Sapiens
FLVSAVFLL

SEQ ID NO: 1191393 - protein, 9 aa, Homo Sapiens
SKRLGVCTG

SEQ ID NO: 1191394 - protein, 9 aa, Homo Sapiens
PGPMNPLVF

SEQ ID NO: 1191395 - protein, 9 aa, Homo Sapiens
GARPGRGGR

SEQ ID NO: 1191396 - protein, 9 aa, Homo Sapiens
AAVAGAALV

SEQ ID NO: 1191397 - protein, 9 aa, Homo Sapiens
QWRQPPGKR

SEQ ID NO: 1191398 - protein, 9 aa, Homo Sapiens
QIFGQNFIS

SEQ ID NO: 1191399 - protein, 9 aa, Homo Sapiens
IAHSLVTVM

SEQ ID NO: 1191400 - protein, 9 aa, Homo Sapiens
KRGISITSS

SEQ ID NO: 1191401 - protein, 9 aa, Homo Sapiens
HSHMYYFLK

SEQ ID NO: 1191402 - protein, 9 aa, Homo Sapiens
QEIERERES

SEQ ID NO: 1191403 - protein, 9 aa, Homo Sapiens
SNKEVTRAL

SEQ ID NO: 1191404 - protein, 9 aa, Homo Sapiens
TGKISTTED

SEQ ID NO: 1191405 - protein, 9 aa, Homo Sapiens
VLTAFGIAF

SEQ ID NO: 1191406 - protein, 9 aa, Homo Sapiens
SSPTASVLP

SEQ ID NO: 1191407 - protein, 9 aa, Homo Sapiens
AVTNHHIVA

SEQ ID NO: 1191408 - protein, 9 aa, Homo Sapiens
ASRLGMQNL

SEQ ID NO: 1191409 - protein, 9 aa, Homo Sapiens
DVGLHSMRY

SEQ ID NO: 1191410 - protein, 9 aa, Homo Sapiens
PPQPGNQRS

SEQ ID NO: 1191411 - protein, 9 aa, Homo Sapiens
LPHGELHRQ

SEQ ID NO: 1191412 - protein, 9 aa, Homo Sapiens
PHGRSSRQP

SEQ ID NO: 1191413 - protein, 9 aa, Homo Sapiens
PRHCIEFRP

SEQ ID NO: 1191414 - protein, 9 aa, Homo Sapiens
AGHLPAAPA

SEQ ID NO: 1191415 - protein, 9 aa, Homo Sapiens
MVTIKEFCN

SEQ ID NO: 1191416 - protein, 9 aa, Homo Sapiens
NPCEDKDRF

SEQ ID NO: 1191417 - protein, 9 aa, Homo Sapiens
YDFFYREPG

SEQ ID NO: 1191418 - protein, 9 aa, Homo Sapiens
PQSRVDGSG

SEQ ID NO: 1191419 - protein, 9 aa, Homo Sapiens
TMPHVPRAT

SEQ ID NO: 1191420 - protein, 9 aa, Homo Sapiens
VHLQDLVIH

SEQ ID NO: 1191421 - protein, 9 aa, Homo Sapiens
PGDFPKIFP

SEQ ID NO: 1191422 - protein, 9 aa, Homo Sapiens
GMGCPFQGR

SEQ ID NO: 1191423 - protein, 9 aa, Homo Sapiens
FGIEKDHLW

SEQ ID NO: 1191424 - protein, 9 aa, Homo Sapiens
AAPNDSSGS

SEQ ID NO: 1191425 - protein, 9 aa, Homo Sapiens
WDRQGYTAV

SEQ ID NO: 1191426 - protein, 9 aa, Homo Sapiens
ALQPHLRLR

SEQ ID NO: 1191427 - protein, 9 aa, Homo Sapiens
PAPLPFRAG

SEQ ID NO: 1191428 - protein, 9 aa, Homo Sapiens
AQSPQQQPP

SEQ ID NO: 1191429 - protein, 9 aa, Homo Sapiens
LHRQISLPL

SEQ ID NO: 1191430 - protein, 9 aa, Homo Sapiens
NPPTSSCMT

SEQ ID NO: 1191431 - protein, 9 aa, Homo Sapiens
QLPAAQRRW

SEQ ID NO: 1191432 - protein, 9 aa, Homo Sapiens
SVFSWDETE

SEQ ID NO: 1191433 - protein, 9 aa, Homo Sapiens
WNETAEKIW

SEQ ID NO: 1191434 - protein, 9 aa, Homo Sapiens
AERTAETRV

SEQ ID NO: 1191435 - protein, 9 aa, Homo Sapiens
CRVLSLLKL

SEQ ID NO: 1191436 - protein, 9 aa, Homo Sapiens
WKPSWTSRQ

SEQ ID NO: 1191437 - protein, 9 aa, Homo Sapiens
KESPVSLHE

SEQ ID NO: 1191438 - protein, 9 aa, Homo Sapiens
EPVAGQEAM

SEQ ID NO: 1191439 - protein, 9 aa, Homo Sapiens
TAIILRHTI

SEQ ID NO: 1191440 - protein, 9 aa, Homo Sapiens
YTKEVIMDL

SEQ ID NO: 1191441 - protein, 9 aa, Homo Sapiens
HGPPRTGGP

SEQ ID NO: 1191442 - protein, 9 aa, Homo Sapiens
QAAVGATST

SEQ ID NO: 1191443 - protein, 9 aa, Homo Sapiens
LANASSLRK

SEQ ID NO: 1191444 - protein, 9 aa, Homo Sapiens
LHLTLGADL

SEQ ID NO: 1191445 - protein, 9 aa, Homo Sapiens
GDAEVVVQG

SEQ ID NO: 1191446 - protein, 9 aa, Homo Sapiens
AIVNLLKMW

SEQ ID NO: 1191447 - protein, 9 aa, Homo Sapiens
LALQGARLE

SEQ ID NO: 1191448 - protein, 9 aa, Homo Sapiens
RLEKLGIFV

SEQ ID NO: 1191449 - protein, 9 aa, Homo Sapiens
RRKKKVRSL

SEQ ID NO: 1191450 - protein, 9 aa, Homo Sapiens
LFNMSQLLA

SEQ ID NO: 1191451 - protein, 9 aa, Homo Sapiens
GQMKGAQSR

SEQ ID NO: 1191452 - protein, 9 aa, Homo Sapiens
LTHRVQAGQ

SEQ ID NO: 1191453 - protein, 9 aa, Homo Sapiens
IEFRPVDCA

SEQ ID NO: 1191454 - protein, 9 aa, Homo Sapiens
PKVCEDLTD

SEQ ID NO: 1191455 - protein, 9 aa, Homo Sapiens
VQQHLQEAL

SEQ ID NO: 1191456 - protein, 9 aa, Homo Sapiens
GEPRKLLAQ

SEQ ID NO: 1191457 - protein, 9 aa, Homo Sapiens
RVDGSGSGG

SEQ ID NO: 1191458 - protein, 9 aa, Homo Sapiens
GVGPGGCIP

SEQ ID NO: 1191459 - protein, 9 aa, Homo Sapiens
LGCGFGGTT

SEQ ID NO: 1191460 - protein, 9 aa, Homo Sapiens
SASCCVLAG

SEQ ID NO: 1191461 - protein, 9 aa, Homo Sapiens
VTVAVGCRR

SEQ ID NO: 1191462 - protein, 9 aa, Homo Sapiens
IASASNSSR

SEQ ID NO: 1191463 - protein, 9 aa, Homo Sapiens
TLSVVRTEG

SEQ ID NO: 1191464 - protein, 9 aa, Homo Sapiens
LAPARVVIP

SEQ ID NO: 1191465 - protein, 9 aa, Homo Sapiens
VVVYQLHNF

SEQ ID NO: 1191466 - protein, 9 aa, Homo Sapiens
LEEKQKEDI

SEQ ID NO: 1191467 - protein, 9 aa, Homo Sapiens
LQQAWTVGW

SEQ ID NO: 1191468 - protein, 9 aa, Homo Sapiens
EGGEKHVEW

SEQ ID NO: 1191469 - protein, 9 aa, Homo Sapiens
PWLNWSSCW

SEQ ID NO: 1191470 - protein, 9 aa, Homo Sapiens
NRPGSGGGV

SEQ ID NO: 1191471 - protein, 9 aa, Homo Sapiens
GLRARVWRG

SEQ ID NO: 1191472 - protein, 9 aa, Homo Sapiens
GGVEGDLGE

SEQ ID NO: 1191473 - protein, 9 aa, Homo Sapiens
FALGAKEAP

SEQ ID NO: 1191474 - protein, 9 aa, Homo Sapiens
SKDLTSPAQ

SEQ ID NO: 1191475 - protein, 9 aa, Homo Sapiens
ACPAYPYPW

SEQ ID NO: 1191476 - protein, 9 aa, Homo Sapiens
VTPAPPPCR

SEQ ID NO: 1191477 - protein, 9 aa, Homo Sapiens
TVTGESPPA

SEQ ID NO: 1191478 - protein, 9 aa, Homo Sapiens
DDDCKNLQW

SEQ ID NO: 1191479 - protein, 9 aa, Homo Sapiens
QCRTKFKSI

SEQ ID NO: 1191480 - protein, 9 aa, Homo Sapiens
GSPASPAPT

SEQ ID NO: 1191481 - protein, 9 aa, Homo Sapiens
GAGVNLMKE

SEQ ID NO: 1191482 - protein, 9 aa, Homo Sapiens
TRERAAAAL

SEQ ID NO: 1191483 - protein, 9 aa, Homo Sapiens
THSSPTASV

SEQ ID NO: 1191484 - protein, 9 aa, Homo Sapiens
QQDVLQTRV

SEQ ID NO: 1191485 - protein, 9 aa, Homo Sapiens
PRVTPGPPP

SEQ ID NO: 1191486 - protein, 9 aa, Homo Sapiens
MPDISGSVY

SEQ ID NO: 1191487 - protein, 9 aa, Homo Sapiens
AHCPLQTFH

SEQ ID NO: 1191488 - protein, 9 aa, Homo Sapiens
KYSKAEYAP

SEQ ID NO: 1191489 - protein, 9 aa, Homo Sapiens
FIGPACQII

SEQ ID NO: 1191490 - protein, 9 aa, Homo Sapiens
AKFRCNLLR

SEQ ID NO: 1191491 - protein, 9 aa, Homo Sapiens
GLKNIPGIR

SEQ ID NO: 1191492 - protein, 9 aa, Homo Sapiens
FLTQRQDTS

SEQ ID NO: 1191493 - protein, 9 aa, Homo Sapiens
SRSWARSLA

SEQ ID NO: 1191494 - protein, 9 aa, Homo Sapiens
EKPYECKQR

SEQ ID NO: 1191495 - protein, 9 aa, Homo Sapiens
TGEADFNWW

SEQ ID NO: 1191496 - protein, 9 aa, Homo Sapiens
SYPEFQSSS

SEQ ID NO: 1191497 - protein, 9 aa, Homo Sapiens
IEKLQQVFI

SEQ ID NO: 1191498 - protein, 9 aa, Homo Sapiens
QRQQCLVCV

SEQ ID NO: 1191499 - protein, 9 aa, Homo Sapiens
PAPRPVAGA

SEQ ID NO: 1191500 - protein, 9 aa, Homo Sapiens
LHVGYLVVW

SEQ ID NO: 1191501 - protein, 9 aa, Homo Sapiens
NREKAKGPG

SEQ ID NO: 1191502 - protein, 9 aa, Homo Sapiens
ILAGMRMDL

SEQ ID NO: 1191503 - protein, 9 aa, Homo Sapiens
SDNFYPEDI

SEQ ID NO: 1191504 - protein, 9 aa, Homo Sapiens
IPGLNVMLR

SEQ ID NO: 1191505 - protein, 9 aa, Homo Sapiens
RVAETIFIK

SEQ ID NO: 1191506 - protein, 9 aa, Homo Sapiens
RATSPCTKL

SEQ ID NO: 1191507 - protein, 9 aa, Homo Sapiens
SLAQQAPEF

SEQ ID NO: 1191508 - protein, 9 aa, Homo Sapiens
QPFVKDCLT

SEQ ID NO: 1191509 - protein, 9 aa, Homo Sapiens
IATQKSRQR

SEQ ID NO: 1191510 - protein, 9 aa, Homo Sapiens
EAGGSHVGA

SEQ ID NO: 1191511 - protein, 9 aa, Homo Sapiens
VDSLRVRTV

SEQ ID NO: 1191512 - protein, 9 aa, Homo Sapiens
RRSLPLRQI

SEQ ID NO: 1191513 - protein, 9 aa, Homo Sapiens
NFRGNKPRD

SEQ ID NO: 1191514 - protein, 9 aa, Homo Sapiens
KPEPTDEGW

SEQ ID NO: 1191515 - protein, 9 aa, Homo Sapiens
CLTPDSLAA

SEQ ID NO: 1191516 - protein, 9 aa, Homo Sapiens
VVHMDLMRE

SEQ ID NO: 1191517 - protein, 9 aa, Homo Sapiens
NSLKLMKLN

SEQ ID NO: 1191518 - protein, 9 aa, Homo Sapiens
AAELWSTCL

SEQ ID NO: 1191519 - protein, 9 aa, Homo Sapiens
CFYINSPTG

SEQ ID NO: 1191520 - protein, 9 aa, Homo Sapiens
PMDSPCCQA

SEQ ID NO: 1191521 - protein, 9 aa, Homo Sapiens
LLTTVHPEP

SEQ ID NO: 1191522 - protein, 9 aa, Homo Sapiens
SAKKSLWEC

SEQ ID NO: 1191523 - protein, 9 aa, Homo Sapiens
KNGKMGINA

SEQ ID NO: 1191524 - protein, 9 aa, Homo Sapiens
ARGSQRLAQ

SEQ ID NO: 1191525 - protein, 9 aa, Homo Sapiens
RTLAACPSG

SEQ ID NO: 1191526 - protein, 9 aa, Homo Sapiens
QPPPPPHPL

SEQ ID NO: 1191527 - protein, 9 aa, Homo Sapiens
SLPLRQILG

SEQ ID NO: 1191528 - protein, 9 aa, Homo Sapiens
PGIRGALTT

SEQ ID NO: 1191529 - protein, 9 aa, Homo Sapiens
CNPRLDFHP

SEQ ID NO: 1191530 - protein, 9 aa, Homo Sapiens
GGSAGAGPP

SEQ ID NO: 1191531 - protein, 9 aa, Homo Sapiens
RGRVGARRG

SEQ ID NO: 1191532 - protein, 9 aa, Homo Sapiens
NLLHVSEPS

SEQ ID NO: 1191533 - protein, 9 aa, Homo Sapiens
CPRAGPCLP

SEQ ID NO: 1191534 - protein, 9 aa, Homo Sapiens
PGSGGGVPA

SEQ ID NO: 1191535 - protein, 9 aa, Homo Sapiens
SRARPSHAC

SEQ ID NO: 1191536 - protein, 9 aa, Homo Sapiens
LDILQTVLE

SEQ ID NO: 1191537 - protein, 9 aa, Homo Sapiens
VLCTPGLRD

SEQ ID NO: 1191538 - protein, 9 aa, Homo Sapiens
HGLPVHQGL

SEQ ID NO: 1191539 - protein, 9 aa, Homo Sapiens
GRHPSWPWT

SEQ ID NO: 1191540 - protein, 9 aa, Homo Sapiens
ATRHLASMR

SEQ ID NO: 1191541 - protein, 9 aa, Homo Sapiens
SSSPQPAGY

SEQ ID NO: 1191542 - protein, 9 aa, Homo Sapiens
PNYKKMESC

SEQ ID NO: 1191543 - protein, 9 aa, Homo Sapiens
YPVCTPNGI

SEQ ID NO: 1191544 - protein, 9 aa, Homo Sapiens
EEPELLQFQ

SEQ ID NO: 1191545 - protein, 9 aa, Homo Sapiens
LGIAVRHPQ

SEQ ID NO: 1191546 - protein, 9 aa, Homo Sapiens
PVATLSPGE

SEQ ID NO: 1191547 - protein, 9 aa, Homo Sapiens
MQDRMELAA

SEQ ID NO: 1191548 - protein, 9 aa, Homo Sapiens
AISGFIPLS

SEQ ID NO: 1191549 - protein, 9 aa, Homo Sapiens
PAQSWCAKC

SEQ ID NO: 1191550 - protein, 9 aa, Homo Sapiens
SVFPDKKSE

SEQ ID NO: 1191551 - protein, 9 aa, Homo Sapiens
SNWHWTERD

SEQ ID NO: 1191552 - protein, 9 aa, Homo Sapiens
TSPQKSSAM

SEQ ID NO: 1191553 - protein, 9 aa, Homo Sapiens
LSPTVEYND

SEQ ID NO: 1191554 - protein, 9 aa, Homo Sapiens
KVWSWTTMM

SEQ ID NO: 1191555 - protein, 9 aa, Homo Sapiens
DSSVYFRSM

SEQ ID NO: 1191556 - protein, 9 aa, Homo Sapiens
FCQKFSFAE

SEQ ID NO: 1191557 - protein, 9 aa, Homo Sapiens
HRHHQEEDL

SEQ ID NO: 1191558 - protein, 9 aa, Homo Sapiens
PSPRSRWRH

SEQ ID NO: 1191559 - protein, 9 aa, Homo Sapiens
KKLIVNPGT

SEQ ID NO: 1191560 - protein, 9 aa, Homo Sapiens
TPRPPPCRP

SEQ ID NO: 1191561 - protein, 9 aa, Homo Sapiens
TPPGSAPSM

SEQ ID NO: 1191562 - protein, 9 aa, Homo Sapiens
LAHPRTLTL

SEQ ID NO: 1191563 - protein, 9 aa, Homo Sapiens
VIPPPPPPG

SEQ ID NO: 1191564 - protein, 9 aa, Homo Sapiens
EAHCPLQTF

SEQ ID NO: 1191565 - protein, 9 aa, Homo Sapiens
YIGCTVFIW

SEQ ID NO: 1191566 - protein, 9 aa, Homo Sapiens
RAQEDLRIR

SEQ ID NO: 1191567 - protein, 9 aa, Homo Sapiens
GLPPQAQTP

SEQ ID NO: 1191568 - protein, 9 aa, Homo Sapiens
REASRPHQC

SEQ ID NO: 1191569 - protein, 9 aa, Homo Sapiens
GLPLDRLRS

SEQ ID NO: 1191570 - protein, 9 aa, Homo Sapiens
TCFPEADGV

SEQ ID NO: 1191571 - protein, 9 aa, Homo Sapiens
WPPQRPSNS

SEQ ID NO: 1191572 - protein, 9 aa, Homo Sapiens
RAFDGAHPP

SEQ ID NO: 1191573 - protein, 9 aa, Homo Sapiens
VGFLWRSNG

SEQ ID NO: 1191574 - protein, 9 aa, Homo Sapiens
SKTTELQLK

SEQ ID NO: 1191575 - protein, 9 aa, Homo Sapiens
ALCRTFESD

SEQ ID NO: 1191576 - protein, 9 aa, Homo Sapiens
REAKDCDPS

SEQ ID NO: 1191577 - protein, 9 aa, Homo Sapiens
RRPIASPWF

SEQ ID NO: 1191578 - protein, 9 aa, Homo Sapiens
VPPGPQAGP

SEQ ID NO: 1191579 - protein, 9 aa, Homo Sapiens
ERKPATQQK

SEQ ID NO: 1191580 - protein, 9 aa, Homo Sapiens
IWESWQMKT

SEQ ID NO: 1191581 - protein, 9 aa, Homo Sapiens
FNPIRAVPL

SEQ ID NO: 1191582 - protein, 9 aa, Homo Sapiens
VSPPSLPPG

SEQ ID NO: 1191583 - protein, 9 aa, Homo Sapiens
WRSPKCIIH

SEQ ID NO: 1191584 - protein, 9 aa, Homo Sapiens
TRPSFDSLG

SEQ ID NO: 1191585 - protein, 9 aa, Homo Sapiens
GAAHSQPLA

SEQ ID NO: 1191586 - protein, 9 aa, Homo Sapiens
CPLRASRRC

SEQ ID NO: 1191587 - protein, 9 aa, Homo Sapiens
KIFPYPLLL

SEQ ID NO: 1191588 - protein, 9 aa, Homo Sapiens
KPMAPQGCR

SEQ ID NO: 1191589 - protein, 9 aa, Homo Sapiens
GSSCQSGFG

SEQ ID NO: 1191590 - protein, 9 aa, Homo Sapiens
RSSERTPGL

SEQ ID NO: 1191591 - protein, 9 aa, Homo Sapiens
DRSVVTTAR

SEQ ID NO: 1191592 - protein, 9 aa, Homo Sapiens
AHPPPSGPL

SEQ ID NO: 1191593 - protein, 9 aa, Homo Sapiens
AFGIAFLLR

SEQ ID NO: 1191594 - protein, 9 aa, Homo Sapiens
VKNHEHGGQ

SEQ ID NO: 1191595 - protein, 9 aa, Homo Sapiens
AESSMSEDN

SEQ ID NO: 1191596 - protein, 9 aa, Homo Sapiens
DADDPMFDL

SEQ ID NO: 1191597 - protein, 9 aa, Homo Sapiens
VGGASALHR

SEQ ID NO: 1191598 - protein, 9 aa, Homo Sapiens
LDVQCLLRR

SEQ ID NO: 1191599 - protein, 9 aa, Homo Sapiens
QSSPSTNAT

SEQ ID NO: 1191600 - protein, 9 aa, Homo Sapiens
GSHLDILQT

SEQ ID NO: 1191601 - protein, 9 aa, Homo Sapiens
MNGQPAFIP

SEQ ID NO: 1191602 - protein, 9 aa, Homo Sapiens
VRDSYTRII

SEQ ID NO: 1191603 - protein, 9 aa, Homo Sapiens
WLEVAVFMP

SEQ ID NO: 1191604 - protein, 9 aa, Homo Sapiens
HPHNPRTAR

SEQ ID NO: 1191605 - protein, 9 aa, Homo Sapiens
RPWRGTTRN

SEQ ID NO: 1191606 - protein, 9 aa, Homo Sapiens
CKNKQPQKT

SEQ ID NO: 1191607 - protein, 9 aa, Homo Sapiens
SVILSVVHM

SEQ ID NO: 1191608 - protein, 9 aa, Homo Sapiens
EISLLAAAG

SEQ ID NO: 1191609 - protein, 9 aa, Homo Sapiens
IEVLKTFAL

SEQ ID NO: 1191610 - protein, 9 aa, Homo Sapiens
AERPGVGPC

SEQ ID NO: 1191611 - protein, 9 aa, Homo Sapiens
STIKSILIH

SEQ ID NO: 1191612 - protein, 9 aa, Homo Sapiens
GHHRLDGRS

SEQ ID NO: 1191613 - protein, 9 aa, Homo Sapiens
EAVHAHALP

SEQ ID NO: 1191614 - protein, 9 aa, Homo Sapiens
PGQFVIADS

SEQ ID NO: 1191615 - protein, 9 aa, Homo Sapiens
SGLPHGLWF

SEQ ID NO: 1191616 - protein, 9 aa, Homo Sapiens
TPPPPPGWL

SEQ ID NO: 1191617 - protein, 9 aa, Homo Sapiens
PTKNGGLSG

SEQ ID NO: 1191618 - protein, 9 aa, Homo Sapiens
RPEGSHRCR

SEQ ID NO: 1191619 - protein, 9 aa, Homo Sapiens
QVKTEAAGP

SEQ ID NO: 1191620 - protein, 9 aa, Homo Sapiens
IPPTKNGGL

SEQ ID NO: 1191621 - protein, 9 aa, Homo Sapiens
LRASRRCCP

SEQ ID NO: 1191622 - protein, 9 aa, Homo Sapiens
NFNEAKYNA

SEQ ID NO: 1191623 - protein, 9 aa, Homo Sapiens
PKREHSSEQ

SEQ ID NO: 1191624 - protein, 9 aa, Homo Sapiens
LPSLEALAC

SEQ ID NO: 1191625 - protein, 9 aa, Homo Sapiens
ALGSRSGGR

SEQ ID NO: 1191626 - protein, 9 aa, Homo Sapiens
YFLRYKTAG

SEQ ID NO: 1191627 - protein, 9 aa, Homo Sapiens
PRASTQLPA

SEQ ID NO: 1191628 - protein, 9 aa, Homo Sapiens
WLPSVHVPP

SEQ ID NO: 1191629 - protein, 9 aa, Homo Sapiens
CPTPARWGW

SEQ ID NO: 1191630 - protein, 9 aa, Homo Sapiens
HVAGCRRWP

SEQ ID NO: 1191631 - protein, 9 aa, Homo Sapiens
GGREAAGGA

SEQ ID NO: 1191632 - protein, 9 aa, Homo Sapiens
DSAPVPRGP

SEQ ID NO: 1191633 - protein, 9 aa, Homo Sapiens
PPSPAPGSS

SEQ ID NO: 1191634 - protein, 9 aa, Homo Sapiens
DTGFSNIPQ

SEQ ID NO: 1191635 - protein, 9 aa, Homo Sapiens
RCPKSTSML

SEQ ID NO: 1191636 - protein, 9 aa, Homo Sapiens
LQCPRHWQV

SEQ ID NO: 1191637 - protein, 9 aa, Homo Sapiens
PSKAPGVCR

SEQ ID NO: 1191638 - protein, 9 aa, Homo Sapiens
MVFIFSSSI

SEQ ID NO: 1191639 - protein, 9 aa, Homo Sapiens
EEEEVSNMG

SEQ ID NO: 1191640 - protein, 9 aa, Homo Sapiens
VTHQITVQE

SEQ ID NO: 1191641 - protein, 9 aa, Homo Sapiens
KEQTVIAVE

SEQ ID NO: 1191642 - protein, 9 aa, Homo Sapiens
RQDTSKNII

SEQ ID NO: 1191643 - protein, 9 aa, Homo Sapiens
KIPYSLWRL

SEQ ID NO: 1191644 - protein, 9 aa, Homo Sapiens
CRAPSDQVS

SEQ ID NO: 1191645 - protein, 9 aa, Homo Sapiens
KTTLPGLFV

SEQ ID NO: 1191646 - protein, 9 aa, Homo Sapiens
RHRFDCISR

SEQ ID NO: 1191647 - protein, 9 aa, Homo Sapiens
LRTHRPRHR

SEQ ID NO: 1191648 - protein, 9 aa, Homo Sapiens
PPRWPRGLL

SEQ ID NO: 1191649 - protein, 9 aa, Homo Sapiens
FMATMMMVD

SEQ ID NO: 1191650 - protein, 9 aa, Homo Sapiens
SLPLRGFLL

SEQ ID NO: 1191651 - protein, 9 aa, Homo Sapiens
NAVGRRGPD

SEQ ID NO: 1191652 - protein, 9 aa, Homo Sapiens
CKRFVQSSQ

SEQ ID NO: 1191653 - protein, 9 aa, Homo Sapiens
QLVSEKVGV

SEQ ID NO: 1191654 - protein, 9 aa, Homo Sapiens
YIAVNDMGS

SEQ ID NO: 1191655 - protein, 9 aa, Homo Sapiens
CPPVRRDKN

SEQ ID NO: 1191656 - protein, 9 aa, Homo Sapiens
GHLGLPLIL

SEQ ID NO: 1191657 - protein, 9 aa, Homo Sapiens
GLCGYSVEV

SEQ ID NO: 1191658 - protein, 9 aa, Homo Sapiens
HSHGHGHTH

SEQ ID NO: 1191659 - protein, 9 aa, Homo Sapiens
ALRPHRVTH

SEQ ID NO: 1191660 - protein, 9 aa, Homo Sapiens
RTLSARAVA

SEQ ID NO: 1191661 - protein, 9 aa, Homo Sapiens
PPRLPLRPQ

SEQ ID NO: 1191662 - protein, 9 aa, Homo Sapiens
HSQPLAQLQ

SEQ ID NO: 1191663 - protein, 9 aa, Homo Sapiens
VSGLGGFGG

SEQ ID NO: 1191664 - protein, 9 aa, Homo Sapiens
GGQKCMVSI

SEQ ID NO: 1191665 - protein, 9 aa, Homo Sapiens
HSPLHYSAQ

SEQ ID NO: 1191666 - protein, 9 aa, Homo Sapiens
SEGWHWGAA

SEQ ID NO: 1191667 - protein, 9 aa, Homo Sapiens
YECKQRGKL

SEQ ID NO: 1191668 - protein, 9 aa, Homo Sapiens
PGCGAPDPR

SEQ ID NO: 1191669 - protein, 9 aa, Homo Sapiens
SVLYEKTKT

SEQ ID NO: 1191670 - protein, 9 aa, Homo Sapiens
PHAPPAAAA

SEQ ID NO: 1191671 - protein, 9 aa, Homo Sapiens
KLCALIIQY

SEQ ID NO: 1191672 - protein, 9 aa, Homo Sapiens
WVMSQTQQI

SEQ ID NO: 1191673 - protein, 9 aa, Homo Sapiens
RQRGLLLHG

SEQ ID NO: 1191674 - protein, 9 aa, Homo Sapiens
HAGEKVGII

SEQ ID NO: 1191675 - protein, 9 aa, Homo Sapiens
PASAVQSLP

SEQ ID NO: 1191676 - protein, 9 aa, Homo Sapiens
VLALQGARL

SEQ ID NO: 1191677 - protein, 9 aa, Homo Sapiens
PAGPSTGAP

SEQ ID NO: 1191678 - protein, 9 aa, Homo Sapiens
SGLHFLLLF

SEQ ID NO: 1191679 - protein, 9 aa, Homo Sapiens
WTWKPSTWT

SEQ ID NO: 1191680 - protein, 9 aa, Homo Sapiens
ATCRTRWPA

SEQ ID NO: 1191681 - protein, 9 aa, Homo Sapiens
DNLKTRAKC

SEQ ID NO: 1191682 - protein, 9 aa, Homo Sapiens
IRLSIWPRQ

SEQ ID NO: 1191683 - protein, 9 aa, Homo Sapiens
TFHDQAIVR

SEQ ID NO: 1191684 - protein, 9 aa, Homo Sapiens
YPRKNLRCH

SEQ ID NO: 1191685 - protein, 9 aa, Homo Sapiens
TGAHLLHEA

SEQ ID NO: 1191686 - protein, 9 aa, Homo Sapiens
RFRLDNLFN

SEQ ID NO: 1191687 - protein, 9 aa, Homo Sapiens
PDPRRRPSY

SEQ ID NO: 1191688 - protein, 9 aa, Homo Sapiens
PNHVLIHND

SEQ ID NO: 1191689 - protein, 9 aa, Homo Sapiens
PPGSAPSMP

SEQ ID NO: 1191690 - protein, 9 aa, Homo Sapiens
TTSQSQLSS

SEQ ID NO: 1191691 - protein, 9 aa, Homo Sapiens
TGESPPASL

SEQ ID NO: 1191692 - protein, 9 aa, Homo Sapiens
CQPLPQPLP

SEQ ID NO: 1191693 - protein, 9 aa, Homo Sapiens
AQKKNSLKL

SEQ ID NO: 1191694 - protein, 9 aa, Homo Sapiens
ASCCCPTAR

SEQ ID NO: 1191695 - protein, 9 aa, Homo Sapiens
RHPRSPTPT

SEQ ID NO: 1191696 - protein, 9 aa, Homo Sapiens
ASPNQNSML

SEQ ID NO: 1191697 - protein, 9 aa, Homo Sapiens
GRLIVSWTP

SEQ ID NO: 1191698 - protein, 9 aa, Homo Sapiens
GPGLPLLDT

SEQ ID NO: 1191699 - protein, 9 aa, Homo Sapiens
EAERPGVGP

SEQ ID NO: 1191700 - protein, 9 aa, Homo Sapiens
KGLITTNVG

SEQ ID NO: 1191701 - protein, 9 aa, Homo Sapiens
RFHVKDHRN

SEQ ID NO: 1191702 - protein, 9 aa, Homo Sapiens
HRSADSGGA

SEQ ID NO: 1191703 - protein, 9 aa, Homo Sapiens
MVLLWIIEV

SEQ ID NO: 1191704 - protein, 9 aa, Homo Sapiens
MSCLWTWKP

SEQ ID NO: 1191705 - protein, 9 aa, Homo Sapiens
SVEYKPPKN

SEQ ID NO: 1191706 - protein, 9 aa, Homo Sapiens
NGFGKNGFS

SEQ ID NO: 1191707 - protein, 9 aa, Homo Sapiens
QCAHAGASR

SEQ ID NO: 1191708 - protein, 9 aa, Homo Sapiens
TFCSEGMSP

SEQ ID NO: 1191709 - protein, 9 aa, Homo Sapiens
WKNGNLKWH

SEQ ID NO: 1191710 - protein, 9 aa, Homo Sapiens
TAPAALDTE

SEQ ID NO: 1191711 - protein, 9 aa, Homo Sapiens
EHYKCEIKR

SEQ ID NO: 1191712 - protein, 9 aa, Homo Sapiens
NDFNCNVWD

SEQ ID NO: 1191713 - protein, 9 aa, Homo Sapiens
ARSPLTGSK

SEQ ID NO: 1191714 - protein, 9 aa, Homo Sapiens
QGHRQTPGD

SEQ ID NO: 1191715 - protein, 9 aa, Homo Sapiens
GKKLVNYYS

SEQ ID NO: 1191716 - protein, 9 aa, Homo Sapiens
EESSNCKNG

SEQ ID NO: 1191717 - protein, 9 aa, Homo Sapiens
GVVDQPETH

SEQ ID NO: 1191718 - protein, 9 aa, Homo Sapiens
SPTQLPSLE

SEQ ID NO: 1191719 - protein, 9 aa, Homo Sapiens
CPNLLQDRF

SEQ ID NO: 1191720 - protein, 9 aa, Homo Sapiens
QPDSSLGIL

SEQ ID NO: 1191721 - protein, 9 aa, Homo Sapiens
PAGRPGVPL

SEQ ID NO: 1191722 - protein, 9 aa, Homo Sapiens
LHRWLQQTT

SEQ ID NO: 1191723 - protein, 9 aa, Homo Sapiens
PCIVLWPKA

SEQ ID NO: 1191724 - protein, 9 aa, Homo Sapiens
SNNVFFSLH

SEQ ID NO: 1191725 - protein, 9 aa, Homo Sapiens
MPACARGPR

SEQ ID NO: 1191726 - protein, 9 aa, Homo Sapiens
AVHDLLLVT

SEQ ID NO: 1191727 - protein, 9 aa, Homo Sapiens
VLPRSRKFP

SEQ ID NO: 1191728 - protein, 9 aa, Homo Sapiens
LIDRDQGGG

SEQ ID NO: 1191729 - protein, 9 aa, Homo Sapiens
LECMEPQDQ

SEQ ID NO: 1191730 - protein, 9 aa, Homo Sapiens
SEFQHLMDI

SEQ ID NO: 1191731 - protein, 9 aa, Homo Sapiens
CLQDSYITS

SEQ ID NO: 1191732 - protein, 9 aa, Homo Sapiens
TTAAGTGGA

SEQ ID NO: 1191733 - protein, 9 aa, Homo Sapiens
AVKAVTKVI

SEQ ID NO: 1191734 - protein, 9 aa, Homo Sapiens
AKLVRLVST

SEQ ID NO: 1191735 - protein, 9 aa, Homo Sapiens
ERGVLQMRS

SEQ ID NO: 1191736 - protein, 9 aa, Homo Sapiens
FKETAFLYV

SEQ ID NO: 1191737 - protein, 9 aa, Homo Sapiens
PLTGSKVWR

SEQ ID NO: 1191738 - protein, 9 aa, Homo Sapiens
IDKVSEKSI

SEQ ID NO: 1191739 - protein, 9 aa, Homo Sapiens
EHFRGVWNT

SEQ ID NO: 1191740 - protein, 9 aa, Homo Sapiens
LKKLLKWHL

SEQ ID NO: 1191741 - protein, 9 aa, Homo Sapiens
EVTLIPVLS

SEQ ID NO: 1191742 - protein, 9 aa, Homo Sapiens
WDAMLETYG

SEQ ID NO: 1191743 - protein, 9 aa, Homo Sapiens
SEHNYCRLI

SEQ ID NO: 1191744 - protein, 9 aa, Homo Sapiens
DGRSSARSW

SEQ ID NO: 1191745 - protein, 9 aa, Homo Sapiens
PPCRPRVTP

SEQ ID NO: 1191746 - protein, 9 aa, Homo Sapiens
EQEERKPAT

SEQ ID NO: 1191747 - protein, 9 aa, Homo Sapiens
ASRGLRFVV

SEQ ID NO: 1191748 - protein, 9 aa, Homo Sapiens
QDVLQTRVK

SEQ ID NO: 1191749 - protein, 9 aa, Homo Sapiens
WEVPPRSTF

SEQ ID NO: 1191750 - protein, 9 aa, Homo Sapiens
QEAARQAVQ

SEQ ID NO: 1191751 - protein, 9 aa, Homo Sapiens
TRTLRYLWR

SEQ ID NO: 1191752 - protein, 9 aa, Homo Sapiens
YCIEKLQQV

SEQ ID NO: 1191753 - protein, 9 aa, Homo Sapiens
WQILFSVIK

SEQ ID NO: 1191754 - protein, 9 aa, Homo Sapiens
VENLQALLT

SEQ ID NO: 1191755 - protein, 9 aa, Homo Sapiens
GPDPPTGIG

SEQ ID NO: 1191756 - protein, 9 aa, Homo Sapiens
PQGLWEDLI

SEQ ID NO: 1191757 - protein, 9 aa, Homo Sapiens
PKYKLPSNT

SEQ ID NO: 1191758 - protein, 9 aa, Homo Sapiens
RLMGKRVNL

SEQ ID NO: 1191759 - protein, 9 aa, Homo Sapiens
ATMMMVDPL

SEQ ID NO: 1191760 - protein, 9 aa, Homo Sapiens
LKSEGGVEG

SEQ ID NO: 1191761 - protein, 9 aa, Homo Sapiens
GGGYVSERT

SEQ ID NO: 1191762 - protein, 9 aa, Homo Sapiens
RVLRPHILG

SEQ ID NO: 1191763 - protein, 9 aa, Homo Sapiens
DPNVLDSFH

SEQ ID NO: 1191764 - protein, 9 aa, Homo Sapiens
NFAICGLHY

SEQ ID NO: 1191765 - protein, 9 aa, Homo Sapiens
CSPAGPSTG

SEQ ID NO: 1191766 - protein, 9 aa, Homo Sapiens
IPPTRLLIK

SEQ ID NO: 1191767 - protein, 9 aa, Homo Sapiens
QRGQAVVGE

SEQ ID NO: 1191768 - protein, 9 aa, Homo Sapiens
FTTPYGYAM

SEQ ID NO: 1191769 - protein, 9 aa, Homo Sapiens
GSEHTLPIL

SEQ ID NO: 1191770 - protein, 9 aa, Homo Sapiens
PSAPVHSSG

SEQ ID NO: 1191771 - protein, 9 aa, Homo Sapiens
KPQQMNASL

SEQ ID NO: 1191772 - protein, 9 aa, Homo Sapiens
KKRGKSQGG

SEQ ID NO: 1191773 - protein, 9 aa, Homo Sapiens
KPCCGVPDS

SEQ ID NO: 1191774 - protein, 9 aa, Homo Sapiens
MPSYDPDTG

SEQ ID NO: 1191775 - protein, 9 aa, Homo Sapiens
FEIKKACIR

SEQ ID NO: 1191776 - protein, 9 aa, Homo Sapiens
AILFWQFFV

SEQ ID NO: 1191777 - protein, 9 aa, Homo Sapiens
LHLAAHYSR

SEQ ID NO: 1191778 - protein, 9 aa, Homo Sapiens
AAQLPGASH

SEQ ID NO: 1191779 - protein, 9 aa, Homo Sapiens
PDPALSLEA

SEQ ID NO: 1191780 - protein, 9 aa, Homo Sapiens
WMSSVRSWC

SEQ ID NO: 1191781 - protein, 9 aa, Homo Sapiens
FHCAPPLHH

SEQ ID NO: 1191782 - protein, 9 aa, Homo Sapiens
LCHKCYSSV

SEQ ID NO: 1191783 - protein, 9 aa, Homo Sapiens
LVSEKVGVA

SEQ ID NO: 1191784 - protein, 9 aa, Homo Sapiens
MHAVVIAAV

SEQ ID NO: 1191785 - protein, 9 aa, Homo Sapiens
LCMCFQPDL

SEQ ID NO: 1191786 - protein, 9 aa, Homo Sapiens
RSCFPFRWR

SEQ ID NO: 1191787 - protein, 9 aa, Homo Sapiens
YCQSEELRC

SEQ ID NO: 1191788 - protein, 9 aa, Homo Sapiens
LRGSGLPAR

SEQ ID NO: 1191789 - protein, 9 aa, Homo Sapiens
VYRIGRSVE

SEQ ID NO: 1191790 - protein, 9 aa, Homo Sapiens
LLLHGVEPL

SEQ ID NO: 1191791 - protein, 9 aa, Homo Sapiens
LPLGPGAQQ

SEQ ID NO: 1191792 - protein, 9 aa, Homo Sapiens
AGAADTEPG

SEQ ID NO: 1191793 - protein, 9 aa, Homo Sapiens
EARSCPTTS

SEQ ID NO: 1191794 - protein, 9 aa, Homo Sapiens
PLPAFGRAT

SEQ ID NO: 1191795 - protein, 9 aa, Homo Sapiens
MPHSRGREL

SEQ ID NO: 1191796 - protein, 9 aa, Homo Sapiens
GGGSWSSAS

SEQ ID NO: 1191797 - protein, 9 aa, Homo Sapiens
TANAPPGGP

SEQ ID NO: 1191798 - protein, 9 aa, Homo Sapiens
VHLYMYSKN

SEQ ID NO: 1191799 - protein, 9 aa, Homo Sapiens
QKSSAMAPE

SEQ ID NO: 1191800 - protein, 9 aa, Homo Sapiens
PKSSVHPTT

SEQ ID NO: 1191801 - protein, 9 aa, Homo Sapiens
SVEQPPNPN

SEQ ID NO: 1191802 - protein, 9 aa, Homo Sapiens
ACRVTLDGK

SEQ ID NO: 1191803 - protein, 9 aa, Homo Sapiens
HRQISLPLR

SEQ ID NO: 1191804 - protein, 9 aa, Homo Sapiens
GPARCCRWP

SEQ ID NO: 1191805 - protein, 9 aa, Homo Sapiens
ARYARWAGV

SEQ ID NO: 1191806 - protein, 9 aa, Homo Sapiens
GDSCVSAHT

SEQ ID NO: 1191807 - protein, 9 aa, Homo Sapiens
RLDNLFNMA

SEQ ID NO: 1191808 - protein, 9 aa, Homo Sapiens
RDLKSCSRP

SEQ ID NO: 1191809 - protein, 9 aa, Homo Sapiens
MKYWANFAC

SEQ ID NO: 1191810 - protein, 9 aa, Homo Sapiens
KPATQQKKN

SEQ ID NO: 1191811 - protein, 9 aa, Homo Sapiens
PLLDTDPAH

SEQ ID NO: 1191812 - protein, 9 aa, Homo Sapiens
CCSLTQGPR

SEQ ID NO: 1191813 - protein, 9 aa, Homo Sapiens
ASCCVIPPD

SEQ ID NO: 1191814 - protein, 9 aa, Homo Sapiens
VSNKFQDLL

SEQ ID NO: 1191815 - protein, 9 aa, Homo Sapiens
CWTRPSFDS

SEQ ID NO: 1191816 - protein, 9 aa, Homo Sapiens
YGNLELKKV

SEQ ID NO: 1191817 - protein, 9 aa, Homo Sapiens
SIWPRTRCC

SEQ ID NO: 1191818 - protein, 9 aa, Homo Sapiens
QMECLEALD

SEQ ID NO: 1191819 - protein, 9 aa, Homo Sapiens
TGLEQSPQL

SEQ ID NO: 1191820 - protein, 9 aa, Homo Sapiens
IADVEAQRL

SEQ ID NO: 1191821 - protein, 9 aa, Homo Sapiens
LEHTPTSPD

SEQ ID NO: 1191822 - protein, 9 aa, Homo Sapiens
KQKPLEKNG

SEQ ID NO: 1191823 - protein, 9 aa, Homo Sapiens
AKYNAFTMY

SEQ ID NO: 1191824 - protein, 9 aa, Homo Sapiens
KVTSYGVKP

SEQ ID NO: 1191825 - protein, 9 aa, Homo Sapiens
RRPVKDGAG

SEQ ID NO: 1191826 - protein, 9 aa, Homo Sapiens
LPLNCAPRP

SEQ ID NO: 1191827 - protein, 9 aa, Homo Sapiens
GICAVGLIG

SEQ ID NO: 1191828 - protein, 9 aa, Homo Sapiens
CTVELSLFS

SEQ ID NO: 1191829 - protein, 9 aa, Homo Sapiens
ARWAGVASS

SEQ ID NO: 1191830 - protein, 9 aa, Homo Sapiens
TTVIPSNVS

SEQ ID NO: 1191831 - protein, 9 aa, Homo Sapiens
LATGLHLHR

SEQ ID NO: 1191832 - protein, 9 aa, Homo Sapiens
GISGFGGDV

SEQ ID NO: 1191833 - protein, 9 aa, Homo Sapiens
KSTTDNDIT

SEQ ID NO: 1191834 - protein, 9 aa, Homo Sapiens
AVFLTTTSR

SEQ ID NO: 1191835 - protein, 9 aa, Homo Sapiens
TELGWAGII

SEQ ID NO: 1191836 - protein, 9 aa, Homo Sapiens
NRALGFGTK

SEQ ID NO: 1191837 - protein, 9 aa, Homo Sapiens
LKAEPRLTR

SEQ ID NO: 1191838 - protein, 9 aa, Homo Sapiens
NSPTGCKSW

SEQ ID NO: 1191839 - protein, 9 aa, Homo Sapiens
ESKSCFPPK

SEQ ID NO: 1191840 - protein, 9 aa, Homo Sapiens
LHHRAQDKK

SEQ ID NO: 1191841 - protein, 9 aa, Homo Sapiens
AHFDHKVTG

SEQ ID NO: 1191842 - protein, 9 aa, Homo Sapiens
FHLHHCRTQ

SEQ ID NO: 1191843 - protein, 9 aa, Homo Sapiens
GLGGEVLGI

SEQ ID NO: 1191844 - protein, 9 aa, Homo Sapiens
EEQEERKPA

SEQ ID NO: 1191845 - protein, 9 aa, Homo Sapiens
MGWPNGWCQ

SEQ ID NO: 1191846 - protein, 9 aa, Homo Sapiens
AAHHVVALV

SEQ ID NO: 1191847 - protein, 9 aa, Homo Sapiens
CDPSSPRRC

SEQ ID NO: 1191848 - protein, 9 aa, Homo Sapiens
LRAVGTQIS

SEQ ID NO: 1191849 - protein, 9 aa, Homo Sapiens
LALQPHLRL

SEQ ID NO: 1191850 - protein, 9 aa, Homo Sapiens
FGRATLLFL

SEQ ID NO: 1191851 - protein, 9 aa, Homo Sapiens
KQEENNVVE

SEQ ID NO: 1191852 - protein, 9 aa, Homo Sapiens
TLPATRKPP

SEQ ID NO: 1191853 - protein, 9 aa, Homo Sapiens
CRLGLDRAP

SEQ ID NO: 1191854 - protein, 9 aa, Homo Sapiens
APSPAPQAQ

SEQ ID NO: 1191855 - protein, 9 aa, Homo Sapiens
CCANYVNGN

SEQ ID NO: 1191856 - protein, 9 aa, Homo Sapiens
RVNLECMEP

SEQ ID NO: 1191857 - protein, 9 aa, Homo Sapiens
TPMEVVVYQ

SEQ ID NO: 1191858 - protein, 9 aa, Homo Sapiens
VHAHALPKH

SEQ ID NO: 1191859 - protein, 9 aa, Homo Sapiens
GQRARGCPP

SEQ ID NO: 1191860 - protein, 9 aa, Homo Sapiens
WASVGVAGP

SEQ ID NO: 1191861 - protein, 9 aa, Homo Sapiens
WSMSRSTTR

SEQ ID NO: 1191862 - protein, 9 aa, Homo Sapiens
RKNLRCHML

SEQ ID NO: 1191863 - protein, 9 aa, Homo Sapiens
LSIFKLDGL

SEQ ID NO: 1191864 - protein, 9 aa, Homo Sapiens
PGVISERCT

SEQ ID NO: 1191865 - protein, 9 aa, Homo Sapiens
TGGALQGLA

SEQ ID NO: 1191866 - protein, 9 aa, Homo Sapiens
WPPAPLTSV

SEQ ID NO: 1191867 - protein, 9 aa, Homo Sapiens
DHVHYLRCL

SEQ ID NO: 1191868 - protein, 9 aa, Homo Sapiens
VYTDRFTPL

SEQ ID NO: 1191869 - protein, 9 aa, Homo Sapiens
GQAPMDSPC

SEQ ID NO: 1191870 - protein, 9 aa, Homo Sapiens
LINAGKSNW

SEQ ID NO: 1191871 - protein, 9 aa, Homo Sapiens
RTQGTPAEQ

SEQ ID NO: 1191872 - protein, 9 aa, Homo Sapiens
CWASQSIWE

SEQ ID NO: 1191873 - protein, 9 aa, Homo Sapiens
STLMPSYDP

SEQ ID NO: 1191874 - protein, 9 aa, Homo Sapiens
RIAAVISVT

SEQ ID NO: 1191875 - protein, 9 aa, Homo Sapiens
WPLAGWSSR

SEQ ID NO: 1191876 - protein, 9 aa, Homo Sapiens
MVSRTAPTA

SEQ ID NO: 1191877 - protein, 9 aa, Homo Sapiens
EPRAGSPQS

SEQ ID NO: 1191878 - protein, 9 aa, Homo Sapiens
QVGRDVKAL

SEQ ID NO: 1191879 - protein, 9 aa, Homo Sapiens
EKKNMKKKR

SEQ ID NO: 1191880 - protein, 9 aa, Homo Sapiens
WAPPKRCAA

SEQ ID NO: 1191881 - protein, 9 aa, Homo Sapiens
PPGSHSQAS

SEQ ID NO: 1191882 - protein, 9 aa, Homo Sapiens
AGGGGSWSS

SEQ ID NO: 1191883 - protein, 9 aa, Homo Sapiens
PLWLMTAMW

SEQ ID NO: 1191884 - protein, 9 aa, Homo Sapiens
LDKVQVPSK

SEQ ID NO: 1191885 - protein, 9 aa, Homo Sapiens
AGAIADVEA

SEQ ID NO: 1191886 - protein, 9 aa, Homo Sapiens
TAISFQLPM

SEQ ID NO: 1191887 - protein, 9 aa, Homo Sapiens
IPSNVSSPA

SEQ ID NO: 1191888 - protein, 9 aa, Homo Sapiens
SFTTPYGYA

SEQ ID NO: 1191889 - protein, 9 aa, Homo Sapiens
AAQGWRARA

SEQ ID NO: 1191890 - protein, 9 aa, Homo Sapiens
AQSPKHRFV

SEQ ID NO: 1191891 - protein, 9 aa, Homo Sapiens
AQDTSGHRG

SEQ ID NO: 1191892 - protein, 9 aa, Homo Sapiens
RQAVQLWAG

SEQ ID NO: 1191893 - protein, 9 aa, Homo Sapiens
SVIYWPHPS

SEQ ID NO: 1191894 - protein, 9 aa, Homo Sapiens
QRLGLPAIV

SEQ ID NO: 1191895 - protein, 9 aa, Homo Sapiens
HIWPVQPHP

SEQ ID NO: 1191896 - protein, 9 aa, Homo Sapiens
GLINAGKSN

SEQ ID NO: 1191897 - protein, 9 aa, Homo Sapiens
SSEQPPAED

SEQ ID NO: 1191898 - protein, 9 aa, Homo Sapiens
MLRTRSKGT

SEQ ID NO: 1191899 - protein, 9 aa, Homo Sapiens
PWIDPNPQP

SEQ ID NO: 1191900 - protein, 9 aa, Homo Sapiens
HCPQAPHQP

SEQ ID NO: 1191901 - protein, 9 aa, Homo Sapiens
LWKKRFGQW

SEQ ID NO: 1191902 - protein, 9 aa, Homo Sapiens
TGGTPRGGS

SEQ ID NO: 1191903 - protein, 9 aa, Homo Sapiens
GAAAAAVLG

SEQ ID NO: 1191904 - protein, 9 aa, Homo Sapiens
RAPPSRPSG

SEQ ID NO: 1191905 - protein, 9 aa, Homo Sapiens
WMWSRDCLY

SEQ ID NO: 1191906 - protein, 9 aa, Homo Sapiens
LYFRGRLPR

SEQ ID NO: 1191907 - protein, 9 aa, Homo Sapiens
KPYECKQRG

SEQ ID NO: 1191908 - protein, 9 aa, Homo Sapiens
MSWSLPCPP

SEQ ID NO: 1191909 - protein, 9 aa, Homo Sapiens
PRTARASRW

SEQ ID NO: 1191910 - protein, 9 aa, Homo Sapiens
VPLKQLKRK

SEQ ID NO: 1191911 - protein, 9 aa, Homo Sapiens
GCPQASSLQ

SEQ ID NO: 1191912 - protein, 9 aa, Homo Sapiens
LPPGQFVIA

SEQ ID NO: 1191913 - protein, 9 aa, Homo Sapiens
MLHINNNKI

SEQ ID NO: 1191914 - protein, 9 aa, Homo Sapiens
DRPCQLHAR

SEQ ID NO: 1191915 - protein, 9 aa, Homo Sapiens
GPAPAPKMC

SEQ ID NO: 1191916 - protein, 9 aa, Homo Sapiens
ISLKFKSMH

SEQ ID NO: 1191917 - protein, 9 aa, Homo Sapiens
HAVVIAAVK

SEQ ID NO: 1191918 - protein, 9 aa, Homo Sapiens
AVMWGRQLK

SEQ ID NO: 1191919 - protein, 9 aa, Homo Sapiens
TCLTPDSLA

SEQ ID NO: 1191920 - protein, 9 aa, Homo Sapiens
ILEGIGHVA

SEQ ID NO: 1191921 - protein, 9 aa, Homo Sapiens
NQGCLAPAR

SEQ ID NO: 1191922 - protein, 9 aa, Homo Sapiens
KTFFLGRWA

SEQ ID NO: 1191923 - protein, 9 aa, Homo Sapiens
VKPGRGGQR

SEQ ID NO: 1191924 - protein, 9 aa, Homo Sapiens
TYIAVNDMG

SEQ ID NO: 1191925 - protein, 9 aa, Homo Sapiens
RTTTTTTPH

SEQ ID NO: 1191926 - protein, 9 aa, Homo Sapiens
PRPGCGAPD

SEQ ID NO: 1191927 - protein, 9 aa, Homo Sapiens
SLNNDRLTI

SEQ ID NO: 1191928 - protein, 9 aa, Homo Sapiens
RSVAHPART

SEQ ID NO: 1191929 - protein, 9 aa, Homo Sapiens
SGLMTTFLG

SEQ ID NO: 1191930 - protein, 9 aa, Homo Sapiens
QRMHTGKIP

SEQ ID NO: 1191931 - protein, 9 aa, Homo Sapiens
LKLRRNIPG

SEQ ID NO: 1191932 - protein, 9 aa, Homo Sapiens
ITMQNIEAM

SEQ ID NO: 1191933 - protein, 9 aa, Homo Sapiens
NDITLLHLA

SEQ ID NO: 1191934 - protein, 9 aa, Homo Sapiens
DRADHLLDL

SEQ ID NO: 1191935 - protein, 9 aa, Homo Sapiens
INLSTIKSI

SEQ ID NO: 1191936 - protein, 9 aa, Homo Sapiens
DLERNGSSG

SEQ ID NO: 1191937 - protein, 9 aa, Homo Sapiens
TWITTGWII

SEQ ID NO: 1191938 - protein, 9 aa, Homo Sapiens
DVRGKCIDV

SEQ ID NO: 1191939 - protein, 9 aa, Homo Sapiens
FIYHLPREF

SEQ ID NO: 1191940 - protein, 9 aa, Homo Sapiens
SMRECQGFV

SEQ ID NO: 1191941 - protein, 9 aa, Homo Sapiens
PPSVEQPPN

SEQ ID NO: 1191942 - protein, 9 aa, Homo Sapiens
APQGAVYMD

SEQ ID NO: 1191943 - protein, 9 aa, Homo Sapiens
FANSLSGAQ

SEQ ID NO: 1191944 - protein, 9 aa, Homo Sapiens
EPEVKTCLW

SEQ ID NO: 1191945 - protein, 9 aa, Homo Sapiens
NGHRDRSHS

SEQ ID NO: 1191946 - protein, 9 aa, Homo Sapiens
FTSSWSGTT

SEQ ID NO: 1191947 - protein, 9 aa, Homo Sapiens
NSAAPQLRK

SEQ ID NO: 1191948 - protein, 9 aa, Homo Sapiens
SRGQAQDTS

SEQ ID NO: 1191949 - protein, 9 aa, Homo Sapiens
RPEWYDFFY

SEQ ID NO: 1191950 - protein, 9 aa, Homo Sapiens
LIGFVEFVL

SEQ ID NO: 1191951 - protein, 9 aa, Homo Sapiens
CGWREASRP

SEQ ID NO: 1191952 - protein, 9 aa, Homo Sapiens
QASRLKPSA

SEQ ID NO: 1191953 - protein, 9 aa, Homo Sapiens
STNCPMTTS

SEQ ID NO: 1191954 - protein, 9 aa, Homo Sapiens
GEARAPLES

SEQ ID NO: 1191955 - protein, 9 aa, Homo Sapiens
PLGLADWAC

SEQ ID NO: 1191956 - protein, 9 aa, Homo Sapiens
DIQADGTFD

SEQ ID NO: 1191957 - protein, 9 aa, Homo Sapiens
VILQAMYLL

SEQ ID NO: 1191958 - protein, 9 aa, Homo Sapiens
RCCPPSSST

SEQ ID NO: 1191959 - protein, 9 aa, Homo Sapiens
SKPVRVVQY

SEQ ID NO: 1191960 - protein, 9 aa, Homo Sapiens
KENLAFPGD

SEQ ID NO: 1191961 - protein, 9 aa, Homo Sapiens
QQTTGCSQR

SEQ ID NO: 1191962 - protein, 9 aa, Homo Sapiens
VSCCQQTAI

SEQ ID NO: 1191963 - protein, 9 aa, Homo Sapiens
TLDLNCVVS

SEQ ID NO: 1191964 - protein, 9 aa, Homo Sapiens
DQADSLTVY

SEQ ID NO: 1191965 - protein, 9 aa, Homo Sapiens
PGWKRTQQR

SEQ ID NO: 1191966 - protein, 9 aa, Homo Sapiens
RSTARATSP

SEQ ID NO: 1191967 - protein, 9 aa, Homo Sapiens
FYREPGCEK

SEQ ID NO: 1191968 - protein, 9 aa, Homo Sapiens
CASCTGAGV

SEQ ID NO: 1191969 - protein, 9 aa, Homo Sapiens
DGVWPCIVL

SEQ ID NO: 1191970 - protein, 9 aa, Homo Sapiens
ELGWAGIIW

SEQ ID NO: 1191971 - protein, 9 aa, Homo Sapiens
RTQPSSCPP

SEQ ID NO: 1191972 - protein, 9 aa, Homo Sapiens
DGQHWHTTE

SEQ ID NO: 1191973 - protein, 9 aa, Homo Sapiens
LFSFVLDVF

SEQ ID NO: 1191974 - protein, 9 aa, Homo Sapiens
SGERGPGLP

SEQ ID NO: 1191975 - protein, 9 aa, Homo Sapiens
PGPHAVSGC

SEQ ID NO: 1191976 - protein, 9 aa, Homo Sapiens
QKKTFFLGR

SEQ ID NO: 1191977 - protein, 9 aa, Homo Sapiens
WLCSQLCRK

SEQ ID NO: 1191978 - protein, 9 aa, Homo Sapiens
LLRRKINSR

SEQ ID NO: 1191979 - protein, 9 aa, Homo Sapiens
AKAAASGPI

SEQ ID NO: 1191980 - protein, 9 aa, Homo Sapiens
ASWRSASTA

SEQ ID NO: 1191981 - protein, 9 aa, Homo Sapiens
PPGRRQYIL

SEQ ID NO: 1191982 - protein, 9 aa, Homo Sapiens
IISPTSIQG

SEQ ID NO: 1191983 - protein, 9 aa, Homo Sapiens
RRWHTRGCR

SEQ ID NO: 1191984 - protein, 9 aa, Homo Sapiens
LARKCLTLA

SEQ ID NO: 1191985 - protein, 9 aa, Homo Sapiens
HPGHHGADV

SEQ ID NO: 1191986 - protein, 9 aa, Homo Sapiens
PVCTPNGIV

SEQ ID NO: 1191987 - protein, 9 aa, Homo Sapiens
DFQPFVKDC

SEQ ID NO: 1191988 - protein, 9 aa, Homo Sapiens
AGVASSGEL

SEQ ID NO: 1191989 - protein, 9 aa, Homo Sapiens
IRHTIPWLE

SEQ ID NO: 1191990 - protein, 9 aa, Homo Sapiens
MGFSGDFQP

SEQ ID NO: 1191991 - protein, 9 aa, Homo Sapiens
VKLGVGVFN

SEQ ID NO: 1191992 - protein, 9 aa, Homo Sapiens
DSELLWDIL

SEQ ID NO: 1191993 - protein, 9 aa, Homo Sapiens
KDQPFMGGQ

SEQ ID NO: 1191994 - protein, 9 aa, Homo Sapiens
HGGLWAHRA

SEQ ID NO: 1191995 - protein, 9 aa, Homo Sapiens
NMRCSVNVT

SEQ ID NO: 1191996 - protein, 9 aa, Homo Sapiens
LQAKAYDAD

SEQ ID NO: 1191997 - protein, 9 aa, Homo Sapiens
RDLGVPFWV

SEQ ID NO: 1191998 - protein, 9 aa, Homo Sapiens
LLYQQARLR

SEQ ID NO: 1191999 - protein, 9 aa, Homo Sapiens
EAAEKEYLK

SEQ ID NO: 1192000 - protein, 9 aa, Homo Sapiens
SAPQPGGTP

SEQ ID NO: 1192001 - protein, 9 aa, Homo Sapiens
STSVFPDKK

SEQ ID NO: 1192002 - protein, 9 aa, Homo Sapiens
PRERKIKYP

SEQ ID NO: 1192003 - protein, 9 aa, Homo Sapiens
LHFSILLCK

SEQ ID NO: 1192004 - protein, 9 aa, Homo Sapiens
IKAWGMESK

SEQ ID NO: 1192005 - protein, 9 aa, Homo Sapiens
CQFITSVTT

SEQ ID NO: 1192006 - protein, 9 aa, Homo Sapiens
HNPRTARAS

SEQ ID NO: 1192007 - protein, 9 aa, Homo Sapiens
RYKTAGDSG

SEQ ID NO: 1192008 - protein, 9 aa, Homo Sapiens
RSSPVTINQ

SEQ ID NO: 1192009 - protein, 9 aa, Homo Sapiens
PVWGLPGWK

SEQ ID NO: 1192010 - protein, 9 aa, Homo Sapiens
QRTRGGARA

SEQ ID NO: 1192011 - protein, 9 aa, Homo Sapiens
PSPPGAPPC

SEQ ID NO: 1192012 - protein, 9 aa, Homo Sapiens
EAFPLPRAS

SEQ ID NO: 1192013 - protein, 9 aa, Homo Sapiens
ARVYAGRLE

SEQ ID NO: 1192014 - protein, 9 aa, Homo Sapiens
AVGRLPVTP

SEQ ID NO: 1192015 - protein, 9 aa, Homo Sapiens
VYSTDICSP

SEQ ID NO: 1192016 - protein, 9 aa, Homo Sapiens
LGLGRQKKA

SEQ ID NO: 1192017 - protein, 9 aa, Homo Sapiens
RSAYLANHQ

SEQ ID NO: 1192018 - protein, 9 aa, Homo Sapiens
YVDNPNKTA

SEQ ID NO: 1192019 - protein, 9 aa, Homo Sapiens
GQRTRGGAR

SEQ ID NO: 1192020 - protein, 9 aa, Homo Sapiens
PGAEMPASL

SEQ ID NO: 1192021 - protein, 9 aa, Homo Sapiens
LLLLIALPS

SEQ ID NO: 1192022 - protein, 9 aa, Homo Sapiens
GGADMPIVI

SEQ ID NO: 1192023 - protein, 9 aa, Homo Sapiens
YWPHPSALS

SEQ ID NO: 1192024 - protein, 9 aa, Homo Sapiens
TALHLAAHY

SEQ ID NO: 1192025 - protein, 9 aa, Homo Sapiens
KGFTSSLPC

SEQ ID NO: 1192026 - protein, 9 aa, Homo Sapiens
QDDELDHIL

SEQ ID NO: 1192027 - protein, 9 aa, Homo Sapiens
HEQQLSIHF

SEQ ID NO: 1192028 - protein, 9 aa, Homo Sapiens
WTCSQTRPL

SEQ ID NO: 1192029 - protein, 9 aa, Homo Sapiens
QPNFMQLRD

SEQ ID NO: 1192030 - protein, 9 aa, Homo Sapiens
QKKNSLKLM

SEQ ID NO: 1192031 - protein, 9 aa, Homo Sapiens
WEELKKKLK

SEQ ID NO: 1192032 - protein, 9 aa, Homo Sapiens
YGLCTMHNY

SEQ ID NO: 1192033 - protein, 9 aa, Homo Sapiens
DRAGRMGGR

SEQ ID NO: 1192034 - protein, 9 aa, Homo Sapiens
RASRRCCPP

SEQ ID NO: 1192035 - protein, 9 aa, Homo Sapiens
CPKREGPRM

SEQ ID NO: 1192036 - protein, 9 aa, Homo Sapiens
CTVFIWCCL

SEQ ID NO: 1192037 - protein, 9 aa, Homo Sapiens
VQVPPGRRQ

SEQ ID NO: 1192038 - protein, 9 aa, Homo Sapiens
FLGLWNTQY

SEQ ID NO: 1192039 - protein, 9 aa, Homo Sapiens
ASCACMTGI

SEQ ID NO: 1192040 - protein, 9 aa, Homo Sapiens
WGWRSPKCI

SEQ ID NO: 1192041 - protein, 9 aa, Homo Sapiens
SHCQNCMVQ

SEQ ID NO: 1192042 - protein, 9 aa, Homo Sapiens
RDHLPQELA

SEQ ID NO: 1192043 - protein, 9 aa, Homo Sapiens
KSHSLSSVL

SEQ ID NO: 1192044 - protein, 9 aa, Homo Sapiens
SRGRIYIII

SEQ ID NO: 1192045 - protein, 9 aa, Homo Sapiens
DVGMLKWRL

SEQ ID NO: 1192046 - protein, 9 aa, Homo Sapiens
VAVGCRRCS

SEQ ID NO: 1192047 - protein, 9 aa, Homo Sapiens
NFSRSPPTL

SEQ ID NO: 1192048 - protein, 9 aa, Homo Sapiens
PGHADSHVF

SEQ ID NO: 1192049 - protein, 9 aa, Homo Sapiens
RNQPSFDGI

SEQ ID NO: 1192050 - protein, 9 aa, Homo Sapiens
PGPGGGREA

SEQ ID NO: 1192051 - protein, 9 aa, Homo Sapiens
FVVYDLAGD

SEQ ID NO: 1192052 - protein, 9 aa, Homo Sapiens
ARAPPSTPP

SEQ ID NO: 1192053 - protein, 9 aa, Homo Sapiens
SSVDPKREQ

SEQ ID NO: 1192054 - protein, 9 aa, Homo Sapiens
ECLCLYAPV

SEQ ID NO: 1192055 - protein, 9 aa, Homo Sapiens
KMWSTPCCK

SEQ ID NO: 1192056 - protein, 9 aa, Homo Sapiens
GGEVLGICA

SEQ ID NO: 1192057 - protein, 9 aa, Homo Sapiens
GLGALPLHT

SEQ ID NO: 1192058 - protein, 9 aa, Homo Sapiens
YPGQRDKQH

SEQ ID NO: 1192059 - protein, 9 aa, Homo Sapiens
GAAGQRTEA

SEQ ID NO: 1192060 - protein, 9 aa, Homo Sapiens
GSFIAFFIP

SEQ ID NO: 1192061 - protein, 9 aa, Homo Sapiens
PAPTARASS

SEQ ID NO: 1192062 - protein, 9 aa, Homo Sapiens
VVSSAALTH

SEQ ID NO: 1192063 - protein, 9 aa, Homo Sapiens
ASRASGTPG

SEQ ID NO: 1192064 - protein, 9 aa, Homo Sapiens
RTAERPVLG

SEQ ID NO: 1192065 - protein, 9 aa, Homo Sapiens
LPRRSCCSR

SEQ ID NO: 1192066 - protein, 9 aa, Homo Sapiens
LYQCGCGTF

SEQ ID NO: 1192067 - protein, 9 aa, Homo Sapiens
QNSALRPHR

SEQ ID NO: 1192068 - protein, 9 aa, Homo Sapiens
GAPARARRT

SEQ ID NO: 1192069 - protein, 9 aa, Homo Sapiens
EGAVDALSP

SEQ ID NO: 1192070 - protein, 9 aa, Homo Sapiens
SDLIKHHRV

SEQ ID NO: 1192071 - protein, 9 aa, Homo Sapiens
REDGVHAQL

SEQ ID NO: 1192072 - protein, 9 aa, Homo Sapiens
RCGQLLAQL

SEQ ID NO: 1192073 - protein, 9 aa, Homo Sapiens
HPKCTPKCP

SEQ ID NO: 1192074 - protein, 9 aa, Homo Sapiens
SFPEHFIGN

SEQ ID NO: 1192075 - protein, 9 aa, Homo Sapiens
TVSGERGPG

SEQ ID NO: 1192076 - protein, 9 aa, Homo Sapiens
PGEDGQNLV

SEQ ID NO: 1192077 - protein, 9 aa, Homo Sapiens
MTSRTLAAC

SEQ ID NO: 1192078 - protein, 9 aa, Homo Sapiens
RKNLNPPTF

SEQ ID NO: 1192079 - protein, 9 aa, Homo Sapiens
KNGNLKWHY

SEQ ID NO: 1192080 - protein, 9 aa, Homo Sapiens
IVTVNLIVV

SEQ ID NO: 1192081 - protein, 9 aa, Homo Sapiens
PGRWGLGRI

SEQ ID NO: 1192082 - protein, 9 aa, Homo Sapiens
YPYQAANRF

SEQ ID NO: 1192083 - protein, 9 aa, Homo Sapiens
LLWKKRFGQ

SEQ ID NO: 1192084 - protein, 9 aa, Homo Sapiens
SESRHPSRP

SEQ ID NO: 1192085 - protein, 9 aa, Homo Sapiens
SCLCNRFVH

SEQ ID NO: 1192086 - protein, 9 aa, Homo Sapiens
FLLRRRTSW

SEQ ID NO: 1192087 - protein, 9 aa, Homo Sapiens
REPRAGSPQ

SEQ ID NO: 1192088 - protein, 9 aa, Homo Sapiens
LYVVSSAAL

SEQ ID NO: 1192089 - protein, 9 aa, Homo Sapiens
RVAERQVGR

SEQ ID NO: 1192090 - protein, 9 aa, Homo Sapiens
EGVLIDVLH

SEQ ID NO: 1192091 - protein, 9 aa, Homo Sapiens
QAPSALSSS

SEQ ID NO: 1192092 - protein, 9 aa, Homo Sapiens
WRWNEDGAI

SEQ ID NO: 1192093 - protein, 9 aa, Homo Sapiens
LNCAPRPRR

SEQ ID NO: 1192094 - protein, 9 aa, Homo Sapiens
SPGRWGLGR

SEQ ID NO: 1192095 - protein, 9 aa, Homo Sapiens
EVPPRSTFL

SEQ ID NO: 1192096 - protein, 9 aa, Homo Sapiens
KLYCKAESF

SEQ ID NO: 1192097 - protein, 9 aa, Homo Sapiens
FLTMSLAAH

SEQ ID NO: 1192098 - protein, 9 aa, Homo Sapiens
RVALSRPPG

SEQ ID NO: 1192099 - protein, 9 aa, Homo Sapiens
GLWAHRAGP

SEQ ID NO: 1192100 - protein, 9 aa, Homo Sapiens
LSSLIKKKT

SEQ ID NO: 1192101 - protein, 9 aa, Homo Sapiens
GSANQPVVS

SEQ ID NO: 1192102 - protein, 9 aa, Homo Sapiens
DPNFAICGL

SEQ ID NO: 1192103 - protein, 9 aa, Homo Sapiens
SGSVIRHLS

SEQ ID NO: 1192104 - protein, 9 aa, Homo Sapiens
QARLDVQCL

SEQ ID NO: 1192105 - protein, 9 aa, Homo Sapiens
EPFLILLIA

SEQ ID NO: 1192106 - protein, 9 aa, Homo Sapiens
LTVIMRLQL

SEQ ID NO: 1192107 - protein, 9 aa, Homo Sapiens
LPGHARVYA

SEQ ID NO: 1192108 - protein, 9 aa, Homo Sapiens
TGAVKAVTK

SEQ ID NO: 1192109 - protein, 9 aa, Homo Sapiens
SCPRSAWKR

SEQ ID NO: 1192110 - protein, 9 aa, Homo Sapiens
GLQLVKMLH

SEQ ID NO: 1192111 - protein, 9 aa, Homo Sapiens
SWSLPCPPG

SEQ ID NO: 1192112 - protein, 9 aa, Homo Sapiens
STPPSCCRR

SEQ ID NO: 1192113 - protein, 9 aa, Homo Sapiens
DNDITLLHL

SEQ ID NO: 1192114 - protein, 9 aa, Homo Sapiens
FNRSTNHGL

SEQ ID NO: 1192115 - protein, 9 aa, Homo Sapiens
AVAKRSQQA

SEQ ID NO: 1192116 - protein, 9 aa, Homo Sapiens
TGSAVLRAV

SEQ ID NO: 1192117 - protein, 9 aa, Homo Sapiens
PRAGSPQSR

SEQ ID NO: 1192118 - protein, 9 aa, Homo Sapiens
GRLTEAAVA

SEQ ID NO: 1192119 - protein, 9 aa, Homo Sapiens
DCLTPSWEV

SEQ ID NO: 1192120 - protein, 9 aa, Homo Sapiens
RAQKLCALI

SEQ ID NO: 1192121 - protein, 9 aa, Homo Sapiens
FSMLPWQFA

SEQ ID NO: 1192122 - protein, 9 aa, Homo Sapiens
ARFSGWCGG

SEQ ID NO: 1192123 - protein, 9 aa, Homo Sapiens
TVPGDPWPG

SEQ ID NO: 1192124 - protein, 9 aa, Homo Sapiens
LLLHFGQAL

SEQ ID NO: 1192125 - protein, 9 aa, Homo Sapiens
DVEPDLHLE

SEQ ID NO: 1192126 - protein, 9 aa, Homo Sapiens
AFGRATLLF

SEQ ID NO: 1192127 - protein, 9 aa, Homo Sapiens
GFWRQEQSV

SEQ ID NO: 1192128 - protein, 9 aa, Homo Sapiens
GIQGRSMSV

SEQ ID NO: 1192129 - protein, 9 aa, Homo Sapiens
ASALHRARP

SEQ ID NO: 1192130 - protein, 9 aa, Homo Sapiens
QLLQQAQTA

SEQ ID NO: 1192131 - protein, 9 aa, Homo Sapiens
WIRHTIPWL

SEQ ID NO: 1192132 - protein, 9 aa, Homo Sapiens
ALIDRDQGG

SEQ ID NO: 1192133 - protein, 9 aa, Homo Sapiens
YSQPSSASS

SEQ ID NO: 1192134 - protein, 9 aa, Homo Sapiens
THELGVVKP

SEQ ID NO: 1192135 - protein, 9 aa, Homo Sapiens
DARHGGWTT

SEQ ID NO: 1192136 - protein, 9 aa, Homo Sapiens
RWTLCFATG

SEQ ID NO: 1192137 - protein, 9 aa, Homo Sapiens
SLTKASILK

SEQ ID NO: 1192138 - protein, 9 aa, Homo Sapiens
LQLVLWGWR

SEQ ID NO: 1192139 - protein, 9 aa, Homo Sapiens
KVVPRLSLD

SEQ ID NO: 1192140 - protein, 9 aa, Homo Sapiens
KSMHGDGVL

SEQ ID NO: 1192141 - protein, 9 aa, Homo Sapiens
AHRSTAKLL

SEQ ID NO: 1192142 - protein, 9 aa, Homo Sapiens
FQPFVKDCL

SEQ ID NO: 1192143 - protein, 9 aa, Homo Sapiens
QRFRLDNLF

SEQ ID NO: 1192144 - protein, 9 aa, Homo Sapiens
DEQTLKRQG

SEQ ID NO: 1192145 - protein, 9 aa, Homo Sapiens
SPQWSPSPL

SEQ ID NO: 1192146 - protein, 9 aa, Homo Sapiens
ADATNVSNW

SEQ ID NO: 1192147 - protein, 9 aa, Homo Sapiens
VREENKVCA

SEQ ID NO: 1192148 - protein, 9 aa, Homo Sapiens
LAPPAPLSQ

SEQ ID NO: 1192149 - protein, 9 aa, Homo Sapiens
SFLSNLSFL

SEQ ID NO: 1192150 - protein, 9 aa, Homo Sapiens
GRWGLGRIP

SEQ ID NO: 1192151 - protein, 9 aa, Homo Sapiens
IICSPLCLI

SEQ ID NO: 1192152 - protein, 9 aa, Homo Sapiens
VVTACLLIL

SEQ ID NO: 1192153 - protein, 9 aa, Homo Sapiens
DRVKWTGSS

SEQ ID NO: 1192154 - protein, 9 aa, Homo Sapiens
PHPPPAAAG

SEQ ID NO: 1192155 - protein, 9 aa, Homo Sapiens
QEGGGSEFL

SEQ ID NO: 1192156 - protein, 9 aa, Homo Sapiens
AGAAPGSHG

SEQ ID NO: 1192157 - protein, 9 aa, Homo Sapiens
IGKQSTCAP

SEQ ID NO: 1192158 - protein, 9 aa, Homo Sapiens
SYYEQCILV

SEQ ID NO: 1192159 - protein, 9 aa, Homo Sapiens
RLRLRLPRT

SEQ ID NO: 1192160 - protein, 9 aa, Homo Sapiens
GLAGMRGIQ

SEQ ID NO: 1192161 - protein, 9 aa, Homo Sapiens
AGPSTGAPA

SEQ ID NO: 1192162 - protein, 9 aa, Homo Sapiens
NTNQPNFMQ

SEQ ID NO: 1192163 - protein, 9 aa, Homo Sapiens
GGPRRRSFL

SEQ ID NO: 1192164 - protein, 9 aa, Homo Sapiens
VWPCIVLWP

SEQ ID NO: 1192165 - protein, 9 aa, Homo Sapiens
RLQHGVGPG

SEQ ID NO: 1192166 - protein, 9 aa, Homo Sapiens
PRNVPTAAS

SEQ ID NO: 1192167 - protein, 9 aa, Homo Sapiens
AGKSNWRQL

SEQ ID NO: 1192168 - protein, 9 aa, Homo Sapiens
QKWAAVLVP

SEQ ID NO: 1192169 - protein, 9 aa, Homo Sapiens
SWNHEVKLE

SEQ ID NO: 1192170 - protein, 9 aa, Homo Sapiens
GTQAAEEPS

SEQ ID NO: 1192171 - protein, 9 aa, Homo Sapiens
AFIIIHTFA

SEQ ID NO: 1192172 - protein, 9 aa, Homo Sapiens
KGIRPTYSS

SEQ ID NO: 1192173 - protein, 9 aa, Homo Sapiens
GAVDALSPA

SEQ ID NO: 1192174 - protein, 9 aa, Homo Sapiens
GRGPGLFPR

SEQ ID NO: 1192175 - protein, 9 aa, Homo Sapiens
LLGDPGRGR

SEQ ID NO: 1192176 - protein, 9 aa, Homo Sapiens
CVSLHMEKH

SEQ ID NO: 1192177 - protein, 9 aa, Homo Sapiens
WTCLKMSIG

SEQ ID NO: 1192178 - protein, 9 aa, Homo Sapiens
GHVCPWLQW

SEQ ID NO: 1192179 - protein, 9 aa, Homo Sapiens
ACRSASWRS

SEQ ID NO: 1192180 - protein, 9 aa, Homo Sapiens
HLVPAVSHD

SEQ ID NO: 1192181 - protein, 9 aa, Homo Sapiens
PVKDGAGAR

SEQ ID NO: 1192182 - protein, 9 aa, Homo Sapiens
CRTGPCCSR

SEQ ID NO: 1192183 - protein, 9 aa, Homo Sapiens
QQPGALRQA

SEQ ID NO: 1192184 - protein, 9 aa, Homo Sapiens
TQYPEKIHT

SEQ ID NO: 1192185 - protein, 9 aa, Homo Sapiens
ARVDGRCGV

SEQ ID NO: 1192186 - protein, 9 aa, Homo Sapiens
VGQPHALVA

SEQ ID NO: 1192187 - protein, 9 aa, Homo Sapiens
CLRRLCGRG

SEQ ID NO: 1192188 - protein, 9 aa, Homo Sapiens
AHSFYSFIY

SEQ ID NO: 1192189 - protein, 9 aa, Homo Sapiens
VCVPVHGHG

SEQ ID NO: 1192190 - protein, 9 aa, Homo Sapiens
KPGALTPLQ

SEQ ID NO: 1192191 - protein, 9 aa, Homo Sapiens
TSVTTLYDL

SEQ ID NO: 1192192 - protein, 9 aa, Homo Sapiens
ARVVGLGCG

SEQ ID NO: 1192193 - protein, 9 aa, Homo Sapiens
GKQEENNVV

SEQ ID NO: 1192194 - protein, 9 aa, Homo Sapiens
VRSAGLGPT

SEQ ID NO: 1192195 - protein, 9 aa, Homo Sapiens
SSTLERVSP

SEQ ID NO: 1192196 - protein, 9 aa, Homo Sapiens
PSSVSISFI

SEQ ID NO: 1192197 - protein, 9 aa, Homo Sapiens
LLNKGAEAF

SEQ ID NO: 1192198 - protein, 9 aa, Homo Sapiens
SWARSLASP

SEQ ID NO: 1192199 - protein, 9 aa, Homo Sapiens
AFARTLRRY

SEQ ID NO: 1192200 - protein, 9 aa, Homo Sapiens
LTPLQQRPG

SEQ ID NO: 1192201 - protein, 9 aa, Homo Sapiens
IIAIAAFII

SEQ ID NO: 1192202 - protein, 9 aa, Homo Sapiens
LSVSWKKRI

SEQ ID NO: 1192203 - protein, 9 aa, Homo Sapiens
EEQPLFPQI

SEQ ID NO: 1192204 - protein, 9 aa, Homo Sapiens
LPGPLPASH

SEQ ID NO: 1192205 - protein, 9 aa, Homo Sapiens
SAELQGGSK

SEQ ID NO: 1192206 - protein, 9 aa, Homo Sapiens
LLPPPPPCP

SEQ ID NO: 1192207 - protein, 9 aa, Homo Sapiens
GHTHSHTRG

SEQ ID NO: 1192208 - protein, 9 aa, Homo Sapiens
NVMLRSQSS

SEQ ID NO: 1192209 - protein, 9 aa, Homo Sapiens
RTASITLPT

SEQ ID NO: 1192210 - protein, 9 aa, Homo Sapiens
GARAGARGG

SEQ ID NO: 1192211 - protein, 9 aa, Homo Sapiens
VVWVCHPDV

SEQ ID NO: 1192212 - protein, 9 aa, Homo Sapiens
ADMCTNAHR

SEQ ID NO: 1192213 - protein, 9 aa, Homo Sapiens
LWTWMTCTS

SEQ ID NO: 1192214 - protein, 9 aa, Homo Sapiens
AWTDFRSCT

SEQ ID NO: 1192215 - protein, 9 aa, Homo Sapiens
SSRTLCSPW

SEQ ID NO: 1192216 - protein, 9 aa, Homo Sapiens
QHQHVYLGC

SEQ ID NO: 1192217 - protein, 9 aa, Homo Sapiens
ANKEKEHYK

SEQ ID NO: 1192218 - protein, 9 aa, Homo Sapiens
THLLLLIAL

SEQ ID NO: 1192219 - protein, 9 aa, Homo Sapiens
EAAAVVMVV

SEQ ID NO: 1192220 - protein, 9 aa, Homo Sapiens
SVAWRASFL

SEQ ID NO: 1192221 - protein, 9 aa, Homo Sapiens
PRPLGLADW

SEQ ID NO: 1192222 - protein, 9 aa, Homo Sapiens
LMKEATFVL

SEQ ID NO: 1192223 - protein, 9 aa, Homo Sapiens
ECSAAGATT

SEQ ID NO: 1192224 - protein, 9 aa, Homo Sapiens
RFEPEVKTC

SEQ ID NO: 1192225 - protein, 9 aa, Homo Sapiens
GSSPRPCRR

SEQ ID NO: 1192226 - protein, 9 aa, Homo Sapiens
EASGVTAAK

SEQ ID NO: 1192227 - protein, 9 aa, Homo Sapiens
TFLTQRQDT

SEQ ID NO: 1192228 - protein, 9 aa, Homo Sapiens
RLLSERGAA

SEQ ID NO: 1192229 - protein, 9 aa, Homo Sapiens
SRCPKSTSM

SEQ ID NO: 1192230 - protein, 9 aa, Homo Sapiens
RSLLRRKLK

SEQ ID NO: 1192231 - protein, 9 aa, Homo Sapiens
TAKRARSCP

SEQ ID NO: 1192232 - protein, 9 aa, Homo Sapiens
IFWTCLKMS

SEQ ID NO: 1192233 - protein, 9 aa, Homo Sapiens
CFILCSTHQ

SEQ ID NO: 1192234 - protein, 9 aa, Homo Sapiens
DLCVCGPGS

SEQ ID NO: 1192235 - protein, 9 aa, Homo Sapiens
HHPHPKPKT

SEQ ID NO: 1192236 - protein, 9 aa, Homo Sapiens
ASFTTPYGY

SEQ ID NO: 1192237 - protein, 9 aa, Homo Sapiens
TSNAAVALL

SEQ ID NO: 1192238 - protein, 9 aa, Homo Sapiens
ATLPGPPAQ

SEQ ID NO: 1192239 - protein, 9 aa, Homo Sapiens
PTVEYNDGR

SEQ ID NO: 1192240 - protein, 9 aa, Homo Sapiens
CSMRTGTLG

SEQ ID NO: 1192241 - protein, 9 aa, Homo Sapiens
GGLWAHRAG

SEQ ID NO: 1192242 - protein, 9 aa, Homo Sapiens
EQFVINYCI

SEQ ID NO: 1192243 - protein, 9 aa, Homo Sapiens
THPRSRLSH

SEQ ID NO: 1192244 - protein, 9 aa, Homo Sapiens
AALMSLLAS

SEQ ID NO: 1192245 - protein, 9 aa, Homo Sapiens
FALVSLHIS

SEQ ID NO: 1192246 - protein, 9 aa, Homo Sapiens
HPCNTLKYP

SEQ ID NO: 1192247 - protein, 9 aa, Homo Sapiens
LSISRRQSE

SEQ ID NO: 1192248 - protein, 9 aa, Homo Sapiens
QKRHLHRSV

SEQ ID NO: 1192249 - protein, 9 aa, Homo Sapiens
GLEEDKEEL

SEQ ID NO: 1192250 - protein, 9 aa, Homo Sapiens
MWLSASHFT

SEQ ID NO: 1192251 - protein, 9 aa, Homo Sapiens
VPFWVRPAG

SEQ ID NO: 1192252 - protein, 9 aa, Homo Sapiens
KSTSMLSAA

SEQ ID NO: 1192253 - protein, 9 aa, Homo Sapiens
ANFNEAKYN

SEQ ID NO: 1192254 - protein, 9 aa, Homo Sapiens
VLALMQKHH

SEQ ID NO: 1192255 - protein, 9 aa, Homo Sapiens
GHAGKAQLR

SEQ ID NO: 1192256 - protein, 9 aa, Homo Sapiens
ATSTTGPGT

SEQ ID NO: 1192257 - protein, 9 aa, Homo Sapiens
RRRWHTRGC

SEQ ID NO: 1192258 - protein, 9 aa, Homo Sapiens
VITVGPRGH

SEQ ID NO: 1192259 - protein, 9 aa, Homo Sapiens
GGGGGKRAA

SEQ ID NO: 1192260 - protein, 9 aa, Homo Sapiens
HWNETAEKI

SEQ ID NO: 1192261 - protein, 9 aa, Homo Sapiens
KSGGHAAQL

SEQ ID NO: 1192262 - protein, 9 aa, Homo Sapiens
PGPAPWWHP

SEQ ID NO: 1192263 - protein, 9 aa, Homo Sapiens
GWLPRLTRE

SEQ ID NO: 1192264 - protein, 9 aa, Homo Sapiens
PNPQPQSLG

SEQ ID NO: 1192265 - protein, 9 aa, Homo Sapiens
SAVASDLGE

SEQ ID NO: 1192266 - protein, 9 aa, Homo Sapiens
RTRLPTKKK

SEQ ID NO: 1192267 - protein, 9 aa, Homo Sapiens
SISCSVRHA

SEQ ID NO: 1192268 - protein, 9 aa, Homo Sapiens
GHGHTHSHT

SEQ ID NO: 1192269 - protein, 9 aa, Homo Sapiens
KLSGETTLV

SEQ ID NO: 1192270 - protein, 9 aa, Homo Sapiens
NMSQLLANE

SEQ ID NO: 1192271 - protein, 9 aa, Homo Sapiens
GNLELKKVV

SEQ ID NO: 1192272 - protein, 9 aa, Homo Sapiens
FGPRSINPT

SEQ ID NO: 1192273 - protein, 9 aa, Homo Sapiens
FERQKYLSM

SEQ ID NO: 1192274 - protein, 9 aa, Homo Sapiens
ASVPPGRRQ

SEQ ID NO: 1192275 - protein, 9 aa, Homo Sapiens
DNFYPEDIV

SEQ ID NO: 1192276 - protein, 9 aa, Homo Sapiens
KNLQWMRGL

SEQ ID NO: 1192277 - protein, 9 aa, Homo Sapiens
VDGHEQQLS

SEQ ID NO: 1192278 - protein, 9 aa, Homo Sapiens
ALFVPGGGA

SEQ ID NO: 1192279 - protein, 9 aa, Homo Sapiens
TQQRPPWRT

SEQ ID NO: 1192280 - protein, 9 aa, Homo Sapiens
LDTCYGNIL

SEQ ID NO: 1192281 - protein, 9 aa, Homo Sapiens
PMPGSCRSP

SEQ ID NO: 1192282 - protein, 9 aa, Homo Sapiens
PPWRTSRGQ

SEQ ID NO: 1192283 - protein, 9 aa, Homo Sapiens
AADTEPGPG

SEQ ID NO: 1192284 - protein, 9 aa, Homo Sapiens
LSFLTPPCA

SEQ ID NO: 1192285 - protein, 9 aa, Homo Sapiens
RTLRRYTSL

SEQ ID NO: 1192286 - protein, 9 aa, Homo Sapiens
AGGAAAAAV

SEQ ID NO: 1192287 - protein, 9 aa, Homo Sapiens
FIPRLVHLY

SEQ ID NO: 1192288 - protein, 9 aa, Homo Sapiens
FTTELGWAG

SEQ ID NO: 1192289 - protein, 9 aa, Homo Sapiens
AIVGIAWLT

SEQ ID NO: 1192290 - protein, 9 aa, Homo Sapiens
KVKKRKRRR

SEQ ID NO: 1192291 - protein, 9 aa, Homo Sapiens
PGLPLLDTD

SEQ ID NO: 1192292 - protein, 9 aa, Homo Sapiens
LDEYRDIAN

SEQ ID NO: 1192293 - protein, 9 aa, Homo Sapiens
AAGAAVWGA

SEQ ID NO: 1192294 - protein, 9 aa, Homo Sapiens
TQGTPAEQE

SEQ ID NO: 1192295 - protein, 9 aa, Homo Sapiens
RLFSHSQVL

SEQ ID NO: 1192296 - protein, 9 aa, Homo Sapiens
LQGLACRRR

SEQ ID NO: 1192297 - protein, 9 aa, Homo Sapiens
ARPPPRWPR

SEQ ID NO: 1192298 - protein, 9 aa, Homo Sapiens
AAPATVRPG

SEQ ID NO: 1192299 - protein, 9 aa, Homo Sapiens
LIPLGDLSV

SEQ ID NO: 1192300 - protein, 9 aa, Homo Sapiens
FLYGHLGLP

SEQ ID NO: 1192301 - protein, 9 aa, Homo Sapiens
PQDPNVLDS

SEQ ID NO: 1192302 - protein, 9 aa, Homo Sapiens
ESTGNGPPT

SEQ ID NO: 1192303 - protein, 9 aa, Homo Sapiens
RPRVTPGPP

SEQ ID NO: 1192304 - protein, 9 aa, Homo Sapiens
ARVEVAAGP

SEQ ID NO: 1192305 - protein, 9 aa, Homo Sapiens
SHISDTSFS

SEQ ID NO: 1192306 - protein, 9 aa, Homo Sapiens
SGGHAAQLL

SEQ ID NO: 1192307 - protein, 9 aa, Homo Sapiens
EEEEEEDLS

SEQ ID NO: 1192308 - protein, 9 aa, Homo Sapiens
QREGEEKDS

SEQ ID NO: 1192309 - protein, 9 aa, Homo Sapiens
GWASSRLCH

SEQ ID NO: 1192310 - protein, 9 aa, Homo Sapiens
QARHLVIHE

SEQ ID NO: 1192311 - protein, 9 aa, Homo Sapiens
VRPVATLSP

SEQ ID NO: 1192312 - protein, 9 aa, Homo Sapiens
YSGSVIRHL

SEQ ID NO: 1192313 - protein, 9 aa, Homo Sapiens
VCPVHLVAC

SEQ ID NO: 1192314 - protein, 9 aa, Homo Sapiens
LRGRARAGV

SEQ ID NO: 1192315 - protein, 9 aa, Homo Sapiens
LLFLIKSLL

SEQ ID NO: 1192316 - protein, 9 aa, Homo Sapiens
EKSNYPPEC

SEQ ID NO: 1192317 - protein, 9 aa, Homo Sapiens
LTLHLLPGQ

SEQ ID NO: 1192318 - protein, 9 aa, Homo Sapiens
PIVITVLNS

SEQ ID NO: 1192319 - protein, 9 aa, Homo Sapiens
SPHIWPVQP

SEQ ID NO: 1192320 - protein, 9 aa, Homo Sapiens
TEAAGPQGP

SEQ ID NO: 1192321 - protein, 9 aa, Homo Sapiens
RILKYSKAE

SEQ ID NO: 1192322 - protein, 9 aa, Homo Sapiens
CLTHCTFWT

SEQ ID NO: 1192323 - protein, 9 aa, Homo Sapiens
HVEVREAHE

SEQ ID NO: 1192324 - protein, 9 aa, Homo Sapiens
LILTPSRSQ

SEQ ID NO: 1192325 - protein, 9 aa, Homo Sapiens
WPPPWLSPL

SEQ ID NO: 1192326 - protein, 9 aa, Homo Sapiens
DVWARLECE

SEQ ID NO: 1192327 - protein, 9 aa, Homo Sapiens
VHHPQPKST

SEQ ID NO: 1192328 - protein, 9 aa, Homo Sapiens
LSLDHNFLS

SEQ ID NO: 1192329 - protein, 9 aa, Homo Sapiens
WSFCFSPLW

SEQ ID NO: 1192330 - protein, 9 aa, Homo Sapiens
HPQWCWSLV

SEQ ID NO: 1192331 - protein, 9 aa, Homo Sapiens
LYDHVRPVG

SEQ ID NO: 1192332 - protein, 9 aa, Homo Sapiens
VKTEAAGPQ

SEQ ID NO: 1192333 - protein, 9 aa, Homo Sapiens
RHTIPWLED

SEQ ID NO: 1192334 - protein, 9 aa, Homo Sapiens
EAQIKAANK

SEQ ID NO: 1192335 - protein, 9 aa, Homo Sapiens
VDVEVVENE

SEQ ID NO: 1192336 - protein, 9 aa, Homo Sapiens
IYNCTLVHE

SEQ ID NO: 1192337 - protein, 9 aa, Homo Sapiens
PWRAPRASR

SEQ ID NO: 1192338 - protein, 9 aa, Homo Sapiens
VQPHSPVRL

SEQ ID NO: 1192339 - protein, 9 aa, Homo Sapiens
RQDSDLTCL

SEQ ID NO: 1192340 - protein, 9 aa, Homo Sapiens
WPVLQRVHG

SEQ ID NO: 1192341 - protein, 9 aa, Homo Sapiens
APLPAFGRA

SEQ ID NO: 1192342 - protein, 9 aa, Homo Sapiens
MHVSFLNED

SEQ ID NO: 1192343 - protein, 9 aa, Homo Sapiens
WEFSSVGPY

SEQ ID NO: 1192344 - protein, 9 aa, Homo Sapiens
KRYLRKNLN

SEQ ID NO: 1192345 - protein, 9 aa, Homo Sapiens
DKNFSSTSD

SEQ ID NO: 1192346 - protein, 9 aa, Homo Sapiens
GPPTAPQRP

SEQ ID NO: 1192347 - protein, 9 aa, Homo Sapiens
LDHSHEMAE

SEQ ID NO: 1192348 - protein, 9 aa, Homo Sapiens
AARSPLTGS

SEQ ID NO: 1192349 - protein, 9 aa, Homo Sapiens
AILHVQHQP

SEQ ID NO: 1192350 - protein, 9 aa, Homo Sapiens
PSNVSSPAR

SEQ ID NO: 1192351 - protein, 9 aa, Homo Sapiens
PYDTRSRRG

SEQ ID NO: 1192352 - protein, 9 aa, Homo Sapiens
PEKERYMQE

SEQ ID NO: 1192353 - protein, 9 aa, Homo Sapiens
DYGNTPLRC

SEQ ID NO: 1192354 - protein, 9 aa, Homo Sapiens
GAAVQRLGL

SEQ ID NO: 1192355 - protein, 9 aa, Homo Sapiens
QRSNRSLPG

SEQ ID NO: 1192356 - protein, 9 aa, Homo Sapiens
IQLIQFALV

SEQ ID NO: 1192357 - protein, 9 aa, Homo Sapiens
EKRTYKSAV

SEQ ID NO: 1192358 - protein, 9 aa, Homo Sapiens
GGYGSARTC

SEQ ID NO: 1192359 - protein, 9 aa, Homo Sapiens
VPPGWMPRC

SEQ ID NO: 1192360 - protein, 9 aa, Homo Sapiens
TSMLSAAGS

SEQ ID NO: 1192361 - protein, 9 aa, Homo Sapiens
CHWEGLWGW

SEQ ID NO: 1192362 - protein, 9 aa, Homo Sapiens
IFCLPLGLG

SEQ ID NO: 1192363 - protein, 9 aa, Homo Sapiens
KVLRPFYCA

SEQ ID NO: 1192364 - protein, 9 aa, Homo Sapiens
VVSAFARTL

SEQ ID NO: 1192365 - protein, 9 aa, Homo Sapiens
SGGGGGTKY

SEQ ID NO: 1192366 - protein, 9 aa, Homo Sapiens
HPILRWQRL

SEQ ID NO: 1192367 - protein, 9 aa, Homo Sapiens
PYRPCTHLA

SEQ ID NO: 1192368 - protein, 9 aa, Homo Sapiens
YGTSNAAVA

SEQ ID NO: 1192369 - protein, 9 aa, Homo Sapiens
AGSPQSRVD

SEQ ID NO: 1192370 - protein, 9 aa, Homo Sapiens
SPSGALNIK

SEQ ID NO: 1192371 - protein, 9 aa, Homo Sapiens
RKGKGEKKN

SEQ ID NO: 1192372 - protein, 9 aa, Homo Sapiens
AFVGPRCSF

SEQ ID NO: 1192373 - protein, 9 aa, Homo Sapiens
TCLKMSIGA

SEQ ID NO: 1192374 - protein, 9 aa, Homo Sapiens
QPAARLLLH

SEQ ID NO: 1192375 - protein, 9 aa, Homo Sapiens
HHLCPILCH

SEQ ID NO: 1192376 - protein, 9 aa, Homo Sapiens
NVGINNQKR

SEQ ID NO: 1192377 - protein, 9 aa, Homo Sapiens
CRICAFLLW

SEQ ID NO: 1192378 - protein, 9 aa, Homo Sapiens
EEEEEDVEK

SEQ ID NO: 1192379 - protein, 9 aa, Homo Sapiens
RGAAQMSWS

SEQ ID NO: 1192380 - protein, 9 aa, Homo Sapiens
AKTGGSRSA

SEQ ID NO: 1192381 - protein, 9 aa, Homo Sapiens
ALPWLSRRM

SEQ ID NO: 1192382 - protein, 9 aa, Homo Sapiens
GPRSINPTL

SEQ ID NO: 1192383 - protein, 9 aa, Homo Sapiens
GLHLHPSPA

SEQ ID NO: 1192384 - protein, 9 aa, Homo Sapiens
YLRKNLNPP

SEQ ID NO: 1192385 - protein, 9 aa, Homo Sapiens
ISFQLPMCT

SEQ ID NO: 1192386 - protein, 9 aa, Homo Sapiens
RIQTHGEGY

SEQ ID NO: 1192387 - protein, 9 aa, Homo Sapiens
HLQSQLAPW

SEQ ID NO: 1192388 - protein, 9 aa, Homo Sapiens
PGSHSQASH

SEQ ID NO: 1192389 - protein, 9 aa, Homo Sapiens
RQALVRCGQ

SEQ ID NO: 1192390 - protein, 9 aa, Homo Sapiens
QGICPRPPP

SEQ ID NO: 1192391 - protein, 9 aa, Homo Sapiens
HPPHPHHTQ

SEQ ID NO: 1192392 - protein, 9 aa, Homo Sapiens
GPGRPAGQV

SEQ ID NO: 1192393 - protein, 9 aa, Homo Sapiens
ECVPGRGGE

SEQ ID NO: 1192394 - protein, 9 aa, Homo Sapiens
WPDAHLSAA

SEQ ID NO: 1192395 - protein, 9 aa, Homo Sapiens
KFHSEYLSS

SEQ ID NO: 1192396 - protein, 9 aa, Homo Sapiens
DHGPIKMYK

SEQ ID NO: 1192397 - protein, 9 aa, Homo Sapiens
RLSTKHKEK

SEQ ID NO: 1192398 - protein, 9 aa, Homo Sapiens
SPSRTCSTE

SEQ ID NO: 1192399 - protein, 9 aa, Homo Sapiens
LTHFVANSL

SEQ ID NO: 1192400 - protein, 9 aa, Homo Sapiens
ARRTWPRSV

SEQ ID NO: 1192401 - protein, 9 aa, Homo Sapiens
RSESRVEPP

SEQ ID NO: 1192402 - protein, 9 aa, Homo Sapiens
AGGLHLHPS

SEQ ID NO: 1192403 - protein, 9 aa, Homo Sapiens
CSQTRPLWS

SEQ ID NO: 1192404 - protein, 9 aa, Homo Sapiens
CQSEDARAW

SEQ ID NO: 1192405 - protein, 9 aa, Homo Sapiens
GGSGSANQP

SEQ ID NO: 1192406 - protein, 9 aa, Homo Sapiens
TIQTHNIRH

SEQ ID NO: 1192407 - protein, 9 aa, Homo Sapiens
LQTGTPRSP

SEQ ID NO: 1192408 - protein, 9 aa, Homo Sapiens
HTTPAQALH

SEQ ID NO: 1192409 - protein, 9 aa, Homo Sapiens
RNGSGPGRR

SEQ ID NO: 1192410 - protein, 9 aa, Homo Sapiens
DAFLGRPPT

SEQ ID NO: 1192411 - protein, 9 aa, Homo Sapiens
GITILVGSN

SEQ ID NO: 1192412 - protein, 9 aa, Homo Sapiens
YDISAIERN

SEQ ID NO: 1192413 - protein, 9 aa, Homo Sapiens
NYGYVGYIR

SEQ ID NO: 1192414 - protein, 9 aa, Homo Sapiens
SCLSIWPRT

SEQ ID NO: 1192415 - protein, 9 aa, Homo Sapiens
LRPCLPSPR

SEQ ID NO: 1192416 - protein, 9 aa, Homo Sapiens
LEALEFYYH

SEQ ID NO: 1192417 - protein, 9 aa, Homo Sapiens
AQRYIDSKV

SEQ ID NO: 1192418 - protein, 9 aa, Homo Sapiens
NNDPSWNHE

SEQ ID NO: 1192419 - protein, 9 aa, Homo Sapiens
CQIKRDVNR

SEQ ID NO: 1192420 - protein, 9 aa, Homo Sapiens
LSMQDRMEL

SEQ ID NO: 1192421 - protein, 9 aa, Homo Sapiens
VMWGRQLKI

SEQ ID NO: 1192422 - protein, 9 aa, Homo Sapiens
VRTARTLLD

SEQ ID NO: 1192423 - protein, 9 aa, Homo Sapiens
VIRDAVTHT

SEQ ID NO: 1192424 - protein, 9 aa, Homo Sapiens
TLRVPSPLT

SEQ ID NO: 1192425 - protein, 9 aa, Homo Sapiens
SAYLANHQR

SEQ ID NO: 1192426 - protein, 9 aa, Homo Sapiens
DGVPCSMRT

SEQ ID NO: 1192427 - protein, 9 aa, Homo Sapiens
LEAAAKFLS

SEQ ID NO: 1192428 - protein, 9 aa, Homo Sapiens
PAAAGCSWT

SEQ ID NO: 1192429 - protein, 9 aa, Homo Sapiens
PSSASSAYH

SEQ ID NO: 1192430 - protein, 9 aa, Homo Sapiens
DQLKEMAPT

SEQ ID NO: 1192431 - protein, 9 aa, Homo Sapiens
LASSAPTWG

SEQ ID NO: 1192432 - protein, 9 aa, Homo Sapiens
PSAPWIDPN

SEQ ID NO: 1192433 - protein, 9 aa, Homo Sapiens
LTMPCWTRP

SEQ ID NO: 1192434 - protein, 9 aa, Homo Sapiens
GWRSPKCII

SEQ ID NO: 1192435 - protein, 9 aa, Homo Sapiens
RTAAPGQPG

SEQ ID NO: 1192436 - protein, 9 aa, Homo Sapiens
HADHLPPRG

SEQ ID NO: 1192437 - protein, 9 aa, Homo Sapiens
RWPRGLLCP

SEQ ID NO: 1192438 - protein, 9 aa, Homo Sapiens
TAEATTRLN

SEQ ID NO: 1192439 - protein, 9 aa, Homo Sapiens
SGSAPAPTA

SEQ ID NO: 1192440 - protein, 9 aa, Homo Sapiens
RSWCCRPSA

SEQ ID NO: 1192441 - protein, 9 aa, Homo Sapiens
LGTQLPGRR

SEQ ID NO: 1192442 - protein, 9 aa, Homo Sapiens
HLPREFGDA

SEQ ID NO: 1192443 - protein, 9 aa, Homo Sapiens
APTAAAPTA

SEQ ID NO: 1192444 - protein, 9 aa, Homo Sapiens
EHSIQMLTL

SEQ ID NO: 1192445 - protein, 9 aa, Homo Sapiens
QTRPKSSVH

SEQ ID NO: 1192446 - protein, 9 aa, Homo Sapiens
LIFVLNRMQ

SEQ ID NO: 1192447 - protein, 9 aa, Homo Sapiens
RKCLRSAQH

SEQ ID NO: 1192448 - protein, 9 aa, Homo Sapiens
SGIYGKAHA

SEQ ID NO: 1192449 - protein, 9 aa, Homo Sapiens
KQDPYIVSM

SEQ ID NO: 1192450 - protein, 9 aa, Homo Sapiens
HVFHKKNRR

SEQ ID NO: 1192451 - protein, 9 aa, Homo Sapiens
YARWAGVAS

SEQ ID NO: 1192452 - protein, 9 aa, Homo Sapiens
RGMGCPFQG

SEQ ID NO: 1192453 - protein, 9 aa, Homo Sapiens
ELHIECSDE

SEQ ID NO: 1192454 - protein, 9 aa, Homo Sapiens
LAPKTTLPG

SEQ ID NO: 1192455 - protein, 9 aa, Homo Sapiens
CPPSSSTLE

SEQ ID NO: 1192456 - protein, 9 aa, Homo Sapiens
VPTCHNSKD

SEQ ID NO: 1192457 - protein, 9 aa, Homo Sapiens
LPPRGDQCC

SEQ ID NO: 1192458 - protein, 9 aa, Homo Sapiens
GCLVLEPSE

SEQ ID NO: 1192459 - protein, 9 aa, Homo Sapiens
SSTSPRASL

SEQ ID NO: 1192460 - protein, 9 aa, Homo Sapiens
LVVVLCTPG

SEQ ID NO: 1192461 - protein, 9 aa, Homo Sapiens
ASPRACARR

SEQ ID NO: 1192462 - protein, 9 aa, Homo Sapiens
GMRMDLGEC

SEQ ID NO: 1192463 - protein, 9 aa, Homo Sapiens
EGPNKGATT

SEQ ID NO: 1192464 - protein, 9 aa, Homo Sapiens
LPPKPLGPE

SEQ ID NO: 1192465 - protein, 9 aa, Homo Sapiens
IPFLLICIS

SEQ ID NO: 1192466 - protein, 9 aa, Homo Sapiens
FTQDRGLQA

SEQ ID NO: 1192467 - protein, 9 aa, Homo Sapiens
TTNMATFIS

SEQ ID NO: 1192468 - protein, 9 aa, Homo Sapiens
HCPLQTFHL

SEQ ID NO: 1192469 - protein, 9 aa, Homo Sapiens
TQKSRQRQT

SEQ ID NO: 1192470 - protein, 9 aa, Homo Sapiens
GHRDRSHSG

SEQ ID NO: 1192471 - protein, 9 aa, Homo Sapiens
ILLVPAVDG

SEQ ID NO: 1192472 - protein, 9 aa, Homo Sapiens
LWTWKPSTW

SEQ ID NO: 1192473 - protein, 9 aa, Homo Sapiens
TCWASQSIW

SEQ ID NO: 1192474 - protein, 9 aa, Homo Sapiens
ASHMLPQPE

SEQ ID NO: 1192475 - protein, 9 aa, Homo Sapiens
SKQSDSRFQ

SEQ ID NO: 1192476 - protein, 9 aa, Homo Sapiens
ISRLDNYDT

SEQ ID NO: 1192477 - protein, 9 aa, Homo Sapiens
DPSRLLLGW

SEQ ID NO: 1192478 - protein, 9 aa, Homo Sapiens
VSKKRLPKL

SEQ ID NO: 1192479 - protein, 9 aa, Homo Sapiens
QHLQEALGM

SEQ ID NO: 1192480 - protein, 9 aa, Homo Sapiens
KALPSTGPT

SEQ ID NO: 1192481 - protein, 9 aa, Homo Sapiens
LYWDAMLET

SEQ ID NO: 1192482 - protein, 9 aa, Homo Sapiens
RDKRIAKHV

SEQ ID NO: 1192483 - protein, 9 aa, Homo Sapiens
LRPASSGSG

SEQ ID NO: 1192484 - protein, 9 aa, Homo Sapiens
PQLLRGPPT

SEQ ID NO: 1192485 - protein, 9 aa, Homo Sapiens
PRKHRGPWG

SEQ ID NO: 1192486 - protein, 9 aa, Homo Sapiens
GTFLVSAVF

SEQ ID NO: 1192487 - protein, 9 aa, Homo Sapiens
QHKQDPYIV

SEQ ID NO: 1192488 - protein, 9 aa, Homo Sapiens
AVRFLGCPQ

SEQ ID NO: 1192489 - protein, 9 aa, Homo Sapiens
SPLATYAPV

SEQ ID NO: 1192490 - protein, 9 aa, Homo Sapiens
KKKVRSLHT

SEQ ID NO: 1192491 - protein, 9 aa, Homo Sapiens
RIATQKSRQ

SEQ ID NO: 1192492 - protein, 9 aa, Homo Sapiens
PSCSSPEGP

SEQ ID NO: 1192493 - protein, 9 aa, Homo Sapiens
AVVDANGKN

SEQ ID NO: 1192494 - protein, 9 aa, Homo Sapiens
GLMSLRLLH

SEQ ID NO: 1192495 - protein, 9 aa, Homo Sapiens
PASHPLFGR

SEQ ID NO: 1192496 - protein, 9 aa, Homo Sapiens
VGLAGDTNL

SEQ ID NO: 1192497 - protein, 9 aa, Homo Sapiens
ADPYSSCAS

SEQ ID NO: 1192498 - protein, 9 aa, Homo Sapiens
YPSLIPITN

SEQ ID NO: 1192499 - protein, 9 aa, Homo Sapiens
SHMLPQPEP

SEQ ID NO: 1192500 - protein, 9 aa, Homo Sapiens
LAWSPRAVA

SEQ ID NO: 1192501 - protein, 9 aa, Homo Sapiens
RQQNWMSSV

SEQ ID NO: 1192502 - protein, 9 aa, Homo Sapiens
VSVGCVASI

SEQ ID NO: 1192503 - protein, 9 aa, Homo Sapiens
PTAASPCWL

SEQ ID NO: 1192504 - protein, 9 aa, Homo Sapiens
PSGDGQLFP

SEQ ID NO: 1192505 - protein, 9 aa, Homo Sapiens
GPGKYICQR

SEQ ID NO: 1192506 - protein, 9 aa, Homo Sapiens
LDAHFDHKV

SEQ ID NO: 1192507 - protein, 9 aa, Homo Sapiens
CKLHLLILL

SEQ ID NO: 1192508 - protein, 9 aa, Homo Sapiens
RLTEAAVAG

SEQ ID NO: 1192509 - protein, 9 aa, Homo Sapiens
SSPSTNATL

SEQ ID NO: 1192510 - protein, 9 aa, Homo Sapiens
SCPYHPGHH

SEQ ID NO: 1192511 - protein, 9 aa, Homo Sapiens
QTINTTRHG

SEQ ID NO: 1192512 - protein, 9 aa, Homo Sapiens
IKRAGMSKP

SEQ ID NO: 1192513 - protein, 9 aa, Homo Sapiens
DVECAKNLL

SEQ ID NO: 1192514 - protein, 9 aa, Homo Sapiens
RAGGQRTRG

SEQ ID NO: 1192515 - protein, 9 aa, Homo Sapiens
TPTLPATRK

SEQ ID NO: 1192516 - protein, 9 aa, Homo Sapiens
FVLDVFASG

SEQ ID NO: 1192517 - protein, 9 aa, Homo Sapiens
KGTESSLAR

SEQ ID NO: 1192518 - protein, 9 aa, Homo Sapiens
KLDKASFTT

SEQ ID NO: 1192519 - protein, 9 aa, Homo Sapiens
LLQQAQTAI

SEQ ID NO: 1192520 - protein, 9 aa, Homo Sapiens
LPQGPTVPG

SEQ ID NO: 1192521 - protein, 9 aa, Homo Sapiens
LWLMTAMWL

SEQ ID NO: 1192522 - protein, 9 aa, Homo Sapiens
LVLTAFGIA

SEQ ID NO: 1192523 - protein, 9 aa, Homo Sapiens
PLTSVPWPV

SEQ ID NO: 1192524 - protein, 9 aa, Homo Sapiens
NNLKAPPPE

SEQ ID NO: 1192525 - protein, 9 aa, Homo Sapiens
QASESGASG

SEQ ID NO: 1192526 - protein, 9 aa, Homo Sapiens
QCPASGGGK

SEQ ID NO: 1192527 - protein, 9 aa, Homo Sapiens
VREPRAGSP

SEQ ID NO: 1192528 - protein, 9 aa, Homo Sapiens
LRTVALANP

SEQ ID NO: 1192529 - protein, 9 aa, Homo Sapiens
LMAKTIRFT

SEQ ID NO: 1192530 - protein, 9 aa, Homo Sapiens
LRCISSGWR

SEQ ID NO: 1192531 - protein, 9 aa, Homo Sapiens
HGREDGVHA

SEQ ID NO: 1192532 - protein, 9 aa, Homo Sapiens
WCEVQDRKL

SEQ ID NO: 1192533 - protein, 9 aa, Homo Sapiens
GPTSPPMMR

SEQ ID NO: 1192534 - protein, 9 aa, Homo Sapiens
VNLMKEATF

SEQ ID NO: 1192535 - protein, 9 aa, Homo Sapiens
GCFESCSSD

SEQ ID NO: 1192536 - protein, 9 aa, Homo Sapiens
LSHQIKSSF

SEQ ID NO: 1192537 - protein, 9 aa, Homo Sapiens
DLLQLPEPI

SEQ ID NO: 1192538 - protein, 9 aa, Homo Sapiens
ERPVLGWRL

SEQ ID NO: 1192539 - protein, 9 aa, Homo Sapiens
AGSGQVAAP

SEQ ID NO: 1192540 - protein, 9 aa, Homo Sapiens
MGVGADARL

SEQ ID NO: 1192541 - protein, 9 aa, Homo Sapiens
LPEPHGLPL

SEQ ID NO: 1192542 - protein, 9 aa, Homo Sapiens
EKLENLYDA

SEQ ID NO: 1192543 - protein, 9 aa, Homo Sapiens
YKLPSNTGY

SEQ ID NO: 1192544 - protein, 9 aa, Homo Sapiens
FAVKLEGGQ

SEQ ID NO: 1192545 - protein, 9 aa, Homo Sapiens
HSNNLYCDY

SEQ ID NO: 1192546 - protein, 9 aa, Homo Sapiens
QPKSTPDAC

SEQ ID NO: 1192547 - protein, 9 aa, Homo Sapiens
TPHSHIKPY

SEQ ID NO: 1192548 - protein, 9 aa, Homo Sapiens
CPPLLEAFP

SEQ ID NO: 1192549 - protein, 9 aa, Homo Sapiens
RRTTCRRPA

SEQ ID NO: 1192550 - protein, 9 aa, Homo Sapiens
ALDDGNTFK

SEQ ID NO: 1192551 - protein, 9 aa, Homo Sapiens
HPQAFNGLM

SEQ ID NO: 1192552 - protein, 9 aa, Homo Sapiens
GRDAVWRGA

SEQ ID NO: 1192553 - protein, 9 aa, Homo Sapiens
PLSDLPSLT

SEQ ID NO: 1192554 - protein, 9 aa, Homo Sapiens
LKDELSHQF

SEQ ID NO: 1192555 - protein, 9 aa, Homo Sapiens
GSIFLGALE

SEQ ID NO: 1192556 - protein, 9 aa, Homo Sapiens
VTVNLIVVL

SEQ ID NO: 1192557 - protein, 9 aa, Homo Sapiens
EALLNKGAE

SEQ ID NO: 1192558 - protein, 9 aa, Homo Sapiens
TAAEQAVFL

SEQ ID NO: 1192559 - protein, 9 aa, Homo Sapiens
MQLGRLYMK

SEQ ID NO: 1192560 - protein, 9 aa, Homo Sapiens
PAPKMCAPV

SEQ ID NO: 1192561 - protein, 9 aa, Homo Sapiens
NWMSSVRSW

SEQ ID NO: 1192562 - protein, 9 aa, Homo Sapiens
PPTRELGAR

SEQ ID NO: 1192563 - protein, 9 aa, Homo Sapiens
QNVTTCPEL

SEQ ID NO: 1192564 - protein, 9 aa, Homo Sapiens
NMWFKHENY

SEQ ID NO: 1192565 - protein, 9 aa, Homo Sapiens
RRTGNFIPP

SEQ ID NO: 1192566 - protein, 9 aa, Homo Sapiens
VEAGGSHVG

SEQ ID NO: 1192567 - protein, 9 aa, Homo Sapiens
YKKMESCMC

SEQ ID NO: 1192568 - protein, 9 aa, Homo Sapiens
NIKRYLRKN

SEQ ID NO: 1192569 - protein, 9 aa, Homo Sapiens
EKMQWLPCL

SEQ ID NO: 1192570 - protein, 9 aa, Homo Sapiens
FFVLVNLEV

SEQ ID NO: 1192571 - protein, 9 aa, Homo Sapiens
AWAPDAAGT

SEQ ID NO: 1192572 - protein, 9 aa, Homo Sapiens
ILTRRNGFW

SEQ ID NO: 1192573 - protein, 9 aa, Homo Sapiens
TAAKAGMNR

SEQ ID NO: 1192574 - protein, 9 aa, Homo Sapiens
SMCDSISEW

SEQ ID NO: 1192575 - protein, 9 aa, Homo Sapiens
VQCLLRRCI

SEQ ID NO: 1192576 - protein, 9 aa, Homo Sapiens
VAGVTWGNG

SEQ ID NO: 1192577 - protein, 9 aa, Homo Sapiens
FGNPMMCDL

SEQ ID NO: 1192578 - protein, 9 aa, Homo Sapiens
GRTSFPRIL

SEQ ID NO: 1192579 - protein, 9 aa, Homo Sapiens
LRGTILVKQ

SEQ ID NO: 1192580 - protein, 9 aa, Homo Sapiens
CERCCKRFV

SEQ ID NO: 1192581 - protein, 9 aa, Homo Sapiens
FFYREPGCE

SEQ ID NO: 1192582 - protein, 9 aa, Homo Sapiens
SSCQVQELN

SEQ ID NO: 1192583 - protein, 9 aa, Homo Sapiens
CLGAYGTSN

SEQ ID NO: 1192584 - protein, 9 aa, Homo Sapiens
PCLQDGIER

SEQ ID NO: 1192585 - protein, 9 aa, Homo Sapiens
VKGWFEQRK

SEQ ID NO: 1192586 - protein, 9 aa, Homo Sapiens
LSLSRPHGR

SEQ ID NO: 1192587 - protein, 9 aa, Homo Sapiens
KLPSNTGYA

SEQ ID NO: 1192588 - protein, 9 aa, Homo Sapiens
AGDDAPPGC

SEQ ID NO: 1192589 - protein, 9 aa, Homo Sapiens
ARDMLGGMG

SEQ ID NO: 1192590 - protein, 9 aa, Homo Sapiens
QRLQEGEEG

SEQ ID NO: 1192591 - protein, 9 aa, Homo Sapiens
KSFVQTKCK

SEQ ID NO: 1192592 - protein, 9 aa, Homo Sapiens
EPQQQAPEA

SEQ ID NO: 1192593 - protein, 9 aa, Homo Sapiens
FGGDVVEGV

SEQ ID NO: 1192594 - protein, 9 aa, Homo Sapiens
RGGVIPPPP

SEQ ID NO: 1192595 - protein, 9 aa, Homo Sapiens
MRWTLCFAT

SEQ ID NO: 1192596 - protein, 9 aa, Homo Sapiens
GGQACINGH

SEQ ID NO: 1192597 - protein, 9 aa, Homo Sapiens
LPGHLNAVH

SEQ ID NO: 1192598 - protein, 9 aa, Homo Sapiens
VQHLRPGEA

SEQ ID NO: 1192599 - protein, 9 aa, Homo Sapiens
RSFGTTNMA

SEQ ID NO: 1192600 - protein, 9 aa, Homo Sapiens
IMEEAEPAP

SEQ ID NO: 1192601 - protein, 9 aa, Homo Sapiens
ARSTWPRPS

SEQ ID NO: 1192602 - protein, 9 aa, Homo Sapiens
LSSGGGGGT

SEQ ID NO: 1192603 - protein, 9 aa, Homo Sapiens
GSKISCQTS

SEQ ID NO: 1192604 - protein, 9 aa, Homo Sapiens
GIRQPKYRD

SEQ ID NO: 1192605 - protein, 9 aa, Homo Sapiens
LLLAFPQGC

SEQ ID NO: 1192606 - protein, 9 aa, Homo Sapiens
GGQKEGDRG

SEQ ID NO: 1192607 - protein, 9 aa, Homo Sapiens
NQKLRVCVA

SEQ ID NO: 1192608 - protein, 9 aa, Homo Sapiens
DHADHLPPR

SEQ ID NO: 1192609 - protein, 9 aa, Homo Sapiens
NLLMVTIKE

SEQ ID NO: 1192610 - protein, 9 aa, Homo Sapiens
SLKPDIPPK

SEQ ID NO: 1192611 - protein, 9 aa, Homo Sapiens
FMGAVMFIT

SEQ ID NO: 1192612 - protein, 9 aa, Homo Sapiens
LAYKRFHVK

SEQ ID NO: 1192613 - protein, 9 aa, Homo Sapiens
SWRPRWRQQ

SEQ ID NO: 1192614 - protein, 9 aa, Homo Sapiens
GSRTSCCPR

SEQ ID NO: 1192615 - protein, 9 aa, Homo Sapiens
RAVPLAFGY

SEQ ID NO: 1192616 - protein, 9 aa, Homo Sapiens
VRHQRIHMA

SEQ ID NO: 1192617 - protein, 9 aa, Homo Sapiens
SSLPCLKIV

SEQ ID NO: 1192618 - protein, 9 aa, Homo Sapiens
DSSSSGLTS

SEQ ID NO: 1192619 - protein, 9 aa, Homo Sapiens
GFGGFSSGS

SEQ ID NO: 1192620 - protein, 9 aa, Homo Sapiens
IPAFVIVTV

SEQ ID NO: 1192621 - protein, 9 aa, Homo Sapiens
VIKRAGMSK

SEQ ID NO: 1192622 - protein, 9 aa, Homo Sapiens
AYAGFHLTP

SEQ ID NO: 1192623 - protein, 9 aa, Homo Sapiens
DYSLTCHNH

SEQ ID NO: 1192624 - protein, 9 aa, Homo Sapiens
FSVMRRMRK

SEQ ID NO: 1192625 - protein, 9 aa, Homo Sapiens
CQVAHDPPQ

SEQ ID NO: 1192626 - protein, 9 aa, Homo Sapiens
SPSVIYWPH

SEQ ID NO: 1192627 - protein, 9 aa, Homo Sapiens
AAGAHGLAQ

SEQ ID NO: 1192628 - protein, 9 aa, Homo Sapiens
STQALGWPG

SEQ ID NO: 1192629 - protein, 9 aa, Homo Sapiens
LGKSDGHER

SEQ ID NO: 1192630 - protein, 9 aa, Homo Sapiens
VLLLKSRLY

SEQ ID NO: 1192631 - protein, 9 aa, Homo Sapiens
LLAARRRPV

SEQ ID NO: 1192632 - protein, 9 aa, Homo Sapiens
RGPWGPPQS

SEQ ID NO: 1192633 - protein, 9 aa, Homo Sapiens
DMGAYGMQT

SEQ ID NO: 1192634 - protein, 9 aa, Homo Sapiens
GPPRMGPAA

SEQ ID NO: 1192635 - protein, 9 aa, Homo Sapiens
GCAGGGVGE

SEQ ID NO: 1192636 - protein, 9 aa, Homo Sapiens
PPGHSSHIL

SEQ ID NO: 1192637 - protein, 9 aa, Homo Sapiens
VGSCCKNRT

SEQ ID NO: 1192638 - protein, 9 aa, Homo Sapiens
PPSPPGCDG

SEQ ID NO: 1192639 - protein, 9 aa, Homo Sapiens
ILKPYMNIF

SEQ ID NO: 1192640 - protein, 9 aa, Homo Sapiens
GFSGDFQPF

SEQ ID NO: 1192641 - protein, 9 aa, Homo Sapiens
FQNIATQAT

SEQ ID NO: 1192642 - protein, 9 aa, Homo Sapiens
LIAARGLCS

SEQ ID NO: 1192643 - protein, 9 aa, Homo Sapiens
SLLASIFNS

SEQ ID NO: 1192644 - protein, 9 aa, Homo Sapiens
GRVGARRGL

SEQ ID NO: 1192645 - protein, 9 aa, Homo Sapiens
SLAPPRGPG

SEQ ID NO: 1192646 - protein, 9 aa, Homo Sapiens
IIIHTFAVK

SEQ ID NO: 1192647 - protein, 9 aa, Homo Sapiens
EKQQVPRPR

SEQ ID NO: 1192648 - protein, 9 aa, Homo Sapiens
APGLAARRR

SEQ ID NO: 1192649 - protein, 9 aa, Homo Sapiens
SGTTQTCAV

SEQ ID NO: 1192650 - protein, 9 aa, Homo Sapiens
SVTSSNTGM

SEQ ID NO: 1192651 - protein, 9 aa, Homo Sapiens
VPLTCSVVS

SEQ ID NO: 1192652 - protein, 9 aa, Homo Sapiens
MTTSADPRQ

SEQ ID NO: 1192653 - protein, 9 aa, Homo Sapiens
LFHKLPSIG

SEQ ID NO: 1192654 - protein, 9 aa, Homo Sapiens
LALRSRRRG

SEQ ID NO: 1192655 - protein, 9 aa, Homo Sapiens
GEIMKTAKS

SEQ ID NO: 1192656 - protein, 9 aa, Homo Sapiens
APTWGCLCR

SEQ ID NO: 1192657 - protein, 9 aa, Homo Sapiens
GDTSCGQVI

SEQ ID NO: 1192658 - protein, 9 aa, Homo Sapiens
FEKIRKVLP

SEQ ID NO: 1192659 - protein, 9 aa, Homo Sapiens
HENDDDANQ

SEQ ID NO: 1192660 - protein, 9 aa, Homo Sapiens
TPGATTVAG

SEQ ID NO: 1192661 - protein, 9 aa, Homo Sapiens
ATRATPGAT

SEQ ID NO: 1192662 - protein, 9 aa, Homo Sapiens
TEMLEEWRP

SEQ ID NO: 1192663 - protein, 9 aa, Homo Sapiens
VTAMAMVYV

SEQ ID NO: 1192664 - protein, 9 aa, Homo Sapiens
NIIRLSIWP

SEQ ID NO: 1192665 - protein, 9 aa, Homo Sapiens
RRSRTCTSS

SEQ ID NO: 1192666 - protein, 9 aa, Homo Sapiens
ASAGRRAAG

SEQ ID NO: 1192667 - protein, 9 aa, Homo Sapiens
DGRSLQGAL

SEQ ID NO: 1192668 - protein, 9 aa, Homo Sapiens
YLKKKWEEL

SEQ ID NO: 1192669 - protein, 9 aa, Homo Sapiens
VSISFISSS

SEQ ID NO: 1192670 - protein, 9 aa, Homo Sapiens
TRPPPTPFD

SEQ ID NO: 1192671 - protein, 9 aa, Homo Sapiens
DNAETKDPA

SEQ ID NO: 1192672 - protein, 9 aa, Homo Sapiens
PDVECAKNL

SEQ ID NO: 1192673 - protein, 9 aa, Homo Sapiens
QDPTISQAP

SEQ ID NO: 1192674 - protein, 9 aa, Homo Sapiens
GLPLPARPL

SEQ ID NO: 1192675 - protein, 9 aa, Homo Sapiens
VHAICQAMC

SEQ ID NO: 1192676 - protein, 9 aa, Homo Sapiens
MGHPGRVKH

SEQ ID NO: 1192677 - protein, 9 aa, Homo Sapiens
PLPPGCRLQ

SEQ ID NO: 1192678 - protein, 9 aa, Homo Sapiens
LRENKKEHR

SEQ ID NO: 1192679 - protein, 9 aa, Homo Sapiens
HTIPWLEDR

SEQ ID NO: 1192680 - protein, 9 aa, Homo Sapiens
TGRAASWAS

SEQ ID NO: 1192681 - protein, 9 aa, Homo Sapiens
QTDAFLGRP

SEQ ID NO: 1192682 - protein, 9 aa, Homo Sapiens
AAGTTTAAG

SEQ ID NO: 1192683 - protein, 9 aa, Homo Sapiens
IPPDLTAFA

SEQ ID NO: 1192684 - protein, 9 aa, Homo Sapiens
GAVLLVAVA

SEQ ID NO: 1192685 - protein, 9 aa, Homo Sapiens
LNPLIYSLS

SEQ ID NO: 1192686 - protein, 9 aa, Homo Sapiens
MVVRPVATL

SEQ ID NO: 1192687 - protein, 9 aa, Homo Sapiens
LSVCPETMM

SEQ ID NO: 1192688 - protein, 9 aa, Homo Sapiens
LHVSEPSEP

SEQ ID NO: 1192689 - protein, 9 aa, Homo Sapiens
GCSWTCSQT

SEQ ID NO: 1192690 - protein, 9 aa, Homo Sapiens
QPQPPPPPH

SEQ ID NO: 1192691 - protein, 9 aa, Homo Sapiens
PDKAGLSEH

SEQ ID NO: 1192692 - protein, 9 aa, Homo Sapiens
HEEQLGDEG

SEQ ID NO: 1192693 - protein, 9 aa, Homo Sapiens
PASGGGKGT

SEQ ID NO: 1192694 - protein, 9 aa, Homo Sapiens
HFLLKFHLQ

SEQ ID NO: 1192695 - protein, 9 aa, Homo Sapiens
MCMCQLNPG

SEQ ID NO: 1192696 - protein, 9 aa, Homo Sapiens
TLLLDFKEF

SEQ ID NO: 1192697 - protein, 9 aa, Homo Sapiens
ADSLLIIGL

SEQ ID NO: 1192698 - protein, 9 aa, Homo Sapiens
GARPLRGGR

SEQ ID NO: 1192699 - protein, 9 aa, Homo Sapiens
QHLRPGEAV

SEQ ID NO: 1192700 - protein, 9 aa, Homo Sapiens
ALSSAPGPA

SEQ ID NO: 1192701 - protein, 9 aa, Homo Sapiens
VYTPGTQHI

SEQ ID NO: 1192702 - protein, 9 aa, Homo Sapiens
ELSMCDSIS

SEQ ID NO: 1192703 - protein, 9 aa, Homo Sapiens
FLFESLPRA

SEQ ID NO: 1192704 - protein, 9 aa, Homo Sapiens
SAWQLDGIR

SEQ ID NO: 1192705 - protein, 9 aa, Homo Sapiens
KTWRRSLPL

SEQ ID NO: 1192706 - protein, 9 aa, Homo Sapiens
RRARALGLA

SEQ ID NO: 1192707 - protein, 9 aa, Homo Sapiens
EEDEGRGKR

SEQ ID NO: 1192708 - protein, 9 aa, Homo Sapiens
TSLAASVPT

SEQ ID NO: 1192709 - protein, 9 aa, Homo Sapiens
IGSFIAFFI

SEQ ID NO: 1192710 - protein, 9 aa, Homo Sapiens
PSFLPQRGT

SEQ ID NO: 1192711 - protein, 9 aa, Homo Sapiens
SRNQFRQRH

SEQ ID NO: 1192712 - protein, 9 aa, Homo Sapiens
PPGVPLAGW

SEQ ID NO: 1192713 - protein, 9 aa, Homo Sapiens
RTCRSPCKS

SEQ ID NO: 1192714 - protein, 9 aa, Homo Sapiens
IRTAEIVAS

SEQ ID NO: 1192715 - protein, 9 aa, Homo Sapiens
EQGNQMAEL

SEQ ID NO: 1192716 - protein, 9 aa, Homo Sapiens
SDPRKLEAF

SEQ ID NO: 1192717 - protein, 9 aa, Homo Sapiens
HIICSPLCL

SEQ ID NO: 1192718 - protein, 9 aa, Homo Sapiens
CKAESFEFF

SEQ ID NO: 1192719 - protein, 9 aa, Homo Sapiens
GPGEADSGR

SEQ ID NO: 1192720 - protein, 9 aa, Homo Sapiens
LSGLMTTFL

SEQ ID NO: 1192721 - protein, 9 aa, Homo Sapiens
GQTLPLLQG

SEQ ID NO: 1192722 - protein, 9 aa, Homo Sapiens
SSLECTYIV

SEQ ID NO: 1192723 - protein, 9 aa, Homo Sapiens
GEMGPGPGL

SEQ ID NO: 1192724 - protein, 9 aa, Homo Sapiens
WPVEVRLFS

SEQ ID NO: 1192725 - protein, 9 aa, Homo Sapiens
DWLQENIAG

SEQ ID NO: 1192726 - protein, 9 aa, Homo Sapiens
STTGPGTGG

SEQ ID NO: 1192727 - protein, 9 aa, Homo Sapiens
PLSQQEWPQ

SEQ ID NO: 1192728 - protein, 9 aa, Homo Sapiens
LQSQLAPWP

SEQ ID NO: 1192729 - protein, 9 aa, Homo Sapiens
VPEEHVNTK

SEQ ID NO: 1192730 - protein, 9 aa, Homo Sapiens
WMRVKYTKE

SEQ ID NO: 1192731 - protein, 9 aa, Homo Sapiens
AAPGQAPMD

SEQ ID NO: 1192732 - protein, 9 aa, Homo Sapiens
LTSPAQRYI

SEQ ID NO: 1192733 - protein, 9 aa, Homo Sapiens
IKAANKARD

SEQ ID NO: 1192734 - protein, 9 aa, Homo Sapiens
CLCLAWSPR

SEQ ID NO: 1192735 - protein, 9 aa, Homo Sapiens
LVAVALAVC

SEQ ID NO: 1192736 - protein, 9 aa, Homo Sapiens
KQSDSRFQL

SEQ ID NO: 1192737 - protein, 9 aa, Homo Sapiens
QLVTVMNPN

SEQ ID NO: 1192738 - protein, 9 aa, Homo Sapiens
KMWQGEEVF

SEQ ID NO: 1192739 - protein, 9 aa, Homo Sapiens
NNVGDTSCG

SEQ ID NO: 1192740 - protein, 9 aa, Homo Sapiens
VPQLRIWLP

SEQ ID NO: 1192741 - protein, 9 aa, Homo Sapiens
SDWTVVEVE

SEQ ID NO: 1192742 - protein, 9 aa, Homo Sapiens
SSTPTCLRT

SEQ ID NO: 1192743 - protein, 9 aa, Homo Sapiens
DRRPRTSHI

SEQ ID NO: 1192744 - protein, 9 aa, Homo Sapiens
GRQCIRTAE

SEQ ID NO: 1192745 - protein, 9 aa, Homo Sapiens
LSENGIPPA

SEQ ID NO: 1192746 - protein, 9 aa, Homo Sapiens
LDVGLAHLV

SEQ ID NO: 1192747 - protein, 9 aa, Homo Sapiens
ARNLQAMST

SEQ ID NO: 1192748 - protein, 9 aa, Homo Sapiens
GCVASINLS

SEQ ID NO: 1192749 - protein, 9 aa, Homo Sapiens
PTTGPSGSG

SEQ ID NO: 1192750 - protein, 9 aa, Homo Sapiens
HQNGTEDES

SEQ ID NO: 1192751 - protein, 9 aa, Homo Sapiens
EADLGNGHN

SEQ ID NO: 1192752 - protein, 9 aa, Homo Sapiens
GRPLSLSRP

SEQ ID NO: 1192753 - protein, 9 aa, Homo Sapiens
LELSSLKPG

SEQ ID NO: 1192754 - protein, 9 aa, Homo Sapiens
FLMALQCPR

SEQ ID NO: 1192755 - protein, 9 aa, Homo Sapiens
ERILVIQNA

SEQ ID NO: 1192756 - protein, 9 aa, Homo Sapiens
RTTPAAGEW

SEQ ID NO: 1192757 - protein, 9 aa, Homo Sapiens
AQEDLRIRV

SEQ ID NO: 1192758 - protein, 9 aa, Homo Sapiens
APWIDPNPQ

SEQ ID NO: 1192759 - protein, 9 aa, Homo Sapiens
VRVGSCVDS

SEQ ID NO: 1192760 - protein, 9 aa, Homo Sapiens
GGPECVPGR

SEQ ID NO: 1192761 - protein, 9 aa, Homo Sapiens
LCQQTEARV

SEQ ID NO: 1192762 - protein, 9 aa, Homo Sapiens
DEGRGKRTA

SEQ ID NO: 1192763 - protein, 9 aa, Homo Sapiens
MNMLVLGKH

SEQ ID NO: 1192764 - protein, 9 aa, Homo Sapiens
FLILLIAIS

SEQ ID NO: 1192765 - protein, 9 aa, Homo Sapiens
TFESAKKSL

SEQ ID NO: 1192766 - protein, 9 aa, Homo Sapiens
STPPPPPGW

SEQ ID NO: 1192767 - protein, 9 aa, Homo Sapiens
TWDTEYTCV

SEQ ID NO: 1192768 - protein, 9 aa, Homo Sapiens
VVRPVATLS

SEQ ID NO: 1192769 - protein, 9 aa, Homo Sapiens
PDLGAAFVK

SEQ ID NO: 1192770 - protein, 9 aa, Homo Sapiens
QHGRGALRD

SEQ ID NO: 1192771 - protein, 9 aa, Homo Sapiens
SAPSMPACA

SEQ ID NO: 1192772 - protein, 9 aa, Homo Sapiens
PHNPRTARA

SEQ ID NO: 1192773 - protein, 9 aa, Homo Sapiens
PRTLTLECP

SEQ ID NO: 1192774 - protein, 9 aa, Homo Sapiens
VLVLGLTYT

SEQ ID NO: 1192775 - protein, 9 aa, Homo Sapiens
TRTSSTCGT

SEQ ID NO: 1192776 - protein, 9 aa, Homo Sapiens
VALVGGLDG

SEQ ID NO: 1192777 - protein, 9 aa, Homo Sapiens
LFPRSASRA

SEQ ID NO: 1192778 - protein, 9 aa, Homo Sapiens
LEAFPLPRA

SEQ ID NO: 1192779 - protein, 9 aa, Homo Sapiens
LGADLGHWR

SEQ ID NO: 1192780 - protein, 9 aa, Homo Sapiens
DDVKVVPRL

SEQ ID NO: 1192781 - protein, 9 aa, Homo Sapiens
RAVGGLRAL

SEQ ID NO: 1192782 - protein, 9 aa, Homo Sapiens
HTNMYVNSI

SEQ ID NO: 1192783 - protein, 9 aa, Homo Sapiens
EFEEEGEEE

SEQ ID NO: 1192784 - protein, 9 aa, Homo Sapiens
VPGATVSGE

SEQ ID NO: 1192785 - protein, 9 aa, Homo Sapiens
ATFVLRGTI

SEQ ID NO: 1192786 - protein, 9 aa, Homo Sapiens
ANHVNSVRR

SEQ ID NO: 1192787 - protein, 9 aa, Homo Sapiens
KLVRLVSTS

SEQ ID NO: 1192788 - protein, 9 aa, Homo Sapiens
AGMQAKYLD

SEQ ID NO: 1192789 - protein, 9 aa, Homo Sapiens
EECWNGHIK

SEQ ID NO: 1192790 - protein, 9 aa, Homo Sapiens
AHPRTLTLE

SEQ ID NO: 1192791 - protein, 9 aa, Homo Sapiens
DGGWGWRSP

SEQ ID NO: 1192792 - protein, 9 aa, Homo Sapiens
RLGVCTGRA

SEQ ID NO: 1192793 - protein, 9 aa, Homo Sapiens
LEVRLWPQK

SEQ ID NO: 1192794 - protein, 9 aa, Homo Sapiens
LTASLIPSQ

SEQ ID NO: 1192795 - protein, 9 aa, Homo Sapiens
PGACPACPL

SEQ ID NO: 1192796 - protein, 9 aa, Homo Sapiens
KEGIPPTSR

SEQ ID NO: 1192797 - protein, 9 aa, Homo Sapiens
LEALTGQGM

SEQ ID NO: 1192798 - protein, 9 aa, Homo Sapiens
LVIHSQQPG

SEQ ID NO: 1192799 - protein, 9 aa, Homo Sapiens
LELEEQTPN

SEQ ID NO: 1192800 - protein, 9 aa, Homo Sapiens
HPPPAAAGC

SEQ ID NO: 1192801 - protein, 9 aa, Homo Sapiens
AEERMEAPS

SEQ ID NO: 1192802 - protein, 9 aa, Homo Sapiens
HLHHCRTQP

SEQ ID NO: 1192803 - protein, 9 aa, Homo Sapiens
GMEPGAEMP

SEQ ID NO: 1192804 - protein, 9 aa, Homo Sapiens
LAYGIYCCW

SEQ ID NO: 1192805 - protein, 9 aa, Homo Sapiens
SADPRQRRC

SEQ ID NO: 1192806 - protein, 9 aa, Homo Sapiens
EIFPALSRN

SEQ ID NO: 1192807 - protein, 9 aa, Homo Sapiens
TGPVSSVGG

SEQ ID NO: 1192808 - protein, 9 aa, Homo Sapiens
GPRHPLLIV

SEQ ID NO: 1192809 - protein, 9 aa, Homo Sapiens
GTPATAAAN

SEQ ID NO: 1192810 - protein, 9 aa, Homo Sapiens
ALVAHRVAE

SEQ ID NO: 1192811 - protein, 9 aa, Homo Sapiens
PTISQAPCP

SEQ ID NO: 1192812 - protein, 9 aa, Homo Sapiens
APVPRGPDG

SEQ ID NO: 1192813 - protein, 9 aa, Homo Sapiens
RKSRPCIWS

SEQ ID NO: 1192814 - protein, 9 aa, Homo Sapiens
LHDPMTLLA

SEQ ID NO: 1192815 - protein, 9 aa, Homo Sapiens
AGMTQMLQH

SEQ ID NO: 1192816 - protein, 9 aa, Homo Sapiens
ARTTVWTAA

SEQ ID NO: 1192817 - protein, 9 aa, Homo Sapiens
PRLPGPLSH

SEQ ID NO: 1192818 - protein, 9 aa, Homo Sapiens
NGDWLQENI

SEQ ID NO: 1192819 - protein, 9 aa, Homo Sapiens
VVRPLACSH

SEQ ID NO: 1192820 - protein, 9 aa, Homo Sapiens
VALNTAYVA

SEQ ID NO: 1192821 - protein, 9 aa, Homo Sapiens
RQSGATGTD

SEQ ID NO: 1192822 - protein, 9 aa, Homo Sapiens
GLNLGIAPG

SEQ ID NO: 1192823 - protein, 9 aa, Homo Sapiens
YDLCVCGPG

SEQ ID NO: 1192824 - protein, 9 aa, Homo Sapiens
QSWCAKCNA

SEQ ID NO: 1192825 - protein, 9 aa, Homo Sapiens
CVCGPGSSA

SEQ ID NO: 1192826 - protein, 9 aa, Homo Sapiens
MTCTSLSKS

SEQ ID NO: 1192827 - protein, 9 aa, Homo Sapiens
TWRRPVPNP

SEQ ID NO: 1192828 - protein, 9 aa, Homo Sapiens
AALVGAGAA

SEQ ID NO: 1192829 - protein, 9 aa, Homo Sapiens
PRASRPLPG

SEQ ID NO: 1192830 - protein, 9 aa, Homo Sapiens
SPAWPAVLP

SEQ ID NO: 1192831 - protein, 9 aa, Homo Sapiens
PRSCRQTPP

SEQ ID NO: 1192832 - protein, 9 aa, Homo Sapiens
VGYLVVWVC

SEQ ID NO: 1192833 - protein, 9 aa, Homo Sapiens
EAWGQPQMQ

SEQ ID NO: 1192834 - protein, 9 aa, Homo Sapiens
IWNGNHGAT

SEQ ID NO: 1192835 - protein, 9 aa, Homo Sapiens
DGWGAMALT

SEQ ID NO: 1192836 - protein, 9 aa, Homo Sapiens
KCKHRHLRF

SEQ ID NO: 1192837 - protein, 9 aa, Homo Sapiens
HSHIKPYVR

SEQ ID NO: 1192838 - protein, 9 aa, Homo Sapiens
KFLSANKMK

SEQ ID NO: 1192839 - protein, 9 aa, Homo Sapiens
TNMYVNSIG

SEQ ID NO: 1192840 - protein, 9 aa, Homo Sapiens
IKARYLPEI

SEQ ID NO: 1192841 - protein, 9 aa, Homo Sapiens
VSVSLSGSM

SEQ ID NO: 1192842 - protein, 9 aa, Homo Sapiens
PPGAGAADT

SEQ ID NO: 1192843 - protein, 9 aa, Homo Sapiens
GVEPLAKCG

SEQ ID NO: 1192844 - protein, 9 aa, Homo Sapiens
AQARVAVGD

SEQ ID NO: 1192845 - protein, 9 aa, Homo Sapiens
GNVYTPGTQ

SEQ ID NO: 1192846 - protein, 9 aa, Homo Sapiens
TPHSLTSGI

SEQ ID NO: 1192847 - protein, 9 aa, Homo Sapiens
GWIIRLGIA

SEQ ID NO: 1192848 - protein, 9 aa, Homo Sapiens
LNRGFTYAR

SEQ ID NO: 1192849 - protein, 9 aa, Homo Sapiens
LVTVMNPNV

SEQ ID NO: 1192850 - protein, 9 aa, Homo Sapiens
TRAKCLLHP

SEQ ID NO: 1192851 - protein, 9 aa, Homo Sapiens
PFDCKLSNW

SEQ ID NO: 1192852 - protein, 9 aa, Homo Sapiens
QKHHRRERR

SEQ ID NO: 1192853 - protein, 9 aa, Homo Sapiens
GLQLHQRVH

SEQ ID NO: 1192854 - protein, 9 aa, Homo Sapiens
LPGLFVKTM

SEQ ID NO: 1192855 - protein, 9 aa, Homo Sapiens
RSTWPRPSA

SEQ ID NO: 1192856 - protein, 9 aa, Homo Sapiens
GQWVGMVLL

SEQ ID NO: 1192857 - protein, 9 aa, Homo Sapiens
WLSRRMASQ

SEQ ID NO: 1192858 - protein, 9 aa, Homo Sapiens
RLPPKPLGP

SEQ ID NO: 1192859 - protein, 9 aa, Homo Sapiens
LRKSHLIFS

SEQ ID NO: 1192860 - protein, 9 aa, Homo Sapiens
AQQAALPWL

SEQ ID NO: 1192861 - protein, 9 aa, Homo Sapiens
PLSLMMTQI

SEQ ID NO: 1192862 - protein, 9 aa, Homo Sapiens
KNLTDELSG

SEQ ID NO: 1192863 - protein, 9 aa, Homo Sapiens
HMSELLPGP

SEQ ID NO: 1192864 - protein, 9 aa, Homo Sapiens
TTGRPLSLS

SEQ ID NO: 1192865 - protein, 9 aa, Homo Sapiens
FDRYTDAGT

SEQ ID NO: 1192866 - protein, 9 aa, Homo Sapiens
SVSEEASAE

SEQ ID NO: 1192867 - protein, 9 aa, Homo Sapiens
ARCWMTSRT

SEQ ID NO: 1192868 - protein, 9 aa, Homo Sapiens
ACWVVHTTL

SEQ ID NO: 1192869 - protein, 9 aa, Homo Sapiens
LNPPTFPCS

SEQ ID NO: 1192870 - protein, 9 aa, Homo Sapiens
DLEPECSAA

SEQ ID NO: 1192871 - protein, 9 aa, Homo Sapiens
VTVMNPNVL

SEQ ID NO: 1192872 - protein, 9 aa, Homo Sapiens
HEEPELLQF

SEQ ID NO: 1192873 - protein, 9 aa, Homo Sapiens
GAKAAASGP

SEQ ID NO: 1192874 - protein, 9 aa, Homo Sapiens
PRSTCTLWT

SEQ ID NO: 1192875 - protein, 9 aa, Homo Sapiens
LHLLVGLAL

SEQ ID NO: 1192876 - protein, 9 aa, Homo Sapiens
FRRLTADMQ

SEQ ID NO: 1192877 - protein, 9 aa, Homo Sapiens
QDVGLQTPP

SEQ ID NO: 1192878 - protein, 9 aa, Homo Sapiens
WAPCMPWRS

SEQ ID NO: 1192879 - protein, 9 aa, Homo Sapiens
HVVSLVSTA

SEQ ID NO: 1192880 - protein, 9 aa, Homo Sapiens
PRHPHRSPP

SEQ ID NO: 1192881 - protein, 9 aa, Homo Sapiens
ERPAGRPGV

SEQ ID NO: 1192882 - protein, 9 aa, Homo Sapiens
GCRRCSGLS

SEQ ID NO: 1192883 - protein, 9 aa, Homo Sapiens
WREASRPHQ

SEQ ID NO: 1192884 - protein, 9 aa, Homo Sapiens
DFWMSGKQR

SEQ ID NO: 1192885 - protein, 9 aa, Homo Sapiens
ELVQELQKH

SEQ ID NO: 1192886 - protein, 9 aa, Homo Sapiens
SLQQLLELS

SEQ ID NO: 1192887 - protein, 9 aa, Homo Sapiens
HTEHAKRKT

SEQ ID NO: 1192888 - protein, 9 aa, Homo Sapiens
PRPRPHPLY

SEQ ID NO: 1192889 - protein, 9 aa, Homo Sapiens
EERPPATLP

SEQ ID NO: 1192890 - protein, 9 aa, Homo Sapiens
FRMFSKQGA

SEQ ID NO: 1192891 - protein, 9 aa, Homo Sapiens
AYQNFMIDT

SEQ ID NO: 1192892 - protein, 9 aa, Homo Sapiens
AHAGASRGT

SEQ ID NO: 1192893 - protein, 9 aa, Homo Sapiens
WNGHIKARY

SEQ ID NO: 1192894 - protein, 9 aa, Homo Sapiens
TPPASAVQS

SEQ ID NO: 1192895 - protein, 9 aa, Homo Sapiens
WTGSSAAKR

SEQ ID NO: 1192896 - protein, 9 aa, Homo Sapiens
WFNASFGST

SEQ ID NO: 1192897 - protein, 9 aa, Homo Sapiens
RPSNSRKFG

SEQ ID NO: 1192898 - protein, 9 aa, Homo Sapiens
ERVSPGGAG

SEQ ID NO: 1192899 - protein, 9 aa, Homo Sapiens
VINYCIEKL

SEQ ID NO: 1192900 - protein, 9 aa, Homo Sapiens
AWCRARVDG

SEQ ID NO: 1192901 - protein, 9 aa, Homo Sapiens
KGWFEQRKV

SEQ ID NO: 1192902 - protein, 9 aa, Homo Sapiens
PKCIIHGPA

SEQ ID NO: 1192903 - protein, 9 aa, Homo Sapiens
PAAHARVVG

SEQ ID NO: 1192904 - protein, 9 aa, Homo Sapiens
DLLTFITGQ

SEQ ID NO: 1192905 - protein, 9 aa, Homo Sapiens
VVPRLSLDH

SEQ ID NO: 1192906 - protein, 9 aa, Homo Sapiens
VIMRLQLFI

SEQ ID NO: 1192907 - protein, 9 aa, Homo Sapiens
QRLSVSWKK

SEQ ID NO: 1192908 - protein, 9 aa, Homo Sapiens
AARSWASAA

SEQ ID NO: 1192909 - protein, 9 aa, Homo Sapiens
YILGIFGIE

SEQ ID NO: 1192910 - protein, 9 aa, Homo Sapiens
RSWWSMSRS

SEQ ID NO: 1192911 - protein, 9 aa, Homo Sapiens
RNHSNSDNA

SEQ ID NO: 1192912 - protein, 9 aa, Homo Sapiens
GLQTPPASA

SEQ ID NO: 1192913 - protein, 9 aa, Homo Sapiens
LLGLGAAAG

SEQ ID NO: 1192914 - protein, 9 aa, Homo Sapiens
QPILQIDSA

SEQ ID NO: 1192915 - protein, 9 aa, Homo Sapiens
AASPCWLSC

SEQ ID NO: 1192916 - protein, 9 aa, Homo Sapiens
ARKSWAASW

SEQ ID NO: 1192917 - protein, 9 aa, Homo Sapiens
GLDRAPHLG

SEQ ID NO: 1192918 - protein, 9 aa, Homo Sapiens
EERGRRTQK

SEQ ID NO: 1192919 - protein, 9 aa, Homo Sapiens
FLRAGRQMG

SEQ ID NO: 1192920 - protein, 9 aa, Homo Sapiens
VRGIQGRSM

SEQ ID NO: 1192921 - protein, 9 aa, Homo Sapiens
RLPRRSCCS

SEQ ID NO: 1192922 - protein, 9 aa, Homo Sapiens
ELHINGQHL

SEQ ID NO: 1192923 - protein, 9 aa, Homo Sapiens
SDDHGPIKM

SEQ ID NO: 1192924 - protein, 9 aa, Homo Sapiens
DSSGSSFGG

SEQ ID NO: 1192925 - protein, 9 aa, Homo Sapiens
LQQRQQCLV

SEQ ID NO: 1192926 - protein, 9 aa, Homo Sapiens
RVEILPMGS

SEQ ID NO: 1192927 - protein, 9 aa, Homo Sapiens
ESDGQMKGA

SEQ ID NO: 1192928 - protein, 9 aa, Homo Sapiens
PRGGSAGAG

SEQ ID NO: 1192929 - protein, 9 aa, Homo Sapiens
DVGPSLGLA

SEQ ID NO: 1192930 - protein, 9 aa, Homo Sapiens
PTAAPMSVG

SEQ ID NO: 1192931 - protein, 9 aa, Homo Sapiens
SSRPRASCS

SEQ ID NO: 1192932 - protein, 9 aa, Homo Sapiens
EEALVLITE

SEQ ID NO: 1192933 - protein, 9 aa, Homo Sapiens
GGGGGNPCT

SEQ ID NO: 1192934 - protein, 9 aa, Homo Sapiens
LQALLTHRV

SEQ ID NO: 1192935 - protein, 9 aa, Homo Sapiens
VSLAPPRGP

SEQ ID NO: 1192936 - protein, 9 aa, Homo Sapiens
KLHHRAQDK

SEQ ID NO: 1192937 - protein, 9 aa, Homo Sapiens
PGGGREAAG

SEQ ID NO: 1192938 - protein, 9 aa, Homo Sapiens
LPSLQQLLE

SEQ ID NO: 1192939 - protein, 9 aa, Homo Sapiens
YRRWRGRGQ

SEQ ID NO: 1192940 - protein, 9 aa, Homo Sapiens
RRRLLGLGA

SEQ ID NO: 1192941 - protein, 9 aa, Homo Sapiens
GRLETRWQA

SEQ ID NO: 1192942 - protein, 9 aa, Homo Sapiens
PCCGVPDSG

SEQ ID NO: 1192943 - protein, 9 aa, Homo Sapiens
PGHLNAVHL

SEQ ID NO: 1192944 - protein, 9 aa, Homo Sapiens
LVFFFLFWF

SEQ ID NO: 1192945 - protein, 9 aa, Homo Sapiens
QALTPEHVS

SEQ ID NO: 1192946 - protein, 9 aa, Homo Sapiens
HGRRQVREP

SEQ ID NO: 1192947 - protein, 9 aa, Homo Sapiens
YDSLSNHNS

SEQ ID NO: 1192948 - protein, 9 aa, Homo Sapiens
SAHLVGHIG

SEQ ID NO: 1192949 - protein, 9 aa, Homo Sapiens
PGRGRPRAG

SEQ ID NO: 1192950 - protein, 9 aa, Homo Sapiens
HKKNRREVL

SEQ ID NO: 1192951 - protein, 9 aa, Homo Sapiens
DRGEAAPSP

SEQ ID NO: 1192952 - protein, 9 aa, Homo Sapiens
MKWKKELWL

SEQ ID NO: 1192953 - protein, 9 aa, Homo Sapiens
MPRLRVIQL

SEQ ID NO: 1192954 - protein, 9 aa, Homo Sapiens
GPGHDFRGE

SEQ ID NO: 1192955 - protein, 9 aa, Homo Sapiens
RTGTLGSLT

SEQ ID NO: 1192956 - protein, 9 aa, Homo Sapiens
VTSYGVKPR

SEQ ID NO: 1192957 - protein, 9 aa, Homo Sapiens
RWGWCPVGR

SEQ ID NO: 1192958 - protein, 9 aa, Homo Sapiens
DEYRDIANM

SEQ ID NO: 1192959 - protein, 9 aa, Homo Sapiens
VDCSDILAL

SEQ ID NO: 1192960 - protein, 9 aa, Homo Sapiens
KGSKTRVPL

SEQ ID NO: 1192961 - protein, 9 aa, Homo Sapiens
SWSGTTQTC

SEQ ID NO: 1192962 - protein, 9 aa, Homo Sapiens
DNPDLGAAF

SEQ ID NO: 1192963 - protein, 9 aa, Homo Sapiens
TYVESGNAQ

SEQ ID NO: 1192964 - protein, 9 aa, Homo Sapiens
VDKVIYLSG

SEQ ID NO: 1192965 - protein, 9 aa, Homo Sapiens
VWRGASGAR

SEQ ID NO: 1192966 - protein, 9 aa, Homo Sapiens
PRRGCPTAA

SEQ ID NO: 1192967 - protein, 9 aa, Homo Sapiens
SQVSAPTCA

SEQ ID NO: 1192968 - protein, 9 aa, Homo Sapiens
PAARRPWVV

SEQ ID NO: 1192969 - protein, 9 aa, Homo Sapiens
GPASTGQAY

SEQ ID NO: 1192970 - protein, 9 aa, Homo Sapiens
PAPAARRPW

SEQ ID NO: 1192971 - protein, 9 aa, Homo Sapiens
LGARWDAGL

SEQ ID NO: 1192972 - protein, 9 aa, Homo Sapiens
RELRSPRPE

SEQ ID NO: 1192973 - protein, 9 aa, Homo Sapiens
ADSGVATPV

SEQ ID NO: 1192974 - protein, 9 aa, Homo Sapiens
LMVTIKEFC

SEQ ID NO: 1192975 - protein, 9 aa, Homo Sapiens
ESREALSQT

SEQ ID NO: 1192976 - protein, 9 aa, Homo Sapiens
IYLDQTNTP

SEQ ID NO: 1192977 - protein, 9 aa, Homo Sapiens
LRDHLPQEL

SEQ ID NO: 1192978 - protein, 9 aa, Homo Sapiens
RAVAALSSS

SEQ ID NO: 1192979 - protein, 9 aa, Homo Sapiens
ARAWRMLTA

SEQ ID NO: 1192980 - protein, 9 aa, Homo Sapiens
PRPDPALSL

SEQ ID NO: 1192981 - protein, 9 aa, Homo Sapiens
FITSVTTLY

SEQ ID NO: 1192982 - protein, 9 aa, Homo Sapiens
AEPLGPVAD

SEQ ID NO: 1192983 - protein, 9 aa, Homo Sapiens
LKWHLVEIA

SEQ ID NO: 1192984 - protein, 9 aa, Homo Sapiens
EAVGLHERR

SEQ ID NO: 1192985 - protein, 9 aa, Homo Sapiens
QMSWSLPCP

SEQ ID NO: 1192986 - protein, 9 aa, Homo Sapiens
GTSNAAVAL

SEQ ID NO: 1192987 - protein, 9 aa, Homo Sapiens
PTGLVDNDL

SEQ ID NO: 1192988 - protein, 9 aa, Homo Sapiens
FHTLTTYTL

SEQ ID NO: 1192989 - protein, 9 aa, Homo Sapiens
PQLRIWLPS

SEQ ID NO: 1192990 - protein, 9 aa, Homo Sapiens
HISFPDLKV

SEQ ID NO: 1192991 - protein, 9 aa, Homo Sapiens
RDQNTFHTL

SEQ ID NO: 1192992 - protein, 9 aa, Homo Sapiens
KARKVKKRK

SEQ ID NO: 1192993 - protein, 9 aa, Homo Sapiens
WPQKKCLIW

SEQ ID NO: 1192994 - protein, 9 aa, Homo Sapiens
IKYESEIAG

SEQ ID NO: 1192995 - protein, 9 aa, Homo Sapiens
RRPLGVSPL

SEQ ID NO: 1192996 - protein, 9 aa, Homo Sapiens
PGDPAPVAP

SEQ ID NO: 1192997 - protein, 9 aa, Homo Sapiens
QHQPLGVLA

SEQ ID NO: 1192998 - protein, 9 aa, Homo Sapiens
GVLIDVLHL

SEQ ID NO: 1192999 - protein, 9 aa, Homo Sapiens
AAGTAEATT

SEQ ID NO: 1193000 - protein, 9 aa, Homo Sapiens
KLVVVGAGD

SEQ ID NO: 1193001 - protein, 9 aa, Homo Sapiens
TMGYNTDRL

SEQ ID NO: 1193002 - protein, 9 aa, Homo Sapiens
VWEVIWAVR

SEQ ID NO: 1193003 - protein, 9 aa, Homo Sapiens
PGGAGRLAS

SEQ ID NO: 1193004 - protein, 9 aa, Homo Sapiens
PRGPWRAPR

SEQ ID NO: 1193005 - protein, 9 aa, Homo Sapiens
EDGVHAQLL

SEQ ID NO: 1193006 - protein, 9 aa, Homo Sapiens
KGSRTSCCP

SEQ ID NO: 1193007 - protein, 9 aa, Homo Sapiens
ERRAAGAHG

SEQ ID NO: 1193008 - protein, 9 aa, Homo Sapiens
PSPLLVEAR

SEQ ID NO: 1193009 - protein, 9 aa, Homo Sapiens
MLSEPNMAS

SEQ ID NO: 1193010 - protein, 9 aa, Homo Sapiens
ALHLAAHYS

SEQ ID NO: 1193011 - protein, 9 aa, Homo Sapiens
CARLSTKHK

SEQ ID NO: 1193012 - protein, 9 aa, Homo Sapiens
CSKGGRGSC

SEQ ID NO: 1193013 - protein, 9 aa, Homo Sapiens
VAALGQQRQ

SEQ ID NO: 1193014 - protein, 9 aa, Homo Sapiens
VSQGGSQPQ

SEQ ID NO: 1193015 - protein, 9 aa, Homo Sapiens
SHGHGHTHS

SEQ ID NO: 1193016 - protein, 9 aa, Homo Sapiens
VVSQGGSQP

SEQ ID NO: 1193017 - protein, 9 aa, Homo Sapiens
SRNSLIQMT

SEQ ID NO: 1193018 - protein, 9 aa, Homo Sapiens
TSCFKLDLS

SEQ ID NO: 1193019 - protein, 9 aa, Homo Sapiens
TYFLRYKTA

SEQ ID NO: 1193020 - protein, 9 aa, Homo Sapiens
DEKGVEVIP

SEQ ID NO: 1193021 - protein, 9 aa, Homo Sapiens
PCRRKKKVR

SEQ ID NO: 1193022 - protein, 9 aa, Homo Sapiens
HHGADVEPD

SEQ ID NO: 1193023 - protein, 9 aa, Homo Sapiens
VPQVGPSAA

SEQ ID NO: 1193024 - protein, 9 aa, Homo Sapiens
CIVLHKLHL

SEQ ID NO: 1193025 - protein, 9 aa, Homo Sapiens
SEPKFHSEY

SEQ ID NO: 1193026 - protein, 9 aa, Homo Sapiens
VLRPPTLWT

SEQ ID NO: 1193027 - protein, 9 aa, Homo Sapiens
VHYLRCLRA

SEQ ID NO: 1193028 - protein, 9 aa, Homo Sapiens
PGLFVKTMV

SEQ ID NO: 1193029 - protein, 9 aa, Homo Sapiens
GTTNMATFI

SEQ ID NO: 1193030 - protein, 9 aa, Homo Sapiens
GPWLHIDIP

SEQ ID NO: 1193031 - protein, 9 aa, Homo Sapiens
GPSSLTTAN

SEQ ID NO: 1193032 - protein, 9 aa, Homo Sapiens
GLPQEFVKG

SEQ ID NO: 1193033 - protein, 9 aa, Homo Sapiens
PPRLSEHTH

SEQ ID NO: 1193034 - protein, 9 aa, Homo Sapiens
TARASSTSP

SEQ ID NO: 1193035 - protein, 9 aa, Homo Sapiens
PSLLSRHQD

SEQ ID NO: 1193036 - protein, 9 aa, Homo Sapiens
SHIKPYVRS

SEQ ID NO: 1193037 - protein, 9 aa, Homo Sapiens
NTGMPDISG

SEQ ID NO: 1193038 - protein, 9 aa, Homo Sapiens
PPECTLKGD

SEQ ID NO: 1193039 - protein, 9 aa, Homo Sapiens
ALPGAELQL

SEQ ID NO: 1193040 - protein, 9 aa, Homo Sapiens
LLSCWHRYL

SEQ ID NO: 1193041 - protein, 9 aa, Homo Sapiens
PSHPYEITL

SEQ ID NO: 1193042 - protein, 9 aa, Homo Sapiens
RETEEIASA

SEQ ID NO: 1193043 - protein, 9 aa, Homo Sapiens
DPLAFFYSP

SEQ ID NO: 1193044 - protein, 9 aa, Homo Sapiens
ISVTAMQCR

SEQ ID NO: 1193045 - protein, 9 aa, Homo Sapiens
SIFLYILTI

SEQ ID NO: 1193046 - protein, 9 aa, Homo Sapiens
WKRTQQRPP

SEQ ID NO: 1193047 - protein, 9 aa, Homo Sapiens
SAVVDANGK

SEQ ID NO: 1193048 - protein, 9 aa, Homo Sapiens
SRYVWLRQR

SEQ ID NO: 1193049 - protein, 9 aa, Homo Sapiens
PPRMGPAAA

SEQ ID NO: 1193050 - protein, 9 aa, Homo Sapiens
EIFRLLISR

SEQ ID NO: 1193051 - protein, 9 aa, Homo Sapiens
LMIAQKKGF

SEQ ID NO: 1193052 - protein, 9 aa, Homo Sapiens
VGEPRHCIE

SEQ ID NO: 1193053 - protein, 9 aa, Homo Sapiens
SILLCKRKI

SEQ ID NO: 1193054 - protein, 9 aa, Homo Sapiens
DIVGVPTGG

SEQ ID NO: 1193055 - protein, 9 aa, Homo Sapiens
EALGYLKNL

SEQ ID NO: 1193056 - protein, 9 aa, Homo Sapiens
GFLLHQPLP

SEQ ID NO: 1193057 - protein, 9 aa, Homo Sapiens
CPRLEGRLG

SEQ ID NO: 1193058 - protein, 9 aa, Homo Sapiens
ALTSLALSM

SEQ ID NO: 1193059 - protein, 9 aa, Homo Sapiens
GPREGERSY

SEQ ID NO: 1193060 - protein, 9 aa, Homo Sapiens
LGGGRRGAP

SEQ ID NO: 1193061 - protein, 9 aa, Homo Sapiens
SLHERPEDV

SEQ ID NO: 1193062 - protein, 9 aa, Homo Sapiens
GDSSRVIVA

SEQ ID NO: 1193063 - protein, 9 aa, Homo Sapiens
ESKSKKGTM

SEQ ID NO: 1193064 - protein, 9 aa, Homo Sapiens
LTPDSLAAL

SEQ ID NO: 1193065 - protein, 9 aa, Homo Sapiens
AHLQEEEGE

SEQ ID NO: 1193066 - protein, 9 aa, Homo Sapiens
GRKRRRPKK

SEQ ID NO: 1193067 - protein, 9 aa, Homo Sapiens
QRFSVRYTP

SEQ ID NO: 1193068 - protein, 9 aa, Homo Sapiens
GMGVGADAR

SEQ ID NO: 1193069 - protein, 9 aa, Homo Sapiens
LWGHAGKAQ

SEQ ID NO: 1193070 - protein, 9 aa, Homo Sapiens
YQTMKVRSA

SEQ ID NO: 1193071 - protein, 9 aa, Homo Sapiens
AGSPSVNAV

SEQ ID NO: 1193072 - protein, 9 aa, Homo Sapiens
STTDNDITL

SEQ ID NO: 1193073 - protein, 9 aa, Homo Sapiens
INGQHLQHQ

SEQ ID NO: 1193074 - protein, 9 aa, Homo Sapiens
KSSKRSFGT

SEQ ID NO: 1193075 - protein, 9 aa, Homo Sapiens
NFVALAVFS

SEQ ID NO: 1193076 - protein, 9 aa, Homo Sapiens
QGAVYMDIP

SEQ ID NO: 1193077 - protein, 9 aa, Homo Sapiens
PPQARGPGA

SEQ ID NO: 1193078 - protein, 9 aa, Homo Sapiens
IRHCTLTWS

SEQ ID NO: 1193079 - protein, 9 aa, Homo Sapiens
YALAKMNGQ

SEQ ID NO: 1193080 - protein, 9 aa, Homo Sapiens
YAFVHFSTE

SEQ ID NO: 1193081 - protein, 9 aa, Homo Sapiens
ADHLPPRGD

SEQ ID NO: 1193082 - protein, 9 aa, Homo Sapiens
LGPGAQQPG

SEQ ID NO: 1193083 - protein, 9 aa, Homo Sapiens
LPRRPRGPW

SEQ ID NO: 1193084 - protein, 9 aa, Homo Sapiens
ESVSEKETW

SEQ ID NO: 1193085 - protein, 9 aa, Homo Sapiens
SDNAETKDP

SEQ ID NO: 1193086 - protein, 9 aa, Homo Sapiens
WFIVDGPFL

SEQ ID NO: 1193087 - protein, 9 aa, Homo Sapiens
RMSDLMPVH

SEQ ID NO: 1193088 - protein, 9 aa, Homo Sapiens
PARTPAPTP

SEQ ID NO: 1193089 - protein, 9 aa, Homo Sapiens
HRWSWRMGP

SEQ ID NO: 1193090 - protein, 9 aa, Homo Sapiens
MNDARHGGW

SEQ ID NO: 1193091 - protein, 9 aa, Homo Sapiens
SHSKPSQIL

SEQ ID NO: 1193092 - protein, 9 aa, Homo Sapiens
IPCESNEVN

SEQ ID NO: 1193093 - protein, 9 aa, Homo Sapiens
FQHLMDISP

SEQ ID NO: 1193094 - protein, 9 aa, Homo Sapiens
QQAALPWLS

SEQ ID NO: 1193095 - protein, 9 aa, Homo Sapiens
GKDWPSAIC

SEQ ID NO: 1193096 - protein, 9 aa, Homo Sapiens
KVGVAEGTK

SEQ ID NO: 1193097 - protein, 9 aa, Homo Sapiens
SDTRLSQQN

SEQ ID NO: 1193098 - protein, 9 aa, Homo Sapiens
LSAFPKPPE

SEQ ID NO: 1193099 - protein, 9 aa, Homo Sapiens
NLLPLDGLK

SEQ ID NO: 1193100 - protein, 9 aa, Homo Sapiens
LPTASGLKN

SEQ ID NO: 1193101 - protein, 9 aa, Homo Sapiens
KPYMNIFNQ

SEQ ID NO: 1193102 - protein, 9 aa, Homo Sapiens
IGFVEFVLH

SEQ ID NO: 1193103 - protein, 9 aa, Homo Sapiens
ERTAWSWCG

SEQ ID NO: 1193104 - protein, 9 aa, Homo Sapiens
SLMRRVWMV

SEQ ID NO: 1193105 - protein, 9 aa, Homo Sapiens
AQGWRARAW

SEQ ID NO: 1193106 - protein, 9 aa, Homo Sapiens
CTNSNASTV

SEQ ID NO: 1193107 - protein, 9 aa, Homo Sapiens
VATGSAVES

SEQ ID NO: 1193108 - protein, 9 aa, Homo Sapiens
MSKRLGVCT

SEQ ID NO: 1193109 - protein, 9 aa, Homo Sapiens
DGLDLLQLP

SEQ ID NO: 1193110 - protein, 9 aa, Homo Sapiens
LAARRRPVQ

SEQ ID NO: 1193111 - protein, 9 aa, Homo Sapiens
DQEGRFVLK

SEQ ID NO: 1193112 - protein, 9 aa, Homo Sapiens
KRIPENILG

SEQ ID NO: 1193113 - protein, 9 aa, Homo Sapiens
LVNMGGNRS

SEQ ID NO: 1193114 - protein, 9 aa, Homo Sapiens
HLTLGAPTI

SEQ ID NO: 1193115 - protein, 9 aa, Homo Sapiens
ARTLLDRDA

SEQ ID NO: 1193116 - protein, 9 aa, Homo Sapiens
KIEEEEVEF

SEQ ID NO: 1193117 - protein, 9 aa, Homo Sapiens
QALGGIASR

SEQ ID NO: 1193118 - protein, 9 aa, Homo Sapiens
TEARSCPTT

SEQ ID NO: 1193119 - protein, 9 aa, Homo Sapiens
WGLGRIPQA

SEQ ID NO: 1193120 - protein, 9 aa, Homo Sapiens
TIIILVSRL

SEQ ID NO: 1193121 - protein, 9 aa, Homo Sapiens
FGQNFISPK

SEQ ID NO: 1193122 - protein, 9 aa, Homo Sapiens
QARCWMTSR

SEQ ID NO: 1193123 - protein, 9 aa, Homo Sapiens
IFSFNSHCQ

SEQ ID NO: 1193124 - protein, 9 aa, Homo Sapiens
AFMVEGGEK

SEQ ID NO: 1193125 - protein, 9 aa, Homo Sapiens
SFRRRLGQA

SEQ ID NO: 1193126 - protein, 9 aa, Homo Sapiens
GGSWSSASG

SEQ ID NO: 1193127 - protein, 9 aa, Homo Sapiens
HLQHQTGFE

SEQ ID NO: 1193128 - protein, 9 aa, Homo Sapiens
AGRLRTLLL

SEQ ID NO: 1193129 - protein, 9 aa, Homo Sapiens
PRPPPCRPR

SEQ ID NO: 1193130 - protein, 9 aa, Homo Sapiens
AHPFFPRDK

SEQ ID NO: 1193131 - protein, 9 aa, Homo Sapiens
PWPPAPLTS

SEQ ID NO: 1193132 - protein, 9 aa, Homo Sapiens
SCTPAGPHT

SEQ ID NO: 1193133 - protein, 9 aa, Homo Sapiens
VVEGVLIDV

SEQ ID NO: 1193134 - protein, 9 aa, Homo Sapiens
QTAISFQLP

SEQ ID NO: 1193135 - protein, 9 aa, Homo Sapiens
YCKAESFEF

SEQ ID NO: 1193136 - protein, 9 aa, Homo Sapiens
RGLQALGSR

SEQ ID NO: 1193137 - protein, 9 aa, Homo Sapiens
GCGCEAQEA

SEQ ID NO: 1193138 - protein, 9 aa, Homo Sapiens
MEVVVYQLH

SEQ ID NO: 1193139 - protein, 9 aa, Homo Sapiens
IDRDQGGGS

SEQ ID NO: 1193140 - protein, 9 aa, Homo Sapiens
SHTMDFLKC

SEQ ID NO: 1193141 - protein, 9 aa, Homo Sapiens
PVLQRVHGG

SEQ ID NO: 1193142 - protein, 9 aa, Homo Sapiens
YTEDVIASD

SEQ ID NO: 1193143 - protein, 9 aa, Homo Sapiens
VRRGDTCPC

SEQ ID NO: 1193144 - protein, 9 aa, Homo Sapiens
FQGRWVHGF

SEQ ID NO: 1193145 - protein, 9 aa, Homo Sapiens
RVGSCVDSA

SEQ ID NO: 1193146 - protein, 9 aa, Homo Sapiens
FTYARYSSR

SEQ ID NO: 1193147 - protein, 9 aa, Homo Sapiens
APDLAGTMC

SEQ ID NO: 1193148 - protein, 9 aa, Homo Sapiens
WSLVIWVTN

SEQ ID NO: 1193149 - protein, 9 aa, Homo Sapiens
CRQCDLYFE

SEQ ID NO: 1193150 - protein, 9 aa, Homo Sapiens
FRPVDCADH

SEQ ID NO: 1193151 - protein, 9 aa, Homo Sapiens
PQRNLSADQ

SEQ ID NO: 1193152 - protein, 9 aa, Homo Sapiens
QVSADEDLK

SEQ ID NO: 1193153 - protein, 9 aa, Homo Sapiens
NPIRAVPLA

SEQ ID NO: 1193154 - protein, 9 aa, Homo Sapiens
CLPLHCGPP

SEQ ID NO: 1193155 - protein, 9 aa, Homo Sapiens
FPLSLLFFW

SEQ ID NO: 1193156 - protein, 9 aa, Homo Sapiens
GNWGWPVEV

SEQ ID NO: 1193157 - protein, 9 aa, Homo Sapiens
AQFGEGAVD

SEQ ID NO: 1193158 - protein, 9 aa, Homo Sapiens
TSKFLRKCS

SEQ ID NO: 1193159 - protein, 9 aa, Homo Sapiens
LDLLQLPEP

SEQ ID NO: 1193160 - protein, 9 aa, Homo Sapiens
CQLNPGIYP

SEQ ID NO: 1193161 - protein, 9 aa, Homo Sapiens
CEDCGNAFS

SEQ ID NO: 1193162 - protein, 9 aa, Homo Sapiens
GTTSRPWDP

SEQ ID NO: 1193163 - protein, 9 aa, Homo Sapiens
EMTSDTRLS

SEQ ID NO: 1193164 - protein, 9 aa, Homo Sapiens
RALFNYVRC

SEQ ID NO: 1193165 - protein, 9 aa, Homo Sapiens
PAARLLLHF

SEQ ID NO: 1193166 - protein, 9 aa, Homo Sapiens
CARRCAEPS

SEQ ID NO: 1193167 - protein, 9 aa, Homo Sapiens
EVVVYQLHN

SEQ ID NO: 1193168 - protein, 9 aa, Homo Sapiens
WEGLWGWRG

SEQ ID NO: 1193169 - protein, 9 aa, Homo Sapiens
EGWELIKTV

SEQ ID NO: 1193170 - protein, 9 aa, Homo Sapiens
MIVDLSAKD

SEQ ID NO: 1193171 - protein, 9 aa, Homo Sapiens
QGPTVPGDP

SEQ ID NO: 1193172 - protein, 9 aa, Homo Sapiens
ASGGGKGTE

SEQ ID NO: 1193173 - protein, 9 aa, Homo Sapiens
GGGAGCPRR

SEQ ID NO: 1193174 - protein, 9 aa, Homo Sapiens
CQKFSFAEH

SEQ ID NO: 1193175 - protein, 9 aa, Homo Sapiens
GGGTFLVSA

SEQ ID NO: 1193176 - protein, 9 aa, Homo Sapiens
RSVGGLRRR

SEQ ID NO: 1193177 - protein, 9 aa, Homo Sapiens
HCGPPSPPG

SEQ ID NO: 1193178 - protein, 9 aa, Homo Sapiens
FSDNFYPED

SEQ ID NO: 1193179 - protein, 9 aa, Homo Sapiens
HALRHRFDC

SEQ ID NO: 1193180 - protein, 9 aa, Homo Sapiens
TSGVGAGRR

SEQ ID NO: 1193181 - protein, 9 aa, Homo Sapiens
SLVADHDYI

SEQ ID NO: 1193182 - protein, 9 aa, Homo Sapiens
MSLAAHRST

SEQ ID NO: 1193183 - protein, 9 aa, Homo Sapiens
EITLLNCDG

SEQ ID NO: 1193184 - protein, 9 aa, Homo Sapiens
HNFLSIFKL

SEQ ID NO: 1193185 - protein, 9 aa, Homo Sapiens
KEAPELVEP

SEQ ID NO: 1193186 - protein, 9 aa, Homo Sapiens
AAAAGGRET

SEQ ID NO: 1193187 - protein, 9 aa, Homo Sapiens
ASVRGIQGR

SEQ ID NO: 1193188 - protein, 9 aa, Homo Sapiens
MKTAKSSSS

SEQ ID NO: 1193189 - protein, 9 aa, Homo Sapiens
QAVVGEEHS

SEQ ID NO: 1193190 - protein, 9 aa, Homo Sapiens
HVKGLLNML

SEQ ID NO: 1193191 - protein, 9 aa, Homo Sapiens
LPLRPQRGP

SEQ ID NO: 1193192 - protein, 9 aa, Homo Sapiens
APAKESTHT

SEQ ID NO: 1193193 - protein, 9 aa, Homo Sapiens
DMISKCVYW

SEQ ID NO: 1193194 - protein, 9 aa, Homo Sapiens
RGPPSPAPG

SEQ ID NO: 1193195 - protein, 9 aa, Homo Sapiens
SGGRRPNIP

SEQ ID NO: 1193196 - protein, 9 aa, Homo Sapiens
RLKSEGGVE

SEQ ID NO: 1193197 - protein, 9 aa, Homo Sapiens
LHSLAQQAP

SEQ ID NO: 1193198 - protein, 9 aa, Homo Sapiens
QRARGCPPF

SEQ ID NO: 1193199 - protein, 9 aa, Homo Sapiens
RFSGAPPRA

SEQ ID NO: 1193200 - protein, 9 aa, Homo Sapiens
TVCSEAKGL

SEQ ID NO: 1193201 - protein, 9 aa, Homo Sapiens
LHEEKVEVW

SEQ ID NO: 1193202 - protein, 9 aa, Homo Sapiens
WSPRAVAAL

SEQ ID NO: 1193203 - protein, 9 aa, Homo Sapiens
GSCVDSAVT

SEQ ID NO: 1193204 - protein, 9 aa, Homo Sapiens
LAGMRGIQN

SEQ ID NO: 1193205 - protein, 9 aa, Homo Sapiens
HGDYFAKNY

SEQ ID NO: 1193206 - protein, 9 aa, Homo Sapiens
PEIYLAYQN

SEQ ID NO: 1193207 - protein, 9 aa, Homo Sapiens
SRDQNTFHT

SEQ ID NO: 1193208 - protein, 9 aa, Homo Sapiens
KTMQLKKEI

SEQ ID NO: 1193209 - protein, 9 aa, Homo Sapiens
FLRVAMELI

SEQ ID NO: 1193210 - protein, 9 aa, Homo Sapiens
EVDVEVVEN

SEQ ID NO: 1193211 - protein, 9 aa, Homo Sapiens
FGQTGKIST

SEQ ID NO: 1193212 - protein, 9 aa, Homo Sapiens
GPCLPSSTA

SEQ ID NO: 1193213 - protein, 9 aa, Homo Sapiens
GKRSTARAT

SEQ ID NO: 1193214 - protein, 9 aa, Homo Sapiens
CGCGCEAQE

SEQ ID NO: 1193215 - protein, 9 aa, Homo Sapiens
PLNCAPRPR

SEQ ID NO: 1193216 - protein, 9 aa, Homo Sapiens
HSSGRLLPP

SEQ ID NO: 1193217 - protein, 9 aa, Homo Sapiens
PLAGWSSRR

SEQ ID NO: 1193218 - protein, 9 aa, Homo Sapiens
RQGESSGLN

SEQ ID NO: 1193219 - protein, 9 aa, Homo Sapiens
SRPWDPGCV

SEQ ID NO: 1193220 - protein, 9 aa, Homo Sapiens
VRISAKEVT

SEQ ID NO: 1193221 - protein, 9 aa, Homo Sapiens
GHAQMCRVN

SEQ ID NO: 1193222 - protein, 9 aa, Homo Sapiens
LLFFNPIRA

SEQ ID NO: 1193223 - protein, 9 aa, Homo Sapiens
PWRSSRRQT

SEQ ID NO: 1193224 - protein, 9 aa, Homo Sapiens
GTIKGLITT

SEQ ID NO: 1193225 - protein, 9 aa, Homo Sapiens
AAAGCSWTC

SEQ ID NO: 1193226 - protein, 9 aa, Homo Sapiens
CGMEPGAEM

SEQ ID NO: 1193227 - protein, 9 aa, Homo Sapiens
VFHFSTAGT

SEQ ID NO: 1193228 - protein, 9 aa, Homo Sapiens
SCCPRSHPR

SEQ ID NO: 1193229 - protein, 9 aa, Homo Sapiens
RAQGQNLVV

SEQ ID NO: 1193230 - protein, 9 aa, Homo Sapiens
NLLRLQSLL

SEQ ID NO: 1193231 - protein, 9 aa, Homo Sapiens
WTDFRSCTN

SEQ ID NO: 1193232 - protein, 9 aa, Homo Sapiens
GGTPRGGSA

SEQ ID NO: 1193233 - protein, 9 aa, Homo Sapiens
RWSWRMGPG

SEQ ID NO: 1193234 - protein, 9 aa, Homo Sapiens
WQMRASTPA

SEQ ID NO: 1193235 - protein, 9 aa, Homo Sapiens
WWRVDVAIS

SEQ ID NO: 1193236 - protein, 9 aa, Homo Sapiens
SPRSRWRHP

SEQ ID NO: 1193237 - protein, 9 aa, Homo Sapiens
RTAWSWCGM

SEQ ID NO: 1193238 - protein, 9 aa, Homo Sapiens
MTGIPRLPQ

SEQ ID NO: 1193239 - protein, 9 aa, Homo Sapiens
WTSGVGTYI

SEQ ID NO: 1193240 - protein, 9 aa, Homo Sapiens
DNKRHSPGQ

SEQ ID NO: 1193241 - protein, 9 aa, Homo Sapiens
EDASGAFSG

SEQ ID NO: 1193242 - protein, 9 aa, Homo Sapiens
STSMLSAAG

SEQ ID NO: 1193243 - protein, 9 aa, Homo Sapiens
ILQAMYLLW

SEQ ID NO: 1193244 - protein, 9 aa, Homo Sapiens
LKNGFTFRK

SEQ ID NO: 1193245 - protein, 9 aa, Homo Sapiens
SVPLLPRLV

SEQ ID NO: 1193246 - protein, 9 aa, Homo Sapiens
EPLAEDHPR

SEQ ID NO: 1193247 - protein, 9 aa, Homo Sapiens
LLLAGYNDF

SEQ ID NO: 1193248 - protein, 9 aa, Homo Sapiens
HFFCRVLSL

SEQ ID NO: 1193249 - protein, 9 aa, Homo Sapiens
RRVWMVLGL

SEQ ID NO: 1193250 - protein, 9 aa, Homo Sapiens
FLLAVPLLK

SEQ ID NO: 1193251 - protein, 9 aa, Homo Sapiens
IDDYFYING

SEQ ID NO: 1193252 - protein, 9 aa, Homo Sapiens
RQGHRHHQE

SEQ ID NO: 1193253 - protein, 9 aa, Homo Sapiens
PCTHLAFPP

SEQ ID NO: 1193254 - protein, 9 aa, Homo Sapiens
CRAQGQNLV

SEQ ID NO: 1193255 - protein, 9 aa, Homo Sapiens
YTSGVGAGR

SEQ ID NO: 1193256 - protein, 9 aa, Homo Sapiens
GIHTREWVS

SEQ ID NO: 1193257 - protein, 9 aa, Homo Sapiens
PPRHQCPAS

SEQ ID NO: 1193258 - protein, 9 aa, Homo Sapiens
VPRQRGLLL

SEQ ID NO: 1193259 - protein, 9 aa, Homo Sapiens
ERINRAIQE

SEQ ID NO: 1193260 - protein, 9 aa, Homo Sapiens
ARKQRLAPT

SEQ ID NO: 1193261 - protein, 9 aa, Homo Sapiens
PVPLGPWNG

SEQ ID NO: 1193262 - protein, 9 aa, Homo Sapiens
IWVTNWKPS

SEQ ID NO: 1193263 - protein, 9 aa, Homo Sapiens
DGEERGRRT

SEQ ID NO: 1193264 - protein, 9 aa, Homo Sapiens
DVVMKVKKE

SEQ ID NO: 1193265 - protein, 9 aa, Homo Sapiens
PLRGGRPPV

SEQ ID NO: 1193266 - protein, 9 aa, Homo Sapiens
TYFNRSTNH

SEQ ID NO: 1193267 - protein, 9 aa, Homo Sapiens
VLAGTAKRA

SEQ ID NO: 1193268 - protein, 9 aa, Homo Sapiens
RRRRWHTRG

SEQ ID NO: 1193269 - protein, 9 aa, Homo Sapiens
QPPPRLPLR

SEQ ID NO: 1193270 - protein, 9 aa, Homo Sapiens
TAAANELNN

SEQ ID NO: 1193271 - protein, 9 aa, Homo Sapiens
THCSFYRTR

SEQ ID NO: 1193272 - protein, 9 aa, Homo Sapiens
LYAMGGQDG

SEQ ID NO: 1193273 - protein, 9 aa, Homo Sapiens
EEECWNGHI

SEQ ID NO: 1193274 - protein, 9 aa, Homo Sapiens
IFHFCTMKC

SEQ ID NO: 1193275 - protein, 9 aa, Homo Sapiens
LGHHKVRTA

SEQ ID NO: 1193276 - protein, 9 aa, Homo Sapiens
VAPPPQPGN

SEQ ID NO: 1193277 - protein, 9 aa, Homo Sapiens
FEDIWGQSD

SEQ ID NO: 1193278 - protein, 9 aa, Homo Sapiens
SHIWVGIFR

SEQ ID NO: 1193279 - protein, 9 aa, Homo Sapiens
CCVIPPDLT

SEQ ID NO: 1193280 - protein, 9 aa, Homo Sapiens
KLRRNIPGI

SEQ ID NO: 1193281 - protein, 9 aa, Homo Sapiens
SMGHPGRVK

SEQ ID NO: 1193282 - protein, 9 aa, Homo Sapiens
HLLATVTNA

SEQ ID NO: 1193283 - protein, 9 aa, Homo Sapiens
LLNHQRTHT

SEQ ID NO: 1193284 - protein, 9 aa, Homo Sapiens
MLHAHQALP

SEQ ID NO: 1193285 - protein, 9 aa, Homo Sapiens
NLECMEPQD

SEQ ID NO: 1193286 - protein, 9 aa, Homo Sapiens
GTACLIPPA

SEQ ID NO: 1193287 - protein, 9 aa, Homo Sapiens
DGEIMKTAK

SEQ ID NO: 1193288 - protein, 9 aa, Homo Sapiens
MKTSGGGEM

SEQ ID NO: 1193289 - protein, 9 aa, Homo Sapiens
TCSTRSVAH

SEQ ID NO: 1193290 - protein, 9 aa, Homo Sapiens
MTEDGFLTV

SEQ ID NO: 1193291 - protein, 9 aa, Homo Sapiens
DQDSAPVPR

SEQ ID NO: 1193292 - protein, 9 aa, Homo Sapiens
TGLVDNDLC

SEQ ID NO: 1193293 - protein, 9 aa, Homo Sapiens
RWGLGRIPQ

SEQ ID NO: 1193294 - protein, 9 aa, Homo Sapiens
AEPRNLSFL

SEQ ID NO: 1193295 - protein, 9 aa, Homo Sapiens
ADTEPGPGG

SEQ ID NO: 1193296 - protein, 9 aa, Homo Sapiens
SITMQNIEA

SEQ ID NO: 1193297 - protein, 9 aa, Homo Sapiens
SSDSELLWD

SEQ ID NO: 1193298 - protein, 9 aa, Homo Sapiens
SSLTTANAP

SEQ ID NO: 1193299 - protein, 9 aa, Homo Sapiens
DNMYRFEDT

SEQ ID NO: 1193300 - protein, 9 aa, Homo Sapiens
YEQCILVTN

SEQ ID NO: 1193301 - protein, 9 aa, Homo Sapiens
ILTEGRERI

SEQ ID NO: 1193302 - protein, 9 aa, Homo Sapiens
AARKSWAAS

SEQ ID NO: 1193303 - protein, 9 aa, Homo Sapiens
PAFGRATLL

SEQ ID NO: 1193304 - protein, 9 aa, Homo Sapiens
NRPQQPPPR

SEQ ID NO: 1193305 - protein, 9 aa, Homo Sapiens
IPPQRGGLP

SEQ ID NO: 1193306 - protein, 9 aa, Homo Sapiens
DWFNASFGS

SEQ ID NO: 1193307 - protein, 9 aa, Homo Sapiens
KTTSQSQLS

SEQ ID NO: 1193308 - protein, 9 aa, Homo Sapiens
RGASGARET

SEQ ID NO: 1193309 - protein, 9 aa, Homo Sapiens
IQASESGAS

SEQ ID NO: 1193310 - protein, 9 aa, Homo Sapiens
FCSEGMSPL

SEQ ID NO: 1193311 - protein, 9 aa, Homo Sapiens
GDWLQENIA

SEQ ID NO: 1193312 - protein, 9 aa, Homo Sapiens
RPSQGYRRW

SEQ ID NO: 1193313 - protein, 9 aa, Homo Sapiens
LWSDGVPCS

SEQ ID NO: 1193314 - protein, 9 aa, Homo Sapiens
SMVLGCLFA

SEQ ID NO: 1193315 - protein, 9 aa, Homo Sapiens
RRKLKRHPH

SEQ ID NO: 1193316 - protein, 9 aa, Homo Sapiens
DYVRRCLTA

SEQ ID NO: 1193317 - protein, 9 aa, Homo Sapiens
NNVVEKLNL

SEQ ID NO: 1193318 - protein, 9 aa, Homo Sapiens
SRGRGGVIP

SEQ ID NO: 1193319 - protein, 9 aa, Homo Sapiens
GPAAGAAVW

SEQ ID NO: 1193320 - protein, 9 aa, Homo Sapiens
LSREGLVEN

SEQ ID NO: 1193321 - protein, 9 aa, Homo Sapiens
HLRLRLPLP

SEQ ID NO: 1193322 - protein, 9 aa, Homo Sapiens
KAFYPVWSS

SEQ ID NO: 1193323 - protein, 9 aa, Homo Sapiens
KQSTITNMG

SEQ ID NO: 1193324 - protein, 9 aa, Homo Sapiens
CTTSAPRRP

SEQ ID NO: 1193325 - protein, 9 aa, Homo Sapiens
KIVHAGEKP

SEQ ID NO: 1193326 - protein, 9 aa, Homo Sapiens
WPGHMSELL

SEQ ID NO: 1193327 - protein, 9 aa, Homo Sapiens
WTEMQRMLI

SEQ ID NO: 1193328 - protein, 9 aa, Homo Sapiens
QPTSGSIFL

SEQ ID NO: 1193329 - protein, 9 aa, Homo Sapiens
VDLEAFMKV

SEQ ID NO: 1193330 - protein, 9 aa, Homo Sapiens
REQFLRPAS

SEQ ID NO: 1193331 - protein, 9 aa, Homo Sapiens
GPPKLVSSA

SEQ ID NO: 1193332 - protein, 9 aa, Homo Sapiens
IHTFAVKLE

SEQ ID NO: 1193333 - protein, 9 aa, Homo Sapiens
RLQSLLSLY

SEQ ID NO: 1193334 - protein, 9 aa, Homo Sapiens
KDGAGARTA

SEQ ID NO: 1193335 - protein, 9 aa, Homo Sapiens
CWPSFSWTI

SEQ ID NO: 1193336 - protein, 9 aa, Homo Sapiens
LSTNLIKLC

SEQ ID NO: 1193337 - protein, 9 aa, Homo Sapiens
VVSAHLVGH

SEQ ID NO: 1193338 - protein, 9 aa, Homo Sapiens
PAGHRLQHG

SEQ ID NO: 1193339 - protein, 9 aa, Homo Sapiens
PPAGSGQVA

SEQ ID NO: 1193340 - protein, 9 aa, Homo Sapiens
VRKCLPAAP

SEQ ID NO: 1193341 - protein, 9 aa, Homo Sapiens
ICRGAGHKP

SEQ ID NO: 1193342 - protein, 9 aa, Homo Sapiens
RPRGPWRAP

SEQ ID NO: 1193343 - protein, 9 aa, Homo Sapiens
GYRLEKETC

SEQ ID NO: 1193344 - protein, 9 aa, Homo Sapiens
HTQSLVGAD

SEQ ID NO: 1193345 - protein, 9 aa, Homo Sapiens
YTDAGTVQE

SEQ ID NO: 1193346 - protein, 9 aa, Homo Sapiens
IQTHNIRHL

SEQ ID NO: 1193347 - protein, 9 aa, Homo Sapiens
VPAGHVCPW

SEQ ID NO: 1193348 - protein, 9 aa, Homo Sapiens
KPFLFYHAK

SEQ ID NO: 1193349 - protein, 9 aa, Homo Sapiens
IASRLGMQN

SEQ ID NO: 1193350 - protein, 9 aa, Homo Sapiens
NHVLIHNDL

SEQ ID NO: 1193351 - protein, 9 aa, Homo Sapiens
SAGMTQMLQ

SEQ ID NO: 1193352 - protein, 9 aa, Homo Sapiens
GAPGPCLAQ

SEQ ID NO: 1193353 - protein, 9 aa, Homo Sapiens
GISKKKKSR

SEQ ID NO: 1193354 - protein, 9 aa, Homo Sapiens
QQAPEALGL

SEQ ID NO: 1193355 - protein, 9 aa, Homo Sapiens
ELLSPYSPI

SEQ ID NO: 1193356 - protein, 9 aa, Homo Sapiens
SSVCDSHPH

SEQ ID NO: 1193357 - protein, 9 aa, Homo Sapiens
PKDNKLLAT

SEQ ID NO: 1193358 - protein, 9 aa, Homo Sapiens
VDGEIMKTA

SEQ ID NO: 1193359 - protein, 9 aa, Homo Sapiens
EENMRGVCF

SEQ ID NO: 1193360 - protein, 9 aa, Homo Sapiens
QEPSRLGGG

SEQ ID NO: 1193361 - protein, 9 aa, Homo Sapiens
SPRYQGAAV

SEQ ID NO: 1193362 - protein, 9 aa, Homo Sapiens
HLGLRKQYG

SEQ ID NO: 1193363 - protein, 9 aa, Homo Sapiens
GKAHKKSSC

SEQ ID NO: 1193364 - protein, 9 aa, Homo Sapiens
CSAAGATTP

SEQ ID NO: 1193365 - protein, 9 aa, Homo Sapiens
RDAVTHTEH

SEQ ID NO: 1193366 - protein, 9 aa, Homo Sapiens
CLEHDIQAD

SEQ ID NO: 1193367 - protein, 9 aa, Homo Sapiens
EKEKKKAEA

SEQ ID NO: 1193368 - protein, 9 aa, Homo Sapiens
DDPKADGMT

SEQ ID NO: 1193369 - protein, 9 aa, Homo Sapiens
QTPMEVVVY

SEQ ID NO: 1193370 - protein, 9 aa, Homo Sapiens
WAREQQRLQ

SEQ ID NO: 1193371 - protein, 9 aa, Homo Sapiens
VVMVVRPVA

SEQ ID NO: 1193372 - protein, 9 aa, Homo Sapiens
AELGYRTQG

SEQ ID NO: 1193373 - protein, 9 aa, Homo Sapiens
VGAVGVGGA

SEQ ID NO: 1193374 - protein, 9 aa, Homo Sapiens
DQWGPKDHQ

SEQ ID NO: 1193375 - protein, 9 aa, Homo Sapiens
LDLEPECSA

SEQ ID NO: 1193376 - protein, 9 aa, Homo Sapiens
GGPGSARPP

SEQ ID NO: 1193377 - protein, 9 aa, Homo Sapiens
QVAHDPPQS

SEQ ID NO: 1193378 - protein, 9 aa, Homo Sapiens
VQAGQHAGP

SEQ ID NO: 1193379 - protein, 9 aa, Homo Sapiens
SDFPTPAAL

SEQ ID NO: 1193380 - protein, 9 aa, Homo Sapiens
RPWDPGCVQ

SEQ ID NO: 1193381 - protein, 9 aa, Homo Sapiens
KLKRHPHKS

SEQ ID NO: 1193382 - protein, 9 aa, Homo Sapiens
TEISAVVDA

SEQ ID NO: 1193383 - protein, 9 aa, Homo Sapiens
GCSSSGTED

SEQ ID NO: 1193384 - protein, 9 aa, Homo Sapiens
LLCVTRPSE

SEQ ID NO: 1193385 - protein, 9 aa, Homo Sapiens
LRGGRPPVW

SEQ ID NO: 1193386 - protein, 9 aa, Homo Sapiens
AACPTRAHS

SEQ ID NO: 1193387 - protein, 9 aa, Homo Sapiens
AGTAEATTR

SEQ ID NO: 1193388 - protein, 9 aa, Homo Sapiens
YGLEVTLIP

SEQ ID NO: 1193389 - protein, 9 aa, Homo Sapiens
HIGICHPGP

SEQ ID NO: 1193390 - protein, 9 aa, Homo Sapiens
GPGARRHPP

SEQ ID NO: 1193391 - protein, 9 aa, Homo Sapiens
ERMEAPSVG

SEQ ID NO: 1193392 - protein, 9 aa, Homo Sapiens
RRKMRPAHL

SEQ ID NO: 1193393 - protein, 9 aa, Homo Sapiens
VVAVGDHHV

SEQ ID NO: 1193394 - protein, 9 aa, Homo Sapiens
SIARNLQAM

SEQ ID NO: 1193395 - protein, 9 aa, Homo Sapiens
GLPLNCAPR

SEQ ID NO: 1193396 - protein, 9 aa, Homo Sapiens
DRLTILLPG

SEQ ID NO: 1193397 - protein, 9 aa, Homo Sapiens
LKQLKRKQK

SEQ ID NO: 1193398 - protein, 9 aa, Homo Sapiens
KWPVGMTGP

SEQ ID NO: 1193399 - protein, 9 aa, Homo Sapiens
ATGQWMEWK

SEQ ID NO: 1193400 - protein, 9 aa, Homo Sapiens
FLMGGCPGH

SEQ ID NO: 1193401 - protein, 9 aa, Homo Sapiens
QIYSEHNYC

SEQ ID NO: 1193402 - protein, 9 aa, Homo Sapiens
HRDYSLTCH

SEQ ID NO: 1193403 - protein, 9 aa, Homo Sapiens
RGLRFVVYD

SEQ ID NO: 1193404 - protein, 9 aa, Homo Sapiens
IYIQRLSVS

SEQ ID NO: 1193405 - protein, 9 aa, Homo Sapiens
SLGGGTFLV

SEQ ID NO: 1193406 - protein, 9 aa, Homo Sapiens
PLLLAPVPG

SEQ ID NO: 1193407 - protein, 9 aa, Homo Sapiens
HIECSDEKS

SEQ ID NO: 1193408 - protein, 9 aa, Homo Sapiens
TEPGPGGGR

SEQ ID NO: 1193409 - protein, 9 aa, Homo Sapiens
MLSLLELNT

SEQ ID NO: 1193410 - protein, 9 aa, Homo Sapiens
LEVIVDVVM

SEQ ID NO: 1193411 - protein, 9 aa, Homo Sapiens
RVPLKQLKR

SEQ ID NO: 1193412 - protein, 9 aa, Homo Sapiens
SNTGYALHD

SEQ ID NO: 1193413 - protein, 9 aa, Homo Sapiens
HPPRNGSGP

SEQ ID NO: 1193414 - protein, 9 aa, Homo Sapiens
VGLLGAGPS

SEQ ID NO: 1193415 - protein, 9 aa, Homo Sapiens
DLIAWLSSC

SEQ ID NO: 1193416 - protein, 9 aa, Homo Sapiens
ALGFGTKYL

SEQ ID NO: 1193417 - protein, 9 aa, Homo Sapiens
VHEVQVPPG

SEQ ID NO: 1193418 - protein, 9 aa, Homo Sapiens
VWTAASAPQ

SEQ ID NO: 1193419 - protein, 9 aa, Homo Sapiens
SFSDNFYPE

SEQ ID NO: 1193420 - protein, 9 aa, Homo Sapiens
PSQILQGHL

SEQ ID NO: 1193421 - protein, 9 aa, Homo Sapiens
CAVPTWASV

SEQ ID NO: 1193422 - protein, 9 aa, Homo Sapiens
KAEPRLTRC

SEQ ID NO: 1193423 - protein, 9 aa, Homo Sapiens
PRSHPRLPG

SEQ ID NO: 1193424 - protein, 9 aa, Homo Sapiens
MKSAHLPEH

SEQ ID NO: 1193425 - protein, 9 aa, Homo Sapiens
SLRKEPVAM

SEQ ID NO: 1193426 - protein, 9 aa, Homo Sapiens
GLWFLLKST

SEQ ID NO: 1193427 - protein, 9 aa, Homo Sapiens
VEQAAEGGH

SEQ ID NO: 1193428 - protein, 9 aa, Homo Sapiens
LLAWAPDAA

SEQ ID NO: 1193429 - protein, 9 aa, Homo Sapiens
TARSWTPPA

SEQ ID NO: 1193430 - protein, 9 aa, Homo Sapiens
KVEESREAL

SEQ ID NO: 1193431 - protein, 9 aa, Homo Sapiens
PTARGRPAS

SEQ ID NO: 1193432 - protein, 9 aa, Homo Sapiens
GWARDGGAW

SEQ ID NO: 1193433 - protein, 9 aa, Homo Sapiens
SEGRLDALH

SEQ ID NO: 1193434 - protein, 9 aa, Homo Sapiens
DNNLAMLER

SEQ ID NO: 1193435 - protein, 9 aa, Homo Sapiens
WTCPRASTQ

SEQ ID NO: 1193436 - protein, 9 aa, Homo Sapiens
RAPPGACPA

SEQ ID NO: 1193437 - protein, 9 aa, Homo Sapiens
KLLKWHLVE

SEQ ID NO: 1193438 - protein, 9 aa, Homo Sapiens
KSVPLKTGE

SEQ ID NO: 1193439 - protein, 9 aa, Homo Sapiens
FHTVGSCCK

SEQ ID NO: 1193440 - protein, 9 aa, Homo Sapiens
LPAAPGAKA

SEQ ID NO: 1193441 - protein, 9 aa, Homo Sapiens
SVPSAFSCL

SEQ ID NO: 1193442 - protein, 9 aa, Homo Sapiens
PPRSCRQTP

SEQ ID NO: 1193443 - protein, 9 aa, Homo Sapiens
SMLTQSLLL

SEQ ID NO: 1193444 - protein, 9 aa, Homo Sapiens
CLPSPRSRW

SEQ ID NO: 1193445 - protein, 9 aa, Homo Sapiens
CGHHRLDGR

SEQ ID NO: 1193446 - protein, 9 aa, Homo Sapiens
ILFHPSLLF

SEQ ID NO: 1193447 - protein, 9 aa, Homo Sapiens
VATVGAVGV

SEQ ID NO: 1193448 - protein, 9 aa, Homo Sapiens
RRPRPPCSS

SEQ ID NO: 1193449 - protein, 9 aa, Homo Sapiens
HAAQLLRAV

SEQ ID NO: 1193450 - protein, 9 aa, Homo Sapiens
STCTLWTWM

SEQ ID NO: 1193451 - protein, 9 aa, Homo Sapiens
PAMLHAHQA

SEQ ID NO: 1193452 - protein, 9 aa, Homo Sapiens
RPPTRELGA

SEQ ID NO: 1193453 - protein, 9 aa, Homo Sapiens
APQPDSSLG

SEQ ID NO: 1193454 - protein, 9 aa, Homo Sapiens
ASSLQKSCS

SEQ ID NO: 1193455 - protein, 9 aa, Homo Sapiens
LRYKTAGDS

SEQ ID NO: 1193456 - protein, 9 aa, Homo Sapiens
VKLEGGQAC

SEQ ID NO: 1193457 - protein, 9 aa, Homo Sapiens
PLSLSRPHG

SEQ ID NO: 1193458 - protein, 9 aa, Homo Sapiens
VIVASYDKT

SEQ ID NO: 1193459 - protein, 9 aa, Homo Sapiens
ELVAVQHLR

SEQ ID NO: 1193460 - protein, 9 aa, Homo Sapiens
TAIPRSTSF

SEQ ID NO: 1193461 - protein, 9 aa, Homo Sapiens
EECAESHRA

SEQ ID NO: 1193462 - protein, 9 aa, Homo Sapiens
TLEERRPIA

SEQ ID NO: 1193463 - protein, 9 aa, Homo Sapiens
NQRSNRSLP

SEQ ID NO: 1193464 - protein, 9 aa, Homo Sapiens
CKNLQWMRG

SEQ ID NO: 1193465 - protein, 9 aa, Homo Sapiens
YTLVLTAFG

SEQ ID NO: 1193466 - protein, 9 aa, Homo Sapiens
YIMKELLTC

SEQ ID NO: 1193467 - protein, 9 aa, Homo Sapiens
SNSPLAMAL

SEQ ID NO: 1193468 - protein, 9 aa, Homo Sapiens
GLGCGFGGT

SEQ ID NO: 1193469 - protein, 9 aa, Homo Sapiens
SAVESIKTV

SEQ ID NO: 1193470 - protein, 9 aa, Homo Sapiens
TMGYGYIYP

SEQ ID NO: 1193471 - protein, 9 aa, Homo Sapiens
ALGFRSRRS

SEQ ID NO: 1193472 - protein, 9 aa, Homo Sapiens
TYKQISALA

SEQ ID NO: 1193473 - protein, 9 aa, Homo Sapiens
SPPSFPAML

SEQ ID NO: 1193474 - protein, 9 aa, Homo Sapiens
SATGSARSC

SEQ ID NO: 1193475 - protein, 9 aa, Homo Sapiens
SLVQTAISF

SEQ ID NO: 1193476 - protein, 9 aa, Homo Sapiens
TSFSSLVSP

SEQ ID NO: 1193477 - protein, 9 aa, Homo Sapiens
CRRPASPAR

SEQ ID NO: 1193478 - protein, 9 aa, Homo Sapiens
IIEVGRHLI

SEQ ID NO: 1193479 - protein, 9 aa, Homo Sapiens
KVGIIGRTG

SEQ ID NO: 1193480 - protein, 9 aa, Homo Sapiens
LELPASVHA

SEQ ID NO: 1193481 - protein, 9 aa, Homo Sapiens
ASGRGLSPL

SEQ ID NO: 1193482 - protein, 9 aa, Homo Sapiens
SLWRLTGLE

SEQ ID NO: 1193483 - protein, 9 aa, Homo Sapiens
RRPRTSHIS

SEQ ID NO: 1193484 - protein, 9 aa, Homo Sapiens
HQSPINIIS

SEQ ID NO: 1193485 - protein, 9 aa, Homo Sapiens
GAWALGCQA

SEQ ID NO: 1193486 - protein, 9 aa, Homo Sapiens
ARPGRGGRP

SEQ ID NO: 1193487 - protein, 9 aa, Homo Sapiens
QMWYEWEVT

SEQ ID NO: 1193488 - protein, 9 aa, Homo Sapiens
GPRMKWKKE

SEQ ID NO: 1193489 - protein, 9 aa, Homo Sapiens
TGPTPCATC

SEQ ID NO: 1193490 - protein, 9 aa, Homo Sapiens
STSRGGGGS

SEQ ID NO: 1193491 - protein, 9 aa, Homo Sapiens
AREQQRLQE

SEQ ID NO: 1193492 - protein, 9 aa, Homo Sapiens
PLILTPSRS

SEQ ID NO: 1193493 - protein, 9 aa, Homo Sapiens
WSWCGMIRD

SEQ ID NO: 1193494 - protein, 9 aa, Homo Sapiens
EIASMNITM

SEQ ID NO: 1193495 - protein, 9 aa, Homo Sapiens
SGALNIKCR

SEQ ID NO: 1193496 - protein, 9 aa, Homo Sapiens
HSTHCSFYR

SEQ ID NO: 1193497 - protein, 9 aa, Homo Sapiens
QHSPNGRLC

SEQ ID NO: 1193498 - protein, 9 aa, Homo Sapiens
SPPGAPPCQ

SEQ ID NO: 1193499 - protein, 9 aa, Homo Sapiens
RSYPEFQSS

SEQ ID NO: 1193500 - protein, 9 aa, Homo Sapiens
FFRKKLKLR

SEQ ID NO: 1193501 - protein, 9 aa, Homo Sapiens
LSEKLSGET

SEQ ID NO: 1193502 - protein, 9 aa, Homo Sapiens
DVDAPGHAD

SEQ ID NO: 1193503 - protein, 9 aa, Homo Sapiens
CTWAMSMSL

SEQ ID NO: 1193504 - protein, 9 aa, Homo Sapiens
RLGVGAAVQ

SEQ ID NO: 1193505 - protein, 9 aa, Homo Sapiens
CLRCQHQHV

SEQ ID NO: 1193506 - protein, 9 aa, Homo Sapiens
TPCATCRTR

SEQ ID NO: 1193507 - protein, 9 aa, Homo Sapiens
AGLEEDKEE

SEQ ID NO: 1193508 - protein, 9 aa, Homo Sapiens
RLLLQALNV

SEQ ID NO: 1193509 - protein, 9 aa, Homo Sapiens
IGSEHTLPI

SEQ ID NO: 1193510 - protein, 9 aa, Homo Sapiens
PPASAVQSL

SEQ ID NO: 1193511 - protein, 9 aa, Homo Sapiens
KGVQQHLQE

SEQ ID NO: 1193512 - protein, 9 aa, Homo Sapiens
GLNVMLRSQ

SEQ ID NO: 1193513 - protein, 9 aa, Homo Sapiens
IVLWPKAFY

SEQ ID NO: 1193514 - protein, 9 aa, Homo Sapiens
NHEHGGQKE

SEQ ID NO: 1193515 - protein, 9 aa, Homo Sapiens
ALSRNKYGT

SEQ ID NO: 1193516 - protein, 9 aa, Homo Sapiens
SPSLLAQLV

SEQ ID NO: 1193517 - protein, 9 aa, Homo Sapiens
NFVMASFYK

SEQ ID NO: 1193518 - protein, 9 aa, Homo Sapiens
VSEKSIRIT

SEQ ID NO: 1193519 - protein, 9 aa, Homo Sapiens
IIDLLTFIT

SEQ ID NO: 1193520 - protein, 9 aa, Homo Sapiens
SGETTLVKS

SEQ ID NO: 1193521 - protein, 9 aa, Homo Sapiens
AFVLGHHKV

SEQ ID NO: 1193522 - protein, 9 aa, Homo Sapiens
HHPPGRQLP

SEQ ID NO: 1193523 - protein, 9 aa, Homo Sapiens
LDIKVYTDR

SEQ ID NO: 1193524 - protein, 9 aa, Homo Sapiens
KPSWTSRQW

SEQ ID NO: 1193525 - protein, 9 aa, Homo Sapiens
IPECKKSST

SEQ ID NO: 1193526 - protein, 9 aa, Homo Sapiens
LTVCSEAKG

SEQ ID NO: 1193527 - protein, 9 aa, Homo Sapiens
GGMGFLTSI

SEQ ID NO: 1193528 - protein, 9 aa, Homo Sapiens
ALGFRYLVC

SEQ ID NO: 1193529 - protein, 9 aa, Homo Sapiens
EFQHLMDIS

SEQ ID NO: 1193530 - protein, 9 aa, Homo Sapiens
PPGRAWAPA

SEQ ID NO: 1193531 - protein, 9 aa, Homo Sapiens
GAAPLPPRA

SEQ ID NO: 1193532 - protein, 9 aa, Homo Sapiens
EREKQQVPR

SEQ ID NO: 1193533 - protein, 9 aa, Homo Sapiens
YSFIYFILL

SEQ ID NO: 1193534 - protein, 9 aa, Homo Sapiens
LEAHPFFPR

SEQ ID NO: 1193535 - protein, 9 aa, Homo Sapiens
PTWGCLCRA

SEQ ID NO: 1193536 - protein, 9 aa, Homo Sapiens
TLMPSYDPD

SEQ ID NO: 1193537 - protein, 9 aa, Homo Sapiens
ADGQAALVD

SEQ ID NO: 1193538 - protein, 9 aa, Homo Sapiens
QQLLRRKIN

SEQ ID NO: 1193539 - protein, 9 aa, Homo Sapiens
PHDRADHLL

SEQ ID NO: 1193540 - protein, 9 aa, Homo Sapiens
KDHLWTIGV

SEQ ID NO: 1193541 - protein, 9 aa, Homo Sapiens
VAPTRTSST

SEQ ID NO: 1193542 - protein, 9 aa, Homo Sapiens
LGGDSNSSS

SEQ ID NO: 1193543 - protein, 9 aa, Homo Sapiens
TRCLRMRPP

SEQ ID NO: 1193544 - protein, 9 aa, Homo Sapiens
WPHPSALSS

SEQ ID NO: 1193545 - protein, 9 aa, Homo Sapiens
RRATALSGP

SEQ ID NO: 1193546 - protein, 9 aa, Homo Sapiens
TNSISRTCR

SEQ ID NO: 1193547 - protein, 9 aa, Homo Sapiens
GEADFNWWF

SEQ ID NO: 1193548 - protein, 9 aa, Homo Sapiens
FLPLPWGDC

SEQ ID NO: 1193549 - protein, 9 aa, Homo Sapiens
AGRGAPRHP

SEQ ID NO: 1193550 - protein, 9 aa, Homo Sapiens
LPCRGPMPG

SEQ ID NO: 1193551 - protein, 9 aa, Homo Sapiens
DDPMFDLSL

SEQ ID NO: 1193552 - protein, 9 aa, Homo Sapiens
VGIVTVILR

SEQ ID NO: 1193553 - protein, 9 aa, Homo Sapiens
EFVCHWGAA

SEQ ID NO: 1193554 - protein, 9 aa, Homo Sapiens
GLLCPPRGK

SEQ ID NO: 1193555 - protein, 9 aa, Homo Sapiens
LRPSTRPEA

SEQ ID NO: 1193556 - protein, 9 aa, Homo Sapiens
GVVPTCHNS

SEQ ID NO: 1193557 - protein, 9 aa, Homo Sapiens
QAGQCPRLE

SEQ ID NO: 1193558 - protein, 9 aa, Homo Sapiens
PKREGPRMK

SEQ ID NO: 1193559 - protein, 9 aa, Homo Sapiens
GPPCRSSRT

SEQ ID NO: 1193560 - protein, 9 aa, Homo Sapiens
ALITFLTQR

SEQ ID NO: 1193561 - protein, 9 aa, Homo Sapiens
PTASVLPHP

SEQ ID NO: 1193562 - protein, 9 aa, Homo Sapiens
LQQLLELSS

SEQ ID NO: 1193563 - protein, 9 aa, Homo Sapiens
RTSSTCGTL

SEQ ID NO: 1193564 - protein, 9 aa, Homo Sapiens
LGLQLVKML

SEQ ID NO: 1193565 - protein, 9 aa, Homo Sapiens
GAVNQHGGI

SEQ ID NO: 1193566 - protein, 9 aa, Homo Sapiens
LNMLSEPNM

SEQ ID NO: 1193567 - protein, 9 aa, Homo Sapiens
QGCRCWKAT

SEQ ID NO: 1193568 - protein, 9 aa, Homo Sapiens
QTGTCLMVT

SEQ ID NO: 1193569 - protein, 9 aa, Homo Sapiens
DTSKNIIRL

SEQ ID NO: 1193570 - protein, 9 aa, Homo Sapiens
EWQHSPNGR

SEQ ID NO: 1193571 - protein, 9 aa, Homo Sapiens
HSLAQQAPE

SEQ ID NO: 1193572 - protein, 9 aa, Homo Sapiens
DVAGVTWGN

SEQ ID NO: 1193573 - protein, 9 aa, Homo Sapiens
FESDFPTPA

SEQ ID NO: 1193574 - protein, 9 aa, Homo Sapiens
IVKNLGEMH

SEQ ID NO: 1193575 - protein, 9 aa, Homo Sapiens
WVCHPDVDA

SEQ ID NO: 1193576 - protein, 9 aa, Homo Sapiens
PLLPGHARV

SEQ ID NO: 1193577 - protein, 9 aa, Homo Sapiens
KCSAAHGCA

SEQ ID NO: 1193578 - protein, 9 aa, Homo Sapiens
VRQIYSEHN

SEQ ID NO: 1193579 - protein, 9 aa, Homo Sapiens
GRSSPVTIN

SEQ ID NO: 1193580 - protein, 9 aa, Homo Sapiens
EYFFDRNQP

SEQ ID NO: 1193581 - protein, 9 aa, Homo Sapiens
YRVSASKRI

SEQ ID NO: 1193582 - protein, 9 aa, Homo Sapiens
EPATCPAVV

SEQ ID NO: 1193583 - protein, 9 aa, Homo Sapiens
KQRGKLLSH

SEQ ID NO: 1193584 - protein, 9 aa, Homo Sapiens
GGTTTGQAA

SEQ ID NO: 1193585 - protein, 9 aa, Homo Sapiens
GLHERRAAG

SEQ ID NO: 1193586 - protein, 9 aa, Homo Sapiens
RATLLFLIK

SEQ ID NO: 1193587 - protein, 9 aa, Homo Sapiens
KKMESCMCP

SEQ ID NO: 1193588 - protein, 9 aa, Homo Sapiens
RPPREARKQ

SEQ ID NO: 1193589 - protein, 9 aa, Homo Sapiens
AGHVCPWLQ

SEQ ID NO: 1193590 - protein, 9 aa, Homo Sapiens
PGRRRSRQS

SEQ ID NO: 1193591 - protein, 9 aa, Homo Sapiens
QLHVGYLVV

SEQ ID NO: 1193592 - protein, 9 aa, Homo Sapiens
GVWRRRTGP

SEQ ID NO: 1193593 - protein, 9 aa, Homo Sapiens
RHWQVCPQV

SEQ ID NO: 1193594 - protein, 9 aa, Homo Sapiens
VLAYGIYCC

SEQ ID NO: 1193595 - protein, 9 aa, Homo Sapiens
CSVDRTAER

SEQ ID NO: 1193596 - protein, 9 aa, Homo Sapiens
PRGAGRLRT

SEQ ID NO: 1193597 - protein, 9 aa, Homo Sapiens
WSTPCCKPM

SEQ ID NO: 1193598 - protein, 9 aa, Homo Sapiens
ARCCPGGLP

SEQ ID NO: 1193599 - protein, 9 aa, Homo Sapiens
VEDGSGGSP

SEQ ID NO: 1193600 - protein, 9 aa, Homo Sapiens
QIRTPSVQD

SEQ ID NO: 1193601 - protein, 9 aa, Homo Sapiens
KRSTARATS

SEQ ID NO: 1193602 - protein, 9 aa, Homo Sapiens
YCAELRWML

SEQ ID NO: 1193603 - protein, 9 aa, Homo Sapiens
SAGVVDQPE

SEQ ID NO: 1193604 - protein, 9 aa, Homo Sapiens
SSGDSSSSG

SEQ ID NO: 1193605 - protein, 9 aa, Homo Sapiens
AWGQPQMQH

SEQ ID NO: 1193606 - protein, 9 aa, Homo Sapiens
DCIWDWRKG

SEQ ID NO: 1193607 - protein, 9 aa, Homo Sapiens
HGQSPAQEI

SEQ ID NO: 1193608 - protein, 9 aa, Homo Sapiens
RCFYINSPT

SEQ ID NO: 1193609 - protein, 9 aa, Homo Sapiens
HLGQPHSCF

SEQ ID NO: 1193610 - protein, 9 aa, Homo Sapiens
QHLQHQTGF

SEQ ID NO: 1193611 - protein, 9 aa, Homo Sapiens
VMVEILVVE

SEQ ID NO: 1193612 - protein, 9 aa, Homo Sapiens
LTTSNDKCR

SEQ ID NO: 1193613 - protein, 9 aa, Homo Sapiens
VCEDLTDLT

SEQ ID NO: 1193614 - protein, 9 aa, Homo Sapiens
TILGRNLPG

SEQ ID NO: 1193615 - protein, 9 aa, Homo Sapiens
KIARDVAGV

SEQ ID NO: 1193616 - protein, 9 aa, Homo Sapiens
ARVDGPVET

SEQ ID NO: 1193617 - protein, 9 aa, Homo Sapiens
FVIVTVNLI

SEQ ID NO: 1193618 - protein, 9 aa, Homo Sapiens
RPLPGAAHS

SEQ ID NO: 1193619 - protein, 9 aa, Homo Sapiens
SALAMHKRT

SEQ ID NO: 1193620 - protein, 9 aa, Homo Sapiens
PVWSSRTLC

SEQ ID NO: 1193621 - protein, 9 aa, Homo Sapiens
GPQCPSGCA

SEQ ID NO: 1193622 - protein, 9 aa, Homo Sapiens
PPSRPSGRP

SEQ ID NO: 1193623 - protein, 9 aa, Homo Sapiens
KKWEELKKK

SEQ ID NO: 1193624 - protein, 9 aa, Homo Sapiens
EERTEASRS

SEQ ID NO: 1193625 - protein, 9 aa, Homo Sapiens
GRPRAGTRP

SEQ ID NO: 1193626 - protein, 9 aa, Homo Sapiens
LKIVIAVTT

SEQ ID NO: 1193627 - protein, 9 aa, Homo Sapiens
SFISSSSYS

SEQ ID NO: 1193628 - protein, 9 aa, Homo Sapiens
PGPQCPSGC

SEQ ID NO: 1193629 - protein, 9 aa, Homo Sapiens
DDRSVVTTA

SEQ ID NO: 1193630 - protein, 9 aa, Homo Sapiens
NGHIKARYL

SEQ ID NO: 1193631 - protein, 9 aa, Homo Sapiens
HQLHGKVGQ

SEQ ID NO: 1193632 - protein, 9 aa, Homo Sapiens
PILRWQRLR

SEQ ID NO: 1193633 - protein, 9 aa, Homo Sapiens
TCVCWPSFS

SEQ ID NO: 1193634 - protein, 9 aa, Homo Sapiens
PIESQMASK

SEQ ID NO: 1193635 - protein, 9 aa, Homo Sapiens
DFFRKKLKL

SEQ ID NO: 1193636 - protein, 9 aa, Homo Sapiens
EPPVPLLEH

SEQ ID NO: 1193637 - protein, 9 aa, Homo Sapiens
YHHPPGRQL

SEQ ID NO: 1193638 - protein, 9 aa, Homo Sapiens
RASRSRRWA

SEQ ID NO: 1193639 - protein, 9 aa, Homo Sapiens
PGCRLQRVG

SEQ ID NO: 1193640 - protein, 9 aa, Homo Sapiens
ANDRVPYDI

SEQ ID NO: 1193641 - protein, 9 aa, Homo Sapiens
LQLPEPILA

SEQ ID NO: 1193642 - protein, 9 aa, Homo Sapiens
GYLQRFSVR

SEQ ID NO: 1193643 - protein, 9 aa, Homo Sapiens
LWPKAFYPV

SEQ ID NO: 1193644 - protein, 9 aa, Homo Sapiens
YRKIQLEKE

SEQ ID NO: 1193645 - protein, 9 aa, Homo Sapiens
PPGLPLTHV

SEQ ID NO: 1193646 - protein, 9 aa, Homo Sapiens
ADVAKGQPG

SEQ ID NO: 1193647 - protein, 9 aa, Homo Sapiens
AAGEWTSLW

SEQ ID NO: 1193648 - protein, 9 aa, Homo Sapiens
VAGSGSRAA

SEQ ID NO: 1193649 - protein, 9 aa, Homo Sapiens
PAYYPGLSR

SEQ ID NO: 1193650 - protein, 9 aa, Homo Sapiens
PGLRARVWR

SEQ ID NO: 1193651 - protein, 9 aa, Homo Sapiens
EGLVWVSLP

SEQ ID NO: 1193652 - protein, 9 aa, Homo Sapiens
NGFEHGGLV

SEQ ID NO: 1193653 - protein, 9 aa, Homo Sapiens
LTSLALSMM

SEQ ID NO: 1193654 - protein, 9 aa, Homo Sapiens
CRRWPGCRG

SEQ ID NO: 1193655 - protein, 9 aa, Homo Sapiens
LHGKVGQCL

SEQ ID NO: 1193656 - protein, 9 aa, Homo Sapiens
GRPKGSKTR

SEQ ID NO: 1193657 - protein, 9 aa, Homo Sapiens
LNTAYVAIV

SEQ ID NO: 1193658 - protein, 9 aa, Homo Sapiens
LHLHFLKAV

SEQ ID NO: 1193659 - protein, 9 aa, Homo Sapiens
GATVSGERG

SEQ ID NO: 1193660 - protein, 9 aa, Homo Sapiens
KKSHSLSSV

SEQ ID NO: 1193661 - protein, 9 aa, Homo Sapiens
HPLRTVALA

SEQ ID NO: 1193662 - protein, 9 aa, Homo Sapiens
LLLIALPSL

SEQ ID NO: 1193663 - protein, 9 aa, Homo Sapiens
RPLEGECRQ

SEQ ID NO: 1193664 - protein, 9 aa, Homo Sapiens
NLQQSHLMG

SEQ ID NO: 1193665 - protein, 9 aa, Homo Sapiens
QRVGARPGR

SEQ ID NO: 1193666 - protein, 9 aa, Homo Sapiens
WQRIAQRLK

SEQ ID NO: 1193667 - protein, 9 aa, Homo Sapiens
PSDPHLLAT

SEQ ID NO: 1193668 - protein, 9 aa, Homo Sapiens
TLFKFFWFG

SEQ ID NO: 1193669 - protein, 9 aa, Homo Sapiens
NSLSGAQQQ

SEQ ID NO: 1193670 - protein, 9 aa, Homo Sapiens
QPFKDMVKS

SEQ ID NO: 1193671 - protein, 9 aa, Homo Sapiens
LYMSRIHGG

SEQ ID NO: 1193672 - protein, 9 aa, Homo Sapiens
LQLHAGRQG

SEQ ID NO: 1193673 - protein, 9 aa, Homo Sapiens
RRRPPREGP

SEQ ID NO: 1193674 - protein, 9 aa, Homo Sapiens
QLGDEGGRD

SEQ ID NO: 1193675 - protein, 9 aa, Homo Sapiens
WGWPVEVRL

SEQ ID NO: 1193676 - protein, 9 aa, Homo Sapiens
FLKVPPGWM

SEQ ID NO: 1193677 - protein, 9 aa, Homo Sapiens
ETTEISAVV

SEQ ID NO: 1193678 - protein, 9 aa, Homo Sapiens
EAKDCDPSS

SEQ ID NO: 1193679 - protein, 9 aa, Homo Sapiens
KDELSHQFQ

SEQ ID NO: 1193680 - protein, 9 aa, Homo Sapiens
TAAGGAGDE

SEQ ID NO: 1193681 - protein, 9 aa, Homo Sapiens
PHPGPRHPL

SEQ ID NO: 1193682 - protein, 9 aa, Homo Sapiens
GQAALVDAA

SEQ ID NO: 1193683 - protein, 9 aa, Homo Sapiens
HRLMGVDST

SEQ ID NO: 1193684 - protein, 9 aa, Homo Sapiens
TFQHPCNTL

SEQ ID NO: 1193685 - protein, 9 aa, Homo Sapiens
PDSSLGILP

SEQ ID NO: 1193686 - protein, 9 aa, Homo Sapiens
SPSHAHGLS

SEQ ID NO: 1193687 - protein, 9 aa, Homo Sapiens
CVPGRGGES

SEQ ID NO: 1193688 - protein, 9 aa, Homo Sapiens
YQTNANQLQ

SEQ ID NO: 1193689 - protein, 9 aa, Homo Sapiens
GGCEYLEDG

SEQ ID NO: 1193690 - protein, 9 aa, Homo Sapiens
SSGWRHIGI

SEQ ID NO: 1193691 - protein, 9 aa, Homo Sapiens
DCMPCVFLV

SEQ ID NO: 1193692 - protein, 9 aa, Homo Sapiens
SAAHGCAMR

SEQ ID NO: 1193693 - protein, 9 aa, Homo Sapiens
SSKSNSKNS

SEQ ID NO: 1193694 - protein, 9 aa, Homo Sapiens
GRQMGQGPL

SEQ ID NO: 1193695 - protein, 9 aa, Homo Sapiens
DRSHSGHCP

SEQ ID NO: 1193696 - protein, 9 aa, Homo Sapiens
DKKKEKGTA

SEQ ID NO: 1193697 - protein, 9 aa, Homo Sapiens
YEWEVTFLE

SEQ ID NO: 1193698 - protein, 9 aa, Homo Sapiens
NFALGVRIS

SEQ ID NO: 1193699 - protein, 9 aa, Homo Sapiens
DQEAARQAV

SEQ ID NO: 1193700 - protein, 9 aa, Homo Sapiens
RLTADMQAL

SEQ ID NO: 1193701 - protein, 9 aa, Homo Sapiens
CLCRAPPSR

SEQ ID NO: 1193702 - protein, 9 aa, Homo Sapiens
QVSAPTCAS

SEQ ID NO: 1193703 - protein, 9 aa, Homo Sapiens
VQVGGNWGW

SEQ ID NO: 1193704 - protein, 9 aa, Homo Sapiens
QLHLHFLKA

SEQ ID NO: 1193705 - protein, 9 aa, Homo Sapiens
SIQGKADIR

SEQ ID NO: 1193706 - protein, 9 aa, Homo Sapiens
GSAVESIKT

SEQ ID NO: 1193707 - protein, 9 aa, Homo Sapiens
CQTDAFLGR

SEQ ID NO: 1193708 - protein, 9 aa, Homo Sapiens
QHGVGPGGC

SEQ ID NO: 1193709 - protein, 9 aa, Homo Sapiens
PLWSRLSLL

SEQ ID NO: 1193710 - protein, 9 aa, Homo Sapiens
IPENILGKV

SEQ ID NO: 1193711 - protein, 9 aa, Homo Sapiens
RVGARRGLA

SEQ ID NO: 1193712 - protein, 9 aa, Homo Sapiens
TPEIYLAYQ

SEQ ID NO: 1193713 - protein, 9 aa, Homo Sapiens
HCPLLQRPS

SEQ ID NO: 1193714 - protein, 9 aa, Homo Sapiens
PGHSSHILC

SEQ ID NO: 1193715 - protein, 9 aa, Homo Sapiens
SPPTSCPPL

SEQ ID NO: 1193716 - protein, 9 aa, Homo Sapiens
GCLLTTVHP

SEQ ID NO: 1193717 - protein, 9 aa, Homo Sapiens
SHEAGGDLR

SEQ ID NO: 1193718 - protein, 9 aa, Homo Sapiens
RKKSHCLQD

SEQ ID NO: 1193719 - protein, 9 aa, Homo Sapiens
QRAARVDGP

SEQ ID NO: 1193720 - protein, 9 aa, Homo Sapiens
RNPRPGCGA

SEQ ID NO: 1193721 - protein, 9 aa, Homo Sapiens
SHSQVLCHV

SEQ ID NO: 1193722 - protein, 9 aa, Homo Sapiens
DGARTPGAS

SEQ ID NO: 1193723 - protein, 9 aa, Homo Sapiens
PGPGYLFRV

SEQ ID NO: 1193724 - protein, 9 aa, Homo Sapiens
WKVADLQPQ

SEQ ID NO: 1193725 - protein, 9 aa, Homo Sapiens
WAPRIKASS

SEQ ID NO: 1193726 - protein, 9 aa, Homo Sapiens
PSTAGEPPS

SEQ ID NO: 1193727 - protein, 9 aa, Homo Sapiens
TSTPSLVTN

SEQ ID NO: 1193728 - protein, 9 aa, Homo Sapiens
STHLLLLIA

SEQ ID NO: 1193729 - protein, 9 aa, Homo Sapiens
KYWANFACT

SEQ ID NO: 1193730 - protein, 9 aa, Homo Sapiens
APLESVRQI

SEQ ID NO: 1193731 - protein, 9 aa, Homo Sapiens
AITHLFGGI

SEQ ID NO: 1193732 - protein, 9 aa, Homo Sapiens
QGHLSHSVH

SEQ ID NO: 1193733 - protein, 9 aa, Homo Sapiens
IRHGQTLPL

SEQ ID NO: 1193734 - protein, 9 aa, Homo Sapiens
ITAVAKRSQ

SEQ ID NO: 1193735 - protein, 9 aa, Homo Sapiens
EMGPGPGLG

SEQ ID NO: 1193736 - protein, 9 aa, Homo Sapiens
APDVVLRLS

SEQ ID NO: 1193737 - protein, 9 aa, Homo Sapiens
SSAMAPEDH

SEQ ID NO: 1193738 - protein, 9 aa, Homo Sapiens
CPPGGAEER

SEQ ID NO: 1193739 - protein, 9 aa, Homo Sapiens
RGAGHKPPR

SEQ ID NO: 1193740 - protein, 9 aa, Homo Sapiens
PLLSCWHRY

SEQ ID NO: 1193741 - protein, 9 aa, Homo Sapiens
QPVRGHAHA

SEQ ID NO: 1193742 - protein, 9 aa, Homo Sapiens
ATSKFLRKC

SEQ ID NO: 1193743 - protein, 9 aa, Homo Sapiens
WIPAFMVEG

SEQ ID NO: 1193744 - protein, 9 aa, Homo Sapiens
GVGRCPPGP

SEQ ID NO: 1193745 - protein, 9 aa, Homo Sapiens
EATFVLRGT

SEQ ID NO: 1193746 - protein, 9 aa, Homo Sapiens
LPRHPRSPT

SEQ ID NO: 1193747 - protein, 9 aa, Homo Sapiens
APHLGQPHS

SEQ ID NO: 1193748 - protein, 9 aa, Homo Sapiens
QLDEYRDIA

SEQ ID NO: 1193749 - protein, 9 aa, Homo Sapiens
CRQGHRHHQ

SEQ ID NO: 1193750 - protein, 9 aa, Homo Sapiens
RLAEAVAAA

SEQ ID NO: 1193751 - protein, 9 aa, Homo Sapiens
ASPQSDWTV

SEQ ID NO: 1193752 - protein, 9 aa, Homo Sapiens
LFCLEHDIQ

SEQ ID NO: 1193753 - protein, 9 aa, Homo Sapiens
YDHSYLGSV

SEQ ID NO: 1193754 - protein, 9 aa, Homo Sapiens
QGSHLDILQ

SEQ ID NO: 1193755 - protein, 9 aa, Homo Sapiens
YLAYKRFHV

SEQ ID NO: 1193756 - protein, 9 aa, Homo Sapiens
QFQLSDIRW

SEQ ID NO: 1193757 - protein, 9 aa, Homo Sapiens
LPSLTSGLP

SEQ ID NO: 1193758 - protein, 9 aa, Homo Sapiens
TSTNCPMTT

SEQ ID NO: 1193759 - protein, 9 aa, Homo Sapiens
DEFLMGGCP

SEQ ID NO: 1193760 - protein, 9 aa, Homo Sapiens
ATPTLPATR

SEQ ID NO: 1193761 - protein, 9 aa, Homo Sapiens
GRQGASLAG

SEQ ID NO: 1193762 - protein, 9 aa, Homo Sapiens
CARTMVDKL

SEQ ID NO: 1193763 - protein, 9 aa, Homo Sapiens
RRRSFLRAG

SEQ ID NO: 1193764 - protein, 9 aa, Homo Sapiens
APVHSSGRL

SEQ ID NO: 1193765 - protein, 9 aa, Homo Sapiens
LPHGLWFLL

SEQ ID NO: 1193766 - protein, 9 aa, Homo Sapiens
NTFHTLTTY

SEQ ID NO: 1193767 - protein, 9 aa, Homo Sapiens
ERADATNVS

SEQ ID NO: 1193768 - protein, 9 aa, Homo Sapiens
SPCPFTTKT

SEQ ID NO: 1193769 - protein, 9 aa, Homo Sapiens
VRHPQCLCT

SEQ ID NO: 1193770 - protein, 9 aa, Homo Sapiens
LAAVSNKFQ

SEQ ID NO: 1193771 - protein, 9 aa, Homo Sapiens
ILWGHAGKA

SEQ ID NO: 1193772 - protein, 9 aa, Homo Sapiens
LDALHGPPR

SEQ ID NO: 1193773 - protein, 9 aa, Homo Sapiens
RRPMYHILR

SEQ ID NO: 1193774 - protein, 9 aa, Homo Sapiens
PAEDQPAGG

SEQ ID NO: 1193775 - protein, 9 aa, Homo Sapiens
RKQRLAPTT

SEQ ID NO: 1193776 - protein, 9 aa, Homo Sapiens
DSYTRIIQA

SEQ ID NO: 1193777 - protein, 9 aa, Homo Sapiens
GMVLLHCCE

SEQ ID NO: 1193778 - protein, 9 aa, Homo Sapiens
LCALIIQYQ

SEQ ID NO: 1193779 - protein, 9 aa, Homo Sapiens
LRPHRVTHT

SEQ ID NO: 1193780 - protein, 9 aa, Homo Sapiens
RSCPWLKCS

SEQ ID NO: 1193781 - protein, 9 aa, Homo Sapiens
RPGLGLGAR

SEQ ID NO: 1193782 - protein, 9 aa, Homo Sapiens
SGGCCSPAG

SEQ ID NO: 1193783 - protein, 9 aa, Homo Sapiens
FLLVSLAMF

SEQ ID NO: 1193784 - protein, 9 aa, Homo Sapiens
LHKLHLTLG

SEQ ID NO: 1193785 - protein, 9 aa, Homo Sapiens
FGYFGILLS

SEQ ID NO: 1193786 - protein, 9 aa, Homo Sapiens
LLQGSLVAD

SEQ ID NO: 1193787 - protein, 9 aa, Homo Sapiens
TGRPLSLSR

SEQ ID NO: 1193788 - protein, 9 aa, Homo Sapiens
HLVHQLHGK

SEQ ID NO: 1193789 - protein, 9 aa, Homo Sapiens
LLCMCFQPD

SEQ ID NO: 1193790 - protein, 9 aa, Homo Sapiens
VAETIFIKV

SEQ ID NO: 1193791 - protein, 9 aa, Homo Sapiens
VHPTTGPSG

SEQ ID NO: 1193792 - protein, 9 aa, Homo Sapiens
GKVIFTNYL

SEQ ID NO: 1193793 - protein, 9 aa, Homo Sapiens
MSMSLPSGI

SEQ ID NO: 1193794 - protein, 9 aa, Homo Sapiens
ATSCLERTA

SEQ ID NO: 1193795 - protein, 9 aa, Homo Sapiens
QRGPRPLHR

SEQ ID NO: 1193796 - protein, 9 aa, Homo Sapiens
DIGKQSTCA

SEQ ID NO: 1193797 - protein, 9 aa, Homo Sapiens
GPCCSRGAT

SEQ ID NO: 1193798 - protein, 9 aa, Homo Sapiens
AAGPQGPPH

SEQ ID NO: 1193799 - protein, 9 aa, Homo Sapiens
VVMKVKKEI

SEQ ID NO: 1193800 - protein, 9 aa, Homo Sapiens
HPYEITLLN

SEQ ID NO: 1193801 - protein, 9 aa, Homo Sapiens
QPSSCPPAW

SEQ ID NO: 1193802 - protein, 9 aa, Homo Sapiens
ANSLSGAQQ

SEQ ID NO: 1193803 - protein, 9 aa, Homo Sapiens
KELWEQKKL

SEQ ID NO: 1193804 - protein, 9 aa, Homo Sapiens
VVVRVYRPL

SEQ ID NO: 1193805 - protein, 9 aa, Homo Sapiens
LWECGWSPV

SEQ ID NO: 1193806 - protein, 9 aa, Homo Sapiens
REENKVCAV

SEQ ID NO: 1193807 - protein, 9 aa, Homo Sapiens
GHARVYAGR

SEQ ID NO: 1193808 - protein, 9 aa, Homo Sapiens
VTSSNTGMP

SEQ ID NO: 1193809 - protein, 9 aa, Homo Sapiens
QVIQCVFHF

SEQ ID NO: 1193810 - protein, 9 aa, Homo Sapiens
GIYTYIAVN

SEQ ID NO: 1193811 - protein, 9 aa, Homo Sapiens
QCVGHYNEV

SEQ ID NO: 1193812 - protein, 9 aa, Homo Sapiens
ISKMFLTVI

SEQ ID NO: 1193813 - protein, 9 aa, Homo Sapiens
MKGAQSRSL

SEQ ID NO: 1193814 - protein, 9 aa, Homo Sapiens
VMNPNVLME

SEQ ID NO: 1193815 - protein, 9 aa, Homo Sapiens
RAVAAFVLA

SEQ ID NO: 1193816 - protein, 9 aa, Homo Sapiens
SGRPRPDPA

SEQ ID NO: 1193817 - protein, 9 aa, Homo Sapiens
IRFTVRTCV

SEQ ID NO: 1193818 - protein, 9 aa, Homo Sapiens
AAVAGSGSR

SEQ ID NO: 1193819 - protein, 9 aa, Homo Sapiens
ANQPVVSTV

SEQ ID NO: 1193820 - protein, 9 aa, Homo Sapiens
VIQCVFHFS

SEQ ID NO: 1193821 - protein, 9 aa, Homo Sapiens
IKCRICGDK

SEQ ID NO: 1193822 - protein, 9 aa, Homo Sapiens
PCLTHCTFW

SEQ ID NO: 1193823 - protein, 9 aa, Homo Sapiens
RCAAEKCLA

SEQ ID NO: 1193824 - protein, 9 aa, Homo Sapiens
EFVRESDCS

SEQ ID NO: 1193825 - protein, 9 aa, Homo Sapiens
ELSLFSRMS

SEQ ID NO: 1193826 - protein, 9 aa, Homo Sapiens
RPGVGPCKL

SEQ ID NO: 1193827 - protein, 9 aa, Homo Sapiens
AFADLHALR

SEQ ID NO: 1193828 - protein, 9 aa, Homo Sapiens
RLTILLPGH

SEQ ID NO: 1193829 - protein, 9 aa, Homo Sapiens
HVAASLHNT

SEQ ID NO: 1193830 - protein, 9 aa, Homo Sapiens
FIRETEEIA

SEQ ID NO: 1193831 - protein, 9 aa, Homo Sapiens
CQQTEARVQ

SEQ ID NO: 1193832 - protein, 9 aa, Homo Sapiens
SHSGHCPLQ

SEQ ID NO: 1193833 - protein, 9 aa, Homo Sapiens
KKGIRPTYS

SEQ ID NO: 1193834 - protein, 9 aa, Homo Sapiens
STSQSPQLR

SEQ ID NO: 1193835 - protein, 9 aa, Homo Sapiens
LSAGVVDQP

SEQ ID NO: 1193836 - protein, 9 aa, Homo Sapiens
MMMVDPLVL

SEQ ID NO: 1193837 - protein, 9 aa, Homo Sapiens
AAGATPTGP

SEQ ID NO: 1193838 - protein, 9 aa, Homo Sapiens
NKKEHRVQH

SEQ ID NO: 1193839 - protein, 9 aa, Homo Sapiens
SSCLCFIYV

SEQ ID NO: 1193840 - protein, 9 aa, Homo Sapiens
HLLPGQALD

SEQ ID NO: 1193841 - protein, 9 aa, Homo Sapiens
LLDAHFDHK

SEQ ID NO: 1193842 - protein, 9 aa, Homo Sapiens
AVHLQDLVI

SEQ ID NO: 1193843 - protein, 9 aa, Homo Sapiens
AVEAPPQTR

SEQ ID NO: 1193844 - protein, 9 aa, Homo Sapiens
GCAAGPKAS

SEQ ID NO: 1193845 - protein, 9 aa, Homo Sapiens
TFCQKFSFA

SEQ ID NO: 1193846 - protein, 9 aa, Homo Sapiens
KVSERAGGQ

SEQ ID NO: 1193847 - protein, 9 aa, Homo Sapiens
GRDRAQGGE

SEQ ID NO: 1193848 - protein, 9 aa, Homo Sapiens
ALEAHPFFP

SEQ ID NO: 1193849 - protein, 9 aa, Homo Sapiens
KQSTCAPGA

SEQ ID NO: 1193850 - protein, 9 aa, Homo Sapiens
TTSRKSRPC

SEQ ID NO: 1193851 - protein, 9 aa, Homo Sapiens
WHPGRRRAR

SEQ ID NO: 1193852 - protein, 9 aa, Homo Sapiens
QTGTPRSPC

SEQ ID NO: 1193853 - protein, 9 aa, Homo Sapiens
EIQGEIGIS

SEQ ID NO: 1193854 - protein, 9 aa, Homo Sapiens
RSQQAGFCC

SEQ ID NO: 1193855 - protein, 9 aa, Homo Sapiens
NGHNKLFRR

SEQ ID NO: 1193856 - protein, 9 aa, Homo Sapiens
SFIYFILLI

SEQ ID NO: 1193857 - protein, 9 aa, Homo Sapiens
GWQQSWEIV

SEQ ID NO: 1193858 - protein, 9 aa, Homo Sapiens
NIFNQSADI

SEQ ID NO: 1193859 - protein, 9 aa, Homo Sapiens
PLRPSHSSP

SEQ ID NO: 1193860 - protein, 9 aa, Homo Sapiens
VYDLCVCGP

SEQ ID NO: 1193861 - protein, 9 aa, Homo Sapiens
VSHDSARVF

SEQ ID NO: 1193862 - protein, 9 aa, Homo Sapiens
WRQPPGKRS

SEQ ID NO: 1193863 - protein, 9 aa, Homo Sapiens
GTTRMRHRV

SEQ ID NO: 1193864 - protein, 9 aa, Homo Sapiens
SHLMGPGFP

SEQ ID NO: 1193865 - protein, 9 aa, Homo Sapiens
PRLKSEGGV

SEQ ID NO: 1193866 - protein, 9 aa, Homo Sapiens
RTFHGDYFA

SEQ ID NO: 1193867 - protein, 9 aa, Homo Sapiens
ITMPLAMFC

SEQ ID NO: 1193868 - protein, 9 aa, Homo Sapiens
QDAEWQHSP

SEQ ID NO: 1193869 - protein, 9 aa, Homo Sapiens
PVHLVACSR

SEQ ID NO: 1193870 - protein, 9 aa, Homo Sapiens
SLRCAAEKC

SEQ ID NO: 1193871 - protein, 9 aa, Homo Sapiens
ATWAPCMPW

SEQ ID NO: 1193872 - protein, 9 aa, Homo Sapiens
MPLVAFMLP

SEQ ID NO: 1193873 - protein, 9 aa, Homo Sapiens
NGTGRRARA

SEQ ID NO: 1193874 - protein, 9 aa, Homo Sapiens
LQHGVGPGG

SEQ ID NO: 1193875 - protein, 9 aa, Homo Sapiens
DDSQNVIDH

SEQ ID NO: 1193876 - protein, 9 aa, Homo Sapiens
HLWLSHRLR

SEQ ID NO: 1193877 - protein, 9 aa, Homo Sapiens
RRRPKKMNT

SEQ ID NO: 1193878 - protein, 9 aa, Homo Sapiens
LLCKRKIFL

SEQ ID NO: 1193879 - protein, 9 aa, Homo Sapiens
TFQKWAAVL

SEQ ID NO: 1193880 - protein, 9 aa, Homo Sapiens
PSPPVPLGP

SEQ ID NO: 1193881 - protein, 9 aa, Homo Sapiens
GFSDVSHDS

SEQ ID NO: 1193882 - protein, 9 aa, Homo Sapiens
CFAKCKHRH

SEQ ID NO: 1193883 - protein, 9 aa, Homo Sapiens
LEVTLIPVL

SEQ ID NO: 1193884 - protein, 9 aa, Homo Sapiens
PTFTFSAVA

SEQ ID NO: 1193885 - protein, 9 aa, Homo Sapiens
PLGPGAQQP

SEQ ID NO: 1193886 - protein, 9 aa, Homo Sapiens
NKADIPECK

SEQ ID NO: 1193887 - protein, 9 aa, Homo Sapiens
APWPGLPGD

SEQ ID NO: 1193888 - protein, 9 aa, Homo Sapiens
KHRHLRFPP

SEQ ID NO: 1193889 - protein, 9 aa, Homo Sapiens
LSHLPPRTK

SEQ ID NO: 1193890 - protein, 9 aa, Homo Sapiens
RQIYSEHNY

SEQ ID NO: 1193891 - protein, 9 aa, Homo Sapiens
SQQENRRRA

SEQ ID NO: 1193892 - protein, 9 aa, Homo Sapiens
RDVQGQAVL

SEQ ID NO: 1193893 - protein, 9 aa, Homo Sapiens
ILKTENIRE

SEQ ID NO: 1193894 - protein, 9 aa, Homo Sapiens
LHAGRQGAS

SEQ ID NO: 1193895 - protein, 9 aa, Homo Sapiens
SPLTGSKVW

SEQ ID NO: 1193896 - protein, 9 aa, Homo Sapiens
IAAFIIIHT

SEQ ID NO: 1193897 - protein, 9 aa, Homo Sapiens
GLVENGGLG

SEQ ID NO: 1193898 - protein, 9 aa, Homo Sapiens
PGAKAAASG

SEQ ID NO: 1193899 - protein, 9 aa, Homo Sapiens
HTFAVKLEG

SEQ ID NO: 1193900 - protein, 9 aa, Homo Sapiens
TGIPRLPQW

SEQ ID NO: 1193901 - protein, 9 aa, Homo Sapiens
GIPPTSRGS

SEQ ID NO: 1193902 - protein, 9 aa, Homo Sapiens
HVPPQTGQA

SEQ ID NO: 1193903 - protein, 9 aa, Homo Sapiens
SCFPFRWRV

SEQ ID NO: 1193904 - protein, 9 aa, Homo Sapiens
SPQQQPPQQ

SEQ ID NO: 1193905 - protein, 9 aa, Homo Sapiens
SCLERTAWS

SEQ ID NO: 1193906 - protein, 9 aa, Homo Sapiens
GSAVLRAVG

SEQ ID NO: 1193907 - protein, 9 aa, Homo Sapiens
AALGQQRQP

SEQ ID NO: 1193908 - protein, 9 aa, Homo Sapiens
PVPGLPLPA

SEQ ID NO: 1193909 - protein, 9 aa, Homo Sapiens
PGVGPGPHA

SEQ ID NO: 1193910 - protein, 9 aa, Homo Sapiens
KQYFVVLIW

SEQ ID NO: 1193911 - protein, 9 aa, Homo Sapiens
DDPGPTGCF

SEQ ID NO: 1193912 - protein, 9 aa, Homo Sapiens
EGAGVGEHE

SEQ ID NO: 1193913 - protein, 9 aa, Homo Sapiens
EEQLGDEGG

SEQ ID NO: 1193914 - protein, 9 aa, Homo Sapiens
AEKCLASTA

SEQ ID NO: 1193915 - protein, 9 aa, Homo Sapiens
FLIEPTVDV

SEQ ID NO: 1193916 - protein, 9 aa, Homo Sapiens
LWFLLKSTH

SEQ ID NO: 1193917 - protein, 9 aa, Homo Sapiens
ISGMNFVQD

SEQ ID NO: 1193918 - protein, 9 aa, Homo Sapiens
VRCMFGIRY

SEQ ID NO: 1193919 - protein, 9 aa, Homo Sapiens
ELHGDAEVV

SEQ ID NO: 1193920 - protein, 9 aa, Homo Sapiens
SMMTSWHRP

SEQ ID NO: 1193921 - protein, 9 aa, Homo Sapiens
APGHPGVGP

SEQ ID NO: 1193922 - protein, 9 aa, Homo Sapiens
ADMGAYGMQ

SEQ ID NO: 1193923 - protein, 9 aa, Homo Sapiens
SLPCLKIVI

SEQ ID NO: 1193924 - protein, 9 aa, Homo Sapiens
RKIKYPKLL

SEQ ID NO: 1193925 - protein, 9 aa, Homo Sapiens
TSADPRQRR

SEQ ID NO: 1193926 - protein, 9 aa, Homo Sapiens
APFLRPCHL

SEQ ID NO: 1193927 - protein, 9 aa, Homo Sapiens
PRPERSSSS

SEQ ID NO: 1193928 - protein, 9 aa, Homo Sapiens
VVRVYRPLP

SEQ ID NO: 1193929 - protein, 9 aa, Homo Sapiens
FSLSSSCLC

SEQ ID NO: 1193930 - protein, 9 aa, Homo Sapiens
PHTAPAALD

SEQ ID NO: 1193931 - protein, 9 aa, Homo Sapiens
TYAPFPGKN

SEQ ID NO: 1193932 - protein, 9 aa, Homo Sapiens
VLLVAVALA

SEQ ID NO: 1193933 - protein, 9 aa, Homo Sapiens
PLLKKLLKW

SEQ ID NO: 1193934 - protein, 9 aa, Homo Sapiens
GRPGVPLVR

SEQ ID NO: 1193935 - protein, 9 aa, Homo Sapiens
KASSWASVG

SEQ ID NO: 1193936 - protein, 9 aa, Homo Sapiens
SCGQVIIIS

SEQ ID NO: 1193937 - protein, 9 aa, Homo Sapiens
DVKVVPRLS

SEQ ID NO: 1193938 - protein, 9 aa, Homo Sapiens
CPRPLGLAD

SEQ ID NO: 1193939 - protein, 9 aa, Homo Sapiens
DRYTDAGTV

SEQ ID NO: 1193940 - protein, 9 aa, Homo Sapiens
EEPSHEGLS

SEQ ID NO: 1193941 - protein, 9 aa, Homo Sapiens
FSFRRRLGQ

SEQ ID NO: 1193942 - protein, 9 aa, Homo Sapiens
QEQIAESYC

SEQ ID NO: 1193943 - protein, 9 aa, Homo Sapiens
RMKWKKELW

SEQ ID NO: 1193944 - protein, 9 aa, Homo Sapiens
LEVAVFMPA

SEQ ID NO: 1193945 - protein, 9 aa, Homo Sapiens
TRLPTKKKP

SEQ ID NO: 1193946 - protein, 9 aa, Homo Sapiens
HTHRYEAAN

SEQ ID NO: 1193947 - protein, 9 aa, Homo Sapiens
VWRGAGTGL

SEQ ID NO: 1193948 - protein, 9 aa, Homo Sapiens
AHSLVTVMA

SEQ ID NO: 1193949 - protein, 9 aa, Homo Sapiens
TRPEAPAPG

SEQ ID NO: 1193950 - protein, 9 aa, Homo Sapiens
GTTKKGIRP

SEQ ID NO: 1193951 - protein, 9 aa, Homo Sapiens
AKKSLWECG

SEQ ID NO: 1193952 - protein, 9 aa, Homo Sapiens
QSLPSLLSR

SEQ ID NO: 1193953 - protein, 9 aa, Homo Sapiens
PCCQAPCWT

SEQ ID NO: 1193954 - protein, 9 aa, Homo Sapiens
MTKKSISLT

SEQ ID NO: 1193955 - protein, 9 aa, Homo Sapiens
GPARAVTPH

SEQ ID NO: 1193956 - protein, 9 aa, Homo Sapiens
QRGRAPAPL

SEQ ID NO: 1193957 - protein, 9 aa, Homo Sapiens
WTIRHCTLT

SEQ ID NO: 1193958 - protein, 9 aa, Homo Sapiens
LVENGGLGW

SEQ ID NO: 1193959 - protein, 9 aa, Homo Sapiens
LMNMLVLGK

SEQ ID NO: 1193960 - protein, 9 aa, Homo Sapiens
CSTKQLVSL

SEQ ID NO: 1193961 - protein, 9 aa, Homo Sapiens
ANSLQLKIR

SEQ ID NO: 1193962 - protein, 9 aa, Homo Sapiens
PCALKCRAQ

SEQ ID NO: 1193963 - protein, 9 aa, Homo Sapiens
GWKSCGMAS

SEQ ID NO: 1193964 - protein, 9 aa, Homo Sapiens
ALSPAPLLA

SEQ ID NO: 1193965 - protein, 9 aa, Homo Sapiens
QALGWPGLK

SEQ ID NO: 1193966 - protein, 9 aa, Homo Sapiens
HDPMTLLAR

SEQ ID NO: 1193967 - protein, 9 aa, Homo Sapiens
VVVLCTPGL

SEQ ID NO: 1193968 - protein, 9 aa, Homo Sapiens
TLDMISKCV

SEQ ID NO: 1193969 - protein, 9 aa, Homo Sapiens
GGGRRGAPG

SEQ ID NO: 1193970 - protein, 9 aa, Homo Sapiens
PLDLTLHLL

SEQ ID NO: 1193971 - protein, 9 aa, Homo Sapiens
PPRLLAPFL

SEQ ID NO: 1193972 - protein, 9 aa, Homo Sapiens
CTVPNVRLQ

SEQ ID NO: 1193973 - protein, 9 aa, Homo Sapiens
SLTSGLPHG

SEQ ID NO: 1193974 - protein, 9 aa, Homo Sapiens
SDLLEWIRH

SEQ ID NO: 1193975 - protein, 9 aa, Homo Sapiens
RLSQQNEEP

SEQ ID NO: 1193976 - protein, 9 aa, Homo Sapiens
DIPECKKSS

SEQ ID NO: 1193977 - protein, 9 aa, Homo Sapiens
ARRACGQRR

SEQ ID NO: 1193978 - protein, 9 aa, Homo Sapiens
DIKVYTDRF

SEQ ID NO: 1193979 - protein, 9 aa, Homo Sapiens
QVPELHGDA

SEQ ID NO: 1193980 - protein, 9 aa, Homo Sapiens
FGILLSREG

SEQ ID NO: 1193981 - protein, 9 aa, Homo Sapiens
VVILQLRNK

SEQ ID NO: 1193982 - protein, 9 aa, Homo Sapiens
LPGQALDRA

SEQ ID NO: 1193983 - protein, 9 aa, Homo Sapiens
HLHPSPALC

SEQ ID NO: 1193984 - protein, 9 aa, Homo Sapiens
LGLGRVLRP

SEQ ID NO: 1193985 - protein, 9 aa, Homo Sapiens
CPQAPHQPA

SEQ ID NO: 1193986 - protein, 9 aa, Homo Sapiens
VAQSPQQQP

SEQ ID NO: 1193987 - protein, 9 aa, Homo Sapiens
RSSNRNSIE

SEQ ID NO: 1193988 - protein, 9 aa, Homo Sapiens
QQLNSAAPQ

SEQ ID NO: 1193989 - protein, 9 aa, Homo Sapiens
NLIKLCQLS

SEQ ID NO: 1193990 - protein, 9 aa, Homo Sapiens
QGFGDVGLH

SEQ ID NO: 1193991 - protein, 9 aa, Homo Sapiens
SVSIFLYGH

SEQ ID NO: 1193992 - protein, 9 aa, Homo Sapiens
YRHQNGTED

SEQ ID NO: 1193993 - protein, 9 aa, Homo Sapiens
QEENNVVEK

SEQ ID NO: 1193994 - protein, 9 aa, Homo Sapiens
PPLPPGCRL

SEQ ID NO: 1193995 - protein, 9 aa, Homo Sapiens
VFHKKNRRE

SEQ ID NO: 1193996 - protein, 9 aa, Homo Sapiens
VIAVTTSSL

SEQ ID NO: 1193997 - protein, 9 aa, Homo Sapiens
SRPLPGAAH

SEQ ID NO: 1193998 - protein, 9 aa, Homo Sapiens
PHQPALSWG

SEQ ID NO: 1193999 - protein, 9 aa, Homo Sapiens
GRGGESGSS

SEQ ID NO: 1194000 - protein, 9 aa, Homo Sapiens
QAPGYHARD

SEQ ID NO: 1194001 - protein, 9 aa, Homo Sapiens
PRLPLRPQR

SEQ ID NO: 1194002 - protein, 9 aa, Homo Sapiens
VSFIFQNIA

SEQ ID NO: 1194003 - protein, 9 aa, Homo Sapiens
LRRKLKRHP

SEQ ID NO: 1194004 - protein, 9 aa, Homo Sapiens
KVADLQPQL

SEQ ID NO: 1194005 - protein, 9 aa, Homo Sapiens
HNGESRHAY

SEQ ID NO: 1194006 - protein, 9 aa, Homo Sapiens
LDLSLNFGR

SEQ ID NO: 1194007 - protein, 9 aa, Homo Sapiens
RPRVTPAPP

SEQ ID NO: 1194008 - protein, 9 aa, Homo Sapiens
VENGGLGWW

SEQ ID NO: 1194009 - protein, 9 aa, Homo Sapiens
RSLPLRQIL

SEQ ID NO: 1194010 - protein, 9 aa, Homo Sapiens
PLRCAVEKN

SEQ ID NO: 1194011 - protein, 9 aa, Homo Sapiens
SLARGSQRL

SEQ ID NO: 1194012 - protein, 9 aa, Homo Sapiens
ACINGHRDR

SEQ ID NO: 1194013 - protein, 9 aa, Homo Sapiens
GDEKGVEVI

SEQ ID NO: 1194014 - protein, 9 aa, Homo Sapiens
DALAQFGEG

SEQ ID NO: 1194015 - protein, 9 aa, Homo Sapiens
PGHPGVGPG

SEQ ID NO: 1194016 - protein, 9 aa, Homo Sapiens
CAPRPRRSE

SEQ ID NO: 1194017 - protein, 9 aa, Homo Sapiens
RKQCVGHYN

SEQ ID NO: 1194018 - protein, 9 aa, Homo Sapiens
IHHFFCRVL

SEQ ID NO: 1194019 - protein, 9 aa, Homo Sapiens
TTRVKKVWS

SEQ ID NO: 1194020 - protein, 9 aa, Homo Sapiens
QAKAVAWSR

SEQ ID NO: 1194021 - protein, 9 aa, Homo Sapiens
IIPASTGAV

SEQ ID NO: 1194022 - protein, 9 aa, Homo Sapiens
CVYDLCVCG

SEQ ID NO: 1194023 - protein, 9 aa, Homo Sapiens
PPQTGQAPA

SEQ ID NO: 1194024 - protein, 9 aa, Homo Sapiens
STGPTRPPT

SEQ ID NO: 1194025 - protein, 9 aa, Homo Sapiens
RLGIAVRHP

SEQ ID NO: 1194026 - protein, 9 aa, Homo Sapiens
GDFQPFVKD

SEQ ID NO: 1194027 - protein, 9 aa, Homo Sapiens
PQQPPPRLP

SEQ ID NO: 1194028 - protein, 9 aa, Homo Sapiens
RGKSQGGRI

SEQ ID NO: 1194029 - protein, 9 aa, Homo Sapiens
VHPSADEFH

SEQ ID NO: 1194030 - protein, 9 aa, Homo Sapiens
LRRLGVGAA

SEQ ID NO: 1194031 - protein, 9 aa, Homo Sapiens
PERSSSSPQ

SEQ ID NO: 1194032 - protein, 9 aa, Homo Sapiens
RSRWRHPLP

SEQ ID NO: 1194033 - protein, 9 aa, Homo Sapiens
LRPPTLWTL

SEQ ID NO: 1194034 - protein, 9 aa, Homo Sapiens
DETNDDNNE

SEQ ID NO: 1194035 - protein, 9 aa, Homo Sapiens
LLHSLGTTG

SEQ ID NO: 1194036 - protein, 9 aa, Homo Sapiens
VDFFRPPEE

SEQ ID NO: 1194037 - protein, 9 aa, Homo Sapiens
EEEVSNMGN

SEQ ID NO: 1194038 - protein, 9 aa, Homo Sapiens
LERTAWSWC

SEQ ID NO: 1194039 - protein, 9 aa, Homo Sapiens
SLQLKIRLS

SEQ ID NO: 1194040 - protein, 9 aa, Homo Sapiens
DEDAGHLLQ

SEQ ID NO: 1194041 - protein, 9 aa, Homo Sapiens
YFGILLSRE

SEQ ID NO: 1194042 - protein, 9 aa, Homo Sapiens
LRQAPGYHA

SEQ ID NO: 1194043 - protein, 9 aa, Homo Sapiens
KERYMQETR

SEQ ID NO: 1194044 - protein, 9 aa, Homo Sapiens
GRGGRPRRA

SEQ ID NO: 1194045 - protein, 9 aa, Homo Sapiens
GASHQRGRP

SEQ ID NO: 1194046 - protein, 9 aa, Homo Sapiens
KFLKIMFSC

SEQ ID NO: 1194047 - protein, 9 aa, Homo Sapiens
HLPEHIFDG

SEQ ID NO: 1194048 - protein, 9 aa, Homo Sapiens
SAMAPEDHG

SEQ ID NO: 1194049 - protein, 9 aa, Homo Sapiens
LSWGKWPVG

SEQ ID NO: 1194050 - protein, 9 aa, Homo Sapiens
MWQGEEVFQ

SEQ ID NO: 1194051 - protein, 9 aa, Homo Sapiens
QQLLQQAQT

SEQ ID NO: 1194052 - protein, 9 aa, Homo Sapiens
LTKASILKD

SEQ ID NO: 1194053 - protein, 9 aa, Homo Sapiens
VAFVLGHHK

SEQ ID NO: 1194054 - protein, 9 aa, Homo Sapiens
SPQLRGHAQ

SEQ ID NO: 1194055 - protein, 9 aa, Homo Sapiens
HPEIVVHMD

SEQ ID NO: 1194056 - protein, 9 aa, Homo Sapiens
REFGDAELI

SEQ ID NO: 1194057 - protein, 9 aa, Homo Sapiens
RPSHSSPLP

SEQ ID NO: 1194058 - protein, 9 aa, Homo Sapiens
HVSFCATHM

SEQ ID NO: 1194059 - protein, 9 aa, Homo Sapiens
AGNNSKPVQ

SEQ ID NO: 1194060 - protein, 9 aa, Homo Sapiens
HFVKPDTGF

SEQ ID NO: 1194061 - protein, 9 aa, Homo Sapiens
AKVGQLFAV

SEQ ID NO: 1194062 - protein, 9 aa, Homo Sapiens
GKAQEDPKP

SEQ ID NO: 1194063 - protein, 9 aa, Homo Sapiens
ELLWDILQK

SEQ ID NO: 1194064 - protein, 9 aa, Homo Sapiens
HVTNSLVDL

SEQ ID NO: 1194065 - protein, 9 aa, Homo Sapiens
KTLTSSVTS

SEQ ID NO: 1194066 - protein, 9 aa, Homo Sapiens
PGHMSELLP

SEQ ID NO: 1194067 - protein, 9 aa, Homo Sapiens
IFRVNTPVL

SEQ ID NO: 1194068 - protein, 9 aa, Homo Sapiens
PVQPHSPVR

SEQ ID NO: 1194069 - protein, 9 aa, Homo Sapiens
APRIKASSM

SEQ ID NO: 1194070 - protein, 9 aa, Homo Sapiens
QKYLSMQDR

SEQ ID NO: 1194071 - protein, 9 aa, Homo Sapiens
GSCCKNRTG

SEQ ID NO: 1194072 - protein, 9 aa, Homo Sapiens
RPLPCPPRV

SEQ ID NO: 1194073 - protein, 9 aa, Homo Sapiens
AHALPKHLA

SEQ ID NO: 1194074 - protein, 9 aa, Homo Sapiens
SAPAEATSW

SEQ ID NO: 1194075 - protein, 9 aa, Homo Sapiens
PAGYFALGA

SEQ ID NO: 1194076 - protein, 9 aa, Homo Sapiens
QWDPSFNCS

SEQ ID NO: 1194077 - protein, 9 aa, Homo Sapiens
MAPTIDWLS

SEQ ID NO: 1194078 - protein, 9 aa, Homo Sapiens
VFSMLPWQF

SEQ ID NO: 1194079 - protein, 9 aa, Homo Sapiens
KKNMKKKRI

SEQ ID NO: 1194080 - protein, 9 aa, Homo Sapiens
RRSRRGRGA

SEQ ID NO: 1194081 - protein, 9 aa, Homo Sapiens
GPERQLCGG

SEQ ID NO: 1194082 - protein, 9 aa, Homo Sapiens
QLRIWLPSV

SEQ ID NO: 1194083 - protein, 9 aa, Homo Sapiens
GRTRLPTKK

SEQ ID NO: 1194084 - protein, 9 aa, Homo Sapiens
CDSHPHPPQ

SEQ ID NO: 1194085 - protein, 9 aa, Homo Sapiens
AGGAAAARA

SEQ ID NO: 1194086 - protein, 9 aa, Homo Sapiens
FQYGVKVIL

SEQ ID NO: 1194087 - protein, 9 aa, Homo Sapiens
SRQSGATGT

SEQ ID NO: 1194088 - protein, 9 aa, Homo Sapiens
VPRHSSVLA

SEQ ID NO: 1194089 - protein, 9 aa, Homo Sapiens
YSSGLRPCL

SEQ ID NO: 1194090 - protein, 9 aa, Homo Sapiens
DRNQPSFDG

SEQ ID NO: 1194091 - protein, 9 aa, Homo Sapiens
GLPCPRTTW

SEQ ID NO: 1194092 - protein, 9 aa, Homo Sapiens
PWGWLGTQL

SEQ ID NO: 1194093 - protein, 9 aa, Homo Sapiens
TNANQLQKL

SEQ ID NO: 1194094 - protein, 9 aa, Homo Sapiens
PYGILLHLQ

SEQ ID NO: 1194095 - protein, 9 aa, Homo Sapiens
LFYHAKTGR

SEQ ID NO: 1194096 - protein, 9 aa, Homo Sapiens
ACPQTSKVA

SEQ ID NO: 1194097 - protein, 9 aa, Homo Sapiens
LLVVVLCTP

SEQ ID NO: 1194098 - protein, 9 aa, Homo Sapiens
LQIDSARLA

SEQ ID NO: 1194099 - protein, 9 aa, Homo Sapiens
VPDRGAAQM

SEQ ID NO: 1194100 - protein, 9 aa, Homo Sapiens
LRFVVYDLA

SEQ ID NO: 1194101 - protein, 9 aa, Homo Sapiens
CLKTSCFKL

SEQ ID NO: 1194102 - protein, 9 aa, Homo Sapiens
STMGYGYIY

SEQ ID NO: 1194103 - protein, 9 aa, Homo Sapiens
NRSTNHGLE

SEQ ID NO: 1194104 - protein, 9 aa, Homo Sapiens
EMPASLCMV

SEQ ID NO: 1194105 - protein, 9 aa, Homo Sapiens
WNEDGAICR

SEQ ID NO: 1194106 - protein, 9 aa, Homo Sapiens
HLEVVEGVL

SEQ ID NO: 1194107 - protein, 9 aa, Homo Sapiens
SKLHQRGQS

SEQ ID NO: 1194108 - protein, 9 aa, Homo Sapiens
GHAHAGAIA

SEQ ID NO: 1194109 - protein, 9 aa, Homo Sapiens
AHRAGPALP

SEQ ID NO: 1194110 - protein, 9 aa, Homo Sapiens
EDLIAWLSS

SEQ ID NO: 1194111 - protein, 9 aa, Homo Sapiens
EQAAEGGHV

SEQ ID NO: 1194112 - protein, 9 aa, Homo Sapiens
MTSDTRLSQ

SEQ ID NO: 1194113 - protein, 9 aa, Homo Sapiens
RGCRTGPCC

SEQ ID NO: 1194114 - protein, 9 aa, Homo Sapiens
YREPGCEKW

SEQ ID NO: 1194115 - protein, 9 aa, Homo Sapiens
CDRSSSMGH

SEQ ID NO: 1194116 - protein, 9 aa, Homo Sapiens
RDTLTMSED

SEQ ID NO: 1194117 - protein, 9 aa, Homo Sapiens
RIIEAILNH

SEQ ID NO: 1194118 - protein, 9 aa, Homo Sapiens
LVVGRVVEA

SEQ ID NO: 1194119 - protein, 9 aa, Homo Sapiens
GTDADGVWP

SEQ ID NO: 1194120 - protein, 9 aa, Homo Sapiens
RARRACGQR

SEQ ID NO: 1194121 - protein, 9 aa, Homo Sapiens
AGALGTPAT

SEQ ID NO: 1194122 - protein, 9 aa, Homo Sapiens
CRVDERPVG

SEQ ID NO: 1194123 - protein, 9 aa, Homo Sapiens
DAVTHTEHA

SEQ ID NO: 1194124 - protein, 9 aa, Homo Sapiens
QCIEHYHRL

SEQ ID NO: 1194125 - protein, 9 aa, Homo Sapiens
GTYILGIFG

SEQ ID NO: 1194126 - protein, 9 aa, Homo Sapiens
GHFASPNQN

SEQ ID NO: 1194127 - protein, 9 aa, Homo Sapiens
ADLGTFHDQ

SEQ ID NO: 1194128 - protein, 9 aa, Homo Sapiens
KEDIEKMKE

SEQ ID NO: 1194129 - protein, 9 aa, Homo Sapiens
FLHEVHWAV

SEQ ID NO: 1194130 - protein, 9 aa, Homo Sapiens
KIGSLVQPG

SEQ ID NO: 1194131 - protein, 9 aa, Homo Sapiens
NYLPVAFQL

SEQ ID NO: 1194132 - protein, 9 aa, Homo Sapiens
RREDVGPSL

SEQ ID NO: 1194133 - protein, 9 aa, Homo Sapiens
GQVPELHGD

SEQ ID NO: 1194134 - protein, 9 aa, Homo Sapiens
CTHIHLNET

SEQ ID NO: 1194135 - protein, 9 aa, Homo Sapiens
LEALLNKGA

SEQ ID NO: 1194136 - protein, 9 aa, Homo Sapiens
KRCAARRRT

SEQ ID NO: 1194137 - protein, 9 aa, Homo Sapiens
GRETAAGGG

SEQ ID NO: 1194138 - protein, 9 aa, Homo Sapiens
GVAEGTKLD

SEQ ID NO: 1194139 - protein, 9 aa, Homo Sapiens
CLMVTALCF

SEQ ID NO: 1194140 - protein, 9 aa, Homo Sapiens
TTTCPTPAR

SEQ ID NO: 1194141 - protein, 9 aa, Homo Sapiens
KYEMTSDTR

SEQ ID NO: 1194142 - protein, 9 aa, Homo Sapiens
VGLQTPPAS

SEQ ID NO: 1194143 - protein, 9 aa, Homo Sapiens
PRLLAPFLR

SEQ ID NO: 1194144 - protein, 9 aa, Homo Sapiens
PRSRATGSP

SEQ ID NO: 1194145 - protein, 9 aa, Homo Sapiens
LPNGDWLQE

SEQ ID NO: 1194146 - protein, 9 aa, Homo Sapiens
PPTGTPRPL

SEQ ID NO: 1194147 - protein, 9 aa, Homo Sapiens
PVQPHPKGH

SEQ ID NO: 1194148 - protein, 9 aa, Homo Sapiens
ESPSHAHGL

SEQ ID NO: 1194149 - protein, 9 aa, Homo Sapiens
TWLSLALRS

SEQ ID NO: 1194150 - protein, 9 aa, Homo Sapiens
GMPDISGSV

SEQ ID NO: 1194151 - protein, 9 aa, Homo Sapiens
LEKLEKKDY

SEQ ID NO: 1194152 - protein, 9 aa, Homo Sapiens
GRQKKAPPL

SEQ ID NO: 1194153 - protein, 9 aa, Homo Sapiens
LQCLLHSLG

SEQ ID NO: 1194154 - protein, 9 aa, Homo Sapiens
LLVEARAVA

SEQ ID NO: 1194155 - protein, 9 aa, Homo Sapiens
FSKMGNLRN

SEQ ID NO: 1194156 - protein, 9 aa, Homo Sapiens
AQRRWPLAG

SEQ ID NO: 1194157 - protein, 9 aa, Homo Sapiens
RCSGLSVSV

SEQ ID NO: 1194158 - protein, 9 aa, Homo Sapiens
TQQILPFPA

SEQ ID NO: 1194159 - protein, 9 aa, Homo Sapiens
FIWCCLNLK

SEQ ID NO: 1194160 - protein, 9 aa, Homo Sapiens
IWPVQPHPK

SEQ ID NO: 1194161 - protein, 9 aa, Homo Sapiens
KTFHFQAHD

SEQ ID NO: 1194162 - protein, 9 aa, Homo Sapiens
ETDGRKERA

SEQ ID NO: 1194163 - protein, 9 aa, Homo Sapiens
VETDKDDPG

SEQ ID NO: 1194164 - protein, 9 aa, Homo Sapiens
YNCTLVHEV

SEQ ID NO: 1194165 - protein, 9 aa, Homo Sapiens
TSSARTSWL

SEQ ID NO: 1194166 - protein, 9 aa, Homo Sapiens
RTPATWRRP

SEQ ID NO: 1194167 - protein, 9 aa, Homo Sapiens
VTCPATTTC

SEQ ID NO: 1194168 - protein, 9 aa, Homo Sapiens
IVDNVNRAL

SEQ ID NO: 1194169 - protein, 9 aa, Homo Sapiens
CPFTTKTCN

SEQ ID NO: 1194170 - protein, 9 aa, Homo Sapiens
LTCSVVSAH

SEQ ID NO: 1194171 - protein, 9 aa, Homo Sapiens
DCISRKCPA

SEQ ID NO: 1194172 - protein, 9 aa, Homo Sapiens
LWSWSPKPQ

SEQ ID NO: 1194173 - protein, 9 aa, Homo Sapiens
GCLCRAPPS

SEQ ID NO: 1194174 - protein, 9 aa, Homo Sapiens
MIAQKKGFT

SEQ ID NO: 1194175 - protein, 9 aa, Homo Sapiens
RPPGVPLAG

SEQ ID NO: 1194176 - protein, 9 aa, Homo Sapiens
TLPGEDGQN

SEQ ID NO: 1194177 - protein, 9 aa, Homo Sapiens
DMYPHVFHK

SEQ ID NO: 1194178 - protein, 9 aa, Homo Sapiens
HCDAPAEPL

SEQ ID NO: 1194179 - protein, 9 aa, Homo Sapiens
LLHQLVTVM

SEQ ID NO: 1194180 - protein, 9 aa, Homo Sapiens
GRSLQGALG

SEQ ID NO: 1194181 - protein, 9 aa, Homo Sapiens
VAKRSQQAQ

SEQ ID NO: 1194182 - protein, 9 aa, Homo Sapiens
AGHVAGCRR

SEQ ID NO: 1194183 - protein, 9 aa, Homo Sapiens
KSKEAPPIP

SEQ ID NO: 1194184 - protein, 9 aa, Homo Sapiens
NIKCRICGD

SEQ ID NO: 1194185 - protein, 9 aa, Homo Sapiens
TNSLVDLEA

SEQ ID NO: 1194186 - protein, 9 aa, Homo Sapiens
KLSNWSSWG

SEQ ID NO: 1194187 - protein, 9 aa, Homo Sapiens
KLVSSADLK

SEQ ID NO: 1194188 - protein, 9 aa, Homo Sapiens
KVQVGGNWG

SEQ ID NO: 1194189 - protein, 9 aa, Homo Sapiens
MERKAPKKK

SEQ ID NO: 1194190 - protein, 9 aa, Homo Sapiens
SRKFGWQMR

SEQ ID NO: 1194191 - protein, 9 aa, Homo Sapiens
LPFPASLAR

SEQ ID NO: 1194192 - protein, 9 aa, Homo Sapiens
EGGVEGDLG

SEQ ID NO: 1194193 - protein, 9 aa, Homo Sapiens
SKGYVRIIE

SEQ ID NO: 1194194 - protein, 9 aa, Homo Sapiens
QVERALAAI

SEQ ID NO: 1194195 - protein, 9 aa, Homo Sapiens
FLYVVSSAA

SEQ ID NO: 1194196 - protein, 9 aa, Homo Sapiens
SHILCMAIS

SEQ ID NO: 1194197 - protein, 9 aa, Homo Sapiens
TSTYLHCDA

SEQ ID NO: 1194198 - protein, 9 aa, Homo Sapiens
DYSFSEIHF

SEQ ID NO: 1194199 - protein, 9 aa, Homo Sapiens
GGLAGMRGI

SEQ ID NO: 1194200 - protein, 9 aa, Homo Sapiens
LAPPRGPGP

SEQ ID NO: 1194201 - protein, 9 aa, Homo Sapiens
LPGDHADHL

SEQ ID NO: 1194202 - protein, 9 aa, Homo Sapiens
YQNRTPPRR

SEQ ID NO: 1194203 - protein, 9 aa, Homo Sapiens
QRRRRRRRP

SEQ ID NO: 1194204 - protein, 9 aa, Homo Sapiens
AAGQRTEAG

SEQ ID NO: 1194205 - protein, 9 aa, Homo Sapiens
MGMCPLCSA

SEQ ID NO: 1194206 - protein, 9 aa, Homo Sapiens
SANHVNSVR

SEQ ID NO: 1194207 - protein, 9 aa, Homo Sapiens
NAPRAHTVL

SEQ ID NO: 1194208 - protein, 9 aa, Homo Sapiens
RGTQPGRRR

SEQ ID NO: 1194209 - protein, 9 aa, Homo Sapiens
SPCPPTPRP

SEQ ID NO: 1194210 - protein, 9 aa, Homo Sapiens
SPRGPPSPA

SEQ ID NO: 1194211 - protein, 9 aa, Homo Sapiens
GPRTGAPAR

SEQ ID NO: 1194212 - protein, 9 aa, Homo Sapiens
LASSDHEGT

SEQ ID NO: 1194213 - protein, 9 aa, Homo Sapiens
AHKKSSCQL

SEQ ID NO: 1194214 - protein, 9 aa, Homo Sapiens
HTTLFLSHI

SEQ ID NO: 1194215 - protein, 9 aa, Homo Sapiens
AASAPQARC

SEQ ID NO: 1194216 - protein, 9 aa, Homo Sapiens
HGLWFLLKS

SEQ ID NO: 1194217 - protein, 9 aa, Homo Sapiens
QGPSWCLTP

SEQ ID NO: 1194218 - protein, 9 aa, Homo Sapiens
HRPPDADPN

SEQ ID NO: 1194219 - protein, 9 aa, Homo Sapiens
RIAKHVAAS

SEQ ID NO: 1194220 - protein, 9 aa, Homo Sapiens
QNCMVQIIA

SEQ ID NO: 1194221 - protein, 9 aa, Homo Sapiens
SSPLPSRSL

SEQ ID NO: 1194222 - protein, 9 aa, Homo Sapiens
RTHHPHPKP

SEQ ID NO: 1194223 - protein, 9 aa, Homo Sapiens
MRKLFSFRR

SEQ ID NO: 1194224 - protein, 9 aa, Homo Sapiens
PLPFRAGSV

SEQ ID NO: 1194225 - protein, 9 aa, Homo Sapiens
PRAITHLFG

SEQ ID NO: 1194226 - protein, 9 aa, Homo Sapiens
LIHNDLILW

SEQ ID NO: 1194227 - protein, 9 aa, Homo Sapiens
PQRPSNSRK

SEQ ID NO: 1194228 - protein, 9 aa, Homo Sapiens
PVLDTCYGN

SEQ ID NO: 1194229 - protein, 9 aa, Homo Sapiens
TFLVSAVFL

SEQ ID NO: 1194230 - protein, 9 aa, Homo Sapiens
SLVDLEAFM

SEQ ID NO: 1194231 - protein, 9 aa, Homo Sapiens
LAQYQTNAN

SEQ ID NO: 1194232 - protein, 9 aa, Homo Sapiens
CLTPSWEVP

SEQ ID NO: 1194233 - protein, 9 aa, Homo Sapiens
LHLLILLVP

SEQ ID NO: 1194234 - protein, 9 aa, Homo Sapiens
SRVQIRHVV

SEQ ID NO: 1194235 - protein, 9 aa, Homo Sapiens
HPLLIVSTQ

SEQ ID NO: 1194236 - protein, 9 aa, Homo Sapiens
LFGAVLLVA

SEQ ID NO: 1194237 - protein, 9 aa, Homo Sapiens
RDHLGLRKQ

SEQ ID NO: 1194238 - protein, 9 aa, Homo Sapiens
TPHPPLPSP

SEQ ID NO: 1194239 - protein, 9 aa, Homo Sapiens
TYILGIFGI

SEQ ID NO: 1194240 - protein, 9 aa, Homo Sapiens
PNGIVFDLL

SEQ ID NO: 1194241 - protein, 9 aa, Homo Sapiens
PGRAWAPAP

SEQ ID NO: 1194242 - protein, 9 aa, Homo Sapiens
IIAICTVSS

SEQ ID NO: 1194243 - protein, 9 aa, Homo Sapiens
NCHKTYDTT

SEQ ID NO: 1194244 - protein, 9 aa, Homo Sapiens
RAQRRCQPH

SEQ ID NO: 1194245 - protein, 9 aa, Homo Sapiens
PQPTSGSIF

SEQ ID NO: 1194246 - protein, 9 aa, Homo Sapiens
VQKMNMWFK

SEQ ID NO: 1194247 - protein, 9 aa, Homo Sapiens
SMSRSTTRP

SEQ ID NO: 1194248 - protein, 9 aa, Homo Sapiens
RQTPPGSAP

SEQ ID NO: 1194249 - protein, 9 aa, Homo Sapiens
IHHSWTSGV

SEQ ID NO: 1194250 - protein, 9 aa, Homo Sapiens
HKAESKSCF

SEQ ID NO: 1194251 - protein, 9 aa, Homo Sapiens
SPCKSSKSN

SEQ ID NO: 1194252 - protein, 9 aa, Homo Sapiens
CRQTPPGSA

SEQ ID NO: 1194253 - protein, 9 aa, Homo Sapiens
WRCGGGCEY

SEQ ID NO: 1194254 - protein, 9 aa, Homo Sapiens
RTHTGEHPF

SEQ ID NO: 1194255 - protein, 9 aa, Homo Sapiens
GGVIPPPPP

SEQ ID NO: 1194256 - protein, 9 aa, Homo Sapiens
PCMPWRSSR

SEQ ID NO: 1194257 - protein, 9 aa, Homo Sapiens
ARFEPEVKT

SEQ ID NO: 1194258 - protein, 9 aa, Homo Sapiens
GAFADLHAL

SEQ ID NO: 1194259 - protein, 9 aa, Homo Sapiens
LQQSHLMGP

SEQ ID NO: 1194260 - protein, 9 aa, Homo Sapiens
MGPLRENKK

SEQ ID NO: 1194261 - protein, 9 aa, Homo Sapiens
QVLLDVWAR

SEQ ID NO: 1194262 - protein, 9 aa, Homo Sapiens
ACPLRASRR

SEQ ID NO: 1194263 - protein, 9 aa, Homo Sapiens
QGYRRWRGR

SEQ ID NO: 1194264 - protein, 9 aa, Homo Sapiens
KMNMWFKHE

SEQ ID NO: 1194265 - protein, 9 aa, Homo Sapiens
HYGPGVCFI

SEQ ID NO: 1194266 - protein, 9 aa, Homo Sapiens
IHKDSANLL

SEQ ID NO: 1194267 - protein, 9 aa, Homo Sapiens
PEGSHRCRQ

SEQ ID NO: 1194268 - protein, 9 aa, Homo Sapiens
KKKKDKKRR

SEQ ID NO: 1194269 - protein, 9 aa, Homo Sapiens
NLTDELSGL

SEQ ID NO: 1194270 - protein, 9 aa, Homo Sapiens
KGLLNMLSE

SEQ ID NO: 1194271 - protein, 9 aa, Homo Sapiens
VSAHTANFG

SEQ ID NO: 1194272 - protein, 9 aa, Homo Sapiens
RPLKGRRAA

SEQ ID NO: 1194273 - protein, 9 aa, Homo Sapiens
PRILQASVA

SEQ ID NO: 1194274 - protein, 9 aa, Homo Sapiens
GSGEEVPQV

SEQ ID NO: 1194275 - protein, 9 aa, Homo Sapiens
EPTVDVYYA

SEQ ID NO: 1194276 - protein, 9 aa, Homo Sapiens
EERMEAPSV

SEQ ID NO: 1194277 - protein, 9 aa, Homo Sapiens
GDPAPVAPG

SEQ ID NO: 1194278 - protein, 9 aa, Homo Sapiens
LITEAQHRK

SEQ ID NO: 1194279 - protein, 9 aa, Homo Sapiens
SGCRSPPLD

SEQ ID NO: 1194280 - protein, 9 aa, Homo Sapiens
KKTCFPEAD

SEQ ID NO: 1194281 - protein, 9 aa, Homo Sapiens
ICTVSSLLV

SEQ ID NO: 1194282 - protein, 9 aa, Homo Sapiens
HCSSSRQSS

SEQ ID NO: 1194283 - protein, 9 aa, Homo Sapiens
IPSSNEEIH

SEQ ID NO: 1194284 - protein, 9 aa, Homo Sapiens
GSVGFLWRS

SEQ ID NO: 1194285 - protein, 9 aa, Homo Sapiens
SPAPQAQDP

SEQ ID NO: 1194286 - protein, 9 aa, Homo Sapiens
TARTLLDRD

SEQ ID NO: 1194287 - protein, 9 aa, Homo Sapiens
HCQNCMVQI

SEQ ID NO: 1194288 - protein, 9 aa, Homo Sapiens
APLRGYGLC

SEQ ID NO: 1194289 - protein, 9 aa, Homo Sapiens
TPAGMQAKY

SEQ ID NO: 1194290 - protein, 9 aa, Homo Sapiens
WLPRLTRER

SEQ ID NO: 1194291 - protein, 9 aa, Homo Sapiens
TRVKKVWSW

SEQ ID NO: 1194292 - protein, 9 aa, Homo Sapiens
AAQRRWPLA

SEQ ID NO: 1194293 - protein, 9 aa, Homo Sapiens
RRRSRARPS

SEQ ID NO: 1194294 - protein, 9 aa, Homo Sapiens
NLELEEQTP

SEQ ID NO: 1194295 - protein, 9 aa, Homo Sapiens
LCLINIRHP

SEQ ID NO: 1194296 - protein, 9 aa, Homo Sapiens
SGCVPRRSA

SEQ ID NO: 1194297 - protein, 9 aa, Homo Sapiens
EDNPRVARV

SEQ ID NO: 1194298 - protein, 9 aa, Homo Sapiens
DHLPQELAD

SEQ ID NO: 1194299 - protein, 9 aa, Homo Sapiens
GVAISEVLV

SEQ ID NO: 1194300 - protein, 9 aa, Homo Sapiens
SGQAHAQVT

SEQ ID NO: 1194301 - protein, 9 aa, Homo Sapiens
PWWHPGRRR

SEQ ID NO: 1194302 - protein, 9 aa, Homo Sapiens
PGSAGSVSG

SEQ ID NO: 1194303 - protein, 9 aa, Homo Sapiens
AVHAAGHVH

SEQ ID NO: 1194304 - protein, 9 aa, Homo Sapiens
ATGLHLHRQ

SEQ ID NO: 1194305 - protein, 9 aa, Homo Sapiens
PAPAPGGYG

SEQ ID NO: 1194306 - protein, 9 aa, Homo Sapiens
NEYSGDDCS

SEQ ID NO: 1194307 - protein, 9 aa, Homo Sapiens
KWAAVLVPS

SEQ ID NO: 1194308 - protein, 9 aa, Homo Sapiens
ILGRNLPGQ

SEQ ID NO: 1194309 - protein, 9 aa, Homo Sapiens
VSWTPVSPP

SEQ ID NO: 1194310 - protein, 9 aa, Homo Sapiens
REGEEKDSG

SEQ ID NO: 1194311 - protein, 9 aa, Homo Sapiens
YFVVLIWDI

SEQ ID NO: 1194312 - protein, 9 aa, Homo Sapiens
TFAVKLEGG

SEQ ID NO: 1194313 - protein, 9 aa, Homo Sapiens
CLAVLYYIV

SEQ ID NO: 1194314 - protein, 9 aa, Homo Sapiens
RCTKRMFKF

SEQ ID NO: 1194315 - protein, 9 aa, Homo Sapiens
AVVVRVYRP

SEQ ID NO: 1194316 - protein, 9 aa, Homo Sapiens
QTAIPRSTS

SEQ ID NO: 1194317 - protein, 9 aa, Homo Sapiens
SSTSTTSAA

SEQ ID NO: 1194318 - protein, 9 aa, Homo Sapiens
SSVHPTTGP

SEQ ID NO: 1194319 - protein, 9 aa, Homo Sapiens
TILVGSNDR

SEQ ID NO: 1194320 - protein, 9 aa, Homo Sapiens
TCPATTTCP

SEQ ID NO: 1194321 - protein, 9 aa, Homo Sapiens
STPAPCLTH

SEQ ID NO: 1194322 - protein, 9 aa, Homo Sapiens
LVQELQKHH

SEQ ID NO: 1194323 - protein, 9 aa, Homo Sapiens
GRAIPRASR

SEQ ID NO: 1194324 - protein, 9 aa, Homo Sapiens
ERTEASRSE

SEQ ID NO: 1194325 - protein, 9 aa, Homo Sapiens
SFSWTIRHC

SEQ ID NO: 1194326 - protein, 9 aa, Homo Sapiens
APQAPSALS

SEQ ID NO: 1194327 - protein, 9 aa, Homo Sapiens
GARPNHVLI

SEQ ID NO: 1194328 - protein, 9 aa, Homo Sapiens
IKYPKLLSM

SEQ ID NO: 1194329 - protein, 9 aa, Homo Sapiens
KYRNMVVCS

SEQ ID NO: 1194330 - protein, 9 aa, Homo Sapiens
RGVLQMRSL

SEQ ID NO: 1194331 - protein, 9 aa, Homo Sapiens
TNCSRRPAR

SEQ ID NO: 1194332 - protein, 9 aa, Homo Sapiens
AARRRPVQR

SEQ ID NO: 1194333 - protein, 9 aa, Homo Sapiens
LSNKEVTRA

SEQ ID NO: 1194334 - protein, 9 aa, Homo Sapiens
MKTSTNCPM

SEQ ID NO: 1194335 - protein, 9 aa, Homo Sapiens
LTWSRSSFT

SEQ ID NO: 1194336 - protein, 9 aa, Homo Sapiens
RTSSACSAG

SEQ ID NO: 1194337 - protein, 9 aa, Homo Sapiens
TRRSCSGLV

SEQ ID NO: 1194338 - protein, 9 aa, Homo Sapiens
HSIQMLTLL

SEQ ID NO: 1194339 - protein, 9 aa, Homo Sapiens
ALSWGKWPV

SEQ ID NO: 1194340 - protein, 9 aa, Homo Sapiens
EAARQAVQL

SEQ ID NO: 1194341 - protein, 9 aa, Homo Sapiens
RAATVTRTP

SEQ ID NO: 1194342 - protein, 9 aa, Homo Sapiens
GLACRRRRS

SEQ ID NO: 1194343 - protein, 9 aa, Homo Sapiens
RASLTGPPW

SEQ ID NO: 1194344 - protein, 9 aa, Homo Sapiens
WVTNWKPSW

SEQ ID NO: 1194345 - protein, 9 aa, Homo Sapiens
KYESEIAGL

SEQ ID NO: 1194346 - protein, 9 aa, Homo Sapiens
NMYVNSIGP

SEQ ID NO: 1194347 - protein, 9 aa, Homo Sapiens
SVGLCRPVE

SEQ ID NO: 1194348 - protein, 9 aa, Homo Sapiens
VALSRPPGP

SEQ ID NO: 1194349 - protein, 9 aa, Homo Sapiens
REERGHPST

SEQ ID NO: 1194350 - protein, 9 aa, Homo Sapiens
IYGKAHAQK

SEQ ID NO: 1194351 - protein, 9 aa, Homo Sapiens
SVVSAHLVG

SEQ ID NO: 1194352 - protein, 9 aa, Homo Sapiens
QWPVLQRVH

SEQ ID NO: 1194353 - protein, 9 aa, Homo Sapiens
QSEELRCWF

SEQ ID NO: 1194354 - protein, 9 aa, Homo Sapiens
CIFSFNSHC

SEQ ID NO: 1194355 - protein, 9 aa, Homo Sapiens
CRELGCGGG

SEQ ID NO: 1194356 - protein, 9 aa, Homo Sapiens
HAAGHVHGI

SEQ ID NO: 1194357 - protein, 9 aa, Homo Sapiens
GKNTWRKQY

SEQ ID NO: 1194358 - protein, 9 aa, Homo Sapiens
QNVIDHKIE

SEQ ID NO: 1194359 - protein, 9 aa, Homo Sapiens
QRGKAEEIL

SEQ ID NO: 1194360 - protein, 9 aa, Homo Sapiens
VAKVPTPPG

SEQ ID NO: 1194361 - protein, 9 aa, Homo Sapiens
ANFALGVRI

SEQ ID NO: 1194362 - protein, 9 aa, Homo Sapiens
LQWMRGLLE

SEQ ID NO: 1194363 - protein, 9 aa, Homo Sapiens
KVPSLFEFQ

SEQ ID NO: 1194364 - protein, 9 aa, Homo Sapiens
ERSSSSPQP

SEQ ID NO: 1194365 - protein, 9 aa, Homo Sapiens
CFDVHDVTL

SEQ ID NO: 1194366 - protein, 9 aa, Homo Sapiens
YAPFPGKNT

SEQ ID NO: 1194367 - protein, 9 aa, Homo Sapiens
CPHDILAGM

SEQ ID NO: 1194368 - protein, 9 aa, Homo Sapiens
DNEYSGDDC

SEQ ID NO: 1194369 - protein, 9 aa, Homo Sapiens
CVQAGSEER

SEQ ID NO: 1194370 - protein, 9 aa, Homo Sapiens
RWPLAGWSS

SEQ ID NO: 1194371 - protein, 9 aa, Homo Sapiens
LPLSDLPSL

SEQ ID NO: 1194372 - protein, 9 aa, Homo Sapiens
GIASRLGMQ

SEQ ID NO: 1194373 - protein, 9 aa, Homo Sapiens
KAVHDLLLV

SEQ ID NO: 1194374 - protein, 9 aa, Homo Sapiens
KSILIHDRS

SEQ ID NO: 1194375 - protein, 9 aa, Homo Sapiens
RSNRSLPGT

SEQ ID NO: 1194376 - protein, 9 aa, Homo Sapiens
QGYTMYETQ

SEQ ID NO: 1194377 - protein, 9 aa, Homo Sapiens
SNSSSSPLR

SEQ ID NO: 1194378 - protein, 9 aa, Homo Sapiens
GQGHSTYVV

SEQ ID NO: 1194379 - protein, 9 aa, Homo Sapiens
DTRLSQQNE

SEQ ID NO: 1194380 - protein, 9 aa, Homo Sapiens
PSDFQECVS

SEQ ID NO: 1194381 - protein, 9 aa, Homo Sapiens
LPTKKKPPP

SEQ ID NO: 1194382 - protein, 9 aa, Homo Sapiens
QAPSCLSIW

SEQ ID NO: 1194383 - protein, 9 aa, Homo Sapiens
QEKELWEQK

SEQ ID NO: 1194384 - protein, 9 aa, Homo Sapiens
GNGPPTWPT

SEQ ID NO: 1194385 - protein, 9 aa, Homo Sapiens
WQRRTAAPG

SEQ ID NO: 1194386 - protein, 9 aa, Homo Sapiens
VRDCGAWPP

SEQ ID NO: 1194387 - protein, 9 aa, Homo Sapiens
PDGVMVRVG

SEQ ID NO: 1194388 - protein, 9 aa, Homo Sapiens
LVLGLTYTR

SEQ ID NO: 1194389 - protein, 9 aa, Homo Sapiens
GSCRSPRST

SEQ ID NO: 1194390 - protein, 9 aa, Homo Sapiens
AHLLHEAVS

SEQ ID NO: 1194391 - protein, 9 aa, Homo Sapiens
LLALFVPGG

SEQ ID NO: 1194392 - protein, 9 aa, Homo Sapiens
GPECVPGRG

SEQ ID NO: 1194393 - protein, 9 aa, Homo Sapiens
AVNDNGIEV

SEQ ID NO: 1194394 - protein, 9 aa, Homo Sapiens
ARGRTRLPT

SEQ ID NO: 1194395 - protein, 9 aa, Homo Sapiens
RRAGAGAAA

SEQ ID NO: 1194396 - protein, 9 aa, Homo Sapiens
ELTASLIPS

SEQ ID NO: 1194397 - protein, 9 aa, Homo Sapiens
SRLGMQNLN

SEQ ID NO: 1194398 - protein, 9 aa, Homo Sapiens
LNCVVSGQA

SEQ ID NO: 1194399 - protein, 9 aa, Homo Sapiens
LCQIKRDVN

SEQ ID NO: 1194400 - protein, 9 aa, Homo Sapiens
NTLRHQVVL

SEQ ID NO: 1194401 - protein, 9 aa, Homo Sapiens
LPWLSRRMA

SEQ ID NO: 1194402 - protein, 9 aa, Homo Sapiens
ACICVCACV

SEQ ID NO: 1194403 - protein, 9 aa, Homo Sapiens
PKVGQWVGM

SEQ ID NO: 1194404 - protein, 9 aa, Homo Sapiens
SASRASGTP

SEQ ID NO: 1194405 - protein, 9 aa, Homo Sapiens
HRGPWGPPQ

SEQ ID NO: 1194406 - protein, 9 aa, Homo Sapiens
VFLGMARCQ

SEQ ID NO: 1194407 - protein, 9 aa, Homo Sapiens
GEQPPDQWC

SEQ ID NO: 1194408 - protein, 9 aa, Homo Sapiens
SVPLKTGEG

SEQ ID NO: 1194409 - protein, 9 aa, Homo Sapiens
KSSVHPTTG

SEQ ID NO: 1194410 - protein, 9 aa, Homo Sapiens
GRGAPRHPH

SEQ ID NO: 1194411 - protein, 9 aa, Homo Sapiens
WMTCTSLSK

SEQ ID NO: 1194412 - protein, 9 aa, Homo Sapiens
RPVEERVVE

SEQ ID NO: 1194413 - protein, 9 aa, Homo Sapiens
QQPPPRLPL

SEQ ID NO: 1194414 - protein, 9 aa, Homo Sapiens
EDKMLRTRS

SEQ ID NO: 1194415 - protein, 9 aa, Homo Sapiens
TGSSAAKRA

SEQ ID NO: 1194416 - protein, 9 aa, Homo Sapiens
AVFSMPFLD

SEQ ID NO: 1194417 - protein, 9 aa, Homo Sapiens
QVAQSPKHR

SEQ ID NO: 1194418 - protein, 9 aa, Homo Sapiens
DHPRILQAS

SEQ ID NO: 1194419 - protein, 9 aa, Homo Sapiens
RPVPNPPTS

SEQ ID NO: 1194420 - protein, 9 aa, Homo Sapiens
RAITHLFGG

SEQ ID NO: 1194421 - protein, 9 aa, Homo Sapiens
PGASAGRRA

SEQ ID NO: 1194422 - protein, 9 aa, Homo Sapiens
LASGHHTTP

SEQ ID NO: 1194423 - protein, 9 aa, Homo Sapiens
RRAAAPGQA

SEQ ID NO: 1194424 - protein, 9 aa, Homo Sapiens
QQQQSQQPY

SEQ ID NO: 1194425 - protein, 9 aa, Homo Sapiens
HRLAEAVAA

SEQ ID NO: 1194426 - protein, 9 aa, Homo Sapiens
YGFLHEVHW

SEQ ID NO: 1194427 - protein, 9 aa, Homo Sapiens
ELPASVHAI

SEQ ID NO: 1194428 - protein, 9 aa, Homo Sapiens
LHYTSGVGA

SEQ ID NO: 1194429 - protein, 9 aa, Homo Sapiens
VNRRRAMRT

SEQ ID NO: 1194430 - protein, 9 aa, Homo Sapiens
LCPKREHSS

SEQ ID NO: 1194431 - protein, 9 aa, Homo Sapiens
CEAAADVAK

SEQ ID NO: 1194432 - protein, 9 aa, Homo Sapiens
DHLPPRGDQ

SEQ ID NO: 1194433 - protein, 9 aa, Homo Sapiens
ARGTARSWT

SEQ ID NO: 1194434 - protein, 9 aa, Homo Sapiens
PTMPHVPRA

SEQ ID NO: 1194435 - protein, 9 aa, Homo Sapiens
IPPAHLSMT

SEQ ID NO: 1194436 - protein, 9 aa, Homo Sapiens
RHPSWPWTR

SEQ ID NO: 1194437 - protein, 9 aa, Homo Sapiens
LVQHKGLLE

SEQ ID NO: 1194438 - protein, 9 aa, Homo Sapiens
HVDSLRVRT

SEQ ID NO: 1194439 - protein, 9 aa, Homo Sapiens
QALVLQQVG

SEQ ID NO: 1194440 - protein, 9 aa, Homo Sapiens
RPTYSSKAA

SEQ ID NO: 1194441 - protein, 9 aa, Homo Sapiens
WAVRHISSE

SEQ ID NO: 1194442 - protein, 9 aa, Homo Sapiens
HKSGGHAAQ

SEQ ID NO: 1194443 - protein, 9 aa, Homo Sapiens
ARPGQLRGR

SEQ ID NO: 1194444 - protein, 9 aa, Homo Sapiens
YPEKIHTKL

SEQ ID NO: 1194445 - protein, 9 aa, Homo Sapiens
SPNGRLCPA

SEQ ID NO: 1194446 - protein, 9 aa, Homo Sapiens
QRQDTSKNI

SEQ ID NO: 1194447 - protein, 9 aa, Homo Sapiens
DNLQLVLWG

SEQ ID NO: 1194448 - protein, 9 aa, Homo Sapiens
VAVGRLPVT

SEQ ID NO: 1194449 - protein, 9 aa, Homo Sapiens
GSRSGGRSR

SEQ ID NO: 1194450 - protein, 9 aa, Homo Sapiens
VRGAFVGPR

SEQ ID NO: 1194451 - protein, 9 aa, Homo Sapiens
SCTGAGVNL

SEQ ID NO: 1194452 - protein, 9 aa, Homo Sapiens
CLKFQREEQ

SEQ ID NO: 1194453 - protein, 9 aa, Homo Sapiens
RSFLRAGRQ

SEQ ID NO: 1194454 - protein, 9 aa, Homo Sapiens
AVAPKAGPG

SEQ ID NO: 1194455 - protein, 9 aa, Homo Sapiens
LAPPGSLEL

SEQ ID NO: 1194456 - protein, 9 aa, Homo Sapiens
GYVGYIRDL

SEQ ID NO: 1194457 - protein, 9 aa, Homo Sapiens
GEDADDPMF

SEQ ID NO: 1194458 - protein, 9 aa, Homo Sapiens
VRYTPLAKR

SEQ ID NO: 1194459 - protein, 9 aa, Homo Sapiens
KSITTERYP

SEQ ID NO: 1194460 - protein, 9 aa, Homo Sapiens
YLHAMHTLS

SEQ ID NO: 1194461 - protein, 9 aa, Homo Sapiens
NKFQDLLQE

SEQ ID NO: 1194462 - protein, 9 aa, Homo Sapiens
DLAGTMCAS

SEQ ID NO: 1194463 - protein, 9 aa, Homo Sapiens
GNVSLFFRR

SEQ ID NO: 1194464 - protein, 9 aa, Homo Sapiens
AHRVAERQV

SEQ ID NO: 1194465 - protein, 9 aa, Homo Sapiens
GVTWGNGSG

SEQ ID NO: 1194466 - protein, 9 aa, Homo Sapiens
VFALGLQEE

SEQ ID NO: 1194467 - protein, 9 aa, Homo Sapiens
QERLKGCKN

SEQ ID NO: 1194468 - protein, 9 aa, Homo Sapiens
PPHPLPRSP

SEQ ID NO: 1194469 - protein, 9 aa, Homo Sapiens
VLLAARRRP

SEQ ID NO: 1194470 - protein, 9 aa, Homo Sapiens
MMSNGCWGW

SEQ ID NO: 1194471 - protein, 9 aa, Homo Sapiens
GIPRLPQWW

SEQ ID NO: 1194472 - protein, 9 aa, Homo Sapiens
VSGERGPGL

SEQ ID NO: 1194473 - protein, 9 aa, Homo Sapiens
FRGNKPRDK

SEQ ID NO: 1194474 - protein, 9 aa, Homo Sapiens
VKQAGKSQQ

SEQ ID NO: 1194475 - protein, 9 aa, Homo Sapiens
EQMECLEAL

SEQ ID NO: 1194476 - protein, 9 aa, Homo Sapiens
VMRRMRKTF

SEQ ID NO: 1194477 - protein, 9 aa, Homo Sapiens
SGEEVPQVG

SEQ ID NO: 1194478 - protein, 9 aa, Homo Sapiens
TKKSISLTK

SEQ ID NO: 1194479 - protein, 9 aa, Homo Sapiens
LQCNPRLDF

SEQ ID NO: 1194480 - protein, 9 aa, Homo Sapiens
LLVAVALAV

SEQ ID NO: 1194481 - protein, 9 aa, Homo Sapiens
IQTHGEGYA

SEQ ID NO: 1194482 - protein, 9 aa, Homo Sapiens
GTVQGDTSH

SEQ ID NO: 1194483 - protein, 9 aa, Homo Sapiens
ASMESPSHA

SEQ ID NO: 1194484 - protein, 9 aa, Homo Sapiens
APTARASST

SEQ ID NO: 1194485 - protein, 9 aa, Homo Sapiens
GIKPERRVE

SEQ ID NO: 1194486 - protein, 9 aa, Homo Sapiens
WYRNGKVLR

SEQ ID NO: 1194487 - protein, 9 aa, Homo Sapiens
LQRSGSLLC

SEQ ID NO: 1194488 - protein, 9 aa, Homo Sapiens
SNNLKAPPP

SEQ ID NO: 1194489 - protein, 9 aa, Homo Sapiens
DIISIFLYI

SEQ ID NO: 1194490 - protein, 9 aa, Homo Sapiens
EKNFVKRRR

SEQ ID NO: 1194491 - protein, 9 aa, Homo Sapiens
WCQSEDARA

SEQ ID NO: 1194492 - protein, 9 aa, Homo Sapiens
GGAEERMEA

SEQ ID NO: 1194493 - protein, 9 aa, Homo Sapiens
PNGDWLQEN

SEQ ID NO: 1194494 - protein, 9 aa, Homo Sapiens
GPPALAHLQ

SEQ ID NO: 1194495 - protein, 9 aa, Homo Sapiens
PRHPRSPTP

SEQ ID NO: 1194496 - protein, 9 aa, Homo Sapiens
SQLAPWPGL

SEQ ID NO: 1194497 - protein, 9 aa, Homo Sapiens
FPTISLSFK

SEQ ID NO: 1194498 - protein, 9 aa, Homo Sapiens
GADVEPDLH

SEQ ID NO: 1194499 - protein, 9 aa, Homo Sapiens
VGIIGRTGA

SEQ ID NO: 1194500 - protein, 9 aa, Homo Sapiens
EYQVLLDVW

SEQ ID NO: 1194501 - protein, 9 aa, Homo Sapiens
SFIGPACQI

SEQ ID NO: 1194502 - protein, 9 aa, Homo Sapiens
ILPMGSLVP

SEQ ID NO: 1194503 - protein, 9 aa, Homo Sapiens
LQEGEEGLR

SEQ ID NO: 1194504 - protein, 9 aa, Homo Sapiens
GGFLYAMGG

SEQ ID NO: 1194505 - protein, 9 aa, Homo Sapiens
PPGRRQRRR

SEQ ID NO: 1194506 - protein, 9 aa, Homo Sapiens
GQAAVGATS

SEQ ID NO: 1194507 - protein, 9 aa, Homo Sapiens
HGIAPDVVL

SEQ ID NO: 1194508 - protein, 9 aa, Homo Sapiens
HAQLLEMEA

SEQ ID NO: 1194509 - protein, 9 aa, Homo Sapiens
LWGWRPKAE

SEQ ID NO: 1194510 - protein, 9 aa, Homo Sapiens
APQLRKWLK

SEQ ID NO: 1194511 - protein, 9 aa, Homo Sapiens
AIWNGNHGA

SEQ ID NO: 1194512 - protein, 9 aa, Homo Sapiens
GPPSPLLVE

SEQ ID NO: 1194513 - protein, 9 aa, Homo Sapiens
SCRSPRSTW

SEQ ID NO: 1194514 - protein, 9 aa, Homo Sapiens
SLPCPPGGA

SEQ ID NO: 1194515 - protein, 9 aa, Homo Sapiens
MLAALMSLL

SEQ ID NO: 1194516 - protein, 9 aa, Homo Sapiens
ERVEALESA

SEQ ID NO: 1194517 - protein, 9 aa, Homo Sapiens
RYARWAGVA

SEQ ID NO: 1194518 - protein, 9 aa, Homo Sapiens
TIDYVDDGK

SEQ ID NO: 1194519 - protein, 9 aa, Homo Sapiens
SGAAKAVGP

SEQ ID NO: 1194520 - protein, 9 aa, Homo Sapiens
GHIICSPLC

SEQ ID NO: 1194521 - protein, 9 aa, Homo Sapiens
RPCRRGTLA

SEQ ID NO: 1194522 - protein, 9 aa, Homo Sapiens
PCPFTTKTC

SEQ ID NO: 1194523 - protein, 9 aa, Homo Sapiens
PSSAGTQAA

SEQ ID NO: 1194524 - protein, 9 aa, Homo Sapiens
RLCVALTSL

SEQ ID NO: 1194525 - protein, 9 aa, Homo Sapiens
LMSLRLLHL

SEQ ID NO: 1194526 - protein, 9 aa, Homo Sapiens
FSHSQVLCH

SEQ ID NO: 1194527 - protein, 9 aa, Homo Sapiens
APVAPGPGP

SEQ ID NO: 1194528 - protein, 9 aa, Homo Sapiens
AVVIAAVKP

SEQ ID NO: 1194529 - protein, 9 aa, Homo Sapiens
HLRPGEAVG

SEQ ID NO: 1194530 - protein, 9 aa, Homo Sapiens
CQGFVPDAE

SEQ ID NO: 1194531 - protein, 9 aa, Homo Sapiens
LASPRACAR

SEQ ID NO: 1194532 - protein, 9 aa, Homo Sapiens
LRSVLYEKT

SEQ ID NO: 1194533 - protein, 9 aa, Homo Sapiens
EGAVLPRSR

SEQ ID NO: 1194534 - protein, 9 aa, Homo Sapiens
LLYYQRRHP

SEQ ID NO: 1194535 - protein, 9 aa, Homo Sapiens
GLGAAAGAA

SEQ ID NO: 1194536 - protein, 9 aa, Homo Sapiens
TASVLPHPA

SEQ ID NO: 1194537 - protein, 9 aa, Homo Sapiens
LAASVPTSE

SEQ ID NO: 1194538 - protein, 9 aa, Homo Sapiens
FTFSAVASD

SEQ ID NO: 1194539 - protein, 9 aa, Homo Sapiens
ARTCRALAP

SEQ ID NO: 1194540 - protein, 9 aa, Homo Sapiens
SVDPKREQQ

SEQ ID NO: 1194541 - protein, 9 aa, Homo Sapiens
RSGLESGEA

SEQ ID NO: 1194542 - protein, 9 aa, Homo Sapiens
APGPAPSTC

SEQ ID NO: 1194543 - protein, 9 aa, Homo Sapiens
SLTGPPWQW

SEQ ID NO: 1194544 - protein, 9 aa, Homo Sapiens
SWYRGWAPR

SEQ ID NO: 1194545 - protein, 9 aa, Homo Sapiens
GPRSSSPTQ

SEQ ID NO: 1194546 - protein, 9 aa, Homo Sapiens
PAESRQGWL

SEQ ID NO: 1194547 - protein, 9 aa, Homo Sapiens
ELSDGITIL

SEQ ID NO: 1194548 - protein, 9 aa, Homo Sapiens
WRHPLPPRP

SEQ ID NO: 1194549 - protein, 9 aa, Homo Sapiens
VWSWTTMME

SEQ ID NO: 1194550 - protein, 9 aa, Homo Sapiens
TRCVWQQPS

SEQ ID NO: 1194551 - protein, 9 aa, Homo Sapiens
DGGNGPERQ

SEQ ID NO: 1194552 - protein, 9 aa, Homo Sapiens
GLVWVSLPL

SEQ ID NO: 1194553 - protein, 9 aa, Homo Sapiens
RGHAQMCRV

SEQ ID NO: 1194554 - protein, 9 aa, Homo Sapiens
CSVVSAHLV

SEQ ID NO: 1194555 - protein, 9 aa, Homo Sapiens
FTGDRCQNF

SEQ ID NO: 1194556 - protein, 9 aa, Homo Sapiens
KMNRMWQRI

SEQ ID NO: 1194557 - protein, 9 aa, Homo Sapiens
PSLKPDIPP

SEQ ID NO: 1194558 - protein, 9 aa, Homo Sapiens
RRGDTCPCP

SEQ ID NO: 1194559 - protein, 9 aa, Homo Sapiens
PQRPPSSWP

SEQ ID NO: 1194560 - protein, 9 aa, Homo Sapiens
TIFIKVTRS

SEQ ID NO: 1194561 - protein, 9 aa, Homo Sapiens
GELPEPHGL

SEQ ID NO: 1194562 - protein, 9 aa, Homo Sapiens
FRKKLKLRR

SEQ ID NO: 1194563 - protein, 9 aa, Homo Sapiens
QLPGTVQGD

SEQ ID NO: 1194564 - protein, 9 aa, Homo Sapiens
PGVPLAGWA

SEQ ID NO: 1194565 - protein, 9 aa, Homo Sapiens
FLLICISYV

SEQ ID NO: 1194566 - protein, 9 aa, Homo Sapiens
GNVPDRGAA

SEQ ID NO: 1194567 - protein, 9 aa, Homo Sapiens
MQCRKKSHC

SEQ ID NO: 1194568 - protein, 9 aa, Homo Sapiens
SGHCPLQGF

SEQ ID NO: 1194569 - protein, 9 aa, Homo Sapiens
NRFAYNANQ

SEQ ID NO: 1194570 - protein, 9 aa, Homo Sapiens
AQTRRSYPE

SEQ ID NO: 1194571 - protein, 9 aa, Homo Sapiens
VNPRSRATG

SEQ ID NO: 1194572 - protein, 9 aa, Homo Sapiens
PKAFYPVWS

SEQ ID NO: 1194573 - protein, 9 aa, Homo Sapiens
LRPSHSSPL

SEQ ID NO: 1194574 - protein, 9 aa, Homo Sapiens
VIADSGVAT

SEQ ID NO: 1194575 - protein, 9 aa, Homo Sapiens
PRRGPPKDN

SEQ ID NO: 1194576 - protein, 9 aa, Homo Sapiens
AQRRCQPHQ

SEQ ID NO: 1194577 - protein, 9 aa, Homo Sapiens
EDAGHLLQP

SEQ ID NO: 1194578 - protein, 9 aa, Homo Sapiens
LHSLGTTGT

SEQ ID NO: 1194579 - protein, 9 aa, Homo Sapiens
EAPPQTRLE

SEQ ID NO: 1194580 - protein, 9 aa, Homo Sapiens
APKASPPPA

SEQ ID NO: 1194581 - protein, 9 aa, Homo Sapiens
VSFFIYRKI

SEQ ID NO: 1194582 - protein, 9 aa, Homo Sapiens
LSYADWFNA

SEQ ID NO: 1194583 - protein, 9 aa, Homo Sapiens
WAQMQIDKV

SEQ ID NO: 1194584 - protein, 9 aa, Homo Sapiens
RHSSVLATG

SEQ ID NO: 1194585 - protein, 9 aa, Homo Sapiens
RYLVCPRAG

SEQ ID NO: 1194586 - protein, 9 aa, Homo Sapiens
NLLNHQRTH

SEQ ID NO: 1194587 - protein, 9 aa, Homo Sapiens
QRPQQQRQR

SEQ ID NO: 1194588 - protein, 9 aa, Homo Sapiens
LIVSWTPVS

SEQ ID NO: 1194589 - protein, 9 aa, Homo Sapiens
PCPHPSGLR

SEQ ID NO: 1194590 - protein, 9 aa, Homo Sapiens
GVGTYILGI

SEQ ID NO: 1194591 - protein, 9 aa, Homo Sapiens
LSVAWRASF

SEQ ID NO: 1194592 - protein, 9 aa, Homo Sapiens
HWGAAPMMS

SEQ ID NO: 1194593 - protein, 9 aa, Homo Sapiens
SRFQLEGAS

SEQ ID NO: 1194594 - protein, 9 aa, Homo Sapiens
APVRAWRTS

SEQ ID NO: 1194595 - protein, 9 aa, Homo Sapiens
RTLFDWYRH

SEQ ID NO: 1194596 - protein, 9 aa, Homo Sapiens
IMSMGITWF

SEQ ID NO: 1194597 - protein, 9 aa, Homo Sapiens
RPPGPQCPS

SEQ ID NO: 1194598 - protein, 9 aa, Homo Sapiens
EQETTTKLV

SEQ ID NO: 1194599 - protein, 9 aa, Homo Sapiens
HRARPPQAR

SEQ ID NO: 1194600 - protein, 9 aa, Homo Sapiens
GLEQSPQLL

SEQ ID NO: 1194601 - protein, 9 aa, Homo Sapiens
VFSTMGYGY

SEQ ID NO: 1194602 - protein, 9 aa, Homo Sapiens
CGCLVLEPS

SEQ ID NO: 1194603 - protein, 9 aa, Homo Sapiens
GQQTGIPTV

SEQ ID NO: 1194604 - protein, 9 aa, Homo Sapiens
YQTPMEVVV

SEQ ID NO: 1194605 - protein, 9 aa, Homo Sapiens
QEECAESHR

SEQ ID NO: 1194606 - protein, 9 aa, Homo Sapiens
APRRGCPTA

SEQ ID NO: 1194607 - protein, 9 aa, Homo Sapiens
MSEDNSPEH

SEQ ID NO: 1194608 - protein, 9 aa, Homo Sapiens
TLVLKKLLC

SEQ ID NO: 1194609 - protein, 9 aa, Homo Sapiens
SYTRIIQAT

SEQ ID NO: 1194610 - protein, 9 aa, Homo Sapiens
RSLASPRAC

SEQ ID NO: 1194611 - protein, 9 aa, Homo Sapiens
TSLKGSRTS

SEQ ID NO: 1194612 - protein, 9 aa, Homo Sapiens
RKPATQQKK

SEQ ID NO: 1194613 - protein, 9 aa, Homo Sapiens
LPPRAPHPP

SEQ ID NO: 1194614 - protein, 9 aa, Homo Sapiens
NGRVNAVAS

SEQ ID NO: 1194615 - protein, 9 aa, Homo Sapiens
QQSWEIVME

SEQ ID NO: 1194616 - protein, 9 aa, Homo Sapiens
KSQEPLQLE

SEQ ID NO: 1194617 - protein, 9 aa, Homo Sapiens
IHDRSVSRD

SEQ ID NO: 1194618 - protein, 9 aa, Homo Sapiens
GLPARRGAG

SEQ ID NO: 1194619 - protein, 9 aa, Homo Sapiens
SCFPPKGYA

SEQ ID NO: 1194620 - protein, 9 aa, Homo Sapiens
MASKLPDML

SEQ ID NO: 1194621 - protein, 9 aa, Homo Sapiens
PPTSCPPLL

SEQ ID NO: 1194622 - protein, 9 aa, Homo Sapiens
EARKQRLAP

SEQ ID NO: 1194623 - protein, 9 aa, Homo Sapiens
AMHTLSEDT

SEQ ID NO: 1194624 - protein, 9 aa, Homo Sapiens
LVETHIHNQ

SEQ ID NO: 1194625 - protein, 9 aa, Homo Sapiens
LPVTPGPAH

SEQ ID NO: 1194626 - protein, 9 aa, Homo Sapiens
ITHLFGGIA

SEQ ID NO: 1194627 - protein, 9 aa, Homo Sapiens
SANLLPLDG

SEQ ID NO: 1194628 - protein, 9 aa, Homo Sapiens
LLIVSTQAL

SEQ ID NO: 1194629 - protein, 9 aa, Homo Sapiens
NLSPTVEYN

SEQ ID NO: 1194630 - protein, 9 aa, Homo Sapiens
VAVDQQIRT

SEQ ID NO: 1194631 - protein, 9 aa, Homo Sapiens
QGLPPQAQT

SEQ ID NO: 1194632 - protein, 9 aa, Homo Sapiens
LIFSIDPKG

SEQ ID NO: 1194633 - protein, 9 aa, Homo Sapiens
WIHSDERPY

SEQ ID NO: 1194634 - protein, 9 aa, Homo Sapiens
ARPLRGGRP

SEQ ID NO: 1194635 - protein, 9 aa, Homo Sapiens
GFLYAMGGQ

SEQ ID NO: 1194636 - protein, 9 aa, Homo Sapiens
TSKVAGLSR

SEQ ID NO: 1194637 - protein, 9 aa, Homo Sapiens
STGNGPPTW

SEQ ID NO: 1194638 - protein, 9 aa, Homo Sapiens
CPSESMLTQ

SEQ ID NO: 1194639 - protein, 9 aa, Homo Sapiens
TMVCCLKTS

SEQ ID NO: 1194640 - protein, 9 aa, Homo Sapiens
EKGTANIKR

SEQ ID NO: 1194641 - protein, 9 aa, Homo Sapiens
QGHFASPNQ

SEQ ID NO: 1194642 - protein, 9 aa, Homo Sapiens
PSSRPRASC

SEQ ID NO: 1194643 - protein, 9 aa, Homo Sapiens
VISKKESVF

SEQ ID NO: 1194644 - protein, 9 aa, Homo Sapiens
LPLRGFLLH

SEQ ID NO: 1194645 - protein, 9 aa, Homo Sapiens
VETHIHNQG

SEQ ID NO: 1194646 - protein, 9 aa, Homo Sapiens
ACARGPRAP

SEQ ID NO: 1194647 - protein, 9 aa, Homo Sapiens
GAGRRRRRS

SEQ ID NO: 1194648 - protein, 9 aa, Homo Sapiens
TTTKLVPEE

SEQ ID NO: 1194649 - protein, 9 aa, Homo Sapiens
QPRLPPPPP

SEQ ID NO: 1194650 - protein, 9 aa, Homo Sapiens
YNMSAGMTQ

SEQ ID NO: 1194651 - protein, 9 aa, Homo Sapiens
EQAVYCCKK

SEQ ID NO: 1194652 - protein, 9 aa, Homo Sapiens
EQEAGSKIS

SEQ ID NO: 1194653 - protein, 9 aa, Homo Sapiens
SYADWFNAS

SEQ ID NO: 1194654 - protein, 9 aa, Homo Sapiens
EEVPQVGPS

SEQ ID NO: 1194655 - protein, 9 aa, Homo Sapiens
SDPLCVLAP

SEQ ID NO: 1194656 - protein, 9 aa, Homo Sapiens
NDTTEINQN

SEQ ID NO: 1194657 - protein, 9 aa, Homo Sapiens
GAVLPRSRK

SEQ ID NO: 1194658 - protein, 9 aa, Homo Sapiens
TWRKQYSIA

SEQ ID NO: 1194659 - protein, 9 aa, Homo Sapiens
HDSTAILSR

SEQ ID NO: 1194660 - protein, 9 aa, Homo Sapiens
TLAACPSGS

SEQ ID NO: 1194661 - protein, 9 aa, Homo Sapiens
KAESKSCFP

SEQ ID NO: 1194662 - protein, 9 aa, Homo Sapiens
PRQRGLLLH

SEQ ID NO: 1194663 - protein, 9 aa, Homo Sapiens
MNITMPLAM

SEQ ID NO: 1194664 - protein, 9 aa, Homo Sapiens
RVDSQRGQA

SEQ ID NO: 1194665 - protein, 9 aa, Homo Sapiens
RKLFSFRRR

SEQ ID NO: 1194666 - protein, 9 aa, Homo Sapiens
LPPLLSCWH

SEQ ID NO: 1194667 - protein, 9 aa, Homo Sapiens
PHSRGRELG

SEQ ID NO: 1194668 - protein, 9 aa, Homo Sapiens
DPYSSCASC

SEQ ID NO: 1194669 - protein, 9 aa, Homo Sapiens
SERAGGQRT

SEQ ID NO: 1194670 - protein, 9 aa, Homo Sapiens
GEHEFDCKL

SEQ ID NO: 1194671 - protein, 9 aa, Homo Sapiens
KEVYRQQPQ

SEQ ID NO: 1194672 - protein, 9 aa, Homo Sapiens
IPSCSSPEG

SEQ ID NO: 1194673 - protein, 9 aa, Homo Sapiens
YIIDLLTFI

SEQ ID NO: 1194674 - protein, 9 aa, Homo Sapiens
GIFRVNTPV

SEQ ID NO: 1194675 - protein, 9 aa, Homo Sapiens
MTTALGIPS

SEQ ID NO: 1194676 - protein, 9 aa, Homo Sapiens
LSDLPSLTS

SEQ ID NO: 1194677 - protein, 9 aa, Homo Sapiens
GTTTGQAAA

SEQ ID NO: 1194678 - protein, 9 aa, Homo Sapiens
QRNLSADQW

SEQ ID NO: 1194679 - protein, 9 aa, Homo Sapiens
GNTPLRCAV

SEQ ID NO: 1194680 - protein, 9 aa, Homo Sapiens
RAEKPTAAL

SEQ ID NO: 1194681 - protein, 9 aa, Homo Sapiens
QLGNAPLHC

SEQ ID NO: 1194682 - protein, 9 aa, Homo Sapiens
SVVHMAFGV

SEQ ID NO: 1194683 - protein, 9 aa, Homo Sapiens
MGQWDPSFN

SEQ ID NO: 1194684 - protein, 9 aa, Homo Sapiens
PHDILAGMR

SEQ ID NO: 1194685 - protein, 9 aa, Homo Sapiens
LCGWREASR

SEQ ID NO: 1194686 - protein, 9 aa, Homo Sapiens
RALGFRSRR

SEQ ID NO: 1194687 - protein, 9 aa, Homo Sapiens
KAEYAPPIY

SEQ ID NO: 1194688 - protein, 9 aa, Homo Sapiens
TYTKIYIQR

SEQ ID NO: 1194689 - protein, 9 aa, Homo Sapiens
MAAVFLTTT

SEQ ID NO: 1194690 - protein, 9 aa, Homo Sapiens
SPLQRSGSL

SEQ ID NO: 1194691 - protein, 9 aa, Homo Sapiens
AAGGAPARQ

SEQ ID NO: 1194692 - protein, 9 aa, Homo Sapiens
ASMNITMPL

SEQ ID NO: 1194693 - protein, 9 aa, Homo Sapiens
THRYEAANR

SEQ ID NO: 1194694 - protein, 9 aa, Homo Sapiens
VSRTHSSPT

SEQ ID NO: 1194695 - protein, 9 aa, Homo Sapiens
TVALANPGS

SEQ ID NO: 1194696 - protein, 9 aa, Homo Sapiens
VDSQRGQAV

SEQ ID NO: 1194697 - protein, 9 aa, Homo Sapiens
RQYLERGES

SEQ ID NO: 1194698 - protein, 9 aa, Homo Sapiens
ESLWSDSPV

SEQ ID NO: 1194699 - protein, 9 aa, Homo Sapiens
AGGSGGHRP

SEQ ID NO: 1194700 - protein, 9 aa, Homo Sapiens
EFQGPSWCL

SEQ ID NO: 1194701 - protein, 9 aa, Homo Sapiens
TPALGQALT

SEQ ID NO: 1194702 - protein, 9 aa, Homo Sapiens
QCNPRLDFH

SEQ ID NO: 1194703 - protein, 9 aa, Homo Sapiens
DAHFDHKVT

SEQ ID NO: 1194704 - protein, 9 aa, Homo Sapiens
LGFRYLVCP

SEQ ID NO: 1194705 - protein, 9 aa, Homo Sapiens
PLGLGGEVL

SEQ ID NO: 1194706 - protein, 9 aa, Homo Sapiens
IYTYIAVND

SEQ ID NO: 1194707 - protein, 9 aa, Homo Sapiens
NIPGIRGAL

SEQ ID NO: 1194708 - protein, 9 aa, Homo Sapiens
LMNNNNVVK

SEQ ID NO: 1194709 - protein, 9 aa, Homo Sapiens
PRLEGRLGR

SEQ ID NO: 1194710 - protein, 9 aa, Homo Sapiens
SGDFQPFVK

SEQ ID NO: 1194711 - protein, 9 aa, Homo Sapiens
AVSVVAHLG

SEQ ID NO: 1194712 - protein, 9 aa, Homo Sapiens
IFSESRHPS

SEQ ID NO: 1194713 - protein, 9 aa, Homo Sapiens
AVNCPSWRS

SEQ ID NO: 1194714 - protein, 9 aa, Homo Sapiens
QMRSLEAHC

SEQ ID NO: 1194715 - protein, 9 aa, Homo Sapiens
MLWTMDPSP

SEQ ID NO: 1194716 - protein, 9 aa, Homo Sapiens
QRQRGRPHA

SEQ ID NO: 1194717 - protein, 9 aa, Homo Sapiens
ERGPGLPLL

SEQ ID NO: 1194718 - protein, 9 aa, Homo Sapiens
RLQAMQKRH

SEQ ID NO: 1194719 - protein, 9 aa, Homo Sapiens
APPTRCVWQ

SEQ ID NO: 1194720 - protein, 9 aa, Homo Sapiens
VKWTEWKMH

SEQ ID NO: 1194721 - protein, 9 aa, Homo Sapiens
LGGGTFLVS

SEQ ID NO: 1194722 - protein, 9 aa, Homo Sapiens
LPPGCRLQR

SEQ ID NO: 1194723 - protein, 9 aa, Homo Sapiens
VVELLQLHA

SEQ ID NO: 1194724 - protein, 9 aa, Homo Sapiens
CSRRYQKYR

SEQ ID NO: 1194725 - protein, 9 aa, Homo Sapiens
ENCHKTYDT

SEQ ID NO: 1194726 - protein, 9 aa, Homo Sapiens
ASASCCCPT

SEQ ID NO: 1194727 - protein, 9 aa, Homo Sapiens
RPGSGGGVP

SEQ ID NO: 1194728 - protein, 9 aa, Homo Sapiens
GGGQPGGCS

SEQ ID NO: 1194729 - protein, 9 aa, Homo Sapiens
TQFMGAVMF

SEQ ID NO: 1194730 - protein, 9 aa, Homo Sapiens
EKMNRMWQR

SEQ ID NO: 1194731 - protein, 9 aa, Homo Sapiens
WEPWIKKSK

SEQ ID NO: 1194732 - protein, 9 aa, Homo Sapiens
SPVPPGPQA

SEQ ID NO: 1194733 - protein, 9 aa, Homo Sapiens
TLPGLFVKT

SEQ ID NO: 1194734 - protein, 9 aa, Homo Sapiens
TSSWSGTTQ

SEQ ID NO: 1194735 - protein, 9 aa, Homo Sapiens
EERSDPLCV

SEQ ID NO: 1194736 - protein, 9 aa, Homo Sapiens
SRLKPSAPN

SEQ ID NO: 1194737 - protein, 9 aa, Homo Sapiens
WMTSRTLAA

SEQ ID NO: 1194738 - protein, 9 aa, Homo Sapiens
KLAQKFPLG

SEQ ID NO: 1194739 - protein, 9 aa, Homo Sapiens
VCFIHFLHK

SEQ ID NO: 1194740 - protein, 9 aa, Homo Sapiens
SARAVAAFV

SEQ ID NO: 1194741 - protein, 9 aa, Homo Sapiens
PLFSFVLDV

SEQ ID NO: 1194742 - protein, 9 aa, Homo Sapiens
CQKQSTITN

SEQ ID NO: 1194743 - protein, 9 aa, Homo Sapiens
ASAGFSSML

SEQ ID NO: 1194744 - protein, 9 aa, Homo Sapiens
RSPRPERSS

SEQ ID NO: 1194745 - protein, 9 aa, Homo Sapiens
RAPLESVRQ

SEQ ID NO: 1194746 - protein, 9 aa, Homo Sapiens
PGKNTWRKQ

SEQ ID NO: 1194747 - protein, 9 aa, Homo Sapiens
LGLYGLEVT

SEQ ID NO: 1194748 - protein, 9 aa, Homo Sapiens
RKKKVRSLH

SEQ ID NO: 1194749 - protein, 9 aa, Homo Sapiens
PMAPQGCRC

SEQ ID NO: 1194750 - protein, 9 aa, Homo Sapiens
KIFRQDSDL

SEQ ID NO: 1194751 - protein, 9 aa, Homo Sapiens
MLRSRCPKS

SEQ ID NO: 1194752 - protein, 9 aa, Homo Sapiens
AYDWEFSSV

SEQ ID NO: 1194753 - protein, 9 aa, Homo Sapiens
LWPQKKCLI

SEQ ID NO: 1194754 - protein, 9 aa, Homo Sapiens
LKPRRACQK

SEQ ID NO: 1194755 - protein, 9 aa, Homo Sapiens
AQKLCALII

SEQ ID NO: 1194756 - protein, 9 aa, Homo Sapiens
GPPMREVAE

SEQ ID NO: 1194757 - protein, 9 aa, Homo Sapiens
KVKQQNTLR

SEQ ID NO: 1194758 - protein, 9 aa, Homo Sapiens
IEAQVSADE

SEQ ID NO: 1194759 - protein, 9 aa, Homo Sapiens
APTRTSSTC

SEQ ID NO: 1194760 - protein, 9 aa, Homo Sapiens
YGYVGYIRD

SEQ ID NO: 1194761 - protein, 9 aa, Homo Sapiens
RHQCPASGG

SEQ ID NO: 1194762 - protein, 9 aa, Homo Sapiens
EKQKEDIEK

SEQ ID NO: 1194763 - protein, 9 aa, Homo Sapiens
PAPSTCSTR

SEQ ID NO: 1194764 - protein, 9 aa, Homo Sapiens
RRACQKQST

SEQ ID NO: 1194765 - protein, 9 aa, Homo Sapiens
RLSLLAPKT

SEQ ID NO: 1194766 - protein, 9 aa, Homo Sapiens
APCWTCPRA

SEQ ID NO: 1194767 - protein, 9 aa, Homo Sapiens
HGGQKEGDR

SEQ ID NO: 1194768 - protein, 9 aa, Homo Sapiens
DRAQGGEPQ

SEQ ID NO: 1194769 - protein, 9 aa, Homo Sapiens
SVVPDDRSV

SEQ ID NO: 1194770 - protein, 9 aa, Homo Sapiens
QQQPPQQQQ

SEQ ID NO: 1194771 - protein, 9 aa, Homo Sapiens
WSCQPLPQP

SEQ ID NO: 1194772 - protein, 9 aa, Homo Sapiens
VRPLACSHV

SEQ ID NO: 1194773 - protein, 9 aa, Homo Sapiens
ATRPPPTPF

SEQ ID NO: 1194774 - protein, 9 aa, Homo Sapiens
DAAAAAHRT

SEQ ID NO: 1194775 - protein, 9 aa, Homo Sapiens
LVQPGPYEA

SEQ ID NO: 1194776 - protein, 9 aa, Homo Sapiens
NLEKRTYKS

SEQ ID NO: 1194777 - protein, 9 aa, Homo Sapiens
LLHQPLPGQ

SEQ ID NO: 1194778 - protein, 9 aa, Homo Sapiens
NPMMCDLKE

SEQ ID NO: 1194779 - protein, 9 aa, Homo Sapiens
GPACQIILV

SEQ ID NO: 1194780 - protein, 9 aa, Homo Sapiens
LTLGAPTIS

SEQ ID NO: 1194781 - protein, 9 aa, Homo Sapiens
PVRRDKNFS

SEQ ID NO: 1194782 - protein, 9 aa, Homo Sapiens
WGAGRAIPR

SEQ ID NO: 1194783 - protein, 9 aa, Homo Sapiens
HKVLRPFYC

SEQ ID NO: 1194784 - protein, 9 aa, Homo Sapiens
RIWLPSVHV

SEQ ID NO: 1194785 - protein, 9 aa, Homo Sapiens
VHGIAPDVV

SEQ ID NO: 1194786 - protein, 9 aa, Homo Sapiens
QACINGHRD

SEQ ID NO: 1194787 - protein, 9 aa, Homo Sapiens
CLPSSTATV

SEQ ID NO: 1194788 - protein, 9 aa, Homo Sapiens
GPDSSGSRS

SEQ ID NO: 1194789 - protein, 9 aa, Homo Sapiens
KKLLCPKRE

SEQ ID NO: 1194790 - protein, 9 aa, Homo Sapiens
ECLEALDAN

SEQ ID NO: 1194791 - protein, 9 aa, Homo Sapiens
FHSEYLSSN

SEQ ID NO: 1194792 - protein, 9 aa, Homo Sapiens
TAFGIAFLL

SEQ ID NO: 1194793 - protein, 9 aa, Homo Sapiens
PHHLCPILC

SEQ ID NO: 1194794 - protein, 9 aa, Homo Sapiens
DELVLGAGL

SEQ ID NO: 1194795 - protein, 9 aa, Homo Sapiens
SLGGGYVSE

SEQ ID NO: 1194796 - protein, 9 aa, Homo Sapiens
NHSNSDNAE

SEQ ID NO: 1194797 - protein, 9 aa, Homo Sapiens
EYSQPSSAS

SEQ ID NO: 1194798 - protein, 9 aa, Homo Sapiens
GVARRRRRS

SEQ ID NO: 1194799 - protein, 9 aa, Homo Sapiens
AGPPALAHL

SEQ ID NO: 1194800 - protein, 9 aa, Homo Sapiens
LCQLSRGRI

SEQ ID NO: 1194801 - protein, 9 aa, Homo Sapiens
TTRNCSSTS

SEQ ID NO: 1194802 - protein, 9 aa, Homo Sapiens
HCRTQPSSC

SEQ ID NO: 1194803 - protein, 9 aa, Homo Sapiens
LRTVAVCMG

SEQ ID NO: 1194804 - protein, 9 aa, Homo Sapiens
NERINRAIQ

SEQ ID NO: 1194805 - protein, 9 aa, Homo Sapiens
MNPLVFGHG

SEQ ID NO: 1194806 - protein, 9 aa, Homo Sapiens
WASQSIWER

SEQ ID NO: 1194807 - protein, 9 aa, Homo Sapiens
GHVAGCRRW

SEQ ID NO: 1194808 - protein, 9 aa, Homo Sapiens
LAAIERQMA

SEQ ID NO: 1194809 - protein, 9 aa, Homo Sapiens
HPHPKPKTT

SEQ ID NO: 1194810 - protein, 9 aa, Homo Sapiens
PVSVDMGED

SEQ ID NO: 1194811 - protein, 9 aa, Homo Sapiens
DTCYGNILW

SEQ ID NO: 1194812 - protein, 9 aa, Homo Sapiens
EMHAVVIAA

SEQ ID NO: 1194813 - protein, 9 aa, Homo Sapiens
VRTEGSRIA

SEQ ID NO: 1194814 - protein, 9 aa, Homo Sapiens
NSGVKHVLD

SEQ ID NO: 1194815 - protein, 9 aa, Homo Sapiens
IFGQNFISP

SEQ ID NO: 1194816 - protein, 9 aa, Homo Sapiens
MAVSLGAPC

SEQ ID NO: 1194817 - protein, 9 aa, Homo Sapiens
PRYQGAAVA

SEQ ID NO: 1194818 - protein, 9 aa, Homo Sapiens
VAVCMGESA

SEQ ID NO: 1194819 - protein, 9 aa, Homo Sapiens
PSWTSRQWC

SEQ ID NO: 1194820 - protein, 9 aa, Homo Sapiens
KCICSSIGR

SEQ ID NO: 1194821 - protein, 9 aa, Homo Sapiens
VCVHSCVYV

SEQ ID NO: 1194822 - protein, 9 aa, Homo Sapiens
VCCEPATCP

SEQ ID NO: 1194823 - protein, 9 aa, Homo Sapiens
TPPAAPAPA

SEQ ID NO: 1194824 - protein, 9 aa, Homo Sapiens
IVSTQALGW

SEQ ID NO: 1194825 - protein, 9 aa, Homo Sapiens
ENLQALLTH

SEQ ID NO: 1194826 - protein, 9 aa, Homo Sapiens
NGWCQSEDA

SEQ ID NO: 1194827 - protein, 9 aa, Homo Sapiens
GQILVNGRS

SEQ ID NO: 1194828 - protein, 9 aa, Homo Sapiens
TRWPAPAAR

SEQ ID NO: 1194829 - protein, 9 aa, Homo Sapiens
SSTNSISRT

SEQ ID NO: 1194830 - protein, 9 aa, Homo Sapiens
PCPPRVTPR

SEQ ID NO: 1194831 - protein, 9 aa, Homo Sapiens
DQNTFHTLT

SEQ ID NO: 1194832 - protein, 9 aa, Homo Sapiens
LDKASFTTP

SEQ ID NO: 1194833 - protein, 9 aa, Homo Sapiens
VDYSFSEIH

SEQ ID NO: 1194834 - protein, 9 aa, Homo Sapiens
ENEGLVWVS

SEQ ID NO: 1194835 - protein, 9 aa, Homo Sapiens
IFSSSIQVF

SEQ ID NO: 1194836 - protein, 9 aa, Homo Sapiens
EGWHWGAAP

SEQ ID NO: 1194837 - protein, 9 aa, Homo Sapiens
ACSAGGDAS

SEQ ID NO: 1194838 - protein, 9 aa, Homo Sapiens
RYERDNNLA

SEQ ID NO: 1194839 - protein, 9 aa, Homo Sapiens
ICDNEYSGD

SEQ ID NO: 1194840 - protein, 9 aa, Homo Sapiens
QYPEKIHTK

SEQ ID NO: 1194841 - protein, 9 aa, Homo Sapiens
YPQGLWEDL

SEQ ID NO: 1194842 - protein, 9 aa, Homo Sapiens
YGEPRKLLA

SEQ ID NO: 1194843 - protein, 9 aa, Homo Sapiens
AARGLCSAA

SEQ ID NO: 1194844 - protein, 9 aa, Homo Sapiens
RRRATALSG

SEQ ID NO: 1194845 - protein, 9 aa, Homo Sapiens
VGGLDGDDE

SEQ ID NO: 1194846 - protein, 9 aa, Homo Sapiens
IESGMGSPG

SEQ ID NO: 1194847 - protein, 9 aa, Homo Sapiens
WGMESKEDI

SEQ ID NO: 1194848 - protein, 9 aa, Homo Sapiens
MSLRLLHLE

SEQ ID NO: 1194849 - protein, 9 aa, Homo Sapiens
EWEVTFLEQ

SEQ ID NO: 1194850 - protein, 9 aa, Homo Sapiens
VGGLRRRQL

SEQ ID NO: 1194851 - protein, 9 aa, Homo Sapiens
HEFDCKLHL

SEQ ID NO: 1194852 - protein, 9 aa, Homo Sapiens
LRLLLQALN

SEQ ID NO: 1194853 - protein, 9 aa, Homo Sapiens
RAPSDQVSC

SEQ ID NO: 1194854 - protein, 9 aa, Homo Sapiens
RGRGGVIPP

SEQ ID NO: 1194855 - protein, 9 aa, Homo Sapiens
GTANIKRYL

SEQ ID NO: 1194856 - protein, 9 aa, Homo Sapiens
FIFSSSIQV

SEQ ID NO: 1194857 - protein, 9 aa, Homo Sapiens
LLQPVRGHA

SEQ ID NO: 1194858 - protein, 9 aa, Homo Sapiens
NATELATIS

SEQ ID NO: 1194859 - protein, 9 aa, Homo Sapiens
VHVPPQTGQ

SEQ ID NO: 1194860 - protein, 9 aa, Homo Sapiens
AAAPTARAP

SEQ ID NO: 1194861 - protein, 9 aa, Homo Sapiens
LKNGVHSPI

SEQ ID NO: 1194862 - protein, 9 aa, Homo Sapiens
PPKMPPPRS

SEQ ID NO: 1194863 - protein, 9 aa, Homo Sapiens
QVPRPRPSQ

SEQ ID NO: 1194864 - protein, 9 aa, Homo Sapiens
SSRRARCCS

SEQ ID NO: 1194865 - protein, 9 aa, Homo Sapiens
KSAHLPEHI

SEQ ID NO: 1194866 - protein, 9 aa, Homo Sapiens
EPKFHSEYL

SEQ ID NO: 1194867 - protein, 9 aa, Homo Sapiens
HPFACDWQG

SEQ ID NO: 1194868 - protein, 9 aa, Homo Sapiens
LLILLIIWT

SEQ ID NO: 1194869 - protein, 9 aa, Homo Sapiens
WHWGAAPMM

SEQ ID NO: 1194870 - protein, 9 aa, Homo Sapiens
HVTGSAACG

SEQ ID NO: 1194871 - protein, 9 aa, Homo Sapiens
NKLAQKFPL

SEQ ID NO: 1194872 - protein, 9 aa, Homo Sapiens
YMSRIHGGA

SEQ ID NO: 1194873 - protein, 9 aa, Homo Sapiens
AHTCWQRRT

SEQ ID NO: 1194874 - protein, 9 aa, Homo Sapiens
DKAGLSEHS

SEQ ID NO: 1194875 - protein, 9 aa, Homo Sapiens
VIPEGSHIK

SEQ ID NO: 1194876 - protein, 9 aa, Homo Sapiens
TVFIWCCLN

SEQ ID NO: 1194877 - protein, 9 aa, Homo Sapiens
MKTIHCNRI

SEQ ID NO: 1194878 - protein, 9 aa, Homo Sapiens
EESREALSQ

SEQ ID NO: 1194879 - protein, 9 aa, Homo Sapiens
GTGGALSSA

SEQ ID NO: 1194880 - protein, 9 aa, Homo Sapiens
HSLVTVMAE

SEQ ID NO: 1194881 - protein, 9 aa, Homo Sapiens
MCGVVLRVV

SEQ ID NO: 1194882 - protein, 9 aa, Homo Sapiens
QKYRRKGKK

SEQ ID NO: 1194883 - protein, 9 aa, Homo Sapiens
ARTAATPTL

SEQ ID NO: 1194884 - protein, 9 aa, Homo Sapiens
QPPGKRSTA

SEQ ID NO: 1194885 - protein, 9 aa, Homo Sapiens
SACEVFCFY

SEQ ID NO: 1194886 - protein, 9 aa, Homo Sapiens
IARNLQAMS

SEQ ID NO: 1194887 - protein, 9 aa, Homo Sapiens
LLRLQSLLS

SEQ ID NO: 1194888 - protein, 9 aa, Homo Sapiens
SPSRRPLGV

SEQ ID NO: 1194889 - protein, 9 aa, Homo Sapiens
VAAPGLAAR

SEQ ID NO: 1194890 - protein, 9 aa, Homo Sapiens
NRALHSAVK

SEQ ID NO: 1194891 - protein, 9 aa, Homo Sapiens
NFRKVRSFL

SEQ ID NO: 1194892 - protein, 9 aa, Homo Sapiens
LWEDLIAWL

SEQ ID NO: 1194893 - protein, 9 aa, Homo Sapiens
TMSLAAHRS

SEQ ID NO: 1194894 - protein, 9 aa, Homo Sapiens
VNFVALAVF

SEQ ID NO: 1194895 - protein, 9 aa, Homo Sapiens
DPSLWDRQG

SEQ ID NO: 1194896 - protein, 9 aa, Homo Sapiens
EGIGHVAPS

SEQ ID NO: 1194897 - protein, 9 aa, Homo Sapiens
ARRRTTCRR

SEQ ID NO: 1194898 - protein, 9 aa, Homo Sapiens
RRALGFRSR

SEQ ID NO: 1194899 - protein, 9 aa, Homo Sapiens
TPASVPPGR

SEQ ID NO: 1194900 - protein, 9 aa, Homo Sapiens
QACGEEPSH

SEQ ID NO: 1194901 - protein, 9 aa, Homo Sapiens
KNRIATQKS

SEQ ID NO: 1194902 - protein, 9 aa, Homo Sapiens
LACRRRRSR

SEQ ID NO: 1194903 - protein, 9 aa, Homo Sapiens
KCRFSKGGK

SEQ ID NO: 1194904 - protein, 9 aa, Homo Sapiens
IFPALSRNK

SEQ ID NO: 1194905 - protein, 9 aa, Homo Sapiens
ILMIAQKKG

SEQ ID NO: 1194906 - protein, 9 aa, Homo Sapiens
PHQAGSPRY

SEQ ID NO: 1194907 - protein, 9 aa, Homo Sapiens
GLGGSPASP

SEQ ID NO: 1194908 - protein, 9 aa, Homo Sapiens
VAKGSRRCT

SEQ ID NO: 1194909 - protein, 9 aa, Homo Sapiens
EHSLTAAGG

SEQ ID NO: 1194910 - protein, 9 aa, Homo Sapiens
GALTLEIRK

SEQ ID NO: 1194911 - protein, 9 aa, Homo Sapiens
KANPNDRCF

SEQ ID NO: 1194912 - protein, 9 aa, Homo Sapiens
LGVSPLAPC

SEQ ID NO: 1194913 - protein, 9 aa, Homo Sapiens
NKARKVKKR

SEQ ID NO: 1194914 - protein, 9 aa, Homo Sapiens
VRHISSEHF

SEQ ID NO: 1194915 - protein, 9 aa, Homo Sapiens
GVGVFNLTL

SEQ ID NO: 1194916 - protein, 9 aa, Homo Sapiens
TAMAMVYVL

SEQ ID NO: 1194917 - protein, 9 aa, Homo Sapiens
MMSSMACGS

SEQ ID NO: 1194918 - protein, 9 aa, Homo Sapiens
QPSSASSAY

SEQ ID NO: 1194919 - protein, 9 aa, Homo Sapiens
SQKNEVFWM

SEQ ID NO: 1194920 - protein, 9 aa, Homo Sapiens
ILFGAVLLV

SEQ ID NO: 1194921 - protein, 9 aa, Homo Sapiens
HPSLLFFNP

SEQ ID NO: 1194922 - protein, 9 aa, Homo Sapiens
YLSMQDRME

SEQ ID NO: 1194923 - protein, 9 aa, Homo Sapiens
HRPAHAYLL

SEQ ID NO: 1194924 - protein, 9 aa, Homo Sapiens
ETMRTRLEH

SEQ ID NO: 1194925 - protein, 9 aa, Homo Sapiens
YSQPLNIMS

SEQ ID NO: 1194926 - protein, 9 aa, Homo Sapiens
GVLQMRSLE

SEQ ID NO: 1194927 - protein, 9 aa, Homo Sapiens
HGRSSRQPR

SEQ ID NO: 1194928 - protein, 9 aa, Homo Sapiens
AARAAGGAA

SEQ ID NO: 1194929 - protein, 9 aa, Homo Sapiens
RRQRRRRRR

SEQ ID NO: 1194930 - protein, 9 aa, Homo Sapiens
QLPPLPPGC

SEQ ID NO: 1194931 - protein, 9 aa, Homo Sapiens
QPPGPAPWW

SEQ ID NO: 1194932 - protein, 9 aa, Homo Sapiens
LRRLCGRGA

SEQ ID NO: 1194933 - protein, 9 aa, Homo Sapiens
DFQECVSLH

SEQ ID NO: 1194934 - protein, 9 aa, Homo Sapiens
SRLRCARTM

SEQ ID NO: 1194935 - protein, 9 aa, Homo Sapiens
LFDEFVRES

SEQ ID NO: 1194936 - protein, 9 aa, Homo Sapiens
SSDHEGTVI

SEQ ID NO: 1194937 - protein, 9 aa, Homo Sapiens
RDRKFLGEE

SEQ ID NO: 1194938 - protein, 9 aa, Homo Sapiens
FLVVELEPW

SEQ ID NO: 1194939 - protein, 9 aa, Homo Sapiens
PHRAAPATV

SEQ ID NO: 1194940 - protein, 9 aa, Homo Sapiens
YLAYQNFMI

SEQ ID NO: 1194941 - protein, 9 aa, Homo Sapiens
PLDTLRVPS

SEQ ID NO: 1194942 - protein, 9 aa, Homo Sapiens
FYSPLLLFC

SEQ ID NO: 1194943 - protein, 9 aa, Homo Sapiens
AMRWTLCFA

SEQ ID NO: 1194944 - protein, 9 aa, Homo Sapiens
RAGTRPGLG

SEQ ID NO: 1194945 - protein, 9 aa, Homo Sapiens
TPGASAGRR

SEQ ID NO: 1194946 - protein, 9 aa, Homo Sapiens
VIDHKIESD

SEQ ID NO: 1194947 - protein, 9 aa, Homo Sapiens
GPAPSTCST

SEQ ID NO: 1194948 - protein, 9 aa, Homo Sapiens
PLGVSPLAP

SEQ ID NO: 1194949 - protein, 9 aa, Homo Sapiens
CPHPSGLRE

SEQ ID NO: 1194950 - protein, 9 aa, Homo Sapiens
IMKTAKSSS

SEQ ID NO: 1194951 - protein, 9 aa, Homo Sapiens
GRVVEAGGS

SEQ ID NO: 1194952 - protein, 9 aa, Homo Sapiens
LLFTLINSF

SEQ ID NO: 1194953 - protein, 9 aa, Homo Sapiens
PISTQRTAV

SEQ ID NO: 1194954 - protein, 9 aa, Homo Sapiens
PGARRHPPR

SEQ ID NO: 1194955 - protein, 9 aa, Homo Sapiens
GSGSAVGRG

SEQ ID NO: 1194956 - protein, 9 aa, Homo Sapiens
DTDYKSVPL

SEQ ID NO: 1194957 - protein, 9 aa, Homo Sapiens
ECQGFVPDA

SEQ ID NO: 1194958 - protein, 9 aa, Homo Sapiens
VLGFQNPTL

SEQ ID NO: 1194959 - protein, 9 aa, Homo Sapiens
RSTCTLWTW

SEQ ID NO: 1194960 - protein, 9 aa, Homo Sapiens
HCPPPTAAP

SEQ ID NO: 1194961 - protein, 9 aa, Homo Sapiens
APGHADSHV

SEQ ID NO: 1194962 - protein, 9 aa, Homo Sapiens
KNGFTFRKE

SEQ ID NO: 1194963 - protein, 9 aa, Homo Sapiens
LVLRPPTLW

SEQ ID NO: 1194964 - protein, 9 aa, Homo Sapiens
LRAFDGAHP

SEQ ID NO: 1194965 - protein, 9 aa, Homo Sapiens
AWPPPWLSP

SEQ ID NO: 1194966 - protein, 9 aa, Homo Sapiens
LLLAPVPGS

SEQ ID NO: 1194967 - protein, 9 aa, Homo Sapiens
GRPHAPPAA

SEQ ID NO: 1194968 - protein, 9 aa, Homo Sapiens
QLSIHFAAH

SEQ ID NO: 1194969 - protein, 9 aa, Homo Sapiens
THVQDLTPA

SEQ ID NO: 1194970 - protein, 9 aa, Homo Sapiens
PNPCEDKDR

SEQ ID NO: 1194971 - protein, 9 aa, Homo Sapiens
WEVTFLEQW

SEQ ID NO: 1194972 - protein, 9 aa, Homo Sapiens
PWPGLPGDH

SEQ ID NO: 1194973 - protein, 9 aa, Homo Sapiens
GRLCPALPA

SEQ ID NO: 1194974 - protein, 9 aa, Homo Sapiens
KTMVCCLKT

SEQ ID NO: 1194975 - protein, 9 aa, Homo Sapiens
RRRGLPCPR

SEQ ID NO: 1194976 - protein, 9 aa, Homo Sapiens
NDSSGSSFG

SEQ ID NO: 1194977 - protein, 9 aa, Homo Sapiens
GSHTMDFLK

SEQ ID NO: 1194978 - protein, 9 aa, Homo Sapiens
ESVFSWDET

SEQ ID NO: 1194979 - protein, 9 aa, Homo Sapiens
SSWKMAAVF

SEQ ID NO: 1194980 - protein, 9 aa, Homo Sapiens
QGTPAEQEA

SEQ ID NO: 1194981 - protein, 9 aa, Homo Sapiens
TAGTIFCLP

SEQ ID NO: 1194982 - protein, 9 aa, Homo Sapiens
QAAAAGGRE

SEQ ID NO: 1194983 - protein, 9 aa, Homo Sapiens
VLQTRVKTT

SEQ ID NO: 1194984 - protein, 9 aa, Homo Sapiens
AKEKTSACR

SEQ ID NO: 1194985 - protein, 9 aa, Homo Sapiens
VCGPGSSAD

SEQ ID NO: 1194986 - protein, 9 aa, Homo Sapiens
GAAPMMSSM

SEQ ID NO: 1194987 - protein, 9 aa, Homo Sapiens
SAFARTLRR

SEQ ID NO: 1194988 - protein, 9 aa, Homo Sapiens
SVASCWPDA

SEQ ID NO: 1194989 - protein, 9 aa, Homo Sapiens
YYQRRHPEH

SEQ ID NO: 1194990 - protein, 9 aa, Homo Sapiens
HFASPNQNS

SEQ ID NO: 1194991 - protein, 9 aa, Homo Sapiens
TMCIKECLC

SEQ ID NO: 1194992 - protein, 9 aa, Homo Sapiens
REHLEDVVG

SEQ ID NO: 1194993 - protein, 9 aa, Homo Sapiens
GGVGEPRHC

SEQ ID NO: 1194994 - protein, 9 aa, Homo Sapiens
PTIQTHNIR

SEQ ID NO: 1194995 - protein, 9 aa, Homo Sapiens
CSSTSCGSC

SEQ ID NO: 1194996 - protein, 9 aa, Homo Sapiens
EKYRVLACR

SEQ ID NO: 1194997 - protein, 9 aa, Homo Sapiens
GKKVVVVKN

SEQ ID NO: 1194998 - protein, 9 aa, Homo Sapiens
AYKCQIVIV

SEQ ID NO: 1194999 - protein, 9 aa, Homo Sapiens
PNLSPTVEY

SEQ ID NO: 1195000 - protein, 9 aa, Homo Sapiens
WCTTSAPRR

SEQ ID NO: 1195001 - protein, 9 aa, Homo Sapiens
SERGAAKQR

SEQ ID NO: 1195002 - protein, 9 aa, Homo Sapiens
RRRRSRRGR

SEQ ID NO: 1195003 - protein, 9 aa, Homo Sapiens
CPWLQWPVL

SEQ ID NO: 1195004 - protein, 9 aa, Homo Sapiens
RTGNMRELI

SEQ ID NO: 1195005 - protein, 9 aa, Homo Sapiens
REEQGNQMA

SEQ ID NO: 1195006 - protein, 9 aa, Homo Sapiens
SLPRAVLSA

SEQ ID NO: 1195007 - protein, 9 aa, Homo Sapiens
QKKNMSCLW

SEQ ID NO: 1195008 - protein, 9 aa, Homo Sapiens
CGFTQDRGL

SEQ ID NO: 1195009 - protein, 9 aa, Homo Sapiens
KMSVILSVV

SEQ ID NO: 1195010 - protein, 9 aa, Homo Sapiens
ITRDFNLLH

SEQ ID NO: 1195011 - protein, 9 aa, Homo Sapiens
RDVNRRRAM

SEQ ID NO: 1195012 - protein, 9 aa, Homo Sapiens
STGAVKAVT

SEQ ID NO: 1195013 - protein, 9 aa, Homo Sapiens
LGRWAEAEG

SEQ ID NO: 1195014 - protein, 9 aa, Homo Sapiens
SSVSFPVDF

SEQ ID NO: 1195015 - protein, 9 aa, Homo Sapiens
SMYRSAHFL

SEQ ID NO: 1195016 - protein, 9 aa, Homo Sapiens
LGLDRAPHL

SEQ ID NO: 1195017 - protein, 9 aa, Homo Sapiens
LGWSPCDRS

SEQ ID NO: 1195018 - protein, 9 aa, Homo Sapiens
SKGKKCICS

SEQ ID NO: 1195019 - protein, 9 aa, Homo Sapiens
GCGTFFASA

SEQ ID NO: 1195020 - protein, 9 aa, Homo Sapiens
DATTEMLEE

SEQ ID NO: 1195021 - protein, 9 aa, Homo Sapiens
NMVVCSCGC

SEQ ID NO: 1195022 - protein, 9 aa, Homo Sapiens
ALAMHKRTA

SEQ ID NO: 1195023 - protein, 9 aa, Homo Sapiens
STTLDRSEE

SEQ ID NO: 1195024 - protein, 9 aa, Homo Sapiens
HLHRQISLP

SEQ ID NO: 1195025 - protein, 9 aa, Homo Sapiens
HSLPSDPHL

SEQ ID NO: 1195026 - protein, 9 aa, Homo Sapiens
GVEMVLLWI

SEQ ID NO: 1195027 - protein, 9 aa, Homo Sapiens
SLLAAAGGN

SEQ ID NO: 1195028 - protein, 9 aa, Homo Sapiens
LHCGPPSPP

SEQ ID NO: 1195029 - protein, 9 aa, Homo Sapiens
TYLVLERLE

SEQ ID NO: 1195030 - protein, 9 aa, Homo Sapiens
TLWTWMTCT

SEQ ID NO: 1195031 - protein, 9 aa, Homo Sapiens
LLLKALAPL

SEQ ID NO: 1195032 - protein, 9 aa, Homo Sapiens
YLAKTGGSR

SEQ ID NO: 1195033 - protein, 9 aa, Homo Sapiens
YSQARLDVQ

SEQ ID NO: 1195034 - protein, 9 aa, Homo Sapiens
LVLQQVGQP

SEQ ID NO: 1195035 - protein, 9 aa, Homo Sapiens
AQGDHQSPI

SEQ ID NO: 1195036 - protein, 9 aa, Homo Sapiens
VEVREAHEA

SEQ ID NO: 1195037 - protein, 9 aa, Homo Sapiens
MPDHDSTAI

SEQ ID NO: 1195038 - protein, 9 aa, Homo Sapiens
IRQDETFNC

SEQ ID NO: 1195039 - protein, 9 aa, Homo Sapiens
TSGILGVPL

SEQ ID NO: 1195040 - protein, 9 aa, Homo Sapiens
VEYNDGRPA

SEQ ID NO: 1195041 - protein, 9 aa, Homo Sapiens
WASGQPLDP

SEQ ID NO: 1195042 - protein, 9 aa, Homo Sapiens
KVMGPLSFN

SEQ ID NO: 1195043 - protein, 9 aa, Homo Sapiens
EHLEDVVGG

SEQ ID NO: 1195044 - protein, 9 aa, Homo Sapiens
TVMNPNVLM

SEQ ID NO: 1195045 - protein, 9 aa, Homo Sapiens
FNEAKYNAF

SEQ ID NO: 1195046 - protein, 9 aa, Homo Sapiens
AELQGGSKW

SEQ ID NO: 1195047 - protein, 9 aa, Homo Sapiens
ELLQLHAGR

SEQ ID NO: 1195048 - protein, 9 aa, Homo Sapiens
GSAACGCGC

SEQ ID NO: 1195049 - protein, 9 aa, Homo Sapiens
HRVAERQVG

SEQ ID NO: 1195050 - protein, 9 aa, Homo Sapiens
RCHMLERFV

SEQ ID NO: 1195051 - protein, 9 aa, Homo Sapiens
PRHSSVLAT

SEQ ID NO: 1195052 - protein, 9 aa, Homo Sapiens
RLRSGARGS

SEQ ID NO: 1195053 - protein, 9 aa, Homo Sapiens
VKLPLDNKT

SEQ ID NO: 1195054 - protein, 9 aa, Homo Sapiens
VGLAHLVVG

SEQ ID NO: 1195055 - protein, 9 aa, Homo Sapiens
AARRPPGVP

SEQ ID NO: 1195056 - protein, 9 aa, Homo Sapiens
SEYLSSNPS

SEQ ID NO: 1195057 - protein, 9 aa, Homo Sapiens
FRAMAGLQL

SEQ ID NO: 1195058 - protein, 9 aa, Homo Sapiens
TVGSCCKNR

SEQ ID NO: 1195059 - protein, 9 aa, Homo Sapiens
LNWVLPPDI

SEQ ID NO: 1195060 - protein, 9 aa, Homo Sapiens
APHPRTASI

SEQ ID NO: 1195061 - protein, 9 aa, Homo Sapiens
SLLAPKTTL

SEQ ID NO: 1195062 - protein, 9 aa, Homo Sapiens
QPKYRDRKV

SEQ ID NO: 1195063 - protein, 9 aa, Homo Sapiens
KTRAKCLLH

SEQ ID NO: 1195064 - protein, 9 aa, Homo Sapiens
PDGSHLGQP

SEQ ID NO: 1195065 - protein, 9 aa, Homo Sapiens
GNTIIILVS

SEQ ID NO: 1195066 - protein, 9 aa, Homo Sapiens
KNEVFWMWS

SEQ ID NO: 1195067 - protein, 9 aa, Homo Sapiens
DQCCFQNGR

SEQ ID NO: 1195068 - protein, 9 aa, Homo Sapiens
RLLLHFGQA

SEQ ID NO: 1195069 - protein, 9 aa, Homo Sapiens
ETWASGQPL

SEQ ID NO: 1195070 - protein, 9 aa, Homo Sapiens
SLSMMAALT

SEQ ID NO: 1195071 - protein, 9 aa, Homo Sapiens
VSWKKRISK

SEQ ID NO: 1195072 - protein, 9 aa, Homo Sapiens
VLAPVAVND

SEQ ID NO: 1195073 - protein, 9 aa, Homo Sapiens
SNGCWGWQQ

SEQ ID NO: 1195074 - protein, 9 aa, Homo Sapiens
HLDILQTVL

SEQ ID NO: 1195075 - protein, 9 aa, Homo Sapiens
CHANIIQLV

SEQ ID NO: 1195076 - protein, 9 aa, Homo Sapiens
SSRRQTRPK

SEQ ID NO: 1195077 - protein, 9 aa, Homo Sapiens
KSSAFDRYT

SEQ ID NO: 1195078 - protein, 9 aa, Homo Sapiens
PGLVDRHRV

SEQ ID NO: 1195079 - protein, 9 aa, Homo Sapiens
RGATSRGGR

SEQ ID NO: 1195080 - protein, 9 aa, Homo Sapiens
RNGFKDNSH

SEQ ID NO: 1195081 - protein, 9 aa, Homo Sapiens
AVDQQIRTP

SEQ ID NO: 1195082 - protein, 9 aa, Homo Sapiens
EGGGSEFLF

SEQ ID NO: 1195083 - protein, 9 aa, Homo Sapiens
PPSFLPQRG

SEQ ID NO: 1195084 - protein, 9 aa, Homo Sapiens
MDAHSFYSF

SEQ ID NO: 1195085 - protein, 9 aa, Homo Sapiens
LAVTLQGVR

SEQ ID NO: 1195086 - protein, 9 aa, Homo Sapiens
DHTMSSGVN

SEQ ID NO: 1195087 - protein, 9 aa, Homo Sapiens
QGSLVADHD

SEQ ID NO: 1195088 - protein, 9 aa, Homo Sapiens
NPRVARVNN

SEQ ID NO: 1195089 - protein, 9 aa, Homo Sapiens
PEHVSFCAT

SEQ ID NO: 1195090 - protein, 9 aa, Homo Sapiens
QNNNFQTFP

SEQ ID NO: 1195091 - protein, 9 aa, Homo Sapiens
QASSLQKSC

SEQ ID NO: 1195092 - protein, 9 aa, Homo Sapiens
KSIQLSYRK

SEQ ID NO: 1195093 - protein, 9 aa, Homo Sapiens
LTAAEQAVF

SEQ ID NO: 1195094 - protein, 9 aa, Homo Sapiens
LGSRSGGRS

SEQ ID NO: 1195095 - protein, 9 aa, Homo Sapiens
PGHHGADVE

SEQ ID NO: 1195096 - protein, 9 aa, Homo Sapiens
QNAYYFFVQ

SEQ ID NO: 1195097 - protein, 9 aa, Homo Sapiens
WMEWKIEGR

SEQ ID NO: 1195098 - protein, 9 aa, Homo Sapiens
AGGGPECVP

SEQ ID NO: 1195099 - protein, 9 aa, Homo Sapiens
RELGARWDA

SEQ ID NO: 1195100 - protein, 9 aa, Homo Sapiens
RKHRGPWGP

SEQ ID NO: 1195101 - protein, 9 aa, Homo Sapiens
PSTAIILRH

SEQ ID NO: 1195102 - protein, 9 aa, Homo Sapiens
QLSRGRIYI

SEQ ID NO: 1195103 - protein, 9 aa, Homo Sapiens
PGGAEERME

SEQ ID NO: 1195104 - protein, 9 aa, Homo Sapiens
AYYPGLSRP

SEQ ID NO: 1195105 - protein, 9 aa, Homo Sapiens
RWAGVASSG

SEQ ID NO: 1195106 - protein, 9 aa, Homo Sapiens
SQYSSGLRP

SEQ ID NO: 1195107 - protein, 9 aa, Homo Sapiens
VLNRMQAVR

SEQ ID NO: 1195108 - protein, 9 aa, Homo Sapiens
WRRGGGQVP

SEQ ID NO: 1195109 - protein, 9 aa, Homo Sapiens
DGAHPPPSG

SEQ ID NO: 1195110 - protein, 9 aa, Homo Sapiens
WQLDGIRNI

SEQ ID NO: 1195111 - protein, 9 aa, Homo Sapiens
WMWGEQEQQ

SEQ ID NO: 1195112 - protein, 9 aa, Homo Sapiens
IYLAYQNFM

SEQ ID NO: 1195113 - protein, 9 aa, Homo Sapiens
RATWAPCMP

SEQ ID NO: 1195114 - protein, 9 aa, Homo Sapiens
PRGAFIYNM

SEQ ID NO: 1195115 - protein, 9 aa, Homo Sapiens
ASGGCCSPA

SEQ ID NO: 1195116 - protein, 9 aa, Homo Sapiens
LNLGIAPGD

SEQ ID NO: 1195117 - protein, 9 aa, Homo Sapiens
RWKVADLQP

SEQ ID NO: 1195118 - protein, 9 aa, Homo Sapiens
PPGGAEERM

SEQ ID NO: 1195119 - protein, 9 aa, Homo Sapiens
DKMLRTRSK

SEQ ID NO: 1195120 - protein, 9 aa, Homo Sapiens
FFNAGGSMK

SEQ ID NO: 1195121 - protein, 9 aa, Homo Sapiens
ASINLSTIK

SEQ ID NO: 1195122 - protein, 9 aa, Homo Sapiens
AGPEVVGPL

SEQ ID NO: 1195123 - protein, 9 aa, Homo Sapiens
SNLVYSTDI

SEQ ID NO: 1195124 - protein, 9 aa, Homo Sapiens
CKQRGKLLS

SEQ ID NO: 1195125 - protein, 9 aa, Homo Sapiens
KIIRNTLYK

SEQ ID NO: 1195126 - protein, 9 aa, Homo Sapiens
QAARRPPGV

SEQ ID NO: 1195127 - protein, 9 aa, Homo Sapiens
LLKKLLKWH

SEQ ID NO: 1195128 - protein, 9 aa, Homo Sapiens
EIAGLEEDK

SEQ ID NO: 1195129 - protein, 9 aa, Homo Sapiens
NPSGVILSI

SEQ ID NO: 1195130 - protein, 9 aa, Homo Sapiens
TFCPRNVPT

SEQ ID NO: 1195131 - protein, 9 aa, Homo Sapiens
DMPIVITVL

SEQ ID NO: 1195132 - protein, 9 aa, Homo Sapiens
KHHRRERRF

SEQ ID NO: 1195133 - protein, 9 aa, Homo Sapiens
LLLQALNVG

SEQ ID NO: 1195134 - protein, 9 aa, Homo Sapiens
GPTVPGDPW

SEQ ID NO: 1195135 - protein, 9 aa, Homo Sapiens
FVANSLQLK

SEQ ID NO: 1195136 - protein, 9 aa, Homo Sapiens
IHFVKPDTG

SEQ ID NO: 1195137 - protein, 9 aa, Homo Sapiens
TFANLQQSH

SEQ ID NO: 1195138 - protein, 9 aa, Homo Sapiens
SCVCILGEL

SEQ ID NO: 1195139 - protein, 9 aa, Homo Sapiens
PGGSGSANQ

SEQ ID NO: 1195140 - protein, 9 aa, Homo Sapiens
VWLHFSPPL

SEQ ID NO: 1195141 - protein, 9 aa, Homo Sapiens
PTPCATCRT

SEQ ID NO: 1195142 - protein, 9 aa, Homo Sapiens
CAFLLWKKR

SEQ ID NO: 1195143 - protein, 9 aa, Homo Sapiens
RPSYRPWRG

SEQ ID NO: 1195144 - protein, 9 aa, Homo Sapiens
KKSISLTKA

SEQ ID NO: 1195145 - protein, 9 aa, Homo Sapiens
RRPVQRPQQ

SEQ ID NO: 1195146 - protein, 9 aa, Homo Sapiens
MVTAATFCP

SEQ ID NO: 1195147 - protein, 9 aa, Homo Sapiens
NMCGVVLRV

SEQ ID NO: 1195148 - protein, 9 aa, Homo Sapiens
WIIRLGIAV

SEQ ID NO: 1195149 - protein, 9 aa, Homo Sapiens
HWEGLWGWR

SEQ ID NO: 1195150 - protein, 9 aa, Homo Sapiens
SEQPPAEDQ

SEQ ID NO: 1195151 - protein, 9 aa, Homo Sapiens
DLHLEVVEG

SEQ ID NO: 1195152 - protein, 9 aa, Homo Sapiens
QSSLGGGYV

SEQ ID NO: 1195153 - protein, 9 aa, Homo Sapiens
ALVGAGAAW

SEQ ID NO: 1195154 - protein, 9 aa, Homo Sapiens
PSVPLLPRL

SEQ ID NO: 1195155 - protein, 9 aa, Homo Sapiens
LLSHEAGGD

SEQ ID NO: 1195156 - protein, 9 aa, Homo Sapiens
PYSPILKFF

SEQ ID NO: 1195157 - protein, 9 aa, Homo Sapiens
DVSHDSARV

SEQ ID NO: 1195158 - protein, 9 aa, Homo Sapiens
PPPPPPTTT

SEQ ID NO: 1195159 - protein, 9 aa, Homo Sapiens
QAAEGGHVE

SEQ ID NO: 1195160 - protein, 9 aa, Homo Sapiens
CSLMRRVWM

SEQ ID NO: 1195161 - protein, 9 aa, Homo Sapiens
ASITLPTTS

SEQ ID NO: 1195162 - protein, 9 aa, Homo Sapiens
KEEQQQLLR

SEQ ID NO: 1195163 - protein, 9 aa, Homo Sapiens
QRTEAGPPA

SEQ ID NO: 1195164 - protein, 9 aa, Homo Sapiens
NWKPSWTSR

SEQ ID NO: 1195165 - protein, 9 aa, Homo Sapiens
VPLVRTGLL

SEQ ID NO: 1195166 - protein, 9 aa, Homo Sapiens
RRSCSGLVR

SEQ ID NO: 1195167 - protein, 9 aa, Homo Sapiens
CNRFVHPSA

SEQ ID NO: 1195168 - protein, 9 aa, Homo Sapiens
GIMEEAEPA

SEQ ID NO: 1195169 - protein, 9 aa, Homo Sapiens
LVCSALPFD

SEQ ID NO: 1195170 - protein, 9 aa, Homo Sapiens
HQRGRPREL

SEQ ID NO: 1195171 - protein, 9 aa, Homo Sapiens
TPVPGKAHK

SEQ ID NO: 1195172 - protein, 9 aa, Homo Sapiens
GCGSSCQSG

SEQ ID NO: 1195173 - protein, 9 aa, Homo Sapiens
CGKAFHQGL

SEQ ID NO: 1195174 - protein, 9 aa, Homo Sapiens
SQTRPLWSR

SEQ ID NO: 1195175 - protein, 9 aa, Homo Sapiens
VQTAISFQL

SEQ ID NO: 1195176 - protein, 9 aa, Homo Sapiens
GILAIIYMS

SEQ ID NO: 1195177 - protein, 9 aa, Homo Sapiens
AAQDGRVDS

SEQ ID NO: 1195178 - protein, 9 aa, Homo Sapiens
PLPLRPSHS

SEQ ID NO: 1195179 - protein, 9 aa, Homo Sapiens
LSEHTHRYE

SEQ ID NO: 1195180 - protein, 9 aa, Homo Sapiens
QLKEMAPTI

SEQ ID NO: 1195181 - protein, 9 aa, Homo Sapiens
LLLLLLVVL

SEQ ID NO: 1195182 - protein, 9 aa, Homo Sapiens
TDKQYFVVL

SEQ ID NO: 1195183 - protein, 9 aa, Homo Sapiens
VSHLCNFNV

SEQ ID NO: 1195184 - protein, 9 aa, Homo Sapiens
RNPKGKKRQ

SEQ ID NO: 1195185 - protein, 9 aa, Homo Sapiens
GCARLSTKH

SEQ ID NO: 1195186 - protein, 9 aa, Homo Sapiens
VSLGAPCWA

SEQ ID NO: 1195187 - protein, 9 aa, Homo Sapiens
PGRGGRPRR

SEQ ID NO: 1195188 - protein, 9 aa, Homo Sapiens
PEAIKAWGM

SEQ ID NO: 1195189 - protein, 9 aa, Homo Sapiens
STNSISRTC

SEQ ID NO: 1195190 - protein, 9 aa, Homo Sapiens
CEVFCFYKL

SEQ ID NO: 1195191 - protein, 9 aa, Homo Sapiens
CPVGRHRSC

SEQ ID NO: 1195192 - protein, 9 aa, Homo Sapiens
ALWALGRPL

SEQ ID NO: 1195193 - protein, 9 aa, Homo Sapiens
LREQFLRPA

SEQ ID NO: 1195194 - protein, 9 aa, Homo Sapiens
SFNCSSGDF

SEQ ID NO: 1195195 - protein, 9 aa, Homo Sapiens
KASILKDQW

SEQ ID NO: 1195196 - protein, 9 aa, Homo Sapiens
SHTGERPFT

SEQ ID NO: 1195197 - protein, 9 aa, Homo Sapiens
LMVIVTACL

SEQ ID NO: 1195198 - protein, 9 aa, Homo Sapiens
EQPLFPQIL

SEQ ID NO: 1195199 - protein, 9 aa, Homo Sapiens
KRGCGCLVL

SEQ ID NO: 1195200 - protein, 9 aa, Homo Sapiens
GALKLRGSG

SEQ ID NO: 1195201 - protein, 9 aa, Homo Sapiens
VGPGGCIPA

SEQ ID NO: 1195202 - protein, 9 aa, Homo Sapiens
EMVLLWIIE

SEQ ID NO: 1195203 - protein, 9 aa, Homo Sapiens
TEVFTLFLV

SEQ ID NO: 1195204 - protein, 9 aa, Homo Sapiens
PSSTATVGL

SEQ ID NO: 1195205 - protein, 9 aa, Homo Sapiens
ETFQHPCNT

SEQ ID NO: 1195206 - protein, 9 aa, Homo Sapiens
LGVPLTCSV

SEQ ID NO: 1195207 - protein, 9 aa, Homo Sapiens
WPGCRGGLA

SEQ ID NO: 1195208 - protein, 9 aa, Homo Sapiens
AVFLDFDFV

SEQ ID NO: 1195209 - protein, 9 aa, Homo Sapiens
CCKKCTYRD

SEQ ID NO: 1195210 - protein, 9 aa, Homo Sapiens
PWPVATVGA

SEQ ID NO: 1195211 - protein, 9 aa, Homo Sapiens
NGLMSLRLL

SEQ ID NO: 1195212 - protein, 9 aa, Homo Sapiens
WTIGVEMVL

SEQ ID NO: 1195213 - protein, 9 aa, Homo Sapiens
GVPAGHVCP

SEQ ID NO: 1195214 - protein, 9 aa, Homo Sapiens
ALAPALCRA

SEQ ID NO: 1195215 - protein, 9 aa, Homo Sapiens
SFEFFFAMS

SEQ ID NO: 1195216 - protein, 9 aa, Homo Sapiens
FSESRHPSR

SEQ ID NO: 1195217 - protein, 9 aa, Homo Sapiens
GAQDGVHEV

SEQ ID NO: 1195218 - protein, 9 aa, Homo Sapiens
WIVDNVNRA

SEQ ID NO: 1195219 - protein, 9 aa, Homo Sapiens
VYPQRNLSA

SEQ ID NO: 1195220 - protein, 9 aa, Homo Sapiens
SLDPLAFFY

SEQ ID NO: 1195221 - protein, 9 aa, Homo Sapiens
PPGWLPRLT

SEQ ID NO: 1195222 - protein, 9 aa, Homo Sapiens
WLPHVADFW

SEQ ID NO: 1195223 - protein, 9 aa, Homo Sapiens
TPRSPCPPT

SEQ ID NO: 1195224 - protein, 9 aa, Homo Sapiens
SASQEEQDD

SEQ ID NO: 1195225 - protein, 9 aa, Homo Sapiens
VALEAWGQP

SEQ ID NO: 1195226 - protein, 9 aa, Homo Sapiens
AAHGCAMRW

SEQ ID NO: 1195227 - protein, 9 aa, Homo Sapiens
ERKIKYPKL

SEQ ID NO: 1195228 - protein, 9 aa, Homo Sapiens
PGTVQGDTS

SEQ ID NO: 1195229 - protein, 9 aa, Homo Sapiens
TRLEILEII

SEQ ID NO: 1195230 - protein, 9 aa, Homo Sapiens
MMSIIKLTT

SEQ ID NO: 1195231 - protein, 9 aa, Homo Sapiens
WESFMGLPL

SEQ ID NO: 1195232 - protein, 9 aa, Homo Sapiens
GLLNMLSEP

SEQ ID NO: 1195233 - protein, 9 aa, Homo Sapiens
GCLAPARVV

SEQ ID NO: 1195234 - protein, 9 aa, Homo Sapiens
ASRLKPSAP

SEQ ID NO: 1195235 - protein, 9 aa, Homo Sapiens
PHGELHRQQ

SEQ ID NO: 1195236 - protein, 9 aa, Homo Sapiens
PQAQDPTIS

SEQ ID NO: 1195237 - protein, 9 aa, Homo Sapiens
TQLPAAQRR

SEQ ID NO: 1195238 - protein, 9 aa, Homo Sapiens
PRASLLWLA

SEQ ID NO: 1195239 - protein, 9 aa, Homo Sapiens
QYQTNANQL

SEQ ID NO: 1195240 - protein, 9 aa, Homo Sapiens
DSPCPFTTK

SEQ ID NO: 1195241 - protein, 9 aa, Homo Sapiens
MVIVTACLT

SEQ ID NO: 1195242 - protein, 9 aa, Homo Sapiens
HSWTSGVGT

SEQ ID NO: 1195243 - protein, 9 aa, Homo Sapiens
IKSSFGQKM

SEQ ID NO: 1195244 - protein, 9 aa, Homo Sapiens
GVPGATVSG

SEQ ID NO: 1195245 - protein, 9 aa, Homo Sapiens
FLCLAVLYY

SEQ ID NO: 1195246 - protein, 9 aa, Homo Sapiens
MYNMSAGMT

SEQ ID NO: 1195247 - protein, 9 aa, Homo Sapiens
VLQQVGQPH

SEQ ID NO: 1195248 - protein, 9 aa, Homo Sapiens
HLLVQDVVF

SEQ ID NO: 1195249 - protein, 9 aa, Homo Sapiens
FRQDSDLTC

SEQ ID NO: 1195250 - protein, 9 aa, Homo Sapiens
LPATRKPPS

SEQ ID NO: 1195251 - protein, 9 aa, Homo Sapiens
LDLNCVVSG

SEQ ID NO: 1195252 - protein, 9 aa, Homo Sapiens
PPWQWRGMG

SEQ ID NO: 1195253 - protein, 9 aa, Homo Sapiens
GALGTPATA

SEQ ID NO: 1195254 - protein, 9 aa, Homo Sapiens
PGLKPRRAC

SEQ ID NO: 1195255 - protein, 9 aa, Homo Sapiens
PRLVAGAVL

SEQ ID NO: 1195256 - protein, 9 aa, Homo Sapiens
ILKYSKAEY

SEQ ID NO: 1195257 - protein, 9 aa, Homo Sapiens
PRRRPSYRP

SEQ ID NO: 1195258 - protein, 9 aa, Homo Sapiens
LTRRNGFWR

SEQ ID NO: 1195259 - protein, 9 aa, Homo Sapiens
HKKSSCQLL

SEQ ID NO: 1195260 - protein, 9 aa, Homo Sapiens
LPLDRLRSG

SEQ ID NO: 1195261 - protein, 9 aa, Homo Sapiens
VLSANQGFS

SEQ ID NO: 1195262 - protein, 9 aa, Homo Sapiens
SSPEYTCWA

SEQ ID NO: 1195263 - protein, 9 aa, Homo Sapiens
ETAFLYVVS

SEQ ID NO: 1195264 - protein, 9 aa, Homo Sapiens
APQARCWMT

SEQ ID NO: 1195265 - protein, 9 aa, Homo Sapiens
PAHLVPAVS

SEQ ID NO: 1195266 - protein, 9 aa, Homo Sapiens
EERGHPSTP

SEQ ID NO: 1195267 - protein, 9 aa, Homo Sapiens
KKCICSSIG

SEQ ID NO: 1195268 - protein, 9 aa, Homo Sapiens
VNCPSWRSG

SEQ ID NO: 1195269 - protein, 9 aa, Homo Sapiens
SGLVRDCGA

SEQ ID NO: 1195270 - protein, 9 aa, Homo Sapiens
NNNNVVKVD

SEQ ID NO: 1195271 - protein, 9 aa, Homo Sapiens
FFEVSHLCN

SEQ ID NO: 1195272 - protein, 9 aa, Homo Sapiens
SPHPGPRHP

SEQ ID NO: 1195273 - protein, 9 aa, Homo Sapiens
GPCKLSSPR

SEQ ID NO: 1195274 - protein, 9 aa, Homo Sapiens
DLDARAKRY

SEQ ID NO: 1195275 - protein, 9 aa, Homo Sapiens
TTPHPPLPS

SEQ ID NO: 1195276 - protein, 9 aa, Homo Sapiens
SGGGVPAGH

SEQ ID NO: 1195277 - protein, 9 aa, Homo Sapiens
SDHEGTVIL

SEQ ID NO: 1195278 - protein, 9 aa, Homo Sapiens
PRLPPKPLG

SEQ ID NO: 1195279 - protein, 9 aa, Homo Sapiens
RPRHRQLHV

SEQ ID NO: 1195280 - protein, 9 aa, Homo Sapiens
SLGTVLSAN

SEQ ID NO: 1195281 - protein, 9 aa, Homo Sapiens
PQMQHSPHI

SEQ ID NO: 1195282 - protein, 9 aa, Homo Sapiens
PGKRSTARA

SEQ ID NO: 1195283 - protein, 9 aa, Homo Sapiens
LEQLLLFLG

SEQ ID NO: 1195284 - protein, 9 aa, Homo Sapiens
DLAPPAPLS

SEQ ID NO: 1195285 - protein, 9 aa, Homo Sapiens
PLTHVQDLT

SEQ ID NO: 1195286 - protein, 9 aa, Homo Sapiens
CSWTCSQTR

SEQ ID NO: 1195287 - protein, 9 aa, Homo Sapiens
GLHFLLLFA

SEQ ID NO: 1195288 - protein, 9 aa, Homo Sapiens
HEGSLYPPP

SEQ ID NO: 1195289 - protein, 9 aa, Homo Sapiens
KSSFGQKMG

SEQ ID NO: 1195290 - protein, 9 aa, Homo Sapiens
LVSAVFLLA

SEQ ID NO: 1195291 - protein, 9 aa, Homo Sapiens
LQGGSKWIR

SEQ ID NO: 1195292 - protein, 9 aa, Homo Sapiens
SLKIVDDPK

SEQ ID NO: 1195293 - protein, 9 aa, Homo Sapiens
TLSPGEARA

SEQ ID NO: 1195294 - protein, 9 aa, Homo Sapiens
PARWGWCPV

SEQ ID NO: 1195295 - protein, 9 aa, Homo Sapiens
RPPTLWTLC

SEQ ID NO: 1195296 - protein, 9 aa, Homo Sapiens
MEPGAEMPA

SEQ ID NO: 1195297 - protein, 9 aa, Homo Sapiens
PASPAPTAR

SEQ ID NO: 1195298 - protein, 9 aa, Homo Sapiens
QLHARTQLS

SEQ ID NO: 1195299 - protein, 9 aa, Homo Sapiens
TVGAVGVGG

SEQ ID NO: 1195300 - protein, 9 aa, Homo Sapiens
PPNPNSRGF

SEQ ID NO: 1195301 - protein, 9 aa, Homo Sapiens
FYKGEDIFW

SEQ ID NO: 1195302 - protein, 9 aa, Homo Sapiens
ITILVGSND

SEQ ID NO: 1195303 - protein, 9 aa, Homo Sapiens
LKPGALTPL

SEQ ID NO: 1195304 - protein, 9 aa, Homo Sapiens
CLYAPVVNI

SEQ ID NO: 1195305 - protein, 9 aa, Homo Sapiens
FISILPVIL

SEQ ID NO: 1195306 - protein, 9 aa, Homo Sapiens
LTPEHVSFC

SEQ ID NO: 1195307 - protein, 9 aa, Homo Sapiens
RRRRRRRPP

SEQ ID NO: 1195308 - protein, 9 aa, Homo Sapiens
VAAWPSRRA

SEQ ID NO: 1195309 - protein, 9 aa, Homo Sapiens
ALAGLGGSP

SEQ ID NO: 1195310 - protein, 9 aa, Homo Sapiens
VKLLCMCFQ

SEQ ID NO: 1195311 - protein, 9 aa, Homo Sapiens
VRGHAHAGA

SEQ ID NO: 1195312 - protein, 9 aa, Homo Sapiens
GATTVAGPR

SEQ ID NO: 1195313 - protein, 9 aa, Homo Sapiens
QAHEEQLGD

SEQ ID NO: 1195314 - protein, 9 aa, Homo Sapiens
QAGAPLGGS

SEQ ID NO: 1195315 - protein, 9 aa, Homo Sapiens
ADLERNGSS

SEQ ID NO: 1195316 - protein, 9 aa, Homo Sapiens
PSRTCSTET

SEQ ID NO: 1195317 - protein, 9 aa, Homo Sapiens
WLALWALGR

SEQ ID NO: 1195318 - protein, 9 aa, Homo Sapiens
ALIAARGLC

SEQ ID NO: 1195319 - protein, 9 aa, Homo Sapiens
YNDFNCNVW

SEQ ID NO: 1195320 - protein, 9 aa, Homo Sapiens
APPLHHYTT

SEQ ID NO: 1195321 - protein, 9 aa, Homo Sapiens
DIWGQSDIA

SEQ ID NO: 1195322 - protein, 9 aa, Homo Sapiens
MWSTPCCKP

SEQ ID NO: 1195323 - protein, 9 aa, Homo Sapiens
GRNTDKNGD

SEQ ID NO: 1195324 - protein, 9 aa, Homo Sapiens
SSASCCVLA

SEQ ID NO: 1195325 - protein, 9 aa, Homo Sapiens
FIAFFIPLT

SEQ ID NO: 1195326 - protein, 9 aa, Homo Sapiens
NKLLATNGT

SEQ ID NO: 1195327 - protein, 9 aa, Homo Sapiens
HLPQELADK

SEQ ID NO: 1195328 - protein, 9 aa, Homo Sapiens
IKECLCLYA

SEQ ID NO: 1195329 - protein, 9 aa, Homo Sapiens
GAGRLRTLL

SEQ ID NO: 1195330 - protein, 9 aa, Homo Sapiens
DLKMNSGVK

SEQ ID NO: 1195331 - protein, 9 aa, Homo Sapiens
APVAVNDNG

SEQ ID NO: 1195332 - protein, 9 aa, Homo Sapiens
PEPILADDL

SEQ ID NO: 1195333 - protein, 9 aa, Homo Sapiens
RQKYLSMQD

SEQ ID NO: 1195334 - protein, 9 aa, Homo Sapiens
TCYGNILWH

SEQ ID NO: 1195335 - protein, 9 aa, Homo Sapiens
SYLMRPKVY

SEQ ID NO: 1195336 - protein, 9 aa, Homo Sapiens
GQHAGPPLG

SEQ ID NO: 1195337 - protein, 9 aa, Homo Sapiens
VFMPAMQFS

SEQ ID NO: 1195338 - protein, 9 aa, Homo Sapiens
MKVRSAGLG

SEQ ID NO: 1195339 - protein, 9 aa, Homo Sapiens
MDISKKSIT

SEQ ID NO: 1195340 - protein, 9 aa, Homo Sapiens
PPRAPHPPP

SEQ ID NO: 1195341 - protein, 9 aa, Homo Sapiens
RLCGRGARP

SEQ ID NO: 1195342 - protein, 9 aa, Homo Sapiens
QDRGLQALG

SEQ ID NO: 1195343 - protein, 9 aa, Homo Sapiens
ALSDTEIQG

SEQ ID NO: 1195344 - protein, 9 aa, Homo Sapiens
GLGGFGGFS

SEQ ID NO: 1195345 - protein, 9 aa, Homo Sapiens
EIQNGNVSL

SEQ ID NO: 1195346 - protein, 9 aa, Homo Sapiens
KQLKRKQKP

SEQ ID NO: 1195347 - protein, 9 aa, Homo Sapiens
DAPPGCLPL

SEQ ID NO: 1195348 - protein, 9 aa, Homo Sapiens
KRIAKHVAA

SEQ ID NO: 1195349 - protein, 9 aa, Homo Sapiens
RPVDCADHW

SEQ ID NO: 1195350 - protein, 9 aa, Homo Sapiens
PFLILLIAI

SEQ ID NO: 1195351 - protein, 9 aa, Homo Sapiens
SCSSPEGPD

SEQ ID NO: 1195352 - protein, 9 aa, Homo Sapiens
PLLIVSTQA

SEQ ID NO: 1195353 - protein, 9 aa, Homo Sapiens
GAVKAVTKV

SEQ ID NO: 1195354 - protein, 9 aa, Homo Sapiens
SDQLGNAPL

SEQ ID NO: 1195355 - protein, 9 aa, Homo Sapiens
PGARDVLCH

SEQ ID NO: 1195356 - protein, 9 aa, Homo Sapiens
ILMSFLCLA

SEQ ID NO: 1195357 - protein, 9 aa, Homo Sapiens
LMKLNPLMM

SEQ ID NO: 1195358 - protein, 9 aa, Homo Sapiens
GTILGRNLP

SEQ ID NO: 1195359 - protein, 9 aa, Homo Sapiens
LRPCHLLPL

SEQ ID NO: 1195360 - protein, 9 aa, Homo Sapiens
ALLVVVLCT

SEQ ID NO: 1195361 - protein, 9 aa, Homo Sapiens
RLQTGTPRS

SEQ ID NO: 1195362 - protein, 9 aa, Homo Sapiens
SEVLVCPVH

SEQ ID NO: 1195363 - protein, 9 aa, Homo Sapiens
LQQQQQQQS

SEQ ID NO: 1195364 - protein, 9 aa, Homo Sapiens
TPSRSQWVM

SEQ ID NO: 1195365 - protein, 9 aa, Homo Sapiens
MSVCLFMKR

SEQ ID NO: 1195366 - protein, 9 aa, Homo Sapiens
GCTVFIWCC

SEQ ID NO: 1195367 - protein, 9 aa, Homo Sapiens
TLEETWASG

SEQ ID NO: 1195368 - protein, 9 aa, Homo Sapiens
LAVPLLKKL

SEQ ID NO: 1195369 - protein, 9 aa, Homo Sapiens
MKMSVILSV

SEQ ID NO: 1195370 - protein, 9 aa, Homo Sapiens
PVSLAPPRG

SEQ ID NO: 1195371 - protein, 9 aa, Homo Sapiens
TGNFIPPQR

SEQ ID NO: 1195372 - protein, 9 aa, Homo Sapiens
DRHPQMSEP

SEQ ID NO: 1195373 - protein, 9 aa, Homo Sapiens
ECSDEKSPS

SEQ ID NO: 1195374 - protein, 9 aa, Homo Sapiens
EKDHLWTIG

SEQ ID NO: 1195375 - protein, 9 aa, Homo Sapiens
EVAVFMPAM

SEQ ID NO: 1195376 - protein, 9 aa, Homo Sapiens
AGHKPPRHQ

SEQ ID NO: 1195377 - protein, 9 aa, Homo Sapiens
ASPCSLSAP

SEQ ID NO: 1195378 - protein, 9 aa, Homo Sapiens
IASMNITMP

SEQ ID NO: 1195379 - protein, 9 aa, Homo Sapiens
SREALSQTP

SEQ ID NO: 1195380 - protein, 9 aa, Homo Sapiens
PLAAPGDVE

SEQ ID NO: 1195381 - protein, 9 aa, Homo Sapiens
AAQMSWSLP

SEQ ID NO: 1195382 - protein, 9 aa, Homo Sapiens
ESFEFFFAM

SEQ ID NO: 1195383 - protein, 9 aa, Homo Sapiens
SWPWTRCLR

SEQ ID NO: 1195384 - protein, 9 aa, Homo Sapiens
SLGTTGTLV

SEQ ID NO: 1195385 - protein, 9 aa, Homo Sapiens
RLLLAGYND

SEQ ID NO: 1195386 - protein, 9 aa, Homo Sapiens
AVQRLGLPA

SEQ ID NO: 1195387 - protein, 9 aa, Homo Sapiens
SLSNKEVTR

SEQ ID NO: 1195388 - protein, 9 aa, Homo Sapiens
LLKFHLQYR

SEQ ID NO: 1195389 - protein, 9 aa, Homo Sapiens
FAKCKHRHL

SEQ ID NO: 1195390 - protein, 9 aa, Homo Sapiens
GMLLISKVR

SEQ ID NO: 1195391 - protein, 9 aa, Homo Sapiens
NAGCARLST

SEQ ID NO: 1195392 - protein, 9 aa, Homo Sapiens
FLLNHPSRL

SEQ ID NO: 1195393 - protein, 9 aa, Homo Sapiens
ALVLITEAQ

SEQ ID NO: 1195394 - protein, 9 aa, Homo Sapiens
IRWLEVAVF

SEQ ID NO: 1195395 - protein, 9 aa, Homo Sapiens
GWRHIGICH

SEQ ID NO: 1195396 - protein, 9 aa, Homo Sapiens
PSLEALACP

SEQ ID NO: 1195397 - protein, 9 aa, Homo Sapiens
DRSWLPCRG

SEQ ID NO: 1195398 - protein, 9 aa, Homo Sapiens
RGLLCPPRG

SEQ ID NO: 1195399 - protein, 9 aa, Homo Sapiens
RRRPPREAR

SEQ ID NO: 1195400 - protein, 9 aa, Homo Sapiens
RRSASRLWR

SEQ ID NO: 1195401 - protein, 9 aa, Homo Sapiens
RRQLRRRPP

SEQ ID NO: 1195402 - protein, 9 aa, Homo Sapiens
WRGASGARE

SEQ ID NO: 1195403 - protein, 9 aa, Homo Sapiens
HPRILQASV

SEQ ID NO: 1195404 - protein, 9 aa, Homo Sapiens
MGPLSFNAS

SEQ ID NO: 1195405 - protein, 9 aa, Homo Sapiens
RGGQRARGC

SEQ ID NO: 1195406 - protein, 9 aa, Homo Sapiens
WTLCFATGA

SEQ ID NO: 1195407 - protein, 9 aa, Homo Sapiens
PQGPTVPGD

SEQ ID NO: 1195408 - protein, 9 aa, Homo Sapiens
PALCRAGPT

SEQ ID NO: 1195409 - protein, 9 aa, Homo Sapiens
SVSWKKRIS

SEQ ID NO: 1195410 - protein, 9 aa, Homo Sapiens
HAGKAQLRA

SEQ ID NO: 1195411 - protein, 9 aa, Homo Sapiens
SVGGLRRRQ

SEQ ID NO: 1195412 - protein, 9 aa, Homo Sapiens
PQGCRCWKA

SEQ ID NO: 1195413 - protein, 9 aa, Homo Sapiens
YPGLSRPAT

SEQ ID NO: 1195414 - protein, 9 aa, Homo Sapiens
TSFCSSLPH

SEQ ID NO: 1195415 - protein, 9 aa, Homo Sapiens
QAQTPALGQ

SEQ ID NO: 1195416 - protein, 9 aa, Homo Sapiens
SRTCRSPCK

SEQ ID NO: 1195417 - protein, 9 aa, Homo Sapiens
FCCTVFSTM

SEQ ID NO: 1195418 - protein, 9 aa, Homo Sapiens
TEELFLLVS

SEQ ID NO: 1195419 - protein, 9 aa, Homo Sapiens
HHKVRTAPL

SEQ ID NO: 1195420 - protein, 9 aa, Homo Sapiens
VEVRLFSHS

SEQ ID NO: 1195421 - protein, 9 aa, Homo Sapiens
PSGIYGKAH

SEQ ID NO: 1195422 - protein, 9 aa, Homo Sapiens
DDGSFSDNF

SEQ ID NO: 1195423 - protein, 9 aa, Homo Sapiens
PVETDGRKE

SEQ ID NO: 1195424 - protein, 9 aa, Homo Sapiens
VKKVWSWTT

SEQ ID NO: 1195425 - protein, 9 aa, Homo Sapiens
RARAWRMLT

SEQ ID NO: 1195426 - protein, 9 aa, Homo Sapiens
QRIRHGQTL

SEQ ID NO: 1195427 - protein, 9 aa, Homo Sapiens
SEEDEGRGK

SEQ ID NO: 1195428 - protein, 9 aa, Homo Sapiens
DELSHQFQL

SEQ ID NO: 1195429 - protein, 9 aa, Homo Sapiens
TNATLPGPP

SEQ ID NO: 1195430 - protein, 9 aa, Homo Sapiens
VRLVSTSRK

SEQ ID NO: 1195431 - protein, 9 aa, Homo Sapiens
ALGTACLIP

SEQ ID NO: 1195432 - protein, 9 aa, Homo Sapiens
HVPNGCAAG

SEQ ID NO: 1195433 - protein, 9 aa, Homo Sapiens
SAGLGPTPG

SEQ ID NO: 1195434 - protein, 9 aa, Homo Sapiens
SDLMPVHFT

SEQ ID NO: 1195435 - protein, 9 aa, Homo Sapiens
HRRERRFGR

SEQ ID NO: 1195436 - protein, 9 aa, Homo Sapiens
RSPCPPTPR

SEQ ID NO: 1195437 - protein, 9 aa, Homo Sapiens
VKTMVCCLK

SEQ ID NO: 1195438 - protein, 9 aa, Homo Sapiens
QQILPFPAS

SEQ ID NO: 1195439 - protein, 9 aa, Homo Sapiens
KVSTPPSCC

SEQ ID NO: 1195440 - protein, 9 aa, Homo Sapiens
RVTPRPPPC

SEQ ID NO: 1195441 - protein, 9 aa, Homo Sapiens
QPALSWGKW

SEQ ID NO: 1195442 - protein, 9 aa, Homo Sapiens
VGNTIIILV

SEQ ID NO: 1195443 - protein, 9 aa, Homo Sapiens
VEVIPEGSH

SEQ ID NO: 1195444 - protein, 9 aa, Homo Sapiens
ALGTPATAA

SEQ ID NO: 1195445 - protein, 9 aa, Homo Sapiens
KWTGSSAAK

SEQ ID NO: 1195446 - protein, 9 aa, Homo Sapiens
HGKVQVGGN

SEQ ID NO: 1195447 - protein, 9 aa, Homo Sapiens
FTDCGIHTR

SEQ ID NO: 1195448 - protein, 9 aa, Homo Sapiens
RFLGCPQAS

SEQ ID NO: 1195449 - protein, 9 aa, Homo Sapiens
TEAAVAGSG

SEQ ID NO: 1195450 - protein, 9 aa, Homo Sapiens
GLMVIVTAC

SEQ ID NO: 1195451 - protein, 9 aa, Homo Sapiens
AAPHPRTAS

SEQ ID NO: 1195452 - protein, 9 aa, Homo Sapiens
APSTLMPSY

SEQ ID NO: 1195453 - protein, 9 aa, Homo Sapiens
HSLTSGILG

SEQ ID NO: 1195454 - protein, 9 aa, Homo Sapiens
RCLTAEDLF

SEQ ID NO: 1195455 - protein, 9 aa, Homo Sapiens
CFGILSNCN

SEQ ID NO: 1195456 - protein, 9 aa, Homo Sapiens
NGQEADLGN

SEQ ID NO: 1195457 - protein, 9 aa, Homo Sapiens
PHKSLPKRT

SEQ ID NO: 1195458 - protein, 9 aa, Homo Sapiens
WRCCANYVN

SEQ ID NO: 1195459 - protein, 9 aa, Homo Sapiens
PSTNATLPG

SEQ ID NO: 1195460 - protein, 9 aa, Homo Sapiens
GFISILPVI

SEQ ID NO: 1195461 - protein, 9 aa, Homo Sapiens
RRTAAPGQP

SEQ ID NO: 1195462 - protein, 9 aa, Homo Sapiens
SLGAPCWAS

SEQ ID NO: 1195463 - protein, 9 aa, Homo Sapiens
PQAPSALSS

SEQ ID NO: 1195464 - protein, 9 aa, Homo Sapiens
QDIKENLAF

SEQ ID NO: 1195465 - protein, 9 aa, Homo Sapiens
KSAGSGVPG

SEQ ID NO: 1195466 - protein, 9 aa, Homo Sapiens
GPLSHLPPR

SEQ ID NO: 1195467 - protein, 9 aa, Homo Sapiens
ADFWWRVDV

SEQ ID NO: 1195468 - protein, 9 aa, Homo Sapiens
LVVNFVALA

SEQ ID NO: 1195469 - protein, 9 aa, Homo Sapiens
KQQNTLRHQ

SEQ ID NO: 1195470 - protein, 9 aa, Homo Sapiens
PSHAHGLSH

SEQ ID NO: 1195471 - protein, 9 aa, Homo Sapiens
LFALFQEGG

SEQ ID NO: 1195472 - protein, 9 aa, Homo Sapiens
PQRSSKTMQ

SEQ ID NO: 1195473 - protein, 9 aa, Homo Sapiens
DNKLLATNG

SEQ ID NO: 1195474 - protein, 9 aa, Homo Sapiens
MVEILVVEL

SEQ ID NO: 1195475 - protein, 9 aa, Homo Sapiens
FFIYRKIQL

SEQ ID NO: 1195476 - protein, 9 aa, Homo Sapiens
AGCARLSTK

SEQ ID NO: 1195477 - protein, 9 aa, Homo Sapiens
SCRQTPPGS

SEQ ID NO: 1195478 - protein, 9 aa, Homo Sapiens
GILGVPLTC

SEQ ID NO: 1195479 - protein, 9 aa, Homo Sapiens
VVVGVGVMV

SEQ ID NO: 1195480 - protein, 9 aa, Homo Sapiens
RDRRPRTSH

SEQ ID NO: 1195481 - protein, 9 aa, Homo Sapiens
SSWSGTTQT

SEQ ID NO: 1195482 - protein, 9 aa, Homo Sapiens
SIPPTRLLI

SEQ ID NO: 1195483 - protein, 9 aa, Homo Sapiens
KLNPLMMKS

SEQ ID NO: 1195484 - protein, 9 aa, Homo Sapiens
RPPPCRPRV

SEQ ID NO: 1195485 - protein, 9 aa, Homo Sapiens
AQDPTISQA

SEQ ID NO: 1195486 - protein, 9 aa, Homo Sapiens
PTIGARIAE

SEQ ID NO: 1195487 - protein, 9 aa, Homo Sapiens
ELGARWDAG

SEQ ID NO: 1195488 - protein, 9 aa, Homo Sapiens
EEVSNMGND

SEQ ID NO: 1195489 - protein, 9 aa, Homo Sapiens
SLSGSMVLG

SEQ ID NO: 1195490 - protein, 9 aa, Homo Sapiens
RGRPASGGC

SEQ ID NO: 1195491 - protein, 9 aa, Homo Sapiens
APGSAGSVS

SEQ ID NO: 1195492 - protein, 9 aa, Homo Sapiens
QTHRDTLTM

SEQ ID NO: 1195493 - protein, 9 aa, Homo Sapiens
FVPDAELHI

SEQ ID NO: 1195494 - protein, 9 aa, Homo Sapiens
RSWASAAAR

SEQ ID NO: 1195495 - protein, 9 aa, Homo Sapiens
KPSQILQGH

SEQ ID NO: 1195496 - protein, 9 aa, Homo Sapiens
VSMMTSWHR

SEQ ID NO: 1195497 - protein, 9 aa, Homo Sapiens
LSTIDYVDD

SEQ ID NO: 1195498 - protein, 9 aa, Homo Sapiens
SKMFLTVIM

SEQ ID NO: 1195499 - protein, 9 aa, Homo Sapiens
AADVAKGQP

SEQ ID NO: 1195500 - protein, 9 aa, Homo Sapiens
CCSPAGPST

SEQ ID NO: 1195501 - protein, 9 aa, Homo Sapiens
PGVCFIHFL

SEQ ID NO: 1195502 - protein, 9 aa, Homo Sapiens
THSTHCSFY

SEQ ID NO: 1195503 - protein, 9 aa, Homo Sapiens
PPLPLPRRP

SEQ ID NO: 1195504 - protein, 9 aa, Homo Sapiens
PSTCSTRSV

SEQ ID NO: 1195505 - protein, 9 aa, Homo Sapiens
QAHDADERE

SEQ ID NO: 1195506 - protein, 9 aa, Homo Sapiens
RTRLEHSIQ

SEQ ID NO: 1195507 - protein, 9 aa, Homo Sapiens
LAVLYYIVW

SEQ ID NO: 1195508 - protein, 9 aa, Homo Sapiens
KNYTEDVIA

SEQ ID NO: 1195509 - protein, 9 aa, Homo Sapiens
LLQLPEPIL

SEQ ID NO: 1195510 - protein, 9 aa, Homo Sapiens
KRQYRGKAR

SEQ ID NO: 1195511 - protein, 9 aa, Homo Sapiens
LRRRQLRRR

SEQ ID NO: 1195512 - protein, 9 aa, Homo Sapiens
EMNIKIIRN

SEQ ID NO: 1195513 - protein, 9 aa, Homo Sapiens
VVLCTPGLR

SEQ ID NO: 1195514 - protein, 9 aa, Homo Sapiens
WRRRTGPPR

SEQ ID NO: 1195515 - protein, 9 aa, Homo Sapiens
YFFDRNQPS

SEQ ID NO: 1195516 - protein, 9 aa, Homo Sapiens
VLPSSEDLV

SEQ ID NO: 1195517 - protein, 9 aa, Homo Sapiens
PSNTGYALH

SEQ ID NO: 1195518 - protein, 9 aa, Homo Sapiens
TSRQWCTTS

SEQ ID NO: 1195519 - protein, 9 aa, Homo Sapiens
LNLYTDIIS

SEQ ID NO: 1195520 - protein, 9 aa, Homo Sapiens
SAARKSWAA

SEQ ID NO: 1195521 - protein, 9 aa, Homo Sapiens
GAEERMEAP

SEQ ID NO: 1195522 - protein, 9 aa, Homo Sapiens
EKEYLKQLA

SEQ ID NO: 1195523 - protein, 9 aa, Homo Sapiens
RSTNHGLEI

SEQ ID NO: 1195524 - protein, 9 aa, Homo Sapiens
TFSAVASDL

SEQ ID NO: 1195525 - protein, 9 aa, Homo Sapiens
AAGAAPGSH

SEQ ID NO: 1195526 - protein, 9 aa, Homo Sapiens
IGICHPGPG

SEQ ID NO: 1195527 - protein, 9 aa, Homo Sapiens
LPRPIQGLH

SEQ ID NO: 1195528 - protein, 9 aa, Homo Sapiens
GRRTQKKNM

SEQ ID NO: 1195529 - protein, 9 aa, Homo Sapiens
ASRRCCPPS

SEQ ID NO: 1195530 - protein, 9 aa, Homo Sapiens
FQLSDIRWQ

SEQ ID NO: 1195531 - protein, 9 aa, Homo Sapiens
AVSMMTSWH

SEQ ID NO: 1195532 - protein, 9 aa, Homo Sapiens
SVIKRAGMS

SEQ ID NO: 1195533 - protein, 9 aa, Homo Sapiens
APCLRRLCG

SEQ ID NO: 1195534 - protein, 9 aa, Homo Sapiens
ISKKKKSRI

SEQ ID NO: 1195535 - protein, 9 aa, Homo Sapiens
LQLVKMLHI

SEQ ID NO: 1195536 - protein, 9 aa, Homo Sapiens
RSINPTLTR

SEQ ID NO: 1195537 - protein, 9 aa, Homo Sapiens
RSTTRPSWP

SEQ ID NO: 1195538 - protein, 9 aa, Homo Sapiens
SVDMGEDAS

SEQ ID NO: 1195539 - protein, 9 aa, Homo Sapiens
TQDHLGFQV

SEQ ID NO: 1195540 - protein, 9 aa, Homo Sapiens
SQAPCPLVP

SEQ ID NO: 1195541 - protein, 9 aa, Homo Sapiens
WYDFFYREP

SEQ ID NO: 1195542 - protein, 9 aa, Homo Sapiens
KTGGSRSAI

SEQ ID NO: 1195543 - protein, 9 aa, Homo Sapiens
AGKSQQENR

SEQ ID NO: 1195544 - protein, 9 aa, Homo Sapiens
FTNYLPVAF

SEQ ID NO: 1195545 - protein, 9 aa, Homo Sapiens
TCAPGAGHV

SEQ ID NO: 1195546 - protein, 9 aa, Homo Sapiens
GFSQSRSSS

SEQ ID NO: 1195547 - protein, 9 aa, Homo Sapiens
SRSLWPPQR

SEQ ID NO: 1195548 - protein, 9 aa, Homo Sapiens
VNGRSRELR

SEQ ID NO: 1195549 - protein, 9 aa, Homo Sapiens
RAGPTSPPM

SEQ ID NO: 1195550 - protein, 9 aa, Homo Sapiens
NITLEERRP

SEQ ID NO: 1195551 - protein, 9 aa, Homo Sapiens
PPPWLSPLQ

SEQ ID NO: 1195552 - protein, 9 aa, Homo Sapiens
KTAGDSGIL

SEQ ID NO: 1195553 - protein, 9 aa, Homo Sapiens
GVISERCTD

SEQ ID NO: 1195554 - protein, 9 aa, Homo Sapiens
QLQYRPFPS

SEQ ID NO: 1195555 - protein, 9 aa, Homo Sapiens
AVQLWAGAA

SEQ ID NO: 1195556 - protein, 9 aa, Homo Sapiens
SDGHERRKV

SEQ ID NO: 1195557 - protein, 9 aa, Homo Sapiens
GGLRALRGG

SEQ ID NO: 1195558 - protein, 9 aa, Homo Sapiens
APAARRPWV

SEQ ID NO: 1195559 - protein, 9 aa, Homo Sapiens
RAVSVVAHL

SEQ ID NO: 1195560 - protein, 9 aa, Homo Sapiens
KRRRNILMI

SEQ ID NO: 1195561 - protein, 9 aa, Homo Sapiens
ELAARALHS

SEQ ID NO: 1195562 - protein, 9 aa, Homo Sapiens
AGWSSRRAR

SEQ ID NO: 1195563 - protein, 9 aa, Homo Sapiens
PRTTWSAPQ

SEQ ID NO: 1195564 - protein, 9 aa, Homo Sapiens
DRCFGILSN

SEQ ID NO: 1195565 - protein, 9 aa, Homo Sapiens
GYSVEVKEG

SEQ ID NO: 1195566 - protein, 9 aa, Homo Sapiens
LVFGSGSAV

SEQ ID NO: 1195567 - protein, 9 aa, Homo Sapiens
QKTFHFQAH

SEQ ID NO: 1195568 - protein, 9 aa, Homo Sapiens
APNSFLTSY

SEQ ID NO: 1195569 - protein, 9 aa, Homo Sapiens
ALFPRRRNF

SEQ ID NO: 1195570 - protein, 9 aa, Homo Sapiens
KRRRPKKMN

SEQ ID NO: 1195571 - protein, 9 aa, Homo Sapiens
EAMTTALGI

SEQ ID NO: 1195572 - protein, 9 aa, Homo Sapiens
ERQKYLSMQ

SEQ ID NO: 1195573 - protein, 9 aa, Homo Sapiens
GAGHKPPRH

SEQ ID NO: 1195574 - protein, 9 aa, Homo Sapiens
LLLYYQRRH

SEQ ID NO: 1195575 - protein, 9 aa, Homo Sapiens
DSISHCQNC

SEQ ID NO: 1195576 - protein, 9 aa, Homo Sapiens
KCIFSFNSH

SEQ ID NO: 1195577 - protein, 9 aa, Homo Sapiens
PPPPLPLPR

SEQ ID NO: 1195578 - protein, 9 aa, Homo Sapiens
GGRHPSWPW

SEQ ID NO: 1195579 - protein, 9 aa, Homo Sapiens
DPPRSCRQT

SEQ ID NO: 1195580 - protein, 9 aa, Homo Sapiens
GKESVFLLN

SEQ ID NO: 1195581 - protein, 9 aa, Homo Sapiens
AIRVRVSPT

SEQ ID NO: 1195582 - protein, 9 aa, Homo Sapiens
HCAELGYRT

SEQ ID NO: 1195583 - protein, 9 aa, Homo Sapiens
EISGTIEDA

SEQ ID NO: 1195584 - protein, 9 aa, Homo Sapiens
RQLCGWREA

SEQ ID NO: 1195585 - protein, 9 aa, Homo Sapiens
RTSWLSWRP

SEQ ID NO: 1195586 - protein, 9 aa, Homo Sapiens
NKPRDKRLE

SEQ ID NO: 1195587 - protein, 9 aa, Homo Sapiens
RIIQATEKT

SEQ ID NO: 1195588 - protein, 9 aa, Homo Sapiens
AMQKRHLHR

SEQ ID NO: 1195589 - protein, 9 aa, Homo Sapiens
EREHSLDHS

SEQ ID NO: 1195590 - protein, 9 aa, Homo Sapiens
VYLGCPNLL

SEQ ID NO: 1195591 - protein, 9 aa, Homo Sapiens
LSASHFTTL

SEQ ID NO: 1195592 - protein, 9 aa, Homo Sapiens
MMPRLRVIQ

SEQ ID NO: 1195593 - protein, 9 aa, Homo Sapiens
PKMIVDLSA

SEQ ID NO: 1195594 - protein, 9 aa, Homo Sapiens
FQLEGASDA

SEQ ID NO: 1195595 - protein, 9 aa, Homo Sapiens
PHSCFPSGD

SEQ ID NO: 1195596 - protein, 9 aa, Homo Sapiens
YQNFMIDTY

SEQ ID NO: 1195597 - protein, 9 aa, Homo Sapiens
DRALRCISS

SEQ ID NO: 1195598 - protein, 9 aa, Homo Sapiens
APARVVIPR

SEQ ID NO: 1195599 - protein, 9 aa, Homo Sapiens
LHFLKAVHD

SEQ ID NO: 1195600 - protein, 9 aa, Homo Sapiens
LGSLTATSC

SEQ ID NO: 1195601 - protein, 9 aa, Homo Sapiens
QPPSPTPVH

SEQ ID NO: 1195602 - protein, 9 aa, Homo Sapiens
PSPTPVHRP

SEQ ID NO: 1195603 - protein, 9 aa, Homo Sapiens
MCIKECLCL

SEQ ID NO: 1195604 - protein, 9 aa, Homo Sapiens
PQEFVKGWF

SEQ ID NO: 1195605 - protein, 9 aa, Homo Sapiens
RMQAVRAQS

SEQ ID NO: 1195606 - protein, 9 aa, Homo Sapiens
YEITLLNCD

SEQ ID NO: 1195607 - protein, 9 aa, Homo Sapiens
SPDQDSAPV

SEQ ID NO: 1195608 - protein, 9 aa, Homo Sapiens
WPAPAARRP

SEQ ID NO: 1195609 - protein, 9 aa, Homo Sapiens
PERRVEDIL

SEQ ID NO: 1195610 - protein, 9 aa, Homo Sapiens
ATTTCPTPA

SEQ ID NO: 1195611 - protein, 9 aa, Homo Sapiens
IWVGIFRVN

SEQ ID NO: 1195612 - protein, 9 aa, Homo Sapiens
ISITSSSHA

SEQ ID NO: 1195613 - protein, 9 aa, Homo Sapiens
RETHKALAR

SEQ ID NO: 1195614 - protein, 9 aa, Homo Sapiens
MCQLNPGIY

SEQ ID NO: 1195615 - protein, 9 aa, Homo Sapiens
SGCGRAPAQ

SEQ ID NO: 1195616 - protein, 9 aa, Homo Sapiens
PVITSSQYS

SEQ ID NO: 1195617 - protein, 9 aa, Homo Sapiens
REERTEASR

SEQ ID NO: 1195618 - protein, 9 aa, Homo Sapiens
EIASASNSS

SEQ ID NO: 1195619 - protein, 9 aa, Homo Sapiens
PYIVSMEHH

SEQ ID NO: 1195620 - protein, 9 aa, Homo Sapiens
MCDLKENGD

SEQ ID NO: 1195621 - protein, 9 aa, Homo Sapiens
APGPCLAQA

SEQ ID NO: 1195622 - protein, 9 aa, Homo Sapiens
HMAEKSFRC

SEQ ID NO: 1195623 - protein, 9 aa, Homo Sapiens
SYVEDGSGG

SEQ ID NO: 1195624 - protein, 9 aa, Homo Sapiens
ISTQRTAVA

SEQ ID NO: 1195625 - protein, 9 aa, Homo Sapiens
WMPRCTWAM

SEQ ID NO: 1195626 - protein, 9 aa, Homo Sapiens
LVVVGAGDV

SEQ ID NO: 1195627 - protein, 9 aa, Homo Sapiens
EHSSEQPPA

SEQ ID NO: 1195628 - protein, 9 aa, Homo Sapiens
LRVPSPLTP

SEQ ID NO: 1195629 - protein, 9 aa, Homo Sapiens
WEKLENLYD

SEQ ID NO: 1195630 - protein, 9 aa, Homo Sapiens
SSRNQFRQR

SEQ ID NO: 1195631 - protein, 9 aa, Homo Sapiens
LFTTELGWA

SEQ ID NO: 1195632 - protein, 9 aa, Homo Sapiens
LLLDFKEFD

SEQ ID NO: 1195633 - protein, 9 aa, Homo Sapiens
TTGPSGSGV

SEQ ID NO: 1195634 - protein, 9 aa, Homo Sapiens
LWAHRAGPA

SEQ ID NO: 1195635 - protein, 9 aa, Homo Sapiens
LTCSHPFSK

SEQ ID NO: 1195636 - protein, 9 aa, Homo Sapiens
SQVLCHVTG

SEQ ID NO: 1195637 - protein, 9 aa, Homo Sapiens
PSRRAQRRC

SEQ ID NO: 1195638 - protein, 9 aa, Homo Sapiens
VQRPQQQRQ

SEQ ID NO: 1195639 - protein, 9 aa, Homo Sapiens
PSKPEQEGI

SEQ ID NO: 1195640 - protein, 9 aa, Homo Sapiens
MPTCSFPEH

SEQ ID NO: 1195641 - protein, 9 aa, Homo Sapiens
GLPGDHADH

SEQ ID NO: 1195642 - protein, 9 aa, Homo Sapiens
TGTDADGVW

SEQ ID NO: 1195643 - protein, 9 aa, Homo Sapiens
SPRAVAALS

SEQ ID NO: 1195644 - protein, 9 aa, Homo Sapiens
AGTIFCLPL

SEQ ID NO: 1195645 - protein, 9 aa, Homo Sapiens
VLKTFALQQ

SEQ ID NO: 1195646 - protein, 9 aa, Homo Sapiens
ASLCTTVII

SEQ ID NO: 1195647 - protein, 9 aa, Homo Sapiens
TATPPSTNC

SEQ ID NO: 1195648 - protein, 9 aa, Homo Sapiens
LGLNDTPFQ

SEQ ID NO: 1195649 - protein, 9 aa, Homo Sapiens
TTCRRPASP

SEQ ID NO: 1195650 - protein, 9 aa, Homo Sapiens
LQEKKSHSL

SEQ ID NO: 1195651 - protein, 9 aa, Homo Sapiens
PHLGQPHSC

SEQ ID NO: 1195652 - protein, 9 aa, Homo Sapiens
GRSRAEKPT

SEQ ID NO: 1195653 - protein, 9 aa, Homo Sapiens
RSSARTTVW

SEQ ID NO: 1195654 - protein, 9 aa, Homo Sapiens
CPGITRVYR

SEQ ID NO: 1195655 - protein, 9 aa, Homo Sapiens
SPPQRSSKT

SEQ ID NO: 1195656 - protein, 9 aa, Homo Sapiens
SISHCQNCM

SEQ ID NO: 1195657 - protein, 9 aa, Homo Sapiens
TTALGIPSG

SEQ ID NO: 1195658 - protein, 9 aa, Homo Sapiens
FFYVNMADI

SEQ ID NO: 1195659 - protein, 9 aa, Homo Sapiens
DLAKEKECM

SEQ ID NO: 1195660 - protein, 9 aa, Homo Sapiens
PPPAAAGCS

SEQ ID NO: 1195661 - protein, 9 aa, Homo Sapiens
QVREPRAGS

SEQ ID NO: 1195662 - protein, 9 aa, Homo Sapiens
GLSEHSQLY

SEQ ID NO: 1195663 - protein, 9 aa, Homo Sapiens
LSARAVAAF

SEQ ID NO: 1195664 - protein, 9 aa, Homo Sapiens
MLTDFIREE

SEQ ID NO: 1195665 - protein, 9 aa, Homo Sapiens
MGPAAACPT

SEQ ID NO: 1195666 - protein, 9 aa, Homo Sapiens
SSCWAAPVI

SEQ ID NO: 1195667 - protein, 9 aa, Homo Sapiens
CTGRAASWA

SEQ ID NO: 1195668 - protein, 9 aa, Homo Sapiens
PPPPGWLPR

SEQ ID NO: 1195669 - protein, 9 aa, Homo Sapiens
GGGQVPELH

SEQ ID NO: 1195670 - protein, 9 aa, Homo Sapiens
VVGRVVEAG

SEQ ID NO: 1195671 - protein, 9 aa, Homo Sapiens
IKIIRNTLY

SEQ ID NO: 1195672 - protein, 9 aa, Homo Sapiens
QCGCGTFFA

SEQ ID NO: 1195673 - protein, 9 aa, Homo Sapiens
LHINGQHLQ

SEQ ID NO: 1195674 - protein, 9 aa, Homo Sapiens
VMSQTQQIL

SEQ ID NO: 1195675 - protein, 9 aa, Homo Sapiens
LTYTRTLRY

SEQ ID NO: 1195676 - protein, 9 aa, Homo Sapiens
FLLKFHLQY

SEQ ID NO: 1195677 - protein, 9 aa, Homo Sapiens
VKNLGEMHV

SEQ ID NO: 1195678 - protein, 9 aa, Homo Sapiens
GSHLGQPRQ

SEQ ID NO: 1195679 - protein, 9 aa, Homo Sapiens
LMVTALCFV

SEQ ID NO: 1195680 - protein, 9 aa, Homo Sapiens
GLSPLSVCP

SEQ ID NO: 1195681 - protein, 9 aa, Homo Sapiens
AAEQAVFLD

SEQ ID NO: 1195682 - protein, 9 aa, Homo Sapiens
SIAKEKTSA

SEQ ID NO: 1195683 - protein, 9 aa, Homo Sapiens
CMTFFEVSH

SEQ ID NO: 1195684 - protein, 9 aa, Homo Sapiens
VLYEKTKTD

SEQ ID NO: 1195685 - protein, 9 aa, Homo Sapiens
PGGYGSART

SEQ ID NO: 1195686 - protein, 9 aa, Homo Sapiens
LAKKKTCFP

SEQ ID NO: 1195687 - protein, 9 aa, Homo Sapiens
PPQAQTPAL

SEQ ID NO: 1195688 - protein, 9 aa, Homo Sapiens
GLHLHRQIS

SEQ ID NO: 1195689 - protein, 9 aa, Homo Sapiens
RGLLLHGVE

SEQ ID NO: 1195690 - protein, 9 aa, Homo Sapiens
PGAELQLPP

SEQ ID NO: 1195691 - protein, 9 aa, Homo Sapiens
PPKDNKLLA

SEQ ID NO: 1195692 - protein, 9 aa, Homo Sapiens
AQAGQCPRL

SEQ ID NO: 1195693 - protein, 9 aa, Homo Sapiens
TLFLSHIWV

SEQ ID NO: 1195694 - protein, 9 aa, Homo Sapiens
NMTLPGEDG

SEQ ID NO: 1195695 - protein, 9 aa, Homo Sapiens
SSPRRCDII

SEQ ID NO: 1195696 - protein, 9 aa, Homo Sapiens
LAAPGDVEG

SEQ ID NO: 1195697 - protein, 9 aa, Homo Sapiens
KEVIMDLTN

SEQ ID NO: 1195698 - protein, 9 aa, Homo Sapiens
GNNQKLRVC

SEQ ID NO: 1195699 - protein, 9 aa, Homo Sapiens
SEFEEEGEE

SEQ ID NO: 1195700 - protein, 9 aa, Homo Sapiens
SAHLPEHIF

SEQ ID NO: 1195701 - protein, 9 aa, Homo Sapiens
RPDPALSLE

SEQ ID NO: 1195702 - protein, 9 aa, Homo Sapiens
PHVQRGRAP

SEQ ID NO: 1195703 - protein, 9 aa, Homo Sapiens
RFADLGTFH

SEQ ID NO: 1195704 - protein, 9 aa, Homo Sapiens
HLRLLLQAL

SEQ ID NO: 1195705 - protein, 9 aa, Homo Sapiens
DVKALRRLG

SEQ ID NO: 1195706 - protein, 9 aa, Homo Sapiens
QHAGPPLGD

SEQ ID NO: 1195707 - protein, 9 aa, Homo Sapiens
HSPGQMLFQ

SEQ ID NO: 1195708 - protein, 9 aa, Homo Sapiens
TVSSLLVLT

SEQ ID NO: 1195709 - protein, 9 aa, Homo Sapiens
FSVIKVTRN

SEQ ID NO: 1195710 - protein, 9 aa, Homo Sapiens
EQDDELDHI

SEQ ID NO: 1195711 - protein, 9 aa, Homo Sapiens
PQAPHQPAL

SEQ ID NO: 1195712 - protein, 9 aa, Homo Sapiens
TTLPGLFVK

SEQ ID NO: 1195713 - protein, 9 aa, Homo Sapiens
LLSERGAAK

SEQ ID NO: 1195714 - protein, 9 aa, Homo Sapiens
AGGGGGNPC

SEQ ID NO: 1195715 - protein, 9 aa, Homo Sapiens
MRNTSVVKK

SEQ ID NO: 1195716 - protein, 9 aa, Homo Sapiens
HITVLRDSG

SEQ ID NO: 1195717 - protein, 9 aa, Homo Sapiens
VAFEIKKAC

SEQ ID NO: 1195718 - protein, 9 aa, Homo Sapiens
ADPSLWDRQ

SEQ ID NO: 1195719 - protein, 9 aa, Homo Sapiens
ALQCPRHWQ

SEQ ID NO: 1195720 - protein, 9 aa, Homo Sapiens
RLRDRGAAE

SEQ ID NO: 1195721 - protein, 9 aa, Homo Sapiens
AMQCRKKSH

SEQ ID NO: 1195722 - protein, 9 aa, Homo Sapiens
KNGGLSGLM

SEQ ID NO: 1195723 - protein, 9 aa, Homo Sapiens
LGTPPPPPR

SEQ ID NO: 1195724 - protein, 9 aa, Homo Sapiens
TAAVAKVPT

SEQ ID NO: 1195725 - protein, 9 aa, Homo Sapiens
RTSSARTSW

SEQ ID NO: 1195726 - protein, 9 aa, Homo Sapiens
NKTAANIRG

SEQ ID NO: 1195727 - protein, 9 aa, Homo Sapiens
CARWRTRCW

SEQ ID NO: 1195728 - protein, 9 aa, Homo Sapiens
ALTPLQQRP

SEQ ID NO: 1195729 - protein, 9 aa, Homo Sapiens
PPCQSAECQ

SEQ ID NO: 1195730 - protein, 9 aa, Homo Sapiens
PQLALHEGS

SEQ ID NO: 1195731 - protein, 9 aa, Homo Sapiens
QARTKMAGG

SEQ ID NO: 1195732 - protein, 9 aa, Homo Sapiens
HPHPPQPTS

SEQ ID NO: 1195733 - protein, 9 aa, Homo Sapiens
PGATVSGER

SEQ ID NO: 1195734 - protein, 9 aa, Homo Sapiens
LGLAGPARA

SEQ ID NO: 1195735 - protein, 9 aa, Homo Sapiens
LTPGPEMPA

SEQ ID NO: 1195736 - protein, 9 aa, Homo Sapiens
GYGKKVVVV

SEQ ID NO: 1195737 - protein, 9 aa, Homo Sapiens
FAICGLHYD

SEQ ID NO: 1195738 - protein, 9 aa, Homo Sapiens
EDTLYQCGC

SEQ ID NO: 1195739 - protein, 9 aa, Homo Sapiens
LHILEGIGH

SEQ ID NO: 1195740 - protein, 9 aa, Homo Sapiens
NLGIAPGDT

SEQ ID NO: 1195741 - protein, 9 aa, Homo Sapiens
LHLHRQISL

SEQ ID NO: 1195742 - protein, 9 aa, Homo Sapiens
SFNSHCQER

SEQ ID NO: 1195743 - protein, 9 aa, Homo Sapiens
DKASFTTPY

SEQ ID NO: 1195744 - protein, 9 aa, Homo Sapiens
SVSFPVDFF

SEQ ID NO: 1195745 - protein, 9 aa, Homo Sapiens
NQNSMLSQL

SEQ ID NO: 1195746 - protein, 9 aa, Homo Sapiens
TISQAPCPL

SEQ ID NO: 1195747 - protein, 9 aa, Homo Sapiens
HLTPEPVPT

SEQ ID NO: 1195748 - protein, 9 aa, Homo Sapiens
RVSPGGAGR

SEQ ID NO: 1195749 - protein, 9 aa, Homo Sapiens
SRDGWGAMA

SEQ ID NO: 1195750 - protein, 9 aa, Homo Sapiens
SPQPAGYFA

SEQ ID NO: 1195751 - protein, 9 aa, Homo Sapiens
TKKTKDLIA

SEQ ID NO: 1195752 - protein, 9 aa, Homo Sapiens
KKRISKMFL

SEQ ID NO: 1195753 - protein, 9 aa, Homo Sapiens
SKGISKKKK

SEQ ID NO: 1195754 - protein, 9 aa, Homo Sapiens
PVGGPTMPH

SEQ ID NO: 1195755 - protein, 9 aa, Homo Sapiens
DFPTPAALC

SEQ ID NO: 1195756 - protein, 9 aa, Homo Sapiens
VCDSHPHPP

SEQ ID NO: 1195757 - protein, 9 aa, Homo Sapiens
PRPRRSEPV

SEQ ID NO: 1195758 - protein, 9 aa, Homo Sapiens
SIPGLNVML

SEQ ID NO: 1195759 - protein, 9 aa, Homo Sapiens
TSCSSAGNN

SEQ ID NO: 1195760 - protein, 9 aa, Homo Sapiens
QILFSVIKV

SEQ ID NO: 1195761 - protein, 9 aa, Homo Sapiens
RENKKEHRV

SEQ ID NO: 1195762 - protein, 9 aa, Homo Sapiens
LNAVHLQDL

SEQ ID NO: 1195763 - protein, 9 aa, Homo Sapiens
ACLLILLII

SEQ ID NO: 1195764 - protein, 9 aa, Homo Sapiens
PPRVTPRPP

SEQ ID NO: 1195765 - protein, 9 aa, Homo Sapiens
LFRRSLLRR

SEQ ID NO: 1195766 - protein, 9 aa, Homo Sapiens
CIEHYHRLR

SEQ ID NO: 1195767 - protein, 9 aa, Homo Sapiens
VAAGPPMRE

SEQ ID NO: 1195768 - protein, 9 aa, Homo Sapiens
AVMFITLLG

SEQ ID NO: 1195769 - protein, 9 aa, Homo Sapiens
QRGKLLSHR

SEQ ID NO: 1195770 - protein, 9 aa, Homo Sapiens
KTSACRPPL

SEQ ID NO: 1195771 - protein, 9 aa, Homo Sapiens
DKKLENNMC

SEQ ID NO: 1195772 - protein, 9 aa, Homo Sapiens
DTEIQGEIG

SEQ ID NO: 1195773 - protein, 9 aa, Homo Sapiens
TAGEPPSGV

SEQ ID NO: 1195774 - protein, 9 aa, Homo Sapiens
SPITAAVAK

SEQ ID NO: 1195775 - protein, 9 aa, Homo Sapiens
HVGYLVVWV

SEQ ID NO: 1195776 - protein, 9 aa, Homo Sapiens
SHPLFGRLV

SEQ ID NO: 1195777 - protein, 9 aa, Homo Sapiens
PSCLSIWPR

SEQ ID NO: 1195778 - protein, 9 aa, Homo Sapiens
YNAFTMYTT

SEQ ID NO: 1195779 - protein, 9 aa, Homo Sapiens
LLCGATFPH

SEQ ID NO: 1195780 - protein, 9 aa, Homo Sapiens
YRRPMYHIL

SEQ ID NO: 1195781 - protein, 9 aa, Homo Sapiens
NMSCLWTWK

SEQ ID NO: 1195782 - protein, 9 aa, Homo Sapiens
RYTPLAKRP

SEQ ID NO: 1195783 - protein, 9 aa, Homo Sapiens
HAGAIADVE

SEQ ID NO: 1195784 - protein, 9 aa, Homo Sapiens
TFQGRWVHG

SEQ ID NO: 1195785 - protein, 9 aa, Homo Sapiens
SSVTSPISH

SEQ ID NO: 1195786 - protein, 9 aa, Homo Sapiens
NVFFSLHAV

SEQ ID NO: 1195787 - protein, 9 aa, Homo Sapiens
WSPSLLAQL

SEQ ID NO: 1195788 - protein, 9 aa, Homo Sapiens
EKKQGGPTI

SEQ ID NO: 1195789 - protein, 9 aa, Homo Sapiens
EVDRGEAAP

SEQ ID NO: 1195790 - protein, 9 aa, Homo Sapiens
CVALTSLAL

SEQ ID NO: 1195791 - protein, 9 aa, Homo Sapiens
CGLGTECLV

SEQ ID NO: 1195792 - protein, 9 aa, Homo Sapiens
ADWFNASFG

SEQ ID NO: 1195793 - protein, 9 aa, Homo Sapiens
GLQEEVAVG

SEQ ID NO: 1195794 - protein, 9 aa, Homo Sapiens
LPAIVVVLL

SEQ ID NO: 1195795 - protein, 9 aa, Homo Sapiens
APIPWLNWS

SEQ ID NO: 1195796 - protein, 9 aa, Homo Sapiens
SLPHLPIEC

SEQ ID NO: 1195797 - protein, 9 aa, Homo Sapiens
TCSTETTTG

SEQ ID NO: 1195798 - protein, 9 aa, Homo Sapiens
QRTAVAPKA

SEQ ID NO: 1195799 - protein, 9 aa, Homo Sapiens
TTHPRSRLS

SEQ ID NO: 1195800 - protein, 9 aa, Homo Sapiens
CLKIVIAVT

SEQ ID NO: 1195801 - protein, 9 aa, Homo Sapiens
GSEVDVEVV

SEQ ID NO: 1195802 - protein, 9 aa, Homo Sapiens
GVPTGGALQ

SEQ ID NO: 1195803 - protein, 9 aa, Homo Sapiens
SDRNPRPGC

SEQ ID NO: 1195804 - protein, 9 aa, Homo Sapiens
CPPFTVPGP

SEQ ID NO: 1195805 - protein, 9 aa, Homo Sapiens
DVWSCVCIL

SEQ ID NO: 1195806 - protein, 9 aa, Homo Sapiens
FVLVNLEVT

SEQ ID NO: 1195807 - protein, 9 aa, Homo Sapiens
VEFVLHLNR

SEQ ID NO: 1195808 - protein, 9 aa, Homo Sapiens
CMPCVFLVD

SEQ ID NO: 1195809 - protein, 9 aa, Homo Sapiens
DDAPPGCLP

SEQ ID NO: 1195810 - protein, 9 aa, Homo Sapiens
AAGSPSVNA

SEQ ID NO: 1195811 - protein, 9 aa, Homo Sapiens
LPWGDCSSA

SEQ ID NO: 1195812 - protein, 9 aa, Homo Sapiens
AAAGGNRRT

SEQ ID NO: 1195813 - protein, 9 aa, Homo Sapiens
LFKTNEEKR

SEQ ID NO: 1195814 - protein, 9 aa, Homo Sapiens
LYVLVCSAL

SEQ ID NO: 1195815 - protein, 9 aa, Homo Sapiens
YLVVWVCHP

SEQ ID NO: 1195816 - protein, 9 aa, Homo Sapiens
PPRGPGPGA

SEQ ID NO: 1195817 - protein, 9 aa, Homo Sapiens
SKTMQLKKE

SEQ ID NO: 1195818 - protein, 9 aa, Homo Sapiens
CSRSWARSL

SEQ ID NO: 1195819 - protein, 9 aa, Homo Sapiens
KNHEHGGQK

SEQ ID NO: 1195820 - protein, 9 aa, Homo Sapiens
HPMNRALGF

SEQ ID NO: 1195821 - protein, 9 aa, Homo Sapiens
VLIFVLNRM

SEQ ID NO: 1195822 - protein, 9 aa, Homo Sapiens
LVACSRVQI

SEQ ID NO: 1195823 - protein, 9 aa, Homo Sapiens
AAGPPMREV

SEQ ID NO: 1195824 - protein, 9 aa, Homo Sapiens
HSGHCPLQG

SEQ ID NO: 1195825 - protein, 9 aa, Homo Sapiens
IQCVFHFST

SEQ ID NO: 1195826 - protein, 9 aa, Homo Sapiens
FGKLSAFPK

SEQ ID NO: 1195827 - protein, 9 aa, Homo Sapiens
EKLDKASFT

SEQ ID NO: 1195828 - protein, 9 aa, Homo Sapiens
CPILCHPDK

SEQ ID NO: 1195829 - protein, 9 aa, Homo Sapiens
TVGIKPERR

SEQ ID NO: 1195830 - protein, 9 aa, Homo Sapiens
AVYMDIPAP

SEQ ID NO: 1195831 - protein, 9 aa, Homo Sapiens
PWLQWPVLQ

SEQ ID NO: 1195832 - protein, 9 aa, Homo Sapiens
WSRDQNTFH

SEQ ID NO: 1195833 - protein, 9 aa, Homo Sapiens
LSIAKEKTS

SEQ ID NO: 1195834 - protein, 9 aa, Homo Sapiens
FIISPTSIQ

SEQ ID NO: 1195835 - protein, 9 aa, Homo Sapiens
WPRGLLCPP

SEQ ID NO: 1195836 - protein, 9 aa, Homo Sapiens
CSHTLLRFP

SEQ ID NO: 1195837 - protein, 9 aa, Homo Sapiens
PPAPQGPPR

SEQ ID NO: 1195838 - protein, 9 aa, Homo Sapiens
LICISYVFI

SEQ ID NO: 1195839 - protein, 9 aa, Homo Sapiens
IKSILIHDR

SEQ ID NO: 1195840 - protein, 9 aa, Homo Sapiens
VPCAFLLLH

SEQ ID NO: 1195841 - protein, 9 aa, Homo Sapiens
PLEGECRQG

SEQ ID NO: 1195842 - protein, 9 aa, Homo Sapiens
LLAAAGGNR

SEQ ID NO: 1195843 - protein, 9 aa, Homo Sapiens
GAGCPRRCQ

SEQ ID NO: 1195844 - protein, 9 aa, Homo Sapiens
FATGQWMEW

SEQ ID NO: 1195845 - protein, 9 aa, Homo Sapiens
RNGFWRQEQ

SEQ ID NO: 1195846 - protein, 9 aa, Homo Sapiens
PVAPGPGPM

SEQ ID NO: 1195847 - protein, 9 aa, Homo Sapiens
SCMCPIPPT

SEQ ID NO: 1195848 - protein, 9 aa, Homo Sapiens
GPRRRSFLR

SEQ ID NO: 1195849 - protein, 9 aa, Homo Sapiens
RKQKPLEKN

SEQ ID NO: 1195850 - protein, 9 aa, Homo Sapiens
AGLSGRKAP

SEQ ID NO: 1195851 - protein, 9 aa, Homo Sapiens
AMLHAHQAL

SEQ ID NO: 1195852 - protein, 9 aa, Homo Sapiens
LGEGHLRLL

SEQ ID NO: 1195853 - protein, 9 aa, Homo Sapiens
TGAPARARR

SEQ ID NO: 1195854 - protein, 9 aa, Homo Sapiens
VSVARGQGH

SEQ ID NO: 1195855 - protein, 9 aa, Homo Sapiens
RCWACCGTR

SEQ ID NO: 1195856 - protein, 9 aa, Homo Sapiens
SARTSWLSW

SEQ ID NO: 1195857 - protein, 9 aa, Homo Sapiens
RAPHLGQPH

SEQ ID NO: 1195858 - protein, 9 aa, Homo Sapiens
CLDVGLAHL

SEQ ID NO: 1195859 - protein, 9 aa, Homo Sapiens
AIPAFVIVT

SEQ ID NO: 1195860 - protein, 9 aa, Homo Sapiens
IFLHSSLDP

SEQ ID NO: 1195861 - protein, 9 aa, Homo Sapiens
EKERYMQET

SEQ ID NO: 1195862 - protein, 9 aa, Homo Sapiens
VQIIAIAAF

SEQ ID NO: 1195863 - protein, 9 aa, Homo Sapiens
SSRVIVASY

SEQ ID NO: 1195864 - protein, 9 aa, Homo Sapiens
PRSRWRHPL

SEQ ID NO: 1195865 - protein, 9 aa, Homo Sapiens
SRPSGRPRP

SEQ ID NO: 1195866 - protein, 9 aa, Homo Sapiens
ESPVSLHER

SEQ ID NO: 1195867 - protein, 9 aa, Homo Sapiens
PRWRQQNWM

SEQ ID NO: 1195868 - protein, 9 aa, Homo Sapiens
CFIHFLHKA

SEQ ID NO: 1195869 - protein, 9 aa, Homo Sapiens
RARAGVCCE

SEQ ID NO: 1195870 - protein, 9 aa, Homo Sapiens
KTEAAGPQG

SEQ ID NO: 1195871 - protein, 9 aa, Homo Sapiens
SWGKWPVGM

SEQ ID NO: 1195872 - protein, 9 aa, Homo Sapiens
CSAGGDASC

SEQ ID NO: 1195873 - protein, 9 aa, Homo Sapiens
HQCLRCQHQ

SEQ ID NO: 1195874 - protein, 9 aa, Homo Sapiens
ISKGYVRII

SEQ ID NO: 1195875 - protein, 9 aa, Homo Sapiens
RPPCSSTST

SEQ ID NO: 1195876 - protein, 9 aa, Homo Sapiens
AQMSWSLPC

SEQ ID NO: 1195877 - protein, 9 aa, Homo Sapiens
LEEEEVSNM

SEQ ID NO: 1195878 - protein, 9 aa, Homo Sapiens
SRELRTFRK

SEQ ID NO: 1195879 - protein, 9 aa, Homo Sapiens
APFPGKNTW

SEQ ID NO: 1195880 - protein, 9 aa, Homo Sapiens
DCDPSSPRR

SEQ ID NO: 1195881 - protein, 9 aa, Homo Sapiens
FVLIGSFIA

SEQ ID NO: 1195882 - protein, 9 aa, Homo Sapiens
PPSPTPVHR

SEQ ID NO: 1195883 - protein, 9 aa, Homo Sapiens
SQRGQAVVG

SEQ ID NO: 1195884 - protein, 9 aa, Homo Sapiens
ILSIDDYFY

SEQ ID NO: 1195885 - protein, 9 aa, Homo Sapiens
TVLSANQGF

SEQ ID NO: 1195886 - protein, 9 aa, Homo Sapiens
PYISGMNFV

SEQ ID NO: 1195887 - protein, 9 aa, Homo Sapiens
LQGHLSHSV

SEQ ID NO: 1195888 - protein, 9 aa, Homo Sapiens
GGKGTESSL

SEQ ID NO: 1195889 - protein, 9 aa, Homo Sapiens
PLEKNGQEA

SEQ ID NO: 1195890 - protein, 9 aa, Homo Sapiens
GAAKQRLVV

SEQ ID NO: 1195891 - protein, 9 aa, Homo Sapiens
QAPMDSPCC

SEQ ID NO: 1195892 - protein, 9 aa, Homo Sapiens
DFWWRVDVA

SEQ ID NO: 1195893 - protein, 9 aa, Homo Sapiens
GSSQAGTGG

SEQ ID NO: 1195894 - protein, 9 aa, Homo Sapiens
HVKDHRNKA

SEQ ID NO: 1195895 - protein, 9 aa, Homo Sapiens
LAQTHRDTL

SEQ ID NO: 1195896 - protein, 9 aa, Homo Sapiens
GLWGWRGRG

SEQ ID NO: 1195897 - protein, 9 aa, Homo Sapiens
GACPPVRRD

SEQ ID NO: 1195898 - protein, 9 aa, Homo Sapiens
NCPRYASCE

SEQ ID NO: 1195899 - protein, 9 aa, Homo Sapiens
GKVGQCLDV

SEQ ID NO: 1195900 - protein, 9 aa, Homo Sapiens
THRDTLTMS

SEQ ID NO: 1195901 - protein, 9 aa, Homo Sapiens
DPNPQPQSL

SEQ ID NO: 1195902 - protein, 9 aa, Homo Sapiens
PPTRCVWQQ

SEQ ID NO: 1195903 - protein, 9 aa, Homo Sapiens
CTLWTWMTC

SEQ ID NO: 1195904 - protein, 9 aa, Homo Sapiens
SDCSSVQAM

SEQ ID NO: 1195905 - protein, 9 aa, Homo Sapiens
IQLALIGFV

SEQ ID NO: 1195906 - protein, 9 aa, Homo Sapiens
PSLIFLDVT

SEQ ID NO: 1195907 - protein, 9 aa, Homo Sapiens
SRGATSRGG

SEQ ID NO: 1195908 - protein, 9 aa, Homo Sapiens
PEEVLQDLS

SEQ ID NO: 1195909 - protein, 9 aa, Homo Sapiens
KHTSNNLKA

SEQ ID NO: 1195910 - protein, 9 aa, Homo Sapiens
IKSLLVTVG

SEQ ID NO: 1195911 - protein, 9 aa, Homo Sapiens
FILCSTHQK

SEQ ID NO: 1195912 - protein, 9 aa, Homo Sapiens
ISLTKASIL

SEQ ID NO: 1195913 - protein, 9 aa, Homo Sapiens
VHSSGRLLP

SEQ ID NO: 1195914 - protein, 9 aa, Homo Sapiens
PGVGPCKLS

SEQ ID NO: 1195915 - protein, 9 aa, Homo Sapiens
VFLLNHPSR

SEQ ID NO: 1195916 - protein, 9 aa, Homo Sapiens
TPARWGWCP

SEQ ID NO: 1195917 - protein, 9 aa, Homo Sapiens
STNLIKLCQ

SEQ ID NO: 1195918 - protein, 9 aa, Homo Sapiens
VGDALAQFG

SEQ ID NO: 1195919 - protein, 9 aa, Homo Sapiens
KDKKRRNLQ

SEQ ID NO: 1195920 - protein, 9 aa, Homo Sapiens
CMPWRSSRR

SEQ ID NO: 1195921 - protein, 9 aa, Homo Sapiens
GVSEVDRGE

SEQ ID NO: 1195922 - protein, 9 aa, Homo Sapiens
ERVVEGAGV

SEQ ID NO: 1195923 - protein, 9 aa, Homo Sapiens
GSMVLGCLF

SEQ ID NO: 1195924 - protein, 9 aa, Homo Sapiens
PRVCHALVF

SEQ ID NO: 1195925 - protein, 9 aa, Homo Sapiens
IESQMASKL

SEQ ID NO: 1195926 - protein, 9 aa, Homo Sapiens
LDMISKCVY

SEQ ID NO: 1195927 - protein, 9 aa, Homo Sapiens
RRYQKYRRK

SEQ ID NO: 1195928 - protein, 9 aa, Homo Sapiens
HLVDDAFGK

SEQ ID NO: 1195929 - protein, 9 aa, Homo Sapiens
DSARPPPRW

SEQ ID NO: 1195930 - protein, 9 aa, Homo Sapiens
NPSSVSISF

SEQ ID NO: 1195931 - protein, 9 aa, Homo Sapiens
HWQVCPQVH

SEQ ID NO: 1195932 - protein, 9 aa, Homo Sapiens
GNPMMCDLK

SEQ ID NO: 1195933 - protein, 9 aa, Homo Sapiens
FRSRRSGLE

SEQ ID NO: 1195934 - protein, 9 aa, Homo Sapiens
MILVYDIAN

SEQ ID NO: 1195935 - protein, 9 aa, Homo Sapiens
PEVVGPLGE

SEQ ID NO: 1195936 - protein, 9 aa, Homo Sapiens
DLGHWRRGG

SEQ ID NO: 1195937 - protein, 9 aa, Homo Sapiens
IKASSMPQT

SEQ ID NO: 1195938 - protein, 9 aa, Homo Sapiens
TAFLYVVSS

SEQ ID NO: 1195939 - protein, 9 aa, Homo Sapiens
FQEGGGSEF

SEQ ID NO: 1195940 - protein, 9 aa, Homo Sapiens
MATFISQCT

SEQ ID NO: 1195941 - protein, 9 aa, Homo Sapiens
GEGAVDALS

SEQ ID NO: 1195942 - protein, 9 aa, Homo Sapiens
HSPVRLGDQ

SEQ ID NO: 1195943 - protein, 9 aa, Homo Sapiens
MCPLCSAQY

SEQ ID NO: 1195944 - protein, 9 aa, Homo Sapiens
CALRLVVNF

SEQ ID NO: 1195945 - protein, 9 aa, Homo Sapiens
CHWGAAPGS

SEQ ID NO: 1195946 - protein, 9 aa, Homo Sapiens
RVNTPVLLH

SEQ ID NO: 1195947 - protein, 9 aa, Homo Sapiens
FYVNMADIE

SEQ ID NO: 1195948 - protein, 9 aa, Homo Sapiens
SNDKCRFSK

SEQ ID NO: 1195949 - protein, 9 aa, Homo Sapiens
ILLCKRKIF

SEQ ID NO: 1195950 - protein, 9 aa, Homo Sapiens
ALPSLQQLL

SEQ ID NO: 1195951 - protein, 9 aa, Homo Sapiens
LTLGADLGH

SEQ ID NO: 1195952 - protein, 9 aa, Homo Sapiens
SLKPGALTP

SEQ ID NO: 1195953 - protein, 9 aa, Homo Sapiens
GCVPRRSAS

SEQ ID NO: 1195954 - protein, 9 aa, Homo Sapiens
VCHPDVDAP

SEQ ID NO: 1195955 - protein, 9 aa, Homo Sapiens
GGGVARVEV

SEQ ID NO: 1195956 - protein, 9 aa, Homo Sapiens
RSVLYEKTK

SEQ ID NO: 1195957 - protein, 9 aa, Homo Sapiens
PPGPQCPSG

SEQ ID NO: 1195958 - protein, 9 aa, Homo Sapiens
NQTYLVLER

SEQ ID NO: 1195959 - protein, 9 aa, Homo Sapiens
WSAPQPGGT

SEQ ID NO: 1195960 - protein, 9 aa, Homo Sapiens
GCPRRCQIR

SEQ ID NO: 1195961 - protein, 9 aa, Homo Sapiens
FLRKCSLMR

SEQ ID NO: 1195962 - protein, 9 aa, Homo Sapiens
SEIESGMGS

SEQ ID NO: 1195963 - protein, 9 aa, Homo Sapiens
APGAKAAAS

SEQ ID NO: 1195964 - protein, 9 aa, Homo Sapiens
ALLTHRVQA

SEQ ID NO: 1195965 - protein, 9 aa, Homo Sapiens
RPCHLLPLS

SEQ ID NO: 1195966 - protein, 9 aa, Homo Sapiens
LAAAGGNRR

SEQ ID NO: 1195967 - protein, 9 aa, Homo Sapiens
EEHFRGVWN

SEQ ID NO: 1195968 - protein, 9 aa, Homo Sapiens
CPEKERYMQ

SEQ ID NO: 1195969 - protein, 9 aa, Homo Sapiens
SFCFSPLWL

SEQ ID NO: 1195970 - protein, 9 aa, Homo Sapiens
PTSPPMMRN

SEQ ID NO: 1195971 - protein, 9 aa, Homo Sapiens
VMVRVGSCV

SEQ ID NO: 1195972 - protein, 9 aa, Homo Sapiens
NSNISSPVN

SEQ ID NO: 1195973 - protein, 9 aa, Homo Sapiens
PDYKDNYGL

SEQ ID NO: 1195974 - protein, 9 aa, Homo Sapiens
KNERINRAI

SEQ ID NO: 1195975 - protein, 9 aa, Homo Sapiens
EPGHRAGHL

SEQ ID NO: 1195976 - protein, 9 aa, Homo Sapiens
AAPDQADSL

SEQ ID NO: 1195977 - protein, 9 aa, Homo Sapiens
TAPQRPPSS

SEQ ID NO: 1195978 - protein, 9 aa, Homo Sapiens
NPDLGAAFV

SEQ ID NO: 1195979 - protein, 9 aa, Homo Sapiens
QQPGHIHGL

SEQ ID NO: 1195980 - protein, 9 aa, Homo Sapiens
FISQCTVEL

SEQ ID NO: 1195981 - protein, 9 aa, Homo Sapiens
PPPPHPLPR

SEQ ID NO: 1195982 - protein, 9 aa, Homo Sapiens
GVGADARLE

SEQ ID NO: 1195983 - protein, 9 aa, Homo Sapiens
EILVVELLQ

SEQ ID NO: 1195984 - protein, 9 aa, Homo Sapiens
QILVNGRSR

SEQ ID NO: 1195985 - protein, 9 aa, Homo Sapiens
CSFPEHFIG

SEQ ID NO: 1195986 - protein, 9 aa, Homo Sapiens
GGATRPPPT

SEQ ID NO: 1195987 - protein, 9 aa, Homo Sapiens
HAGPPLGDI

SEQ ID NO: 1195988 - protein, 9 aa, Homo Sapiens
PVAHHLPRP

SEQ ID NO: 1195989 - protein, 9 aa, Homo Sapiens
RVVEAGGSH

SEQ ID NO: 1195990 - protein, 9 aa, Homo Sapiens
QLLLFLGSN

SEQ ID NO: 1195991 - protein, 9 aa, Homo Sapiens
DVNRRRAMR

SEQ ID NO: 1195992 - protein, 9 aa, Homo Sapiens
FYYRGQVNY

SEQ ID NO: 1195993 - protein, 9 aa, Homo Sapiens
LRCAAEKCL

SEQ ID NO: 1195994 - protein, 9 aa, Homo Sapiens
PVLLHILEG

SEQ ID NO: 1195995 - protein, 9 aa, Homo Sapiens
SSMGHPGRV

SEQ ID NO: 1195996 - protein, 9 aa, Homo Sapiens
KLFSFRRRL

SEQ ID NO: 1195997 - protein, 9 aa, Homo Sapiens
GDISEIESG

SEQ ID NO: 1195998 - protein, 9 aa, Homo Sapiens
RTARTLLDR

SEQ ID NO: 1195999 - protein, 9 aa, Homo Sapiens
VTNWKPSWT

SEQ ID NO: 1196000 - protein, 9 aa, Homo Sapiens
EQPPAEDQP

SEQ ID NO: 1196001 - protein, 9 aa, Homo Sapiens
NYTEDVIAS

SEQ ID NO: 1196002 - protein, 9 aa, Homo Sapiens
GDVVEGVKG

SEQ ID NO: 1196003 - protein, 9 aa, Homo Sapiens
DFEKIRKVL

SEQ ID NO: 1196004 - protein, 9 aa, Homo Sapiens
LYPIAQGDH

SEQ ID NO: 1196005 - protein, 9 aa, Homo Sapiens
RSPCKSSKS

SEQ ID NO: 1196006 - protein, 9 aa, Homo Sapiens
FTNCPRYAS

SEQ ID NO: 1196007 - protein, 9 aa, Homo Sapiens
RWHTRGCRT

SEQ ID NO: 1196008 - protein, 9 aa, Homo Sapiens
IYMSAASFH

SEQ ID NO: 1196009 - protein, 9 aa, Homo Sapiens
VSRTAPTAR

SEQ ID NO: 1196010 - protein, 9 aa, Homo Sapiens
GVCFDVHDV

SEQ ID NO: 1196011 - protein, 9 aa, Homo Sapiens
GGEPQQQAP

SEQ ID NO: 1196012 - protein, 9 aa, Homo Sapiens
GLESGEAPS

SEQ ID NO: 1196013 - protein, 9 aa, Homo Sapiens
GLPHGLWFL

SEQ ID NO: 1196014 - protein, 9 aa, Homo Sapiens
EQFLRPASS

SEQ ID NO: 1196015 - protein, 9 aa, Homo Sapiens
SISRRQSEP

SEQ ID NO: 1196016 - protein, 9 aa, Homo Sapiens
AQVAGPEVV

SEQ ID NO: 1196017 - protein, 9 aa, Homo Sapiens
GHLPAAPAA

SEQ ID NO: 1196018 - protein, 9 aa, Homo Sapiens
LSLALRSRR

SEQ ID NO: 1196019 - protein, 9 aa, Homo Sapiens
TEARVQALQ

SEQ ID NO: 1196020 - protein, 9 aa, Homo Sapiens
GTFHDQAIV

SEQ ID NO: 1196021 - protein, 9 aa, Homo Sapiens
PPGVVPTCH

SEQ ID NO: 1196022 - protein, 9 aa, Homo Sapiens
SALPSPHKA

SEQ ID NO: 1196023 - protein, 9 aa, Homo Sapiens
KWKKELWLH

SEQ ID NO: 1196024 - protein, 9 aa, Homo Sapiens
QTHGEGYAK

SEQ ID NO: 1196025 - protein, 9 aa, Homo Sapiens
CLQDGIERS

SEQ ID NO: 1196026 - protein, 9 aa, Homo Sapiens
AFGYFGILL

SEQ ID NO: 1196027 - protein, 9 aa, Homo Sapiens
APCMPWRSS

SEQ ID NO: 1196028 - protein, 9 aa, Homo Sapiens
VQRLPGHLN

SEQ ID NO: 1196029 - protein, 9 aa, Homo Sapiens
PRGLLCPPR

SEQ ID NO: 1196030 - protein, 9 aa, Homo Sapiens
SVGHCSVPE

SEQ ID NO: 1196031 - protein, 9 aa, Homo Sapiens
CCLNLKQFI

SEQ ID NO: 1196032 - protein, 9 aa, Homo Sapiens
FWLADSLLI

SEQ ID NO: 1196033 - protein, 9 aa, Homo Sapiens
GLMTTFLGL

SEQ ID NO: 1196034 - protein, 9 aa, Homo Sapiens
IMEKNGNNQ

SEQ ID NO: 1196035 - protein, 9 aa, Homo Sapiens
QLRKWLKRF

SEQ ID NO: 1196036 - protein, 9 aa, Homo Sapiens
KLRGSGLPA

SEQ ID NO: 1196037 - protein, 9 aa, Homo Sapiens
APLHCAAYR

SEQ ID NO: 1196038 - protein, 9 aa, Homo Sapiens
SCASCTGAG

SEQ ID NO: 1196039 - protein, 9 aa, Homo Sapiens
PASGGCCSP

SEQ ID NO: 1196040 - protein, 9 aa, Homo Sapiens
VQDRKLTKA

SEQ ID NO: 1196041 - protein, 9 aa, Homo Sapiens
SGEDADDPM

SEQ ID NO: 1196042 - protein, 9 aa, Homo Sapiens
LLEEDIFMP

SEQ ID NO: 1196043 - protein, 9 aa, Homo Sapiens
GEERGRRTQ

SEQ ID NO: 1196044 - protein, 9 aa, Homo Sapiens
TGDRCQNFV

SEQ ID NO: 1196045 - protein, 9 aa, Homo Sapiens
IEAYKCQIV

SEQ ID NO: 1196046 - protein, 9 aa, Homo Sapiens
MGYGYIYPV

SEQ ID NO: 1196047 - protein, 9 aa, Homo Sapiens
SFLCLAVLY

SEQ ID NO: 1196048 - protein, 9 aa, Homo Sapiens
TPLQQRPGA

SEQ ID NO: 1196049 - protein, 9 aa, Homo Sapiens
MSMALTPAA

SEQ ID NO: 1196050 - protein, 9 aa, Homo Sapiens
IKSQEPLQL

SEQ ID NO: 1196051 - protein, 9 aa, Homo Sapiens
LSYVGIVTV

SEQ ID NO: 1196052 - protein, 9 aa, Homo Sapiens
GYPYQAANR

SEQ ID NO: 1196053 - protein, 9 aa, Homo Sapiens
MCAWYAAID

SEQ ID NO: 1196054 - protein, 9 aa, Homo Sapiens
CRARVDGRC

SEQ ID NO: 1196055 - protein, 9 aa, Homo Sapiens
EDVIASDSE

SEQ ID NO: 1196056 - protein, 9 aa, Homo Sapiens
PPQSLPSLL

SEQ ID NO: 1196057 - protein, 9 aa, Homo Sapiens
CNEHLKCAG

SEQ ID NO: 1196058 - protein, 9 aa, Homo Sapiens
GNKPRDKRL

SEQ ID NO: 1196059 - protein, 9 aa, Homo Sapiens
LVRLVSTSR

SEQ ID NO: 1196060 - protein, 9 aa, Homo Sapiens
YSVEVKEGA

SEQ ID NO: 1196061 - protein, 9 aa, Homo Sapiens
RLPLRPQRG

SEQ ID NO: 1196062 - protein, 9 aa, Homo Sapiens
LVKLPLDNK

SEQ ID NO: 1196063 - protein, 9 aa, Homo Sapiens
RGGCGHHRL

SEQ ID NO: 1196064 - protein, 9 aa, Homo Sapiens
SIGRSNFRK

SEQ ID NO: 1196065 - protein, 9 aa, Homo Sapiens
AGISGFGGD

SEQ ID NO: 1196066 - protein, 9 aa, Homo Sapiens
ERDNNLAML

SEQ ID NO: 1196067 - protein, 9 aa, Homo Sapiens
AAPTARAPP

SEQ ID NO: 1196068 - protein, 9 aa, Homo Sapiens
ARSCFPFRW

SEQ ID NO: 1196069 - protein, 9 aa, Homo Sapiens
PTQQDVLQT

SEQ ID NO: 1196070 - protein, 9 aa, Homo Sapiens
YTPGTQHIE

SEQ ID NO: 1196071 - protein, 9 aa, Homo Sapiens
LHLHPSPAL

SEQ ID NO: 1196072 - protein, 9 aa, Homo Sapiens
KPTAALGWS

SEQ ID NO: 1196073 - protein, 9 aa, Homo Sapiens
EADFNWWFI

SEQ ID NO: 1196074 - protein, 9 aa, Homo Sapiens
AIADVEAQR

SEQ ID NO: 1196075 - protein, 9 aa, Homo Sapiens
NKKLRSLYD

SEQ ID NO: 1196076 - protein, 9 aa, Homo Sapiens
LGPDPPTGI

SEQ ID NO: 1196077 - protein, 9 aa, Homo Sapiens
GLSRPATSP

SEQ ID NO: 1196078 - protein, 9 aa, Homo Sapiens
PENILGKVS

SEQ ID NO: 1196079 - protein, 9 aa, Homo Sapiens
PVTQDHLGF

SEQ ID NO: 1196080 - protein, 9 aa, Homo Sapiens
ILAYAGFHL

SEQ ID NO: 1196081 - protein, 9 aa, Homo Sapiens
VCWPSFSWT

SEQ ID NO: 1196082 - protein, 9 aa, Homo Sapiens
CVPRRSASR

SEQ ID NO: 1196083 - protein, 9 aa, Homo Sapiens
CSVLGEYYA

SEQ ID NO: 1196084 - protein, 9 aa, Homo Sapiens
LLPRKHRGP

SEQ ID NO: 1196085 - protein, 9 aa, Homo Sapiens
FYLEAAAKF

SEQ ID NO: 1196086 - protein, 9 aa, Homo Sapiens
PWVVTARPA

SEQ ID NO: 1196087 - protein, 9 aa, Homo Sapiens
KPSAPNSFL

SEQ ID NO: 1196088 - protein, 9 aa, Homo Sapiens
DSEEFYYRG

SEQ ID NO: 1196089 - protein, 9 aa, Homo Sapiens
TSQSPQLRG

SEQ ID NO: 1196090 - protein, 9 aa, Homo Sapiens
WMVLGLMST

SEQ ID NO: 1196091 - protein, 9 aa, Homo Sapiens
CDRSWLPCR

SEQ ID NO: 1196092 - protein, 9 aa, Homo Sapiens
PHLPIECSE

SEQ ID NO: 1196093 - protein, 9 aa, Homo Sapiens
AVGLHERRA

SEQ ID NO: 1196094 - protein, 9 aa, Homo Sapiens
GTVLSANQG

SEQ ID NO: 1196095 - protein, 9 aa, Homo Sapiens
AKEAPELVE

SEQ ID NO: 1196096 - protein, 9 aa, Homo Sapiens
NIKIIRNTL

SEQ ID NO: 1196097 - protein, 9 aa, Homo Sapiens
YHAKTGRTS

SEQ ID NO: 1196098 - protein, 9 aa, Homo Sapiens
VGVVSAFAR

SEQ ID NO: 1196099 - protein, 9 aa, Homo Sapiens
RAIPRASRP

SEQ ID NO: 1196100 - protein, 9 aa, Homo Sapiens
LPGTVQGDT

SEQ ID NO: 1196101 - protein, 9 aa, Homo Sapiens
PPPCRPRVT

SEQ ID NO: 1196102 - protein, 9 aa, Homo Sapiens
LKGCKNKQP

SEQ ID NO: 1196103 - protein, 9 aa, Homo Sapiens
EAPSVGVAR

SEQ ID NO: 1196104 - protein, 9 aa, Homo Sapiens
QHVDSLRVR

SEQ ID NO: 1196105 - protein, 9 aa, Homo Sapiens
PIFYPQGLW

SEQ ID NO: 1196106 - protein, 9 aa, Homo Sapiens
AHLVPAVSH

SEQ ID NO: 1196107 - protein, 9 aa, Homo Sapiens
TTSFHIVIE

SEQ ID NO: 1196108 - protein, 9 aa, Homo Sapiens
HCNRIAAVI

SEQ ID NO: 1196109 - protein, 9 aa, Homo Sapiens
AAQGRLIVS

SEQ ID NO: 1196110 - protein, 9 aa, Homo Sapiens
AEAVAAASL

SEQ ID NO: 1196111 - protein, 9 aa, Homo Sapiens
PPPRLLAPF

SEQ ID NO: 1196112 - protein, 9 aa, Homo Sapiens
PRVALSRPP

SEQ ID NO: 1196113 - protein, 9 aa, Homo Sapiens
TCTSSSSSS

SEQ ID NO: 1196114 - protein, 9 aa, Homo Sapiens
AISAPISSD

SEQ ID NO: 1196115 - protein, 9 aa, Homo Sapiens
LPGPLSHLP

SEQ ID NO: 1196116 - protein, 9 aa, Homo Sapiens
FCFSPLWLM

SEQ ID NO: 1196117 - protein, 9 aa, Homo Sapiens
SSLKKHLWI

SEQ ID NO: 1196118 - protein, 9 aa, Homo Sapiens
LYHHPPGRQ

SEQ ID NO: 1196119 - protein, 9 aa, Homo Sapiens
KKDKKKEKG

SEQ ID NO: 1196120 - protein, 9 aa, Homo Sapiens
IHCNRIAAV

SEQ ID NO: 1196121 - protein, 9 aa, Homo Sapiens
RIKEFRRLT

SEQ ID NO: 1196122 - protein, 9 aa, Homo Sapiens
RQPPGKRST

SEQ ID NO: 1196123 - protein, 9 aa, Homo Sapiens
GSGSGGVSP

SEQ ID NO: 1196124 - protein, 9 aa, Homo Sapiens
PVATVGAVG

SEQ ID NO: 1196125 - protein, 9 aa, Homo Sapiens
CYSTTETMP

SEQ ID NO: 1196126 - protein, 9 aa, Homo Sapiens
YGHLGLPLI

SEQ ID NO: 1196127 - protein, 9 aa, Homo Sapiens
ERGHPSTPD

SEQ ID NO: 1196128 - protein, 9 aa, Homo Sapiens
HPRTASITL

SEQ ID NO: 1196129 - protein, 9 aa, Homo Sapiens
AGMRMDLGE

SEQ ID NO: 1196130 - protein, 9 aa, Homo Sapiens
LYPAIPAAQ

SEQ ID NO: 1196131 - protein, 9 aa, Homo Sapiens
RKAPRVALS

SEQ ID NO: 1196132 - protein, 9 aa, Homo Sapiens
ECAESHRAG

SEQ ID NO: 1196133 - protein, 9 aa, Homo Sapiens
STPDIGKQS

SEQ ID NO: 1196134 - protein, 9 aa, Homo Sapiens
LAPWPGLPG

SEQ ID NO: 1196135 - protein, 9 aa, Homo Sapiens
RQCIEHYHR

SEQ ID NO: 1196136 - protein, 9 aa, Homo Sapiens
AYDADAQEQ

SEQ ID NO: 1196137 - protein, 9 aa, Homo Sapiens
PWRTSRGQA

SEQ ID NO: 1196138 - protein, 9 aa, Homo Sapiens
PVRAWRTSS

SEQ ID NO: 1196139 - protein, 9 aa, Homo Sapiens
RSQVDKVIE

SEQ ID NO: 1196140 - protein, 9 aa, Homo Sapiens
KKGTMKTST

SEQ ID NO: 1196141 - protein, 9 aa, Homo Sapiens
HSHPTRARC

SEQ ID NO: 1196142 - protein, 9 aa, Homo Sapiens
VFSMPFLDD

SEQ ID NO: 1196143 - protein, 9 aa, Homo Sapiens
GDFPKIFPY

SEQ ID NO: 1196144 - protein, 9 aa, Homo Sapiens
NLKQFILFH

SEQ ID NO: 1196145 - protein, 9 aa, Homo Sapiens
HSKPSQILQ

SEQ ID NO: 1196146 - protein, 9 aa, Homo Sapiens
SENGIPPAH

SEQ ID NO: 1196147 - protein, 9 aa, Homo Sapiens
PRDKRLEKM

SEQ ID NO: 1196148 - protein, 9 aa, Homo Sapiens
PPHRAAPAT

SEQ ID NO: 1196149 - protein, 9 aa, Homo Sapiens
LQHGRGALR

SEQ ID NO: 1196150 - protein, 9 aa, Homo Sapiens
ETHKALARR

SEQ ID NO: 1196151 - protein, 9 aa, Homo Sapiens
VNLLKMWQG

SEQ ID NO: 1196152 - protein, 9 aa, Homo Sapiens
NKRHSPGQM

SEQ ID NO: 1196153 - protein, 9 aa, Homo Sapiens
RLEKETCMS

SEQ ID NO: 1196154 - protein, 9 aa, Homo Sapiens
RHPQMSEPG

SEQ ID NO: 1196155 - protein, 9 aa, Homo Sapiens
AQQLWLALW

SEQ ID NO: 1196156 - protein, 9 aa, Homo Sapiens
AAEKEYLKQ

SEQ ID NO: 1196157 - protein, 9 aa, Homo Sapiens
PQWSPSPLS

SEQ ID NO: 1196158 - protein, 9 aa, Homo Sapiens
ESGEAPSAP

SEQ ID NO: 1196159 - protein, 9 aa, Homo Sapiens
SSKLHQRGQ

SEQ ID NO: 1196160 - protein, 9 aa, Homo Sapiens
VPLLLAPVP

SEQ ID NO: 1196161 - protein, 9 aa, Homo Sapiens
LVPLLLAPV

SEQ ID NO: 1196162 - protein, 9 aa, Homo Sapiens
FRVNTPVLL

SEQ ID NO: 1196163 - protein, 9 aa, Homo Sapiens
AWRATRRPL

SEQ ID NO: 1196164 - protein, 9 aa, Homo Sapiens
YIQRLSVSW

SEQ ID NO: 1196165 - protein, 9 aa, Homo Sapiens
ALSQTPEKG

SEQ ID NO: 1196166 - protein, 9 aa, Homo Sapiens
ILLPGHWVF

SEQ ID NO: 1196167 - protein, 9 aa, Homo Sapiens
ARAPLESVR

SEQ ID NO: 1196168 - protein, 9 aa, Homo Sapiens
GGLCGYSVE

SEQ ID NO: 1196169 - protein, 9 aa, Homo Sapiens
KVRSFLEGL

SEQ ID NO: 1196170 - protein, 9 aa, Homo Sapiens
PTAWSHCPL

SEQ ID NO: 1196171 - protein, 9 aa, Homo Sapiens
KGEEEEEDV

SEQ ID NO: 1196172 - protein, 9 aa, Homo Sapiens
VEGGEKHVE

SEQ ID NO: 1196173 - protein, 9 aa, Homo Sapiens
HLGQPRQLP

SEQ ID NO: 1196174 - protein, 9 aa, Homo Sapiens
SSGSSFGGA

SEQ ID NO: 1196175 - protein, 9 aa, Homo Sapiens
PAGVPRQRG

SEQ ID NO: 1196176 - protein, 9 aa, Homo Sapiens
PLKQLKRKQ

SEQ ID NO: 1196177 - protein, 9 aa, Homo Sapiens
EADSGRPRM

SEQ ID NO: 1196178 - protein, 9 aa, Homo Sapiens
PSTRPEAPA

SEQ ID NO: 1196179 - protein, 9 aa, Homo Sapiens
SLPSLLSRH

SEQ ID NO: 1196180 - protein, 9 aa, Homo Sapiens
RCCANYVNG

SEQ ID NO: 1196181 - protein, 9 aa, Homo Sapiens
KASPPPAGH

SEQ ID NO: 1196182 - protein, 9 aa, Homo Sapiens
PRSSSPTQL

SEQ ID NO: 1196183 - protein, 9 aa, Homo Sapiens
IYWPHPSAL

SEQ ID NO: 1196184 - protein, 9 aa, Homo Sapiens
PDGSEVDVE

SEQ ID NO: 1196185 - protein, 9 aa, Homo Sapiens
TIEDASGAF

SEQ ID NO: 1196186 - protein, 9 aa, Homo Sapiens
VACSRVQIR

SEQ ID NO: 1196187 - protein, 9 aa, Homo Sapiens
DLTLHLLPG

SEQ ID NO: 1196188 - protein, 9 aa, Homo Sapiens
DDDFLEKKW

SEQ ID NO: 1196189 - protein, 9 aa, Homo Sapiens
LRIWLPSVH

SEQ ID NO: 1196190 - protein, 9 aa, Homo Sapiens
LVNLIEKVT

SEQ ID NO: 1196191 - protein, 9 aa, Homo Sapiens
RKRQWGPGE

SEQ ID NO: 1196192 - protein, 9 aa, Homo Sapiens
TKEMLALTS

SEQ ID NO: 1196193 - protein, 9 aa, Homo Sapiens
GRRAAAPGQ

SEQ ID NO: 1196194 - protein, 9 aa, Homo Sapiens
GLELPASVH

SEQ ID NO: 1196195 - protein, 9 aa, Homo Sapiens
HRQTPGDPA

SEQ ID NO: 1196196 - protein, 9 aa, Homo Sapiens
RNLLRLQSL

SEQ ID NO: 1196197 - protein, 9 aa, Homo Sapiens
TALGFRYLV

SEQ ID NO: 1196198 - protein, 9 aa, Homo Sapiens
PQKSSAMAP

SEQ ID NO: 1196199 - protein, 9 aa, Homo Sapiens
LLCTPPGSC

SEQ ID NO: 1196200 - protein, 9 aa, Homo Sapiens
RATALSGPW

SEQ ID NO: 1196201 - protein, 9 aa, Homo Sapiens
NGPERQLCG

SEQ ID NO: 1196202 - protein, 9 aa, Homo Sapiens
DWSGGALPY

SEQ ID NO: 1196203 - protein, 9 aa, Homo Sapiens
TKDLIAHSL

SEQ ID NO: 1196204 - protein, 9 aa, Homo Sapiens
LSCPYHPGH

SEQ ID NO: 1196205 - protein, 9 aa, Homo Sapiens
APGQPGRHR

SEQ ID NO: 1196206 - protein, 9 aa, Homo Sapiens
VPGGSRPGW

SEQ ID NO: 1196207 - protein, 9 aa, Homo Sapiens
PDLHLEVVE

SEQ ID NO: 1196208 - protein, 9 aa, Homo Sapiens
AVAALSSSG

SEQ ID NO: 1196209 - protein, 9 aa, Homo Sapiens
GHLNAVHLQ

SEQ ID NO: 1196210 - protein, 9 aa, Homo Sapiens
YTKIYIQRL

SEQ ID NO: 1196211 - protein, 9 aa, Homo Sapiens
LINSFLYQC

SEQ ID NO: 1196212 - protein, 9 aa, Homo Sapiens
TECLVHRAV

SEQ ID NO: 1196213 - protein, 9 aa, Homo Sapiens
ASSRLCHWE

SEQ ID NO: 1196214 - protein, 9 aa, Homo Sapiens
VLCGKNWEK

SEQ ID NO: 1196215 - protein, 9 aa, Homo Sapiens
LAGWARDGG

SEQ ID NO: 1196216 - protein, 9 aa, Homo Sapiens
GVTCPATTT

SEQ ID NO: 1196217 - protein, 9 aa, Homo Sapiens
AVKKLIVNP

SEQ ID NO: 1196218 - protein, 9 aa, Homo Sapiens
PVDYSFSEI

SEQ ID NO: 1196219 - protein, 9 aa, Homo Sapiens
GALTPLQQR

SEQ ID NO: 1196220 - protein, 9 aa, Homo Sapiens
QKLCALIIQ

SEQ ID NO: 1196221 - protein, 9 aa, Homo Sapiens
FFLTMSLAA

SEQ ID NO: 1196222 - protein, 9 aa, Homo Sapiens
LLHLLVGLA

SEQ ID NO: 1196223 - protein, 9 aa, Homo Sapiens
LILMAMLWH

SEQ ID NO: 1196224 - protein, 9 aa, Homo Sapiens
DFNLLHVSE

SEQ ID NO: 1196225 - protein, 9 aa, Homo Sapiens
SRSESRVEP

SEQ ID NO: 1196226 - protein, 9 aa, Homo Sapiens
QVPSKPEQE

SEQ ID NO: 1196227 - protein, 9 aa, Homo Sapiens
GQAPAGVPR

SEQ ID NO: 1196228 - protein, 9 aa, Homo Sapiens
VTLIPVLSF

SEQ ID NO: 1196229 - protein, 9 aa, Homo Sapiens
QWRGMGCPF

SEQ ID NO: 1196230 - protein, 9 aa, Homo Sapiens
LENNMCGVV

SEQ ID NO: 1196231 - protein, 9 aa, Homo Sapiens
RTLFKFFWF

SEQ ID NO: 1196232 - protein, 9 aa, Homo Sapiens
DLYLPASMK

SEQ ID NO: 1196233 - protein, 9 aa, Homo Sapiens
SSICTVPNV

SEQ ID NO: 1196234 - protein, 9 aa, Homo Sapiens
AAPLPPRAP

SEQ ID NO: 1196235 - protein, 9 aa, Homo Sapiens
KSQGGRILL

SEQ ID NO: 1196236 - protein, 9 aa, Homo Sapiens
YVCERCCKR

SEQ ID NO: 1196237 - protein, 9 aa, Homo Sapiens
TVLSALQRE

SEQ ID NO: 1196238 - protein, 9 aa, Homo Sapiens
SMSEFQHLM

SEQ ID NO: 1196239 - protein, 9 aa, Homo Sapiens
HSEYLSSNP

SEQ ID NO: 1196240 - protein, 9 aa, Homo Sapiens
AGQCPRLEG

SEQ ID NO: 1196241 - protein, 9 aa, Homo Sapiens
LLWIIEVGR

SEQ ID NO: 1196242 - protein, 9 aa, Homo Sapiens
LGGEVLGIC

SEQ ID NO: 1196243 - protein, 9 aa, Homo Sapiens
VPNPPTSSC

SEQ ID NO: 1196244 - protein, 9 aa, Homo Sapiens
VEVVENEDG

SEQ ID NO: 1196245 - protein, 9 aa, Homo Sapiens
EVHAVVEQA

SEQ ID NO: 1196246 - protein, 9 aa, Homo Sapiens
ASGHHTTPA

SEQ ID NO: 1196247 - protein, 9 aa, Homo Sapiens
QCCFQNGRR

SEQ ID NO: 1196248 - protein, 9 aa, Homo Sapiens
TEKMQWLPC

SEQ ID NO: 1196249 - protein, 9 aa, Homo Sapiens
DQKFVPVDY

SEQ ID NO: 1196250 - protein, 9 aa, Homo Sapiens
KVVVVKNGR

SEQ ID NO: 1196251 - protein, 9 aa, Homo Sapiens
FFPRDKSAG

SEQ ID NO: 1196252 - protein, 9 aa, Homo Sapiens
PKPSKPGKK

SEQ ID NO: 1196253 - protein, 9 aa, Homo Sapiens
QSDSRFQLE

SEQ ID NO: 1196254 - protein, 9 aa, Homo Sapiens
VPLAGWARD

SEQ ID NO: 1196255 - protein, 9 aa, Homo Sapiens
GRGGVIPPP

SEQ ID NO: 1196256 - protein, 9 aa, Homo Sapiens
CRRRRSRRG

SEQ ID NO: 1196257 - protein, 9 aa, Homo Sapiens
KGEKKNMKK

SEQ ID NO: 1196258 - protein, 9 aa, Homo Sapiens
FPHVQRGRA

SEQ ID NO: 1196259 - protein, 9 aa, Homo Sapiens
AMGGAWPRP

SEQ ID NO: 1196260 - protein, 9 aa, Homo Sapiens
LFLGSNQLP

SEQ ID NO: 1196261 - protein, 9 aa, Homo Sapiens
RPIQGLHCP

SEQ ID NO: 1196262 - protein, 9 aa, Homo Sapiens
GRNLPGQPN

SEQ ID NO: 1196263 - protein, 9 aa, Homo Sapiens
LAEAVAAAS

SEQ ID NO: 1196264 - protein, 9 aa, Homo Sapiens
SPAGPSTGA

SEQ ID NO: 1196265 - protein, 9 aa, Homo Sapiens
SSLPHLPIE

SEQ ID NO: 1196266 - protein, 9 aa, Homo Sapiens
MGGCPGHLQ

SEQ ID NO: 1196267 - protein, 9 aa, Homo Sapiens
QPRQLPRDR

SEQ ID NO: 1196268 - protein, 9 aa, Homo Sapiens
MVSINVLLA

SEQ ID NO: 1196269 - protein, 9 aa, Homo Sapiens
RNMTLPGED

SEQ ID NO: 1196270 - protein, 9 aa, Homo Sapiens
HTLPILTTQ

SEQ ID NO: 1196271 - protein, 9 aa, Homo Sapiens
TAWTIIYNC

SEQ ID NO: 1196272 - protein, 9 aa, Homo Sapiens
GLVRDCGAW

SEQ ID NO: 1196273 - protein, 9 aa, Homo Sapiens
SNLLNHQRT

SEQ ID NO: 1196274 - protein, 9 aa, Homo Sapiens
HILRYMWGT

SEQ ID NO: 1196275 - protein, 9 aa, Homo Sapiens
PRNLSFLTP

SEQ ID NO: 1196276 - protein, 9 aa, Homo Sapiens
PPPSRHCPP

SEQ ID NO: 1196277 - protein, 9 aa, Homo Sapiens
EHSQLYGKG

SEQ ID NO: 1196278 - protein, 9 aa, Homo Sapiens
NVIRDAVTH

SEQ ID NO: 1196279 - protein, 9 aa, Homo Sapiens
ARSWTPPAS

SEQ ID NO: 1196280 - protein, 9 aa, Homo Sapiens
RYLRKNLNP

SEQ ID NO: 1196281 - protein, 9 aa, Homo Sapiens
GRARAGVCC

SEQ ID NO: 1196282 - protein, 9 aa, Homo Sapiens
NDKCRFSKG

SEQ ID NO: 1196283 - protein, 9 aa, Homo Sapiens
RHPQWCWSL

SEQ ID NO: 1196284 - protein, 9 aa, Homo Sapiens
RVLAGTAKR

SEQ ID NO: 1196285 - protein, 9 aa, Homo Sapiens
NCSRRPARP

SEQ ID NO: 1196286 - protein, 9 aa, Homo Sapiens
EELRSLPLT

SEQ ID NO: 1196287 - protein, 9 aa, Homo Sapiens
PRPIQGLHC

SEQ ID NO: 1196288 - protein, 9 aa, Homo Sapiens
FEEEGEEEE

SEQ ID NO: 1196289 - protein, 9 aa, Homo Sapiens
SRLDNYDTL

SEQ ID NO: 1196290 - protein, 9 aa, Homo Sapiens
GPLRENKKE

SEQ ID NO: 1196291 - protein, 9 aa, Homo Sapiens
GLIGNTAVI

SEQ ID NO: 1196292 - protein, 9 aa, Homo Sapiens
EEGEIYHLY

SEQ ID NO: 1196293 - protein, 9 aa, Homo Sapiens
RRARCCSNR

SEQ ID NO: 1196294 - protein, 9 aa, Homo Sapiens
HGFNSGGSQ

SEQ ID NO: 1196295 - protein, 9 aa, Homo Sapiens
DNGADPSLW

SEQ ID NO: 1196296 - protein, 9 aa, Homo Sapiens
VVEGAGVGE

SEQ ID NO: 1196297 - protein, 9 aa, Homo Sapiens
VDSTAAAAA

SEQ ID NO: 1196298 - protein, 9 aa, Homo Sapiens
FKSMHGDGV

SEQ ID NO: 1196299 - protein, 9 aa, Homo Sapiens
ESLPRAVLS

SEQ ID NO: 1196300 - protein, 9 aa, Homo Sapiens
PRLPPPPPL

SEQ ID NO: 1196301 - protein, 9 aa, Homo Sapiens
WLRQRLCRQ

SEQ ID NO: 1196302 - protein, 9 aa, Homo Sapiens
VHGFNSGGS

SEQ ID NO: 1196303 - protein, 9 aa, Homo Sapiens
QRAVSVVAH

SEQ ID NO: 1196304 - protein, 9 aa, Homo Sapiens
STNCSRRPA

SEQ ID NO: 1196305 - protein, 9 aa, Homo Sapiens
QYSSGLRPC

SEQ ID NO: 1196306 - protein, 9 aa, Homo Sapiens
SCLCFIYVA

SEQ ID NO: 1196307 - protein, 9 aa, Homo Sapiens
VIKVTRNLK

SEQ ID NO: 1196308 - protein, 9 aa, Homo Sapiens
YHEHFTLLT

SEQ ID NO: 1196309 - protein, 9 aa, Homo Sapiens
ALRCISSGW

SEQ ID NO: 1196310 - protein, 9 aa, Homo Sapiens
PGSCGFTQD

SEQ ID NO: 1196311 - protein, 9 aa, Homo Sapiens
GGKAAQARV

SEQ ID NO: 1196312 - protein, 9 aa, Homo Sapiens
GGGREAAGG

SEQ ID NO: 1196313 - protein, 9 aa, Homo Sapiens
VQVPSKPEQ

SEQ ID NO: 1196314 - protein, 9 aa, Homo Sapiens
VTAMQCRKK

SEQ ID NO: 1196315 - protein, 9 aa, Homo Sapiens
QTFHLHHCR

SEQ ID NO: 1196316 - protein, 9 aa, Homo Sapiens
RGPDGVMVR

SEQ ID NO: 1196317 - protein, 9 aa, Homo Sapiens
PTPTRRPRP

SEQ ID NO: 1196318 - protein, 9 aa, Homo Sapiens
PVASTDRWS

SEQ ID NO: 1196319 - protein, 9 aa, Homo Sapiens
LTLECPFCR

SEQ ID NO: 1196320 - protein, 9 aa, Homo Sapiens
ICGLHYDVQ

SEQ ID NO: 1196321 - protein, 9 aa, Homo Sapiens
WEDLIAWLS

SEQ ID NO: 1196322 - protein, 9 aa, Homo Sapiens
IRYTHILNW

SEQ ID NO: 1196323 - protein, 9 aa, Homo Sapiens
YERAGQRGK

SEQ ID NO: 1196324 - protein, 9 aa, Homo Sapiens
EEMKKTTSQ

SEQ ID NO: 1196325 - protein, 9 aa, Homo Sapiens
ASRSRRWAT

SEQ ID NO: 1196326 - protein, 9 aa, Homo Sapiens
MVTALCFVL

SEQ ID NO: 1196327 - protein, 9 aa, Homo Sapiens
DKDDPGPTG

SEQ ID NO: 1196328 - protein, 9 aa, Homo Sapiens
RHRSCPWLK

SEQ ID NO: 1196329 - protein, 9 aa, Homo Sapiens
PRGDQCCFQ

SEQ ID NO: 1196330 - protein, 9 aa, Homo Sapiens
RDLYLPASM

SEQ ID NO: 1196331 - protein, 9 aa, Homo Sapiens
HLLHEAVST

SEQ ID NO: 1196332 - protein, 9 aa, Homo Sapiens
QGGRILLQR

SEQ ID NO: 1196333 - protein, 9 aa, Homo Sapiens
CPRNVPTAA

SEQ ID NO: 1196334 - protein, 9 aa, Homo Sapiens
MNRALGFGT

SEQ ID NO: 1196335 - protein, 9 aa, Homo Sapiens
NSDVGMLKW

SEQ ID NO: 1196336 - protein, 9 aa, Homo Sapiens
LKGSSASCC

SEQ ID NO: 1196337 - protein, 9 aa, Homo Sapiens
KADIPECKK

SEQ ID NO: 1196338 - protein, 9 aa, Homo Sapiens
ILLHLQSQL

SEQ ID NO: 1196339 - protein, 9 aa, Homo Sapiens
EVLGICALR

SEQ ID NO: 1196340 - protein, 9 aa, Homo Sapiens
FNLLHVSEP

SEQ ID NO: 1196341 - protein, 9 aa, Homo Sapiens
RERAAAALR

SEQ ID NO: 1196342 - protein, 9 aa, Homo Sapiens
LSGKESVFL

SEQ ID NO: 1196343 - protein, 9 aa, Homo Sapiens
LLEAFPLPR

SEQ ID NO: 1196344 - protein, 9 aa, Homo Sapiens
QMRASTPAP

SEQ ID NO: 1196345 - protein, 9 aa, Homo Sapiens
EQTLKRQGE

SEQ ID NO: 1196346 - protein, 9 aa, Homo Sapiens
VDIYLDQTN

SEQ ID NO: 1196347 - protein, 9 aa, Homo Sapiens
NDLILWGHA

SEQ ID NO: 1196348 - protein, 9 aa, Homo Sapiens
QKESEEEVE

SEQ ID NO: 1196349 - protein, 9 aa, Homo Sapiens
VASPQSDWT

SEQ ID NO: 1196350 - protein, 9 aa, Homo Sapiens
AAALRAVGT

SEQ ID NO: 1196351 - protein, 9 aa, Homo Sapiens
CTQRQRWGY

SEQ ID NO: 1196352 - protein, 9 aa, Homo Sapiens
EYDPNFAIC

SEQ ID NO: 1196353 - protein, 9 aa, Homo Sapiens
PQQQAPEAL

SEQ ID NO: 1196354 - protein, 9 aa, Homo Sapiens
GQWDPSFNC

SEQ ID NO: 1196355 - protein, 9 aa, Homo Sapiens
GPAAACPTR

SEQ ID NO: 1196356 - protein, 9 aa, Homo Sapiens
IKPERRVED

SEQ ID NO: 1196357 - protein, 9 aa, Homo Sapiens
DNYDTLDIA

SEQ ID NO: 1196358 - protein, 9 aa, Homo Sapiens
LLLASLCTT

SEQ ID NO: 1196359 - protein, 9 aa, Homo Sapiens
DMLGGMGFL

SEQ ID NO: 1196360 - protein, 9 aa, Homo Sapiens
VFKNGKMGI

SEQ ID NO: 1196361 - protein, 9 aa, Homo Sapiens
LFVTCLMNT

SEQ ID NO: 1196362 - protein, 9 aa, Homo Sapiens
PDLDPDPSR

SEQ ID NO: 1196363 - protein, 9 aa, Homo Sapiens
IAFFIPLTI

SEQ ID NO: 1196364 - protein, 9 aa, Homo Sapiens
KKKAEATGH

SEQ ID NO: 1196365 - protein, 9 aa, Homo Sapiens
QARMGCRSL

SEQ ID NO: 1196366 - protein, 9 aa, Homo Sapiens
TRTPATWRR

SEQ ID NO: 1196367 - protein, 9 aa, Homo Sapiens
LCPPRGKRT

SEQ ID NO: 1196368 - protein, 9 aa, Homo Sapiens
GCRTGPCCS

SEQ ID NO: 1196369 - protein, 9 aa, Homo Sapiens
RGLDSQQCT

SEQ ID NO: 1196370 - protein, 9 aa, Homo Sapiens
HKSPKRWGW

SEQ ID NO: 1196371 - protein, 9 aa, Homo Sapiens
GEGHLRLLL

SEQ ID NO: 1196372 - protein, 9 aa, Homo Sapiens
KRKQKPLEK

SEQ ID NO: 1196373 - protein, 9 aa, Homo Sapiens
QGCYSTTET

SEQ ID NO: 1196374 - protein, 9 aa, Homo Sapiens
KVRSAGLGP

SEQ ID NO: 1196375 - protein, 9 aa, Homo Sapiens
WHGLAQGGS

SEQ ID NO: 1196376 - protein, 9 aa, Homo Sapiens
PTVPGDPWP

SEQ ID NO: 1196377 - protein, 9 aa, Homo Sapiens
PTWPTQTWT

SEQ ID NO: 1196378 - protein, 9 aa, Homo Sapiens
FPQGCYSTT

SEQ ID NO: 1196379 - protein, 9 aa, Homo Sapiens
VAISEVLVC

SEQ ID NO: 1196380 - protein, 9 aa, Homo Sapiens
AWLLLAWAP

SEQ ID NO: 1196381 - protein, 9 aa, Homo Sapiens
IIYMSAASF

SEQ ID NO: 1196382 - protein, 9 aa, Homo Sapiens
SLSPTAWSH

SEQ ID NO: 1196383 - protein, 9 aa, Homo Sapiens
LLISRAEIH

SEQ ID NO: 1196384 - protein, 9 aa, Homo Sapiens
LKDLEAQIK

SEQ ID NO: 1196385 - protein, 9 aa, Homo Sapiens
HAHGLSHLR

SEQ ID NO: 1196386 - protein, 9 aa, Homo Sapiens
TLWTLCSST

SEQ ID NO: 1196387 - protein, 9 aa, Homo Sapiens
RCMFGIRYD

SEQ ID NO: 1196388 - protein, 9 aa, Homo Sapiens
CPVHLVACS

SEQ ID NO: 1196389 - protein, 9 aa, Homo Sapiens
GARDVLCHQ

SEQ ID NO: 1196390 - protein, 9 aa, Homo Sapiens
QLALHEGSL

SEQ ID NO: 1196391 - protein, 9 aa, Homo Sapiens
ALMQKHHRR

SEQ ID NO: 1196392 - protein, 9 aa, Homo Sapiens
PRIKASSMP

SEQ ID NO: 1196393 - protein, 9 aa, Homo Sapiens
GVMSVCLFM

SEQ ID NO: 1196394 - protein, 9 aa, Homo Sapiens
TEESIPSCS

SEQ ID NO: 1196395 - protein, 9 aa, Homo Sapiens
LSLLFFWRP

SEQ ID NO: 1196396 - protein, 9 aa, Homo Sapiens
DRERAAQTR

SEQ ID NO: 1196397 - protein, 9 aa, Homo Sapiens
VVDANGKNL

SEQ ID NO: 1196398 - protein, 9 aa, Homo Sapiens
RYMQETRSQ

SEQ ID NO: 1196399 - protein, 9 aa, Homo Sapiens
ILLIIWTLL

SEQ ID NO: 1196400 - protein, 9 aa, Homo Sapiens
GEMHVPTAA

SEQ ID NO: 1196401 - protein, 9 aa, Homo Sapiens
VIVDVVMKV

SEQ ID NO: 1196402 - protein, 9 aa, Homo Sapiens
AHGLHVALE

SEQ ID NO: 1196403 - protein, 9 aa, Homo Sapiens
HKLPSIGEK

SEQ ID NO: 1196404 - protein, 9 aa, Homo Sapiens
WRTKEMLAL

SEQ ID NO: 1196405 - protein, 9 aa, Homo Sapiens
VASAGFSSM

SEQ ID NO: 1196406 - protein, 9 aa, Homo Sapiens
GAGAADTEP

SEQ ID NO: 1196407 - protein, 9 aa, Homo Sapiens
PGPLPASHP

SEQ ID NO: 1196408 - protein, 9 aa, Homo Sapiens
VEGLGQTAQ

SEQ ID NO: 1196409 - protein, 9 aa, Homo Sapiens
NTQYPEKIH

SEQ ID NO: 1196410 - protein, 9 aa, Homo Sapiens
PVGPPCRSS

SEQ ID NO: 1196411 - protein, 9 aa, Homo Sapiens
TSGVGTYIL

SEQ ID NO: 1196412 - protein, 9 aa, Homo Sapiens
NRAIQELGL

SEQ ID NO: 1196413 - protein, 9 aa, Homo Sapiens
QAGSPRYQG

SEQ ID NO: 1196414 - protein, 9 aa, Homo Sapiens
RGPRAPPGA

SEQ ID NO: 1196415 - protein, 9 aa, Homo Sapiens
CPYHPGHHG

SEQ ID NO: 1196416 - protein, 9 aa, Homo Sapiens
WNKLAQKFP

SEQ ID NO: 1196417 - protein, 9 aa, Homo Sapiens
ALSLEAHTC

SEQ ID NO: 1196418 - protein, 9 aa, Homo Sapiens
FPIKSFVQT

SEQ ID NO: 1196419 - protein, 9 aa, Homo Sapiens
STHQKDKPG

SEQ ID NO: 1196420 - protein, 9 aa, Homo Sapiens
RSRAEKPTA

SEQ ID NO: 1196421 - protein, 9 aa, Homo Sapiens
YIPGQGHST

SEQ ID NO: 1196422 - protein, 9 aa, Homo Sapiens
FNLWYTMDR

SEQ ID NO: 1196423 - protein, 9 aa, Homo Sapiens
AIKAWGMES

SEQ ID NO: 1196424 - protein, 9 aa, Homo Sapiens
CLRSAQHIS

SEQ ID NO: 1196425 - protein, 9 aa, Homo Sapiens
RRGGGQVPE

SEQ ID NO: 1196426 - protein, 9 aa, Homo Sapiens
CLVHRAVCQ

SEQ ID NO: 1196427 - protein, 9 aa, Homo Sapiens
EKPTAALGW

SEQ ID NO: 1196428 - protein, 9 aa, Homo Sapiens
RTAEIVASL

SEQ ID NO: 1196429 - protein, 9 aa, Homo Sapiens
WNKDDQEGR

SEQ ID NO: 1196430 - protein, 9 aa, Homo Sapiens
HLCPILCHP

SEQ ID NO: 1196431 - protein, 9 aa, Homo Sapiens
RCPPGVVPT

SEQ ID NO: 1196432 - protein, 9 aa, Homo Sapiens
SFVLDVFAS

SEQ ID NO: 1196433 - protein, 9 aa, Homo Sapiens
IAKHVAASL

SEQ ID NO: 1196434 - protein, 9 aa, Homo Sapiens
SLTAAGGAG

SEQ ID NO: 1196435 - protein, 9 aa, Homo Sapiens
GGGLCGYSV

SEQ ID NO: 1196436 - protein, 9 aa, Homo Sapiens
YGSARTCRA

SEQ ID NO: 1196437 - protein, 9 aa, Homo Sapiens
CGSTPPPPP

SEQ ID NO: 1196438 - protein, 9 aa, Homo Sapiens
WRKQYSIAL

SEQ ID NO: 1196439 - protein, 9 aa, Homo Sapiens
AAACPTRAH

SEQ ID NO: 1196440 - protein, 9 aa, Homo Sapiens
RYQGAAVAC

SEQ ID NO: 1196441 - protein, 9 aa, Homo Sapiens
RGGSAGAGP

SEQ ID NO: 1196442 - protein, 9 aa, Homo Sapiens
KKYRNMVVC

SEQ ID NO: 1196443 - protein, 9 aa, Homo Sapiens
NVVEKLNLF

SEQ ID NO: 1196444 - protein, 9 aa, Homo Sapiens
VAWSRLLLP

SEQ ID NO: 1196445 - protein, 9 aa, Homo Sapiens
ATLPESTHM

SEQ ID NO: 1196446 - protein, 9 aa, Homo Sapiens
SVPPGRRQR

SEQ ID NO: 1196447 - protein, 9 aa, Homo Sapiens
TVPGPIACL

SEQ ID NO: 1196448 - protein, 9 aa, Homo Sapiens
ALEALLNKG

SEQ ID NO: 1196449 - protein, 9 aa, Homo Sapiens
WVMWMWGEQ

SEQ ID NO: 1196450 - protein, 9 aa, Homo Sapiens
WSWRMGPGR

SEQ ID NO: 1196451 - protein, 9 aa, Homo Sapiens
GLHVALEAW

SEQ ID NO: 1196452 - protein, 9 aa, Homo Sapiens
HHCRTQPSS

SEQ ID NO: 1196453 - protein, 9 aa, Homo Sapiens
ATGAGKDWP

SEQ ID NO: 1196454 - protein, 9 aa, Homo Sapiens
RVTHTREIT

SEQ ID NO: 1196455 - protein, 9 aa, Homo Sapiens
AKSSKRSFG

SEQ ID NO: 1196456 - protein, 9 aa, Homo Sapiens
GCPTAAPPA

SEQ ID NO: 1196457 - protein, 9 aa, Homo Sapiens
PRDHSPPHR

SEQ ID NO: 1196458 - protein, 9 aa, Homo Sapiens
SNLLMVTIK

SEQ ID NO: 1196459 - protein, 9 aa, Homo Sapiens
RRPRGPWRA

SEQ ID NO: 1196460 - protein, 9 aa, Homo Sapiens
RVIQLTSDE

SEQ ID NO: 1196461 - protein, 9 aa, Homo Sapiens
SDFIPRLVH

SEQ ID NO: 1196462 - protein, 9 aa, Homo Sapiens
LVHQLHGKV

SEQ ID NO: 1196463 - protein, 9 aa, Homo Sapiens
HQCPASGGG

SEQ ID NO: 1196464 - protein, 9 aa, Homo Sapiens
TAILSRQTK

SEQ ID NO: 1196465 - protein, 9 aa, Homo Sapiens
AGHPHNPRT

SEQ ID NO: 1196466 - protein, 9 aa, Homo Sapiens
TGGTLSHQI

SEQ ID NO: 1196467 - protein, 9 aa, Homo Sapiens
EIVVHMDLM

SEQ ID NO: 1196468 - protein, 9 aa, Homo Sapiens
GAAPSSRPR

SEQ ID NO: 1196469 - protein, 9 aa, Homo Sapiens
STARATSPC

SEQ ID NO: 1196470 - protein, 9 aa, Homo Sapiens
PNPPTSSCM

SEQ ID NO: 1196471 - protein, 9 aa, Homo Sapiens
APLPFRAGS

SEQ ID NO: 1196472 - protein, 9 aa, Homo Sapiens
FYDPCLQDG

SEQ ID NO: 1196473 - protein, 9 aa, Homo Sapiens
GTGRRARAL

SEQ ID NO: 1196474 - protein, 9 aa, Homo Sapiens
GWFEQRKVY

SEQ ID NO: 1196475 - protein, 9 aa, Homo Sapiens
GECRQGHRH

SEQ ID NO: 1196476 - protein, 9 aa, Homo Sapiens
RRWPLAGWS

SEQ ID NO: 1196477 - protein, 9 aa, Homo Sapiens
LGIAPGDTS

SEQ ID NO: 1196478 - protein, 9 aa, Homo Sapiens
VKMVIVVMT

SEQ ID NO: 1196479 - protein, 9 aa, Homo Sapiens
REKAKGPGK

SEQ ID NO: 1196480 - protein, 9 aa, Homo Sapiens
KTNEEKRQC

SEQ ID NO: 1196481 - protein, 9 aa, Homo Sapiens
PARRRAGAG

SEQ ID NO: 1196482 - protein, 9 aa, Homo Sapiens
AGPALPPAC

SEQ ID NO: 1196483 - protein, 9 aa, Homo Sapiens
SVTAMQCRK

SEQ ID NO: 1196484 - protein, 9 aa, Homo Sapiens
QSPAQEIVF

SEQ ID NO: 1196485 - protein, 9 aa, Homo Sapiens
QSQQPYPQQ

SEQ ID NO: 1196486 - protein, 9 aa, Homo Sapiens
RLVSTSRKR

SEQ ID NO: 1196487 - protein, 9 aa, Homo Sapiens
ILTPSRSQW

SEQ ID NO: 1196488 - protein, 9 aa, Homo Sapiens
DGYRLEKET

SEQ ID NO: 1196489 - protein, 9 aa, Homo Sapiens
QLNPGIYPQ

SEQ ID NO: 1196490 - protein, 9 aa, Homo Sapiens
SLCLPAQSW

SEQ ID NO: 1196491 - protein, 9 aa, Homo Sapiens
PCRPRVTPA

SEQ ID NO: 1196492 - protein, 9 aa, Homo Sapiens
PCRPRVTPG

SEQ ID NO: 1196493 - protein, 9 aa, Homo Sapiens
KCGMEPGAE

SEQ ID NO: 1196494 - protein, 9 aa, Homo Sapiens
MGESAQAAI

SEQ ID NO: 1196495 - protein, 9 aa, Homo Sapiens
EQQLSIHFA

SEQ ID NO: 1196496 - protein, 9 aa, Homo Sapiens
KASFTTPYG

SEQ ID NO: 1196497 - protein, 9 aa, Homo Sapiens
VIWVTNWKP

SEQ ID NO: 1196498 - protein, 9 aa, Homo Sapiens
IKRYLRKNL

SEQ ID NO: 1196499 - protein, 9 aa, Homo Sapiens
LAMALCGSK

SEQ ID NO: 1196500 - protein, 9 aa, Homo Sapiens
YLHCDAPAE

SEQ ID NO: 1196501 - protein, 9 aa, Homo Sapiens
TLERVSPGG

SEQ ID NO: 1196502 - protein, 9 aa, Homo Sapiens
DILQTVLET

SEQ ID NO: 1196503 - protein, 9 aa, Homo Sapiens
SAGNNSKPV

SEQ ID NO: 1196504 - protein, 9 aa, Homo Sapiens
DVATRHLAS

SEQ ID NO: 1196505 - protein, 9 aa, Homo Sapiens
AEAEDKMLR

SEQ ID NO: 1196506 - protein, 9 aa, Homo Sapiens
SMQDRMELA

SEQ ID NO: 1196507 - protein, 9 aa, Homo Sapiens
FPVNSDVGM

SEQ ID NO: 1196508 - protein, 9 aa, Homo Sapiens
IYSEHNYCR

SEQ ID NO: 1196509 - protein, 9 aa, Homo Sapiens
AAVVMVVRP

SEQ ID NO: 1196510 - protein, 9 aa, Homo Sapiens
PTLPQGPTV

SEQ ID NO: 1196511 - protein, 9 aa, Homo Sapiens
RKLEAFAER

SEQ ID NO: 1196512 - protein, 9 aa, Homo Sapiens
ARSWWSMSR

SEQ ID NO: 1196513 - protein, 9 aa, Homo Sapiens
WSLPCPPGG

SEQ ID NO: 1196514 - protein, 9 aa, Homo Sapiens
LYLLQGSLV

SEQ ID NO: 1196515 - protein, 9 aa, Homo Sapiens
GVCFIHFLH

SEQ ID NO: 1196516 - protein, 9 aa, Homo Sapiens
NQPSFDGIL

SEQ ID NO: 1196517 - protein, 9 aa, Homo Sapiens
LPFRAGSVP

SEQ ID NO: 1196518 - protein, 9 aa, Homo Sapiens
QPLGISVLL

SEQ ID NO: 1196519 - protein, 9 aa, Homo Sapiens
VDVVMKVKK

SEQ ID NO: 1196520 - protein, 9 aa, Homo Sapiens
CLFMKRYTA

SEQ ID NO: 1196521 - protein, 9 aa, Homo Sapiens
PAHGLHVAL

SEQ ID NO: 1196522 - protein, 9 aa, Homo Sapiens
VAHDPPQSL

SEQ ID NO: 1196523 - protein, 9 aa, Homo Sapiens
TMYETQMPL

SEQ ID NO: 1196524 - protein, 9 aa, Homo Sapiens
VSTPPSCCR

SEQ ID NO: 1196525 - protein, 9 aa, Homo Sapiens
TIGVEMVLL

SEQ ID NO: 1196526 - protein, 9 aa, Homo Sapiens
VLRPFYCAE

SEQ ID NO: 1196527 - protein, 9 aa, Homo Sapiens
YQKYRRKGK

SEQ ID NO: 1196528 - protein, 9 aa, Homo Sapiens
PGPCLAQAP

SEQ ID NO: 1196529 - protein, 9 aa, Homo Sapiens
DLMNMLVLG

SEQ ID NO: 1196530 - protein, 9 aa, Homo Sapiens
TKASILKDQ

SEQ ID NO: 1196531 - protein, 9 aa, Homo Sapiens
HFIGNMLLS

SEQ ID NO: 1196532 - protein, 9 aa, Homo Sapiens
PHSHIKPYV

SEQ ID NO: 1196533 - protein, 9 aa, Homo Sapiens
LCVALTSLA

SEQ ID NO: 1196534 - protein, 9 aa, Homo Sapiens
VFGSGSAVG

SEQ ID NO: 1196535 - protein, 9 aa, Homo Sapiens
LITTLVLKK

SEQ ID NO: 1196536 - protein, 9 aa, Homo Sapiens
ELTDMSSIC

SEQ ID NO: 1196537 - protein, 9 aa, Homo Sapiens
WGWCPVGRH

SEQ ID NO: 1196538 - protein, 9 aa, Homo Sapiens
ARLDVQCLL

SEQ ID NO: 1196539 - protein, 9 aa, Homo Sapiens
ATPQGHLAV

SEQ ID NO: 1196540 - protein, 9 aa, Homo Sapiens
ALRAVGTQI

SEQ ID NO: 1196541 - protein, 9 aa, Homo Sapiens
VLRGTILVK

SEQ ID NO: 1196542 - protein, 9 aa, Homo Sapiens
GPGYLFRVA

SEQ ID NO: 1196543 - protein, 9 aa, Homo Sapiens
EQKARGGLP

SEQ ID NO: 1196544 - protein, 9 aa, Homo Sapiens
PPKPLGPEQ

SEQ ID NO: 1196545 - protein, 9 aa, Homo Sapiens
GPMNPLVFG

SEQ ID NO: 1196546 - protein, 9 aa, Homo Sapiens
SLLCTPPGS

SEQ ID NO: 1196547 - protein, 9 aa, Homo Sapiens
ILGSGEEVP

SEQ ID NO: 1196548 - protein, 9 aa, Homo Sapiens
FSKFSLDRP

SEQ ID NO: 1196549 - protein, 9 aa, Homo Sapiens
PGKAHKKSS

SEQ ID NO: 1196550 - protein, 9 aa, Homo Sapiens
SWRITWSSS

SEQ ID NO: 1196551 - protein, 9 aa, Homo Sapiens
RDSRDGWGA

SEQ ID NO: 1196552 - protein, 9 aa, Homo Sapiens
HKIVHAGEK

SEQ ID NO: 1196553 - protein, 9 aa, Homo Sapiens
PKDHQDIKE

SEQ ID NO: 1196554 - protein, 9 aa, Homo Sapiens
HTTEACFSC

SEQ ID NO: 1196555 - protein, 9 aa, Homo Sapiens
FVGPRCSFC

SEQ ID NO: 1196556 - protein, 9 aa, Homo Sapiens
RSRRSGLES

SEQ ID NO: 1196557 - protein, 9 aa, Homo Sapiens
TNMATFISQ

SEQ ID NO: 1196558 - protein, 9 aa, Homo Sapiens
VPRDVVLDV

SEQ ID NO: 1196559 - protein, 9 aa, Homo Sapiens
HKAVYRISF

SEQ ID NO: 1196560 - protein, 9 aa, Homo Sapiens
QMASKLPDM

SEQ ID NO: 1196561 - protein, 9 aa, Homo Sapiens
SNAAVALLM

SEQ ID NO: 1196562 - protein, 9 aa, Homo Sapiens
RREKNRIAT

SEQ ID NO: 1196563 - protein, 9 aa, Homo Sapiens
IIEAVDCSD

SEQ ID NO: 1196564 - protein, 9 aa, Homo Sapiens
YTRTLRYLW

SEQ ID NO: 1196565 - protein, 9 aa, Homo Sapiens
LFPIKSFVQ

SEQ ID NO: 1196566 - protein, 9 aa, Homo Sapiens
PLVAFMLPA

SEQ ID NO: 1196567 - protein, 9 aa, Homo Sapiens
GQSGQGQST

SEQ ID NO: 1196568 - protein, 9 aa, Homo Sapiens
ITTGWIIRL

SEQ ID NO: 1196569 - protein, 9 aa, Homo Sapiens
GRPRRALGF

SEQ ID NO: 1196570 - protein, 9 aa, Homo Sapiens
GHERRKVVV

SEQ ID NO: 1196571 - protein, 9 aa, Homo Sapiens
ATVGAVGVG

SEQ ID NO: 1196572 - protein, 9 aa, Homo Sapiens
QPGMYNMSA

SEQ ID NO: 1196573 - protein, 9 aa, Homo Sapiens
ECTLKGDLF

SEQ ID NO: 1196574 - protein, 9 aa, Homo Sapiens
NVLDSFHCS

SEQ ID NO: 1196575 - protein, 9 aa, Homo Sapiens
QQRQQCLVC

SEQ ID NO: 1196576 - protein, 9 aa, Homo Sapiens
QQENRRRAK

SEQ ID NO: 1196577 - protein, 9 aa, Homo Sapiens
APRHPHRSP

SEQ ID NO: 1196578 - protein, 9 aa, Homo Sapiens
GARETRGPR

SEQ ID NO: 1196579 - protein, 9 aa, Homo Sapiens
AVPVQPHSP

SEQ ID NO: 1196580 - protein, 9 aa, Homo Sapiens
WKKRFGQWA

SEQ ID NO: 1196581 - protein, 9 aa, Homo Sapiens
DLVIHSQQP

SEQ ID NO: 1196582 - protein, 9 aa, Homo Sapiens
HYLRCLRAW

SEQ ID NO: 1196583 - protein, 9 aa, Homo Sapiens
RGSGLPARR

SEQ ID NO: 1196584 - protein, 9 aa, Homo Sapiens
RSWVHSPLH

SEQ ID NO: 1196585 - protein, 9 aa, Homo Sapiens
VCRAPSDQV

SEQ ID NO: 1196586 - protein, 9 aa, Homo Sapiens
RPPREGPNK

SEQ ID NO: 1196587 - protein, 9 aa, Homo Sapiens
VSTQALGWP

SEQ ID NO: 1196588 - protein, 9 aa, Homo Sapiens
HLNAVHLQD

SEQ ID NO: 1196589 - protein, 9 aa, Homo Sapiens
VVVKNGRRY

SEQ ID NO: 1196590 - protein, 9 aa, Homo Sapiens
KTLSQTKKT

SEQ ID NO: 1196591 - protein, 9 aa, Homo Sapiens
IAFLLRRRT

SEQ ID NO: 1196592 - protein, 9 aa, Homo Sapiens
EYLKKKWEE

SEQ ID NO: 1196593 - protein, 9 aa, Homo Sapiens
FPDLMNMLV

SEQ ID NO: 1196594 - protein, 9 aa, Homo Sapiens
VEAPPQTRL

SEQ ID NO: 1196595 - protein, 9 aa, Homo Sapiens
NKEKEHYKC

SEQ ID NO: 1196596 - protein, 9 aa, Homo Sapiens
SVGFLWRSN

SEQ ID NO: 1196597 - protein, 9 aa, Homo Sapiens
KVGQCLDVG

SEQ ID NO: 1196598 - protein, 9 aa, Homo Sapiens
ETIFIKVTR

SEQ ID NO: 1196599 - protein, 9 aa, Homo Sapiens
INYCIEKLQ

SEQ ID NO: 1196600 - protein, 9 aa, Homo Sapiens
KQLVCPVTQ

SEQ ID NO: 1196601 - protein, 9 aa, Homo Sapiens
CQLHARTQL

SEQ ID NO: 1196602 - protein, 9 aa, Homo Sapiens
AAPVITSSQ

SEQ ID NO: 1196603 - protein, 9 aa, Homo Sapiens
PPAGRGAPR

SEQ ID NO: 1196604 - protein, 9 aa, Homo Sapiens
SFPVDFFRP

SEQ ID NO: 1196605 - protein, 9 aa, Homo Sapiens
EKNGNNQKL

SEQ ID NO: 1196606 - protein, 9 aa, Homo Sapiens
ARPGATRAT

SEQ ID NO: 1196607 - protein, 9 aa, Homo Sapiens
SPDVECAKN

SEQ ID NO: 1196608 - protein, 9 aa, Homo Sapiens
FLTTTSRKS

SEQ ID NO: 1196609 - protein, 9 aa, Homo Sapiens
TFGKAQEDP

SEQ ID NO: 1196610 - protein, 9 aa, Homo Sapiens
HAMHTLSED

SEQ ID NO: 1196611 - protein, 9 aa, Homo Sapiens
ALKCRAQGQ

SEQ ID NO: 1196612 - protein, 9 aa, Homo Sapiens
LHALRALHL

SEQ ID NO: 1196613 - protein, 9 aa, Homo Sapiens
PNGRLCPAL

SEQ ID NO: 1196614 - protein, 9 aa, Homo Sapiens
FWMAMFQQK

SEQ ID NO: 1196615 - protein, 9 aa, Homo Sapiens
LLEWIRHTI

SEQ ID NO: 1196616 - protein, 9 aa, Homo Sapiens
AYKCEDCGN

SEQ ID NO: 1196617 - protein, 9 aa, Homo Sapiens
PEAAPDQAD

SEQ ID NO: 1196618 - protein, 9 aa, Homo Sapiens
KNLNPPTFP

SEQ ID NO: 1196619 - protein, 9 aa, Homo Sapiens
YIRDLFIDG

SEQ ID NO: 1196620 - protein, 9 aa, Homo Sapiens
QRRCQPHQA

SEQ ID NO: 1196621 - protein, 9 aa, Homo Sapiens
SALPFDGST

SEQ ID NO: 1196622 - protein, 9 aa, Homo Sapiens
WTRPSFDSL

SEQ ID NO: 1196623 - protein, 9 aa, Homo Sapiens
TPGPAHGLH

SEQ ID NO: 1196624 - protein, 9 aa, Homo Sapiens
WRQLCGWRE

SEQ ID NO: 1196625 - protein, 9 aa, Homo Sapiens
SGPGRRRRW

SEQ ID NO: 1196626 - protein, 9 aa, Homo Sapiens
MSSMACGSA

SEQ ID NO: 1196627 - protein, 9 aa, Homo Sapiens
QGHSTYVVP

SEQ ID NO: 1196628 - protein, 9 aa, Homo Sapiens
LSNWSSWGS

SEQ ID NO: 1196629 - protein, 9 aa, Homo Sapiens
RSSKTMQLK

SEQ ID NO: 1196630 - protein, 9 aa, Homo Sapiens
YLIIAICTV

SEQ ID NO: 1196631 - protein, 9 aa, Homo Sapiens
LRGFISILP

SEQ ID NO: 1196632 - protein, 9 aa, Homo Sapiens
KDLEAQIKA

SEQ ID NO: 1196633 - protein, 9 aa, Homo Sapiens
ALVLQQVGQ

SEQ ID NO: 1196634 - protein, 9 aa, Homo Sapiens
AQQQLQAFT

SEQ ID NO: 1196635 - protein, 9 aa, Homo Sapiens
GFHLTPEPV

SEQ ID NO: 1196636 - protein, 9 aa, Homo Sapiens
EVADGQAAL

SEQ ID NO: 1196637 - protein, 9 aa, Homo Sapiens
DAHSFYSFI

SEQ ID NO: 1196638 - protein, 9 aa, Homo Sapiens
QASHMLPQP

SEQ ID NO: 1196639 - protein, 9 aa, Homo Sapiens
PRKLLAQDW

SEQ ID NO: 1196640 - protein, 9 aa, Homo Sapiens
TVQGDTSHL

SEQ ID NO: 1196641 - protein, 9 aa, Homo Sapiens
CSDILALLN

SEQ ID NO: 1196642 - protein, 9 aa, Homo Sapiens
IEDASGAFS

SEQ ID NO: 1196643 - protein, 9 aa, Homo Sapiens
QPLPQPLPR

SEQ ID NO: 1196644 - protein, 9 aa, Homo Sapiens
GPPWQWRGM

SEQ ID NO: 1196645 - protein, 9 aa, Homo Sapiens
LDPDPSRLL

SEQ ID NO: 1196646 - protein, 9 aa, Homo Sapiens
KGKGEKKNM

SEQ ID NO: 1196647 - protein, 9 aa, Homo Sapiens
FSDVSHDSA

SEQ ID NO: 1196648 - protein, 9 aa, Homo Sapiens
PSRPSGRPR

SEQ ID NO: 1196649 - protein, 9 aa, Homo Sapiens
LAGPARAVT

SEQ ID NO: 1196650 - protein, 9 aa, Homo Sapiens
LMRRVWMVL

SEQ ID NO: 1196651 - protein, 9 aa, Homo Sapiens
GSVASCWPD

SEQ ID NO: 1196652 - protein, 9 aa, Homo Sapiens
VCTCMCTHI

SEQ ID NO: 1196653 - protein, 9 aa, Homo Sapiens
RARVWRGAG

SEQ ID NO: 1196654 - protein, 9 aa, Homo Sapiens
VAVNDNGIE

SEQ ID NO: 1196655 - protein, 9 aa, Homo Sapiens
SPGQMLFQN

SEQ ID NO: 1196656 - protein, 9 aa, Homo Sapiens
VRPAGMTFN

SEQ ID NO: 1196657 - protein, 9 aa, Homo Sapiens
RRLHSHMYY

SEQ ID NO: 1196658 - protein, 9 aa, Homo Sapiens
HLAVTLQGV

SEQ ID NO: 1196659 - protein, 9 aa, Homo Sapiens
RPLRGGRPP

SEQ ID NO: 1196660 - protein, 9 aa, Homo Sapiens
VFLVVFLYM

SEQ ID NO: 1196661 - protein, 9 aa, Homo Sapiens
STETTTGRP

SEQ ID NO: 1196662 - protein, 9 aa, Homo Sapiens
LYLDLLDAH

SEQ ID NO: 1196663 - protein, 9 aa, Homo Sapiens
PVPRGPDGA

SEQ ID NO: 1196664 - protein, 9 aa, Homo Sapiens
TYKSAVSGA

SEQ ID NO: 1196665 - protein, 9 aa, Homo Sapiens
QISLPLRGF

SEQ ID NO: 1196666 - protein, 9 aa, Homo Sapiens
TATWRCCAN

SEQ ID NO: 1196667 - protein, 9 aa, Homo Sapiens
EFVKGWFEQ

SEQ ID NO: 1196668 - protein, 9 aa, Homo Sapiens
FHFQAHDAD

SEQ ID NO: 1196669 - protein, 9 aa, Homo Sapiens
WPRTRCCPR

SEQ ID NO: 1196670 - protein, 9 aa, Homo Sapiens
RTKEMLALT

SEQ ID NO: 1196671 - protein, 9 aa, Homo Sapiens
RPLHRWLQQ

SEQ ID NO: 1196672 - protein, 9 aa, Homo Sapiens
APSCLSIWP

SEQ ID NO: 1196673 - protein, 9 aa, Homo Sapiens
GDDEVVAVG

SEQ ID NO: 1196674 - protein, 9 aa, Homo Sapiens
SSLGKSDGH

SEQ ID NO: 1196675 - protein, 9 aa, Homo Sapiens
MRRMRKTFA

SEQ ID NO: 1196676 - protein, 9 aa, Homo Sapiens
FRLDNLFNM

SEQ ID NO: 1196677 - protein, 9 aa, Homo Sapiens
HRTGIRIFA

SEQ ID NO: 1196678 - protein, 9 aa, Homo Sapiens
CSSSRQSSS

SEQ ID NO: 1196679 - protein, 9 aa, Homo Sapiens
MPEGKKLVN

SEQ ID NO: 1196680 - protein, 9 aa, Homo Sapiens
VGIKPERRV

SEQ ID NO: 1196681 - protein, 9 aa, Homo Sapiens
IEELQVIQC

SEQ ID NO: 1196682 - protein, 9 aa, Homo Sapiens
TNYLPVAFQ

SEQ ID NO: 1196683 - protein, 9 aa, Homo Sapiens
VILSVVHMA

SEQ ID NO: 1196684 - protein, 9 aa, Homo Sapiens
LEGIGHVAP

SEQ ID NO: 1196685 - protein, 9 aa, Homo Sapiens
THRVQAGQH

SEQ ID NO: 1196686 - protein, 9 aa, Homo Sapiens
LGAYGTSNA

SEQ ID NO: 1196687 - protein, 9 aa, Homo Sapiens
DWACLWSPS

SEQ ID NO: 1196688 - protein, 9 aa, Homo Sapiens
SNCKNGSPQ

SEQ ID NO: 1196689 - protein, 9 aa, Homo Sapiens
CGGGAGCPR

SEQ ID NO: 1196690 - protein, 9 aa, Homo Sapiens
KRAGMSKPV

SEQ ID NO: 1196691 - protein, 9 aa, Homo Sapiens
SACNGLRGF

SEQ ID NO: 1196692 - protein, 9 aa, Homo Sapiens
AGCRRWPGC

SEQ ID NO: 1196693 - protein, 9 aa, Homo Sapiens
GNGHNKLFR

SEQ ID NO: 1196694 - protein, 9 aa, Homo Sapiens
QAQAGQCPR

SEQ ID NO: 1196695 - protein, 9 aa, Homo Sapiens
FMKQMNDAR

SEQ ID NO: 1196696 - protein, 9 aa, Homo Sapiens
EQLGDEGGR

SEQ ID NO: 1196697 - protein, 9 aa, Homo Sapiens
DSCVSAHTA

SEQ ID NO: 1196698 - protein, 9 aa, Homo Sapiens
GAGHVAGCR

SEQ ID NO: 1196699 - protein, 9 aa, Homo Sapiens
WPRQASRLK

SEQ ID NO: 1196700 - protein, 9 aa, Homo Sapiens
GHGKVQVGG

SEQ ID NO: 1196701 - protein, 9 aa, Homo Sapiens
FGVGGYVGD

SEQ ID NO: 1196702 - protein, 9 aa, Homo Sapiens
YKCQIVIVQ

SEQ ID NO: 1196703 - protein, 9 aa, Homo Sapiens
GQPQMQHSP

SEQ ID NO: 1196704 - protein, 9 aa, Homo Sapiens
QLALIGFVE

SEQ ID NO: 1196705 - protein, 9 aa, Homo Sapiens
LMPGPDSSG

SEQ ID NO: 1196706 - protein, 9 aa, Homo Sapiens
RRGAPGHPG

SEQ ID NO: 1196707 - protein, 9 aa, Homo Sapiens
ALKLRGSGL

SEQ ID NO: 1196708 - protein, 9 aa, Homo Sapiens
EPPMLWTMD

SEQ ID NO: 1196709 - protein, 9 aa, Homo Sapiens
LLVDFQLAP

SEQ ID NO: 1196710 - protein, 9 aa, Homo Sapiens
DDVASPQSD

SEQ ID NO: 1196711 - protein, 9 aa, Homo Sapiens
PAAPAPAPG

SEQ ID NO: 1196712 - protein, 9 aa, Homo Sapiens
GAKEAPELV

SEQ ID NO: 1196713 - protein, 9 aa, Homo Sapiens
APPGGPARG

SEQ ID NO: 1196714 - protein, 9 aa, Homo Sapiens
VLGGFLYAM

SEQ ID NO: 1196715 - protein, 9 aa, Homo Sapiens
RLCPALPAG

SEQ ID NO: 1196716 - protein, 9 aa, Homo Sapiens
RKLLAQDWV

SEQ ID NO: 1196717 - protein, 9 aa, Homo Sapiens
RTPGASAGR

SEQ ID NO: 1196718 - protein, 9 aa, Homo Sapiens
FNYRRPMYH

SEQ ID NO: 1196719 - protein, 9 aa, Homo Sapiens
TKVQQYRVT

SEQ ID NO: 1196720 - protein, 9 aa, Homo Sapiens
AVLRAVGGL

SEQ ID NO: 1196721 - protein, 9 aa, Homo Sapiens
CPETMMLSL

SEQ ID NO: 1196722 - protein, 9 aa, Homo Sapiens
TPLRCAVEK

SEQ ID NO: 1196723 - protein, 9 aa, Homo Sapiens
DANGRVNAV

SEQ ID NO: 1196724 - protein, 9 aa, Homo Sapiens
SSSMGHPGR

SEQ ID NO: 1196725 - protein, 9 aa, Homo Sapiens
SSFVNSLAC

SEQ ID NO: 1196726 - protein, 9 aa, Homo Sapiens
ITTLVLKKL

SEQ ID NO: 1196727 - protein, 9 aa, Homo Sapiens
LLCPKREHS

SEQ ID NO: 1196728 - protein, 9 aa, Homo Sapiens
PSLPPGPGR

SEQ ID NO: 1196729 - protein, 9 aa, Homo Sapiens
VALTSLALS

SEQ ID NO: 1196730 - protein, 9 aa, Homo Sapiens
FSCNNKELI

SEQ ID NO: 1196731 - protein, 9 aa, Homo Sapiens
EILPMGSLV

SEQ ID NO: 1196732 - protein, 9 aa, Homo Sapiens
YCCKKCTYR

SEQ ID NO: 1196733 - protein, 9 aa, Homo Sapiens
ARCCSNRLW

SEQ ID NO: 1196734 - protein, 9 aa, Homo Sapiens
FPSWRITWS

SEQ ID NO: 1196735 - protein, 9 aa, Homo Sapiens
AVIVVASEL

SEQ ID NO: 1196736 - protein, 9 aa, Homo Sapiens
IQGEIGISN

SEQ ID NO: 1196737 - protein, 9 aa, Homo Sapiens
SSQYSSGLR

SEQ ID NO: 1196738 - protein, 9 aa, Homo Sapiens
RPGEAVGLH

SEQ ID NO: 1196739 - protein, 9 aa, Homo Sapiens
SLAITQGRR

SEQ ID NO: 1196740 - protein, 9 aa, Homo Sapiens
VTVGNVYTP

SEQ ID NO: 1196741 - protein, 9 aa, Homo Sapiens
EGGHVEVRE

SEQ ID NO: 1196742 - protein, 9 aa, Homo Sapiens
PALSRNKYG

SEQ ID NO: 1196743 - protein, 9 aa, Homo Sapiens
YRRKGKKAL

SEQ ID NO: 1196744 - protein, 9 aa, Homo Sapiens
CCLKTSCFK

SEQ ID NO: 1196745 - protein, 9 aa, Homo Sapiens
LRRVCHANI

SEQ ID NO: 1196746 - protein, 9 aa, Homo Sapiens
CPTAAPPAP

SEQ ID NO: 1196747 - protein, 9 aa, Homo Sapiens
PRIHSPLAT

SEQ ID NO: 1196748 - protein, 9 aa, Homo Sapiens
TWAPCMPWR

SEQ ID NO: 1196749 - protein, 9 aa, Homo Sapiens
PVPGKAHKK

SEQ ID NO: 1196750 - protein, 9 aa, Homo Sapiens
LRATAERVE

SEQ ID NO: 1196751 - protein, 9 aa, Homo Sapiens
SRRWATWLS

SEQ ID NO: 1196752 - protein, 9 aa, Homo Sapiens
PAGQVSGSQ

SEQ ID NO: 1196753 - protein, 9 aa, Homo Sapiens
WCCLNLKQF

SEQ ID NO: 1196754 - protein, 9 aa, Homo Sapiens
RTQQRPPWR

SEQ ID NO: 1196755 - protein, 9 aa, Homo Sapiens
SRAAPQAPS

SEQ ID NO: 1196756 - protein, 9 aa, Homo Sapiens
PLHHYTTSY

SEQ ID NO: 1196757 - protein, 9 aa, Homo Sapiens
THLAFPPEP

SEQ ID NO: 1196758 - protein, 9 aa, Homo Sapiens
RTEGSRIAT

SEQ ID NO: 1196759 - protein, 9 aa, Homo Sapiens
RDVKALRRL

SEQ ID NO: 1196760 - protein, 9 aa, Homo Sapiens
EALSQTPEK

SEQ ID NO: 1196761 - protein, 9 aa, Homo Sapiens
DVGLAHLVV

SEQ ID NO: 1196762 - protein, 9 aa, Homo Sapiens
AVRHPQCLC

SEQ ID NO: 1196763 - protein, 9 aa, Homo Sapiens
YLPASMKLF

SEQ ID NO: 1196764 - protein, 9 aa, Homo Sapiens
RMHTGKIPS

SEQ ID NO: 1196765 - protein, 9 aa, Homo Sapiens
GKDQPFMGG

SEQ ID NO: 1196766 - protein, 9 aa, Homo Sapiens
TPPSTNCSR

SEQ ID NO: 1196767 - protein, 9 aa, Homo Sapiens
HDQEAARQA

SEQ ID NO: 1196768 - protein, 9 aa, Homo Sapiens
PTKKRGKSQ

SEQ ID NO: 1196769 - protein, 9 aa, Homo Sapiens
WPNGWCQSE

SEQ ID NO: 1196770 - protein, 9 aa, Homo Sapiens
IALSYVGIV

SEQ ID NO: 1196771 - protein, 9 aa, Homo Sapiens
EVREAHEAP

SEQ ID NO: 1196772 - protein, 9 aa, Homo Sapiens
GPTPCATCR

SEQ ID NO: 1196773 - protein, 9 aa, Homo Sapiens
QQQRVQSQR

SEQ ID NO: 1196774 - protein, 9 aa, Homo Sapiens
ASPDYKDNY

SEQ ID NO: 1196775 - protein, 9 aa, Homo Sapiens
MAEKSFRCS

SEQ ID NO: 1196776 - protein, 9 aa, Homo Sapiens
HTVLSTSIQ

SEQ ID NO: 1196777 - protein, 9 aa, Homo Sapiens
LKKVVKVWM

SEQ ID NO: 1196778 - protein, 9 aa, Homo Sapiens
TAACLLGQL

SEQ ID NO: 1196779 - protein, 9 aa, Homo Sapiens
KMAAVFLTT

SEQ ID NO: 1196780 - protein, 9 aa, Homo Sapiens
PGPAPSTCS

SEQ ID NO: 1196781 - protein, 9 aa, Homo Sapiens
TAIHQVPLI

SEQ ID NO: 1196782 - protein, 9 aa, Homo Sapiens
SSLGILPEE

SEQ ID NO: 1196783 - protein, 9 aa, Homo Sapiens
PTGTPRPLP

SEQ ID NO: 1196784 - protein, 9 aa, Homo Sapiens
IQGRSMSVP

SEQ ID NO: 1196785 - protein, 9 aa, Homo Sapiens
PCNTLKYPN

SEQ ID NO: 1196786 - protein, 9 aa, Homo Sapiens
FGKNGFSQS

SEQ ID NO: 1196787 - protein, 9 aa, Homo Sapiens
RHPHKSLPK

SEQ ID NO: 1196788 - protein, 9 aa, Homo Sapiens
VGRRGPDGV

SEQ ID NO: 1196789 - protein, 9 aa, Homo Sapiens
RHSAESSMS

SEQ ID NO: 1196790 - protein, 9 aa, Homo Sapiens
KAQEDPKPF

SEQ ID NO: 1196791 - protein, 9 aa, Homo Sapiens
VRFLGCPQA

SEQ ID NO: 1196792 - protein, 9 aa, Homo Sapiens
TPATWRRPV

SEQ ID NO: 1196793 - protein, 9 aa, Homo Sapiens
DVVEGVKGS

SEQ ID NO: 1196794 - protein, 9 aa, Homo Sapiens
MVYPQRNLS

SEQ ID NO: 1196795 - protein, 9 aa, Homo Sapiens
LRDRGAAEM

SEQ ID NO: 1196796 - protein, 9 aa, Homo Sapiens
DISKKSITT

SEQ ID NO: 1196797 - protein, 9 aa, Homo Sapiens
LPARRGAGA

SEQ ID NO: 1196798 - protein, 9 aa, Homo Sapiens
MLETYGTVV

SEQ ID NO: 1196799 - protein, 9 aa, Homo Sapiens
ATVGLELPA

SEQ ID NO: 1196800 - protein, 9 aa, Homo Sapiens
WRQEQSVYY

SEQ ID NO: 1196801 - protein, 9 aa, Homo Sapiens
TELSVLEQL

SEQ ID NO: 1196802 - protein, 9 aa, Homo Sapiens
DVLCHQALQ

SEQ ID NO: 1196803 - protein, 9 aa, Homo Sapiens
CGCSKGGRG

SEQ ID NO: 1196804 - protein, 9 aa, Homo Sapiens
KRHLHRSVL

SEQ ID NO: 1196805 - protein, 9 aa, Homo Sapiens
ELLPGPAAG

SEQ ID NO: 1196806 - protein, 9 aa, Homo Sapiens
DVESDPRKL

SEQ ID NO: 1196807 - protein, 9 aa, Homo Sapiens
LFWFGLVCF

SEQ ID NO: 1196808 - protein, 9 aa, Homo Sapiens
QMKGAQSRS

SEQ ID NO: 1196809 - protein, 9 aa, Homo Sapiens
KYPSSLECT

SEQ ID NO: 1196810 - protein, 9 aa, Homo Sapiens
LLLVVLAAV

SEQ ID NO: 1196811 - protein, 9 aa, Homo Sapiens
KDKLHHRAQ

SEQ ID NO: 1196812 - protein, 9 aa, Homo Sapiens
PVTPGPAHG

SEQ ID NO: 1196813 - protein, 9 aa, Homo Sapiens
LEALACPAY

SEQ ID NO: 1196814 - protein, 9 aa, Homo Sapiens
LIHDRSVSR

SEQ ID NO: 1196815 - protein, 9 aa, Homo Sapiens
RPATSPSPD

SEQ ID NO: 1196816 - protein, 9 aa, Homo Sapiens
KSNSPLAMA

SEQ ID NO: 1196817 - protein, 9 aa, Homo Sapiens
KRHSPGQML

SEQ ID NO: 1196818 - protein, 9 aa, Homo Sapiens
CTKRMFKFH

SEQ ID NO: 1196819 - protein, 9 aa, Homo Sapiens
HQRGQSNRG

SEQ ID NO: 1196820 - protein, 9 aa, Homo Sapiens
VGAAVQRLG

SEQ ID NO: 1196821 - protein, 9 aa, Homo Sapiens
GVPRQRGLL

SEQ ID NO: 1196822 - protein, 9 aa, Homo Sapiens
AASASCCCP

SEQ ID NO: 1196823 - protein, 9 aa, Homo Sapiens
GCGCLVLEP

SEQ ID NO: 1196824 - protein, 9 aa, Homo Sapiens
RWMLRSRCP

SEQ ID NO: 1196825 - protein, 9 aa, Homo Sapiens
PRMGPAAAC

SEQ ID NO: 1196826 - protein, 9 aa, Homo Sapiens
VTAAKAGMN

SEQ ID NO: 1196827 - protein, 9 aa, Homo Sapiens
VNGTGRRAR

SEQ ID NO: 1196828 - protein, 9 aa, Homo Sapiens
LHCDAPAEP

SEQ ID NO: 1196829 - protein, 9 aa, Homo Sapiens
TTPLGQVPQ

SEQ ID NO: 1196830 - protein, 9 aa, Homo Sapiens
PRAHTVLST

SEQ ID NO: 1196831 - protein, 9 aa, Homo Sapiens
SSLGGGYVS

SEQ ID NO: 1196832 - protein, 9 aa, Homo Sapiens
GQPAFIPAQ

SEQ ID NO: 1196833 - protein, 9 aa, Homo Sapiens
GQALVLQQV

SEQ ID NO: 1196834 - protein, 9 aa, Homo Sapiens
LAKEKECMQ

SEQ ID NO: 1196835 - protein, 9 aa, Homo Sapiens
FHPSLLFFN

SEQ ID NO: 1196836 - protein, 9 aa, Homo Sapiens
GSEERSDPL

SEQ ID NO: 1196837 - protein, 9 aa, Homo Sapiens
GCGGGAGCP

SEQ ID NO: 1196838 - protein, 9 aa, Homo Sapiens
SVPWPVATV

SEQ ID NO: 1196839 - protein, 9 aa, Homo Sapiens
SGARETRGP

SEQ ID NO: 1196840 - protein, 9 aa, Homo Sapiens
AWLYPGQRD

SEQ ID NO: 1196841 - protein, 9 aa, Homo Sapiens
KGTTTADHT

SEQ ID NO: 1196842 - protein, 9 aa, Homo Sapiens
EIDRERAAQ

SEQ ID NO: 1196843 - protein, 9 aa, Homo Sapiens
LGLGAAPLP

SEQ ID NO: 1196844 - protein, 9 aa, Homo Sapiens
GLPGWKSCG

SEQ ID NO: 1196845 - protein, 9 aa, Homo Sapiens
PLSLLFFWR

SEQ ID NO: 1196846 - protein, 9 aa, Homo Sapiens
QDHLGFQVT

SEQ ID NO: 1196847 - protein, 9 aa, Homo Sapiens
EPQARTKMA

SEQ ID NO: 1196848 - protein, 9 aa, Homo Sapiens
CNLLRQENT

SEQ ID NO: 1196849 - protein, 9 aa, Homo Sapiens
CLMPLVAFM

SEQ ID NO: 1196850 - protein, 9 aa, Homo Sapiens
YVRCMFGIR

SEQ ID NO: 1196851 - protein, 9 aa, Homo Sapiens
AGVPRQRGL

SEQ ID NO: 1196852 - protein, 9 aa, Homo Sapiens
VPVDYSFSE

SEQ ID NO: 1196853 - protein, 9 aa, Homo Sapiens
WSGAVVGLR

SEQ ID NO: 1196854 - protein, 9 aa, Homo Sapiens
NSSSSPLRV

SEQ ID NO: 1196855 - protein, 9 aa, Homo Sapiens
QDLSNATEL

SEQ ID NO: 1196856 - protein, 9 aa, Homo Sapiens
RKFPSWRIT

SEQ ID NO: 1196857 - protein, 9 aa, Homo Sapiens
CIDPFSKMG

SEQ ID NO: 1196858 - protein, 9 aa, Homo Sapiens
GHHGADVEP

SEQ ID NO: 1196859 - protein, 9 aa, Homo Sapiens
GARFRKRQW

SEQ ID NO: 1196860 - protein, 9 aa, Homo Sapiens
QILPFPASL

SEQ ID NO: 1196861 - protein, 9 aa, Homo Sapiens
SELTLLLDF

SEQ ID NO: 1196862 - protein, 9 aa, Homo Sapiens
LVWVSLPLP

SEQ ID NO: 1196863 - protein, 9 aa, Homo Sapiens
QPQQQKGGR

SEQ ID NO: 1196864 - protein, 9 aa, Homo Sapiens
PLRQILGRI

SEQ ID NO: 1196865 - protein, 9 aa, Homo Sapiens
QQVGQPHAL

SEQ ID NO: 1196866 - protein, 9 aa, Homo Sapiens
LQLDEYRDI

SEQ ID NO: 1196867 - protein, 9 aa, Homo Sapiens
PPGPGRPAG

SEQ ID NO: 1196868 - protein, 9 aa, Homo Sapiens
SHLDILQTV

SEQ ID NO: 1196869 - protein, 9 aa, Homo Sapiens
GSAVGRGPT

SEQ ID NO: 1196870 - protein, 9 aa, Homo Sapiens
PKFHSEYLS

SEQ ID NO: 1196871 - protein, 9 aa, Homo Sapiens
LLQALNVGR

SEQ ID NO: 1196872 - protein, 9 aa, Homo Sapiens
IFYDPCLQD

SEQ ID NO: 1196873 - protein, 9 aa, Homo Sapiens
ARTPAPTPS

SEQ ID NO: 1196874 - protein, 9 aa, Homo Sapiens
VNMGGNRSI

SEQ ID NO: 1196875 - protein, 9 aa, Homo Sapiens
LLFFWRPPT

SEQ ID NO: 1196876 - protein, 9 aa, Homo Sapiens
MRPAHLVPA

SEQ ID NO: 1196877 - protein, 9 aa, Homo Sapiens
SWTTMMEGA

SEQ ID NO: 1196878 - protein, 9 aa, Homo Sapiens
MYPHVFHKK

SEQ ID NO: 1196879 - protein, 9 aa, Homo Sapiens
MMVDPLVLT

SEQ ID NO: 1196880 - protein, 9 aa, Homo Sapiens
SLFSRMSIQ

SEQ ID NO: 1196881 - protein, 9 aa, Homo Sapiens
TQAARRPPG

SEQ ID NO: 1196882 - protein, 9 aa, Homo Sapiens
RRRRRPPRE

SEQ ID NO: 1196883 - protein, 9 aa, Homo Sapiens
TGDEKGVEV

SEQ ID NO: 1196884 - protein, 9 aa, Homo Sapiens
EDDGIYTYI

SEQ ID NO: 1196885 - protein, 9 aa, Homo Sapiens
VPVHGHGKV

SEQ ID NO: 1196886 - protein, 9 aa, Homo Sapiens
SRPCVWSRL

SEQ ID NO: 1196887 - protein, 9 aa, Homo Sapiens
GLCRPVEER

SEQ ID NO: 1196888 - protein, 9 aa, Homo Sapiens
LDGRSLQGA

SEQ ID NO: 1196889 - protein, 9 aa, Homo Sapiens
GVPHDRADH

SEQ ID NO: 1196890 - protein, 9 aa, Homo Sapiens
PMMCDLKEN

SEQ ID NO: 1196891 - protein, 9 aa, Homo Sapiens
FLLKSTHLL

SEQ ID NO: 1196892 - protein, 9 aa, Homo Sapiens
PDRGAAQMS

SEQ ID NO: 1196893 - protein, 9 aa, Homo Sapiens
LGLRKQYGG

SEQ ID NO: 1196894 - protein, 9 aa, Homo Sapiens
RATRRPLKG

SEQ ID NO: 1196895 - protein, 9 aa, Homo Sapiens
SGVILSIDD

SEQ ID NO: 1196896 - protein, 9 aa, Homo Sapiens
TPAIRVRVS

SEQ ID NO: 1196897 - protein, 9 aa, Homo Sapiens
AAQKCHKKT

SEQ ID NO: 1196898 - protein, 9 aa, Homo Sapiens
GRGRPRAGT

SEQ ID NO: 1196899 - protein, 9 aa, Homo Sapiens
SNAVGRRGP

SEQ ID NO: 1196900 - protein, 9 aa, Homo Sapiens
VPPGRRQRR

SEQ ID NO: 1196901 - protein, 9 aa, Homo Sapiens
FYCAELRWM

SEQ ID NO: 1196902 - protein, 9 aa, Homo Sapiens
TWSAPQPGG

SEQ ID NO: 1196903 - protein, 9 aa, Homo Sapiens
LASDRNPRP

SEQ ID NO: 1196904 - protein, 9 aa, Homo Sapiens
QLFTTELGW

SEQ ID NO: 1196905 - protein, 9 aa, Homo Sapiens
RTWASPCSL

SEQ ID NO: 1196906 - protein, 9 aa, Homo Sapiens
RCQNFVMAS

SEQ ID NO: 1196907 - protein, 9 aa, Homo Sapiens
DDLIGSEHT

SEQ ID NO: 1196908 - protein, 9 aa, Homo Sapiens
PSPTHSTHC

SEQ ID NO: 1196909 - protein, 9 aa, Homo Sapiens
ARWGWCPVG

SEQ ID NO: 1196910 - protein, 9 aa, Homo Sapiens
FPAAAPNDS

SEQ ID NO: 1196911 - protein, 9 aa, Homo Sapiens
KGISKKKKS

SEQ ID NO: 1196912 - protein, 9 aa, Homo Sapiens
IFLDVTTGK

SEQ ID NO: 1196913 - protein, 9 aa, Homo Sapiens
DLHALRALH

SEQ ID NO: 1196914 - protein, 9 aa, Homo Sapiens
QNPTLTPGP

SEQ ID NO: 1196915 - protein, 9 aa, Homo Sapiens
VRPGTQAAR

SEQ ID NO: 1196916 - protein, 9 aa, Homo Sapiens
YQVLLDVWA

SEQ ID NO: 1196917 - protein, 9 aa, Homo Sapiens
CQIVIVQYP

SEQ ID NO: 1196918 - protein, 9 aa, Homo Sapiens
CPVGGPTMP

SEQ ID NO: 1196919 - protein, 9 aa, Homo Sapiens
IFYPQGLWE

SEQ ID NO: 1196920 - protein, 9 aa, Homo Sapiens
NTATVTTYN

SEQ ID NO: 1196921 - protein, 9 aa, Homo Sapiens
QQSQQPYPQ

SEQ ID NO: 1196922 - protein, 9 aa, Homo Sapiens
EKELWEQKK

SEQ ID NO: 1196923 - protein, 9 aa, Homo Sapiens
SGVGAGRRR

SEQ ID NO: 1196924 - protein, 9 aa, Homo Sapiens
GFPEKYPSS

SEQ ID NO: 1196925 - protein, 9 aa, Homo Sapiens
SSSCLCFIY

SEQ ID NO: 1196926 - protein, 9 aa, Homo Sapiens
KQRLAPTTL

SEQ ID NO: 1196927 - protein, 9 aa, Homo Sapiens
CPRHWQVCP

SEQ ID NO: 1196928 - protein, 9 aa, Homo Sapiens
SCCKNRTGA

SEQ ID NO: 1196929 - protein, 9 aa, Homo Sapiens
FQAHDADER

SEQ ID NO: 1196930 - protein, 9 aa, Homo Sapiens
QPHSCFPSG

SEQ ID NO: 1196931 - protein, 9 aa, Homo Sapiens
LQSLLSLYS

SEQ ID NO: 1196932 - protein, 9 aa, Homo Sapiens
EGGQACING

SEQ ID NO: 1196933 - protein, 9 aa, Homo Sapiens
CCKPMAPQG

SEQ ID NO: 1196934 - protein, 9 aa, Homo Sapiens
IWCCLNLKQ

SEQ ID NO: 1196935 - protein, 9 aa, Homo Sapiens
ALHSLAQQA

SEQ ID NO: 1196936 - protein, 9 aa, Homo Sapiens
APAGVPRQR

SEQ ID NO: 1196937 - protein, 9 aa, Homo Sapiens
LSSKLHQRG

SEQ ID NO: 1196938 - protein, 9 aa, Homo Sapiens
EAGHPHNPR

SEQ ID NO: 1196939 - protein, 9 aa, Homo Sapiens
CGAPDPRRR

SEQ ID NO: 1196940 - protein, 9 aa, Homo Sapiens
FLKEPKVCE

SEQ ID NO: 1196941 - protein, 9 aa, Homo Sapiens
SSVGGRRQM

SEQ ID NO: 1196942 - protein, 9 aa, Homo Sapiens
RPHILGEGH

SEQ ID NO: 1196943 - protein, 9 aa, Homo Sapiens
GLALPGAEL

SEQ ID NO: 1196944 - protein, 9 aa, Homo Sapiens
MSMGITWFW

SEQ ID NO: 1196945 - protein, 9 aa, Homo Sapiens
FSGWCGGPW

SEQ ID NO: 1196946 - protein, 9 aa, Homo Sapiens
VDGNFLEAV

SEQ ID NO: 1196947 - protein, 9 aa, Homo Sapiens
SLVSTAACL

SEQ ID NO: 1196948 - protein, 9 aa, Homo Sapiens
TTLFLSHIW

SEQ ID NO: 1196949 - protein, 9 aa, Homo Sapiens
AQDGRVDSQ

SEQ ID NO: 1196950 - protein, 9 aa, Homo Sapiens
GCRRWPGCR

SEQ ID NO: 1196951 - protein, 9 aa, Homo Sapiens
QGRHVPPTG

SEQ ID NO: 1196952 - protein, 9 aa, Homo Sapiens
GLDLEPECS

SEQ ID NO: 1196953 - protein, 9 aa, Homo Sapiens
GELVAVQHL

SEQ ID NO: 1196954 - protein, 9 aa, Homo Sapiens
TSKNIIRLS

SEQ ID NO: 1196955 - protein, 9 aa, Homo Sapiens
EAGPPALAH

SEQ ID NO: 1196956 - protein, 9 aa, Homo Sapiens
IVDLSAKDK

SEQ ID NO: 1196957 - protein, 9 aa, Homo Sapiens
ATLSPGEAR

SEQ ID NO: 1196958 - protein, 9 aa, Homo Sapiens
RDRGAAEMV

SEQ ID NO: 1196959 - protein, 9 aa, Homo Sapiens
IPTQQDVLQ

SEQ ID NO: 1196960 - protein, 9 aa, Homo Sapiens
RGPGPGAAS

SEQ ID NO: 1196961 - protein, 9 aa, Homo Sapiens
GRLLLAGYN

SEQ ID NO: 1196962 - protein, 9 aa, Homo Sapiens
CAPPLHHYT

SEQ ID NO: 1196963 - protein, 9 aa, Homo Sapiens
LTDELSGLD

SEQ ID NO: 1196964 - protein, 9 aa, Homo Sapiens
LFNMAYGVK

SEQ ID NO: 1196965 - protein, 9 aa, Homo Sapiens
KKLLKWHLV

SEQ ID NO: 1196966 - protein, 9 aa, Homo Sapiens
AFLLLHLLV

SEQ ID NO: 1196967 - protein, 9 aa, Homo Sapiens
DAVWRGASG

SEQ ID NO: 1196968 - protein, 9 aa, Homo Sapiens
MSELLPGPA

SEQ ID NO: 1196969 - protein, 9 aa, Homo Sapiens
FGTTNMATF

SEQ ID NO: 1196970 - protein, 9 aa, Homo Sapiens
QSTITNMGT

SEQ ID NO: 1196971 - protein, 9 aa, Homo Sapiens
ACVYDLCVC

SEQ ID NO: 1196972 - protein, 9 aa, Homo Sapiens
GLPLGPGAQ

SEQ ID NO: 1196973 - protein, 9 aa, Homo Sapiens
IREIEQNAE

SEQ ID NO: 1196974 - protein, 9 aa, Homo Sapiens
TGTPRPLPC

SEQ ID NO: 1196975 - protein, 9 aa, Homo Sapiens
EVVENEDGT

SEQ ID NO: 1196976 - protein, 9 aa, Homo Sapiens
LARGSQRLA

SEQ ID NO: 1196977 - protein, 9 aa, Homo Sapiens
TSHISALIA

SEQ ID NO: 1196978 - protein, 9 aa, Homo Sapiens
YTHILNWVL

SEQ ID NO: 1196979 - protein, 9 aa, Homo Sapiens
CGQRRRALG

SEQ ID NO: 1196980 - protein, 9 aa, Homo Sapiens
HLYHHPPGR

SEQ ID NO: 1196981 - protein, 9 aa, Homo Sapiens
TNQGLFHKL

SEQ ID NO: 1196982 - protein, 9 aa, Homo Sapiens
NEVGIMEEA

SEQ ID NO: 1196983 - protein, 9 aa, Homo Sapiens
EKNYTEDVI

SEQ ID NO: 1196984 - protein, 9 aa, Homo Sapiens
AAADVAKGQ

SEQ ID NO: 1196985 - protein, 9 aa, Homo Sapiens
GAHGLPVHQ

SEQ ID NO: 1196986 - protein, 9 aa, Homo Sapiens
PLLEVTTFC

SEQ ID NO: 1196987 - protein, 9 aa, Homo Sapiens
LTWWLAHDC

SEQ ID NO: 1196988 - protein, 9 aa, Homo Sapiens
QGLHCPQAP

SEQ ID NO: 1196989 - protein, 9 aa, Homo Sapiens
MSFLCLAVL

SEQ ID NO: 1196990 - protein, 9 aa, Homo Sapiens
DTLRVPSPL

SEQ ID NO: 1196991 - protein, 9 aa, Homo Sapiens
KESEEEVEE

SEQ ID NO: 1196992 - protein, 9 aa, Homo Sapiens
HYLHPILRW

SEQ ID NO: 1196993 - protein, 9 aa, Homo Sapiens
AIQELGLDK

SEQ ID NO: 1196994 - protein, 9 aa, Homo Sapiens
SDTEIQGEI

SEQ ID NO: 1196995 - protein, 9 aa, Homo Sapiens
PAGRHPQWC

SEQ ID NO: 1196996 - protein, 9 aa, Homo Sapiens
NIKIEEEEV

SEQ ID NO: 1196997 - protein, 9 aa, Homo Sapiens
DCDVLVGHK

SEQ ID NO: 1196998 - protein, 9 aa, Homo Sapiens
AGQRTEAGP

SEQ ID NO: 1196999 - protein, 9 aa, Homo Sapiens
PQSDWTVVE

SEQ ID NO: 1197000 - protein, 9 aa, Homo Sapiens
LGGFLYAMG

SEQ ID NO: 1197001 - protein, 9 aa, Homo Sapiens
PGLPGDHAD

SEQ ID NO: 1197002 - protein, 9 aa, Homo Sapiens
PASMKLFCS

SEQ ID NO: 1197003 - protein, 9 aa, Homo Sapiens
RVANFALGV

SEQ ID NO: 1197004 - protein, 9 aa, Homo Sapiens
RLCHWEGLW

SEQ ID NO: 1197005 - protein, 9 aa, Homo Sapiens
LFIYHLPRE

SEQ ID NO: 1197006 - protein, 9 aa, Homo Sapiens
LTAAGGAGD

SEQ ID NO: 1197007 - protein, 9 aa, Homo Sapiens
ISCSVRHAH

SEQ ID NO: 1197008 - protein, 9 aa, Homo Sapiens
LSGAQQQLQ

SEQ ID NO: 1197009 - protein, 9 aa, Homo Sapiens
EPRKLLAQD

SEQ ID NO: 1197010 - protein, 9 aa, Homo Sapiens
SVSVGCVAS

SEQ ID NO: 1197011 - protein, 9 aa, Homo Sapiens
RLMLHTNTA

SEQ ID NO: 1197012 - protein, 9 aa, Homo Sapiens
TSTTGPGTG

SEQ ID NO: 1197013 - protein, 9 aa, Homo Sapiens
QYRVTMTAK

SEQ ID NO: 1197014 - protein, 9 aa, Homo Sapiens
WSPVLDTCY

SEQ ID NO: 1197015 - protein, 9 aa, Homo Sapiens
GLQRIRHGQ

SEQ ID NO: 1197016 - protein, 9 aa, Homo Sapiens
SCPPLLEAF

SEQ ID NO: 1197017 - protein, 9 aa, Homo Sapiens
RAGARGGAR

SEQ ID NO: 1197018 - protein, 9 aa, Homo Sapiens
TSQSQLSSE

SEQ ID NO: 1197019 - protein, 9 aa, Homo Sapiens
HPPQPTSGS

SEQ ID NO: 1197020 - protein, 9 aa, Homo Sapiens
LDGDDEVVA

SEQ ID NO: 1197021 - protein, 9 aa, Homo Sapiens
NLIEKVTSY

SEQ ID NO: 1197022 - protein, 9 aa, Homo Sapiens
HPQPKSTPD

SEQ ID NO: 1197023 - protein, 9 aa, Homo Sapiens
KMIVDLSAK

SEQ ID NO: 1197024 - protein, 9 aa, Homo Sapiens
ATVSGERGP

SEQ ID NO: 1197025 - protein, 9 aa, Homo Sapiens
RPQQQRQRG

SEQ ID NO: 1197026 - protein, 9 aa, Homo Sapiens
VHAVVEQAA

SEQ ID NO: 1197027 - protein, 9 aa, Homo Sapiens
PTLWTLCSS

SEQ ID NO: 1197028 - protein, 9 aa, Homo Sapiens
FIKVTRSGG

SEQ ID NO: 1197029 - protein, 9 aa, Homo Sapiens
LYQQARLRD

SEQ ID NO: 1197030 - protein, 9 aa, Homo Sapiens
FFCRVLSLL

SEQ ID NO: 1197031 - protein, 9 aa, Homo Sapiens
LAGLGGSPA

SEQ ID NO: 1197032 - protein, 9 aa, Homo Sapiens
SLPSGIYGK

SEQ ID NO: 1197033 - protein, 9 aa, Homo Sapiens
TAALIDRDQ

SEQ ID NO: 1197034 - protein, 9 aa, Homo Sapiens
IRQPKYRDR

SEQ ID NO: 1197035 - protein, 9 aa, Homo Sapiens
ARAVAAFVL

SEQ ID NO: 1197036 - protein, 9 aa, Homo Sapiens
PGWKSCGMA

SEQ ID NO: 1197037 - protein, 9 aa, Homo Sapiens
ERAQEDLRI

SEQ ID NO: 1197038 - protein, 9 aa, Homo Sapiens
LTSGILGVP

SEQ ID NO: 1197039 - protein, 9 aa, Homo Sapiens
QCLLHSLGT

SEQ ID NO: 1197040 - protein, 9 aa, Homo Sapiens
LCISNVFSM

SEQ ID NO: 1197041 - protein, 9 aa, Homo Sapiens
RHCIEFRPV

SEQ ID NO: 1197042 - protein, 9 aa, Homo Sapiens
TKKYDSLSN

SEQ ID NO: 1197043 - protein, 9 aa, Homo Sapiens
AVGGASALH

SEQ ID NO: 1197044 - protein, 9 aa, Homo Sapiens
GCRLQRVGA

SEQ ID NO: 1197045 - protein, 9 aa, Homo Sapiens
ALVFLGMAR

SEQ ID NO: 1197046 - protein, 9 aa, Homo Sapiens
GFIRKQCVG

SEQ ID NO: 1197047 - protein, 9 aa, Homo Sapiens
ELTLLLDFK

SEQ ID NO: 1197048 - protein, 9 aa, Homo Sapiens
GQGPLPRHP

SEQ ID NO: 1197049 - protein, 9 aa, Homo Sapiens
SLSAPAEAT

SEQ ID NO: 1197050 - protein, 9 aa, Homo Sapiens
YIRWLEVAV

SEQ ID NO: 1197051 - protein, 9 aa, Homo Sapiens
IFVFHCAPP

SEQ ID NO: 1197052 - protein, 9 aa, Homo Sapiens
LTHVQDLTP

SEQ ID NO: 1197053 - protein, 9 aa, Homo Sapiens
SICTVPNVR

SEQ ID NO: 1197054 - protein, 9 aa, Homo Sapiens
GCYSTTETM

SEQ ID NO: 1197055 - protein, 9 aa, Homo Sapiens
TVHPEPPTA

SEQ ID NO: 1197056 - protein, 9 aa, Homo Sapiens
KLLAQDWVQ

SEQ ID NO: 1197057 - protein, 9 aa, Homo Sapiens
RCGPSRATW

SEQ ID NO: 1197058 - protein, 9 aa, Homo Sapiens
LRVEILPMG

SEQ ID NO: 1197059 - protein, 9 aa, Homo Sapiens
RGGRPRRAL

SEQ ID NO: 1197060 - protein, 9 aa, Homo Sapiens
KPFFYVNMA

SEQ ID NO: 1197061 - protein, 9 aa, Homo Sapiens
DRMLALQPH

SEQ ID NO: 1197062 - protein, 9 aa, Homo Sapiens
APGSSPRPC

SEQ ID NO: 1197063 - protein, 9 aa, Homo Sapiens
SGSSQAGTG

SEQ ID NO: 1197064 - protein, 9 aa, Homo Sapiens
AAHRSTAKL

SEQ ID NO: 1197065 - protein, 9 aa, Homo Sapiens
LSNATELAT

SEQ ID NO: 1197066 - protein, 9 aa, Homo Sapiens
AQAPIPWLN

SEQ ID NO: 1197067 - protein, 9 aa, Homo Sapiens
CQIILVNLL

SEQ ID NO: 1197068 - protein, 9 aa, Homo Sapiens
IEPTVDVYY

SEQ ID NO: 1197069 - protein, 9 aa, Homo Sapiens
ILAVIVVAS

SEQ ID NO: 1197070 - protein, 9 aa, Homo Sapiens
IWPRTRCCP

SEQ ID NO: 1197071 - protein, 9 aa, Homo Sapiens
TFHTLTTYT

SEQ ID NO: 1197072 - protein, 9 aa, Homo Sapiens
KEFVCHWGA

SEQ ID NO: 1197073 - protein, 9 aa, Homo Sapiens
IKEFRRLTA

SEQ ID NO: 1197074 - protein, 9 aa, Homo Sapiens
DKIFRQDSD

SEQ ID NO: 1197075 - protein, 9 aa, Homo Sapiens
DKLHHRAQD

SEQ ID NO: 1197076 - protein, 9 aa, Homo Sapiens
CSSTPTCLR

SEQ ID NO: 1197077 - protein, 9 aa, Homo Sapiens
FKETLMATC

SEQ ID NO: 1197078 - protein, 9 aa, Homo Sapiens
AAQAAIAFS

SEQ ID NO: 1197079 - protein, 9 aa, Homo Sapiens
AEGVGCFES

SEQ ID NO: 1197080 - protein, 9 aa, Homo Sapiens
RVYRIGRSV

SEQ ID NO: 1197081 - protein, 9 aa, Homo Sapiens
ATAERVEAL

SEQ ID NO: 1197082 - protein, 9 aa, Homo Sapiens
YMDIPAPEA

SEQ ID NO: 1197083 - protein, 9 aa, Homo Sapiens
SDFQECVSL

SEQ ID NO: 1197084 - protein, 9 aa, Homo Sapiens
NGKVLRPLE

SEQ ID NO: 1197085 - protein, 9 aa, Homo Sapiens
RRSRQSGAT

SEQ ID NO: 1197086 - protein, 9 aa, Homo Sapiens
AADRVKWTG

SEQ ID NO: 1197087 - protein, 9 aa, Homo Sapiens
WSSRRARCC

SEQ ID NO: 1197088 - protein, 9 aa, Homo Sapiens
GPGSARPPS

SEQ ID NO: 1197089 - protein, 9 aa, Homo Sapiens
LIEKVTSYG

SEQ ID NO: 1197090 - protein, 9 aa, Homo Sapiens
GSGQVAAPG

SEQ ID NO: 1197091 - protein, 9 aa, Homo Sapiens
SSVLATGLH

SEQ ID NO: 1197092 - protein, 9 aa, Homo Sapiens
TFALQQRQQ

SEQ ID NO: 1197093 - protein, 9 aa, Homo Sapiens
ARKVHLHEE

SEQ ID NO: 1197094 - protein, 9 aa, Homo Sapiens
AEHQRTHTG

SEQ ID NO: 1197095 - protein, 9 aa, Homo Sapiens
YRVTMTAKD

SEQ ID NO: 1197096 - protein, 9 aa, Homo Sapiens
SVVRTEGSR

SEQ ID NO: 1197097 - protein, 9 aa, Homo Sapiens
YKSVPLKTG

SEQ ID NO: 1197098 - protein, 9 aa, Homo Sapiens
NFISPKKPK

SEQ ID NO: 1197099 - protein, 9 aa, Homo Sapiens
ERDHAVVVR

SEQ ID NO: 1197100 - protein, 9 aa, Homo Sapiens
ADRVKWTGS

SEQ ID NO: 1197101 - protein, 9 aa, Homo Sapiens
PLPGAAHSQ

SEQ ID NO: 1197102 - protein, 9 aa, Homo Sapiens
KQALTPEHV

SEQ ID NO: 1197103 - protein, 9 aa, Homo Sapiens
VVQGELVAV

SEQ ID NO: 1197104 - protein, 9 aa, Homo Sapiens
SWRSASTAR

SEQ ID NO: 1197105 - protein, 9 aa, Homo Sapiens
GIIGRTGAG

SEQ ID NO: 1197106 - protein, 9 aa, Homo Sapiens
DLLEWIRHT

SEQ ID NO: 1197107 - protein, 9 aa, Homo Sapiens
GHHHPQLAL

SEQ ID NO: 1197108 - protein, 9 aa, Homo Sapiens
SNWSSWGSC

SEQ ID NO: 1197109 - protein, 9 aa, Homo Sapiens
AVAGAALVG

SEQ ID NO: 1197110 - protein, 9 aa, Homo Sapiens
KASSMPQTP

SEQ ID NO: 1197111 - protein, 9 aa, Homo Sapiens
ALGAKEAPE

SEQ ID NO: 1197112 - protein, 9 aa, Homo Sapiens
SGPISAARK

SEQ ID NO: 1197113 - protein, 9 aa, Homo Sapiens
NYCIEKLQQ

SEQ ID NO: 1197114 - protein, 9 aa, Homo Sapiens
EDTGFSNIP

SEQ ID NO: 1197115 - protein, 9 aa, Homo Sapiens
RGRPRELRS

SEQ ID NO: 1197116 - protein, 9 aa, Homo Sapiens
GGSGGHRPA

SEQ ID NO: 1197117 - protein, 9 aa, Homo Sapiens
PSPAPQAQD

SEQ ID NO: 1197118 - protein, 9 aa, Homo Sapiens
LKAVHDLLL

SEQ ID NO: 1197119 - protein, 9 aa, Homo Sapiens
VLQRVHGGL

SEQ ID NO: 1197120 - protein, 9 aa, Homo Sapiens
PSVEQPPNP

SEQ ID NO: 1197121 - protein, 9 aa, Homo Sapiens
VVVDGEIMK

SEQ ID NO: 1197122 - protein, 9 aa, Homo Sapiens
WFGTIKSQE

SEQ ID NO: 1197123 - protein, 9 aa, Homo Sapiens
VEYGTIKGL

SEQ ID NO: 1197124 - protein, 9 aa, Homo Sapiens
DVFASGSPL

SEQ ID NO: 1197125 - protein, 9 aa, Homo Sapiens
ISNVFSMLP

SEQ ID NO: 1197126 - protein, 9 aa, Homo Sapiens
CHLMPGPDS

SEQ ID NO: 1197127 - protein, 9 aa, Homo Sapiens
AVAVDQQIR

SEQ ID NO: 1197128 - protein, 9 aa, Homo Sapiens
TFNAEAMTT

SEQ ID NO: 1197129 - protein, 9 aa, Homo Sapiens
AARVDGPVE

SEQ ID NO: 1197130 - protein, 9 aa, Homo Sapiens
VEESREALS

SEQ ID NO: 1197131 - protein, 9 aa, Homo Sapiens
SYLGSVRER

SEQ ID NO: 1197132 - protein, 9 aa, Homo Sapiens
SSVGPYSFL

SEQ ID NO: 1197133 - protein, 9 aa, Homo Sapiens
TRVPLKQLK

SEQ ID NO: 1197134 - protein, 9 aa, Homo Sapiens
PPPPPGWLP

SEQ ID NO: 1197135 - protein, 9 aa, Homo Sapiens
QHVYLGCPN

SEQ ID NO: 1197136 - protein, 9 aa, Homo Sapiens
YLFPAAAPN

SEQ ID NO: 1197137 - protein, 9 aa, Homo Sapiens
CRGAGHKPP

SEQ ID NO: 1197138 - protein, 9 aa, Homo Sapiens
VPTGGALQG

SEQ ID NO: 1197139 - protein, 9 aa, Homo Sapiens
KLEAFAERF

SEQ ID NO: 1197140 - protein, 9 aa, Homo Sapiens
VAAFVLANE

SEQ ID NO: 1197141 - protein, 9 aa, Homo Sapiens
WTWMTCTSL

SEQ ID NO: 1197142 - protein, 9 aa, Homo Sapiens
ESSVSFPVD

SEQ ID NO: 1197143 - protein, 9 aa, Homo Sapiens
SGRSSPVTI

SEQ ID NO: 1197144 - protein, 9 aa, Homo Sapiens
SFGTTNMAT

SEQ ID NO: 1197145 - protein, 9 aa, Homo Sapiens
EDHPRILQA

SEQ ID NO: 1197146 - protein, 9 aa, Homo Sapiens
EQGHFASPN

SEQ ID NO: 1197147 - protein, 9 aa, Homo Sapiens
TTEACFSCA

SEQ ID NO: 1197148 - protein, 9 aa, Homo Sapiens
EPNGLLLYY

SEQ ID NO: 1197149 - protein, 9 aa, Homo Sapiens
WALGCQAPS

SEQ ID NO: 1197150 - protein, 9 aa, Homo Sapiens
GVPFWVRPA

SEQ ID NO: 1197151 - protein, 9 aa, Homo Sapiens
SKAPGVCRV

SEQ ID NO: 1197152 - protein, 9 aa, Homo Sapiens
VFWMWSRDC

SEQ ID NO: 1197153 - protein, 9 aa, Homo Sapiens
KTYKQISAL

SEQ ID NO: 1197154 - protein, 9 aa, Homo Sapiens
VTPRPPPCR

SEQ ID NO: 1197155 - protein, 9 aa, Homo Sapiens
GLFPRSASR

SEQ ID NO: 1197156 - protein, 9 aa, Homo Sapiens
LVALMNSNI

SEQ ID NO: 1197157 - protein, 9 aa, Homo Sapiens
KFKSMHGDG

SEQ ID NO: 1197158 - protein, 9 aa, Homo Sapiens
QAPEALGLG

SEQ ID NO: 1197159 - protein, 9 aa, Homo Sapiens
LTCHNHALH

SEQ ID NO: 1197160 - protein, 9 aa, Homo Sapiens
DGNFLEAVK

SEQ ID NO: 1197161 - protein, 9 aa, Homo Sapiens
SPTPTRRPR

SEQ ID NO: 1197162 - protein, 9 aa, Homo Sapiens
VSTVLHLTL

SEQ ID NO: 1197163 - protein, 9 aa, Homo Sapiens
MMEGAVLPR

SEQ ID NO: 1197164 - protein, 9 aa, Homo Sapiens
YWDAMLETY

SEQ ID NO: 1197165 - protein, 9 aa, Homo Sapiens
VWGLPGWKS

SEQ ID NO: 1197166 - protein, 9 aa, Homo Sapiens
FEPEVKTCL

SEQ ID NO: 1197167 - protein, 9 aa, Homo Sapiens
DNPNKTAAN

SEQ ID NO: 1197168 - protein, 9 aa, Homo Sapiens
LKCAGKRLT

SEQ ID NO: 1197169 - protein, 9 aa, Homo Sapiens
HLLILLVPA

SEQ ID NO: 1197170 - protein, 9 aa, Homo Sapiens
RIKASSMPQ

SEQ ID NO: 1197171 - protein, 9 aa, Homo Sapiens
FSLSMMAAL

SEQ ID NO: 1197172 - protein, 9 aa, Homo Sapiens
RGAGAQDGV

SEQ ID NO: 1197173 - protein, 9 aa, Homo Sapiens
SETATWRCC

SEQ ID NO: 1197174 - protein, 9 aa, Homo Sapiens
YITSTKTRK

SEQ ID NO: 1197175 - protein, 9 aa, Homo Sapiens
RIPENILGK

SEQ ID NO: 1197176 - protein, 9 aa, Homo Sapiens
SGLNLGIAP

SEQ ID NO: 1197177 - protein, 9 aa, Homo Sapiens
RRMERKAPK

SEQ ID NO: 1197178 - protein, 9 aa, Homo Sapiens
RLEGRLGRL

SEQ ID NO: 1197179 - protein, 9 aa, Homo Sapiens
SLEALACPA

SEQ ID NO: 1197180 - protein, 9 aa, Homo Sapiens
GARRHPPRN

SEQ ID NO: 1197181 - protein, 9 aa, Homo Sapiens
VPELHGDAE

SEQ ID NO: 1197182 - protein, 9 aa, Homo Sapiens
MRGVCFDVH

SEQ ID NO: 1197183 - protein, 9 aa, Homo Sapiens
RSWLPCRGP

SEQ ID NO: 1197184 - protein, 9 aa, Homo Sapiens
SFCSSLPHL

SEQ ID NO: 1197185 - protein, 9 aa, Homo Sapiens
VSSMSEFQH

SEQ ID NO: 1197186 - protein, 9 aa, Homo Sapiens
ALRQAPGYH

SEQ ID NO: 1197187 - protein, 9 aa, Homo Sapiens
CSSLPHLPI

SEQ ID NO: 1197188 - protein, 9 aa, Homo Sapiens
CWQRRTAAP

SEQ ID NO: 1197189 - protein, 9 aa, Homo Sapiens
GGNPCTKAT

SEQ ID NO: 1197190 - protein, 9 aa, Homo Sapiens
SRAEKPTAA

SEQ ID NO: 1197191 - protein, 9 aa, Homo Sapiens
TAIQLIQFA

SEQ ID NO: 1197192 - protein, 9 aa, Homo Sapiens
RGEAAPSPT

SEQ ID NO: 1197193 - protein, 9 aa, Homo Sapiens
RILQASVAA

SEQ ID NO: 1197194 - protein, 9 aa, Homo Sapiens
EPQDQWGPK

SEQ ID NO: 1197195 - protein, 9 aa, Homo Sapiens
PALPPACPL

SEQ ID NO: 1197196 - protein, 9 aa, Homo Sapiens
LNHPSRLRS

SEQ ID NO: 1197197 - protein, 9 aa, Homo Sapiens
IWPRQASRL

SEQ ID NO: 1197198 - protein, 9 aa, Homo Sapiens
CGMIRDNGV

SEQ ID NO: 1197199 - protein, 9 aa, Homo Sapiens
RNQFRQRHP

SEQ ID NO: 1197200 - protein, 9 aa, Homo Sapiens
NGDELHGGK

SEQ ID NO: 1197201 - protein, 9 aa, Homo Sapiens
GYLAYKRFH

SEQ ID NO: 1197202 - protein, 9 aa, Homo Sapiens
LIGSEHTLP

SEQ ID NO: 1197203 - protein, 9 aa, Homo Sapiens
TSAPRRPKA

SEQ ID NO: 1197204 - protein, 9 aa, Homo Sapiens
LLLFLGSNQ

SEQ ID NO: 1197205 - protein, 9 aa, Homo Sapiens
VSVVAHLGF

SEQ ID NO: 1197206 - protein, 9 aa, Homo Sapiens
LDQTNTPLS

SEQ ID NO: 1197207 - protein, 9 aa, Homo Sapiens
SLKGSRTSC

SEQ ID NO: 1197208 - protein, 9 aa, Homo Sapiens
DDNNEYDAY

SEQ ID NO: 1197209 - protein, 9 aa, Homo Sapiens
GGGGSRRGG

SEQ ID NO: 1197210 - protein, 9 aa, Homo Sapiens
LIKLCQLSR

SEQ ID NO: 1197211 - protein, 9 aa, Homo Sapiens
LPGWKSCGM

SEQ ID NO: 1197212 - protein, 9 aa, Homo Sapiens
ELEEQTPNV

SEQ ID NO: 1197213 - protein, 9 aa, Homo Sapiens
WRPPTRELG

SEQ ID NO: 1197214 - protein, 9 aa, Homo Sapiens
LEWIRHTIP

SEQ ID NO: 1197215 - protein, 9 aa, Homo Sapiens
QFFVGVRTV

SEQ ID NO: 1197216 - protein, 9 aa, Homo Sapiens
GICPRPPPA

SEQ ID NO: 1197217 - protein, 9 aa, Homo Sapiens
ISATSFSSL

SEQ ID NO: 1197218 - protein, 9 aa, Homo Sapiens
NAPPGGPAR

SEQ ID NO: 1197219 - protein, 9 aa, Homo Sapiens
TDMSSICTV

SEQ ID NO: 1197220 - protein, 9 aa, Homo Sapiens
HPSWPWTRC

SEQ ID NO: 1197221 - protein, 9 aa, Homo Sapiens
SVGVARRRR

SEQ ID NO: 1197222 - protein, 9 aa, Homo Sapiens
HRAGHLPAA

SEQ ID NO: 1197223 - protein, 9 aa, Homo Sapiens
LTSTPSLVT

SEQ ID NO: 1197224 - protein, 9 aa, Homo Sapiens
QSLPYGILL

SEQ ID NO: 1197225 - protein, 9 aa, Homo Sapiens
LGGMGFLTS

SEQ ID NO: 1197226 - protein, 9 aa, Homo Sapiens
TMPCWTRPS

SEQ ID NO: 1197227 - protein, 9 aa, Homo Sapiens
GLVKLPLDN

SEQ ID NO: 1197228 - protein, 9 aa, Homo Sapiens
QYFVVLIWD

SEQ ID NO: 1197229 - protein, 9 aa, Homo Sapiens
ITAAVAKVP

SEQ ID NO: 1197230 - protein, 9 aa, Homo Sapiens
ILFWQFFVG

SEQ ID NO: 1197231 - protein, 9 aa, Homo Sapiens
VLLHILEGI

SEQ ID NO: 1197232 - protein, 9 aa, Homo Sapiens
QPPNPNSRG

SEQ ID NO: 1197233 - protein, 9 aa, Homo Sapiens
KIKYPKLLS

SEQ ID NO: 1197234 - protein, 9 aa, Homo Sapiens
AGTAGGGGS

SEQ ID NO: 1197235 - protein, 9 aa, Homo Sapiens
CHCAELGYR

SEQ ID NO: 1197236 - protein, 9 aa, Homo Sapiens
PQAQTPALG

SEQ ID NO: 1197237 - protein, 9 aa, Homo Sapiens
TTTGRPLSL

SEQ ID NO: 1197238 - protein, 9 aa, Homo Sapiens
GVHSPIMAT

SEQ ID NO: 1197239 - protein, 9 aa, Homo Sapiens
NSTTCMVTA

SEQ ID NO: 1197240 - protein, 9 aa, Homo Sapiens
LPMGSLVPS

SEQ ID NO: 1197241 - protein, 9 aa, Homo Sapiens
PILIHTPAE

SEQ ID NO: 1197242 - protein, 9 aa, Homo Sapiens
STSTTSAAS

SEQ ID NO: 1197243 - protein, 9 aa, Homo Sapiens
LILSSKLHQ

SEQ ID NO: 1197244 - protein, 9 aa, Homo Sapiens
WRGAGTGLE

SEQ ID NO: 1197245 - protein, 9 aa, Homo Sapiens
APGQAPMDS

SEQ ID NO: 1197246 - protein, 9 aa, Homo Sapiens
PLHCGPPSP

SEQ ID NO: 1197247 - protein, 9 aa, Homo Sapiens
MYSFLSNLS

SEQ ID NO: 1197248 - protein, 9 aa, Homo Sapiens
KTEAAEKEY

SEQ ID NO: 1197249 - protein, 9 aa, Homo Sapiens
LTSVPWPVA

SEQ ID NO: 1197250 - protein, 9 aa, Homo Sapiens
SGTPGLRAR

SEQ ID NO: 1197251 - protein, 9 aa, Homo Sapiens
AFPLPRASL

SEQ ID NO: 1197252 - protein, 9 aa, Homo Sapiens
CGCGTFFAS

SEQ ID NO: 1197253 - protein, 9 aa, Homo Sapiens
HIKPYVRSK

SEQ ID NO: 1197254 - protein, 9 aa, Homo Sapiens
VRPVGAFAK

SEQ ID NO: 1197255 - protein, 9 aa, Homo Sapiens
RGHPSTPDI

SEQ ID NO: 1197256 - protein, 9 aa, Homo Sapiens
DSAVTVAVG

SEQ ID NO: 1197257 - protein, 9 aa, Homo Sapiens
SSIQVFSIV

SEQ ID NO: 1197258 - protein, 9 aa, Homo Sapiens
NSLVQTAIS

SEQ ID NO: 1197259 - protein, 9 aa, Homo Sapiens
TRAPRRGCP

SEQ ID NO: 1197260 - protein, 9 aa, Homo Sapiens
ITVQEQLQL

SEQ ID NO: 1197261 - protein, 9 aa, Homo Sapiens
TALSGPWGS

SEQ ID NO: 1197262 - protein, 9 aa, Homo Sapiens
SDGQMKGAQ

SEQ ID NO: 1197263 - protein, 9 aa, Homo Sapiens
QQQAPEALG

SEQ ID NO: 1197264 - protein, 9 aa, Homo Sapiens
DQTNTPLSL

SEQ ID NO: 1197265 - protein, 9 aa, Homo Sapiens
ELEKEKKKA

SEQ ID NO: 1197266 - protein, 9 aa, Homo Sapiens
LLAPVPGSS

SEQ ID NO: 1197267 - protein, 9 aa, Homo Sapiens
VVLLAARRR

SEQ ID NO: 1197268 - protein, 9 aa, Homo Sapiens
CAMRWTLCF

SEQ ID NO: 1197269 - protein, 9 aa, Homo Sapiens
WDPPRSCRQ

SEQ ID NO: 1197270 - protein, 9 aa, Homo Sapiens
RFHQQLNSA

SEQ ID NO: 1197271 - protein, 9 aa, Homo Sapiens
TDQKFVPVD

SEQ ID NO: 1197272 - protein, 9 aa, Homo Sapiens
RLSRTDQKF

SEQ ID NO: 1197273 - protein, 9 aa, Homo Sapiens
PMYSFLSNL

SEQ ID NO: 1197274 - protein, 9 aa, Homo Sapiens
GCCSPAGPS

SEQ ID NO: 1197275 - protein, 9 aa, Homo Sapiens
EPGWASSRL

SEQ ID NO: 1197276 - protein, 9 aa, Homo Sapiens
AAQARVAVG

SEQ ID NO: 1197277 - protein, 9 aa, Homo Sapiens
QRQPAARLL

SEQ ID NO: 1197278 - protein, 9 aa, Homo Sapiens
GFSSMLSEE

SEQ ID NO: 1197279 - protein, 9 aa, Homo Sapiens
VIPPDLTAF

SEQ ID NO: 1197280 - protein, 9 aa, Homo Sapiens
TMQNIEAMS

SEQ ID NO: 1197281 - protein, 9 aa, Homo Sapiens
PAAAPNDSS

SEQ ID NO: 1197282 - protein, 9 aa, Homo Sapiens
QELQKHHSA

SEQ ID NO: 1197283 - protein, 9 aa, Homo Sapiens
FSGLNRGFT

SEQ ID NO: 1197284 - protein, 9 aa, Homo Sapiens
SVSGSGSGG

SEQ ID NO: 1197285 - protein, 9 aa, Homo Sapiens
RSRRRSRTC

SEQ ID NO: 1197286 - protein, 9 aa, Homo Sapiens
CPLQTFHLH

SEQ ID NO: 1197287 - protein, 9 aa, Homo Sapiens
SAPQARCWM

SEQ ID NO: 1197288 - protein, 9 aa, Homo Sapiens
ELASRLRCA

SEQ ID NO: 1197289 - protein, 9 aa, Homo Sapiens
QAGKSQQEN

SEQ ID NO: 1197290 - protein, 9 aa, Homo Sapiens
KDIVDVGLA

SEQ ID NO: 1197291 - protein, 9 aa, Homo Sapiens
TKLVPEEHV

SEQ ID NO: 1197292 - protein, 9 aa, Homo Sapiens
GDSTSQSPQ

SEQ ID NO: 1197293 - protein, 9 aa, Homo Sapiens
PRAGTRPGL

SEQ ID NO: 1197294 - protein, 9 aa, Homo Sapiens
VITSSQYSS

SEQ ID NO: 1197295 - protein, 9 aa, Homo Sapiens
IKVYTDRFT

SEQ ID NO: 1197296 - protein, 9 aa, Homo Sapiens
EPWLDAEVY

SEQ ID NO: 1197297 - protein, 9 aa, Homo Sapiens
AAPQAPSAL

SEQ ID NO: 1197298 - protein, 9 aa, Homo Sapiens
PTQEASGVT

SEQ ID NO: 1197299 - protein, 9 aa, Homo Sapiens
GPRPLHRWL

SEQ ID NO: 1197300 - protein, 9 aa, Homo Sapiens
CGALAAPDL

SEQ ID NO: 1197301 - protein, 9 aa, Homo Sapiens
LMPVHFTPL

SEQ ID NO: 1197302 - protein, 9 aa, Homo Sapiens
TTADHTMSS

SEQ ID NO: 1197303 - protein, 9 aa, Homo Sapiens
KLMKLNPLM

SEQ ID NO: 1197304 - protein, 9 aa, Homo Sapiens
RSGARGSPW

SEQ ID NO: 1197305 - protein, 9 aa, Homo Sapiens
HDPPQSLPS

SEQ ID NO: 1197306 - protein, 9 aa, Homo Sapiens
SKIPYSLWR

SEQ ID NO: 1197307 - protein, 9 aa, Homo Sapiens
SLRVRTVAG

SEQ ID NO: 1197308 - protein, 9 aa, Homo Sapiens
VRESDCSSV

SEQ ID NO: 1197309 - protein, 9 aa, Homo Sapiens
SSARTSWLS

SEQ ID NO: 1197310 - protein, 9 aa, Homo Sapiens
ILSVVHMAF

SEQ ID NO: 1197311 - protein, 9 aa, Homo Sapiens
HLSTIDYVD

SEQ ID NO: 1197312 - protein, 9 aa, Homo Sapiens
RWRHPLPPR

SEQ ID NO: 1197313 - protein, 9 aa, Homo Sapiens
ANAPPGGPA

SEQ ID NO: 1197314 - protein, 9 aa, Homo Sapiens
CRRGTLASS

SEQ ID NO: 1197315 - protein, 9 aa, Homo Sapiens
LSVKMVIVV

SEQ ID NO: 1197316 - protein, 9 aa, Homo Sapiens
APVITSSQY

SEQ ID NO: 1197317 - protein, 9 aa, Homo Sapiens
LGLVSGLGG

SEQ ID NO: 1197318 - protein, 9 aa, Homo Sapiens
PPNLSPTVE

SEQ ID NO: 1197319 - protein, 9 aa, Homo Sapiens
CAAGPKASR

SEQ ID NO: 1197320 - protein, 9 aa, Homo Sapiens
RRGCPTAAP

SEQ ID NO: 1197321 - protein, 9 aa, Homo Sapiens
HGELHRQQQ

SEQ ID NO: 1197322 - protein, 9 aa, Homo Sapiens
LDFHPRSSS

SEQ ID NO: 1197323 - protein, 9 aa, Homo Sapiens
GDELVLGAG

SEQ ID NO: 1197324 - protein, 9 aa, Homo Sapiens
QSWEIVMET

SEQ ID NO: 1197325 - protein, 9 aa, Homo Sapiens
TLTMSEDRP

SEQ ID NO: 1197326 - protein, 9 aa, Homo Sapiens
TKFKSIQLS

SEQ ID NO: 1197327 - protein, 9 aa, Homo Sapiens
QLFIHCPMV

SEQ ID NO: 1197328 - protein, 9 aa, Homo Sapiens
VYPVCTPNG

SEQ ID NO: 1197329 - protein, 9 aa, Homo Sapiens
LLEVTTFCS

SEQ ID NO: 1197330 - protein, 9 aa, Homo Sapiens
FGQKMGKVI

SEQ ID NO: 1197331 - protein, 9 aa, Homo Sapiens
HQPQQQHHH

SEQ ID NO: 1197332 - protein, 9 aa, Homo Sapiens
ELGKKHTSN

SEQ ID NO: 1197333 - protein, 9 aa, Homo Sapiens
KRICRGAGH

SEQ ID NO: 1197334 - protein, 9 aa, Homo Sapiens
APTPSARSS

SEQ ID NO: 1197335 - protein, 9 aa, Homo Sapiens
TTTADHTMS

SEQ ID NO: 1197336 - protein, 9 aa, Homo Sapiens
RQAGAPLGG

SEQ ID NO: 1197337 - protein, 9 aa, Homo Sapiens
RVYRPLPKS

SEQ ID NO: 1197338 - protein, 9 aa, Homo Sapiens
GRLPRHPRS

SEQ ID NO: 1197339 - protein, 9 aa, Homo Sapiens
LTDMSSICT

SEQ ID NO: 1197340 - protein, 9 aa, Homo Sapiens
HLSVAWRAS

SEQ ID NO: 1197341 - protein, 9 aa, Homo Sapiens
RRACGQRRR

SEQ ID NO: 1197342 - protein, 9 aa, Homo Sapiens
MKESPVSLH

SEQ ID NO: 1197343 - protein, 9 aa, Homo Sapiens
SIGRPGICC

SEQ ID NO: 1197344 - protein, 9 aa, Homo Sapiens
EGLWGWRGR

SEQ ID NO: 1197345 - protein, 9 aa, Homo Sapiens
YVCACICVC

SEQ ID NO: 1197346 - protein, 9 aa, Homo Sapiens
MQETRSQLS

SEQ ID NO: 1197347 - protein, 9 aa, Homo Sapiens
FTNQGLFHK

SEQ ID NO: 1197348 - protein, 9 aa, Homo Sapiens
RAVGTQISI

SEQ ID NO: 1197349 - protein, 9 aa, Homo Sapiens
YTDRFTPLT

SEQ ID NO: 1197350 - protein, 9 aa, Homo Sapiens
PPRGKRTQG

SEQ ID NO: 1197351 - protein, 9 aa, Homo Sapiens
CIYVSANSG

SEQ ID NO: 1197352 - protein, 9 aa, Homo Sapiens
KKTEAAEKE

SEQ ID NO: 1197353 - protein, 9 aa, Homo Sapiens
TQPSSCPPA

SEQ ID NO: 1197354 - protein, 9 aa, Homo Sapiens
LSDPGVCIF

SEQ ID NO: 1197355 - protein, 9 aa, Homo Sapiens
MCTNAHRVV

SEQ ID NO: 1197356 - protein, 9 aa, Homo Sapiens
LILPYISGM

SEQ ID NO: 1197357 - protein, 9 aa, Homo Sapiens
LLLFALFQE

SEQ ID NO: 1197358 - protein, 9 aa, Homo Sapiens
RDYSLTCHN

SEQ ID NO: 1197359 - protein, 9 aa, Homo Sapiens
CSVRHAHLS

SEQ ID NO: 1197360 - protein, 9 aa, Homo Sapiens
LLHFGQALV

SEQ ID NO: 1197361 - protein, 9 aa, Homo Sapiens
LGSNQLPVP

SEQ ID NO: 1197362 - protein, 9 aa, Homo Sapiens
AYGMQTCGL

SEQ ID NO: 1197363 - protein, 9 aa, Homo Sapiens
SPSTAGEPP

SEQ ID NO: 1197364 - protein, 9 aa, Homo Sapiens
SEEFYYRGQ

SEQ ID NO: 1197365 - protein, 9 aa, Homo Sapiens
ILCMAISSD

SEQ ID NO: 1197366 - protein, 9 aa, Homo Sapiens
TSPPMMRNS

SEQ ID NO: 1197367 - protein, 9 aa, Homo Sapiens
PWPHHLCPI

SEQ ID NO: 1197368 - protein, 9 aa, Homo Sapiens
WVVTARPAR

SEQ ID NO: 1197369 - protein, 9 aa, Homo Sapiens
APSDQVSCC

SEQ ID NO: 1197370 - protein, 9 aa, Homo Sapiens
PRAPHPPPA

SEQ ID NO: 1197371 - protein, 9 aa, Homo Sapiens
IKENLAFPG

SEQ ID NO: 1197372 - protein, 9 aa, Homo Sapiens
GLTYTRTLR

SEQ ID NO: 1197373 - protein, 9 aa, Homo Sapiens
GGSRRGGGG

SEQ ID NO: 1197374 - protein, 9 aa, Homo Sapiens
SGVGTYILG

SEQ ID NO: 1197375 - protein, 9 aa, Homo Sapiens
PWTGSAVLR

SEQ ID NO: 1197376 - protein, 9 aa, Homo Sapiens
ERSWVHSPL

SEQ ID NO: 1197377 - protein, 9 aa, Homo Sapiens
FFLGRWAEA

SEQ ID NO: 1197378 - protein, 9 aa, Homo Sapiens
GLGSKGEPG

SEQ ID NO: 1197379 - protein, 9 aa, Homo Sapiens
KREGPRMKW

SEQ ID NO: 1197380 - protein, 9 aa, Homo Sapiens
AGGSTSVFP

SEQ ID NO: 1197381 - protein, 9 aa, Homo Sapiens
AAKAVGPPS

SEQ ID NO: 1197382 - protein, 9 aa, Homo Sapiens
AIAAFIIIH

SEQ ID NO: 1197383 - protein, 9 aa, Homo Sapiens
ATSFSSLVS

SEQ ID NO: 1197384 - protein, 9 aa, Homo Sapiens
RISKMFLTV

SEQ ID NO: 1197385 - protein, 9 aa, Homo Sapiens
CCKRFVQSS

SEQ ID NO: 1197386 - protein, 9 aa, Homo Sapiens
HQRMHTGKI

SEQ ID NO: 1197387 - protein, 9 aa, Homo Sapiens
WRPRWRQQN

SEQ ID NO: 1197388 - protein, 9 aa, Homo Sapiens
PPSCCRRTS

SEQ ID NO: 1197389 - protein, 9 aa, Homo Sapiens
AQPILQIDS

SEQ ID NO: 1197390 - protein, 9 aa, Homo Sapiens
SVEVKEGAT

SEQ ID NO: 1197391 - protein, 9 aa, Homo Sapiens
NDSEEFYYR

SEQ ID NO: 1197392 - protein, 9 aa, Homo Sapiens
RNDTLDSTW

SEQ ID NO: 1197393 - protein, 9 aa, Homo Sapiens
KIMFSCNNK

SEQ ID NO: 1197394 - protein, 9 aa, Homo Sapiens
VPGLPLPAR

SEQ ID NO: 1197395 - protein, 9 aa, Homo Sapiens
SSLARGSQR

SEQ ID NO: 1197396 - protein, 9 aa, Homo Sapiens
VPQDWRQRC

SEQ ID NO: 1197397 - protein, 9 aa, Homo Sapiens
PSAPPWPRR

SEQ ID NO: 1197398 - protein, 9 aa, Homo Sapiens
SMSLPSGIY

SEQ ID NO: 1197399 - protein, 9 aa, Homo Sapiens
FLRPASSGS

SEQ ID NO: 1197400 - protein, 9 aa, Homo Sapiens
TSYGVKPRY

SEQ ID NO: 1197401 - protein, 9 aa, Homo Sapiens
GPGPHAVSG

SEQ ID NO: 1197402 - protein, 9 aa, Homo Sapiens
QALVRCGQL

SEQ ID NO: 1197403 - protein, 9 aa, Homo Sapiens
ELSSLKPGA

SEQ ID NO: 1197404 - protein, 9 aa, Homo Sapiens
NRKASQNAY

SEQ ID NO: 1197405 - protein, 9 aa, Homo Sapiens
LVNGRSREL

SEQ ID NO: 1197406 - protein, 9 aa, Homo Sapiens
RVPYDISAI

SEQ ID NO: 1197407 - protein, 9 aa, Homo Sapiens
IHMAEKSFR

SEQ ID NO: 1197408 - protein, 9 aa, Homo Sapiens
LFEFQGPSW

SEQ ID NO: 1197409 - protein, 9 aa, Homo Sapiens
RTKWPLQCL

SEQ ID NO: 1197410 - protein, 9 aa, Homo Sapiens
VPWPVATVG

SEQ ID NO: 1197411 - protein, 9 aa, Homo Sapiens
KYRDRKVHH

SEQ ID NO: 1197412 - protein, 9 aa, Homo Sapiens
YSSCASCTG

SEQ ID NO: 1197413 - protein, 9 aa, Homo Sapiens
ERDRKFLGE

SEQ ID NO: 1197414 - protein, 9 aa, Homo Sapiens
GVGEHEFDC

SEQ ID NO: 1197415 - protein, 9 aa, Homo Sapiens
NLPGQPNFP

SEQ ID NO: 1197416 - protein, 9 aa, Homo Sapiens
TMKVRSAGL

SEQ ID NO: 1197417 - protein, 9 aa, Homo Sapiens
YDWEFSSVG

SEQ ID NO: 1197418 - protein, 9 aa, Homo Sapiens
PEPQARTKM

SEQ ID NO: 1197419 - protein, 9 aa, Homo Sapiens
ILQTVLETI

SEQ ID NO: 1197420 - protein, 9 aa, Homo Sapiens
VPGSSAPKV

SEQ ID NO: 1197421 - protein, 9 aa, Homo Sapiens
AGAFADLHA

SEQ ID NO: 1197422 - protein, 9 aa, Homo Sapiens
QGNQMAELQ

SEQ ID NO: 1197423 - protein, 9 aa, Homo Sapiens
QQRPPWRTS

SEQ ID NO: 1197424 - protein, 9 aa, Homo Sapiens
VNVTPQQMP

SEQ ID NO: 1197425 - protein, 9 aa, Homo Sapiens
TSGSIFLGA

SEQ ID NO: 1197426 - protein, 9 aa, Homo Sapiens
ILGEGHLRL

SEQ ID NO: 1197427 - protein, 9 aa, Homo Sapiens
TRPGLGLGA

SEQ ID NO: 1197428 - protein, 9 aa, Homo Sapiens
PAPTAAAPT

SEQ ID NO: 1197429 - protein, 9 aa, Homo Sapiens
VARVEVAAG

SEQ ID NO: 1197430 - protein, 9 aa, Homo Sapiens
GVCTGRAAS

SEQ ID NO: 1197431 - protein, 9 aa, Homo Sapiens
HFTKDIVDV

SEQ ID NO: 1197432 - protein, 9 aa, Homo Sapiens
TDFKETLMA

SEQ ID NO: 1197433 - protein, 9 aa, Homo Sapiens
RPRGRRGVG

SEQ ID NO: 1197434 - protein, 9 aa, Homo Sapiens
PCPPGGAEE

SEQ ID NO: 1197435 - protein, 9 aa, Homo Sapiens
PAAQRRWPL

SEQ ID NO: 1197436 - protein, 9 aa, Homo Sapiens
VPDDRSVVT

SEQ ID NO: 1197437 - protein, 9 aa, Homo Sapiens
TKEVIMDLT

SEQ ID NO: 1197438 - protein, 9 aa, Homo Sapiens
MCTHIHLNE

SEQ ID NO: 1197439 - protein, 9 aa, Homo Sapiens
EGKEQEEEE

SEQ ID NO: 1197440 - protein, 9 aa, Homo Sapiens
TLLHLAQPA

SEQ ID NO: 1197441 - protein, 9 aa, Homo Sapiens
DDDANQSAT

SEQ ID NO: 1197442 - protein, 9 aa, Homo Sapiens
ADLHALRAL

SEQ ID NO: 1197443 - protein, 9 aa, Homo Sapiens
NNDRLTILL

SEQ ID NO: 1197444 - protein, 9 aa, Homo Sapiens
KIVDDPKAD

SEQ ID NO: 1197445 - protein, 9 aa, Homo Sapiens
PAAGAAVWG

SEQ ID NO: 1197446 - protein, 9 aa, Homo Sapiens
IGILAVIVV

SEQ ID NO: 1197447 - protein, 9 aa, Homo Sapiens
GSVSEEASA

SEQ ID NO: 1197448 - protein, 9 aa, Homo Sapiens
KMQWLPCLL

SEQ ID NO: 1197449 - protein, 9 aa, Homo Sapiens
GLYGLEVTL

SEQ ID NO: 1197450 - protein, 9 aa, Homo Sapiens
GALPYDTRS

SEQ ID NO: 1197451 - protein, 9 aa, Homo Sapiens
ATGTDADGV

SEQ ID NO: 1197452 - protein, 9 aa, Homo Sapiens
ERAGGQRTR

SEQ ID NO: 1197453 - protein, 9 aa, Homo Sapiens
AAPGSHGRR

SEQ ID NO: 1197454 - protein, 9 aa, Homo Sapiens
VAPKAGPGV

SEQ ID NO: 1197455 - protein, 9 aa, Homo Sapiens
CLTAEDLFE

SEQ ID NO: 1197456 - protein, 9 aa, Homo Sapiens
CIVLWPKAF

SEQ ID NO: 1197457 - protein, 9 aa, Homo Sapiens
PQGPPRMGP

SEQ ID NO: 1197458 - protein, 9 aa, Homo Sapiens
GTLASSAAQ

SEQ ID NO: 1197459 - protein, 9 aa, Homo Sapiens
ETEEIASAS

SEQ ID NO: 1197460 - protein, 9 aa, Homo Sapiens
TWSSSPKFT

SEQ ID NO: 1197461 - protein, 9 aa, Homo Sapiens
EPRLTRCCL

SEQ ID NO: 1197462 - protein, 9 aa, Homo Sapiens
PTISLSFKE

SEQ ID NO: 1197463 - protein, 9 aa, Homo Sapiens
DFGPRSINP

SEQ ID NO: 1197464 - protein, 9 aa, Homo Sapiens
LVTVGNVYT

SEQ ID NO: 1197465 - protein, 9 aa, Homo Sapiens
LLIPPPRLL

SEQ ID NO: 1197466 - protein, 9 aa, Homo Sapiens
TDYKSVPLK

SEQ ID NO: 1197467 - protein, 9 aa, Homo Sapiens
NRTPPRRRS

SEQ ID NO: 1197468 - protein, 9 aa, Homo Sapiens
LWGWRGRGP

SEQ ID NO: 1197469 - protein, 9 aa, Homo Sapiens
KQMNDARHG

SEQ ID NO: 1197470 - protein, 9 aa, Homo Sapiens
LKRHPHKSL

SEQ ID NO: 1197471 - protein, 9 aa, Homo Sapiens
GINAEHSWA

SEQ ID NO: 1197472 - protein, 9 aa, Homo Sapiens
EQTVIAVEA

SEQ ID NO: 1197473 - protein, 9 aa, Homo Sapiens
LVALNTAYV

SEQ ID NO: 1197474 - protein, 9 aa, Homo Sapiens
WCWSLVIWV

SEQ ID NO: 1197475 - protein, 9 aa, Homo Sapiens
ALMNSNISS

SEQ ID NO: 1197476 - protein, 9 aa, Homo Sapiens
AGGQKCMVS

SEQ ID NO: 1197477 - protein, 9 aa, Homo Sapiens
GSGCRSPPL

SEQ ID NO: 1197478 - protein, 9 aa, Homo Sapiens
KLENLYDAL

SEQ ID NO: 1197479 - protein, 9 aa, Homo Sapiens
ANPNDRCFG

SEQ ID NO: 1197480 - protein, 9 aa, Homo Sapiens
HYTSGVGAG

SEQ ID NO: 1197481 - protein, 9 aa, Homo Sapiens
FDCISRKCP

SEQ ID NO: 1197482 - protein, 9 aa, Homo Sapiens
PRTKWPLQC

SEQ ID NO: 1197483 - protein, 9 aa, Homo Sapiens
AGCPRRCQI

SEQ ID NO: 1197484 - protein, 9 aa, Homo Sapiens
CIFSESRHP

SEQ ID NO: 1197485 - protein, 9 aa, Homo Sapiens
LRARVWRGA

SEQ ID NO: 1197486 - protein, 9 aa, Homo Sapiens
WAGVASSGE

SEQ ID NO: 1197487 - protein, 9 aa, Homo Sapiens
FIYNMLTDF

SEQ ID NO: 1197488 - protein, 9 aa, Homo Sapiens
ASGVTAAKA

SEQ ID NO: 1197489 - protein, 9 aa, Homo Sapiens
GYRTQGVCS

SEQ ID NO: 1197490 - protein, 9 aa, Homo Sapiens
TLFDWYRHQ

SEQ ID NO: 1197491 - protein, 9 aa, Homo Sapiens
CSSSGTEDT

SEQ ID NO: 1197492 - protein, 9 aa, Homo Sapiens
LQDLVIHSQ

SEQ ID NO: 1197493 - protein, 9 aa, Homo Sapiens
LGKKHTSNN

SEQ ID NO: 1197494 - protein, 9 aa, Homo Sapiens
SIDDYFYIN

SEQ ID NO: 1197495 - protein, 9 aa, Homo Sapiens
YRVLACRVT

SEQ ID NO: 1197496 - protein, 9 aa, Homo Sapiens
KFHLQYRPA

SEQ ID NO: 1197497 - protein, 9 aa, Homo Sapiens
MCFQPDLVT

SEQ ID NO: 1197498 - protein, 9 aa, Homo Sapiens
STTEDTPEA

SEQ ID NO: 1197499 - protein, 9 aa, Homo Sapiens
EKKEEGKEQ

SEQ ID NO: 1197500 - protein, 9 aa, Homo Sapiens
RRMRKTFAR

SEQ ID NO: 1197501 - protein, 9 aa, Homo Sapiens
ATALSGPWG

SEQ ID NO: 1197502 - protein, 9 aa, Homo Sapiens
DFIPRLVHL

SEQ ID NO: 1197503 - protein, 9 aa, Homo Sapiens
TRKIEAQVS

SEQ ID NO: 1197504 - protein, 9 aa, Homo Sapiens
CHKTYDTTV

SEQ ID NO: 1197505 - protein, 9 aa, Homo Sapiens
TGCFCPADP

SEQ ID NO: 1197506 - protein, 9 aa, Homo Sapiens
GPKASREQQ

SEQ ID NO: 1197507 - protein, 9 aa, Homo Sapiens
NYVRCMFGI

SEQ ID NO: 1197508 - protein, 9 aa, Homo Sapiens
ESFMGLPLD

SEQ ID NO: 1197509 - protein, 9 aa, Homo Sapiens
LHSSLDPLA

SEQ ID NO: 1197510 - protein, 9 aa, Homo Sapiens
LSLMMTQIS

SEQ ID NO: 1197511 - protein, 9 aa, Homo Sapiens
PNEALGYLK

SEQ ID NO: 1197512 - protein, 9 aa, Homo Sapiens
LAQKFPLGS

SEQ ID NO: 1197513 - protein, 9 aa, Homo Sapiens
INTTRHGQS

SEQ ID NO: 1197514 - protein, 9 aa, Homo Sapiens
RGGLPCRLG

SEQ ID NO: 1197515 - protein, 9 aa, Homo Sapiens
QLCGWREAS

SEQ ID NO: 1197516 - protein, 9 aa, Homo Sapiens
RRNLQRNLK

SEQ ID NO: 1197517 - protein, 9 aa, Homo Sapiens
VANFALGVR

SEQ ID NO: 1197518 - protein, 9 aa, Homo Sapiens
WASSRLCHW

SEQ ID NO: 1197519 - protein, 9 aa, Homo Sapiens
TCLMNTMGY

SEQ ID NO: 1197520 - protein, 9 aa, Homo Sapiens
LEERRPIAS

SEQ ID NO: 1197521 - protein, 9 aa, Homo Sapiens
SDPHLLATV

SEQ ID NO: 1197522 - protein, 9 aa, Homo Sapiens
RVLLVDFQL

SEQ ID NO: 1197523 - protein, 9 aa, Homo Sapiens
NVSNWHWTE

SEQ ID NO: 1197524 - protein, 9 aa, Homo Sapiens
TSRTLAACP

SEQ ID NO: 1197525 - protein, 9 aa, Homo Sapiens
DQMWYEWEV

SEQ ID NO: 1197526 - protein, 9 aa, Homo Sapiens
SLQKSCSTH

SEQ ID NO: 1197527 - protein, 9 aa, Homo Sapiens
RGRRGVGRC

SEQ ID NO: 1197528 - protein, 9 aa, Homo Sapiens
PSAPNSFLT

SEQ ID NO: 1197529 - protein, 9 aa, Homo Sapiens
PSNSGRPPP

SEQ ID NO: 1197530 - protein, 9 aa, Homo Sapiens
VSEKETWIT

SEQ ID NO: 1197531 - protein, 9 aa, Homo Sapiens
NSLVDLEAF

SEQ ID NO: 1197532 - protein, 9 aa, Homo Sapiens
QASSIPPTR

SEQ ID NO: 1197533 - protein, 9 aa, Homo Sapiens
VGLRPVAHH

SEQ ID NO: 1197534 - protein, 9 aa, Homo Sapiens
AIHQVPLIL

SEQ ID NO: 1197535 - protein, 9 aa, Homo Sapiens
HLWTIGVEM

SEQ ID NO: 1197536 - protein, 9 aa, Homo Sapiens
FCSSLPHLP

SEQ ID NO: 1197537 - protein, 9 aa, Homo Sapiens
TSWLSWRPR

SEQ ID NO: 1197538 - protein, 9 aa, Homo Sapiens
QQLSIHFAA

SEQ ID NO: 1197539 - protein, 9 aa, Homo Sapiens
GTRRSCSGL

SEQ ID NO: 1197540 - protein, 9 aa, Homo Sapiens
ALTLEIRKP

SEQ ID NO: 1197541 - protein, 9 aa, Homo Sapiens
SSDPVGPPC

SEQ ID NO: 1197542 - protein, 9 aa, Homo Sapiens
SAVKLLCMC

SEQ ID NO: 1197543 - protein, 9 aa, Homo Sapiens
GMGSPGSRK

SEQ ID NO: 1197544 - protein, 9 aa, Homo Sapiens
SGGGTTTGQ

SEQ ID NO: 1197545 - protein, 9 aa, Homo Sapiens
KQQVPRPRP

SEQ ID NO: 1197546 - protein, 9 aa, Homo Sapiens
AGPPLGDIV

SEQ ID NO: 1197547 - protein, 9 aa, Homo Sapiens
LEKVSKKRL

SEQ ID NO: 1197548 - protein, 9 aa, Homo Sapiens
GSPQSRVDG

SEQ ID NO: 1197549 - protein, 9 aa, Homo Sapiens
TPSWEVPPR

SEQ ID NO: 1197550 - protein, 9 aa, Homo Sapiens
VKVILQAMY

SEQ ID NO: 1197551 - protein, 9 aa, Homo Sapiens
CDNEYSGDD

SEQ ID NO: 1197552 - protein, 9 aa, Homo Sapiens
VGVMVEILV

SEQ ID NO: 1197553 - protein, 9 aa, Homo Sapiens
LWDRQGYTA

SEQ ID NO: 1197554 - protein, 9 aa, Homo Sapiens
RQLPRDRRP

SEQ ID NO: 1197555 - protein, 9 aa, Homo Sapiens
LEMDISKKS

SEQ ID NO: 1197556 - protein, 9 aa, Homo Sapiens
IGCTVFIWC

SEQ ID NO: 1197557 - protein, 9 aa, Homo Sapiens
SPSVNAVSM

SEQ ID NO: 1197558 - protein, 9 aa, Homo Sapiens
PMNPLVFGH

SEQ ID NO: 1197559 - protein, 9 aa, Homo Sapiens
QACCSTKQL

SEQ ID NO: 1197560 - protein, 9 aa, Homo Sapiens
PACQIILVN

SEQ ID NO: 1197561 - protein, 9 aa, Homo Sapiens
GKGTESSLA

SEQ ID NO: 1197562 - protein, 9 aa, Homo Sapiens
GRRRARPGQ

SEQ ID NO: 1197563 - protein, 9 aa, Homo Sapiens
RTRCWACCG

SEQ ID NO: 1197564 - protein, 9 aa, Homo Sapiens
ADYLHAMHT

SEQ ID NO: 1197565 - protein, 9 aa, Homo Sapiens
FRVAMLLLS

SEQ ID NO: 1197566 - protein, 9 aa, Homo Sapiens
GPWRAPRAS

SEQ ID NO: 1197567 - protein, 9 aa, Homo Sapiens
SAGSVSGSG

SEQ ID NO: 1197568 - protein, 9 aa, Homo Sapiens
ARKVKKRKR

SEQ ID NO: 1197569 - protein, 9 aa, Homo Sapiens
SKMGNLRNL

SEQ ID NO: 1197570 - protein, 9 aa, Homo Sapiens
DFRGEIFRL

SEQ ID NO: 1197571 - protein, 9 aa, Homo Sapiens
SYSRGAQGM

SEQ ID NO: 1197572 - protein, 9 aa, Homo Sapiens
CEDGYRLEK

SEQ ID NO: 1197573 - protein, 9 aa, Homo Sapiens
LPLRPSHSS

SEQ ID NO: 1197574 - protein, 9 aa, Homo Sapiens
WKMWSTPCC

SEQ ID NO: 1197575 - protein, 9 aa, Homo Sapiens
WFLLKSTHL

SEQ ID NO: 1197576 - protein, 9 aa, Homo Sapiens
SSCPPAWIL

SEQ ID NO: 1197577 - protein, 9 aa, Homo Sapiens
GQKMGKVIF

SEQ ID NO: 1197578 - protein, 9 aa, Homo Sapiens
EPILADDLI

SEQ ID NO: 1197579 - protein, 9 aa, Homo Sapiens
AFVIVTVNL

SEQ ID NO: 1197580 - protein, 9 aa, Homo Sapiens
SLGLHTGEV

SEQ ID NO: 1197581 - protein, 9 aa, Homo Sapiens
AAPQLRKWL

SEQ ID NO: 1197582 - protein, 9 aa, Homo Sapiens
ISILPVILR

SEQ ID NO: 1197583 - protein, 9 aa, Homo Sapiens
CICVCACVY

SEQ ID NO: 1197584 - protein, 9 aa, Homo Sapiens
CGLHYDVQR

SEQ ID NO: 1197585 - protein, 9 aa, Homo Sapiens
ENIKIEEEE

SEQ ID NO: 1197586 - protein, 9 aa, Homo Sapiens
ECKQRGKLL

SEQ ID NO: 1197587 - protein, 9 aa, Homo Sapiens
MHVPTAADV

SEQ ID NO: 1197588 - protein, 9 aa, Homo Sapiens
ISIFLYILT

SEQ ID NO: 1197589 - protein, 9 aa, Homo Sapiens
AMALCGSKG

SEQ ID NO: 1197590 - protein, 9 aa, Homo Sapiens
KCLTLANAS

SEQ ID NO: 1197591 - protein, 9 aa, Homo Sapiens
QDSAPVPRG

SEQ ID NO: 1197592 - protein, 9 aa, Homo Sapiens
LAFPGDLVA

SEQ ID NO: 1197593 - protein, 9 aa, Homo Sapiens
SWPGHMSEL

SEQ ID NO: 1197594 - protein, 9 aa, Homo Sapiens
PPAEDQPAG

SEQ ID NO: 1197595 - protein, 9 aa, Homo Sapiens
RAPCLRRLC

SEQ ID NO: 1197596 - protein, 9 aa, Homo Sapiens
FDHKVTGAH

SEQ ID NO: 1197597 - protein, 9 aa, Homo Sapiens
KRFHVKDHR

SEQ ID NO: 1197598 - protein, 9 aa, Homo Sapiens
GTDAAQAAI

SEQ ID NO: 1197599 - protein, 9 aa, Homo Sapiens
RDRSHSGHC

SEQ ID NO: 1197600 - protein, 9 aa, Homo Sapiens
ESQMASKLP

SEQ ID NO: 1197601 - protein, 9 aa, Homo Sapiens
LSAKDKTIS

SEQ ID NO: 1197602 - protein, 9 aa, Homo Sapiens
ALRGGCGHH

SEQ ID NO: 1197603 - protein, 9 aa, Homo Sapiens
AFLGRPPTP

SEQ ID NO: 1197604 - protein, 9 aa, Homo Sapiens
SKSNSKNSS

SEQ ID NO: 1197605 - protein, 9 aa, Homo Sapiens
RGKAEEILR

SEQ ID NO: 1197606 - protein, 9 aa, Homo Sapiens
DGPFLFFIR

SEQ ID NO: 1197607 - protein, 9 aa, Homo Sapiens
CGYSVEVKE

SEQ ID NO: 1197608 - protein, 9 aa, Homo Sapiens
TYTRTLRYL

SEQ ID NO: 1197609 - protein, 9 aa, Homo Sapiens
LVENLQALL

SEQ ID NO: 1197610 - protein, 9 aa, Homo Sapiens
RWRQQNWMS

SEQ ID NO: 1197611 - protein, 9 aa, Homo Sapiens
LNVMLRSQS

SEQ ID NO: 1197612 - protein, 9 aa, Homo Sapiens
FPRRRNFLE

SEQ ID NO: 1197613 - protein, 9 aa, Homo Sapiens
TNAHRVVRK

SEQ ID NO: 1197614 - protein, 9 aa, Homo Sapiens
ENNVVEKLN

SEQ ID NO: 1197615 - protein, 9 aa, Homo Sapiens
MGPGRHRGD

SEQ ID NO: 1197616 - protein, 9 aa, Homo Sapiens
LQTFHLHHC

SEQ ID NO: 1197617 - protein, 9 aa, Homo Sapiens
SDFGPRSIN

SEQ ID NO: 1197618 - protein, 9 aa, Homo Sapiens
LIQFALVSL

SEQ ID NO: 1197619 - protein, 9 aa, Homo Sapiens
VGLHERRAA

SEQ ID NO: 1197620 - protein, 9 aa, Homo Sapiens
CQHQHVYLG

SEQ ID NO: 1197621 - protein, 9 aa, Homo Sapiens
LRPLEGAVV

SEQ ID NO: 1197622 - protein, 9 aa, Homo Sapiens
PGKYICQRC

SEQ ID NO: 1197623 - protein, 9 aa, Homo Sapiens
SSSPEYTCW

SEQ ID NO: 1197624 - protein, 9 aa, Homo Sapiens
PRRRATALS

SEQ ID NO: 1197625 - protein, 9 aa, Homo Sapiens
KMKMSVILS

SEQ ID NO: 1197626 - protein, 9 aa, Homo Sapiens
RAGVCCEPA

SEQ ID NO: 1197627 - protein, 9 aa, Homo Sapiens
KSLLVTVGN

SEQ ID NO: 1197628 - protein, 9 aa, Homo Sapiens
IHTREWVSP

SEQ ID NO: 1197629 - protein, 9 aa, Homo Sapiens
SPVRLGDQV

SEQ ID NO: 1197630 - protein, 9 aa, Homo Sapiens
PVPPGPQAG

SEQ ID NO: 1197631 - protein, 9 aa, Homo Sapiens
WVRPAGMTF

SEQ ID NO: 1197632 - protein, 9 aa, Homo Sapiens
AGAHGLAQR

SEQ ID NO: 1197633 - protein, 9 aa, Homo Sapiens
TLSHQIKSS

SEQ ID NO: 1197634 - protein, 9 aa, Homo Sapiens
RRWKVADLQ

SEQ ID NO: 1197635 - protein, 9 aa, Homo Sapiens
SVRHAHLSR

SEQ ID NO: 1197636 - protein, 9 aa, Homo Sapiens
RRSSNRNSI

SEQ ID NO: 1197637 - protein, 9 aa, Homo Sapiens
RSNGAYNIF

SEQ ID NO: 1197638 - protein, 9 aa, Homo Sapiens
MKQALTPEH

SEQ ID NO: 1197639 - protein, 9 aa, Homo Sapiens
GPWNGTTMM

SEQ ID NO: 1197640 - protein, 9 aa, Homo Sapiens
IPYSLWRLT

SEQ ID NO: 1197641 - protein, 9 aa, Homo Sapiens
HFSTEKMQW

SEQ ID NO: 1197642 - protein, 9 aa, Homo Sapiens
KCAGKRLTD

SEQ ID NO: 1197643 - protein, 9 aa, Homo Sapiens
LPSVHVPPQ

SEQ ID NO: 1197644 - protein, 9 aa, Homo Sapiens
LVDFQLAPP

SEQ ID NO: 1197645 - protein, 9 aa, Homo Sapiens
MAEKNFVKR

SEQ ID NO: 1197646 - protein, 9 aa, Homo Sapiens
FTDFKETLM

SEQ ID NO: 1197647 - protein, 9 aa, Homo Sapiens
RTSHISALI

SEQ ID NO: 1197648 - protein, 9 aa, Homo Sapiens
LKKHLWIHS

SEQ ID NO: 1197649 - protein, 9 aa, Homo Sapiens
QSRVDGSGS

SEQ ID NO: 1197650 - protein, 9 aa, Homo Sapiens
YHILRYMWG

SEQ ID NO: 1197651 - protein, 9 aa, Homo Sapiens
KKPCCGVPD

SEQ ID NO: 1197652 - protein, 9 aa, Homo Sapiens
RGAGRLRTL

SEQ ID NO: 1197653 - protein, 9 aa, Homo Sapiens
PVEVRLFSH

SEQ ID NO: 1197654 - protein, 9 aa, Homo Sapiens
VVLNFHKSP

SEQ ID NO: 1197655 - protein, 9 aa, Homo Sapiens
PLGDLSVPS

SEQ ID NO: 1197656 - protein, 9 aa, Homo Sapiens
DEDAVASAG

SEQ ID NO: 1197657 - protein, 9 aa, Homo Sapiens
GGHAAQLLR

SEQ ID NO: 1197658 - protein, 9 aa, Homo Sapiens
DQPFMGGQK

SEQ ID NO: 1197659 - protein, 9 aa, Homo Sapiens
LEETWASGQ

SEQ ID NO: 1197660 - protein, 9 aa, Homo Sapiens
WLSHRLRLR

SEQ ID NO: 1197661 - protein, 9 aa, Homo Sapiens
WWSMSRSTT

SEQ ID NO: 1197662 - protein, 9 aa, Homo Sapiens
VKGPPQGPW

SEQ ID NO: 1197663 - protein, 9 aa, Homo Sapiens
KIQLEKELA

SEQ ID NO: 1197664 - protein, 9 aa, Homo Sapiens
VAKGQPGFK

SEQ ID NO: 1197665 - protein, 9 aa, Homo Sapiens
TEHYKCSEC

SEQ ID NO: 1197666 - protein, 9 aa, Homo Sapiens
VETDGRKER

SEQ ID NO: 1197667 - protein, 9 aa, Homo Sapiens
FRSCTNSNA

SEQ ID NO: 1197668 - protein, 9 aa, Homo Sapiens
RLRVIQLTS

SEQ ID NO: 1197669 - protein, 9 aa, Homo Sapiens
MGPGPGLGP

SEQ ID NO: 1197670 - protein, 9 aa, Homo Sapiens
EGLDLEPEC

SEQ ID NO: 1197671 - protein, 9 aa, Homo Sapiens
DHQDIKENL

SEQ ID NO: 1197672 - protein, 9 aa, Homo Sapiens
MHGDGVLFH

SEQ ID NO: 1197673 - protein, 9 aa, Homo Sapiens
HPQLALHEG

SEQ ID NO: 1197674 - protein, 9 aa, Homo Sapiens
PSRHCPPPT

SEQ ID NO: 1197675 - protein, 9 aa, Homo Sapiens
PARCCRWPR

SEQ ID NO: 1197676 - protein, 9 aa, Homo Sapiens
MSNGCWGWQ

SEQ ID NO: 1197677 - protein, 9 aa, Homo Sapiens
CAKNLLSTN

SEQ ID NO: 1197678 - protein, 9 aa, Homo Sapiens
TMDFLKCVP

SEQ ID NO: 1197679 - protein, 9 aa, Homo Sapiens
PPSGVKRLP

SEQ ID NO: 1197680 - protein, 9 aa, Homo Sapiens
VVKVWMRVK

SEQ ID NO: 1197681 - protein, 9 aa, Homo Sapiens
GHSTYVVPT

SEQ ID NO: 1197682 - protein, 9 aa, Homo Sapiens
GREAAGGAP

SEQ ID NO: 1197683 - protein, 9 aa, Homo Sapiens
LLEHTPTSP

SEQ ID NO: 1197684 - protein, 9 aa, Homo Sapiens
QFGMPEGKK

SEQ ID NO: 1197685 - protein, 9 aa, Homo Sapiens
KAPRVALSR

SEQ ID NO: 1197686 - protein, 9 aa, Homo Sapiens
RVDGPVETD

SEQ ID NO: 1197687 - protein, 9 aa, Homo Sapiens
TARAPPSTP

SEQ ID NO: 1197688 - protein, 9 aa, Homo Sapiens
LYQGQWSGA

SEQ ID NO: 1197689 - protein, 9 aa, Homo Sapiens
HKCYSSVDP

SEQ ID NO: 1197690 - protein, 9 aa, Homo Sapiens
IFTDCGIHT

SEQ ID NO: 1197691 - protein, 9 aa, Homo Sapiens
PRSRCGPSR

SEQ ID NO: 1197692 - protein, 9 aa, Homo Sapiens
PRSVGGLRR

SEQ ID NO: 1197693 - protein, 9 aa, Homo Sapiens
SPCCQAPCW

SEQ ID NO: 1197694 - protein, 9 aa, Homo Sapiens
FRRRLGQAL

SEQ ID NO: 1197695 - protein, 9 aa, Homo Sapiens
MSLLASIFN

SEQ ID NO: 1197696 - protein, 9 aa, Homo Sapiens
TYVPVAPPP

SEQ ID NO: 1197697 - protein, 9 aa, Homo Sapiens
PQRGGLPPG

SEQ ID NO: 1197698 - protein, 9 aa, Homo Sapiens
VEILVVELL

SEQ ID NO: 1197699 - protein, 9 aa, Homo Sapiens
LPCRLGLDR

SEQ ID NO: 1197700 - protein, 9 aa, Homo Sapiens
ATTDANGRV

SEQ ID NO: 1197701 - protein, 9 aa, Homo Sapiens
ISKYAMPSS

SEQ ID NO: 1197702 - protein, 9 aa, Homo Sapiens
TKMAGGLHL

SEQ ID NO: 1197703 - protein, 9 aa, Homo Sapiens
PGTQAARRP

SEQ ID NO: 1197704 - protein, 9 aa, Homo Sapiens
AGKAQLRAS

SEQ ID NO: 1197705 - protein, 9 aa, Homo Sapiens
RMRKTFARY

SEQ ID NO: 1197706 - protein, 9 aa, Homo Sapiens
QGGSQPQLM

SEQ ID NO: 1197707 - protein, 9 aa, Homo Sapiens
TTDNDITLL

SEQ ID NO: 1197708 - protein, 9 aa, Homo Sapiens
AAAGGRETA

SEQ ID NO: 1197709 - protein, 9 aa, Homo Sapiens
TKELVRSQV

SEQ ID NO: 1197710 - protein, 9 aa, Homo Sapiens
TASGLKNIP

SEQ ID NO: 1197711 - protein, 9 aa, Homo Sapiens
RYLFPAAAP

SEQ ID NO: 1197712 - protein, 9 aa, Homo Sapiens
RLGDQVHID

SEQ ID NO: 1197713 - protein, 9 aa, Homo Sapiens
LGTFHDQAI

SEQ ID NO: 1197714 - protein, 9 aa, Homo Sapiens
DWEFSSVGP

SEQ ID NO: 1197715 - protein, 9 aa, Homo Sapiens
YAGRLETRW

SEQ ID NO: 1197716 - protein, 9 aa, Homo Sapiens
TSCPPLLEA

SEQ ID NO: 1197717 - protein, 9 aa, Homo Sapiens
NGSSGGGGG

SEQ ID NO: 1197718 - protein, 9 aa, Homo Sapiens
GPTIGARIA

SEQ ID NO: 1197719 - protein, 9 aa, Homo Sapiens
ILDLRFSGA

SEQ ID NO: 1197720 - protein, 9 aa, Homo Sapiens
STVLHLTLG

SEQ ID NO: 1197721 - protein, 9 aa, Homo Sapiens
FEVSHLCNF

SEQ ID NO: 1197722 - protein, 9 aa, Homo Sapiens
VQDLTPAMS

SEQ ID NO: 1197723 - protein, 9 aa, Homo Sapiens
FSFVLDVFA

SEQ ID NO: 1197724 - protein, 9 aa, Homo Sapiens
NWVLPPDIR

SEQ ID NO: 1197725 - protein, 9 aa, Homo Sapiens
VHCCSSTNS

SEQ ID NO: 1197726 - protein, 9 aa, Homo Sapiens
ANRFAYNAN

SEQ ID NO: 1197727 - protein, 9 aa, Homo Sapiens
TVELSLFSR

SEQ ID NO: 1197728 - protein, 9 aa, Homo Sapiens
REEQMECLE

SEQ ID NO: 1197729 - protein, 9 aa, Homo Sapiens
SLSLGTVLS

SEQ ID NO: 1197730 - protein, 9 aa, Homo Sapiens
AMDVGDDLK

SEQ ID NO: 1197731 - protein, 9 aa, Homo Sapiens
LADSLLIIG

SEQ ID NO: 1197732 - protein, 9 aa, Homo Sapiens
GVKVILQAM

SEQ ID NO: 1197733 - protein, 9 aa, Homo Sapiens
DDEVVAVGD

SEQ ID NO: 1197734 - protein, 9 aa, Homo Sapiens
VGVFNLTLS

SEQ ID NO: 1197735 - protein, 9 aa, Homo Sapiens
VIRLYMSRI

SEQ ID NO: 1197736 - protein, 9 aa, Homo Sapiens
PSLQQLLEL

SEQ ID NO: 1197737 - protein, 9 aa, Homo Sapiens
LHFSPPLPA

SEQ ID NO: 1197738 - protein, 9 aa, Homo Sapiens
RGHHHPQLA

SEQ ID NO: 1197739 - protein, 9 aa, Homo Sapiens
KQDADSLQQ

SEQ ID NO: 1197740 - protein, 9 aa, Homo Sapiens
VLRAVGGLR

SEQ ID NO: 1197741 - protein, 9 aa, Homo Sapiens
LPQRGTQPG

SEQ ID NO: 1197742 - protein, 9 aa, Homo Sapiens
AAFIIIHTF

SEQ ID NO: 1197743 - protein, 9 aa, Homo Sapiens
YVKEEMKKT

SEQ ID NO: 1197744 - protein, 9 aa, Homo Sapiens
PGPLSHLPP

SEQ ID NO: 1197745 - protein, 9 aa, Homo Sapiens
PTRRPRPPC

SEQ ID NO: 1197746 - protein, 9 aa, Homo Sapiens
PSRLLLGWA

SEQ ID NO: 1197747 - protein, 9 aa, Homo Sapiens
PRLTRERAA

SEQ ID NO: 1197748 - protein, 9 aa, Homo Sapiens
LRCHMLERF

SEQ ID NO: 1197749 - protein, 9 aa, Homo Sapiens
GPGAQQPGH

SEQ ID NO: 1197750 - protein, 9 aa, Homo Sapiens
CPRPPPAAP

SEQ ID NO: 1197751 - protein, 9 aa, Homo Sapiens
GSLASVRGI

SEQ ID NO: 1197752 - protein, 9 aa, Homo Sapiens
VVLRLSCPY

SEQ ID NO: 1197753 - protein, 9 aa, Homo Sapiens
IYTAALIDR

SEQ ID NO: 1197754 - protein, 9 aa, Homo Sapiens
LKPDIPPKP

SEQ ID NO: 1197755 - protein, 9 aa, Homo Sapiens
TPSTPAIRV

SEQ ID NO: 1197756 - protein, 9 aa, Homo Sapiens
KLCQLSRGR

SEQ ID NO: 1197757 - protein, 9 aa, Homo Sapiens
NLNPPTFPC

SEQ ID NO: 1197758 - protein, 9 aa, Homo Sapiens
KNGNNQKLR

SEQ ID NO: 1197759 - protein, 9 aa, Homo Sapiens
PRHWQVCPQ

SEQ ID NO: 1197760 - protein, 9 aa, Homo Sapiens
QSGFGGRAS

SEQ ID NO: 1197761 - protein, 9 aa, Homo Sapiens
EAAGTTTAA

SEQ ID NO: 1197762 - protein, 9 aa, Homo Sapiens
TAAPGQPGR

SEQ ID NO: 1197763 - protein, 9 aa, Homo Sapiens
LKMNSGVKH

SEQ ID NO: 1197764 - protein, 9 aa, Homo Sapiens
SDLPSLTSG

SEQ ID NO: 1197765 - protein, 9 aa, Homo Sapiens
IPAPRPVAG

SEQ ID NO: 1197766 - protein, 9 aa, Homo Sapiens
LCFIYVAPG

SEQ ID NO: 1197767 - protein, 9 aa, Homo Sapiens
NCTLVHEVW

SEQ ID NO: 1197768 - protein, 9 aa, Homo Sapiens
LLEKVSKKR

SEQ ID NO: 1197769 - protein, 9 aa, Homo Sapiens
PARPGATRA

SEQ ID NO: 1197770 - protein, 9 aa, Homo Sapiens
DASRGLRFV

SEQ ID NO: 1197771 - protein, 9 aa, Homo Sapiens
VGGPTMPHV

SEQ ID NO: 1197772 - protein, 9 aa, Homo Sapiens
SVNVTPQQM

SEQ ID NO: 1197773 - protein, 9 aa, Homo Sapiens
AVSGCGRAP

SEQ ID NO: 1197774 - protein, 9 aa, Homo Sapiens
SSCASCTGA

SEQ ID NO: 1197775 - protein, 9 aa, Homo Sapiens
GEIYHLYHH

SEQ ID NO: 1197776 - protein, 9 aa, Homo Sapiens
QGDHQSPIN

SEQ ID NO: 1197777 - protein, 9 aa, Homo Sapiens
EASIVILHS

SEQ ID NO: 1197778 - protein, 9 aa, Homo Sapiens
VSACEVFCF

SEQ ID NO: 1197779 - protein, 9 aa, Homo Sapiens
CALKCRAQG

SEQ ID NO: 1197780 - protein, 9 aa, Homo Sapiens
WYTMDRPPI

SEQ ID NO: 1197781 - protein, 9 aa, Homo Sapiens
NATLPGPPA

SEQ ID NO: 1197782 - protein, 9 aa, Homo Sapiens
LYPPPFPAA

SEQ ID NO: 1197783 - protein, 9 aa, Homo Sapiens
TQRQRWGYR

SEQ ID NO: 1197784 - protein, 9 aa, Homo Sapiens
VPQRTHHPH

SEQ ID NO: 1197785 - protein, 9 aa, Homo Sapiens
DLTTRVKKV

SEQ ID NO: 1197786 - protein, 9 aa, Homo Sapiens
VLRPHILGE

SEQ ID NO: 1197787 - protein, 9 aa, Homo Sapiens
FWLMCMCQL

SEQ ID NO: 1197788 - protein, 9 aa, Homo Sapiens
GKTYKQISA

SEQ ID NO: 1197789 - protein, 9 aa, Homo Sapiens
PGVPLVRTG

SEQ ID NO: 1197790 - protein, 9 aa, Homo Sapiens
SGGGEMGPG

SEQ ID NO: 1197791 - protein, 9 aa, Homo Sapiens
WNTQYPEKI

SEQ ID NO: 1197792 - protein, 9 aa, Homo Sapiens
LFKAHEVAP

SEQ ID NO: 1197793 - protein, 9 aa, Homo Sapiens
SAGGVKRSI

SEQ ID NO: 1197794 - protein, 9 aa, Homo Sapiens
DKNGDELHG

SEQ ID NO: 1197795 - protein, 9 aa, Homo Sapiens
LNNDRLTIL

SEQ ID NO: 1197796 - protein, 9 aa, Homo Sapiens
HIEELQVIQ

SEQ ID NO: 1197797 - protein, 9 aa, Homo Sapiens
VRPEGSHRC

SEQ ID NO: 1197798 - protein, 9 aa, Homo Sapiens
SRSGGRSRA

SEQ ID NO: 1197799 - protein, 9 aa, Homo Sapiens
LCEDGCQTN

SEQ ID NO: 1197800 - protein, 9 aa, Homo Sapiens
SAEPLGPVA

SEQ ID NO: 1197801 - protein, 9 aa, Homo Sapiens
WLADSLLII

SEQ ID NO: 1197802 - protein, 9 aa, Homo Sapiens
RGAPRHPHR

SEQ ID NO: 1197803 - protein, 9 aa, Homo Sapiens
FKFFWFGYC

SEQ ID NO: 1197804 - protein, 9 aa, Homo Sapiens
GESPPASLK

SEQ ID NO: 1197805 - protein, 9 aa, Homo Sapiens
APSSRPRAS

SEQ ID NO: 1197806 - protein, 9 aa, Homo Sapiens
ITSSQYSSG

SEQ ID NO: 1197807 - protein, 9 aa, Homo Sapiens
KDLRKSHLI

SEQ ID NO: 1197808 - protein, 9 aa, Homo Sapiens
LLGAASSPA

SEQ ID NO: 1197809 - protein, 9 aa, Homo Sapiens
DADGVWPCI

SEQ ID NO: 1197810 - protein, 9 aa, Homo Sapiens
PITNAASCA

SEQ ID NO: 1197811 - protein, 9 aa, Homo Sapiens
IVVVLLAAR

SEQ ID NO: 1197812 - protein, 9 aa, Homo Sapiens
KCQIVIVQY

SEQ ID NO: 1197813 - protein, 9 aa, Homo Sapiens
LPAMGGAWP

SEQ ID NO: 1197814 - protein, 9 aa, Homo Sapiens
EKEAAGTTT

SEQ ID NO: 1197815 - protein, 9 aa, Homo Sapiens
HRVTHTREI

SEQ ID NO: 1197816 - protein, 9 aa, Homo Sapiens
DSPCCQAPC

SEQ ID NO: 1197817 - protein, 9 aa, Homo Sapiens
TDICSPSTC

SEQ ID NO: 1197818 - protein, 9 aa, Homo Sapiens
RGLPCPRTT

SEQ ID NO: 1197819 - protein, 9 aa, Homo Sapiens
RPARPGATR

SEQ ID NO: 1197820 - protein, 9 aa, Homo Sapiens
WDTEYTCVK

SEQ ID NO: 1197821 - protein, 9 aa, Homo Sapiens
GCPNLLQDR

SEQ ID NO: 1197822 - protein, 9 aa, Homo Sapiens
PNKGATTRP

SEQ ID NO: 1197823 - protein, 9 aa, Homo Sapiens
PCQLHARTQ

SEQ ID NO: 1197824 - protein, 9 aa, Homo Sapiens
VMDAHSFYS

SEQ ID NO: 1197825 - protein, 9 aa, Homo Sapiens
LLRRKLKRH

SEQ ID NO: 1197826 - protein, 9 aa, Homo Sapiens
SAPRRPKAT

SEQ ID NO: 1197827 - protein, 9 aa, Homo Sapiens
VPLLEHTPT

SEQ ID NO: 1197828 - protein, 9 aa, Homo Sapiens
ALGQQRQPA

SEQ ID NO: 1197829 - protein, 9 aa, Homo Sapiens
TPTRRPRPP

SEQ ID NO: 1197830 - protein, 9 aa, Homo Sapiens
GWCQSEDAR

SEQ ID NO: 1197831 - protein, 9 aa, Homo Sapiens
AGQRGKAEE

SEQ ID NO: 1197832 - protein, 9 aa, Homo Sapiens
KDNYGLTPL

SEQ ID NO: 1197833 - protein, 9 aa, Homo Sapiens
SPRSPSRTC

SEQ ID NO: 1197834 - protein, 9 aa, Homo Sapiens
ASLAGHRGT

SEQ ID NO: 1197835 - protein, 9 aa, Homo Sapiens
DSQRGQAVV

SEQ ID NO: 1197836 - protein, 9 aa, Homo Sapiens
GGGCEYLED

SEQ ID NO: 1197837 - protein, 9 aa, Homo Sapiens
LAATSKFLR

SEQ ID NO: 1197838 - protein, 9 aa, Homo Sapiens
VTGSAACGC

SEQ ID NO: 1197839 - protein, 9 aa, Homo Sapiens
KKHTSNNLK

SEQ ID NO: 1197840 - protein, 9 aa, Homo Sapiens
DRWSELTEA

SEQ ID NO: 1197841 - protein, 9 aa, Homo Sapiens
LGVPFWVRP

SEQ ID NO: 1197842 - protein, 9 aa, Homo Sapiens
TPAEQEAGS

SEQ ID NO: 1197843 - protein, 9 aa, Homo Sapiens
GASGARETR

SEQ ID NO: 1197844 - protein, 9 aa, Homo Sapiens
TKTCNPETF

SEQ ID NO: 1197845 - protein, 9 aa, Homo Sapiens
GRVNAVASS

SEQ ID NO: 1197846 - protein, 9 aa, Homo Sapiens
RACQKQSTI

SEQ ID NO: 1197847 - protein, 9 aa, Homo Sapiens
TSCCPRSHP

SEQ ID NO: 1197848 - protein, 9 aa, Homo Sapiens
QRVHGGLWA

SEQ ID NO: 1197849 - protein, 9 aa, Homo Sapiens
TSISATSFS

SEQ ID NO: 1197850 - protein, 9 aa, Homo Sapiens
AESEIKKKQ

SEQ ID NO: 1197851 - protein, 9 aa, Homo Sapiens
QLWLALWAL

SEQ ID NO: 1197852 - protein, 9 aa, Homo Sapiens
AGAAVWGAG

SEQ ID NO: 1197853 - protein, 9 aa, Homo Sapiens
LRRRTSWKM

SEQ ID NO: 1197854 - protein, 9 aa, Homo Sapiens
AQVSADEDL

SEQ ID NO: 1197855 - protein, 9 aa, Homo Sapiens
ISTTEDTPE

SEQ ID NO: 1197856 - protein, 9 aa, Homo Sapiens
RPSTRPEAP

SEQ ID NO: 1197857 - protein, 9 aa, Homo Sapiens
PTCSFPEHF

SEQ ID NO: 1197858 - protein, 9 aa, Homo Sapiens
PKASSWASV

SEQ ID NO: 1197859 - protein, 9 aa, Homo Sapiens
GNAPLHCAA

SEQ ID NO: 1197860 - protein, 9 aa, Homo Sapiens
LVPSGEEQR

SEQ ID NO: 1197861 - protein, 9 aa, Homo Sapiens
NLASCCVIP

SEQ ID NO: 1197862 - protein, 9 aa, Homo Sapiens
SSRLCHWEG

SEQ ID NO: 1197863 - protein, 9 aa, Homo Sapiens
TDKNGDELH

SEQ ID NO: 1197864 - protein, 9 aa, Homo Sapiens
EYQASSIPP

SEQ ID NO: 1197865 - protein, 9 aa, Homo Sapiens
TAGDSGILS

SEQ ID NO: 1197866 - protein, 9 aa, Homo Sapiens
ELGLYGLEV

SEQ ID NO: 1197867 - protein, 9 aa, Homo Sapiens
GESAQAAIF

SEQ ID NO: 1197868 - protein, 9 aa, Homo Sapiens
RTAVAPKAG

SEQ ID NO: 1197869 - protein, 9 aa, Homo Sapiens
SWAASWAPP

SEQ ID NO: 1197870 - protein, 9 aa, Homo Sapiens
YSLRCAAEK

SEQ ID NO: 1197871 - protein, 9 aa, Homo Sapiens
RVQSQRSVP

SEQ ID NO: 1197872 - protein, 9 aa, Homo Sapiens
WGWRGRGPG

SEQ ID NO: 1197873 - protein, 9 aa, Homo Sapiens
SSANHVNSV

SEQ ID NO: 1197874 - protein, 9 aa, Homo Sapiens
TCRRPASPA

SEQ ID NO: 1197875 - protein, 9 aa, Homo Sapiens
DVSACEVFC

SEQ ID NO: 1197876 - protein, 9 aa, Homo Sapiens
KTVTAMAMV

SEQ ID NO: 1197877 - protein, 9 aa, Homo Sapiens
STCAPGAGH

SEQ ID NO: 1197878 - protein, 9 aa, Homo Sapiens
WLGTQLPGR

SEQ ID NO: 1197879 - protein, 9 aa, Homo Sapiens
ALRLVVNFV

SEQ ID NO: 1197880 - protein, 9 aa, Homo Sapiens
IWGQSDIAI

SEQ ID NO: 1197881 - protein, 9 aa, Homo Sapiens
LDFGEFGVG

SEQ ID NO: 1197882 - protein, 9 aa, Homo Sapiens
VSSVGGRRQ

SEQ ID NO: 1197883 - protein, 9 aa, Homo Sapiens
YSIALHFSI

SEQ ID NO: 1197884 - protein, 9 aa, Homo Sapiens
RSPKCIIHG

SEQ ID NO: 1197885 - protein, 9 aa, Homo Sapiens
STSPRASLL

SEQ ID NO: 1197886 - protein, 9 aa, Homo Sapiens
NMSAGMTQM

SEQ ID NO: 1197887 - protein, 9 aa, Homo Sapiens
YMKTLLPVS

SEQ ID NO: 1197888 - protein, 9 aa, Homo Sapiens
RHPSRPSNS

SEQ ID NO: 1197889 - protein, 9 aa, Homo Sapiens
VYQLHLHFL

SEQ ID NO: 1197890 - protein, 9 aa, Homo Sapiens
PAFMVEGGE

SEQ ID NO: 1197891 - protein, 9 aa, Homo Sapiens
LEEQTPNVQ

SEQ ID NO: 1197892 - protein, 9 aa, Homo Sapiens
KCIIHGPAP

SEQ ID NO: 1197893 - protein, 9 aa, Homo Sapiens
RPSGRPRPD

SEQ ID NO: 1197894 - protein, 9 aa, Homo Sapiens
RNLSFLTPP

SEQ ID NO: 1197895 - protein, 9 aa, Homo Sapiens
KFFWFGYCN

SEQ ID NO: 1197896 - protein, 9 aa, Homo Sapiens
PTPTEPPLP

SEQ ID NO: 1197897 - protein, 9 aa, Homo Sapiens
VIGILAVIV

SEQ ID NO: 1197898 - protein, 9 aa, Homo Sapiens
FQNPTLTPG

SEQ ID NO: 1197899 - protein, 9 aa, Homo Sapiens
SLKKHLWIH

SEQ ID NO: 1197900 - protein, 9 aa, Homo Sapiens
LPGASHQRG

SEQ ID NO: 1197901 - protein, 9 aa, Homo Sapiens
LDEMNIKII

SEQ ID NO: 1197902 - protein, 9 aa, Homo Sapiens
ETTSSKTTE

SEQ ID NO: 1197903 - protein, 9 aa, Homo Sapiens
RPRPPCSST

SEQ ID NO: 1197904 - protein, 9 aa, Homo Sapiens
AQGGEPQQQ

SEQ ID NO: 1197905 - protein, 9 aa, Homo Sapiens
WTIIYNCTL

SEQ ID NO: 1197906 - protein, 9 aa, Homo Sapiens
LRFSGAPPR

SEQ ID NO: 1197907 - protein, 9 aa, Homo Sapiens
LQPVRGHAH

SEQ ID NO: 1197908 - protein, 9 aa, Homo Sapiens
KVIYLSGYR

SEQ ID NO: 1197909 - protein, 9 aa, Homo Sapiens
QEAMTLGLW

SEQ ID NO: 1197910 - protein, 9 aa, Homo Sapiens
FTCAECGKA

SEQ ID NO: 1197911 - protein, 9 aa, Homo Sapiens
AWILYQGQW

SEQ ID NO: 1197912 - protein, 9 aa, Homo Sapiens
TLYDLSSDD

SEQ ID NO: 1197913 - protein, 9 aa, Homo Sapiens
SARVFWEGA

SEQ ID NO: 1197914 - protein, 9 aa, Homo Sapiens
QVCPQVHCC

SEQ ID NO: 1197915 - protein, 9 aa, Homo Sapiens
TLDSTWTLY

SEQ ID NO: 1197916 - protein, 9 aa, Homo Sapiens
CSDEKSPSD

SEQ ID NO: 1197917 - protein, 9 aa, Homo Sapiens
SRKMGFHVI

SEQ ID NO: 1197918 - protein, 9 aa, Homo Sapiens
QQQRQRGRP

SEQ ID NO: 1197919 - protein, 9 aa, Homo Sapiens
VPDAELHIF

SEQ ID NO: 1197920 - protein, 9 aa, Homo Sapiens
DIPPKPSFA

SEQ ID NO: 1197921 - protein, 9 aa, Homo Sapiens
TWASPCSLS

SEQ ID NO: 1197922 - protein, 9 aa, Homo Sapiens
YSPILKFFM

SEQ ID NO: 1197923 - protein, 9 aa, Homo Sapiens
YDSAASISA

SEQ ID NO: 1197924 - protein, 9 aa, Homo Sapiens
ASSAPTWGC

SEQ ID NO: 1197925 - protein, 9 aa, Homo Sapiens
VKEEMKKTT

SEQ ID NO: 1197926 - protein, 9 aa, Homo Sapiens
SDVESDPRK

SEQ ID NO: 1197927 - protein, 9 aa, Homo Sapiens
RGARPNHVL

SEQ ID NO: 1197928 - protein, 9 aa, Homo Sapiens
PKVYRLINE

SEQ ID NO: 1197929 - protein, 9 aa, Homo Sapiens
SLWECGWSP

SEQ ID NO: 1197930 - protein, 9 aa, Homo Sapiens
FSTEKMQWL

SEQ ID NO: 1197931 - protein, 9 aa, Homo Sapiens
VYLIIAICT

SEQ ID NO: 1197932 - protein, 9 aa, Homo Sapiens
MMLSLLELN

SEQ ID NO: 1197933 - protein, 9 aa, Homo Sapiens
ASMTKKSIS

SEQ ID NO: 1197934 - protein, 9 aa, Homo Sapiens
SNKFQDLLQ

SEQ ID NO: 1197935 - protein, 9 aa, Homo Sapiens
VAGQEAMTL

SEQ ID NO: 1197936 - protein, 9 aa, Homo Sapiens
WGWQQSWEI

SEQ ID NO: 1197937 - protein, 9 aa, Homo Sapiens
GHHTTPAQA

SEQ ID NO: 1197938 - protein, 9 aa, Homo Sapiens
HPGPGYLFR

SEQ ID NO: 1197939 - protein, 9 aa, Homo Sapiens
TMTAKDCSI

SEQ ID NO: 1197940 - protein, 9 aa, Homo Sapiens
MGINAEHSW

SEQ ID NO: 1197941 - protein, 9 aa, Homo Sapiens
DFKETLMAT

SEQ ID NO: 1197942 - protein, 9 aa, Homo Sapiens
NSSRNQFRQ

SEQ ID NO: 1197943 - protein, 9 aa, Homo Sapiens
GGLFNMSQL

SEQ ID NO: 1197944 - protein, 9 aa, Homo Sapiens
KYPKLLSME

SEQ ID NO: 1197945 - protein, 9 aa, Homo Sapiens
AKNTDCIWD

SEQ ID NO: 1197946 - protein, 9 aa, Homo Sapiens
TCTLWTWMT

SEQ ID NO: 1197947 - protein, 9 aa, Homo Sapiens
PQPAGYFAL

SEQ ID NO: 1197948 - protein, 9 aa, Homo Sapiens
SPAPLLAVG

SEQ ID NO: 1197949 - protein, 9 aa, Homo Sapiens
SYSQARLDV

SEQ ID NO: 1197950 - protein, 9 aa, Homo Sapiens
GKEQEEEED

SEQ ID NO: 1197951 - protein, 9 aa, Homo Sapiens
RGCPTAAPP

SEQ ID NO: 1197952 - protein, 9 aa, Homo Sapiens
VTRHKEVKN

SEQ ID NO: 1197953 - protein, 9 aa, Homo Sapiens
PTGPSSLTT

SEQ ID NO: 1197954 - protein, 9 aa, Homo Sapiens
ITLPTTSLK

SEQ ID NO: 1197955 - protein, 9 aa, Homo Sapiens
SCSSAGNNS

SEQ ID NO: 1197956 - protein, 9 aa, Homo Sapiens
ADVEPDLHL

SEQ ID NO: 1197957 - protein, 9 aa, Homo Sapiens
GGWGWRSPK

SEQ ID NO: 1197958 - protein, 9 aa, Homo Sapiens
GVMVRVGSC

SEQ ID NO: 1197959 - protein, 9 aa, Homo Sapiens
HGQTLPLLQ

SEQ ID NO: 1197960 - protein, 9 aa, Homo Sapiens
KVHLHEEKV

SEQ ID NO: 1197961 - protein, 9 aa, Homo Sapiens
MVEGGEKHV

SEQ ID NO: 1197962 - protein, 9 aa, Homo Sapiens
ETNDDNNEY

SEQ ID NO: 1197963 - protein, 9 aa, Homo Sapiens
IKKKQFYHW

SEQ ID NO: 1197964 - protein, 9 aa, Homo Sapiens
VSLFFRRVS

SEQ ID NO: 1197965 - protein, 9 aa, Homo Sapiens
LLPRLVAGA

SEQ ID NO: 1197966 - protein, 9 aa, Homo Sapiens
TFESDFPTP

SEQ ID NO: 1197967 - protein, 9 aa, Homo Sapiens
VPPGRRQYI

SEQ ID NO: 1197968 - protein, 9 aa, Homo Sapiens
GQAVVGEEH

SEQ ID NO: 1197969 - protein, 9 aa, Homo Sapiens
TRLEHSIQM

SEQ ID NO: 1197970 - protein, 9 aa, Homo Sapiens
RNLQAMSTQ

SEQ ID NO: 1197971 - protein, 9 aa, Homo Sapiens
VLQMRSLEA

SEQ ID NO: 1197972 - protein, 9 aa, Homo Sapiens
ALCRAGPTS

SEQ ID NO: 1197973 - protein, 9 aa, Homo Sapiens
ASCCVLAGM

SEQ ID NO: 1197974 - protein, 9 aa, Homo Sapiens
IRPTYSSKA

SEQ ID NO: 1197975 - protein, 9 aa, Homo Sapiens
GADMPIVIT

SEQ ID NO: 1197976 - protein, 9 aa, Homo Sapiens
GKRTAFIKD

SEQ ID NO: 1197977 - protein, 9 aa, Homo Sapiens
LLSPPEPQA

SEQ ID NO: 1197978 - protein, 9 aa, Homo Sapiens
RRGVGRCPP

SEQ ID NO: 1197979 - protein, 9 aa, Homo Sapiens
LDDSLSVKM

SEQ ID NO: 1197980 - protein, 9 aa, Homo Sapiens
LLVTDKSHS

SEQ ID NO: 1197981 - protein, 9 aa, Homo Sapiens
EAQVSADED

SEQ ID NO: 1197982 - protein, 9 aa, Homo Sapiens
PCDHVHYLR

SEQ ID NO: 1197983 - protein, 9 aa, Homo Sapiens
RKASQNAYY

SEQ ID NO: 1197984 - protein, 9 aa, Homo Sapiens
LHQRGQSNR

SEQ ID NO: 1197985 - protein, 9 aa, Homo Sapiens
RKEYLKKKW

SEQ ID NO: 1197986 - protein, 9 aa, Homo Sapiens
CSTRSVAHP

SEQ ID NO: 1197987 - protein, 9 aa, Homo Sapiens
RTWPRSVGG

SEQ ID NO: 1197988 - protein, 9 aa, Homo Sapiens
ACLIPPAGS

SEQ ID NO: 1197989 - protein, 9 aa, Homo Sapiens
WNGTTMMAT

SEQ ID NO: 1197990 - protein, 9 aa, Homo Sapiens
LLLFTLINS

SEQ ID NO: 1197991 - protein, 9 aa, Homo Sapiens
GQLFPVPGL

SEQ ID NO: 1197992 - protein, 9 aa, Homo Sapiens
NYTIELENL

SEQ ID NO: 1197993 - protein, 9 aa, Homo Sapiens
KELVRSQVD

SEQ ID NO: 1197994 - protein, 9 aa, Homo Sapiens
QVEEHFRGV

SEQ ID NO: 1197995 - protein, 9 aa, Homo Sapiens
RRTWPRSVG

SEQ ID NO: 1197996 - protein, 9 aa, Homo Sapiens
CCQQTAIHQ

SEQ ID NO: 1197997 - protein, 9 aa, Homo Sapiens
DGSDAPLEA

SEQ ID NO: 1197998 - protein, 9 aa, Homo Sapiens
HDCLTPSWE

SEQ ID NO: 1197999 - protein, 9 aa, Homo Sapiens
DALSPAPLL

SEQ ID NO: 1198000 - protein, 9 aa, Homo Sapiens
GLHCPQAPH

SEQ ID NO: 1198001 - protein, 9 aa, Homo Sapiens
LCLAVLYYI

SEQ ID NO: 1198002 - protein, 9 aa, Homo Sapiens
SAFPKPPED

SEQ ID NO: 1198003 - protein, 9 aa, Homo Sapiens
RGLALPGAE

SEQ ID NO: 1198004 - protein, 9 aa, Homo Sapiens
LDRPSCDMM

SEQ ID NO: 1198005 - protein, 9 aa, Homo Sapiens
GSAPAPTAA

SEQ ID NO: 1198006 - protein, 9 aa, Homo Sapiens
RRHPPRNGS

SEQ ID NO: 1198007 - protein, 9 aa, Homo Sapiens
FIYAIVGIA

SEQ ID NO: 1198008 - protein, 9 aa, Homo Sapiens
RAPRRGCPT

SEQ ID NO: 1198009 - protein, 9 aa, Homo Sapiens
HTGPVSSVG

SEQ ID NO: 1198010 - protein, 9 aa, Homo Sapiens
GTPRSPCPP

SEQ ID NO: 1198011 - protein, 9 aa, Homo Sapiens
QLVARPRGR

SEQ ID NO: 1198012 - protein, 9 aa, Homo Sapiens
LYCKAESFE

SEQ ID NO: 1198013 - protein, 9 aa, Homo Sapiens
PGDHADHLP

SEQ ID NO: 1198014 - protein, 9 aa, Homo Sapiens
VLWGWRPKA

SEQ ID NO: 1198015 - protein, 9 aa, Homo Sapiens
GPPPCRPRV

SEQ ID NO: 1198016 - protein, 9 aa, Homo Sapiens
PWLSPLQRS

SEQ ID NO: 1198017 - protein, 9 aa, Homo Sapiens
VGLCRPVEE

SEQ ID NO: 1198018 - protein, 9 aa, Homo Sapiens
LPRKHRGPW

SEQ ID NO: 1198019 - protein, 9 aa, Homo Sapiens
WKKELWLHS

SEQ ID NO: 1198020 - protein, 9 aa, Homo Sapiens
KRRNLQRNL

SEQ ID NO: 1198021 - protein, 9 aa, Homo Sapiens
LEKEKKKAE

SEQ ID NO: 1198022 - protein, 9 aa, Homo Sapiens
KVTGAHLLH

SEQ ID NO: 1198023 - protein, 9 aa, Homo Sapiens
TKKKPPPPP

SEQ ID NO: 1198024 - protein, 9 aa, Homo Sapiens
GTLSHQIKS

SEQ ID NO: 1198025 - protein, 9 aa, Homo Sapiens
APALKCEVN

SEQ ID NO: 1198026 - protein, 9 aa, Homo Sapiens
IKSFVQTKC

SEQ ID NO: 1198027 - protein, 9 aa, Homo Sapiens
YAMGGQDGV

SEQ ID NO: 1198028 - protein, 9 aa, Homo Sapiens
FANLQQSHL

SEQ ID NO: 1198029 - protein, 9 aa, Homo Sapiens
PVGNGCAGG

SEQ ID NO: 1198030 - protein, 9 aa, Homo Sapiens
EQCILVTNK

SEQ ID NO: 1198031 - protein, 9 aa, Homo Sapiens
GGQRTRGGA

SEQ ID NO: 1198032 - protein, 9 aa, Homo Sapiens
IKVTRSGGA

SEQ ID NO: 1198033 - protein, 9 aa, Homo Sapiens
QASSSGQHC

SEQ ID NO: 1198034 - protein, 9 aa, Homo Sapiens
VPSHPYEIT

SEQ ID NO: 1198035 - protein, 9 aa, Homo Sapiens
VGRAVWLHF

SEQ ID NO: 1198036 - protein, 9 aa, Homo Sapiens
GVRISAKEV

SEQ ID NO: 1198037 - protein, 9 aa, Homo Sapiens
ETYGTVVSL

SEQ ID NO: 1198038 - protein, 9 aa, Homo Sapiens
TSLCLPAQS

SEQ ID NO: 1198039 - protein, 9 aa, Homo Sapiens
MRMDLGECT

SEQ ID NO: 1198040 - protein, 9 aa, Homo Sapiens
PWDPGCVQA

SEQ ID NO: 1198041 - protein, 9 aa, Homo Sapiens
IAEGVGCFE

SEQ ID NO: 1198042 - protein, 9 aa, Homo Sapiens
GFLWRSNGA

SEQ ID NO: 1198043 - protein, 9 aa, Homo Sapiens
KPDIPPKPS

SEQ ID NO: 1198044 - protein, 9 aa, Homo Sapiens
PHSLTSGIL

SEQ ID NO: 1198045 - protein, 9 aa, Homo Sapiens
GTIFCLPLG

SEQ ID NO: 1198046 - protein, 9 aa, Homo Sapiens
PCKSSKSNS

SEQ ID NO: 1198047 - protein, 9 aa, Homo Sapiens
CYRRRRTFH

SEQ ID NO: 1198048 - protein, 9 aa, Homo Sapiens
HPGVGPGPH

SEQ ID NO: 1198049 - protein, 9 aa, Homo Sapiens
CCPRSHPRL

SEQ ID NO: 1198050 - protein, 9 aa, Homo Sapiens
QTPGDPAPV

SEQ ID NO: 1198051 - protein, 9 aa, Homo Sapiens
YINSPTGCK

SEQ ID NO: 1198052 - protein, 9 aa, Homo Sapiens
RPRASCSDG

SEQ ID NO: 1198053 - protein, 9 aa, Homo Sapiens
TQSLVGADR

SEQ ID NO: 1198054 - protein, 9 aa, Homo Sapiens
QAQDPTISQ

SEQ ID NO: 1198055 - protein, 9 aa, Homo Sapiens
PATQQKKNT

SEQ ID NO: 1198056 - protein, 9 aa, Homo Sapiens
HPPPSGPLR

SEQ ID NO: 1198057 - protein, 9 aa, Homo Sapiens
HFAAHDQEA

SEQ ID NO: 1198058 - protein, 9 aa, Homo Sapiens
DNSYYEQCI

SEQ ID NO: 1198059 - protein, 9 aa, Homo Sapiens
KVLPSSEDL

SEQ ID NO: 1198060 - protein, 9 aa, Homo Sapiens
RWPGCRGGL

SEQ ID NO: 1198061 - protein, 9 aa, Homo Sapiens
RSGAPMIKR

SEQ ID NO: 1198062 - protein, 9 aa, Homo Sapiens
PCSMRTGTL

SEQ ID NO: 1198063 - protein, 9 aa, Homo Sapiens
PTLEETWAS

SEQ ID NO: 1198064 - protein, 9 aa, Homo Sapiens
KKEKGTANI

SEQ ID NO: 1198065 - protein, 9 aa, Homo Sapiens
TRRPLKGRR

SEQ ID NO: 1198066 - protein, 9 aa, Homo Sapiens
AVAKVPTPP

SEQ ID NO: 1198067 - protein, 9 aa, Homo Sapiens
TAAAPTARA

SEQ ID NO: 1198068 - protein, 9 aa, Homo Sapiens
LHTLQNYLP

SEQ ID NO: 1198069 - protein, 9 aa, Homo Sapiens
CMCFQPDLV

SEQ ID NO: 1198070 - protein, 9 aa, Homo Sapiens
SELSDGITI

SEQ ID NO: 1198071 - protein, 9 aa, Homo Sapiens
PARGTARSW

SEQ ID NO: 1198072 - protein, 9 aa, Homo Sapiens
IRAVPLAFG

SEQ ID NO: 1198073 - protein, 9 aa, Homo Sapiens
EKTELSVLE

SEQ ID NO: 1198074 - protein, 9 aa, Homo Sapiens
SREGLVENG

SEQ ID NO: 1198075 - protein, 9 aa, Homo Sapiens
LETRWQARH

SEQ ID NO: 1198076 - protein, 9 aa, Homo Sapiens
VDQMWYEWE

SEQ ID NO: 1198077 - protein, 9 aa, Homo Sapiens
LYMWSFCFS

SEQ ID NO: 1198078 - protein, 9 aa, Homo Sapiens
RLCQQTEAR

SEQ ID NO: 1198079 - protein, 9 aa, Homo Sapiens
DALHGPPRT

SEQ ID NO: 1198080 - protein, 9 aa, Homo Sapiens
CCPTARGRP

SEQ ID NO: 1198081 - protein, 9 aa, Homo Sapiens
QLARKVHLH

SEQ ID NO: 1198082 - protein, 9 aa, Homo Sapiens
NFIPPQRGG

SEQ ID NO: 1198083 - protein, 9 aa, Homo Sapiens
SRLGGGRRG

SEQ ID NO: 1198084 - protein, 9 aa, Homo Sapiens
WPGLPGDHA

SEQ ID NO: 1198085 - protein, 9 aa, Homo Sapiens
CAQQAALPW

SEQ ID NO: 1198086 - protein, 9 aa, Homo Sapiens
HGKVGQCLD

SEQ ID NO: 1198087 - protein, 9 aa, Homo Sapiens
QEADLGNGH

SEQ ID NO: 1198088 - protein, 9 aa, Homo Sapiens
LWALGRPLP

SEQ ID NO: 1198089 - protein, 9 aa, Homo Sapiens
LGDQVHIDD

SEQ ID NO: 1198090 - protein, 9 aa, Homo Sapiens
DVLQTRVKT

SEQ ID NO: 1198091 - protein, 9 aa, Homo Sapiens
VKKRKRRRR

SEQ ID NO: 1198092 - protein, 9 aa, Homo Sapiens
LRIRVAALG

SEQ ID NO: 1198093 - protein, 9 aa, Homo Sapiens
GTESSLARG

SEQ ID NO: 1198094 - protein, 9 aa, Homo Sapiens
PLLLFCYIG

SEQ ID NO: 1198095 - protein, 9 aa, Homo Sapiens
HAPPAAAAR

SEQ ID NO: 1198096 - protein, 9 aa, Homo Sapiens
CGATFPHVQ

SEQ ID NO: 1198097 - protein, 9 aa, Homo Sapiens
KKACIRQDE

SEQ ID NO: 1198098 - protein, 9 aa, Homo Sapiens
MEKNGNNQK

SEQ ID NO: 1198099 - protein, 9 aa, Homo Sapiens
SELLWDILQ

SEQ ID NO: 1198100 - protein, 9 aa, Homo Sapiens
QWSGAVVGL

SEQ ID NO: 1198101 - protein, 9 aa, Homo Sapiens
CPTTSEGTS

SEQ ID NO: 1198102 - protein, 9 aa, Homo Sapiens
HCSVPEGPF

SEQ ID NO: 1198103 - protein, 9 aa, Homo Sapiens
TLTLECPFC

SEQ ID NO: 1198104 - protein, 9 aa, Homo Sapiens
GQPRQLPRD

SEQ ID NO: 1198105 - protein, 9 aa, Homo Sapiens
APPRASQPS

SEQ ID NO: 1198106 - protein, 9 aa, Homo Sapiens
EGRLDALHG

SEQ ID NO: 1198107 - protein, 9 aa, Homo Sapiens
LLKALAPLL

SEQ ID NO: 1198108 - protein, 9 aa, Homo Sapiens
LADDLIKVS

SEQ ID NO: 1198109 - protein, 9 aa, Homo Sapiens
KTRVPLKQL

SEQ ID NO: 1198110 - protein, 9 aa, Homo Sapiens
FGMPEGKKL

SEQ ID NO: 1198111 - protein, 9 aa, Homo Sapiens
GTARSWTPP

SEQ ID NO: 1198112 - protein, 9 aa, Homo Sapiens
IFKLDGLQR

SEQ ID NO: 1198113 - protein, 9 aa, Homo Sapiens
DYRVSASKR

SEQ ID NO: 1198114 - protein, 9 aa, Homo Sapiens
CRAGPTSPP

SEQ ID NO: 1198115 - protein, 9 aa, Homo Sapiens
RTKFKSIQL

SEQ ID NO: 1198116 - protein, 9 aa, Homo Sapiens
EEASAEECQ

SEQ ID NO: 1198117 - protein, 9 aa, Homo Sapiens
LAGWSSRRA

SEQ ID NO: 1198118 - protein, 9 aa, Homo Sapiens
VPPRSTFLP

SEQ ID NO: 1198119 - protein, 9 aa, Homo Sapiens
NLVYSTDIC

SEQ ID NO: 1198120 - protein, 9 aa, Homo Sapiens
PTCASPRGP

SEQ ID NO: 1198121 - protein, 9 aa, Homo Sapiens
YGKKVVVVK

SEQ ID NO: 1198122 - protein, 9 aa, Homo Sapiens
FFTWDTEYT

SEQ ID NO: 1198123 - protein, 9 aa, Homo Sapiens
KSNWRQLCG

SEQ ID NO: 1198124 - protein, 9 aa, Homo Sapiens
EQIAESYCP

SEQ ID NO: 1198125 - protein, 9 aa, Homo Sapiens
NWEKLENLY

SEQ ID NO: 1198126 - protein, 9 aa, Homo Sapiens
KDHQDIKEN

SEQ ID NO: 1198127 - protein, 9 aa, Homo Sapiens
GEYYAPALK

SEQ ID NO: 1198128 - protein, 9 aa, Homo Sapiens
KCLGGSTLS

SEQ ID NO: 1198129 - protein, 9 aa, Homo Sapiens
QFGGKRGCG

SEQ ID NO: 1198130 - protein, 9 aa, Homo Sapiens
ERHSAESSM

SEQ ID NO: 1198131 - protein, 9 aa, Homo Sapiens
KGYVRIIEA

SEQ ID NO: 1198132 - protein, 9 aa, Homo Sapiens
IRAWCRARV

SEQ ID NO: 1198133 - protein, 9 aa, Homo Sapiens
PSTGAPARC

SEQ ID NO: 1198134 - protein, 9 aa, Homo Sapiens
GGRETAAGG

SEQ ID NO: 1198135 - protein, 9 aa, Homo Sapiens
LLKWHLVEI

SEQ ID NO: 1198136 - protein, 9 aa, Homo Sapiens
GEIFRLLIS

SEQ ID NO: 1198137 - protein, 9 aa, Homo Sapiens
GLRPVAHHL

SEQ ID NO: 1198138 - protein, 9 aa, Homo Sapiens
KIEAQVSAD

SEQ ID NO: 1198139 - protein, 9 aa, Homo Sapiens
RPHAPPAAA

SEQ ID NO: 1198140 - protein, 9 aa, Homo Sapiens
IFTNYLPVA

SEQ ID NO: 1198141 - protein, 9 aa, Homo Sapiens
EPTDEGWEL

SEQ ID NO: 1198142 - protein, 9 aa, Homo Sapiens
LEPECSAAG

SEQ ID NO: 1198143 - protein, 9 aa, Homo Sapiens
EVAVGRLPV

SEQ ID NO: 1198144 - protein, 9 aa, Homo Sapiens
SKNIIRLSI

SEQ ID NO: 1198145 - protein, 9 aa, Homo Sapiens
TRKPPSPSA

SEQ ID NO: 1198146 - protein, 9 aa, Homo Sapiens
EPSSAGTQA

SEQ ID NO: 1198147 - protein, 9 aa, Homo Sapiens
YAPALKCEV

SEQ ID NO: 1198148 - protein, 9 aa, Homo Sapiens
YLPVAFQLV

SEQ ID NO: 1198149 - protein, 9 aa, Homo Sapiens
AKAVGPPSP

SEQ ID NO: 1198150 - protein, 9 aa, Homo Sapiens
GPPSPPGCD

SEQ ID NO: 1198151 - protein, 9 aa, Homo Sapiens
PPRRRSRAR

SEQ ID NO: 1198152 - protein, 9 aa, Homo Sapiens
GSDAPLEAL

SEQ ID NO: 1198153 - protein, 9 aa, Homo Sapiens
DHSYLGSVR

SEQ ID NO: 1198154 - protein, 9 aa, Homo Sapiens
KRKGKGEKK

SEQ ID NO: 1198155 - protein, 9 aa, Homo Sapiens
GLPAIVVVL

SEQ ID NO: 1198156 - protein, 9 aa, Homo Sapiens
LPGPAAGAA

SEQ ID NO: 1198157 - protein, 9 aa, Homo Sapiens
PPREGPNKG

SEQ ID NO: 1198158 - protein, 9 aa, Homo Sapiens
SRQWCTTSA

SEQ ID NO: 1198159 - protein, 9 aa, Homo Sapiens
FSSVGPYSF

SEQ ID NO: 1198160 - protein, 9 aa, Homo Sapiens
RGFLLHQPL

SEQ ID NO: 1198161 - protein, 9 aa, Homo Sapiens
AVGVGGAWA

SEQ ID NO: 1198162 - protein, 9 aa, Homo Sapiens
SRPGWKRTQ

SEQ ID NO: 1198163 - protein, 9 aa, Homo Sapiens
KDKVLVFSS

SEQ ID NO: 1198164 - protein, 9 aa, Homo Sapiens
SFLMALQCP

SEQ ID NO: 1198165 - protein, 9 aa, Homo Sapiens
AWVEGEVHA

SEQ ID NO: 1198166 - protein, 9 aa, Homo Sapiens
SFHIVIEAH

SEQ ID NO: 1198167 - protein, 9 aa, Homo Sapiens
KKKWEELKK

SEQ ID NO: 1198168 - protein, 9 aa, Homo Sapiens
ADFNWWFIF

SEQ ID NO: 1198169 - protein, 9 aa, Homo Sapiens
RPVAHHLPR

SEQ ID NO: 1198170 - protein, 9 aa, Homo Sapiens
NIFWMAMFQ

SEQ ID NO: 1198171 - protein, 9 aa, Homo Sapiens
AMAMVYVLK

SEQ ID NO: 1198172 - protein, 9 aa, Homo Sapiens
KRRRRKRKR

SEQ ID NO: 1198173 - protein, 9 aa, Homo Sapiens
RAGAGAAAR

SEQ ID NO: 1198174 - protein, 9 aa, Homo Sapiens
QTRPLWSRL

SEQ ID NO: 1198175 - protein, 9 aa, Homo Sapiens
GQVAAPGLA

SEQ ID NO: 1198176 - protein, 9 aa, Homo Sapiens
GTPRGGSAG

SEQ ID NO: 1198177 - protein, 9 aa, Homo Sapiens
SWASAAART

SEQ ID NO: 1198178 - protein, 9 aa, Homo Sapiens
CAVGLIGNT

SEQ ID NO: 1198179 - protein, 9 aa, Homo Sapiens
QKPQQMNAS

SEQ ID NO: 1198180 - protein, 9 aa, Homo Sapiens
GEDGQNLVE

SEQ ID NO: 1198181 - protein, 9 aa, Homo Sapiens
WGCLLTTVH

SEQ ID NO: 1198182 - protein, 9 aa, Homo Sapiens
FLKIMFSCN

SEQ ID NO: 1198183 - protein, 9 aa, Homo Sapiens
SSVYFRSME

SEQ ID NO: 1198184 - protein, 9 aa, Homo Sapiens
LEAHTCWQR

SEQ ID NO: 1198185 - protein, 9 aa, Homo Sapiens
PQGYTMYET

SEQ ID NO: 1198186 - protein, 9 aa, Homo Sapiens
LDARAKRYR

SEQ ID NO: 1198187 - protein, 9 aa, Homo Sapiens
LGAAAGAAP

SEQ ID NO: 1198188 - protein, 9 aa, Homo Sapiens
TRPKSSVHP

SEQ ID NO: 1198189 - protein, 9 aa, Homo Sapiens
NGIEVLKTF

SEQ ID NO: 1198190 - protein, 9 aa, Homo Sapiens
AIGGADMPI

SEQ ID NO: 1198191 - protein, 9 aa, Homo Sapiens
SRQCAHAGA

SEQ ID NO: 1198192 - protein, 9 aa, Homo Sapiens
TAASPCWLS

SEQ ID NO: 1198193 - protein, 9 aa, Homo Sapiens
WTTMMEGAV

SEQ ID NO: 1198194 - protein, 9 aa, Homo Sapiens
PVGRHRSCP

SEQ ID NO: 1198195 - protein, 9 aa, Homo Sapiens
PFPASLARK

SEQ ID NO: 1198196 - protein, 9 aa, Homo Sapiens
EKKKAEATG

SEQ ID NO: 1198197 - protein, 9 aa, Homo Sapiens
HHTQGPPHH

SEQ ID NO: 1198198 - protein, 9 aa, Homo Sapiens
MQNIEAMSS

SEQ ID NO: 1198199 - protein, 9 aa, Homo Sapiens
GLQPPAPQG

SEQ ID NO: 1198200 - protein, 9 aa, Homo Sapiens
PGLQPPAPQ

SEQ ID NO: 1198201 - protein, 9 aa, Homo Sapiens
GSISCSVRH

SEQ ID NO: 1198202 - protein, 9 aa, Homo Sapiens
RKRRRRKRK

SEQ ID NO: 1198203 - protein, 9 aa, Homo Sapiens
DCKLHLLIL

SEQ ID NO: 1198204 - protein, 9 aa, Homo Sapiens
YAGFHLTPE

SEQ ID NO: 1198205 - protein, 9 aa, Homo Sapiens
PLLEHTPTS

SEQ ID NO: 1198206 - protein, 9 aa, Homo Sapiens
VALDFWMSG

SEQ ID NO: 1198207 - protein, 9 aa, Homo Sapiens
LKPSAPNSF

SEQ ID NO: 1198208 - protein, 9 aa, Homo Sapiens
DAEAEDKML

SEQ ID NO: 1198209 - protein, 9 aa, Homo Sapiens
PHPLYFRGR

SEQ ID NO: 1198210 - protein, 9 aa, Homo Sapiens
LIYSLSNKE

SEQ ID NO: 1198211 - protein, 9 aa, Homo Sapiens
TPVLLHILE

SEQ ID NO: 1198212 - protein, 9 aa, Homo Sapiens
AAAAAHRTG

SEQ ID NO: 1198213 - protein, 9 aa, Homo Sapiens
QEIKGVQQH

SEQ ID NO: 1198214 - protein, 9 aa, Homo Sapiens
RQRRCCSLT

SEQ ID NO: 1198215 - protein, 9 aa, Homo Sapiens
LCTPPGSCG

SEQ ID NO: 1198216 - protein, 9 aa, Homo Sapiens
SVLGEYYAP

SEQ ID NO: 1198217 - protein, 9 aa, Homo Sapiens
GCRSLAITQ

SEQ ID NO: 1198218 - protein, 9 aa, Homo Sapiens
IEHYHRLRR

SEQ ID NO: 1198219 - protein, 9 aa, Homo Sapiens
RVCHANIIQ

SEQ ID NO: 1198220 - protein, 9 aa, Homo Sapiens
LSVPSAFSC

SEQ ID NO: 1198221 - protein, 9 aa, Homo Sapiens
GSSASCCVL

SEQ ID NO: 1198222 - protein, 9 aa, Homo Sapiens
LGVGVFNLT

SEQ ID NO: 1198223 - protein, 9 aa, Homo Sapiens
FVPVDYSFS

SEQ ID NO: 1198224 - protein, 9 aa, Homo Sapiens
RLLPPLLSC

SEQ ID NO: 1198225 - protein, 9 aa, Homo Sapiens
GALAAPDLA

SEQ ID NO: 1198226 - protein, 9 aa, Homo Sapiens
RLPVTPGPA

SEQ ID NO: 1198227 - protein, 9 aa, Homo Sapiens
QVPLILTPS

SEQ ID NO: 1198228 - protein, 9 aa, Homo Sapiens
SEDTLYQCG

SEQ ID NO: 1198229 - protein, 9 aa, Homo Sapiens
TTSNDKCRF

SEQ ID NO: 1198230 - protein, 9 aa, Homo Sapiens
HACRSASWR

SEQ ID NO: 1198231 - protein, 9 aa, Homo Sapiens
PRLDFHPRS

SEQ ID NO: 1198232 - protein, 9 aa, Homo Sapiens
MKLNPLMMK

SEQ ID NO: 1198233 - protein, 9 aa, Homo Sapiens
TEESSNCKN

SEQ ID NO: 1198234 - protein, 9 aa, Homo Sapiens
GLSGRKAPR

SEQ ID NO: 1198235 - protein, 9 aa, Homo Sapiens
PAAGEWTSL

SEQ ID NO: 1198236 - protein, 9 aa, Homo Sapiens
PFPGKNTWR

SEQ ID NO: 1198237 - protein, 9 aa, Homo Sapiens
LESGEAPSA

SEQ ID NO: 1198238 - protein, 9 aa, Homo Sapiens
AAAAHRTGI

SEQ ID NO: 1198239 - protein, 9 aa, Homo Sapiens
PGPGPMNPL

SEQ ID NO: 1198240 - protein, 9 aa, Homo Sapiens
CSVVRPLAC

SEQ ID NO: 1198241 - protein, 9 aa, Homo Sapiens
LSHEAGGDL

SEQ ID NO: 1198242 - protein, 9 aa, Homo Sapiens
ELPEPHGLP

SEQ ID NO: 1198243 - protein, 9 aa, Homo Sapiens
ANALLSPPE

SEQ ID NO: 1198244 - protein, 9 aa, Homo Sapiens
HKTLTSSVT

SEQ ID NO: 1198245 - protein, 9 aa, Homo Sapiens
SSGLTSQES

SEQ ID NO: 1198246 - protein, 9 aa, Homo Sapiens
THSHTRGSH

SEQ ID NO: 1198247 - protein, 9 aa, Homo Sapiens
PDHDSTAIL

SEQ ID NO: 1198248 - protein, 9 aa, Homo Sapiens
VPGAKQLTN

SEQ ID NO: 1198249 - protein, 9 aa, Homo Sapiens
HEAVSTVLH

SEQ ID NO: 1198250 - protein, 9 aa, Homo Sapiens
LGCPNLLQD

SEQ ID NO: 1198251 - protein, 9 aa, Homo Sapiens
TAERPVLGW

SEQ ID NO: 1198252 - protein, 9 aa, Homo Sapiens
AGSKISCQT

SEQ ID NO: 1198253 - protein, 9 aa, Homo Sapiens
QPGLVDRHR

SEQ ID NO: 1198254 - protein, 9 aa, Homo Sapiens
QHLWLSHRL

SEQ ID NO: 1198255 - protein, 9 aa, Homo Sapiens
CIIHGPAPA

SEQ ID NO: 1198256 - protein, 9 aa, Homo Sapiens
ARRGLALPG

SEQ ID NO: 1198257 - protein, 9 aa, Homo Sapiens
ELGVVKPGR

SEQ ID NO: 1198258 - protein, 9 aa, Homo Sapiens
DSSRVIVAS

SEQ ID NO: 1198259 - protein, 9 aa, Homo Sapiens
APALCRAGP

SEQ ID NO: 1198260 - protein, 9 aa, Homo Sapiens
EGRTSFPRI

SEQ ID NO: 1198261 - protein, 9 aa, Homo Sapiens
RATAERVEA

SEQ ID NO: 1198262 - protein, 9 aa, Homo Sapiens
SGSSFGGAQ

SEQ ID NO: 1198263 - protein, 9 aa, Homo Sapiens
RPGQLRGRA

SEQ ID NO: 1198264 - protein, 9 aa, Homo Sapiens
PRPVAGAGE

SEQ ID NO: 1198265 - protein, 9 aa, Homo Sapiens
LVSTAACLL

SEQ ID NO: 1198266 - protein, 9 aa, Homo Sapiens
PGLNVMLRS

SEQ ID NO: 1198267 - protein, 9 aa, Homo Sapiens
KEREKQQVP

SEQ ID NO: 1198268 - protein, 9 aa, Homo Sapiens
TLGSLTATS

SEQ ID NO: 1198269 - protein, 9 aa, Homo Sapiens
LSRTDQKFV

SEQ ID NO: 1198270 - protein, 9 aa, Homo Sapiens
GHRPAHAYL

SEQ ID NO: 1198271 - protein, 9 aa, Homo Sapiens
MMAALTFGC

SEQ ID NO: 1198272 - protein, 9 aa, Homo Sapiens
FYINSPTGC

SEQ ID NO: 1198273 - protein, 9 aa, Homo Sapiens
AFPGDLVAQ

SEQ ID NO: 1198274 - protein, 9 aa, Homo Sapiens
PPAPYRPCT

SEQ ID NO: 1198275 - protein, 9 aa, Homo Sapiens
VSITMQNIE

SEQ ID NO: 1198276 - protein, 9 aa, Homo Sapiens
HNIRHLPDI

SEQ ID NO: 1198277 - protein, 9 aa, Homo Sapiens
AIPKTWRRS

SEQ ID NO: 1198278 - protein, 9 aa, Homo Sapiens
TGQWMEWKI

SEQ ID NO: 1198279 - protein, 9 aa, Homo Sapiens
LHFGQALVL

SEQ ID NO: 1198280 - protein, 9 aa, Homo Sapiens
SAPNSFLTS

SEQ ID NO: 1198281 - protein, 9 aa, Homo Sapiens
TQRTAVAPK

SEQ ID NO: 1198282 - protein, 9 aa, Homo Sapiens
GSGMGMLLI

SEQ ID NO: 1198283 - protein, 9 aa, Homo Sapiens
LCVCGPGSS

SEQ ID NO: 1198284 - protein, 9 aa, Homo Sapiens
QTPPGSAPS

SEQ ID NO: 1198285 - protein, 9 aa, Homo Sapiens
TEAAEKEYL

SEQ ID NO: 1198286 - protein, 9 aa, Homo Sapiens
PGWLPRLTR

SEQ ID NO: 1198287 - protein, 9 aa, Homo Sapiens
CLTLANASS

SEQ ID NO: 1198288 - protein, 9 aa, Homo Sapiens
SGGHRPAHA

SEQ ID NO: 1198289 - protein, 9 aa, Homo Sapiens
TTELGWAGI

SEQ ID NO: 1198290 - protein, 9 aa, Homo Sapiens
NITEELFLL

SEQ ID NO: 1198291 - protein, 9 aa, Homo Sapiens
APAPLPFRA

SEQ ID NO: 1198292 - protein, 9 aa, Homo Sapiens
LRAHPGVIS

SEQ ID NO: 1198293 - protein, 9 aa, Homo Sapiens
YRFEDTGFS

SEQ ID NO: 1198294 - protein, 9 aa, Homo Sapiens
VMLAALMSL

SEQ ID NO: 1198295 - protein, 9 aa, Homo Sapiens
CRVTLDGKV

SEQ ID NO: 1198296 - protein, 9 aa, Homo Sapiens
SRTWASPCS

SEQ ID NO: 1198297 - protein, 9 aa, Homo Sapiens
HKLHLTLGA

SEQ ID NO: 1198298 - protein, 9 aa, Homo Sapiens
CTMKCDEER

SEQ ID NO: 1198299 - protein, 9 aa, Homo Sapiens
SRVIFHFCT

SEQ ID NO: 1198300 - protein, 9 aa, Homo Sapiens
LHQLVTVMN

SEQ ID NO: 1198301 - protein, 9 aa, Homo Sapiens
MGSLVPSSL

SEQ ID NO: 1198302 - protein, 9 aa, Homo Sapiens
MVCCLKTSC

SEQ ID NO: 1198303 - protein, 9 aa, Homo Sapiens
AIGGGVARV

SEQ ID NO: 1198304 - protein, 9 aa, Homo Sapiens
PLESVRQIY

SEQ ID NO: 1198305 - protein, 9 aa, Homo Sapiens
QWSPSPLSG

SEQ ID NO: 1198306 - protein, 9 aa, Homo Sapiens
SWQMKTIHC

SEQ ID NO: 1198307 - protein, 9 aa, Homo Sapiens
HSAISAPIS

SEQ ID NO: 1198308 - protein, 9 aa, Homo Sapiens
PGCDGGNGP

SEQ ID NO: 1198309 - protein, 9 aa, Homo Sapiens
VREGINIFW

SEQ ID NO: 1198310 - protein, 9 aa, Homo Sapiens
PGSCRSPRS

SEQ ID NO: 1198311 - protein, 9 aa, Homo Sapiens
PRPSAPPWP

SEQ ID NO: 1198312 - protein, 9 aa, Homo Sapiens
HLTLGADLG

SEQ ID NO: 1198313 - protein, 9 aa, Homo Sapiens
PPSSSTLER

SEQ ID NO: 1198314 - protein, 9 aa, Homo Sapiens
RQAPGYHAR

SEQ ID NO: 1198315 - protein, 9 aa, Homo Sapiens
APAARSPLT

SEQ ID NO: 1198316 - protein, 9 aa, Homo Sapiens
NGCGSSCQS

SEQ ID NO: 1198317 - protein, 9 aa, Homo Sapiens
VFTLFLVMF

SEQ ID NO: 1198318 - protein, 9 aa, Homo Sapiens
QTHNIRHLP

SEQ ID NO: 1198319 - protein, 9 aa, Homo Sapiens
PFRWRVSSS

SEQ ID NO: 1198320 - protein, 9 aa, Homo Sapiens
HSPIMATKI

SEQ ID NO: 1198321 - protein, 9 aa, Homo Sapiens
KRKIFLWTF

SEQ ID NO: 1198322 - protein, 9 aa, Homo Sapiens
VQHKGLLEE

SEQ ID NO: 1198323 - protein, 9 aa, Homo Sapiens
YRLEKETCM

SEQ ID NO: 1198324 - protein, 9 aa, Homo Sapiens
NCPMTTSAD

SEQ ID NO: 1198325 - protein, 9 aa, Homo Sapiens
KLKLRRNIP

SEQ ID NO: 1198326 - protein, 9 aa, Homo Sapiens
IQLEKELAS

SEQ ID NO: 1198327 - protein, 9 aa, Homo Sapiens
PPREARKQR

SEQ ID NO: 1198328 - protein, 9 aa, Homo Sapiens
WCPVGRHRS

SEQ ID NO: 1198329 - protein, 9 aa, Homo Sapiens
LRPFYCAEL

SEQ ID NO: 1198330 - protein, 9 aa, Homo Sapiens
PNAAQAQKK

SEQ ID NO: 1198331 - protein, 9 aa, Homo Sapiens
ICYERAGQR

SEQ ID NO: 1198332 - protein, 9 aa, Homo Sapiens
TADTTHPRS

SEQ ID NO: 1198333 - protein, 9 aa, Homo Sapiens
SRRQTRPKS

SEQ ID NO: 1198334 - protein, 9 aa, Homo Sapiens
KFATGQWME

SEQ ID NO: 1198335 - protein, 9 aa, Homo Sapiens
VEAQRLLAA

SEQ ID NO: 1198336 - protein, 9 aa, Homo Sapiens
QLPNGDWLQ

SEQ ID NO: 1198337 - protein, 9 aa, Homo Sapiens
VILHSAISA

SEQ ID NO: 1198338 - protein, 9 aa, Homo Sapiens
QPLAQLQYR

SEQ ID NO: 1198339 - protein, 9 aa, Homo Sapiens
DARAKRYRA

SEQ ID NO: 1198340 - protein, 9 aa, Homo Sapiens
GYLKNLAYL

SEQ ID NO: 1198341 - protein, 9 aa, Homo Sapiens
LACWVVHTT

SEQ ID NO: 1198342 - protein, 9 aa, Homo Sapiens
SRGGGGSRR

SEQ ID NO: 1198343 - protein, 9 aa, Homo Sapiens
KKVVKVWMR

SEQ ID NO: 1198344 - protein, 9 aa, Homo Sapiens
LPRVCHALV

SEQ ID NO: 1198345 - protein, 9 aa, Homo Sapiens
PRCTWAMSM

SEQ ID NO: 1198346 - protein, 9 aa, Homo Sapiens
PMTLLARLH

SEQ ID NO: 1198347 - protein, 9 aa, Homo Sapiens
FLLWKKRFG

SEQ ID NO: 1198348 - protein, 9 aa, Homo Sapiens
ASWAPPKRC

SEQ ID NO: 1198349 - protein, 9 aa, Homo Sapiens
MSIIKLTTL

SEQ ID NO: 1198350 - protein, 9 aa, Homo Sapiens
DLGAAFVKF

SEQ ID NO: 1198351 - protein, 9 aa, Homo Sapiens
LSIDDYFYI

SEQ ID NO: 1198352 - protein, 9 aa, Homo Sapiens
PGAHGLPVH

SEQ ID NO: 1198353 - protein, 9 aa, Homo Sapiens
DPSFNCSSG

SEQ ID NO: 1198354 - protein, 9 aa, Homo Sapiens
SLGKSDGHE

SEQ ID NO: 1198355 - protein, 9 aa, Homo Sapiens
GFKDNSHIS

SEQ ID NO: 1198356 - protein, 9 aa, Homo Sapiens
PTEPPLPTA

SEQ ID NO: 1198357 - protein, 9 aa, Homo Sapiens
GNFIPPQRG

SEQ ID NO: 1198358 - protein, 9 aa, Homo Sapiens
RWATWLSLA

SEQ ID NO: 1198359 - protein, 9 aa, Homo Sapiens
CSDGRSSAR

SEQ ID NO: 1198360 - protein, 9 aa, Homo Sapiens
SGVTAAKAG

SEQ ID NO: 1198361 - protein, 9 aa, Homo Sapiens
WRSSRRQTR

SEQ ID NO: 1198362 - protein, 9 aa, Homo Sapiens
NGVTCPATT

SEQ ID NO: 1198363 - protein, 9 aa, Homo Sapiens
QVSVARGQG

SEQ ID NO: 1198364 - protein, 9 aa, Homo Sapiens
QCIRTAEIV

SEQ ID NO: 1198365 - protein, 9 aa, Homo Sapiens
SISATSFSS

SEQ ID NO: 1198366 - protein, 9 aa, Homo Sapiens
ELQKHHSAE

SEQ ID NO: 1198367 - protein, 9 aa, Homo Sapiens
DAVASAGFS

SEQ ID NO: 1198368 - protein, 9 aa, Homo Sapiens
TSRGSSLQA

SEQ ID NO: 1198369 - protein, 9 aa, Homo Sapiens
LQTRVKTTG

SEQ ID NO: 1198370 - protein, 9 aa, Homo Sapiens
LLRGPPTAP

SEQ ID NO: 1198371 - protein, 9 aa, Homo Sapiens
PAQALHHPP

SEQ ID NO: 1198372 - protein, 9 aa, Homo Sapiens
GQEADLGNG

SEQ ID NO: 1198373 - protein, 9 aa, Homo Sapiens
GDDAPPGCL

SEQ ID NO: 1198374 - protein, 9 aa, Homo Sapiens
PDQADSLTV

SEQ ID NO: 1198375 - protein, 9 aa, Homo Sapiens
GGLDGDDEV

SEQ ID NO: 1198376 - protein, 9 aa, Homo Sapiens
RSNFRKVRS

SEQ ID NO: 1198377 - protein, 9 aa, Homo Sapiens
PHILGEGHL

SEQ ID NO: 1198378 - protein, 9 aa, Homo Sapiens
KRAMRQYLE

SEQ ID NO: 1198379 - protein, 9 aa, Homo Sapiens
SASWRSAST

SEQ ID NO: 1198380 - protein, 9 aa, Homo Sapiens
SNVSSPARR

SEQ ID NO: 1198381 - protein, 9 aa, Homo Sapiens
RSADSGGAA

SEQ ID NO: 1198382 - protein, 9 aa, Homo Sapiens
VQTKCKKNL

SEQ ID NO: 1198383 - protein, 9 aa, Homo Sapiens
HLLPLSDLP

SEQ ID NO: 1198384 - protein, 9 aa, Homo Sapiens
VIASDSEAI

SEQ ID NO: 1198385 - protein, 9 aa, Homo Sapiens
KIRDRRSSN

SEQ ID NO: 1198386 - protein, 9 aa, Homo Sapiens
QFVIADSGV

SEQ ID NO: 1198387 - protein, 9 aa, Homo Sapiens
WAPAPPTRC

SEQ ID NO: 1198388 - protein, 8 aa, Homo Sapiens
VPKLFTSQ

SEQ ID NO: 1198389 - protein, 9 aa, Homo Sapiens
GSGGVSPPS

SEQ ID NO: 1198390 - protein, 9 aa, Homo Sapiens
LRLVVNFVA

SEQ ID NO: 1198391 - protein, 9 aa, Homo Sapiens
GMSAELQGG

SEQ ID NO: 1198392 - protein, 9 aa, Homo Sapiens
MSGKQREDI

SEQ ID NO: 1198393 - protein, 9 aa, Homo Sapiens
PPTAAPMSV

SEQ ID NO: 1198394 - protein, 9 aa, Homo Sapiens
DKGKCLGGS

SEQ ID NO: 1198395 - protein, 9 aa, Homo Sapiens
VKPFLFYHA

SEQ ID NO: 1198396 - protein, 9 aa, Homo Sapiens
RPLEGAVVI

SEQ ID NO: 1198397 - protein, 9 aa, Homo Sapiens
AHRVVRKSW

SEQ ID NO: 1198398 - protein, 9 aa, Homo Sapiens
FVHPSADEF

SEQ ID NO: 1198399 - protein, 9 aa, Homo Sapiens
PTPFDRHPQ

SEQ ID NO: 1198400 - protein, 9 aa, Homo Sapiens
KVPPGWMPR

SEQ ID NO: 1198401 - protein, 9 aa, Homo Sapiens
PLAPCPPLE

SEQ ID NO: 1198402 - protein, 9 aa, Homo Sapiens
SPPPAGHPG

SEQ ID NO: 1198403 - protein, 9 aa, Homo Sapiens
EQLAQYQTN

SEQ ID NO: 1198404 - protein, 9 aa, Homo Sapiens
AGLGGSPAS

SEQ ID NO: 1198405 - protein, 9 aa, Homo Sapiens
SGDGQLFPV

SEQ ID NO: 1198406 - protein, 9 aa, Homo Sapiens
KAYDADAQE

SEQ ID NO: 1198407 - protein, 9 aa, Homo Sapiens
WHRYLFPAA

SEQ ID NO: 1198408 - protein, 9 aa, Homo Sapiens
FSGYVDNPN

SEQ ID NO: 1198409 - protein, 9 aa, Homo Sapiens
TGQAAAAGG

SEQ ID NO: 1198410 - protein, 9 aa, Homo Sapiens
GPRAPVRAW

SEQ ID NO: 1198411 - protein, 9 aa, Homo Sapiens
EIYLAYQNF

SEQ ID NO: 1198412 - protein, 9 aa, Homo Sapiens
RAGHLPAAP

SEQ ID NO: 1198413 - protein, 9 aa, Homo Sapiens
RPKGSKTRV

SEQ ID NO: 1198414 - protein, 9 aa, Homo Sapiens
EDQPAGGEL

SEQ ID NO: 1198415 - protein, 9 aa, Homo Sapiens
LSSAPGPAP

SEQ ID NO: 1198416 - protein, 9 aa, Homo Sapiens
HMYYFLKHL

SEQ ID NO: 1198417 - protein, 9 aa, Homo Sapiens
FNWWFIFTM

SEQ ID NO: 1198418 - protein, 9 aa, Homo Sapiens
RSASRLWRA

SEQ ID NO: 1198419 - protein, 9 aa, Homo Sapiens
INQTDKEKE

SEQ ID NO: 1198420 - protein, 9 aa, Homo Sapiens
IPPKPSFAP

SEQ ID NO: 1198421 - protein, 9 aa, Homo Sapiens
DAGLSGRKA

SEQ ID NO: 1198422 - protein, 9 aa, Homo Sapiens
HPRTLTLEC

SEQ ID NO: 1198423 - protein, 9 aa, Homo Sapiens
EGRGKRTAF

SEQ ID NO: 1198424 - protein, 9 aa, Homo Sapiens
LPKHLADAQ

SEQ ID NO: 1198425 - protein, 9 aa, Homo Sapiens
ECMEPQDQW

SEQ ID NO: 1198426 - protein, 9 aa, Homo Sapiens
LGDEGGRDR

SEQ ID NO: 1198427 - protein, 9 aa, Homo Sapiens
TEPPLPTAS

SEQ ID NO: 1198428 - protein, 9 aa, Homo Sapiens
RRLLGLGAA

SEQ ID NO: 1198429 - protein, 9 aa, Homo Sapiens
SSPTQLPSL

SEQ ID NO: 1198430 - protein, 9 aa, Homo Sapiens
SHPRLPGPL

SEQ ID NO: 1198431 - protein, 9 aa, Homo Sapiens
FITGQKAVK

SEQ ID NO: 1198432 - protein, 9 aa, Homo Sapiens
ARLEQLLLF

SEQ ID NO: 1198433 - protein, 9 aa, Homo Sapiens
RPPWRTSRG

SEQ ID NO: 1198434 - protein, 9 aa, Homo Sapiens
APKMIVDLS

SEQ ID NO: 1198435 - protein, 9 aa, Homo Sapiens
IIEAILNHP

SEQ ID NO: 1198436 - protein, 9 aa, Homo Sapiens
MPVHFTPLD

SEQ ID NO: 1198437 - protein, 9 aa, Homo Sapiens
LSLFSRMSI

SEQ ID NO: 1198438 - protein, 9 aa, Homo Sapiens
RPPQARGPG

SEQ ID NO: 1198439 - protein, 9 aa, Homo Sapiens
LGLGAAAGA

SEQ ID NO: 1198440 - protein, 9 aa, Homo Sapiens
VLIDVLHLV

SEQ ID NO: 1198441 - protein, 9 aa, Homo Sapiens
RSRKFPSWR

SEQ ID NO: 1198442 - protein, 9 aa, Homo Sapiens
VFHCAPPLH

SEQ ID NO: 1198443 - protein, 9 aa, Homo Sapiens
GWGAMALTR

SEQ ID NO: 1198444 - protein, 9 aa, Homo Sapiens
TVIAVEAPP

SEQ ID NO: 1198445 - protein, 9 aa, Homo Sapiens
IRGALTTRP

SEQ ID NO: 1198446 - protein, 9 aa, Homo Sapiens
FSTGPTRPP

SEQ ID NO: 1198447 - protein, 9 aa, Homo Sapiens
GLAGPARAV

SEQ ID NO: 1198448 - protein, 9 aa, Homo Sapiens
IDYVDDGKG

SEQ ID NO: 1198449 - protein, 9 aa, Homo Sapiens
ELVRSQVDK

SEQ ID NO: 1198450 - protein, 9 aa, Homo Sapiens
TNTTTVATQ

SEQ ID NO: 1198451 - protein, 9 aa, Homo Sapiens
ASIVILHSI

SEQ ID NO: 1198452 - protein, 9 aa, Homo Sapiens
LWIHSDERP

SEQ ID NO: 1198453 - protein, 9 aa, Homo Sapiens
LREERGHPS

SEQ ID NO: 1198454 - protein, 9 aa, Homo Sapiens
VPHDRADHL

SEQ ID NO: 1198455 - protein, 9 aa, Homo Sapiens
QMTYFNRST

SEQ ID NO: 1198456 - protein, 9 aa, Homo Sapiens
AIVVVLLAA

SEQ ID NO: 1198457 - protein, 9 aa, Homo Sapiens
CPFQGRHVP

SEQ ID NO: 1198458 - protein, 9 aa, Homo Sapiens
KCYSSVDPK

SEQ ID NO: 1198459 - protein, 9 aa, Homo Sapiens
FNMSQLLAN

SEQ ID NO: 1198460 - protein, 9 aa, Homo Sapiens
LRKCSLMRR

SEQ ID NO: 1198461 - protein, 9 aa, Homo Sapiens
IEEEEVEFI

SEQ ID NO: 1198462 - protein, 9 aa, Homo Sapiens
APDQADSLT

SEQ ID NO: 1198463 - protein, 9 aa, Homo Sapiens
SPLFSFVLD

SEQ ID NO: 1198464 - protein, 9 aa, Homo Sapiens
ACSHVALLS

SEQ ID NO: 1198465 - protein, 9 aa, Homo Sapiens
CPRRCQIRA

SEQ ID NO: 1198466 - protein, 9 aa, Homo Sapiens
HRDTLTMSE

SEQ ID NO: 1198467 - protein, 9 aa, Homo Sapiens
PPLGDIVGV

SEQ ID NO: 1198468 - protein, 9 aa, Homo Sapiens
MYHILRYMW

SEQ ID NO: 1198469 - protein, 9 aa, Homo Sapiens
PLSHLPPRT

SEQ ID NO: 1198470 - protein, 9 aa, Homo Sapiens
DLRFSGAPP

SEQ ID NO: 1198471 - protein, 9 aa, Homo Sapiens
LGLTYTRTL

SEQ ID NO: 1198472 - protein, 9 aa, Homo Sapiens
GARTPGASA

SEQ ID NO: 1198473 - protein, 9 aa, Homo Sapiens
PGGLFNMSQ

SEQ ID NO: 1198474 - protein, 9 aa, Homo Sapiens
VQSQRSVPS

SEQ ID NO: 1198475 - protein, 9 aa, Homo Sapiens
DHEEPELLQ

SEQ ID NO: 1198476 - protein, 9 aa, Homo Sapiens
GQRDKQHFT

SEQ ID NO: 1198477 - protein, 9 aa, Homo Sapiens
DVAPSTLMP

SEQ ID NO: 1198478 - protein, 9 aa, Homo Sapiens
HSAESSMSE

SEQ ID NO: 1198479 - protein, 9 aa, Homo Sapiens
KCHPKCTPK

SEQ ID NO: 1198480 - protein, 9 aa, Homo Sapiens
RCARTMVDK

SEQ ID NO: 1198481 - protein, 9 aa, Homo Sapiens
PARCGPWAT

SEQ ID NO: 1198482 - protein, 9 aa, Homo Sapiens
DSVEQAVYC

SEQ ID NO: 1198483 - protein, 9 aa, Homo Sapiens
SMTKKSISL

SEQ ID NO: 1198484 - protein, 9 aa, Homo Sapiens
GGAAAAAVL

SEQ ID NO: 1198485 - protein, 9 aa, Homo Sapiens
RLSCPYHPG

SEQ ID NO: 1198486 - protein, 9 aa, Homo Sapiens
VAGLSRGLS

SEQ ID NO: 1198487 - protein, 9 aa, Homo Sapiens
QASVAAWPS

SEQ ID NO: 1198488 - protein, 9 aa, Homo Sapiens
AWCEVQDRK

SEQ ID NO: 1198489 - protein, 9 aa, Homo Sapiens
AYVAIVHHN

SEQ ID NO: 1198490 - protein, 9 aa, Homo Sapiens
ESGASGRRV

SEQ ID NO: 1198491 - protein, 9 aa, Homo Sapiens
SVEQAVYCC

SEQ ID NO: 1198492 - protein, 9 aa, Homo Sapiens
MAGLQLHQR

SEQ ID NO: 1198493 - protein, 9 aa, Homo Sapiens
VEYKPPKNP

SEQ ID NO: 1198494 - protein, 9 aa, Homo Sapiens
LSHIWVGIF

SEQ ID NO: 1198495 - protein, 9 aa, Homo Sapiens
VKVWMRVKY

SEQ ID NO: 1198496 - protein, 9 aa, Homo Sapiens
MPPAKEGGR

SEQ ID NO: 1198497 - protein, 9 aa, Homo Sapiens
NKIGSLVQP

SEQ ID NO: 1198498 - protein, 9 aa, Homo Sapiens
SVGCVASIN

SEQ ID NO: 1198499 - protein, 9 aa, Homo Sapiens
HARVVGLGC

SEQ ID NO: 1198500 - protein, 9 aa, Homo Sapiens
AVGRGPTIL

SEQ ID NO: 1198501 - protein, 9 aa, Homo Sapiens
APGVCRVDE

SEQ ID NO: 1198502 - protein, 9 aa, Homo Sapiens
RMGCRSLAI

SEQ ID NO: 1198503 - protein, 9 aa, Homo Sapiens
RELINSPFR

SEQ ID NO: 1198504 - protein, 9 aa, Homo Sapiens
GNPCTKATP

SEQ ID NO: 1198505 - protein, 9 aa, Homo Sapiens
SVHVPPQTG

SEQ ID NO: 1198506 - protein, 9 aa, Homo Sapiens
AGASRGTGG

SEQ ID NO: 1198507 - protein, 9 aa, Homo Sapiens
REHSLDHSH

SEQ ID NO: 1198508 - protein, 9 aa, Homo Sapiens
APPPQPGNQ

SEQ ID NO: 1198509 - protein, 9 aa, Homo Sapiens
RLREQFLRP

SEQ ID NO: 1198510 - protein, 9 aa, Homo Sapiens
NGCAAGPKA

SEQ ID NO: 1198511 - protein, 9 aa, Homo Sapiens
KSHLIFSID

SEQ ID NO: 1198512 - protein, 9 aa, Homo Sapiens
HARFSGWCG

SEQ ID NO: 1198513 - protein, 9 aa, Homo Sapiens
LHQPLPGQH

SEQ ID NO: 1198514 - protein, 9 aa, Homo Sapiens
GYTQDVRGK

SEQ ID NO: 1198515 - protein, 9 aa, Homo Sapiens
PLQAKAYDA

SEQ ID NO: 1198516 - protein, 9 aa, Homo Sapiens
VTDKSHSKP

SEQ ID NO: 1198517 - protein, 9 aa, Homo Sapiens
LAGTAKRAR

SEQ ID NO: 1198518 - protein, 9 aa, Homo Sapiens
MPIVITVLN

SEQ ID NO: 1198519 - protein, 9 aa, Homo Sapiens
IALPSLQQL

SEQ ID NO: 1198520 - protein, 9 aa, Homo Sapiens
PPRPRPHPL

SEQ ID NO: 1198521 - protein, 9 aa, Homo Sapiens
NLKWHYYYQ

SEQ ID NO: 1198522 - protein, 9 aa, Homo Sapiens
CRSPRSTWP

SEQ ID NO: 1198523 - protein, 9 aa, Homo Sapiens
CKHRHLRFP

SEQ ID NO: 1198524 - protein, 9 aa, Homo Sapiens
GRWVHGFNS

SEQ ID NO: 1198525 - protein, 9 aa, Homo Sapiens
GGVKRSIPC

SEQ ID NO: 1198526 - protein, 9 aa, Homo Sapiens
GSKGEPGGG

SEQ ID NO: 1198527 - protein, 9 aa, Homo Sapiens
RVARVNNKV

SEQ ID NO: 1198528 - protein, 9 aa, Homo Sapiens
SGAYDWEFS

SEQ ID NO: 1198529 - protein, 9 aa, Homo Sapiens
DFLKEPKVC

SEQ ID NO: 1198530 - protein, 9 aa, Homo Sapiens
WRAPRASRS

SEQ ID NO: 1198531 - protein, 9 aa, Homo Sapiens
TLLLALVVA

SEQ ID NO: 1198532 - protein, 9 aa, Homo Sapiens
YLEAAAKFL

SEQ ID NO: 1198533 - protein, 9 aa, Homo Sapiens
SITSSSHAS

SEQ ID NO: 1198534 - protein, 9 aa, Homo Sapiens
WGCLCRAPP

SEQ ID NO: 1198535 - protein, 9 aa, Homo Sapiens
RMTARRRVS

SEQ ID NO: 1198536 - protein, 9 aa, Homo Sapiens
EKMNEVGIM

SEQ ID NO: 1198537 - protein, 9 aa, Homo Sapiens
MPFLDDDYL

SEQ ID NO: 1198538 - protein, 9 aa, Homo Sapiens
ICSPSTCQL

SEQ ID NO: 1198539 - protein, 9 aa, Homo Sapiens
QDKEGIPPT

SEQ ID NO: 1198540 - protein, 9 aa, Homo Sapiens
EKVTSYGVK

SEQ ID NO: 1198541 - protein, 9 aa, Homo Sapiens
NAFSYNSSL

SEQ ID NO: 1198542 - protein, 9 aa, Homo Sapiens
LCLAWSPRA

SEQ ID NO: 1198543 - protein, 9 aa, Homo Sapiens
YTCVKEKED

SEQ ID NO: 1198544 - protein, 9 aa, Homo Sapiens
GYGLCTMHN

SEQ ID NO: 1198545 - protein, 9 aa, Homo Sapiens
TSRGQAQDT

SEQ ID NO: 1198546 - protein, 9 aa, Homo Sapiens
SPASPAPTA

SEQ ID NO: 1198547 - protein, 9 aa, Homo Sapiens
TARSTWPRP

SEQ ID NO: 1198548 - protein, 9 aa, Homo Sapiens
KTENIREIE

SEQ ID NO: 1198549 - protein, 9 aa, Homo Sapiens
ASSWKMAAV

SEQ ID NO: 1198550 - protein, 9 aa, Homo Sapiens
LITFLTQRQ

SEQ ID NO: 1198551 - protein, 9 aa, Homo Sapiens
ARFRKRQWG

SEQ ID NO: 1198552 - protein, 9 aa, Homo Sapiens
LKEVQKYPQ

SEQ ID NO: 1198553 - protein, 9 aa, Homo Sapiens
VTALCFVLV

SEQ ID NO: 1198554 - protein, 9 aa, Homo Sapiens
AVVGLRPVA

SEQ ID NO: 1198555 - protein, 9 aa, Homo Sapiens
MLRSQSSVL

SEQ ID NO: 1198556 - protein, 9 aa, Homo Sapiens
GWSPCDRSW

SEQ ID NO: 1198557 - protein, 9 aa, Homo Sapiens
SANDRVPYD

SEQ ID NO: 1198558 - protein, 9 aa, Homo Sapiens
LDFWMSGKQ

SEQ ID NO: 1198559 - protein, 9 aa, Homo Sapiens
LVEIAPKWI

SEQ ID NO: 1198560 - protein, 9 aa, Homo Sapiens
PILKFFMVK

SEQ ID NO: 1198561 - protein, 9 aa, Homo Sapiens
YMSAASFHL

SEQ ID NO: 1198562 - protein, 9 aa, Homo Sapiens
GGGGKRAAT

SEQ ID NO: 1198563 - protein, 9 aa, Homo Sapiens
NFVLIGSFI

SEQ ID NO: 1198564 - protein, 9 aa, Homo Sapiens
KKQGGPTIG

SEQ ID NO: 1198565 - protein, 9 aa, Homo Sapiens
VRVYRPLPK

SEQ ID NO: 1198566 - protein, 9 aa, Homo Sapiens
GAADGLDLL

SEQ ID NO: 1198567 - protein, 9 aa, Homo Sapiens
RLPTKKKPP

SEQ ID NO: 1198568 - protein, 9 aa, Homo Sapiens
RVEVAAGPP

SEQ ID NO: 1198569 - protein, 9 aa, Homo Sapiens
PWLHIDIPR

SEQ ID NO: 1198570 - protein, 9 aa, Homo Sapiens
PSLLHDPMT

SEQ ID NO: 1198571 - protein, 9 aa, Homo Sapiens
DDGKGIRRV

SEQ ID NO: 1198572 - protein, 9 aa, Homo Sapiens
VIPSNVSSP

SEQ ID NO: 1198573 - protein, 9 aa, Homo Sapiens
CTVFSTMGY

SEQ ID NO: 1198574 - protein, 9 aa, Homo Sapiens
LIALPSLQQ

SEQ ID NO: 1198575 - protein, 9 aa, Homo Sapiens
GTPAEQEAG

SEQ ID NO: 1198576 - protein, 9 aa, Homo Sapiens
ESPPASLKN

SEQ ID NO: 1198577 - protein, 9 aa, Homo Sapiens
PEWYDFFYR

SEQ ID NO: 1198578 - protein, 9 aa, Homo Sapiens
ASYDYVRRC

SEQ ID NO: 1198579 - protein, 9 aa, Homo Sapiens
SLVIWVTNW

SEQ ID NO: 1198580 - protein, 9 aa, Homo Sapiens
AWTIIYNCT

SEQ ID NO: 1198581 - protein, 9 aa, Homo Sapiens
PQLRGHAQM

SEQ ID NO: 1198582 - protein, 9 aa, Homo Sapiens
PQAFNGLMS

SEQ ID NO: 1198583 - protein, 9 aa, Homo Sapiens
KNSSRNQFR

SEQ ID NO: 1198584 - protein, 9 aa, Homo Sapiens
HDFRGEIFR

SEQ ID NO: 1198585 - protein, 9 aa, Homo Sapiens
VGEEHSLTA

SEQ ID NO: 1198586 - protein, 9 aa, Homo Sapiens
FSFAEHQRT

SEQ ID NO: 1198587 - protein, 9 aa, Homo Sapiens
RRPLKGRRA

SEQ ID NO: 1198588 - protein, 9 aa, Homo Sapiens
PKTTLPGLF

SEQ ID NO: 1198589 - protein, 9 aa, Homo Sapiens
QAPCPLVPT

SEQ ID NO: 1198590 - protein, 9 aa, Homo Sapiens
AMGGQDGVS

SEQ ID NO: 1198591 - protein, 9 aa, Homo Sapiens
KPSKPGKKH

SEQ ID NO: 1198592 - protein, 9 aa, Homo Sapiens
RNLPGQPNF

SEQ ID NO: 1198593 - protein, 9 aa, Homo Sapiens
SEIAGLEED

SEQ ID NO: 1198594 - protein, 9 aa, Homo Sapiens
PRHQCPASG

SEQ ID NO: 1198595 - protein, 9 aa, Homo Sapiens
LETYGTVVS

SEQ ID NO: 1198596 - protein, 9 aa, Homo Sapiens
ADGLGSKGE

SEQ ID NO: 1198597 - protein, 9 aa, Homo Sapiens
KPTLIHTNM

SEQ ID NO: 1198598 - protein, 9 aa, Homo Sapiens
QHLMDISPF

SEQ ID NO: 1198599 - protein, 9 aa, Homo Sapiens
SLTATSCLE

SEQ ID NO: 1198600 - protein, 9 aa, Homo Sapiens
ALGGIASRL

SEQ ID NO: 1198601 - protein, 9 aa, Homo Sapiens
LCPILCHPD

SEQ ID NO: 1198602 - protein, 9 aa, Homo Sapiens
DGLQRIRHG

SEQ ID NO: 1198603 - protein, 9 aa, Homo Sapiens
LPLHCGPPS

SEQ ID NO: 1198604 - protein, 9 aa, Homo Sapiens
DRAPHLGQP

SEQ ID NO: 1198605 - protein, 9 aa, Homo Sapiens
WWFGTIKSQ

SEQ ID NO: 1198606 - protein, 9 aa, Homo Sapiens
FVEFVLHLN

SEQ ID NO: 1198607 - protein, 9 aa, Homo Sapiens
CEGQVEEHF

SEQ ID NO: 1198608 - protein, 9 aa, Homo Sapiens
RDKNFSSTS

SEQ ID NO: 1198609 - protein, 9 aa, Homo Sapiens
CGWSPVLDT

SEQ ID NO: 1198610 - protein, 9 aa, Homo Sapiens
APHFSILPM

SEQ ID NO: 1198611 - protein, 9 aa, Homo Sapiens
TASLIPSQA

SEQ ID NO: 1198612 - protein, 9 aa, Homo Sapiens
VGATSTTGP

SEQ ID NO: 1198613 - protein, 9 aa, Homo Sapiens
CPRTTWSAP

SEQ ID NO: 1198614 - protein, 9 aa, Homo Sapiens
HLCNFNVIE

SEQ ID NO: 1198615 - protein, 9 aa, Homo Sapiens
PKHLADAQV

SEQ ID NO: 1198616 - protein, 9 aa, Homo Sapiens
LPPGAHGLP

SEQ ID NO: 1198617 - protein, 9 aa, Homo Sapiens
ELDSLDGGM

SEQ ID NO: 1198618 - protein, 9 aa, Homo Sapiens
LHGQSPAQE

SEQ ID NO: 1198619 - protein, 9 aa, Homo Sapiens
TDIISIFLY

SEQ ID NO: 1198620 - protein, 9 aa, Homo Sapiens
MGLPLDRLR

SEQ ID NO: 1198621 - protein, 9 aa, Homo Sapiens
LQDFFRKKL

SEQ ID NO: 1198622 - protein, 9 aa, Homo Sapiens
CDHVHYLRC

SEQ ID NO: 1198623 - protein, 9 aa, Homo Sapiens
VRHAHLSRE

SEQ ID NO: 1198624 - protein, 9 aa, Homo Sapiens
ALARQHQAL

SEQ ID NO: 1198625 - protein, 9 aa, Homo Sapiens
QLPRDRRPR

SEQ ID NO: 1198626 - protein, 9 aa, Homo Sapiens
SRCGPSRAT

SEQ ID NO: 1198627 - protein, 9 aa, Homo Sapiens
SWTSRQWCT

SEQ ID NO: 1198628 - protein, 9 aa, Homo Sapiens
NGRSRELRT

SEQ ID NO: 1198629 - protein, 9 aa, Homo Sapiens
APVGNGCAG

SEQ ID NO: 1198630 - protein, 9 aa, Homo Sapiens
LFEDIWGQS

SEQ ID NO: 1198631 - protein, 9 aa, Homo Sapiens
AAQTRRSYP

SEQ ID NO: 1198632 - protein, 9 aa, Homo Sapiens
CQAPCWTCP

SEQ ID NO: 1198633 - protein, 9 aa, Homo Sapiens
LPLPRRPRG

SEQ ID NO: 1198634 - protein, 9 aa, Homo Sapiens
AHSQPLAQL

SEQ ID NO: 1198635 - protein, 9 aa, Homo Sapiens
EIMKTAKSS

SEQ ID NO: 1198636 - protein, 9 aa, Homo Sapiens
ALPSTGPTP

SEQ ID NO: 1198637 - protein, 9 aa, Homo Sapiens
PARRGAGAQ

SEQ ID NO: 1198638 - protein, 9 aa, Homo Sapiens
ALGPWGWLG

SEQ ID NO: 1198639 - protein, 9 aa, Homo Sapiens
GQKEGDRGS

SEQ ID NO: 1198640 - protein, 9 aa, Homo Sapiens
TGQAPAGVP

SEQ ID NO: 1198641 - protein, 9 aa, Homo Sapiens
FVVLIWDIF

SEQ ID NO: 1198642 - protein, 9 aa, Homo Sapiens
GARRGLALP

SEQ ID NO: 1198643 - protein, 9 aa, Homo Sapiens
LLPLSDLPS

SEQ ID NO: 1198644 - protein, 9 aa, Homo Sapiens
WDAGLSGRK

SEQ ID NO: 1198645 - protein, 9 aa, Homo Sapiens
QCTQRQRWG

SEQ ID NO: 1198646 - protein, 9 aa, Homo Sapiens
LGVVKPGRG

SEQ ID NO: 1198647 - protein, 9 aa, Homo Sapiens
GGNGPERQL

SEQ ID NO: 1198648 - protein, 9 aa, Homo Sapiens
PGQPGRHRQ

SEQ ID NO: 1198649 - protein, 9 aa, Homo Sapiens
IIRLSIWPR

SEQ ID NO: 1198650 - protein, 9 aa, Homo Sapiens
AESRQGWLL

SEQ ID NO: 1198651 - protein, 9 aa, Homo Sapiens
DNLFNMAYG

SEQ ID NO: 1198652 - protein, 9 aa, Homo Sapiens
HLAAHYSRS

SEQ ID NO: 1198653 - protein, 9 aa, Homo Sapiens
PLPRSTCTL

SEQ ID NO: 1198654 - protein, 9 aa, Homo Sapiens
PSRSQWVMS

SEQ ID NO: 1198655 - protein, 9 aa, Homo Sapiens
DTGLPCFHG

SEQ ID NO: 1198656 - protein, 9 aa, Homo Sapiens
MAGRKRRRP

SEQ ID NO: 1198657 - protein, 9 aa, Homo Sapiens
AQAAIAFSF

SEQ ID NO: 1198658 - protein, 9 aa, Homo Sapiens
KMLHINNNK

SEQ ID NO: 1198659 - protein, 9 aa, Homo Sapiens
SFLPLPWGD

SEQ ID NO: 1198660 - protein, 9 aa, Homo Sapiens
IVDDPKADG

SEQ ID NO: 1198661 - protein, 9 aa, Homo Sapiens
LHITVLRDS

SEQ ID NO: 1198662 - protein, 9 aa, Homo Sapiens
SEVDVEVVE

SEQ ID NO: 1198663 - protein, 9 aa, Homo Sapiens
AKCLLHPLP

SEQ ID NO: 1198664 - protein, 9 aa, Homo Sapiens
WQQSWEIVM

SEQ ID NO: 1198665 - protein, 9 aa, Homo Sapiens
PNGWCQSED

SEQ ID NO: 1198666 - protein, 9 aa, Homo Sapiens
RCPPGPWAW

SEQ ID NO: 1198667 - protein, 9 aa, Homo Sapiens
ELEPWLDAE

SEQ ID NO: 1198668 - protein, 9 aa, Homo Sapiens
LLFTQFMGA

SEQ ID NO: 1198669 - protein, 9 aa, Homo Sapiens
STNATLPGP

SEQ ID NO: 1198670 - protein, 9 aa, Homo Sapiens
AMRQYLERG

SEQ ID NO: 1198671 - protein, 9 aa, Homo Sapiens
LTPAATTWA

SEQ ID NO: 1198672 - protein, 9 aa, Homo Sapiens
FGQALVLQQ

SEQ ID NO: 1198673 - protein, 9 aa, Homo Sapiens
PAPVAPGPG

SEQ ID NO: 1198674 - protein, 9 aa, Homo Sapiens
DHDSTAILS

SEQ ID NO: 1198675 - protein, 9 aa, Homo Sapiens
HLRFPPMDT

SEQ ID NO: 1198676 - protein, 9 aa, Homo Sapiens
SADMGAYGM

SEQ ID NO: 1198677 - protein, 9 aa, Homo Sapiens
PMSVGPRSS

SEQ ID NO: 1198678 - protein, 9 aa, Homo Sapiens
FNSHCQERP

SEQ ID NO: 1198679 - protein, 9 aa, Homo Sapiens
WELFCLEHD

SEQ ID NO: 1198680 - protein, 9 aa, Homo Sapiens
SMRNTSVVK

SEQ ID NO: 1198681 - protein, 9 aa, Homo Sapiens
KDSGGRRPN

SEQ ID NO: 1198682 - protein, 9 aa, Homo Sapiens
GGVKLGVGV

SEQ ID NO: 1198683 - protein, 9 aa, Homo Sapiens
SLYPPPFPA

SEQ ID NO: 1198684 - protein, 9 aa, Homo Sapiens
TAIGGGVAR

SEQ ID NO: 1198685 - protein, 9 aa, Homo Sapiens
LISRAEIHH

SEQ ID NO: 1198686 - protein, 9 aa, Homo Sapiens
TTTTTPHPP

SEQ ID NO: 1198687 - protein, 9 aa, Homo Sapiens
KKKTCFPEA

SEQ ID NO: 1198688 - protein, 9 aa, Homo Sapiens
KDDSQNVID

SEQ ID NO: 1198689 - protein, 9 aa, Homo Sapiens
LAQRAARVD

SEQ ID NO: 1198690 - protein, 9 aa, Homo Sapiens
GFEHGGLVK

SEQ ID NO: 1198691 - protein, 9 aa, Homo Sapiens
CQLSRGRIY

SEQ ID NO: 1198692 - protein, 9 aa, Homo Sapiens
PCLPSPRSR

SEQ ID NO: 1198693 - protein, 9 aa, Homo Sapiens
VRRVAPHFS

SEQ ID NO: 1198694 - protein, 9 aa, Homo Sapiens
RIYTAALID

SEQ ID NO: 1198695 - protein, 9 aa, Homo Sapiens
EAVGLINAG

SEQ ID NO: 1198696 - protein, 9 aa, Homo Sapiens
VAVGDHHVR

SEQ ID NO: 1198697 - protein, 9 aa, Homo Sapiens
CPPGPWAWR

SEQ ID NO: 1198698 - protein, 9 aa, Homo Sapiens
ERTAETRVP

SEQ ID NO: 1198699 - protein, 9 aa, Homo Sapiens
QFDEQTLKR

SEQ ID NO: 1198700 - protein, 9 aa, Homo Sapiens
GAQQQLQAF

SEQ ID NO: 1198701 - protein, 9 aa, Homo Sapiens
GPMPGSCRS

SEQ ID NO: 1198702 - protein, 9 aa, Homo Sapiens
PTVDVYYAV

SEQ ID NO: 1198703 - protein, 9 aa, Homo Sapiens
IKKSKEAPP

SEQ ID NO: 1198704 - protein, 9 aa, Homo Sapiens
YVLVCSALP

SEQ ID NO: 1198705 - protein, 9 aa, Homo Sapiens
AGARGGARR

SEQ ID NO: 1198706 - protein, 9 aa, Homo Sapiens
GGPGDFPKI

SEQ ID NO: 1198707 - protein, 9 aa, Homo Sapiens
IACLMPLVA

SEQ ID NO: 1198708 - protein, 9 aa, Homo Sapiens
TNEEKRQCR

SEQ ID NO: 1198709 - protein, 9 aa, Homo Sapiens
CIEKLQQVF

SEQ ID NO: 1198710 - protein, 9 aa, Homo Sapiens
STCSTRSVA

SEQ ID NO: 1198711 - protein, 9 aa, Homo Sapiens
QKMGKVIFT

SEQ ID NO: 1198712 - protein, 9 aa, Homo Sapiens
PPTLMMSNG

SEQ ID NO: 1198713 - protein, 9 aa, Homo Sapiens
QHPEIVVHM

SEQ ID NO: 1198714 - protein, 9 aa, Homo Sapiens
EKVGIIGRT

SEQ ID NO: 1198715 - protein, 9 aa, Homo Sapiens
SPTSIQGKA

SEQ ID NO: 1198716 - protein, 9 aa, Homo Sapiens
ATQKSRQRQ

SEQ ID NO: 1198717 - protein, 9 aa, Homo Sapiens
FPVPGLPLP

SEQ ID NO: 1198718 - protein, 9 aa, Homo Sapiens
GQSSLGGGY

SEQ ID NO: 1198719 - protein, 9 aa, Homo Sapiens
MMRNSTTCM

SEQ ID NO: 1198720 - protein, 9 aa, Homo Sapiens
PLCLINIRH

SEQ ID NO: 1198721 - protein, 9 aa, Homo Sapiens
SCWAAPVIT

SEQ ID NO: 1198722 - protein, 9 aa, Homo Sapiens
DKKRRNLQR

SEQ ID NO: 1198723 - protein, 9 aa, Homo Sapiens
ENKVCAVPT

SEQ ID NO: 1198724 - protein, 9 aa, Homo Sapiens
RAHTVLSTS

SEQ ID NO: 1198725 - protein, 9 aa, Homo Sapiens
ASLIPSQAH

SEQ ID NO: 1198726 - protein, 9 aa, Homo Sapiens
TSGGGEMGP

SEQ ID NO: 1198727 - protein, 9 aa, Homo Sapiens
NRIAAVISV

SEQ ID NO: 1198728 - protein, 9 aa, Homo Sapiens
ARGSPWTGS

SEQ ID NO: 1198729 - protein, 9 aa, Homo Sapiens
GKISTTEDT

SEQ ID NO: 1198730 - protein, 9 aa, Homo Sapiens
VEERVVEGA

SEQ ID NO: 1198731 - protein, 9 aa, Homo Sapiens
LILLIIWTL

SEQ ID NO: 1198732 - protein, 9 aa, Homo Sapiens
GVAAPHPRT

SEQ ID NO: 1198733 - protein, 9 aa, Homo Sapiens
LAWLYPGQR

SEQ ID NO: 1198734 - protein, 9 aa, Homo Sapiens
AVKLLCMCF

SEQ ID NO: 1198735 - protein, 9 aa, Homo Sapiens
EAPAKESTH

SEQ ID NO: 1198736 - protein, 9 aa, Homo Sapiens
AGAGAAARS

SEQ ID NO: 1198737 - protein, 9 aa, Homo Sapiens
LLMVTIKEF

SEQ ID NO: 1198738 - protein, 9 aa, Homo Sapiens
ELGRVDGNF

SEQ ID NO: 1198739 - protein, 9 aa, Homo Sapiens
PRASLRATV

SEQ ID NO: 1198740 - protein, 9 aa, Homo Sapiens
NSYYEQCIL

SEQ ID NO: 1198741 - protein, 9 aa, Homo Sapiens
ADGAAPSSR

SEQ ID NO: 1198742 - protein, 9 aa, Homo Sapiens
SLDRPSCDM

SEQ ID NO: 1198743 - protein, 9 aa, Homo Sapiens
LVDGGGSGG

SEQ ID NO: 1198744 - protein, 9 aa, Homo Sapiens
SSNEEIHLV

SEQ ID NO: 1198745 - protein, 9 aa, Homo Sapiens
SFLPQRGTQ

SEQ ID NO: 1198746 - protein, 9 aa, Homo Sapiens
WPTQTWTRL

SEQ ID NO: 1198747 - protein, 9 aa, Homo Sapiens
IRVAALGQQ

SEQ ID NO: 1198748 - protein, 9 aa, Homo Sapiens
GLNRGFTYA

SEQ ID NO: 1198749 - protein, 9 aa, Homo Sapiens
NPNDRCFGI

SEQ ID NO: 1198750 - protein, 9 aa, Homo Sapiens
RGVGRCPPG

SEQ ID NO: 1198751 - protein, 9 aa, Homo Sapiens
PASTGAVKA

SEQ ID NO: 1198752 - protein, 9 aa, Homo Sapiens
VGRDVKALR

SEQ ID NO: 1198753 - protein, 9 aa, Homo Sapiens
RGHLLVQDV

SEQ ID NO: 1198754 - protein, 9 aa, Homo Sapiens
EIKGVQQHL

SEQ ID NO: 1198755 - protein, 9 aa, Homo Sapiens
RATGSPRTR

SEQ ID NO: 1198756 - protein, 9 aa, Homo Sapiens
EATSWSCQP

SEQ ID NO: 1198757 - protein, 9 aa, Homo Sapiens
DPRDLKSCS

SEQ ID NO: 1198758 - protein, 9 aa, Homo Sapiens
QPGNQRSNR

SEQ ID NO: 1198759 - protein, 9 aa, Homo Sapiens
LEPWLDAEV

SEQ ID NO: 1198760 - protein, 9 aa, Homo Sapiens
VQPHPKGHR

SEQ ID NO: 1198761 - protein, 9 aa, Homo Sapiens
KQYSIALHF

SEQ ID NO: 1198762 - protein, 9 aa, Homo Sapiens
PYQAANRFA

SEQ ID NO: 1198763 - protein, 9 aa, Homo Sapiens
EHTHRYEAA

SEQ ID NO: 1198764 - protein, 9 aa, Homo Sapiens
KTSCFKLDL

SEQ ID NO: 1198765 - protein, 9 aa, Homo Sapiens
TTQTCAVNC

SEQ ID NO: 1198766 - protein, 9 aa, Homo Sapiens
VQEQLQLLE

SEQ ID NO: 1198767 - protein, 9 aa, Homo Sapiens
LSPAPLLAV

SEQ ID NO: 1198768 - protein, 9 aa, Homo Sapiens
YPAIPAAQR

SEQ ID NO: 1198769 - protein, 9 aa, Homo Sapiens
LCSTHQKDK

SEQ ID NO: 1198770 - protein, 9 aa, Homo Sapiens
FDCKLHLLI

SEQ ID NO: 1198771 - protein, 9 aa, Homo Sapiens
AGRHPQWCW

SEQ ID NO: 1198772 - protein, 9 aa, Homo Sapiens
LRPHILGEG

SEQ ID NO: 1198773 - protein, 9 aa, Homo Sapiens
QGGYGKKVV

SEQ ID NO: 1198774 - protein, 9 aa, Homo Sapiens
RTGIRIFAV

SEQ ID NO: 1198775 - protein, 9 aa, Homo Sapiens
GPFLFFIRH

SEQ ID NO: 1198776 - protein, 9 aa, Homo Sapiens
CLEALDANS

SEQ ID NO: 1198777 - protein, 9 aa, Homo Sapiens
GPPSPAPGS

SEQ ID NO: 1198778 - protein, 9 aa, Homo Sapiens
FCPADPYSS

SEQ ID NO: 1198779 - protein, 9 aa, Homo Sapiens
SSSANHVNS

SEQ ID NO: 1198780 - protein, 9 aa, Homo Sapiens
ASSTSPRAS

SEQ ID NO: 1198781 - protein, 9 aa, Homo Sapiens
NRMQAVRAQ

SEQ ID NO: 1198782 - protein, 9 aa, Homo Sapiens
GLPLLDTDP

SEQ ID NO: 1198783 - protein, 9 aa, Homo Sapiens
PQASSLQKS

SEQ ID NO: 1198784 - protein, 9 aa, Homo Sapiens
QHSPHIWPV

SEQ ID NO: 1198785 - protein, 9 aa, Homo Sapiens
KENWNKLAQ

SEQ ID NO: 1198786 - protein, 9 aa, Homo Sapiens
VCCLKTSCF

SEQ ID NO: 1198787 - protein, 9 aa, Homo Sapiens
PYMNIFNQS

SEQ ID NO: 1198788 - protein, 9 aa, Homo Sapiens
RRRKRKRAN

SEQ ID NO: 1198789 - protein, 9 aa, Homo Sapiens
SADSGGAAG

SEQ ID NO: 1198790 - protein, 9 aa, Homo Sapiens
RGTLASSAA

SEQ ID NO: 1198791 - protein, 9 aa, Homo Sapiens
AWGMESKED

SEQ ID NO: 1198792 - protein, 9 aa, Homo Sapiens
AKVSTPPSC

SEQ ID NO: 1198793 - protein, 9 aa, Homo Sapiens
DKCRFSKGG

SEQ ID NO: 1198794 - protein, 9 aa, Homo Sapiens
HSCVYVCMC

SEQ ID NO: 1198795 - protein, 9 aa, Homo Sapiens
RSPPTLMMS

SEQ ID NO: 1198796 - protein, 9 aa, Homo Sapiens
GHMSELLPG

SEQ ID NO: 1198797 - protein, 9 aa, Homo Sapiens
PECSAAGAT

SEQ ID NO: 1198798 - protein, 9 aa, Homo Sapiens
HHFFCRVLS

SEQ ID NO: 1198799 - protein, 9 aa, Homo Sapiens
RWRTRCWAC

SEQ ID NO: 1198800 - protein, 9 aa, Homo Sapiens
RKAVEMHAV

SEQ ID NO: 1198801 - protein, 9 aa, Homo Sapiens
RSLEAHCPL

SEQ ID NO: 1198802 - protein, 9 aa, Homo Sapiens
WSGGALPYD

SEQ ID NO: 1198803 - protein, 9 aa, Homo Sapiens
VDQQIRTPS

SEQ ID NO: 1198804 - protein, 9 aa, Homo Sapiens
RLPRHPRSP

SEQ ID NO: 1198805 - protein, 9 aa, Homo Sapiens
RVHGGLWAH

SEQ ID NO: 1198806 - protein, 9 aa, Homo Sapiens
GIRGALTTR

SEQ ID NO: 1198807 - protein, 9 aa, Homo Sapiens
FCYIGCTVF

SEQ ID NO: 1198808 - protein, 9 aa, Homo Sapiens
QPHLRLRLP

SEQ ID NO: 1198809 - protein, 9 aa, Homo Sapiens
RRVAPHFSI

SEQ ID NO: 1198810 - protein, 9 aa, Homo Sapiens
AMAPEDHGS

SEQ ID NO: 1198811 - protein, 9 aa, Homo Sapiens
VDGSGSGGV

SEQ ID NO: 1198812 - protein, 9 aa, Homo Sapiens
SSLQKSCST

SEQ ID NO: 1198813 - protein, 9 aa, Homo Sapiens
CLSIWPRTR

SEQ ID NO: 1198814 - protein, 9 aa, Homo Sapiens
KQCVGHYNE

SEQ ID NO: 1198815 - protein, 9 aa, Homo Sapiens
LQQRPGAPG

SEQ ID NO: 1198816 - protein, 9 aa, Homo Sapiens
QQTEARVQA

SEQ ID NO: 1198817 - protein, 9 aa, Homo Sapiens
VVLAAVGVV

SEQ ID NO: 1198818 - protein, 9 aa, Homo Sapiens
YFPADATTE

SEQ ID NO: 1198819 - protein, 9 aa, Homo Sapiens
AKRYRALFR

SEQ ID NO: 1198820 - protein, 9 aa, Homo Sapiens
RVPGAKQLT

SEQ ID NO: 1198821 - protein, 9 aa, Homo Sapiens
AGVVDQPET

SEQ ID NO: 1198822 - protein, 9 aa, Homo Sapiens
ASSPAWPAV

SEQ ID NO: 1198823 - protein, 9 aa, Homo Sapiens
VGVGGAWAL

SEQ ID NO: 1198824 - protein, 9 aa, Homo Sapiens
PNGLLLYYQ

SEQ ID NO: 1198825 - protein, 9 aa, Homo Sapiens
PGPWAWRAT

SEQ ID NO: 1198826 - protein, 9 aa, Homo Sapiens
NPKGKKRQY

SEQ ID NO: 1198827 - protein, 9 aa, Homo Sapiens
ASPAPTARA

SEQ ID NO: 1198828 - protein, 9 aa, Homo Sapiens
HVQRGRAPA

SEQ ID NO: 1198829 - protein, 9 aa, Homo Sapiens
TRRNGFWRQ

SEQ ID NO: 1198830 - protein, 9 aa, Homo Sapiens
DPAPVAPGP

SEQ ID NO: 1198831 - protein, 9 aa, Homo Sapiens
FSILLCKRK

SEQ ID NO: 1198832 - protein, 9 aa, Homo Sapiens
SEGGVEGDL

SEQ ID NO: 1198833 - protein, 9 aa, Homo Sapiens
RSCRQTPPG

SEQ ID NO: 1198834 - protein, 9 aa, Homo Sapiens
QGRLIVSWT

SEQ ID NO: 1198835 - protein, 9 aa, Homo Sapiens
APEALGLGR

SEQ ID NO: 1198836 - protein, 9 aa, Homo Sapiens
RPAGRPGVP

SEQ ID NO: 1198837 - protein, 9 aa, Homo Sapiens
WERGVLQMR

SEQ ID NO: 1198838 - protein, 9 aa, Homo Sapiens
TLDIASIAV

SEQ ID NO: 1198839 - protein, 9 aa, Homo Sapiens
PPRNGSGPG

SEQ ID NO: 1198840 - protein, 9 aa, Homo Sapiens
LIGSFIAFF

SEQ ID NO: 1198841 - protein, 9 aa, Homo Sapiens
CGVVLRVVT

SEQ ID NO: 1198842 - protein, 9 aa, Homo Sapiens
GRSSRQPRL

SEQ ID NO: 1198843 - protein, 9 aa, Homo Sapiens
SLPGTTRMR

SEQ ID NO: 1198844 - protein, 9 aa, Homo Sapiens
RSPRSPSRT

SEQ ID NO: 1198845 - protein, 9 aa, Homo Sapiens
GCPGHLQEE

SEQ ID NO: 1198846 - protein, 9 aa, Homo Sapiens
DKSHSKPSQ

SEQ ID NO: 1198847 - protein, 9 aa, Homo Sapiens
EDADDPMFD

SEQ ID NO: 1198848 - protein, 9 aa, Homo Sapiens
EKTSACRPP

SEQ ID NO: 1198849 - protein, 9 aa, Homo Sapiens
VGIFRVNTP

SEQ ID NO: 1198850 - protein, 9 aa, Homo Sapiens
LSTIKSILI

SEQ ID NO: 1198851 - protein, 9 aa, Homo Sapiens
NKRAMRQYL

SEQ ID NO: 1198852 - protein, 9 aa, Homo Sapiens
GGYVGDALA

SEQ ID NO: 1198853 - protein, 9 aa, Homo Sapiens
QRDRPCQLH

SEQ ID NO: 1198854 - protein, 9 aa, Homo Sapiens
MLTQSLLLE

SEQ ID NO: 1198855 - protein, 9 aa, Homo Sapiens
HAVSGCGRA

SEQ ID NO: 1198856 - protein, 9 aa, Homo Sapiens
RPFYCAELR

SEQ ID NO: 1198857 - protein, 9 aa, Homo Sapiens
NCPSWRSGC

SEQ ID NO: 1198858 - protein, 9 aa, Homo Sapiens
DTLDSTWTL

SEQ ID NO: 1198859 - protein, 9 aa, Homo Sapiens
RITWSSSPK

SEQ ID NO: 1198860 - protein, 9 aa, Homo Sapiens
MLALQPHLR

SEQ ID NO: 1198861 - protein, 9 aa, Homo Sapiens
EISAVVDAN

SEQ ID NO: 1198862 - protein, 9 aa, Homo Sapiens
SSFGGAQAI

SEQ ID NO: 1198863 - protein, 9 aa, Homo Sapiens
DGVHEVQVP

SEQ ID NO: 1198864 - protein, 9 aa, Homo Sapiens
LGPGEADSG

SEQ ID NO: 1198865 - protein, 9 aa, Homo Sapiens
AGVNLMKEA

SEQ ID NO: 1198866 - protein, 9 aa, Homo Sapiens
VRRCLTAED

SEQ ID NO: 1198867 - protein, 9 aa, Homo Sapiens
EPRHCIEFR

SEQ ID NO: 1198868 - protein, 9 aa, Homo Sapiens
TPGTQHIEE

SEQ ID NO: 1198869 - protein, 9 aa, Homo Sapiens
SCCCPTARG

SEQ ID NO: 1198870 - protein, 9 aa, Homo Sapiens
VEPLAKCGL

SEQ ID NO: 1198871 - protein, 9 aa, Homo Sapiens
LLASLCTTV

SEQ ID NO: 1198872 - protein, 9 aa, Homo Sapiens
NPRSRATGS

SEQ ID NO: 1198873 - protein, 9 aa, Homo Sapiens
LEAQIKAAN

SEQ ID NO: 1198874 - protein, 9 aa, Homo Sapiens
RTEAGPPAL

SEQ ID NO: 1198875 - protein, 9 aa, Homo Sapiens
YFSLQLDEY

SEQ ID NO: 1198876 - protein, 9 aa, Homo Sapiens
WAPDAAGTP

SEQ ID NO: 1198877 - protein, 9 aa, Homo Sapiens
ATAAAAATS

SEQ ID NO: 1198878 - protein, 9 aa, Homo Sapiens
HCIEFRPVD

SEQ ID NO: 1198879 - protein, 9 aa, Homo Sapiens
PPPPPPPTT

SEQ ID NO: 1198880 - protein, 9 aa, Homo Sapiens
KDNKLLATN

SEQ ID NO: 1198881 - protein, 9 aa, Homo Sapiens
TTSSKTTEL

SEQ ID NO: 1198882 - protein, 9 aa, Homo Sapiens
MFSCNNKEL

SEQ ID NO: 1198883 - protein, 9 aa, Homo Sapiens
VILKTENIR

SEQ ID NO: 1198884 - protein, 9 aa, Homo Sapiens
SGDSSSSGL

SEQ ID NO: 1198885 - protein, 9 aa, Homo Sapiens
GLADWACLW

SEQ ID NO: 1198886 - protein, 9 aa, Homo Sapiens
NLSTIKSIL

SEQ ID NO: 1198887 - protein, 9 aa, Homo Sapiens
GGAWALGCQ

SEQ ID NO: 1198888 - protein, 9 aa, Homo Sapiens
PTARASSTS

SEQ ID NO: 1198889 - protein, 9 aa, Homo Sapiens
VTLQGVRAW

SEQ ID NO: 1198890 - protein, 9 aa, Homo Sapiens
IFPYPLLLA

SEQ ID NO: 1198891 - protein, 9 aa, Homo Sapiens
LVPTRAPPS

SEQ ID NO: 1198892 - protein, 9 aa, Homo Sapiens
QIKAANKAR

SEQ ID NO: 1198893 - protein, 9 aa, Homo Sapiens
QSQKNEVFW

SEQ ID NO: 1198894 - protein, 9 aa, Homo Sapiens
WLDAEVYKT

SEQ ID NO: 1198895 - protein, 9 aa, Homo Sapiens
PRRPKATSQ

SEQ ID NO: 1198896 - protein, 9 aa, Homo Sapiens
GIYCCWEEY

SEQ ID NO: 1198897 - protein, 9 aa, Homo Sapiens
MSAGMTQML

SEQ ID NO: 1198898 - protein, 9 aa, Homo Sapiens
LDVAPSTLM

SEQ ID NO: 1198899 - protein, 9 aa, Homo Sapiens
KPPRHQCPA

SEQ ID NO: 1198900 - protein, 9 aa, Homo Sapiens
EKVSKKRLP

SEQ ID NO: 1198901 - protein, 9 aa, Homo Sapiens
HHPQPKSTP

SEQ ID NO: 1198902 - protein, 9 aa, Homo Sapiens
NLQALLTHR

SEQ ID NO: 1198903 - protein, 9 aa, Homo Sapiens
TIDWLSCLQ

SEQ ID NO: 1198904 - protein, 9 aa, Homo Sapiens
PYDISAIER

SEQ ID NO: 1198905 - protein, 9 aa, Homo Sapiens
PIACLMPLV

SEQ ID NO: 1198906 - protein, 9 aa, Homo Sapiens
VDNPNKTAA

SEQ ID NO: 1198907 - protein, 9 aa, Homo Sapiens
RASFLMALQ

SEQ ID NO: 1198908 - protein, 9 aa, Homo Sapiens
KPPGHSSHI

SEQ ID NO: 1198909 - protein, 9 aa, Homo Sapiens
SWASVGVAG

SEQ ID NO: 1198910 - protein, 9 aa, Homo Sapiens
GMAYFPTIS

SEQ ID NO: 1198911 - protein, 9 aa, Homo Sapiens
QLHGKVGQC

SEQ ID NO: 1198912 - protein, 9 aa, Homo Sapiens
WTLYSSASR

SEQ ID NO: 1198913 - protein, 9 aa, Homo Sapiens
ANIKRYLRK

SEQ ID NO: 1198914 - protein, 9 aa, Homo Sapiens
RSDPLCVLA

SEQ ID NO: 1198915 - protein, 9 aa, Homo Sapiens
KGSVSEEAS

SEQ ID NO: 1198916 - protein, 9 aa, Homo Sapiens
LGSKGEPGG

SEQ ID NO: 1198917 - protein, 9 aa, Homo Sapiens
IAIAAFIII

SEQ ID NO: 1198918 - protein, 9 aa, Homo Sapiens
DLIKVSDDL

SEQ ID NO: 1198919 - protein, 9 aa, Homo Sapiens
MWMWGEQEQ

SEQ ID NO: 1198920 - protein, 9 aa, Homo Sapiens
GLRALRGGC

SEQ ID NO: 1198921 - protein, 9 aa, Homo Sapiens
GDLSVPSAF

SEQ ID NO: 1198922 - protein, 9 aa, Homo Sapiens
THILNWVLP

SEQ ID NO: 1198923 - protein, 9 aa, Homo Sapiens
SGKESVFLL

SEQ ID NO: 1198924 - protein, 9 aa, Homo Sapiens
PLCVLAPVA

SEQ ID NO: 1198925 - protein, 9 aa, Homo Sapiens
RLDFHPRSS

SEQ ID NO: 1198926 - protein, 9 aa, Homo Sapiens
VTGYSGSVI

SEQ ID NO: 1198927 - protein, 9 aa, Homo Sapiens
TCNAGCARL

SEQ ID NO: 1198928 - protein, 9 aa, Homo Sapiens
PGGPARGTA

SEQ ID NO: 1198929 - protein, 9 aa, Homo Sapiens
LAGHRGTHE

SEQ ID NO: 1198930 - protein, 9 aa, Homo Sapiens
LRAVGGLRA

SEQ ID NO: 1198931 - protein, 9 aa, Homo Sapiens
LTMSLAAHR

SEQ ID NO: 1198932 - protein, 9 aa, Homo Sapiens
IPWLNWSSC

SEQ ID NO: 1198933 - protein, 9 aa, Homo Sapiens
PAFVIVTVN

SEQ ID NO: 1198934 - protein, 9 aa, Homo Sapiens
QLHAGRQGA

SEQ ID NO: 1198935 - protein, 9 aa, Homo Sapiens
GDQVHIDDG

SEQ ID NO: 1198936 - protein, 9 aa, Homo Sapiens
TDNDITLLH

SEQ ID NO: 1198937 - protein, 9 aa, Homo Sapiens
PDVDAPGHA

SEQ ID NO: 1198938 - protein, 9 aa, Homo Sapiens
LKSTHLLLL

SEQ ID NO: 1198939 - protein, 9 aa, Homo Sapiens
FRHYGPGVC

SEQ ID NO: 1198940 - protein, 9 aa, Homo Sapiens
SLEAHCPLQ

SEQ ID NO: 1198941 - protein, 9 aa, Homo Sapiens
ICPRPPPAA

SEQ ID NO: 1198942 - protein, 9 aa, Homo Sapiens
LADLLKTYV

SEQ ID NO: 1198943 - protein, 9 aa, Homo Sapiens
DHAVVVRVY

SEQ ID NO: 1198944 - protein, 9 aa, Homo Sapiens
PCTKLMAKT

SEQ ID NO: 1198945 - protein, 9 aa, Homo Sapiens
RAGSVPQLR

SEQ ID NO: 1198946 - protein, 9 aa, Homo Sapiens
GAVGVGGAW

SEQ ID NO: 1198947 - protein, 9 aa, Homo Sapiens
ERLKGCKNK

SEQ ID NO: 1198948 - protein, 9 aa, Homo Sapiens
SKQGALTLE

SEQ ID NO: 1198949 - protein, 9 aa, Homo Sapiens
APGAGHVAG

SEQ ID NO: 1198950 - protein, 9 aa, Homo Sapiens
PAILFWQFF

SEQ ID NO: 1198951 - protein, 9 aa, Homo Sapiens
VAGPEVVGP

SEQ ID NO: 1198952 - protein, 9 aa, Homo Sapiens
KTSYLMRPK

SEQ ID NO: 1198953 - protein, 9 aa, Homo Sapiens
PLPRSPRSP

SEQ ID NO: 1198954 - protein, 9 aa, Homo Sapiens
ARTSWLSWR

SEQ ID NO: 1198955 - protein, 9 aa, Homo Sapiens
PTFNAEAMT

SEQ ID NO: 1198956 - protein, 9 aa, Homo Sapiens
EYRDIANMI

SEQ ID NO: 1198957 - protein, 9 aa, Homo Sapiens
PLPGQHLWL

SEQ ID NO: 1198958 - protein, 9 aa, Homo Sapiens
LPLPWGDCS

SEQ ID NO: 1198959 - protein, 9 aa, Homo Sapiens
KRTQQRPPW

SEQ ID NO: 1198960 - protein, 9 aa, Homo Sapiens
PFDRHPQMS

SEQ ID NO: 1198961 - protein, 9 aa, Homo Sapiens
WPVATVGAV

SEQ ID NO: 1198962 - protein, 9 aa, Homo Sapiens
GIPPAHLSM

SEQ ID NO: 1198963 - protein, 9 aa, Homo Sapiens
VWSCVCILG

SEQ ID NO: 1198964 - protein, 9 aa, Homo Sapiens
GLVSGLGGF

SEQ ID NO: 1198965 - protein, 9 aa, Homo Sapiens
KYKLPSNTG

SEQ ID NO: 1198966 - protein, 9 aa, Homo Sapiens
RPFPSALGP

SEQ ID NO: 1198967 - protein, 9 aa, Homo Sapiens
SGWRHIGIC

SEQ ID NO: 1198968 - protein, 9 aa, Homo Sapiens
PAGQQTGIP

SEQ ID NO: 1198969 - protein, 9 aa, Homo Sapiens
IMRLQLFIH

SEQ ID NO: 1198970 - protein, 9 aa, Homo Sapiens
TGMPDISGS

SEQ ID NO: 1198971 - protein, 9 aa, Homo Sapiens
PATVRPGTQ

SEQ ID NO: 1198972 - protein, 9 aa, Homo Sapiens
FKSIQLSYR

SEQ ID NO: 1198973 - protein, 9 aa, Homo Sapiens
RAPPSTPPA

SEQ ID NO: 1198974 - protein, 9 aa, Homo Sapiens
TLEEFTSLA

SEQ ID NO: 1198975 - protein, 9 aa, Homo Sapiens
PYQNRTPPR

SEQ ID NO: 1198976 - protein, 9 aa, Homo Sapiens
SPKCIIHGP

SEQ ID NO: 1198977 - protein, 9 aa, Homo Sapiens
WIKKSKEAP

SEQ ID NO: 1198978 - protein, 9 aa, Homo Sapiens
LGDPGRGRP

SEQ ID NO: 1198979 - protein, 9 aa, Homo Sapiens
KFLRKCSLM

SEQ ID NO: 1198980 - protein, 9 aa, Homo Sapiens
SPGPASTGQ

SEQ ID NO: 1198981 - protein, 9 aa, Homo Sapiens
TTSAPRRPK

SEQ ID NO: 1198982 - protein, 9 aa, Homo Sapiens
HISDTSFSL

SEQ ID NO: 1198983 - protein, 9 aa, Homo Sapiens
LSSSCLCFI

SEQ ID NO: 1198984 - protein, 9 aa, Homo Sapiens
CPKSTSMLS

SEQ ID NO: 1198985 - protein, 9 aa, Homo Sapiens
SESVSEKET

SEQ ID NO: 1198986 - protein, 9 aa, Homo Sapiens
AGAGPPGAG

SEQ ID NO: 1198987 - protein, 9 aa, Homo Sapiens
RTLLDRDAL

SEQ ID NO: 1198988 - protein, 9 aa, Homo Sapiens
SGDSCVSAH

SEQ ID NO: 1198989 - protein, 9 aa, Homo Sapiens
AICTVSSLL

SEQ ID NO: 1198990 - protein, 9 aa, Homo Sapiens
PHPHHTQGP

SEQ ID NO: 1198991 - protein, 9 aa, Homo Sapiens
DHQSPINII

SEQ ID NO: 1198992 - protein, 9 aa, Homo Sapiens
WSGTTQTCA

SEQ ID NO: 1198993 - protein, 9 aa, Homo Sapiens
RKEPVAMDV

SEQ ID NO: 1198994 - protein, 9 aa, Homo Sapiens
LSPPEPQAR

SEQ ID NO: 1198995 - protein, 9 aa, Homo Sapiens
ARALGLAGP

SEQ ID NO: 1198996 - protein, 9 aa, Homo Sapiens
LPSPPVPLG

SEQ ID NO: 1198997 - protein, 9 aa, Homo Sapiens
LHVALEAWG

SEQ ID NO: 1198998 - protein, 9 aa, Homo Sapiens
LFVPGGGAA

SEQ ID NO: 1198999 - protein, 9 aa, Homo Sapiens
PLKGRRAAA

SEQ ID NO: 1199000 - protein, 9 aa, Homo Sapiens
RDLVQRLPG

SEQ ID NO: 1199001 - protein, 9 aa, Homo Sapiens
GQTWTGGTL

SEQ ID NO: 1199002 - protein, 9 aa, Homo Sapiens
SHGRRQVRE

SEQ ID NO: 1199003 - protein, 9 aa, Homo Sapiens
LELKKVVKV

SEQ ID NO: 1199004 - protein, 9 aa, Homo Sapiens
ARPNHVLIH

SEQ ID NO: 1199005 - protein, 9 aa, Homo Sapiens
QITVQEQLQ

SEQ ID NO: 1199006 - protein, 9 aa, Homo Sapiens
LGAAFVKFS

SEQ ID NO: 1199007 - protein, 9 aa, Homo Sapiens
HGYWFWEGA

SEQ ID NO: 1199008 - protein, 9 aa, Homo Sapiens
CGTRRSCSG

SEQ ID NO: 1199009 - protein, 9 aa, Homo Sapiens
TLVGNTIII

SEQ ID NO: 1199010 - protein, 9 aa, Homo Sapiens
WRMLTALGF

SEQ ID NO: 1199011 - protein, 9 aa, Homo Sapiens
APEFRRWKV

SEQ ID NO: 1199012 - protein, 9 aa, Homo Sapiens
MMKKPCCGV

SEQ ID NO: 1199013 - protein, 9 aa, Homo Sapiens
RIKEERKSK

SEQ ID NO: 1199014 - protein, 9 aa, Homo Sapiens
RTTVWTAAS

SEQ ID NO: 1199015 - protein, 9 aa, Homo Sapiens
NFYPEDIVS

SEQ ID NO: 1199016 - protein, 9 aa, Homo Sapiens
FHVKDHRNK

SEQ ID NO: 1199017 - protein, 9 aa, Homo Sapiens
DKVMGPLSF

SEQ ID NO: 1199018 - protein, 9 aa, Homo Sapiens
IVATGSAVE

SEQ ID NO: 1199019 - protein, 9 aa, Homo Sapiens
EGHLRLLLQ

SEQ ID NO: 1199020 - protein, 9 aa, Homo Sapiens
LGLQEEVAV

SEQ ID NO: 1199021 - protein, 9 aa, Homo Sapiens
FIVDGPFLF

SEQ ID NO: 1199022 - protein, 9 aa, Homo Sapiens
PLPQPLPRS

SEQ ID NO: 1199023 - protein, 9 aa, Homo Sapiens
NEEIHLVDD

SEQ ID NO: 1199024 - protein, 9 aa, Homo Sapiens
TQDVRGKCI

SEQ ID NO: 1199025 - protein, 9 aa, Homo Sapiens
SAFDRYTDA

SEQ ID NO: 1199026 - protein, 9 aa, Homo Sapiens
KRTQGTPAE

SEQ ID NO: 1199027 - protein, 9 aa, Homo Sapiens
CQAMCSRSW

SEQ ID NO: 1199028 - protein, 9 aa, Homo Sapiens
GRGKRTAFI

SEQ ID NO: 1199029 - protein, 9 aa, Homo Sapiens
QTRVKTTGI

SEQ ID NO: 1199030 - protein, 9 aa, Homo Sapiens
KSCSRPCVW

SEQ ID NO: 1199031 - protein, 9 aa, Homo Sapiens
RKKRETHKA

SEQ ID NO: 1199032 - protein, 9 aa, Homo Sapiens
TMMLSLLEL

SEQ ID NO: 1199033 - protein, 9 aa, Homo Sapiens
CWTCPRAST

SEQ ID NO: 1199034 - protein, 9 aa, Homo Sapiens
TMPLAMFCL

SEQ ID NO: 1199035 - protein, 9 aa, Homo Sapiens
SHCPLLQRP

SEQ ID NO: 1199036 - protein, 9 aa, Homo Sapiens
RRSRYVWLR

SEQ ID NO: 1199037 - protein, 9 aa, Homo Sapiens
RRPPGVPLA

SEQ ID NO: 1199038 - protein, 9 aa, Homo Sapiens
TSWHRPQLR

SEQ ID NO: 1199039 - protein, 9 aa, Homo Sapiens
ARSWASAAA

SEQ ID NO: 1199040 - protein, 9 aa, Homo Sapiens
ASSWASVGV

SEQ ID NO: 1199041 - protein, 9 aa, Homo Sapiens
YVRRCLTAE

SEQ ID NO: 1199042 - protein, 9 aa, Homo Sapiens
KHVAASLHN

SEQ ID NO: 1199043 - protein, 9 aa, Homo Sapiens
HTPAEAPLP

SEQ ID NO: 1199044 - protein, 9 aa, Homo Sapiens
TVAGPRTGA

SEQ ID NO: 1199045 - protein, 9 aa, Homo Sapiens
CQSAECQPH

SEQ ID NO: 1199046 - protein, 9 aa, Homo Sapiens
VELEPWLDA

SEQ ID NO: 1199047 - protein, 9 aa, Homo Sapiens
IHRLAEAVA

SEQ ID NO: 1199048 - protein, 9 aa, Homo Sapiens
RPPLPLRPS

SEQ ID NO: 1199049 - protein, 9 aa, Homo Sapiens
MVLLHCCEL

SEQ ID NO: 1199050 - protein, 9 aa, Homo Sapiens
GTTGTLVWE

SEQ ID NO: 1199051 - protein, 9 aa, Homo Sapiens
EEEVLIPPL

SEQ ID NO: 1199052 - protein, 9 aa, Homo Sapiens
YHGREDGVH

SEQ ID NO: 1199053 - protein, 9 aa, Homo Sapiens
GPLGEAVGL

SEQ ID NO: 1199054 - protein, 9 aa, Homo Sapiens
RGFTYARYS

SEQ ID NO: 1199055 - protein, 9 aa, Homo Sapiens
NSRKFGWQM

SEQ ID NO: 1199056 - protein, 9 aa, Homo Sapiens
TPVHRPPDA

SEQ ID NO: 1199057 - protein, 9 aa, Homo Sapiens
GRIYIIILS

SEQ ID NO: 1199058 - protein, 9 aa, Homo Sapiens
YVPVAPPPQ

SEQ ID NO: 1199059 - protein, 9 aa, Homo Sapiens
PPHPHHTQG

SEQ ID NO: 1199060 - protein, 9 aa, Homo Sapiens
CSSYSYVED

SEQ ID NO: 1199061 - protein, 9 aa, Homo Sapiens
STEARSCPT

SEQ ID NO: 1199062 - protein, 9 aa, Homo Sapiens
YNLEKRTYK

SEQ ID NO: 1199063 - protein, 9 aa, Homo Sapiens
VAPKRIEEK

SEQ ID NO: 1199064 - protein, 9 aa, Homo Sapiens
DAGHLLQPV

SEQ ID NO: 1199065 - protein, 9 aa, Homo Sapiens
CARGPRAPV

SEQ ID NO: 1199066 - protein, 9 aa, Homo Sapiens
PGTTRMRHR

SEQ ID NO: 1199067 - protein, 9 aa, Homo Sapiens
VGRLPVTPG

SEQ ID NO: 1199068 - protein, 9 aa, Homo Sapiens
YPMVTRWRW

SEQ ID NO: 1199069 - protein, 9 aa, Homo Sapiens
VGPRGHLLV

SEQ ID NO: 1199070 - protein, 9 aa, Homo Sapiens
QAKYLDVGW

SEQ ID NO: 1199071 - protein, 9 aa, Homo Sapiens
GPDGVMVRV

SEQ ID NO: 1199072 - protein, 9 aa, Homo Sapiens
LPSPTHSTH

SEQ ID NO: 1199073 - protein, 9 aa, Homo Sapiens
ALGLQEEVA

SEQ ID NO: 1199074 - protein, 9 aa, Homo Sapiens
SRPHGRSSR

SEQ ID NO: 1199075 - protein, 9 aa, Homo Sapiens
ADHTMSSGV

SEQ ID NO: 1199076 - protein, 9 aa, Homo Sapiens
EHGGLVKLP

SEQ ID NO: 1199077 - protein, 9 aa, Homo Sapiens
VTTLYDLSS

SEQ ID NO: 1199078 - protein, 9 aa, Homo Sapiens
CPCPHPSGL

SEQ ID NO: 1199079 - protein, 9 aa, Homo Sapiens
PTPSARSSA

SEQ ID NO: 1199080 - protein, 9 aa, Homo Sapiens
VVNFVALAV

SEQ ID NO: 1199081 - protein, 9 aa, Homo Sapiens
PLLAVGGAS

SEQ ID NO: 1199082 - protein, 9 aa, Homo Sapiens
HLHTPMYSF

SEQ ID NO: 1199083 - protein, 9 aa, Homo Sapiens
QGQAVLLLC

SEQ ID NO: 1199084 - protein, 9 aa, Homo Sapiens
NRVHSAIWN

SEQ ID NO: 1199085 - protein, 9 aa, Homo Sapiens
PGRRRARPG

SEQ ID NO: 1199086 - protein, 9 aa, Homo Sapiens
YVRIIEAIL

SEQ ID NO: 1199087 - protein, 9 aa, Homo Sapiens
KAESFEFFF

SEQ ID NO: 1199088 - protein, 9 aa, Homo Sapiens
HCLQDSYIT

SEQ ID NO: 1199089 - protein, 9 aa, Homo Sapiens
EPQRPPRSI

SEQ ID NO: 1199090 - protein, 9 aa, Homo Sapiens
AERPVLGWR

SEQ ID NO: 1199091 - protein, 9 aa, Homo Sapiens
ERRKVVVIL

SEQ ID NO: 1199092 - protein, 9 aa, Homo Sapiens
SWTSGVGTY

SEQ ID NO: 1199093 - protein, 9 aa, Homo Sapiens
TSCGQVIII

SEQ ID NO: 1199094 - protein, 9 aa, Homo Sapiens
PRRSASRLW

SEQ ID NO: 1199095 - protein, 9 aa, Homo Sapiens
KSNYPPECT

SEQ ID NO: 1199096 - protein, 9 aa, Homo Sapiens
ASVAAWPSR

SEQ ID NO: 1199097 - protein, 9 aa, Homo Sapiens
CRSPPLDLT

SEQ ID NO: 1199098 - protein, 9 aa, Homo Sapiens
VNAVSMMTS

SEQ ID NO: 1199099 - protein, 9 aa, Homo Sapiens
FVKRRRNIL

SEQ ID NO: 1199100 - protein, 9 aa, Homo Sapiens
AAPDLAGTM

SEQ ID NO: 1199101 - protein, 9 aa, Homo Sapiens
GRKAPRVAL

SEQ ID NO: 1199102 - protein, 9 aa, Homo Sapiens
KRFHQQLNS

SEQ ID NO: 1199103 - protein, 9 aa, Homo Sapiens
DLRIRVAAL

SEQ ID NO: 1199104 - protein, 9 aa, Homo Sapiens
CCRRTSSAR

SEQ ID NO: 1199105 - protein, 9 aa, Homo Sapiens
YVGIVTVIL

SEQ ID NO: 1199106 - protein, 9 aa, Homo Sapiens
APAPAPGGY

SEQ ID NO: 1199107 - protein, 9 aa, Homo Sapiens
SPAPGSSPR

SEQ ID NO: 1199108 - protein, 9 aa, Homo Sapiens
PVWVMWMWG

SEQ ID NO: 1199109 - protein, 9 aa, Homo Sapiens
TQTWTRLPR

SEQ ID NO: 1199110 - protein, 9 aa, Homo Sapiens
LDNLFNMAY

SEQ ID NO: 1199111 - protein, 9 aa, Homo Sapiens
LESSVSFPV

SEQ ID NO: 1199112 - protein, 9 aa, Homo Sapiens
SALQREGEE

SEQ ID NO: 1199113 - protein, 9 aa, Homo Sapiens
LNYGYVGYI

SEQ ID NO: 1199114 - protein, 9 aa, Homo Sapiens
GESRHAYSS

SEQ ID NO: 1199115 - protein, 9 aa, Homo Sapiens
VIFTNYLPV

SEQ ID NO: 1199116 - protein, 9 aa, Homo Sapiens
TLMMSNGCW

SEQ ID NO: 1199117 - protein, 9 aa, Homo Sapiens
DLIAHSLVT

SEQ ID NO: 1199118 - protein, 9 aa, Homo Sapiens
PPTKKRGKS

SEQ ID NO: 1199119 - protein, 9 aa, Homo Sapiens
RYASCETGF

SEQ ID NO: 1199120 - protein, 9 aa, Homo Sapiens
LIVSTQALG

SEQ ID NO: 1199121 - protein, 9 aa, Homo Sapiens
RIHRLAEAV

SEQ ID NO: 1199122 - protein, 9 aa, Homo Sapiens
ARDVHVVAI

SEQ ID NO: 1199123 - protein, 9 aa, Homo Sapiens
ARQAVQLWA

SEQ ID NO: 1199124 - protein, 9 aa, Homo Sapiens
QPQLMQNFY

SEQ ID NO: 1199125 - protein, 9 aa, Homo Sapiens
HPARTPAPT

SEQ ID NO: 1199126 - protein, 9 aa, Homo Sapiens
RAAGATPTG

SEQ ID NO: 1199127 - protein, 9 aa, Homo Sapiens
RTCTSSSSS

SEQ ID NO: 1199128 - protein, 9 aa, Homo Sapiens
QEGEEGLRA

SEQ ID NO: 1199129 - protein, 9 aa, Homo Sapiens
GSSAAKRAA

SEQ ID NO: 1199130 - protein, 9 aa, Homo Sapiens
APGSHGRRQ

SEQ ID NO: 1199131 - protein, 9 aa, Homo Sapiens
GPSRATWAP

SEQ ID NO: 1199132 - protein, 9 aa, Homo Sapiens
WTSRQWCTT

SEQ ID NO: 1199133 - protein, 9 aa, Homo Sapiens
FYPEDIVSQ

SEQ ID NO: 1199134 - protein, 9 aa, Homo Sapiens
NLFNMAYGV

SEQ ID NO: 1199135 - protein, 9 aa, Homo Sapiens
DTCPCPHPS

SEQ ID NO: 1199136 - protein, 9 aa, Homo Sapiens
GASALHRAR

SEQ ID NO: 1199137 - protein, 9 aa, Homo Sapiens
VTLDMISKC

SEQ ID NO: 1199138 - protein, 9 aa, Homo Sapiens
PEGKKLVNY

SEQ ID NO: 1199139 - protein, 9 aa, Homo Sapiens
FVVQGFGDV

SEQ ID NO: 1199140 - protein, 9 aa, Homo Sapiens
RLHTGPVSS

SEQ ID NO: 1199141 - protein, 9 aa, Homo Sapiens
FCLPLGLGG

SEQ ID NO: 1199142 - protein, 9 aa, Homo Sapiens
YRDRKVHHM

SEQ ID NO: 1199143 - protein, 9 aa, Homo Sapiens
KRETHKALA

SEQ ID NO: 1199144 - protein, 9 aa, Homo Sapiens
SVQALDVAT

SEQ ID NO: 1199145 - protein, 9 aa, Homo Sapiens
RRIQTHGEG

SEQ ID NO: 1199146 - protein, 9 aa, Homo Sapiens
CSRPCVWSR

SEQ ID NO: 1199147 - protein, 9 aa, Homo Sapiens
ARRPWVVTA

SEQ ID NO: 1199148 - protein, 9 aa, Homo Sapiens
RLTRCCLSR

SEQ ID NO: 1199149 - protein, 9 aa, Homo Sapiens
RRAQRRCQP

SEQ ID NO: 1199150 - protein, 9 aa, Homo Sapiens
AAGCSWTCS

SEQ ID NO: 1199151 - protein, 9 aa, Homo Sapiens
SVAHPARTP

SEQ ID NO: 1199152 - protein, 9 aa, Homo Sapiens
VNMADIESL

SEQ ID NO: 1199153 - protein, 9 aa, Homo Sapiens
LLILLVPAV

SEQ ID NO: 1199154 - protein, 9 aa, Homo Sapiens
GAPRRRATA

SEQ ID NO: 1199155 - protein, 9 aa, Homo Sapiens
GTPPPPPRV

SEQ ID NO: 1199156 - protein, 9 aa, Homo Sapiens
GQRTEAGPP

SEQ ID NO: 1199157 - protein, 9 aa, Homo Sapiens
RPRPDPALS

SEQ ID NO: 1199158 - protein, 9 aa, Homo Sapiens
GLSVSVGCV

SEQ ID NO: 1199159 - protein, 9 aa, Homo Sapiens
GADLGHWRR

SEQ ID NO: 1199160 - protein, 9 aa, Homo Sapiens
DPCLQDGIE

SEQ ID NO: 1199161 - protein, 9 aa, Homo Sapiens
RGWAPRIKA

SEQ ID NO: 1199162 - protein, 9 aa, Homo Sapiens
PARARRTWP

SEQ ID NO: 1199163 - protein, 9 aa, Homo Sapiens
AQEDPKPFC

SEQ ID NO: 1199164 - protein, 9 aa, Homo Sapiens
LASLCTTVI

SEQ ID NO: 1199165 - protein, 9 aa, Homo Sapiens
PILYLDLLD

SEQ ID NO: 1199166 - protein, 9 aa, Homo Sapiens
RAPHPPPAA

SEQ ID NO: 1199167 - protein, 9 aa, Homo Sapiens
TDVTSNLLM

SEQ ID NO: 1199168 - protein, 9 aa, Homo Sapiens
LIPPLRPSK

SEQ ID NO: 1199169 - protein, 9 aa, Homo Sapiens
TIPFLLICI

SEQ ID NO: 1199170 - protein, 9 aa, Homo Sapiens
IPLGDLSVP

SEQ ID NO: 1199171 - protein, 9 aa, Homo Sapiens
IQGLHCPQA

SEQ ID NO: 1199172 - protein, 9 aa, Homo Sapiens
LVEPGHRAG

SEQ ID NO: 1199173 - protein, 9 aa, Homo Sapiens
TNTATVTTY

SEQ ID NO: 1199174 - protein, 9 aa, Homo Sapiens
VSRDGGWGW

SEQ ID NO: 1199175 - protein, 9 aa, Homo Sapiens
AVWGAGRAI

SEQ ID NO: 1199176 - protein, 9 aa, Homo Sapiens
ESEIKKKQF

SEQ ID NO: 1199177 - protein, 9 aa, Homo Sapiens
ALFQEGGGS

SEQ ID NO: 1199178 - protein, 9 aa, Homo Sapiens
TEPNGLLLY

SEQ ID NO: 1199179 - protein, 9 aa, Homo Sapiens
ITSVTTLYD

SEQ ID NO: 1199180 - protein, 9 aa, Homo Sapiens
RPWVVTARP

SEQ ID NO: 1199181 - protein, 9 aa, Homo Sapiens
GGSHVGAAD

SEQ ID NO: 1199182 - protein, 9 aa, Homo Sapiens
RSRCGPSRA

SEQ ID NO: 1199183 - protein, 9 aa, Homo Sapiens
CPRYASCET

SEQ ID NO: 1199184 - protein, 9 aa, Homo Sapiens
GGFGGFSSG

SEQ ID NO: 1199185 - protein, 9 aa, Homo Sapiens
DLIGSEHTL

SEQ ID NO: 1199186 - protein, 9 aa, Homo Sapiens
TWGCLCRAP

SEQ ID NO: 1199187 - protein, 9 aa, Homo Sapiens
FPVDFFRPP

SEQ ID NO: 1199188 - protein, 9 aa, Homo Sapiens
LNLKQFILF

SEQ ID NO: 1199189 - protein, 9 aa, Homo Sapiens
PQPTATPPS

SEQ ID NO: 1199190 - protein, 9 aa, Homo Sapiens
LWPPQRPSN

SEQ ID NO: 1199191 - protein, 9 aa, Homo Sapiens
CRSSRTWAS

SEQ ID NO: 1199192 - protein, 9 aa, Homo Sapiens
QVHCCSSTN

SEQ ID NO: 1199193 - protein, 9 aa, Homo Sapiens
EAAAKFLSA

SEQ ID NO: 1199194 - protein, 9 aa, Homo Sapiens
SSYSYVEDG

SEQ ID NO: 1199195 - protein, 9 aa, Homo Sapiens
LIAISGFIP

SEQ ID NO: 1199196 - protein, 9 aa, Homo Sapiens
ASKLPDMLN

SEQ ID NO: 1199197 - protein, 9 aa, Homo Sapiens
AGQVSGSQV

SEQ ID NO: 1199198 - protein, 9 aa, Homo Sapiens
QPLDIKVYT

SEQ ID NO: 1199199 - protein, 9 aa, Homo Sapiens
IVIAVTTSS

SEQ ID NO: 1199200 - protein, 9 aa, Homo Sapiens
AHDADEREK

SEQ ID NO: 1199201 - protein, 9 aa, Homo Sapiens
SPTASVLPH

SEQ ID NO: 1199202 - protein, 9 aa, Homo Sapiens
YQQARLRDR

SEQ ID NO: 1199203 - protein, 9 aa, Homo Sapiens
PAMGGAWPR

SEQ ID NO: 1199204 - protein, 9 aa, Homo Sapiens
CGFGGTTSR

SEQ ID NO: 1199205 - protein, 9 aa, Homo Sapiens
PMNRALGFG

SEQ ID NO: 1199206 - protein, 9 aa, Homo Sapiens
RLWPQKKCL

SEQ ID NO: 1199207 - protein, 9 aa, Homo Sapiens
AQRLLAAVP

SEQ ID NO: 1199208 - protein, 9 aa, Homo Sapiens
AVDCSDILA

SEQ ID NO: 1199209 - protein, 9 aa, Homo Sapiens
LLSREGLVE

SEQ ID NO: 1199210 - protein, 9 aa, Homo Sapiens
ASLARKCLT

SEQ ID NO: 1199211 - protein, 9 aa, Homo Sapiens
SPCDRSWLP

SEQ ID NO: 1199212 - protein, 9 aa, Homo Sapiens
PSSPRRCDI

SEQ ID NO: 1199213 - protein, 9 aa, Homo Sapiens
RPPRSILSL

SEQ ID NO: 1199214 - protein, 9 aa, Homo Sapiens
PAGRGAPRH

SEQ ID NO: 1199215 - protein, 9 aa, Homo Sapiens
DIYLDQTNT

SEQ ID NO: 1199216 - protein, 9 aa, Homo Sapiens
KNTWRKQYS

SEQ ID NO: 1199217 - protein, 9 aa, Homo Sapiens
DVYYAVEML

SEQ ID NO: 1199218 - protein, 9 aa, Homo Sapiens
VLATGLHLH

SEQ ID NO: 1199219 - protein, 9 aa, Homo Sapiens
AQGSHLDIL

SEQ ID NO: 1199220 - protein, 9 aa, Homo Sapiens
VGARRGLAL

SEQ ID NO: 1199221 - protein, 9 aa, Homo Sapiens
PITAAVAKV

SEQ ID NO: 1199222 - protein, 9 aa, Homo Sapiens
PYSSCASCT

SEQ ID NO: 1199223 - protein, 9 aa, Homo Sapiens
QTLPLLQGL

SEQ ID NO: 1199224 - protein, 9 aa, Homo Sapiens
HTHSHTRGS

SEQ ID NO: 1199225 - protein, 9 aa, Homo Sapiens
HPHRSPPTS

SEQ ID NO: 1199226 - protein, 9 aa, Homo Sapiens
RRRRKRKRA

SEQ ID NO: 1199227 - protein, 9 aa, Homo Sapiens
WGQSDIAIT

SEQ ID NO: 1199228 - protein, 9 aa, Homo Sapiens
AGLQLHQRV

SEQ ID NO: 1199229 - protein, 9 aa, Homo Sapiens
YPQRNLSAD

SEQ ID NO: 1199230 - protein, 9 aa, Homo Sapiens
SGASGRRVM

SEQ ID NO: 1199231 - protein, 9 aa, Homo Sapiens
PLYFRGRLP

SEQ ID NO: 1199232 - protein, 9 aa, Homo Sapiens
QAPIPWLNW

SEQ ID NO: 1199233 - protein, 9 aa, Homo Sapiens
PRGPGPGAA

SEQ ID NO: 1199234 - protein, 9 aa, Homo Sapiens
HGLAQRAAR

SEQ ID NO: 1199235 - protein, 9 aa, Homo Sapiens
GGAAAARAA

SEQ ID NO: 1199236 - protein, 9 aa, Homo Sapiens
AETKDPAPQ

SEQ ID NO: 1199237 - protein, 9 aa, Homo Sapiens
VGAADGLDL

SEQ ID NO: 1199238 - protein, 9 aa, Homo Sapiens
PQGCYSTTE

SEQ ID NO: 1199239 - protein, 9 aa, Homo Sapiens
AGEWTSLWS

SEQ ID NO: 1199240 - protein, 9 aa, Homo Sapiens
GLDAKNTDC

SEQ ID NO: 1199241 - protein, 9 aa, Homo Sapiens
ESGMGSPGS

SEQ ID NO: 1199242 - protein, 9 aa, Homo Sapiens
DVMGQWDPS

SEQ ID NO: 1199243 - protein, 9 aa, Homo Sapiens
PQWCWSLVI

SEQ ID NO: 1199244 - protein, 9 aa, Homo Sapiens
CMCTHIHLN

SEQ ID NO: 1199245 - protein, 9 aa, Homo Sapiens
TAVAKRSQQ

SEQ ID NO: 1199246 - protein, 9 aa, Homo Sapiens
ITEAQHRKT

SEQ ID NO: 1199247 - protein, 9 aa, Homo Sapiens
VSSTDQEHE

SEQ ID NO: 1199248 - protein, 9 aa, Homo Sapiens
PDSLKIVDD

SEQ ID NO: 1199249 - protein, 9 aa, Homo Sapiens
APPGACPAC

SEQ ID NO: 1199250 - protein, 9 aa, Homo Sapiens
PARAVTPHS

SEQ ID NO: 1199251 - protein, 9 aa, Homo Sapiens
AGVCCEPAT

SEQ ID NO: 1199252 - protein, 9 aa, Homo Sapiens
RVKIRDRRS

SEQ ID NO: 1199253 - protein, 9 aa, Homo Sapiens
LILLVPAVD

SEQ ID NO: 1199254 - protein, 9 aa, Homo Sapiens
RIGRSVEGR

SEQ ID NO: 1199255 - protein, 9 aa, Homo Sapiens
CEYLEDGSH

SEQ ID NO: 1199256 - protein, 9 aa, Homo Sapiens
EAAADVAKG

SEQ ID NO: 1199257 - protein, 9 aa, Homo Sapiens
IRDNGVTCP

SEQ ID NO: 1199258 - protein, 9 aa, Homo Sapiens
FFTNCPRYA

SEQ ID NO: 1199259 - protein, 9 aa, Homo Sapiens
HTREWVSPA

SEQ ID NO: 1199260 - protein, 9 aa, Homo Sapiens
TKLMAKTIR

SEQ ID NO: 1199261 - protein, 9 aa, Homo Sapiens
VVLYVLVCS

SEQ ID NO: 1199262 - protein, 9 aa, Homo Sapiens
DLFGNPMMC

SEQ ID NO: 1199263 - protein, 9 aa, Homo Sapiens
RGTTRNCSS

SEQ ID NO: 1199264 - protein, 9 aa, Homo Sapiens
ARAKFRCNL

SEQ ID NO: 1199265 - protein, 9 aa, Homo Sapiens
GSCGFTQDR

SEQ ID NO: 1199266 - protein, 9 aa, Homo Sapiens
LPVHQGLLR

SEQ ID NO: 1199267 - protein, 9 aa, Homo Sapiens
AARRRTTCR

SEQ ID NO: 1199268 - protein, 9 aa, Homo Sapiens
AAARSWASA

SEQ ID NO: 1199269 - protein, 9 aa, Homo Sapiens
WALGRPLPT

SEQ ID NO: 1199270 - protein, 9 aa, Homo Sapiens
ERSYSMEHF

SEQ ID NO: 1199271 - protein, 9 aa, Homo Sapiens
AWPSRRAQR

SEQ ID NO: 1199272 - protein, 9 aa, Homo Sapiens
VLACRVTLD

SEQ ID NO: 1199273 - protein, 9 aa, Homo Sapiens
QAMCSRSWA

SEQ ID NO: 1199274 - protein, 9 aa, Homo Sapiens
MVTRWRWNE

SEQ ID NO: 1199275 - protein, 9 aa, Homo Sapiens
SLPYGILLH

SEQ ID NO: 1199276 - protein, 9 aa, Homo Sapiens
GHWRRGGGQ

SEQ ID NO: 1199277 - protein, 9 aa, Homo Sapiens
WVVHTTLFL

SEQ ID NO: 1199278 - protein, 9 aa, Homo Sapiens
RGALRDDVK

SEQ ID NO: 1199279 - protein, 9 aa, Homo Sapiens
KFPSWRITW

SEQ ID NO: 1199280 - protein, 9 aa, Homo Sapiens
QYRPFPSAL

SEQ ID NO: 1199281 - protein, 9 aa, Homo Sapiens
TMRTRLEHS

SEQ ID NO: 1199282 - protein, 9 aa, Homo Sapiens
LARAEGIPC

SEQ ID NO: 1199283 - protein, 9 aa, Homo Sapiens
GLAHLVVGR

SEQ ID NO: 1199284 - protein, 9 aa, Homo Sapiens
SGLTSQEST

SEQ ID NO: 1199285 - protein, 9 aa, Homo Sapiens
ERRPVKDGA

SEQ ID NO: 1199286 - protein, 9 aa, Homo Sapiens
EVIMDLTNV

SEQ ID NO: 1199287 - protein, 9 aa, Homo Sapiens
PAPLTSVPW

SEQ ID NO: 1199288 - protein, 9 aa, Homo Sapiens
VAFQLVIHS

SEQ ID NO: 1199289 - protein, 9 aa, Homo Sapiens
LINSPFRDI

SEQ ID NO: 1199290 - protein, 9 aa, Homo Sapiens
SLTSGILGV

SEQ ID NO: 1199291 - protein, 9 aa, Homo Sapiens
WTGSAVLRA

SEQ ID NO: 1199292 - protein, 9 aa, Homo Sapiens
NLAFPGDLV

SEQ ID NO: 1199293 - protein, 9 aa, Homo Sapiens
VDMYPHVFH

SEQ ID NO: 1199294 - protein, 9 aa, Homo Sapiens
TTVIIFWVA

SEQ ID NO: 1199295 - protein, 9 aa, Homo Sapiens
QDFFRKKLK

SEQ ID NO: 1199296 - protein, 9 aa, Homo Sapiens
LLAAVPVQP

SEQ ID NO: 1199297 - protein, 9 aa, Homo Sapiens
GRPRELRSP

SEQ ID NO: 1199298 - protein, 9 aa, Homo Sapiens
PPQRGGLPP

SEQ ID NO: 1199299 - protein, 9 aa, Homo Sapiens
LNLELEEQT

SEQ ID NO: 1199300 - protein, 9 aa, Homo Sapiens
ARGQGHRQT

SEQ ID NO: 1199301 - protein, 9 aa, Homo Sapiens
KWNSVADCM

SEQ ID NO: 1199302 - protein, 9 aa, Homo Sapiens
LMPLVAFML

SEQ ID NO: 1199303 - protein, 9 aa, Homo Sapiens
KAKGPGKYI

SEQ ID NO: 1199304 - protein, 9 aa, Homo Sapiens
RQGASLAGH

SEQ ID NO: 1199305 - protein, 9 aa, Homo Sapiens
LPGTTRMRH

SEQ ID NO: 1199306 - protein, 9 aa, Homo Sapiens
FRGEIFRLL

SEQ ID NO: 1199307 - protein, 9 aa, Homo Sapiens
IPGIRGALT

SEQ ID NO: 1199308 - protein, 9 aa, Homo Sapiens
GHSSHILCM

SEQ ID NO: 1199309 - protein, 9 aa, Homo Sapiens
YVESGNAQA

SEQ ID NO: 1199310 - protein, 9 aa, Homo Sapiens
LDVATRHLA

SEQ ID NO: 1199311 - protein, 9 aa, Homo Sapiens
EAIKAWGME

SEQ ID NO: 1199312 - protein, 9 aa, Homo Sapiens
DSLKIVDDP

SEQ ID NO: 1199313 - protein, 9 aa, Homo Sapiens
VGGLRALRG

SEQ ID NO: 1199314 - protein, 9 aa, Homo Sapiens
QDKNKKLRS

SEQ ID NO: 1199315 - protein, 9 aa, Homo Sapiens
QNFVMASFY

SEQ ID NO: 1199316 - protein, 9 aa, Homo Sapiens
HSPNGRLCP

SEQ ID NO: 1199317 - protein, 9 aa, Homo Sapiens
VKPDTGFTN

SEQ ID NO: 1199318 - protein, 9 aa, Homo Sapiens
CSSPEGPDP

SEQ ID NO: 1199319 - protein, 9 aa, Homo Sapiens
LCSQLCRKA

SEQ ID NO: 1199320 - protein, 9 aa, Homo Sapiens
DADSLQQAW

SEQ ID NO: 1199321 - protein, 9 aa, Homo Sapiens
VVVGAGDVG

SEQ ID NO: 1199322 - protein, 9 aa, Homo Sapiens
VMSVCLFMK

SEQ ID NO: 1199323 - protein, 9 aa, Homo Sapiens
TTNTTTVAT

SEQ ID NO: 1199324 - protein, 9 aa, Homo Sapiens
MMCDLKENG

SEQ ID NO: 1199325 - protein, 9 aa, Homo Sapiens
FWWRVDVAI

SEQ ID NO: 1199326 - protein, 9 aa, Homo Sapiens
GRGGQRARG

SEQ ID NO: 1199327 - protein, 9 aa, Homo Sapiens
SGWCGGPWR

SEQ ID NO: 1199328 - protein, 9 aa, Homo Sapiens
HHRLDGRSL

SEQ ID NO: 1199329 - protein, 9 aa, Homo Sapiens
CRPPLPLRP

SEQ ID NO: 1199330 - protein, 9 aa, Homo Sapiens
VQGQAVLLL

SEQ ID NO: 1199331 - protein, 9 aa, Homo Sapiens
LPPRPRPHP

SEQ ID NO: 1199332 - protein, 9 aa, Homo Sapiens
LKFHLQYRP

SEQ ID NO: 1199333 - protein, 9 aa, Homo Sapiens
HHTTPAQAL

SEQ ID NO: 1199334 - protein, 9 aa, Homo Sapiens
LWSDSPVPP

SEQ ID NO: 1199335 - protein, 9 aa, Homo Sapiens
AADGLDLLQ

SEQ ID NO: 1199336 - protein, 9 aa, Homo Sapiens
CWSLVIWVT

SEQ ID NO: 1199337 - protein, 9 aa, Homo Sapiens
FLGRWAEAE

SEQ ID NO: 1199338 - protein, 9 aa, Homo Sapiens
RRRPVQRPQ

SEQ ID NO: 1199339 - protein, 9 aa, Homo Sapiens
MRLQLFIHC

SEQ ID NO: 1199340 - protein, 9 aa, Homo Sapiens
CQQTAIHQV

SEQ ID NO: 1199341 - protein, 9 aa, Homo Sapiens
EDIFWTCLK

SEQ ID NO: 1199342 - protein, 9 aa, Homo Sapiens
LSAPLRPST

SEQ ID NO: 1199343 - protein, 9 aa, Homo Sapiens
GRAPAPLPF

SEQ ID NO: 1199344 - protein, 9 aa, Homo Sapiens
ACQKQSTIT

SEQ ID NO: 1199345 - protein, 9 aa, Homo Sapiens
LSSCQVQEL

SEQ ID NO: 1199346 - protein, 9 aa, Homo Sapiens
HQGLLRTHR

SEQ ID NO: 1199347 - protein, 9 aa, Homo Sapiens
FEHGGLVKL

SEQ ID NO: 1199348 - protein, 9 aa, Homo Sapiens
RLSIWPRQA

SEQ ID NO: 1199349 - protein, 9 aa, Homo Sapiens
RMEAPSVGV

SEQ ID NO: 1199350 - protein, 9 aa, Homo Sapiens
IKGLITTNV

SEQ ID NO: 1199351 - protein, 9 aa, Homo Sapiens
PCKLSSPRA

SEQ ID NO: 1199352 - protein, 9 aa, Homo Sapiens
CRPRVTPAP

SEQ ID NO: 1199353 - protein, 9 aa, Homo Sapiens
CMVSRTAPT

SEQ ID NO: 1199354 - protein, 9 aa, Homo Sapiens
KSNLLNHQR

SEQ ID NO: 1199355 - protein, 9 aa, Homo Sapiens
WAASWAPPK

SEQ ID NO: 1199356 - protein, 9 aa, Homo Sapiens
QRTHHPHPK

SEQ ID NO: 1199357 - protein, 9 aa, Homo Sapiens
KAQLRASLT

SEQ ID NO: 1199358 - protein, 9 aa, Homo Sapiens
QAQKKNSLK

SEQ ID NO: 1199359 - protein, 9 aa, Homo Sapiens
QGELVAVQH

SEQ ID NO: 1199360 - protein, 9 aa, Homo Sapiens
VGGYVGDAL

SEQ ID NO: 1199361 - protein, 9 aa, Homo Sapiens
AVCMGESAQ

SEQ ID NO: 1199362 - protein, 9 aa, Homo Sapiens
MYPPPYYPG

SEQ ID NO: 1199363 - protein, 9 aa, Homo Sapiens
SRRRGLPCP

SEQ ID NO: 1199364 - protein, 9 aa, Homo Sapiens
SGSGCRSPP

SEQ ID NO: 1199365 - protein, 9 aa, Homo Sapiens
GRAWAPAPP

SEQ ID NO: 1199366 - protein, 9 aa, Homo Sapiens
STYLHCDAP

SEQ ID NO: 1199367 - protein, 9 aa, Homo Sapiens
LKSCSRPCV

SEQ ID NO: 1199368 - protein, 9 aa, Homo Sapiens
GTPRPLPCP

SEQ ID NO: 1199369 - protein, 9 aa, Homo Sapiens
ACGQRRRAL

SEQ ID NO: 1199370 - protein, 9 aa, Homo Sapiens
HTPAGMQAK

SEQ ID NO: 1199371 - protein, 9 aa, Homo Sapiens
EEIHLVDDA

SEQ ID NO: 1199372 - protein, 9 aa, Homo Sapiens
PAAPGAKAA

SEQ ID NO: 1199373 - protein, 9 aa, Homo Sapiens
ARAVTPHSL

SEQ ID NO: 1199374 - protein, 9 aa, Homo Sapiens
IVDGPFLFF

SEQ ID NO: 1199375 - protein, 9 aa, Homo Sapiens
EIVKNLGEM

SEQ ID NO: 1199376 - protein, 9 aa, Homo Sapiens
ILLIAISGF

SEQ ID NO: 1199377 - protein, 9 aa, Homo Sapiens
HPSTPDIGK

SEQ ID NO: 1199378 - protein, 9 aa, Homo Sapiens
PSMPACARG

SEQ ID NO: 1199379 - protein, 9 aa, Homo Sapiens
AHARVVGLG

SEQ ID NO: 1199380 - protein, 9 aa, Homo Sapiens
VQGELVAVQ

SEQ ID NO: 1199381 - protein, 9 aa, Homo Sapiens
PPSTPPAAP

SEQ ID NO: 1199382 - protein, 9 aa, Homo Sapiens
RETRGPRAP

SEQ ID NO: 1199383 - protein, 9 aa, Homo Sapiens
CEPATCPAV

SEQ ID NO: 1199384 - protein, 9 aa, Homo Sapiens
MVQIIAIAA

SEQ ID NO: 1199385 - protein, 9 aa, Homo Sapiens
GAAFVKFST

SEQ ID NO: 1199386 - protein, 9 aa, Homo Sapiens
PQPGNQRSN

SEQ ID NO: 1199387 - protein, 9 aa, Homo Sapiens
AHDQEAARQ

SEQ ID NO: 1199388 - protein, 9 aa, Homo Sapiens
QRRMERKAP

SEQ ID NO: 1199389 - protein, 9 aa, Homo Sapiens
LALEALLNK

SEQ ID NO: 1199390 - protein, 9 aa, Homo Sapiens
MTYFNRSTN

SEQ ID NO: 1199391 - protein, 9 aa, Homo Sapiens
GMSKPVRVV

SEQ ID NO: 1199392 - protein, 9 aa, Homo Sapiens
VWARLECEI

SEQ ID NO: 1199393 - protein, 9 aa, Homo Sapiens
PEGVAAPHP

SEQ ID NO: 1199394 - protein, 9 aa, Homo Sapiens
AFYPVWSSR

SEQ ID NO: 1199395 - protein, 9 aa, Homo Sapiens
PGQGHSTYV

SEQ ID NO: 1199396 - protein, 9 aa, Homo Sapiens
LAHDCLTPS

SEQ ID NO: 1199397 - protein, 9 aa, Homo Sapiens
LKNIPGIRG

SEQ ID NO: 1199398 - protein, 9 aa, Homo Sapiens
LGTTGTLVW

SEQ ID NO: 1199399 - protein, 9 aa, Homo Sapiens
VTPHSLTSG

SEQ ID NO: 1199400 - protein, 9 aa, Homo Sapiens
HLLQPVRGH

SEQ ID NO: 1199401 - protein, 9 aa, Homo Sapiens
FLWSDGVPC

SEQ ID NO: 1199402 - protein, 9 aa, Homo Sapiens
MDAEAEDKM

SEQ ID NO: 1199403 - protein, 9 aa, Homo Sapiens
GAAPGSHGR

SEQ ID NO: 1199404 - protein, 9 aa, Homo Sapiens
LFLIKSLLV

SEQ ID NO: 1199405 - protein, 9 aa, Homo Sapiens
KAWGMESKE

SEQ ID NO: 1199406 - protein, 9 aa, Homo Sapiens
ESAGVMSVC

SEQ ID NO: 1199407 - protein, 9 aa, Homo Sapiens
GLVDRHRVT

SEQ ID NO: 1199408 - protein, 9 aa, Homo Sapiens
REASIVILH

SEQ ID NO: 1199409 - protein, 9 aa, Homo Sapiens
FTSLAASVP

SEQ ID NO: 1199410 - protein, 9 aa, Homo Sapiens
GNTFKILVA

SEQ ID NO: 1199411 - protein, 9 aa, Homo Sapiens
RWLEVAVFM

SEQ ID NO: 1199412 - protein, 9 aa, Homo Sapiens
KSQQENRRR

SEQ ID NO: 1199413 - protein, 9 aa, Homo Sapiens
PMDKIFRQD

SEQ ID NO: 1199414 - protein, 9 aa, Homo Sapiens
ESVFLLNHP

SEQ ID NO: 1199415 - protein, 9 aa, Homo Sapiens
EKETWITTG

SEQ ID NO: 1199416 - protein, 9 aa, Homo Sapiens
HPQMSEPGW

SEQ ID NO: 1199417 - protein, 9 aa, Homo Sapiens
RRRTSWKMW

SEQ ID NO: 1199418 - protein, 9 aa, Homo Sapiens
QPPAPQGPP

SEQ ID NO: 1199419 - protein, 9 aa, Homo Sapiens
AAPGDVEGL

SEQ ID NO: 1199420 - protein, 9 aa, Homo Sapiens
VLRDSGAAD

SEQ ID NO: 1199421 - protein, 9 aa, Homo Sapiens
FTKDIVDVG

SEQ ID NO: 1199422 - protein, 9 aa, Homo Sapiens
VQRLGLPAI

SEQ ID NO: 1199423 - protein, 9 aa, Homo Sapiens
QAGQHAGPP

SEQ ID NO: 1199424 - protein, 9 aa, Homo Sapiens
PRNGSGPGR

SEQ ID NO: 1199425 - protein, 9 aa, Homo Sapiens
IVASYDKTV

SEQ ID NO: 1199426 - protein, 9 aa, Homo Sapiens
STSCGSCPR

SEQ ID NO: 1199427 - protein, 9 aa, Homo Sapiens
SQCTVELSL

SEQ ID NO: 1199428 - protein, 9 aa, Homo Sapiens
IGSLVQPGP

SEQ ID NO: 1199429 - protein, 9 aa, Homo Sapiens
LAQLVARPR

SEQ ID NO: 1199430 - protein, 9 aa, Homo Sapiens
VHQGLLRTH

SEQ ID NO: 1199431 - protein, 9 aa, Homo Sapiens
GHRGHHHPQ

SEQ ID NO: 1199432 - protein, 9 aa, Homo Sapiens
RLCSHTLLR

SEQ ID NO: 1199433 - protein, 9 aa, Homo Sapiens
PAEATSWSC

SEQ ID NO: 1199434 - protein, 9 aa, Homo Sapiens
PPLLEAFPL

SEQ ID NO: 1199435 - protein, 9 aa, Homo Sapiens
QCILVTNKC

SEQ ID NO: 1199436 - protein, 9 aa, Homo Sapiens
KSRPCIWSC

SEQ ID NO: 1199437 - protein, 9 aa, Homo Sapiens
RTYKSAVSG

SEQ ID NO: 1199438 - protein, 9 aa, Homo Sapiens
PEEAPLRGY

SEQ ID NO: 1199439 - protein, 9 aa, Homo Sapiens
CPQTSKVAG
